United States Patent 11,492,591 (UNIVERSAL DONOR STEM CELLS AND RELATED METHODS) - sequence listing, part 12

SEQ ID NO: 367571 - DNA, 20 bp, Artificial
  CRISPR gRNA sequence
catagatcttagctctaaat

SEQ ID NO: 367572 - DNA, 20 bp, Artificial
  CRISPR gRNA sequence
tcttagctctaaataggatg

SEQ ID NO: 367573 - DNA, 20 bp, Artificial
  CRISPR gRNA sequence
ctaaataggatgtagaatat

SEQ ID NO: 367574 - DNA, 20 bp, Artificial
  CRISPR gRNA sequence
taaataggatgtagaatatt

SEQ ID NO: 367575 - DNA, 20 bp, Artificial
  CRISPR gRNA sequence
aataggatgtagaatattgg

SEQ ID NO: 367576 - DNA, 20 bp, Artificial
  CRISPR gRNA sequence
taggatgtagaatattggga

SEQ ID NO: 367577 - DNA, 20 bp, Artificial
  CRISPR gRNA sequence
ggatgtagaatattgggaga

SEQ ID NO: 367578 - DNA, 20 bp, Artificial
  CRISPR gRNA sequence
tagaatattgggagagagaa

SEQ ID NO: 367579 - DNA, 20 bp, Artificial
  CRISPR gRNA sequence
tatatcacaaattattattt

SEQ ID NO: 367580 - DNA, 20 bp, Artificial
  CRISPR gRNA sequence
atatcacaaattattatttg

SEQ ID NO: 367581 - DNA, 20 bp, Artificial
  CRISPR gRNA sequence
attatttgaggcaaaaaaat

SEQ ID NO: 367582 - DNA, 20 bp, Artificial
  CRISPR gRNA sequence
caaaaaaataagtcgcattg

SEQ ID NO: 367583 - DNA, 20 bp, Artificial
  CRISPR gRNA sequence
aaataagtcgcattgtagtc

SEQ ID NO: 367584 - DNA, 20 bp, Artificial
  CRISPR gRNA sequence
ataagtcgcattgtagtcta

SEQ ID NO: 367585 - DNA, 20 bp, Artificial
  CRISPR gRNA sequence
taagtcgcattgtagtctag

SEQ ID NO: 367586 - DNA, 20 bp, Artificial
  CRISPR gRNA sequence
ggatataattttattttacc

SEQ ID NO: 367587 - DNA, 20 bp, Artificial
  CRISPR gRNA sequence
gatataattttattttacct

SEQ ID NO: 367588 - DNA, 20 bp, Artificial
  CRISPR gRNA sequence
tttattttacctaggaaatt

SEQ ID NO: 367589 - DNA, 20 bp, Artificial
  CRISPR gRNA sequence
ttattttacctaggaaattc

SEQ ID NO: 367590 - DNA, 20 bp, Artificial
  CRISPR gRNA sequence
tattttacctaggaaattca

SEQ ID NO: 367591 - DNA, 20 bp, Artificial
  CRISPR gRNA sequence
tttacctaggaaattcaggg

SEQ ID NO: 367592 - DNA, 20 bp, Artificial
  CRISPR gRNA sequence
tacctaggaaattcagggca

SEQ ID NO: 367593 - DNA, 20 bp, Artificial
  CRISPR gRNA sequence
tcagggcagagtccctgaaa

SEQ ID NO: 367594 - DNA, 20 bp, Artificial
  CRISPR gRNA sequence
gggcagagtccctgaaaaag

SEQ ID NO: 367595 - DNA, 20 bp, Artificial
  CRISPR gRNA sequence
tggaatttgaactgccaacc

SEQ ID NO: 367596 - DNA, 20 bp, Artificial
  CRISPR gRNA sequence
aactgccaacccagaaaatt

SEQ ID NO: 367597 - DNA, 20 bp, Artificial
  CRISPR gRNA sequence
acccagaaaatttggatgtt

SEQ ID NO: 367598 - DNA, 20 bp, Artificial
  CRISPR gRNA sequence
aatttggatgttgagattaa

SEQ ID NO: 367599 - DNA, 20 bp, Artificial
  CRISPR gRNA sequence
atttggatgttgagattaat

SEQ ID NO: 367600 - DNA, 20 bp, Artificial
  CRISPR gRNA sequence
gagattaataggcactattc

SEQ ID NO: 367601 - DNA, 20 bp, Artificial
  CRISPR gRNA sequence
agattaataggcactattcc

SEQ ID NO: 367602 - DNA, 20 bp, Artificial
  CRISPR gRNA sequence
attaataggcactattccag

SEQ ID NO: 367603 - DNA, 20 bp, Artificial
  CRISPR gRNA sequence
ctattccaggagaattgctt

SEQ ID NO: 367604 - DNA, 20 bp, Artificial
  CRISPR gRNA sequence
aattgctttagaaaattatc

SEQ ID NO: 367605 - DNA, 20 bp, Artificial
  CRISPR gRNA sequence
ttagaaaattatctagaaaa

SEQ ID NO: 367606 - DNA, 20 bp, Artificial
  CRISPR gRNA sequence
aaaattatctagaaaataga

SEQ ID NO: 367607 - DNA, 20 bp, Artificial
  CRISPR gRNA sequence
gaaaatagacagctattttc

SEQ ID NO: 367608 - DNA, 20 bp, Artificial
  CRISPR gRNA sequence
atagacagctattttctaga

SEQ ID NO: 367609 - DNA, 20 bp, Artificial
  CRISPR gRNA sequence
gacagctattttctagatag

SEQ ID NO: 367610 - DNA, 20 bp, Artificial
  CRISPR gRNA sequence
acagctattttctagatagt

SEQ ID NO: 367611 - DNA, 20 bp, Artificial
  CRISPR gRNA sequence
attttctagatagtaggctc

SEQ ID NO: 367612 - DNA, 20 bp, Artificial
  CRISPR gRNA sequence
ggctccagtgtaacctactt

SEQ ID NO: 367613 - DNA, 20 bp, Artificial
  CRISPR gRNA sequence
tccagtgtaacctactttgg

SEQ ID NO: 367614 - DNA, 20 bp, Artificial
  CRISPR gRNA sequence
agataattttcattgttcaa

SEQ ID NO: 367615 - DNA, 20 bp, Artificial
  CRISPR gRNA sequence
gataattttcattgttcaaa

SEQ ID NO: 367616 - DNA, 20 bp, Artificial
  CRISPR gRNA sequence
tctaaaattgaaccaacaca

SEQ ID NO: 367617 - DNA, 20 bp, Artificial
  CRISPR gRNA sequence
tagaattgatcaacaaatta

SEQ ID NO: 367618 - DNA, 20 bp, Artificial
  CRISPR gRNA sequence
caaattaaagcaatttattc

SEQ ID NO: 367619 - DNA, 20 bp, Artificial
  CRISPR gRNA sequence
ttattccggtttacaattca

SEQ ID NO: 367620 - DNA, 20 bp, Artificial
  CRISPR gRNA sequence
ccggtttacaattcatggct

SEQ ID NO: 367621 - DNA, 20 bp, Artificial
  CRISPR gRNA sequence
atgttgaattgctgcttcaa

SEQ ID NO: 367622 - DNA, 20 bp, Artificial
  CRISPR gRNA sequence
tgttgaattgctgcttcaaa

SEQ ID NO: 367623 - DNA, 20 bp, Artificial
  CRISPR gRNA sequence
gaattgctgcttcaaaaggc

SEQ ID NO: 367624 - DNA, 20 bp, Artificial
  CRISPR gRNA sequence
aattgctgcttcaaaaggca

SEQ ID NO: 367625 - DNA, 20 bp, Artificial
  CRISPR gRNA sequence
attgctgcttcaaaaggcaa

SEQ ID NO: 367626 - DNA, 20 bp, Artificial
  CRISPR gRNA sequence
gctgcttcaaaaggcaaggg

SEQ ID NO: 367627 - DNA, 20 bp, Artificial
  CRISPR gRNA sequence
cttcaaaaggcaagggaagc

SEQ ID NO: 367628 - DNA, 20 bp, Artificial
  CRISPR gRNA sequence
gtattttacaacctatctta

SEQ ID NO: 367629 - DNA, 20 bp, Artificial
  CRISPR gRNA sequence
gtatttgcacactttcattt

SEQ ID NO: 367630 - DNA, 20 bp, Artificial
  CRISPR gRNA sequence
tgttttgcctatcccaaatt

SEQ ID NO: 367631 - DNA, 20 bp, Artificial
  CRISPR gRNA sequence
tttgcctatcccaaattcag

SEQ ID NO: 367632 - DNA, 20 bp, Artificial
  CRISPR gRNA sequence
ttgcctatcccaaattcaga

SEQ ID NO: 367633 - DNA, 20 bp, Artificial
  CRISPR gRNA sequence
cctatcccaaattcagaagg

SEQ ID NO: 367634 - DNA, 20 bp, Artificial
  CRISPR gRNA sequence
ctatcccaaattcagaagga

SEQ ID NO: 367635 - DNA, 20 bp, Artificial
  CRISPR gRNA sequence
tcccaaattcagaaggaagg

SEQ ID NO: 367636 - DNA, 20 bp, Artificial
  CRISPR gRNA sequence
actatcatatctattaatga

SEQ ID NO: 367637 - DNA, 20 bp, Artificial
  CRISPR gRNA sequence
ctatcatatctattaatgac

SEQ ID NO: 367638 - DNA, 20 bp, Artificial
  CRISPR gRNA sequence
tatctattaatgacaggtga

SEQ ID NO: 367639 - DNA, 20 bp, Artificial
  CRISPR gRNA sequence
ttaatgacaggtgaaagtga

SEQ ID NO: 367640 - DNA, 20 bp, Artificial
  CRISPR gRNA sequence
aatgacaggtgaaagtgatg

SEQ ID NO: 367641 - DNA, 20 bp, Artificial
  CRISPR gRNA sequence
atgacaggtgaaagtgatgg

SEQ ID NO: 367642 - DNA, 20 bp, Artificial
  CRISPR gRNA sequence
gacaggtgaaagtgatggag

SEQ ID NO: 367643 - DNA, 20 bp, Artificial
  CRISPR gRNA sequence
acaggtgaaagtgatggagg

SEQ ID NO: 367644 - DNA, 20 bp, Artificial
  CRISPR gRNA sequence
aggtgaaagtgatggaggag

SEQ ID NO: 367645 - DNA, 20 bp, Artificial
  CRISPR gRNA sequence
aagtgatggaggaggagatt

SEQ ID NO: 367646 - DNA, 20 bp, Artificial
  CRISPR gRNA sequence
gaggaggagatttggtctga

SEQ ID NO: 367647 - DNA, 20 bp, Artificial
  CRISPR gRNA sequence
aggaggagatttggtctgaa

SEQ ID NO: 367648 - DNA, 20 bp, Artificial
  CRISPR gRNA sequence
tgaaaggctattgcctgtca

SEQ ID NO: 367649 - DNA, 20 bp, Artificial
  CRISPR gRNA sequence
gaaaggctattgcctgtcaa

SEQ ID NO: 367650 - DNA, 20 bp, Artificial
  CRISPR gRNA sequence
tgtcaaaggaaatttcaaac

SEQ ID NO: 367651 - DNA, 20 bp, Artificial
  CRISPR gRNA sequence
gtcaaaggaaatttcaaaca

SEQ ID NO: 367652 - DNA, 20 bp, Artificial
  CRISPR gRNA sequence
aggaaatttcaaacaaggtt

SEQ ID NO: 367653 - DNA, 20 bp, Artificial
  CRISPR gRNA sequence
aaatttcaaacaaggttaag

SEQ ID NO: 367654 - DNA, 20 bp, Artificial
  CRISPR gRNA sequence
aatttcaaacaaggttaaga

SEQ ID NO: 367655 - DNA, 20 bp, Artificial
  CRISPR gRNA sequence
aaacaaggttaagaaggcca

SEQ ID NO: 367656 - DNA, 20 bp, Artificial
  CRISPR gRNA sequence
acaaggttaagaaggccaca

SEQ ID NO: 367657 - DNA, 20 bp, Artificial
  CRISPR gRNA sequence
ggttaagaaggccacagaga

SEQ ID NO: 367658 - DNA, 20 bp, Artificial
  CRISPR gRNA sequence
ttaagaaggccacagagaaa

SEQ ID NO: 367659 - DNA, 20 bp, Artificial
  CRISPR gRNA sequence
ctttcttattctcctgttat

SEQ ID NO: 367660 - DNA, 20 bp, Artificial
  CRISPR gRNA sequence
tttcttattctcctgttata

SEQ ID NO: 367661 - DNA, 20 bp, Artificial
  CRISPR gRNA sequence
ttcttattctcctgttataa

SEQ ID NO: 367662 - DNA, 20 bp, Artificial
  CRISPR gRNA sequence
taagggtcaccaattcctgc

SEQ ID NO: 367663 - DNA, 20 bp, Artificial
  CRISPR gRNA sequence
ccaattcctgctagcttcct

SEQ ID NO: 367664 - DNA, 20 bp, Artificial
  CRISPR gRNA sequence
tagcttccttagtccttgtg

SEQ ID NO: 367665 - DNA, 20 bp, Artificial
  CRISPR gRNA sequence
gtccttgtgtagaccttttt

SEQ ID NO: 367666 - DNA, 20 bp, Artificial
  CRISPR gRNA sequence
ctatcacttttaattttctt

SEQ ID NO: 367667 - DNA, 20 bp, Artificial
  CRISPR gRNA sequence
cacttttaattttcttaagt

SEQ ID NO: 367668 - DNA, 20 bp, Artificial
  CRISPR gRNA sequence
tttaattttcttaagtcaga

SEQ ID NO: 367669 - DNA, 20 bp, Artificial
  CRISPR gRNA sequence
taattttcttaagtcagatg

SEQ ID NO: 367670 - DNA, 20 bp, Artificial
  CRISPR gRNA sequence
cttaagtcagatggagaaat

SEQ ID NO: 367671 - DNA, 20 bp, Artificial
  CRISPR gRNA sequence
agatggagaaataagaaaaa

SEQ ID NO: 367672 - DNA, 20 bp, Artificial
  CRISPR gRNA sequence
ataagaaaaaaagtcattcc

SEQ ID NO: 367673 - DNA, 20 bp, Artificial
  CRISPR gRNA sequence
gtcattccaagtcaactgat

SEQ ID NO: 367674 - DNA, 20 bp, Artificial
  CRISPR gRNA sequence
cattccaagtcaactgatta

SEQ ID NO: 367675 - DNA, 20 bp, Artificial
  CRISPR gRNA sequence
agtcaactgattagagaatg

SEQ ID NO: 367676 - DNA, 20 bp, Artificial
  CRISPR gRNA sequence
tgattagagaatgaagccat

SEQ ID NO: 367677 - DNA, 20 bp, Artificial
  CRISPR gRNA sequence
gaagccataagctctctctt

SEQ ID NO: 367678 - DNA, 20 bp, Artificial
  CRISPR gRNA sequence
aagccataagctctctcttc

SEQ ID NO: 367679 - DNA, 20 bp, Artificial
  CRISPR gRNA sequence
ctctctcttcaggcccattc

SEQ ID NO: 367680 - DNA, 20 bp, Artificial
  CRISPR gRNA sequence
ctcttcaggcccattctggt

SEQ ID NO: 367681 - DNA, 20 bp, Artificial
  CRISPR gRNA sequence
caggcccattctggtgagat

SEQ ID NO: 367682 - DNA, 20 bp, Artificial
  CRISPR gRNA sequence
attctggtgagattagaaat

SEQ ID NO: 367683 - DNA, 20 bp, Artificial
  CRISPR gRNA sequence
gagattagaaataagtcata

SEQ ID NO: 367684 - DNA, 20 bp, Artificial
  CRISPR gRNA sequence
agattagaaataagtcataa

SEQ ID NO: 367685 - DNA, 20 bp, Artificial
  CRISPR gRNA sequence
gtgtatgcatgcacacacac

SEQ ID NO: 367686 - DNA, 20 bp, Artificial
  CRISPR gRNA sequence
gactaaaaaatgttacattt

SEQ ID NO: 367687 - DNA, 20 bp, Artificial
  CRISPR gRNA sequence
taaaaaatgttacattttag

SEQ ID NO: 367688 - DNA, 20 bp, Artificial
  CRISPR gRNA sequence
ttttagcagtttttcattta

SEQ ID NO: 367689 - DNA, 20 bp, Artificial
  CRISPR gRNA sequence
ttaaagaaaaaaatactaaa

SEQ ID NO: 367690 - DNA, 20 bp, Artificial
  CRISPR gRNA sequence
aaatactaaatggtacctat

SEQ ID NO: 367691 - DNA, 20 bp, Artificial
  CRISPR gRNA sequence
aatactaaatggtacctata

SEQ ID NO: 367692 - DNA, 20 bp, Artificial
  CRISPR gRNA sequence
ggtacctataaggaatccac

SEQ ID NO: 367693 - DNA, 20 bp, Artificial
  CRISPR gRNA sequence
gtacctataaggaatccaca

SEQ ID NO: 367694 - DNA, 20 bp, Artificial
  CRISPR gRNA sequence
tacctataaggaatccacaa

SEQ ID NO: 367695 - DNA, 20 bp, Artificial
  CRISPR gRNA sequence
taaggaatccacaagggatg

SEQ ID NO: 367696 - DNA, 20 bp, Artificial
  CRISPR gRNA sequence
ggaatccacaagggatgaag

SEQ ID NO: 367697 - DNA, 20 bp, Artificial
  CRISPR gRNA sequence
gatgaagcagaaacatttta

SEQ ID NO: 367698 - DNA, 20 bp, Artificial
  CRISPR gRNA sequence
atgaagcagaaacattttaa

SEQ ID NO: 367699 - DNA, 20 bp, Artificial
  CRISPR gRNA sequence
cactccgtaatgaaataaaa

SEQ ID NO: 367700 - DNA, 20 bp, Artificial
  CRISPR gRNA sequence
atgaaataaaatagtatata

SEQ ID NO: 367701 - DNA, 20 bp, Artificial
  CRISPR gRNA sequence
aaataaaatagtatataaag

SEQ ID NO: 367702 - DNA, 20 bp, Artificial
  CRISPR gRNA sequence
aataaaatagtatataaaga

SEQ ID NO: 367703 - DNA, 20 bp, Artificial
  CRISPR gRNA sequence
aaaatagtatataaagaagg

SEQ ID NO: 367704 - DNA, 20 bp, Artificial
  CRISPR gRNA sequence
cagacgataaaaaacatttt

SEQ ID NO: 367705 - DNA, 20 bp, Artificial
  CRISPR gRNA sequence
aaaaaacattttaagactca

SEQ ID NO: 367706 - DNA, 20 bp, Artificial
  CRISPR gRNA sequence
aacattttaagactcacaga

SEQ ID NO: 367707 - DNA, 20 bp, Artificial
  CRISPR gRNA sequence
ttttaagactcacagaaagc

SEQ ID NO: 367708 - DNA, 20 bp, Artificial
  CRISPR gRNA sequence
tttaagactcacagaaagca

SEQ ID NO: 367709 - DNA, 20 bp, Artificial
  CRISPR gRNA sequence
actcacagaaagcaaggtta

SEQ ID NO: 367710 - DNA, 20 bp, Artificial
  CRISPR gRNA sequence
ttatggtcactgcacttctc

SEQ ID NO: 367711 - DNA, 20 bp, Artificial
  CRISPR gRNA sequence
tatggtcactgcacttctca

SEQ ID NO: 367712 - DNA, 20 bp, Artificial
  CRISPR gRNA sequence
atggtcactgcacttctcaa

SEQ ID NO: 367713 - DNA, 20 bp, Artificial
  CRISPR gRNA sequence
cactgcacttctcaagggtg

SEQ ID NO: 367714 - DNA, 20 bp, Artificial
  CRISPR gRNA sequence
cttctcaagggtgaagtaaa

SEQ ID NO: 367715 - DNA, 20 bp, Artificial
  CRISPR gRNA sequence
ttctcaagggtgaagtaaat

SEQ ID NO: 367716 - DNA, 20 bp, Artificial
  CRISPR gRNA sequence
tgaagtaaatgggaaactga

SEQ ID NO: 367717 - DNA, 20 bp, Artificial
  CRISPR gRNA sequence
agtaaatgggaaactgaaag

SEQ ID NO: 367718 - DNA, 20 bp, Artificial
  CRISPR gRNA sequence
aatgggaaactgaaagtgga

SEQ ID NO: 367719 - DNA, 20 bp, Artificial
  CRISPR gRNA sequence
aactgaaagtggatggttac

SEQ ID NO: 367720 - DNA, 20 bp, Artificial
  CRISPR gRNA sequence
tggttaccagaacgtgtgcc

SEQ ID NO: 367721 - DNA, 20 bp, Artificial
  CRISPR gRNA sequence
ggttaccagaacgtgtgcca

SEQ ID NO: 367722 - DNA, 20 bp, Artificial
  CRISPR gRNA sequence
ccacgtgctttccctgtgct

SEQ ID NO: 367723 - DNA, 20 bp, Artificial
  CRISPR gRNA sequence
tgctttccctgtgctaagcc

SEQ ID NO: 367724 - DNA, 20 bp, Artificial
  CRISPR gRNA sequence
gctttccctgtgctaagccc

SEQ ID NO: 367725 - DNA, 20 bp, Artificial
  CRISPR gRNA sequence
ttccctgtgctaagcccagg

SEQ ID NO: 367726 - DNA, 20 bp, Artificial
  CRISPR gRNA sequence
tccctgtgctaagcccagga

SEQ ID NO: 367727 - DNA, 20 bp, Artificial
  CRISPR gRNA sequence
gtgctaagcccaggaaggaa

SEQ ID NO: 367728 - DNA, 20 bp, Artificial
  CRISPR gRNA sequence
tgctaagcccaggaaggaac

SEQ ID NO: 367729 - DNA, 20 bp, Artificial
  CRISPR gRNA sequence
gcccaggaaggaacaggcac

SEQ ID NO: 367730 - DNA, 20 bp, Artificial
  CRISPR gRNA sequence
cacaagaacacatgtcactg

SEQ ID NO: 367731 - DNA, 20 bp, Artificial
  CRISPR gRNA sequence
acaagaacacatgtcactgt

SEQ ID NO: 367732 - DNA, 20 bp, Artificial
  CRISPR gRNA sequence
tcactgtgggaatcaaccct

SEQ ID NO: 367733 - DNA, 20 bp, Artificial
  CRISPR gRNA sequence
cactgtgggaatcaaccctc

SEQ ID NO: 367734 - DNA, 20 bp, Artificial
  CRISPR gRNA sequence
ggaatcaaccctcaggcttt

SEQ ID NO: 367735 - DNA, 20 bp, Artificial
  CRISPR gRNA sequence
gaatcaaccctcaggctttc

SEQ ID NO: 367736 - DNA, 20 bp, Artificial
  CRISPR gRNA sequence
aaccctcaggctttcaggca

SEQ ID NO: 367737 - DNA, 20 bp, Artificial
  CRISPR gRNA sequence
gtaatcaaaaatcaaaaaaa

SEQ ID NO: 367738 - DNA, 20 bp, Artificial
  CRISPR gRNA sequence
aatcaaaaatcaaaaaaaaa

SEQ ID NO: 367739 - DNA, 20 bp, Artificial
  CRISPR gRNA sequence
aaaaatcaaaaaaaaagaga

SEQ ID NO: 367740 - DNA, 20 bp, Artificial
  CRISPR gRNA sequence
gaaagtttaaaaactctcta

SEQ ID NO: 367741 - DNA, 20 bp, Artificial
  CRISPR gRNA sequence
gtttaaaaactctctaaagc

SEQ ID NO: 367742 - DNA, 20 bp, Artificial
  CRISPR gRNA sequence
aattgaattcaataatcgaa

SEQ ID NO: 367743 - DNA, 20 bp, Artificial
  CRISPR gRNA sequence
caataatcgaatggctgata

SEQ ID NO: 367744 - DNA, 20 bp, Artificial
  CRISPR gRNA sequence
taatcgaatggctgatacag

SEQ ID NO: 367745 - DNA, 20 bp, Artificial
  CRISPR gRNA sequence
gatacagtggaattcacgta

SEQ ID NO: 367746 - DNA, 20 bp, Artificial
  CRISPR gRNA sequence
atacagtggaattcacgtac

SEQ ID NO: 367747 - DNA, 20 bp, Artificial
  CRISPR gRNA sequence
gtggaattcacgtacaggca

SEQ ID NO: 367748 - DNA, 20 bp, Artificial
  CRISPR gRNA sequence
tggaattcacgtacaggcac

SEQ ID NO: 367749 - DNA, 20 bp, Artificial
  CRISPR gRNA sequence
ttcacgtacaggcacgggta

SEQ ID NO: 367750 - DNA, 20 bp, Artificial
  CRISPR gRNA sequence
tcacgtacaggcacgggtac

SEQ ID NO: 367751 - DNA, 20 bp, Artificial
  CRISPR gRNA sequence
tacaggcacgggtacaggct

SEQ ID NO: 367752 - DNA, 20 bp, Artificial
  CRISPR gRNA sequence
cgggtacaggcttggatttt

SEQ ID NO: 367753 - DNA, 20 bp, Artificial
  CRISPR gRNA sequence
gggtacaggcttggattttt

SEQ ID NO: 367754 - DNA, 20 bp, Artificial
  CRISPR gRNA sequence
ggtacaggcttggatttttg

SEQ ID NO: 367755 - DNA, 20 bp, Artificial
  CRISPR gRNA sequence
ggcttggatttttggggatt

SEQ ID NO: 367756 - DNA, 20 bp, Artificial
  CRISPR gRNA sequence
tgtccgtctgtctcgatgcc

SEQ ID NO: 367757 - DNA, 20 bp, Artificial
  CRISPR gRNA sequence
gtccgtctgtctcgatgcct

SEQ ID NO: 367758 - DNA, 20 bp, Artificial
  CRISPR gRNA sequence
tcacctcctttatgccccgt

SEQ ID NO: 367759 - DNA, 20 bp, Artificial
  CRISPR gRNA sequence
ttatgccccgtgagacaccc

SEQ ID NO: 367760 - DNA, 20 bp, Artificial
  CRISPR gRNA sequence
ccccagtctttgacacttct

SEQ ID NO: 367761 - DNA, 20 bp, Artificial
  CRISPR gRNA sequence
tctttgacacttctgagctg

SEQ ID NO: 367762 - DNA, 20 bp, Artificial
  CRISPR gRNA sequence
ttctgagctgtagcaaaatc

SEQ ID NO: 367763 - DNA, 20 bp, Artificial
  CRISPR gRNA sequence
ctgagctgtagcaaaatcca

SEQ ID NO: 367764 - DNA, 20 bp, Artificial
  CRISPR gRNA sequence
tgagctgtagcaaaatccag

SEQ ID NO: 367765 - DNA, 20 bp, Artificial
  CRISPR gRNA sequence
tccagaggaaacttttactt

SEQ ID NO: 367766 - DNA, 20 bp, Artificial
  CRISPR gRNA sequence
ccagaggaaacttttacttt

SEQ ID NO: 367767 - DNA, 20 bp, Artificial
  CRISPR gRNA sequence
tttgggcttgttgtcaaatg

SEQ ID NO: 367768 - DNA, 20 bp, Artificial
  CRISPR gRNA sequence
ggcttgttgtcaaatgcagt

SEQ ID NO: 367769 - DNA, 20 bp, Artificial
  CRISPR gRNA sequence
gcttgttgtcaaatgcagtc

SEQ ID NO: 367770 - DNA, 20 bp, Artificial
  CRISPR gRNA sequence
gttgtcaaatgcagtcaggc

SEQ ID NO: 367771 - DNA, 20 bp, Artificial
  CRISPR gRNA sequence
tcaaatgcagtcaggcgagc

SEQ ID NO: 367772 - DNA, 20 bp, Artificial
  CRISPR gRNA sequence
aaatgcagtcaggcgagcca

SEQ ID NO: 367773 - DNA, 20 bp, Artificial
  CRISPR gRNA sequence
tgcagtcaggcgagccagag

SEQ ID NO: 367774 - DNA, 20 bp, Artificial
  CRISPR gRNA sequence
gcagtcaggcgagccagagc

SEQ ID NO: 367775 - DNA, 20 bp, Artificial
  CRISPR gRNA sequence
cagtcaggcgagccagagca

SEQ ID NO: 367776 - DNA, 20 bp, Artificial
  CRISPR gRNA sequence
gtcaggcgagccagagcagg

SEQ ID NO: 367777 - DNA, 20 bp, Artificial
  CRISPR gRNA sequence
aggcgagccagagcagggag

SEQ ID NO: 367778 - DNA, 20 bp, Artificial
  CRISPR gRNA sequence
gccagagcagggagtggaat

SEQ ID NO: 367779 - DNA, 20 bp, Artificial
  CRISPR gRNA sequence
ttggctgccatctttgtgtg

SEQ ID NO: 367780 - DNA, 20 bp, Artificial
  CRISPR gRNA sequence
aaactgtacccttcttattg

SEQ ID NO: 367781 - DNA, 20 bp, Artificial
  CRISPR gRNA sequence
aactgtacccttcttattgt

SEQ ID NO: 367782 - DNA, 20 bp, Artificial
  CRISPR gRNA sequence
ttgtaggtatttatattttc

SEQ ID NO: 367783 - DNA, 20 bp, Artificial
  CRISPR gRNA sequence
ttatattttcaagatgattg

SEQ ID NO: 367784 - DNA, 20 bp, Artificial
  CRISPR gRNA sequence
atattttcaagatgattgta

SEQ ID NO: 367785 - DNA, 20 bp, Artificial
  CRISPR gRNA sequence
ttttcaagatgattgtagag

SEQ ID NO: 367786 - DNA, 20 bp, Artificial
  CRISPR gRNA sequence
tttcaagatgattgtagagt

SEQ ID NO: 367787 - DNA, 20 bp, Artificial
  CRISPR gRNA sequence
ttcaagatgattgtagagta

SEQ ID NO: 367788 - DNA, 20 bp, Artificial
  CRISPR gRNA sequence
tcaagatgattgtagagtag

SEQ ID NO: 367789 - DNA, 20 bp, Artificial
  CRISPR gRNA sequence
ttgtagagtaggggtatgct

SEQ ID NO: 367790 - DNA, 20 bp, Artificial
  CRISPR gRNA sequence
ggtatgcttggctgaattga

SEQ ID NO: 367791 - DNA, 20 bp, Artificial
  CRISPR gRNA sequence
tatgcttggctgaattgata

SEQ ID NO: 367792 - DNA, 20 bp, Artificial
  CRISPR gRNA sequence
ttggctgaattgatagagaa

SEQ ID NO: 367793 - DNA, 20 bp, Artificial
  CRISPR gRNA sequence
tggctgaattgatagagaat

SEQ ID NO: 367794 - DNA, 20 bp, Artificial
  CRISPR gRNA sequence
aattgatagagaatgggcta

SEQ ID NO: 367795 - DNA, 20 bp, Artificial
  CRISPR gRNA sequence
tagagaatgggctacagctg

SEQ ID NO: 367796 - DNA, 20 bp, Artificial
  CRISPR gRNA sequence
atgggctacagctgaagctt

SEQ ID NO: 367797 - DNA, 20 bp, Artificial
  CRISPR gRNA sequence
cactgattctcctgtgacct

SEQ ID NO: 367798 - DNA, 20 bp, Artificial
  CRISPR gRNA sequence
gtgacctcagaacattctgt

SEQ ID NO: 367799 - DNA, 20 bp, Artificial
  CRISPR gRNA sequence
ctcagaacattctgtgagta

SEQ ID NO: 367800 - DNA, 20 bp, Artificial
  CRISPR gRNA sequence
gaacattctgtgagtatagc

SEQ ID NO: 367801 - DNA, 20 bp, Artificial
  CRISPR gRNA sequence
gagtatagctggaaactaca

SEQ ID NO: 367802 - DNA, 20 bp, Artificial
  CRISPR gRNA sequence
gctggaaactacacagttct

SEQ ID NO: 367803 - DNA, 20 bp, Artificial
  CRISPR gRNA sequence
gtttttcctccttcaactct

SEQ ID NO: 367804 - DNA, 20 bp, Artificial
  CRISPR gRNA sequence
tccttcaactctcagtgatc

SEQ ID NO: 367805 - DNA, 20 bp, Artificial
  CRISPR gRNA sequence
aactcacacctttaccacaa

SEQ ID NO: 367806 - DNA, 20 bp, Artificial
  CRISPR gRNA sequence
taccacaacagctgtttacc

SEQ ID NO: 367807 - DNA, 20 bp, Artificial
  CRISPR gRNA sequence
cagctgtttacccagcactg

SEQ ID NO: 367808 - DNA, 20 bp, Artificial
  CRISPR gRNA sequence
agctgtttacccagcactga

SEQ ID NO: 367809 - DNA, 20 bp, Artificial
  CRISPR gRNA sequence
tgtttacccagcactgaagg

SEQ ID NO: 367810 - DNA, 20 bp, Artificial
  CRISPR gRNA sequence
gcggctgccaaccacaacat

SEQ ID NO: 367811 - DNA, 20 bp, Artificial
  CRISPR gRNA sequence
cggctgccaaccacaacatg

SEQ ID NO: 367812 - DNA, 20 bp, Artificial
  CRISPR gRNA sequence
tgaggaatacatttcctctt

SEQ ID NO: 367813 - DNA, 20 bp, Artificial
  CRISPR gRNA sequence
aatacatttcctcttcagaa

SEQ ID NO: 367814 - DNA, 20 bp, Artificial
  CRISPR gRNA sequence
atacatttcctcttcagaat

SEQ ID NO: 367815 - DNA, 20 bp, Artificial
  CRISPR gRNA sequence
ttcctcttcagaatgggtgt

SEQ ID NO: 367816 - DNA, 20 bp, Artificial
  CRISPR gRNA sequence
ctcttcagaatgggtgttgg

SEQ ID NO: 367817 - DNA, 20 bp, Artificial
  CRISPR gRNA sequence
gaatgggtgttggtggtgtg

SEQ ID NO: 367818 - DNA, 20 bp, Artificial
  CRISPR gRNA sequence
aatgggtgttggtggtgtgt

SEQ ID NO: 367819 - DNA, 20 bp, Artificial
  CRISPR gRNA sequence
gtggtgtgtgggtgccaatg

SEQ ID NO: 367820 - DNA, 20 bp, Artificial
  CRISPR gRNA sequence
gtgtgggtgccaatgcagcg

SEQ ID NO: 367821 - DNA, 20 bp, Artificial
  CRISPR gRNA sequence
tgtgggtgccaatgcagcgt

SEQ ID NO: 367822 - DNA, 20 bp, Artificial
  CRISPR gRNA sequence
gtgggtgccaatgcagcgtg

SEQ ID NO: 367823 - DNA, 20 bp, Artificial
  CRISPR gRNA sequence
ccaatgcagcgtggggactg

SEQ ID NO: 367824 - DNA, 20 bp, Artificial
  CRISPR gRNA sequence
gggactgtggcctcacacat

SEQ ID NO: 367825 - DNA, 20 bp, Artificial
  CRISPR gRNA sequence
ctgtggcctcacacatgagt

SEQ ID NO: 367826 - DNA, 20 bp, Artificial
  CRISPR gRNA sequence
gtggcctcacacatgagtaa

SEQ ID NO: 367827 - DNA, 20 bp, Artificial
  CRISPR gRNA sequence
cctcacacatgagtaagagc

SEQ ID NO: 367828 - DNA, 20 bp, Artificial
  CRISPR gRNA sequence
gagtaagagctggtgtccta

SEQ ID NO: 367829 - DNA, 20 bp, Artificial
  CRISPR gRNA sequence
caatgcctgtcaaataactg

SEQ ID NO: 367830 - DNA, 20 bp, Artificial
  CRISPR gRNA sequence
aaataactgtggaacatgtt

SEQ ID NO: 367831 - DNA, 20 bp, Artificial
  CRISPR gRNA sequence
atgttcagcccacacacgtt

SEQ ID NO: 367832 - DNA, 20 bp, Artificial
  CRISPR gRNA sequence
cacacgttgagactcctcct

SEQ ID NO: 367833 - DNA, 20 bp, Artificial
  CRISPR gRNA sequence
gactcctcctcagaccatct

SEQ ID NO: 367834 - DNA, 20 bp, Artificial
  CRISPR gRNA sequence
ttaaaaaattcctcacttca

SEQ ID NO: 367835 - DNA, 20 bp, Artificial
  CRISPR gRNA sequence
taaaaaattcctcacttcaa

SEQ ID NO: 367836 - DNA, 20 bp, Artificial
  CRISPR gRNA sequence
aattcctcacttcaaaggtt

SEQ ID NO: 367837 - DNA, 20 bp, Artificial
  CRISPR gRNA sequence
ttcctcacttcaaaggttga

SEQ ID NO: 367838 - DNA, 20 bp, Artificial
  CRISPR gRNA sequence
acttcaaaggttgagagctg

SEQ ID NO: 367839 - DNA, 20 bp, Artificial
  CRISPR gRNA sequence
caaaggttgagagctgcaga

SEQ ID NO: 367840 - DNA, 20 bp, Artificial
  CRISPR gRNA sequence
aggttgagagctgcagatag

SEQ ID NO: 367841 - DNA, 20 bp, Artificial
  CRISPR gRNA sequence
ggttgagagctgcagatagt

SEQ ID NO: 367842 - DNA, 20 bp, Artificial
  CRISPR gRNA sequence
agatagtgggcattgttctc

SEQ ID NO: 367843 - DNA, 20 bp, Artificial
  CRISPR gRNA sequence
ttgttctccagcacttgctc

SEQ ID NO: 367844 - DNA, 20 bp, Artificial
  CRISPR gRNA sequence
tgttctccagcacttgctct

SEQ ID NO: 367845 - DNA, 20 bp, Artificial
  CRISPR gRNA sequence
tgctctgggaaacttcctta

SEQ ID NO: 367846 - DNA, 20 bp, Artificial
  CRISPR gRNA sequence
gctctgggaaacttccttat

SEQ ID NO: 367847 - DNA, 20 bp, Artificial
  CRISPR gRNA sequence
gggaaacttccttataggat

SEQ ID NO: 367848 - DNA, 20 bp, Artificial
  CRISPR gRNA sequence
aacttccttataggattagt

SEQ ID NO: 367849 - DNA, 20 bp, Artificial
  CRISPR gRNA sequence
ttccttataggattagtgag

SEQ ID NO: 367850 - DNA, 20 bp, Artificial
  CRISPR gRNA sequence
tccttataggattagtgagt

SEQ ID NO: 367851 - DNA, 20 bp, Artificial
  CRISPR gRNA sequence
taggattagtgagtaggtgt

SEQ ID NO: 367852 - DNA, 20 bp, Artificial
  CRISPR gRNA sequence
aggtgtgagtgaccttcaaa

SEQ ID NO: 367853 - DNA, 20 bp, Artificial
  CRISPR gRNA sequence
ggtgtgagtgaccttcaaaa

SEQ ID NO: 367854 - DNA, 20 bp, Artificial
  CRISPR gRNA sequence
tgaccttcaaaaaggcctta

SEQ ID NO: 367855 - DNA, 20 bp, Artificial
  CRISPR gRNA sequence
gaccttcaaaaaggccttat

SEQ ID NO: 367856 - DNA, 20 bp, Artificial
  CRISPR gRNA sequence
tataggaatttacctcttaa

SEQ ID NO: 367857 - DNA, 20 bp, Artificial
  CRISPR gRNA sequence
cagatcacattattaactga

SEQ ID NO: 367858 - DNA, 20 bp, Artificial
  CRISPR gRNA sequence
ttttgtaaaataaaaaatgt

SEQ ID NO: 367859 - DNA, 20 bp, Artificial
  CRISPR gRNA sequence
aaataaaaaatgtgagattt

SEQ ID NO: 367860 - DNA, 20 bp, Artificial
  CRISPR gRNA sequence
gtgagatttgagatattcaa

SEQ ID NO: 367861 - DNA, 20 bp, Artificial
  CRISPR gRNA sequence
gatattcaaaagcaaacaaa

SEQ ID NO: 367862 - DNA, 20 bp, Artificial
  CRISPR gRNA sequence
aaagcaaacaaaaagaaaat

SEQ ID NO: 367863 - DNA, 20 bp, Artificial
  CRISPR gRNA sequence
aaaaagaaaataagtaactg

SEQ ID NO: 367864 - DNA, 20 bp, Artificial
  CRISPR gRNA sequence
agaaaataagtaactgaaga

SEQ ID NO: 367865 - DNA, 20 bp, Artificial
  CRISPR gRNA sequence
agtaactgaagaaagtccaa

SEQ ID NO: 367866 - DNA, 20 bp, Artificial
  CRISPR gRNA sequence
gaagaaagtccaaaagctct

SEQ ID NO: 367867 - DNA, 20 bp, Artificial
  CRISPR gRNA sequence
aaagtccaaaagctcttagc

SEQ ID NO: 367868 - DNA, 20 bp, Artificial
  CRISPR gRNA sequence
ccaaaagctcttagctggta

SEQ ID NO: 367869 - DNA, 20 bp, Artificial
  CRISPR gRNA sequence
ctcttagctggtaaagctct

SEQ ID NO: 367870 - DNA, 20 bp, Artificial
  CRISPR gRNA sequence
tctcagtttttactgatgct

SEQ ID NO: 367871 - DNA, 20 bp, Artificial
  CRISPR gRNA sequence
tcagtttttactgatgcttg

SEQ ID NO: 367872 - DNA, 20 bp, Artificial
  CRISPR gRNA sequence
tgatgcttggagctcctctg

SEQ ID NO: 367873 - DNA, 20 bp, Artificial
  CRISPR gRNA sequence
tcctctgtggctttatcttt

SEQ ID NO: 367874 - DNA, 20 bp, Artificial
  CRISPR gRNA sequence
gagttaatgctgtcctgtga

SEQ ID NO: 367875 - DNA, 20 bp, Artificial
  CRISPR gRNA sequence
aatgctgtcctgtgatggtt

SEQ ID NO: 367876 - DNA, 20 bp, Artificial
  CRISPR gRNA sequence
atgctgtcctgtgatggttt

SEQ ID NO: 367877 - DNA, 20 bp, Artificial
  CRISPR gRNA sequence
ctgtcctgtgatggtttagg

SEQ ID NO: 367878 - DNA, 20 bp, Artificial
  CRISPR gRNA sequence
gtttaggtagcgtcgataaa

SEQ ID NO: 367879 - DNA, 20 bp, Artificial
  CRISPR gRNA sequence
gtagcgtcgataaaaagatc

SEQ ID NO: 367880 - DNA, 20 bp, Artificial
  CRISPR gRNA sequence
gataaaaagatctggtttct

SEQ ID NO: 367881 - DNA, 20 bp, Artificial
  CRISPR gRNA sequence
aagatctggtttctaagtta

SEQ ID NO: 367882 - DNA, 20 bp, Artificial
  CRISPR gRNA sequence
taagttatggtttttgttgc

SEQ ID NO: 367883 - DNA, 20 bp, Artificial
  CRISPR gRNA sequence
tgctggtttttgtttttgtt

SEQ ID NO: 367884 - DNA, 20 bp, Artificial
  CRISPR gRNA sequence
tttgtttttgtttggtttta

SEQ ID NO: 367885 - DNA, 20 bp, Artificial
  CRISPR gRNA sequence
ttgtttttgtttggttttat

SEQ ID NO: 367886 - DNA, 20 bp, Artificial
  CRISPR gRNA sequence
tgtttttgtttggttttata

SEQ ID NO: 367887 - DNA, 20 bp, Artificial
  CRISPR gRNA sequence
tttttgtttggttttatagg

SEQ ID NO: 367888 - DNA, 20 bp, Artificial
  CRISPR gRNA sequence
tttgtttggttttataggga

SEQ ID NO: 367889 - DNA, 20 bp, Artificial
  CRISPR gRNA sequence
ttgtttggttttatagggag

SEQ ID NO: 367890 - DNA, 20 bp, Artificial
  CRISPR gRNA sequence
gtttggttttatagggagag

SEQ ID NO: 367891 - DNA, 20 bp, Artificial
  CRISPR gRNA sequence
tttggttttatagggagagg

SEQ ID NO: 367892 - DNA, 20 bp, Artificial
  CRISPR gRNA sequence
tttatagggagaggaggttg

SEQ ID NO: 367893 - DNA, 20 bp, Artificial
  CRISPR gRNA sequence
ttatagggagaggaggttgc

SEQ ID NO: 367894 - DNA, 20 bp, Artificial
  CRISPR gRNA sequence
tagggagaggaggttgcagg

SEQ ID NO: 367895 - DNA, 20 bp, Artificial
  CRISPR gRNA sequence
agaggaggttgcaggcagaa

SEQ ID NO: 367896 - DNA, 20 bp, Artificial
  CRISPR gRNA sequence
agaatggctttttctttccg

SEQ ID NO: 367897 - DNA, 20 bp, Artificial
  CRISPR gRNA sequence
aatggctttttctttccgtg

SEQ ID NO: 367898 - DNA, 20 bp, Artificial
  CRISPR gRNA sequence
ttttctttccgtggagaaaa

SEQ ID NO: 367899 - DNA, 20 bp, Artificial
  CRISPR gRNA sequence
tctttccgtggagaaaatgg

SEQ ID NO: 367900 - DNA, 20 bp, Artificial
  CRISPR gRNA sequence
ctttccgtggagaaaatggt

SEQ ID NO: 367901 - DNA, 20 bp, Artificial
  CRISPR gRNA sequence
ttccgtggagaaaatggtag

SEQ ID NO: 367902 - DNA, 20 bp, Artificial
  CRISPR gRNA sequence
atggtaggagactatttctg

SEQ ID NO: 367903 - DNA, 20 bp, Artificial
  CRISPR gRNA sequence
gactatttctgaagacattt

SEQ ID NO: 367904 - DNA, 20 bp, Artificial
  CRISPR gRNA sequence
tttaagattttgaaactgtt

SEQ ID NO: 367905 - DNA, 20 bp, Artificial
  CRISPR gRNA sequence
ttgaaactgttaagaatttc

SEQ ID NO: 367906 - DNA, 20 bp, Artificial
  CRISPR gRNA sequence
ttaagaatttcaagaccatc

SEQ ID NO: 367907 - DNA, 20 bp, Artificial
  CRISPR gRNA sequence
agaccatcaagtcaatcctt

SEQ ID NO: 367908 - DNA, 20 bp, Artificial
  CRISPR gRNA sequence
gaccatcaagtcaatccttc

SEQ ID NO: 367909 - DNA, 20 bp, Artificial
  CRISPR gRNA sequence
accatcaagtcaatccttca

SEQ ID NO: 367910 - DNA, 20 bp, Artificial
  CRISPR gRNA sequence
caagtcaatccttcagggat

SEQ ID NO: 367911 - DNA, 20 bp, Artificial
  CRISPR gRNA sequence
tcagtgtgaaattattccct

SEQ ID NO: 367912 - DNA, 20 bp, Artificial
  CRISPR gRNA sequence
cagtgtgaaattattccctc

SEQ ID NO: 367913 - DNA, 20 bp, Artificial
  CRISPR gRNA sequence
catctcttctacttactcct

SEQ ID NO: 367914 - DNA, 20 bp, Artificial
  CRISPR gRNA sequence
ctcttctacttactcctgag

SEQ ID NO: 367915 - DNA, 20 bp, Artificial
  CRISPR gRNA sequence
gcagttttaattaaataact

SEQ ID NO: 367916 - DNA, 20 bp, Artificial
  CRISPR gRNA sequence
taattaaataactcagttga

SEQ ID NO: 367917 - DNA, 20 bp, Artificial
  CRISPR gRNA sequence
aattaaataactcagttgat

SEQ ID NO: 367918 - DNA, 20 bp, Artificial
  CRISPR gRNA sequence
attaaataactcagttgatg

SEQ ID NO: 367919 - DNA, 20 bp, Artificial
  CRISPR gRNA sequence
aactcagttgatggggcttc

SEQ ID NO: 367920 - DNA, 20 bp, Artificial
  CRISPR gRNA sequence
gggcttctggcacttccctt

SEQ ID NO: 367921 - DNA, 20 bp, Artificial
  CRISPR gRNA sequence
gcttctggcacttcccttga

SEQ ID NO: 367922 - DNA, 20 bp, Artificial
  CRISPR gRNA sequence
aatccaataactcttaatgt

SEQ ID NO: 367923 - DNA, 20 bp, Artificial
  CRISPR gRNA sequence
gagaaaatttttcctgactt

SEQ ID NO: 367924 - DNA, 20 bp, Artificial
  CRISPR gRNA sequence
tcttctttgtaatctgcctc

SEQ ID NO: 367925 - DNA, 20 bp, Artificial
  CRISPR gRNA sequence
ttctttgtaatctgcctcga

SEQ ID NO: 367926 - DNA, 20 bp, Artificial
  CRISPR gRNA sequence
ttgtaatctgcctcgagaga

SEQ ID NO: 367927 - DNA, 20 bp, Artificial
  CRISPR gRNA sequence
gtaatctgcctcgagagaaa

SEQ ID NO: 367928 - DNA, 20 bp, Artificial
  CRISPR gRNA sequence
agagaaagagccatgtttca

SEQ ID NO: 367929 - DNA, 20 bp, Artificial
  CRISPR gRNA sequence
gtttcatagaatactgatat

SEQ ID NO: 367930 - DNA, 20 bp, Artificial
  CRISPR gRNA sequence
tcatagaatactgatataag

SEQ ID NO: 367931 - DNA, 20 bp, Artificial
  CRISPR gRNA sequence
actgatataagaagacttcc

SEQ ID NO: 367932 - DNA, 20 bp, Artificial
  CRISPR gRNA sequence
ctgatataagaagacttcca

SEQ ID NO: 367933 - DNA, 20 bp, Artificial
  CRISPR gRNA sequence
tataagaagacttccaagga

SEQ ID NO: 367934 - DNA, 20 bp, Artificial
  CRISPR gRNA sequence
taagaagacttccaaggatg

SEQ ID NO: 367935 - DNA, 20 bp, Artificial
  CRISPR gRNA sequence
aagaagacttccaaggatgg

SEQ ID NO: 367936 - DNA, 20 bp, Artificial
  CRISPR gRNA sequence
aacacaatattcatacttac

SEQ ID NO: 367937 - DNA, 20 bp, Artificial
  CRISPR gRNA sequence
atacttactagtgttgtaaa

SEQ ID NO: 367938 - DNA, 20 bp, Artificial
  CRISPR gRNA sequence
atgtgcatcatatctgcaca

SEQ ID NO: 367939 - DNA, 20 bp, Artificial
  CRISPR gRNA sequence
tgcatcatatctgcacacag

SEQ ID NO: 367940 - DNA, 20 bp, Artificial
  CRISPR gRNA sequence
tctgcacacagtggtgaccg

SEQ ID NO: 367941 - DNA, 20 bp, Artificial
  CRISPR gRNA sequence
cagtggtgaccgtggccaaa

SEQ ID NO: 367942 - DNA, 20 bp, Artificial
  CRISPR gRNA sequence
tggccaaacagaataaaatc

SEQ ID NO: 367943 - DNA, 20 bp, Artificial
  CRISPR gRNA sequence
ggccaaacagaataaaatct

SEQ ID NO: 367944 - DNA, 20 bp, Artificial
  CRISPR gRNA sequence
taaaatctgggcattaattc

SEQ ID NO: 367945 - DNA, 20 bp, Artificial
  CRISPR gRNA sequence
aaaatctgggcattaattct

SEQ ID NO: 367946 - DNA, 20 bp, Artificial
  CRISPR gRNA sequence
aatctgggcattaattctgg

SEQ ID NO: 367947 - DNA, 20 bp, Artificial
  CRISPR gRNA sequence
gcattaattctgggagcatt

SEQ ID NO: 367948 - DNA, 20 bp, Artificial
  CRISPR gRNA sequence
atttagctgcaccatttaat

SEQ ID NO: 367949 - DNA, 20 bp, Artificial
  CRISPR gRNA sequence
tagctgcaccatttaatgag

SEQ ID NO: 367950 - DNA, 20 bp, Artificial
  CRISPR gRNA sequence
catttaatgagcagaatcct

SEQ ID NO: 367951 - DNA, 20 bp, Artificial
  CRISPR gRNA sequence
gaaacttaacattctcattt

SEQ ID NO: 367952 - DNA, 20 bp, Artificial
  CRISPR gRNA sequence
acttaacattctcattttag

SEQ ID NO: 367953 - DNA, 20 bp, Artificial
  CRISPR gRNA sequence
aacattctcattttagcaga

SEQ ID NO: 367954 - DNA, 20 bp, Artificial
  CRISPR gRNA sequence
acattctcattttagcagac

SEQ ID NO: 367955 - DNA, 20 bp, Artificial
  CRISPR gRNA sequence
attttagcagacaggctctt

SEQ ID NO: 367956 - DNA, 20 bp, Artificial
  CRISPR gRNA sequence
aacatacttgttccaattct

SEQ ID NO: 367957 - DNA, 20 bp, Artificial
  CRISPR gRNA sequence
tacttgttccaattcttggc

SEQ ID NO: 367958 - DNA, 20 bp, Artificial
  CRISPR gRNA sequence
gctaccaacaccgatatttc

SEQ ID NO: 367959 - DNA, 20 bp, Artificial
  CRISPR gRNA sequence
ccgatatttccagaattgct

SEQ ID NO: 367960 - DNA, 20 bp, Artificial
  CRISPR gRNA sequence
atttccagaattgcttagtg

SEQ ID NO: 367961 - DNA, 20 bp, Artificial
  CRISPR gRNA sequence
tttccagaattgcttagtga

SEQ ID NO: 367962 - DNA, 20 bp, Artificial
  CRISPR gRNA sequence
ttccagaattgcttagtgaa

SEQ ID NO: 367963 - DNA, 20 bp, Artificial
  CRISPR gRNA sequence
tccagaattgcttagtgaag

SEQ ID NO: 367964 - DNA, 20 bp, Artificial
  CRISPR gRNA sequence
gtgtgtgtgtatcctctgtg

SEQ ID NO: 367965 - DNA, 20 bp, Artificial
  CRISPR gRNA sequence
gtgtgtatcctctgtgtgga

SEQ ID NO: 367966 - DNA, 20 bp, Artificial
  CRISPR gRNA sequence
tgtgtatcctctgtgtggac

SEQ ID NO: 367967 - DNA, 20 bp, Artificial
  CRISPR gRNA sequence
catttccttcatgatatata

SEQ ID NO: 367968 - DNA, 20 bp, Artificial
  CRISPR gRNA sequence
tcatgatatataaagaaccc

SEQ ID NO: 367969 - DNA, 20 bp, Artificial
  CRISPR gRNA sequence
atataaagaacccgagacta

SEQ ID NO: 367970 - DNA, 20 bp, Artificial
  CRISPR gRNA sequence
ccgagactatagcaaatttt

SEQ ID NO: 367971 - DNA, 20 bp, Artificial
  CRISPR gRNA sequence
tacctaattcatttcactaa

SEQ ID NO: 367972 - DNA, 20 bp, Artificial
  CRISPR gRNA sequence
acctaattcatttcactaat

SEQ ID NO: 367973 - DNA, 20 bp, Artificial
  CRISPR gRNA sequence
atttatttctctttgcaaac

SEQ ID NO: 367974 - DNA, 20 bp, Artificial
  CRISPR gRNA sequence
tatttctctttgcaaactgg

SEQ ID NO: 367975 - DNA, 20 bp, Artificial
  CRISPR gRNA sequence
tctttgcaaactggaagctc

SEQ ID NO: 367976 - DNA, 20 bp, Artificial
  CRISPR gRNA sequence
aatgtatacctttttcatgt

SEQ ID NO: 367977 - DNA, 20 bp, Artificial
  CRISPR gRNA sequence
tacctttttcatgtgagaaa

SEQ ID NO: 367978 - DNA, 20 bp, Artificial
  CRISPR gRNA sequence
tttcatgtgagaaacagcca

SEQ ID NO: 367979 - DNA, 20 bp, Artificial
  CRISPR gRNA sequence
tgagaaacagccaaagaatt

SEQ ID NO: 367980 - DNA, 20 bp, Artificial
  CRISPR gRNA sequence
aaagaattcagttgttgtat

SEQ ID NO: 367981 - DNA, 20 bp, Artificial
  CRISPR gRNA sequence
agttgttgtattggtaatgt

SEQ ID NO: 367982 - DNA, 20 bp, Artificial
  CRISPR gRNA sequence
atgttagtatatgtctccaa

SEQ ID NO: 367983 - DNA, 20 bp, Artificial
  CRISPR gRNA sequence
gttagtatatgtctccaaaa

SEQ ID NO: 367984 - DNA, 20 bp, Artificial
  CRISPR gRNA sequence
tccaaaagagatcctttgta

SEQ ID NO: 367985 - DNA, 20 bp, Artificial
  CRISPR gRNA sequence
gtcccattaactcctgacat

SEQ ID NO: 367986 - DNA, 20 bp, Artificial
  CRISPR gRNA sequence
atacctctttattatctttt

SEQ ID NO: 367987 - DNA, 20 bp, Artificial
  CRISPR gRNA sequence
ttattatcttttaagaaaca

SEQ ID NO: 367988 - DNA, 20 bp, Artificial
  CRISPR gRNA sequence
agaaacatagttgctcattt

SEQ ID NO: 367989 - DNA, 20 bp, Artificial
  CRISPR gRNA sequence
ttgctcatttaagtgaaata

SEQ ID NO: 367990 - DNA, 20 bp, Artificial
  CRISPR gRNA sequence
gaaataaagaatacttaaca

SEQ ID NO: 367991 - DNA, 20 bp, Artificial
  CRISPR gRNA sequence
aaataaagaatacttaacat

SEQ ID NO: 367992 - DNA, 20 bp, Artificial
  CRISPR gRNA sequence
aataaagaatacttaacata

SEQ ID NO: 367993 - DNA, 20 bp, Artificial
  CRISPR gRNA sequence
ttaaatcctataaatgtttc

SEQ ID NO: 367994 - DNA, 20 bp, Artificial
  CRISPR gRNA sequence
atcctataaatgtttctgga

SEQ ID NO: 367995 - DNA, 20 bp, Artificial
  CRISPR gRNA sequence
cctataaatgtttctggaaa

SEQ ID NO: 367996 - DNA, 20 bp, Artificial
  CRISPR gRNA sequence
ggaaagagcaaacatttaat

SEQ ID NO: 367997 - DNA, 20 bp, Artificial
  CRISPR gRNA sequence
tgtgtttctttgtgctgaca

SEQ ID NO: 367998 - DNA, 20 bp, Artificial
  CRISPR gRNA sequence
ttgaattttcattcttaaca

SEQ ID NO: 367999 - DNA, 20 bp, Artificial
  CRISPR gRNA sequence
tggtctgattattctgtttt

SEQ ID NO: 368000 - DNA, 20 bp, Artificial
  CRISPR gRNA sequence
tattctgttttcagtgaaaa

SEQ ID NO: 368001 - DNA, 20 bp, Artificial
  CRISPR gRNA sequence
tctgttttcagtgaaaatag

SEQ ID NO: 368002 - DNA, 20 bp, Artificial
  CRISPR gRNA sequence
aaaatagcagaattgaacta

SEQ ID NO: 368003 - DNA, 20 bp, Artificial
  CRISPR gRNA sequence
aaatagcagaattgaactaa

SEQ ID NO: 368004 - DNA, 20 bp, Artificial
  CRISPR gRNA sequence
aatagcagaattgaactaaa

SEQ ID NO: 368005 - DNA, 20 bp, Artificial
  CRISPR gRNA sequence
gaattgaactaaagggaaaa

SEQ ID NO: 368006 - DNA, 20 bp, Artificial
  CRISPR gRNA sequence
ttgttgttgctcaaatgaca

SEQ ID NO: 368007 - DNA, 20 bp, Artificial
  CRISPR gRNA sequence
gttgttgctcaaatgacaca

SEQ ID NO: 368008 - DNA, 20 bp, Artificial
  CRISPR gRNA sequence
ttgttgctcaaatgacacag

SEQ ID NO: 368009 - DNA, 20 bp, Artificial
  CRISPR gRNA sequence
ggtaattgaatctgctttat

SEQ ID NO: 368010 - DNA, 20 bp, Artificial
  CRISPR gRNA sequence
tgaatctgctttattggatg

SEQ ID NO: 368011 - DNA, 20 bp, Artificial
  CRISPR gRNA sequence
gaatctgctttattggatga

SEQ ID NO: 368012 - DNA, 20 bp, Artificial
  CRISPR gRNA sequence
tattggatgaaggatgataa

SEQ ID NO: 368013 - DNA, 20 bp, Artificial
  CRISPR gRNA sequence
tcttacctaaatctgttgaa

SEQ ID NO: 368014 - DNA, 20 bp, Artificial
  CRISPR gRNA sequence
tagatattattgtttgctgt

SEQ ID NO: 368015 - DNA, 20 bp, Artificial
  CRISPR gRNA sequence
agatattattgtttgctgtg

SEQ ID NO: 368016 - DNA, 20 bp, Artificial
  CRISPR gRNA sequence
ttattgtttgctgtgaggaa

SEQ ID NO: 368017 - DNA, 20 bp, Artificial
  CRISPR gRNA sequence
tgtttgctgtgaggaaaaga

SEQ ID NO: 368018 - DNA, 20 bp, Artificial
  CRISPR gRNA sequence
tatacgccatgtaaaacgtt

SEQ ID NO: 368019 - DNA, 20 bp, Artificial
  CRISPR gRNA sequence
atacgccatgtaaaacgttt

SEQ ID NO: 368020 - DNA, 20 bp, Artificial
  CRISPR gRNA sequence
ccatgtaaaacgtttgggcc

SEQ ID NO: 368021 - DNA, 20 bp, Artificial
  CRISPR gRNA sequence
gggccaagtgactgtaatgc

SEQ ID NO: 368022 - DNA, 20 bp, Artificial
  CRISPR gRNA sequence
ggccaagtgactgtaatgca

SEQ ID NO: 368023 - DNA, 20 bp, Artificial
  CRISPR gRNA sequence
caagtgactgtaatgcaagg

SEQ ID NO: 368024 - DNA, 20 bp, Artificial
  CRISPR gRNA sequence
ctgtaatgcaaggtggaatt

SEQ ID NO: 368025 - DNA, 20 bp, Artificial
  CRISPR gRNA sequence
aatgcaaggtggaatttgga

SEQ ID NO: 368026 - DNA, 20 bp, Artificial
  CRISPR gRNA sequence
gcaaggtggaatttggaaag

SEQ ID NO: 368027 - DNA, 20 bp, Artificial
  CRISPR gRNA sequence
ggaatttggaaagtagctta

SEQ ID NO: 368028 - DNA, 20 bp, Artificial
  CRISPR gRNA sequence
tttggaaagtagcttaaagc

SEQ ID NO: 368029 - DNA, 20 bp, Artificial
  CRISPR gRNA sequence
ttggaaagtagcttaaagca

SEQ ID NO: 368030 - DNA, 20 bp, Artificial
  CRISPR gRNA sequence
aagtagcttaaagcaaggtt

SEQ ID NO: 368031 - DNA, 20 bp, Artificial
  CRISPR gRNA sequence
agtagcttaaagcaaggttt

SEQ ID NO: 368032 - DNA, 20 bp, Artificial
  CRISPR gRNA sequence
gtagcttaaagcaaggtttg

SEQ ID NO: 368033 - DNA, 20 bp, Artificial
  CRISPR gRNA sequence
agcttaaagcaaggtttggg

SEQ ID NO: 368034 - DNA, 20 bp, Artificial
  CRISPR gRNA sequence
taaagcaaggtttggggagt

SEQ ID NO: 368035 - DNA, 20 bp, Artificial
  CRISPR gRNA sequence
aagcaaggtttggggagttg

SEQ ID NO: 368036 - DNA, 20 bp, Artificial
  CRISPR gRNA sequence
agcaaggtttggggagttgg

SEQ ID NO: 368037 - DNA, 20 bp, Artificial
  CRISPR gRNA sequence
gtttggggagttggaggtga

SEQ ID NO: 368038 - DNA, 20 bp, Artificial
  CRISPR gRNA sequence
ttggggagttggaggtgaca

SEQ ID NO: 368039 - DNA, 20 bp, Artificial
  CRISPR gRNA sequence
tggggagttggaggtgacag

SEQ ID NO: 368040 - DNA, 20 bp, Artificial
  CRISPR gRNA sequence
gaggtgacagaggttacttc

SEQ ID NO: 368041 - DNA, 20 bp, Artificial
  CRISPR gRNA sequence
gacagaggttacttctggtt

SEQ ID NO: 368042 - DNA, 20 bp, Artificial
  CRISPR gRNA sequence
acagaggttacttctggttt

SEQ ID NO: 368043 - DNA, 20 bp, Artificial
  CRISPR gRNA sequence
cagaggttacttctggtttg

SEQ ID NO: 368044 - DNA, 20 bp, Artificial
  CRISPR gRNA sequence
cttctggtttggggaaacca

SEQ ID NO: 368045 - DNA, 20 bp, Artificial
  CRISPR gRNA sequence
ggtttggggaaaccatggcc

SEQ ID NO: 368046 - DNA, 20 bp, Artificial
  CRISPR gRNA sequence
gaaaccatggcctggaaata

SEQ ID NO: 368047 - DNA, 20 bp, Artificial
  CRISPR gRNA sequence
aaaccatggcctggaaatat

SEQ ID NO: 368048 - DNA, 20 bp, Artificial
  CRISPR gRNA sequence
ctggaaatataggtgtaatt

SEQ ID NO: 368049 - DNA, 20 bp, Artificial
  CRISPR gRNA sequence
ataggtgtaatttggatgaa

SEQ ID NO: 368050 - DNA, 20 bp, Artificial
  CRISPR gRNA sequence
aggtgtaatttggatgaatg

SEQ ID NO: 368051 - DNA, 20 bp, Artificial
  CRISPR gRNA sequence
taatttggatgaatggagac

SEQ ID NO: 368052 - DNA, 20 bp, Artificial
  CRISPR gRNA sequence
aatttggatgaatggagaca

SEQ ID NO: 368053 - DNA, 20 bp, Artificial
  CRISPR gRNA sequence
atttggatgaatggagacaa

SEQ ID NO: 368054 - DNA, 20 bp, Artificial
  CRISPR gRNA sequence
ggatgaatggagacaagggc

SEQ ID NO: 368055 - DNA, 20 bp, Artificial
  CRISPR gRNA sequence
tgaatggagacaagggctgg

SEQ ID NO: 368056 - DNA, 20 bp, Artificial
  CRISPR gRNA sequence
gaatggagacaagggctggc

SEQ ID NO: 368057 - DNA, 20 bp, Artificial
  CRISPR gRNA sequence
tggagacaagggctggcagg

SEQ ID NO: 368058 - DNA, 20 bp, Artificial
  CRISPR gRNA sequence
gagacaagggctggcaggaa

SEQ ID NO: 368059 - DNA, 20 bp, Artificial
  CRISPR gRNA sequence
agacaagggctggcaggaag

SEQ ID NO: 368060 - DNA, 20 bp, Artificial
  CRISPR gRNA sequence
gacaagggctggcaggaaga

SEQ ID NO: 368061 - DNA, 20 bp, Artificial
  CRISPR gRNA sequence
caagggctggcaggaagagg

SEQ ID NO: 368062 - DNA, 20 bp, Artificial
  CRISPR gRNA sequence
aagggctggcaggaagaggg

SEQ ID NO: 368063 - DNA, 20 bp, Artificial
  CRISPR gRNA sequence
ggctggcaggaagagggagg

SEQ ID NO: 368064 - DNA, 20 bp, Artificial
  CRISPR gRNA sequence
gaagagggaggaagttcaaa

SEQ ID NO: 368065 - DNA, 20 bp, Artificial
  CRISPR gRNA sequence
aagagggaggaagttcaaac

SEQ ID NO: 368066 - DNA, 20 bp, Artificial
  CRISPR gRNA sequence
gggaggaagttcaaacagga

SEQ ID NO: 368067 - DNA, 20 bp, Artificial
  CRISPR gRNA sequence
caaacaggaaagtgcatcac

SEQ ID NO: 368068 - DNA, 20 bp, Artificial
  CRISPR gRNA sequence
tcacaagaaacatcgcatac

SEQ ID NO: 368069 - DNA, 20 bp, Artificial
  CRISPR gRNA sequence
cacaagaaacatcgcatacc

SEQ ID NO: 368070 - DNA, 20 bp, Artificial
  CRISPR gRNA sequence
acaagaaacatcgcatacca

SEQ ID NO: 368071 - DNA, 20 bp, Artificial
  CRISPR gRNA sequence
aagaaacatcgcataccagg

SEQ ID NO: 368072 - DNA, 20 bp, Artificial
  CRISPR gRNA sequence
gggagatgctctttgtgttt

SEQ ID NO: 368073 - DNA, 20 bp, Artificial
  CRISPR gRNA sequence
ggagatgctctttgtgtttg

SEQ ID NO: 368074 - DNA, 20 bp, Artificial
  CRISPR gRNA sequence
aggcacatgaaaaacaaatt

SEQ ID NO: 368075 - DNA, 20 bp, Artificial
  CRISPR gRNA sequence
acatgaaaaacaaatttggc

SEQ ID NO: 368076 - DNA, 20 bp, Artificial
  CRISPR gRNA sequence
atgaaaaacaaatttggcca

SEQ ID NO: 368077 - DNA, 20 bp, Artificial
  CRISPR gRNA sequence
tgaaaaacaaatttggccag

SEQ ID NO: 368078 - DNA, 20 bp, Artificial
  CRISPR gRNA sequence
aacaaatttggccagaggct

SEQ ID NO: 368079 - DNA, 20 bp, Artificial
  CRISPR gRNA sequence
acaaatttggccagaggctt

SEQ ID NO: 368080 - DNA, 20 bp, Artificial
  CRISPR gRNA sequence
caaatttggccagaggctta

SEQ ID NO: 368081 - DNA, 20 bp, Artificial
  CRISPR gRNA sequence
aaatttggccagaggcttag

SEQ ID NO: 368082 - DNA, 20 bp, Artificial
  CRISPR gRNA sequence
tttggccagaggcttagggg

SEQ ID NO: 368083 - DNA, 20 bp, Artificial
  CRISPR gRNA sequence
ttggccagaggcttagggga

SEQ ID NO: 368084 - DNA, 20 bp, Artificial
  CRISPR gRNA sequence
ccagaggcttaggggaaggt

SEQ ID NO: 368085 - DNA, 20 bp, Artificial
  CRISPR gRNA sequence
agaggcttaggggaaggtcg

SEQ ID NO: 368086 - DNA, 20 bp, Artificial
  CRISPR gRNA sequence
gaggcttaggggaaggtcgg

SEQ ID NO: 368087 - DNA, 20 bp, Artificial
  CRISPR gRNA sequence
aggcttaggggaaggtcgga

SEQ ID NO: 368088 - DNA, 20 bp, Artificial
  CRISPR gRNA sequence
cttaggggaaggtcggaggg

SEQ ID NO: 368089 - DNA, 20 bp, Artificial
  CRISPR gRNA sequence
aggggaaggtcggagggtgg

SEQ ID NO: 368090 - DNA, 20 bp, Artificial
  CRISPR gRNA sequence
ggggaaggtcggagggtgga

SEQ ID NO: 368091 - DNA, 20 bp, Artificial
  CRISPR gRNA sequence
aggtcggagggtggaaggtc

SEQ ID NO: 368092 - DNA, 20 bp, Artificial
  CRISPR gRNA sequence
agggtggaaggtccagattt

SEQ ID NO: 368093 - DNA, 20 bp, Artificial
  CRISPR gRNA sequence
tccagattttggacttcatt

SEQ ID NO: 368094 - DNA, 20 bp, Artificial
  CRISPR gRNA sequence
tttggacttcatttggttgt

SEQ ID NO: 368095 - DNA, 20 bp, Artificial
  CRISPR gRNA sequence
acttcatttggttgttagta

SEQ ID NO: 368096 - DNA, 20 bp, Artificial
  CRISPR gRNA sequence
ttgttagtaaagttttcaaa

SEQ ID NO: 368097 - DNA, 20 bp, Artificial
  CRISPR gRNA sequence
gtaaagttttcaaatagtga

SEQ ID NO: 368098 - DNA, 20 bp, Artificial
  CRISPR gRNA sequence
aaatagtgaaagtctcatgt

SEQ ID NO: 368099 - DNA, 20 bp, Artificial
  CRISPR gRNA sequence
agtctcatgttggccatgat

SEQ ID NO: 368100 - DNA, 20 bp, Artificial
  CRISPR gRNA sequence
gtctcatgttggccatgatt

SEQ ID NO: 368101 - DNA, 20 bp, Artificial
  CRISPR gRNA sequence
ctcatgttggccatgattgg

SEQ ID NO: 368102 - DNA, 20 bp, Artificial
  CRISPR gRNA sequence
gggagccatgaccctaccaa

SEQ ID NO: 368103 - DNA, 20 bp, Artificial
  CRISPR gRNA sequence
ccatgaccctaccaacagca

SEQ ID NO: 368104 - DNA, 20 bp, Artificial
  CRISPR gRNA sequence
atgaccctaccaacagcacg

SEQ ID NO: 368105 - DNA, 20 bp, Artificial
  CRISPR gRNA sequence
tgaccctaccaacagcacgg

SEQ ID NO: 368106 - DNA, 20 bp, Artificial
  CRISPR gRNA sequence
caacagcacggaggatgatg

SEQ ID NO: 368107 - DNA, 20 bp, Artificial
  CRISPR gRNA sequence
acagcacggaggatgatgta

SEQ ID NO: 368108 - DNA, 20 bp, Artificial
  CRISPR gRNA sequence
cagcacggaggatgatgtag

SEQ ID NO: 368109 - DNA, 20 bp, Artificial
  CRISPR gRNA sequence
cacggaggatgatgtagagg

SEQ ID NO: 368110 - DNA, 20 bp, Artificial
  CRISPR gRNA sequence
acggaggatgatgtagaggt

SEQ ID NO: 368111 - DNA, 20 bp, Artificial
  CRISPR gRNA sequence
gaggatgatgtagaggtagg

SEQ ID NO: 368112 - DNA, 20 bp, Artificial
  CRISPR gRNA sequence
aggatgatgtagaggtagga

SEQ ID NO: 368113 - DNA, 20 bp, Artificial
  CRISPR gRNA sequence
atgatgtagaggtaggaagg

SEQ ID NO: 368114 - DNA, 20 bp, Artificial
  CRISPR gRNA sequence
tgtagaggtaggaaggcaga

SEQ ID NO: 368115 - DNA, 20 bp, Artificial
  CRISPR gRNA sequence
gaggtaggaaggcagaaaga

SEQ ID NO: 368116 - DNA, 20 bp, Artificial
  CRISPR gRNA sequence
aggtaggaaggcagaaagat

SEQ ID NO: 368117 - DNA, 20 bp, Artificial
  CRISPR gRNA sequence
gtaggaaggcagaaagatag

SEQ ID NO: 368118 - DNA, 20 bp, Artificial
  CRISPR gRNA sequence
taggaaggcagaaagatagg

SEQ ID NO: 368119 - DNA, 20 bp, Artificial
  CRISPR gRNA sequence
cagaaagataggaggcacaa

SEQ ID NO: 368120 - DNA, 20 bp, Artificial
  CRISPR gRNA sequence
aaagataggaggcacaaaag

SEQ ID NO: 368121 - DNA, 20 bp, Artificial
  CRISPR gRNA sequence
aagataggaggcacaaaagc

SEQ ID NO: 368122 - DNA, 20 bp, Artificial
  CRISPR gRNA sequence
ataggaggcacaaaagcagg

SEQ ID NO: 368123 - DNA, 20 bp, Artificial
  CRISPR gRNA sequence
gaggcacaaaagcaggcaga

SEQ ID NO: 368124 - DNA, 20 bp, Artificial
  CRISPR gRNA sequence
aggcacaaaagcaggcagat

SEQ ID NO: 368125 - DNA, 20 bp, Artificial
  CRISPR gRNA sequence
gcacaaaagcaggcagatag

SEQ ID NO: 368126 - DNA, 20 bp, Artificial
  CRISPR gRNA sequence
gcagataggagacacgaaaa

SEQ ID NO: 368127 - DNA, 20 bp, Artificial
  CRISPR gRNA sequence
cagataggagacacgaaaac

SEQ ID NO: 368128 - DNA, 20 bp, Artificial
  CRISPR gRNA sequence
taggagacacgaaaacaggc

SEQ ID NO: 368129 - DNA, 20 bp, Artificial
  CRISPR gRNA sequence
agacacgaaaacaggcaaga

SEQ ID NO: 368130 - DNA, 20 bp, Artificial
  CRISPR gRNA sequence
cacgaaaacaggcaagaaag

SEQ ID NO: 368131 - DNA, 20 bp, Artificial
  CRISPR gRNA sequence
acgaaaacaggcaagaaagt

SEQ ID NO: 368132 - DNA, 20 bp, Artificial
  CRISPR gRNA sequence
gaaaacaggcaagaaagtgg

SEQ ID NO: 368133 - DNA, 20 bp, Artificial
  CRISPR gRNA sequence
aaaacaggcaagaaagtggg

SEQ ID NO: 368134 - DNA, 20 bp, Artificial
  CRISPR gRNA sequence
gcaagaaagtgggaggcctg

SEQ ID NO: 368135 - DNA, 20 bp, Artificial
  CRISPR gRNA sequence
gtgggaggcctgtggccctg

SEQ ID NO: 368136 - DNA, 20 bp, Artificial
  CRISPR gRNA sequence
gaggcctgtggccctgcagt

SEQ ID NO: 368137 - DNA, 20 bp, Artificial
  CRISPR gRNA sequence
aggcctgtggccctgcagtg

SEQ ID NO: 368138 - DNA, 20 bp, Artificial
  CRISPR gRNA sequence
ggcctgtggccctgcagtga

SEQ ID NO: 368139 - DNA, 20 bp, Artificial
  CRISPR gRNA sequence
cctgtggccctgcagtgagg

SEQ ID NO: 368140 - DNA, 20 bp, Artificial
  CRISPR gRNA sequence
ctgtggccctgcagtgaggg

SEQ ID NO: 368141 - DNA, 20 bp, Artificial
  CRISPR gRNA sequence
gagggaggacactgccccca

SEQ ID NO: 368142 - DNA, 20 bp, Artificial
  CRISPR gRNA sequence
aggacactgcccccacggtg

SEQ ID NO: 368143 - DNA, 20 bp, Artificial
  CRISPR gRNA sequence
gcccccacggtgcagcccac

SEQ ID NO: 368144 - DNA, 20 bp, Artificial
  CRISPR gRNA sequence
ccccacggtgcagcccacca

SEQ ID NO: 368145 - DNA, 20 bp, Artificial
  CRISPR gRNA sequence
cacggtgcagcccaccagag

SEQ ID NO: 368146 - DNA, 20 bp, Artificial
  CRISPR gRNA sequence
agtctttccaaattacacac

SEQ ID NO: 368147 - DNA, 20 bp, Artificial
  CRISPR gRNA sequence
gtctttccaaattacacacc

SEQ ID NO: 368148 - DNA, 20 bp, Artificial
  CRISPR gRNA sequence
ttccaaattacacaccagga

SEQ ID NO: 368149 - DNA, 20 bp, Artificial
  CRISPR gRNA sequence
caggaaagctcccctgctgc

SEQ ID NO: 368150 - DNA, 20 bp, Artificial
  CRISPR gRNA sequence
attgaatgtctgtcatatgc

SEQ ID NO: 368151 - DNA, 20 bp, Artificial
  CRISPR gRNA sequence
ttgaatgtctgtcatatgct

SEQ ID NO: 368152 - DNA, 20 bp, Artificial
  CRISPR gRNA sequence
gtcatatgctgggcctgtgt

SEQ ID NO: 368153 - DNA, 20 bp, Artificial
  CRISPR gRNA sequence
tcatatgctgggcctgtgtg

SEQ ID NO: 368154 - DNA, 20 bp, Artificial
  CRISPR gRNA sequence
atgctgggcctgtgtgaggt

SEQ ID NO: 368155 - DNA, 20 bp, Artificial
  CRISPR gRNA sequence
gctgggcctgtgtgaggttg

SEQ ID NO: 368156 - DNA, 20 bp, Artificial
  CRISPR gRNA sequence
ctgggcctgtgtgaggttgg

SEQ ID NO: 368157 - DNA, 20 bp, Artificial
  CRISPR gRNA sequence
tgtgtgaggttggaggcata

SEQ ID NO: 368158 - DNA, 20 bp, Artificial
  CRISPR gRNA sequence
gtgtgaggttggaggcatac

SEQ ID NO: 368159 - DNA, 20 bp, Artificial
  CRISPR gRNA sequence
gtgaggttggaggcatacag

SEQ ID NO: 368160 - DNA, 20 bp, Artificial
  CRISPR gRNA sequence
ggcatacaggagaaatgtcc

SEQ ID NO: 368161 - DNA, 20 bp, Artificial
  CRISPR gRNA sequence
atgtcccagtccctcatctc

SEQ ID NO: 368162 - DNA, 20 bp, Artificial
  CRISPR gRNA sequence
cagtccctcatctcaagctc

SEQ ID NO: 368163 - DNA, 20 bp, Artificial
  CRISPR gRNA sequence
agtccctcatctcaagctca

SEQ ID NO: 368164 - DNA, 20 bp, Artificial
  CRISPR gRNA sequence
atgcttacattgtttgtgtg

SEQ ID NO: 368165 - DNA, 20 bp, Artificial
  CRISPR gRNA sequence
gcttacattgtttgtgtgca

SEQ ID NO: 368166 - DNA, 20 bp, Artificial
  CRISPR gRNA sequence
cttacattgtttgtgtgcag

SEQ ID NO: 368167 - DNA, 20 bp, Artificial
  CRISPR gRNA sequence
cattgtttgtgtgcagagga

SEQ ID NO: 368168 - DNA, 20 bp, Artificial
  CRISPR gRNA sequence
attgtttgtgtgcagaggac

SEQ ID NO: 368169 - DNA, 20 bp, Artificial
  CRISPR gRNA sequence
tgtgtgcagaggacgggaat

SEQ ID NO: 368170 - DNA, 20 bp, Artificial
  CRISPR gRNA sequence
gtgcagaggacgggaattgg

SEQ ID NO: 368171 - DNA, 20 bp, Artificial
  CRISPR gRNA sequence
gcagaggacgggaattggtg

SEQ ID NO: 368172 - DNA, 20 bp, Artificial
  CRISPR gRNA sequence
aggacgggaattggtggagc

SEQ ID NO: 368173 - DNA, 20 bp, Artificial
  CRISPR gRNA sequence
ggacgggaattggtggagct

SEQ ID NO: 368174 - DNA, 20 bp, Artificial
  CRISPR gRNA sequence
acgggaattggtggagctag

SEQ ID NO: 368175 - DNA, 20 bp, Artificial
  CRISPR gRNA sequence
ggaattggtggagctaggag

SEQ ID NO: 368176 - DNA, 20 bp, Artificial
  CRISPR gRNA sequence
gaattggtggagctaggagt

SEQ ID NO: 368177 - DNA, 20 bp, Artificial
  CRISPR gRNA sequence
gagctaggagtgggtcgtga

SEQ ID NO: 368178 - DNA, 20 bp, Artificial
  CRISPR gRNA sequence
acagtgtatgtgtgtgcatg

SEQ ID NO: 368179 - DNA, 20 bp, Artificial
  CRISPR gRNA sequence
cagtgtatgtgtgtgcatgt

SEQ ID NO: 368180 - DNA, 20 bp, Artificial
  CRISPR gRNA sequence
tgtatgtgtgtgcatgtggg

SEQ ID NO: 368181 - DNA, 20 bp, Artificial
  CRISPR gRNA sequence
gtatgtgtgtgcatgtggga

SEQ ID NO: 368182 - DNA, 20 bp, Artificial
  CRISPR gRNA sequence
atgtgtgtgcatgtgggaag

SEQ ID NO: 368183 - DNA, 20 bp, Artificial
  CRISPR gRNA sequence
tgtgtgtgcatgtgggaagg

SEQ ID NO: 368184 - DNA, 20 bp, Artificial
  CRISPR gRNA sequence
gtgtgtgcatgtgggaagga

SEQ ID NO: 368185 - DNA, 20 bp, Artificial
  CRISPR gRNA sequence
gcatgtgggaaggagggttg

SEQ ID NO: 368186 - DNA, 20 bp, Artificial
  CRISPR gRNA sequence
atgtgggaaggagggttgtg

SEQ ID NO: 368187 - DNA, 20 bp, Artificial
  CRISPR gRNA sequence
gggaaggagggttgtggagt

SEQ ID NO: 368188 - DNA, 20 bp, Artificial
  CRISPR gRNA sequence
ggaaggagggttgtggagtg

SEQ ID NO: 368189 - DNA, 20 bp, Artificial
  CRISPR gRNA sequence
gaaggagggttgtggagtga

SEQ ID NO: 368190 - DNA, 20 bp, Artificial
  CRISPR gRNA sequence
ggagggttgtggagtgaggg

SEQ ID NO: 368191 - DNA, 20 bp, Artificial
  CRISPR gRNA sequence
gagggttgtggagtgaggga

SEQ ID NO: 368192 - DNA, 20 bp, Artificial
  CRISPR gRNA sequence
agggttgtggagtgagggaa

SEQ ID NO: 368193 - DNA, 20 bp, Artificial
  CRISPR gRNA sequence
gggttgtggagtgagggaag

SEQ ID NO: 368194 - DNA, 20 bp, Artificial
  CRISPR gRNA sequence
agtgagggaaggggtcattc

SEQ ID NO: 368195 - DNA, 20 bp, Artificial
  CRISPR gRNA sequence
gtgagggaaggggtcattca

SEQ ID NO: 368196 - DNA, 20 bp, Artificial
  CRISPR gRNA sequence
aggggtcattcaaggaactt

SEQ ID NO: 368197 - DNA, 20 bp, Artificial
  CRISPR gRNA sequence
gggtcattcaaggaacttca

SEQ ID NO: 368198 - DNA, 20 bp, Artificial
  CRISPR gRNA sequence
attcaaggaacttcagagat

SEQ ID NO: 368199 - DNA, 20 bp, Artificial
  CRISPR gRNA sequence
caaggaacttcagagatcag

SEQ ID NO: 368200 - DNA, 20 bp, Artificial
  CRISPR gRNA sequence
cttcagagatcagaagacac

SEQ ID NO: 368201 - DNA, 20 bp, Artificial
  CRISPR gRNA sequence
tcagagatcagaagacacga

SEQ ID NO: 368202 - DNA, 20 bp, Artificial
  CRISPR gRNA sequence
agacacgagagcttactcat

SEQ ID NO: 368203 - DNA, 20 bp, Artificial
  CRISPR gRNA sequence
gacacgagagcttactcatg

SEQ ID NO: 368204 - DNA, 20 bp, Artificial
  CRISPR gRNA sequence
acacgagagcttactcatga

SEQ ID NO: 368205 - DNA, 20 bp, Artificial
  CRISPR gRNA sequence
cgagagcttactcatgaggg

SEQ ID NO: 368206 - DNA, 20 bp, Artificial
  CRISPR gRNA sequence
gcttactcatgagggaagat

SEQ ID NO: 368207 - DNA, 20 bp, Artificial
  CRISPR gRNA sequence
ctcatgagggaagatgagaa

SEQ ID NO: 368208 - DNA, 20 bp, Artificial
  CRISPR gRNA sequence
gggaagatgagaacggactg

SEQ ID NO: 368209 - DNA, 20 bp, Artificial
  CRISPR gRNA sequence
gatgagaacggactgaagcg

SEQ ID NO: 368210 - DNA, 20 bp, Artificial
  CRISPR gRNA sequence
ctgaagcgtggtcatgctgt

SEQ ID NO: 368211 - DNA, 20 bp, Artificial
  CRISPR gRNA sequence
agcgtggtcatgctgttagc

SEQ ID NO: 368212 - DNA, 20 bp, Artificial
  CRISPR gRNA sequence
tggtcatgctgttagctgga

SEQ ID NO: 368213 - DNA, 20 bp, Artificial
  CRISPR gRNA sequence
tagctggatggcattcctgc

SEQ ID NO: 368214 - DNA, 20 bp, Artificial
  CRISPR gRNA sequence
gctggatggcattcctgctg

SEQ ID NO: 368215 - DNA, 20 bp, Artificial
  CRISPR gRNA sequence
ctggatggcattcctgctgg

SEQ ID NO: 368216 - DNA, 20 bp, Artificial
  CRISPR gRNA sequence
tggatggcattcctgctgga

SEQ ID NO: 368217 - DNA, 20 bp, Artificial
  CRISPR gRNA sequence
ctggagggaaatcatgctaa

SEQ ID NO: 368218 - DNA, 20 bp, Artificial
  CRISPR gRNA sequence
aaatcatgctaatggcgcaa

SEQ ID NO: 368219 - DNA, 20 bp, Artificial
  CRISPR gRNA sequence
taatggcgcaaaagcaaaat

SEQ ID NO: 368220 - DNA, 20 bp, Artificial
  CRISPR gRNA sequence
aatggcgcaaaagcaaaatg

SEQ ID NO: 368221 - DNA, 20 bp, Artificial
  CRISPR gRNA sequence
gcgcaaaagcaaaatgaggc

SEQ ID NO: 368222 - DNA, 20 bp, Artificial
  CRISPR gRNA sequence
caaaatgaggctggtgtgct

SEQ ID NO: 368223 - DNA, 20 bp, Artificial
  CRISPR gRNA sequence
aaaatgaggctggtgtgctt

SEQ ID NO: 368224 - DNA, 20 bp, Artificial
  CRISPR gRNA sequence
gctggtgtgcttgggaattg

SEQ ID NO: 368225 - DNA, 20 bp, Artificial
  CRISPR gRNA sequence
ctggtgtgcttgggaattgc

SEQ ID NO: 368226 - DNA, 20 bp, Artificial
  CRISPR gRNA sequence
tgtgcttgggaattgcagga

SEQ ID NO: 368227 - DNA, 20 bp, Artificial
  CRISPR gRNA sequence
gaattgcaggatggatcata

SEQ ID NO: 368228 - DNA, 20 bp, Artificial
  CRISPR gRNA sequence
caggatggatcataaagcct

SEQ ID NO: 368229 - DNA, 20 bp, Artificial
  CRISPR gRNA sequence
ggatcataaagcctgagtaa

SEQ ID NO: 368230 - DNA, 20 bp, Artificial
  CRISPR gRNA sequence
gcctgagtaaaagctaattt

SEQ ID NO: 368231 - DNA, 20 bp, Artificial
  CRISPR gRNA sequence
tgagtaaaagctaatttaag

SEQ ID NO: 368232 - DNA, 20 bp, Artificial
  CRISPR gRNA sequence
gagtaaaagctaatttaagt

SEQ ID NO: 368233 - DNA, 20 bp, Artificial
  CRISPR gRNA sequence
taaaagctaatttaagtggg

SEQ ID NO: 368234 - DNA, 20 bp, Artificial
  CRISPR gRNA sequence
aagctaatttaagtgggtag

SEQ ID NO: 368235 - DNA, 20 bp, Artificial
  CRISPR gRNA sequence
atttaagtgggtagtggtgc

SEQ ID NO: 368236 - DNA, 20 bp, Artificial
  CRISPR gRNA sequence
tttaagtgggtagtggtgcc

SEQ ID NO: 368237 - DNA, 20 bp, Artificial
  CRISPR gRNA sequence
aagtgggtagtggtgccagg

SEQ ID NO: 368238 - DNA, 20 bp, Artificial
  CRISPR gRNA sequence
gtggtgccaggtggtgaact

SEQ ID NO: 368239 - DNA, 20 bp, Artificial
  CRISPR gRNA sequence
ggtgccaggtggtgaacttg

SEQ ID NO: 368240 - DNA, 20 bp, Artificial
  CRISPR gRNA sequence
gtgccaggtggtgaacttgg

SEQ ID NO: 368241 - DNA, 20 bp, Artificial
  CRISPR gRNA sequence
tgccaggtggtgaacttgga

SEQ ID NO: 368242 - DNA, 20 bp, Artificial
  CRISPR gRNA sequence
gccaggtggtgaacttggag

SEQ ID NO: 368243 - DNA, 20 bp, Artificial
  CRISPR gRNA sequence
aggtggtgaacttggagggg

SEQ ID NO: 368244 - DNA, 20 bp, Artificial
  CRISPR gRNA sequence
ggtgaacttggaggggtgga

SEQ ID NO: 368245 - DNA, 20 bp, Artificial
  CRISPR gRNA sequence
gaacttggaggggtggatag

SEQ ID NO: 368246 - DNA, 20 bp, Artificial
  CRISPR gRNA sequence
aggggtggatagtggtgata

SEQ ID NO: 368247 - DNA, 20 bp, Artificial
  CRISPR gRNA sequence
aaagaaatttgatgtgtgat

SEQ ID NO: 368248 - DNA, 20 bp, Artificial
  CRISPR gRNA sequence
gaaatttgatgtgtgatcag

SEQ ID NO: 368249 - DNA, 20 bp, Artificial
  CRISPR gRNA sequence
aaatttgatgtgtgatcagc

SEQ ID NO: 368250 - DNA, 20 bp, Artificial
  CRISPR gRNA sequence
atttgatgtgtgatcagcag

SEQ ID NO: 368251 - DNA, 20 bp, Artificial
  CRISPR gRNA sequence
tgtgtgatcagcaggagctc

SEQ ID NO: 368252 - DNA, 20 bp, Artificial
  CRISPR gRNA sequence
aggagctccagatttttgct

SEQ ID NO: 368253 - DNA, 20 bp, Artificial
  CRISPR gRNA sequence
agctccagatttttgcttag

SEQ ID NO: 368254 - DNA, 20 bp, Artificial
  CRISPR gRNA sequence
ctccagatttttgcttagaa

SEQ ID NO: 368255 - DNA, 20 bp, Artificial
  CRISPR gRNA sequence
tccagatttttgcttagaag

SEQ ID NO: 368256 - DNA, 20 bp, Artificial
  CRISPR gRNA sequence
ccagatttttgcttagaaga

SEQ ID NO: 368257 - DNA, 20 bp, Artificial
  CRISPR gRNA sequence
cagatttttgcttagaagag

SEQ ID NO: 368258 - DNA, 20 bp, Artificial
  CRISPR gRNA sequence
agatttttgcttagaagagg

SEQ ID NO: 368259 - DNA, 20 bp, Artificial
  CRISPR gRNA sequence
tgcttagaagagggggcatt

SEQ ID NO: 368260 - DNA, 20 bp, Artificial
  CRISPR gRNA sequence
ggcattcagaacacttgatt

SEQ ID NO: 368261 - DNA, 20 bp, Artificial
  CRISPR gRNA sequence
gatttggaactgcatgttca

SEQ ID NO: 368262 - DNA, 20 bp, Artificial
  CRISPR gRNA sequence
agcaaacccacatgcttact

SEQ ID NO: 368263 - DNA, 20 bp, Artificial
  CRISPR gRNA sequence
acttagatgcattttctttg

SEQ ID NO: 368264 - DNA, 20 bp, Artificial
  CRISPR gRNA sequence
tagatgcattttctttgcag

SEQ ID NO: 368265 - DNA, 20 bp, Artificial
  CRISPR gRNA sequence
agatgcattttctttgcagt

SEQ ID NO: 368266 - DNA, 20 bp, Artificial
  CRISPR gRNA sequence
gcattttctttgcagtgggc

SEQ ID NO: 368267 - DNA, 20 bp, Artificial
  CRISPR gRNA sequence
cattttctttgcagtgggct

SEQ ID NO: 368268 - DNA, 20 bp, Artificial
  CRISPR gRNA sequence
ttttctttgcagtgggctgg

SEQ ID NO: 368269 - DNA, 20 bp, Artificial
  CRISPR gRNA sequence
tctttgcagtgggctgggag

SEQ ID NO: 368270 - DNA, 20 bp, Artificial
  CRISPR gRNA sequence
ctttgcagtgggctgggagt

SEQ ID NO: 368271 - DNA, 20 bp, Artificial
  CRISPR gRNA sequence
ttgcagtgggctgggagtag

SEQ ID NO: 368272 - DNA, 20 bp, Artificial
  CRISPR gRNA sequence
gtaggagctttacttccctc

SEQ ID NO: 368273 - DNA, 20 bp, Artificial
  CRISPR gRNA sequence
tcacaaatgtacactattct

SEQ ID NO: 368274 - DNA, 20 bp, Artificial
  CRISPR gRNA sequence
attctaagatattttgactt

SEQ ID NO: 368275 - DNA, 20 bp, Artificial
  CRISPR gRNA sequence
gatattttgactttagattt

SEQ ID NO: 368276 - DNA, 20 bp, Artificial
  CRISPR gRNA sequence
atattttgactttagatttt

SEQ ID NO: 368277 - DNA, 20 bp, Artificial
  CRISPR gRNA sequence
tttgactttagattttaggc

SEQ ID NO: 368278 - DNA, 20 bp, Artificial
  CRISPR gRNA sequence
ttgactttagattttaggca

SEQ ID NO: 368279 - DNA, 20 bp, Artificial
  CRISPR gRNA sequence
tgactttagattttaggcaa

SEQ ID NO: 368280 - DNA, 20 bp, Artificial
  CRISPR gRNA sequence
tttaggcaagggatttcgat

SEQ ID NO: 368281 - DNA, 20 bp, Artificial
  CRISPR gRNA sequence
aagggatttcgattagtctg

SEQ ID NO: 368282 - DNA, 20 bp, Artificial
  CRISPR gRNA sequence
gatttcgattagtctgcagt

SEQ ID NO: 368283 - DNA, 20 bp, Artificial
  CRISPR gRNA sequence
tcgattagtctgcagttaga

SEQ ID NO: 368284 - DNA, 20 bp, Artificial
  CRISPR gRNA sequence
gattagtctgcagttagaaa

SEQ ID NO: 368285 - DNA, 20 bp, Artificial
  CRISPR gRNA sequence
ctgcagttagaaagagcact

SEQ ID NO: 368286 - DNA, 20 bp, Artificial
  CRISPR gRNA sequence
agttagaaagagcactcaga

SEQ ID NO: 368287 - DNA, 20 bp, Artificial
  CRISPR gRNA sequence
gttagaaagagcactcagac

SEQ ID NO: 368288 - DNA, 20 bp, Artificial
  CRISPR gRNA sequence
ttagaaagagcactcagaca

SEQ ID NO: 368289 - DNA, 20 bp, Artificial
  CRISPR gRNA sequence
aagagcactcagacagggtt

SEQ ID NO: 368290 - DNA, 20 bp, Artificial
  CRISPR gRNA sequence
agcactcagacagggtttag

SEQ ID NO: 368291 - DNA, 20 bp, Artificial
  CRISPR gRNA sequence
cactcagacagggtttagaa

SEQ ID NO: 368292 - DNA, 20 bp, Artificial
  CRISPR gRNA sequence
ctcagacagggtttagaaga

SEQ ID NO: 368293 - DNA, 20 bp, Artificial
  CRISPR gRNA sequence
acagggtttagaagagagat

SEQ ID NO: 368294 - DNA, 20 bp, Artificial
  CRISPR gRNA sequence
gggtttagaagagagattgg

SEQ ID NO: 368295 - DNA, 20 bp, Artificial
  CRISPR gRNA sequence
ttagaagagagattggaagt

SEQ ID NO: 368296 - DNA, 20 bp, Artificial
  CRISPR gRNA sequence
agaagagagattggaagtaa

SEQ ID NO: 368297 - DNA, 20 bp, Artificial
  CRISPR gRNA sequence
aagagagattggaagtaaga

SEQ ID NO: 368298 - DNA, 20 bp, Artificial
  CRISPR gRNA sequence
agattggaagtaagagagaa

SEQ ID NO: 368299 - DNA, 20 bp, Artificial
  CRISPR gRNA sequence
attggaagtaagagagaata

SEQ ID NO: 368300 - DNA, 20 bp, Artificial
  CRISPR gRNA sequence
ttggaagtaagagagaatag

SEQ ID NO: 368301 - DNA, 20 bp, Artificial
  CRISPR gRNA sequence
aagtaagagagaatagagga

SEQ ID NO: 368302 - DNA, 20 bp, Artificial
  CRISPR gRNA sequence
agagagaatagaggaaagac

SEQ ID NO: 368303 - DNA, 20 bp, Artificial
  CRISPR gRNA sequence
agaatagaggaaagacaagt

SEQ ID NO: 368304 - DNA, 20 bp, Artificial
  CRISPR gRNA sequence
gaatagaggaaagacaagtc

SEQ ID NO: 368305 - DNA, 20 bp, Artificial
  CRISPR gRNA sequence
atagaggaaagacaagtcag

SEQ ID NO: 368306 - DNA, 20 bp, Artificial
  CRISPR gRNA sequence
gtcaggagaattgtgtcccc

SEQ ID NO: 368307 - DNA, 20 bp, Artificial
  CRISPR gRNA sequence
attgtgtccccaagtttatt

SEQ ID NO: 368308 - DNA, 20 bp, Artificial
  CRISPR gRNA sequence
gtccccaagtttatttggtg

SEQ ID NO: 368309 - DNA, 20 bp, Artificial
  CRISPR gRNA sequence
agttgcaactcctgatatct

SEQ ID NO: 368310 - DNA, 20 bp, Artificial
  CRISPR gRNA sequence
tgcaactcctgatatctcag

SEQ ID NO: 368311 - DNA, 20 bp, Artificial
  CRISPR gRNA sequence
gcaactcctgatatctcaga

SEQ ID NO: 368312 - DNA, 20 bp, Artificial
  CRISPR gRNA sequence
tatctcagaaggtgactatt

SEQ ID NO: 368313 - DNA, 20 bp, Artificial
  CRISPR gRNA sequence
gaaggtgactatttggaaat

SEQ ID NO: 368314 - DNA, 20 bp, Artificial
  CRISPR gRNA sequence
aaggtgactatttggaaatg

SEQ ID NO: 368315 - DNA, 20 bp, Artificial
  CRISPR gRNA sequence
atttggaaatgaggctttta

SEQ ID NO: 368316 - DNA, 20 bp, Artificial
  CRISPR gRNA sequence
ttggaaatgaggcttttaaa

SEQ ID NO: 368317 - DNA, 20 bp, Artificial
  CRISPR gRNA sequence
tggaaatgaggcttttaaag

SEQ ID NO: 368318 - DNA, 20 bp, Artificial
  CRISPR gRNA sequence
aggcttttaaagaggtaatt

SEQ ID NO: 368319 - DNA, 20 bp, Artificial
  CRISPR gRNA sequence
agaggtaattaagttaaaat

SEQ ID NO: 368320 - DNA, 20 bp, Artificial
  CRISPR gRNA sequence
gaggtaattaagttaaaatg

SEQ ID NO: 368321 - DNA, 20 bp, Artificial
  CRISPR gRNA sequence
ttaagttaaaatgaggttat

SEQ ID NO: 368322 - DNA, 20 bp, Artificial
  CRISPR gRNA sequence
taagttaaaatgaggttatt

SEQ ID NO: 368323 - DNA, 20 bp, Artificial
  CRISPR gRNA sequence
aagttaaaatgaggttatta

SEQ ID NO: 368324 - DNA, 20 bp, Artificial
  CRISPR gRNA sequence
ttaaaatgaggttattaggg

SEQ ID NO: 368325 - DNA, 20 bp, Artificial
  CRISPR gRNA sequence
taaaatgaggttattagggt

SEQ ID NO: 368326 - DNA, 20 bp, Artificial
  CRISPR gRNA sequence
gggatctaatccaatatgac

SEQ ID NO: 368327 - DNA, 20 bp, Artificial
  CRISPR gRNA sequence
aatatgactggtttccaaat

SEQ ID NO: 368328 - DNA, 20 bp, Artificial
  CRISPR gRNA sequence
atgactggtttccaaataag

SEQ ID NO: 368329 - DNA, 20 bp, Artificial
  CRISPR gRNA sequence
gactggtttccaaataagaa

SEQ ID NO: 368330 - DNA, 20 bp, Artificial
  CRISPR gRNA sequence
actggtttccaaataagaag

SEQ ID NO: 368331 - DNA, 20 bp, Artificial
  CRISPR gRNA sequence
tggtttccaaataagaagag

SEQ ID NO: 368332 - DNA, 20 bp, Artificial
  CRISPR gRNA sequence
tccaaataagaagaggagat

SEQ ID NO: 368333 - DNA, 20 bp, Artificial
  CRISPR gRNA sequence
ccaaataagaagaggagatt

SEQ ID NO: 368334 - DNA, 20 bp, Artificial
  CRISPR gRNA sequence
aagaagaggagattaggaca

SEQ ID NO: 368335 - DNA, 20 bp, Artificial
  CRISPR gRNA sequence
gaagaggagattaggacaca

SEQ ID NO: 368336 - DNA, 20 bp, Artificial
  CRISPR gRNA sequence
aagaggagattaggacacag

SEQ ID NO: 368337 - DNA, 20 bp, Artificial
  CRISPR gRNA sequence
agaggagattaggacacaga

SEQ ID NO: 368338 - DNA, 20 bp, Artificial
  CRISPR gRNA sequence
ttaggacacagagggtcatc

SEQ ID NO: 368339 - DNA, 20 bp, Artificial
  CRISPR gRNA sequence
cagagggtcatctggaaacc

SEQ ID NO: 368340 - DNA, 20 bp, Artificial
  CRISPR gRNA sequence
agagggtcatctggaaacca

SEQ ID NO: 368341 - DNA, 20 bp, Artificial
  CRISPR gRNA sequence
agggtcatctggaaaccaag

SEQ ID NO: 368342 - DNA, 20 bp, Artificial
  CRISPR gRNA sequence
ggtcatctggaaaccaagga

SEQ ID NO: 368343 - DNA, 20 bp, Artificial
  CRISPR gRNA sequence
tcatctggaaaccaaggaga

SEQ ID NO: 368344 - DNA, 20 bp, Artificial
  CRISPR gRNA sequence
catctggaaaccaaggagag

SEQ ID NO: 368345 - DNA, 20 bp, Artificial
  CRISPR gRNA sequence
accaaggagagaggcctcaa

SEQ ID NO: 368346 - DNA, 20 bp, Artificial
  CRISPR gRNA sequence
ccaaggagagaggcctcaaa

SEQ ID NO: 368347 - DNA, 20 bp, Artificial
  CRISPR gRNA sequence
tcaaaaggaatcaaccctgc

SEQ ID NO: 368348 - DNA, 20 bp, Artificial
  CRISPR gRNA sequence
ccctgctggcacctgaattt

SEQ ID NO: 368349 - DNA, 20 bp, Artificial
  CRISPR gRNA sequence
cctgctggcacctgaatttt

SEQ ID NO: 368350 - DNA, 20 bp, Artificial
  CRISPR gRNA sequence
gcacctgaattttgggtttc

SEQ ID NO: 368351 - DNA, 20 bp, Artificial
  CRISPR gRNA sequence
aattttgggtttctagcctg

SEQ ID NO: 368352 - DNA, 20 bp, Artificial
  CRISPR gRNA sequence
ctgcagaattgcgataaaat

SEQ ID NO: 368353 - DNA, 20 bp, Artificial
  CRISPR gRNA sequence
aaaataagtttctgttgttt

SEQ ID NO: 368354 - DNA, 20 bp, Artificial
  CRISPR gRNA sequence
tttctgttgtttaagccatc

SEQ ID NO: 368355 - DNA, 20 bp, Artificial
  CRISPR gRNA sequence
tgtttaagccatccagtctg

SEQ ID NO: 368356 - DNA, 20 bp, Artificial
  CRISPR gRNA sequence
cagtctgtggtactttatta

SEQ ID NO: 368357 - DNA, 20 bp, Artificial
  CRISPR gRNA sequence
tctgtggtactttattatgg

SEQ ID NO: 368358 - DNA, 20 bp, Artificial
  CRISPR gRNA sequence
gtactttattatggcagccc

SEQ ID NO: 368359 - DNA, 20 bp, Artificial
  CRISPR gRNA sequence
gcagccctagcaaactaatg

SEQ ID NO: 368360 - DNA, 20 bp, Artificial
  CRISPR gRNA sequence
agccctagcaaactaatgca

SEQ ID NO: 368361 - DNA, 20 bp, Artificial
  CRISPR gRNA sequence
gccctagcaaactaatgcag

SEQ ID NO: 368362 - DNA, 20 bp, Artificial
  CRISPR gRNA sequence
gcaaactaatgcagaggtga

SEQ ID NO: 368363 - DNA, 20 bp, Artificial
  CRISPR gRNA sequence
caaactaatgcagaggtgat

SEQ ID NO: 368364 - DNA, 20 bp, Artificial
  CRISPR gRNA sequence
aatgcagaggtgatgggaat

SEQ ID NO: 368365 - DNA, 20 bp, Artificial
  CRISPR gRNA sequence
cagaggtgatgggaataagt

SEQ ID NO: 368366 - DNA, 20 bp, Artificial
  CRISPR gRNA sequence
gtgatgggaataagtcagac

SEQ ID NO: 368367 - DNA, 20 bp, Artificial
  CRISPR gRNA sequence
aagtcagacaagcgatgaaa

SEQ ID NO: 368368 - DNA, 20 bp, Artificial
  CRISPR gRNA sequence
cgatgaaaaagaattaaact

SEQ ID NO: 368369 - DNA, 20 bp, Artificial
  CRISPR gRNA sequence
gatgaaaaagaattaaacta

SEQ ID NO: 368370 - DNA, 20 bp, Artificial
  CRISPR gRNA sequence
gaaaaagaattaaactaagg

SEQ ID NO: 368371 - DNA, 20 bp, Artificial
  CRISPR gRNA sequence
gaattaaactaaggcagctt

SEQ ID NO: 368372 - DNA, 20 bp, Artificial
  CRISPR gRNA sequence
ttaaactaaggcagcttaag

SEQ ID NO: 368373 - DNA, 20 bp, Artificial
  CRISPR gRNA sequence
taaactaaggcagcttaagt

SEQ ID NO: 368374 - DNA, 20 bp, Artificial
  CRISPR gRNA sequence
aaactaaggcagcttaagtg

SEQ ID NO: 368375 - DNA, 20 bp, Artificial
  CRISPR gRNA sequence
aggcagcttaagtggggata

SEQ ID NO: 368376 - DNA, 20 bp, Artificial
  CRISPR gRNA sequence
cagcttaagtggggataaag

SEQ ID NO: 368377 - DNA, 20 bp, Artificial
  CRISPR gRNA sequence
ttaagtggggataaagcaga

SEQ ID NO: 368378 - DNA, 20 bp, Artificial
  CRISPR gRNA sequence
taagtggggataaagcagat

SEQ ID NO: 368379 - DNA, 20 bp, Artificial
  CRISPR gRNA sequence
aagtggggataaagcagatg

SEQ ID NO: 368380 - DNA, 20 bp, Artificial
  CRISPR gRNA sequence
aaagcagatggggcatattc

SEQ ID NO: 368381 - DNA, 20 bp, Artificial
  CRISPR gRNA sequence
ttcaagatgaattttattcc

SEQ ID NO: 368382 - DNA, 20 bp, Artificial
  CRISPR gRNA sequence
tctgaattcttcccctcttg

SEQ ID NO: 368383 - DNA, 20 bp, Artificial
  CRISPR gRNA sequence
ttcttcccctcttgaagatt

SEQ ID NO: 368384 - DNA, 20 bp, Artificial
  CRISPR gRNA sequence
tcttcccctcttgaagattc

SEQ ID NO: 368385 - DNA, 20 bp, Artificial
  CRISPR gRNA sequence
taaaaaactattacaactgc

SEQ ID NO: 368386 - DNA, 20 bp, Artificial
  CRISPR gRNA sequence
aaaaactattacaactgcca

SEQ ID NO: 368387 - DNA, 20 bp, Artificial
  CRISPR gRNA sequence
tattacaactgccagagctt

SEQ ID NO: 368388 - DNA, 20 bp, Artificial
  CRISPR gRNA sequence
caactgccagagctttggct

SEQ ID NO: 368389 - DNA, 20 bp, Artificial
  CRISPR gRNA sequence
agctttggctcagaaattgc

SEQ ID NO: 368390 - DNA, 20 bp, Artificial
  CRISPR gRNA sequence
cctgcctacttgctttgtca

SEQ ID NO: 368391 - DNA, 20 bp, Artificial
  CRISPR gRNA sequence
ctttgtcaaagtttcactca

SEQ ID NO: 368392 - DNA, 20 bp, Artificial
  CRISPR gRNA sequence
agtttcactcatggttctgt

SEQ ID NO: 368393 - DNA, 20 bp, Artificial
  CRISPR gRNA sequence
ctaccttaatttgtgttttg

SEQ ID NO: 368394 - DNA, 20 bp, Artificial
  CRISPR gRNA sequence
gcacacacctccatctttcc

SEQ ID NO: 368395 - DNA, 20 bp, Artificial
  CRISPR gRNA sequence
acctccatctttcccagaat

SEQ ID NO: 368396 - DNA, 20 bp, Artificial
  CRISPR gRNA sequence
tttcccagaattagtacact

SEQ ID NO: 368397 - DNA, 20 bp, Artificial
  CRISPR gRNA sequence
tgcctgatgctgtaatatta

SEQ ID NO: 368398 - DNA, 20 bp, Artificial
  CRISPR gRNA sequence
ctgatgctgtaatattaaag

SEQ ID NO: 368399 - DNA, 20 bp, Artificial
  CRISPR gRNA sequence
ctgtttttttcttctttgct

SEQ ID NO: 368400 - DNA, 20 bp, Artificial
  CRISPR gRNA sequence
ttttattattattatacttt

SEQ ID NO: 368401 - DNA, 20 bp, Artificial
  CRISPR gRNA sequence
tattattatactttaagttt

SEQ ID NO: 368402 - DNA, 20 bp, Artificial
  CRISPR gRNA sequence
attattatactttaagtttt

SEQ ID NO: 368403 - DNA, 20 bp, Artificial
  CRISPR gRNA sequence
ttattatactttaagtttta

SEQ ID NO: 368404 - DNA, 20 bp, Artificial
  CRISPR gRNA sequence
gggtacatgtgcacaacatg

SEQ ID NO: 368405 - DNA, 20 bp, Artificial
  CRISPR gRNA sequence
ggtacatgtgcacaacatgc

SEQ ID NO: 368406 - DNA, 20 bp, Artificial
  CRISPR gRNA sequence
tatgtatacatgtgccatgt

SEQ ID NO: 368407 - DNA, 20 bp, Artificial
  CRISPR gRNA sequence
gcacccattaacttgtcatt

SEQ ID NO: 368408 - DNA, 20 bp, Artificial
  CRISPR gRNA sequence
attaacttgtcatttagcat

SEQ ID NO: 368409 - DNA, 20 bp, Artificial
  CRISPR gRNA sequence
ttaacttgtcatttagcatt

SEQ ID NO: 368410 - DNA, 20 bp, Artificial
  CRISPR gRNA sequence
cccctctccccaccccacaa

SEQ ID NO: 368411 - DNA, 20 bp, Artificial
  CRISPR gRNA sequence
ccccaccccacaacagttcc

SEQ ID NO: 368412 - DNA, 20 bp, Artificial
  CRISPR gRNA sequence
attgttcaattcccacctat

SEQ ID NO: 368413 - DNA, 20 bp, Artificial
  CRISPR gRNA sequence
ttcaattcccacctatgagt

SEQ ID NO: 368414 - DNA, 20 bp, Artificial
  CRISPR gRNA sequence
cacctatgagtgagaacatg

SEQ ID NO: 368415 - DNA, 20 bp, Artificial
  CRISPR gRNA sequence
gagtgagaacatgcggtgtt

SEQ ID NO: 368416 - DNA, 20 bp, Artificial
  CRISPR gRNA sequence
tttggtttttgtctttgtga

SEQ ID NO: 368417 - DNA, 20 bp, Artificial
  CRISPR gRNA sequence
tgtctttgtgatagtttgct

SEQ ID NO: 368418 - DNA, 20 bp, Artificial
  CRISPR gRNA sequence
tgatagtttgctgagaatga

SEQ ID NO: 368419 - DNA, 20 bp, Artificial
  CRISPR gRNA sequence
ttgctgagaatgatggtttc

SEQ ID NO: 368420 - DNA, 20 bp, Artificial
  CRISPR gRNA sequence
gtttcatccatgtccctaca

SEQ ID NO: 368421 - DNA, 20 bp, Artificial
  CRISPR gRNA sequence
tttcatccatgtccctacaa

SEQ ID NO: 368422 - DNA, 20 bp, Artificial
  CRISPR gRNA sequence
catgaactcatcatttttta

SEQ ID NO: 368423 - DNA, 20 bp, Artificial
  CRISPR gRNA sequence
catcattttttatggctgca

SEQ ID NO: 368424 - DNA, 20 bp, Artificial
  CRISPR gRNA sequence
tatggctgcatagtattcca

SEQ ID NO: 368425 - DNA, 20 bp, Artificial
  CRISPR gRNA sequence
tgtgccacattttcttaatc

SEQ ID NO: 368426 - DNA, 20 bp, Artificial
  CRISPR gRNA sequence
ttaatccagtctatcgttgt

SEQ ID NO: 368427 - DNA, 20 bp, Artificial
  CRISPR gRNA sequence
gtctatcgttgttggacatt

SEQ ID NO: 368428 - DNA, 20 bp, Artificial
  CRISPR gRNA sequence
tctatcgttgttggacattt

SEQ ID NO: 368429 - DNA, 20 bp, Artificial
  CRISPR gRNA sequence
tcgttgttggacatttgggt

SEQ ID NO: 368430 - DNA, 20 bp, Artificial
  CRISPR gRNA sequence
tggacatttgggttggttcc

SEQ ID NO: 368431 - DNA, 20 bp, Artificial
  CRISPR gRNA sequence
caagtctttgctactgtgaa

SEQ ID NO: 368432 - DNA, 20 bp, Artificial
  CRISPR gRNA sequence
tgctactgtgaatagtgccg

SEQ ID NO: 368433 - DNA, 20 bp, Artificial
  CRISPR gRNA sequence
gaatagtgccgcagtgtttg

SEQ ID NO: 368434 - DNA, 20 bp, Artificial
  CRISPR gRNA sequence
ttttcactgtgtgctgctca

SEQ ID NO: 368435 - DNA, 20 bp, Artificial
  CRISPR gRNA sequence
gctgctcatagtccttgata

SEQ ID NO: 368436 - DNA, 20 bp, Artificial
  CRISPR gRNA sequence
tagtccttgataaagccttc

SEQ ID NO: 368437 - DNA, 20 bp, Artificial
  CRISPR gRNA sequence
agtccttgataaagccttct

SEQ ID NO: 368438 - DNA, 20 bp, Artificial
  CRISPR gRNA sequence
gtccttgataaagccttctg

SEQ ID NO: 368439 - DNA, 20 bp, Artificial
  CRISPR gRNA sequence
agccttctggggattctctg

SEQ ID NO: 368440 - DNA, 20 bp, Artificial
  CRISPR gRNA sequence
attctctgaagtctaacatg

SEQ ID NO: 368441 - DNA, 20 bp, Artificial
  CRISPR gRNA sequence
ttctctgaagtctaacatga

SEQ ID NO: 368442 - DNA, 20 bp, Artificial
  CRISPR gRNA sequence
tctctgaagtctaacatgaa

SEQ ID NO: 368443 - DNA, 20 bp, Artificial
  CRISPR gRNA sequence
catgaagggacctttgttct

SEQ ID NO: 368444 - DNA, 20 bp, Artificial
  CRISPR gRNA sequence
tgaagggacctttgttctca

SEQ ID NO: 368445 - DNA, 20 bp, Artificial
  CRISPR gRNA sequence
gaagggacctttgttctcag

SEQ ID NO: 368446 - DNA, 20 bp, Artificial
  CRISPR gRNA sequence
agggacctttgttctcagag

SEQ ID NO: 368447 - DNA, 20 bp, Artificial
  CRISPR gRNA sequence
ttctcagaggagtcgaaacc

SEQ ID NO: 368448 - DNA, 20 bp, Artificial
  CRISPR gRNA sequence
gtcgaaacctggattacttt

SEQ ID NO: 368449 - DNA, 20 bp, Artificial
  CRISPR gRNA sequence
acctggattactttcagcct

SEQ ID NO: 368450 - DNA, 20 bp, Artificial
  CRISPR gRNA sequence
tactttcagcctgagcttta

SEQ ID NO: 368451 - DNA, 20 bp, Artificial
  CRISPR gRNA sequence
ctttcagcctgagctttatg

SEQ ID NO: 368452 - DNA, 20 bp, Artificial
  CRISPR gRNA sequence
tttatggagcacctgtacta

SEQ ID NO: 368453 - DNA, 20 bp, Artificial
  CRISPR gRNA sequence
ttatggagcacctgtactat

SEQ ID NO: 368454 - DNA, 20 bp, Artificial
  CRISPR gRNA sequence
gcacctgtactatgggaatt

SEQ ID NO: 368455 - DNA, 20 bp, Artificial
  CRISPR gRNA sequence
cacctgtactatgggaattt

SEQ ID NO: 368456 - DNA, 20 bp, Artificial
  CRISPR gRNA sequence
tttaggctataaatccacat

SEQ ID NO: 368457 - DNA, 20 bp, Artificial
  CRISPR gRNA sequence
ttaggctataaatccacatg

SEQ ID NO: 368458 - DNA, 20 bp, Artificial
  CRISPR gRNA sequence
catgaggactgatttgtgct

SEQ ID NO: 368459 - DNA, 20 bp, Artificial
  CRISPR gRNA sequence
atttgtgcttagaactactc

SEQ ID NO: 368460 - DNA, 20 bp, Artificial
  CRISPR gRNA sequence
tttgtgcttagaactactca

SEQ ID NO: 368461 - DNA, 20 bp, Artificial
  CRISPR gRNA sequence
ctttctttcccttattcacc

SEQ ID NO: 368462 - DNA, 20 bp, Artificial
  CRISPR gRNA sequence
tttctttcccttattcacct

SEQ ID NO: 368463 - DNA, 20 bp, Artificial
  CRISPR gRNA sequence
ttctttcccttattcacctg

SEQ ID NO: 368464 - DNA, 20 bp, Artificial
  CRISPR gRNA sequence
cccttattcacctggggatg

SEQ ID NO: 368465 - DNA, 20 bp, Artificial
  CRISPR gRNA sequence
ccttattcacctggggatgc

SEQ ID NO: 368466 - DNA, 20 bp, Artificial
  CRISPR gRNA sequence
attcacctggggatgcgggt

SEQ ID NO: 368467 - DNA, 20 bp, Artificial
  CRISPR gRNA sequence
ggtgagcacatgcttatttc

SEQ ID NO: 368468 - DNA, 20 bp, Artificial
  CRISPR gRNA sequence
gtgagcacatgcttatttcc

SEQ ID NO: 368469 - DNA, 20 bp, Artificial
  CRISPR gRNA sequence
tccaggtcattgttaccatg

SEQ ID NO: 368470 - DNA, 20 bp, Artificial
  CRISPR gRNA sequence
ccaggtcattgttaccatga

SEQ ID NO: 368471 - DNA, 20 bp, Artificial
  CRISPR gRNA sequence
aggtcattgttaccatgaag

SEQ ID NO: 368472 - DNA, 20 bp, Artificial
  CRISPR gRNA sequence
taccatgaaggagtatcact

SEQ ID NO: 368473 - DNA, 20 bp, Artificial
  CRISPR gRNA sequence
ccatgaaggagtatcactta

SEQ ID NO: 368474 - DNA, 20 bp, Artificial
  CRISPR gRNA sequence
catgaaggagtatcacttag

SEQ ID NO: 368475 - DNA, 20 bp, Artificial
  CRISPR gRNA sequence
tatcacttagaggtctcgac

SEQ ID NO: 368476 - DNA, 20 bp, Artificial
  CRISPR gRNA sequence
cttagaggtctcgacaagac

SEQ ID NO: 368477 - DNA, 20 bp, Artificial
  CRISPR gRNA sequence
tagaggtctcgacaagacaa

SEQ ID NO: 368478 - DNA, 20 bp, Artificial
  CRISPR gRNA sequence
agaggtctcgacaagacaag

SEQ ID NO: 368479 - DNA, 20 bp, Artificial
  CRISPR gRNA sequence
ggtctcgacaagacaagagg

SEQ ID NO: 368480 - DNA, 20 bp, Artificial
  CRISPR gRNA sequence
gtctcgacaagacaagagga

SEQ ID NO: 368481 - DNA, 20 bp, Artificial
  CRISPR gRNA sequence
cttctttttaattctcactt

SEQ ID NO: 368482 - DNA, 20 bp, Artificial
  CRISPR gRNA sequence
ttctttttaattctcacttc

SEQ ID NO: 368483 - DNA, 20 bp, Artificial
  CRISPR gRNA sequence
tttttaattctcacttcagg

SEQ ID NO: 368484 - DNA, 20 bp, Artificial
  CRISPR gRNA sequence
ttttaattctcacttcaggt

SEQ ID NO: 368485 - DNA, 20 bp, Artificial
  CRISPR gRNA sequence
ttctcacttcaggtaggtcc

SEQ ID NO: 368486 - DNA, 20 bp, Artificial
  CRISPR gRNA sequence
tctcacttcaggtaggtcct

SEQ ID NO: 368487 - DNA, 20 bp, Artificial
  CRISPR gRNA sequence
ctatttctttcgtgttgtat

SEQ ID NO: 368488 - DNA, 20 bp, Artificial
  CRISPR gRNA sequence
tatttctttcgtgttgtatg

SEQ ID NO: 368489 - DNA, 20 bp, Artificial
  CRISPR gRNA sequence
gttgtatgaggttcaaaaat

SEQ ID NO: 368490 - DNA, 20 bp, Artificial
  CRISPR gRNA sequence
tgtatgaggttcaaaaatca

SEQ ID NO: 368491 - DNA, 20 bp, Artificial
  CRISPR gRNA sequence
aaatcagagttcacgttgct

SEQ ID NO: 368492 - DNA, 20 bp, Artificial
  CRISPR gRNA sequence
agagttcacgttgcttagac

SEQ ID NO: 368493 - DNA, 20 bp, Artificial
  CRISPR gRNA sequence
gttcacgttgcttagactgg

SEQ ID NO: 368494 - DNA, 20 bp, Artificial
  CRISPR gRNA sequence
ttcacgttgcttagactggc

SEQ ID NO: 368495 - DNA, 20 bp, Artificial
  CRISPR gRNA sequence
cttagactggcaggtgtgct

SEQ ID NO: 368496 - DNA, 20 bp, Artificial
  CRISPR gRNA sequence
ttagactggcaggtgtgctc

SEQ ID NO: 368497 - DNA, 20 bp, Artificial
  CRISPR gRNA sequence
tagactggcaggtgtgctca

SEQ ID NO: 368498 - DNA, 20 bp, Artificial
  CRISPR gRNA sequence
actggcaggtgtgctcaggg

SEQ ID NO: 368499 - DNA, 20 bp, Artificial
  CRISPR gRNA sequence
ggcaggtgtgctcagggcag

SEQ ID NO: 368500 - DNA, 20 bp, Artificial
  CRISPR gRNA sequence
aggtgtgctcagggcagaag

SEQ ID NO: 368501 - DNA, 20 bp, Artificial
  CRISPR gRNA sequence
cttccacgtccctatgtctc

SEQ ID NO: 368502 - DNA, 20 bp, Artificial
  CRISPR gRNA sequence
tctagtttttcacttctacc

SEQ ID NO: 368503 - DNA, 20 bp, Artificial
  CRISPR gRNA sequence
cacttctacctggatttttc

SEQ ID NO: 368504 - DNA, 20 bp, Artificial
  CRISPR gRNA sequence
ttctacctggatttttccgg

SEQ ID NO: 368505 - DNA, 20 bp, Artificial
  CRISPR gRNA sequence
tccggtggtccctgtgttct

SEQ ID NO: 368506 - DNA, 20 bp, Artificial
  CRISPR gRNA sequence
cggtggtccctgtgttctca

SEQ ID NO: 368507 - DNA, 20 bp, Artificial
  CRISPR gRNA sequence
tcacaaatctgtcctgctcc

SEQ ID NO: 368508 - DNA, 20 bp, Artificial
  CRISPR gRNA sequence
gctcccagtctttctcattt

SEQ ID NO: 368509 - DNA, 20 bp, Artificial
  CRISPR gRNA sequence
attcccacatcttaaaaaca

SEQ ID NO: 368510 - DNA, 20 bp, Artificial
  CRISPR gRNA sequence
cccacatcttaaaaacatag

SEQ ID NO: 368511 - DNA, 20 bp, Artificial
  CRISPR gRNA sequence
ttgcctcatttttcacatct

SEQ ID NO: 368512 - DNA, 20 bp, Artificial
  CRISPR gRNA sequence
atttttcacatctaagtgtc

SEQ ID NO: 368513 - DNA, 20 bp, Artificial
  CRISPR gRNA sequence
aagtgtctagacttgcaaaa

SEQ ID NO: 368514 - DNA, 20 bp, Artificial
  CRISPR gRNA sequence
tatctcaaaccatattgcaa

SEQ ID NO: 368515 - DNA, 20 bp, Artificial
  CRISPR gRNA sequence
tttaaaaaatatttgtcatc

SEQ ID NO: 368516 - DNA, 20 bp, Artificial
  CRISPR gRNA sequence
atctagatgcttttacctga

SEQ ID NO: 368517 - DNA, 20 bp, Artificial
  CRISPR gRNA sequence
aaagtctgatctgaataatg

SEQ ID NO: 368518 - DNA, 20 bp, Artificial
  CRISPR gRNA sequence
aatgtagcccatcatcttcc

SEQ ID NO: 368519 - DNA, 20 bp, Artificial
  CRISPR gRNA sequence
atgtagcccatcatcttccc

SEQ ID NO: 368520 - DNA, 20 bp, Artificial
  CRISPR gRNA sequence
gaatgatgtatcaaataccc

SEQ ID NO: 368521 - DNA, 20 bp, Artificial
  CRISPR gRNA sequence
gtatcaaataccccagtttt

SEQ ID NO: 368522 - DNA, 20 bp, Artificial
  CRISPR gRNA sequence
ccagtttttggactcttctc

SEQ ID NO: 368523 - DNA, 20 bp, Artificial
  CRISPR gRNA sequence
tttggactcttctccagtcc

SEQ ID NO: 368524 - DNA, 20 bp, Artificial
  CRISPR gRNA sequence
ggactcttctccagtcccag

SEQ ID NO: 368525 - DNA, 20 bp, Artificial
  CRISPR gRNA sequence
gactcttctccagtcccagt

SEQ ID NO: 368526 - DNA, 20 bp, Artificial
  CRISPR gRNA sequence
tcccagtaggattttgtttg

SEQ ID NO: 368527 - DNA, 20 bp, Artificial
  CRISPR gRNA sequence
tttgtagttgcccgtgctca

SEQ ID NO: 368528 - DNA, 20 bp, Artificial
  CRISPR gRNA sequence
agttgcccgtgctcatggtg

SEQ ID NO: 368529 - DNA, 20 bp, Artificial
  CRISPR gRNA sequence
ttgcccgtgctcatggtgca

SEQ ID NO: 368530 - DNA, 20 bp, Artificial
  CRISPR gRNA sequence
tgcccgtgctcatggtgcag

SEQ ID NO: 368531 - DNA, 20 bp, Artificial
  CRISPR gRNA sequence
cccgtgctcatggtgcagag

SEQ ID NO: 368532 - DNA, 20 bp, Artificial
  CRISPR gRNA sequence
cgtgctcatggtgcagagga

SEQ ID NO: 368533 - DNA, 20 bp, Artificial
  CRISPR gRNA sequence
atggtgcagaggagagatgc

SEQ ID NO: 368534 - DNA, 20 bp, Artificial
  CRISPR gRNA sequence
ccttcattcttgatcacctc

SEQ ID NO: 368535 - DNA, 20 bp, Artificial
  CRISPR gRNA sequence
ttcattcttgatcacctcca

SEQ ID NO: 368536 - DNA, 20 bp, Artificial
  CRISPR gRNA sequence
ttcttgatcacctccagaga

SEQ ID NO: 368537 - DNA, 20 bp, Artificial
  CRISPR gRNA sequence
tcacctccagagatggcatg

SEQ ID NO: 368538 - DNA, 20 bp, Artificial
  CRISPR gRNA sequence
cagagatggcatgcagcctg

SEQ ID NO: 368539 - DNA, 20 bp, Artificial
  CRISPR gRNA sequence
ctgtggaatttccatatttc

SEQ ID NO: 368540 - DNA, 20 bp, Artificial
  CRISPR gRNA sequence
tgtggaatttccatatttct

SEQ ID NO: 368541 - DNA, 20 bp, Artificial
  CRISPR gRNA sequence
atttccatatttctgggaat

SEQ ID NO: 368542 - DNA, 20 bp, Artificial
  CRISPR gRNA sequence
catatttctgggaatgagct

SEQ ID NO: 368543 - DNA, 20 bp, Artificial
  CRISPR gRNA sequence
ctgggaatgagctcagacaa

SEQ ID NO: 368544 - DNA, 20 bp, Artificial
  CRISPR gRNA sequence
tgggaatgagctcagacaat

SEQ ID NO: 368545 - DNA, 20 bp, Artificial
  CRISPR gRNA sequence
aatgagctcagacaataggc

SEQ ID NO: 368546 - DNA, 20 bp, Artificial
  CRISPR gRNA sequence
tgagctcagacaataggcta

SEQ ID NO: 368547 - DNA, 20 bp, Artificial
  CRISPR gRNA sequence
agctcagacaataggctaga

SEQ ID NO: 368548 - DNA, 20 bp, Artificial
  CRISPR gRNA sequence
ctcagacaataggctagaga

SEQ ID NO: 368549 - DNA, 20 bp, Artificial
  CRISPR gRNA sequence
ataggctagagagagacaca

SEQ ID NO: 368550 - DNA, 20 bp, Artificial
  CRISPR gRNA sequence
aggctagagagagacacaca

SEQ ID NO: 368551 - DNA, 20 bp, Artificial
  CRISPR gRNA sequence
tagagagagacacacagaga

SEQ ID NO: 368552 - DNA, 20 bp, Artificial
  CRISPR gRNA sequence
gagagagacacacagagaca

SEQ ID NO: 368553 - DNA, 20 bp, Artificial
  CRISPR gRNA sequence
gagagacacacagagacaga

SEQ ID NO: 368554 - DNA, 20 bp, Artificial
  CRISPR gRNA sequence
gagacacacagagacagaga

SEQ ID NO: 368555 - DNA, 20 bp, Artificial
  CRISPR gRNA sequence
cagagacagagagagaaatt

SEQ ID NO: 368556 - DNA, 20 bp, Artificial
  CRISPR gRNA sequence
agagagaaattgagaaatga

SEQ ID NO: 368557 - DNA, 20 bp, Artificial
  CRISPR gRNA sequence
attcgatgttgcgtgtgaaa

SEQ ID NO: 368558 - DNA, 20 bp, Artificial
  CRISPR gRNA sequence
atgttgcgtgtgaaatagaa

SEQ ID NO: 368559 - DNA, 20 bp, Artificial
  CRISPR gRNA sequence
tgttgcgtgtgaaatagaaa

SEQ ID NO: 368560 - DNA, 20 bp, Artificial
  CRISPR gRNA sequence
gttgcgtgtgaaatagaaaa

SEQ ID NO: 368561 - DNA, 20 bp, Artificial
  CRISPR gRNA sequence
gtgaaatagaaaagggattc

SEQ ID NO: 368562 - DNA, 20 bp, Artificial
  CRISPR gRNA sequence
gaaatagaaaagggattcaa

SEQ ID NO: 368563 - DNA, 20 bp, Artificial
  CRISPR gRNA sequence
atagaaaagggattcaagag

SEQ ID NO: 368564 - DNA, 20 bp, Artificial
  CRISPR gRNA sequence
aagggattcaagagtggcac

SEQ ID NO: 368565 - DNA, 20 bp, Artificial
  CRISPR gRNA sequence
agggattcaagagtggcacc

SEQ ID NO: 368566 - DNA, 20 bp, Artificial
  CRISPR gRNA sequence
gagtggcaccaggttttact

SEQ ID NO: 368567 - DNA, 20 bp, Artificial
  CRISPR gRNA sequence
agtggcaccaggttttactt

SEQ ID NO: 368568 - DNA, 20 bp, Artificial
  CRISPR gRNA sequence
caggttttacttgggatcct

SEQ ID NO: 368569 - DNA, 20 bp, Artificial
  CRISPR gRNA sequence
gttttacttgggatcctgag

SEQ ID NO: 368570 - DNA, 20 bp, Artificial
  CRISPR gRNA sequence
tacttgggatcctgagtaga

SEQ ID NO: 368571 - DNA, 20 bp, Artificial
  CRISPR gRNA sequence
ggtgctgtcattgactgcat

SEQ ID NO: 368572 - DNA, 20 bp, Artificial
  CRISPR gRNA sequence
gtgctgtcattgactgcatc

SEQ ID NO: 368573 - DNA, 20 bp, Artificial
  CRISPR gRNA sequence
tgctgtcattgactgcatca

SEQ ID NO: 368574 - DNA, 20 bp, Artificial
  CRISPR gRNA sequence
ctgtcattgactgcatcagg

SEQ ID NO: 368575 - DNA, 20 bp, Artificial
  CRISPR gRNA sequence
ttgactgcatcagggagaat

SEQ ID NO: 368576 - DNA, 20 bp, Artificial
  CRISPR gRNA sequence
tgcatcagggagaatgagat

SEQ ID NO: 368577 - DNA, 20 bp, Artificial
  CRISPR gRNA sequence
atcagggagaatgagatgag

SEQ ID NO: 368578 - DNA, 20 bp, Artificial
  CRISPR gRNA sequence
gagaatgagatgagaagctc

SEQ ID NO: 368579 - DNA, 20 bp, Artificial
  CRISPR gRNA sequence
gaatgagatgagaagctccg

SEQ ID NO: 368580 - DNA, 20 bp, Artificial
  CRISPR gRNA sequence
tgagatgagaagctccggag

SEQ ID NO: 368581 - DNA, 20 bp, Artificial
  CRISPR gRNA sequence
gagatgagaagctccggagt

SEQ ID NO: 368582 - DNA, 20 bp, Artificial
  CRISPR gRNA sequence
agatgagaagctccggagtg

SEQ ID NO: 368583 - DNA, 20 bp, Artificial
  CRISPR gRNA sequence
cggagtggggttgaatcgtt

SEQ ID NO: 368584 - DNA, 20 bp, Artificial
  CRISPR gRNA sequence
ggagtggggttgaatcgttt

SEQ ID NO: 368585 - DNA, 20 bp, Artificial
  CRISPR gRNA sequence
ggggttgaatcgtttaggtt

SEQ ID NO: 368586 - DNA, 20 bp, Artificial
  CRISPR gRNA sequence
tcgtttaggtttagacatcc

SEQ ID NO: 368587 - DNA, 20 bp, Artificial
  CRISPR gRNA sequence
taggtttagacatccaagtg

SEQ ID NO: 368588 - DNA, 20 bp, Artificial
  CRISPR gRNA sequence
gacatccaagtgaagctctc

SEQ ID NO: 368589 - DNA, 20 bp, Artificial
  CRISPR gRNA sequence
atccaagtgaagctctctag

SEQ ID NO: 368590 - DNA, 20 bp, Artificial
  CRISPR gRNA sequence
tccaagtgaagctctctagc

SEQ ID NO: 368591 - DNA, 20 bp, Artificial
  CRISPR gRNA sequence
aagtgaagctctctagcagg

SEQ ID NO: 368592 - DNA, 20 bp, Artificial
  CRISPR gRNA sequence
agtgaagctctctagcaggc

SEQ ID NO: 368593 - DNA, 20 bp, Artificial
  CRISPR gRNA sequence
tgaagctctctagcaggcag

SEQ ID NO: 368594 - DNA, 20 bp, Artificial
  CRISPR gRNA sequence
gaagctctctagcaggcagg

SEQ ID NO: 368595 - DNA, 20 bp, Artificial
  CRISPR gRNA sequence
aggcaggaggattttttaat

SEQ ID NO: 368596 - DNA, 20 bp, Artificial
  CRISPR gRNA sequence
ggattttttaatcagaaccc

SEQ ID NO: 368597 - DNA, 20 bp, Artificial
  CRISPR gRNA sequence
attttttaatcagaacccaa

SEQ ID NO: 368598 - DNA, 20 bp, Artificial
  CRISPR gRNA sequence
tttttaatcagaacccaaga

SEQ ID NO: 368599 - DNA, 20 bp, Artificial
  CRISPR gRNA sequence
tcagaacccaagagagaact

SEQ ID NO: 368600 - DNA, 20 bp, Artificial
  CRISPR gRNA sequence
cagaacccaagagagaactt

SEQ ID NO: 368601 - DNA, 20 bp, Artificial
  CRISPR gRNA sequence
acccaagagagaacttgggt

SEQ ID NO: 368602 - DNA, 20 bp, Artificial
  CRISPR gRNA sequence
ccaagagagaacttgggttg

SEQ ID NO: 368603 - DNA, 20 bp, Artificial
  CRISPR gRNA sequence
ttgggttggagatgcaaatg

SEQ ID NO: 368604 - DNA, 20 bp, Artificial
  CRISPR gRNA sequence
ttggagatgcaaatgtggta

SEQ ID NO: 368605 - DNA, 20 bp, Artificial
  CRISPR gRNA sequence
atgcaaatgtggtaaagtca

SEQ ID NO: 368606 - DNA, 20 bp, Artificial
  CRISPR gRNA sequence
tgcaaatgtggtaaagtcat

SEQ ID NO: 368607 - DNA, 20 bp, Artificial
  CRISPR gRNA sequence
tggtaaagtcatgggtgtac

SEQ ID NO: 368608 - DNA, 20 bp, Artificial
  CRISPR gRNA sequence
catgggtgtacgagtatgca

SEQ ID NO: 368609 - DNA, 20 bp, Artificial
  CRISPR gRNA sequence
tgggtgtacgagtatgcaca

SEQ ID NO: 368610 - DNA, 20 bp, Artificial
  CRISPR gRNA sequence
ggtgtacgagtatgcacaga

SEQ ID NO: 368611 - DNA, 20 bp, Artificial
  CRISPR gRNA sequence
cgagtatgcacagagagctt

SEQ ID NO: 368612 - DNA, 20 bp, Artificial
  CRISPR gRNA sequence
tatgcacagagagctttggc

SEQ ID NO: 368613 - DNA, 20 bp, Artificial
  CRISPR gRNA sequence
accgttgaatgtttattatg

SEQ ID NO: 368614 - DNA, 20 bp, Artificial
  CRISPR gRNA sequence
gttgaatgtttattatgtgg

SEQ ID NO: 368615 - DNA, 20 bp, Artificial
  CRISPR gRNA sequence
tgtttattatgtggcagccc

SEQ ID NO: 368616 - DNA, 20 bp, Artificial
  CRISPR gRNA sequence
gtttattatgtggcagccct

SEQ ID NO: 368617 - DNA, 20 bp, Artificial
  CRISPR gRNA sequence
tattatgtggcagccctggg

SEQ ID NO: 368618 - DNA, 20 bp, Artificial
  CRISPR gRNA sequence
attatgtggcagccctgggc

SEQ ID NO: 368619 - DNA, 20 bp, Artificial
  CRISPR gRNA sequence
ttatgtggcagccctgggca

SEQ ID NO: 368620 - DNA, 20 bp, Artificial
  CRISPR gRNA sequence
cagccctgggcagggctcta

SEQ ID NO: 368621 - DNA, 20 bp, Artificial
  CRISPR gRNA sequence
agccctgggcagggctctaa

SEQ ID NO: 368622 - DNA, 20 bp, Artificial
  CRISPR gRNA sequence
aaccctcacattgtccctgt

SEQ ID NO: 368623 - DNA, 20 bp, Artificial
  CRISPR gRNA sequence
accctcacattgtccctgtg

SEQ ID NO: 368624 - DNA, 20 bp, Artificial
  CRISPR gRNA sequence
ccctcacattgtccctgtga

SEQ ID NO: 368625 - DNA, 20 bp, Artificial
  CRISPR gRNA sequence
ctcacattgtccctgtgagg

SEQ ID NO: 368626 - DNA, 20 bp, Artificial
  CRISPR gRNA sequence
cattgtccctgtgagggaga

SEQ ID NO: 368627 - DNA, 20 bp, Artificial
  CRISPR gRNA sequence
ttattaatacataatttaaa

SEQ ID NO: 368628 - DNA, 20 bp, Artificial
  CRISPR gRNA sequence
tttaaaaagcaaaatttaaa

SEQ ID NO: 368629 - DNA, 20 bp, Artificial
  CRISPR gRNA sequence
aaaagcaaaatttaaaaagt

SEQ ID NO: 368630 - DNA, 20 bp, Artificial
  CRISPR gRNA sequence
aaagcaaaatttaaaaagtg

SEQ ID NO: 368631 - DNA, 20 bp, Artificial
  CRISPR gRNA sequence
caaaatttaaaaagtgagga

SEQ ID NO: 368632 - DNA, 20 bp, Artificial
  CRISPR gRNA sequence
taaaaagtgaggatagacta

SEQ ID NO: 368633 - DNA, 20 bp, Artificial
  CRISPR gRNA sequence
aaaagtgaggatagactatg

SEQ ID NO: 368634 - DNA, 20 bp, Artificial
  CRISPR gRNA sequence
aggatagactatggagcata

SEQ ID NO: 368635 - DNA, 20 bp, Artificial
  CRISPR gRNA sequence
ggatagactatggagcatat

SEQ ID NO: 368636 - DNA, 20 bp, Artificial
  CRISPR gRNA sequence
gatagactatggagcatata

SEQ ID NO: 368637 - DNA, 20 bp, Artificial
  CRISPR gRNA sequence
tagactatggagcatatagg

SEQ ID NO: 368638 - DNA, 20 bp, Artificial
  CRISPR gRNA sequence
atggagcatatagggagaaa

SEQ ID NO: 368639 - DNA, 20 bp, Artificial
  CRISPR gRNA sequence
tggagcatatagggagaaaa

SEQ ID NO: 368640 - DNA, 20 bp, Artificial
  CRISPR gRNA sequence
atatagggagaaaaaggacc

SEQ ID NO: 368641 - DNA, 20 bp, Artificial
  CRISPR gRNA sequence
agaaaaaggacctagcacat

SEQ ID NO: 368642 - DNA, 20 bp, Artificial
  CRISPR gRNA sequence
aaaaaggacctagcacatga

SEQ ID NO: 368643 - DNA, 20 bp, Artificial
  CRISPR gRNA sequence
acttgataaaatgatgttac

SEQ ID NO: 368644 - DNA, 20 bp, Artificial
  CRISPR gRNA sequence
aatgatgttacaagtacatg

SEQ ID NO: 368645 - DNA, 20 bp, Artificial
  CRISPR gRNA sequence
tacaagtacatgaagaaatc

SEQ ID NO: 368646 - DNA, 20 bp, Artificial
  CRISPR gRNA sequence
agtacatgaagaaatcaaga

SEQ ID NO: 368647 - DNA, 20 bp, Artificial
  CRISPR gRNA sequence
acatgaagaaatcaagatgg

SEQ ID NO: 368648 - DNA, 20 bp, Artificial
  CRISPR gRNA sequence
catgaagaaatcaagatgga

SEQ ID NO: 368649 - DNA, 20 bp, Artificial
  CRISPR gRNA sequence
atgaagaaatcaagatggaa

SEQ ID NO: 368650 - DNA, 20 bp, Artificial
  CRISPR gRNA sequence
caagatggaagggatgttac

SEQ ID NO: 368651 - DNA, 20 bp, Artificial
  CRISPR gRNA sequence
ggaagggatgttactagatc

SEQ ID NO: 368652 - DNA, 20 bp, Artificial
  CRISPR gRNA sequence
gaagggatgttactagatcc

SEQ ID NO: 368653 - DNA, 20 bp, Artificial
  CRISPR gRNA sequence
aagggatgttactagatcca

SEQ ID NO: 368654 - DNA, 20 bp, Artificial
  CRISPR gRNA sequence
tgtcctcacgatccacacca

SEQ ID NO: 368655 - DNA, 20 bp, Artificial
  CRISPR gRNA sequence
ccacaccacagtttgcaaac

SEQ ID NO: 368656 - DNA, 20 bp, Artificial
  CRISPR gRNA sequence
caccacagtttgcaaacaag

SEQ ID NO: 368657 - DNA, 20 bp, Artificial
  CRISPR gRNA sequence
tcatttgaccaacacatttt

SEQ ID NO: 368658 - DNA, 20 bp, Artificial
  CRISPR gRNA sequence
tttgaccaacacatttttgg

SEQ ID NO: 368659 - DNA, 20 bp, Artificial
  CRISPR gRNA sequence
ccaacacatttttggaagat

SEQ ID NO: 368660 - DNA, 20 bp, Artificial
  CRISPR gRNA sequence
gaaacactcatatgcacatc

SEQ ID NO: 368661 - DNA, 20 bp, Artificial
  CRISPR gRNA sequence
cactcatatgcacatctgga

SEQ ID NO: 368662 - DNA, 20 bp, Artificial
  CRISPR gRNA sequence
tggactattaatactgccat

SEQ ID NO: 368663 - DNA, 20 bp, Artificial
  CRISPR gRNA sequence
actgccataagttttctgct

SEQ ID NO: 368664 - DNA, 20 bp, Artificial
  CRISPR gRNA sequence
gccataagttttctgcttgg

SEQ ID NO: 368665 - DNA, 20 bp, Artificial
  CRISPR gRNA sequence
ttctgcttggcagcattttc

SEQ ID NO: 368666 - DNA, 20 bp, Artificial
  CRISPR gRNA sequence
tctgcttggcagcattttct

SEQ ID NO: 368667 - DNA, 20 bp, Artificial
  CRISPR gRNA sequence
cttggcagcattttctaggc

SEQ ID NO: 368668 - DNA, 20 bp, Artificial
  CRISPR gRNA sequence
ttggcagcattttctaggct

SEQ ID NO: 368669 - DNA, 20 bp, Artificial
  CRISPR gRNA sequence
gcagcattttctaggctggg

SEQ ID NO: 368670 - DNA, 20 bp, Artificial
  CRISPR gRNA sequence
gcattttctaggctgggtag

SEQ ID NO: 368671 - DNA, 20 bp, Artificial
  CRISPR gRNA sequence
tttgtaaataatatattcct

SEQ ID NO: 368672 - DNA, 20 bp, Artificial
  CRISPR gRNA sequence
cttccctattgtaatacctt

SEQ ID NO: 368673 - DNA, 20 bp, Artificial
  CRISPR gRNA sequence
tattgtaatacctttggctc

SEQ ID NO: 368674 - DNA, 20 bp, Artificial
  CRISPR gRNA sequence
ggtcatttccatgatcttcc

SEQ ID NO: 368675 - DNA, 20 bp, Artificial
  CRISPR gRNA sequence
catgatcttcctggaccctc

SEQ ID NO: 368676 - DNA, 20 bp, Artificial
  CRISPR gRNA sequence
atgatcttcctggaccctct

SEQ ID NO: 368677 - DNA, 20 bp, Artificial
  CRISPR gRNA sequence
accctctgggaatttgtctt

SEQ ID NO: 368678 - DNA, 20 bp, Artificial
  CRISPR gRNA sequence
cctctgggaatttgtctttg

SEQ ID NO: 368679 - DNA, 20 bp, Artificial
  CRISPR gRNA sequence
ctttggagccctcacctacg

SEQ ID NO: 368680 - DNA, 20 bp, Artificial
  CRISPR gRNA sequence
tggttaatcttgattcttac

SEQ ID NO: 368681 - DNA, 20 bp, Artificial
  CRISPR gRNA sequence
gattcttacaagtgctgttc

SEQ ID NO: 368682 - DNA, 20 bp, Artificial
  CRISPR gRNA sequence
attcttacaagtgctgttca

SEQ ID NO: 368683 - DNA, 20 bp, Artificial
  CRISPR gRNA sequence
agtgctgttcaaggtcttct

SEQ ID NO: 368684 - DNA, 20 bp, Artificial
  CRISPR gRNA sequence
gtgctgttcaaggtcttcta

SEQ ID NO: 368685 - DNA, 20 bp, Artificial
  CRISPR gRNA sequence
gttcaaggtcttctaaggct

SEQ ID NO: 368686 - DNA, 20 bp, Artificial
  CRISPR gRNA sequence
tggtccctgcataccttcca

SEQ ID NO: 368687 - DNA, 20 bp, Artificial
  CRISPR gRNA sequence
cactttgcattccttttttt

SEQ ID NO: 368688 - DNA, 20 bp, Artificial
  CRISPR gRNA sequence
tcctttttttcagccaaaca

SEQ ID NO: 368689 - DNA, 20 bp, Artificial
  CRISPR gRNA sequence
tttttcagccaaacatggtt

SEQ ID NO: 368690 - DNA, 20 bp, Artificial
  CRISPR gRNA sequence
atggttaagtgcaaattccc

SEQ ID NO: 368691 - DNA, 20 bp, Artificial
  CRISPR gRNA sequence
tggttaagtgcaaattccct

SEQ ID NO: 368692 - DNA, 20 bp, Artificial
  CRISPR gRNA sequence
tcctctgcatttctgaattg

SEQ ID NO: 368693 - DNA, 20 bp, Artificial
  CRISPR gRNA sequence
ctctttcactctgtgtacta

SEQ ID NO: 368694 - DNA, 20 bp, Artificial
  CRISPR gRNA sequence
gaatgccaacatgatgctca

SEQ ID NO: 368695 - DNA, 20 bp, Artificial
  CRISPR gRNA sequence
aatgccaacatgatgctcaa

SEQ ID NO: 368696 - DNA, 20 bp, Artificial
  CRISPR gRNA sequence
tgctcaaaggaaatgctcat

SEQ ID NO: 368697 - DNA, 20 bp, Artificial
  CRISPR gRNA sequence
ctcaaaggaaatgctcattg

SEQ ID NO: 368698 - DNA, 20 bp, Artificial
  CRISPR gRNA sequence
aaatgctcattggagcattt

SEQ ID NO: 368699 - DNA, 20 bp, Artificial
  CRISPR gRNA sequence
cattggagcattttagattt

SEQ ID NO: 368700 - DNA, 20 bp, Artificial
  CRISPR gRNA sequence
cattttagatttcagatttt

SEQ ID NO: 368701 - DNA, 20 bp, Artificial
  CRISPR gRNA sequence
agatttcagatttttggatt

SEQ ID NO: 368702 - DNA, 20 bp, Artificial
  CRISPR gRNA sequence
gatttcagatttttggattt

SEQ ID NO: 368703 - DNA, 20 bp, Artificial
  CRISPR gRNA sequence
atttttggatttgggatgtt

SEQ ID NO: 368704 - DNA, 20 bp, Artificial
  CRISPR gRNA sequence
ttggatttgggatgttcagc

SEQ ID NO: 368705 - DNA, 20 bp, Artificial
  CRISPR gRNA sequence
gtaaatattccaaaatccaa

SEQ ID NO: 368706 - DNA, 20 bp, Artificial
  CRISPR gRNA sequence
tctgaaacacttatgttccc

SEQ ID NO: 368707 - DNA, 20 bp, Artificial
  CRISPR gRNA sequence
acttatgttcccaagtattt

SEQ ID NO: 368708 - DNA, 20 bp, Artificial
  CRISPR gRNA sequence
tgttcccaagtattttggat

SEQ ID NO: 368709 - DNA, 20 bp, Artificial
  CRISPR gRNA sequence
gttcccaagtattttggata

SEQ ID NO: 368710 - DNA, 20 bp, Artificial
  CRISPR gRNA sequence
ttcccaagtattttggataa

SEQ ID NO: 368711 - DNA, 20 bp, Artificial
  CRISPR gRNA sequence
ctcaacctgtactcattctt

SEQ ID NO: 368712 - DNA, 20 bp, Artificial
  CRISPR gRNA sequence
cctgtactcattcttcagct

SEQ ID NO: 368713 - DNA, 20 bp, Artificial
  CRISPR gRNA sequence
ctgtactcattcttcagcta

SEQ ID NO: 368714 - DNA, 20 bp, Artificial
  CRISPR gRNA sequence
acattgtcccacccctaaaa

SEQ ID NO: 368715 - DNA, 20 bp, Artificial
  CRISPR gRNA sequence
cattgtcccacccctaaaac

SEQ ID NO: 368716 - DNA, 20 bp, Artificial
  CRISPR gRNA sequence
ccatgtttcctgcattcccc

SEQ ID NO: 368717 - DNA, 20 bp, Artificial
  CRISPR gRNA sequence
attcccccggatgttgtttg

SEQ ID NO: 368718 - DNA, 20 bp, Artificial
  CRISPR gRNA sequence
tattttccttgcattccatc

SEQ ID NO: 368719 - DNA, 20 bp, Artificial
  CRISPR gRNA sequence
caccgcctcctgtcctgaat

SEQ ID NO: 368720 - DNA, 20 bp, Artificial
  CRISPR gRNA sequence
accgcctcctgtcctgaatg

SEQ ID NO: 368721 - DNA, 20 bp, Artificial
  CRISPR gRNA sequence
ccgcctcctgtcctgaatga

SEQ ID NO: 368722 - DNA, 20 bp, Artificial
  CRISPR gRNA sequence
cctcctgtcctgaatgaggg

SEQ ID NO: 368723 - DNA, 20 bp, Artificial
  CRISPR gRNA sequence
ctcctgtcctgaatgagggc

SEQ ID NO: 368724 - DNA, 20 bp, Artificial
  CRISPR gRNA sequence
cttcatgatcccaataatgt

SEQ ID NO: 368725 - DNA, 20 bp, Artificial
  CRISPR gRNA sequence
ttcatgatcccaataatgtt

SEQ ID NO: 368726 - DNA, 20 bp, Artificial
  CRISPR gRNA sequence
gatcccaataatgttgggaa

SEQ ID NO: 368727 - DNA, 20 bp, Artificial
  CRISPR gRNA sequence
tcccaataatgttgggaaca

SEQ ID NO: 368728 - DNA, 20 bp, Artificial
  CRISPR gRNA sequence
tgggaacagagctttgccct

SEQ ID NO: 368729 - DNA, 20 bp, Artificial
  CRISPR gRNA sequence
gggaacagagctttgccctt

SEQ ID NO: 368730 - DNA, 20 bp, Artificial
  CRISPR gRNA sequence
gaacagagctttgcccttag

SEQ ID NO: 368731 - DNA, 20 bp, Artificial
  CRISPR gRNA sequence
aggagacatgctcaataaaa

SEQ ID NO: 368732 - DNA, 20 bp, Artificial
  CRISPR gRNA sequence
catgctcaataaaacagcaa

SEQ ID NO: 368733 - DNA, 20 bp, Artificial
  CRISPR gRNA sequence
tgctcaataaaacagcaaaa

SEQ ID NO: 368734 - DNA, 20 bp, Artificial
  CRISPR gRNA sequence
caataaaacagcaaaagagt

SEQ ID NO: 368735 - DNA, 20 bp, Artificial
  CRISPR gRNA sequence
aataaaacagcaaaagagtt

SEQ ID NO: 368736 - DNA, 20 bp, Artificial
  CRISPR gRNA sequence
ataaaacagcaaaagagttg

SEQ ID NO: 368737 - DNA, 20 bp, Artificial
  CRISPR gRNA sequence
acagcaaaagagttggggtg

SEQ ID NO: 368738 - DNA, 20 bp, Artificial
  CRISPR gRNA sequence
gcaaaagagttggggtgaag

SEQ ID NO: 368739 - DNA, 20 bp, Artificial
  CRISPR gRNA sequence
caaaagagttggggtgaagt

SEQ ID NO: 368740 - DNA, 20 bp, Artificial
  CRISPR gRNA sequence
aaaagagttggggtgaagta

SEQ ID NO: 368741 - DNA, 20 bp, Artificial
  CRISPR gRNA sequence
aaagagttggggtgaagtag

SEQ ID NO: 368742 - DNA, 20 bp, Artificial
  CRISPR gRNA sequence
aagagttggggtgaagtagg

SEQ ID NO: 368743 - DNA, 20 bp, Artificial
  CRISPR gRNA sequence
gagttggggtgaagtagggg

SEQ ID NO: 368744 - DNA, 20 bp, Artificial
  CRISPR gRNA sequence
gggtgaagtagggggagtga

SEQ ID NO: 368745 - DNA, 20 bp, Artificial
  CRISPR gRNA sequence
ggggagtgatagaaaatgat

SEQ ID NO: 368746 - DNA, 20 bp, Artificial
  CRISPR gRNA sequence
accaattgctgatctgtaca

SEQ ID NO: 368747 - DNA, 20 bp, Artificial
  CRISPR gRNA sequence
ccaattgctgatctgtacat

SEQ ID NO: 368748 - DNA, 20 bp, Artificial
  CRISPR gRNA sequence
tatgaattccatatgtaatt

SEQ ID NO: 368749 - DNA, 20 bp, Artificial
  CRISPR gRNA sequence
gaattccatatgtaattaag

SEQ ID NO: 368750 - DNA, 20 bp, Artificial
  CRISPR gRNA sequence
ccatatgtaattaagtagaa

SEQ ID NO: 368751 - DNA, 20 bp, Artificial
  CRISPR gRNA sequence
tgtaattaagtagaatagaa

SEQ ID NO: 368752 - DNA, 20 bp, Artificial
  CRISPR gRNA sequence
agaatagaacagctgcctat

SEQ ID NO: 368753 - DNA, 20 bp, Artificial
  CRISPR gRNA sequence
agctgcctatgagtactttc

SEQ ID NO: 368754 - DNA, 20 bp, Artificial
  CRISPR gRNA sequence
gcctatgagtactttcgagt

SEQ ID NO: 368755 - DNA, 20 bp, Artificial
  CRISPR gRNA sequence
agtactttcgagtaagtgaa

SEQ ID NO: 368756 - DNA, 20 bp, Artificial
  CRISPR gRNA sequence
gtaagtgaaaagtattcccc

SEQ ID NO: 368757 - DNA, 20 bp, Artificial
  CRISPR gRNA sequence
taagtgaaaagtattcccct

SEQ ID NO: 368758 - DNA, 20 bp, Artificial
  CRISPR gRNA sequence
gtgaaaagtattcccctggg

SEQ ID NO: 368759 - DNA, 20 bp, Artificial
  CRISPR gRNA sequence
tgaaaagtattcccctgggt

SEQ ID NO: 368760 - DNA, 20 bp, Artificial
  CRISPR gRNA sequence
tattcccctgggtgggaaca

SEQ ID NO: 368761 - DNA, 20 bp, Artificial
  CRISPR gRNA sequence
attcccctgggtgggaacaa

SEQ ID NO: 368762 - DNA, 20 bp, Artificial
  CRISPR gRNA sequence
tgggtgggaacaaaggttta

SEQ ID NO: 368763 - DNA, 20 bp, Artificial
  CRISPR gRNA sequence
agctcatcatatgtgaaaca

SEQ ID NO: 368764 - DNA, 20 bp, Artificial
  CRISPR gRNA sequence
catatgtgaaacatggtttg

SEQ ID NO: 368765 - DNA, 20 bp, Artificial
  CRISPR gRNA sequence
aacatggtttgaagtgtatt

SEQ ID NO: 368766 - DNA, 20 bp, Artificial
  CRISPR gRNA sequence
tatgaatttgtctttctaaa

SEQ ID NO: 368767 - DNA, 20 bp, Artificial
  CRISPR gRNA sequence
ccgcttttctgcatatttca

SEQ ID NO: 368768 - DNA, 20 bp, Artificial
  CRISPR gRNA sequence
tgcatatttcatagcttaat

SEQ ID NO: 368769 - DNA, 20 bp, Artificial
  CRISPR gRNA sequence
catagcttaatgagattctt

SEQ ID NO: 368770 - DNA, 20 bp, Artificial
  CRISPR gRNA sequence
ttcttcagtatttcacccac

SEQ ID NO: 368771 - DNA, 20 bp, Artificial
  CRISPR gRNA sequence
tagtttgttattttaccact

SEQ ID NO: 368772 - DNA, 20 bp, Artificial
  CRISPR gRNA sequence
gtttgttattttaccactca

SEQ ID NO: 368773 - DNA, 20 bp, Artificial
  CRISPR gRNA sequence
tgttattttaccactcagag

SEQ ID NO: 368774 - DNA, 20 bp, Artificial
  CRISPR gRNA sequence
ttttaccactcagagtggtt

SEQ ID NO: 368775 - DNA, 20 bp, Artificial
  CRISPR gRNA sequence
agtggtttagtgtcatttgc

SEQ ID NO: 368776 - DNA, 20 bp, Artificial
  CRISPR gRNA sequence
tgtcatttgcaagtttttga

SEQ ID NO: 368777 - DNA, 20 bp, Artificial
  CRISPR gRNA sequence
gtcatttgcaagtttttgat

SEQ ID NO: 368778 - DNA, 20 bp, Artificial
  CRISPR gRNA sequence
tcatttgcaagtttttgata

SEQ ID NO: 368779 - DNA, 20 bp, Artificial
  CRISPR gRNA sequence
tttttgatagggatatttat

SEQ ID NO: 368780 - DNA, 20 bp, Artificial
  CRISPR gRNA sequence
gtaaacatattatgtgaact

SEQ ID NO: 368781 - DNA, 20 bp, Artificial
  CRISPR gRNA sequence
tagtacactcatgttcataa

SEQ ID NO: 368782 - DNA, 20 bp, Artificial
  CRISPR gRNA sequence
cataacagcattattcacaa

SEQ ID NO: 368783 - DNA, 20 bp, Artificial
  CRISPR gRNA sequence
cattattcacaacagctaaa

SEQ ID NO: 368784 - DNA, 20 bp, Artificial
  CRISPR gRNA sequence
tattcacaacagctaaaaag

SEQ ID NO: 368785 - DNA, 20 bp, Artificial
  CRISPR gRNA sequence
tcacaacagctaaaaagaag

SEQ ID NO: 368786 - DNA, 20 bp, Artificial
  CRISPR gRNA sequence
ctaaaaagaagaagcaacct

SEQ ID NO: 368787 - DNA, 20 bp, Artificial
  CRISPR gRNA sequence
agaagcaacctaagtgtcta

SEQ ID NO: 368788 - DNA, 20 bp, Artificial
  CRISPR gRNA sequence
aagcaacctaagtgtctacg

SEQ ID NO: 368789 - DNA, 20 bp, Artificial
  CRISPR gRNA sequence
agcaacctaagtgtctacgg

SEQ ID NO: 368790 - DNA, 20 bp, Artificial
  CRISPR gRNA sequence
agtgtctacggaggaataaa

SEQ ID NO: 368791 - DNA, 20 bp, Artificial
  CRISPR gRNA sequence
aggaataaatggacaaaatg

SEQ ID NO: 368792 - DNA, 20 bp, Artificial
  CRISPR gRNA sequence
gacaaaatgcagaatatcta

SEQ ID NO: 368793 - DNA, 20 bp, Artificial
  CRISPR gRNA sequence
tataaaatgtatgtaacatg

SEQ ID NO: 368794 - DNA, 20 bp, Artificial
  CRISPR gRNA sequence
aacatgtagaatatatacaa

SEQ ID NO: 368795 - DNA, 20 bp, Artificial
  CRISPR gRNA sequence
tattcttcattcttaaaaat

SEQ ID NO: 368796 - DNA, 20 bp, Artificial
  CRISPR gRNA sequence
attcttcattcttaaaaatg

SEQ ID NO: 368797 - DNA, 20 bp, Artificial
  CRISPR gRNA sequence
tttgaacacatgctgcaaca

SEQ ID NO: 368798 - DNA, 20 bp, Artificial
  CRISPR gRNA sequence
ttgaacacatgctgcaacat

SEQ ID NO: 368799 - DNA, 20 bp, Artificial
  CRISPR gRNA sequence
gctgcaacatgggtgaaccc

SEQ ID NO: 368800 - DNA, 20 bp, Artificial
  CRISPR gRNA sequence
ctgcaacatgggtgaaccct

SEQ ID NO: 368801 - DNA, 20 bp, Artificial
  CRISPR gRNA sequence
tgcaacatgggtgaaccctg

SEQ ID NO: 368802 - DNA, 20 bp, Artificial
  CRISPR gRNA sequence
gacattattccaaatgaaca

SEQ ID NO: 368803 - DNA, 20 bp, Artificial
  CRISPR gRNA sequence
ttattccaaatgaacaaagc

SEQ ID NO: 368804 - DNA, 20 bp, Artificial
  CRISPR gRNA sequence
aaatgaacaaagccagtcac

SEQ ID NO: 368805 - DNA, 20 bp, Artificial
  CRISPR gRNA sequence
ctttgtgattccacttatat

SEQ ID NO: 368806 - DNA, 20 bp, Artificial
  CRISPR gRNA sequence
tttgtgattccacttatatg

SEQ ID NO: 368807 - DNA, 20 bp, Artificial
  CRISPR gRNA sequence
ttccacttatatgaggtaca

SEQ ID NO: 368808 - DNA, 20 bp, Artificial
  CRISPR gRNA sequence
ccacttatatgaggtacaca

SEQ ID NO: 368809 - DNA, 20 bp, Artificial
  CRISPR gRNA sequence
cacttatatgaggtacacag

SEQ ID NO: 368810 - DNA, 20 bp, Artificial
  CRISPR gRNA sequence
cttatatgaggtacacagag

SEQ ID NO: 368811 - DNA, 20 bp, Artificial
  CRISPR gRNA sequence
aggagtcaaattcattgatt

SEQ ID NO: 368812 - DNA, 20 bp, Artificial
  CRISPR gRNA sequence
gtcaaattcattgattcaga

SEQ ID NO: 368813 - DNA, 20 bp, Artificial
  CRISPR gRNA sequence
aaattcattgattcagaaag

SEQ ID NO: 368814 - DNA, 20 bp, Artificial
  CRISPR gRNA sequence
cattgattcagaaagtggaa

SEQ ID NO: 368815 - DNA, 20 bp, Artificial
  CRISPR gRNA sequence
tgattcagaaagtggaatgg

SEQ ID NO: 368816 - DNA, 20 bp, Artificial
  CRISPR gRNA sequence
gaaagtggaatggtagttgt

SEQ ID NO: 368817 - DNA, 20 bp, Artificial
  CRISPR gRNA sequence
aaagtggaatggtagttgtc

SEQ ID NO: 368818 - DNA, 20 bp, Artificial
  CRISPR gRNA sequence
aagtggaatggtagttgtcg

SEQ ID NO: 368819 - DNA, 20 bp, Artificial
  CRISPR gRNA sequence
agtggaatggtagttgtcgg

SEQ ID NO: 368820 - DNA, 20 bp, Artificial
  CRISPR gRNA sequence
ggaatggtagttgtcggggg

SEQ ID NO: 368821 - DNA, 20 bp, Artificial
  CRISPR gRNA sequence
gaatggtagttgtcgggggt

SEQ ID NO: 368822 - DNA, 20 bp, Artificial
  CRISPR gRNA sequence
aatggtagttgtcgggggtg

SEQ ID NO: 368823 - DNA, 20 bp, Artificial
  CRISPR gRNA sequence
atggtagttgtcgggggtgg

SEQ ID NO: 368824 - DNA, 20 bp, Artificial
  CRISPR gRNA sequence
tagttgtcgggggtggggga

SEQ ID NO: 368825 - DNA, 20 bp, Artificial
  CRISPR gRNA sequence
agttgtcgggggtgggggat

SEQ ID NO: 368826 - DNA, 20 bp, Artificial
  CRISPR gRNA sequence
ttgtcgggggtgggggatgg

SEQ ID NO: 368827 - DNA, 20 bp, Artificial
  CRISPR gRNA sequence
gggggtgggggatgggagaa

SEQ ID NO: 368828 - DNA, 20 bp, Artificial
  CRISPR gRNA sequence
ggggtgggggatgggagaac

SEQ ID NO: 368829 - DNA, 20 bp, Artificial
  CRISPR gRNA sequence
gggtgggggatgggagaaca

SEQ ID NO: 368830 - DNA, 20 bp, Artificial
  CRISPR gRNA sequence
gtgggggatgggagaacagg

SEQ ID NO: 368831 - DNA, 20 bp, Artificial
  CRISPR gRNA sequence
gagaacagggagttgtttaa

SEQ ID NO: 368832 - DNA, 20 bp, Artificial
  CRISPR gRNA sequence
agaacagggagttgtttaat

SEQ ID NO: 368833 - DNA, 20 bp, Artificial
  CRISPR gRNA sequence
acagggagttgtttaatggg

SEQ ID NO: 368834 - DNA, 20 bp, Artificial
  CRISPR gRNA sequence
cagggagttgtttaatgggt

SEQ ID NO: 368835 - DNA, 20 bp, Artificial
  CRISPR gRNA sequence
gggtaggatttcgattctgt

SEQ ID NO: 368836 - DNA, 20 bp, Artificial
  CRISPR gRNA sequence
tttcgattctgtgagataaa

SEQ ID NO: 368837 - DNA, 20 bp, Artificial
  CRISPR gRNA sequence
tcgattctgtgagataaaaa

SEQ ID NO: 368838 - DNA, 20 bp, Artificial
  CRISPR gRNA sequence
ataaaaagagttctgaaaat

SEQ ID NO: 368839 - DNA, 20 bp, Artificial
  CRISPR gRNA sequence
taaaaagagttctgaaaatt

SEQ ID NO: 368840 - DNA, 20 bp, Artificial
  CRISPR gRNA sequence
tactgaactgtacattttaa

SEQ ID NO: 368841 - DNA, 20 bp, Artificial
  CRISPR gRNA sequence
actgaactgtacattttaaa

SEQ ID NO: 368842 - DNA, 20 bp, Artificial
  CRISPR gRNA sequence
ctgaactgtacattttaaaa

SEQ ID NO: 368843 - DNA, 20 bp, Artificial
  CRISPR gRNA sequence
ctgtacattttaaaagggct

SEQ ID NO: 368844 - DNA, 20 bp, Artificial
  CRISPR gRNA sequence
acattttaaaagggctaaga

SEQ ID NO: 368845 - DNA, 20 bp, Artificial
  CRISPR gRNA sequence
tgtgtgtgtgtgtgtgtgtg

SEQ ID NO: 368846 - DNA, 20 bp, Artificial
  CRISPR gRNA sequence
tgtgtgtgtgtgtagtgtct

SEQ ID NO: 368847 - DNA, 20 bp, Artificial
  CRISPR gRNA sequence
gtgtagtgtcttagtctgtt

SEQ ID NO: 368848 - DNA, 20 bp, Artificial
  CRISPR gRNA sequence
tgtagtgtcttagtctgttc

SEQ ID NO: 368849 - DNA, 20 bp, Artificial
  CRISPR gRNA sequence
ctgttcaggctgctataaca

SEQ ID NO: 368850 - DNA, 20 bp, Artificial
  CRISPR gRNA sequence
gctgctataacaaagtacct

SEQ ID NO: 368851 - DNA, 20 bp, Artificial
  CRISPR gRNA sequence
ctataacaaagtaccttaga

SEQ ID NO: 368852 - DNA, 20 bp, Artificial
  CRISPR gRNA sequence
tataacaaagtaccttagat

SEQ ID NO: 368853 - DNA, 20 bp, Artificial
  CRISPR gRNA sequence
tgggtaatttataaataaat

SEQ ID NO: 368854 - DNA, 20 bp, Artificial
  CRISPR gRNA sequence
agttgtatatctcaccgttc

SEQ ID NO: 368855 - DNA, 20 bp, Artificial
  CRISPR gRNA sequence
ttgtatatctcaccgttcta

SEQ ID NO: 368856 - DNA, 20 bp, Artificial
  CRISPR gRNA sequence
tgtatatctcaccgttctag

SEQ ID NO: 368857 - DNA, 20 bp, Artificial
  CRISPR gRNA sequence
tatctcaccgttctagaggc

SEQ ID NO: 368858 - DNA, 20 bp, Artificial
  CRISPR gRNA sequence
atctcaccgttctagaggct

SEQ ID NO: 368859 - DNA, 20 bp, Artificial
  CRISPR gRNA sequence
tcaccgttctagaggctagg

SEQ ID NO: 368860 - DNA, 20 bp, Artificial
  CRISPR gRNA sequence
ttctagaggctaggaagtcc

SEQ ID NO: 368861 - DNA, 20 bp, Artificial
  CRISPR gRNA sequence
ggctaggaagtccaagacca

SEQ ID NO: 368862 - DNA, 20 bp, Artificial
  CRISPR gRNA sequence
gaagtccaagaccaaagcac

SEQ ID NO: 368863 - DNA, 20 bp, Artificial
  CRISPR gRNA sequence
gcacgagcaaatttactgtc

SEQ ID NO: 368864 - DNA, 20 bp, Artificial
  CRISPR gRNA sequence
gagcaaatttactgtctagt

SEQ ID NO: 368865 - DNA, 20 bp, Artificial
  CRISPR gRNA sequence
agcaaatttactgtctagtg

SEQ ID NO: 368866 - DNA, 20 bp, Artificial
  CRISPR gRNA sequence
gcaaatttactgtctagtga

SEQ ID NO: 368867 - DNA, 20 bp, Artificial
  CRISPR gRNA sequence
caaatttactgtctagtgag

SEQ ID NO: 368868 - DNA, 20 bp, Artificial
  CRISPR gRNA sequence
aggggttgctctttgcttcc

SEQ ID NO: 368869 - DNA, 20 bp, Artificial
  CRISPR gRNA sequence
gttgctctttgcttccaaga

SEQ ID NO: 368870 - DNA, 20 bp, Artificial
  CRISPR gRNA sequence
cttcttgctgcgtcctcata

SEQ ID NO: 368871 - DNA, 20 bp, Artificial
  CRISPR gRNA sequence
cttgctgcgtcctcatatgg

SEQ ID NO: 368872 - DNA, 20 bp, Artificial
  CRISPR gRNA sequence
gctgcgtcctcatatggtgg

SEQ ID NO: 368873 - DNA, 20 bp, Artificial
  CRISPR gRNA sequence
ctgcgtcctcatatggtgga

SEQ ID NO: 368874 - DNA, 20 bp, Artificial
  CRISPR gRNA sequence
tgcgtcctcatatggtggaa

SEQ ID NO: 368875 - DNA, 20 bp, Artificial
  CRISPR gRNA sequence
gcgtcctcatatggtggaag

SEQ ID NO: 368876 - DNA, 20 bp, Artificial
  CRISPR gRNA sequence
ctcatatggtggaaggggca

SEQ ID NO: 368877 - DNA, 20 bp, Artificial
  CRISPR gRNA sequence
atatggtggaaggggcaaag

SEQ ID NO: 368878 - DNA, 20 bp, Artificial
  CRISPR gRNA sequence
ctcccttcaacatctttctg

SEQ ID NO: 368879 - DNA, 20 bp, Artificial
  CRISPR gRNA sequence
tcccttcaacatctttctga

SEQ ID NO: 368880 - DNA, 20 bp, Artificial
  CRISPR gRNA sequence
cccttcaacatctttctgaa

SEQ ID NO: 368881 - DNA, 20 bp, Artificial
  CRISPR gRNA sequence
ggcactaatcacattcatga

SEQ ID NO: 368882 - DNA, 20 bp, Artificial
  CRISPR gRNA sequence
actaatcacattcatgaaag

SEQ ID NO: 368883 - DNA, 20 bp, Artificial
  CRISPR gRNA sequence
ttcatgaaagcagaattctc

SEQ ID NO: 368884 - DNA, 20 bp, Artificial
  CRISPR gRNA sequence
agacttaatgatgtccccaa

SEQ ID NO: 368885 - DNA, 20 bp, Artificial
  CRISPR gRNA sequence
atctcttaataccaccacaa

SEQ ID NO: 368886 - DNA, 20 bp, Artificial
  CRISPR gRNA sequence
tctcttaataccaccacaat

SEQ ID NO: 368887 - DNA, 20 bp, Artificial
  CRISPR gRNA sequence
ctcttaataccaccacaatg

SEQ ID NO: 368888 - DNA, 20 bp, Artificial
  CRISPR gRNA sequence
aataccaccacaatggggat

SEQ ID NO: 368889 - DNA, 20 bp, Artificial
  CRISPR gRNA sequence
ataccaccacaatggggatt

SEQ ID NO: 368890 - DNA, 20 bp, Artificial
  CRISPR gRNA sequence
ttaggtttcaatatgaattt

SEQ ID NO: 368891 - DNA, 20 bp, Artificial
  CRISPR gRNA sequence
atatgaatttgagaaacatt

SEQ ID NO: 368892 - DNA, 20 bp, Artificial
  CRISPR gRNA sequence
tttgagaaacattcagatca

SEQ ID NO: 368893 - DNA, 20 bp, Artificial
  CRISPR gRNA sequence
gagaaacattcagatcatag

SEQ ID NO: 368894 - DNA, 20 bp, Artificial
  CRISPR gRNA sequence
aacattcagatcatagcagt

SEQ ID NO: 368895 - DNA, 20 bp, Artificial
  CRISPR gRNA sequence
tcagatcatagcagtgagct

SEQ ID NO: 368896 - DNA, 20 bp, Artificial
  CRISPR gRNA sequence
catagcagtgagcttagttc

SEQ ID NO: 368897 - DNA, 20 bp, Artificial
  CRISPR gRNA sequence
atagcagtgagcttagttcc

SEQ ID NO: 368898 - DNA, 20 bp, Artificial
  CRISPR gRNA sequence
cttagttccaggattatttc

SEQ ID NO: 368899 - DNA, 20 bp, Artificial
  CRISPR gRNA sequence
ttagttccaggattatttca

SEQ ID NO: 368900 - DNA, 20 bp, Artificial
  CRISPR gRNA sequence
tagttccaggattatttcaa

SEQ ID NO: 368901 - DNA, 20 bp, Artificial
  CRISPR gRNA sequence
attgttaacaattctttatt

SEQ ID NO: 368902 - DNA, 20 bp, Artificial
  CRISPR gRNA sequence
tgttaacaattctttattta

SEQ ID NO: 368903 - DNA, 20 bp, Artificial
  CRISPR gRNA sequence
attcctgctatctattgttt

SEQ ID NO: 368904 - DNA, 20 bp, Artificial
  CRISPR gRNA sequence
tttattacacgaaaacaaaa

SEQ ID NO: 368905 - DNA, 20 bp, Artificial
  CRISPR gRNA sequence
ttattacacgaaaacaaaaa

SEQ ID NO: 368906 - DNA, 20 bp, Artificial
  CRISPR gRNA sequence
caaaaaaggatttgttgaca

SEQ ID NO: 368907 - DNA, 20 bp, Artificial
  CRISPR gRNA sequence
aaaaaggatttgttgacaca

SEQ ID NO: 368908 - DNA, 20 bp, Artificial
  CRISPR gRNA sequence
atttgttgacacagagcttt

SEQ ID NO: 368909 - DNA, 20 bp, Artificial
  CRISPR gRNA sequence
tgtcctgctcctaactcatc

SEQ ID NO: 368910 - DNA, 20 bp, Artificial
  CRISPR gRNA sequence
ctcatctggtgatgtctgaa

SEQ ID NO: 368911 - DNA, 20 bp, Artificial
  CRISPR gRNA sequence
aaaagtttcttcatttttct

SEQ ID NO: 368912 - DNA, 20 bp, Artificial
  CRISPR gRNA sequence
ttcttcatttttctgagctt

SEQ ID NO: 368913 - DNA, 20 bp, Artificial
  CRISPR gRNA sequence
agcttcagtttactcatgta

SEQ ID NO: 368914 - DNA, 20 bp, Artificial
  CRISPR gRNA sequence
tcagtttactcatgtataga

SEQ ID NO: 368915 - DNA, 20 bp, Artificial
  CRISPR gRNA sequence
ctcatgtataatatgtacct

SEQ ID NO: 368916 - DNA, 20 bp, Artificial
  CRISPR gRNA sequence
tcatgtataatatgtacctt

SEQ ID NO: 368917 - DNA, 20 bp, Artificial
  CRISPR gRNA sequence
catgtataatatgtacctta

SEQ ID NO: 368918 - DNA, 20 bp, Artificial
  CRISPR gRNA sequence
atgtataatatgtaccttag

SEQ ID NO: 368919 - DNA, 20 bp, Artificial
  CRISPR gRNA sequence
gtataatatgtaccttaggg

SEQ ID NO: 368920 - DNA, 20 bp, Artificial
  CRISPR gRNA sequence
tataatatgtaccttagggg

SEQ ID NO: 368921 - DNA, 20 bp, Artificial
  CRISPR gRNA sequence
atgtaccttaggggaggcat

SEQ ID NO: 368922 - DNA, 20 bp, Artificial
  CRISPR gRNA sequence
ggggaggcatgagaactaat

SEQ ID NO: 368923 - DNA, 20 bp, Artificial
  CRISPR gRNA sequence
aactaatgagataatataca

SEQ ID NO: 368924 - DNA, 20 bp, Artificial
  CRISPR gRNA sequence
caaagatcctatataatact

SEQ ID NO: 368925 - DNA, 20 bp, Artificial
  CRISPR gRNA sequence
cctatataatacttggcaca

SEQ ID NO: 368926 - DNA, 20 bp, Artificial
  CRISPR gRNA sequence
atataatacttggcacatgg

SEQ ID NO: 368927 - DNA, 20 bp, Artificial
  CRISPR gRNA sequence
cttggcacatggaagttgcc

SEQ ID NO: 368928 - DNA, 20 bp, Artificial
  CRISPR gRNA sequence
ggaagttgcccagcacatga

SEQ ID NO: 368929 - DNA, 20 bp, Artificial
  CRISPR gRNA sequence
ttccctttccatgttccctg

SEQ ID NO: 368930 - DNA, 20 bp, Artificial
  CRISPR gRNA sequence
ttccatgttccctgaagaat

SEQ ID NO: 368931 - DNA, 20 bp, Artificial
  CRISPR gRNA sequence
gaagaattagatatcttgtt

SEQ ID NO: 368932 - DNA, 20 bp, Artificial
  CRISPR gRNA sequence
catttcaactaacacatatt

SEQ ID NO: 368933 - DNA, 20 bp, Artificial
  CRISPR gRNA sequence
atttagctgttaccacttgc

SEQ ID NO: 368934 - DNA, 20 bp, Artificial
  CRISPR gRNA sequence
tttagctgttaccacttgcc

SEQ ID NO: 368935 - DNA, 20 bp, Artificial
  CRISPR gRNA sequence
ccacttgccaggcattccat

SEQ ID NO: 368936 - DNA, 20 bp, Artificial
  CRISPR gRNA sequence
cacttgccaggcattccatc

SEQ ID NO: 368937 - DNA, 20 bp, Artificial
  CRISPR gRNA sequence
ccaggcattccatcaggaac

SEQ ID NO: 368938 - DNA, 20 bp, Artificial
  CRISPR gRNA sequence
ccatcaggaactggaaatat

SEQ ID NO: 368939 - DNA, 20 bp, Artificial
  CRISPR gRNA sequence
catcaggaactggaaatatt

SEQ ID NO: 368940 - DNA, 20 bp, Artificial
  CRISPR gRNA sequence
ctggaaatattaggatgaat

SEQ ID NO: 368941 - DNA, 20 bp, Artificial
  CRISPR gRNA sequence
ttaggatgaatgagatatta

SEQ ID NO: 368942 - DNA, 20 bp, Artificial
  CRISPR gRNA sequence
ccctcctccctatcatatgt

SEQ ID NO: 368943 - DNA, 20 bp, Artificial
  CRISPR gRNA sequence
tcctccctatcatatgtaag

SEQ ID NO: 368944 - DNA, 20 bp, Artificial
  CRISPR gRNA sequence
tgtaagtagacattacatga

SEQ ID NO: 368945 - DNA, 20 bp, Artificial
  CRISPR gRNA sequence
ggtatgaaataacgctctca

SEQ ID NO: 368946 - DNA, 20 bp, Artificial
  CRISPR gRNA sequence
gtatgaaataacgctctcat

SEQ ID NO: 368947 - DNA, 20 bp, Artificial
  CRISPR gRNA sequence
tatgaaataacgctctcatg

SEQ ID NO: 368948 - DNA, 20 bp, Artificial
  CRISPR gRNA sequence
ctcatggggataatgccata

SEQ ID NO: 368949 - DNA, 20 bp, Artificial
  CRISPR gRNA sequence
tcatggggataatgccataa

SEQ ID NO: 368950 - DNA, 20 bp, Artificial
  CRISPR gRNA sequence
catggggataatgccataaa

SEQ ID NO: 368951 - DNA, 20 bp, Artificial
  CRISPR gRNA sequence
atggggataatgccataaag

SEQ ID NO: 368952 - DNA, 20 bp, Artificial
  CRISPR gRNA sequence
aatgccataaaggggactct

SEQ ID NO: 368953 - DNA, 20 bp, Artificial
  CRISPR gRNA sequence
tgccataaaggggactctca

SEQ ID NO: 368954 - DNA, 20 bp, Artificial
  CRISPR gRNA sequence
aggggactctcagagtcctt

SEQ ID NO: 368955 - DNA, 20 bp, Artificial
  CRISPR gRNA sequence
gttgtcattcctcattgttc

SEQ ID NO: 368956 - DNA, 20 bp, Artificial
  CRISPR gRNA sequence
tcattcctcattgttcaagt

SEQ ID NO: 368957 - DNA, 20 bp, Artificial
  CRISPR gRNA sequence
tcctcattgttcaagttgga

SEQ ID NO: 368958 - DNA, 20 bp, Artificial
  CRISPR gRNA sequence
gaaaacacatctgacaacta

SEQ ID NO: 368959 - DNA, 20 bp, Artificial
  CRISPR gRNA sequence
aacacatctgacaactaaag

SEQ ID NO: 368960 - DNA, 20 bp, Artificial
  CRISPR gRNA sequence
acatctgacaactaaagaag

SEQ ID NO: 368961 - DNA, 20 bp, Artificial
  CRISPR gRNA sequence
catctgacaactaaagaagt

SEQ ID NO: 368962 - DNA, 20 bp, Artificial
  CRISPR gRNA sequence
tctgacaactaaagaagtag

SEQ ID NO: 368963 - DNA, 20 bp, Artificial
  CRISPR gRNA sequence
acaactaaagaagtaggagt

SEQ ID NO: 368964 - DNA, 20 bp, Artificial
  CRISPR gRNA sequence
aaagaagtaggagttagcca

SEQ ID NO: 368965 - DNA, 20 bp, Artificial
  CRISPR gRNA sequence
aagtaggagttagccaaaga

SEQ ID NO: 368966 - DNA, 20 bp, Artificial
  CRISPR gRNA sequence
agtaggagttagccaaagaa

SEQ ID NO: 368967 - DNA, 20 bp, Artificial
  CRISPR gRNA sequence
gtaggagttagccaaagaaa

SEQ ID NO: 368968 - DNA, 20 bp, Artificial
  CRISPR gRNA sequence
ggagttagccaaagaaaggg

SEQ ID NO: 368969 - DNA, 20 bp, Artificial
  CRISPR gRNA sequence
gagttagccaaagaaagggc

SEQ ID NO: 368970 - DNA, 20 bp, Artificial
  CRISPR gRNA sequence
agttagccaaagaaagggca

SEQ ID NO: 368971 - DNA, 20 bp, Artificial
  CRISPR gRNA sequence
gaaagggcagggtgtccttg

SEQ ID NO: 368972 - DNA, 20 bp, Artificial
  CRISPR gRNA sequence
agggcagggtgtccttgcag

SEQ ID NO: 368973 - DNA, 20 bp, Artificial
  CRISPR gRNA sequence
gggcagggtgtccttgcagt

SEQ ID NO: 368974 - DNA, 20 bp, Artificial
  CRISPR gRNA sequence
gggtgtccttgcagtaggaa

SEQ ID NO: 368975 - DNA, 20 bp, Artificial
  CRISPR gRNA sequence
gtccttgcagtaggaatagc

SEQ ID NO: 368976 - DNA, 20 bp, Artificial
  CRISPR gRNA sequence
cagtaggaatagcaagtgca

SEQ ID NO: 368977 - DNA, 20 bp, Artificial
  CRISPR gRNA sequence
agtaggaatagcaagtgcaa

SEQ ID NO: 368978 - DNA, 20 bp, Artificial
  CRISPR gRNA sequence
atagcaagtgcaaaggtccc

SEQ ID NO: 368979 - DNA, 20 bp, Artificial
  CRISPR gRNA sequence
gcaagtgcaaaggtcccgag

SEQ ID NO: 368980 - DNA, 20 bp, Artificial
  CRISPR gRNA sequence
aggtcccgagaagaaataca

SEQ ID NO: 368981 - DNA, 20 bp, Artificial
  CRISPR gRNA sequence
tcccgagaagaaatacaaag

SEQ ID NO: 368982 - DNA, 20 bp, Artificial
  CRISPR gRNA sequence
cccgagaagaaatacaaagc

SEQ ID NO: 368983 - DNA, 20 bp, Artificial
  CRISPR gRNA sequence
cgagaagaaatacaaagcgg

SEQ ID NO: 368984 - DNA, 20 bp, Artificial
  CRISPR gRNA sequence
aaatacaaagcgggagatgt

SEQ ID NO: 368985 - DNA, 20 bp, Artificial
  CRISPR gRNA sequence
atacaaagcgggagatgtaa

SEQ ID NO: 368986 - DNA, 20 bp, Artificial
  CRISPR gRNA sequence
tacaaagcgggagatgtaag

SEQ ID NO: 368987 - DNA, 20 bp, Artificial
  CRISPR gRNA sequence
aagcgggagatgtaagagga

SEQ ID NO: 368988 - DNA, 20 bp, Artificial
  CRISPR gRNA sequence
ggagatgtaagaggatggaa

SEQ ID NO: 368989 - DNA, 20 bp, Artificial
  CRISPR gRNA sequence
gatgtaagaggatggaaaag

SEQ ID NO: 368990 - DNA, 20 bp, Artificial
  CRISPR gRNA sequence
catcctgaaacataatgtat

SEQ ID NO: 368991 - DNA, 20 bp, Artificial
  CRISPR gRNA sequence
atcctgaaacataatgtatg

SEQ ID NO: 368992 - DNA, 20 bp, Artificial
  CRISPR gRNA sequence
ctgaaacataatgtatgagg

SEQ ID NO: 368993 - DNA, 20 bp, Artificial
  CRISPR gRNA sequence
tgaaacataatgtatgaggt

SEQ ID NO: 368994 - DNA, 20 bp, Artificial
  CRISPR gRNA sequence
cataatgtatgaggtgggaa

SEQ ID NO: 368995 - DNA, 20 bp, Artificial
  CRISPR gRNA sequence
ataatgtatgaggtgggaat

SEQ ID NO: 368996 - DNA, 20 bp, Artificial
  CRISPR gRNA sequence
tgtatgaggtgggaatggga

SEQ ID NO: 368997 - DNA, 20 bp, Artificial
  CRISPR gRNA sequence
ggtgggaatgggatagatac

SEQ ID NO: 368998 - DNA, 20 bp, Artificial
  CRISPR gRNA sequence
gggaatgggatagatacaag

SEQ ID NO: 368999 - DNA, 20 bp, Artificial
  CRISPR gRNA sequence
gaatgggatagatacaagca

SEQ ID NO: 369000 - DNA, 20 bp, Artificial
  CRISPR gRNA sequence
atgggatagatacaagcaga

SEQ ID NO: 369001 - DNA, 20 bp, Artificial
  CRISPR gRNA sequence
tgggatagatacaagcagag

SEQ ID NO: 369002 - DNA, 20 bp, Artificial
  CRISPR gRNA sequence
gatagatacaagcagagagg

SEQ ID NO: 369003 - DNA, 20 bp, Artificial
  CRISPR gRNA sequence
atagatacaagcagagaggt

SEQ ID NO: 369004 - DNA, 20 bp, Artificial
  CRISPR gRNA sequence
tacaagcagagaggtaggca

SEQ ID NO: 369005 - DNA, 20 bp, Artificial
  CRISPR gRNA sequence
gtaggcaaagacctgatgct

SEQ ID NO: 369006 - DNA, 20 bp, Artificial
  CRISPR gRNA sequence
ggcaaagacctgatgctgag

SEQ ID NO: 369007 - DNA, 20 bp, Artificial
  CRISPR gRNA sequence
tttgttgttattgttgtttt

SEQ ID NO: 369008 - DNA, 20 bp, Artificial
  CRISPR gRNA sequence
ttgttattgttgttttgaga

SEQ ID NO: 369009 - DNA, 20 bp, Artificial
  CRISPR gRNA sequence
gttattgttgttttgagatg

SEQ ID NO: 369010 - DNA, 20 bp, Artificial
  CRISPR gRNA sequence
tggagtctcactctgtcgcc

SEQ ID NO: 369011 - DNA, 20 bp, Artificial
  CRISPR gRNA sequence
tctcactctgtcgcccagtc

SEQ ID NO: 369012 - DNA, 20 bp, Artificial
  CRISPR gRNA sequence
tcactctgtcgcccagtctg

SEQ ID NO: 369013 - DNA, 20 bp, Artificial
  CRISPR gRNA sequence
ctgtcgcccagtctggagtg

SEQ ID NO: 369014 - DNA, 20 bp, Artificial
  CRISPR gRNA sequence
tcgcccagtctggagtgcag

SEQ ID NO: 369015 - DNA, 20 bp, Artificial
  CRISPR gRNA sequence
ggagtgcagtggcgcaatct

SEQ ID NO: 369016 - DNA, 20 bp, Artificial
  CRISPR gRNA sequence
acactgcgacctccacatcc

SEQ ID NO: 369017 - DNA, 20 bp, Artificial
  CRISPR gRNA sequence
cactgcgacctccacatcct

SEQ ID NO: 369018 - DNA, 20 bp, Artificial
  CRISPR gRNA sequence
gacctccacatcctgggttc

SEQ ID NO: 369019 - DNA, 20 bp, Artificial
  CRISPR gRNA sequence
ttccagtgattctccttcct

SEQ ID NO: 369020 - DNA, 20 bp, Artificial
  CRISPR gRNA sequence
ttctccttcctcagcctccc

SEQ ID NO: 369021 - DNA, 20 bp, Artificial
  CRISPR gRNA sequence
tccttcctcagcctcccgag

SEQ ID NO: 369022 - DNA, 20 bp, Artificial
  CRISPR gRNA sequence
cctcagcctcccgagtagct

SEQ ID NO: 369023 - DNA, 20 bp, Artificial
  CRISPR gRNA sequence
ctcccgagtagcttggattg

SEQ ID NO: 369024 - DNA, 20 bp, Artificial
  CRISPR gRNA sequence
ctgactactttttgtatatt

SEQ ID NO: 369025 - DNA, 20 bp, Artificial
  CRISPR gRNA sequence
actactttttgtatatttgg

SEQ ID NO: 369026 - DNA, 20 bp, Artificial
  CRISPR gRNA sequence
tactttttgtatatttggta

SEQ ID NO: 369027 - DNA, 20 bp, Artificial
  CRISPR gRNA sequence
ttttgtatatttggtagaga

SEQ ID NO: 369028 - DNA, 20 bp, Artificial
  CRISPR gRNA sequence
tttgtatatttggtagagat

SEQ ID NO: 369029 - DNA, 20 bp, Artificial
  CRISPR gRNA sequence
ttgtatatttggtagagatg

SEQ ID NO: 369030 - DNA, 20 bp, Artificial
  CRISPR gRNA sequence
gagatggggtatcaccatat

SEQ ID NO: 369031 - DNA, 20 bp, Artificial
  CRISPR gRNA sequence
tggggtatcaccatattggc

SEQ ID NO: 369032 - DNA, 20 bp, Artificial
  CRISPR gRNA sequence
ggggtatcaccatattggcc

SEQ ID NO: 369033 - DNA, 20 bp, Artificial
  CRISPR gRNA sequence
tatcaccatattggccaggc

SEQ ID NO: 369034 - DNA, 20 bp, Artificial
  CRISPR gRNA sequence
ccaggctggtctcgaactcc

SEQ ID NO: 369035 - DNA, 20 bp, Artificial
  CRISPR gRNA sequence
tggtctcgaactcctggcct

SEQ ID NO: 369036 - DNA, 20 bp, Artificial
  CRISPR gRNA sequence
ggtctcgaactcctggcctc

SEQ ID NO: 369037 - DNA, 20 bp, Artificial
  CRISPR gRNA sequence
ctcgaactcctggcctcagg

SEQ ID NO: 369038 - DNA, 20 bp, Artificial
  CRISPR gRNA sequence
ctcaggtggtctgcccgcct

SEQ ID NO: 369039 - DNA, 20 bp, Artificial
  CRISPR gRNA sequence
ctgcccgcctcggcctccca

SEQ ID NO: 369040 - DNA, 20 bp, Artificial
  CRISPR gRNA sequence
gcctcggcctcccaaagtgc

SEQ ID NO: 369041 - DNA, 20 bp, Artificial
  CRISPR gRNA sequence
cctcggcctcccaaagtgct

SEQ ID NO: 369042 - DNA, 20 bp, Artificial
  CRISPR gRNA sequence
ctcccaaagtgctgggatta

SEQ ID NO: 369043 - DNA, 20 bp, Artificial
  CRISPR gRNA sequence
tcccaaagtgctgggattac

SEQ ID NO: 369044 - DNA, 20 bp, Artificial
  CRISPR gRNA sequence
caaagtgctgggattacagg

SEQ ID NO: 369045 - DNA, 20 bp, Artificial
  CRISPR gRNA sequence
aaagtgctgggattacaggc

SEQ ID NO: 369046 - DNA, 20 bp, Artificial
  CRISPR gRNA sequence
caggcaggatccactgtttc

SEQ ID NO: 369047 - DNA, 20 bp, Artificial
  CRISPR gRNA sequence
tccactgtttccagcctgct

SEQ ID NO: 369048 - DNA, 20 bp, Artificial
  CRISPR gRNA sequence
ctaagtgattctatgtgctg

SEQ ID NO: 369049 - DNA, 20 bp, Artificial
  CRISPR gRNA sequence
gtgattctatgtgctgtggt

SEQ ID NO: 369050 - DNA, 20 bp, Artificial
  CRISPR gRNA sequence
attctatgtgctgtggtgag

SEQ ID NO: 369051 - DNA, 20 bp, Artificial
  CRISPR gRNA sequence
gagaagtgcatactcaccat

SEQ ID NO: 369052 - DNA, 20 bp, Artificial
  CRISPR gRNA sequence
agaagtgcatactcaccata

SEQ ID NO: 369053 - DNA, 20 bp, Artificial
  CRISPR gRNA sequence
gaagtgcatactcaccataa

SEQ ID NO: 369054 - DNA, 20 bp, Artificial
  CRISPR gRNA sequence
aagtgcatactcaccataag

SEQ ID NO: 369055 - DNA, 20 bp, Artificial
  CRISPR gRNA sequence
atactcaccataaggggact

SEQ ID NO: 369056 - DNA, 20 bp, Artificial
  CRISPR gRNA sequence
actcaccataaggggactga

SEQ ID NO: 369057 - DNA, 20 bp, Artificial
  CRISPR gRNA sequence
aggggactgagagtttattg

SEQ ID NO: 369058 - DNA, 20 bp, Artificial
  CRISPR gRNA sequence
ggggactgagagtttattga

SEQ ID NO: 369059 - DNA, 20 bp, Artificial
  CRISPR gRNA sequence
gggactgagagtttattgaa

SEQ ID NO: 369060 - DNA, 20 bp, Artificial
  CRISPR gRNA sequence
ttgaagggttttaatgtctt

SEQ ID NO: 369061 - DNA, 20 bp, Artificial
  CRISPR gRNA sequence
gaagggttttaatgtcttga

SEQ ID NO: 369062 - DNA, 20 bp, Artificial
  CRISPR gRNA sequence
agggttttaatgtcttgaga

SEQ ID NO: 369063 - DNA, 20 bp, Artificial
  CRISPR gRNA sequence
ggttttaatgtcttgagaga

SEQ ID NO: 369064 - DNA, 20 bp, Artificial
  CRISPR gRNA sequence
taatgtcttgagagagagat

SEQ ID NO: 369065 - DNA, 20 bp, Artificial
  CRISPR gRNA sequence
tgagagagagatcagattga

SEQ ID NO: 369066 - DNA, 20 bp, Artificial
  CRISPR gRNA sequence
agatcagattgatggtatcg

SEQ ID NO: 369067 - DNA, 20 bp, Artificial
  CRISPR gRNA sequence
atcgtggactgtcgttcata

SEQ ID NO: 369068 - DNA, 20 bp, Artificial
  CRISPR gRNA sequence
tcgtggactgtcgttcatat

SEQ ID NO: 369069 - DNA, 20 bp, Artificial
  CRISPR gRNA sequence
gtggactgtcgttcatatgg

SEQ ID NO: 369070 - DNA, 20 bp, Artificial
  CRISPR gRNA sequence
actgtcgttcatatgggagc

SEQ ID NO: 369071 - DNA, 20 bp, Artificial
  CRISPR gRNA sequence
cgttcatatgggagcgagac

SEQ ID NO: 369072 - DNA, 20 bp, Artificial
  CRISPR gRNA sequence
ttcatatgggagcgagactg

SEQ ID NO: 369073 - DNA, 20 bp, Artificial
  CRISPR gRNA sequence
atgggagcgagactggagtg

SEQ ID NO: 369074 - DNA, 20 bp, Artificial
  CRISPR gRNA sequence
tgggagcgagactggagtga

SEQ ID NO: 369075 - DNA, 20 bp, Artificial
  CRISPR gRNA sequence
ggagcgagactggagtgaag

SEQ ID NO: 369076 - DNA, 20 bp, Artificial
  CRISPR gRNA sequence
gagcgagactggagtgaagg

SEQ ID NO: 369077 - DNA, 20 bp, Artificial
  CRISPR gRNA sequence
gagactggagtgaaggaggc

SEQ ID NO: 369078 - DNA, 20 bp, Artificial
  CRISPR gRNA sequence
agactggagtgaaggaggct

SEQ ID NO: 369079 - DNA, 20 bp, Artificial
  CRISPR gRNA sequence
ctggagtgaaggaggctggg

SEQ ID NO: 369080 - DNA, 20 bp, Artificial
  CRISPR gRNA sequence
gagtgaaggaggctgggcag

SEQ ID NO: 369081 - DNA, 20 bp, Artificial
  CRISPR gRNA sequence
ggctgggcagaagtctattt

SEQ ID NO: 369082 - DNA, 20 bp, Artificial
  CRISPR gRNA sequence
agaagtctattttagtaata

SEQ ID NO: 369083 - DNA, 20 bp, Artificial
  CRISPR gRNA sequence
agtctattttagtaatatag

SEQ ID NO: 369084 - DNA, 20 bp, Artificial
  CRISPR gRNA sequence
gtctattttagtaatatagt

SEQ ID NO: 369085 - DNA, 20 bp, Artificial
  CRISPR gRNA sequence
tctattttagtaatatagta

SEQ ID NO: 369086 - DNA, 20 bp, Artificial
  CRISPR gRNA sequence
ttttagtaatatagtaggga

SEQ ID NO: 369087 - DNA, 20 bp, Artificial
  CRISPR gRNA sequence
ttagtaatatagtagggatg

SEQ ID NO: 369088 - DNA, 20 bp, Artificial
  CRISPR gRNA sequence
gtaatatagtagggatggag

SEQ ID NO: 369089 - DNA, 20 bp, Artificial
  CRISPR gRNA sequence
atagtagggatggagcagaa

SEQ ID NO: 369090 - DNA, 20 bp, Artificial
  CRISPR gRNA sequence
tagtagggatggagcagaat

SEQ ID NO: 369091 - DNA, 20 bp, Artificial
  CRISPR gRNA sequence
agtagggatggagcagaata

SEQ ID NO: 369092 - DNA, 20 bp, Artificial
  CRISPR gRNA sequence
gcagaatagggcaatttgta

SEQ ID NO: 369093 - DNA, 20 bp, Artificial
  CRISPR gRNA sequence
agaatagggcaatttgtata

SEQ ID NO: 369094 - DNA, 20 bp, Artificial
  CRISPR gRNA sequence
aatagggcaatttgtataga

SEQ ID NO: 369095 - DNA, 20 bp, Artificial
  CRISPR gRNA sequence
ggcaatttgtatagagagtg

SEQ ID NO: 369096 - DNA, 20 bp, Artificial
  CRISPR gRNA sequence
gcaatttgtatagagagtgt

SEQ ID NO: 369097 - DNA, 20 bp, Artificial
  CRISPR gRNA sequence
caatttgtatagagagtgta

SEQ ID NO: 369098 - DNA, 20 bp, Artificial
  CRISPR gRNA sequence
agagtgtagggtccatgttt

SEQ ID NO: 369099 - DNA, 20 bp, Artificial
  CRISPR gRNA sequence
agtgtagggtccatgtttga

SEQ ID NO: 369100 - DNA, 20 bp, Artificial
  CRISPR gRNA sequence
catgtttgagagatgtttaa

SEQ ID NO: 369101 - DNA, 20 bp, Artificial
  CRISPR gRNA sequence
atgtttgagagatgtttaaa

SEQ ID NO: 369102 - DNA, 20 bp, Artificial
  CRISPR gRNA sequence
tttgagagatgtttaaaagg

SEQ ID NO: 369103 - DNA, 20 bp, Artificial
  CRISPR gRNA sequence
tgagagatgtttaaaaggta

SEQ ID NO: 369104 - DNA, 20 bp, Artificial
  CRISPR gRNA sequence
tgtttaaaaggtagagttga

SEQ ID NO: 369105 - DNA, 20 bp, Artificial
  CRISPR gRNA sequence
gtttaaaaggtagagttgac

SEQ ID NO: 369106 - DNA, 20 bp, Artificial
  CRISPR gRNA sequence
aaggtagagttgacgggatc

SEQ ID NO: 369107 - DNA, 20 bp, Artificial
  CRISPR gRNA sequence
gacgggatccagcaactgat

SEQ ID NO: 369108 - DNA, 20 bp, Artificial
  CRISPR gRNA sequence
gatccagcaactgattggat

SEQ ID NO: 369109 - DNA, 20 bp, Artificial
  CRISPR gRNA sequence
cagcaactgattggatgagt

SEQ ID NO: 369110 - DNA, 20 bp, Artificial
  CRISPR gRNA sequence
aactgattggatgagtgaga

SEQ ID NO: 369111 - DNA, 20 bp, Artificial
  CRISPR gRNA sequence
actgattggatgagtgagaa

SEQ ID NO: 369112 - DNA, 20 bp, Artificial
  CRISPR gRNA sequence
ctgattggatgagtgagaaa

SEQ ID NO: 369113 - DNA, 20 bp, Artificial
  CRISPR gRNA sequence
attggatgagtgagaaaggg

SEQ ID NO: 369114 - DNA, 20 bp, Artificial
  CRISPR gRNA sequence
tggatgagtgagaaagggaa

SEQ ID NO: 369115 - DNA, 20 bp, Artificial
  CRISPR gRNA sequence
ggatgagtgagaaagggaag

SEQ ID NO: 369116 - DNA, 20 bp, Artificial
  CRISPR gRNA sequence
tgagaaagggaagaggtgtt

SEQ ID NO: 369117 - DNA, 20 bp, Artificial
  CRISPR gRNA sequence
gaaagggaagaggtgttaag

SEQ ID NO: 369118 - DNA, 20 bp, Artificial
  CRISPR gRNA sequence
aaagggaagaggtgttaaga

SEQ ID NO: 369119 - DNA, 20 bp, Artificial
  CRISPR gRNA sequence
gaggtgttaagaaggatacc

SEQ ID NO: 369120 - DNA, 20 bp, Artificial
  CRISPR gRNA sequence
aaggatacccagtttctgaa

SEQ ID NO: 369121 - DNA, 20 bp, Artificial
  CRISPR gRNA sequence
gatacccagtttctgaacag

SEQ ID NO: 369122 - DNA, 20 bp, Artificial
  CRISPR gRNA sequence
atacccagtttctgaacagt

SEQ ID NO: 369123 - DNA, 20 bp, Artificial
  CRISPR gRNA sequence
tacccagtttctgaacagtg

SEQ ID NO: 369124 - DNA, 20 bp, Artificial
  CRISPR gRNA sequence
cccagtttctgaacagtggg

SEQ ID NO: 369125 - DNA, 20 bp, Artificial
  CRISPR gRNA sequence
cagtttctgaacagtgggga

SEQ ID NO: 369126 - DNA, 20 bp, Artificial
  CRISPR gRNA sequence
tgaacagtggggagagtaaa

SEQ ID NO: 369127 - DNA, 20 bp, Artificial
  CRISPR gRNA sequence
gaacagtggggagagtaaaa

SEQ ID NO: 369128 - DNA, 20 bp, Artificial
  CRISPR gRNA sequence
acagtggggagagtaaaaag

SEQ ID NO: 369129 - DNA, 20 bp, Artificial
  CRISPR gRNA sequence
tggggagagtaaaaaggagc

SEQ ID NO: 369130 - DNA, 20 bp, Artificial
  CRISPR gRNA sequence
agagtaaaaaggagccagtt

SEQ ID NO: 369131 - DNA, 20 bp, Artificial
  CRISPR gRNA sequence
agtaaaaaggagccagtttg

SEQ ID NO: 369132 - DNA, 20 bp, Artificial
  CRISPR gRNA sequence
taaaaaggagccagtttgga

SEQ ID NO: 369133 - DNA, 20 bp, Artificial
  CRISPR gRNA sequence
aaaaaggagccagtttggag

SEQ ID NO: 369134 - DNA, 20 bp, Artificial
  CRISPR gRNA sequence
aaaaggagccagtttggaga

SEQ ID NO: 369135 - DNA, 20 bp, Artificial
  CRISPR gRNA sequence
aaaggagccagtttggagag

SEQ ID NO: 369136 - DNA, 20 bp, Artificial
  CRISPR gRNA sequence
ccagtttggagaggggaata

SEQ ID NO: 369137 - DNA, 20 bp, Artificial
  CRISPR gRNA sequence
tggagaggggaatatggttt

SEQ ID NO: 369138 - DNA, 20 bp, Artificial
  CRISPR gRNA sequence
ggttttggaatatctgtgaa

SEQ ID NO: 369139 - DNA, 20 bp, Artificial
  CRISPR gRNA sequence
ttggaatatctgtgaataga

SEQ ID NO: 369140 - DNA, 20 bp, Artificial
  CRISPR gRNA sequence
gaatatctgtgaatagaaag

SEQ ID NO: 369141 - DNA, 20 bp, Artificial
  CRISPR gRNA sequence
aatagaaagtggaaaaaaaa

SEQ ID NO: 369142 - DNA, 20 bp, Artificial
  CRISPR gRNA sequence
tagaaagtggaaaaaaaaaa

SEQ ID NO: 369143 - DNA, 20 bp, Artificial
  CRISPR gRNA sequence
aagagcttgaaaatctaaac

SEQ ID NO: 369144 - DNA, 20 bp, Artificial
  CRISPR gRNA sequence
tgacatgtgatttatctacc

SEQ ID NO: 369145 - DNA, 20 bp, Artificial
  CRISPR gRNA sequence
gacatgtgatttatctaccc

SEQ ID NO: 369146 - DNA, 20 bp, Artificial
  CRISPR gRNA sequence
tttatctacccaggaaattc

SEQ ID NO: 369147 - DNA, 20 bp, Artificial
  CRISPR gRNA sequence
atctacccaggaaattctag

SEQ ID NO: 369148 - DNA, 20 bp, Artificial
  CRISPR gRNA sequence
tctacccaggaaattctagc

SEQ ID NO: 369149 - DNA, 20 bp, Artificial
  CRISPR gRNA sequence
atttgcattctttttctttg

SEQ ID NO: 369150 - DNA, 20 bp, Artificial
  CRISPR gRNA sequence
ttgcattctttttctttgca

SEQ ID NO: 369151 - DNA, 20 bp, Artificial
  CRISPR gRNA sequence
tcattctgcatttctgatcc

SEQ ID NO: 369152 - DNA, 20 bp, Artificial
  CRISPR gRNA sequence
ttctgatcctagtttgtatt

SEQ ID NO: 369153 - DNA, 20 bp, Artificial
  CRISPR gRNA sequence
tttgtatttggttatgcacg

SEQ ID NO: 369154 - DNA, 20 bp, Artificial
  CRISPR gRNA sequence
tatgcacgaagtacttgtcc

SEQ ID NO: 369155 - DNA, 20 bp, Artificial
  CRISPR gRNA sequence
cttgtcccagcacattctct

SEQ ID NO: 369156 - DNA, 20 bp, Artificial
  CRISPR gRNA sequence
agcacattctctcagttttt

SEQ ID NO: 369157 - DNA, 20 bp, Artificial
  CRISPR gRNA sequence
ttctctcagttttttagaca

SEQ ID NO: 369158 - DNA, 20 bp, Artificial
  CRISPR gRNA sequence
tctcagttttttagacatag

SEQ ID NO: 369159 - DNA, 20 bp, Artificial
  CRISPR gRNA sequence
agttttttagacatagcagt

SEQ ID NO: 369160 - DNA, 20 bp, Artificial
  CRISPR gRNA sequence
gacatagcagtgagactctc

SEQ ID NO: 369161 - DNA, 20 bp, Artificial
  CRISPR gRNA sequence
ctttaatttcatgacctacc

SEQ ID NO: 369162 - DNA, 20 bp, Artificial
  CRISPR gRNA sequence
ttaatttcatgacctaccta

SEQ ID NO: 369163 - DNA, 20 bp, Artificial
  CRISPR gRNA sequence
cctacctagagttccccttt

SEQ ID NO: 369164 - DNA, 20 bp, Artificial
  CRISPR gRNA sequence
cctagagttccccttttgga

SEQ ID NO: 369165 - DNA, 20 bp, Artificial
  CRISPR gRNA sequence
ttgaaaacacactcattctg

SEQ ID NO: 369166 - DNA, 20 bp, Artificial
  CRISPR gRNA sequence
aacacactcattctgaagca

SEQ ID NO: 369167 - DNA, 20 bp, Artificial
  CRISPR gRNA sequence
acactcattctgaagcatgg

SEQ ID NO: 369168 - DNA, 20 bp, Artificial
  CRISPR gRNA sequence
tggtggccatttgcaaatat

SEQ ID NO: 369169 - DNA, 20 bp, Artificial
  CRISPR gRNA sequence
tggccatttgcaaatatcgg

SEQ ID NO: 369170 - DNA, 20 bp, Artificial
  CRISPR gRNA sequence
cggaagtgcattttgtccaa

SEQ ID NO: 369171 - DNA, 20 bp, Artificial
  CRISPR gRNA sequence
ggaagtgcattttgtccaac

SEQ ID NO: 369172 - DNA, 20 bp, Artificial
  CRISPR gRNA sequence
ttgtccaacaggttgtcttg

SEQ ID NO: 369173 - DNA, 20 bp, Artificial
  CRISPR gRNA sequence
gttgtcttgtagcacctgca

SEQ ID NO: 369174 - DNA, 20 bp, Artificial
  CRISPR gRNA sequence
tcttgtagcacctgcaaagc

SEQ ID NO: 369175 - DNA, 20 bp, Artificial
  CRISPR gRNA sequence
tagcacctgcaaagcaagct

SEQ ID NO: 369176 - DNA, 20 bp, Artificial
  CRISPR gRNA sequence
cacctgcaaagcaagctgag

SEQ ID NO: 369177 - DNA, 20 bp, Artificial
  CRISPR gRNA sequence
cctgcaaagcaagctgagtg

SEQ ID NO: 369178 - DNA, 20 bp, Artificial
  CRISPR gRNA sequence
ctgcaaagcaagctgagtgg

SEQ ID NO: 369179 - DNA, 20 bp, Artificial
  CRISPR gRNA sequence
gagtggaggatttttgttcc

SEQ ID NO: 369180 - DNA, 20 bp, Artificial
  CRISPR gRNA sequence
ggaggatttttgttcccggt

SEQ ID NO: 369181 - DNA, 20 bp, Artificial
  CRISPR gRNA sequence
cccggtgagaacgttttgtt

SEQ ID NO: 369182 - DNA, 20 bp, Artificial
  CRISPR gRNA sequence
gaacgttttgttcagttcat

SEQ ID NO: 369183 - DNA, 20 bp, Artificial
  CRISPR gRNA sequence
gttttgttcagttcatgagt

SEQ ID NO: 369184 - DNA, 20 bp, Artificial
  CRISPR gRNA sequence
ttttgttcagttcatgagtt

SEQ ID NO: 369185 - DNA, 20 bp, Artificial
  CRISPR gRNA sequence
tcagttcatgagttaggtca

SEQ ID NO: 369186 - DNA, 20 bp, Artificial
  CRISPR gRNA sequence
cagttcatgagttaggtcaa

SEQ ID NO: 369187 - DNA, 20 bp, Artificial
  CRISPR gRNA sequence
gtcaaaggcttatttattta

SEQ ID NO: 369188 - DNA, 20 bp, Artificial
  CRISPR gRNA sequence
atgttgcttatctgttctaa

SEQ ID NO: 369189 - DNA, 20 bp, Artificial
  CRISPR gRNA sequence
atctgttctaatggaaaatt

SEQ ID NO: 369190 - DNA, 20 bp, Artificial
  CRISPR gRNA sequence
tctgttctaatggaaaattc

SEQ ID NO: 369191 - DNA, 20 bp, Artificial
  CRISPR gRNA sequence
ctctaatcactttttccaaa

SEQ ID NO: 369192 - DNA, 20 bp, Artificial
  CRISPR gRNA sequence
aaagatgaaacgaatccctt

SEQ ID NO: 369193 - DNA, 20 bp, Artificial
  CRISPR gRNA sequence
tgttgttttcaaatgccatg

SEQ ID NO: 369194 - DNA, 20 bp, Artificial
  CRISPR gRNA sequence
tgatgtgctgaaaaacttct

SEQ ID NO: 369195 - DNA, 20 bp, Artificial
  CRISPR gRNA sequence
aaacttctcagcatttactt

SEQ ID NO: 369196 - DNA, 20 bp, Artificial
  CRISPR gRNA sequence
acttctcagcatttactttg

SEQ ID NO: 369197 - DNA, 20 bp, Artificial
  CRISPR gRNA sequence
tttactttggagtgctatgt

SEQ ID NO: 369198 - DNA, 20 bp, Artificial
  CRISPR gRNA sequence
ctttggagtgctatgtgaga

SEQ ID NO: 369199 - DNA, 20 bp, Artificial
  CRISPR gRNA sequence
gatagttttcaaacactctt

SEQ ID NO: 369200 - DNA, 20 bp, Artificial
  CRISPR gRNA sequence
atagttttcaaacactcttt

SEQ ID NO: 369201 - DNA, 20 bp, Artificial
  CRISPR gRNA sequence
tcactgcttatttgtacctc

SEQ ID NO: 369202 - DNA, 20 bp, Artificial
  CRISPR gRNA sequence
cactgcttatttgtacctct

SEQ ID NO: 369203 - DNA, 20 bp, Artificial
  CRISPR gRNA sequence
atttgtacctctgggctttg

SEQ ID NO: 369204 - DNA, 20 bp, Artificial
  CRISPR gRNA sequence
ctgggctttgcagttctccc

SEQ ID NO: 369205 - DNA, 20 bp, Artificial
  CRISPR gRNA sequence
cttttttttttttttttttt

SEQ ID NO: 369206 - DNA, 20 bp, Artificial
  CRISPR gRNA sequence
ctgttgccctttgactttgt

SEQ ID NO: 369207 - DNA, 20 bp, Artificial
  CRISPR gRNA sequence
gccctttgactttgtcagtt

SEQ ID NO: 369208 - DNA, 20 bp, Artificial
  CRISPR gRNA sequence
gactttgtcagttcagccat

SEQ ID NO: 369209 - DNA, 20 bp, Artificial
  CRISPR gRNA sequence
actttgtcagttcagccata

SEQ ID NO: 369210 - DNA, 20 bp, Artificial
  CRISPR gRNA sequence
ctttgtcagttcagccataa

SEQ ID NO: 369211 - DNA, 20 bp, Artificial
  CRISPR gRNA sequence
tttgtcagttcagccataag

SEQ ID NO: 369212 - DNA, 20 bp, Artificial
  CRISPR gRNA sequence
gccataaggggttttatttg

SEQ ID NO: 369213 - DNA, 20 bp, Artificial
  CRISPR gRNA sequence
ggggttttatttgaagcact

SEQ ID NO: 369214 - DNA, 20 bp, Artificial
  CRISPR gRNA sequence
atttgaagcacttggccctt

SEQ ID NO: 369215 - DNA, 20 bp, Artificial
  CRISPR gRNA sequence
acttggccctttagatctgt

SEQ ID NO: 369216 - DNA, 20 bp, Artificial
  CRISPR gRNA sequence
ctgttggcatatattttccc

SEQ ID NO: 369217 - DNA, 20 bp, Artificial
  CRISPR gRNA sequence
ggactttcaaaaacatgttt

SEQ ID NO: 369218 - DNA, 20 bp, Artificial
  CRISPR gRNA sequence
tttggtttttttttttttgt

SEQ ID NO: 369219 - DNA, 20 bp, Artificial
  CRISPR gRNA sequence
tttttttttttttgtaagtc

SEQ ID NO: 369220 - DNA, 20 bp, Artificial
  CRISPR gRNA sequence
ttttttttttttgtaagtct

SEQ ID NO: 369221 - DNA, 20 bp, Artificial
  CRISPR gRNA sequence
tttttttttttgtaagtcta

SEQ ID NO: 369222 - DNA, 20 bp, Artificial
  CRISPR gRNA sequence
ttttttttttgtaagtctag

SEQ ID NO: 369223 - DNA, 20 bp, Artificial
  CRISPR gRNA sequence
tgtaagtctaggggtttctt

SEQ ID NO: 369224 - DNA, 20 bp, Artificial
  CRISPR gRNA sequence
gtaagtctaggggtttcttt

SEQ ID NO: 369225 - DNA, 20 bp, Artificial
  CRISPR gRNA sequence
tatacttttacttttttaac

SEQ ID NO: 369226 - DNA, 20 bp, Artificial
  CRISPR gRNA sequence
agaatatttgcattttattg

SEQ ID NO: 369227 - DNA, 20 bp, Artificial
  CRISPR gRNA sequence
aacttttgactttgcctttc

SEQ ID NO: 369228 - DNA, 20 bp, Artificial
  CRISPR gRNA sequence
tttgactttgcctttctagt

SEQ ID NO: 369229 - DNA, 20 bp, Artificial
  CRISPR gRNA sequence
cttttgtcatttgatcatga

SEQ ID NO: 369230 - DNA, 20 bp, Artificial
  CRISPR gRNA sequence
tgatcatgacagatgattca

SEQ ID NO: 369231 - DNA, 20 bp, Artificial
  CRISPR gRNA sequence
tatttttattcctataaatt

SEQ ID NO: 369232 - DNA, 20 bp, Artificial
  CRISPR gRNA sequence
atttttattcctataaattc

SEQ ID NO: 369233 - DNA, 20 bp, Artificial
  CRISPR gRNA sequence
ttttattcctataaattcag

SEQ ID NO: 369234 - DNA, 20 bp, Artificial
  CRISPR gRNA sequence
attcctataaattcaggagc

SEQ ID NO: 369235 - DNA, 20 bp, Artificial
  CRISPR gRNA sequence
attcaggagccagttatgtg

SEQ ID NO: 369236 - DNA, 20 bp, Artificial
  CRISPR gRNA sequence
agttatgtgtagtacaaatg

SEQ ID NO: 369237 - DNA, 20 bp, Artificial
  CRISPR gRNA sequence
gtacaaatgtagtgtgtctg

SEQ ID NO: 369238 - DNA, 20 bp, Artificial
  CRISPR gRNA sequence
tagtgtgtctgtagcttttt

SEQ ID NO: 369239 - DNA, 20 bp, Artificial
  CRISPR gRNA sequence
gtgtgtctgtagctttttca

SEQ ID NO: 369240 - DNA, 20 bp, Artificial
  CRISPR gRNA sequence
tgtgtctgtagctttttcag

SEQ ID NO: 369241 - DNA, 20 bp, Artificial
  CRISPR gRNA sequence
gtctgtagctttttcagagg

SEQ ID NO: 369242 - DNA, 20 bp, Artificial
  CRISPR gRNA sequence
ctttttcagaggtagaattc

SEQ ID NO: 369243 - DNA, 20 bp, Artificial
  CRISPR gRNA sequence
gtagaattcaagatacgatg

SEQ ID NO: 369244 - DNA, 20 bp, Artificial
  CRISPR gRNA sequence
tcaagatacgatgcagataa

SEQ ID NO: 369245 - DNA, 20 bp, Artificial
  CRISPR gRNA sequence
agatacgatgcagataatgg

SEQ ID NO: 369246 - DNA, 20 bp, Artificial
  CRISPR gRNA sequence
tacgatgcagataatggaag

SEQ ID NO: 369247 - DNA, 20 bp, Artificial
  CRISPR gRNA sequence
agataatggaagtagtccgt

SEQ ID NO: 369248 - DNA, 20 bp, Artificial
  CRISPR gRNA sequence
aatattttcttctatgacgt

SEQ ID NO: 369249 - DNA, 20 bp, Artificial
  CRISPR gRNA sequence
tttcttctatgacgttggct

SEQ ID NO: 369250 - DNA, 20 bp, Artificial
  CRISPR gRNA sequence
cttctatgacgttggctcgg

SEQ ID NO: 369251 - DNA, 20 bp, Artificial
  CRISPR gRNA sequence
gacgttggctcggtggtcta

SEQ ID NO: 369252 - DNA, 20 bp, Artificial
  CRISPR gRNA sequence
ggtggtctatggtataattc

SEQ ID NO: 369253 - DNA, 20 bp, Artificial
  CRISPR gRNA sequence
ggtctatggtataattcaag

SEQ ID NO: 369254 - DNA, 20 bp, Artificial
  CRISPR gRNA sequence
aagctcgtttctcccttgta

SEQ ID NO: 369255 - DNA, 20 bp, Artificial
  CRISPR gRNA sequence
tttctcccttgtaaagtgtt

SEQ ID NO: 369256 - DNA, 20 bp, Artificial
  CRISPR gRNA sequence
ttctcccttgtaaagtgttg

SEQ ID NO: 369257 - DNA, 20 bp, Artificial
  CRISPR gRNA sequence
taaagtgttgaggtttctgt

SEQ ID NO: 369258 - DNA, 20 bp, Artificial
  CRISPR gRNA sequence
agtgttgaggtttctgttgg

SEQ ID NO: 369259 - DNA, 20 bp, Artificial
  CRISPR gRNA sequence
ttctgttggcagttgctatt

SEQ ID NO: 369260 - DNA, 20 bp, Artificial
  CRISPR gRNA sequence
ggcagttgctatttagatat

SEQ ID NO: 369261 - DNA, 20 bp, Artificial
  CRISPR gRNA sequence
ctatttagatatgagttttg

SEQ ID NO: 369262 - DNA, 20 bp, Artificial
  CRISPR gRNA sequence
tttagatatgagttttgtgg

SEQ ID NO: 369263 - DNA, 20 bp, Artificial
  CRISPR gRNA sequence
ctgcatctgtttttattttg

SEQ ID NO: 369264 - DNA, 20 bp, Artificial
  CRISPR gRNA sequence
ctgtttttattttgaagtct

SEQ ID NO: 369265 - DNA, 20 bp, Artificial
  CRISPR gRNA sequence
tgtttttattttgaagtctg

SEQ ID NO: 369266 - DNA, 20 bp, Artificial
  CRISPR gRNA sequence
tgattttttttttttttttt

SEQ ID NO: 369267 - DNA, 20 bp, Artificial
  CRISPR gRNA sequence
ttttttttttttttttgaga

SEQ ID NO: 369268 - DNA, 20 bp, Artificial
  CRISPR gRNA sequence
ttttttttttttttgagacg

SEQ ID NO: 369269 - DNA, 20 bp, Artificial
  CRISPR gRNA sequence
cggagtctcgctctgtcgcc

SEQ ID NO: 369270 - DNA, 20 bp, Artificial
  CRISPR gRNA sequence
ggagtctcgctctgtcgccc

SEQ ID NO: 369271 - DNA, 20 bp, Artificial
  CRISPR gRNA sequence
tctcgctctgtcgcccaggc

SEQ ID NO: 369272 - DNA, 20 bp, Artificial
  CRISPR gRNA sequence
tcgctctgtcgcccaggctg

SEQ ID NO: 369273 - DNA, 20 bp, Artificial
  CRISPR gRNA sequence
ctgtcgcccaggctggagtg

SEQ ID NO: 369274 - DNA, 20 bp, Artificial
  CRISPR gRNA sequence
tcgcccaggctggagtgcag

SEQ ID NO: 369275 - DNA, 20 bp, Artificial
  CRISPR gRNA sequence
ggagtgcagtggcgcgatct

SEQ ID NO: 369276 - DNA, 20 bp, Artificial
  CRISPR gRNA sequence
gcgcgatctcggctcactgc

SEQ ID NO: 369277 - DNA, 20 bp, Artificial
  CRISPR gRNA sequence
tcactgcaagctccgcctcc

SEQ ID NO: 369278 - DNA, 20 bp, Artificial
  CRISPR gRNA sequence
cactgcaagctccgcctcct

SEQ ID NO: 369279 - DNA, 20 bp, Artificial
  CRISPR gRNA sequence
ttcatgccattctcctgcct

SEQ ID NO: 369280 - DNA, 20 bp, Artificial
  CRISPR gRNA sequence
ttctcctgcctcagcctccc

SEQ ID NO: 369281 - DNA, 20 bp, Artificial
  CRISPR gRNA sequence
tcctgcctcagcctcccaag

SEQ ID NO: 369282 - DNA, 20 bp, Artificial
  CRISPR gRNA sequence
gcctcagcctcccaagtagc

SEQ ID NO: 369283 - DNA, 20 bp, Artificial
  CRISPR gRNA sequence
cctcagcctcccaagtagct

SEQ ID NO: 369284 - DNA, 20 bp, Artificial
  CRISPR gRNA sequence
ctcccaagtagctgggacta

SEQ ID NO: 369285 - DNA, 20 bp, Artificial
  CRISPR gRNA sequence
tcccaagtagctgggactac

SEQ ID NO: 369286 - DNA, 20 bp, Artificial
  CRISPR gRNA sequence
caggcgcccgccactacgcc

SEQ ID NO: 369287 - DNA, 20 bp, Artificial
  CRISPR gRNA sequence
cggctaattttttgtatttt

SEQ ID NO: 369288 - DNA, 20 bp, Artificial
  CRISPR gRNA sequence
ctaattttttgtatttttag

SEQ ID NO: 369289 - DNA, 20 bp, Artificial
  CRISPR gRNA sequence
aattttttgtatttttagta

SEQ ID NO: 369290 - DNA, 20 bp, Artificial
  CRISPR gRNA sequence
ttttgtatttttagtagaga

SEQ ID NO: 369291 - DNA, 20 bp, Artificial
  CRISPR gRNA sequence
tttgtatttttagtagagac

SEQ ID NO: 369292 - DNA, 20 bp, Artificial
  CRISPR gRNA sequence
ttgtatttttagtagagacg

SEQ ID NO: 369293 - DNA, 20 bp, Artificial
  CRISPR gRNA sequence
agacggggtttcaccgtttt

SEQ ID NO: 369294 - DNA, 20 bp, Artificial
  CRISPR gRNA sequence
ggggtttcaccgtttttagc

SEQ ID NO: 369295 - DNA, 20 bp, Artificial
  CRISPR gRNA sequence
gggtttcaccgtttttagcc

SEQ ID NO: 369296 - DNA, 20 bp, Artificial
  CRISPR gRNA sequence
ttcaccgtttttagccggga

SEQ ID NO: 369297 - DNA, 20 bp, Artificial
  CRISPR gRNA sequence
acctcgtgatccgcccgcct

SEQ ID NO: 369298 - DNA, 20 bp, Artificial
  CRISPR gRNA sequence
ccgcccgcctcggcctccca

SEQ ID NO: 369299 - DNA, 20 bp, Artificial
  CRISPR gRNA sequence
gcctcggcctcccaaagtgc

SEQ ID NO: 369300 - DNA, 20 bp, Artificial
  CRISPR gRNA sequence
cctcggcctcccaaagtgct

SEQ ID NO: 369301 - DNA, 20 bp, Artificial
  CRISPR gRNA sequence
ctcccaaagtgctgggatta

SEQ ID NO: 369302 - DNA, 20 bp, Artificial
  CRISPR gRNA sequence
tcccaaagtgctgggattac

SEQ ID NO: 369303 - DNA, 20 bp, Artificial
  CRISPR gRNA sequence
agtgctgggattacaggcgt

SEQ ID NO: 369304 - DNA, 20 bp, Artificial
  CRISPR gRNA sequence
caggcgtgagccaccgcgcc

SEQ ID NO: 369305 - DNA, 20 bp, Artificial
  CRISPR gRNA sequence
aacctttttccatcctaaat

SEQ ID NO: 369306 - DNA, 20 bp, Artificial
  CRISPR gRNA sequence
tcagatgtgtcacttctatc

SEQ ID NO: 369307 - DNA, 20 bp, Artificial
  CRISPR gRNA sequence
cagatgtgtcacttctatcg

SEQ ID NO: 369308 - DNA, 20 bp, Artificial
  CRISPR gRNA sequence
cgaggttgtcactttcttgc

SEQ ID NO: 369309 - DNA, 20 bp, Artificial
  CRISPR gRNA sequence
attaatcctcttaatttttt

SEQ ID NO: 369310 - DNA, 20 bp, Artificial
  CRISPR gRNA sequence
ttaatcctcttaattttttt

SEQ ID NO: 369311 - DNA, 20 bp, Artificial
  CRISPR gRNA sequence
tcttaatttttttaggcctc

SEQ ID NO: 369312 - DNA, 20 bp, Artificial
  CRISPR gRNA sequence
cttaatttttttaggcctct

SEQ ID NO: 369313 - DNA, 20 bp, Artificial
  CRISPR gRNA sequence
ttttaggcctctgggatttc

SEQ ID NO: 369314 - DNA, 20 bp, Artificial
  CRISPR gRNA sequence
ttaggcctctgggatttctg

SEQ ID NO: 369315 - DNA, 20 bp, Artificial
  CRISPR gRNA sequence
ctctgggatttctggagata

SEQ ID NO: 369316 - DNA, 20 bp, Artificial
  CRISPR gRNA sequence
ataaagttatgaatttccat

SEQ ID NO: 369317 - DNA, 20 bp, Artificial
  CRISPR gRNA sequence
agttatgaatttccattggt

SEQ ID NO: 369318 - DNA, 20 bp, Artificial
  CRISPR gRNA sequence
aatttccattggtcagttct

SEQ ID NO: 369319 - DNA, 20 bp, Artificial
  CRISPR gRNA sequence
tccattggtcagttctcaga

SEQ ID NO: 369320 - DNA, 20 bp, Artificial
  CRISPR gRNA sequence
cattggtcagttctcagata

SEQ ID NO: 369321 - DNA, 20 bp, Artificial
  CRISPR gRNA sequence
tggtcagttctcagatagag

SEQ ID NO: 369322 - DNA, 20 bp, Artificial
  CRISPR gRNA sequence
ggtcagttctcagatagaga

SEQ ID NO: 369323 - DNA, 20 bp, Artificial
  CRISPR gRNA sequence
ttctcagatagagaaggtga

SEQ ID NO: 369324 - DNA, 20 bp, Artificial
  CRISPR gRNA sequence
ctcagatagagaaggtgata

SEQ ID NO: 369325 - DNA, 20 bp, Artificial
  CRISPR gRNA sequence
tcagatagagaaggtgatag

SEQ ID NO: 369326 - DNA, 20 bp, Artificial
  CRISPR gRNA sequence
gaaggtgatagaggcttcac

SEQ ID NO: 369327 - DNA, 20 bp, Artificial
  CRISPR gRNA sequence
aggtgatagaggcttcacta

SEQ ID NO: 369328 - DNA, 20 bp, Artificial
  CRISPR gRNA sequence
gaacaacaaatgtttttaaa

SEQ ID NO: 369329 - DNA, 20 bp, Artificial
  CRISPR gRNA sequence
aacaacaaatgtttttaaaa

SEQ ID NO: 369330 - DNA, 20 bp, Artificial
  CRISPR gRNA sequence
acaaatgtttttaaaaaggc

SEQ ID NO: 369331 - DNA, 20 bp, Artificial
  CRISPR gRNA sequence
aaatgtttttaaaaaggcca

SEQ ID NO: 369332 - DNA, 20 bp, Artificial
  CRISPR gRNA sequence
tttaaaaaggccagagctga

SEQ ID NO: 369333 - DNA, 20 bp, Artificial
  CRISPR gRNA sequence
ttaaaaaggccagagctgat

SEQ ID NO: 369334 - DNA, 20 bp, Artificial
  CRISPR gRNA sequence
taaaaaggccagagctgatg

SEQ ID NO: 369335 - DNA, 20 bp, Artificial
  CRISPR gRNA sequence
aaggccagagctgatggggt

SEQ ID NO: 369336 - DNA, 20 bp, Artificial
  CRISPR gRNA sequence
aggccagagctgatggggta

SEQ ID NO: 369337 - DNA, 20 bp, Artificial
  CRISPR gRNA sequence
ccagagctgatggggtaagg

SEQ ID NO: 369338 - DNA, 20 bp, Artificial
  CRISPR gRNA sequence
cagagctgatggggtaaggc

SEQ ID NO: 369339 - DNA, 20 bp, Artificial
  CRISPR gRNA sequence
agagctgatggggtaaggca

SEQ ID NO: 369340 - DNA, 20 bp, Artificial
  CRISPR gRNA sequence
tggggtaaggcagggataaa

SEQ ID NO: 369341 - DNA, 20 bp, Artificial
  CRISPR gRNA sequence
gggtaaggcagggataaaaa

SEQ ID NO: 369342 - DNA, 20 bp, Artificial
  CRISPR gRNA sequence
ggtaaggcagggataaaaag

SEQ ID NO: 369343 - DNA, 20 bp, Artificial
  CRISPR gRNA sequence
ataaaaagaggacgttttcg

SEQ ID NO: 369344 - DNA, 20 bp, Artificial
  CRISPR gRNA sequence
aaagaggacgttttcgcagt

SEQ ID NO: 369345 - DNA, 20 bp, Artificial
  CRISPR gRNA sequence
acgttttcgcagttggtttt

SEQ ID NO: 369346 - DNA, 20 bp, Artificial
  CRISPR gRNA sequence
cgttttcgcagttggttttg

SEQ ID NO: 369347 - DNA, 20 bp, Artificial
  CRISPR gRNA sequence
ttttcgcagttggttttgag

SEQ ID NO: 369348 - DNA, 20 bp, Artificial
  CRISPR gRNA sequence
tttcgcagttggttttgagg

SEQ ID NO: 369349 - DNA, 20 bp, Artificial
  CRISPR gRNA sequence
ttcgcagttggttttgagga

SEQ ID NO: 369350 - DNA, 20 bp, Artificial
  CRISPR gRNA sequence
tcgcagttggttttgaggag

SEQ ID NO: 369351 - DNA, 20 bp, Artificial
  CRISPR gRNA sequence
cgcagttggttttgaggagg

SEQ ID NO: 369352 - DNA, 20 bp, Artificial
  CRISPR gRNA sequence
agttggttttgaggaggggg

SEQ ID NO: 369353 - DNA, 20 bp, Artificial
  CRISPR gRNA sequence
gttggttttgaggagggggc

SEQ ID NO: 369354 - DNA, 20 bp, Artificial
  CRISPR gRNA sequence
ggagggggcaggattctaac

SEQ ID NO: 369355 - DNA, 20 bp, Artificial
  CRISPR gRNA sequence
ggggcaggattctaaccagt

SEQ ID NO: 369356 - DNA, 20 bp, Artificial
  CRISPR gRNA sequence
attctaaccagtgagaactt

SEQ ID NO: 369357 - DNA, 20 bp, Artificial
  CRISPR gRNA sequence
ccctgcattgatcccactcc

SEQ ID NO: 369358 - DNA, 20 bp, Artificial
  CRISPR gRNA sequence
atgttttgctattttgttat

SEQ ID NO: 369359 - DNA, 20 bp, Artificial
  CRISPR gRNA sequence
ctttcttctttgactttttt

SEQ ID NO: 369360 - DNA, 20 bp, Artificial
  CRISPR gRNA sequence
cttctttgacttttttgaga

SEQ ID NO: 369361 - DNA, 20 bp, Artificial
  CRISPR gRNA sequence
tctttgacttttttgagaca

SEQ ID NO: 369362 - DNA, 20 bp, Artificial
  CRISPR gRNA sequence
gacagagtctcactgttgcc

SEQ ID NO: 369363 - DNA, 20 bp, Artificial
  CRISPR gRNA sequence
acagagtctcactgttgccc

SEQ ID NO: 369364 - DNA, 20 bp, Artificial
  CRISPR gRNA sequence
agtctcactgttgcccaggc

SEQ ID NO: 369365 - DNA, 20 bp, Artificial
  CRISPR gRNA sequence
tctcactgttgcccaggctg

SEQ ID NO: 369366 - DNA, 20 bp, Artificial
  CRISPR gRNA sequence
ctgttgcccaggctggagtg

SEQ ID NO: 369367 - DNA, 20 bp, Artificial
  CRISPR gRNA sequence
ttgcccaggctggagtgtag

SEQ ID NO: 369368 - DNA, 20 bp, Artificial
  CRISPR gRNA sequence
ggagtgtagtggcgcaatct

SEQ ID NO: 369369 - DNA, 20 bp, Artificial
  CRISPR gRNA sequence
tcactgcaacctctgcctct

SEQ ID NO: 369370 - DNA, 20 bp, Artificial
  CRISPR gRNA sequence
cactgcaacctctgcctctt

SEQ ID NO: 369371 - DNA, 20 bp, Artificial
  CRISPR gRNA sequence
aacctctgcctcttgggttc

SEQ ID NO: 369372 - DNA, 20 bp, Artificial
  CRISPR gRNA sequence
ttcaagccattctcctgcct

SEQ ID NO: 369373 - DNA, 20 bp, Artificial
  CRISPR gRNA sequence
ttctcctgcctcagcctcct

SEQ ID NO: 369374 - DNA, 20 bp, Artificial
  CRISPR gRNA sequence
tcctgcctcagcctcctgag

SEQ ID NO: 369375 - DNA, 20 bp, Artificial
  CRISPR gRNA sequence
gcctcagcctcctgagtagc

SEQ ID NO: 369376 - DNA, 20 bp, Artificial
  CRISPR gRNA sequence
cctcagcctcctgagtagct

SEQ ID NO: 369377 - DNA, 20 bp, Artificial
  CRISPR gRNA sequence
ctcctgagtagctgggatta

SEQ ID NO: 369378 - DNA, 20 bp, Artificial
  CRISPR gRNA sequence
tcctgagtagctgggattac

SEQ ID NO: 369379 - DNA, 20 bp, Artificial
  CRISPR gRNA sequence
caggtgcccgccaccatgct

SEQ ID NO: 369380 - DNA, 20 bp, Artificial
  CRISPR gRNA sequence
ttggctaatttttgtaattt

SEQ ID NO: 369381 - DNA, 20 bp, Artificial
  CRISPR gRNA sequence
gctaatttttgtaattttag

SEQ ID NO: 369382 - DNA, 20 bp, Artificial
  CRISPR gRNA sequence
taatttttgtaattttagta

SEQ ID NO: 369383 - DNA, 20 bp, Artificial
  CRISPR gRNA sequence
ttttgtaattttagtagaga

SEQ ID NO: 369384 - DNA, 20 bp, Artificial
  CRISPR gRNA sequence
tttgtaattttagtagagat

SEQ ID NO: 369385 - DNA, 20 bp, Artificial
  CRISPR gRNA sequence
ttgtaattttagtagagatg

SEQ ID NO: 369386 - DNA, 20 bp, Artificial
  CRISPR gRNA sequence
tgtaattttagtagagatgg

SEQ ID NO: 369387 - DNA, 20 bp, Artificial
  CRISPR gRNA sequence
agatgggggtttcaccatgt

SEQ ID NO: 369388 - DNA, 20 bp, Artificial
  CRISPR gRNA sequence
gggggtttcaccatgttggc

SEQ ID NO: 369389 - DNA, 20 bp, Artificial
  CRISPR gRNA sequence
ggggtttcaccatgttggcc

SEQ ID NO: 369390 - DNA, 20 bp, Artificial
  CRISPR gRNA sequence
tttcaccatgttggccaggc

SEQ ID NO: 369391 - DNA, 20 bp, Artificial
  CRISPR gRNA sequence
tggtctcgaactcctgacct

SEQ ID NO: 369392 - DNA, 20 bp, Artificial
  CRISPR gRNA sequence
ggtctcgaactcctgacctt

SEQ ID NO: 369393 - DNA, 20 bp, Artificial
  CRISPR gRNA sequence
cttaggcgatctgcctgcct

SEQ ID NO: 369394 - DNA, 20 bp, Artificial
  CRISPR gRNA sequence
ctgcctgccttggcctccca

SEQ ID NO: 369395 - DNA, 20 bp, Artificial
  CRISPR gRNA sequence
gccttggcctcccaaagtgc

SEQ ID NO: 369396 - DNA, 20 bp, Artificial
  CRISPR gRNA sequence
ccttggcctcccaaagtgct

SEQ ID NO: 369397 - DNA, 20 bp, Artificial
  CRISPR gRNA sequence
ttggcctcccaaagtgctgg

SEQ ID NO: 369398 - DNA, 20 bp, Artificial
  CRISPR gRNA sequence
tcccaaagtgctgggagtac

SEQ ID NO: 369399 - DNA, 20 bp, Artificial
  CRISPR gRNA sequence
cccaaagtgctgggagtaca

SEQ ID NO: 369400 - DNA, 20 bp, Artificial
  CRISPR gRNA sequence
gtgctgggagtacaaggcat

SEQ ID NO: 369401 - DNA, 20 bp, Artificial
  CRISPR gRNA sequence
agtacaaggcatgagccacc

SEQ ID NO: 369402 - DNA, 20 bp, Artificial
  CRISPR gRNA sequence
aaggcatgagccaccaagcc

SEQ ID NO: 369403 - DNA, 20 bp, Artificial
  CRISPR gRNA sequence
catgagccaccaagcctggc

SEQ ID NO: 369404 - DNA, 20 bp, Artificial
  CRISPR gRNA sequence
caccaagcctggccagttat

SEQ ID NO: 369405 - DNA, 20 bp, Artificial
  CRISPR gRNA sequence
tttcaaaactgctctcatgc

SEQ ID NO: 369406 - DNA, 20 bp, Artificial
  CRISPR gRNA sequence
gctctcatgccagtgtttat

SEQ ID NO: 369407 - DNA, 20 bp, Artificial
  CRISPR gRNA sequence
tatcagctctcactacttga

SEQ ID NO: 369408 - DNA, 20 bp, Artificial
  CRISPR gRNA sequence
tcactacttgaaagctgtat

SEQ ID NO: 369409 - DNA, 20 bp, Artificial
  CRISPR gRNA sequence
cactacttgaaagctgtatg

SEQ ID NO: 369410 - DNA, 20 bp, Artificial
  CRISPR gRNA sequence
actacttgaaagctgtatga

SEQ ID NO: 369411 - DNA, 20 bp, Artificial
  CRISPR gRNA sequence
acttgaaagctgtatgaggg

SEQ ID NO: 369412 - DNA, 20 bp, Artificial
  CRISPR gRNA sequence
aagctgtatgagggtggaat

SEQ ID NO: 369413 - DNA, 20 bp, Artificial
  CRISPR gRNA sequence
agctgtatgagggtggaatt

SEQ ID NO: 369414 - DNA, 20 bp, Artificial
  CRISPR gRNA sequence
tgtatgagggtggaattggg

SEQ ID NO: 369415 - DNA, 20 bp, Artificial
  CRISPR gRNA sequence
gtggaattgggtagactgcg

SEQ ID NO: 369416 - DNA, 20 bp, Artificial
  CRISPR gRNA sequence
tggaattgggtagactgcga

SEQ ID NO: 369417 - DNA, 20 bp, Artificial
  CRISPR gRNA sequence
ggaattgggtagactgcgaa

SEQ ID NO: 369418 - DNA, 20 bp, Artificial
  CRISPR gRNA sequence
actgcgaagggccccattcc

SEQ ID NO: 369419 - DNA, 20 bp, Artificial
  CRISPR gRNA sequence
ctgcgaagggccccattccc

SEQ ID NO: 369420 - DNA, 20 bp, Artificial
  CRISPR gRNA sequence
tgcgaagggccccattccca

SEQ ID NO: 369421 - DNA, 20 bp, Artificial
  CRISPR gRNA sequence
gcgaagggccccattcccag

SEQ ID NO: 369422 - DNA, 20 bp, Artificial
  CRISPR gRNA sequence
cattcccaggggttcgtttt

SEQ ID NO: 369423 - DNA, 20 bp, Artificial
  CRISPR gRNA sequence
agcactgtgcatcctcacaa

SEQ ID NO: 369424 - DNA, 20 bp, Artificial
  CRISPR gRNA sequence
tgtgcatcctcacaatggcc

SEQ ID NO: 369425 - DNA, 20 bp, Artificial
  CRISPR gRNA sequence
ggcctggtctgtttcttgac

SEQ ID NO: 369426 - DNA, 20 bp, Artificial
  CRISPR gRNA sequence
ggtctgtttcttgactagat

SEQ ID NO: 369427 - DNA, 20 bp, Artificial
  CRISPR gRNA sequence
tcttgactagataagatttg

SEQ ID NO: 369428 - DNA, 20 bp, Artificial
  CRISPR gRNA sequence
ttgactagataagatttgtg

SEQ ID NO: 369429 - DNA, 20 bp, Artificial
  CRISPR gRNA sequence
gactagataagatttgtgga

SEQ ID NO: 369430 - DNA, 20 bp, Artificial
  CRISPR gRNA sequence
gataagatttgtggagagat

SEQ ID NO: 369431 - DNA, 20 bp, Artificial
  CRISPR gRNA sequence
gagatgagtcctcatttctc

SEQ ID NO: 369432 - DNA, 20 bp, Artificial
  CRISPR gRNA sequence
gagtcctcatttctcaagtc

SEQ ID NO: 369433 - DNA, 20 bp, Artificial
  CRISPR gRNA sequence
ttccataattgttccattta

SEQ ID NO: 369434 - DNA, 20 bp, Artificial
  CRISPR gRNA sequence
cataattgttccatttacag

SEQ ID NO: 369435 - DNA, 20 bp, Artificial
  CRISPR gRNA sequence
catttacagaagtctgtttt

SEQ ID NO: 369436 - DNA, 20 bp, Artificial
  CRISPR gRNA sequence
ttagtgtaaaacattataca

SEQ ID NO: 369437 - DNA, 20 bp, Artificial
  CRISPR gRNA sequence
tgtaaaacattatacaaagc

SEQ ID NO: 369438 - DNA, 20 bp, Artificial
  CRISPR gRNA sequence
gtaaaacattatacaaagcc

SEQ ID NO: 369439 - DNA, 20 bp, Artificial
  CRISPR gRNA sequence
acattatacaaagccgggca

SEQ ID NO: 369440 - DNA, 20 bp, Artificial
  CRISPR gRNA sequence
ttatacaaagccgggcacag

SEQ ID NO: 369441 - DNA, 20 bp, Artificial
  CRISPR gRNA sequence
gtggctcacacctgtaatca

SEQ ID NO: 369442 - DNA, 20 bp, Artificial
  CRISPR gRNA sequence
cacctgtaatcacagaattt

SEQ ID NO: 369443 - DNA, 20 bp, Artificial
  CRISPR gRNA sequence
acctgtaatcacagaatttt

SEQ ID NO: 369444 - DNA, 20 bp, Artificial
  CRISPR gRNA sequence
tcacagaattttgggaaacc

SEQ ID NO: 369445 - DNA, 20 bp, Artificial
  CRISPR gRNA sequence
cacagaattttgggaaaccg

SEQ ID NO: 369446 - DNA, 20 bp, Artificial
  CRISPR gRNA sequence
agaattttgggaaaccgagg

SEQ ID NO: 369447 - DNA, 20 bp, Artificial
  CRISPR gRNA sequence
gaattttgggaaaccgaggc

SEQ ID NO: 369448 - DNA, 20 bp, Artificial
  CRISPR gRNA sequence
attttgggaaaccgaggcag

SEQ ID NO: 369449 - DNA, 20 bp, Artificial
  CRISPR gRNA sequence
ttttgggaaaccgaggcagg

SEQ ID NO: 369450 - DNA, 20 bp, Artificial
  CRISPR gRNA sequence
ccgaggcaggaggattgctt

SEQ ID NO: 369451 - DNA, 20 bp, Artificial
  CRISPR gRNA sequence
gcaggaggattgcttgagcc

SEQ ID NO: 369452 - DNA, 20 bp, Artificial
  CRISPR gRNA sequence
caggaggattgcttgagcct

SEQ ID NO: 369453 - DNA, 20 bp, Artificial
  CRISPR gRNA sequence
ggaggattgcttgagcctag

SEQ ID NO: 369454 - DNA, 20 bp, Artificial
  CRISPR gRNA sequence
tgagcctaggagtttgaaac

SEQ ID NO: 369455 - DNA, 20 bp, Artificial
  CRISPR gRNA sequence
ctaggagtttgaaaccagcc

SEQ ID NO: 369456 - DNA, 20 bp, Artificial
  CRISPR gRNA sequence
taggagtttgaaaccagcct

SEQ ID NO: 369457 - DNA, 20 bp, Artificial
  CRISPR gRNA sequence
tgaaaccagcctgggtaaca

SEQ ID NO: 369458 - DNA, 20 bp, Artificial
  CRISPR gRNA sequence
accagcctgggtaacatagt

SEQ ID NO: 369459 - DNA, 20 bp, Artificial
  CRISPR gRNA sequence
tgggtaacatagtgagactg

SEQ ID NO: 369460 - DNA, 20 bp, Artificial
  CRISPR gRNA sequence
attgaaaataaaaaattatc

SEQ ID NO: 369461 - DNA, 20 bp, Artificial
  CRISPR gRNA sequence
aataaaaaattatccagttg

SEQ ID NO: 369462 - DNA, 20 bp, Artificial
  CRISPR gRNA sequence
aaaaaattatccagttgtgg

SEQ ID NO: 369463 - DNA, 20 bp, Artificial
  CRISPR gRNA sequence
gttgtggtggtatgcatctg

SEQ ID NO: 369464 - DNA, 20 bp, Artificial
  CRISPR gRNA sequence
gtggtatgcatctgtggtcc

SEQ ID NO: 369465 - DNA, 20 bp, Artificial
  CRISPR gRNA sequence
catctgtggtcccagctact

SEQ ID NO: 369466 - DNA, 20 bp, Artificial
  CRISPR gRNA sequence
atctgtggtcccagctactt

SEQ ID NO: 369467 - DNA, 20 bp, Artificial
  CRISPR gRNA sequence
ctgtggtcccagctacttgg

SEQ ID NO: 369468 - DNA, 20 bp, Artificial
  CRISPR gRNA sequence
tgtggtcccagctacttggg

SEQ ID NO: 369469 - DNA, 20 bp, Artificial
  CRISPR gRNA sequence
tcccagctacttgggaggct

SEQ ID NO: 369470 - DNA, 20 bp, Artificial
  CRISPR gRNA sequence
cccagctacttgggaggctg

SEQ ID NO: 369471 - DNA, 20 bp, Artificial
  CRISPR gRNA sequence
agctacttgggaggctgagg

SEQ ID NO: 369472 - DNA, 20 bp, Artificial
  CRISPR gRNA sequence
gctacttgggaggctgaggc

SEQ ID NO: 369473 - DNA, 20 bp, Artificial
  CRISPR gRNA sequence
tacttgggaggctgaggcag

SEQ ID NO: 369474 - DNA, 20 bp, Artificial
  CRISPR gRNA sequence
acttgggaggctgaggcagg

SEQ ID NO: 369475 - DNA, 20 bp, Artificial
  CRISPR gRNA sequence
gcaggaggactgcctgtgcc

SEQ ID NO: 369476 - DNA, 20 bp, Artificial
  CRISPR gRNA sequence
caggaggactgcctgtgccc

SEQ ID NO: 369477 - DNA, 20 bp, Artificial
  CRISPR gRNA sequence
tgcctgtgcccaggtgcttg

SEQ ID NO: 369478 - DNA, 20 bp, Artificial
  CRISPR gRNA sequence
tgcccaggtgcttgaagctg

SEQ ID NO: 369479 - DNA, 20 bp, Artificial
  CRISPR gRNA sequence
caggtgcttgaagctgcagt

SEQ ID NO: 369480 - DNA, 20 bp, Artificial
  CRISPR gRNA sequence
gtgagctatgatcgcaccac

SEQ ID NO: 369481 - DNA, 20 bp, Artificial
  CRISPR gRNA sequence
atgatcgcaccactggactc

SEQ ID NO: 369482 - DNA, 20 bp, Artificial
  CRISPR gRNA sequence
tgatcgcaccactggactcc

SEQ ID NO: 369483 - DNA, 20 bp, Artificial
  CRISPR gRNA sequence
cgcaccactggactccaggc

SEQ ID NO: 369484 - DNA, 20 bp, Artificial
  CRISPR gRNA sequence
gcaccactggactccaggct

SEQ ID NO: 369485 - DNA, 20 bp, Artificial
  CRISPR gRNA sequence
ctggactccaggctgggtgc

SEQ ID NO: 369486 - DNA, 20 bp, Artificial
  CRISPR gRNA sequence
ggactccaggctgggtgcca

SEQ ID NO: 369487 - DNA, 20 bp, Artificial
  CRISPR gRNA sequence
tccaggctgggtgccagagt

SEQ ID NO: 369488 - DNA, 20 bp, Artificial
  CRISPR gRNA sequence
aaataaacaaacgaaaatta

SEQ ID NO: 369489 - DNA, 20 bp, Artificial
  CRISPR gRNA sequence
tagacattcaacaaatactc

SEQ ID NO: 369490 - DNA, 20 bp, Artificial
  CRISPR gRNA sequence
agacattcaacaaatactca

SEQ ID NO: 369491 - DNA, 20 bp, Artificial
  CRISPR gRNA sequence
tcatttgccattccttgaat

SEQ ID NO: 369492 - DNA, 20 bp, Artificial
  CRISPR gRNA sequence
catttgccattccttgaatt

SEQ ID NO: 369493 - DNA, 20 bp, Artificial
  CRISPR gRNA sequence
ttttaaatatttatgctttt

SEQ ID NO: 369494 - DNA, 20 bp, Artificial
  CRISPR gRNA sequence
aaatatttatgctttttaga

SEQ ID NO: 369495 - DNA, 20 bp, Artificial
  CRISPR gRNA sequence
tgccacatttctgatgctgt

SEQ ID NO: 369496 - DNA, 20 bp, Artificial
  CRISPR gRNA sequence
ctcctgcatgtttatttttc

SEQ ID NO: 369497 - DNA, 20 bp, Artificial
  CRISPR gRNA sequence
ttccagacttttgtacacct

SEQ ID NO: 369498 - DNA, 20 bp, Artificial
  CRISPR gRNA sequence
gtacaccttagtgctccgtt

SEQ ID NO: 369499 - DNA, 20 bp, Artificial
  CRISPR gRNA sequence
accttagtgctccgtttagt

SEQ ID NO: 369500 - DNA, 20 bp, Artificial
  CRISPR gRNA sequence
ctccgtttagtaagtgtaac

SEQ ID NO: 369501 - DNA, 20 bp, Artificial
  CRISPR gRNA sequence
gtgtaactagtcctttatca

SEQ ID NO: 369502 - DNA, 20 bp, Artificial
  CRISPR gRNA sequence
tgtaactagtcctttatcat

SEQ ID NO: 369503 - DNA, 20 bp, Artificial
  CRISPR gRNA sequence
gtaactagtcctttatcatg

SEQ ID NO: 369504 - DNA, 20 bp, Artificial
  CRISPR gRNA sequence
tttcttatgcttgatgtgac

SEQ ID NO: 369505 - DNA, 20 bp, Artificial
  CRISPR gRNA sequence
ttgatgtgactggtaataac

SEQ ID NO: 369506 - DNA, 20 bp, Artificial
  CRISPR gRNA sequence
tgatgtgactggtaataacg

SEQ ID NO: 369507 - DNA, 20 bp, Artificial
  CRISPR gRNA sequence
taataacgaggtccctaaaa

SEQ ID NO: 369508 - DNA, 20 bp, Artificial
  CRISPR gRNA sequence
acgaggtccctaaaacagtg

SEQ ID NO: 369509 - DNA, 20 bp, Artificial
  CRISPR gRNA sequence
cctaaaacagtgaagattct

SEQ ID NO: 369510 - DNA, 20 bp, Artificial
  CRISPR gRNA sequence
aagattcttggtacttcctc

SEQ ID NO: 369511 - DNA, 20 bp, Artificial
  CRISPR gRNA sequence
attcttggtacttcctcaag

SEQ ID NO: 369512 - DNA, 20 bp, Artificial
  CRISPR gRNA sequence
tcttggtacttcctcaagtg

SEQ ID NO: 369513 - DNA, 20 bp, Artificial
  CRISPR gRNA sequence
tcctcaagtggagttttcca

SEQ ID NO: 369514 - DNA, 20 bp, Artificial
  CRISPR gRNA sequence
gagttttccaaagacaaaaa

SEQ ID NO: 369515 - DNA, 20 bp, Artificial
  CRISPR gRNA sequence
agttttccaaagacaaaaat

SEQ ID NO: 369516 - DNA, 20 bp, Artificial
  CRISPR gRNA sequence
ttttccaaagacaaaaatgg

SEQ ID NO: 369517 - DNA, 20 bp, Artificial
  CRISPR gRNA sequence
ttgtttttaatttctaccaa

SEQ ID NO: 369518 - DNA, 20 bp, Artificial
  CRISPR gRNA sequence
aatttctaccaaaagaaaca

SEQ ID NO: 369519 - DNA, 20 bp, Artificial
  CRISPR gRNA sequence
aaaaacccataaaatcccca

SEQ ID NO: 369520 - DNA, 20 bp, Artificial
  CRISPR gRNA sequence
ctaaatcaaaacaaaaaacc

SEQ ID NO: 369521 - DNA, 20 bp, Artificial
  CRISPR gRNA sequence
aaatcaaaacaaaaaacccg

SEQ ID NO: 369522 - DNA, 20 bp, Artificial
  CRISPR gRNA sequence
aatcaaaacaaaaaacccgg

SEQ ID NO: 369523 - DNA, 20 bp, Artificial
  CRISPR gRNA sequence
aaaacaaaaaacccggagga

SEQ ID NO: 369524 - DNA, 20 bp, Artificial
  CRISPR gRNA sequence
acaaaaaacccggaggaaag

SEQ ID NO: 369525 - DNA, 20 bp, Artificial
  CRISPR gRNA sequence
aaaacccggaggaaagaagt

SEQ ID NO: 369526 - DNA, 20 bp, Artificial
  CRISPR gRNA sequence
acccggaggaaagaagtcag

SEQ ID NO: 369527 - DNA, 20 bp, Artificial
  CRISPR gRNA sequence
ccggaggaaagaagtcagta

SEQ ID NO: 369528 - DNA, 20 bp, Artificial
  CRISPR gRNA sequence
gaggaaagaagtcagtagag

SEQ ID NO: 369529 - DNA, 20 bp, Artificial
  CRISPR gRNA sequence
aaagaagtcagtagagcagt

SEQ ID NO: 369530 - DNA, 20 bp, Artificial
  CRISPR gRNA sequence
gtcagtagagcagtaagact

SEQ ID NO: 369531 - DNA, 20 bp, Artificial
  CRISPR gRNA sequence
gagcagtaagactaagaata

SEQ ID NO: 369532 - DNA, 20 bp, Artificial
  CRISPR gRNA sequence
actaagaataaagaatatca

SEQ ID NO: 369533 - DNA, 20 bp, Artificial
  CRISPR gRNA sequence
taagaataaagaatatcatg

SEQ ID NO: 369534 - DNA, 20 bp, Artificial
  CRISPR gRNA sequence
aagaataaagaatatcatgg

SEQ ID NO: 369535 - DNA, 20 bp, Artificial
  CRISPR gRNA sequence
catggaggcaaattatgcca

SEQ ID NO: 369536 - DNA, 20 bp, Artificial
  CRISPR gRNA sequence
tggaggcaaattatgccaaa

SEQ ID NO: 369537 - DNA, 20 bp, Artificial
  CRISPR gRNA sequence
caaattatgccaaagagcat

SEQ ID NO: 369538 - DNA, 20 bp, Artificial
  CRISPR gRNA sequence
aaagagcattggataaaact

SEQ ID NO: 369539 - DNA, 20 bp, Artificial
  CRISPR gRNA sequence
agagcattggataaaacttg

SEQ ID NO: 369540 - DNA, 20 bp, Artificial
  CRISPR gRNA sequence
tggataaaacttggagtgtg

SEQ ID NO: 369541 - DNA, 20 bp, Artificial
  CRISPR gRNA sequence
gcattcttccctttgactta

SEQ ID NO: 369542 - DNA, 20 bp, Artificial
  CRISPR gRNA sequence
agttacttaaactgactaac

SEQ ID NO: 369543 - DNA, 20 bp, Artificial
  CRISPR gRNA sequence
gttacttaaactgactaaca

SEQ ID NO: 369544 - DNA, 20 bp, Artificial
  CRISPR gRNA sequence
tacttaaactgactaacaag

SEQ ID NO: 369545 - DNA, 20 bp, Artificial
  CRISPR gRNA sequence
aaactgactaacaaggagac

SEQ ID NO: 369546 - DNA, 20 bp, Artificial
  CRISPR gRNA sequence
aacaaggagacaagtgattt

SEQ ID NO: 369547 - DNA, 20 bp, Artificial
  CRISPR gRNA sequence
tgatttaagataatattcaa

SEQ ID NO: 369548 - DNA, 20 bp, Artificial
  CRISPR gRNA sequence
taagataatattcaaaagat

SEQ ID NO: 369549 - DNA, 20 bp, Artificial
  CRISPR gRNA sequence
aagataatattcaaaagata

SEQ ID NO: 369550 - DNA, 20 bp, Artificial
  CRISPR gRNA sequence
aaagataaggccaatccacg

SEQ ID NO: 369551 - DNA, 20 bp, Artificial
  CRISPR gRNA sequence
aagataaggccaatccacga

SEQ ID NO: 369552 - DNA, 20 bp, Artificial
  CRISPR gRNA sequence
agataaggccaatccacgaa

SEQ ID NO: 369553 - DNA, 20 bp, Artificial
  CRISPR gRNA sequence
ccaatccacgaagggcctca

SEQ ID NO: 369554 - DNA, 20 bp, Artificial
  CRISPR gRNA sequence
caatccacgaagggcctcat

SEQ ID NO: 369555 - DNA, 20 bp, Artificial
  CRISPR gRNA sequence
gggcctcatgggtcttccca

SEQ ID NO: 369556 - DNA, 20 bp, Artificial
  CRISPR gRNA sequence
ggcctcatgggtcttcccac

SEQ ID NO: 369557 - DNA, 20 bp, Artificial
  CRISPR gRNA sequence
gcctcatgggtcttcccaca

SEQ ID NO: 369558 - DNA, 20 bp, Artificial
  CRISPR gRNA sequence
tcatgggtcttcccacaggg

SEQ ID NO: 369559 - DNA, 20 bp, Artificial
  CRISPR gRNA sequence
catgggtcttcccacagggc

SEQ ID NO: 369560 - DNA, 20 bp, Artificial
  CRISPR gRNA sequence
aggtgtgatgttctgccttg

SEQ ID NO: 369561 - DNA, 20 bp, Artificial
  CRISPR gRNA sequence
tgatgttctgccttgtggct

SEQ ID NO: 369562 - DNA, 20 bp, Artificial
  CRISPR gRNA sequence
ttctgccttgtggctcggcc

SEQ ID NO: 369563 - DNA, 20 bp, Artificial
  CRISPR gRNA sequence
tctgccttgtggctcggcct

SEQ ID NO: 369564 - DNA, 20 bp, Artificial
  CRISPR gRNA sequence
ctgccttgtggctcggcctg

SEQ ID NO: 369565 - DNA, 20 bp, Artificial
  CRISPR gRNA sequence
tgccttgtggctcggcctgg

SEQ ID NO: 369566 - DNA, 20 bp, Artificial
  CRISPR gRNA sequence
cttgtggctcggcctggggg

SEQ ID NO: 369567 - DNA, 20 bp, Artificial
  CRISPR gRNA sequence
ttgtggctcggcctggggga

SEQ ID NO: 369568 - DNA, 20 bp, Artificial
  CRISPR gRNA sequence
gtggctcggcctgggggaag

SEQ ID NO: 369569 - DNA, 20 bp, Artificial
  CRISPR gRNA sequence
tggctcggcctgggggaagg

SEQ ID NO: 369570 - DNA, 20 bp, Artificial
  CRISPR gRNA sequence
tcggcctgggggaaggagga

SEQ ID NO: 369571 - DNA, 20 bp, Artificial
  CRISPR gRNA sequence
ggaggacagccaccttatta

SEQ ID NO: 369572 - DNA, 20 bp, Artificial
  CRISPR gRNA sequence
aggacagccaccttattaaa

SEQ ID NO: 369573 - DNA, 20 bp, Artificial
  CRISPR gRNA sequence
agccaccttattaaagagat

SEQ ID NO: 369574 - DNA, 20 bp, Artificial
  CRISPR gRNA sequence
gccaccttattaaagagatt

SEQ ID NO: 369575 - DNA, 20 bp, Artificial
  CRISPR gRNA sequence
accttattaaagagattggg

SEQ ID NO: 369576 - DNA, 20 bp, Artificial
  CRISPR gRNA sequence
ccttattaaagagattgggt

SEQ ID NO: 369577 - DNA, 20 bp, Artificial
  CRISPR gRNA sequence
tattaaagagattgggtagg

SEQ ID NO: 369578 - DNA, 20 bp, Artificial
  CRISPR gRNA sequence
attaaagagattgggtagga

SEQ ID NO: 369579 - DNA, 20 bp, Artificial
  CRISPR gRNA sequence
agattgggtaggaaggttaa

SEQ ID NO: 369580 - DNA, 20 bp, Artificial
  CRISPR gRNA sequence
ggtaggaaggttaaaagatg

SEQ ID NO: 369581 - DNA, 20 bp, Artificial
  CRISPR gRNA sequence
tggtgccctcttatatgact

SEQ ID NO: 369582 - DNA, 20 bp, Artificial
  CRISPR gRNA sequence
tgccctcttatatgactaag

SEQ ID NO: 369583 - DNA, 20 bp, Artificial
  CRISPR gRNA sequence
ctaagaagtcattccttctg

SEQ ID NO: 369584 - DNA, 20 bp, Artificial
  CRISPR gRNA sequence
aagaagtcattccttctgtg

SEQ ID NO: 369585 - DNA, 20 bp, Artificial
  CRISPR gRNA sequence
tggagatgcttacaatccaa

SEQ ID NO: 369586 - DNA, 20 bp, Artificial
  CRISPR gRNA sequence
ttacaatccaatggcccaat

SEQ ID NO: 369587 - DNA, 20 bp, Artificial
  CRISPR gRNA sequence
aatggcccaataagatgtgt

SEQ ID NO: 369588 - DNA, 20 bp, Artificial
  CRISPR gRNA sequence
taagatgtgttagcttctca

SEQ ID NO: 369589 - DNA, 20 bp, Artificial
  CRISPR gRNA sequence
agatgtgttagcttctcaca

SEQ ID NO: 369590 - DNA, 20 bp, Artificial
  CRISPR gRNA sequence
gtgttagcttctcacagaga

SEQ ID NO: 369591 - DNA, 20 bp, Artificial
  CRISPR gRNA sequence
tagcttctcacagagatggc

SEQ ID NO: 369592 - DNA, 20 bp, Artificial
  CRISPR gRNA sequence
gcttctcacagagatggcca

SEQ ID NO: 369593 - DNA, 20 bp, Artificial
  CRISPR gRNA sequence
tcacagagatggccagagtg

SEQ ID NO: 369594 - DNA, 20 bp, Artificial
  CRISPR gRNA sequence
agagatggccagagtgcaga

SEQ ID NO: 369595 - DNA, 20 bp, Artificial
  CRISPR gRNA sequence
gagatggccagagtgcagat

SEQ ID NO: 369596 - DNA, 20 bp, Artificial
  CRISPR gRNA sequence
tggccagagtgcagatagga

SEQ ID NO: 369597 - DNA, 20 bp, Artificial
  CRISPR gRNA sequence
ggccagagtgcagataggat

SEQ ID NO: 369598 - DNA, 20 bp, Artificial
  CRISPR gRNA sequence
ggatgcaaactgcgccccca

SEQ ID NO: 369599 - DNA, 20 bp, Artificial
  CRISPR gRNA sequence
gcaaactgcgcccccaaagc

SEQ ID NO: 369600 - DNA, 20 bp, Artificial
  CRISPR gRNA sequence
ctgcgcccccaaagctggcg

SEQ ID NO: 369601 - DNA, 20 bp, Artificial
  CRISPR gRNA sequence
ccaaagctggcgaagcttcc

SEQ ID NO: 369602 - DNA, 20 bp, Artificial
  CRISPR gRNA sequence
cttcccagatgatcccatgc

SEQ ID NO: 369603 - DNA, 20 bp, Artificial
  CRISPR gRNA sequence
ttcccagatgatcccatgcg

SEQ ID NO: 369604 - DNA, 20 bp, Artificial
  CRISPR gRNA sequence
cccagatgatcccatgcgag

SEQ ID NO: 369605 - DNA, 20 bp, Artificial
  CRISPR gRNA sequence
ccagatgatcccatgcgagg

SEQ ID NO: 369606 - DNA, 20 bp, Artificial
  CRISPR gRNA sequence
atcccatgcgaggaggcctt

SEQ ID NO: 369607 - DNA, 20 bp, Artificial
  CRISPR gRNA sequence
tcccatgcgaggaggccttc

SEQ ID NO: 369608 - DNA, 20 bp, Artificial
  CRISPR gRNA sequence
cccatgcgaggaggccttca

SEQ ID NO: 369609 - DNA, 20 bp, Artificial
  CRISPR gRNA sequence
cgaggaggccttcagggttt

SEQ ID NO: 369610 - DNA, 20 bp, Artificial
  CRISPR gRNA sequence
gaggaggccttcagggtttg

SEQ ID NO: 369611 - DNA, 20 bp, Artificial
  CRISPR gRNA sequence
ccttcagggtttgaggatct

SEQ ID NO: 369612 - DNA, 20 bp, Artificial
  CRISPR gRNA sequence
tcagggtttgaggatctcag

SEQ ID NO: 369613 - DNA, 20 bp, Artificial
  CRISPR gRNA sequence
ggtttgaggatctcagcaga

SEQ ID NO: 369614 - DNA, 20 bp, Artificial
  CRISPR gRNA sequence
agcagacagaacaacctgca

SEQ ID NO: 369615 - DNA, 20 bp, Artificial
  CRISPR gRNA sequence
gcagacagaacaacctgcac

SEQ ID NO: 369616 - DNA, 20 bp, Artificial
  CRISPR gRNA sequence
cagacagaacaacctgcacg

SEQ ID NO: 369617 - DNA, 20 bp, Artificial
  CRISPR gRNA sequence
agaacaacctgcacggggca

SEQ ID NO: 369618 - DNA, 20 bp, Artificial
  CRISPR gRNA sequence
aacaacctgcacggggcatg

SEQ ID NO: 369619 - DNA, 20 bp, Artificial
  CRISPR gRNA sequence
acaacctgcacggggcatgg

SEQ ID NO: 369620 - DNA, 20 bp, Artificial
  CRISPR gRNA sequence
ctgcacggggcatggaggcg

SEQ ID NO: 369621 - DNA, 20 bp, Artificial
  CRISPR gRNA sequence
cggggcatggaggcgtggac

SEQ ID NO: 369622 - DNA, 20 bp, Artificial
  CRISPR gRNA sequence
gggcatggaggcgtggacaa

SEQ ID NO: 369623 - DNA, 20 bp, Artificial
  CRISPR gRNA sequence
gcatggaggcgtggacaaga

SEQ ID NO: 369624 - DNA, 20 bp, Artificial
  CRISPR gRNA sequence
catggaggcgtggacaagag

SEQ ID NO: 369625 - DNA, 20 bp, Artificial
  CRISPR gRNA sequence
gacaagagaggtgaacacat

SEQ ID NO: 369626 - DNA, 20 bp, Artificial
  CRISPR gRNA sequence
acaagagaggtgaacacatg

SEQ ID NO: 369627 - DNA, 20 bp, Artificial
  CRISPR gRNA sequence
caagagaggtgaacacatga

SEQ ID NO: 369628 - DNA, 20 bp, Artificial
  CRISPR gRNA sequence
gaggtgaacacatgagggcc

SEQ ID NO: 369629 - DNA, 20 bp, Artificial
  CRISPR gRNA sequence
ggtgaacacatgagggcctg

SEQ ID NO: 369630 - DNA, 20 bp, Artificial
  CRISPR gRNA sequence
gaacacatgagggcctggag

SEQ ID NO: 369631 - DNA, 20 bp, Artificial
  CRISPR gRNA sequence
cacatgagggcctggagtgg

SEQ ID NO: 369632 - DNA, 20 bp, Artificial
  CRISPR gRNA sequence
cctggagtggtggtgattaa

SEQ ID NO: 369633 - DNA, 20 bp, Artificial
  CRISPR gRNA sequence
ggagtggtggtgattaatgg

SEQ ID NO: 369634 - DNA, 20 bp, Artificial
  CRISPR gRNA sequence
gtgattaatggtggtgattg

SEQ ID NO: 369635 - DNA, 20 bp, Artificial
  CRISPR gRNA sequence
tgattaatggtggtgattgt

SEQ ID NO: 369636 - DNA, 20 bp, Artificial
  CRISPR gRNA sequence
gattaatggtggtgattgtg

SEQ ID NO: 369637 - DNA, 20 bp, Artificial
  CRISPR gRNA sequence
atggtggtgattgtggggca

SEQ ID NO: 369638 - DNA, 20 bp, Artificial
  CRISPR gRNA sequence
tggtgattgtggggcatgga

SEQ ID NO: 369639 - DNA, 20 bp, Artificial
  CRISPR gRNA sequence
ttgtggggcatggacagatg

SEQ ID NO: 369640 - DNA, 20 bp, Artificial
  CRISPR gRNA sequence
ggggcatggacagatgtagt

SEQ ID NO: 369641 - DNA, 20 bp, Artificial
  CRISPR gRNA sequence
ggcatggacagatgtagtga

SEQ ID NO: 369642 - DNA, 20 bp, Artificial
  CRISPR gRNA sequence
gcatggacagatgtagtgag

SEQ ID NO: 369643 - DNA, 20 bp, Artificial
  CRISPR gRNA sequence
ggacagatgtagtgagaggt

SEQ ID NO: 369644 - DNA, 20 bp, Artificial
  CRISPR gRNA sequence
gacagatgtagtgagaggtg

SEQ ID NO: 369645 - DNA, 20 bp, Artificial
  CRISPR gRNA sequence
acagatgtagtgagaggtga

SEQ ID NO: 369646 - DNA, 20 bp, Artificial
  CRISPR gRNA sequence
gatgtagtgagaggtgaggg

SEQ ID NO: 369647 - DNA, 20 bp, Artificial
  CRISPR gRNA sequence
tgtagtgagaggtgagggca

SEQ ID NO: 369648 - DNA, 20 bp, Artificial
  CRISPR gRNA sequence
tagtgagaggtgagggcaga

SEQ ID NO: 369649 - DNA, 20 bp, Artificial
  CRISPR gRNA sequence
tgagaggtgagggcagagag

SEQ ID NO: 369650 - DNA, 20 bp, Artificial
  CRISPR gRNA sequence
gagaggtgagggcagagaga

SEQ ID NO: 369651 - DNA, 20 bp, Artificial
  CRISPR gRNA sequence
gaggtgagggcagagagaag

SEQ ID NO: 369652 - DNA, 20 bp, Artificial
  CRISPR gRNA sequence
aggtgagggcagagagaagg

SEQ ID NO: 369653 - DNA, 20 bp, Artificial
  CRISPR gRNA sequence
agggcagagagaaggaggct

SEQ ID NO: 369654 - DNA, 20 bp, Artificial
  CRISPR gRNA sequence
ggcagagagaaggaggctta

SEQ ID NO: 369655 - DNA, 20 bp, Artificial
  CRISPR gRNA sequence
cagagagaaggaggcttaga

SEQ ID NO: 369656 - DNA, 20 bp, Artificial
  CRISPR gRNA sequence
gagagaaggaggcttagaga

SEQ ID NO: 369657 - DNA, 20 bp, Artificial
  CRISPR gRNA sequence
gagagagattatacttgcat

SEQ ID NO: 369658 - DNA, 20 bp, Artificial
  CRISPR gRNA sequence
gattatacttgcatgagtgt

SEQ ID NO: 369659 - DNA, 20 bp, Artificial
  CRISPR gRNA sequence
tatacttgcatgagtgtaag

SEQ ID NO: 369660 - DNA, 20 bp, Artificial
  CRISPR gRNA sequence
gcatgagtgtaagaagctcc

SEQ ID NO: 369661 - DNA, 20 bp, Artificial
  CRISPR gRNA sequence
gaagctccaagtattgaaac

SEQ ID NO: 369662 - DNA, 20 bp, Artificial
  CRISPR gRNA sequence
aagtattgaaactggtttgc

SEQ ID NO: 369663 - DNA, 20 bp, Artificial
  CRISPR gRNA sequence
tattgaaactggtttgcaag

SEQ ID NO: 369664 - DNA, 20 bp, Artificial
  CRISPR gRNA sequence
ttgaaactggtttgcaagca

SEQ ID NO: 369665 - DNA, 20 bp, Artificial
  CRISPR gRNA sequence
gaaactggtttgcaagcaga

SEQ ID NO: 369666 - DNA, 20 bp, Artificial
  CRISPR gRNA sequence
aaactggtttgcaagcagag

SEQ ID NO: 369667 - DNA, 20 bp, Artificial
  CRISPR gRNA sequence
caagcagagaggtccatgat

SEQ ID NO: 369668 - DNA, 20 bp, Artificial
  CRISPR gRNA sequence
tccatgatcagatttacatt

SEQ ID NO: 369669 - DNA, 20 bp, Artificial
  CRISPR gRNA sequence
ccatgatcagatttacattt

SEQ ID NO: 369670 - DNA, 20 bp, Artificial
  CRISPR gRNA sequence
tgatcagatttacatttggg

SEQ ID NO: 369671 - DNA, 20 bp, Artificial
  CRISPR gRNA sequence
tttgggaagaattgccctcc

SEQ ID NO: 369672 - DNA, 20 bp, Artificial
  CRISPR gRNA sequence
tgggaagaattgccctccca

SEQ ID NO: 369673 - DNA, 20 bp, Artificial
  CRISPR gRNA sequence
gggaagaattgccctcccag

SEQ ID NO: 369674 - DNA, 20 bp, Artificial
  CRISPR gRNA sequence
tgccctcccagaggaaacat

SEQ ID NO: 369675 - DNA, 20 bp, Artificial
  CRISPR gRNA sequence
gccctcccagaggaaacatt

SEQ ID NO: 369676 - DNA, 20 bp, Artificial
  CRISPR gRNA sequence
ccagaggaaacattgggtat

SEQ ID NO: 369677 - DNA, 20 bp, Artificial
  CRISPR gRNA sequence
ggtataagttttcattgcct

SEQ ID NO: 369678 - DNA, 20 bp, Artificial
  CRISPR gRNA sequence
gttttcattgcctcggcatg

SEQ ID NO: 369679 - DNA, 20 bp, Artificial
  CRISPR gRNA sequence
ttgcctcggcatgaagaact

SEQ ID NO: 369680 - DNA, 20 bp, Artificial
  CRISPR gRNA sequence
tgagcaattgcgtcctgtga

SEQ ID NO: 369681 - DNA, 20 bp, Artificial
  CRISPR gRNA sequence
gcaattgcgtcctgtgacgg

SEQ ID NO: 369682 - DNA, 20 bp, Artificial
  CRISPR gRNA sequence
cctgtgacggcagtgacctg

SEQ ID NO: 369683 - DNA, 20 bp, Artificial
  CRISPR gRNA sequence
tgacggcagtgacctgcaga

SEQ ID NO: 369684 - DNA, 20 bp, Artificial
  CRISPR gRNA sequence
gacggcagtgacctgcagat

SEQ ID NO: 369685 - DNA, 20 bp, Artificial
  CRISPR gRNA sequence
agtgacctgcagatgggaaa

SEQ ID NO: 369686 - DNA, 20 bp, Artificial
  CRISPR gRNA sequence
atgggaaaaagacaaataca

SEQ ID NO: 369687 - DNA, 20 bp, Artificial
  CRISPR gRNA sequence
tgggaaaaagacaaatacac

SEQ ID NO: 369688 - DNA, 20 bp, Artificial
  CRISPR gRNA sequence
gggaaaaagacaaatacaca

SEQ ID NO: 369689 - DNA, 20 bp, Artificial
  CRISPR gRNA sequence
aaagacaaatacacagggct

SEQ ID NO: 369690 - DNA, 20 bp, Artificial
  CRISPR gRNA sequence
agggctgagttgtgctgcat

SEQ ID NO: 369691 - DNA, 20 bp, Artificial
  CRISPR gRNA sequence
ctgagttgtgctgcataagc

SEQ ID NO: 369692 - DNA, 20 bp, Artificial
  CRISPR gRNA sequence
cgagatgacttttttgtata

SEQ ID NO: 369693 - DNA, 20 bp, Artificial
  CRISPR gRNA sequence
gagatgacttttttgtataa

SEQ ID NO: 369694 - DNA, 20 bp, Artificial
  CRISPR gRNA sequence
cttttttgtataaaggattc

SEQ ID NO: 369695 - DNA, 20 bp, Artificial
  CRISPR gRNA sequence
attccagaattaataatttg

SEQ ID NO: 369696 - DNA, 20 bp, Artificial
  CRISPR gRNA sequence
ataatttgtagttatcattt

SEQ ID NO: 369697 - DNA, 20 bp, Artificial
  CRISPR gRNA sequence
taatttgtagttatcatttt

SEQ ID NO: 369698 - DNA, 20 bp, Artificial
  CRISPR gRNA sequence
aatttgtagttatcatttta

SEQ ID NO: 369699 - DNA, 20 bp, Artificial
  CRISPR gRNA sequence
ttttagggaacatgttgtgc

SEQ ID NO: 369700 - DNA, 20 bp, Artificial
  CRISPR gRNA sequence
gatgctattcatctactatt

SEQ ID NO: 369701 - DNA, 20 bp, Artificial
  CRISPR gRNA sequence
atgctattcatctactattt

SEQ ID NO: 369702 - DNA, 20 bp, Artificial
  CRISPR gRNA sequence
catctactatttgggtacgt

SEQ ID NO: 369703 - DNA, 20 bp, Artificial
  CRISPR gRNA sequence
gtttttatttttgttctttt

SEQ ID NO: 369704 - DNA, 20 bp, Artificial
  CRISPR gRNA sequence
tttttatttttgttctttta

SEQ ID NO: 369705 - DNA, 20 bp, Artificial
  CRISPR gRNA sequence
ttttgttcttttaaggaact

SEQ ID NO: 369706 - DNA, 20 bp, Artificial
  CRISPR gRNA sequence
aatactgactctgtcttcgc

SEQ ID NO: 369707 - DNA, 20 bp, Artificial
  CRISPR gRNA sequence
tgttacaatatctttaaaat

SEQ ID NO: 369708 - DNA, 20 bp, Artificial
  CRISPR gRNA sequence
ttacaatatctttaaaatga

SEQ ID NO: 369709 - DNA, 20 bp, Artificial
  CRISPR gRNA sequence
taaaatgagagtcataataa

SEQ ID NO: 369710 - DNA, 20 bp, Artificial
  CRISPR gRNA sequence
aataacagtgcctcaaatga

SEQ ID NO: 369711 - DNA, 20 bp, Artificial
  CRISPR gRNA sequence
ataacagtgcctcaaatgaa

SEQ ID NO: 369712 - DNA, 20 bp, Artificial
  CRISPR gRNA sequence
cagtgcctcaaatgaaaggt

SEQ ID NO: 369713 - DNA, 20 bp, Artificial
  CRISPR gRNA sequence
ttcaataaacatccgctgca

SEQ ID NO: 369714 - DNA, 20 bp, Artificial
  CRISPR gRNA sequence
cgtgcctcattataaatact

SEQ ID NO: 369715 - DNA, 20 bp, Artificial
  CRISPR gRNA sequence
aattttttattatgattaat

SEQ ID NO: 369716 - DNA, 20 bp, Artificial
  CRISPR gRNA sequence
ttggcccaaataacaacata

SEQ ID NO: 369717 - DNA, 20 bp, Artificial
  CRISPR gRNA sequence
gcccaaataacaacatatag

SEQ ID NO: 369718 - DNA, 20 bp, Artificial
  CRISPR gRNA sequence
taacaacatatagaagaatg

SEQ ID NO: 369719 - DNA, 20 bp, Artificial
  CRISPR gRNA sequence
acatatagaagaatgaagca

SEQ ID NO: 369720 - DNA, 20 bp, Artificial
  CRISPR gRNA sequence
agcaaagttatttttctttt

SEQ ID NO: 369721 - DNA, 20 bp, Artificial
  CRISPR gRNA sequence
gcaaagttatttttcttttg

SEQ ID NO: 369722 - DNA, 20 bp, Artificial
  CRISPR gRNA sequence
aaagttatttttcttttgag

SEQ ID NO: 369723 - DNA, 20 bp, Artificial
  CRISPR gRNA sequence
ttcttttgaggagtaattgt

SEQ ID NO: 369724 - DNA, 20 bp, Artificial
  CRISPR gRNA sequence
ggagtaattgtaagtactac

SEQ ID NO: 369725 - DNA, 20 bp, Artificial
  CRISPR gRNA sequence
gagtaattgtaagtactact

SEQ ID NO: 369726 - DNA, 20 bp, Artificial
  CRISPR gRNA sequence
tgtaagtactactgggtata

SEQ ID NO: 369727 - DNA, 20 bp, Artificial
  CRISPR gRNA sequence
actgggtataaagaaaaata

SEQ ID NO: 369728 - DNA, 20 bp, Artificial
  CRISPR gRNA sequence
tgggtataaagaaaaataca

SEQ ID NO: 369729 - DNA, 20 bp, Artificial
  CRISPR gRNA sequence
gggtataaagaaaaatacag

SEQ ID NO: 369730 - DNA, 20 bp, Artificial
  CRISPR gRNA sequence
agaggaatgaattttcatgt

SEQ ID NO: 369731 - DNA, 20 bp, Artificial
  CRISPR gRNA sequence
tgaattttcatgtaagtaaa

SEQ ID NO: 369732 - DNA, 20 bp, Artificial
  CRISPR gRNA sequence
gaattttcatgtaagtaaaa

SEQ ID NO: 369733 - DNA, 20 bp, Artificial
  CRISPR gRNA sequence
attttcatgtaagtaaaaag

SEQ ID NO: 369734 - DNA, 20 bp, Artificial
  CRISPR gRNA sequence
ttcatgtaagtaaaaaggag

SEQ ID NO: 369735 - DNA, 20 bp, Artificial
  CRISPR gRNA sequence
aagtaaaaaggagaagtgtc

SEQ ID NO: 369736 - DNA, 20 bp, Artificial
  CRISPR gRNA sequence
agttttcttatataaaaatg

SEQ ID NO: 369737 - DNA, 20 bp, Artificial
  CRISPR gRNA sequence
aaatgaagaaatgaatgcat

SEQ ID NO: 369738 - DNA, 20 bp, Artificial
  CRISPR gRNA sequence
gaagaaatgaatgcattggt

SEQ ID NO: 369739 - DNA, 20 bp, Artificial
  CRISPR gRNA sequence
aagaaatgaatgcattggtg

SEQ ID NO: 369740 - DNA, 20 bp, Artificial
  CRISPR gRNA sequence
gaatgcattggtgaggcaat

SEQ ID NO: 369741 - DNA, 20 bp, Artificial
  CRISPR gRNA sequence
tctatattataaactccatg

SEQ ID NO: 369742 - DNA, 20 bp, Artificial
  CRISPR gRNA sequence
gtttttatcttgtatataaa

SEQ ID NO: 369743 - DNA, 20 bp, Artificial
  CRISPR gRNA sequence
tgtatataaatggacatttc

SEQ ID NO: 369744 - DNA, 20 bp, Artificial
  CRISPR gRNA sequence
gtatataaatggacatttca

SEQ ID NO: 369745 - DNA, 20 bp, Artificial
  CRISPR gRNA sequence
tataaatggacatttcaagg

SEQ ID NO: 369746 - DNA, 20 bp, Artificial
  CRISPR gRNA sequence
aaatggacatttcaaggcag

SEQ ID NO: 369747 - DNA, 20 bp, Artificial
  CRISPR gRNA sequence
aatggacatttcaaggcagt

SEQ ID NO: 369748 - DNA, 20 bp, Artificial
  CRISPR gRNA sequence
atggacatttcaaggcagta

SEQ ID NO: 369749 - DNA, 20 bp, Artificial
  CRISPR gRNA sequence
tggacatttcaaggcagtag

SEQ ID NO: 369750 - DNA, 20 bp, Artificial
  CRISPR gRNA sequence
catttcaaggcagtagggga

SEQ ID NO: 369751 - DNA, 20 bp, Artificial
  CRISPR gRNA sequence
agtaggggatggattttcta

SEQ ID NO: 369752 - DNA, 20 bp, Artificial
  CRISPR gRNA sequence
aattcctgtttcataatgtg

SEQ ID NO: 369753 - DNA, 20 bp, Artificial
  CRISPR gRNA sequence
gtttcataatgtgaagaaca

SEQ ID NO: 369754 - DNA, 20 bp, Artificial
  CRISPR gRNA sequence
ttcataatgtgaagaacaaa

SEQ ID NO: 369755 - DNA, 20 bp, Artificial
  CRISPR gRNA sequence
gtgaagaacaaagagacctc

SEQ ID NO: 369756 - DNA, 20 bp, Artificial
  CRISPR gRNA sequence
gacctctagtctttttatca

SEQ ID NO: 369757 - DNA, 20 bp, Artificial
  CRISPR gRNA sequence
agtctttttatcaaagcaaa

SEQ ID NO: 369758 - DNA, 20 bp, Artificial
  CRISPR gRNA sequence
ctttttatcaaagcaaatgg

SEQ ID NO: 369759 - DNA, 20 bp, Artificial
  CRISPR gRNA sequence
tttatcaaagcaaatggaag

SEQ ID NO: 369760 - DNA, 20 bp, Artificial
  CRISPR gRNA sequence
tatcaaagcaaatggaagta

SEQ ID NO: 369761 - DNA, 20 bp, Artificial
  CRISPR gRNA sequence
caaagcaaatggaagtagag

SEQ ID NO: 369762 - DNA, 20 bp, Artificial
  CRISPR gRNA sequence
gcaaatggaagtagagaagt

SEQ ID NO: 369763 - DNA, 20 bp, Artificial
  CRISPR gRNA sequence
ttcatttgtaatatcttccc

SEQ ID NO: 369764 - DNA, 20 bp, Artificial
  CRISPR gRNA sequence
tcatttgtaatatcttcccc

SEQ ID NO: 369765 - DNA, 20 bp, Artificial
  CRISPR gRNA sequence
ttgtaatatcttccccagga

SEQ ID NO: 369766 - DNA, 20 bp, Artificial
  CRISPR gRNA sequence
atatcttccccaggaaagca

SEQ ID NO: 369767 - DNA, 20 bp, Artificial
  CRISPR gRNA sequence
tcttccccaggaaagcaaag

SEQ ID NO: 369768 - DNA, 20 bp, Artificial
  CRISPR gRNA sequence
agcagtttaaaaaatatctt

SEQ ID NO: 369769 - DNA, 20 bp, Artificial
  CRISPR gRNA sequence
gtttttcctgtttctatttt

SEQ ID NO: 369770 - DNA, 20 bp, Artificial
  CRISPR gRNA sequence
tttttcctgtttctattttt

SEQ ID NO: 369771 - DNA, 20 bp, Artificial
  CRISPR gRNA sequence
ctgtttctatttttgggttt

SEQ ID NO: 369772 - DNA, 20 bp, Artificial
  CRISPR gRNA sequence
tttttgggtttgagcctgtg

SEQ ID NO: 369773 - DNA, 20 bp, Artificial
  CRISPR gRNA sequence
tttgggtttgagcctgtgta

SEQ ID NO: 369774 - DNA, 20 bp, Artificial
  CRISPR gRNA sequence
tgggtttgagcctgtgtaga

SEQ ID NO: 369775 - DNA, 20 bp, Artificial
  CRISPR gRNA sequence
cctgtgtagagagtgacaac

SEQ ID NO: 369776 - DNA, 20 bp, Artificial
  CRISPR gRNA sequence
ctgtgtagagagtgacaaca

SEQ ID NO: 369777 - DNA, 20 bp, Artificial
  CRISPR gRNA sequence
gtagagagtgacaacaaggc

SEQ ID NO: 369778 - DNA, 20 bp, Artificial
  CRISPR gRNA sequence
tagagagtgacaacaaggct

SEQ ID NO: 369779 - DNA, 20 bp, Artificial
  CRISPR gRNA sequence
agtgacaacaaggctaggca

SEQ ID NO: 369780 - DNA, 20 bp, Artificial
  CRISPR gRNA sequence
gacaacaaggctaggcatgg

SEQ ID NO: 369781 - DNA, 20 bp, Artificial
  CRISPR gRNA sequence
gtggctcacacctgtaatcc

SEQ ID NO: 369782 - DNA, 20 bp, Artificial
  CRISPR gRNA sequence
cacctgtaatcccagcactt

SEQ ID NO: 369783 - DNA, 20 bp, Artificial
  CRISPR gRNA sequence
acctgtaatcccagcacttt

SEQ ID NO: 369784 - DNA, 20 bp, Artificial
  CRISPR gRNA sequence
ctgtaatcccagcactttgg

SEQ ID NO: 369785 - DNA, 20 bp, Artificial
  CRISPR gRNA sequence
tgtaatcccagcactttggg

SEQ ID NO: 369786 - DNA, 20 bp, Artificial
  CRISPR gRNA sequence
tcccagcactttgggaggct

SEQ ID NO: 369787 - DNA, 20 bp, Artificial
  CRISPR gRNA sequence
cccagcactttgggaggctg

SEQ ID NO: 369788 - DNA, 20 bp, Artificial
  CRISPR gRNA sequence
agcactttgggaggctgagg

SEQ ID NO: 369789 - DNA, 20 bp, Artificial
  CRISPR gRNA sequence
gcactttgggaggctgaggc

SEQ ID NO: 369790 - DNA, 20 bp, Artificial
  CRISPR gRNA sequence
ctttgggaggctgaggcagg

SEQ ID NO: 369791 - DNA, 20 bp, Artificial
  CRISPR gRNA sequence
gcaggcagatcccttgatcc

SEQ ID NO: 369792 - DNA, 20 bp, Artificial
  CRISPR gRNA sequence
aggcagatcccttgatccta

SEQ ID NO: 369793 - DNA, 20 bp, Artificial
  CRISPR gRNA sequence
atcccttgatcctagagttc

SEQ ID NO: 369794 - DNA, 20 bp, Artificial
  CRISPR gRNA sequence
ttgatcctagagttcgagac

SEQ ID NO: 369795 - DNA, 20 bp, Artificial
  CRISPR gRNA sequence
cctagagttcgagaccagcc

SEQ ID NO: 369796 - DNA, 20 bp, Artificial
  CRISPR gRNA sequence
ctagagttcgagaccagcct

SEQ ID NO: 369797 - DNA, 20 bp, Artificial
  CRISPR gRNA sequence
cgagaccagcctgggcaact

SEQ ID NO: 369798 - DNA, 20 bp, Artificial
  CRISPR gRNA sequence
ctacaaaaaaatataaaaat

SEQ ID NO: 369799 - DNA, 20 bp, Artificial
  CRISPR gRNA sequence
aaaaaatataaaaattagct

SEQ ID NO: 369800 - DNA, 20 bp, Artificial
  CRISPR gRNA sequence
atataaaaattagctgagtg

SEQ ID NO: 369801 - DNA, 20 bp, Artificial
  CRISPR gRNA sequence
taaaaattagctgagtgtgg

SEQ ID NO: 369802 - DNA, 20 bp, Artificial
  CRISPR gRNA sequence
gtggcacatgtctgttgtcc

SEQ ID NO: 369803 - DNA, 20 bp, Artificial
  CRISPR gRNA sequence
tgtctgttgtcccagctact

SEQ ID NO: 369804 - DNA, 20 bp, Artificial
  CRISPR gRNA sequence
gtctgttgtcccagctactt

SEQ ID NO: 369805 - DNA, 20 bp, Artificial
  CRISPR gRNA sequence
ctgttgtcccagctacttag

SEQ ID NO: 369806 - DNA, 20 bp, Artificial
  CRISPR gRNA sequence
tgttgtcccagctacttagg

SEQ ID NO: 369807 - DNA, 20 bp, Artificial
  CRISPR gRNA sequence
tcccagctacttaggaggct

SEQ ID NO: 369808 - DNA, 20 bp, Artificial
  CRISPR gRNA sequence
cccagctacttaggaggctg

SEQ ID NO: 369809 - DNA, 20 bp, Artificial
  CRISPR gRNA sequence
agctacttaggaggctgagg

SEQ ID NO: 369810 - DNA, 20 bp, Artificial
  CRISPR gRNA sequence
gctacttaggaggctgaggt

SEQ ID NO: 369811 - DNA, 20 bp, Artificial
  CRISPR gRNA sequence
aggaggctgaggtgggatga

SEQ ID NO: 369812 - DNA, 20 bp, Artificial
  CRISPR gRNA sequence
ggatgatggtttgatcctga

SEQ ID NO: 369813 - DNA, 20 bp, Artificial
  CRISPR gRNA sequence
gatgatggtttgatcctgaa

SEQ ID NO: 369814 - DNA, 20 bp, Artificial
  CRISPR gRNA sequence
atggtttgatcctgaaaggt

SEQ ID NO: 369815 - DNA, 20 bp, Artificial
  CRISPR gRNA sequence
tggtttgatcctgaaaggtc

SEQ ID NO: 369816 - DNA, 20 bp, Artificial
  CRISPR gRNA sequence
ggtttgatcctgaaaggtcg

SEQ ID NO: 369817 - DNA, 20 bp, Artificial
  CRISPR gRNA sequence
atcctgaaaggtcggggctt

SEQ ID NO: 369818 - DNA, 20 bp, Artificial
  CRISPR gRNA sequence
cagtgacctgtgattgctca

SEQ ID NO: 369819 - DNA, 20 bp, Artificial
  CRISPR gRNA sequence
agtgacctgtgattgctcat

SEQ ID NO: 369820 - DNA, 20 bp, Artificial
  CRISPR gRNA sequence
ctgtgattgctcatgggcaa

SEQ ID NO: 369821 - DNA, 20 bp, Artificial
  CRISPR gRNA sequence
gtgattgctcatgggcaata

SEQ ID NO: 369822 - DNA, 20 bp, Artificial
  CRISPR gRNA sequence
ttgctcatgggcaatagagc

SEQ ID NO: 369823 - DNA, 20 bp, Artificial
  CRISPR gRNA sequence
atagagcgagaccttgtctt

SEQ ID NO: 369824 - DNA, 20 bp, Artificial
  CRISPR gRNA sequence
ctttggaaaaaaaaaaaaaa

SEQ ID NO: 369825 - DNA, 20 bp, Artificial
  CRISPR gRNA sequence
ttggaaaaaaaaaaaaaaaa

SEQ ID NO: 369826 - DNA, 20 bp, Artificial
  CRISPR gRNA sequence
aaaaaaaagagtgacaacaa

SEQ ID NO: 369827 - DNA, 20 bp, Artificial
  CRISPR gRNA sequence
aaaaagagtgacaacaaaag

SEQ ID NO: 369828 - DNA, 20 bp, Artificial
  CRISPR gRNA sequence
gtgacaacaaaagtagatga

SEQ ID NO: 369829 - DNA, 20 bp, Artificial
  CRISPR gRNA sequence
caacaaaagtagatgaaagt

SEQ ID NO: 369830 - DNA, 20 bp, Artificial
  CRISPR gRNA sequence
acaaaagtagatgaaagtaa

SEQ ID NO: 369831 - DNA, 20 bp, Artificial
  CRISPR gRNA sequence
caaaagtagatgaaagtaag

SEQ ID NO: 369832 - DNA, 20 bp, Artificial
  CRISPR gRNA sequence
aggataactcatgcttctta

SEQ ID NO: 369833 - DNA, 20 bp, Artificial
  CRISPR gRNA sequence
tcatttaaaaaatcctcatt

SEQ ID NO: 369834 - DNA, 20 bp, Artificial
  CRISPR gRNA sequence
aaaaatcctcattcggtgtt

SEQ ID NO: 369835 - DNA, 20 bp, Artificial
  CRISPR gRNA sequence
attcggtgtttggtactgtt

SEQ ID NO: 369836 - DNA, 20 bp, Artificial
  CRISPR gRNA sequence
gttcagtaaatcacatctct

SEQ ID NO: 369837 - DNA, 20 bp, Artificial
  CRISPR gRNA sequence
taaatcacatctcttggtac

SEQ ID NO: 369838 - DNA, 20 bp, Artificial
  CRISPR gRNA sequence
tggtactagtatttatgact

SEQ ID NO: 369839 - DNA, 20 bp, Artificial
  CRISPR gRNA sequence
tgataaacaatttgccttgt

SEQ ID NO: 369840 - DNA, 20 bp, Artificial
  CRISPR gRNA sequence
cttgtcagacttaataaccc

SEQ ID NO: 369841 - DNA, 20 bp, Artificial
  CRISPR gRNA sequence
taaccctggcctgcattgtt

SEQ ID NO: 369842 - DNA, 20 bp, Artificial
  CRISPR gRNA sequence
cctgcattgttcagcgaaat

SEQ ID NO: 369843 - DNA, 20 bp, Artificial
  CRISPR gRNA sequence
agatgaaaatgtgctttgcc

SEQ ID NO: 369844 - DNA, 20 bp, Artificial
  CRISPR gRNA sequence
gcctggtgccatttacttca

SEQ ID NO: 369845 - DNA, 20 bp, Artificial
  CRISPR gRNA sequence
ggtgccatttacttcacaga

SEQ ID NO: 369846 - DNA, 20 bp, Artificial
  CRISPR gRNA sequence
gatattatgttttgtctctt

SEQ ID NO: 369847 - DNA, 20 bp, Artificial
  CRISPR gRNA sequence
atttatttactcttaaaatt

SEQ ID NO: 369848 - DNA, 20 bp, Artificial
  CRISPR gRNA sequence
tttatttactcttaaaattt

SEQ ID NO: 369849 - DNA, 20 bp, Artificial
  CRISPR gRNA sequence
ttaggtaatctccttgcctt

SEQ ID NO: 369850 - DNA, 20 bp, Artificial
  CRISPR gRNA sequence
ctccttgccttcagttcttt

SEQ ID NO: 369851 - DNA, 20 bp, Artificial
  CRISPR gRNA sequence
ttgccttcagttctttcaga

SEQ ID NO: 369852 - DNA, 20 bp, Artificial
  CRISPR gRNA sequence
ccttcagttctttcagaaag

SEQ ID NO: 369853 - DNA, 20 bp, Artificial
  CRISPR gRNA sequence
tattcactttcttttgatac

SEQ ID NO: 369854 - DNA, 20 bp, Artificial
  CRISPR gRNA sequence
ttgatactagacattgtttg

SEQ ID NO: 369855 - DNA, 20 bp, Artificial
  CRISPR gRNA sequence
gatactagacattgtttgaa

SEQ ID NO: 369856 - DNA, 20 bp, Artificial
  CRISPR gRNA sequence
gaagagttttgtctacttcc

SEQ ID NO: 369857 - DNA, 20 bp, Artificial
  CRISPR gRNA sequence
ggatgatcctttaaatatta

SEQ ID NO: 369858 - DNA, 20 bp, Artificial
  CRISPR gRNA sequence
atattatggtgaaaatgaaa

SEQ ID NO: 369859 - DNA, 20 bp, Artificial
  CRISPR gRNA sequence
tcttatgtgataaatttcct

SEQ ID NO: 369860 - DNA, 20 bp, Artificial
  CRISPR gRNA sequence
gtgataaatttccttggttc

SEQ ID NO: 369861 - DNA, 20 bp, Artificial
  CRISPR gRNA sequence
gacttcttttgacaatattt

SEQ ID NO: 369862 - DNA, 20 bp, Artificial
  CRISPR gRNA sequence
atattttagatatttttttg

SEQ ID NO: 369863 - DNA, 20 bp, Artificial
  CRISPR gRNA sequence
tttttttgtagctatgtaaa

SEQ ID NO: 369864 - DNA, 20 bp, Artificial
  CRISPR gRNA sequence
tttgtagctatgtaaacggt

SEQ ID NO: 369865 - DNA, 20 bp, Artificial
  CRISPR gRNA sequence
ttccttcctatgtttgaaaa

SEQ ID NO: 369866 - DNA, 20 bp, Artificial
  CRISPR gRNA sequence
gtttgaaaaaagctccctga

SEQ ID NO: 369867 - DNA, 20 bp, Artificial
  CRISPR gRNA sequence
aagctccctgacagcgtttc

SEQ ID NO: 369868 - DNA, 20 bp, Artificial
  CRISPR gRNA sequence
tctggaatgtttaaattgcc

SEQ ID NO: 369869 - DNA, 20 bp, Artificial
  CRISPR gRNA sequence
ctggaatgtttaaattgcct

SEQ ID NO: 369870 - DNA, 20 bp, Artificial
  CRISPR gRNA sequence
gttgctccgttatttttctt

SEQ ID NO: 369871 - DNA, 20 bp, Artificial
  CRISPR gRNA sequence
ccgttatttttcttcagttt

SEQ ID NO: 369872 - DNA, 20 bp, Artificial
  CRISPR gRNA sequence
tttcttcagtttgagcatta

SEQ ID NO: 369873 - DNA, 20 bp, Artificial
  CRISPR gRNA sequence
cagtttgagcattatggaaa

SEQ ID NO: 369874 - DNA, 20 bp, Artificial
  CRISPR gRNA sequence
gtttgagcattatggaaaca

SEQ ID NO: 369875 - DNA, 20 bp, Artificial
  CRISPR gRNA sequence
ttgagcattatggaaacaga

SEQ ID NO: 369876 - DNA, 20 bp, Artificial
  CRISPR gRNA sequence
tgagcattatggaaacagag

SEQ ID NO: 369877 - DNA, 20 bp, Artificial
  CRISPR gRNA sequence
ggaaacagagaggccacaac

SEQ ID NO: 369878 - DNA, 20 bp, Artificial
  CRISPR gRNA sequence
gagaggccacaaccagttct

SEQ ID NO: 369879 - DNA, 20 bp, Artificial
  CRISPR gRNA sequence
accagttcttggttatcctt

SEQ ID NO: 369880 - DNA, 20 bp, Artificial
  CRISPR gRNA sequence
ttggttatccttgagaaacg

SEQ ID NO: 369881 - DNA, 20 bp, Artificial
  CRISPR gRNA sequence
gttatccttgagaaacgaag

SEQ ID NO: 369882 - DNA, 20 bp, Artificial
  CRISPR gRNA sequence
tgagaaacgaagtggcaaat

SEQ ID NO: 369883 - DNA, 20 bp, Artificial
  CRISPR gRNA sequence
aacgaagtggcaaattagct

SEQ ID NO: 369884 - DNA, 20 bp, Artificial
  CRISPR gRNA sequence
aaattagctgagataatatc

SEQ ID NO: 369885 - DNA, 20 bp, Artificial
  CRISPR gRNA sequence
agataatatccagtactcat

SEQ ID NO: 369886 - DNA, 20 bp, Artificial
  CRISPR gRNA sequence
tatccagtactcattggacg

SEQ ID NO: 369887 - DNA, 20 bp, Artificial
  CRISPR gRNA sequence
ctcattggacgcagtgcttg

SEQ ID NO: 369888 - DNA, 20 bp, Artificial
  CRISPR gRNA sequence
gtccgaacattttctgttta

SEQ ID NO: 369889 - DNA, 20 bp, Artificial
  CRISPR gRNA sequence
taaagtgttaacctttttct

SEQ ID NO: 369890 - DNA, 20 bp, Artificial
  CRISPR gRNA sequence
gtttgccatttatttccttt

SEQ ID NO: 369891 - DNA, 20 bp, Artificial
  CRISPR gRNA sequence
tcggctcttttttcttcatt

SEQ ID NO: 369892 - DNA, 20 bp, Artificial
  CRISPR gRNA sequence
ttttttcttcatttggctgc

SEQ ID NO: 369893 - DNA, 20 bp, Artificial
  CRISPR gRNA sequence
tttttcttcatttggctgcc

SEQ ID NO: 369894 - DNA, 20 bp, Artificial
  CRISPR gRNA sequence
catttggctgccaggtcctc

SEQ ID NO: 369895 - DNA, 20 bp, Artificial
  CRISPR gRNA sequence
ttggctgccaggtcctctgg

SEQ ID NO: 369896 - DNA, 20 bp, Artificial
  CRISPR gRNA sequence
cttcttcatctttccatttc

SEQ ID NO: 369897 - DNA, 20 bp, Artificial
  CRISPR gRNA sequence
ttcttcatctttccatttct

SEQ ID NO: 369898 - DNA, 20 bp, Artificial
  CRISPR gRNA sequence
atctttccatttctaggcct

SEQ ID NO: 369899 - DNA, 20 bp, Artificial
  CRISPR gRNA sequence
tctttccatttctaggcctt

SEQ ID NO: 369900 - DNA, 20 bp, Artificial
  CRISPR gRNA sequence
tttccatttctaggccttgg

SEQ ID NO: 369901 - DNA, 20 bp, Artificial
  CRISPR gRNA sequence
ttccatttctaggccttggg

SEQ ID NO: 369902 - DNA, 20 bp, Artificial
  CRISPR gRNA sequence
tccatttctaggccttggga

SEQ ID NO: 369903 - DNA, 20 bp, Artificial
  CRISPR gRNA sequence
ctaggccttgggagggccca

SEQ ID NO: 369904 - DNA, 20 bp, Artificial
  CRISPR gRNA sequence
attgcatcccatgtctgtat

SEQ ID NO: 369905 - DNA, 20 bp, Artificial
  CRISPR gRNA sequence
atcccatgtctgtatcagtg

SEQ ID NO: 369906 - DNA, 20 bp, Artificial
  CRISPR gRNA sequence
tatcagtgcagcaacaatct

SEQ ID NO: 369907 - DNA, 20 bp, Artificial
  CRISPR gRNA sequence
aacaatctcagcccttcctg

SEQ ID NO: 369908 - DNA, 20 bp, Artificial
  CRISPR gRNA sequence
agcccttcctgaagtatcac

SEQ ID NO: 369909 - DNA, 20 bp, Artificial
  CRISPR gRNA sequence
actagcctgccccacacatt

SEQ ID NO: 369910 - DNA, 20 bp, Artificial
  CRISPR gRNA sequence
attcagtccacgaaattata

SEQ ID NO: 369911 - DNA, 20 bp, Artificial
  CRISPR gRNA sequence
gaaattatacagatgcgtat

SEQ ID NO: 369912 - DNA, 20 bp, Artificial
  CRISPR gRNA sequence
aaattatacagatgcgtatt

SEQ ID NO: 369913 - DNA, 20 bp, Artificial
  CRISPR gRNA sequence
tacagatgcgtattgggcaa

SEQ ID NO: 369914 - DNA, 20 bp, Artificial
  CRISPR gRNA sequence
atgcgtattgggcaacagtc

SEQ ID NO: 369915 - DNA, 20 bp, Artificial
  CRISPR gRNA sequence
tgcgtattgggcaacagtcc

SEQ ID NO: 369916 - DNA, 20 bp, Artificial
  CRISPR gRNA sequence
ccatgactcccctatttgca

SEQ ID NO: 369917 - DNA, 20 bp, Artificial
  CRISPR gRNA sequence
catgactcccctatttgcac

SEQ ID NO: 369918 - DNA, 20 bp, Artificial
  CRISPR gRNA sequence
atgactcccctatttgcaca

SEQ ID NO: 369919 - DNA, 20 bp, Artificial
  CRISPR gRNA sequence
tgactcccctatttgcacag

SEQ ID NO: 369920 - DNA, 20 bp, Artificial
  CRISPR gRNA sequence
atttgcacaggggtgtctat

SEQ ID NO: 369921 - DNA, 20 bp, Artificial
  CRISPR gRNA sequence
aggggtgtctataagtgccc

SEQ ID NO: 369922 - DNA, 20 bp, Artificial
  CRISPR gRNA sequence
gtgccctggatgcctgctga

SEQ ID NO: 369923 - DNA, 20 bp, Artificial
  CRISPR gRNA sequence
tggatgcctgctgatggctg

SEQ ID NO: 369924 - DNA, 20 bp, Artificial
  CRISPR gRNA sequence
gatggctgtggctctgctcc

SEQ ID NO: 369925 - DNA, 20 bp, Artificial
  CRISPR gRNA sequence
ctgtggctctgctccaagtc

SEQ ID NO: 369926 - DNA, 20 bp, Artificial
  CRISPR gRNA sequence
tcaagacattgctctctatc

SEQ ID NO: 369927 - DNA, 20 bp, Artificial
  CRISPR gRNA sequence
tttcctactgtgtccctgca

SEQ ID NO: 369928 - DNA, 20 bp, Artificial
  CRISPR gRNA sequence
tcctactgtgtccctgcaca

SEQ ID NO: 369929 - DNA, 20 bp, Artificial
  CRISPR gRNA sequence
gtgtccctgcacagagctca

SEQ ID NO: 369930 - DNA, 20 bp, Artificial
  CRISPR gRNA sequence
ttacattgtaaacatctgtt

SEQ ID NO: 369931 - DNA, 20 bp, Artificial
  CRISPR gRNA sequence
taaacatctgtttagtttta

SEQ ID NO: 369932 - DNA, 20 bp, Artificial
  CRISPR gRNA sequence
tagttttatggcttccttat

SEQ ID NO: 369933 - DNA, 20 bp, Artificial
  CRISPR gRNA sequence
tggcttccttattagttcct

SEQ ID NO: 369934 - DNA, 20 bp, Artificial
  CRISPR gRNA sequence
tattagttcctaagccctgt

SEQ ID NO: 369935 - DNA, 20 bp, Artificial
  CRISPR gRNA sequence
attagttcctaagccctgtg

SEQ ID NO: 369936 - DNA, 20 bp, Artificial
  CRISPR gRNA sequence
tcctaagccctgtgaggacc

SEQ ID NO: 369937 - DNA, 20 bp, Artificial
  CRISPR gRNA sequence
tgaggaccgagaccatgcct

SEQ ID NO: 369938 - DNA, 20 bp, Artificial
  CRISPR gRNA sequence
gaggaccgagaccatgcctg

SEQ ID NO: 369939 - DNA, 20 bp, Artificial
  CRISPR gRNA sequence
attatccactctatccttaa

SEQ ID NO: 369940 - DNA, 20 bp, Artificial
  CRISPR gRNA sequence
ttttaattaatttatttttt

SEQ ID NO: 369941 - DNA, 20 bp, Artificial
  CRISPR gRNA sequence
aattaatttattttttgaga

SEQ ID NO: 369942 - DNA, 20 bp, Artificial
  CRISPR gRNA sequence
ttaatttattttttgagaca

SEQ ID NO: 369943 - DNA, 20 bp, Artificial
  CRISPR gRNA sequence
agagtcccactctgtcacca

SEQ ID NO: 369944 - DNA, 20 bp, Artificial
  CRISPR gRNA sequence
tcccactctgtcaccaaagc

SEQ ID NO: 369945 - DNA, 20 bp, Artificial
  CRISPR gRNA sequence
ccactctgtcaccaaagctg

SEQ ID NO: 369946 - DNA, 20 bp, Artificial
  CRISPR gRNA sequence
tcaccaaagctggagtgcaa

SEQ ID NO: 369947 - DNA, 20 bp, Artificial
  CRISPR gRNA sequence
ggagtgcaatggcacaatct

SEQ ID NO: 369948 - DNA, 20 bp, Artificial
  CRISPR gRNA sequence
caccgcaacctccacctgcc

SEQ ID NO: 369949 - DNA, 20 bp, Artificial
  CRISPR gRNA sequence
aacctccacctgccaagttc

SEQ ID NO: 369950 - DNA, 20 bp, Artificial
  CRISPR gRNA sequence
ttcaagtgattcttctgcct

SEQ ID NO: 369951 - DNA, 20 bp, Artificial
  CRISPR gRNA sequence
ttcttctgcctcagcctccc

SEQ ID NO: 369952 - DNA, 20 bp, Artificial
  CRISPR gRNA sequence
ttctgcctcagcctcccaag

SEQ ID NO: 369953 - DNA, 20 bp, Artificial
  CRISPR gRNA sequence
gcctcagcctcccaagtagc

SEQ ID NO: 369954 - DNA, 20 bp, Artificial
  CRISPR gRNA sequence
cctcagcctcccaagtagct

SEQ ID NO: 369955 - DNA, 20 bp, Artificial
  CRISPR gRNA sequence
ctcccaagtagctgggatta

SEQ ID NO: 369956 - DNA, 20 bp, Artificial
  CRISPR gRNA sequence
tcccaagtagctgggattac

SEQ ID NO: 369957 - DNA, 20 bp, Artificial
  CRISPR gRNA sequence
caggtgcctgccaccacacc

SEQ ID NO: 369958 - DNA, 20 bp, Artificial
  CRISPR gRNA sequence
taattttatttttgtatttt

SEQ ID NO: 369959 - DNA, 20 bp, Artificial
  CRISPR gRNA sequence
ttttatttttgtatttttag

SEQ ID NO: 369960 - DNA, 20 bp, Artificial
  CRISPR gRNA sequence
ttttgtatttttagtagtga

SEQ ID NO: 369961 - DNA, 20 bp, Artificial
  CRISPR gRNA sequence
tttgtatttttagtagtgat

SEQ ID NO: 369962 - DNA, 20 bp, Artificial
  CRISPR gRNA sequence
ttgtatttttagtagtgatg

SEQ ID NO: 369963 - DNA, 20 bp, Artificial
  CRISPR gRNA sequence
gtgatggggtttcatgatgt

SEQ ID NO: 369964 - DNA, 20 bp, Artificial
  CRISPR gRNA sequence
tggggtttcatgatgttggc

SEQ ID NO: 369965 - DNA, 20 bp, Artificial
  CRISPR gRNA sequence
ggggtttcatgatgttggcc

SEQ ID NO: 369966 - DNA, 20 bp, Artificial
  CRISPR gRNA sequence
tttcatgatgttggccaggc

SEQ ID NO: 369967 - DNA, 20 bp, Artificial
  CRISPR gRNA sequence
tggtctcaaactcctgacct

SEQ ID NO: 369968 - DNA, 20 bp, Artificial
  CRISPR gRNA sequence
ggtctcaaactcctgacctc

SEQ ID NO: 369969 - DNA, 20 bp, Artificial
  CRISPR gRNA sequence
ctcaggtgatccacctgcct

SEQ ID NO: 369970 - DNA, 20 bp, Artificial
  CRISPR gRNA sequence
ccacctgcctcggcctccca

SEQ ID NO: 369971 - DNA, 20 bp, Artificial
  CRISPR gRNA sequence
gcctcggcctcccaaagtgc

SEQ ID NO: 369972 - DNA, 20 bp, Artificial
  CRISPR gRNA sequence
cctcggcctcccaaagtgct

SEQ ID NO: 369973 - DNA, 20 bp, Artificial
  CRISPR gRNA sequence
ctcccaaagtgctgggatta

SEQ ID NO: 369974 - DNA, 20 bp, Artificial
  CRISPR gRNA sequence
tcccaaagtgctgggattac

SEQ ID NO: 369975 - DNA, 20 bp, Artificial
  CRISPR gRNA sequence
agtgctgggattacaggcgt

SEQ ID NO: 369976 - DNA, 20 bp, Artificial
  CRISPR gRNA sequence
caggcgtgagccaccgtgcc

SEQ ID NO: 369977 - DNA, 20 bp, Artificial
  CRISPR gRNA sequence
gccaccgtgcctggccctaa

SEQ ID NO: 369978 - DNA, 20 bp, Artificial
  CRISPR gRNA sequence
cctggccctaatagcttctt

SEQ ID NO: 369979 - DNA, 20 bp, Artificial
  CRISPR gRNA sequence
ctttagtacttctcatgtac

SEQ ID NO: 369980 - DNA, 20 bp, Artificial
  CRISPR gRNA sequence
tttagtacttctcatgtact

SEQ ID NO: 369981 - DNA, 20 bp, Artificial
  CRISPR gRNA sequence
ttgaactgaatttgtaattg

SEQ ID NO: 369982 - DNA, 20 bp, Artificial
  CRISPR gRNA sequence
aactgaatttgtaattgaag

SEQ ID NO: 369983 - DNA, 20 bp, Artificial
  CRISPR gRNA sequence
actgaatttgtaattgaagt

SEQ ID NO: 369984 - DNA, 20 bp, Artificial
  CRISPR gRNA sequence
aagtaggtgactctttttgt

SEQ ID NO: 369985 - DNA, 20 bp, Artificial
  CRISPR gRNA sequence
actctttttgtaagctcttt

SEQ ID NO: 369986 - DNA, 20 bp, Artificial
  CRISPR gRNA sequence
ctctttttgtaagctctttc

SEQ ID NO: 369987 - DNA, 20 bp, Artificial
  CRISPR gRNA sequence
tctttttgtaagctctttca

SEQ ID NO: 369988 - DNA, 20 bp, Artificial
  CRISPR gRNA sequence
aagctctttcagggacgtga

SEQ ID NO: 369989 - DNA, 20 bp, Artificial
  CRISPR gRNA sequence
agctctttcagggacgtgat

SEQ ID NO: 369990 - DNA, 20 bp, Artificial
  CRISPR gRNA sequence
gcctcacacatattttacaa

SEQ ID NO: 369991 - DNA, 20 bp, Artificial
  CRISPR gRNA sequence
attttacaatagacccttaa

SEQ ID NO: 369992 - DNA, 20 bp, Artificial
  CRISPR gRNA sequence
ttacaatagacccttaaaag

SEQ ID NO: 369993 - DNA, 20 bp, Artificial
  CRISPR gRNA sequence
aaaagtagatttgtttaatt

SEQ ID NO: 369994 - DNA, 20 bp, Artificial
  CRISPR gRNA sequence
atgaactcacctccatgttg

SEQ ID NO: 369995 - DNA, 20 bp, Artificial
  CRISPR gRNA sequence
ctccatgttgaagactaaat

SEQ ID NO: 369996 - DNA, 20 bp, Artificial
  CRISPR gRNA sequence
gctgtgcccttctccttgct

SEQ ID NO: 369997 - DNA, 20 bp, Artificial
  CRISPR gRNA sequence
gcccttctccttgcttggtg

SEQ ID NO: 369998 - DNA, 20 bp, Artificial
  CRISPR gRNA sequence
ttctccttgcttggtgtggc

SEQ ID NO: 369999 - DNA, 20 bp, Artificial
  CRISPR gRNA sequence
ccttgcttggtgtggctggt

SEQ ID NO: 370000 - DNA, 20 bp, Artificial
  CRISPR gRNA sequence
cttgcttggtgtggctggtg

SEQ ID NO: 370001 - DNA, 20 bp, Artificial
  CRISPR gRNA sequence
ggcacaaatttaatctcata

SEQ ID NO: 370002 - DNA, 20 bp, Artificial
  CRISPR gRNA sequence
aatttaatctcatatggcct

SEQ ID NO: 370003 - DNA, 20 bp, Artificial
  CRISPR gRNA sequence
atttaatctcatatggcctt

SEQ ID NO: 370004 - DNA, 20 bp, Artificial
  CRISPR gRNA sequence
taatctcatatggccttggg

SEQ ID NO: 370005 - DNA, 20 bp, Artificial
  CRISPR gRNA sequence
aatctcatatggccttgggt

SEQ ID NO: 370006 - DNA, 20 bp, Artificial
  CRISPR gRNA sequence
ctcatatggccttgggtagg

SEQ ID NO: 370007 - DNA, 20 bp, Artificial
  CRISPR gRNA sequence
tcatatggccttgggtaggt

SEQ ID NO: 370008 - DNA, 20 bp, Artificial
  CRISPR gRNA sequence
tggccttgggtaggtgggtt

SEQ ID NO: 370009 - DNA, 20 bp, Artificial
  CRISPR gRNA sequence
ccttgggtaggtgggttcag

SEQ ID NO: 370010 - DNA, 20 bp, Artificial
  CRISPR gRNA sequence
cttgggtaggtgggttcagt

SEQ ID NO: 370011 - DNA, 20 bp, Artificial
  CRISPR gRNA sequence
gggtaggtgggttcagtggg

SEQ ID NO: 370012 - DNA, 20 bp, Artificial
  CRISPR gRNA sequence
tgggcagctgacttgttttc

SEQ ID NO: 370013 - DNA, 20 bp, Artificial
  CRISPR gRNA sequence
gggcagctgacttgttttca

SEQ ID NO: 370014 - DNA, 20 bp, Artificial
  CRISPR gRNA sequence
ctgacttgttttcaaggttt

SEQ ID NO: 370015 - DNA, 20 bp, Artificial
  CRISPR gRNA sequence
gacttgttttcaaggtttta

SEQ ID NO: 370016 - DNA, 20 bp, Artificial
  CRISPR gRNA sequence
tgttttcaaggttttagagc

SEQ ID NO: 370017 - DNA, 20 bp, Artificial
  CRISPR gRNA sequence
gttttcaaggttttagagcc

SEQ ID NO: 370018 - DNA, 20 bp, Artificial
  CRISPR gRNA sequence
ttttcaaggttttagagcca

SEQ ID NO: 370019 - DNA, 20 bp, Artificial
  CRISPR gRNA sequence
tttcaaggttttagagccag

SEQ ID NO: 370020 - DNA, 20 bp, Artificial
  CRISPR gRNA sequence
gttttagagccaggggctct

SEQ ID NO: 370021 - DNA, 20 bp, Artificial
  CRISPR gRNA sequence
aggggctcttggtcattata

SEQ ID NO: 370022 - DNA, 20 bp, Artificial
  CRISPR gRNA sequence
aaagctcttttgctcctctt

SEQ ID NO: 370023 - DNA, 20 bp, Artificial
  CRISPR gRNA sequence
agctcttttgctcctctttg

SEQ ID NO: 370024 - DNA, 20 bp, Artificial
  CRISPR gRNA sequence
aacttccctctgtgatctca

SEQ ID NO: 370025 - DNA, 20 bp, Artificial
  CRISPR gRNA sequence
tctcaaagcataatcaacaa

SEQ ID NO: 370026 - DNA, 20 bp, Artificial
  CRISPR gRNA sequence
agcataatcaacaatggatt

SEQ ID NO: 370027 - DNA, 20 bp, Artificial
  CRISPR gRNA sequence
atcaacaatggattaagtat

SEQ ID NO: 370028 - DNA, 20 bp, Artificial
  CRISPR gRNA sequence
acaatggattaagtattaga

SEQ ID NO: 370029 - DNA, 20 bp, Artificial
  CRISPR gRNA sequence
caatggattaagtattagac

SEQ ID NO: 370030 - DNA, 20 bp, Artificial
  CRISPR gRNA sequence
atggattaagtattagacag

SEQ ID NO: 370031 - DNA, 20 bp, Artificial
  CRISPR gRNA sequence
caatgactccccccttgtcc

SEQ ID NO: 370032 - DNA, 20 bp, Artificial
  CRISPR gRNA sequence
tgactccccccttgtccaag

SEQ ID NO: 370033 - DNA, 20 bp, Artificial
  CRISPR gRNA sequence
cttgtccaagaagctgtatg

SEQ ID NO: 370034 - DNA, 20 bp, Artificial
  CRISPR gRNA sequence
agaagctgtatgaagactta

SEQ ID NO: 370035 - DNA, 20 bp, Artificial
  CRISPR gRNA sequence
atatatttatacacataacg

SEQ ID NO: 370036 - DNA, 20 bp, Artificial
  CRISPR gRNA sequence
tatatttatacacataacgc

SEQ ID NO: 370037 - DNA, 20 bp, Artificial
  CRISPR gRNA sequence
cataacgcaggtcatacctg

SEQ ID NO: 370038 - DNA, 20 bp, Artificial
  CRISPR gRNA sequence
atacctgaagttcacaatga

SEQ ID NO: 370039 - DNA, 20 bp, Artificial
  CRISPR gRNA sequence
aagttcacaatgatagacga

SEQ ID NO: 370040 - DNA, 20 bp, Artificial
  CRISPR gRNA sequence
gatagacgaaagcacccatt

SEQ ID NO: 370041 - DNA, 20 bp, Artificial
  CRISPR gRNA sequence
acgaaagcacccatttggaa

SEQ ID NO: 370042 - DNA, 20 bp, Artificial
  CRISPR gRNA sequence
tatcaacttaactaaactga

SEQ ID NO: 370043 - DNA, 20 bp, Artificial
  CRISPR gRNA sequence
cagcgctaactcactaaaat

SEQ ID NO: 370044 - DNA, 20 bp, Artificial
  CRISPR gRNA sequence
agcgctaactcactaaaatc

SEQ ID NO: 370045 - DNA, 20 bp, Artificial
  CRISPR gRNA sequence
gctaactcactaaaatcagg

SEQ ID NO: 370046 - DNA, 20 bp, Artificial
  CRISPR gRNA sequence
ctaactcactaaaatcaggt

SEQ ID NO: 370047 - DNA, 20 bp, Artificial
  CRISPR gRNA sequence
aactcactaaaatcaggtag

SEQ ID NO: 370048 - DNA, 20 bp, Artificial
  CRISPR gRNA sequence
cctgtgctttatttttaaaa

SEQ ID NO: 370049 - DNA, 20 bp, Artificial
  CRISPR gRNA sequence
tttatttttaaaaaagtcaa

SEQ ID NO: 370050 - DNA, 20 bp, Artificial
  CRISPR gRNA sequence
aaaaaagtcaacagctgcac

SEQ ID NO: 370051 - DNA, 20 bp, Artificial
  CRISPR gRNA sequence
aaaagtcaacagctgcacaa

SEQ ID NO: 370052 - DNA, 20 bp, Artificial
  CRISPR gRNA sequence
aaagtcaacagctgcacaag

SEQ ID NO: 370053 - DNA, 20 bp, Artificial
  CRISPR gRNA sequence
gctgcacaagaggcatatct

SEQ ID NO: 370054 - DNA, 20 bp, Artificial
  CRISPR gRNA sequence
ctgcacaagaggcatatctt

SEQ ID NO: 370055 - DNA, 20 bp, Artificial
  CRISPR gRNA sequence
gcacaagaggcatatcttag

SEQ ID NO: 370056 - DNA, 20 bp, Artificial
  CRISPR gRNA sequence
caagaggcatatcttaggag

SEQ ID NO: 370057 - DNA, 20 bp, Artificial
  CRISPR gRNA sequence
taggagcagcactgtaaatg

SEQ ID NO: 370058 - DNA, 20 bp, Artificial
  CRISPR gRNA sequence
ggagcagcactgtaaatgaa

SEQ ID NO: 370059 - DNA, 20 bp, Artificial
  CRISPR gRNA sequence
gagcagcactgtaaatgaag

SEQ ID NO: 370060 - DNA, 20 bp, Artificial
  CRISPR gRNA sequence
tgtaaatgaagaggtgcata

SEQ ID NO: 370061 - DNA, 20 bp, Artificial
  CRISPR gRNA sequence
gtaaatgaagaggtgcatat

SEQ ID NO: 370062 - DNA, 20 bp, Artificial
  CRISPR gRNA sequence
gtgcatataggctaaaatat

SEQ ID NO: 370063 - DNA, 20 bp, Artificial
  CRISPR gRNA sequence
taggctaaaatatgagcata

SEQ ID NO: 370064 - DNA, 20 bp, Artificial
  CRISPR gRNA sequence
tgagcataaagtgcatgtgt

SEQ ID NO: 370065 - DNA, 20 bp, Artificial
  CRISPR gRNA sequence
gagcataaagtgcatgtgtt

SEQ ID NO: 370066 - DNA, 20 bp, Artificial
  CRISPR gRNA sequence
agcataaagtgcatgtgttg

SEQ ID NO: 370067 - DNA, 20 bp, Artificial
  CRISPR gRNA sequence
gcataaagtgcatgtgttgg

SEQ ID NO: 370068 - DNA, 20 bp, Artificial
  CRISPR gRNA sequence
cataaagtgcatgtgttggg

SEQ ID NO: 370069 - DNA, 20 bp, Artificial
  CRISPR gRNA sequence
ataaagtgcatgtgttgggg

SEQ ID NO: 370070 - DNA, 20 bp, Artificial
  CRISPR gRNA sequence
tgttgggggggtgtgtaacc

SEQ ID NO: 370071 - DNA, 20 bp, Artificial
  CRISPR gRNA sequence
gggggtgtgtaacctagctt

SEQ ID NO: 370072 - DNA, 20 bp, Artificial
  CRISPR gRNA sequence
ggggtgtgtaacctagcttg

SEQ ID NO: 370073 - DNA, 20 bp, Artificial
  CRISPR gRNA sequence
ggtgtgtaacctagcttgag

SEQ ID NO: 370074 - DNA, 20 bp, Artificial
  CRISPR gRNA sequence
gtgtgtaacctagcttgagg

SEQ ID NO: 370075 - DNA, 20 bp, Artificial
  CRISPR gRNA sequence
gtgtaacctagcttgaggag

SEQ ID NO: 370076 - DNA, 20 bp, Artificial
  CRISPR gRNA sequence
tgtaacctagcttgaggagg

SEQ ID NO: 370077 - DNA, 20 bp, Artificial
  CRISPR gRNA sequence
taacctagcttgaggaggag

SEQ ID NO: 370078 - DNA, 20 bp, Artificial
  CRISPR gRNA sequence
cttgaggaggaggagcaacc

SEQ ID NO: 370079 - DNA, 20 bp, Artificial
  CRISPR gRNA sequence
ttgaggaggaggagcaaccc

SEQ ID NO: 370080 - DNA, 20 bp, Artificial
  CRISPR gRNA sequence
ggaggaggagcaacccagga

SEQ ID NO: 370081 - DNA, 20 bp, Artificial
  CRISPR gRNA sequence
agcaacccaggaaagctcaa

SEQ ID NO: 370082 - DNA, 20 bp, Artificial
  CRISPR gRNA sequence
aacccaggaaagctcaatgg

SEQ ID NO: 370083 - DNA, 20 bp, Artificial
  CRISPR gRNA sequence
cccaggaaagctcaatggaa

SEQ ID NO: 370084 - DNA, 20 bp, Artificial
  CRISPR gRNA sequence
ccaggaaagctcaatggaag

SEQ ID NO: 370085 - DNA, 20 bp, Artificial
  CRISPR gRNA sequence
ggaaagctcaatggaagagg

SEQ ID NO: 370086 - DNA, 20 bp, Artificial
  CRISPR gRNA sequence
agctcaatggaagaggcaga

SEQ ID NO: 370087 - DNA, 20 bp, Artificial
  CRISPR gRNA sequence
tcaatggaagaggcagaaag

SEQ ID NO: 370088 - DNA, 20 bp, Artificial
  CRISPR gRNA sequence
atggaagaggcagaaagcag

SEQ ID NO: 370089 - DNA, 20 bp, Artificial
  CRISPR gRNA sequence
gaagaggcagaaagcagcag

SEQ ID NO: 370090 - DNA, 20 bp, Artificial
  CRISPR gRNA sequence
aagaggcagaaagcagcaga

SEQ ID NO: 370091 - DNA, 20 bp, Artificial
  CRISPR gRNA sequence
gaggcagaaagcagcagaag

SEQ ID NO: 370092 - DNA, 20 bp, Artificial
  CRISPR gRNA sequence
aggcagaaagcagcagaagg

SEQ ID NO: 370093 - DNA, 20 bp, Artificial
  CRISPR gRNA sequence
ggcagaaagcagcagaagga

SEQ ID NO: 370094 - DNA, 20 bp, Artificial
  CRISPR gRNA sequence
agaaagcagcagaaggaggg

SEQ ID NO: 370095 - DNA, 20 bp, Artificial
  CRISPR gRNA sequence
gaaagcagcagaaggaggga

SEQ ID NO: 370096 - DNA, 20 bp, Artificial
  CRISPR gRNA sequence
gcagcagaaggagggaagga

SEQ ID NO: 370097 - DNA, 20 bp, Artificial
  CRISPR gRNA sequence
cagaaggagggaaggaaaga

SEQ ID NO: 370098 - DNA, 20 bp, Artificial
  CRISPR gRNA sequence
gagggaaggaaagatggtgc

SEQ ID NO: 370099 - DNA, 20 bp, Artificial
  CRISPR gRNA sequence
agggaaggaaagatggtgct

SEQ ID NO: 370100 - DNA, 20 bp, Artificial
  CRISPR gRNA sequence
gggaaggaaagatggtgctg

SEQ ID NO: 370101 - DNA, 20 bp, Artificial
  CRISPR gRNA sequence
ggaaggaaagatggtgctgg

SEQ ID NO: 370102 - DNA, 20 bp, Artificial
  CRISPR gRNA sequence
aaggaaagatggtgctgggg

SEQ ID NO: 370103 - DNA, 20 bp, Artificial
  CRISPR gRNA sequence
aggaaagatggtgctggggg

SEQ ID NO: 370104 - DNA, 20 bp, Artificial
  CRISPR gRNA sequence
ggaaagatggtgctggggga

SEQ ID NO: 370105 - DNA, 20 bp, Artificial
  CRISPR gRNA sequence
aaagatggtgctgggggagg

SEQ ID NO: 370106 - DNA, 20 bp, Artificial
  CRISPR gRNA sequence
tgctgggggagggagtgtcc

SEQ ID NO: 370107 - DNA, 20 bp, Artificial
  CRISPR gRNA sequence
ggggagggagtgtcctggtc

SEQ ID NO: 370108 - DNA, 20 bp, Artificial
  CRISPR gRNA sequence
ggagggagtgtcctggtcca

SEQ ID NO: 370109 - DNA, 20 bp, Artificial
  CRISPR gRNA sequence
gagtgtcctggtccagagtt

SEQ ID NO: 370110 - DNA, 20 bp, Artificial
  CRISPR gRNA sequence
ctggtccagagttcagacgt

SEQ ID NO: 370111 - DNA, 20 bp, Artificial
  CRISPR gRNA sequence
tccagagttcagacgtgaga

SEQ ID NO: 370112 - DNA, 20 bp, Artificial
  CRISPR gRNA sequence
cagagttcagacgtgagatg

SEQ ID NO: 370113 - DNA, 20 bp, Artificial
  CRISPR gRNA sequence
gacgtgagatggagtgtatg

SEQ ID NO: 370114 - DNA, 20 bp, Artificial
  CRISPR gRNA sequence
tgagatggagtgtatgtggt

SEQ ID NO: 370115 - DNA, 20 bp, Artificial
  CRISPR gRNA sequence
atggagtgtatgtggtgagt

SEQ ID NO: 370116 - DNA, 20 bp, Artificial
  CRISPR gRNA sequence
ggagtgtatgtggtgagttg

SEQ ID NO: 370117 - DNA, 20 bp, Artificial
  CRISPR gRNA sequence
gagtgtatgtggtgagttgg

SEQ ID NO: 370118 - DNA, 20 bp, Artificial
  CRISPR gRNA sequence
tgtggtgagttggaggatct

SEQ ID NO: 370119 - DNA, 20 bp, Artificial
  CRISPR gRNA sequence
gagttggaggatctgagaat

SEQ ID NO: 370120 - DNA, 20 bp, Artificial
  CRISPR gRNA sequence
ggaggatctgagaatgagcc

SEQ ID NO: 370121 - DNA, 20 bp, Artificial
  CRISPR gRNA sequence
gaggatctgagaatgagccc

SEQ ID NO: 370122 - DNA, 20 bp, Artificial
  CRISPR gRNA sequence
aggatctgagaatgagccca

SEQ ID NO: 370123 - DNA, 20 bp, Artificial
  CRISPR gRNA sequence
ggatctgagaatgagcccag

SEQ ID NO: 370124 - DNA, 20 bp, Artificial
  CRISPR gRNA sequence
ctgagaatgagcccaggggc

SEQ ID NO: 370125 - DNA, 20 bp, Artificial
  CRISPR gRNA sequence
tgagaatgagcccaggggca

SEQ ID NO: 370126 - DNA, 20 bp, Artificial
  CRISPR gRNA sequence
aatgagcccaggggcaaggt

SEQ ID NO: 370127 - DNA, 20 bp, Artificial
  CRISPR gRNA sequence
gagcccaggggcaaggtgag

SEQ ID NO: 370128 - DNA, 20 bp, Artificial
  CRISPR gRNA sequence
cccaggggcaaggtgagtgg

SEQ ID NO: 370129 - DNA, 20 bp, Artificial
  CRISPR gRNA sequence
gggcaaggtgagtggtggac

SEQ ID NO: 370130 - DNA, 20 bp, Artificial
  CRISPR gRNA sequence
gcaaggtgagtggtggacca

SEQ ID NO: 370131 - DNA, 20 bp, Artificial
  CRISPR gRNA sequence
ggtggaccagagctgacact

SEQ ID NO: 370132 - DNA, 20 bp, Artificial
  CRISPR gRNA sequence
tggaccagagctgacacttg

SEQ ID NO: 370133 - DNA, 20 bp, Artificial
  CRISPR gRNA sequence
gaaaccatgactacttctat

SEQ ID NO: 370134 - DNA, 20 bp, Artificial
  CRISPR gRNA sequence
aaaccatgactacttctatt

SEQ ID NO: 370135 - DNA, 20 bp, Artificial
  CRISPR gRNA sequence
tgactacttctattaggcct

SEQ ID NO: 370136 - DNA, 20 bp, Artificial
  CRISPR gRNA sequence
taggccttagaatatgtgct

SEQ ID NO: 370137 - DNA, 20 bp, Artificial
  CRISPR gRNA sequence
gccttagaatatgtgctgag

SEQ ID NO: 370138 - DNA, 20 bp, Artificial
  CRISPR gRNA sequence
gagaagtttgaattttatcc

SEQ ID NO: 370139 - DNA, 20 bp, Artificial
  CRISPR gRNA sequence
gaagtttgaattttatcctg

SEQ ID NO: 370140 - DNA, 20 bp, Artificial
  CRISPR gRNA sequence
aagtttgaattttatcctgg

SEQ ID NO: 370141 - DNA, 20 bp, Artificial
  CRISPR gRNA sequence
gaattttatcctggaggctt

SEQ ID NO: 370142 - DNA, 20 bp, Artificial
  CRISPR gRNA sequence
aattttatcctggaggcttt

SEQ ID NO: 370143 - DNA, 20 bp, Artificial
  CRISPR gRNA sequence
attttatcctggaggctttg

SEQ ID NO: 370144 - DNA, 20 bp, Artificial
  CRISPR gRNA sequence
ctggaggctttggggataca

SEQ ID NO: 370145 - DNA, 20 bp, Artificial
  CRISPR gRNA sequence
ttggggatacatagaatttt

SEQ ID NO: 370146 - DNA, 20 bp, Artificial
  CRISPR gRNA sequence
ggatacatagaattttaagc

SEQ ID NO: 370147 - DNA, 20 bp, Artificial
  CRISPR gRNA sequence
gatacatagaattttaagct

SEQ ID NO: 370148 - DNA, 20 bp, Artificial
  CRISPR gRNA sequence
atacatagaattttaagcta

SEQ ID NO: 370149 - DNA, 20 bp, Artificial
  CRISPR gRNA sequence
aattttaagctagggactaa

SEQ ID NO: 370150 - DNA, 20 bp, Artificial
  CRISPR gRNA sequence
attttaagctagggactaat

SEQ ID NO: 370151 - DNA, 20 bp, Artificial
  CRISPR gRNA sequence
ttttaagctagggactaata

SEQ ID NO: 370152 - DNA, 20 bp, Artificial
  CRISPR gRNA sequence
aagctagggactaatagggc

SEQ ID NO: 370153 - DNA, 20 bp, Artificial
  CRISPR gRNA sequence
agggccagatctgttttaca

SEQ ID NO: 370154 - DNA, 20 bp, Artificial
  CRISPR gRNA sequence
ctgttttacaaagattactc

SEQ ID NO: 370155 - DNA, 20 bp, Artificial
  CRISPR gRNA sequence
gctgtactatgtaatgtata

SEQ ID NO: 370156 - DNA, 20 bp, Artificial
  CRISPR gRNA sequence
tgtactatgtaatgtatata

SEQ ID NO: 370157 - DNA, 20 bp, Artificial
  CRISPR gRNA sequence
tgtatatagagaattatgac

SEQ ID NO: 370158 - DNA, 20 bp, Artificial
  CRISPR gRNA sequence
gtatatagagaattatgaca

SEQ ID NO: 370159 - DNA, 20 bp, Artificial
  CRISPR gRNA sequence
aggcccttgtcattaccacc

SEQ ID NO: 370160 - DNA, 20 bp, Artificial
  CRISPR gRNA sequence
ggcccttgtcattaccacct

SEQ ID NO: 370161 - DNA, 20 bp, Artificial
  CRISPR gRNA sequence
gcccttgtcattaccacctg

SEQ ID NO: 370162 - DNA, 20 bp, Artificial
  CRISPR gRNA sequence
ccttgtcattaccacctggg

SEQ ID NO: 370163 - DNA, 20 bp, Artificial
  CRISPR gRNA sequence
ttgtcattaccacctgggga

SEQ ID NO: 370164 - DNA, 20 bp, Artificial
  CRISPR gRNA sequence
tgtcattaccacctggggag

SEQ ID NO: 370165 - DNA, 20 bp, Artificial
  CRISPR gRNA sequence
acctggggagaggtgatgat

SEQ ID NO: 370166 - DNA, 20 bp, Artificial
  CRISPR gRNA sequence
gtgatgataagaacctgttc

SEQ ID NO: 370167 - DNA, 20 bp, Artificial
  CRISPR gRNA sequence
atgataagaacctgttcaag

SEQ ID NO: 370168 - DNA, 20 bp, Artificial
  CRISPR gRNA sequence
tgataagaacctgttcaagt

SEQ ID NO: 370169 - DNA, 20 bp, Artificial
  CRISPR gRNA sequence
aagaacctgttcaagtggga

SEQ ID NO: 370170 - DNA, 20 bp, Artificial
  CRISPR gRNA sequence
aacctgttcaagtgggaaag

SEQ ID NO: 370171 - DNA, 20 bp, Artificial
  CRISPR gRNA sequence
cctgttcaagtgggaaagca

SEQ ID NO: 370172 - DNA, 20 bp, Artificial
  CRISPR gRNA sequence
gttcaagtgggaaagcagag

SEQ ID NO: 370173 - DNA, 20 bp, Artificial
  CRISPR gRNA sequence
caagtgggaaagcagagaag

SEQ ID NO: 370174 - DNA, 20 bp, Artificial
  CRISPR gRNA sequence
aagtgggaaagcagagaagt

SEQ ID NO: 370175 - DNA, 20 bp, Artificial
  CRISPR gRNA sequence
tgggaaagcagagaagtagg

SEQ ID NO: 370176 - DNA, 20 bp, Artificial
  CRISPR gRNA sequence
gcagagaagtaggcagatgt

SEQ ID NO: 370177 - DNA, 20 bp, Artificial
  CRISPR gRNA sequence
cagagaagtaggcagatgta

SEQ ID NO: 370178 - DNA, 20 bp, Artificial
  CRISPR gRNA sequence
taggcagatgtaaggctatt

SEQ ID NO: 370179 - DNA, 20 bp, Artificial
  CRISPR gRNA sequence
aggcagatgtaaggctatta

SEQ ID NO: 370180 - DNA, 20 bp, Artificial
  CRISPR gRNA sequence
gcagatgtaaggctattaag

SEQ ID NO: 370181 - DNA, 20 bp, Artificial
  CRISPR gRNA sequence
cagatgtaaggctattaagg

SEQ ID NO: 370182 - DNA, 20 bp, Artificial
  CRISPR gRNA sequence
gatgtaaggctattaaggag

SEQ ID NO: 370183 - DNA, 20 bp, Artificial
  CRISPR gRNA sequence
atgtaaggctattaaggagg

SEQ ID NO: 370184 - DNA, 20 bp, Artificial
  CRISPR gRNA sequence
taaggctattaaggaggagg

SEQ ID NO: 370185 - DNA, 20 bp, Artificial
  CRISPR gRNA sequence
tattaaggaggaggaagtga

SEQ ID NO: 370186 - DNA, 20 bp, Artificial
  CRISPR gRNA sequence
attaaggaggaggaagtgac

SEQ ID NO: 370187 - DNA, 20 bp, Artificial
  CRISPR gRNA sequence
gaggaggaagtgacaggatt

SEQ ID NO: 370188 - DNA, 20 bp, Artificial
  CRISPR gRNA sequence
aggaggaagtgacaggattt

SEQ ID NO: 370189 - DNA, 20 bp, Artificial
  CRISPR gRNA sequence
aagtgacaggatttgggtgt

SEQ ID NO: 370190 - DNA, 20 bp, Artificial
  CRISPR gRNA sequence
ggatttgggtgtgagtgaaa

SEQ ID NO: 370191 - DNA, 20 bp, Artificial
  CRISPR gRNA sequence
gatttgggtgtgagtgaaat

SEQ ID NO: 370192 - DNA, 20 bp, Artificial
  CRISPR gRNA sequence
tttgggtgtgagtgaaatgg

SEQ ID NO: 370193 - DNA, 20 bp, Artificial
  CRISPR gRNA sequence
ttgggtgtgagtgaaatggg

SEQ ID NO: 370194 - DNA, 20 bp, Artificial
  CRISPR gRNA sequence
tgggtgtgagtgaaatggga

SEQ ID NO: 370195 - DNA, 20 bp, Artificial
  CRISPR gRNA sequence
tgaaatgggagggatgcaca

SEQ ID NO: 370196 - DNA, 20 bp, Artificial
  CRISPR gRNA sequence
gaaatgggagggatgcacaa

SEQ ID NO: 370197 - DNA, 20 bp, Artificial
  CRISPR gRNA sequence
atgggagggatgcacaaagg

SEQ ID NO: 370198 - DNA, 20 bp, Artificial
  CRISPR gRNA sequence
tgggagggatgcacaaagga

SEQ ID NO: 370199 - DNA, 20 bp, Artificial
  CRISPR gRNA sequence
ggagggatgcacaaaggaag

SEQ ID NO: 370200 - DNA, 20 bp, Artificial
  CRISPR gRNA sequence
gatgcacaaaggaaggagtg

SEQ ID NO: 370201 - DNA, 20 bp, Artificial
  CRISPR gRNA sequence
acaaaggaaggagtgaagct

SEQ ID NO: 370202 - DNA, 20 bp, Artificial
  CRISPR gRNA sequence
agcttggcttcaaatcttga

SEQ ID NO: 370203 - DNA, 20 bp, Artificial
  CRISPR gRNA sequence
ttggcttcaaatcttgatag

SEQ ID NO: 370204 - DNA, 20 bp, Artificial
  CRISPR gRNA sequence
tggcttcaaatcttgatagc

SEQ ID NO: 370205 - DNA, 20 bp, Artificial
  CRISPR gRNA sequence
aatcttgatagcaggtcatg

SEQ ID NO: 370206 - DNA, 20 bp, Artificial
  CRISPR gRNA sequence
atcttgatagcaggtcatgt

SEQ ID NO: 370207 - DNA, 20 bp, Artificial
  CRISPR gRNA sequence
tcttgatagcaggtcatgtg

SEQ ID NO: 370208 - DNA, 20 bp, Artificial
  CRISPR gRNA sequence
ttgatagcaggtcatgtggg

SEQ ID NO: 370209 - DNA, 20 bp, Artificial
  CRISPR gRNA sequence
tagcaggtcatgtggggaga

SEQ ID NO: 370210 - DNA, 20 bp, Artificial
  CRISPR gRNA sequence
gtggggagatggtattaacc

SEQ ID NO: 370211 - DNA, 20 bp, Artificial
  CRISPR gRNA sequence
ggagatggtattaaccaaga

SEQ ID NO: 370212 - DNA, 20 bp, Artificial
  CRISPR gRNA sequence
agatggtattaaccaagata

SEQ ID NO: 370213 - DNA, 20 bp, Artificial
  CRISPR gRNA sequence
ttaaccaagatagagattgt

SEQ ID NO: 370214 - DNA, 20 bp, Artificial
  CRISPR gRNA sequence
accaagatagagattgtcag

SEQ ID NO: 370215 - DNA, 20 bp, Artificial
  CRISPR gRNA sequence
ccaagatagagattgtcaga

SEQ ID NO: 370216 - DNA, 20 bp, Artificial
  CRISPR gRNA sequence
cagaaggataccatgtcaca

SEQ ID NO: 370217 - DNA, 20 bp, Artificial
  CRISPR gRNA sequence
agaaggataccatgtcacaa

SEQ ID NO: 370218 - DNA, 20 bp, Artificial
  CRISPR gRNA sequence
gataccatgtcacaaaggtt

SEQ ID NO: 370219 - DNA, 20 bp, Artificial
  CRISPR gRNA sequence
aaaggttcagaattcgtatg

SEQ ID NO: 370220 - DNA, 20 bp, Artificial
  CRISPR gRNA sequence
gttcagaattcgtatgcaga

SEQ ID NO: 370221 - DNA, 20 bp, Artificial
  CRISPR gRNA sequence
tgctctctcaacatccctta

SEQ ID NO: 370222 - DNA, 20 bp, Artificial
  CRISPR gRNA sequence
tcccttaaagcaaacttgat

SEQ ID NO: 370223 - DNA, 20 bp, Artificial
  CRISPR gRNA sequence
aaacttgatgagcatataat

SEQ ID NO: 370224 - DNA, 20 bp, Artificial
  CRISPR gRNA sequence
agcatataatgagtgcccat

SEQ ID NO: 370225 - DNA, 20 bp, Artificial
  CRISPR gRNA sequence
gcatataatgagtgcccatt

SEQ ID NO: 370226 - DNA, 20 bp, Artificial
  CRISPR gRNA sequence
gcccattgggtgctcatatt

SEQ ID NO: 370227 - DNA, 20 bp, Artificial
  CRISPR gRNA sequence
tgggtgctcatattgagtat

SEQ ID NO: 370228 - DNA, 20 bp, Artificial
  CRISPR gRNA sequence
ttatgtacaaaatgtataaa

SEQ ID NO: 370229 - DNA, 20 bp, Artificial
  CRISPR gRNA sequence
tatgtacaaaatgtataaaa

SEQ ID NO: 370230 - DNA, 20 bp, Artificial
  CRISPR gRNA sequence
tacaaaatgtataaaaagga

SEQ ID NO: 370231 - DNA, 20 bp, Artificial
  CRISPR gRNA sequence
aaaaggacagttcatgcccc

SEQ ID NO: 370232 - DNA, 20 bp, Artificial
  CRISPR gRNA sequence
aggacagttcatgcccctag

SEQ ID NO: 370233 - DNA, 20 bp, Artificial
  CRISPR gRNA sequence
ggacagttcatgcccctagt

SEQ ID NO: 370234 - DNA, 20 bp, Artificial
  CRISPR gRNA sequence
cccctagtaggttgataccc

SEQ ID NO: 370235 - DNA, 20 bp, Artificial
  CRISPR gRNA sequence
ctagtaggttgataccctag

SEQ ID NO: 370236 - DNA, 20 bp, Artificial
  CRISPR gRNA sequence
tagtggatgaaccgtgtatt

SEQ ID NO: 370237 - DNA, 20 bp, Artificial
  CRISPR gRNA sequence
gaaccgtgtatttagtatga

SEQ ID NO: 370238 - DNA, 20 bp, Artificial
  CRISPR gRNA sequence
tgtatttagtatgaaagata

SEQ ID NO: 370239 - DNA, 20 bp, Artificial
  CRISPR gRNA sequence
ttagtatgaaagataaagct

SEQ ID NO: 370240 - DNA, 20 bp, Artificial
  CRISPR gRNA sequence
aaagataaagctcagatttc

SEQ ID NO: 370241 - DNA, 20 bp, Artificial
  CRISPR gRNA sequence
actcattaaaaaatattgtg

SEQ ID NO: 370242 - DNA, 20 bp, Artificial
  CRISPR gRNA sequence
tttgatgcttgtctaaacat

SEQ ID NO: 370243 - DNA, 20 bp, Artificial
  CRISPR gRNA sequence
ttgatgcttgtctaaacatc

SEQ ID NO: 370244 - DNA, 20 bp, Artificial
  CRISPR gRNA sequence
acacatcattgtttcttgtt

SEQ ID NO: 370245 - DNA, 20 bp, Artificial
  CRISPR gRNA sequence
gttgagatgataaatgtttt

SEQ ID NO: 370246 - DNA, 20 bp, Artificial
  CRISPR gRNA sequence
atgataaatgttttgagtca

SEQ ID NO: 370247 - DNA, 20 bp, Artificial
  CRISPR gRNA sequence
tgttttgagtcatggctttc

SEQ ID NO: 370248 - DNA, 20 bp, Artificial
  CRISPR gRNA sequence
ttttgagtcatggctttccg

SEQ ID NO: 370249 - DNA, 20 bp, Artificial
  CRISPR gRNA sequence
tttgagtcatggctttccgg

SEQ ID NO: 370250 - DNA, 20 bp, Artificial
  CRISPR gRNA sequence
ttgagtcatggctttccgga

SEQ ID NO: 370251 - DNA, 20 bp, Artificial
  CRISPR gRNA sequence
tttccggagggtattttatt

SEQ ID NO: 370252 - DNA, 20 bp, Artificial
  CRISPR gRNA sequence
ggagggtattttattcagta

SEQ ID NO: 370253 - DNA, 20 bp, Artificial
  CRISPR gRNA sequence
gtattttattcagtacagat

SEQ ID NO: 370254 - DNA, 20 bp, Artificial
  CRISPR gRNA sequence
ttcagtacagattagtctga

SEQ ID NO: 370255 - DNA, 20 bp, Artificial
  CRISPR gRNA sequence
tattttaccttttatttttt

SEQ ID NO: 370256 - DNA, 20 bp, Artificial
  CRISPR gRNA sequence
attttaccttttatttttta

SEQ ID NO: 370257 - DNA, 20 bp, Artificial
  CRISPR gRNA sequence
tttaaggtgtatttcacttt

SEQ ID NO: 370258 - DNA, 20 bp, Artificial
  CRISPR gRNA sequence
tcagcatccgaactatattt

SEQ ID NO: 370259 - DNA, 20 bp, Artificial
  CRISPR gRNA sequence
cagcatccgaactatatttt

SEQ ID NO: 370260 - DNA, 20 bp, Artificial
  CRISPR gRNA sequence
gcatccgaactatattttgg

SEQ ID NO: 370261 - DNA, 20 bp, Artificial
  CRISPR gRNA sequence
atccgaactatattttggga

SEQ ID NO: 370262 - DNA, 20 bp, Artificial
  CRISPR gRNA sequence
tccgaactatattttgggag

SEQ ID NO: 370263 - DNA, 20 bp, Artificial
  CRISPR gRNA sequence
ctatattttgggagaggaaa

SEQ ID NO: 370264 - DNA, 20 bp, Artificial
  CRISPR gRNA sequence
atattttgggagaggaaata

SEQ ID NO: 370265 - DNA, 20 bp, Artificial
  CRISPR gRNA sequence
tattttgggagaggaaatag

SEQ ID NO: 370266 - DNA, 20 bp, Artificial
  CRISPR gRNA sequence
attttgggagaggaaataga

SEQ ID NO: 370267 - DNA, 20 bp, Artificial
  CRISPR gRNA sequence
tgggagaggaaatagaggga

SEQ ID NO: 370268 - DNA, 20 bp, Artificial
  CRISPR gRNA sequence
agaggaaatagagggatggt

SEQ ID NO: 370269 - DNA, 20 bp, Artificial
  CRISPR gRNA sequence
gaaatagagggatggttaga

SEQ ID NO: 370270 - DNA, 20 bp, Artificial
  CRISPR gRNA sequence
tgtcatactaaattattctt

SEQ ID NO: 370271 - DNA, 20 bp, Artificial
  CRISPR gRNA sequence
gtcatactaaattattcttt

SEQ ID NO: 370272 - DNA, 20 bp, Artificial
  CRISPR gRNA sequence
actaaattattctttaggac

SEQ ID NO: 370273 - DNA, 20 bp, Artificial
  CRISPR gRNA sequence
taaattattctttaggacta

SEQ ID NO: 370274 - DNA, 20 bp, Artificial
  CRISPR gRNA sequence
taaattctattatttaaaat

SEQ ID NO: 370275 - DNA, 20 bp, Artificial
  CRISPR gRNA sequence
ttactcttacatgattttat

SEQ ID NO: 370276 - DNA, 20 bp, Artificial
  CRISPR gRNA sequence
ttttcctgaaatatacattg

SEQ ID NO: 370277 - DNA, 20 bp, Artificial
  CRISPR gRNA sequence
gaaatatacattgaagtttt

SEQ ID NO: 370278 - DNA, 20 bp, Artificial
  CRISPR gRNA sequence
gaagtttttagttttgtttg

SEQ ID NO: 370279 - DNA, 20 bp, Artificial
  CRISPR gRNA sequence
attacaaataaatcacaaat

SEQ ID NO: 370280 - DNA, 20 bp, Artificial
  CRISPR gRNA sequence
atcacaaatcagtatctgtg

SEQ ID NO: 370281 - DNA, 20 bp, Artificial
  CRISPR gRNA sequence
agtatctgtgtggttatctc

SEQ ID NO: 370282 - DNA, 20 bp, Artificial
  CRISPR gRNA sequence
tctctggttgctgaaatcat

SEQ ID NO: 370283 - DNA, 20 bp, Artificial
  CRISPR gRNA sequence
atttatttatttgcatcact

SEQ ID NO: 370284 - DNA, 20 bp, Artificial
  CRISPR gRNA sequence
gatgtctaatttaaacctgc

SEQ ID NO: 370285 - DNA, 20 bp, Artificial
  CRISPR gRNA sequence
aatgcaattgaatctattga

SEQ ID NO: 370286 - DNA, 20 bp, Artificial
  CRISPR gRNA sequence
atgcaattgaatctattgac

SEQ ID NO: 370287 - DNA, 20 bp, Artificial
  CRISPR gRNA sequence
ttctcttaactgttattcta

SEQ ID NO: 370288 - DNA, 20 bp, Artificial
  CRISPR gRNA sequence
aatatacctctgaaatgaaa

SEQ ID NO: 370289 - DNA, 20 bp, Artificial
  CRISPR gRNA sequence
aactgcaataaacctcacat

SEQ ID NO: 370290 - DNA, 20 bp, Artificial
  CRISPR gRNA sequence
actgcaataaacctcacatt

SEQ ID NO: 370291 - DNA, 20 bp, Artificial
  CRISPR gRNA sequence
ctgcaataaacctcacatta

SEQ ID NO: 370292 - DNA, 20 bp, Artificial
  CRISPR gRNA sequence
atatctgtaatcattaccac

SEQ ID NO: 370293 - DNA, 20 bp, Artificial
  CRISPR gRNA sequence
gtaatcattaccactggctc

SEQ ID NO: 370294 - DNA, 20 bp, Artificial
  CRISPR gRNA sequence
attctgatccccaaatttta

SEQ ID NO: 370295 - DNA, 20 bp, Artificial
  CRISPR gRNA sequence
ttgttttgttttgcttttaa

SEQ ID NO: 370296 - DNA, 20 bp, Artificial
  CRISPR gRNA sequence
aatgtgaaaaatgtaattcc

SEQ ID NO: 370297 - DNA, 20 bp, Artificial
  CRISPR gRNA sequence
tgaaaaatgtaattccaaga

SEQ ID NO: 370298 - DNA, 20 bp, Artificial
  CRISPR gRNA sequence
aaaatgtaattccaagacag

SEQ ID NO: 370299 - DNA, 20 bp, Artificial
  CRISPR gRNA sequence
aatgtaattccaagacagta

SEQ ID NO: 370300 - DNA, 20 bp, Artificial
  CRISPR gRNA sequence
taattccaagacagtagagt

SEQ ID NO: 370301 - DNA, 20 bp, Artificial
  CRISPR gRNA sequence
aattccaagacagtagagtt

SEQ ID NO: 370302 - DNA, 20 bp, Artificial
  CRISPR gRNA sequence
tccaagacagtagagttagg

SEQ ID NO: 370303 - DNA, 20 bp, Artificial
  CRISPR gRNA sequence
agagttaggaagccattatg

SEQ ID NO: 370304 - DNA, 20 bp, Artificial
  CRISPR gRNA sequence
gagttaggaagccattatga

SEQ ID NO: 370305 - DNA, 20 bp, Artificial
  CRISPR gRNA sequence
agccattatgaaggcaattg

SEQ ID NO: 370306 - DNA, 20 bp, Artificial
  CRISPR gRNA sequence
ccattatgaaggcaattgta

SEQ ID NO: 370307 - DNA, 20 bp, Artificial
  CRISPR gRNA sequence
cattatgaaggcaattgtag

SEQ ID NO: 370308 - DNA, 20 bp, Artificial
  CRISPR gRNA sequence
ggcaattgtagaggaaaatt

SEQ ID NO: 370309 - DNA, 20 bp, Artificial
  CRISPR gRNA sequence
caattgtagaggaaaattga

SEQ ID NO: 370310 - DNA, 20 bp, Artificial
  CRISPR gRNA sequence
ctttaaaatatttaaaatta

SEQ ID NO: 370311 - DNA, 20 bp, Artificial
  CRISPR gRNA sequence
ttaaaatatttaaaattatg

SEQ ID NO: 370312 - DNA, 20 bp, Artificial
  CRISPR gRNA sequence
taaaatatttaaaattatgg

SEQ ID NO: 370313 - DNA, 20 bp, Artificial
  CRISPR gRNA sequence
aatatttaaaattatggagg

SEQ ID NO: 370314 - DNA, 20 bp, Artificial
  CRISPR gRNA sequence
tggaggtggaaattaaattg

SEQ ID NO: 370315 - DNA, 20 bp, Artificial
  CRISPR gRNA sequence
ggaaattaaattgcagactt

SEQ ID NO: 370316 - DNA, 20 bp, Artificial
  CRISPR gRNA sequence
gaaattaaattgcagacttc

SEQ ID NO: 370317 - DNA, 20 bp, Artificial
  CRISPR gRNA sequence
aaattaaattgcagacttcg

SEQ ID NO: 370318 - DNA, 20 bp, Artificial
  CRISPR gRNA sequence
ttaaattgcagacttcgggg

SEQ ID NO: 370319 - DNA, 20 bp, Artificial
  CRISPR gRNA sequence
tcggggaagtgcgtactatg

SEQ ID NO: 370320 - DNA, 20 bp, Artificial
  CRISPR gRNA sequence
cggggaagtgcgtactatgc

SEQ ID NO: 370321 - DNA, 20 bp, Artificial
  CRISPR gRNA sequence
ggggaagtgcgtactatgca

SEQ ID NO: 370322 - DNA, 20 bp, Artificial
  CRISPR gRNA sequence
gggaagtgcgtactatgcag

SEQ ID NO: 370323 - DNA, 20 bp, Artificial
  CRISPR gRNA sequence
tgcgtactatgcaggggaaa

SEQ ID NO: 370324 - DNA, 20 bp, Artificial
  CRISPR gRNA sequence
gtactatgcaggggaaatgg

SEQ ID NO: 370325 - DNA, 20 bp, Artificial
  CRISPR gRNA sequence
aatggaagtcatccctaact

SEQ ID NO: 370326 - DNA, 20 bp, Artificial
  CRISPR gRNA sequence
agtcatccctaacttagaaa

SEQ ID NO: 370327 - DNA, 20 bp, Artificial
  CRISPR gRNA sequence
tcatccctaacttagaaaaa

SEQ ID NO: 370328 - DNA, 20 bp, Artificial
  CRISPR gRNA sequence
taacttagaaaaagagtgtg

SEQ ID NO: 370329 - DNA, 20 bp, Artificial
  CRISPR gRNA sequence
ttagaaaaagagtgtgtagt

SEQ ID NO: 370330 - DNA, 20 bp, Artificial
  CRISPR gRNA sequence
aagagtgtgtagtgagataa

SEQ ID NO: 370331 - DNA, 20 bp, Artificial
  CRISPR gRNA sequence
gagtgtgtagtgagataaaa

SEQ ID NO: 370332 - DNA, 20 bp, Artificial
  CRISPR gRNA sequence
tgtagtgagataaaagagcc

SEQ ID NO: 370333 - DNA, 20 bp, Artificial
  CRISPR gRNA sequence
gtagtgagataaaagagcca

SEQ ID NO: 370334 - DNA, 20 bp, Artificial
  CRISPR gRNA sequence
agtgagataaaagagccaag

SEQ ID NO: 370335 - DNA, 20 bp, Artificial
  CRISPR gRNA sequence
gataaaagagccaaggagaa

SEQ ID NO: 370336 - DNA, 20 bp, Artificial
  CRISPR gRNA sequence
caaggagaatggcaaacact

SEQ ID NO: 370337 - DNA, 20 bp, Artificial
  CRISPR gRNA sequence
cactgagcttaaatatttca

SEQ ID NO: 370338 - DNA, 20 bp, Artificial
  CRISPR gRNA sequence
ttcaaagcaactatttcaat

SEQ ID NO: 370339 - DNA, 20 bp, Artificial
  CRISPR gRNA sequence
tagtttccgcatttaaaaaa

SEQ ID NO: 370340 - DNA, 20 bp, Artificial
  CRISPR gRNA sequence
cgcatttaaaaaatggcgcg

SEQ ID NO: 370341 - DNA, 20 bp, Artificial
  CRISPR gRNA sequence
taaaaaatggcgcgtagcaa

SEQ ID NO: 370342 - DNA, 20 bp, Artificial
  CRISPR gRNA sequence
aaaaaatggcgcgtagcaat

SEQ ID NO: 370343 - DNA, 20 bp, Artificial
  CRISPR gRNA sequence
ataggacatataccaattca

SEQ ID NO: 370344 - DNA, 20 bp, Artificial
  CRISPR gRNA sequence
taggacatataccaattcat

SEQ ID NO: 370345 - DNA, 20 bp, Artificial
  CRISPR gRNA sequence
gacatataccaattcatagg

SEQ ID NO: 370346 - DNA, 20 bp, Artificial
  CRISPR gRNA sequence
cataggaagcatatttatct

SEQ ID NO: 370347 - DNA, 20 bp, Artificial
  CRISPR gRNA sequence
tatctaagttctttctgacc

SEQ ID NO: 370348 - DNA, 20 bp, Artificial
  CRISPR gRNA sequence
tctttctgacctagcttcca

SEQ ID NO: 370349 - DNA, 20 bp, Artificial
  CRISPR gRNA sequence
ctttctgacctagcttccaa

SEQ ID NO: 370350 - DNA, 20 bp, Artificial
  CRISPR gRNA sequence
tagcttccaaaggtatattt

SEQ ID NO: 370351 - DNA, 20 bp, Artificial
  CRISPR gRNA sequence
tttgagaactaactgtaatc

SEQ ID NO: 370352 - DNA, 20 bp, Artificial
  CRISPR gRNA sequence
gaactaactgtaatctggaa

SEQ ID NO: 370353 - DNA, 20 bp, Artificial
  CRISPR gRNA sequence
ctccatttcatctttgcttc

SEQ ID NO: 370354 - DNA, 20 bp, Artificial
  CRISPR gRNA sequence
tccagtgtttacaattttaa

SEQ ID NO: 370355 - DNA, 20 bp, Artificial
  CRISPR gRNA sequence
ccagtgtttacaattttaat

SEQ ID NO: 370356 - DNA, 20 bp, Artificial
  CRISPR gRNA sequence
cagtgtttacaattttaatg

SEQ ID NO: 370357 - DNA, 20 bp, Artificial
  CRISPR gRNA sequence
tacaattttaatggggctgt

SEQ ID NO: 370358 - DNA, 20 bp, Artificial
  CRISPR gRNA sequence
tggggctgttagatgaattc

SEQ ID NO: 370359 - DNA, 20 bp, Artificial
  CRISPR gRNA sequence
gttagatgaattctggcaaa

SEQ ID NO: 370360 - DNA, 20 bp, Artificial
  CRISPR gRNA sequence
tagatgaattctggcaaatg

SEQ ID NO: 370361 - DNA, 20 bp, Artificial
  CRISPR gRNA sequence
ttctggcaaatggagaacca

SEQ ID NO: 370362 - DNA, 20 bp, Artificial
  CRISPR gRNA sequence
gagaaccatggcatgataaa

SEQ ID NO: 370363 - DNA, 20 bp, Artificial
  CRISPR gRNA sequence
aaccatggcatgataaaaag

SEQ ID NO: 370364 - DNA, 20 bp, Artificial
  CRISPR gRNA sequence
tggcatgataaaaagtagct

SEQ ID NO: 370365 - DNA, 20 bp, Artificial
  CRISPR gRNA sequence
ggcatgataaaaagtagctg

SEQ ID NO: 370366 - DNA, 20 bp, Artificial
  CRISPR gRNA sequence
aaaaagtagctgaggacctt

SEQ ID NO: 370367 - DNA, 20 bp, Artificial
  CRISPR gRNA sequence
agtagctgaggacctttggt

SEQ ID NO: 370368 - DNA, 20 bp, Artificial
  CRISPR gRNA sequence
ttaacattgaattcatttat

SEQ ID NO: 370369 - DNA, 20 bp, Artificial
  CRISPR gRNA sequence
tagattaaaaatacatcata

SEQ ID NO: 370370 - DNA, 20 bp, Artificial
  CRISPR gRNA sequence
gactctttgatcatttgcta

SEQ ID NO: 370371 - DNA, 20 bp, Artificial
  CRISPR gRNA sequence
tactcattctgctactaata

SEQ ID NO: 370372 - DNA, 20 bp, Artificial
  CRISPR gRNA sequence
tctgctactaataaagcaaa

SEQ ID NO: 370373 - DNA, 20 bp, Artificial
  CRISPR gRNA sequence
gcaatgattgtcaaccctat

SEQ ID NO: 370374 - DNA, 20 bp, Artificial
  CRISPR gRNA sequence
ttctgtaataaatactttat

SEQ ID NO: 370375 - DNA, 20 bp, Artificial
  CRISPR gRNA sequence
aaccattttgaaatcgtgtc

SEQ ID NO: 370376 - DNA, 20 bp, Artificial
  CRISPR gRNA sequence
accattttgaaatcgtgtcc

SEQ ID NO: 370377 - DNA, 20 bp, Artificial
  CRISPR gRNA sequence
gtgtccaggtgctattgtgt

SEQ ID NO: 370378 - DNA, 20 bp, Artificial
  CRISPR gRNA sequence
gtccaggtgctattgtgtga

SEQ ID NO: 370379 - DNA, 20 bp, Artificial
  CRISPR gRNA sequence
tccaggtgctattgtgtgag

SEQ ID NO: 370380 - DNA, 20 bp, Artificial
  CRISPR gRNA sequence
ccaggtgctattgtgtgaga

SEQ ID NO: 370381 - DNA, 20 bp, Artificial
  CRISPR gRNA sequence
gtgagagggataaaatgaaa

SEQ ID NO: 370382 - DNA, 20 bp, Artificial
  CRISPR gRNA sequence
gaaatgtgttcacctccatt

SEQ ID NO: 370383 - DNA, 20 bp, Artificial
  CRISPR gRNA sequence
gaatcaccgtgaactatgac

SEQ ID NO: 370384 - DNA, 20 bp, Artificial
  CRISPR gRNA sequence
tcaccgtgaactatgactag

SEQ ID NO: 370385 - DNA, 20 bp, Artificial
  CRISPR gRNA sequence
gaagatgtgattaccctgaa

SEQ ID NO: 370386 - DNA, 20 bp, Artificial
  CRISPR gRNA sequence
gtttccaaaatgaacaactc

SEQ ID NO: 370387 - DNA, 20 bp, Artificial
  CRISPR gRNA sequence
caaaatgaacaactctggta

SEQ ID NO: 370388 - DNA, 20 bp, Artificial
  CRISPR gRNA sequence
ggtaaagctctaatacttca

SEQ ID NO: 370389 - DNA, 20 bp, Artificial
  CRISPR gRNA sequence
tccctcactttaaactgaac

SEQ ID NO: 370390 - DNA, 20 bp, Artificial
  CRISPR gRNA sequence
cctcactttaaactgaacaa

SEQ ID NO: 370391 - DNA, 20 bp, Artificial
  CRISPR gRNA sequence
cactttaaactgaacaagag

SEQ ID NO: 370392 - DNA, 20 bp, Artificial
  CRISPR gRNA sequence
ctgaacaagagtagaatttc

SEQ ID NO: 370393 - DNA, 20 bp, Artificial
  CRISPR gRNA sequence
gagtagaatttctagaaaat

SEQ ID NO: 370394 - DNA, 20 bp, Artificial
  CRISPR gRNA sequence
gtagaatttctagaaaatca

SEQ ID NO: 370395 - DNA, 20 bp, Artificial
  CRISPR gRNA sequence
ctagaaaatcagagtatgct

SEQ ID NO: 370396 - DNA, 20 bp, Artificial
  CRISPR gRNA sequence
aaaatcagagtatgctaaga

SEQ ID NO: 370397 - DNA, 20 bp, Artificial
  CRISPR gRNA sequence
atagtaaaaaaatatttttt

SEQ ID NO: 370398 - DNA, 20 bp, Artificial
  CRISPR gRNA sequence
ttcttgtgccaatttacttt

SEQ ID NO: 370399 - DNA, 20 bp, Artificial
  CRISPR gRNA sequence
tcttgtgccaatttactttc

SEQ ID NO: 370400 - DNA, 20 bp, Artificial
  CRISPR gRNA sequence
gtgccaatttactttcaggc

SEQ ID NO: 370401 - DNA, 20 bp, Artificial
  CRISPR gRNA sequence
caatttactttcaggcgagt

SEQ ID NO: 370402 - DNA, 20 bp, Artificial
  CRISPR gRNA sequence
aatttactttcaggcgagtc

SEQ ID NO: 370403 - DNA, 20 bp, Artificial
  CRISPR gRNA sequence
ctttcctttgcaatttcctt

SEQ ID NO: 370404 - DNA, 20 bp, Artificial
  CRISPR gRNA sequence
tttgcaatttccttgagatt

SEQ ID NO: 370405 - DNA, 20 bp, Artificial
  CRISPR gRNA sequence
aatttccttgagatttggct

SEQ ID NO: 370406 - DNA, 20 bp, Artificial
  CRISPR gRNA sequence
ttgagatttggctcagaatt

SEQ ID NO: 370407 - DNA, 20 bp, Artificial
  CRISPR gRNA sequence
tgagatttggctcagaattt

SEQ ID NO: 370408 - DNA, 20 bp, Artificial
  CRISPR gRNA sequence
ttgggacattgtcttaaata

SEQ ID NO: 370409 - DNA, 20 bp, Artificial
  CRISPR gRNA sequence
ggacattgtcttaaatatag

SEQ ID NO: 370410 - DNA, 20 bp, Artificial
  CRISPR gRNA sequence
gacattgtcttaaatatagt

SEQ ID NO: 370411 - DNA, 20 bp, Artificial
  CRISPR gRNA sequence
tatagtaggtcctcaattga

SEQ ID NO: 370412 - DNA, 20 bp, Artificial
  CRISPR gRNA sequence
caattgatggttatttgtgt

SEQ ID NO: 370413 - DNA, 20 bp, Artificial
  CRISPR gRNA sequence
gttatttgtgttagttactt

SEQ ID NO: 370414 - DNA, 20 bp, Artificial
  CRISPR gRNA sequence
tatttgtgttagttacttta

SEQ ID NO: 370415 - DNA, 20 bp, Artificial
  CRISPR gRNA sequence
catgaacatttctgttttat

SEQ ID NO: 370416 - DNA, 20 bp, Artificial
  CRISPR gRNA sequence
atgaacatttctgttttatt

SEQ ID NO: 370417 - DNA, 20 bp, Artificial
  CRISPR gRNA sequence
gaacatttctgttttattgg

SEQ ID NO: 370418 - DNA, 20 bp, Artificial
  CRISPR gRNA sequence
ttctgttttattgggagtaa

SEQ ID NO: 370419 - DNA, 20 bp, Artificial
  CRISPR gRNA sequence
tattgggagtaacagaatga

SEQ ID NO: 370420 - DNA, 20 bp, Artificial
  CRISPR gRNA sequence
acagctgaatgcaactgaaa

SEQ ID NO: 370421 - DNA, 20 bp, Artificial
  CRISPR gRNA sequence
gaatgcaactgaaatggttg

SEQ ID NO: 370422 - DNA, 20 bp, Artificial
  CRISPR gRNA sequence
ttgtggttgtcattctcaat

SEQ ID NO: 370423 - DNA, 20 bp, Artificial
  CRISPR gRNA sequence
tggttgtcattctcaattag

SEQ ID NO: 370424 - DNA, 20 bp, Artificial
  CRISPR gRNA sequence
ggttgtcattctcaattaga

SEQ ID NO: 370425 - DNA, 20 bp, Artificial
  CRISPR gRNA sequence
ttgtcattctcaattagaag

SEQ ID NO: 370426 - DNA, 20 bp, Artificial
  CRISPR gRNA sequence
tgtcattctcaattagaagg

SEQ ID NO: 370427 - DNA, 20 bp, Artificial
  CRISPR gRNA sequence
gtcattctcaattagaagga

SEQ ID NO: 370428 - DNA, 20 bp, Artificial
  CRISPR gRNA sequence
tcaattagaaggagggccaa

SEQ ID NO: 370429 - DNA, 20 bp, Artificial
  CRISPR gRNA sequence
tagaaggagggccaaaagtc

SEQ ID NO: 370430 - DNA, 20 bp, Artificial
  CRISPR gRNA sequence
cttctttttccaatttactt

SEQ ID NO: 370431 - DNA, 20 bp, Artificial
  CRISPR gRNA sequence
ctttttccaatttacttcag

SEQ ID NO: 370432 - DNA, 20 bp, Artificial
  CRISPR gRNA sequence
tcagtagaaatgcttttgta

SEQ ID NO: 370433 - DNA, 20 bp, Artificial
  CRISPR gRNA sequence
cagtagaaatgcttttgtaa

SEQ ID NO: 370434 - DNA, 20 bp, Artificial
  CRISPR gRNA sequence
gtagaaatgcttttgtaaag

SEQ ID NO: 370435 - DNA, 20 bp, Artificial
  CRISPR gRNA sequence
ttttgtaaaggagcaatata

SEQ ID NO: 370436 - DNA, 20 bp, Artificial
  CRISPR gRNA sequence
tttgtaaaggagcaatatat

SEQ ID NO: 370437 - DNA, 20 bp, Artificial
  CRISPR gRNA sequence
aaggagcaatatataggact

SEQ ID NO: 370438 - DNA, 20 bp, Artificial
  CRISPR gRNA sequence
tataggacttggcacaaata

SEQ ID NO: 370439 - DNA, 20 bp, Artificial
  CRISPR gRNA sequence
ggcacaaatacggaactctg

SEQ ID NO: 370440 - DNA, 20 bp, Artificial
  CRISPR gRNA sequence
tacggaactctgtagccctt

SEQ ID NO: 370441 - DNA, 20 bp, Artificial
  CRISPR gRNA sequence
gaactctgtagcccttcagt

SEQ ID NO: 370442 - DNA, 20 bp, Artificial
  CRISPR gRNA sequence
tagcccttcagtgagaaaat

SEQ ID NO: 370443 - DNA, 20 bp, Artificial
  CRISPR gRNA sequence
tcagtgagaaaattggaaac

SEQ ID NO: 370444 - DNA, 20 bp, Artificial
  CRISPR gRNA sequence
gtgagaaaattggaaactgg

SEQ ID NO: 370445 - DNA, 20 bp, Artificial
  CRISPR gRNA sequence
gaaactggcagaactatcac

SEQ ID NO: 370446 - DNA, 20 bp, Artificial
  CRISPR gRNA sequence
aaactggcagaactatcaca

SEQ ID NO: 370447 - DNA, 20 bp, Artificial
  CRISPR gRNA sequence
gaaaataaatattctcctct

SEQ ID NO: 370448 - DNA, 20 bp, Artificial
  CRISPR gRNA sequence
ctcttggtccatgaactcaa

SEQ ID NO: 370449 - DNA, 20 bp, Artificial
  CRISPR gRNA sequence
tcaatggaataattgatata

SEQ ID NO: 370450 - DNA, 20 bp, Artificial
  CRISPR gRNA sequence
tgatatatggtgttcactgt

SEQ ID NO: 370451 - DNA, 20 bp, Artificial
  CRISPR gRNA sequence
ttcactgtgagtttcttttc

SEQ ID NO: 370452 - DNA, 20 bp, Artificial
  CRISPR gRNA sequence
actgtgagtttcttttctgg

SEQ ID NO: 370453 - DNA, 20 bp, Artificial
  CRISPR gRNA sequence
agtgctaatcaacttgaacc

SEQ ID NO: 370454 - DNA, 20 bp, Artificial
  CRISPR gRNA sequence
tgtcttcctcaaattgccaa

SEQ ID NO: 370455 - DNA, 20 bp, Artificial
  CRISPR gRNA sequence
attgccaatggcactgatat

SEQ ID NO: 370456 - DNA, 20 bp, Artificial
  CRISPR gRNA sequence
ttgccaatggcactgatatg

SEQ ID NO: 370457 - DNA, 20 bp, Artificial
  CRISPR gRNA sequence
gatatgaggtgattgacttg

SEQ ID NO: 370458 - DNA, 20 bp, Artificial
  CRISPR gRNA sequence
atgaggtgattgacttgaag

SEQ ID NO: 370459 - DNA, 20 bp, Artificial
  CRISPR gRNA sequence
tgattgacttgaagcagtcg

SEQ ID NO: 370460 - DNA, 20 bp, Artificial
  CRISPR gRNA sequence
tcaaactcatcaaaaatgtc

SEQ ID NO: 370461 - DNA, 20 bp, Artificial
  CRISPR gRNA sequence
caaactcatcaaaaatgtca

SEQ ID NO: 370462 - DNA, 20 bp, Artificial
  CRISPR gRNA sequence
catcaaaaatgtcaaggtcg

SEQ ID NO: 370463 - DNA, 20 bp, Artificial
  CRISPR gRNA sequence
tcaaaaatgtcaaggtcgta

SEQ ID NO: 370464 - DNA, 20 bp, Artificial
  CRISPR gRNA sequence
aaaatgtcaaggtcgtagag

SEQ ID NO: 370465 - DNA, 20 bp, Artificial
  CRISPR gRNA sequence
aaggtcgtagagtagttttg

SEQ ID NO: 370466 - DNA, 20 bp, Artificial
  CRISPR gRNA sequence
aggtcgtagagtagttttgc

SEQ ID NO: 370467 - DNA, 20 bp, Artificial
  CRISPR gRNA sequence
gtgtgatctgaaatattata

SEQ ID NO: 370468 - DNA, 20 bp, Artificial
  CRISPR gRNA sequence
gatctgaaatattatataga

SEQ ID NO: 370469 - DNA, 20 bp, Artificial
  CRISPR gRNA sequence
atctgaaatattatatagaa

SEQ ID NO: 370470 - DNA, 20 bp, Artificial
  CRISPR gRNA sequence
tgaaatattatatagaaagg

SEQ ID NO: 370471 - DNA, 20 bp, Artificial
  CRISPR gRNA sequence
tatatagaaaggtagaattt

SEQ ID NO: 370472 - DNA, 20 bp, Artificial
  CRISPR gRNA sequence
tatagaaaggtagaatttca

SEQ ID NO: 370473 - DNA, 20 bp, Artificial
  CRISPR gRNA sequence
gaaaggtagaatttcagagc

SEQ ID NO: 370474 - DNA, 20 bp, Artificial
  CRISPR gRNA sequence
aaggtagaatttcagagcca

SEQ ID NO: 370475 - DNA, 20 bp, Artificial
  CRISPR gRNA sequence
cattctgacataatacatac

SEQ ID NO: 370476 - DNA, 20 bp, Artificial
  CRISPR gRNA sequence
atacatacaagccaaattca

SEQ ID NO: 370477 - DNA, 20 bp, Artificial
  CRISPR gRNA sequence
atacaagccaaattcataga

SEQ ID NO: 370478 - DNA, 20 bp, Artificial
  CRISPR gRNA sequence
caagccaaattcatagatgg

SEQ ID NO: 370479 - DNA, 20 bp, Artificial
  CRISPR gRNA sequence
atagatggtagtataaatac

SEQ ID NO: 370480 - DNA, 20 bp, Artificial
  CRISPR gRNA sequence
agtataaatactggacattt

SEQ ID NO: 370481 - DNA, 20 bp, Artificial
  CRISPR gRNA sequence
atgctatgaaaatatgatca

SEQ ID NO: 370482 - DNA, 20 bp, Artificial
  CRISPR gRNA sequence
tatgaaaatatgatcacagt

SEQ ID NO: 370483 - DNA, 20 bp, Artificial
  CRISPR gRNA sequence
aaaatatgatcacagtgaga

SEQ ID NO: 370484 - DNA, 20 bp, Artificial
  CRISPR gRNA sequence
tgagacagctttccaaattt

SEQ ID NO: 370485 - DNA, 20 bp, Artificial
  CRISPR gRNA sequence
aattttggaaatctctctaa

SEQ ID NO: 370486 - DNA, 20 bp, Artificial
  CRISPR gRNA sequence
tttggaaatctctctaatag

SEQ ID NO: 370487 - DNA, 20 bp, Artificial
  CRISPR gRNA sequence
ggaaatctctctaatagaag

SEQ ID NO: 370488 - DNA, 20 bp, Artificial
  CRISPR gRNA sequence
cccccaactcattttgtttc

SEQ ID NO: 370489 - DNA, 20 bp, Artificial
  CRISPR gRNA sequence
ttgtttccagaaacctcatt

SEQ ID NO: 370490 - DNA, 20 bp, Artificial
  CRISPR gRNA sequence
agaaacctcattaagatcaa

SEQ ID NO: 370491 - DNA, 20 bp, Artificial
  CRISPR gRNA sequence
cattaagatcaatagaatga

SEQ ID NO: 370492 - DNA, 20 bp, Artificial
  CRISPR gRNA sequence
ttaagatcaatagaatgata

SEQ ID NO: 370493 - DNA, 20 bp, Artificial
  CRISPR gRNA sequence
agatcaatagaatgatagag

SEQ ID NO: 370494 - DNA, 20 bp, Artificial
  CRISPR gRNA sequence
atagaatgatagagaagtcg

SEQ ID NO: 370495 - DNA, 20 bp, Artificial
  CRISPR gRNA sequence
tagaatgatagagaagtcgt

SEQ ID NO: 370496 - DNA, 20 bp, Artificial
  CRISPR gRNA sequence
attttttccccttcacactt

SEQ ID NO: 370497 - DNA, 20 bp, Artificial
  CRISPR gRNA sequence
tttccccttcacactttagt

SEQ ID NO: 370498 - DNA, 20 bp, Artificial
  CRISPR gRNA sequence
tcttcctttttctccctttc

SEQ ID NO: 370499 - DNA, 20 bp, Artificial
  CRISPR gRNA sequence
cctttttctccctttccggt

SEQ ID NO: 370500 - DNA, 20 bp, Artificial
  CRISPR gRNA sequence
ctttttctccctttccggtg

SEQ ID NO: 370501 - DNA, 20 bp, Artificial
  CRISPR gRNA sequence
ctataattctccaattcttt

SEQ ID NO: 370502 - DNA, 20 bp, Artificial
  CRISPR gRNA sequence
caattcttttagcacatctg

SEQ ID NO: 370503 - DNA, 20 bp, Artificial
  CRISPR gRNA sequence
cacatctgaagcccatcttt

SEQ ID NO: 370504 - DNA, 20 bp, Artificial
  CRISPR gRNA sequence
catctgaagcccatctttca

SEQ ID NO: 370505 - DNA, 20 bp, Artificial
  CRISPR gRNA sequence
atctgaagcccatctttcag

SEQ ID NO: 370506 - DNA, 20 bp, Artificial
  CRISPR gRNA sequence
tctgaagcccatctttcaga

SEQ ID NO: 370507 - DNA, 20 bp, Artificial
  CRISPR gRNA sequence
aagcccatctttcagagggc

SEQ ID NO: 370508 - DNA, 20 bp, Artificial
  CRISPR gRNA sequence
gtcccttgctccataatatg

SEQ ID NO: 370509 - DNA, 20 bp, Artificial
  CRISPR gRNA sequence
tcccttgctccataatatgc

SEQ ID NO: 370510 - DNA, 20 bp, Artificial
  CRISPR gRNA sequence
tgctccataatatgcaggct

SEQ ID NO: 370511 - DNA, 20 bp, Artificial
  CRISPR gRNA sequence
atgcaggcttagcatttcac

SEQ ID NO: 370512 - DNA, 20 bp, Artificial
  CRISPR gRNA sequence
tgcaggcttagcatttcact

SEQ ID NO: 370513 - DNA, 20 bp, Artificial
  CRISPR gRNA sequence
agcatttcactaggacactt

SEQ ID NO: 370514 - DNA, 20 bp, Artificial
  CRISPR gRNA sequence
ggacacttgagccctgcaaa

SEQ ID NO: 370515 - DNA, 20 bp, Artificial
  CRISPR gRNA sequence
acacttgagccctgcaaaaa

SEQ ID NO: 370516 - DNA, 20 bp, Artificial
  CRISPR gRNA sequence
ctgaactcctgcctgctcgt

SEQ ID NO: 370517 - DNA, 20 bp, Artificial
  CRISPR gRNA sequence
tgaactcctgcctgctcgtg

SEQ ID NO: 370518 - DNA, 20 bp, Artificial
  CRISPR gRNA sequence
tgctcgtgaggtccatcctg

SEQ ID NO: 370519 - DNA, 20 bp, Artificial
  CRISPR gRNA sequence
ctcgtgaggtccatcctgca

SEQ ID NO: 370520 - DNA, 20 bp, Artificial
  CRISPR gRNA sequence
gcctccttcccaactactct

SEQ ID NO: 370521 - DNA, 20 bp, Artificial
  CRISPR gRNA sequence
ccccacgcttgtaatttaaa

SEQ ID NO: 370522 - DNA, 20 bp, Artificial
  CRISPR gRNA sequence
aatttaaacagtaatttaca

SEQ ID NO: 370523 - DNA, 20 bp, Artificial
  CRISPR gRNA sequence
atttaaacagtaatttacaa

SEQ ID NO: 370524 - DNA, 20 bp, Artificial
  CRISPR gRNA sequence
tttacaaaggttgttactct

SEQ ID NO: 370525 - DNA, 20 bp, Artificial
  CRISPR gRNA sequence
tacaaaggttgttactctaa

SEQ ID NO: 370526 - DNA, 20 bp, Artificial
  CRISPR gRNA sequence
aggttgttactctaagagta

SEQ ID NO: 370527 - DNA, 20 bp, Artificial
  CRISPR gRNA sequence
gagtatggcatacgtttact

SEQ ID NO: 370528 - DNA, 20 bp, Artificial
  CRISPR gRNA sequence
acgtttactgagtttgctct

SEQ ID NO: 370529 - DNA, 20 bp, Artificial
  CRISPR gRNA sequence
tcacatgtaatgcataaaca

SEQ ID NO: 370530 - DNA, 20 bp, Artificial
  CRISPR gRNA sequence
aacatagattaataaaattc

SEQ ID NO: 370531 - DNA, 20 bp, Artificial
  CRISPR gRNA sequence
catagattaataaaattcta

SEQ ID NO: 370532 - DNA, 20 bp, Artificial
  CRISPR gRNA sequence
ataaaattctagagttgctt

SEQ ID NO: 370533 - DNA, 20 bp, Artificial
  CRISPR gRNA sequence
taaaattctagagttgcttt

SEQ ID NO: 370534 - DNA, 20 bp, Artificial
  CRISPR gRNA sequence
aattctagagttgctttagg

SEQ ID NO: 370535 - DNA, 20 bp, Artificial
  CRISPR gRNA sequence
gctttaggcagtttttcatt

SEQ ID NO: 370536 - DNA, 20 bp, Artificial
  CRISPR gRNA sequence
gcagtttttcatttagaaaa

SEQ ID NO: 370537 - DNA, 20 bp, Artificial
  CRISPR gRNA sequence
tttagaaaaaagcacatgtt

SEQ ID NO: 370538 - DNA, 20 bp, Artificial
  CRISPR gRNA sequence
gcacatgtttagaaaataaa

SEQ ID NO: 370539 - DNA, 20 bp, Artificial
  CRISPR gRNA sequence
ttttgttttctaattatgaa

SEQ ID NO: 370540 - DNA, 20 bp, Artificial
  CRISPR gRNA sequence
acctgtccttttctcactct

SEQ ID NO: 370541 - DNA, 20 bp, Artificial
  CRISPR gRNA sequence
ttctcactctgagaaataaa

SEQ ID NO: 370542 - DNA, 20 bp, Artificial
  CRISPR gRNA sequence
tgtgacaataacaaatcctt

SEQ ID NO: 370543 - DNA, 20 bp, Artificial
  CRISPR gRNA sequence
gtgacaataacaaatccttt

SEQ ID NO: 370544 - DNA, 20 bp, Artificial
  CRISPR gRNA sequence
ggcacacttatctcttcaat

SEQ ID NO: 370545 - DNA, 20 bp, Artificial
  CRISPR gRNA sequence
gcacacttatctcttcaata

SEQ ID NO: 370546 - DNA, 20 bp, Artificial
  CRISPR gRNA sequence
ctcttcaataaggacttttt

SEQ ID NO: 370547 - DNA, 20 bp, Artificial
  CRISPR gRNA sequence
ataaggacttttttggtttt

SEQ ID NO: 370548 - DNA, 20 bp, Artificial
  CRISPR gRNA sequence
aaggacttttttggttttca

SEQ ID NO: 370549 - DNA, 20 bp, Artificial
  CRISPR gRNA sequence
ttttttggttttcagagctc

SEQ ID NO: 370550 - DNA, 20 bp, Artificial
  CRISPR gRNA sequence
ttttctttctatgatatcct

SEQ ID NO: 370551 - DNA, 20 bp, Artificial
  CRISPR gRNA sequence
tctctcttctccactgctat

SEQ ID NO: 370552 - DNA, 20 bp, Artificial
  CRISPR gRNA sequence
ctctcttctccactgctatt

SEQ ID NO: 370553 - DNA, 20 bp, Artificial
  CRISPR gRNA sequence
cttctccactgctattggga

SEQ ID NO: 370554 - DNA, 20 bp, Artificial
  CRISPR gRNA sequence
ttctccactgctattgggaa

SEQ ID NO: 370555 - DNA, 20 bp, Artificial
  CRISPR gRNA sequence
ccactgctattgggaaaggt

SEQ ID NO: 370556 - DNA, 20 bp, Artificial
  CRISPR gRNA sequence
cactgctattgggaaaggtg

SEQ ID NO: 370557 - DNA, 20 bp, Artificial
  CRISPR gRNA sequence
actgctattgggaaaggtga

SEQ ID NO: 370558 - DNA, 20 bp, Artificial
  CRISPR gRNA sequence
tattgggaaaggtgagggtg

SEQ ID NO: 370559 - DNA, 20 bp, Artificial
  CRISPR gRNA sequence
ttgggaaaggtgagggtgtg

SEQ ID NO: 370560 - DNA, 20 bp, Artificial
  CRISPR gRNA sequence
gaaaggtgagggtgtggaga

SEQ ID NO: 370561 - DNA, 20 bp, Artificial
  CRISPR gRNA sequence
aaaggtgagggtgtggagac

SEQ ID NO: 370562 - DNA, 20 bp, Artificial
  CRISPR gRNA sequence
aaggtgagggtgtggagacg

SEQ ID NO: 370563 - DNA, 20 bp, Artificial
  CRISPR gRNA sequence
gtgagggtgtggagacgggg

SEQ ID NO: 370564 - DNA, 20 bp, Artificial
  CRISPR gRNA sequence
gggtgtggagacggggaaga

SEQ ID NO: 370565 - DNA, 20 bp, Artificial
  CRISPR gRNA sequence
ggagacggggaagatggctg

SEQ ID NO: 370566 - DNA, 20 bp, Artificial
  CRISPR gRNA sequence
gggaagatggctgtggttgc

SEQ ID NO: 370567 - DNA, 20 bp, Artificial
  CRISPR gRNA sequence
ggaagatggctgtggttgct

SEQ ID NO: 370568 - DNA, 20 bp, Artificial
  CRISPR gRNA sequence
gatggctgtggttgctgggc

SEQ ID NO: 370569 - DNA, 20 bp, Artificial
  CRISPR gRNA sequence
ggctgtggttgctgggctgg

SEQ ID NO: 370570 - DNA, 20 bp, Artificial
  CRISPR gRNA sequence
gctgtggttgctgggctggc

SEQ ID NO: 370571 - DNA, 20 bp, Artificial
  CRISPR gRNA sequence
tgctgggctggcaggtatga

SEQ ID NO: 370572 - DNA, 20 bp, Artificial
  CRISPR gRNA sequence
gcaggtatgacggcgcatcc

SEQ ID NO: 370573 - DNA, 20 bp, Artificial
  CRISPR gRNA sequence
aggtatgacggcgcatccca

SEQ ID NO: 370574 - DNA, 20 bp, Artificial
  CRISPR gRNA sequence
agcccgtttatcccaccatc

SEQ ID NO: 370575 - DNA, 20 bp, Artificial
  CRISPR gRNA sequence
tttatcccaccatctggtgc

SEQ ID NO: 370576 - DNA, 20 bp, Artificial
  CRISPR gRNA sequence
ccaccatctggtgctggtgc

SEQ ID NO: 370577 - DNA, 20 bp, Artificial
  CRISPR gRNA sequence
accatctggtgctggtgcta

SEQ ID NO: 370578 - DNA, 20 bp, Artificial
  CRISPR gRNA sequence
ccatctggtgctggtgctag

SEQ ID NO: 370579 - DNA, 20 bp, Artificial
  CRISPR gRNA sequence
tgctagaggaatctgcccat

SEQ ID NO: 370580 - DNA, 20 bp, Artificial
  CRISPR gRNA sequence
tagaggaatctgcccatcag

SEQ ID NO: 370581 - DNA, 20 bp, Artificial
  CRISPR gRNA sequence
ctattgtccctattcataat

SEQ ID NO: 370582 - DNA, 20 bp, Artificial
  CRISPR gRNA sequence
ttgtccctattcataataag

SEQ ID NO: 370583 - DNA, 20 bp, Artificial
  CRISPR gRNA sequence
gtccctattcataataagca

SEQ ID NO: 370584 - DNA, 20 bp, Artificial
  CRISPR gRNA sequence
ataataagcagagtgtcatt

SEQ ID NO: 370585 - DNA, 20 bp, Artificial
  CRISPR gRNA sequence
agcagagtgtcatttagatc

SEQ ID NO: 370586 - DNA, 20 bp, Artificial
  CRISPR gRNA sequence
gcagagtgtcatttagatct

SEQ ID NO: 370587 - DNA, 20 bp, Artificial
  CRISPR gRNA sequence
agagtgtcatttagatctgg

SEQ ID NO: 370588 - DNA, 20 bp, Artificial
  CRISPR gRNA sequence
gatctgggagtaccttattc

SEQ ID NO: 370589 - DNA, 20 bp, Artificial
  CRISPR gRNA sequence
gagtaccttattctagttat

SEQ ID NO: 370590 - DNA, 20 bp, Artificial
  CRISPR gRNA sequence
ttattctagttataagaaac

SEQ ID NO: 370591 - DNA, 20 bp, Artificial
  CRISPR gRNA sequence
tctagttataagaaaccagt

SEQ ID NO: 370592 - DNA, 20 bp, Artificial
  CRISPR gRNA sequence
gacaaactgtttgttgcact

SEQ ID NO: 370593 - DNA, 20 bp, Artificial
  CRISPR gRNA sequence
cctaaatgctctttatctgc

SEQ ID NO: 370594 - DNA, 20 bp, Artificial
  CRISPR gRNA sequence
gctctttatctgctagctcc

SEQ ID NO: 370595 - DNA, 20 bp, Artificial
  CRISPR gRNA sequence
tagctcctggttgtgctgtg

SEQ ID NO: 370596 - DNA, 20 bp, Artificial
  CRISPR gRNA sequence
gctgtgtggttcctttccta

SEQ ID NO: 370597 - DNA, 20 bp, Artificial
  CRISPR gRNA sequence
gtggttcctttcctaaagct

SEQ ID NO: 370598 - DNA, 20 bp, Artificial
  CRISPR gRNA sequence
tggttcctttcctaaagctg

SEQ ID NO: 370599 - DNA, 20 bp, Artificial
  CRISPR gRNA sequence
gttcctttcctaaagctgag

SEQ ID NO: 370600 - DNA, 20 bp, Artificial
  CRISPR gRNA sequence
tcctttcctaaagctgagga

SEQ ID NO: 370601 - DNA, 20 bp, Artificial
  CRISPR gRNA sequence
ctttcctaaagctgaggaga

SEQ ID NO: 370602 - DNA, 20 bp, Artificial
  CRISPR gRNA sequence
ttcctaaagctgaggagaga

SEQ ID NO: 370603 - DNA, 20 bp, Artificial
  CRISPR gRNA sequence
cctaaagctgaggagagaga

SEQ ID NO: 370604 - DNA, 20 bp, Artificial
  CRISPR gRNA sequence
gctgaggagagagagagaaa

SEQ ID NO: 370605 - DNA, 20 bp, Artificial
  CRISPR gRNA sequence
aaacagatcccatttgttac

SEQ ID NO: 370606 - DNA, 20 bp, Artificial
  CRISPR gRNA sequence
tcccatttgttacaagtgat

SEQ ID NO: 370607 - DNA, 20 bp, Artificial
  CRISPR gRNA sequence
gttacaagtgattagatcca

SEQ ID NO: 370608 - DNA, 20 bp, Artificial
  CRISPR gRNA sequence
ttgtaaatgtgaaaatgaaa

SEQ ID NO: 370609 - DNA, 20 bp, Artificial
  CRISPR gRNA sequence
gaaatagtactgcatatgca

SEQ ID NO: 370610 - DNA, 20 bp, Artificial
  CRISPR gRNA sequence
catatgcaaagcattgaata

SEQ ID NO: 370611 - DNA, 20 bp, Artificial
  CRISPR gRNA sequence
aaagcattgaatatagtcac

SEQ ID NO: 370612 - DNA, 20 bp, Artificial
  CRISPR gRNA sequence
gcattgaatatagtcacaag

SEQ ID NO: 370613 - DNA, 20 bp, Artificial
  CRISPR gRNA sequence
tatagtcacaagcagataat

SEQ ID NO: 370614 - DNA, 20 bp, Artificial
  CRISPR gRNA sequence
gataataagtcctcaaacta

SEQ ID NO: 370615 - DNA, 20 bp, Artificial
  CRISPR gRNA sequence
tagctgttattattattaat

SEQ ID NO: 370616 - DNA, 20 bp, Artificial
  CRISPR gRNA sequence
attattattaatcagaccta

SEQ ID NO: 370617 - DNA, 20 bp, Artificial
  CRISPR gRNA sequence
tattaatcagacctaaagac

SEQ ID NO: 370618 - DNA, 20 bp, Artificial
  CRISPR gRNA sequence
tattatcatctttcttaata

SEQ ID NO: 370619 - DNA, 20 bp, Artificial
  CRISPR gRNA sequence
ttaataaagatcatgaaata

SEQ ID NO: 370620 - DNA, 20 bp, Artificial
  CRISPR gRNA sequence
tgaaatatagccaaatccct

SEQ ID NO: 370621 - DNA, 20 bp, Artificial
  CRISPR gRNA sequence
agccaaatccctgagcaaat

SEQ ID NO: 370622 - DNA, 20 bp, Artificial
  CRISPR gRNA sequence
ccaaatccctgagcaaatca

SEQ ID NO: 370623 - DNA, 20 bp, Artificial
  CRISPR gRNA sequence
caaatccctgagcaaatcag

SEQ ID NO: 370624 - DNA, 20 bp, Artificial
  CRISPR gRNA sequence
atcagaggtgacatttgttc

SEQ ID NO: 370625 - DNA, 20 bp, Artificial
  CRISPR gRNA sequence
gtgacatttgttctagccct

SEQ ID NO: 370626 - DNA, 20 bp, Artificial
  CRISPR gRNA sequence
acatttgttctagccctcag

SEQ ID NO: 370627 - DNA, 20 bp, Artificial
  CRISPR gRNA sequence
atttgttctagccctcagta

SEQ ID NO: 370628 - DNA, 20 bp, Artificial
  CRISPR gRNA sequence
ttgttctagccctcagtaga

SEQ ID NO: 370629 - DNA, 20 bp, Artificial
  CRISPR gRNA sequence
tgttctagccctcagtagag

SEQ ID NO: 370630 - DNA, 20 bp, Artificial
  CRISPR gRNA sequence
attttatgtccaaaaattta

SEQ ID NO: 370631 - DNA, 20 bp, Artificial
  CRISPR gRNA sequence
caaaaatttaaagaattttg

SEQ ID NO: 370632 - DNA, 20 bp, Artificial
  CRISPR gRNA sequence
atttaaagaattttgtagcc

SEQ ID NO: 370633 - DNA, 20 bp, Artificial
  CRISPR gRNA sequence
catctcaatctcaaaatgta

SEQ ID NO: 370634 - DNA, 20 bp, Artificial
  CRISPR gRNA sequence
tctcaatctcaaaatgtaca

SEQ ID NO: 370635 - DNA, 20 bp, Artificial
  CRISPR gRNA sequence
gagctttgtataccctttct

SEQ ID NO: 370636 - DNA, 20 bp, Artificial
  CRISPR gRNA sequence
gtataccctttctcagaact

SEQ ID NO: 370637 - DNA, 20 bp, Artificial
  CRISPR gRNA sequence
tataccctttctcagaactc

SEQ ID NO: 370638 - DNA, 20 bp, Artificial
  CRISPR gRNA sequence
accctttctcagaactcagg

SEQ ID NO: 370639 - DNA, 20 bp, Artificial
  CRISPR gRNA sequence
ccctttctcagaactcagga

SEQ ID NO: 370640 - DNA, 20 bp, Artificial
  CRISPR gRNA sequence
tctcagaactcaggaaggaa

SEQ ID NO: 370641 - DNA, 20 bp, Artificial
  CRISPR gRNA sequence
ctcaggaaggaaaagatatg

SEQ ID NO: 370642 - DNA, 20 bp, Artificial
  CRISPR gRNA sequence
taatcaaacaaacaaaaaca

SEQ ID NO: 370643 - DNA, 20 bp, Artificial
  CRISPR gRNA sequence
tcaaacaaacaaaaacatag

SEQ ID NO: 370644 - DNA, 20 bp, Artificial
  CRISPR gRNA sequence
caaacaaacaaaaacataga

SEQ ID NO: 370645 - DNA, 20 bp, Artificial
  CRISPR gRNA sequence
aaacaaacaaaaacatagaa

SEQ ID NO: 370646 - DNA, 20 bp, Artificial
  CRISPR gRNA sequence
aacaaacaaaaacatagaag

SEQ ID NO: 370647 - DNA, 20 bp, Artificial
  CRISPR gRNA sequence
aaggggcatcattttaaaaa

SEQ ID NO: 370648 - DNA, 20 bp, Artificial
  CRISPR gRNA sequence
ctcactttatgacaacattg

SEQ ID NO: 370649 - DNA, 20 bp, Artificial
  CRISPR gRNA sequence
ttgcagattttgatgtctcc

SEQ ID NO: 370650 - DNA, 20 bp, Artificial
  CRISPR gRNA sequence
tgcagattttgatgtctcct

SEQ ID NO: 370651 - DNA, 20 bp, Artificial
  CRISPR gRNA sequence
tttcactaatttcttcctgt

SEQ ID NO: 370652 - DNA, 20 bp, Artificial
  CRISPR gRNA sequence
cactaatttcttcctgtaag

SEQ ID NO: 370653 - DNA, 20 bp, Artificial
  CRISPR gRNA sequence
actaatttcttcctgtaaga

SEQ ID NO: 370654 - DNA, 20 bp, Artificial
  CRISPR gRNA sequence
aaccattttatgtttaaatg

SEQ ID NO: 370655 - DNA, 20 bp, Artificial
  CRISPR gRNA sequence
atgtttaaatgaagaaatga

SEQ ID NO: 370656 - DNA, 20 bp, Artificial
  CRISPR gRNA sequence
acttttgttgccattgcttt

SEQ ID NO: 370657 - DNA, 20 bp, Artificial
  CRISPR gRNA sequence
tgccattgcttttggtgttt

SEQ ID NO: 370658 - DNA, 20 bp, Artificial
  CRISPR gRNA sequence
gccattgcttttggtgtttt

SEQ ID NO: 370659 - DNA, 20 bp, Artificial
  CRISPR gRNA sequence
cttttggtgttttaggcatg

SEQ ID NO: 370660 - DNA, 20 bp, Artificial
  CRISPR gRNA sequence
gcccatgcctatgtcctgaa

SEQ ID NO: 370661 - DNA, 20 bp, Artificial
  CRISPR gRNA sequence
atgtcctgaatggtaatgcc

SEQ ID NO: 370662 - DNA, 20 bp, Artificial
  CRISPR gRNA sequence
tgtcctgaatggtaatgcct

SEQ ID NO: 370663 - DNA, 20 bp, Artificial
  CRISPR gRNA sequence
gtaatgcctaggttttcttc

SEQ ID NO: 370664 - DNA, 20 bp, Artificial
  CRISPR gRNA sequence
taatgcctaggttttcttct

SEQ ID NO: 370665 - DNA, 20 bp, Artificial
  CRISPR gRNA sequence
aatgcctaggttttcttcta

SEQ ID NO: 370666 - DNA, 20 bp, Artificial
  CRISPR gRNA sequence
gttttcttctagggttttta

SEQ ID NO: 370667 - DNA, 20 bp, Artificial
  CRISPR gRNA sequence
ttctagggtttttatggttt

SEQ ID NO: 370668 - DNA, 20 bp, Artificial
  CRISPR gRNA sequence
tctagggtttttatggtttt

SEQ ID NO: 370669 - DNA, 20 bp, Artificial
  CRISPR gRNA sequence
tggttttaggtctaacattt

SEQ ID NO: 370670 - DNA, 20 bp, Artificial
  CRISPR gRNA sequence
tcttgaattaatttttgtat

SEQ ID NO: 370671 - DNA, 20 bp, Artificial
  CRISPR gRNA sequence
cttgaattaatttttgtata

SEQ ID NO: 370672 - DNA, 20 bp, Artificial
  CRISPR gRNA sequence
ttaatttttgtataaggtgt

SEQ ID NO: 370673 - DNA, 20 bp, Artificial
  CRISPR gRNA sequence
taatttttgtataaggtgta

SEQ ID NO: 370674 - DNA, 20 bp, Artificial
  CRISPR gRNA sequence
tttttgtataaggtgtaagg

SEQ ID NO: 370675 - DNA, 20 bp, Artificial
  CRISPR gRNA sequence
ttttgtataaggtgtaagga

SEQ ID NO: 370676 - DNA, 20 bp, Artificial
  CRISPR gRNA sequence
tttgtataaggtgtaaggaa

SEQ ID NO: 370677 - DNA, 20 bp, Artificial
  CRISPR gRNA sequence
taaggtgtaaggaagggatc

SEQ ID NO: 370678 - DNA, 20 bp, Artificial
  CRISPR gRNA sequence
gtaaggaagggatccagttt

SEQ ID NO: 370679 - DNA, 20 bp, Artificial
  CRISPR gRNA sequence
cagtttcagctttctacata

SEQ ID NO: 370680 - DNA, 20 bp, Artificial
  CRISPR gRNA sequence
ttcagctttctacatatggc

SEQ ID NO: 370681 - DNA, 20 bp, Artificial
  CRISPR gRNA sequence
gctttctacatatggctagc

SEQ ID NO: 370682 - DNA, 20 bp, Artificial
  CRISPR gRNA sequence
atatggctagccagttttcc

SEQ ID NO: 370683 - DNA, 20 bp, Artificial
  CRISPR gRNA sequence
gcacgtgtgcacatgtaccc

SEQ ID NO: 370684 - DNA, 20 bp, Artificial
  CRISPR gRNA sequence
cacatgtaccctagaactta

SEQ ID NO: 370685 - DNA, 20 bp, Artificial
  CRISPR gRNA sequence
aacttaaagtataataaaaa

SEQ ID NO: 370686 - DNA, 20 bp, Artificial
  CRISPR gRNA sequence
taaagtataataaaaaaaga

SEQ ID NO: 370687 - DNA, 20 bp, Artificial
  CRISPR gRNA sequence
aaagaaagaaacattttgaa

SEQ ID NO: 370688 - DNA, 20 bp, Artificial
  CRISPR gRNA sequence
gaaacattttgaatagatat

SEQ ID NO: 370689 - DNA, 20 bp, Artificial
  CRISPR gRNA sequence
tgaatagatataagaaaatg

SEQ ID NO: 370690 - DNA, 20 bp, Artificial
  CRISPR gRNA sequence
aaatgaagatttactgtatt

SEQ ID NO: 370691 - DNA, 20 bp, Artificial
  CRISPR gRNA sequence
actgtattcagctgaacaaa

SEQ ID NO: 370692 - DNA, 20 bp, Artificial
  CRISPR gRNA sequence
attcagctgaacaaaaagtt

SEQ ID NO: 370693 - DNA, 20 bp, Artificial
  CRISPR gRNA sequence
tgaacaaaaagttaagtcca

SEQ ID NO: 370694 - DNA, 20 bp, Artificial
  CRISPR gRNA sequence
aaaaagttaagtccacagcc

SEQ ID NO: 370695 - DNA, 20 bp, Artificial
  CRISPR gRNA sequence
cacagccaagaaatatgatt

SEQ ID NO: 370696 - DNA, 20 bp, Artificial
  CRISPR gRNA sequence
cagccaagaaatatgattaa

SEQ ID NO: 370697 - DNA, 20 bp, Artificial
  CRISPR gRNA sequence
gattaagagatatatttttg

SEQ ID NO: 370698 - DNA, 20 bp, Artificial
  CRISPR gRNA sequence
attaagagatatatttttgt

SEQ ID NO: 370699 - DNA, 20 bp, Artificial
  CRISPR gRNA sequence
gagatatatttttgtgggca

SEQ ID NO: 370700 - DNA, 20 bp, Artificial
  CRISPR gRNA sequence
tttttgtgggcaaagactct

SEQ ID NO: 370701 - DNA, 20 bp, Artificial
  CRISPR gRNA sequence
gtgggcaaagactcttagtt

SEQ ID NO: 370702 - DNA, 20 bp, Artificial
  CRISPR gRNA sequence
tcttagttcagtatgcttat

SEQ ID NO: 370703 - DNA, 20 bp, Artificial
  CRISPR gRNA sequence
cacatacacacatgtaaaat

SEQ ID NO: 370704 - DNA, 20 bp, Artificial
  CRISPR gRNA sequence
agcatattctattttatttt

SEQ ID NO: 370705 - DNA, 20 bp, Artificial
  CRISPR gRNA sequence
attctattttattttgagaa

SEQ ID NO: 370706 - DNA, 20 bp, Artificial
  CRISPR gRNA sequence
tgagaaaagaataaaaatca

SEQ ID NO: 370707 - DNA, 20 bp, Artificial
  CRISPR gRNA sequence
acagttaaaaatgtatacca

SEQ ID NO: 370708 - DNA, 20 bp, Artificial
  CRISPR gRNA sequence
tttacctctttattttaatc

SEQ ID NO: 370709 - DNA, 20 bp, Artificial
  CRISPR gRNA sequence
ctttattttaatcaagtgat

SEQ ID NO: 370710 - DNA, 20 bp, Artificial
  CRISPR gRNA sequence
tgattagaaaatacatgaaa

SEQ ID NO: 370711 - DNA, 20 bp, Artificial
  CRISPR gRNA sequence
atacatgaaaaagtaataca

SEQ ID NO: 370712 - DNA, 20 bp, Artificial
  CRISPR gRNA sequence
tacatgaaaaagtaatacat

SEQ ID NO: 370713 - DNA, 20 bp, Artificial
  CRISPR gRNA sequence
acatgaaaaagtaatacatg

SEQ ID NO: 370714 - DNA, 20 bp, Artificial
  CRISPR gRNA sequence
tgaaaaagtaatacatgggg

SEQ ID NO: 370715 - DNA, 20 bp, Artificial
  CRISPR gRNA sequence
aagtaatacatggggcagat

SEQ ID NO: 370716 - DNA, 20 bp, Artificial
  CRISPR gRNA sequence
atacatggggcagataagtg

SEQ ID NO: 370717 - DNA, 20 bp, Artificial
  CRISPR gRNA sequence
gggcagataagtgtggtgaa

SEQ ID NO: 370718 - DNA, 20 bp, Artificial
  CRISPR gRNA sequence
gcagataagtgtggtgaaaa

SEQ ID NO: 370719 - DNA, 20 bp, Artificial
  CRISPR gRNA sequence
agataagtgtggtgaaaaga

SEQ ID NO: 370720 - DNA, 20 bp, Artificial
  CRISPR gRNA sequence
tggtgaaaagagagttgctt

SEQ ID NO: 370721 - DNA, 20 bp, Artificial
  CRISPR gRNA sequence
aaaagagagttgctttggat

SEQ ID NO: 370722 - DNA, 20 bp, Artificial
  CRISPR gRNA sequence
aagagagttgctttggatta

SEQ ID NO: 370723 - DNA, 20 bp, Artificial
  CRISPR gRNA sequence
agttgctttggattagagtt

SEQ ID NO: 370724 - DNA, 20 bp, Artificial
  CRISPR gRNA sequence
tggattagagttgagaattc

SEQ ID NO: 370725 - DNA, 20 bp, Artificial
  CRISPR gRNA sequence
gagaattctggcctcatttt

SEQ ID NO: 370726 - DNA, 20 bp, Artificial
  CRISPR gRNA sequence
tggcctcattttgagtgaat

SEQ ID NO: 370727 - DNA, 20 bp, Artificial
  CRISPR gRNA sequence
ggcctcattttgagtgaatt

SEQ ID NO: 370728 - DNA, 20 bp, Artificial
  CRISPR gRNA sequence
gtattattccaaacttatat

SEQ ID NO: 370729 - DNA, 20 bp, Artificial
  CRISPR gRNA sequence
ttccaaacttatatgagtgt

SEQ ID NO: 370730 - DNA, 20 bp, Artificial
  CRISPR gRNA sequence
gttagcattcccgtgtgtgt

SEQ ID NO: 370731 - DNA, 20 bp, Artificial
  CRISPR gRNA sequence
gtgtgagtattgccgacctg

SEQ ID NO: 370732 - DNA, 20 bp, Artificial
  CRISPR gRNA sequence
tgtgagtattgccgacctgc

SEQ ID NO: 370733 - DNA, 20 bp, Artificial
  CRISPR gRNA sequence
gtgagtattgccgacctgcg

SEQ ID NO: 370734 - DNA, 20 bp, Artificial
  CRISPR gRNA sequence
gtattgccgacctgcgggga

SEQ ID NO: 370735 - DNA, 20 bp, Artificial
  CRISPR gRNA sequence
tattgccgacctgcggggat

SEQ ID NO: 370736 - DNA, 20 bp, Artificial
  CRISPR gRNA sequence
ccgacctgcggggatgggtg

SEQ ID NO: 370737 - DNA, 20 bp, Artificial
  CRISPR gRNA sequence
acctgcggggatgggtgaag

SEQ ID NO: 370738 - DNA, 20 bp, Artificial
  CRISPR gRNA sequence
ctgcggggatgggtgaagtg

SEQ ID NO: 370739 - DNA, 20 bp, Artificial
  CRISPR gRNA sequence
gatgggtgaagtggagtgcc

SEQ ID NO: 370740 - DNA, 20 bp, Artificial
  CRISPR gRNA sequence
agtggagtgcctggccgcat

SEQ ID NO: 370741 - DNA, 20 bp, Artificial
  CRISPR gRNA sequence
ttgtgcccactctgtgaaca

SEQ ID NO: 370742 - DNA, 20 bp, Artificial
  CRISPR gRNA sequence
actctgtgaacatggacttt

SEQ ID NO: 370743 - DNA, 20 bp, Artificial
  CRISPR gRNA sequence
ctctgtgaacatggacttta

SEQ ID NO: 370744 - DNA, 20 bp, Artificial
  CRISPR gRNA sequence
ttaaggtcgctcttcatatg

SEQ ID NO: 370745 - DNA, 20 bp, Artificial
  CRISPR gRNA sequence
cgctcttcatatgtggtttg

SEQ ID NO: 370746 - DNA, 20 bp, Artificial
  CRISPR gRNA sequence
ggtttgtagcaatatctgtt

SEQ ID NO: 370747 - DNA, 20 bp, Artificial
  CRISPR gRNA sequence
gtttgtagcaatatctgttt

SEQ ID NO: 370748 - DNA, 20 bp, Artificial
  CRISPR gRNA sequence
tttgtagcaatatctgttta

SEQ ID NO: 370749 - DNA, 20 bp, Artificial
  CRISPR gRNA sequence
ggtttattttcaatttgttt

SEQ ID NO: 370750 - DNA, 20 bp, Artificial
  CRISPR gRNA sequence
ggtcccaacttccaaaaatg

SEQ ID NO: 370751 - DNA, 20 bp, Artificial
  CRISPR gRNA sequence
cccaacttccaaaaatgaag

SEQ ID NO: 370752 - DNA, 20 bp, Artificial
  CRISPR gRNA sequence
ccaacttccaaaaatgaaga

SEQ ID NO: 370753 - DNA, 20 bp, Artificial
  CRISPR gRNA sequence
acttccaaaaatgaagaagg

SEQ ID NO: 370754 - DNA, 20 bp, Artificial
  CRISPR gRNA sequence
aaaatgaagaaggcagttcc

SEQ ID NO: 370755 - DNA, 20 bp, Artificial
  CRISPR gRNA sequence
aaatgaagaaggcagttccc

SEQ ID NO: 370756 - DNA, 20 bp, Artificial
  CRISPR gRNA sequence
aatgaagaaggcagttccca

SEQ ID NO: 370757 - DNA, 20 bp, Artificial
  CRISPR gRNA sequence
aggcagttcccagggcttgc

SEQ ID NO: 370758 - DNA, 20 bp, Artificial
  CRISPR gRNA sequence
ggcagttcccagggcttgct

SEQ ID NO: 370759 - DNA, 20 bp, Artificial
  CRISPR gRNA sequence
cccagggcttgctaggctaa

SEQ ID NO: 370760 - DNA, 20 bp, Artificial
  CRISPR gRNA sequence
ctaggctaatagacttttaa

SEQ ID NO: 370761 - DNA, 20 bp, Artificial
  CRISPR gRNA sequence
cttttaatagctcaatattc

SEQ ID NO: 370762 - DNA, 20 bp, Artificial
  CRISPR gRNA sequence
taatagctcaatattctagt

SEQ ID NO: 370763 - DNA, 20 bp, Artificial
  CRISPR gRNA sequence
tattctagttggataaatgt

SEQ ID NO: 370764 - DNA, 20 bp, Artificial
  CRISPR gRNA sequence
gttggataaatgtcagcatt

SEQ ID NO: 370765 - DNA, 20 bp, Artificial
  CRISPR gRNA sequence
tggataaatgtcagcatttg

SEQ ID NO: 370766 - DNA, 20 bp, Artificial
  CRISPR gRNA sequence
taaatgtcagcatttggaga

SEQ ID NO: 370767 - DNA, 20 bp, Artificial
  CRISPR gRNA sequence
aaatgtcagcatttggagaa

SEQ ID NO: 370768 - DNA, 20 bp, Artificial
  CRISPR gRNA sequence
agcatttggagaaaggatgc

SEQ ID NO: 370769 - DNA, 20 bp, Artificial
  CRISPR gRNA sequence
ggagaaaggatgccggtgtt

SEQ ID NO: 370770 - DNA, 20 bp, Artificial
  CRISPR gRNA sequence
ccactctattacccttcctc

SEQ ID NO: 370771 - DNA, 20 bp, Artificial
  CRISPR gRNA sequence
cactctattacccttcctca

SEQ ID NO: 370772 - DNA, 20 bp, Artificial
  CRISPR gRNA sequence
actctattacccttcctcaa

SEQ ID NO: 370773 - DNA, 20 bp, Artificial
  CRISPR gRNA sequence
tattacccttcctcaaggga

SEQ ID NO: 370774 - DNA, 20 bp, Artificial
  CRISPR gRNA sequence
acccttcctcaagggaaaga

SEQ ID NO: 370775 - DNA, 20 bp, Artificial
  CRISPR gRNA sequence
cccttcctcaagggaaagat

SEQ ID NO: 370776 - DNA, 20 bp, Artificial
  CRISPR gRNA sequence
ccttcctcaagggaaagatg

SEQ ID NO: 370777 - DNA, 20 bp, Artificial
  CRISPR gRNA sequence
aagggaaagatggggctctg

SEQ ID NO: 370778 - DNA, 20 bp, Artificial
  CRISPR gRNA sequence
tggggctctgtggcaatctc

SEQ ID NO: 370779 - DNA, 20 bp, Artificial
  CRISPR gRNA sequence
accccaaacctgttccactg

SEQ ID NO: 370780 - DNA, 20 bp, Artificial
  CRISPR gRNA sequence
gttccactgaagccttctct

SEQ ID NO: 370781 - DNA, 20 bp, Artificial
  CRISPR gRNA sequence
gccttctctgagttttttga

SEQ ID NO: 370782 - DNA, 20 bp, Artificial
  CRISPR gRNA sequence
cagtactcacttcaaaaaat

SEQ ID NO: 370783 - DNA, 20 bp, Artificial
  CRISPR gRNA sequence
ttaactcacatgtgccaaca

SEQ ID NO: 370784 - DNA, 20 bp, Artificial
  CRISPR gRNA sequence
tgccaacatggacctatctc

SEQ ID NO: 370785 - DNA, 20 bp, Artificial
  CRISPR gRNA sequence
gccaacatggacctatctca

SEQ ID NO: 370786 - DNA, 20 bp, Artificial
  CRISPR gRNA sequence
aacatggacctatctcaagg

SEQ ID NO: 370787 - DNA, 20 bp, Artificial
  CRISPR gRNA sequence
tggacctatctcaaggaaga

SEQ ID NO: 370788 - DNA, 20 bp, Artificial
  CRISPR gRNA sequence
gacctatctcaaggaagaca

SEQ ID NO: 370789 - DNA, 20 bp, Artificial
  CRISPR gRNA sequence
acagagaaatttatactttt

SEQ ID NO: 370790 - DNA, 20 bp, Artificial
  CRISPR gRNA sequence
agaaatttatactttttagc

SEQ ID NO: 370791 - DNA, 20 bp, Artificial
  CRISPR gRNA sequence
ctttttagctagcaaaatgt

SEQ ID NO: 370792 - DNA, 20 bp, Artificial
  CRISPR gRNA sequence
taacattgtttcttgtgcac

SEQ ID NO: 370793 - DNA, 20 bp, Artificial
  CRISPR gRNA sequence
ttcttgtgcaccagtatgtt

SEQ ID NO: 370794 - DNA, 20 bp, Artificial
  CRISPR gRNA sequence
taactcacttcgccaacacc

SEQ ID NO: 370795 - DNA, 20 bp, Artificial
  CRISPR gRNA sequence
aacacccagtttgctattta

SEQ ID NO: 370796 - DNA, 20 bp, Artificial
  CRISPR gRNA sequence
cagtttgctatttatggcct

SEQ ID NO: 370797 - DNA, 20 bp, Artificial
  CRISPR gRNA sequence
atggcctcggttccacccat

SEQ ID NO: 370798 - DNA, 20 bp, Artificial
  CRISPR gRNA sequence
tcctctttcctaaccgactg

SEQ ID NO: 370799 - DNA, 20 bp, Artificial
  CRISPR gRNA sequence
tttcctaaccgactgcagtg

SEQ ID NO: 370800 - DNA, 20 bp, Artificial
  CRISPR gRNA sequence
aaccgactgcagtgtagtcc

SEQ ID NO: 370801 - DNA, 20 bp, Artificial
  CRISPR gRNA sequence
agtgtagtcccagcgtcttg

SEQ ID NO: 370802 - DNA, 20 bp, Artificial
  CRISPR gRNA sequence
tccattgccttgtaccactc

SEQ ID NO: 370803 - DNA, 20 bp, Artificial
  CRISPR gRNA sequence
ttgccttgtaccactcaaga

SEQ ID NO: 370804 - DNA, 20 bp, Artificial
  CRISPR gRNA sequence
cttgtgtttcttttctttta

SEQ ID NO: 370805 - DNA, 20 bp, Artificial
  CRISPR gRNA sequence
cttttatagactcccaaatc

SEQ ID NO: 370806 - DNA, 20 bp, Artificial
  CRISPR gRNA sequence
ttctaataatctttaaattt

SEQ ID NO: 370807 - DNA, 20 bp, Artificial
  CRISPR gRNA sequence
tttaaattttagaatatttt

SEQ ID NO: 370808 - DNA, 20 bp, Artificial
  CRISPR gRNA sequence
ttagaatatttttagattta

SEQ ID NO: 370809 - DNA, 20 bp, Artificial
  CRISPR gRNA sequence
atatttttagatttacagaa

SEQ ID NO: 370810 - DNA, 20 bp, Artificial
  CRISPR gRNA sequence
tttttagatttacagaaaag

SEQ ID NO: 370811 - DNA, 20 bp, Artificial
  CRISPR gRNA sequence
ttacagaaaagtggaaaaac

SEQ ID NO: 370812 - DNA, 20 bp, Artificial
  CRISPR gRNA sequence
gaaaagtggaaaaactagta

SEQ ID NO: 370813 - DNA, 20 bp, Artificial
  CRISPR gRNA sequence
agtggaaaaactagtacaga

SEQ ID NO: 370814 - DNA, 20 bp, Artificial
  CRISPR gRNA sequence
gtttccatataccccttatc

SEQ ID NO: 370815 - DNA, 20 bp, Artificial
  CRISPR gRNA sequence
gttaacatctcacattattg

SEQ ID NO: 370816 - DNA, 20 bp, Artificial
  CRISPR gRNA sequence
gtggtatgtttgttaaacca

SEQ ID NO: 370817 - DNA, 20 bp, Artificial
  CRISPR gRNA sequence
taaaccaaagaaactgaaac

SEQ ID NO: 370818 - DNA, 20 bp, Artificial
  CRISPR gRNA sequence
ctagtatactaccgttaact

SEQ ID NO: 370819 - DNA, 20 bp, Artificial
  CRISPR gRNA sequence
tactaccgttaactcagctc

SEQ ID NO: 370820 - DNA, 20 bp, Artificial
  CRISPR gRNA sequence
actcagctctagactttatt

SEQ ID NO: 370821 - DNA, 20 bp, Artificial
  CRISPR gRNA sequence
ctagactttatttggatcca

SEQ ID NO: 370822 - DNA, 20 bp, Artificial
  CRISPR gRNA sequence
gttttgtcctctttcctttc

SEQ ID NO: 370823 - DNA, 20 bp, Artificial
  CRISPR gRNA sequence
ttttgtcctctttcctttcc

SEQ ID NO: 370824 - DNA, 20 bp, Artificial
  CRISPR gRNA sequence
tttgtcctctttcctttcca

SEQ ID NO: 370825 - DNA, 20 bp, Artificial
  CRISPR gRNA sequence
ctttccagggtctcctccac

SEQ ID NO: 370826 - DNA, 20 bp, Artificial
  CRISPR gRNA sequence
tttccagggtctcctccacc

SEQ ID NO: 370827 - DNA, 20 bp, Artificial
  CRISPR gRNA sequence
ccaggccaccacattgcatt

SEQ ID NO: 370828 - DNA, 20 bp, Artificial
  CRISPR gRNA sequence
attgagttgccacttctccc

SEQ ID NO: 370829 - DNA, 20 bp, Artificial
  CRISPR gRNA sequence
cagtttcctctgatctgtga

SEQ ID NO: 370830 - DNA, 20 bp, Artificial
  CRISPR gRNA sequence
cttgcttttcacaaccctgt

SEQ ID NO: 370831 - DNA, 20 bp, Artificial
  CRISPR gRNA sequence
ttgcttttcacaaccctgtg

SEQ ID NO: 370832 - DNA, 20 bp, Artificial
  CRISPR gRNA sequence
ttcacaaccctgtgaggcct

SEQ ID NO: 370833 - DNA, 20 bp, Artificial
  CRISPR gRNA sequence
tcacaaccctgtgaggcctg

SEQ ID NO: 370834 - DNA, 20 bp, Artificial
  CRISPR gRNA sequence
ctgtgaggcctgaggaatac

SEQ ID NO: 370835 - DNA, 20 bp, Artificial
  CRISPR gRNA sequence
aggcctgaggaatactagcc

SEQ ID NO: 370836 - DNA, 20 bp, Artificial
  CRISPR gRNA sequence
aatactagcccagtgtcctg

SEQ ID NO: 370837 - DNA, 20 bp, Artificial
  CRISPR gRNA sequence
tactagcccagtgtcctgca

SEQ ID NO: 370838 - DNA, 20 bp, Artificial
  CRISPR gRNA sequence
cctgcagagcatctcccaat

SEQ ID NO: 370839 - DNA, 20 bp, Artificial
  CRISPR gRNA sequence
ctgcagagcatctcccaatt

SEQ ID NO: 370840 - DNA, 20 bp, Artificial
  CRISPR gRNA sequence
tgcagagcatctcccaatta

SEQ ID NO: 370841 - DNA, 20 bp, Artificial
  CRISPR gRNA sequence
tctgatgtttcactcatgat

SEQ ID NO: 370842 - DNA, 20 bp, Artificial
  CRISPR gRNA sequence
tgtttcactcatgattagac

SEQ ID NO: 370843 - DNA, 20 bp, Artificial
  CRISPR gRNA sequence
gtttcactcatgattagact

SEQ ID NO: 370844 - DNA, 20 bp, Artificial
  CRISPR gRNA sequence
tcatgattagactgggaata

SEQ ID NO: 370845 - DNA, 20 bp, Artificial
  CRISPR gRNA sequence
agactgggaatatggaattt

SEQ ID NO: 370846 - DNA, 20 bp, Artificial
  CRISPR gRNA sequence
tgggaatatggaattttgga

SEQ ID NO: 370847 - DNA, 20 bp, Artificial
  CRISPR gRNA sequence
tggaattttggaaagaatac

SEQ ID NO: 370848 - DNA, 20 bp, Artificial
  CRISPR gRNA sequence
gaattttggaaagaatacca

SEQ ID NO: 370849 - DNA, 20 bp, Artificial
  CRISPR gRNA sequence
ccttctcatcacatcatatc

SEQ ID NO: 370850 - DNA, 20 bp, Artificial
  CRISPR gRNA sequence
cttctcatcacatcatatca

SEQ ID NO: 370851 - DNA, 20 bp, Artificial
  CRISPR gRNA sequence
ttctcatcacatcatatcaa

SEQ ID NO: 370852 - DNA, 20 bp, Artificial
  CRISPR gRNA sequence
tctcatcacatcatatcaag

SEQ ID NO: 370853 - DNA, 20 bp, Artificial
  CRISPR gRNA sequence
aggggtacctcatatccacg

SEQ ID NO: 370854 - DNA, 20 bp, Artificial
  CRISPR gRNA sequence
catatccacgcagcgtcact

SEQ ID NO: 370855 - DNA, 20 bp, Artificial
  CRISPR gRNA sequence
acgcagcgtcactgagatgt

SEQ ID NO: 370856 - DNA, 20 bp, Artificial
  CRISPR gRNA sequence
agatgttggtctccatcatg

SEQ ID NO: 370857 - DNA, 20 bp, Artificial
  CRISPR gRNA sequence
ttggtctccatcatgtggtt

SEQ ID NO: 370858 - DNA, 20 bp, Artificial
  CRISPR gRNA sequence
tggtctccatcatgtggtta

SEQ ID NO: 370859 - DNA, 20 bp, Artificial
  CRISPR gRNA sequence
tgccacgttttcccactgtg

SEQ ID NO: 370860 - DNA, 20 bp, Artificial
  CRISPR gRNA sequence
cgttttcccactgtgaagtc

SEQ ID NO: 370861 - DNA, 20 bp, Artificial
  CRISPR gRNA sequence
tatttctcctttctgtgttc

SEQ ID NO: 370862 - DNA, 20 bp, Artificial
  CRISPR gRNA sequence
cctttctgtgttctagtctt

SEQ ID NO: 370863 - DNA, 20 bp, Artificial
  CRISPR gRNA sequence
gtgttctagtctttggacgc

SEQ ID NO: 370864 - DNA, 20 bp, Artificial
  CRISPR gRNA sequence
gtctttggacgcaagtctcc

SEQ ID NO: 370865 - DNA, 20 bp, Artificial
  CRISPR gRNA sequence
tctttggacgcaagtctcca

SEQ ID NO: 370866 - DNA, 20 bp, Artificial
  CRISPR gRNA sequence
ccaaggtgtgcccatcctca

SEQ ID NO: 370867 - DNA, 20 bp, Artificial
  CRISPR gRNA sequence
caaggtgtgcccatcctcac

SEQ ID NO: 370868 - DNA, 20 bp, Artificial
  CRISPR gRNA sequence
aaggtgtgcccatcctcaca

SEQ ID NO: 370869 - DNA, 20 bp, Artificial
  CRISPR gRNA sequence
cacagggctgcctccttctt

SEQ ID NO: 370870 - DNA, 20 bp, Artificial
  CRISPR gRNA sequence
tctttagaaaactactaaca

SEQ ID NO: 370871 - DNA, 20 bp, Artificial
  CRISPR gRNA sequence
aactactaacacagtgcacc

SEQ ID NO: 370872 - DNA, 20 bp, Artificial
  CRISPR gRNA sequence
ctactaacacagtgcaccaa

SEQ ID NO: 370873 - DNA, 20 bp, Artificial
  CRISPR gRNA sequence
gagtatcaaaacaacattta

SEQ ID NO: 370874 - DNA, 20 bp, Artificial
  CRISPR gRNA sequence
acagaaattttaaaatgcat

SEQ ID NO: 370875 - DNA, 20 bp, Artificial
  CRISPR gRNA sequence
agaaattttaaaatgcataa

SEQ ID NO: 370876 - DNA, 20 bp, Artificial
  CRISPR gRNA sequence
ataagagaaataaatgaaaa

SEQ ID NO: 370877 - DNA, 20 bp, Artificial
  CRISPR gRNA sequence
agaaataaatgaaaaaagtt

SEQ ID NO: 370878 - DNA, 20 bp, Artificial
  CRISPR gRNA sequence
gaaataaatgaaaaaagttc

SEQ ID NO: 370879 - DNA, 20 bp, Artificial
  CRISPR gRNA sequence
tttcctgttcaactctcatt

SEQ ID NO: 370880 - DNA, 20 bp, Artificial
  CRISPR gRNA sequence
tcctgttcaactctcattca

SEQ ID NO: 370881 - DNA, 20 bp, Artificial
  CRISPR gRNA sequence
cacacacatgttctaactgt

SEQ ID NO: 370882 - DNA, 20 bp, Artificial
  CRISPR gRNA sequence
acatgttctaactgttagca

SEQ ID NO: 370883 - DNA, 20 bp, Artificial
  CRISPR gRNA sequence
ttttctgtacattatgtcat

SEQ ID NO: 370884 - DNA, 20 bp, Artificial
  CRISPR gRNA sequence
ataagcatttccaatactga

SEQ ID NO: 370885 - DNA, 20 bp, Artificial
  CRISPR gRNA sequence
atgatttgcttcaccttgtt

SEQ ID NO: 370886 - DNA, 20 bp, Artificial
  CRISPR gRNA sequence
gcttcaccttgttaagtttc

SEQ ID NO: 370887 - DNA, 20 bp, Artificial
  CRISPR gRNA sequence
ttgttaagtttctggacatt

SEQ ID NO: 370888 - DNA, 20 bp, Artificial
  CRISPR gRNA sequence
tctctatttcaactaatgct

SEQ ID NO: 370889 - DNA, 20 bp, Artificial
  CRISPR gRNA sequence
atttcaactaatgcttggtg

SEQ ID NO: 370890 - DNA, 20 bp, Artificial
  CRISPR gRNA sequence
ttcacatatgtaatgcttta

SEQ ID NO: 370891 - DNA, 20 bp, Artificial
  CRISPR gRNA sequence
tttacagaattattgttgcg

SEQ ID NO: 370892 - DNA, 20 bp, Artificial
  CRISPR gRNA sequence
ttacagaattattgttgcgt

SEQ ID NO: 370893 - DNA, 20 bp, Artificial
  CRISPR gRNA sequence
tgttgcgtaggattaatttg

SEQ ID NO: 370894 - DNA, 20 bp, Artificial
  CRISPR gRNA sequence
gacatttcctctgacgtata

SEQ ID NO: 370895 - DNA, 20 bp, Artificial
  CRISPR gRNA sequence
caaatccaaaataaatacca

SEQ ID NO: 370896 - DNA, 20 bp, Artificial
  CRISPR gRNA sequence
tcttgtttccctcttgctgt

SEQ ID NO: 370897 - DNA, 20 bp, Artificial
  CRISPR gRNA sequence
ctcttgctgttagttttttc

SEQ ID NO: 370898 - DNA, 20 bp, Artificial
  CRISPR gRNA sequence
tcttgctgttagttttttct

SEQ ID NO: 370899 - DNA, 20 bp, Artificial
  CRISPR gRNA sequence
attacaactatccctgctaa

SEQ ID NO: 370900 - DNA, 20 bp, Artificial
  CRISPR gRNA sequence
gctaatagctgtactcacac

SEQ ID NO: 370901 - DNA, 20 bp, Artificial
  CRISPR gRNA sequence
ttttcattttaacttcatta

SEQ ID NO: 370902 - DNA, 20 bp, Artificial
  CRISPR gRNA sequence
tggtttgaactaaataattt

SEQ ID NO: 370903 - DNA, 20 bp, Artificial
  CRISPR gRNA sequence
aatttcagcctcttctacct

SEQ ID NO: 370904 - DNA, 20 bp, Artificial
  CRISPR gRNA sequence
atttcagcctcttctacctc

SEQ ID NO: 370905 - DNA, 20 bp, Artificial
  CRISPR gRNA sequence
tttcagcctcttctacctca

SEQ ID NO: 370906 - DNA, 20 bp, Artificial
  CRISPR gRNA sequence
tcagcctcttctacctcagg

SEQ ID NO: 370907 - DNA, 20 bp, Artificial
  CRISPR gRNA sequence
cttctacctcagggagttgt

SEQ ID NO: 370908 - DNA, 20 bp, Artificial
  CRISPR gRNA sequence
aaatactgttgatctttctg

SEQ ID NO: 370909 - DNA, 20 bp, Artificial
  CRISPR gRNA sequence
tgatctttctgtggtttgaa

SEQ ID NO: 370910 - DNA, 20 bp, Artificial
  CRISPR gRNA sequence
tctgtggtttgaaaagcacc

SEQ ID NO: 370911 - DNA, 20 bp, Artificial
  CRISPR gRNA sequence
tgtggtttgaaaagcacctg

SEQ ID NO: 370912 - DNA, 20 bp, Artificial
  CRISPR gRNA sequence
gaaaagcacctggagctctt

SEQ ID NO: 370913 - DNA, 20 bp, Artificial
  CRISPR gRNA sequence
aaagcacctggagctctttg

SEQ ID NO: 370914 - DNA, 20 bp, Artificial
  CRISPR gRNA sequence
agcacctggagctctttgga

SEQ ID NO: 370915 - DNA, 20 bp, Artificial
  CRISPR gRNA sequence
cctggagctctttggagagt

SEQ ID NO: 370916 - DNA, 20 bp, Artificial
  CRISPR gRNA sequence
gtattaaaaccataaatttg

SEQ ID NO: 370917 - DNA, 20 bp, Artificial
  CRISPR gRNA sequence
aaaccataaatttgcagtgc

SEQ ID NO: 370918 - DNA, 20 bp, Artificial
  CRISPR gRNA sequence
ttgcagtgctggctgatgct

SEQ ID NO: 370919 - DNA, 20 bp, Artificial
  CRISPR gRNA sequence
tgcagtgctggctgatgctc

SEQ ID NO: 370920 - DNA, 20 bp, Artificial
  CRISPR gRNA sequence
gcagtgctggctgatgctca

SEQ ID NO: 370921 - DNA, 20 bp, Artificial
  CRISPR gRNA sequence
cagtgctggctgatgctcag

SEQ ID NO: 370922 - DNA, 20 bp, Artificial
  CRISPR gRNA sequence
gctggctgatgctcaggggt

SEQ ID NO: 370923 - DNA, 20 bp, Artificial
  CRISPR gRNA sequence
ggctgatgctcaggggtgag

SEQ ID NO: 370924 - DNA, 20 bp, Artificial
  CRISPR gRNA sequence
tgctcaggggtgagtggtgc

SEQ ID NO: 370925 - DNA, 20 bp, Artificial
  CRISPR gRNA sequence
gctcaggggtgagtggtgcc

SEQ ID NO: 370926 - DNA, 20 bp, Artificial
  CRISPR gRNA sequence
tcaggggtgagtggtgccag

SEQ ID NO: 370927 - DNA, 20 bp, Artificial
  CRISPR gRNA sequence
caggggtgagtggtgccagg

SEQ ID NO: 370928 - DNA, 20 bp, Artificial
  CRISPR gRNA sequence
aggggtgagtggtgccagga

SEQ ID NO: 370929 - DNA, 20 bp, Artificial
  CRISPR gRNA sequence
gtgagtggtgccaggaggga

SEQ ID NO: 370930 - DNA, 20 bp, Artificial
  CRISPR gRNA sequence
caggagggaaagctgctgtg

SEQ ID NO: 370931 - DNA, 20 bp, Artificial
  CRISPR gRNA sequence
aggagggaaagctgctgtgt

SEQ ID NO: 370932 - DNA, 20 bp, Artificial
  CRISPR gRNA sequence
ctgctgtgtgggtttccatt

SEQ ID NO: 370933 - DNA, 20 bp, Artificial
  CRISPR gRNA sequence
ctgtgtgggtttccatttgg

SEQ ID NO: 370934 - DNA, 20 bp, Artificial
  CRISPR gRNA sequence
tgtgggtttccatttggcag

SEQ ID NO: 370935 - DNA, 20 bp, Artificial
  CRISPR gRNA sequence
gggtttccatttggcagaag

SEQ ID NO: 370936 - DNA, 20 bp, Artificial
  CRISPR gRNA sequence
ggtttccatttggcagaagt

SEQ ID NO: 370937 - DNA, 20 bp, Artificial
  CRISPR gRNA sequence
ccatttggcagaagtgggaa

SEQ ID NO: 370938 - DNA, 20 bp, Artificial
  CRISPR gRNA sequence
atttggcagaagtgggaatg

SEQ ID NO: 370939 - DNA, 20 bp, Artificial
  CRISPR gRNA sequence
aatggagacccaaactcatg

SEQ ID NO: 370940 - DNA, 20 bp, Artificial
  CRISPR gRNA sequence
atggagacccaaactcatgt

SEQ ID NO: 370941 - DNA, 20 bp, Artificial
  CRISPR gRNA sequence
tggagacccaaactcatgta

SEQ ID NO: 370942 - DNA, 20 bp, Artificial
  CRISPR gRNA sequence
acccaaactcatgtagggcc

SEQ ID NO: 370943 - DNA, 20 bp, Artificial
  CRISPR gRNA sequence
aactcatgtagggcctggac

SEQ ID NO: 370944 - DNA, 20 bp, Artificial
  CRISPR gRNA sequence
ggactggaaaatattgctct

SEQ ID NO: 370945 - DNA, 20 bp, Artificial
  CRISPR gRNA sequence
aaaatattgctctgagttcc

SEQ ID NO: 370946 - DNA, 20 bp, Artificial
  CRISPR gRNA sequence
aatttacaacacatcatctt

SEQ ID NO: 370947 - DNA, 20 bp, Artificial
  CRISPR gRNA sequence
tttacaacacatcatctttg

SEQ ID NO: 370948 - DNA, 20 bp, Artificial
  CRISPR gRNA sequence
gagatgttttctcatccatg

SEQ ID NO: 370949 - DNA, 20 bp, Artificial
  CRISPR gRNA sequence
tgtagtccccccaaaattat

SEQ ID NO: 370950 - DNA, 20 bp, Artificial
  CRISPR gRNA sequence
gtagtccccccaaaattatt

SEQ ID NO: 370951 - DNA, 20 bp, Artificial
  CRISPR gRNA sequence
attgggaaacttaatgtgcc

SEQ ID NO: 370952 - DNA, 20 bp, Artificial
  CRISPR gRNA sequence
aatgtgcctggcattttgct

SEQ ID NO: 370953 - DNA, 20 bp, Artificial
  CRISPR gRNA sequence
gcctggcattttgctaagat

SEQ ID NO: 370954 - DNA, 20 bp, Artificial
  CRISPR gRNA sequence
tgctaagattagacatactg

SEQ ID NO: 370955 - DNA, 20 bp, Artificial
  CRISPR gRNA sequence
gctaagattagacatactga

SEQ ID NO: 370956 - DNA, 20 bp, Artificial
  CRISPR gRNA sequence
actgaaggtacaatgtcttt

SEQ ID NO: 370957 - DNA, 20 bp, Artificial
  CRISPR gRNA sequence
ctgaaggtacaatgtcttta

SEQ ID NO: 370958 - DNA, 20 bp, Artificial
  CRISPR gRNA sequence
gaaggtacaatgtctttaag

SEQ ID NO: 370959 - DNA, 20 bp, Artificial
  CRISPR gRNA sequence
ggtacaatgtctttaaggag

SEQ ID NO: 370960 - DNA, 20 bp, Artificial
  CRISPR gRNA sequence
caatgtctttaaggagtgga

SEQ ID NO: 370961 - DNA, 20 bp, Artificial
  CRISPR gRNA sequence
ttaaggagtggatagtttct

SEQ ID NO: 370962 - DNA, 20 bp, Artificial
  CRISPR gRNA sequence
taaggagtggatagtttctt

SEQ ID NO: 370963 - DNA, 20 bp, Artificial
  CRISPR gRNA sequence
aaggagtggatagtttctta

SEQ ID NO: 370964 - DNA, 20 bp, Artificial
  CRISPR gRNA sequence
gagtggatagtttcttaggg

SEQ ID NO: 370965 - DNA, 20 bp, Artificial
  CRISPR gRNA sequence
agtggatagtttcttagggc

SEQ ID NO: 370966 - DNA, 20 bp, Artificial
  CRISPR gRNA sequence
ggatagtttcttagggcagg

SEQ ID NO: 370967 - DNA, 20 bp, Artificial
  CRISPR gRNA sequence
acaaataaaaaacaacacaa

SEQ ID NO: 370968 - DNA, 20 bp, Artificial
  CRISPR gRNA sequence
aataaaaaacaacacaatag

SEQ ID NO: 370969 - DNA, 20 bp, Artificial
  CRISPR gRNA sequence
ataaaaaacaacacaataga

SEQ ID NO: 370970 - DNA, 20 bp, Artificial
  CRISPR gRNA sequence
aaaaacaacacaatagaagg

SEQ ID NO: 370971 - DNA, 20 bp, Artificial
  CRISPR gRNA sequence
aaacaacacaatagaaggta

SEQ ID NO: 370972 - DNA, 20 bp, Artificial
  CRISPR gRNA sequence
aacaacacaatagaaggtag

SEQ ID NO: 370973 - DNA, 20 bp, Artificial
  CRISPR gRNA sequence
aatagaaggtagaggtaaaa

SEQ ID NO: 370974 - DNA, 20 bp, Artificial
  CRISPR gRNA sequence
tagaaggtagaggtaaaaca

SEQ ID NO: 370975 - DNA, 20 bp, Artificial
  CRISPR gRNA sequence
agaaggtagaggtaaaacag

SEQ ID NO: 370976 - DNA, 20 bp, Artificial
  CRISPR gRNA sequence
aaggtagaggtaaaacagag

SEQ ID NO: 370977 - DNA, 20 bp, Artificial
  CRISPR gRNA sequence
aggtagaggtaaaacagagg

SEQ ID NO: 370978 - DNA, 20 bp, Artificial
  CRISPR gRNA sequence
ggtagaggtaaaacagagga

SEQ ID NO: 370979 - DNA, 20 bp, Artificial
  CRISPR gRNA sequence
tagaggtaaaacagaggagg

SEQ ID NO: 370980 - DNA, 20 bp, Artificial
  CRISPR gRNA sequence
aggtaaaacagaggagggag

SEQ ID NO: 370981 - DNA, 20 bp, Artificial
  CRISPR gRNA sequence
aaaacagaggagggagtggt

SEQ ID NO: 370982 - DNA, 20 bp, Artificial
  CRISPR gRNA sequence
tggttagcctattttgaaat

SEQ ID NO: 370983 - DNA, 20 bp, Artificial
  CRISPR gRNA sequence
tagcctattttgaaatgagt

SEQ ID NO: 370984 - DNA, 20 bp, Artificial
  CRISPR gRNA sequence
aagaaaatacttccttgaaa

SEQ ID NO: 370985 - DNA, 20 bp, Artificial
  CRISPR gRNA sequence
agaaaatacttccttgaaat

SEQ ID NO: 370986 - DNA, 20 bp, Artificial
  CRISPR gRNA sequence
ccttgaaataggtgatgtca

SEQ ID NO: 370987 - DNA, 20 bp, Artificial
  CRISPR gRNA sequence
aataggtgatgtcacagaat

SEQ ID NO: 370988 - DNA, 20 bp, Artificial
  CRISPR gRNA sequence
tcacagaataagtgatatca

SEQ ID NO: 370989 - DNA, 20 bp, Artificial
  CRISPR gRNA sequence
cacagaataagtgatatcac

SEQ ID NO: 370990 - DNA, 20 bp, Artificial
  CRISPR gRNA sequence
aataagtgatatcacaggat

SEQ ID NO: 370991 - DNA, 20 bp, Artificial
  CRISPR gRNA sequence
aagtgatatcacaggataag

SEQ ID NO: 370992 - DNA, 20 bp, Artificial
  CRISPR gRNA sequence
tcacaggataagtggcatca

SEQ ID NO: 370993 - DNA, 20 bp, Artificial
  CRISPR gRNA sequence
cacaggataagtggcatcac

SEQ ID NO: 370994 - DNA, 20 bp, Artificial
  CRISPR gRNA sequence
gataagtggcatcacaggat

SEQ ID NO: 370995 - DNA, 20 bp, Artificial
  CRISPR gRNA sequence
ataagtggcatcacaggata

SEQ ID NO: 370996 - DNA, 20 bp, Artificial
  CRISPR gRNA sequence
agtggcatcacaggataagg

SEQ ID NO: 370997 - DNA, 20 bp, Artificial
  CRISPR gRNA sequence
cacaggataaggtggcatca

SEQ ID NO: 370998 - DNA, 20 bp, Artificial
  CRISPR gRNA sequence
acaggataaggtggcatcac

SEQ ID NO: 370999 - DNA, 20 bp, Artificial
  CRISPR gRNA sequence
gcatcacaggataaattttg

SEQ ID NO: 371000 - DNA, 20 bp, Artificial
  CRISPR gRNA sequence
catcacaggataaattttga

SEQ ID NO: 371001 - DNA, 20 bp, Artificial
  CRISPR gRNA sequence
gataaattttgaaggataaa

SEQ ID NO: 371002 - DNA, 20 bp, Artificial
  CRISPR gRNA sequence
aaattttgaaggataaatag

SEQ ID NO: 371003 - DNA, 20 bp, Artificial
  CRISPR gRNA sequence
aggataaatagcagtgttct

SEQ ID NO: 371004 - DNA, 20 bp, Artificial
  CRISPR gRNA sequence
atagcagtgttcttggaatg

SEQ ID NO: 371005 - DNA, 20 bp, Artificial
  CRISPR gRNA sequence
gcagtgttcttggaatgaag

SEQ ID NO: 371006 - DNA, 20 bp, Artificial
  CRISPR gRNA sequence
gtgttcttggaatgaagtgg

SEQ ID NO: 371007 - DNA, 20 bp, Artificial
  CRISPR gRNA sequence
tgttcttggaatgaagtgga

SEQ ID NO: 371008 - DNA, 20 bp, Artificial
  CRISPR gRNA sequence
tgaagtggaaggattatatg

SEQ ID NO: 371009 - DNA, 20 bp, Artificial
  CRISPR gRNA sequence
gaagtggaaggattatatga

SEQ ID NO: 371010 - DNA, 20 bp, Artificial
  CRISPR gRNA sequence
aggattatatgaaggcattc

SEQ ID NO: 371011 - DNA, 20 bp, Artificial
  CRISPR gRNA sequence
attatatgaaggcattccag

SEQ ID NO: 371012 - DNA, 20 bp, Artificial
  CRISPR gRNA sequence
atatgaaggcattccagaag

SEQ ID NO: 371013 - DNA, 20 bp, Artificial
  CRISPR gRNA sequence
atgaaggcattccagaagaa

SEQ ID NO: 371014 - DNA, 20 bp, Artificial
  CRISPR gRNA sequence
aggcattccagaagaagaga

SEQ ID NO: 371015 - DNA, 20 bp, Artificial
  CRISPR gRNA sequence
gaagaagagatagctgatgc

SEQ ID NO: 371016 - DNA, 20 bp, Artificial
  CRISPR gRNA sequence
atagctgatgcaagatcata

SEQ ID NO: 371017 - DNA, 20 bp, Artificial
  CRISPR gRNA sequence
tagctgatgcaagatcataa

SEQ ID NO: 371018 - DNA, 20 bp, Artificial
  CRISPR gRNA sequence
ataaaggtgaataatgttct

SEQ ID NO: 371019 - DNA, 20 bp, Artificial
  CRISPR gRNA sequence
taaaggtgaataatgttctt

SEQ ID NO: 371020 - DNA, 20 bp, Artificial
  CRISPR gRNA sequence
aaaggtgaataatgttcttg

SEQ ID NO: 371021 - DNA, 20 bp, Artificial
  CRISPR gRNA sequence
aataatgttcttggggaaac

SEQ ID NO: 371022 - DNA, 20 bp, Artificial
  CRISPR gRNA sequence
taatgttcttggggaaactg

SEQ ID NO: 371023 - DNA, 20 bp, Artificial
  CRISPR gRNA sequence
cttggggaaactggagtata

SEQ ID NO: 371024 - DNA, 20 bp, Artificial
  CRISPR gRNA sequence
ggggaaactggagtatatgg

SEQ ID NO: 371025 - DNA, 20 bp, Artificial
  CRISPR gRNA sequence
ctggagtatatggcagattc

SEQ ID NO: 371026 - DNA, 20 bp, Artificial
  CRISPR gRNA sequence
gagtatatggcagattctag

SEQ ID NO: 371027 - DNA, 20 bp, Artificial
  CRISPR gRNA sequence
agtatatggcagattctagt

SEQ ID NO: 371028 - DNA, 20 bp, Artificial
  CRISPR gRNA sequence
tatatggcagattctagtag

SEQ ID NO: 371029 - DNA, 20 bp, Artificial
  CRISPR gRNA sequence
ggcagattctagtaggagat

SEQ ID NO: 371030 - DNA, 20 bp, Artificial
  CRISPR gRNA sequence
attctagtaggagatgagaa

SEQ ID NO: 371031 - DNA, 20 bp, Artificial
  CRISPR gRNA sequence
tctagtaggagatgagaatg

SEQ ID NO: 371032 - DNA, 20 bp, Artificial
  CRISPR gRNA sequence
aggagatgagaatggagaca

SEQ ID NO: 371033 - DNA, 20 bp, Artificial
  CRISPR gRNA sequence
ggagatgagaatggagacaa

SEQ ID NO: 371034 - DNA, 20 bp, Artificial
  CRISPR gRNA sequence
atgagaatggagacaaaggc

SEQ ID NO: 371035 - DNA, 20 bp, Artificial
  CRISPR gRNA sequence
aaggcaagaataaaatcata

SEQ ID NO: 371036 - DNA, 20 bp, Artificial
  CRISPR gRNA sequence
aggcaagaataaaatcatat

SEQ ID NO: 371037 - DNA, 20 bp, Artificial
  CRISPR gRNA sequence
aatcatataggattttgcta

SEQ ID NO: 371038 - DNA, 20 bp, Artificial
  CRISPR gRNA sequence
agaacatgtgctttgtcctg

SEQ ID NO: 371039 - DNA, 20 bp, Artificial
  CRISPR gRNA sequence
acatgtgctttgtcctgtag

SEQ ID NO: 371040 - DNA, 20 bp, Artificial
  CRISPR gRNA sequence
catgtgctttgtcctgtagt

SEQ ID NO: 371041 - DNA, 20 bp, Artificial
  CRISPR gRNA sequence
gctttgtcctgtagtaggaa

SEQ ID NO: 371042 - DNA, 20 bp, Artificial
  CRISPR gRNA sequence
ctttgtcctgtagtaggaat

SEQ ID NO: 371043 - DNA, 20 bp, Artificial
  CRISPR gRNA sequence
ggaaacgtctgaacctttca

SEQ ID NO: 371044 - DNA, 20 bp, Artificial
  CRISPR gRNA sequence
cgtctgaacctttcaaagta

SEQ ID NO: 371045 - DNA, 20 bp, Artificial
  CRISPR gRNA sequence
aacctttcaaagtacagctg

SEQ ID NO: 371046 - DNA, 20 bp, Artificial
  CRISPR gRNA sequence
aagtacagctgtagcctgat

SEQ ID NO: 371047 - DNA, 20 bp, Artificial
  CRISPR gRNA sequence
gcctgataagatttatatgt

SEQ ID NO: 371048 - DNA, 20 bp, Artificial
  CRISPR gRNA sequence
agatttatatgttagttata

SEQ ID NO: 371049 - DNA, 20 bp, Artificial
  CRISPR gRNA sequence
gtctttgatgcaatatgaat

SEQ ID NO: 371050 - DNA, 20 bp, Artificial
  CRISPR gRNA sequence
ctttgatgcaatatgaattg

SEQ ID NO: 371051 - DNA, 20 bp, Artificial
  CRISPR gRNA sequence
tttgatgcaatatgaattgg

SEQ ID NO: 371052 - DNA, 20 bp, Artificial
  CRISPR gRNA sequence
ttgatgcaatatgaattgga

SEQ ID NO: 371053 - DNA, 20 bp, Artificial
  CRISPR gRNA sequence
gcaatatgaattggagggaa

SEQ ID NO: 371054 - DNA, 20 bp, Artificial
  CRISPR gRNA sequence
caatatgaattggagggaaa

SEQ ID NO: 371055 - DNA, 20 bp, Artificial
  CRISPR gRNA sequence
aatatgaattggagggaaaa

SEQ ID NO: 371056 - DNA, 20 bp, Artificial
  CRISPR gRNA sequence
atatgaattggagggaaaag

SEQ ID NO: 371057 - DNA, 20 bp, Artificial
  CRISPR gRNA sequence
gagggaaaaggggctacaat

SEQ ID NO: 371058 - DNA, 20 bp, Artificial
  CRISPR gRNA sequence
gggaaaaggggctacaatta

SEQ ID NO: 371059 - DNA, 20 bp, Artificial
  CRISPR gRNA sequence
cattttgacaactattttaa

SEQ ID NO: 371060 - DNA, 20 bp, Artificial
  CRISPR gRNA sequence
tgacaactattttaatagtc

SEQ ID NO: 371061 - DNA, 20 bp, Artificial
  CRISPR gRNA sequence
atagtccagttgaaaaaatg

SEQ ID NO: 371062 - DNA, 20 bp, Artificial
  CRISPR gRNA sequence
tagtccagttgaaaaaatgt

SEQ ID NO: 371063 - DNA, 20 bp, Artificial
  CRISPR gRNA sequence
agtccagttgaaaaaatgta

SEQ ID NO: 371064 - DNA, 20 bp, Artificial
  CRISPR gRNA sequence
ccagttgaaaaaatgtaggg

SEQ ID NO: 371065 - DNA, 20 bp, Artificial
  CRISPR gRNA sequence
tctcaaattttcattctgtt

SEQ ID NO: 371066 - DNA, 20 bp, Artificial
  CRISPR gRNA sequence
aattttcattctgtttggtt

SEQ ID NO: 371067 - DNA, 20 bp, Artificial
  CRISPR gRNA sequence
actgttcatcatctttgtgt

SEQ ID NO: 371068 - DNA, 20 bp, Artificial
  CRISPR gRNA sequence
tagtcattcttgctgttgtg

SEQ ID NO: 371069 - DNA, 20 bp, Artificial
  CRISPR gRNA sequence
gctgttgtgcagatttcttt

SEQ ID NO: 371070 - DNA, 20 bp, Artificial
  CRISPR gRNA sequence
gagattgtgcttaactccta

SEQ ID NO: 371071 - DNA, 20 bp, Artificial
  CRISPR gRNA sequence
gtgcttaactcctacagatg

SEQ ID NO: 371072 - DNA, 20 bp, Artificial
  CRISPR gRNA sequence
gatgtagtaaatgaattctc

SEQ ID NO: 371073 - DNA, 20 bp, Artificial
  CRISPR gRNA sequence
attaatcatccaatatgtac

SEQ ID NO: 371074 - DNA, 20 bp, Artificial
  CRISPR gRNA sequence
atatgtacaagctattatat

SEQ ID NO: 371075 - DNA, 20 bp, Artificial
  CRISPR gRNA sequence
tatgtacaagctattatata

SEQ ID NO: 371076 - DNA, 20 bp, Artificial
  CRISPR gRNA sequence
tattatataaggtttttcct

SEQ ID NO: 371077 - DNA, 20 bp, Artificial
  CRISPR gRNA sequence
tataaggtttttcctgagat

SEQ ID NO: 371078 - DNA, 20 bp, Artificial
  CRISPR gRNA sequence
aaggtttttcctgagattag

SEQ ID NO: 371079 - DNA, 20 bp, Artificial
  CRISPR gRNA sequence
aggtttttcctgagattaga

SEQ ID NO: 371080 - DNA, 20 bp, Artificial
  CRISPR gRNA sequence
gtttttcctgagattagaag

SEQ ID NO: 371081 - DNA, 20 bp, Artificial
  CRISPR gRNA sequence
caattcaccctacaattaac

SEQ ID NO: 371082 - DNA, 20 bp, Artificial
  CRISPR gRNA sequence
tcaccctacaattaactggc

SEQ ID NO: 371083 - DNA, 20 bp, Artificial
  CRISPR gRNA sequence
actggcaagcttttgaaaca

SEQ ID NO: 371084 - DNA, 20 bp, Artificial
  CRISPR gRNA sequence
ggcaagcttttgaaacatgg

SEQ ID NO: 371085 - DNA, 20 bp, Artificial
  CRISPR gRNA sequence
caagcttttgaaacatggtg

SEQ ID NO: 371086 - DNA, 20 bp, Artificial
  CRISPR gRNA sequence
ttgaaacatggtggagtaac

SEQ ID NO: 371087 - DNA, 20 bp, Artificial
  CRISPR gRNA sequence
caagaaacaaacaaatattt

SEQ ID NO: 371088 - DNA, 20 bp, Artificial
  CRISPR gRNA sequence
tagaaattatttttgcctcc

SEQ ID NO: 371089 - DNA, 20 bp, Artificial
  CRISPR gRNA sequence
agaaattatttttgcctcca

SEQ ID NO: 371090 - DNA, 20 bp, Artificial
  CRISPR gRNA sequence
aaattatttttgcctccaag

SEQ ID NO: 371091 - DNA, 20 bp, Artificial
  CRISPR gRNA sequence
atttttgcctccaaggagct

SEQ ID NO: 371092 - DNA, 20 bp, Artificial
  CRISPR gRNA sequence
ccaaggagcttggcataact

SEQ ID NO: 371093 - DNA, 20 bp, Artificial
  CRISPR gRNA sequence
gagcttggcataactgagaa

SEQ ID NO: 371094 - DNA, 20 bp, Artificial
  CRISPR gRNA sequence
ttggcataactgagaaaagc

SEQ ID NO: 371095 - DNA, 20 bp, Artificial
  CRISPR gRNA sequence
taactgagaaaagcaagaca

SEQ ID NO: 371096 - DNA, 20 bp, Artificial
  CRISPR gRNA sequence
agaaaagcaagacatagcca

SEQ ID NO: 371097 - DNA, 20 bp, Artificial
  CRISPR gRNA sequence
gcaagacatagccacagaaa

SEQ ID NO: 371098 - DNA, 20 bp, Artificial
  CRISPR gRNA sequence
cacagaaatagaaaacacga

SEQ ID NO: 371099 - DNA, 20 bp, Artificial
  CRISPR gRNA sequence
cacgacagtttatattttgc

SEQ ID NO: 371100 - DNA, 20 bp, Artificial
  CRISPR gRNA sequence
cagtttatattttgcaagtg

SEQ ID NO: 371101 - DNA, 20 bp, Artificial
  CRISPR gRNA sequence
tatccaattacacaaaaatg

SEQ ID NO: 371102 - DNA, 20 bp, Artificial
  CRISPR gRNA sequence
caattacacaaaaatgtgga

SEQ ID NO: 371103 - DNA, 20 bp, Artificial
  CRISPR gRNA sequence
attacacaaaaatgtggaaa

SEQ ID NO: 371104 - DNA, 20 bp, Artificial
  CRISPR gRNA sequence
tacacaaaaatgtggaaaga

SEQ ID NO: 371105 - DNA, 20 bp, Artificial
  CRISPR gRNA sequence
cacaaaaatgtggaaagaga

SEQ ID NO: 371106 - DNA, 20 bp, Artificial
  CRISPR gRNA sequence
aatgtggaaagagagagccg

SEQ ID NO: 371107 - DNA, 20 bp, Artificial
  CRISPR gRNA sequence
atgtggaaagagagagccgt

SEQ ID NO: 371108 - DNA, 20 bp, Artificial
  CRISPR gRNA sequence
aaagagagagccgtaggatt

SEQ ID NO: 371109 - DNA, 20 bp, Artificial
  CRISPR gRNA sequence
gagagagccgtaggattcag

SEQ ID NO: 371110 - DNA, 20 bp, Artificial
  CRISPR gRNA sequence
agccgtaggattcagtggct

SEQ ID NO: 371111 - DNA, 20 bp, Artificial
  CRISPR gRNA sequence
ccgtaggattcagtggctga

SEQ ID NO: 371112 - DNA, 20 bp, Artificial
  CRISPR gRNA sequence
cagtggctgagagattactg

SEQ ID NO: 371113 - DNA, 20 bp, Artificial
  CRISPR gRNA sequence
agtggctgagagattactgt

SEQ ID NO: 371114 - DNA, 20 bp, Artificial
  CRISPR gRNA sequence
gctgagagattactgtgggt

SEQ ID NO: 371115 - DNA, 20 bp, Artificial
  CRISPR gRNA sequence
agattactgtgggtaagtcc

SEQ ID NO: 371116 - DNA, 20 bp, Artificial
  CRISPR gRNA sequence
gattactgtgggtaagtcct

SEQ ID NO: 371117 - DNA, 20 bp, Artificial
  CRISPR gRNA sequence
ttactgtgggtaagtcctgg

SEQ ID NO: 371118 - DNA, 20 bp, Artificial
  CRISPR gRNA sequence
actgtgggtaagtcctggga

SEQ ID NO: 371119 - DNA, 20 bp, Artificial
  CRISPR gRNA sequence
tgtgggtaagtcctgggaga

SEQ ID NO: 371120 - DNA, 20 bp, Artificial
  CRISPR gRNA sequence
ggtaagtcctgggagagaga

SEQ ID NO: 371121 - DNA, 20 bp, Artificial
  CRISPR gRNA sequence
gtaagtcctgggagagagat

SEQ ID NO: 371122 - DNA, 20 bp, Artificial
  CRISPR gRNA sequence
tcctgggagagagataggtc

SEQ ID NO: 371123 - DNA, 20 bp, Artificial
  CRISPR gRNA sequence
gggagagagataggtcaagc

SEQ ID NO: 371124 - DNA, 20 bp, Artificial
  CRISPR gRNA sequence
ggagagagataggtcaagct

SEQ ID NO: 371125 - DNA, 20 bp, Artificial
  CRISPR gRNA sequence
gataggtcaagctgggactt

SEQ ID NO: 371126 - DNA, 20 bp, Artificial
  CRISPR gRNA sequence
taggtcaagctgggacttga

SEQ ID NO: 371127 - DNA, 20 bp, Artificial
  CRISPR gRNA sequence
ggtcaagctgggacttgaga

SEQ ID NO: 371128 - DNA, 20 bp, Artificial
  CRISPR gRNA sequence
gctgggacttgagagagtga

SEQ ID NO: 371129 - DNA, 20 bp, Artificial
  CRISPR gRNA sequence
tgggacttgagagagtgata

SEQ ID NO: 371130 - DNA, 20 bp, Artificial
  CRISPR gRNA sequence
gagagagtgatagagccaaa

SEQ ID NO: 371131 - DNA, 20 bp, Artificial
  CRISPR gRNA sequence
gagagtgatagagccaaaca

SEQ ID NO: 371132 - DNA, 20 bp, Artificial
  CRISPR gRNA sequence
gagtgatagagccaaacaga

SEQ ID NO: 371133 - DNA, 20 bp, Artificial
  CRISPR gRNA sequence
tagagccaaacagagagtca

SEQ ID NO: 371134 - DNA, 20 bp, Artificial
  CRISPR gRNA sequence
gccaaacagagagtcaaaga

SEQ ID NO: 371135 - DNA, 20 bp, Artificial
  CRISPR gRNA sequence
caaacagagagtcaaagaca

SEQ ID NO: 371136 - DNA, 20 bp, Artificial
  CRISPR gRNA sequence
cagagagtcaaagacagagt

SEQ ID NO: 371137 - DNA, 20 bp, Artificial
  CRISPR gRNA sequence
tttataattctataaattta

SEQ ID NO: 371138 - DNA, 20 bp, Artificial
  CRISPR gRNA sequence
ttataattctataaatttat

SEQ ID NO: 371139 - DNA, 20 bp, Artificial
  CRISPR gRNA sequence
tataattctataaatttata

SEQ ID NO: 371140 - DNA, 20 bp, Artificial
  CRISPR gRNA sequence
ataaatttatagggtacaaa

SEQ ID NO: 371141 - DNA, 20 bp, Artificial
  CRISPR gRNA sequence
aaatttatagggtacaaaca

SEQ ID NO: 371142 - DNA, 20 bp, Artificial
  CRISPR gRNA sequence
aatttatagggtacaaacag

SEQ ID NO: 371143 - DNA, 20 bp, Artificial
  CRISPR gRNA sequence
taatgtgtaataattaaatc

SEQ ID NO: 371144 - DNA, 20 bp, Artificial
  CRISPR gRNA sequence
gtgtaataattaaatcaagc

SEQ ID NO: 371145 - DNA, 20 bp, Artificial
  CRISPR gRNA sequence
caaatacttaactttttttg

SEQ ID NO: 371146 - DNA, 20 bp, Artificial
  CRISPR gRNA sequence
tacttaactttttttgtggt

SEQ ID NO: 371147 - DNA, 20 bp, Artificial
  CRISPR gRNA sequence
aatatttgaaattcactctc

SEQ ID NO: 371148 - DNA, 20 bp, Artificial
  CRISPR gRNA sequence
actctctagaaattttgaaa

SEQ ID NO: 371149 - DNA, 20 bp, Artificial
  CRISPR gRNA sequence
ctctctagaaattttgaaat

SEQ ID NO: 371150 - DNA, 20 bp, Artificial
  CRISPR gRNA sequence
ctctcttatttatatgcatc

SEQ ID NO: 371151 - DNA, 20 bp, Artificial
  CRISPR gRNA sequence
atatgcatcaagctgtgtga

SEQ ID NO: 371152 - DNA, 20 bp, Artificial
  CRISPR gRNA sequence
atgcatcaagctgtgtgacg

SEQ ID NO: 371153 - DNA, 20 bp, Artificial
  CRISPR gRNA sequence
ctgtgtgacggagctcaaaa

SEQ ID NO: 371154 - DNA, 20 bp, Artificial
  CRISPR gRNA sequence
tgtgtgacggagctcaaaaa

SEQ ID NO: 371155 - DNA, 20 bp, Artificial
  CRISPR gRNA sequence
gtgacggagctcaaaaaagg

SEQ ID NO: 371156 - DNA, 20 bp, Artificial
  CRISPR gRNA sequence
cctatgtcttctgtctgact

SEQ ID NO: 371157 - DNA, 20 bp, Artificial
  CRISPR gRNA sequence
ctatgtcttctgtctgactg

SEQ ID NO: 371158 - DNA, 20 bp, Artificial
  CRISPR gRNA sequence
cccctcattctcccaatccc

SEQ ID NO: 371159 - DNA, 20 bp, Artificial
  CRISPR gRNA sequence
tcccaatccccagccactgt

SEQ ID NO: 371160 - DNA, 20 bp, Artificial
  CRISPR gRNA sequence
atcctaccctctgcttctat

SEQ ID NO: 371161 - DNA, 20 bp, Artificial
  CRISPR gRNA sequence
cctaccctctgcttctatga

SEQ ID NO: 371162 - DNA, 20 bp, Artificial
  CRISPR gRNA sequence
taccctctgcttctatgaga

SEQ ID NO: 371163 - DNA, 20 bp, Artificial
  CRISPR gRNA sequence
tgagagagatttcattgact

SEQ ID NO: 371164 - DNA, 20 bp, Artificial
  CRISPR gRNA sequence
gagagagatttcattgactc

SEQ ID NO: 371165 - DNA, 20 bp, Artificial
  CRISPR gRNA sequence
ttgactcaggtcatgttatc

SEQ ID NO: 371166 - DNA, 20 bp, Artificial
  CRISPR gRNA sequence
actcaggtcatgttatcaag

SEQ ID NO: 371167 - DNA, 20 bp, Artificial
  CRISPR gRNA sequence
atgttatcaagaagacattc

SEQ ID NO: 371168 - DNA, 20 bp, Artificial
  CRISPR gRNA sequence
tgttatcaagaagacattca

SEQ ID NO: 371169 - DNA, 20 bp, Artificial
  CRISPR gRNA sequence
gttatcaagaagacattcaa

SEQ ID NO: 371170 - DNA, 20 bp, Artificial
  CRISPR gRNA sequence
tcaagaagacattcaagggc

SEQ ID NO: 371171 - DNA, 20 bp, Artificial
  CRISPR gRNA sequence
caagaagacattcaagggcc

SEQ ID NO: 371172 - DNA, 20 bp, Artificial
  CRISPR gRNA sequence
agacattcaagggccaggtg

SEQ ID NO: 371173 - DNA, 20 bp, Artificial
  CRISPR gRNA sequence
cattcaagggccaggtgtgg

SEQ ID NO: 371174 - DNA, 20 bp, Artificial
  CRISPR gRNA sequence
gtggcacacacctgtaatcc

SEQ ID NO: 371175 - DNA, 20 bp, Artificial
  CRISPR gRNA sequence
cacctgtaatcccagcactt

SEQ ID NO: 371176 - DNA, 20 bp, Artificial
  CRISPR gRNA sequence
acctgtaatcccagcacttt

SEQ ID NO: 371177 - DNA, 20 bp, Artificial
  CRISPR gRNA sequence
ctgtaatcccagcactttgg

SEQ ID NO: 371178 - DNA, 20 bp, Artificial
  CRISPR gRNA sequence
tgtaatcccagcactttggg

SEQ ID NO: 371179 - DNA, 20 bp, Artificial
  CRISPR gRNA sequence
tcccagcactttgggaggcc

SEQ ID NO: 371180 - DNA, 20 bp, Artificial
  CRISPR gRNA sequence
cccagcactttgggaggccg

SEQ ID NO: 371181 - DNA, 20 bp, Artificial
  CRISPR gRNA sequence
agcactttgggaggccgagg

SEQ ID NO: 371182 - DNA, 20 bp, Artificial
  CRISPR gRNA sequence
gcactttgggaggccgaggt

SEQ ID NO: 371183 - DNA, 20 bp, Artificial
  CRISPR gRNA sequence
ctttgggaggccgaggtggg

SEQ ID NO: 371184 - DNA, 20 bp, Artificial
  CRISPR gRNA sequence
ccgaggtgggcggaccactt

SEQ ID NO: 371185 - DNA, 20 bp, Artificial
  CRISPR gRNA sequence
gtgggcggaccacttgagat

SEQ ID NO: 371186 - DNA, 20 bp, Artificial
  CRISPR gRNA sequence
tgggcggaccacttgagatc

SEQ ID NO: 371187 - DNA, 20 bp, Artificial
  CRISPR gRNA sequence
ggcggaccacttgagatcag

SEQ ID NO: 371188 - DNA, 20 bp, Artificial
  CRISPR gRNA sequence
ccacttgagatcaggagttc

SEQ ID NO: 371189 - DNA, 20 bp, Artificial
  CRISPR gRNA sequence
tgagatcaggagttcgagac

SEQ ID NO: 371190 - DNA, 20 bp, Artificial
  CRISPR gRNA sequence
tcaggagttcgagaccagcc

SEQ ID NO: 371191 - DNA, 20 bp, Artificial
  CRISPR gRNA sequence
cgagaccagcctggccaaca

SEQ ID NO: 371192 - DNA, 20 bp, Artificial
  CRISPR gRNA sequence
tactaaaaatacaaaaaatt

SEQ ID NO: 371193 - DNA, 20 bp, Artificial
  CRISPR gRNA sequence
aaaaatacaaaaaatttagc

SEQ ID NO: 371194 - DNA, 20 bp, Artificial
  CRISPR gRNA sequence
aaaatacaaaaaatttagct

SEQ ID NO: 371195 - DNA, 20 bp, Artificial
  CRISPR gRNA sequence
acaaaaaatttagctgggca

SEQ ID NO: 371196 - DNA, 20 bp, Artificial
  CRISPR gRNA sequence
aaaaatttagctgggcatgg

SEQ ID NO: 371197 - DNA, 20 bp, Artificial
  CRISPR gRNA sequence
gtggtgtgtgcctgtaatcc

SEQ ID NO: 371198 - DNA, 20 bp, Artificial
  CRISPR gRNA sequence
tgcctgtaatcccagttact

SEQ ID NO: 371199 - DNA, 20 bp, Artificial
  CRISPR gRNA sequence
gcctgtaatcccagttactc

SEQ ID NO: 371200 - DNA, 20 bp, Artificial
  CRISPR gRNA sequence
ctgtaatcccagttactcgg

SEQ ID NO: 371201 - DNA, 20 bp, Artificial
  CRISPR gRNA sequence
tgtaatcccagttactcggg

SEQ ID NO: 371202 - DNA, 20 bp, Artificial
  CRISPR gRNA sequence
tcccagttactcgggaggct

SEQ ID NO: 371203 - DNA, 20 bp, Artificial
  CRISPR gRNA sequence
cccagttactcgggaggctg

SEQ ID NO: 371204 - DNA, 20 bp, Artificial
  CRISPR gRNA sequence
agttactcgggaggctgagg

SEQ ID NO: 371205 - DNA, 20 bp, Artificial
  CRISPR gRNA sequence
tactcgggaggctgaggcag

SEQ ID NO: 371206 - DNA, 20 bp, Artificial
  CRISPR gRNA sequence
gcagcagaattgcttgaacc

SEQ ID NO: 371207 - DNA, 20 bp, Artificial
  CRISPR gRNA sequence
cagcagaattgcttgaaccc

SEQ ID NO: 371208 - DNA, 20 bp, Artificial
  CRISPR gRNA sequence
gcagaattgcttgaacccag

SEQ ID NO: 371209 - DNA, 20 bp, Artificial
  CRISPR gRNA sequence
cagaattgcttgaacccagg

SEQ ID NO: 371210 - DNA, 20 bp, Artificial
  CRISPR gRNA sequence
gcttgaacccaggaggtgct

SEQ ID NO: 371211 - DNA, 20 bp, Artificial
  CRISPR gRNA sequence
aacccaggaggtgctgagtc

SEQ ID NO: 371212 - DNA, 20 bp, Artificial
  CRISPR gRNA sequence
aagataccatcactgcactc

SEQ ID NO: 371213 - DNA, 20 bp, Artificial
  CRISPR gRNA sequence
accatcactgcactccagcc

SEQ ID NO: 371214 - DNA, 20 bp, Artificial
  CRISPR gRNA sequence
ccatcactgcactccagcct

SEQ ID NO: 371215 - DNA, 20 bp, Artificial
  CRISPR gRNA sequence
ctgcactccagcctgggcaa

SEQ ID NO: 371216 - DNA, 20 bp, Artificial
  CRISPR gRNA sequence
gcactccagcctgggcaaca

SEQ ID NO: 371217 - DNA, 20 bp, Artificial
  CRISPR gRNA sequence
ctccagcctgggcaacagag

SEQ ID NO: 371218 - DNA, 20 bp, Artificial
  CRISPR gRNA sequence
tccagcctgggcaacagagt

SEQ ID NO: 371219 - DNA, 20 bp, Artificial
  CRISPR gRNA sequence
catctgaaaaacaaacaaaa

SEQ ID NO: 371220 - DNA, 20 bp, Artificial
  CRISPR gRNA sequence
aaacaaacaaaaaagacatt

SEQ ID NO: 371221 - DNA, 20 bp, Artificial
  CRISPR gRNA sequence
aacaaacaaaaaagacattt

SEQ ID NO: 371222 - DNA, 20 bp, Artificial
  CRISPR gRNA sequence
aaaaaagacatttaggaatc

SEQ ID NO: 371223 - DNA, 20 bp, Artificial
  CRISPR gRNA sequence
gacatttaggaatctggttc

SEQ ID NO: 371224 - DNA, 20 bp, Artificial
  CRISPR gRNA sequence
acatttaggaatctggttcc

SEQ ID NO: 371225 - DNA, 20 bp, Artificial
  CRISPR gRNA sequence
tctggttccaggcacactga

SEQ ID NO: 371226 - DNA, 20 bp, Artificial
  CRISPR gRNA sequence
caggcacactgatggaaatt

SEQ ID NO: 371227 - DNA, 20 bp, Artificial
  CRISPR gRNA sequence
actgatggaaatttagattc

SEQ ID NO: 371228 - DNA, 20 bp, Artificial
  CRISPR gRNA sequence
ctgatggaaatttagattct

SEQ ID NO: 371229 - DNA, 20 bp, Artificial
  CRISPR gRNA sequence
aaatttagattctaggctcc

SEQ ID NO: 371230 - DNA, 20 bp, Artificial
  CRISPR gRNA sequence
tctaggctccaagtacaatt

SEQ ID NO: 371231 - DNA, 20 bp, Artificial
  CRISPR gRNA sequence
gctccaagtacaatttagta

SEQ ID NO: 371232 - DNA, 20 bp, Artificial
  CRISPR gRNA sequence
ttctacaattgtgcttgctt

SEQ ID NO: 371233 - DNA, 20 bp, Artificial
  CRISPR gRNA sequence
ttgctttagattgcattcac

SEQ ID NO: 371234 - DNA, 20 bp, Artificial
  CRISPR gRNA sequence
ctttagattgcattcaccag

SEQ ID NO: 371235 - DNA, 20 bp, Artificial
  CRISPR gRNA sequence
tagattgcattcaccagaag

SEQ ID NO: 371236 - DNA, 20 bp, Artificial
  CRISPR gRNA sequence
attcaccagaagcagtccct

SEQ ID NO: 371237 - DNA, 20 bp, Artificial
  CRISPR gRNA sequence
caccagaagcagtccctgag

SEQ ID NO: 371238 - DNA, 20 bp, Artificial
  CRISPR gRNA sequence
ccagaagcagtccctgagaa

SEQ ID NO: 371239 - DNA, 20 bp, Artificial
  CRISPR gRNA sequence
cagaagcagtccctgagaag

SEQ ID NO: 371240 - DNA, 20 bp, Artificial
  CRISPR gRNA sequence
gagaagaggataaatgtgaa

SEQ ID NO: 371241 - DNA, 20 bp, Artificial
  CRISPR gRNA sequence
agaagaggataaatgtgaaa

SEQ ID NO: 371242 - DNA, 20 bp, Artificial
  CRISPR gRNA sequence
taaatgtgaaaaggacccat

SEQ ID NO: 371243 - DNA, 20 bp, Artificial
  CRISPR gRNA sequence
aaatgtgaaaaggacccatt

SEQ ID NO: 371244 - DNA, 20 bp, Artificial
  CRISPR gRNA sequence
tgtgaaaaggacccattagg

SEQ ID NO: 371245 - DNA, 20 bp, Artificial
  CRISPR gRNA sequence
gacccattaggaagtgttcg

SEQ ID NO: 371246 - DNA, 20 bp, Artificial
  CRISPR gRNA sequence
acccattaggaagtgttcgc

SEQ ID NO: 371247 - DNA, 20 bp, Artificial
  CRISPR gRNA sequence
cccattaggaagtgttcgca

SEQ ID NO: 371248 - DNA, 20 bp, Artificial
  CRISPR gRNA sequence
gtgttcgcagggaaacccat

SEQ ID NO: 371249 - DNA, 20 bp, Artificial
  CRISPR gRNA sequence
tgttcgcagggaaacccatc

SEQ ID NO: 371250 - DNA, 20 bp, Artificial
  CRISPR gRNA sequence
gttcgcagggaaacccatca

SEQ ID NO: 371251 - DNA, 20 bp, Artificial
  CRISPR gRNA sequence
ttcgcagggaaacccatcag

SEQ ID NO: 371252 - DNA, 20 bp, Artificial
  CRISPR gRNA sequence
gggaaacccatcaggggatc

SEQ ID NO: 371253 - DNA, 20 bp, Artificial
  CRISPR gRNA sequence
acccatcaggggatctggat

SEQ ID NO: 371254 - DNA, 20 bp, Artificial
  CRISPR gRNA sequence
atcaggggatctggattgga

SEQ ID NO: 371255 - DNA, 20 bp, Artificial
  CRISPR gRNA sequence
tcaggggatctggattggaa

SEQ ID NO: 371256 - DNA, 20 bp, Artificial
  CRISPR gRNA sequence
caggggatctggattggaaa

SEQ ID NO: 371257 - DNA, 20 bp, Artificial
  CRISPR gRNA sequence
gggatctggattggaaaggg

SEQ ID NO: 371258 - DNA, 20 bp, Artificial
  CRISPR gRNA sequence
ggatctggattggaaaggga

SEQ ID NO: 371259 - DNA, 20 bp, Artificial
  CRISPR gRNA sequence
atctggattggaaagggaag

SEQ ID NO: 371260 - DNA, 20 bp, Artificial
  CRISPR gRNA sequence
ctggattggaaagggaagga

SEQ ID NO: 371261 - DNA, 20 bp, Artificial
  CRISPR gRNA sequence
tggaaagggaaggagagatc

SEQ ID NO: 371262 - DNA, 20 bp, Artificial
  CRISPR gRNA sequence
aagggaaggagagatccagc

SEQ ID NO: 371263 - DNA, 20 bp, Artificial
  CRISPR gRNA sequence
agggaaggagagatccagca

SEQ ID NO: 371264 - DNA, 20 bp, Artificial
  CRISPR gRNA sequence
gggaaggagagatccagcaa

SEQ ID NO: 371265 - DNA, 20 bp, Artificial
  CRISPR gRNA sequence
ggagagatccagcaagggca

SEQ ID NO: 371266 - DNA, 20 bp, Artificial
  CRISPR gRNA sequence
gagagatccagcaagggcac

SEQ ID NO: 371267 - DNA, 20 bp, Artificial
  CRISPR gRNA sequence
tccagcaagggcacaggatc

SEQ ID NO: 371268 - DNA, 20 bp, Artificial
  CRISPR gRNA sequence
caagggcacaggatccagcg

SEQ ID NO: 371269 - DNA, 20 bp, Artificial
  CRISPR gRNA sequence
gcacaggatccagcgaagtc

SEQ ID NO: 371270 - DNA, 20 bp, Artificial
  CRISPR gRNA sequence
cacaggatccagcgaagtct

SEQ ID NO: 371271 - DNA, 20 bp, Artificial
  CRISPR gRNA sequence
acaggatccagcgaagtcta

SEQ ID NO: 371272 - DNA, 20 bp, Artificial
  CRISPR gRNA sequence
ggatccagcgaagtctaggg

SEQ ID NO: 371273 - DNA, 20 bp, Artificial
  CRISPR gRNA sequence
cgaagtctagggaagctgcc

SEQ ID NO: 371274 - DNA, 20 bp, Artificial
  CRISPR gRNA sequence
gtctagggaagctgcctggt

SEQ ID NO: 371275 - DNA, 20 bp, Artificial
  CRISPR gRNA sequence
tctagggaagctgcctggtc

SEQ ID NO: 371276 - DNA, 20 bp, Artificial
  CRISPR gRNA sequence
ggaagctgcctggtcaggaa

SEQ ID NO: 371277 - DNA, 20 bp, Artificial
  CRISPR gRNA sequence
tcaggaaaagcaaactctac

SEQ ID NO: 371278 - DNA, 20 bp, Artificial
  CRISPR gRNA sequence
caggaaaagcaaactctacc

SEQ ID NO: 371279 - DNA, 20 bp, Artificial
  CRISPR gRNA sequence
aggaaaagcaaactctacca

SEQ ID NO: 371280 - DNA, 20 bp, Artificial
  CRISPR gRNA sequence
aaagcaaactctaccagggt

SEQ ID NO: 371281 - DNA, 20 bp, Artificial
  CRISPR gRNA sequence
actctaccagggtcagtcac

SEQ ID NO: 371282 - DNA, 20 bp, Artificial
  CRISPR gRNA sequence
accagggtcagtcactggat

SEQ ID NO: 371283 - DNA, 20 bp, Artificial
  CRISPR gRNA sequence
ccagggtcagtcactggatc

SEQ ID NO: 371284 - DNA, 20 bp, Artificial
  CRISPR gRNA sequence
cagggtcagtcactggatca

SEQ ID NO: 371285 - DNA, 20 bp, Artificial
  CRISPR gRNA sequence
ctggatcagggtcccttgat

SEQ ID NO: 371286 - DNA, 20 bp, Artificial
  CRISPR gRNA sequence
ttgatcagtgtgtgcattct

SEQ ID NO: 371287 - DNA, 20 bp, Artificial
  CRISPR gRNA sequence
tgatcagtgtgtgcattctc

SEQ ID NO: 371288 - DNA, 20 bp, Artificial
  CRISPR gRNA sequence
tcagtgtgtgcattctcagg

SEQ ID NO: 371289 - DNA, 20 bp, Artificial
  CRISPR gRNA sequence
cagtgtgtgcattctcaggc

SEQ ID NO: 371290 - DNA, 20 bp, Artificial
  CRISPR gRNA sequence
gtgcattctcaggcaggctc

SEQ ID NO: 371291 - DNA, 20 bp, Artificial
  CRISPR gRNA sequence
caggcaggctccagccaccc

SEQ ID NO: 371292 - DNA, 20 bp, Artificial
  CRISPR gRNA sequence
aggcaggctccagccaccct

SEQ ID NO: 371293 - DNA, 20 bp, Artificial
  CRISPR gRNA sequence
caggctccagccaccctggg

SEQ ID NO: 371294 - DNA, 20 bp, Artificial
  CRISPR gRNA sequence
ccctgggcagtgctccaacc

SEQ ID NO: 371295 - DNA, 20 bp, Artificial
  CRISPR gRNA sequence
tgggcagtgctccaacctag

SEQ ID NO: 371296 - DNA, 20 bp, Artificial
  CRISPR gRNA sequence
gggcagtgctccaacctagc

SEQ ID NO: 371297 - DNA, 20 bp, Artificial
  CRISPR gRNA sequence
ggcagtgctccaacctagcg

SEQ ID NO: 371298 - DNA, 20 bp, Artificial
  CRISPR gRNA sequence
agtgctccaacctagcgggg

SEQ ID NO: 371299 - DNA, 20 bp, Artificial
  CRISPR gRNA sequence
gtgctccaacctagcggggc

SEQ ID NO: 371300 - DNA, 20 bp, Artificial
  CRISPR gRNA sequence
caacctagcggggcaggtgc

SEQ ID NO: 371301 - DNA, 20 bp, Artificial
  CRISPR gRNA sequence
gcggggcaggtgctggctgt

SEQ ID NO: 371302 - DNA, 20 bp, Artificial
  CRISPR gRNA sequence
cggggcaggtgctggctgtt

SEQ ID NO: 371303 - DNA, 20 bp, Artificial
  CRISPR gRNA sequence
ggggcaggtgctggctgtta

SEQ ID NO: 371304 - DNA, 20 bp, Artificial
  CRISPR gRNA sequence
gggcaggtgctggctgttag

SEQ ID NO: 371305 - DNA, 20 bp, Artificial
  CRISPR gRNA sequence
gcaggtgctggctgttaggg

SEQ ID NO: 371306 - DNA, 20 bp, Artificial
  CRISPR gRNA sequence
ggtgctggctgttaggggag

SEQ ID NO: 371307 - DNA, 20 bp, Artificial
  CRISPR gRNA sequence
tgctggctgttaggggagaa

SEQ ID NO: 371308 - DNA, 20 bp, Artificial
  CRISPR gRNA sequence
ctggctgttaggggagaaga

SEQ ID NO: 371309 - DNA, 20 bp, Artificial
  CRISPR gRNA sequence
tgttaggggagaagagagca

SEQ ID NO: 371310 - DNA, 20 bp, Artificial
  CRISPR gRNA sequence
taggggagaagagagcacag

SEQ ID NO: 371311 - DNA, 20 bp, Artificial
  CRISPR gRNA sequence
ggagaagagagcacagaagc

SEQ ID NO: 371312 - DNA, 20 bp, Artificial
  CRISPR gRNA sequence
gagaagagagcacagaagct

SEQ ID NO: 371313 - DNA, 20 bp, Artificial
  CRISPR gRNA sequence
agaagagagcacagaagctg

SEQ ID NO: 371314 - DNA, 20 bp, Artificial
  CRISPR gRNA sequence
cacagaagctggggtgcttc

SEQ ID NO: 371315 - DNA, 20 bp, Artificial
  CRISPR gRNA sequence
agaagctggggtgcttcaag

SEQ ID NO: 371316 - DNA, 20 bp, Artificial
  CRISPR gRNA sequence
gaagctggggtgcttcaaga

SEQ ID NO: 371317 - DNA, 20 bp, Artificial
  CRISPR gRNA sequence
gctggggtgcttcaagaagg

SEQ ID NO: 371318 - DNA, 20 bp, Artificial
  CRISPR gRNA sequence
gggtgcttcaagaaggcaga

SEQ ID NO: 371319 - DNA, 20 bp, Artificial
  CRISPR gRNA sequence
ggtgcttcaagaaggcagaa

SEQ ID NO: 371320 - DNA, 20 bp, Artificial
  CRISPR gRNA sequence
tcaagaaggcagaaaggtcc

SEQ ID NO: 371321 - DNA, 20 bp, Artificial
  CRISPR gRNA sequence
caagaaggcagaaaggtccc

SEQ ID NO: 371322 - DNA, 20 bp, Artificial
  CRISPR gRNA sequence
agaaggcagaaaggtcccag

SEQ ID NO: 371323 - DNA, 20 bp, Artificial
  CRISPR gRNA sequence
gaaggcagaaaggtcccagg

SEQ ID NO: 371324 - DNA, 20 bp, Artificial
  CRISPR gRNA sequence
aaggtcccaggaggtgtccg

SEQ ID NO: 371325 - DNA, 20 bp, Artificial
  CRISPR gRNA sequence
ggtcccaggaggtgtccgta

SEQ ID NO: 371326 - DNA, 20 bp, Artificial
  CRISPR gRNA sequence
gaggtgtccgtagagcctga

SEQ ID NO: 371327 - DNA, 20 bp, Artificial
  CRISPR gRNA sequence
acagcatctgctcactgtcc

SEQ ID NO: 371328 - DNA, 20 bp, Artificial
  CRISPR gRNA sequence
atctgctcactgtccgagtc

SEQ ID NO: 371329 - DNA, 20 bp, Artificial
  CRISPR gRNA sequence
ctcactgtccgagtcaagcc

SEQ ID NO: 371330 - DNA, 20 bp, Artificial
  CRISPR gRNA sequence
cggctcctgctccattttta

SEQ ID NO: 371331 - DNA, 20 bp, Artificial
  CRISPR gRNA sequence
gctcctgctccatttttatg

SEQ ID NO: 371332 - DNA, 20 bp, Artificial
  CRISPR gRNA sequence
ttatggagttccctgcattg

SEQ ID NO: 371333 - DNA, 20 bp, Artificial
  CRISPR gRNA sequence
tatggagttccctgcattgc

SEQ ID NO: 371334 - DNA, 20 bp, Artificial
  CRISPR gRNA sequence
atggagttccctgcattgca

SEQ ID NO: 371335 - DNA, 20 bp, Artificial
  CRISPR gRNA sequence
tccctgcattgcagggtgtt

SEQ ID NO: 371336 - DNA, 20 bp, Artificial
  CRISPR gRNA sequence
ggtgtttggaacttattgct

SEQ ID NO: 371337 - DNA, 20 bp, Artificial
  CRISPR gRNA sequence
cttattgcttagcgaaaccc

SEQ ID NO: 371338 - DNA, 20 bp, Artificial
  CRISPR gRNA sequence
tgcttagcgaaacccaagca

SEQ ID NO: 371339 - DNA, 20 bp, Artificial
  CRISPR gRNA sequence
caagcaaagatttcatcttt

SEQ ID NO: 371340 - DNA, 20 bp, Artificial
  CRISPR gRNA sequence
tgaatattgtctgaaactcg

SEQ ID NO: 371341 - DNA, 20 bp, Artificial
  CRISPR gRNA sequence
tctgaaactcgaagtcctcc

SEQ ID NO: 371342 - DNA, 20 bp, Artificial
  CRISPR gRNA sequence
atcctcacctttcttgcctg

SEQ ID NO: 371343 - DNA, 20 bp, Artificial
  CRISPR gRNA sequence
tcacctttcttgcctgcggc

SEQ ID NO: 371344 - DNA, 20 bp, Artificial
  CRISPR gRNA sequence
ttcttgcctgcggccagtta

SEQ ID NO: 371345 - DNA, 20 bp, Artificial
  CRISPR gRNA sequence
taaagcgtgaaatattttgc

SEQ ID NO: 371346 - DNA, 20 bp, Artificial
  CRISPR gRNA sequence
aaagcgtgaaatattttgct

SEQ ID NO: 371347 - DNA, 20 bp, Artificial
  CRISPR gRNA sequence
aaatattttgctaggcaaaa

SEQ ID NO: 371348 - DNA, 20 bp, Artificial
  CRISPR gRNA sequence
aatattttgctaggcaaaat

SEQ ID NO: 371349 - DNA, 20 bp, Artificial
  CRISPR gRNA sequence
atattttgctaggcaaaata

SEQ ID NO: 371350 - DNA, 20 bp, Artificial
  CRISPR gRNA sequence
agggctcatattcacatttt

SEQ ID NO: 371351 - DNA, 20 bp, Artificial
  CRISPR gRNA sequence
gggctcatattcacattttc

SEQ ID NO: 371352 - DNA, 20 bp, Artificial
  CRISPR gRNA sequence
gctcatattcacattttcag

SEQ ID NO: 371353 - DNA, 20 bp, Artificial
  CRISPR gRNA sequence
tcatattcacattttcagga

SEQ ID NO: 371354 - DNA, 20 bp, Artificial
  CRISPR gRNA sequence
atattcacattttcaggaga

SEQ ID NO: 371355 - DNA, 20 bp, Artificial
  CRISPR gRNA sequence
cattttcaggagagagccat

SEQ ID NO: 371356 - DNA, 20 bp, Artificial
  CRISPR gRNA sequence
attttcaggagagagccata

SEQ ID NO: 371357 - DNA, 20 bp, Artificial
  CRISPR gRNA sequence
ttttcaggagagagccataa

SEQ ID NO: 371358 - DNA, 20 bp, Artificial
  CRISPR gRNA sequence
gagccataagggtgaatttt

SEQ ID NO: 371359 - DNA, 20 bp, Artificial
  CRISPR gRNA sequence
tttttagtttgcttttcttt

SEQ ID NO: 371360 - DNA, 20 bp, Artificial
  CRISPR gRNA sequence
gtcctgttgctattcctgac

SEQ ID NO: 371361 - DNA, 20 bp, Artificial
  CRISPR gRNA sequence
tattcctgacgagatttttg

SEQ ID NO: 371362 - DNA, 20 bp, Artificial
  CRISPR gRNA sequence
gacgagatttttgcagcgct

SEQ ID NO: 371363 - DNA, 20 bp, Artificial
  CRISPR gRNA sequence
agatttttgcagcgctgagc

SEQ ID NO: 371364 - DNA, 20 bp, Artificial
  CRISPR gRNA sequence
tttgcagcgctgagcaagac

SEQ ID NO: 371365 - DNA, 20 bp, Artificial
  CRISPR gRNA sequence
tgcagcgctgagcaagacca

SEQ ID NO: 371366 - DNA, 20 bp, Artificial
  CRISPR gRNA sequence
gcagcgctgagcaagaccag

SEQ ID NO: 371367 - DNA, 20 bp, Artificial
  CRISPR gRNA sequence
cttgtgttctcctttcccta

SEQ ID NO: 371368 - DNA, 20 bp, Artificial
  CRISPR gRNA sequence
tctcctttccctacagaaaa

SEQ ID NO: 371369 - DNA, 20 bp, Artificial
  CRISPR gRNA sequence
agaaaatggcttctatttca

SEQ ID NO: 371370 - DNA, 20 bp, Artificial
  CRISPR gRNA sequence
gaaaatggcttctatttcat

SEQ ID NO: 371371 - DNA, 20 bp, Artificial
  CRISPR gRNA sequence
taggtcatgtcttttgcctg

SEQ ID NO: 371372 - DNA, 20 bp, Artificial
  CRISPR gRNA sequence
cttttgcctgcagaaatttg

SEQ ID NO: 371373 - DNA, 20 bp, Artificial
  CRISPR gRNA sequence
agaaattatcttccaatttt

SEQ ID NO: 371374 - DNA, 20 bp, Artificial
  CRISPR gRNA sequence
aaattatcttccaattttca

SEQ ID NO: 371375 - DNA, 20 bp, Artificial
  CRISPR gRNA sequence
attttcagagcaattttaat

SEQ ID NO: 371376 - DNA, 20 bp, Artificial
  CRISPR gRNA sequence
tcagagcaattttaattgga

SEQ ID NO: 371377 - DNA, 20 bp, Artificial
  CRISPR gRNA sequence
cagagcaattttaattggat

SEQ ID NO: 371378 - DNA, 20 bp, Artificial
  CRISPR gRNA sequence
ttggataggaatcacactgt

SEQ ID NO: 371379 - DNA, 20 bp, Artificial
  CRISPR gRNA sequence
aggaatcacactgttagcaa

SEQ ID NO: 371380 - DNA, 20 bp, Artificial
  CRISPR gRNA sequence
tggtgaacctctgatttcct

SEQ ID NO: 371381 - DNA, 20 bp, Artificial
  CRISPR gRNA sequence
tgaacctctgatttcctgag

SEQ ID NO: 371382 - DNA, 20 bp, Artificial
  CRISPR gRNA sequence
gagcagtgtgttttaaaact

SEQ ID NO: 371383 - DNA, 20 bp, Artificial
  CRISPR gRNA sequence
tgtgttttaaaacttagttt

SEQ ID NO: 371384 - DNA, 20 bp, Artificial
  CRISPR gRNA sequence
tattacatcttttttttcaa

SEQ ID NO: 371385 - DNA, 20 bp, Artificial
  CRISPR gRNA sequence
tacatcttttttttcaatgg

SEQ ID NO: 371386 - DNA, 20 bp, Artificial
  CRISPR gRNA sequence
caatggaagtcaaaatatgt

SEQ ID NO: 371387 - DNA, 20 bp, Artificial
  CRISPR gRNA sequence
aaaatatgtaagttcacatc

SEQ ID NO: 371388 - DNA, 20 bp, Artificial
  CRISPR gRNA sequence
aaatatgtaagttcacatct

SEQ ID NO: 371389 - DNA, 20 bp, Artificial
  CRISPR gRNA sequence
agttcacatctaggcgtata

SEQ ID NO: 371390 - DNA, 20 bp, Artificial
  CRISPR gRNA sequence
ctaggcgtatatagtatgtg

SEQ ID NO: 371391 - DNA, 20 bp, Artificial
  CRISPR gRNA sequence
aggcgtatatagtatgtgta

SEQ ID NO: 371392 - DNA, 20 bp, Artificial
  CRISPR gRNA sequence
gtatgtgtagagtacattgt

SEQ ID NO: 371393 - DNA, 20 bp, Artificial
  CRISPR gRNA sequence
tatgtgtagagtacattgtg

SEQ ID NO: 371394 - DNA, 20 bp, Artificial
  CRISPR gRNA sequence
atgtgtagagtacattgtga

SEQ ID NO: 371395 - DNA, 20 bp, Artificial
  CRISPR gRNA sequence
gagtacattgtgagggtgtg

SEQ ID NO: 371396 - DNA, 20 bp, Artificial
  CRISPR gRNA sequence
agtacattgtgagggtgtgc

SEQ ID NO: 371397 - DNA, 20 bp, Artificial
  CRISPR gRNA sequence
ggtgtgcaggtactgtttct

SEQ ID NO: 371398 - DNA, 20 bp, Artificial
  CRISPR gRNA sequence
tcccatttctaacattatat

SEQ ID NO: 371399 - DNA, 20 bp, Artificial
  CRISPR gRNA sequence
atttctaacattatatcagt

SEQ ID NO: 371400 - DNA, 20 bp, Artificial
  CRISPR gRNA sequence
acattatatcagttggttct

SEQ ID NO: 371401 - DNA, 20 bp, Artificial
  CRISPR gRNA sequence
catatgtcatgcatcacaaa

SEQ ID NO: 371402 - DNA, 20 bp, Artificial
  CRISPR gRNA sequence
gtacttatttgttctccaca

SEQ ID NO: 371403 - DNA, 20 bp, Artificial
  CRISPR gRNA sequence
ttgttctccacaaagccatc

SEQ ID NO: 371404 - DNA, 20 bp, Artificial
  CRISPR gRNA sequence
aaagccatctggaaatacca

SEQ ID NO: 371405 - DNA, 20 bp, Artificial
  CRISPR gRNA sequence
aataccaaagaaatgtaatg

SEQ ID NO: 371406 - DNA, 20 bp, Artificial
  CRISPR gRNA sequence
accaaagaaatgtaatgaag

SEQ ID NO: 371407 - DNA, 20 bp, Artificial
  CRISPR gRNA sequence
taatgaagtagatactaaaa

SEQ ID NO: 371408 - DNA, 20 bp, Artificial
  CRISPR gRNA sequence
tagatactaaaatagtgaca

SEQ ID NO: 371409 - DNA, 20 bp, Artificial
  CRISPR gRNA sequence
tactaaaatagtgacatggt

SEQ ID NO: 371410 - DNA, 20 bp, Artificial
  CRISPR gRNA sequence
gtgacatggtcagaaaatat

SEQ ID NO: 371411 - DNA, 20 bp, Artificial
  CRISPR gRNA sequence
acatggtcagaaaatatgag

SEQ ID NO: 371412 - DNA, 20 bp, Artificial
  CRISPR gRNA sequence
atggtcagaaaatatgagaa

SEQ ID NO: 371413 - DNA, 20 bp, Artificial
  CRISPR gRNA sequence
tggtcagaaaatatgagaag

SEQ ID NO: 371414 - DNA, 20 bp, Artificial
  CRISPR gRNA sequence
tcagaaaatatgagaagagg

SEQ ID NO: 371415 - DNA, 20 bp, Artificial
  CRISPR gRNA sequence
cagaaaatatgagaagagga

SEQ ID NO: 371416 - DNA, 20 bp, Artificial
  CRISPR gRNA sequence
aagaggaaggaaattgaacc

SEQ ID NO: 371417 - DNA, 20 bp, Artificial
  CRISPR gRNA sequence
gaggaaggaaattgaacctg

SEQ ID NO: 371418 - DNA, 20 bp, Artificial
  CRISPR gRNA sequence
gaaggaaattgaacctggag

SEQ ID NO: 371419 - DNA, 20 bp, Artificial
  CRISPR gRNA sequence
aacctggagtagatgctcta

SEQ ID NO: 371420 - DNA, 20 bp, Artificial
  CRISPR gRNA sequence
acctggagtagatgctctaa

SEQ ID NO: 371421 - DNA, 20 bp, Artificial
  CRISPR gRNA sequence
atcaaacttatgcaatcgaa

SEQ ID NO: 371422 - DNA, 20 bp, Artificial
  CRISPR gRNA sequence
cttatgcaatcgaacagctt

SEQ ID NO: 371423 - DNA, 20 bp, Artificial
  CRISPR gRNA sequence
gcaatcgaacagcttaagtt

SEQ ID NO: 371424 - DNA, 20 bp, Artificial
  CRISPR gRNA sequence
aatcgaacagcttaagtttg

SEQ ID NO: 371425 - DNA, 20 bp, Artificial
  CRISPR gRNA sequence
cttaagtttggagtcctaaa

SEQ ID NO: 371426 - DNA, 20 bp, Artificial
  CRISPR gRNA sequence
gtcctaaatagattttcttc

SEQ ID NO: 371427 - DNA, 20 bp, Artificial
  CRISPR gRNA sequence
ctggcaaatacccttgtgtt

SEQ ID NO: 371428 - DNA, 20 bp, Artificial
  CRISPR gRNA sequence
caaatacccttgtgtttggt

SEQ ID NO: 371429 - DNA, 20 bp, Artificial
  CRISPR gRNA sequence
aatacccttgtgtttggtga

SEQ ID NO: 371430 - DNA, 20 bp, Artificial
  CRISPR gRNA sequence
tttggtgagagaatctttga

SEQ ID NO: 371431 - DNA, 20 bp, Artificial
  CRISPR gRNA sequence
agagaatctttgacagacct

SEQ ID NO: 371432 - DNA, 20 bp, Artificial
  CRISPR gRNA sequence
aatctttgacagaccttggt

SEQ ID NO: 371433 - DNA, 20 bp, Artificial
  CRISPR gRNA sequence
cagaccttggtgagcaccgt

SEQ ID NO: 371434 - DNA, 20 bp, Artificial
  CRISPR gRNA sequence
agaccttggtgagcaccgtc

SEQ ID NO: 371435 - DNA, 20 bp, Artificial
  CRISPR gRNA sequence
tggtgagcaccgtcgggcaa

SEQ ID NO: 371436 - DNA, 20 bp, Artificial
  CRISPR gRNA sequence
atagctgcttctgaaactca

SEQ ID NO: 371437 - DNA, 20 bp, Artificial
  CRISPR gRNA sequence
aactcacagctctgtctctt

SEQ ID NO: 371438 - DNA, 20 bp, Artificial
  CRISPR gRNA sequence
actcacagctctgtctcttt

SEQ ID NO: 371439 - DNA, 20 bp, Artificial
  CRISPR gRNA sequence
tctgtctctttgggtctctg

SEQ ID NO: 371440 - DNA, 20 bp, Artificial
  CRISPR gRNA sequence
tgggtctctgcagatgccat

SEQ ID NO: 371441 - DNA, 20 bp, Artificial
  CRISPR gRNA sequence
gggtctctgcagatgccatc

SEQ ID NO: 371442 - DNA, 20 bp, Artificial
  CRISPR gRNA sequence
ggtctctgcagatgccatca

SEQ ID NO: 371443 - DNA, 20 bp, Artificial
  CRISPR gRNA sequence
tgcagatgccatcagggcct

SEQ ID NO: 371444 - DNA, 20 bp, Artificial
  CRISPR gRNA sequence
agatgccatcagggcctcag

SEQ ID NO: 371445 - DNA, 20 bp, Artificial
  CRISPR gRNA sequence
gatgccatcagggcctcagt

SEQ ID NO: 371446 - DNA, 20 bp, Artificial
  CRISPR gRNA sequence
atgccatcagggcctcagtg

SEQ ID NO: 371447 - DNA, 20 bp, Artificial
  CRISPR gRNA sequence
gcctcagtggggaatttcta

SEQ ID NO: 371448 - DNA, 20 bp, Artificial
  CRISPR gRNA sequence
cctcagtggggaatttctac

SEQ ID NO: 371449 - DNA, 20 bp, Artificial
  CRISPR gRNA sequence
gctttcatcactttgttctt

SEQ ID NO: 371450 - DNA, 20 bp, Artificial
  CRISPR gRNA sequence
tttcatcactttgttctttg

SEQ ID NO: 371451 - DNA, 20 bp, Artificial
  CRISPR gRNA sequence
ttcatcactttgttctttgg

SEQ ID NO: 371452 - DNA, 20 bp, Artificial
  CRISPR gRNA sequence
gaggacttatcgtcttttta

SEQ ID NO: 371453 - DNA, 20 bp, Artificial
  CRISPR gRNA sequence
tgtgtgtctctcccctaacc

SEQ ID NO: 371454 - DNA, 20 bp, Artificial
  CRISPR gRNA sequence
gtctgtgttttatttacacc

SEQ ID NO: 371455 - DNA, 20 bp, Artificial
  CRISPR gRNA sequence
tttacacccagtaatctttg

SEQ ID NO: 371456 - DNA, 20 bp, Artificial
  CRISPR gRNA sequence
cccagtaatctttgtggatg

SEQ ID NO: 371457 - DNA, 20 bp, Artificial
  CRISPR gRNA sequence
ccagtaatctttgtggatga

SEQ ID NO: 371458 - DNA, 20 bp, Artificial
  CRISPR gRNA sequence
gaatgaatgttgaatgaata

SEQ ID NO: 371459 - DNA, 20 bp, Artificial
  CRISPR gRNA sequence
aatgaatgttgaatgaataa

SEQ ID NO: 371460 - DNA, 20 bp, Artificial
  CRISPR gRNA sequence
gaatgttgaatgaataaagg

SEQ ID NO: 371461 - DNA, 20 bp, Artificial
  CRISPR gRNA sequence
aatgttgaatgaataaagga

SEQ ID NO: 371462 - DNA, 20 bp, Artificial
  CRISPR gRNA sequence
gaataaaggaaggaaaaata

SEQ ID NO: 371463 - DNA, 20 bp, Artificial
  CRISPR gRNA sequence
aataaaggaaggaaaaataa

SEQ ID NO: 371464 - DNA, 20 bp, Artificial
  CRISPR gRNA sequence
taaaggaaggaaaaataaag

SEQ ID NO: 371465 - DNA, 20 bp, Artificial
  CRISPR gRNA sequence
aaaggaaggaaaaataaagg

SEQ ID NO: 371466 - DNA, 20 bp, Artificial
  CRISPR gRNA sequence
aggtaaaatttcaccgcctc

SEQ ID NO: 371467 - DNA, 20 bp, Artificial
  CRISPR gRNA sequence
atttcaccgcctctggtttg

SEQ ID NO: 371468 - DNA, 20 bp, Artificial
  CRISPR gRNA sequence
tgcagtccatctttctgcat

SEQ ID NO: 371469 - DNA, 20 bp, Artificial
  CRISPR gRNA sequence
cttctctgccctctgccccg

SEQ ID NO: 371470 - DNA, 20 bp, Artificial
  CRISPR gRNA sequence
gccccgcggtgcactcacct

SEQ ID NO: 371471 - DNA, 20 bp, Artificial
  CRISPR gRNA sequence
ccgcggtgcactcaccttgg

SEQ ID NO: 371472 - DNA, 20 bp, Artificial
  CRISPR gRNA sequence
cgcggtgcactcaccttggc

SEQ ID NO: 371473 - DNA, 20 bp, Artificial
  CRISPR gRNA sequence
gcggtgcactcaccttggca

SEQ ID NO: 371474 - DNA, 20 bp, Artificial
  CRISPR gRNA sequence
gcactcaccttggcagggac

SEQ ID NO: 371475 - DNA, 20 bp, Artificial
  CRISPR gRNA sequence
cactcaccttggcagggaca

SEQ ID NO: 371476 - DNA, 20 bp, Artificial
  CRISPR gRNA sequence
caccttggcagggacaaggc

SEQ ID NO: 371477 - DNA, 20 bp, Artificial
  CRISPR gRNA sequence
ggcagggacaaggctagttc

SEQ ID NO: 371478 - DNA, 20 bp, Artificial
  CRISPR gRNA sequence
gcagggacaaggctagttct

SEQ ID NO: 371479 - DNA, 20 bp, Artificial
  CRISPR gRNA sequence
ctcctctctctcctttgcca

SEQ ID NO: 371480 - DNA, 20 bp, Artificial
  CRISPR gRNA sequence
tctctctcctttgccacagc

SEQ ID NO: 371481 - DNA, 20 bp, Artificial
  CRISPR gRNA sequence
tgccacagcaagtctattgc

SEQ ID NO: 371482 - DNA, 20 bp, Artificial
  CRISPR gRNA sequence
tattgctggccactctcctg

SEQ ID NO: 371483 - DNA, 20 bp, Artificial
  CRISPR gRNA sequence
attgctggccactctcctgt

SEQ ID NO: 371484 - DNA, 20 bp, Artificial
  CRISPR gRNA sequence
catcttccttgctttctact

SEQ ID NO: 371485 - DNA, 20 bp, Artificial
  CRISPR gRNA sequence
ctacttggaaaacaatctaa

SEQ ID NO: 371486 - DNA, 20 bp, Artificial
  CRISPR gRNA sequence
acaatttcacactaatgtgt

SEQ ID NO: 371487 - DNA, 20 bp, Artificial
  CRISPR gRNA sequence
actaatgtgttggtgcctgc

SEQ ID NO: 371488 - DNA, 20 bp, Artificial
  CRISPR gRNA sequence
ctaatgtgttggtgcctgcc

SEQ ID NO: 371489 - DNA, 20 bp, Artificial
  CRISPR gRNA sequence
aattttatatgcattttaac

SEQ ID NO: 371490 - DNA, 20 bp, Artificial
  CRISPR gRNA sequence
attttatatgcattttaaca

SEQ ID NO: 371491 - DNA, 20 bp, Artificial
  CRISPR gRNA sequence
atatgcattttaacaaggac

SEQ ID NO: 371492 - DNA, 20 bp, Artificial
  CRISPR gRNA sequence
cattttaacaaggacaagtg

SEQ ID NO: 371493 - DNA, 20 bp, Artificial
  CRISPR gRNA sequence
agaaattgatttctaattat

SEQ ID NO: 371494 - DNA, 20 bp, Artificial
  CRISPR gRNA sequence
aaattgatttctaattataa

SEQ ID NO: 371495 - DNA, 20 bp, Artificial
  CRISPR gRNA sequence
gatttctaattataagagtt

SEQ ID NO: 371496 - DNA, 20 bp, Artificial
  CRISPR gRNA sequence
atttctaattataagagtta

SEQ ID NO: 371497 - DNA, 20 bp, Artificial
  CRISPR gRNA sequence
aattataagagttaaggcat

SEQ ID NO: 371498 - DNA, 20 bp, Artificial
  CRISPR gRNA sequence
gagttaaggcatcagaaaat

SEQ ID NO: 371499 - DNA, 20 bp, Artificial
  CRISPR gRNA sequence
gcatcagaaaataagctatc

SEQ ID NO: 371500 - DNA, 20 bp, Artificial
  CRISPR gRNA sequence
catcagaaaataagctatct

SEQ ID NO: 371501 - DNA, 20 bp, Artificial
  CRISPR gRNA sequence
tcagaaaataagctatctag

SEQ ID NO: 371502 - DNA, 20 bp, Artificial
  CRISPR gRNA sequence
gaaaataagctatctaggag

SEQ ID NO: 371503 - DNA, 20 bp, Artificial
  CRISPR gRNA sequence
aaataagctatctaggagca

SEQ ID NO: 371504 - DNA, 20 bp, Artificial
  CRISPR gRNA sequence
aataagctatctaggagcag

SEQ ID NO: 371505 - DNA, 20 bp, Artificial
  CRISPR gRNA sequence
tctaggagcagaggcatcct

SEQ ID NO: 371506 - DNA, 20 bp, Artificial
  CRISPR gRNA sequence
taggagcagaggcatccttg

SEQ ID NO: 371507 - DNA, 20 bp, Artificial
  CRISPR gRNA sequence
ttggagctgatgttgcctct

SEQ ID NO: 371508 - DNA, 20 bp, Artificial
  CRISPR gRNA sequence
tctgagatcctgccctgctg

SEQ ID NO: 371509 - DNA, 20 bp, Artificial
  CRISPR gRNA sequence
ctgagatcctgccctgctgc

SEQ ID NO: 371510 - DNA, 20 bp, Artificial
  CRISPR gRNA sequence
tgagatcctgccctgctgca

SEQ ID NO: 371511 - DNA, 20 bp, Artificial
  CRISPR gRNA sequence
gatcctgccctgctgcaggg

SEQ ID NO: 371512 - DNA, 20 bp, Artificial
  CRISPR gRNA sequence
tgccctgctgcagggtggaa

SEQ ID NO: 371513 - DNA, 20 bp, Artificial
  CRISPR gRNA sequence
cagggtggaaaagaaaactc

SEQ ID NO: 371514 - DNA, 20 bp, Artificial
  CRISPR gRNA sequence
aagaaaactctggctgtcac

SEQ ID NO: 371515 - DNA, 20 bp, Artificial
  CRISPR gRNA sequence
gaaaactctggctgtcaccg

SEQ ID NO: 371516 - DNA, 20 bp, Artificial
  CRISPR gRNA sequence
ctgtcaccggagtcccttct

SEQ ID NO: 371517 - DNA, 20 bp, Artificial
  CRISPR gRNA sequence
tgtcaccggagtcccttctc

SEQ ID NO: 371518 - DNA, 20 bp, Artificial
  CRISPR gRNA sequence
gtcaccggagtcccttctca

SEQ ID NO: 371519 - DNA, 20 bp, Artificial
  CRISPR gRNA sequence
ccggagtcccttctcagggc

SEQ ID NO: 371520 - DNA, 20 bp, Artificial
  CRISPR gRNA sequence
tcccttctcagggctggttt

SEQ ID NO: 371521 - DNA, 20 bp, Artificial
  CRISPR gRNA sequence
tctcagggctggtttgagac

SEQ ID NO: 371522 - DNA, 20 bp, Artificial
  CRISPR gRNA sequence
ctggtttgagactggctccc

SEQ ID NO: 371523 - DNA, 20 bp, Artificial
  CRISPR gRNA sequence
ggctccctagacgccctgcc

SEQ ID NO: 371524 - DNA, 20 bp, Artificial
  CRISPR gRNA sequence
gctccctagacgccctgcct

SEQ ID NO: 371525 - DNA, 20 bp, Artificial
  CRISPR gRNA sequence
cctagacgccctgcctaggt

SEQ ID NO: 371526 - DNA, 20 bp, Artificial
  CRISPR gRNA sequence
taagaatgtcctgccattca

SEQ ID NO: 371527 - DNA, 20 bp, Artificial
  CRISPR gRNA sequence
aatgtcctgccattcacagc

SEQ ID NO: 371528 - DNA, 20 bp, Artificial
  CRISPR gRNA sequence
atgtcctgccattcacagct

SEQ ID NO: 371529 - DNA, 20 bp, Artificial
  CRISPR gRNA sequence
acagctgggtgacttatttg

SEQ ID NO: 371530 - DNA, 20 bp, Artificial
  CRISPR gRNA sequence
cagctgggtgacttatttgt

SEQ ID NO: 371531 - DNA, 20 bp, Artificial
  CRISPR gRNA sequence
agctgggtgacttatttgtg

SEQ ID NO: 371532 - DNA, 20 bp, Artificial
  CRISPR gRNA sequence
tttgtggggactaaatgcac

SEQ ID NO: 371533 - DNA, 20 bp, Artificial
  CRISPR gRNA sequence
ggggactaaatgcactagct

SEQ ID NO: 371534 - DNA, 20 bp, Artificial
  CRISPR gRNA sequence
gggactaaatgcactagctt

SEQ ID NO: 371535 - DNA, 20 bp, Artificial
  CRISPR gRNA sequence
ttaggtaatgcatttaatgc

SEQ ID NO: 371536 - DNA, 20 bp, Artificial
  CRISPR gRNA sequence
atgcatttaatgctggcact

SEQ ID NO: 371537 - DNA, 20 bp, Artificial
  CRISPR gRNA sequence
atttaatgctggcacttagt

SEQ ID NO: 371538 - DNA, 20 bp, Artificial
  CRISPR gRNA sequence
tttaatgctggcacttagta

SEQ ID NO: 371539 - DNA, 20 bp, Artificial
  CRISPR gRNA sequence
cacttagtaaggactcgttc

SEQ ID NO: 371540 - DNA, 20 bp, Artificial
  CRISPR gRNA sequence
acttagtaaggactcgttca

SEQ ID NO: 371541 - DNA, 20 bp, Artificial
  CRISPR gRNA sequence
aatatactgaaaatattttt

SEQ ID NO: 371542 - DNA, 20 bp, Artificial
  CRISPR gRNA sequence
tgaaaatatttttaagtata

SEQ ID NO: 371543 - DNA, 20 bp, Artificial
  CRISPR gRNA sequence
gaaaatatttttaagtatat

SEQ ID NO: 371544 - DNA, 20 bp, Artificial
  CRISPR gRNA sequence
atgggacaaaatgcttaatg

SEQ ID NO: 371545 - DNA, 20 bp, Artificial
  CRISPR gRNA sequence
aaaatgcttaatgtagtctc

SEQ ID NO: 371546 - DNA, 20 bp, Artificial
  CRISPR gRNA sequence
aaatgcttaatgtagtctcc

SEQ ID NO: 371547 - DNA, 20 bp, Artificial
  CRISPR gRNA sequence
aatgcttaatgtagtctcca

SEQ ID NO: 371548 - DNA, 20 bp, Artificial
  CRISPR gRNA sequence
atcactaacaatctattctc

SEQ ID NO: 371549 - DNA, 20 bp, Artificial
  CRISPR gRNA sequence
taacaatctattctctagta

SEQ ID NO: 371550 - DNA, 20 bp, Artificial
  CRISPR gRNA sequence
attctctagtacagaatcat

SEQ ID NO: 371551 - DNA, 20 bp, Artificial
  CRISPR gRNA sequence
tctctagtacagaatcatta

SEQ ID NO: 371552 - DNA, 20 bp, Artificial
  CRISPR gRNA sequence
tagtacagaatcattagaga

SEQ ID NO: 371553 - DNA, 20 bp, Artificial
  CRISPR gRNA sequence
tctgttaaaaacctgccatg

SEQ ID NO: 371554 - DNA, 20 bp, Artificial
  CRISPR gRNA sequence
ttaaaaacctgccatgcaga

SEQ ID NO: 371555 - DNA, 20 bp, Artificial
  CRISPR gRNA sequence
ctacattaaattgtctaacc

SEQ ID NO: 371556 - DNA, 20 bp, Artificial
  CRISPR gRNA sequence
tacattaaattgtctaacct

SEQ ID NO: 371557 - DNA, 20 bp, Artificial
  CRISPR gRNA sequence
acattaaattgtctaacctg

SEQ ID NO: 371558 - DNA, 20 bp, Artificial
  CRISPR gRNA sequence
cattaaattgtctaacctgg

SEQ ID NO: 371559 - DNA, 20 bp, Artificial
  CRISPR gRNA sequence
attaaattgtctaacctggg

SEQ ID NO: 371560 - DNA, 20 bp, Artificial
  CRISPR gRNA sequence
gtctaacctggggggccaat

SEQ ID NO: 371561 - DNA, 20 bp, Artificial
  CRISPR gRNA sequence
ggggccaattggtaacattt

SEQ ID NO: 371562 - DNA, 20 bp, Artificial
  CRISPR gRNA sequence
gccaattggtaacattttag

SEQ ID NO: 371563 - DNA, 20 bp, Artificial
  CRISPR gRNA sequence
aattggtaacattttagtag

SEQ ID NO: 371564 - DNA, 20 bp, Artificial
  CRISPR gRNA sequence
taacattttagtagaagaaa

SEQ ID NO: 371565 - DNA, 20 bp, Artificial
  CRISPR gRNA sequence
aagaaacagaccaatgctct

SEQ ID NO: 371566 - DNA, 20 bp, Artificial
  CRISPR gRNA sequence
agaaacagaccaatgctctt

SEQ ID NO: 371567 - DNA, 20 bp, Artificial
  CRISPR gRNA sequence
ctcttgggcattttattttt

SEQ ID NO: 371568 - DNA, 20 bp, Artificial
  CRISPR gRNA sequence
attttattttttggttttat

SEQ ID NO: 371569 - DNA, 20 bp, Artificial
  CRISPR gRNA sequence
tttttggttttatgagacct

SEQ ID NO: 371570 - DNA, 20 bp, Artificial
  CRISPR gRNA sequence
tttggttttatgagacctca

SEQ ID NO: 371571 - DNA, 20 bp, Artificial
  CRISPR gRNA sequence
ttaaaattcttatatcccat

SEQ ID NO: 371572 - DNA, 20 bp, Artificial
  CRISPR gRNA sequence
aattcttatatcccattagt

SEQ ID NO: 371573 - DNA, 20 bp, Artificial
  CRISPR gRNA sequence
ccattagtcagtaatttttc

SEQ ID NO: 371574 - DNA, 20 bp, Artificial
  CRISPR gRNA sequence
agtcagtaatttttctggtt

SEQ ID NO: 371575 - DNA, 20 bp, Artificial
  CRISPR gRNA sequence
tcagtaatttttctggttga

SEQ ID NO: 371576 - DNA, 20 bp, Artificial
  CRISPR gRNA sequence
tttctggttgagagaaactg

SEQ ID NO: 371577 - DNA, 20 bp, Artificial
  CRISPR gRNA sequence
ggttgagagaaactgcagaa

SEQ ID NO: 371578 - DNA, 20 bp, Artificial
  CRISPR gRNA sequence
gaaactgcagaatggctcaa

SEQ ID NO: 371579 - DNA, 20 bp, Artificial
  CRISPR gRNA sequence
tttgacttttccatgtgatt

SEQ ID NO: 371580 - DNA, 20 bp, Artificial
  CRISPR gRNA sequence
acatcattctcattgtacca

SEQ ID NO: 371581 - DNA, 20 bp, Artificial
  CRISPR gRNA sequence
tcattctcattgtaccatgg

SEQ ID NO: 371582 - DNA, 20 bp, Artificial
  CRISPR gRNA sequence
attctcattgtaccatggtg

SEQ ID NO: 371583 - DNA, 20 bp, Artificial
  CRISPR gRNA sequence
tctcattgtaccatggtgga

SEQ ID NO: 371584 - DNA, 20 bp, Artificial
  CRISPR gRNA sequence
taccatggtggagagattga

SEQ ID NO: 371585 - DNA, 20 bp, Artificial
  CRISPR gRNA sequence
aagttattttttttaacaat

SEQ ID NO: 371586 - DNA, 20 bp, Artificial
  CRISPR gRNA sequence
acctgaacaaacattacacc

SEQ ID NO: 371587 - DNA, 20 bp, Artificial
  CRISPR gRNA sequence
cctgaacaaacattacacca

SEQ ID NO: 371588 - DNA, 20 bp, Artificial
  CRISPR gRNA sequence
ctgaacaaacattacaccaa

SEQ ID NO: 371589 - DNA, 20 bp, Artificial
  CRISPR gRNA sequence
tgaacaaacattacaccaag

SEQ ID NO: 371590 - DNA, 20 bp, Artificial
  CRISPR gRNA sequence
cattacaccaaggggaccca

SEQ ID NO: 371591 - DNA, 20 bp, Artificial
  CRISPR gRNA sequence
ggggacccacggttaccttt

SEQ ID NO: 371592 - DNA, 20 bp, Artificial
  CRISPR gRNA sequence
gggacccacggttacctttc

SEQ ID NO: 371593 - DNA, 20 bp, Artificial
  CRISPR gRNA sequence
gacccacggttacctttcag

SEQ ID NO: 371594 - DNA, 20 bp, Artificial
  CRISPR gRNA sequence
acctttcaggagccaatctc

SEQ ID NO: 371595 - DNA, 20 bp, Artificial
  CRISPR gRNA sequence
aggagccaatctcaagattc

SEQ ID NO: 371596 - DNA, 20 bp, Artificial
  CRISPR gRNA sequence
gagccaatctcaagattctg

SEQ ID NO: 371597 - DNA, 20 bp, Artificial
  CRISPR gRNA sequence
ctcaagattctggagctcca

SEQ ID NO: 371598 - DNA, 20 bp, Artificial
  CRISPR gRNA sequence
caagattctggagctccacg

SEQ ID NO: 371599 - DNA, 20 bp, Artificial
  CRISPR gRNA sequence
gagctccacggagctgcccc

SEQ ID NO: 371600 - DNA, 20 bp, Artificial
  CRISPR gRNA sequence
gctccacggagctgcccctg

SEQ ID NO: 371601 - DNA, 20 bp, Artificial
  CRISPR gRNA sequence
ctccacggagctgcccctgg

SEQ ID NO: 371602 - DNA, 20 bp, Artificial
  CRISPR gRNA sequence
cacggagctgcccctggagg

SEQ ID NO: 371603 - DNA, 20 bp, Artificial
  CRISPR gRNA sequence
agctgcccctggaggcagcc

SEQ ID NO: 371604 - DNA, 20 bp, Artificial
  CRISPR gRNA sequence
gctgcccctggaggcagcct

SEQ ID NO: 371605 - DNA, 20 bp, Artificial
  CRISPR gRNA sequence
tggaggcagcctgggctctg

SEQ ID NO: 371606 - DNA, 20 bp, Artificial
  CRISPR gRNA sequence
ggcagcctgggctctgaagc

SEQ ID NO: 371607 - DNA, 20 bp, Artificial
  CRISPR gRNA sequence
gcagcctgggctctgaagct

SEQ ID NO: 371608 - DNA, 20 bp, Artificial
  CRISPR gRNA sequence
cagcctgggctctgaagctg

SEQ ID NO: 371609 - DNA, 20 bp, Artificial
  CRISPR gRNA sequence
gcctgggctctgaagctggg

SEQ ID NO: 371610 - DNA, 20 bp, Artificial
  CRISPR gRNA sequence
cctgggctctgaagctgggg

SEQ ID NO: 371611 - DNA, 20 bp, Artificial
  CRISPR gRNA sequence
ggctctgaagctggggaggc

SEQ ID NO: 371612 - DNA, 20 bp, Artificial
  CRISPR gRNA sequence
tctgaagctggggaggccgg

SEQ ID NO: 371613 - DNA, 20 bp, Artificial
  CRISPR gRNA sequence
gctggggaggccggtggtct

SEQ ID NO: 371614 - DNA, 20 bp, Artificial
  CRISPR gRNA sequence
ggggaggccggtggtctcag

SEQ ID NO: 371615 - DNA, 20 bp, Artificial
  CRISPR gRNA sequence
tcagcagttgctttgactcc

SEQ ID NO: 371616 - DNA, 20 bp, Artificial
  CRISPR gRNA sequence
cagcagttgctttgactcct

SEQ ID NO: 371617 - DNA, 20 bp, Artificial
  CRISPR gRNA sequence
cctgggtaatctgaatcaca

SEQ ID NO: 371618 - DNA, 20 bp, Artificial
  CRISPR gRNA sequence
aatctgaatcacaaagctgc

SEQ ID NO: 371619 - DNA, 20 bp, Artificial
  CRISPR gRNA sequence
atctgaatcacaaagctgcc

SEQ ID NO: 371620 - DNA, 20 bp, Artificial
  CRISPR gRNA sequence
tctgaatcacaaagctgccg

SEQ ID NO: 371621 - DNA, 20 bp, Artificial
  CRISPR gRNA sequence
gctgccggggcctgcattgc

SEQ ID NO: 371622 - DNA, 20 bp, Artificial
  CRISPR gRNA sequence
attgcaagtcctttgctgtt

SEQ ID NO: 371623 - DNA, 20 bp, Artificial
  CRISPR gRNA sequence
gtcctttgctgttcagtgct

SEQ ID NO: 371624 - DNA, 20 bp, Artificial
  CRISPR gRNA sequence
tttgctgttcagtgcttaga

SEQ ID NO: 371625 - DNA, 20 bp, Artificial
  CRISPR gRNA sequence
ttgctgttcagtgcttagac

SEQ ID NO: 371626 - DNA, 20 bp, Artificial
  CRISPR gRNA sequence
tgctgttcagtgcttagaca

SEQ ID NO: 371627 - DNA, 20 bp, Artificial
  CRISPR gRNA sequence
gctgttcagtgcttagacag

SEQ ID NO: 371628 - DNA, 20 bp, Artificial
  CRISPR gRNA sequence
tagacaggggaatcgctctt

SEQ ID NO: 371629 - DNA, 20 bp, Artificial
  CRISPR gRNA sequence
ctgcaaatcatctcttaata

SEQ ID NO: 371630 - DNA, 20 bp, Artificial
  CRISPR gRNA sequence
atctcttaatatggattttc

SEQ ID NO: 371631 - DNA, 20 bp, Artificial
  CRISPR gRNA sequence
tctcttaatatggattttct

SEQ ID NO: 371632 - DNA, 20 bp, Artificial
  CRISPR gRNA sequence
ctgaatcctgatttgccatg

SEQ ID NO: 371633 - DNA, 20 bp, Artificial
  CRISPR gRNA sequence
tgaatcctgatttgccatgc

SEQ ID NO: 371634 - DNA, 20 bp, Artificial
  CRISPR gRNA sequence
gatttgccatgcaggacacg

SEQ ID NO: 371635 - DNA, 20 bp, Artificial
  CRISPR gRNA sequence
caggacacgcagcctgaatc

SEQ ID NO: 371636 - DNA, 20 bp, Artificial
  CRISPR gRNA sequence
catttttttatttccacaaa

SEQ ID NO: 371637 - DNA, 20 bp, Artificial
  CRISPR gRNA sequence
tttccacaaatggccttgcc

SEQ ID NO: 371638 - DNA, 20 bp, Artificial
  CRISPR gRNA sequence
tgcctggctttccttcatga

SEQ ID NO: 371639 - DNA, 20 bp, Artificial
  CRISPR gRNA sequence
ttccttcatgatggctttgt

SEQ ID NO: 371640 - DNA, 20 bp, Artificial
  CRISPR gRNA sequence
tccttcatgatggctttgtc

SEQ ID NO: 371641 - DNA, 20 bp, Artificial
  CRISPR gRNA sequence
cccactttatctgtgccttt

SEQ ID NO: 371642 - DNA, 20 bp, Artificial
  CRISPR gRNA sequence
tttatctgtgcctttcagtt

SEQ ID NO: 371643 - DNA, 20 bp, Artificial
  CRISPR gRNA sequence
atctgtgcctttcagttaag

SEQ ID NO: 371644 - DNA, 20 bp, Artificial
  CRISPR gRNA sequence
ctttcagttaagcggtcttt

SEQ ID NO: 371645 - DNA, 20 bp, Artificial
  CRISPR gRNA sequence
agcttattttttatcttgtt

SEQ ID NO: 371646 - DNA, 20 bp, Artificial
  CRISPR gRNA sequence
tttaccttttatctgcactt

SEQ ID NO: 371647 - DNA, 20 bp, Artificial
  CRISPR gRNA sequence
tttatctgcactttagatga

SEQ ID NO: 371648 - DNA, 20 bp, Artificial
  CRISPR gRNA sequence
tctgcactttagatgaaaga

SEQ ID NO: 371649 - DNA, 20 bp, Artificial
  CRISPR gRNA sequence
tttagatgaaagacagaaaa

SEQ ID NO: 371650 - DNA, 20 bp, Artificial
  CRISPR gRNA sequence
agacagaaaatggcaacgtg

SEQ ID NO: 371651 - DNA, 20 bp, Artificial
  CRISPR gRNA sequence
gacagaaaatggcaacgtgt

SEQ ID NO: 371652 - DNA, 20 bp, Artificial
  CRISPR gRNA sequence
agaaaatggcaacgtgtggg

SEQ ID NO: 371653 - DNA, 20 bp, Artificial
  CRISPR gRNA sequence
aaatggcaacgtgtgggaag

SEQ ID NO: 371654 - DNA, 20 bp, Artificial
  CRISPR gRNA sequence
gtgtgggaagcagtgttgtg

SEQ ID NO: 371655 - DNA, 20 bp, Artificial
  CRISPR gRNA sequence
gggaagcagtgttgtgaaga

SEQ ID NO: 371656 - DNA, 20 bp, Artificial
  CRISPR gRNA sequence
gtgaagacggccgattttct

SEQ ID NO: 371657 - DNA, 20 bp, Artificial
  CRISPR gRNA sequence
aagacggccgattttctcag

SEQ ID NO: 371658 - DNA, 20 bp, Artificial
  CRISPR gRNA sequence
agacggccgattttctcagc

SEQ ID NO: 371659 - DNA, 20 bp, Artificial
  CRISPR gRNA sequence
ggccgattttctcagcagga

SEQ ID NO: 371660 - DNA, 20 bp, Artificial
  CRISPR gRNA sequence
gatggacttgctgcttctga

SEQ ID NO: 371661 - DNA, 20 bp, Artificial
  CRISPR gRNA sequence
atggacttgctgcttctgat

SEQ ID NO: 371662 - DNA, 20 bp, Artificial
  CRISPR gRNA sequence
ttgctgcttctgatgggtgc

SEQ ID NO: 371663 - DNA, 20 bp, Artificial
  CRISPR gRNA sequence
tgcttctgatgggtgctggc

SEQ ID NO: 371664 - DNA, 20 bp, Artificial
  CRISPR gRNA sequence
gcttctgatgggtgctggcg

SEQ ID NO: 371665 - DNA, 20 bp, Artificial
  CRISPR gRNA sequence
tgatgggtgctggcgaggcc

SEQ ID NO: 371666 - DNA, 20 bp, Artificial
  CRISPR gRNA sequence
gcgaggcccagactgtaccc

SEQ ID NO: 371667 - DNA, 20 bp, Artificial
  CRISPR gRNA sequence
tacccaagatgtcgtcctga

SEQ ID NO: 371668 - DNA, 20 bp, Artificial
  CRISPR gRNA sequence
tgatggtccttactccctat

SEQ ID NO: 371669 - DNA, 20 bp, Artificial
  CRISPR gRNA sequence
cttactccctattagtgtcc

SEQ ID NO: 371670 - DNA, 20 bp, Artificial
  CRISPR gRNA sequence
tactccctattagtgtccta

SEQ ID NO: 371671 - DNA, 20 bp, Artificial
  CRISPR gRNA sequence
tattagtgtcctagagctgc

SEQ ID NO: 371672 - DNA, 20 bp, Artificial
  CRISPR gRNA sequence
ctgctggcacatgataccaa

SEQ ID NO: 371673 - DNA, 20 bp, Artificial
  CRISPR gRNA sequence
tggcacatgataccaaaagc

SEQ ID NO: 371674 - DNA, 20 bp, Artificial
  CRISPR gRNA sequence
ggcacatgataccaaaagct

SEQ ID NO: 371675 - DNA, 20 bp, Artificial
  CRISPR gRNA sequence
ccaaaagctgggtaacttaa

SEQ ID NO: 371676 - DNA, 20 bp, Artificial
  CRISPR gRNA sequence
aacagaaatgtgttgtcttg

SEQ ID NO: 371677 - DNA, 20 bp, Artificial
  CRISPR gRNA sequence
atgtgttgtcttgcagtttg

SEQ ID NO: 371678 - DNA, 20 bp, Artificial
  CRISPR gRNA sequence
gtcttgcagtttgaagtcca

SEQ ID NO: 371679 - DNA, 20 bp, Artificial
  CRISPR gRNA sequence
gcagtttgaagtccaaagtg

SEQ ID NO: 371680 - DNA, 20 bp, Artificial
  CRISPR gRNA sequence
cagtttgaagtccaaagtga

SEQ ID NO: 371681 - DNA, 20 bp, Artificial
  CRISPR gRNA sequence
gaagtccaaagtgaaggtat

SEQ ID NO: 371682 - DNA, 20 bp, Artificial
  CRISPR gRNA sequence
gtccaaagtgaaggtatcag

SEQ ID NO: 371683 - DNA, 20 bp, Artificial
  CRISPR gRNA sequence
tccaaagtgaaggtatcagc

SEQ ID NO: 371684 - DNA, 20 bp, Artificial
  CRISPR gRNA sequence
ccaaagtgaaggtatcagca

SEQ ID NO: 371685 - DNA, 20 bp, Artificial
  CRISPR gRNA sequence
agtgaaggtatcagcagggt

SEQ ID NO: 371686 - DNA, 20 bp, Artificial
  CRISPR gRNA sequence
tcagcagggttggttccctc

SEQ ID NO: 371687 - DNA, 20 bp, Artificial
  CRISPR gRNA sequence
cagcagggttggttccctct

SEQ ID NO: 371688 - DNA, 20 bp, Artificial
  CRISPR gRNA sequence
agcagggttggttccctctg

SEQ ID NO: 371689 - DNA, 20 bp, Artificial
  CRISPR gRNA sequence
gcagggttggttccctctgg

SEQ ID NO: 371690 - DNA, 20 bp, Artificial
  CRISPR gRNA sequence
tggttccctctgggggttgc

SEQ ID NO: 371691 - DNA, 20 bp, Artificial
  CRISPR gRNA sequence
ggttccctctgggggttgca

SEQ ID NO: 371692 - DNA, 20 bp, Artificial
  CRISPR gRNA sequence
ttccctctgggggttgcaag

SEQ ID NO: 371693 - DNA, 20 bp, Artificial
  CRISPR gRNA sequence
ccctctgggggttgcaagga

SEQ ID NO: 371694 - DNA, 20 bp, Artificial
  CRISPR gRNA sequence
cctctgggggttgcaaggag

SEQ ID NO: 371695 - DNA, 20 bp, Artificial
  CRISPR gRNA sequence
ttgcaaggagaggtctcacc

SEQ ID NO: 371696 - DNA, 20 bp, Artificial
  CRISPR gRNA sequence
gagaggtctcacctagcttc

SEQ ID NO: 371697 - DNA, 20 bp, Artificial
  CRISPR gRNA sequence
acctagcttctggcaatttc

SEQ ID NO: 371698 - DNA, 20 bp, Artificial
  CRISPR gRNA sequence
tggcaatttctggcaatctt

SEQ ID NO: 371699 - DNA, 20 bp, Artificial
  CRISPR gRNA sequence
tggcaatctttggccttcct

SEQ ID NO: 371700 - DNA, 20 bp, Artificial
  CRISPR gRNA sequence
ctttggccttccttggctcg

SEQ ID NO: 371701 - DNA, 20 bp, Artificial
  CRISPR gRNA sequence
tggccttccttggctcgtgg

SEQ ID NO: 371702 - DNA, 20 bp, Artificial
  CRISPR gRNA sequence
tctctgcattcatcttcaca

SEQ ID NO: 371703 - DNA, 20 bp, Artificial
  CRISPR gRNA sequence
gcttgtattcatgcctgtgt

SEQ ID NO: 371704 - DNA, 20 bp, Artificial
  CRISPR gRNA sequence
tcagaatttcccctttttat

SEQ ID NO: 371705 - DNA, 20 bp, Artificial
  CRISPR gRNA sequence
cagaatttcccctttttata

SEQ ID NO: 371706 - DNA, 20 bp, Artificial
  CRISPR gRNA sequence
ttcccctttttataaggaca

SEQ ID NO: 371707 - DNA, 20 bp, Artificial
  CRISPR gRNA sequence
ttataaggacacggtcatat

SEQ ID NO: 371708 - DNA, 20 bp, Artificial
  CRISPR gRNA sequence
aggacacggtcatattggat

SEQ ID NO: 371709 - DNA, 20 bp, Artificial
  CRISPR gRNA sequence
ggacacggtcatattggatt

SEQ ID NO: 371710 - DNA, 20 bp, Artificial
  CRISPR gRNA sequence
gacacggtcatattggatta

SEQ ID NO: 371711 - DNA, 20 bp, Artificial
  CRISPR gRNA sequence
acacggtcatattggattag

SEQ ID NO: 371712 - DNA, 20 bp, Artificial
  CRISPR gRNA sequence
gattaggggccaccctattc

SEQ ID NO: 371713 - DNA, 20 bp, Artificial
  CRISPR gRNA sequence
attaggggccaccctattcc

SEQ ID NO: 371714 - DNA, 20 bp, Artificial
  CRISPR gRNA sequence
ttaactaattgtatctgcaa

SEQ ID NO: 371715 - DNA, 20 bp, Artificial
  CRISPR gRNA sequence
caacagccctatttccaaat

SEQ ID NO: 371716 - DNA, 20 bp, Artificial
  CRISPR gRNA sequence
gccctatttccaaatcagat

SEQ ID NO: 371717 - DNA, 20 bp, Artificial
  CRISPR gRNA sequence
ccctatttccaaatcagatc

SEQ ID NO: 371718 - DNA, 20 bp, Artificial
  CRISPR gRNA sequence
ccaaatcagatcaggttgtg

SEQ ID NO: 371719 - DNA, 20 bp, Artificial
  CRISPR gRNA sequence
cagatcaggttgtgaagtac

SEQ ID NO: 371720 - DNA, 20 bp, Artificial
  CRISPR gRNA sequence
gatcaggttgtgaagtactg

SEQ ID NO: 371721 - DNA, 20 bp, Artificial
  CRISPR gRNA sequence
atcaggttgtgaagtactgg

SEQ ID NO: 371722 - DNA, 20 bp, Artificial
  CRISPR gRNA sequence
ggttgtgaagtactggaggc

SEQ ID NO: 371723 - DNA, 20 bp, Artificial
  CRISPR gRNA sequence
gttgtgaagtactggaggct

SEQ ID NO: 371724 - DNA, 20 bp, Artificial
  CRISPR gRNA sequence
tggaggctaggacttcacca

SEQ ID NO: 371725 - DNA, 20 bp, Artificial
  CRISPR gRNA sequence
ggaggctaggacttcaccat

SEQ ID NO: 371726 - DNA, 20 bp, Artificial
  CRISPR gRNA sequence
ggacttcaccataggaatgt

SEQ ID NO: 371727 - DNA, 20 bp, Artificial
  CRISPR gRNA sequence
gacttcaccataggaatgtt

SEQ ID NO: 371728 - DNA, 20 bp, Artificial
  CRISPR gRNA sequence
acttcaccataggaatgttg

SEQ ID NO: 371729 - DNA, 20 bp, Artificial
  CRISPR gRNA sequence
cttcaccataggaatgttgg

SEQ ID NO: 371730 - DNA, 20 bp, Artificial
  CRISPR gRNA sequence
acctgtaacatccccaaact

SEQ ID NO: 371731 - DNA, 20 bp, Artificial
  CRISPR gRNA sequence
catccccaaacttggccatc

SEQ ID NO: 371732 - DNA, 20 bp, Artificial
  CRISPR gRNA sequence
atccccaaacttggccatct

SEQ ID NO: 371733 - DNA, 20 bp, Artificial
  CRISPR gRNA sequence
ttggccatctgggaacattg

SEQ ID NO: 371734 - DNA, 20 bp, Artificial
  CRISPR gRNA sequence
ctgggaacattgcagctttt

SEQ ID NO: 371735 - DNA, 20 bp, Artificial
  CRISPR gRNA sequence
gggaacattgcagcttttta

SEQ ID NO: 371736 - DNA, 20 bp, Artificial
  CRISPR gRNA sequence
atgtttgaaatgaatgcaca

SEQ ID NO: 371737 - DNA, 20 bp, Artificial
  CRISPR gRNA sequence
tgtttgaaatgaatgcacac

SEQ ID NO: 371738 - DNA, 20 bp, Artificial
  CRISPR gRNA sequence
gtttgaaatgaatgcacaca

SEQ ID NO: 371739 - DNA, 20 bp, Artificial
  CRISPR gRNA sequence
ttgaaatgaatgcacacagg

SEQ ID NO: 371740 - DNA, 20 bp, Artificial
  CRISPR gRNA sequence
gaatgcacacagggagtcta

SEQ ID NO: 371741 - DNA, 20 bp, Artificial
  CRISPR gRNA sequence
cacacagggagtctacagtg

SEQ ID NO: 371742 - DNA, 20 bp, Artificial
  CRISPR gRNA sequence
acacagggagtctacagtgt

SEQ ID NO: 371743 - DNA, 20 bp, Artificial
  CRISPR gRNA sequence
cagggagtctacagtgtagg

SEQ ID NO: 371744 - DNA, 20 bp, Artificial
  CRISPR gRNA sequence
agggagtctacagtgtaggc

SEQ ID NO: 371745 - DNA, 20 bp, Artificial
  CRISPR gRNA sequence
ggagtctacagtgtaggcag

SEQ ID NO: 371746 - DNA, 20 bp, Artificial
  CRISPR gRNA sequence
aggagcttgcattctctttc

SEQ ID NO: 371747 - DNA, 20 bp, Artificial
  CRISPR gRNA sequence
ggagcttgcattctctttct

SEQ ID NO: 371748 - DNA, 20 bp, Artificial
  CRISPR gRNA sequence
ctgggaatgctgatgcgttc

SEQ ID NO: 371749 - DNA, 20 bp, Artificial
  CRISPR gRNA sequence
tgggaatgctgatgcgttct

SEQ ID NO: 371750 - DNA, 20 bp, Artificial
  CRISPR gRNA sequence
gggaatgctgatgcgttcta

SEQ ID NO: 371751 - DNA, 20 bp, Artificial
  CRISPR gRNA sequence
aatgctgatgcgttctaggg

SEQ ID NO: 371752 - DNA, 20 bp, Artificial
  CRISPR gRNA sequence
tgctgatgcgttctagggaa

SEQ ID NO: 371753 - DNA, 20 bp, Artificial
  CRISPR gRNA sequence
gctgatgcgttctagggaag

SEQ ID NO: 371754 - DNA, 20 bp, Artificial
  CRISPR gRNA sequence
ttctgtttctattctgcttg

SEQ ID NO: 371755 - DNA, 20 bp, Artificial
  CRISPR gRNA sequence
ttctgcttgaagctgcctga

SEQ ID NO: 371756 - DNA, 20 bp, Artificial
  CRISPR gRNA sequence
cttgaagctgcctgacagct

SEQ ID NO: 371757 - DNA, 20 bp, Artificial
  CRISPR gRNA sequence
agctgcctgacagctcagtt

SEQ ID NO: 371758 - DNA, 20 bp, Artificial
  CRISPR gRNA sequence
cgactgtctttttcactttt

SEQ ID NO: 371759 - DNA, 20 bp, Artificial
  CRISPR gRNA sequence
ttttcactttttggctgtca

SEQ ID NO: 371760 - DNA, 20 bp, Artificial
  CRISPR gRNA sequence
cactttttggctgtcacagc

SEQ ID NO: 371761 - DNA, 20 bp, Artificial
  CRISPR gRNA sequence
gctgtcacagccagaactat

SEQ ID NO: 371762 - DNA, 20 bp, Artificial
  CRISPR gRNA sequence
ctgtcacagccagaactatg

SEQ ID NO: 371763 - DNA, 20 bp, Artificial
  CRISPR gRNA sequence
tcacagccagaactatgagg

SEQ ID NO: 371764 - DNA, 20 bp, Artificial
  CRISPR gRNA sequence
cacagccagaactatgaggc

SEQ ID NO: 371765 - DNA, 20 bp, Artificial
  CRISPR gRNA sequence
ccagaactatgaggcaggca

SEQ ID NO: 371766 - DNA, 20 bp, Artificial
  CRISPR gRNA sequence
cagaactatgaggcaggcaa

SEQ ID NO: 371767 - DNA, 20 bp, Artificial
  CRISPR gRNA sequence
gaggcaggcaaaggcatcct

SEQ ID NO: 371768 - DNA, 20 bp, Artificial
  CRISPR gRNA sequence
tgtgtttctccttctgtcct

SEQ ID NO: 371769 - DNA, 20 bp, Artificial
  CRISPR gRNA sequence
tcccacactgcatgccctat

SEQ ID NO: 371770 - DNA, 20 bp, Artificial
  CRISPR gRNA sequence
gcatgccctatgagcttcaa

SEQ ID NO: 371771 - DNA, 20 bp, Artificial
  CRISPR gRNA sequence
agtgccatttttccactttc

SEQ ID NO: 371772 - DNA, 20 bp, Artificial
  CRISPR gRNA sequence
ctttgttgcttgcttgtaac

SEQ ID NO: 371773 - DNA, 20 bp, Artificial
  CRISPR gRNA sequence
tttgttgcttgcttgtaact

SEQ ID NO: 371774 - DNA, 20 bp, Artificial
  CRISPR gRNA sequence
tcttttgcttgcttattttt

SEQ ID NO: 371775 - DNA, 20 bp, Artificial
  CRISPR gRNA sequence
tatttttgagaactttatct

SEQ ID NO: 371776 - DNA, 20 bp, Artificial
  CRISPR gRNA sequence
atttttgagaactttatctc

SEQ ID NO: 371777 - DNA, 20 bp, Artificial
  CRISPR gRNA sequence
gaactttatctcaggcactt

SEQ ID NO: 371778 - DNA, 20 bp, Artificial
  CRISPR gRNA sequence
aactttatctcaggcacttt

SEQ ID NO: 371779 - DNA, 20 bp, Artificial
  CRISPR gRNA sequence
ctttatctcaggcactttag

SEQ ID NO: 371780 - DNA, 20 bp, Artificial
  CRISPR gRNA sequence
ggcactttaggagacctcct

SEQ ID NO: 371781 - DNA, 20 bp, Artificial
  CRISPR gRNA sequence
agacctccttagtcatcatg

SEQ ID NO: 371782 - DNA, 20 bp, Artificial
  CRISPR gRNA sequence
catttcattttgcatttatt

SEQ ID NO: 371783 - DNA, 20 bp, Artificial
  CRISPR gRNA sequence
atttcattttgcatttattt

SEQ ID NO: 371784 - DNA, 20 bp, Artificial
  CRISPR gRNA sequence
tttgcatttatttgggtgac

SEQ ID NO: 371785 - DNA, 20 bp, Artificial
  CRISPR gRNA sequence
catttatttgggtgactagt

SEQ ID NO: 371786 - DNA, 20 bp, Artificial
  CRISPR gRNA sequence
tttatttgggtgactagtaa

SEQ ID NO: 371787 - DNA, 20 bp, Artificial
  CRISPR gRNA sequence
gggtgactagtaagagtttg

SEQ ID NO: 371788 - DNA, 20 bp, Artificial
  CRISPR gRNA sequence
actagtaagagtttgtagaa

SEQ ID NO: 371789 - DNA, 20 bp, Artificial
  CRISPR gRNA sequence
ttgtagaaaagttcttaatt

SEQ ID NO: 371790 - DNA, 20 bp, Artificial
  CRISPR gRNA sequence
ttcttaattgagcatattca

SEQ ID NO: 371791 - DNA, 20 bp, Artificial
  CRISPR gRNA sequence
aattgagcatattcatagtc

SEQ ID NO: 371792 - DNA, 20 bp, Artificial
  CRISPR gRNA sequence
attgagcatattcatagtct

SEQ ID NO: 371793 - DNA, 20 bp, Artificial
  CRISPR gRNA sequence
gcatattcatagtctaggca

SEQ ID NO: 371794 - DNA, 20 bp, Artificial
  CRISPR gRNA sequence
attcatagtctaggcacagt

SEQ ID NO: 371795 - DNA, 20 bp, Artificial
  CRISPR gRNA sequence
ttcatagtctaggcacagtt

SEQ ID NO: 371796 - DNA, 20 bp, Artificial
  CRISPR gRNA sequence
ggcacagttgggaatacgtg

SEQ ID NO: 371797 - DNA, 20 bp, Artificial
  CRISPR gRNA sequence
ttgggaatacgtgaagctac

SEQ ID NO: 371798 - DNA, 20 bp, Artificial
  CRISPR gRNA sequence
gggaatacgtgaagctactg

SEQ ID NO: 371799 - DNA, 20 bp, Artificial
  CRISPR gRNA sequence
ctactatcatcatttctaat

SEQ ID NO: 371800 - DNA, 20 bp, Artificial
  CRISPR gRNA sequence
tatcatcatttctaattagc

SEQ ID NO: 371801 - DNA, 20 bp, Artificial
  CRISPR gRNA sequence
ctaattagctagtgtaataa

SEQ ID NO: 371802 - DNA, 20 bp, Artificial
  CRISPR gRNA sequence
gtgtaataatagtgctcctg

SEQ ID NO: 371803 - DNA, 20 bp, Artificial
  CRISPR gRNA sequence
aataatagtgctcctgcaga

SEQ ID NO: 371804 - DNA, 20 bp, Artificial
  CRISPR gRNA sequence
tagtgctcctgcagatggct

SEQ ID NO: 371805 - DNA, 20 bp, Artificial
  CRISPR gRNA sequence
agtgctcctgcagatggctt

SEQ ID NO: 371806 - DNA, 20 bp, Artificial
  CRISPR gRNA sequence
gtgctcctgcagatggctta

SEQ ID NO: 371807 - DNA, 20 bp, Artificial
  CRISPR gRNA sequence
cagatggcttagggcaatgc

SEQ ID NO: 371808 - DNA, 20 bp, Artificial
  CRISPR gRNA sequence
agatggcttagggcaatgct

SEQ ID NO: 371809 - DNA, 20 bp, Artificial
  CRISPR gRNA sequence
atgctgggctgtttaatttt

SEQ ID NO: 371810 - DNA, 20 bp, Artificial
  CRISPR gRNA sequence
tttaatttttagtctatttg

SEQ ID NO: 371811 - DNA, 20 bp, Artificial
  CRISPR gRNA sequence
tagtctatttgaagcatcgt

SEQ ID NO: 371812 - DNA, 20 bp, Artificial
  CRISPR gRNA sequence
atttgaagcatcgtaagaac

SEQ ID NO: 371813 - DNA, 20 bp, Artificial
  CRISPR gRNA sequence
caagttatcgtctcgtgctt

SEQ ID NO: 371814 - DNA, 20 bp, Artificial
  CRISPR gRNA sequence
gtctcgtgctttagaaaccc

SEQ ID NO: 371815 - DNA, 20 bp, Artificial
  CRISPR gRNA sequence
tctcgtgctttagaaaccct

SEQ ID NO: 371816 - DNA, 20 bp, Artificial
  CRISPR gRNA sequence
ctcgtgctttagaaaccctg

SEQ ID NO: 371817 - DNA, 20 bp, Artificial
  CRISPR gRNA sequence
cgtgctttagaaaccctggg

SEQ ID NO: 371818 - DNA, 20 bp, Artificial
  CRISPR gRNA sequence
tgctttagaaaccctgggga

SEQ ID NO: 371819 - DNA, 20 bp, Artificial
  CRISPR gRNA sequence
gctttagaaaccctggggag

SEQ ID NO: 371820 - DNA, 20 bp, Artificial
  CRISPR gRNA sequence
ccctggggagaggtctgact

SEQ ID NO: 371821 - DNA, 20 bp, Artificial
  CRISPR gRNA sequence
tggggagaggtctgactgag

SEQ ID NO: 371822 - DNA, 20 bp, Artificial
  CRISPR gRNA sequence
ggggagaggtctgactgagc

SEQ ID NO: 371823 - DNA, 20 bp, Artificial
  CRISPR gRNA sequence
tttgcacttgatctgcacct

SEQ ID NO: 371824 - DNA, 20 bp, Artificial
  CRISPR gRNA sequence
tgcacttgatctgcacctaa

SEQ ID NO: 371825 - DNA, 20 bp, Artificial
  CRISPR gRNA sequence
cttgatctgcacctaagaga

SEQ ID NO: 371826 - DNA, 20 bp, Artificial
  CRISPR gRNA sequence
cacctaagagatggttgaac

SEQ ID NO: 371827 - DNA, 20 bp, Artificial
  CRISPR gRNA sequence
acctaagagatggttgaaca

SEQ ID NO: 371828 - DNA, 20 bp, Artificial
  CRISPR gRNA sequence
ctaagagatggttgaacaag

SEQ ID NO: 371829 - DNA, 20 bp, Artificial
  CRISPR gRNA sequence
aagagatggttgaacaagga

SEQ ID NO: 371830 - DNA, 20 bp, Artificial
  CRISPR gRNA sequence
agatggttgaacaaggagag

SEQ ID NO: 371831 - DNA, 20 bp, Artificial
  CRISPR gRNA sequence
ggttgaacaaggagagtaga

SEQ ID NO: 371832 - DNA, 20 bp, Artificial
  CRISPR gRNA sequence
gttgaacaaggagagtagat

SEQ ID NO: 371833 - DNA, 20 bp, Artificial
  CRISPR gRNA sequence
ggagagtagataggctcact

SEQ ID NO: 371834 - DNA, 20 bp, Artificial
  CRISPR gRNA sequence
tagataggctcactcagcga

SEQ ID NO: 371835 - DNA, 20 bp, Artificial
  CRISPR gRNA sequence
taggctcactcagcgatggt

SEQ ID NO: 371836 - DNA, 20 bp, Artificial
  CRISPR gRNA sequence
gctcactcagcgatggtgag

SEQ ID NO: 371837 - DNA, 20 bp, Artificial
  CRISPR gRNA sequence
actcagcgatggtgagtaga

SEQ ID NO: 371838 - DNA, 20 bp, Artificial
  CRISPR gRNA sequence
ctcagcgatggtgagtagac

SEQ ID NO: 371839 - DNA, 20 bp, Artificial
  CRISPR gRNA sequence
tcagcgatggtgagtagaca

SEQ ID NO: 371840 - DNA, 20 bp, Artificial
  CRISPR gRNA sequence
gcgatggtgagtagacaggg

SEQ ID NO: 371841 - DNA, 20 bp, Artificial
  CRISPR gRNA sequence
cgatggtgagtagacaggga

SEQ ID NO: 371842 - DNA, 20 bp, Artificial
  CRISPR gRNA sequence
gatggtgagtagacagggaa

SEQ ID NO: 371843 - DNA, 20 bp, Artificial
  CRISPR gRNA sequence
ggtgagtagacagggaaggg

SEQ ID NO: 371844 - DNA, 20 bp, Artificial
  CRISPR gRNA sequence
gagtagacagggaagggcag

SEQ ID NO: 371845 - DNA, 20 bp, Artificial
  CRISPR gRNA sequence
agggaagggcagtggactcc

SEQ ID NO: 371846 - DNA, 20 bp, Artificial
  CRISPR gRNA sequence
gggaagggcagtggactcct

SEQ ID NO: 371847 - DNA, 20 bp, Artificial
  CRISPR gRNA sequence
ggaagggcagtggactcctg

SEQ ID NO: 371848 - DNA, 20 bp, Artificial
  CRISPR gRNA sequence
gaagggcagtggactcctgg

SEQ ID NO: 371849 - DNA, 20 bp, Artificial
  CRISPR gRNA sequence
gcacaacacacatttttttt

SEQ ID NO: 371850 - DNA, 20 bp, Artificial
  CRISPR gRNA sequence
cacaacacacattttttttt

SEQ ID NO: 371851 - DNA, 20 bp, Artificial
  CRISPR gRNA sequence
acaacacacattttttttta

SEQ ID NO: 371852 - DNA, 20 bp, Artificial
  CRISPR gRNA sequence
acacatttttttttagggac

SEQ ID NO: 371853 - DNA, 20 bp, Artificial
  CRISPR gRNA sequence
catttttttttagggacaag

SEQ ID NO: 371854 - DNA, 20 bp, Artificial
  CRISPR gRNA sequence
ttttttttagggacaagcag

SEQ ID NO: 371855 - DNA, 20 bp, Artificial
  CRISPR gRNA sequence
tttttagggacaagcagaag

SEQ ID NO: 371856 - DNA, 20 bp, Artificial
  CRISPR gRNA sequence
tttagggacaagcagaagaa

SEQ ID NO: 371857 - DNA, 20 bp, Artificial
  CRISPR gRNA sequence
gggacaagcagaagaagaga

SEQ ID NO: 371858 - DNA, 20 bp, Artificial
  CRISPR gRNA sequence
gcagaagaagagaaagcatg

SEQ ID NO: 371859 - DNA, 20 bp, Artificial
  CRISPR gRNA sequence
cagaagaagagaaagcatga

SEQ ID NO: 371860 - DNA, 20 bp, Artificial
  CRISPR gRNA sequence
gaagaagagaaagcatgaag

SEQ ID NO: 371861 - DNA, 20 bp, Artificial
  CRISPR gRNA sequence
aagagaaagcatgaaggaga

SEQ ID NO: 371862 - DNA, 20 bp, Artificial
  CRISPR gRNA sequence
agaaagcatgaaggagatag

SEQ ID NO: 371863 - DNA, 20 bp, Artificial
  CRISPR gRNA sequence
aaagcatgaaggagatagca

SEQ ID NO: 371864 - DNA, 20 bp, Artificial
  CRISPR gRNA sequence
aagcatgaaggagatagcag

SEQ ID NO: 371865 - DNA, 20 bp, Artificial
  CRISPR gRNA sequence
agcatgaaggagatagcaga

SEQ ID NO: 371866 - DNA, 20 bp, Artificial
  CRISPR gRNA sequence
catgaaggagatagcagagg

SEQ ID NO: 371867 - DNA, 20 bp, Artificial
  CRISPR gRNA sequence
atgaaggagatagcagaggg

SEQ ID NO: 371868 - DNA, 20 bp, Artificial
  CRISPR gRNA sequence
aggagatagcagagggaggt

SEQ ID NO: 371869 - DNA, 20 bp, Artificial
  CRISPR gRNA sequence
gatagcagagggaggtcaga

SEQ ID NO: 371870 - DNA, 20 bp, Artificial
  CRISPR gRNA sequence
atagcagagggaggtcagaa

SEQ ID NO: 371871 - DNA, 20 bp, Artificial
  CRISPR gRNA sequence
agcagagggaggtcagaaag

SEQ ID NO: 371872 - DNA, 20 bp, Artificial
  CRISPR gRNA sequence
cagagggaggtcagaaagga

SEQ ID NO: 371873 - DNA, 20 bp, Artificial
  CRISPR gRNA sequence
gagggaggtcagaaaggaga

SEQ ID NO: 371874 - DNA, 20 bp, Artificial
  CRISPR gRNA sequence
agggaggtcagaaaggagag

SEQ ID NO: 371875 - DNA, 20 bp, Artificial
  CRISPR gRNA sequence
ggaggtcagaaaggagagag

SEQ ID NO: 371876 - DNA, 20 bp, Artificial
  CRISPR gRNA sequence
aggtcagaaaggagagagga

SEQ ID NO: 371877 - DNA, 20 bp, Artificial
  CRISPR gRNA sequence
ggtcagaaaggagagaggag

SEQ ID NO: 371878 - DNA, 20 bp, Artificial
  CRISPR gRNA sequence
cagaaaggagagaggagagg

SEQ ID NO: 371879 - DNA, 20 bp, Artificial
  CRISPR gRNA sequence
agaaaggagagaggagaggc

SEQ ID NO: 371880 - DNA, 20 bp, Artificial
  CRISPR gRNA sequence
aggagagaggagaggcaggc

SEQ ID NO: 371881 - DNA, 20 bp, Artificial
  CRISPR gRNA sequence
ggcaggcaagtgcaatgtca

SEQ ID NO: 371882 - DNA, 20 bp, Artificial
  CRISPR gRNA sequence
aggcaagtgcaatgtcacgg

SEQ ID NO: 371883 - DNA, 20 bp, Artificial
  CRISPR gRNA sequence
agtgcaatgtcacggaagcc

SEQ ID NO: 371884 - DNA, 20 bp, Artificial
  CRISPR gRNA sequence
gtgcaatgtcacggaagcca

SEQ ID NO: 371885 - DNA, 20 bp, Artificial
  CRISPR gRNA sequence
tgcaatgtcacggaagccaa

SEQ ID NO: 371886 - DNA, 20 bp, Artificial
  CRISPR gRNA sequence
gcaatgtcacggaagccaag

SEQ ID NO: 371887 - DNA, 20 bp, Artificial
  CRISPR gRNA sequence
atgtcacggaagccaagggg

SEQ ID NO: 371888 - DNA, 20 bp, Artificial
  CRISPR gRNA sequence
gtcacggaagccaaggggta

SEQ ID NO: 371889 - DNA, 20 bp, Artificial
  CRISPR gRNA sequence
gccaaggggtagagtatttc

SEQ ID NO: 371890 - DNA, 20 bp, Artificial
  CRISPR gRNA sequence
ccaaggggtagagtatttcc

SEQ ID NO: 371891 - DNA, 20 bp, Artificial
  CRISPR gRNA sequence
aaggggtagagtatttccag

SEQ ID NO: 371892 - DNA, 20 bp, Artificial
  CRISPR gRNA sequence
aggggtagagtatttccagg

SEQ ID NO: 371893 - DNA, 20 bp, Artificial
  CRISPR gRNA sequence
ggggtagagtatttccagga

SEQ ID NO: 371894 - DNA, 20 bp, Artificial
  CRISPR gRNA sequence
tagagtatttccaggagggc

SEQ ID NO: 371895 - DNA, 20 bp, Artificial
  CRISPR gRNA sequence
ttccaggagggctggacatc

SEQ ID NO: 371896 - DNA, 20 bp, Artificial
  CRISPR gRNA sequence
agggctggacatccagcatt

SEQ ID NO: 371897 - DNA, 20 bp, Artificial
  CRISPR gRNA sequence
gggctggacatccagcattc

SEQ ID NO: 371898 - DNA, 20 bp, Artificial
  CRISPR gRNA sequence
ggacatccagcattcaggtc

SEQ ID NO: 371899 - DNA, 20 bp, Artificial
  CRISPR gRNA sequence
aagaacactgatgacatttg

SEQ ID NO: 371900 - DNA, 20 bp, Artificial
  CRISPR gRNA sequence
actgatgacatttgcagtct

SEQ ID NO: 371901 - DNA, 20 bp, Artificial
  CRISPR gRNA sequence
gatgacatttgcagtcttgg

SEQ ID NO: 371902 - DNA, 20 bp, Artificial
  CRISPR gRNA sequence
gacatttgcagtcttggtag

SEQ ID NO: 371903 - DNA, 20 bp, Artificial
  CRISPR gRNA sequence
acatttgcagtcttggtaga

SEQ ID NO: 371904 - DNA, 20 bp, Artificial
  CRISPR gRNA sequence
catttgcagtcttggtagaa

SEQ ID NO: 371905 - DNA, 20 bp, Artificial
  CRISPR gRNA sequence
ttgcagtcttggtagaaggg

SEQ ID NO: 371906 - DNA, 20 bp, Artificial
  CRISPR gRNA sequence
tcttggtagaagggtggaaa

SEQ ID NO: 371907 - DNA, 20 bp, Artificial
  CRISPR gRNA sequence
atggatgctcgattgtgtcg

SEQ ID NO: 371908 - DNA, 20 bp, Artificial
  CRISPR gRNA sequence
cgattgtgtcgaagcacaca

SEQ ID NO: 371909 - DNA, 20 bp, Artificial
  CRISPR gRNA sequence
gattgtgtcgaagcacacat

SEQ ID NO: 371910 - DNA, 20 bp, Artificial
  CRISPR gRNA sequence
gtgtcgaagcacacatggga

SEQ ID NO: 371911 - DNA, 20 bp, Artificial
  CRISPR gRNA sequence
tgtcgaagcacacatgggaa

SEQ ID NO: 371912 - DNA, 20 bp, Artificial
  CRISPR gRNA sequence
gtcgaagcacacatgggaaa

SEQ ID NO: 371913 - DNA, 20 bp, Artificial
  CRISPR gRNA sequence
aagcacacatgggaaagggt

SEQ ID NO: 371914 - DNA, 20 bp, Artificial
  CRISPR gRNA sequence
agcacacatgggaaagggtg

SEQ ID NO: 371915 - DNA, 20 bp, Artificial
  CRISPR gRNA sequence
acatgggaaagggtgaggcc

SEQ ID NO: 371916 - DNA, 20 bp, Artificial
  CRISPR gRNA sequence
tgggaaagggtgaggccgag

SEQ ID NO: 371917 - DNA, 20 bp, Artificial
  CRISPR gRNA sequence
gggaaagggtgaggccgagc

SEQ ID NO: 371918 - DNA, 20 bp, Artificial
  CRISPR gRNA sequence
aagggtgaggccgagcagga

SEQ ID NO: 371919 - DNA, 20 bp, Artificial
  CRISPR gRNA sequence
agggtgaggccgagcaggat

SEQ ID NO: 371920 - DNA, 20 bp, Artificial
  CRISPR gRNA sequence
gcaggatgggaacccactcc

SEQ ID NO: 371921 - DNA, 20 bp, Artificial
  CRISPR gRNA sequence
ctcctggaattttgaatgaa

SEQ ID NO: 371922 - DNA, 20 bp, Artificial
  CRISPR gRNA sequence
tcctggaattttgaatgaat

SEQ ID NO: 371923 - DNA, 20 bp, Artificial
  CRISPR gRNA sequence
cctggaattttgaatgaata

SEQ ID NO: 371924 - DNA, 20 bp, Artificial
  CRISPR gRNA sequence
ggaattttgaatgaataggg

SEQ ID NO: 371925 - DNA, 20 bp, Artificial
  CRISPR gRNA sequence
attttgaatgaatagggaag

SEQ ID NO: 371926 - DNA, 20 bp, Artificial
  CRISPR gRNA sequence
atgaatagggaagaagaaac

SEQ ID NO: 371927 - DNA, 20 bp, Artificial
  CRISPR gRNA sequence
tgaatagggaagaagaaaca

SEQ ID NO: 371928 - DNA, 20 bp, Artificial
  CRISPR gRNA sequence
agggaagaagaaacaaggac

SEQ ID NO: 371929 - DNA, 20 bp, Artificial
  CRISPR gRNA sequence
aagaagaaacaaggactgga

SEQ ID NO: 371930 - DNA, 20 bp, Artificial
  CRISPR gRNA sequence
caaggactggatggcgccaa

SEQ ID NO: 371931 - DNA, 20 bp, Artificial
  CRISPR gRNA sequence
aaggactggatggcgccaaa

SEQ ID NO: 371932 - DNA, 20 bp, Artificial
  CRISPR gRNA sequence
ggatggcgccaaaaggtcca

SEQ ID NO: 371933 - DNA, 20 bp, Artificial
  CRISPR gRNA sequence
ggcgccaaaaggtccaaagt

SEQ ID NO: 371934 - DNA, 20 bp, Artificial
  CRISPR gRNA sequence
aaaggtccaaagttggtttt

SEQ ID NO: 371935 - DNA, 20 bp, Artificial
  CRISPR gRNA sequence
aaggtccaaagttggttttc

SEQ ID NO: 371936 - DNA, 20 bp, Artificial
  CRISPR gRNA sequence
ccaaagttggttttcaggaa

SEQ ID NO: 371937 - DNA, 20 bp, Artificial
  CRISPR gRNA sequence
caaagttggttttcaggaat

SEQ ID NO: 371938 - DNA, 20 bp, Artificial
  CRISPR gRNA sequence
aagttggttttcaggaatgg

SEQ ID NO: 371939 - DNA, 20 bp, Artificial
  CRISPR gRNA sequence
tggttttcaggaatgggaga

SEQ ID NO: 371940 - DNA, 20 bp, Artificial
  CRISPR gRNA sequence
aatgggagaaagatcccgtt

SEQ ID NO: 371941 - DNA, 20 bp, Artificial
  CRISPR gRNA sequence
tgggagaaagatcccgttta

SEQ ID NO: 371942 - DNA, 20 bp, Artificial
  CRISPR gRNA sequence
gggagaaagatcccgtttag

SEQ ID NO: 371943 - DNA, 20 bp, Artificial
  CRISPR gRNA sequence
gaaagatcccgtttagaggt

SEQ ID NO: 371944 - DNA, 20 bp, Artificial
  CRISPR gRNA sequence
aagatcccgtttagaggtga

SEQ ID NO: 371945 - DNA, 20 bp, Artificial
  CRISPR gRNA sequence
gatcccgtttagaggtgaga

SEQ ID NO: 371946 - DNA, 20 bp, Artificial
  CRISPR gRNA sequence
tcccgtttagaggtgagaga

SEQ ID NO: 371947 - DNA, 20 bp, Artificial
  CRISPR gRNA sequence
tttagaggtgagagagagaa

SEQ ID NO: 371948 - DNA, 20 bp, Artificial
  CRISPR gRNA sequence
gagagagagaacagtccact

SEQ ID NO: 371949 - DNA, 20 bp, Artificial
  CRISPR gRNA sequence
gagaacagtccacttagaat

SEQ ID NO: 371950 - DNA, 20 bp, Artificial
  CRISPR gRNA sequence
gaacagtccacttagaattg

SEQ ID NO: 371951 - DNA, 20 bp, Artificial
  CRISPR gRNA sequence
aacagtccacttagaattgg

SEQ ID NO: 371952 - DNA, 20 bp, Artificial
  CRISPR gRNA sequence
ccacttagaattggaggtta

SEQ ID NO: 371953 - DNA, 20 bp, Artificial
  CRISPR gRNA sequence
agaattggaggttaaagata

SEQ ID NO: 371954 - DNA, 20 bp, Artificial
  CRISPR gRNA sequence
gaattggaggttaaagatac

SEQ ID NO: 371955 - DNA, 20 bp, Artificial
  CRISPR gRNA sequence
attggaggttaaagatacag

SEQ ID NO: 371956 - DNA, 20 bp, Artificial
  CRISPR gRNA sequence
tggaggttaaagatacagga

SEQ ID NO: 371957 - DNA, 20 bp, Artificial
  CRISPR gRNA sequence
gaggttaaagatacaggaga

SEQ ID NO: 371958 - DNA, 20 bp, Artificial
  CRISPR gRNA sequence
taaagatacaggagagagtt

SEQ ID NO: 371959 - DNA, 20 bp, Artificial
  CRISPR gRNA sequence
aggagagagtttagcatttg

SEQ ID NO: 371960 - DNA, 20 bp, Artificial
  CRISPR gRNA sequence
gtttagcatttgtggtgttc

SEQ ID NO: 371961 - DNA, 20 bp, Artificial
  CRISPR gRNA sequence
ttctggcatgaaaaatgtat

SEQ ID NO: 371962 - DNA, 20 bp, Artificial
  CRISPR gRNA sequence
tatgagctttaaaaccaaat

SEQ ID NO: 371963 - DNA, 20 bp, Artificial
  CRISPR gRNA sequence
tttctgattctgttctttgc

SEQ ID NO: 371964 - DNA, 20 bp, Artificial
  CRISPR gRNA sequence
gattctgttctttgccagct

SEQ ID NO: 371965 - DNA, 20 bp, Artificial
  CRISPR gRNA sequence
tctttgccagctcagctctt

SEQ ID NO: 371966 - DNA, 20 bp, Artificial
  CRISPR gRNA sequence
ctttgccagctcagctcttt

SEQ ID NO: 371967 - DNA, 20 bp, Artificial
  CRISPR gRNA sequence
gccagctcagctctttggga

SEQ ID NO: 371968 - DNA, 20 bp, Artificial
  CRISPR gRNA sequence
gctctttgggaaagctactt

SEQ ID NO: 371969 - DNA, 20 bp, Artificial
  CRISPR gRNA sequence
ttattttttcaactgtgaaa

SEQ ID NO: 371970 - DNA, 20 bp, Artificial
  CRISPR gRNA sequence
tattttttcaactgtgaaac

SEQ ID NO: 371971 - DNA, 20 bp, Artificial
  CRISPR gRNA sequence
acaggcacattaatactgat

SEQ ID NO: 371972 - DNA, 20 bp, Artificial
  CRISPR gRNA sequence
tactgattggatgttattgt

SEQ ID NO: 371973 - DNA, 20 bp, Artificial
  CRISPR gRNA sequence
actgattggatgttattgtt

SEQ ID NO: 371974 - DNA, 20 bp, Artificial
  CRISPR gRNA sequence
ttggatgttattgttaggat

SEQ ID NO: 371975 - DNA, 20 bp, Artificial
  CRISPR gRNA sequence
ggatgttattgttaggatta

SEQ ID NO: 371976 - DNA, 20 bp, Artificial
  CRISPR gRNA sequence
ttattgttaggattagagat

SEQ ID NO: 371977 - DNA, 20 bp, Artificial
  CRISPR gRNA sequence
tattgttaggattagagatt

SEQ ID NO: 371978 - DNA, 20 bp, Artificial
  CRISPR gRNA sequence
gattagagattgggtgtgtg

SEQ ID NO: 371979 - DNA, 20 bp, Artificial
  CRISPR gRNA sequence
gtgtgtgaagtacctttcac

SEQ ID NO: 371980 - DNA, 20 bp, Artificial
  CRISPR gRNA sequence
tgtgaagtacctttcacaag

SEQ ID NO: 371981 - DNA, 20 bp, Artificial
  CRISPR gRNA sequence
gtgaagtacctttcacaagc

SEQ ID NO: 371982 - DNA, 20 bp, Artificial
  CRISPR gRNA sequence
tgaagtacctttcacaagca

SEQ ID NO: 371983 - DNA, 20 bp, Artificial
  CRISPR gRNA sequence
cacaagcagggactccaatt

SEQ ID NO: 371984 - DNA, 20 bp, Artificial
  CRISPR gRNA sequence
acaagcagggactccaattt

SEQ ID NO: 371985 - DNA, 20 bp, Artificial
  CRISPR gRNA sequence
atactttttttttttttttt

SEQ ID NO: 371986 - DNA, 20 bp, Artificial
  CRISPR gRNA sequence
ttttttttttttttttgagt

SEQ ID NO: 371987 - DNA, 20 bp, Artificial
  CRISPR gRNA sequence
ttttttttttttttgagtca

SEQ ID NO: 371988 - DNA, 20 bp, Artificial
  CRISPR gRNA sequence
cagagtcttgctctgtcgcc

SEQ ID NO: 371989 - DNA, 20 bp, Artificial
  CRISPR gRNA sequence
agagtcttgctctgtcgccc

SEQ ID NO: 371990 - DNA, 20 bp, Artificial
  CRISPR gRNA sequence
tcttgctctgtcgcccaggc

SEQ ID NO: 371991 - DNA, 20 bp, Artificial
  CRISPR gRNA sequence
ttgctctgtcgcccaggctg

SEQ ID NO: 371992 - DNA, 20 bp, Artificial
  CRISPR gRNA sequence
ctgtcgcccaggctggagtg

SEQ ID NO: 371993 - DNA, 20 bp, Artificial
  CRISPR gRNA sequence
tcgcccaggctggagtgcag

SEQ ID NO: 371994 - DNA, 20 bp, Artificial
  CRISPR gRNA sequence
ggagtgcagtggtgcgatct

SEQ ID NO: 371995 - DNA, 20 bp, Artificial
  CRISPR gRNA sequence
gtgcgatctcggctcactgc

SEQ ID NO: 371996 - DNA, 20 bp, Artificial
  CRISPR gRNA sequence
tcactgcaagctctgcctcc

SEQ ID NO: 371997 - DNA, 20 bp, Artificial
  CRISPR gRNA sequence
cactgcaagctctgcctccc

SEQ ID NO: 371998 - DNA, 20 bp, Artificial
  CRISPR gRNA sequence
ttcacgccattcttctgcct

SEQ ID NO: 371999 - DNA, 20 bp, Artificial
  CRISPR gRNA sequence
ttcttctgcctcagcctcct

SEQ ID NO: 372000 - DNA, 20 bp, Artificial
  CRISPR gRNA sequence
ttctgcctcagcctcctgag

SEQ ID NO: 372001 - DNA, 20 bp, Artificial
  CRISPR gRNA sequence
gcctcagcctcctgagtagc

SEQ ID NO: 372002 - DNA, 20 bp, Artificial
  CRISPR gRNA sequence
cctcagcctcctgagtagct

SEQ ID NO: 372003 - DNA, 20 bp, Artificial
  CRISPR gRNA sequence
ctcctgagtagctgggacta

SEQ ID NO: 372004 - DNA, 20 bp, Artificial
  CRISPR gRNA sequence
tcctgagtagctgggactac

SEQ ID NO: 372005 - DNA, 20 bp, Artificial
  CRISPR gRNA sequence
caggcacctgccaccacgcc

SEQ ID NO: 372006 - DNA, 20 bp, Artificial
  CRISPR gRNA sequence
cggctaattttttgtatttt

SEQ ID NO: 372007 - DNA, 20 bp, Artificial
  CRISPR gRNA sequence
ctaattttttgtatttttag

SEQ ID NO: 372008 - DNA, 20 bp, Artificial
  CRISPR gRNA sequence
aattttttgtatttttagta

SEQ ID NO: 372009 - DNA, 20 bp, Artificial
  CRISPR gRNA sequence
ttttgtatttttagtagaga

SEQ ID NO: 372010 - DNA, 20 bp, Artificial
  CRISPR gRNA sequence
tttgtatttttagtagagac

SEQ ID NO: 372011 - DNA, 20 bp, Artificial
  CRISPR gRNA sequence
ttgtatttttagtagagacg

SEQ ID NO: 372012 - DNA, 20 bp, Artificial
  CRISPR gRNA sequence
gagacggggtttcaccatgt

SEQ ID NO: 372013 - DNA, 20 bp, Artificial
  CRISPR gRNA sequence
cggggtttcaccatgttagc

SEQ ID NO: 372014 - DNA, 20 bp, Artificial
  CRISPR gRNA sequence
ggggtttcaccatgttagcc

SEQ ID NO: 372015 - DNA, 20 bp, Artificial
  CRISPR gRNA sequence
tttcaccatgttagccagga

SEQ ID NO: 372016 - DNA, 20 bp, Artificial
  CRISPR gRNA sequence
acctcgtgatctgcctgcct

SEQ ID NO: 372017 - DNA, 20 bp, Artificial
  CRISPR gRNA sequence
ctgcctgcctcggcctccca

SEQ ID NO: 372018 - DNA, 20 bp, Artificial
  CRISPR gRNA sequence
gcctcggcctcccaaagtgc

SEQ ID NO: 372019 - DNA, 20 bp, Artificial
  CRISPR gRNA sequence
cctcccaaagtgctggatta

SEQ ID NO: 372020 - DNA, 20 bp, Artificial
  CRISPR gRNA sequence
ctcccaaagtgctggattac

SEQ ID NO: 372021 - DNA, 20 bp, Artificial
  CRISPR gRNA sequence
aagtgctggattacaggtgt

SEQ ID NO: 372022 - DNA, 20 bp, Artificial
  CRISPR gRNA sequence
caggtgtgagccactgtgcc

SEQ ID NO: 372023 - DNA, 20 bp, Artificial
  CRISPR gRNA sequence
aggtgtgagccactgtgccc

SEQ ID NO: 372024 - DNA, 20 bp, Artificial
  CRISPR gRNA sequence
ggcacaaataaatactttta

SEQ ID NO: 372025 - DNA, 20 bp, Artificial
  CRISPR gRNA sequence
tacttttaaagcttttttaa

SEQ ID NO: 372026 - DNA, 20 bp, Artificial
  CRISPR gRNA sequence
ttttaaagcttttttaatgg

SEQ ID NO: 372027 - DNA, 20 bp, Artificial
  CRISPR gRNA sequence
gtttcaaacatatacaaaaa

SEQ ID NO: 372028 - DNA, 20 bp, Artificial
  CRISPR gRNA sequence
caaacatatacaaaaataga

SEQ ID NO: 372029 - DNA, 20 bp, Artificial
  CRISPR gRNA sequence
atatacaaaaatagaaagaa

SEQ ID NO: 372030 - DNA, 20 bp, Artificial
  CRISPR gRNA sequence
aatagaaagaatagcataat

SEQ ID NO: 372031 - DNA, 20 bp, Artificial
  CRISPR gRNA sequence
ataatcagttcccctgtgac

SEQ ID NO: 372032 - DNA, 20 bp, Artificial
  CRISPR gRNA sequence
gttcccctgtgaccagtata

SEQ ID NO: 372033 - DNA, 20 bp, Artificial
  CRISPR gRNA sequence
atatagcttcgccgactatc

SEQ ID NO: 372034 - DNA, 20 bp, Artificial
  CRISPR gRNA sequence
gcttcgccgactatcaagtt

SEQ ID NO: 372035 - DNA, 20 bp, Artificial
  CRISPR gRNA sequence
cttcgccgactatcaagttt

SEQ ID NO: 372036 - DNA, 20 bp, Artificial
  CRISPR gRNA sequence
gccgactatcaagtttgggt

SEQ ID NO: 372037 - DNA, 20 bp, Artificial
  CRISPR gRNA sequence
tctttcccttgattaatttg

SEQ ID NO: 372038 - DNA, 20 bp, Artificial
  CRISPR gRNA sequence
gattaatttgaagcaaattc

SEQ ID NO: 372039 - DNA, 20 bp, Artificial
  CRISPR gRNA sequence
tgaagcaaattccagccatt

SEQ ID NO: 372040 - DNA, 20 bp, Artificial
  CRISPR gRNA sequence
catctcatcaataaatattt

SEQ ID NO: 372041 - DNA, 20 bp, Artificial
  CRISPR gRNA sequence
tattttagcctgaatctcaa

SEQ ID NO: 372042 - DNA, 20 bp, Artificial
  CRISPR gRNA sequence
tagcctgaatctcaaaagat

SEQ ID NO: 372043 - DNA, 20 bp, Artificial
  CRISPR gRNA sequence
taccttcacccctcacaaaa

SEQ ID NO: 372044 - DNA, 20 bp, Artificial
  CRISPR gRNA sequence
aataatttcttaaaattatt

SEQ ID NO: 372045 - DNA, 20 bp, Artificial
  CRISPR gRNA sequence
gtgtctactttgcatttctc

SEQ ID NO: 372046 - DNA, 20 bp, Artificial
  CRISPR gRNA sequence
tctatgaatttttccttttt

SEQ ID NO: 372047 - DNA, 20 bp, Artificial
  CRISPR gRNA sequence
taatacctccctttaacctg

SEQ ID NO: 372048 - DNA, 20 bp, Artificial
  CRISPR gRNA sequence
aatacctccctttaacctgt

SEQ ID NO: 372049 - DNA, 20 bp, Artificial
  CRISPR gRNA sequence
tttgttgttgttgtcacctt

SEQ ID NO: 372050 - DNA, 20 bp, Artificial
  CRISPR gRNA sequence
ttgagtttttcatattcccg

SEQ ID NO: 372051 - DNA, 20 bp, Artificial
  CRISPR gRNA sequence
tgagtttttcatattcccgt

SEQ ID NO: 372052 - DNA, 20 bp, Artificial
  CRISPR gRNA sequence
tcccgtgggctgctttccca

SEQ ID NO: 372053 - DNA, 20 bp, Artificial
  CRISPR gRNA sequence
cgtgggctgctttcccatgg

SEQ ID NO: 372054 - DNA, 20 bp, Artificial
  CRISPR gRNA sequence
atacgtttctctgctctttg

SEQ ID NO: 372055 - DNA, 20 bp, Artificial
  CRISPR gRNA sequence
tctgctctttgcagttctgt

SEQ ID NO: 372056 - DNA, 20 bp, Artificial
  CRISPR gRNA sequence
ctctttgcagttctgtaagt

SEQ ID NO: 372057 - DNA, 20 bp, Artificial
  CRISPR gRNA sequence
tttgcagttctgtaagttgg

SEQ ID NO: 372058 - DNA, 20 bp, Artificial
  CRISPR gRNA sequence
cagttctgtaagttggtggt

SEQ ID NO: 372059 - DNA, 20 bp, Artificial
  CRISPR gRNA sequence
tgtaagttggtggttagatt

SEQ ID NO: 372060 - DNA, 20 bp, Artificial
  CRISPR gRNA sequence
taagttggtggttagatttg

SEQ ID NO: 372061 - DNA, 20 bp, Artificial
  CRISPR gRNA sequence
aagttggtggttagatttgg

SEQ ID NO: 372062 - DNA, 20 bp, Artificial
  CRISPR gRNA sequence
gttagatttggaggcttgat

SEQ ID NO: 372063 - DNA, 20 bp, Artificial
  CRISPR gRNA sequence
tttggaggcttgattagcat

SEQ ID NO: 372064 - DNA, 20 bp, Artificial
  CRISPR gRNA sequence
ttggaggcttgattagcatc

SEQ ID NO: 372065 - DNA, 20 bp, Artificial
  CRISPR gRNA sequence
tcaggtttgattattttgac

SEQ ID NO: 372066 - DNA, 20 bp, Artificial
  CRISPR gRNA sequence
caggtttgattattttgaca

SEQ ID NO: 372067 - DNA, 20 bp, Artificial
  CRISPR gRNA sequence
ttgacaaggctatgacttcc

SEQ ID NO: 372068 - DNA, 20 bp, Artificial
  CRISPR gRNA sequence
tgacaaggctatgacttcca

SEQ ID NO: 372069 - DNA, 20 bp, Artificial
  CRISPR gRNA sequence
caaggctatgacttccaagg

SEQ ID NO: 372070 - DNA, 20 bp, Artificial
  CRISPR gRNA sequence
tgacttccaaggtggtactg

SEQ ID NO: 372071 - DNA, 20 bp, Artificial
  CRISPR gRNA sequence
tggtactgtggaaacataaa

SEQ ID NO: 372072 - DNA, 20 bp, Artificial
  CRISPR gRNA sequence
aaatggcatttgtgaatttg

SEQ ID NO: 372073 - DNA, 20 bp, Artificial
  CRISPR gRNA sequence
tttgtgaatttgcagacact

SEQ ID NO: 372074 - DNA, 20 bp, Artificial
  CRISPR gRNA sequence
ttgtgaatttgcagacactg

SEQ ID NO: 372075 - DNA, 20 bp, Artificial
  CRISPR gRNA sequence
agacactgaggattgttgcc

SEQ ID NO: 372076 - DNA, 20 bp, Artificial
  CRISPR gRNA sequence
cctagaactctcaattcgtt

SEQ ID NO: 372077 - DNA, 20 bp, Artificial
  CRISPR gRNA sequence
ctagaactctcaattcgttt

SEQ ID NO: 372078 - DNA, 20 bp, Artificial
  CRISPR gRNA sequence
ttaaatatatttcttaatat

SEQ ID NO: 372079 - DNA, 20 bp, Artificial
  CRISPR gRNA sequence
taaatatatttcttaatatt

SEQ ID NO: 372080 - DNA, 20 bp, Artificial
  CRISPR gRNA sequence
aaatatatttcttaatatta

SEQ ID NO: 372081 - DNA, 20 bp, Artificial
  CRISPR gRNA sequence
tcttaatattagggttatta

SEQ ID NO: 372082 - DNA, 20 bp, Artificial
  CRISPR gRNA sequence
aataaaaatacatgcacatt

SEQ ID NO: 372083 - DNA, 20 bp, Artificial
  CRISPR gRNA sequence
aattgcaaattaattttttc

SEQ ID NO: 372084 - DNA, 20 bp, Artificial
  CRISPR gRNA sequence
ttaattttttcaagtgttta

SEQ ID NO: 372085 - DNA, 20 bp, Artificial
  CRISPR gRNA sequence
ttttttcaagtgtttaaagt

SEQ ID NO: 372086 - DNA, 20 bp, Artificial
  CRISPR gRNA sequence
agtgtttaaagtcagaaata

SEQ ID NO: 372087 - DNA, 20 bp, Artificial
  CRISPR gRNA sequence
gaaatacagttttattttat

SEQ ID NO: 372088 - DNA, 20 bp, Artificial
  CRISPR gRNA sequence
aatttttttttttttttttt

SEQ ID NO: 372089 - DNA, 20 bp, Artificial
  CRISPR gRNA sequence
ttttttttttttttttgaga

SEQ ID NO: 372090 - DNA, 20 bp, Artificial
  CRISPR gRNA sequence
ttttttttttttttgagacg

SEQ ID NO: 372091 - DNA, 20 bp, Artificial
  CRISPR gRNA sequence
cggagtctcgctctgtcgcc

SEQ ID NO: 372092 - DNA, 20 bp, Artificial
  CRISPR gRNA sequence
ggagtctcgctctgtcgccc

SEQ ID NO: 372093 - DNA, 20 bp, Artificial
  CRISPR gRNA sequence
tctcgctctgtcgcccaggc

SEQ ID NO: 372094 - DNA, 20 bp, Artificial
  CRISPR gRNA sequence
ctgtcgcccaggccggactg

SEQ ID NO: 372095 - DNA, 20 bp, Artificial
  CRISPR gRNA sequence
ccaggccggactgcggactg

SEQ ID NO: 372096 - DNA, 20 bp, Artificial
  CRISPR gRNA sequence
ggccggactgcggactgcag

SEQ ID NO: 372097 - DNA, 20 bp, Artificial
  CRISPR gRNA sequence
ggactgcagtggcgcaatct

SEQ ID NO: 372098 - DNA, 20 bp, Artificial
  CRISPR gRNA sequence
gcgcaatctcggctcactgc

SEQ ID NO: 372099 - DNA, 20 bp, Artificial
  CRISPR gRNA sequence
tcactgcaagctccgcctcc

SEQ ID NO: 372100 - DNA, 20 bp, Artificial
  CRISPR gRNA sequence
cactgcaagctccgcctccc

SEQ ID NO: 372101 - DNA, 20 bp, Artificial
  CRISPR gRNA sequence
ttcacgccattctcctgcct

SEQ ID NO: 372102 - DNA, 20 bp, Artificial
  CRISPR gRNA sequence
ttctcctgcctcagcctccc

SEQ ID NO: 372103 - DNA, 20 bp, Artificial
  CRISPR gRNA sequence
tcctgcctcagcctcccgag

SEQ ID NO: 372104 - DNA, 20 bp, Artificial
  CRISPR gRNA sequence
gcctcagcctcccgagtagc

SEQ ID NO: 372105 - DNA, 20 bp, Artificial
  CRISPR gRNA sequence
cctcagcctcccgagtagct

SEQ ID NO: 372106 - DNA, 20 bp, Artificial
  CRISPR gRNA sequence
ctcccgagtagctgggacta

SEQ ID NO: 372107 - DNA, 20 bp, Artificial
  CRISPR gRNA sequence
tcccgagtagctgggactac

SEQ ID NO: 372108 - DNA, 20 bp, Artificial
  CRISPR gRNA sequence
caggcgcccgccaccgcgcc

SEQ ID NO: 372109 - DNA, 20 bp, Artificial
  CRISPR gRNA sequence
cggctaattttttgtatttt

SEQ ID NO: 372110 - DNA, 20 bp, Artificial
  CRISPR gRNA sequence
ctaattttttgtatttttag

SEQ ID NO: 372111 - DNA, 20 bp, Artificial
  CRISPR gRNA sequence
aattttttgtatttttagta

SEQ ID NO: 372112 - DNA, 20 bp, Artificial
  CRISPR gRNA sequence
ttttgtatttttagtagaga

SEQ ID NO: 372113 - DNA, 20 bp, Artificial
  CRISPR gRNA sequence
tttgtatttttagtagagac

SEQ ID NO: 372114 - DNA, 20 bp, Artificial
  CRISPR gRNA sequence
ttgtatttttagtagagacg

SEQ ID NO: 372115 - DNA, 20 bp, Artificial
  CRISPR gRNA sequence
gagacggggtttcaccttgt

SEQ ID NO: 372116 - DNA, 20 bp, Artificial
  CRISPR gRNA sequence
cggggtttcaccttgttagc

SEQ ID NO: 372117 - DNA, 20 bp, Artificial
  CRISPR gRNA sequence
ggggtttcaccttgttagcc

SEQ ID NO: 372118 - DNA, 20 bp, Artificial
  CRISPR gRNA sequence
tttcaccttgttagccagga

SEQ ID NO: 372119 - DNA, 20 bp, Artificial
  CRISPR gRNA sequence
acctcgtgatccgcccgcct

SEQ ID NO: 372120 - DNA, 20 bp, Artificial
  CRISPR gRNA sequence
ccgcccgcctcggcctcgca

SEQ ID NO: 372121 - DNA, 20 bp, Artificial
  CRISPR gRNA sequence
gcctcggcctcgcaaagtgc

SEQ ID NO: 372122 - DNA, 20 bp, Artificial
  CRISPR gRNA sequence
cctcggcctcgcaaagtgct

SEQ ID NO: 372123 - DNA, 20 bp, Artificial
  CRISPR gRNA sequence
ctcgcaaagtgctgggatta

SEQ ID NO: 372124 - DNA, 20 bp, Artificial
  CRISPR gRNA sequence
tcgcaaagtgctgggattac

SEQ ID NO: 372125 - DNA, 20 bp, Artificial
  CRISPR gRNA sequence
agtgctgggattacaggcgt

SEQ ID NO: 372126 - DNA, 20 bp, Artificial
  CRISPR gRNA sequence
caggcgtgagccaccgcgcc

SEQ ID NO: 372127 - DNA, 20 bp, Artificial
  CRISPR gRNA sequence
cgtgagccaccgcgcccggc

SEQ ID NO: 372128 - DNA, 20 bp, Artificial
  CRISPR gRNA sequence
aaaatttttaaaaaaacttt

SEQ ID NO: 372129 - DNA, 20 bp, Artificial
  CRISPR gRNA sequence
aaatttttaaaaaaactttt

SEQ ID NO: 372130 - DNA, 20 bp, Artificial
  CRISPR gRNA sequence
taaaaaaacttttaggtttg

SEQ ID NO: 372131 - DNA, 20 bp, Artificial
  CRISPR gRNA sequence
aaaaaaacttttaggtttgt

SEQ ID NO: 372132 - DNA, 20 bp, Artificial
  CRISPR gRNA sequence
taggtttgtgggtacatgtg

SEQ ID NO: 372133 - DNA, 20 bp, Artificial
  CRISPR gRNA sequence
aggtttgtgggtacatgtga

SEQ ID NO: 372134 - DNA, 20 bp, Artificial
  CRISPR gRNA sequence
acatgtgaaggtttgttgca

SEQ ID NO: 372135 - DNA, 20 bp, Artificial
  CRISPR gRNA sequence
catgtgaaggtttgttgcat

SEQ ID NO: 372136 - DNA, 20 bp, Artificial
  CRISPR gRNA sequence
gcataggtaaatatgtgtca

SEQ ID NO: 372137 - DNA, 20 bp, Artificial
  CRISPR gRNA sequence
cataggtaaatatgtgtcac

SEQ ID NO: 372138 - DNA, 20 bp, Artificial
  CRISPR gRNA sequence
ataggtaaatatgtgtcaca

SEQ ID NO: 372139 - DNA, 20 bp, Artificial
  CRISPR gRNA sequence
taggtaaatatgtgtcacag

SEQ ID NO: 372140 - DNA, 20 bp, Artificial
  CRISPR gRNA sequence
tgtacatattatttcatcac

SEQ ID NO: 372141 - DNA, 20 bp, Artificial
  CRISPR gRNA sequence
ttatttcatcaccagttatt

SEQ ID NO: 372142 - DNA, 20 bp, Artificial
  CRISPR gRNA sequence
tcatcaccagttattaagct

SEQ ID NO: 372143 - DNA, 20 bp, Artificial
  CRISPR gRNA sequence
agttattaagctcagtaact

SEQ ID NO: 372144 - DNA, 20 bp, Artificial
  CRISPR gRNA sequence
ttattaagctcagtaactaa

SEQ ID NO: 372145 - DNA, 20 bp, Artificial
  CRISPR gRNA sequence
tcccaccctccgctctcaac

SEQ ID NO: 372146 - DNA, 20 bp, Artificial
  CRISPR gRNA sequence
cctccgctctcaactagacc

SEQ ID NO: 372147 - DNA, 20 bp, Artificial
  CRISPR gRNA sequence
gttcctaacttcttatcctt

SEQ ID NO: 372148 - DNA, 20 bp, Artificial
  CRISPR gRNA sequence
atcctttagctcccatttga

SEQ ID NO: 372149 - DNA, 20 bp, Artificial
  CRISPR gRNA sequence
tttagctcccatttgaaagt

SEQ ID NO: 372150 - DNA, 20 bp, Artificial
  CRISPR gRNA sequence
catttgaaagtgagaacatg

SEQ ID NO: 372151 - DNA, 20 bp, Artificial
  CRISPR gRNA sequence
aagtgagaacatgtggtatt

SEQ ID NO: 372152 - DNA, 20 bp, Artificial
  CRISPR gRNA sequence
ttggttttcaattcctgcat

SEQ ID NO: 372153 - DNA, 20 bp, Artificial
  CRISPR gRNA sequence
aattcctgcattagtttact

SEQ ID NO: 372154 - DNA, 20 bp, Artificial
  CRISPR gRNA sequence
attcctgcattagtttactg

SEQ ID NO: 372155 - DNA, 20 bp, Artificial
  CRISPR gRNA sequence
cattagtttactgaggataa

SEQ ID NO: 372156 - DNA, 20 bp, Artificial
  CRISPR gRNA sequence
ttactgaggataatagcctc

SEQ ID NO: 372157 - DNA, 20 bp, Artificial
  CRISPR gRNA sequence
tatgatctcattctttttta

SEQ ID NO: 372158 - DNA, 20 bp, Artificial
  CRISPR gRNA sequence
cattcttttttatggctgca

SEQ ID NO: 372159 - DNA, 20 bp, Artificial
  CRISPR gRNA sequence
tttatcccatctgtcactga

SEQ ID NO: 372160 - DNA, 20 bp, Artificial
  CRISPR gRNA sequence
atctgtcactgatggacgtt

SEQ ID NO: 372161 - DNA, 20 bp, Artificial
  CRISPR gRNA sequence
tctgtcactgatggacgttt

SEQ ID NO: 372162 - DNA, 20 bp, Artificial
  CRISPR gRNA sequence
catgtctttgctattgtgat

SEQ ID NO: 372163 - DNA, 20 bp, Artificial
  CRISPR gRNA sequence
tgctattgtgattagtgctg

SEQ ID NO: 372164 - DNA, 20 bp, Artificial
  CRISPR gRNA sequence
catgtacatatgtgtcttta

SEQ ID NO: 372165 - DNA, 20 bp, Artificial
  CRISPR gRNA sequence
gtacatatgtgtctttatag

SEQ ID NO: 372166 - DNA, 20 bp, Artificial
  CRISPR gRNA sequence
tacatatgtgtctttatagt

SEQ ID NO: 372167 - DNA, 20 bp, Artificial
  CRISPR gRNA sequence
tgggatgatttatattcctc

SEQ ID NO: 372168 - DNA, 20 bp, Artificial
  CRISPR gRNA sequence
gggatgatttatattcctct

SEQ ID NO: 372169 - DNA, 20 bp, Artificial
  CRISPR gRNA sequence
tattcctctgggtatatgcc

SEQ ID NO: 372170 - DNA, 20 bp, Artificial
  CRISPR gRNA sequence
attcctctgggtatatgccc

SEQ ID NO: 372171 - DNA, 20 bp, Artificial
  CRISPR gRNA sequence
tctgggtatatgcccaggaa

SEQ ID NO: 372172 - DNA, 20 bp, Artificial
  CRISPR gRNA sequence
ctgggtatatgcccaggaat

SEQ ID NO: 372173 - DNA, 20 bp, Artificial
  CRISPR gRNA sequence
atgcccaggaatgggattgc

SEQ ID NO: 372174 - DNA, 20 bp, Artificial
  CRISPR gRNA sequence
tgcccaggaatgggattgct

SEQ ID NO: 372175 - DNA, 20 bp, Artificial
  CRISPR gRNA sequence
aatgggattgctgggtcaaa

SEQ ID NO: 372176 - DNA, 20 bp, Artificial
  CRISPR gRNA sequence
gggattgctgggtcaaatgg

SEQ ID NO: 372177 - DNA, 20 bp, Artificial
  CRISPR gRNA sequence
agttctgcttttatctcttt

SEQ ID NO: 372178 - DNA, 20 bp, Artificial
  CRISPR gRNA sequence
gttctgcttttatctctttg

SEQ ID NO: 372179 - DNA, 20 bp, Artificial
  CRISPR gRNA sequence
tgccatactgctttccacaa

SEQ ID NO: 372180 - DNA, 20 bp, Artificial
  CRISPR gRNA sequence
ttaatttacactcccaccaa

SEQ ID NO: 372181 - DNA, 20 bp, Artificial
  CRISPR gRNA sequence
cactcccaccaacagtgtat

SEQ ID NO: 372182 - DNA, 20 bp, Artificial
  CRISPR gRNA sequence
ccttttctctgcaacctcac

SEQ ID NO: 372183 - DNA, 20 bp, Artificial
  CRISPR gRNA sequence
tctgtaatgttttgcctttt

SEQ ID NO: 372184 - DNA, 20 bp, Artificial
  CRISPR gRNA sequence
atgttttgcctttttagtaa

SEQ ID NO: 372185 - DNA, 20 bp, Artificial
  CRISPR gRNA sequence
ttagtaatagccattctgac

SEQ ID NO: 372186 - DNA, 20 bp, Artificial
  CRISPR gRNA sequence
atagccattctgactggtat

SEQ ID NO: 372187 - DNA, 20 bp, Artificial
  CRISPR gRNA sequence
ccattctgactggtatgaga

SEQ ID NO: 372188 - DNA, 20 bp, Artificial
  CRISPR gRNA sequence
atggtgtctcattgtcattt

SEQ ID NO: 372189 - DNA, 20 bp, Artificial
  CRISPR gRNA sequence
gtttgcctttctgtaatgat

SEQ ID NO: 372190 - DNA, 20 bp, Artificial
  CRISPR gRNA sequence
ctgtaatgatgagtgatatt

SEQ ID NO: 372191 - DNA, 20 bp, Artificial
  CRISPR gRNA sequence
gctttttgtcatatgcttgt

SEQ ID NO: 372192 - DNA, 20 bp, Artificial
  CRISPR gRNA sequence
ccacgtatatgtcttctttt

SEQ ID NO: 372193 - DNA, 20 bp, Artificial
  CRISPR gRNA sequence
cgtatatgtcttcttttgag

SEQ ID NO: 372194 - DNA, 20 bp, Artificial
  CRISPR gRNA sequence
gtcctttacccactttttaa

SEQ ID NO: 372195 - DNA, 20 bp, Artificial
  CRISPR gRNA sequence
tcctttacccactttttaat

SEQ ID NO: 372196 - DNA, 20 bp, Artificial
  CRISPR gRNA sequence
cctttacccactttttaatg

SEQ ID NO: 372197 - DNA, 20 bp, Artificial
  CRISPR gRNA sequence
aaatttgcttaacttcctta

SEQ ID NO: 372198 - DNA, 20 bp, Artificial
  CRISPR gRNA sequence
cttaacttccttatagatgc

SEQ ID NO: 372199 - DNA, 20 bp, Artificial
  CRISPR gRNA sequence
tccttatagatgctggatat

SEQ ID NO: 372200 - DNA, 20 bp, Artificial
  CRISPR gRNA sequence
gctggatattagacctttgt

SEQ ID NO: 372201 - DNA, 20 bp, Artificial
  CRISPR gRNA sequence
ttagacctttgtcagatgca

SEQ ID NO: 372202 - DNA, 20 bp, Artificial
  CRISPR gRNA sequence
aaatatttcctcccattctt

SEQ ID NO: 372203 - DNA, 20 bp, Artificial
  CRISPR gRNA sequence
aatatttcctcccattcttt

SEQ ID NO: 372204 - DNA, 20 bp, Artificial
  CRISPR gRNA sequence
tttcctcccattctttaggt

SEQ ID NO: 372205 - DNA, 20 bp, Artificial
  CRISPR gRNA sequence
tgacttctctactttatgcc

SEQ ID NO: 372206 - DNA, 20 bp, Artificial
  CRISPR gRNA sequence
tctctactttatgccaagca

SEQ ID NO: 372207 - DNA, 20 bp, Artificial
  CRISPR gRNA sequence
ctttatgccaagcatggttc

SEQ ID NO: 372208 - DNA, 20 bp, Artificial
  CRISPR gRNA sequence
tttatgccaagcatggttct

SEQ ID NO: 372209 - DNA, 20 bp, Artificial
  CRISPR gRNA sequence
caagcatggttctaggtgct

SEQ ID NO: 372210 - DNA, 20 bp, Artificial
  CRISPR gRNA sequence
atggttctaggtgctaagta

SEQ ID NO: 372211 - DNA, 20 bp, Artificial
  CRISPR gRNA sequence
ggttctaggtgctaagtaca

SEQ ID NO: 372212 - DNA, 20 bp, Artificial
  CRISPR gRNA sequence
tctaggtgctaagtacagag

SEQ ID NO: 372213 - DNA, 20 bp, Artificial
  CRISPR gRNA sequence
aagtacagagcagtgtaaaa

SEQ ID NO: 372214 - DNA, 20 bp, Artificial
  CRISPR gRNA sequence
cagagcagtgtaaaatggtc

SEQ ID NO: 372215 - DNA, 20 bp, Artificial
  CRISPR gRNA sequence
tgtaaaatggtctagctata

SEQ ID NO: 372216 - DNA, 20 bp, Artificial
  CRISPR gRNA sequence
taaaatggtctagctataca

SEQ ID NO: 372217 - DNA, 20 bp, Artificial
  CRISPR gRNA sequence
aaaatggtctagctatacag

SEQ ID NO: 372218 - DNA, 20 bp, Artificial
  CRISPR gRNA sequence
ggtctagctatacagaggct

SEQ ID NO: 372219 - DNA, 20 bp, Artificial
  CRISPR gRNA sequence
gtctagctatacagaggctt

SEQ ID NO: 372220 - DNA, 20 bp, Artificial
  CRISPR gRNA sequence
tacagaggcttgggtttacg

SEQ ID NO: 372221 - DNA, 20 bp, Artificial
  CRISPR gRNA sequence
gcttgggtttacgaagctga

SEQ ID NO: 372222 - DNA, 20 bp, Artificial
  CRISPR gRNA sequence
aagctgacagtaaaatgact

SEQ ID NO: 372223 - DNA, 20 bp, Artificial
  CRISPR gRNA sequence
agctgacagtaaaatgactc

SEQ ID NO: 372224 - DNA, 20 bp, Artificial
  CRISPR gRNA sequence
gctgacagtaaaatgactca

SEQ ID NO: 372225 - DNA, 20 bp, Artificial
  CRISPR gRNA sequence
aaatgactcagggttttgtg

SEQ ID NO: 372226 - DNA, 20 bp, Artificial
  CRISPR gRNA sequence
tgactcagggttttgtgaag

SEQ ID NO: 372227 - DNA, 20 bp, Artificial
  CRISPR gRNA sequence
gactcagggttttgtgaagt

SEQ ID NO: 372228 - DNA, 20 bp, Artificial
  CRISPR gRNA sequence
agggttttgtgaagtgggtg

SEQ ID NO: 372229 - DNA, 20 bp, Artificial
  CRISPR gRNA sequence
gggttttgtgaagtgggtga

SEQ ID NO: 372230 - DNA, 20 bp, Artificial
  CRISPR gRNA sequence
gaagtgggtgaaggattttg

SEQ ID NO: 372231 - DNA, 20 bp, Artificial
  CRISPR gRNA sequence
agtgggtgaaggattttgca

SEQ ID NO: 372232 - DNA, 20 bp, Artificial
  CRISPR gRNA sequence
agctgctcaaactgcatatg

SEQ ID NO: 372233 - DNA, 20 bp, Artificial
  CRISPR gRNA sequence
gcatatgcagaactgttgac

SEQ ID NO: 372234 - DNA, 20 bp, Artificial
  CRISPR gRNA sequence
atgcagaactgttgaccagt

SEQ ID NO: 372235 - DNA, 20 bp, Artificial
  CRISPR gRNA sequence
tgcagaactgttgaccagtg

SEQ ID NO: 372236 - DNA, 20 bp, Artificial
  CRISPR gRNA sequence
gaactgttgaccagtgagga

SEQ ID NO: 372237 - DNA, 20 bp, Artificial
  CRISPR gRNA sequence
tgttgaccagtgaggatggt

SEQ ID NO: 372238 - DNA, 20 bp, Artificial
  CRISPR gRNA sequence
gttgaccagtgaggatggtg

SEQ ID NO: 372239 - DNA, 20 bp, Artificial
  CRISPR gRNA sequence
tgaccagtgaggatggtgag

SEQ ID NO: 372240 - DNA, 20 bp, Artificial
  CRISPR gRNA sequence
gaccagtgaggatggtgagg

SEQ ID NO: 372241 - DNA, 20 bp, Artificial
  CRISPR gRNA sequence
agtgaggatggtgaggagga

SEQ ID NO: 372242 - DNA, 20 bp, Artificial
  CRISPR gRNA sequence
gtgaggatggtgaggaggac

SEQ ID NO: 372243 - DNA, 20 bp, Artificial
  CRISPR gRNA sequence
ggatggtgaggaggacaggt

SEQ ID NO: 372244 - DNA, 20 bp, Artificial
  CRISPR gRNA sequence
tggtgaggaggacaggtcag

SEQ ID NO: 372245 - DNA, 20 bp, Artificial
  CRISPR gRNA sequence
gaggaggacaggtcagtagc

SEQ ID NO: 372246 - DNA, 20 bp, Artificial
  CRISPR gRNA sequence
aggaggacaggtcagtagcc

SEQ ID NO: 372247 - DNA, 20 bp, Artificial
  CRISPR gRNA sequence
ggaggacaggtcagtagcca

SEQ ID NO: 372248 - DNA, 20 bp, Artificial
  CRISPR gRNA sequence
aggacaggtcagtagccagg

SEQ ID NO: 372249 - DNA, 20 bp, Artificial
  CRISPR gRNA sequence
ggacaggtcagtagccaggg

SEQ ID NO: 372250 - DNA, 20 bp, Artificial
  CRISPR gRNA sequence
gtcagtagccagggaggcgc

SEQ ID NO: 372251 - DNA, 20 bp, Artificial
  CRISPR gRNA sequence
agtagccagggaggcgctag

SEQ ID NO: 372252 - DNA, 20 bp, Artificial
  CRISPR gRNA sequence
gtagccagggaggcgctagt

SEQ ID NO: 372253 - DNA, 20 bp, Artificial
  CRISPR gRNA sequence
gccagggaggcgctagtggg

SEQ ID NO: 372254 - DNA, 20 bp, Artificial
  CRISPR gRNA sequence
ccagggaggcgctagtgggc

SEQ ID NO: 372255 - DNA, 20 bp, Artificial
  CRISPR gRNA sequence
cagggaggcgctagtgggca

SEQ ID NO: 372256 - DNA, 20 bp, Artificial
  CRISPR gRNA sequence
agggaggcgctagtgggcag

SEQ ID NO: 372257 - DNA, 20 bp, Artificial
  CRISPR gRNA sequence
gaggcgctagtgggcagggg

SEQ ID NO: 372258 - DNA, 20 bp, Artificial
  CRISPR gRNA sequence
gcgctagtgggcaggggcag

SEQ ID NO: 372259 - DNA, 20 bp, Artificial
  CRISPR gRNA sequence
aggggcagtggcatgatgtg

SEQ ID NO: 372260 - DNA, 20 bp, Artificial
  CRISPR gRNA sequence
gcatgatgtgaagatgtacc

SEQ ID NO: 372261 - DNA, 20 bp, Artificial
  CRISPR gRNA sequence
aagatgtacccagcaatgtt

SEQ ID NO: 372262 - DNA, 20 bp, Artificial
  CRISPR gRNA sequence
agatgtacccagcaatgttt

SEQ ID NO: 372263 - DNA, 20 bp, Artificial
  CRISPR gRNA sequence
gatgtacccagcaatgtttg

SEQ ID NO: 372264 - DNA, 20 bp, Artificial
  CRISPR gRNA sequence
ccagcaatgtttggggtacc

SEQ ID NO: 372265 - DNA, 20 bp, Artificial
  CRISPR gRNA sequence
cagcaatgtttggggtaccc

SEQ ID NO: 372266 - DNA, 20 bp, Artificial
  CRISPR gRNA sequence
gtttggggtacccaggacat

SEQ ID NO: 372267 - DNA, 20 bp, Artificial
  CRISPR gRNA sequence
tggggtacccaggacatgag

SEQ ID NO: 372268 - DNA, 20 bp, Artificial
  CRISPR gRNA sequence
ggtacccaggacatgagcag

SEQ ID NO: 372269 - DNA, 20 bp, Artificial
  CRISPR gRNA sequence
cccaggacatgagcagtggt

SEQ ID NO: 372270 - DNA, 20 bp, Artificial
  CRISPR gRNA sequence
gacatgagcagtggttggaa

SEQ ID NO: 372271 - DNA, 20 bp, Artificial
  CRISPR gRNA sequence
cagtggttggaaaagtgatg

SEQ ID NO: 372272 - DNA, 20 bp, Artificial
  CRISPR gRNA sequence
gaagcactgaaataatttcc

SEQ ID NO: 372273 - DNA, 20 bp, Artificial
  CRISPR gRNA sequence
aagcactgaaataatttcca

SEQ ID NO: 372274 - DNA, 20 bp, Artificial
  CRISPR gRNA sequence
taatttccaaggatgatttg

SEQ ID NO: 372275 - DNA, 20 bp, Artificial
  CRISPR gRNA sequence
tccaaggatgatttgtggtc

SEQ ID NO: 372276 - DNA, 20 bp, Artificial
  CRISPR gRNA sequence
aggatgatttgtggtcaagc

SEQ ID NO: 372277 - DNA, 20 bp, Artificial
  CRISPR gRNA sequence
gatgatttgtggtcaagcca

SEQ ID NO: 372278 - DNA, 20 bp, Artificial
  CRISPR gRNA sequence
gatttgtggtcaagccagag

SEQ ID NO: 372279 - DNA, 20 bp, Artificial
  CRISPR gRNA sequence
cagagaagccacatacaaaa

SEQ ID NO: 372280 - DNA, 20 bp, Artificial
  CRISPR gRNA sequence
gagaagccacatacaaaata

SEQ ID NO: 372281 - DNA, 20 bp, Artificial
  CRISPR gRNA sequence
atatcctgcaataaaaatca

SEQ ID NO: 372282 - DNA, 20 bp, Artificial
  CRISPR gRNA sequence
tatcctgcaataaaaatcat

SEQ ID NO: 372283 - DNA, 20 bp, Artificial
  CRISPR gRNA sequence
aaaatcatgggaaaacaaca

SEQ ID NO: 372284 - DNA, 20 bp, Artificial
  CRISPR gRNA sequence
gtctattcaatgtttattct

SEQ ID NO: 372285 - DNA, 20 bp, Artificial
  CRISPR gRNA sequence
ttattctaagtattaatacg

SEQ ID NO: 372286 - DNA, 20 bp, Artificial
  CRISPR gRNA sequence
attaatacgtagctacatat

SEQ ID NO: 372287 - DNA, 20 bp, Artificial
  CRISPR gRNA sequence
acgtagctacatataagtat

SEQ ID NO: 372288 - DNA, 20 bp, Artificial
  CRISPR gRNA sequence
agctacatataagtataagc

SEQ ID NO: 372289 - DNA, 20 bp, Artificial
  CRISPR gRNA sequence
cccaattaactacgacattt

SEQ ID NO: 372290 - DNA, 20 bp, Artificial
  CRISPR gRNA sequence
tgaatccactttccaattcc

SEQ ID NO: 372291 - DNA, 20 bp, Artificial
  CRISPR gRNA sequence
ctttccaattccaagttcat

SEQ ID NO: 372292 - DNA, 20 bp, Artificial
  CRISPR gRNA sequence
tttccaattccaagttcatc

SEQ ID NO: 372293 - DNA, 20 bp, Artificial
  CRISPR gRNA sequence
ccaagttcatcaggatccca

SEQ ID NO: 372294 - DNA, 20 bp, Artificial
  CRISPR gRNA sequence
ccacggttctcttgtttgtg

SEQ ID NO: 372295 - DNA, 20 bp, Artificial
  CRISPR gRNA sequence
cacggttctcttgtttgtgt

SEQ ID NO: 372296 - DNA, 20 bp, Artificial
  CRISPR gRNA sequence
ttgtttgtgtgggctctttc

SEQ ID NO: 372297 - DNA, 20 bp, Artificial
  CRISPR gRNA sequence
tttgtgtgggctctttctgg

SEQ ID NO: 372298 - DNA, 20 bp, Artificial
  CRISPR gRNA sequence
tctttctggcagttcttttc

SEQ ID NO: 372299 - DNA, 20 bp, Artificial
  CRISPR gRNA sequence
ctttctggcagttcttttca

SEQ ID NO: 372300 - DNA, 20 bp, Artificial
  CRISPR gRNA sequence
gttcttttcaaggtcatttt

SEQ ID NO: 372301 - DNA, 20 bp, Artificial
  CRISPR gRNA sequence
attttgagctgccttccact

SEQ ID NO: 372302 - DNA, 20 bp, Artificial
  CRISPR gRNA sequence
ctgccttccactgagctttg

SEQ ID NO: 372303 - DNA, 20 bp, Artificial
  CRISPR gRNA sequence
tgccttccactgagctttgc

SEQ ID NO: 372304 - DNA, 20 bp, Artificial
  CRISPR gRNA sequence
cttccactgagctttgcagg

SEQ ID NO: 372305 - DNA, 20 bp, Artificial
  CRISPR gRNA sequence
tccactgagctttgcaggaa

SEQ ID NO: 372306 - DNA, 20 bp, Artificial
  CRISPR gRNA sequence
agctttgcaggaagagcctg

SEQ ID NO: 372307 - DNA, 20 bp, Artificial
  CRISPR gRNA sequence
gcaggaagagcctgtggtct

SEQ ID NO: 372308 - DNA, 20 bp, Artificial
  CRISPR gRNA sequence
ggaagagcctgtggtctgag

SEQ ID NO: 372309 - DNA, 20 bp, Artificial
  CRISPR gRNA sequence
cctgtggtctgagaagccac

SEQ ID NO: 372310 - DNA, 20 bp, Artificial
  CRISPR gRNA sequence
agaagccacaagcaatatct

SEQ ID NO: 372311 - DNA, 20 bp, Artificial
  CRISPR gRNA sequence
gaagccacaagcaatatctg

SEQ ID NO: 372312 - DNA, 20 bp, Artificial
  CRISPR gRNA sequence
ccacaagcaatatctgaggc

SEQ ID NO: 372313 - DNA, 20 bp, Artificial
  CRISPR gRNA sequence
cacaagcaatatctgaggca

SEQ ID NO: 372314 - DNA, 20 bp, Artificial
  CRISPR gRNA sequence
aagcaatatctgaggcaagg

SEQ ID NO: 372315 - DNA, 20 bp, Artificial
  CRISPR gRNA sequence
agcaatatctgaggcaaggc

SEQ ID NO: 372316 - DNA, 20 bp, Artificial
  CRISPR gRNA sequence
tatctgaggcaaggcaggtt

SEQ ID NO: 372317 - DNA, 20 bp, Artificial
  CRISPR gRNA sequence
aggtttggccgacctcgtaa

SEQ ID NO: 372318 - DNA, 20 bp, Artificial
  CRISPR gRNA sequence
ggtttggccgacctcgtaat

SEQ ID NO: 372319 - DNA, 20 bp, Artificial
  CRISPR gRNA sequence
gattttcatctaacaccaat

SEQ ID NO: 372320 - DNA, 20 bp, Artificial
  CRISPR gRNA sequence
caatcagttactctgtttgt

SEQ ID NO: 372321 - DNA, 20 bp, Artificial
  CRISPR gRNA sequence
aatcagttactctgtttgtc

SEQ ID NO: 372322 - DNA, 20 bp, Artificial
  CRISPR gRNA sequence
agttactctgtttgtcagga

SEQ ID NO: 372323 - DNA, 20 bp, Artificial
  CRISPR gRNA sequence
gttactctgtttgtcaggaa

SEQ ID NO: 372324 - DNA, 20 bp, Artificial
  CRISPR gRNA sequence
gtttgtcaggaaaggttaat

SEQ ID NO: 372325 - DNA, 20 bp, Artificial
  CRISPR gRNA sequence
tttgtcaggaaaggttaatc

SEQ ID NO: 372326 - DNA, 20 bp, Artificial
  CRISPR gRNA sequence
ttgtcaggaaaggttaatca

SEQ ID NO: 372327 - DNA, 20 bp, Artificial
  CRISPR gRNA sequence
tgtcaggaaaggttaatcag

SEQ ID NO: 372328 - DNA, 20 bp, Artificial
  CRISPR gRNA sequence
ggttaatcaggggctactct

SEQ ID NO: 372329 - DNA, 20 bp, Artificial
  CRISPR gRNA sequence
ctctgagcttctgaaccacc

SEQ ID NO: 372330 - DNA, 20 bp, Artificial
  CRISPR gRNA sequence
gcttctgaaccacctggctc

SEQ ID NO: 372331 - DNA, 20 bp, Artificial
  CRISPR gRNA sequence
cttctgaaccacctggctct

SEQ ID NO: 372332 - DNA, 20 bp, Artificial
  CRISPR gRNA sequence
ttctgaaccacctggctcta

SEQ ID NO: 372333 - DNA, 20 bp, Artificial
  CRISPR gRNA sequence
gaaccacctggctctagggt

SEQ ID NO: 372334 - DNA, 20 bp, Artificial
  CRISPR gRNA sequence
aaccacctggctctagggtt

SEQ ID NO: 372335 - DNA, 20 bp, Artificial
  CRISPR gRNA sequence
ggaaccacttctttcacctc

SEQ ID NO: 372336 - DNA, 20 bp, Artificial
  CRISPR gRNA sequence
gaaccacttctttcacctcc

SEQ ID NO: 372337 - DNA, 20 bp, Artificial
  CRISPR gRNA sequence
acttctttcacctccaggct

SEQ ID NO: 372338 - DNA, 20 bp, Artificial
  CRISPR gRNA sequence
acctccaggctgagtctatt

SEQ ID NO: 372339 - DNA, 20 bp, Artificial
  CRISPR gRNA sequence
ctccaggctgagtctattga

SEQ ID NO: 372340 - DNA, 20 bp, Artificial
  CRISPR gRNA sequence
tccaggctgagtctattgag

SEQ ID NO: 372341 - DNA, 20 bp, Artificial
  CRISPR gRNA sequence
aggctgagtctattgagagg

SEQ ID NO: 372342 - DNA, 20 bp, Artificial
  CRISPR gRNA sequence
ggctgagtctattgagaggc

SEQ ID NO: 372343 - DNA, 20 bp, Artificial
  CRISPR gRNA sequence
agtctattgagaggcgggtc

SEQ ID NO: 372344 - DNA, 20 bp, Artificial
  CRISPR gRNA sequence
gtctattgagaggcgggtct

SEQ ID NO: 372345 - DNA, 20 bp, Artificial
  CRISPR gRNA sequence
ggcgggtctaggtcctcaca

SEQ ID NO: 372346 - DNA, 20 bp, Artificial
  CRISPR gRNA sequence
cgggtctaggtcctcacatg

SEQ ID NO: 372347 - DNA, 20 bp, Artificial
  CRISPR gRNA sequence
tccctgcactttgctcccca

SEQ ID NO: 372348 - DNA, 20 bp, Artificial
  CRISPR gRNA sequence
tgcactttgctccccaaaga

SEQ ID NO: 372349 - DNA, 20 bp, Artificial
  CRISPR gRNA sequence
aaagacagctgcatcccctc

SEQ ID NO: 372350 - DNA, 20 bp, Artificial
  CRISPR gRNA sequence
aagacagctgcatcccctct

SEQ ID NO: 372351 - DNA, 20 bp, Artificial
  CRISPR gRNA sequence
cattgtcctttgtgaaaatg

SEQ ID NO: 372352 - DNA, 20 bp, Artificial
  CRISPR gRNA sequence
cctttgtgaaaatgcagaca

SEQ ID NO: 372353 - DNA, 20 bp, Artificial
  CRISPR gRNA sequence
gaaaatgcagacacggctat

SEQ ID NO: 372354 - DNA, 20 bp, Artificial
  CRISPR gRNA sequence
aatgcagacacggctatgag

SEQ ID NO: 372355 - DNA, 20 bp, Artificial
  CRISPR gRNA sequence
gtagacccctgtttctacct

SEQ ID NO: 372356 - DNA, 20 bp, Artificial
  CRISPR gRNA sequence
acccctgtttctacctgagt

SEQ ID NO: 372357 - DNA, 20 bp, Artificial
  CRISPR gRNA sequence
cctgtttctacctgagtcgg

SEQ ID NO: 372358 - DNA, 20 bp, Artificial
  CRISPR gRNA sequence
ctgtttctacctgagtcggc

SEQ ID NO: 372359 - DNA, 20 bp, Artificial
  CRISPR gRNA sequence
tacctgagtcggcaggttca

SEQ ID NO: 372360 - DNA, 20 bp, Artificial
  CRISPR gRNA sequence
acctgagtcggcaggttcac

SEQ ID NO: 372361 - DNA, 20 bp, Artificial
  CRISPR gRNA sequence
cctgagtcggcaggttcacg

SEQ ID NO: 372362 - DNA, 20 bp, Artificial
  CRISPR gRNA sequence
ctgagtcggcaggttcacgg

SEQ ID NO: 372363 - DNA, 20 bp, Artificial
  CRISPR gRNA sequence
gcaggttcacgggggcctga

SEQ ID NO: 372364 - DNA, 20 bp, Artificial
  CRISPR gRNA sequence
ttcacgggggcctgacagca

SEQ ID NO: 372365 - DNA, 20 bp, Artificial
  CRISPR gRNA sequence
ggggcctgacagcatggttt

SEQ ID NO: 372366 - DNA, 20 bp, Artificial
  CRISPR gRNA sequence
cctgacagcatggttttggt

SEQ ID NO: 372367 - DNA, 20 bp, Artificial
  CRISPR gRNA sequence
acagcatggttttggttaga

SEQ ID NO: 372368 - DNA, 20 bp, Artificial
  CRISPR gRNA sequence
cagcatggttttggttagat

SEQ ID NO: 372369 - DNA, 20 bp, Artificial
  CRISPR gRNA sequence
catggttttggttagatagg

SEQ ID NO: 372370 - DNA, 20 bp, Artificial
  CRISPR gRNA sequence
tttggttagataggcagaca

SEQ ID NO: 372371 - DNA, 20 bp, Artificial
  CRISPR gRNA sequence
ttggttagataggcagacaa

SEQ ID NO: 372372 - DNA, 20 bp, Artificial
  CRISPR gRNA sequence
ggcagacaaaggaaactcct

SEQ ID NO: 372373 - DNA, 20 bp, Artificial
  CRISPR gRNA sequence
acaaaggaaactcctgagat

SEQ ID NO: 372374 - DNA, 20 bp, Artificial
  CRISPR gRNA sequence
aggaaactcctgagattgga

SEQ ID NO: 372375 - DNA, 20 bp, Artificial
  CRISPR gRNA sequence
ggaaactcctgagattggac

SEQ ID NO: 372376 - DNA, 20 bp, Artificial
  CRISPR gRNA sequence
gaaactcctgagattggacg

SEQ ID NO: 372377 - DNA, 20 bp, Artificial
  CRISPR gRNA sequence
actcctgagattggacgggg

SEQ ID NO: 372378 - DNA, 20 bp, Artificial
  CRISPR gRNA sequence
agattggacggggcggcatc

SEQ ID NO: 372379 - DNA, 20 bp, Artificial
  CRISPR gRNA sequence
attggacggggcggcatcca

SEQ ID NO: 372380 - DNA, 20 bp, Artificial
  CRISPR gRNA sequence
tggacggggcggcatccaga

SEQ ID NO: 372381 - DNA, 20 bp, Artificial
  CRISPR gRNA sequence
acggggcggcatccagagag

SEQ ID NO: 372382 - DNA, 20 bp, Artificial
  CRISPR gRNA sequence
gggcggcatccagagagaag

SEQ ID NO: 372383 - DNA, 20 bp, Artificial
  CRISPR gRNA sequence
cggcatccagagagaagaag

SEQ ID NO: 372384 - DNA, 20 bp, Artificial
  CRISPR gRNA sequence
agaagaagaaaaacacaaaa

SEQ ID NO: 372385 - DNA, 20 bp, Artificial
  CRISPR gRNA sequence
cacaaaacagttgtgcgtgt

SEQ ID NO: 372386 - DNA, 20 bp, Artificial
  CRISPR gRNA sequence
cagttgtgcgtgtgagcact

SEQ ID NO: 372387 - DNA, 20 bp, Artificial
  CRISPR gRNA sequence
agttgtgcgtgtgagcactg

SEQ ID NO: 372388 - DNA, 20 bp, Artificial
  CRISPR gRNA sequence
tcacgctgcctcttacttcc

SEQ ID NO: 372389 - DNA, 20 bp, Artificial
  CRISPR gRNA sequence
cacgctgcctcttacttccc

SEQ ID NO: 372390 - DNA, 20 bp, Artificial
  CRISPR gRNA sequence
acgctgcctcttacttccca

SEQ ID NO: 372391 - DNA, 20 bp, Artificial
  CRISPR gRNA sequence
gcctcttacttcccagggac

SEQ ID NO: 372392 - DNA, 20 bp, Artificial
  CRISPR gRNA sequence
tcttacttcccagggaccag

SEQ ID NO: 372393 - DNA, 20 bp, Artificial
  CRISPR gRNA sequence
cttacttcccagggaccaga

SEQ ID NO: 372394 - DNA, 20 bp, Artificial
  CRISPR gRNA sequence
ttacttcccagggaccagaa

SEQ ID NO: 372395 - DNA, 20 bp, Artificial
  CRISPR gRNA sequence
gaccagaagggctcacatga

SEQ ID NO: 372396 - DNA, 20 bp, Artificial
  CRISPR gRNA sequence
tgttctttcatttctccaca

SEQ ID NO: 372397 - DNA, 20 bp, Artificial
  CRISPR gRNA sequence
catttctccacatggtgtgc

SEQ ID NO: 372398 - DNA, 20 bp, Artificial
  CRISPR gRNA sequence
attttccttttgtttctttt

SEQ ID NO: 372399 - DNA, 20 bp, Artificial
  CRISPR gRNA sequence
tcttgtgttgctttattact

SEQ ID NO: 372400 - DNA, 20 bp, Artificial
  CRISPR gRNA sequence
ttgtgttgctttattactta

SEQ ID NO: 372401 - DNA, 20 bp, Artificial
  CRISPR gRNA sequence
cttagagacgaaatgttttc

SEQ ID NO: 372402 - DNA, 20 bp, Artificial
  CRISPR gRNA sequence
ttagagacgaaatgttttcc

SEQ ID NO: 372403 - DNA, 20 bp, Artificial
  CRISPR gRNA sequence
ttttccgggtgtgtgttatg

SEQ ID NO: 372404 - DNA, 20 bp, Artificial
  CRISPR gRNA sequence
tttccgggtgtgtgttatgt

SEQ ID NO: 372405 - DNA, 20 bp, Artificial
  CRISPR gRNA sequence
gggtgtgtgttatgtgggta

SEQ ID NO: 372406 - DNA, 20 bp, Artificial
  CRISPR gRNA sequence
tgtgggtaaagtgctacctt

SEQ ID NO: 372407 - DNA, 20 bp, Artificial
  CRISPR gRNA sequence
aaagtgctacctttggtaaa

SEQ ID NO: 372408 - DNA, 20 bp, Artificial
  CRISPR gRNA sequence
acctttggtaaacggttgta

SEQ ID NO: 372409 - DNA, 20 bp, Artificial
  CRISPR gRNA sequence
ctttggtaaacggttgtaca

SEQ ID NO: 372410 - DNA, 20 bp, Artificial
  CRISPR gRNA sequence
tttggtaaacggttgtacag

SEQ ID NO: 372411 - DNA, 20 bp, Artificial
  CRISPR gRNA sequence
tggtaaacggttgtacagag

SEQ ID NO: 372412 - DNA, 20 bp, Artificial
  CRISPR gRNA sequence
aaacggttgtacagaggaga

SEQ ID NO: 372413 - DNA, 20 bp, Artificial
  CRISPR gRNA sequence
ggttgtacagaggagaaagc

SEQ ID NO: 372414 - DNA, 20 bp, Artificial
  CRISPR gRNA sequence
ttgtacagaggagaaagctg

SEQ ID NO: 372415 - DNA, 20 bp, Artificial
  CRISPR gRNA sequence
aggagaaagctggagtgctg

SEQ ID NO: 372416 - DNA, 20 bp, Artificial
  CRISPR gRNA sequence
ttttacaacattttgacaca

SEQ ID NO: 372417 - DNA, 20 bp, Artificial
  CRISPR gRNA sequence
acacatggaaccgcatgctg

SEQ ID NO: 372418 - DNA, 20 bp, Artificial
  CRISPR gRNA sequence
tggaaccgcatgctgaagat

SEQ ID NO: 372419 - DNA, 20 bp, Artificial
  CRISPR gRNA sequence
aaccgcatgctgaagatgag

SEQ ID NO: 372420 - DNA, 20 bp, Artificial
  CRISPR gRNA sequence
gcatgctgaagatgagaagc

SEQ ID NO: 372421 - DNA, 20 bp, Artificial
  CRISPR gRNA sequence
gaagatgagaagctagtttt

SEQ ID NO: 372422 - DNA, 20 bp, Artificial
  CRISPR gRNA sequence
tgagaagctagtttttggtg

SEQ ID NO: 372423 - DNA, 20 bp, Artificial
  CRISPR gRNA sequence
tggtgcggctgaaactatcg

SEQ ID NO: 372424 - DNA, 20 bp, Artificial
  CRISPR gRNA sequence
ctatcgtagccatgatattc

SEQ ID NO: 372425 - DNA, 20 bp, Artificial
  CRISPR gRNA sequence
gccatgatattctagttcaa

SEQ ID NO: 372426 - DNA, 20 bp, Artificial
  CRISPR gRNA sequence
tgatattctagttcaataga

SEQ ID NO: 372427 - DNA, 20 bp, Artificial
  CRISPR gRNA sequence
tggcaaatcttactgcactt

SEQ ID NO: 372428 - DNA, 20 bp, Artificial
  CRISPR gRNA sequence
ttttcttttgtttgtatgcc

SEQ ID NO: 372429 - DNA, 20 bp, Artificial
  CRISPR gRNA sequence
ttgtttgtatgccaagacaa

SEQ ID NO: 372430 - DNA, 20 bp, Artificial
  CRISPR gRNA sequence
tatgccaagacaatggctcc

SEQ ID NO: 372431 - DNA, 20 bp, Artificial
  CRISPR gRNA sequence
atgccaagacaatggctcct

SEQ ID NO: 372432 - DNA, 20 bp, Artificial
  CRISPR gRNA sequence
caagacaatggctcctgggc

SEQ ID NO: 372433 - DNA, 20 bp, Artificial
  CRISPR gRNA sequence
atggctcctgggccagtcct

SEQ ID NO: 372434 - DNA, 20 bp, Artificial
  CRISPR gRNA sequence
tcctgagtgaaactgtcaca

SEQ ID NO: 372435 - DNA, 20 bp, Artificial
  CRISPR gRNA sequence
gtgaaactgtcacatagttg

SEQ ID NO: 372436 - DNA, 20 bp, Artificial
  CRISPR gRNA sequence
ctgtcacatagttgaagtga

SEQ ID NO: 372437 - DNA, 20 bp, Artificial
  CRISPR gRNA sequence
cactttttgcatttctccct

SEQ ID NO: 372438 - DNA, 20 bp, Artificial
  CRISPR gRNA sequence
ttgcatttctcccttagtgc

SEQ ID NO: 372439 - DNA, 20 bp, Artificial
  CRISPR gRNA sequence
gcatttctcccttagtgcca

SEQ ID NO: 372440 - DNA, 20 bp, Artificial
  CRISPR gRNA sequence
atttctcccttagtgccaga

SEQ ID NO: 372441 - DNA, 20 bp, Artificial
  CRISPR gRNA sequence
tttgtgacatcattactgcc

SEQ ID NO: 372442 - DNA, 20 bp, Artificial
  CRISPR gRNA sequence
ttgtgacatcattactgccc

SEQ ID NO: 372443 - DNA, 20 bp, Artificial
  CRISPR gRNA sequence
caggcctcactctactgaaa

SEQ ID NO: 372444 - DNA, 20 bp, Artificial
  CRISPR gRNA sequence
gcctcactctactgaaatag

SEQ ID NO: 372445 - DNA, 20 bp, Artificial
  CRISPR gRNA sequence
cctcactctactgaaatagc

SEQ ID NO: 372446 - DNA, 20 bp, Artificial
  CRISPR gRNA sequence
actctactgaaatagcaggt

SEQ ID NO: 372447 - DNA, 20 bp, Artificial
  CRISPR gRNA sequence
ctctactgaaatagcaggtc

SEQ ID NO: 372448 - DNA, 20 bp, Artificial
  CRISPR gRNA sequence
aatagcaggtcaggatttgt

SEQ ID NO: 372449 - DNA, 20 bp, Artificial
  CRISPR gRNA sequence
aggtcaggatttgttggcat

SEQ ID NO: 372450 - DNA, 20 bp, Artificial
  CRISPR gRNA sequence
gttggcattagtgatgccat

SEQ ID NO: 372451 - DNA, 20 bp, Artificial
  CRISPR gRNA sequence
ggcattagtgatgccatcag

SEQ ID NO: 372452 - DNA, 20 bp, Artificial
  CRISPR gRNA sequence
ttagtgatgccatcagaaga

SEQ ID NO: 372453 - DNA, 20 bp, Artificial
  CRISPR gRNA sequence
gtgatgccatcagaagaaag

SEQ ID NO: 372454 - DNA, 20 bp, Artificial
  CRISPR gRNA sequence
tgatgccatcagaagaaaga

SEQ ID NO: 372455 - DNA, 20 bp, Artificial
  CRISPR gRNA sequence
aggtgttcatcactaataaa

SEQ ID NO: 372456 - DNA, 20 bp, Artificial
  CRISPR gRNA sequence
agatccacttgttaccttgc

SEQ ID NO: 372457 - DNA, 20 bp, Artificial
  CRISPR gRNA sequence
gatccacttgttaccttgct

SEQ ID NO: 372458 - DNA, 20 bp, Artificial
  CRISPR gRNA sequence
tgctgggttatcttaatttt

SEQ ID NO: 372459 - DNA, 20 bp, Artificial
  CRISPR gRNA sequence
gggttatcttaattttaaga

SEQ ID NO: 372460 - DNA, 20 bp, Artificial
  CRISPR gRNA sequence
gttatcttaattttaagaaa

SEQ ID NO: 372461 - DNA, 20 bp, Artificial
  CRISPR gRNA sequence
attttaagaaagagttacca

SEQ ID NO: 372462 - DNA, 20 bp, Artificial
  CRISPR gRNA sequence
agttaccacagtttattctt

SEQ ID NO: 372463 - DNA, 20 bp, Artificial
  CRISPR gRNA sequence
ccacagtttattctttagat

SEQ ID NO: 372464 - DNA, 20 bp, Artificial
  CRISPR gRNA sequence
cacagtttattctttagatc

SEQ ID NO: 372465 - DNA, 20 bp, Artificial
  CRISPR gRNA sequence
gatcgggttcccaaactttt

SEQ ID NO: 372466 - DNA, 20 bp, Artificial
  CRISPR gRNA sequence
ttcccaaactttttggtctc

SEQ ID NO: 372467 - DNA, 20 bp, Artificial
  CRISPR gRNA sequence
tgctattttaaaaattactg

SEQ ID NO: 372468 - DNA, 20 bp, Artificial
  CRISPR gRNA sequence
gctattttaaaaattactga

SEQ ID NO: 372469 - DNA, 20 bp, Artificial
  CRISPR gRNA sequence
taaaaattactgaaggccct

SEQ ID NO: 372470 - DNA, 20 bp, Artificial
  CRISPR gRNA sequence
aaaaattactgaaggccctc

SEQ ID NO: 372471 - DNA, 20 bp, Artificial
  CRISPR gRNA sequence
aaaattactgaaggccctca

SEQ ID NO: 372472 - DNA, 20 bp, Artificial
  CRISPR gRNA sequence
aattactgaaggccctcagg

SEQ ID NO: 372473 - DNA, 20 bp, Artificial
  CRISPR gRNA sequence
atctgtcatgtttactgtat

SEQ ID NO: 372474 - DNA, 20 bp, Artificial
  CRISPR gRNA sequence
ctgtattagaaatcaatatt

SEQ ID NO: 372475 - DNA, 20 bp, Artificial
  CRISPR gRNA sequence
ttgagcaaaatttaaaacac

SEQ ID NO: 372476 - DNA, 20 bp, Artificial
  CRISPR gRNA sequence
tttaaaacacaagaattttc

SEQ ID NO: 372477 - DNA, 20 bp, Artificial
  CRISPR gRNA sequence
ttttcaagcatgcataccac

SEQ ID NO: 372478 - DNA, 20 bp, Artificial
  CRISPR gRNA sequence
caagcatgcataccactagc

SEQ ID NO: 372479 - DNA, 20 bp, Artificial
  CRISPR gRNA sequence
gcatgcataccactagctgg

SEQ ID NO: 372480 - DNA, 20 bp, Artificial
  CRISPR gRNA sequence
atgcataccactagctggca

SEQ ID NO: 372481 - DNA, 20 bp, Artificial
  CRISPR gRNA sequence
ccactagctggcagagcctc

SEQ ID NO: 372482 - DNA, 20 bp, Artificial
  CRISPR gRNA sequence
aatatctactgtatacctgt

SEQ ID NO: 372483 - DNA, 20 bp, Artificial
  CRISPR gRNA sequence
tatctactgtatacctgtga

SEQ ID NO: 372484 - DNA, 20 bp, Artificial
  CRISPR gRNA sequence
ctgtatacctgtgagagaac

SEQ ID NO: 372485 - DNA, 20 bp, Artificial
  CRISPR gRNA sequence
gtatacctgtgagagaactg

SEQ ID NO: 372486 - DNA, 20 bp, Artificial
  CRISPR gRNA sequence
cctgtgagagaactggagtg

SEQ ID NO: 372487 - DNA, 20 bp, Artificial
  CRISPR gRNA sequence
tgtgagagaactggagtgaa

SEQ ID NO: 372488 - DNA, 20 bp, Artificial
  CRISPR gRNA sequence
gtgagagaactggagtgaag

SEQ ID NO: 372489 - DNA, 20 bp, Artificial
  CRISPR gRNA sequence
tgagagaactggagtgaaga

SEQ ID NO: 372490 - DNA, 20 bp, Artificial
  CRISPR gRNA sequence
gagagaactggagtgaagag

SEQ ID NO: 372491 - DNA, 20 bp, Artificial
  CRISPR gRNA sequence
agagaactggagtgaagagg

SEQ ID NO: 372492 - DNA, 20 bp, Artificial
  CRISPR gRNA sequence
gaatttcctctcaatatcac

SEQ ID NO: 372493 - DNA, 20 bp, Artificial
  CRISPR gRNA sequence
aatttcctctcaatatcact

SEQ ID NO: 372494 - DNA, 20 bp, Artificial
  CRISPR gRNA sequence
tctcaatatcactaggaaaa

SEQ ID NO: 372495 - DNA, 20 bp, Artificial
  CRISPR gRNA sequence
ctaggaaaatagatttgaac

SEQ ID NO: 372496 - DNA, 20 bp, Artificial
  CRISPR gRNA sequence
ttgaactggcatatccccta

SEQ ID NO: 372497 - DNA, 20 bp, Artificial
  CRISPR gRNA sequence
tgaactggcatatcccctaa

SEQ ID NO: 372498 - DNA, 20 bp, Artificial
  CRISPR gRNA sequence
gaactggcatatcccctaaa

SEQ ID NO: 372499 - DNA, 20 bp, Artificial
  CRISPR gRNA sequence
gcatatcccctaaagggaca

SEQ ID NO: 372500 - DNA, 20 bp, Artificial
  CRISPR gRNA sequence
atatcccctaaagggacaca

SEQ ID NO: 372501 - DNA, 20 bp, Artificial
  CRISPR gRNA sequence
taaagggacacagagatgcc

SEQ ID NO: 372502 - DNA, 20 bp, Artificial
  CRISPR gRNA sequence
aaagggacacagagatgccc

SEQ ID NO: 372503 - DNA, 20 bp, Artificial
  CRISPR gRNA sequence
aagggacacagagatgccca

SEQ ID NO: 372504 - DNA, 20 bp, Artificial
  CRISPR gRNA sequence
agggcccccaaacacactct

SEQ ID NO: 372505 - DNA, 20 bp, Artificial
  CRISPR gRNA sequence
gggcccccaaacacactcta

SEQ ID NO: 372506 - DNA, 20 bp, Artificial
  CRISPR gRNA sequence
caaacacactctaaggacca

SEQ ID NO: 372507 - DNA, 20 bp, Artificial
  CRISPR gRNA sequence
cactctaaggaccatggact

SEQ ID NO: 372508 - DNA, 20 bp, Artificial
  CRISPR gRNA sequence
ggaccatggacttagatatt

SEQ ID NO: 372509 - DNA, 20 bp, Artificial
  CRISPR gRNA sequence
gatatttagtgacaattact

SEQ ID NO: 372510 - DNA, 20 bp, Artificial
  CRISPR gRNA sequence
gacaattactgagtacttta

SEQ ID NO: 372511 - DNA, 20 bp, Artificial
  CRISPR gRNA sequence
aattactgagtactttatgg

SEQ ID NO: 372512 - DNA, 20 bp, Artificial
  CRISPR gRNA sequence
attactgagtactttatggt

SEQ ID NO: 372513 - DNA, 20 bp, Artificial
  CRISPR gRNA sequence
gtactttatggtaggaattc

SEQ ID NO: 372514 - DNA, 20 bp, Artificial
  CRISPR gRNA sequence
tatggtaggaattccagaaa

SEQ ID NO: 372515 - DNA, 20 bp, Artificial
  CRISPR gRNA sequence
aggaattccagaaatggtgt

SEQ ID NO: 372516 - DNA, 20 bp, Artificial
  CRISPR gRNA sequence
ggaattccagaaatggtgtg

SEQ ID NO: 372517 - DNA, 20 bp, Artificial
  CRISPR gRNA sequence
attccagaaatggtgtgagg

SEQ ID NO: 372518 - DNA, 20 bp, Artificial
  CRISPR gRNA sequence
ttccagaaatggtgtgagga

SEQ ID NO: 372519 - DNA, 20 bp, Artificial
  CRISPR gRNA sequence
cagaaatggtgtgaggaagg

SEQ ID NO: 372520 - DNA, 20 bp, Artificial
  CRISPR gRNA sequence
agaaatggtgtgaggaaggt

SEQ ID NO: 372521 - DNA, 20 bp, Artificial
  CRISPR gRNA sequence
aaatggtgtgaggaaggtgg

SEQ ID NO: 372522 - DNA, 20 bp, Artificial
  CRISPR gRNA sequence
tgaggaaggtgggagaatac

SEQ ID NO: 372523 - DNA, 20 bp, Artificial
  CRISPR gRNA sequence
gggagaatactggactttca

SEQ ID NO: 372524 - DNA, 20 bp, Artificial
  CRISPR gRNA sequence
tactggactttcatggtatc

SEQ ID NO: 372525 - DNA, 20 bp, Artificial
  CRISPR gRNA sequence
tcaagaattgataccacatg

SEQ ID NO: 372526 - DNA, 20 bp, Artificial
  CRISPR gRNA sequence
caagaattgataccacatgt

SEQ ID NO: 372527 - DNA, 20 bp, Artificial
  CRISPR gRNA sequence
aagaattgataccacatgtg

SEQ ID NO: 372528 - DNA, 20 bp, Artificial
  CRISPR gRNA sequence
gccctactctacccatgtgt

SEQ ID NO: 372529 - DNA, 20 bp, Artificial
  CRISPR gRNA sequence
aagacaaccctgtatatctg

SEQ ID NO: 372530 - DNA, 20 bp, Artificial
  CRISPR gRNA sequence
accctgtatatctgaagaat

SEQ ID NO: 372531 - DNA, 20 bp, Artificial
  CRISPR gRNA sequence
aatgagatcatgtgtatatt

SEQ ID NO: 372532 - DNA, 20 bp, Artificial
  CRISPR gRNA sequence
agatcatgtgtatattcagt

SEQ ID NO: 372533 - DNA, 20 bp, Artificial
  CRISPR gRNA sequence
tatattcagtgagaatgatt

SEQ ID NO: 372534 - DNA, 20 bp, Artificial
  CRISPR gRNA sequence
ggtatctttttcataactgt

SEQ ID NO: 372535 - DNA, 20 bp, Artificial
  CRISPR gRNA sequence
tttcataactgtcagaatct

SEQ ID NO: 372536 - DNA, 20 bp, Artificial
  CRISPR gRNA sequence
ataactgtcagaatcttagc

SEQ ID NO: 372537 - DNA, 20 bp, Artificial
  CRISPR gRNA sequence
aacctgaacatttgatactg

SEQ ID NO: 372538 - DNA, 20 bp, Artificial
  CRISPR gRNA sequence
acctgaacatttgatactgt

SEQ ID NO: 372539 - DNA, 20 bp, Artificial
  CRISPR gRNA sequence
gaacatttgatactgtaggt

SEQ ID NO: 372540 - DNA, 20 bp, Artificial
  CRISPR gRNA sequence
ttgatactgtaggtcagtgt

SEQ ID NO: 372541 - DNA, 20 bp, Artificial
  CRISPR gRNA sequence
gatactgtaggtcagtgtca

SEQ ID NO: 372542 - DNA, 20 bp, Artificial
  CRISPR gRNA sequence
taggtcagtgtcagagacac

SEQ ID NO: 372543 - DNA, 20 bp, Artificial
  CRISPR gRNA sequence
cagtgtcagagacaccagcc

SEQ ID NO: 372544 - DNA, 20 bp, Artificial
  CRISPR gRNA sequence
agcccagcattattgcctaa

SEQ ID NO: 372545 - DNA, 20 bp, Artificial
  CRISPR gRNA sequence
aacagtctctttgtaaaatt

SEQ ID NO: 372546 - DNA, 20 bp, Artificial
  CRISPR gRNA sequence
cagcctcttgatatgatacc

SEQ ID NO: 372547 - DNA, 20 bp, Artificial
  CRISPR gRNA sequence
tcttgatatgataccaagaa

SEQ ID NO: 372548 - DNA, 20 bp, Artificial
  CRISPR gRNA sequence
tatgataccaagaaaagcac

SEQ ID NO: 372549 - DNA, 20 bp, Artificial
  CRISPR gRNA sequence
atgataccaagaaaagcacc

SEQ ID NO: 372550 - DNA, 20 bp, Artificial
  CRISPR gRNA sequence
tgataccaagaaaagcacca

SEQ ID NO: 372551 - DNA, 20 bp, Artificial
  CRISPR gRNA sequence
gataccaagaaaagcaccag

SEQ ID NO: 372552 - DNA, 20 bp, Artificial
  CRISPR gRNA sequence
aagaaaagcaccaggggttt

SEQ ID NO: 372553 - DNA, 20 bp, Artificial
  CRISPR gRNA sequence
tggctgtgtttctcactaca

SEQ ID NO: 372554 - DNA, 20 bp, Artificial
  CRISPR gRNA sequence
ttctcactacatggttaacc

SEQ ID NO: 372555 - DNA, 20 bp, Artificial
  CRISPR gRNA sequence
ggttaaccaagtaacactta

SEQ ID NO: 372556 - DNA, 20 bp, Artificial
  CRISPR gRNA sequence
cctcttttctatttatctcc

SEQ ID NO: 372557 - DNA, 20 bp, Artificial
  CRISPR gRNA sequence
aaaaaaaccctttctcttac

SEQ ID NO: 372558 - DNA, 20 bp, Artificial
  CRISPR gRNA sequence
aagaatgtgtcattcacaac

SEQ ID NO: 372559 - DNA, 20 bp, Artificial
  CRISPR gRNA sequence
agaatgtgtcattcacaact

SEQ ID NO: 372560 - DNA, 20 bp, Artificial
  CRISPR gRNA sequence
gtgtcattcacaactgggtg

SEQ ID NO: 372561 - DNA, 20 bp, Artificial
  CRISPR gRNA sequence
tcattcacaactgggtgcgg

SEQ ID NO: 372562 - DNA, 20 bp, Artificial
  CRISPR gRNA sequence
gtggctcatgcctgtaatcc

SEQ ID NO: 372563 - DNA, 20 bp, Artificial
  CRISPR gRNA sequence
tgcctgtaatcccagcactt

SEQ ID NO: 372564 - DNA, 20 bp, Artificial
  CRISPR gRNA sequence
gcctgtaatcccagcacttt

SEQ ID NO: 372565 - DNA, 20 bp, Artificial
  CRISPR gRNA sequence
ctgtaatcccagcactttgg

SEQ ID NO: 372566 - DNA, 20 bp, Artificial
  CRISPR gRNA sequence
tgtaatcccagcactttggg

SEQ ID NO: 372567 - DNA, 20 bp, Artificial
  CRISPR gRNA sequence
tcccagcactttgggaggcc

SEQ ID NO: 372568 - DNA, 20 bp, Artificial
  CRISPR gRNA sequence
cccagcactttgggaggccg

SEQ ID NO: 372569 - DNA, 20 bp, Artificial
  CRISPR gRNA sequence
agcactttgggaggccgagg

SEQ ID NO: 372570 - DNA, 20 bp, Artificial
  CRISPR gRNA sequence
gcactttgggaggccgaggt

SEQ ID NO: 372571 - DNA, 20 bp, Artificial
  CRISPR gRNA sequence
ctttgggaggccgaggtggg

SEQ ID NO: 372572 - DNA, 20 bp, Artificial
  CRISPR gRNA sequence
ggccgaggtgggcggatcac

SEQ ID NO: 372573 - DNA, 20 bp, Artificial
  CRISPR gRNA sequence
gccgaggtgggcggatcaca

SEQ ID NO: 372574 - DNA, 20 bp, Artificial
  CRISPR gRNA sequence
aggtgggcggatcacaaggt

SEQ ID NO: 372575 - DNA, 20 bp, Artificial
  CRISPR gRNA sequence
ggtgggcggatcacaaggtc

SEQ ID NO: 372576 - DNA, 20 bp, Artificial
  CRISPR gRNA sequence
tgggcggatcacaaggtcag

SEQ ID NO: 372577 - DNA, 20 bp, Artificial
  CRISPR gRNA sequence
gatcacaaggtcaggagatt

SEQ ID NO: 372578 - DNA, 20 bp, Artificial
  CRISPR gRNA sequence
tcaggagattgagaccatcc

SEQ ID NO: 372579 - DNA, 20 bp, Artificial
  CRISPR gRNA sequence
tgagaccatcctggctaaca

SEQ ID NO: 372580 - DNA, 20 bp, Artificial
  CRISPR gRNA sequence
catcctggctaacacggtga

SEQ ID NO: 372581 - DNA, 20 bp, Artificial
  CRISPR gRNA sequence
ctactaaaaatacaaaaaat

SEQ ID NO: 372582 - DNA, 20 bp, Artificial
  CRISPR gRNA sequence
taaaaatacaaaaaattagc

SEQ ID NO: 372583 - DNA, 20 bp, Artificial
  CRISPR gRNA sequence
aaaaatacaaaaaattagcc

SEQ ID NO: 372584 - DNA, 20 bp, Artificial
  CRISPR gRNA sequence
tacaaaaaattagccgggcg

SEQ ID NO: 372585 - DNA, 20 bp, Artificial
  CRISPR gRNA sequence
aaaaaattagccgggcgcgg

SEQ ID NO: 372586 - DNA, 20 bp, Artificial
  CRISPR gRNA sequence
aaattagccgggcgcggtgg

SEQ ID NO: 372587 - DNA, 20 bp, Artificial
  CRISPR gRNA sequence
aattagccgggcgcggtggc

SEQ ID NO: 372588 - DNA, 20 bp, Artificial
  CRISPR gRNA sequence
ggcgcggtggcgggcgccta

SEQ ID NO: 372589 - DNA, 20 bp, Artificial
  CRISPR gRNA sequence
gtggcgggcgcctatagtcc

SEQ ID NO: 372590 - DNA, 20 bp, Artificial
  CRISPR gRNA sequence
cgcctatagtcccagctact

SEQ ID NO: 372591 - DNA, 20 bp, Artificial
  CRISPR gRNA sequence
gcctatagtcccagctactc

SEQ ID NO: 372592 - DNA, 20 bp, Artificial
  CRISPR gRNA sequence
ctatagtcccagctactcag

SEQ ID NO: 372593 - DNA, 20 bp, Artificial
  CRISPR gRNA sequence
tatagtcccagctactcagg

SEQ ID NO: 372594 - DNA, 20 bp, Artificial
  CRISPR gRNA sequence
tcccagctactcaggaggct

SEQ ID NO: 372595 - DNA, 20 bp, Artificial
  CRISPR gRNA sequence
cccagctactcaggaggctg

SEQ ID NO: 372596 - DNA, 20 bp, Artificial
  CRISPR gRNA sequence
agctactcaggaggctgagg

SEQ ID NO: 372597 - DNA, 20 bp, Artificial
  CRISPR gRNA sequence
gctactcaggaggctgaggc

SEQ ID NO: 372598 - DNA, 20 bp, Artificial
  CRISPR gRNA sequence
tactcaggaggctgaggcag

SEQ ID NO: 372599 - DNA, 20 bp, Artificial
  CRISPR gRNA sequence
aggaggctgaggcaggagaa

SEQ ID NO: 372600 - DNA, 20 bp, Artificial
  CRISPR gRNA sequence
gcaggagaatggcgtgaacc

SEQ ID NO: 372601 - DNA, 20 bp, Artificial
  CRISPR gRNA sequence
caggagaatggcgtgaacct

SEQ ID NO: 372602 - DNA, 20 bp, Artificial
  CRISPR gRNA sequence
ggagaatggcgtgaacctgg

SEQ ID NO: 372603 - DNA, 20 bp, Artificial
  CRISPR gRNA sequence
gagaatggcgtgaacctggg

SEQ ID NO: 372604 - DNA, 20 bp, Artificial
  CRISPR gRNA sequence
aatggcgtgaacctgggagg

SEQ ID NO: 372605 - DNA, 20 bp, Artificial
  CRISPR gRNA sequence
tggcgtgaacctgggaggtg

SEQ ID NO: 372606 - DNA, 20 bp, Artificial
  CRISPR gRNA sequence
ggcgtgaacctgggaggtgg

SEQ ID NO: 372607 - DNA, 20 bp, Artificial
  CRISPR gRNA sequence
tgggaggtggaggttgcatt

SEQ ID NO: 372608 - DNA, 20 bp, Artificial
  CRISPR gRNA sequence
ggtggaggttgcattgagcc

SEQ ID NO: 372609 - DNA, 20 bp, Artificial
  CRISPR gRNA sequence
gagatcacaccactgcactc

SEQ ID NO: 372610 - DNA, 20 bp, Artificial
  CRISPR gRNA sequence
cacaccactgcactctagtc

SEQ ID NO: 372611 - DNA, 20 bp, Artificial
  CRISPR gRNA sequence
acaccactgcactctagtct

SEQ ID NO: 372612 - DNA, 20 bp, Artificial
  CRISPR gRNA sequence
ctgcactctagtctgggtga

SEQ ID NO: 372613 - DNA, 20 bp, Artificial
  CRISPR gRNA sequence
gcactctagtctgggtgaca

SEQ ID NO: 372614 - DNA, 20 bp, Artificial
  CRISPR gRNA sequence
tctagtctgggtgacagagc

SEQ ID NO: 372615 - DNA, 20 bp, Artificial
  CRISPR gRNA sequence
gacagagcaagactccgtct

SEQ ID NO: 372616 - DNA, 20 bp, Artificial
  CRISPR gRNA sequence
acagagcaagactccgtctc

SEQ ID NO: 372617 - DNA, 20 bp, Artificial
  CRISPR gRNA sequence
tctcaggaaaaaaaaaaaaa

SEQ ID NO: 372618 - DNA, 20 bp, Artificial
  CRISPR gRNA sequence
caggaaaaaaaaaaaaaaag

SEQ ID NO: 372619 - DNA, 20 bp, Artificial
  CRISPR gRNA sequence
aaaaaaaaaaaagtagtata

SEQ ID NO: 372620 - DNA, 20 bp, Artificial
  CRISPR gRNA sequence
aaaaaaaaaagtagtataaa

SEQ ID NO: 372621 - DNA, 20 bp, Artificial
  CRISPR gRNA sequence
aaaaaaaaagtagtataaag

SEQ ID NO: 372622 - DNA, 20 bp, Artificial
  CRISPR gRNA sequence
tataaagaggtcattcacaa

SEQ ID NO: 372623 - DNA, 20 bp, Artificial
  CRISPR gRNA sequence
aaagaggtcattcacaacgg

SEQ ID NO: 372624 - DNA, 20 bp, Artificial
  CRISPR gRNA sequence
tcacaacggaagaactgtgt

SEQ ID NO: 372625 - DNA, 20 bp, Artificial
  CRISPR gRNA sequence
cacaacggaagaactgtgtt

SEQ ID NO: 372626 - DNA, 20 bp, Artificial
  CRISPR gRNA sequence
caccaattatttttatgatt

SEQ ID NO: 372627 - DNA, 20 bp, Artificial
  CRISPR gRNA sequence
ttttatgattaagtatcttc

SEQ ID NO: 372628 - DNA, 20 bp, Artificial
  CRISPR gRNA sequence
atgattaagtatcttccagt

SEQ ID NO: 372629 - DNA, 20 bp, Artificial
  CRISPR gRNA sequence
tgattaagtatcttccagtt

SEQ ID NO: 372630 - DNA, 20 bp, Artificial
  CRISPR gRNA sequence
aatcatttgcttcttctttt

SEQ ID NO: 372631 - DNA, 20 bp, Artificial
  CRISPR gRNA sequence
atttgcttcttcttttcaga

SEQ ID NO: 372632 - DNA, 20 bp, Artificial
  CRISPR gRNA sequence
tcttcttttcagatagtttt

SEQ ID NO: 372633 - DNA, 20 bp, Artificial
  CRISPR gRNA sequence
cttcttttcagatagttttg

SEQ ID NO: 372634 - DNA, 20 bp, Artificial
  CRISPR gRNA sequence
cttttcagatagttttgagg

SEQ ID NO: 372635 - DNA, 20 bp, Artificial
  CRISPR gRNA sequence
gaggcagctgtgccatcaaa

SEQ ID NO: 372636 - DNA, 20 bp, Artificial
  CRISPR gRNA sequence
atcaaatagccacattgttt

SEQ ID NO: 372637 - DNA, 20 bp, Artificial
  CRISPR gRNA sequence
agccacattgtttcggaacc

SEQ ID NO: 372638 - DNA, 20 bp, Artificial
  CRISPR gRNA sequence
acattgtttcggaacctgga

SEQ ID NO: 372639 - DNA, 20 bp, Artificial
  CRISPR gRNA sequence
agaatgtcacactcacttgt

SEQ ID NO: 372640 - DNA, 20 bp, Artificial
  CRISPR gRNA sequence
tcacactcacttgtcagcct

SEQ ID NO: 372641 - DNA, 20 bp, Artificial
  CRISPR gRNA sequence
cttgtcagcctcagatgacg

SEQ ID NO: 372642 - DNA, 20 bp, Artificial
  CRISPR gRNA sequence
ctcagatgacgtggcctgtg

SEQ ID NO: 372643 - DNA, 20 bp, Artificial
  CRISPR gRNA sequence
tcagatgacgtggcctgtgc

SEQ ID NO: 372644 - DNA, 20 bp, Artificial
  CRISPR gRNA sequence
gatgacgtggcctgtgcagg

SEQ ID NO: 372645 - DNA, 20 bp, Artificial
  CRISPR gRNA sequence
acgtggcctgtgcaggcagt

SEQ ID NO: 372646 - DNA, 20 bp, Artificial
  CRISPR gRNA sequence
cgtggcctgtgcaggcagtg

SEQ ID NO: 372647 - DNA, 20 bp, Artificial
  CRISPR gRNA sequence
ggcctgtgcaggcagtgagg

SEQ ID NO: 372648 - DNA, 20 bp, Artificial
  CRISPR gRNA sequence
gcctgtgcaggcagtgaggt

SEQ ID NO: 372649 - DNA, 20 bp, Artificial
  CRISPR gRNA sequence
tgcaggcagtgaggtgggaa

SEQ ID NO: 372650 - DNA, 20 bp, Artificial
  CRISPR gRNA sequence
cagtgaggtgggaaaagatc

SEQ ID NO: 372651 - DNA, 20 bp, Artificial
  CRISPR gRNA sequence
gggaaaagatccagccccgt

SEQ ID NO: 372652 - DNA, 20 bp, Artificial
  CRISPR gRNA sequence
cctcttaacttactgcaact

SEQ ID NO: 372653 - DNA, 20 bp, Artificial
  CRISPR gRNA sequence
acttactgcaacttggtcca

SEQ ID NO: 372654 - DNA, 20 bp, Artificial
  CRISPR gRNA sequence
tactgcaacttggtccatgg

SEQ ID NO: 372655 - DNA, 20 bp, Artificial
  CRISPR gRNA sequence
atggcagaaatttcacctcc

SEQ ID NO: 372656 - DNA, 20 bp, Artificial
  CRISPR gRNA sequence
aatttcacctccaagttccc

SEQ ID NO: 372657 - DNA, 20 bp, Artificial
  CRISPR gRNA sequence
ctccaagttcccaagacaaa

SEQ ID NO: 372658 - DNA, 20 bp, Artificial
  CRISPR gRNA sequence
aagttcccaagacaaatagt

SEQ ID NO: 372659 - DNA, 20 bp, Artificial
  CRISPR gRNA sequence
agacaaatagtgagcaactg

SEQ ID NO: 372660 - DNA, 20 bp, Artificial
  CRISPR gRNA sequence
atagtgagcaactgcagcca

SEQ ID NO: 372661 - DNA, 20 bp, Artificial
  CRISPR gRNA sequence
gtgagcaactgcagccacgg

SEQ ID NO: 372662 - DNA, 20 bp, Artificial
  CRISPR gRNA sequence
tgagcaactgcagccacgga

SEQ ID NO: 372663 - DNA, 20 bp, Artificial
  CRISPR gRNA sequence
gcaactgcagccacggaagg

SEQ ID NO: 372664 - DNA, 20 bp, Artificial
  CRISPR gRNA sequence
aactgcagccacggaaggtg

SEQ ID NO: 372665 - DNA, 20 bp, Artificial
  CRISPR gRNA sequence
catcgtcatccccgatgtca

SEQ ID NO: 372666 - DNA, 20 bp, Artificial
  CRISPR gRNA sequence
catccccgatgtcacagtct

SEQ ID NO: 372667 - DNA, 20 bp, Artificial
  CRISPR gRNA sequence
cgatgtcacagtctcagact

SEQ ID NO: 372668 - DNA, 20 bp, Artificial
  CRISPR gRNA sequence
gatgtcacagtctcagactc

SEQ ID NO: 372669 - DNA, 20 bp, Artificial
  CRISPR gRNA sequence
atgtcacagtctcagactcg

SEQ ID NO: 372670 - DNA, 20 bp, Artificial
  CRISPR gRNA sequence
ggctttaccgctgctacttg

SEQ ID NO: 372671 - DNA, 20 bp, Artificial
  CRISPR gRNA sequence
gctttaccgctgctacttgc

SEQ ID NO: 372672 - DNA, 20 bp, Artificial
  CRISPR gRNA sequence
taccgctgctacttgcaggc

SEQ ID NO: 372673 - DNA, 20 bp, Artificial
  CRISPR gRNA sequence
ctgctacttgcaggccagcg

SEQ ID NO: 372674 - DNA, 20 bp, Artificial
  CRISPR gRNA sequence
tgctacttgcaggccagcgc

SEQ ID NO: 372675 - DNA, 20 bp, Artificial
  CRISPR gRNA sequence
ctacttgcaggccagcgcag

SEQ ID NO: 372676 - DNA, 20 bp, Artificial
  CRISPR gRNA sequence
gaaaacgaaaccttcgtgat

SEQ ID NO: 372677 - DNA, 20 bp, Artificial
  CRISPR gRNA sequence
cttcgtgatgagattgactg

SEQ ID NO: 372678 - DNA, 20 bp, Artificial
  CRISPR gRNA sequence
tgatgagattgactgtagcc

SEQ ID NO: 372679 - DNA, 20 bp, Artificial
  CRISPR gRNA sequence
gatgagattgactgtagccg

SEQ ID NO: 372680 - DNA, 20 bp, Artificial
  CRISPR gRNA sequence
atgagattgactgtagccga

SEQ ID NO: 372681 - DNA, 20 bp, Artificial
  CRISPR gRNA sequence
gattgactgtagccgagggt

SEQ ID NO: 372682 - DNA, 20 bp, Artificial
  CRISPR gRNA sequence
gactgtagccgagggtgagt

SEQ ID NO: 372683 - DNA, 20 bp, Artificial
  CRISPR gRNA sequence
agccgagggtgagtgagcac

SEQ ID NO: 372684 - DNA, 20 bp, Artificial
  CRISPR gRNA sequence
agtgagcaccagacatcttc

SEQ ID NO: 372685 - DNA, 20 bp, Artificial
  CRISPR gRNA sequence
acatcttctggtatcaaaca

SEQ ID NO: 372686 - DNA, 20 bp, Artificial
  CRISPR gRNA sequence
tctggtatcaaacatggaaa

SEQ ID NO: 372687 - DNA, 20 bp, Artificial
  CRISPR gRNA sequence
gtatcaaacatggaaaaagc

SEQ ID NO: 372688 - DNA, 20 bp, Artificial
  CRISPR gRNA sequence
catggaaaaagccagccccg

SEQ ID NO: 372689 - DNA, 20 bp, Artificial
  CRISPR gRNA sequence
atggaaaaagccagccccgt

SEQ ID NO: 372690 - DNA, 20 bp, Artificial
  CRISPR gRNA sequence
aaaaagccagccccgtgggc

SEQ ID NO: 372691 - DNA, 20 bp, Artificial
  CRISPR gRNA sequence
ctggtctctgtttttattta

SEQ ID NO: 372692 - DNA, 20 bp, Artificial
  CRISPR gRNA sequence
gttcatttaatgcgcatatt

SEQ ID NO: 372693 - DNA, 20 bp, Artificial
  CRISPR gRNA sequence
atattcagcatttttttaaa

SEQ ID NO: 372694 - DNA, 20 bp, Artificial
  CRISPR gRNA sequence
tttttttaaatggctgaatt

SEQ ID NO: 372695 - DNA, 20 bp, Artificial
  CRISPR gRNA sequence
ttttttaaatggctgaattt

SEQ ID NO: 372696 - DNA, 20 bp, Artificial
  CRISPR gRNA sequence
ttaaatggctgaatttaggt

SEQ ID NO: 372697 - DNA, 20 bp, Artificial
  CRISPR gRNA sequence
atggctgaatttaggtgagt

SEQ ID NO: 372698 - DNA, 20 bp, Artificial
  CRISPR gRNA sequence
aggtgagttggccattattc

SEQ ID NO: 372699 - DNA, 20 bp, Artificial
  CRISPR gRNA sequence
ttggccattattctagtatt

SEQ ID NO: 372700 - DNA, 20 bp, Artificial
  CRISPR gRNA sequence
tggccattattctagtattg

SEQ ID NO: 372701 - DNA, 20 bp, Artificial
  CRISPR gRNA sequence
ggccattattctagtattga

SEQ ID NO: 372702 - DNA, 20 bp, Artificial
  CRISPR gRNA sequence
tatcttgtgaatccatcaat

SEQ ID NO: 372703 - DNA, 20 bp, Artificial
  CRISPR gRNA sequence
gtgaatccatcaatcagata

SEQ ID NO: 372704 - DNA, 20 bp, Artificial
  CRISPR gRNA sequence
tcttatctgccaccatcctg

SEQ ID NO: 372705 - DNA, 20 bp, Artificial
  CRISPR gRNA sequence
caccatcctgaagcttaaaa

SEQ ID NO: 372706 - DNA, 20 bp, Artificial
  CRISPR gRNA sequence
gcttaaaaaagaaattcgta

SEQ ID NO: 372707 - DNA, 20 bp, Artificial
  CRISPR gRNA sequence
cttaaaaaagaaattcgtaa

SEQ ID NO: 372708 - DNA, 20 bp, Artificial
  CRISPR gRNA sequence
ttaaaaaagaaattcgtaaa

SEQ ID NO: 372709 - DNA, 20 bp, Artificial
  CRISPR gRNA sequence
gtaaagggctgaaaaacata

SEQ ID NO: 372710 - DNA, 20 bp, Artificial
  CRISPR gRNA sequence
tgaaaaacatatggtattac

SEQ ID NO: 372711 - DNA, 20 bp, Artificial
  CRISPR gRNA sequence
catatggtattaccagcctt

SEQ ID NO: 372712 - DNA, 20 bp, Artificial
  CRISPR gRNA sequence
atatggtattaccagccttc

SEQ ID NO: 372713 - DNA, 20 bp, Artificial
  CRISPR gRNA sequence
tattaccagccttcaggttt

SEQ ID NO: 372714 - DNA, 20 bp, Artificial
  CRISPR gRNA sequence
cagccttcaggtttcagctg

SEQ ID NO: 372715 - DNA, 20 bp, Artificial
  CRISPR gRNA sequence
aattacatgaatatttttga

SEQ ID NO: 372716 - DNA, 20 bp, Artificial
  CRISPR gRNA sequence
tacatgaatatttttgatgg

SEQ ID NO: 372717 - DNA, 20 bp, Artificial
  CRISPR gRNA sequence
atatttttgatggtggtgat

SEQ ID NO: 372718 - DNA, 20 bp, Artificial
  CRISPR gRNA sequence
tatttttgatggtggtgata

SEQ ID NO: 372719 - DNA, 20 bp, Artificial
  CRISPR gRNA sequence
tgatggtggtgataaggtgt

SEQ ID NO: 372720 - DNA, 20 bp, Artificial
  CRISPR gRNA sequence
gttagaatccccacataccc

SEQ ID NO: 372721 - DNA, 20 bp, Artificial
  CRISPR gRNA sequence
cccacataccccagcaatac

SEQ ID NO: 372722 - DNA, 20 bp, Artificial
  CRISPR gRNA sequence
cataccccagcaatacaaga

SEQ ID NO: 372723 - DNA, 20 bp, Artificial
  CRISPR gRNA sequence
ccagcaatacaagacagtgc

SEQ ID NO: 372724 - DNA, 20 bp, Artificial
  CRISPR gRNA sequence
cagcaatacaagacagtgct

SEQ ID NO: 372725 - DNA, 20 bp, Artificial
  CRISPR gRNA sequence
aagacagtgctaggttgata

SEQ ID NO: 372726 - DNA, 20 bp, Artificial
  CRISPR gRNA sequence
gtgctaggttgatatggctg

SEQ ID NO: 372727 - DNA, 20 bp, Artificial
  CRISPR gRNA sequence
ctaggttgatatggctgaag

SEQ ID NO: 372728 - DNA, 20 bp, Artificial
  CRISPR gRNA sequence
taggttgatatggctgaagc

SEQ ID NO: 372729 - DNA, 20 bp, Artificial
  CRISPR gRNA sequence
aggttgatatggctgaagca

SEQ ID NO: 372730 - DNA, 20 bp, Artificial
  CRISPR gRNA sequence
ggctgaagcagggctgcgtt

SEQ ID NO: 372731 - DNA, 20 bp, Artificial
  CRISPR gRNA sequence
gggctgcgttgagtgcattt

SEQ ID NO: 372732 - DNA, 20 bp, Artificial
  CRISPR gRNA sequence
ctgcgttgagtgcatttcag

SEQ ID NO: 372733 - DNA, 20 bp, Artificial
  CRISPR gRNA sequence
tgcgttgagtgcatttcagc

SEQ ID NO: 372734 - DNA, 20 bp, Artificial
  CRISPR gRNA sequence
gtgcatttcagcaggtgttt

SEQ ID NO: 372735 - DNA, 20 bp, Artificial
  CRISPR gRNA sequence
tcagcaggtgtttgagaatg

SEQ ID NO: 372736 - DNA, 20 bp, Artificial
  CRISPR gRNA sequence
gtgtttgagaatgcggttgc

SEQ ID NO: 372737 - DNA, 20 bp, Artificial
  CRISPR gRNA sequence
gaatgcggttgccagtttgc

SEQ ID NO: 372738 - DNA, 20 bp, Artificial
  CRISPR gRNA sequence
gcggttgccagtttgccaga

SEQ ID NO: 372739 - DNA, 20 bp, Artificial
  CRISPR gRNA sequence
cggttgccagtttgccagac

SEQ ID NO: 372740 - DNA, 20 bp, Artificial
  CRISPR gRNA sequence
gttgccagtttgccagacag

SEQ ID NO: 372741 - DNA, 20 bp, Artificial
  CRISPR gRNA sequence
acaggagcctttttttctct

SEQ ID NO: 372742 - DNA, 20 bp, Artificial
  CRISPR gRNA sequence
ttttttctctcagtcttttt

SEQ ID NO: 372743 - DNA, 20 bp, Artificial
  CRISPR gRNA sequence
ctctcagtctttttcagatg

SEQ ID NO: 372744 - DNA, 20 bp, Artificial
  CRISPR gRNA sequence
gtctttttcagatgtggatg

SEQ ID NO: 372745 - DNA, 20 bp, Artificial
  CRISPR gRNA sequence
ttcagatgtggatgcagaaa

SEQ ID NO: 372746 - DNA, 20 bp, Artificial
  CRISPR gRNA sequence
atgttgcatcttaatattac

SEQ ID NO: 372747 - DNA, 20 bp, Artificial
  CRISPR gRNA sequence
tgttgcatcttaatattact

SEQ ID NO: 372748 - DNA, 20 bp, Artificial
  CRISPR gRNA sequence
tcttaatattactaggaaaa

SEQ ID NO: 372749 - DNA, 20 bp, Artificial
  CRISPR gRNA sequence
cttaatattactaggaaaat

SEQ ID NO: 372750 - DNA, 20 bp, Artificial
  CRISPR gRNA sequence
ggaaaataggtttgaccttg

SEQ ID NO: 372751 - DNA, 20 bp, Artificial
  CRISPR gRNA sequence
ttgaccttgcagatccccaa

SEQ ID NO: 372752 - DNA, 20 bp, Artificial
  CRISPR gRNA sequence
tgaccttgcagatccccaaa

SEQ ID NO: 372753 - DNA, 20 bp, Artificial
  CRISPR gRNA sequence
gaccttgcagatccccaaaa

SEQ ID NO: 372754 - DNA, 20 bp, Artificial
  CRISPR gRNA sequence
gcagatccccaaaagggaca

SEQ ID NO: 372755 - DNA, 20 bp, Artificial
  CRISPR gRNA sequence
cagatccccaaaagggacac

SEQ ID NO: 372756 - DNA, 20 bp, Artificial
  CRISPR gRNA sequence
agatccccaaaagggacaca

SEQ ID NO: 372757 - DNA, 20 bp, Artificial
  CRISPR gRNA sequence
aaaagggacacagggatcct

SEQ ID NO: 372758 - DNA, 20 bp, Artificial
  CRISPR gRNA sequence
aaagggacacagggatcctc

SEQ ID NO: 372759 - DNA, 20 bp, Artificial
  CRISPR gRNA sequence
aagggacacagggatcctca

SEQ ID NO: 372760 - DNA, 20 bp, Artificial
  CRISPR gRNA sequence
gggacccccaaacatactat

SEQ ID NO: 372761 - DNA, 20 bp, Artificial
  CRISPR gRNA sequence
tactataagaaccactgact

SEQ ID NO: 372762 - DNA, 20 bp, Artificial
  CRISPR gRNA sequence
gaaccactgacttagatctt

SEQ ID NO: 372763 - DNA, 20 bp, Artificial
  CRISPR gRNA sequence
gatctttggtgaccattact

SEQ ID NO: 372764 - DNA, 20 bp, Artificial
  CRISPR gRNA sequence
actgagtataatctttgtgc

SEQ ID NO: 372765 - DNA, 20 bp, Artificial
  CRISPR gRNA sequence
aatctttgtgctggtgaaat

SEQ ID NO: 372766 - DNA, 20 bp, Artificial
  CRISPR gRNA sequence
gtgctggtgaaattggcctt

SEQ ID NO: 372767 - DNA, 20 bp, Artificial
  CRISPR gRNA sequence
tgctggtgaaattggccttt

SEQ ID NO: 372768 - DNA, 20 bp, Artificial
  CRISPR gRNA sequence
gctggtgaaattggcctttg

SEQ ID NO: 372769 - DNA, 20 bp, Artificial
  CRISPR gRNA sequence
ttggggcttccacctcctcc

SEQ ID NO: 372770 - DNA, 20 bp, Artificial
  CRISPR gRNA sequence
tggggcttccacctcctcca

SEQ ID NO: 372771 - DNA, 20 bp, Artificial
  CRISPR gRNA sequence
cctcctccaaggcctcctcc

SEQ ID NO: 372772 - DNA, 20 bp, Artificial
  CRISPR gRNA sequence
ctcctccaaggcctcctcca

SEQ ID NO: 372773 - DNA, 20 bp, Artificial
  CRISPR gRNA sequence
gcaccacactatttgtatat

SEQ ID NO: 372774 - DNA, 20 bp, Artificial
  CRISPR gRNA sequence
caccacactatttgtatatt

SEQ ID NO: 372775 - DNA, 20 bp, Artificial
  CRISPR gRNA sequence
gtcttttttttgtcacaatg

SEQ ID NO: 372776 - DNA, 20 bp, Artificial
  CRISPR gRNA sequence
tgaagcctttcattgtgttt

SEQ ID NO: 372777 - DNA, 20 bp, Artificial
  CRISPR gRNA sequence
gaagcctttcattgtgtttc

SEQ ID NO: 372778 - DNA, 20 bp, Artificial
  CRISPR gRNA sequence
gtttcaggacctgcaaaacc

SEQ ID NO: 372779 - DNA, 20 bp, Artificial
  CRISPR gRNA sequence
aacctagatccactttgcat

SEQ ID NO: 372780 - DNA, 20 bp, Artificial
  CRISPR gRNA sequence
gatccactttgcatgagtat

SEQ ID NO: 372781 - DNA, 20 bp, Artificial
  CRISPR gRNA sequence
ctttgcatgagtatgagaaa

SEQ ID NO: 372782 - DNA, 20 bp, Artificial
  CRISPR gRNA sequence
aaagtaatttctttcactta

SEQ ID NO: 372783 - DNA, 20 bp, Artificial
  CRISPR gRNA sequence
gtaatttctttcacttacag

SEQ ID NO: 372784 - DNA, 20 bp, Artificial
  CRISPR gRNA sequence
cacttacagaagtgctaata

SEQ ID NO: 372785 - DNA, 20 bp, Artificial
  CRISPR gRNA sequence
cttacagaagtgctaatata

SEQ ID NO: 372786 - DNA, 20 bp, Artificial
  CRISPR gRNA sequence
tacagaagtgctaatataga

SEQ ID NO: 372787 - DNA, 20 bp, Artificial
  CRISPR gRNA sequence
acagaagtgctaatatagag

SEQ ID NO: 372788 - DNA, 20 bp, Artificial
  CRISPR gRNA sequence
ctaatatagagaggcccata

SEQ ID NO: 372789 - DNA, 20 bp, Artificial
  CRISPR gRNA sequence
aatatagagaggcccatata

SEQ ID NO: 372790 - DNA, 20 bp, Artificial
  CRISPR gRNA sequence
atatagagaggcccatatag

SEQ ID NO: 372791 - DNA, 20 bp, Artificial
  CRISPR gRNA sequence
ggcccatatagaggtctgtg

SEQ ID NO: 372792 - DNA, 20 bp, Artificial
  CRISPR gRNA sequence
cccatatagaggtctgtgta

SEQ ID NO: 372793 - DNA, 20 bp, Artificial
  CRISPR gRNA sequence
ccatatagaggtctgtgtag

SEQ ID NO: 372794 - DNA, 20 bp, Artificial
  CRISPR gRNA sequence
ctgtgtagaggcctgcatta

SEQ ID NO: 372795 - DNA, 20 bp, Artificial
  CRISPR gRNA sequence
tagaggcctgcattacagtt

SEQ ID NO: 372796 - DNA, 20 bp, Artificial
  CRISPR gRNA sequence
gaggcctgcattacagttga

SEQ ID NO: 372797 - DNA, 20 bp, Artificial
  CRISPR gRNA sequence
ggcctgcattacagttgaga

SEQ ID NO: 372798 - DNA, 20 bp, Artificial
  CRISPR gRNA sequence
cctgcattacagttgagaga

SEQ ID NO: 372799 - DNA, 20 bp, Artificial
  CRISPR gRNA sequence
ctgcattacagttgagagag

SEQ ID NO: 372800 - DNA, 20 bp, Artificial
  CRISPR gRNA sequence
cattacagttgagagagagg

SEQ ID NO: 372801 - DNA, 20 bp, Artificial
  CRISPR gRNA sequence
attacagttgagagagagga

SEQ ID NO: 372802 - DNA, 20 bp, Artificial
  CRISPR gRNA sequence
gagagagaggaaggccatcc

SEQ ID NO: 372803 - DNA, 20 bp, Artificial
  CRISPR gRNA sequence
agagagaggaaggccatccc

SEQ ID NO: 372804 - DNA, 20 bp, Artificial
  CRISPR gRNA sequence
aaggccatcccaggctctcc

SEQ ID NO: 372805 - DNA, 20 bp, Artificial
  CRISPR gRNA sequence
ggctctcccagctctgcctc

SEQ ID NO: 372806 - DNA, 20 bp, Artificial
  CRISPR gRNA sequence
gctctcccagctctgcctct

SEQ ID NO: 372807 - DNA, 20 bp, Artificial
  CRISPR gRNA sequence
tcccagctctgcctctgggc

SEQ ID NO: 372808 - DNA, 20 bp, Artificial
  CRISPR gRNA sequence
tgggccagcttcctcactgt

SEQ ID NO: 372809 - DNA, 20 bp, Artificial
  CRISPR gRNA sequence
gggccagcttcctcactgtc

SEQ ID NO: 372810 - DNA, 20 bp, Artificial
  CRISPR gRNA sequence
gcttcctcactgtcgggaca

SEQ ID NO: 372811 - DNA, 20 bp, Artificial
  CRISPR gRNA sequence
tcctcactgtcgggacacgg

SEQ ID NO: 372812 - DNA, 20 bp, Artificial
  CRISPR gRNA sequence
ctcactgtcgggacacggaa

SEQ ID NO: 372813 - DNA, 20 bp, Artificial
  CRISPR gRNA sequence
ttccttccttcctcccactt

SEQ ID NO: 372814 - DNA, 20 bp, Artificial
  CRISPR gRNA sequence
cttccttcctcccacttgag

SEQ ID NO: 372815 - DNA, 20 bp, Artificial
  CRISPR gRNA sequence
ttccttcctcccacttgagc

SEQ ID NO: 372816 - DNA, 20 bp, Artificial
  CRISPR gRNA sequence
acttgagcaggccccttcca

SEQ ID NO: 372817 - DNA, 20 bp, Artificial
  CRISPR gRNA sequence
gcactgcactatttgtgtat

SEQ ID NO: 372818 - DNA, 20 bp, Artificial
  CRISPR gRNA sequence
cactgcactatttgtgtatt

SEQ ID NO: 372819 - DNA, 20 bp, Artificial
  CRISPR gRNA sequence
aatgaatccttaaattgtgt

SEQ ID NO: 372820 - DNA, 20 bp, Artificial
  CRISPR gRNA sequence
ccttaaattgtgtaagattc

SEQ ID NO: 372821 - DNA, 20 bp, Artificial
  CRISPR gRNA sequence
attccagcccccacaaaacc

SEQ ID NO: 372822 - DNA, 20 bp, Artificial
  CRISPR gRNA sequence
gatccactttgtatgattgt

SEQ ID NO: 372823 - DNA, 20 bp, Artificial
  CRISPR gRNA sequence
ctttgtatgattgtgagaaa

SEQ ID NO: 372824 - DNA, 20 bp, Artificial
  CRISPR gRNA sequence
agtgattttttttttattta

SEQ ID NO: 372825 - DNA, 20 bp, Artificial
  CRISPR gRNA sequence
gattttttttttatttacag

SEQ ID NO: 372826 - DNA, 20 bp, Artificial
  CRISPR gRNA sequence
tatttacagaagtacaaata

SEQ ID NO: 372827 - DNA, 20 bp, Artificial
  CRISPR gRNA sequence
tttacagaagtacaaatata

SEQ ID NO: 372828 - DNA, 20 bp, Artificial
  CRISPR gRNA sequence
ttacagaagtacaaatatag

SEQ ID NO: 372829 - DNA, 20 bp, Artificial
  CRISPR gRNA sequence
tacaaatatagaggtccata

SEQ ID NO: 372830 - DNA, 20 bp, Artificial
  CRISPR gRNA sequence
caaatatagaggtccatata

SEQ ID NO: 372831 - DNA, 20 bp, Artificial
  CRISPR gRNA sequence
ggtccatatagagttctgtg

SEQ ID NO: 372832 - DNA, 20 bp, Artificial
  CRISPR gRNA sequence
tccatatagagttctgtgta

SEQ ID NO: 372833 - DNA, 20 bp, Artificial
  CRISPR gRNA sequence
ccatatagagttctgtgtag

SEQ ID NO: 372834 - DNA, 20 bp, Artificial
  CRISPR gRNA sequence
ctgtgtagaggcctgtatta

SEQ ID NO: 372835 - DNA, 20 bp, Artificial
  CRISPR gRNA sequence
ttctcccttccacatgcttt

SEQ ID NO: 372836 - DNA, 20 bp, Artificial
  CRISPR gRNA sequence
cccttccacatgctttcagc

SEQ ID NO: 372837 - DNA, 20 bp, Artificial
  CRISPR gRNA sequence
aatttacctttgacttatgt

SEQ ID NO: 372838 - DNA, 20 bp, Artificial
  CRISPR gRNA sequence
tttgacttatgttagacttg

SEQ ID NO: 372839 - DNA, 20 bp, Artificial
  CRISPR gRNA sequence
tgacttatgttagacttgta

SEQ ID NO: 372840 - DNA, 20 bp, Artificial
  CRISPR gRNA sequence
cttgtagagccaacgcttgc

SEQ ID NO: 372841 - DNA, 20 bp, Artificial
  CRISPR gRNA sequence
ttgtagagccaacgcttgct

SEQ ID NO: 372842 - DNA, 20 bp, Artificial
  CRISPR gRNA sequence
agccaacgcttgctaggctt

SEQ ID NO: 372843 - DNA, 20 bp, Artificial
  CRISPR gRNA sequence
aggctttggctgtcccttta

SEQ ID NO: 372844 - DNA, 20 bp, Artificial
  CRISPR gRNA sequence
ttcttcctgtgttgaaaatg

SEQ ID NO: 372845 - DNA, 20 bp, Artificial
  CRISPR gRNA sequence
ttcctgtgttgaaaatgaag

SEQ ID NO: 372846 - DNA, 20 bp, Artificial
  CRISPR gRNA sequence
gtgttgaaaatgaagaagaa

SEQ ID NO: 372847 - DNA, 20 bp, Artificial
  CRISPR gRNA sequence
tgttgaaaatgaagaagaaa

SEQ ID NO: 372848 - DNA, 20 bp, Artificial
  CRISPR gRNA sequence
aagaaaaggtcttgtataaa

SEQ ID NO: 372849 - DNA, 20 bp, Artificial
  CRISPR gRNA sequence
aaaaggtcttgtataaacag

SEQ ID NO: 372850 - DNA, 20 bp, Artificial
  CRISPR gRNA sequence
ataaacagaagcttccacta

SEQ ID NO: 372851 - DNA, 20 bp, Artificial
  CRISPR gRNA sequence
actatagctctgtgtataat

SEQ ID NO: 372852 - DNA, 20 bp, Artificial
  CRISPR gRNA sequence
ctatagctctgtgtataata

SEQ ID NO: 372853 - DNA, 20 bp, Artificial
  CRISPR gRNA sequence
atagctctgtgtataataag

SEQ ID NO: 372854 - DNA, 20 bp, Artificial
  CRISPR gRNA sequence
agctctgtgtataataagga

SEQ ID NO: 372855 - DNA, 20 bp, Artificial
  CRISPR gRNA sequence
tataataaggagagcatttt

SEQ ID NO: 372856 - DNA, 20 bp, Artificial
  CRISPR gRNA sequence
ataataaggagagcattttc

SEQ ID NO: 372857 - DNA, 20 bp, Artificial
  CRISPR gRNA sequence
taataaggagagcattttca

SEQ ID NO: 372858 - DNA, 20 bp, Artificial
  CRISPR gRNA sequence
cttttcatacacaatcacct

SEQ ID NO: 372859 - DNA, 20 bp, Artificial
  CRISPR gRNA sequence
caatcaccttggaccacatc

SEQ ID NO: 372860 - DNA, 20 bp, Artificial
  CRISPR gRNA sequence
tcaagcctcccttgttcctc

SEQ ID NO: 372861 - DNA, 20 bp, Artificial
  CRISPR gRNA sequence
caagcctcccttgttcctct

SEQ ID NO: 372862 - DNA, 20 bp, Artificial
  CRISPR gRNA sequence
ccttgttcctctaggaactg

SEQ ID NO: 372863 - DNA, 20 bp, Artificial
  CRISPR gRNA sequence
gttcctctaggaactgtggt

SEQ ID NO: 372864 - DNA, 20 bp, Artificial
  CRISPR gRNA sequence
aactgtggtgagacatacat

SEQ ID NO: 372865 - DNA, 20 bp, Artificial
  CRISPR gRNA sequence
ggtgagacatacattggact

SEQ ID NO: 372866 - DNA, 20 bp, Artificial
  CRISPR gRNA sequence
tagaatttaatgaaaatgat

SEQ ID NO: 372867 - DNA, 20 bp, Artificial
  CRISPR gRNA sequence
aatttaatgaaaatgatgag

SEQ ID NO: 372868 - DNA, 20 bp, Artificial
  CRISPR gRNA sequence
taatgaaaatgatgagtggt

SEQ ID NO: 372869 - DNA, 20 bp, Artificial
  CRISPR gRNA sequence
tgagtggttggtgaaatatt

SEQ ID NO: 372870 - DNA, 20 bp, Artificial
  CRISPR gRNA sequence
gagtggttggtgaaatattt

SEQ ID NO: 372871 - DNA, 20 bp, Artificial
  CRISPR gRNA sequence
agtggttggtgaaatatttg

SEQ ID NO: 372872 - DNA, 20 bp, Artificial
  CRISPR gRNA sequence
gtggttggtgaaatatttgg

SEQ ID NO: 372873 - DNA, 20 bp, Artificial
  CRISPR gRNA sequence
ggttggtgaaatatttgggg

SEQ ID NO: 372874 - DNA, 20 bp, Artificial
  CRISPR gRNA sequence
gttggtgaaatatttggggg

SEQ ID NO: 372875 - DNA, 20 bp, Artificial
  CRISPR gRNA sequence
atatttgggggaggaaaaat

SEQ ID NO: 372876 - DNA, 20 bp, Artificial
  CRISPR gRNA sequence
tttgggggaggaaaaattag

SEQ ID NO: 372877 - DNA, 20 bp, Artificial
  CRISPR gRNA sequence
tgggggaggaaaaattagca

SEQ ID NO: 372878 - DNA, 20 bp, Artificial
  CRISPR gRNA sequence
aaatgttgactctgttcctt

SEQ ID NO: 372879 - DNA, 20 bp, Artificial
  CRISPR gRNA sequence
tgactctgttccttcagaca

SEQ ID NO: 372880 - DNA, 20 bp, Artificial
  CRISPR gRNA sequence
ttccttcagacacagacaaa

SEQ ID NO: 372881 - DNA, 20 bp, Artificial
  CRISPR gRNA sequence
cctaaaaatcccttgcatta

SEQ ID NO: 372882 - DNA, 20 bp, Artificial
  CRISPR gRNA sequence
aaaaatcccttgcattatgg

SEQ ID NO: 372883 - DNA, 20 bp, Artificial
  CRISPR gRNA sequence
atggaagtattttttgaaac

SEQ ID NO: 372884 - DNA, 20 bp, Artificial
  CRISPR gRNA sequence
aagtattttttgaaactggt

SEQ ID NO: 372885 - DNA, 20 bp, Artificial
  CRISPR gRNA sequence
agtattttttgaaactggtc

SEQ ID NO: 372886 - DNA, 20 bp, Artificial
  CRISPR gRNA sequence
ttttgaaactggtcaggaaa

SEQ ID NO: 372887 - DNA, 20 bp, Artificial
  CRISPR gRNA sequence
aactggtcaggaaaaagaaa

SEQ ID NO: 372888 - DNA, 20 bp, Artificial
  CRISPR gRNA sequence
ggaaaaagaaacagtgaaaa

SEQ ID NO: 372889 - DNA, 20 bp, Artificial
  CRISPR gRNA sequence
aagaaacagtgaaaacagat

SEQ ID NO: 372890 - DNA, 20 bp, Artificial
  CRISPR gRNA sequence
gaaacagtgaaaacagatta

SEQ ID NO: 372891 - DNA, 20 bp, Artificial
  CRISPR gRNA sequence
gtgaaaacagattagagacc

SEQ ID NO: 372892 - DNA, 20 bp, Artificial
  CRISPR gRNA sequence
tgaaaacagattagagacca

SEQ ID NO: 372893 - DNA, 20 bp, Artificial
  CRISPR gRNA sequence
aacagattagagaccaaggc

SEQ ID NO: 372894 - DNA, 20 bp, Artificial
  CRISPR gRNA sequence
caagaaaaaaatgttctatt

SEQ ID NO: 372895 - DNA, 20 bp, Artificial
  CRISPR gRNA sequence
aaaaaatgttctattcagaa

SEQ ID NO: 372896 - DNA, 20 bp, Artificial
  CRISPR gRNA sequence
ctattcagaaaagtgtcata

SEQ ID NO: 372897 - DNA, 20 bp, Artificial
  CRISPR gRNA sequence
aatcattttcaaacacgtat

SEQ ID NO: 372898 - DNA, 20 bp, Artificial
  CRISPR gRNA sequence
ttgcccattatatgctgaaa

SEQ ID NO: 372899 - DNA, 20 bp, Artificial
  CRISPR gRNA sequence
attgtaaacatcttaaatta

SEQ ID NO: 372900 - DNA, 20 bp, Artificial
  CRISPR gRNA sequence
tgtaaacatcttaaattata

SEQ ID NO: 372901 - DNA, 20 bp, Artificial
  CRISPR gRNA sequence
cttaaattatagagaaaatg

SEQ ID NO: 372902 - DNA, 20 bp, Artificial
  CRISPR gRNA sequence
ttaaattatagagaaaatga

SEQ ID NO: 372903 - DNA, 20 bp, Artificial
  CRISPR gRNA sequence
tatagagaaaatgaaggtaa

SEQ ID NO: 372904 - DNA, 20 bp, Artificial
  CRISPR gRNA sequence
aaatgaaggtaacagatttt

SEQ ID NO: 372905 - DNA, 20 bp, Artificial
  CRISPR gRNA sequence
aatgaaggtaacagattttt

SEQ ID NO: 372906 - DNA, 20 bp, Artificial
  CRISPR gRNA sequence
tgaaggtaacagatttttag

SEQ ID NO: 372907 - DNA, 20 bp, Artificial
  CRISPR gRNA sequence
taacagatttttaggagata

SEQ ID NO: 372908 - DNA, 20 bp, Artificial
  CRISPR gRNA sequence
aaatgtcattcatctgtcca

SEQ ID NO: 372909 - DNA, 20 bp, Artificial
  CRISPR gRNA sequence
tcatctgtccaaagatgact

SEQ ID NO: 372910 - DNA, 20 bp, Artificial
  CRISPR gRNA sequence
ctttgtatgtaaattataaa

SEQ ID NO: 372911 - DNA, 20 bp, Artificial
  CRISPR gRNA sequence
caaactctgccaatgaaatg

SEQ ID NO: 372912 - DNA, 20 bp, Artificial
  CRISPR gRNA sequence
atgaagatgactaaatgtaa

SEQ ID NO: 372913 - DNA, 20 bp, Artificial
  CRISPR gRNA sequence
agatgactaaatgtaatggt

SEQ ID NO: 372914 - DNA, 20 bp, Artificial
  CRISPR gRNA sequence
tgactaaatgtaatggtcag

SEQ ID NO: 372915 - DNA, 20 bp, Artificial
  CRISPR gRNA sequence
aatgtaatggtcagtagtgt

SEQ ID NO: 372916 - DNA, 20 bp, Artificial
  CRISPR gRNA sequence
tagtgtccatgtgttttgaa

SEQ ID NO: 372917 - DNA, 20 bp, Artificial
  CRISPR gRNA sequence
gtgttttgaacagttgcaaa

SEQ ID NO: 372918 - DNA, 20 bp, Artificial
  CRISPR gRNA sequence
gcaaatggctttttgacatt

SEQ ID NO: 372919 - DNA, 20 bp, Artificial
  CRISPR gRNA sequence
gctttttgacattcagttga

SEQ ID NO: 372920 - DNA, 20 bp, Artificial
  CRISPR gRNA sequence
acattcagttgacagattga

SEQ ID NO: 372921 - DNA, 20 bp, Artificial
  CRISPR gRNA sequence
cagattgaaagaatgtcaac

SEQ ID NO: 372922 - DNA, 20 bp, Artificial
  CRISPR gRNA sequence
caactggaccttgtatccat

SEQ ID NO: 372923 - DNA, 20 bp, Artificial
  CRISPR gRNA sequence
accttgtatccattagtaaa

SEQ ID NO: 372924 - DNA, 20 bp, Artificial
  CRISPR gRNA sequence
tagtaaaaagttatcattga

SEQ ID NO: 372925 - DNA, 20 bp, Artificial
  CRISPR gRNA sequence
taaaaagttatcattgacag

SEQ ID NO: 372926 - DNA, 20 bp, Artificial
  CRISPR gRNA sequence
ttatcattgacagaagatga

SEQ ID NO: 372927 - DNA, 20 bp, Artificial
  CRISPR gRNA sequence
cagccattgactgtatgttt

SEQ ID NO: 372928 - DNA, 20 bp, Artificial
  CRISPR gRNA sequence
ttccttttttcaatttttat

SEQ ID NO: 372929 - DNA, 20 bp, Artificial
  CRISPR gRNA sequence
ttttcaatttttataagtga

SEQ ID NO: 372930 - DNA, 20 bp, Artificial
  CRISPR gRNA sequence
gaaagattgaatataaaact

SEQ ID NO: 372931 - DNA, 20 bp, Artificial
  CRISPR gRNA sequence
gaatataaaacttagatgca

SEQ ID NO: 372932 - DNA, 20 bp, Artificial
  CRISPR gRNA sequence
aacttagatgcaaagcaaaa

SEQ ID NO: 372933 - DNA, 20 bp, Artificial
  CRISPR gRNA sequence
cagatcatttgtgttttctc

SEQ ID NO: 372934 - DNA, 20 bp, Artificial
  CRISPR gRNA sequence
atttgattatttcacgtctt

SEQ ID NO: 372935 - DNA, 20 bp, Artificial
  CRISPR gRNA sequence
tttgattatttcacgtcttg

SEQ ID NO: 372936 - DNA, 20 bp, Artificial
  CRISPR gRNA sequence
tttcacgtcttgaggctctt

SEQ ID NO: 372937 - DNA, 20 bp, Artificial
  CRISPR gRNA sequence
tctttggtcaaaaatcaatg

SEQ ID NO: 372938 - DNA, 20 bp, Artificial
  CRISPR gRNA sequence
tttggtcaaaaatcaatgtg

SEQ ID NO: 372939 - DNA, 20 bp, Artificial
  CRISPR gRNA sequence
aaaaatcaatgtggagatta

SEQ ID NO: 372940 - DNA, 20 bp, Artificial
  CRISPR gRNA sequence
aatcaatgtggagattaaag

SEQ ID NO: 372941 - DNA, 20 bp, Artificial
  CRISPR gRNA sequence
tcaatgtggagattaaagca

SEQ ID NO: 372942 - DNA, 20 bp, Artificial
  CRISPR gRNA sequence
aatgtggagattaaagcaga

SEQ ID NO: 372943 - DNA, 20 bp, Artificial
  CRISPR gRNA sequence
tggagattaaagcagagaga

SEQ ID NO: 372944 - DNA, 20 bp, Artificial
  CRISPR gRNA sequence
taaagcagagagacagatat

SEQ ID NO: 372945 - DNA, 20 bp, Artificial
  CRISPR gRNA sequence
agagagacagatataagatg

SEQ ID NO: 372946 - DNA, 20 bp, Artificial
  CRISPR gRNA sequence
gagagacagatataagatgt

SEQ ID NO: 372947 - DNA, 20 bp, Artificial
  CRISPR gRNA sequence
gacagatataagatgtggga

SEQ ID NO: 372948 - DNA, 20 bp, Artificial
  CRISPR gRNA sequence
tttaatttatttcaactgcc

SEQ ID NO: 372949 - DNA, 20 bp, Artificial
  CRISPR gRNA sequence
ttaatttatttcaactgcca

SEQ ID NO: 372950 - DNA, 20 bp, Artificial
  CRISPR gRNA sequence
taatttatttcaactgccaa

SEQ ID NO: 372951 - DNA, 20 bp, Artificial
  CRISPR gRNA sequence
ttatttcaactgccaaggga

SEQ ID NO: 372952 - DNA, 20 bp, Artificial
  CRISPR gRNA sequence
tatttcaactgccaagggaa

SEQ ID NO: 372953 - DNA, 20 bp, Artificial
  CRISPR gRNA sequence
tgccaagggaaaggtgattg

SEQ ID NO: 372954 - DNA, 20 bp, Artificial
  CRISPR gRNA sequence
caagggaaaggtgattgtgg

SEQ ID NO: 372955 - DNA, 20 bp, Artificial
  CRISPR gRNA sequence
attgctgtacatacttttgt

SEQ ID NO: 372956 - DNA, 20 bp, Artificial
  CRISPR gRNA sequence
gttctcaatgacttctttta

SEQ ID NO: 372957 - DNA, 20 bp, Artificial
  CRISPR gRNA sequence
atgacttcttttatagcaca

SEQ ID NO: 372958 - DNA, 20 bp, Artificial
  CRISPR gRNA sequence
tcttttatagcacatagtat

SEQ ID NO: 372959 - DNA, 20 bp, Artificial
  CRISPR gRNA sequence
gcacatagtattggatctaa

SEQ ID NO: 372960 - DNA, 20 bp, Artificial
  CRISPR gRNA sequence
acatagtattggatctaaaa

SEQ ID NO: 372961 - DNA, 20 bp, Artificial
  CRISPR gRNA sequence
atagtattggatctaaaaga

SEQ ID NO: 372962 - DNA, 20 bp, Artificial
  CRISPR gRNA sequence
ggatctaaaagagagatttt

SEQ ID NO: 372963 - DNA, 20 bp, Artificial
  CRISPR gRNA sequence
gatctaaaagagagattttt

SEQ ID NO: 372964 - DNA, 20 bp, Artificial
  CRISPR gRNA sequence
cacacacacacatgcacaca

SEQ ID NO: 372965 - DNA, 20 bp, Artificial
  CRISPR gRNA sequence
cacacatgcacacacagaca

SEQ ID NO: 372966 - DNA, 20 bp, Artificial
  CRISPR gRNA sequence
cacagacacggacacacaca

SEQ ID NO: 372967 - DNA, 20 bp, Artificial
  CRISPR gRNA sequence
cagacacggacacacacaca

SEQ ID NO: 372968 - DNA, 20 bp, Artificial
  CRISPR gRNA sequence
gacacggacacacacacaga

SEQ ID NO: 372969 - DNA, 20 bp, Artificial
  CRISPR gRNA sequence
acacggacacacacacagag

SEQ ID NO: 372970 - DNA, 20 bp, Artificial
  CRISPR gRNA sequence
cacggacacacacacagaga

SEQ ID NO: 372971 - DNA, 20 bp, Artificial
  CRISPR gRNA sequence
acggacacacacacagagag

SEQ ID NO: 372972 - DNA, 20 bp, Artificial
  CRISPR gRNA sequence
tacctgcctgcattcatctt

SEQ ID NO: 372973 - DNA, 20 bp, Artificial
  CRISPR gRNA sequence
gcctgcattcatcttcagac

SEQ ID NO: 372974 - DNA, 20 bp, Artificial
  CRISPR gRNA sequence
attcatcttcagacaagtac

SEQ ID NO: 372975 - DNA, 20 bp, Artificial
  CRISPR gRNA sequence
ttcatcttcagacaagtacc

SEQ ID NO: 372976 - DNA, 20 bp, Artificial
  CRISPR gRNA sequence
acaagtaccaggtcactcaa

SEQ ID NO: 372977 - DNA, 20 bp, Artificial
  CRISPR gRNA sequence
aagtaccaggtcactcaaca

SEQ ID NO: 372978 - DNA, 20 bp, Artificial
  CRISPR gRNA sequence
agtaccaggtcactcaacag

SEQ ID NO: 372979 - DNA, 20 bp, Artificial
  CRISPR gRNA sequence
aacagaggacccctgccaac

SEQ ID NO: 372980 - DNA, 20 bp, Artificial
  CRISPR gRNA sequence
agaggacccctgccaaccag

SEQ ID NO: 372981 - DNA, 20 bp, Artificial
  CRISPR gRNA sequence
gaggacccctgccaaccagc

SEQ ID NO: 372982 - DNA, 20 bp, Artificial
  CRISPR gRNA sequence
cccctgccaaccagcaggtc

SEQ ID NO: 372983 - DNA, 20 bp, Artificial
  CRISPR gRNA sequence
caaccagcaggtcaagtatc

SEQ ID NO: 372984 - DNA, 20 bp, Artificial
  CRISPR gRNA sequence
aaccagcaggtcaagtatcc

SEQ ID NO: 372985 - DNA, 20 bp, Artificial
  CRISPR gRNA sequence
tcaagtatccaggccttgat

SEQ ID NO: 372986 - DNA, 20 bp, Artificial
  CRISPR gRNA sequence
aggccttgattggttttgaa

SEQ ID NO: 372987 - DNA, 20 bp, Artificial
  CRISPR gRNA sequence
gccttgattggttttgaaca

SEQ ID NO: 372988 - DNA, 20 bp, Artificial
  CRISPR gRNA sequence
ccttgattggttttgaacag

SEQ ID NO: 372989 - DNA, 20 bp, Artificial
  CRISPR gRNA sequence
ttgattggttttgaacagag

SEQ ID NO: 372990 - DNA, 20 bp, Artificial
  CRISPR gRNA sequence
gttttgaacagaggagaaaa

SEQ ID NO: 372991 - DNA, 20 bp, Artificial
  CRISPR gRNA sequence
ttgaacagaggagaaaatgg

SEQ ID NO: 372992 - DNA, 20 bp, Artificial
  CRISPR gRNA sequence
aacagaggagaaaatggcag

SEQ ID NO: 372993 - DNA, 20 bp, Artificial
  CRISPR gRNA sequence
gaggagaaaatggcagaagc

SEQ ID NO: 372994 - DNA, 20 bp, Artificial
  CRISPR gRNA sequence
taccactgactttctttgct

SEQ ID NO: 372995 - DNA, 20 bp, Artificial
  CRISPR gRNA sequence
gactttctttgctgagtgaa

SEQ ID NO: 372996 - DNA, 20 bp, Artificial
  CRISPR gRNA sequence
tgcacttatgtcctgaaatg

SEQ ID NO: 372997 - DNA, 20 bp, Artificial
  CRISPR gRNA sequence
aatgtagaatgaaataattc

SEQ ID NO: 372998 - DNA, 20 bp, Artificial
  CRISPR gRNA sequence
ttctgaatttgaaacttgcc

SEQ ID NO: 372999 - DNA, 20 bp, Artificial
  CRISPR gRNA sequence
tttgaaacttgcctggaccg

SEQ ID NO: 373000 - DNA, 20 bp, Artificial
  CRISPR gRNA sequence
ttgaaacttgcctggaccga

SEQ ID NO: 373001 - DNA, 20 bp, Artificial
  CRISPR gRNA sequence
tgaaacttgcctggaccgaa

SEQ ID NO: 373002 - DNA, 20 bp, Artificial
  CRISPR gRNA sequence
acttgcctggaccgaagggc

SEQ ID NO: 373003 - DNA, 20 bp, Artificial
  CRISPR gRNA sequence
cttgcctggaccgaagggca

SEQ ID NO: 373004 - DNA, 20 bp, Artificial
  CRISPR gRNA sequence
cctggaccgaagggcaagga

SEQ ID NO: 373005 - DNA, 20 bp, Artificial
  CRISPR gRNA sequence
ggaccgaagggcaaggaaag

SEQ ID NO: 373006 - DNA, 20 bp, Artificial
  CRISPR gRNA sequence
gaccgaagggcaaggaaagt

SEQ ID NO: 373007 - DNA, 20 bp, Artificial
  CRISPR gRNA sequence
accgaagggcaaggaaagtg

SEQ ID NO: 373008 - DNA, 20 bp, Artificial
  CRISPR gRNA sequence
aagggcaaggaaagtgggga

SEQ ID NO: 373009 - DNA, 20 bp, Artificial
  CRISPR gRNA sequence
agggcaaggaaagtggggac

SEQ ID NO: 373010 - DNA, 20 bp, Artificial
  CRISPR gRNA sequence
gggcaaggaaagtggggacg

SEQ ID NO: 373011 - DNA, 20 bp, Artificial
  CRISPR gRNA sequence
ggcaaggaaagtggggacgg

SEQ ID NO: 373012 - DNA, 20 bp, Artificial
  CRISPR gRNA sequence
gcaaggaaagtggggacggg

SEQ ID NO: 373013 - DNA, 20 bp, Artificial
  CRISPR gRNA sequence
aaggaaagtggggacggggg

SEQ ID NO: 373014 - DNA, 20 bp, Artificial
  CRISPR gRNA sequence
aagtggggacggggggagca

SEQ ID NO: 373015 - DNA, 20 bp, Artificial
  CRISPR gRNA sequence
agtggggacggggggagcac

SEQ ID NO: 373016 - DNA, 20 bp, Artificial
  CRISPR gRNA sequence
gtggggacggggggagcaca

SEQ ID NO: 373017 - DNA, 20 bp, Artificial
  CRISPR gRNA sequence
tggggacggggggagcacag

SEQ ID NO: 373018 - DNA, 20 bp, Artificial
  CRISPR gRNA sequence
ggggaatgtctgtttattga

SEQ ID NO: 373019 - DNA, 20 bp, Artificial
  CRISPR gRNA sequence
ctgtttattgacagtgacta

SEQ ID NO: 373020 - DNA, 20 bp, Artificial
  CRISPR gRNA sequence
acagtgactacagttatttt

SEQ ID NO: 373021 - DNA, 20 bp, Artificial
  CRISPR gRNA sequence
ttttggcccttaacatcctc

SEQ ID NO: 373022 - DNA, 20 bp, Artificial
  CRISPR gRNA sequence
tctggattttcatttgtcat

SEQ ID NO: 373023 - DNA, 20 bp, Artificial
  CRISPR gRNA sequence
tggattttcatttgtcataa

SEQ ID NO: 373024 - DNA, 20 bp, Artificial
  CRISPR gRNA sequence
attttcatttgtcataagag

SEQ ID NO: 373025 - DNA, 20 bp, Artificial
  CRISPR gRNA sequence
ttgtcataagagaagtattt

SEQ ID NO: 373026 - DNA, 20 bp, Artificial
  CRISPR gRNA sequence
tgtcataagagaagtatttt

SEQ ID NO: 373027 - DNA, 20 bp, Artificial
  CRISPR gRNA sequence
tttgtcaaatattttaatat

SEQ ID NO: 373028 - DNA, 20 bp, Artificial
  CRISPR gRNA sequence
aatattagctaaatgatttg

SEQ ID NO: 373029 - DNA, 20 bp, Artificial
  CRISPR gRNA sequence
attgtttaaactgaccttat

SEQ ID NO: 373030 - DNA, 20 bp, Artificial
  CRISPR gRNA sequence
ctgaccttattggctataaa

SEQ ID NO: 373031 - DNA, 20 bp, Artificial
  CRISPR gRNA sequence
tattggctataaaaagaatg

SEQ ID NO: 373032 - DNA, 20 bp, Artificial
  CRISPR gRNA sequence
attggctataaaaagaatga

SEQ ID NO: 373033 - DNA, 20 bp, Artificial
  CRISPR gRNA sequence
tataaaaagaatgaaggcaa

SEQ ID NO: 373034 - DNA, 20 bp, Artificial
  CRISPR gRNA sequence
gaaggcaaaagaaataaaat

SEQ ID NO: 373035 - DNA, 20 bp, Artificial
  CRISPR gRNA sequence
agaaataaaatcagctcttg

SEQ ID NO: 373036 - DNA, 20 bp, Artificial
  CRISPR gRNA sequence
ataaaatcagctcttgcaga

SEQ ID NO: 373037 - DNA, 20 bp, Artificial
  CRISPR gRNA sequence
cagctcttgcagaaagtttc

SEQ ID NO: 373038 - DNA, 20 bp, Artificial
  CRISPR gRNA sequence
gctcttgcagaaagtttctg

SEQ ID NO: 373039 - DNA, 20 bp, Artificial
  CRISPR gRNA sequence
ctcttgcagaaagtttctgg

SEQ ID NO: 373040 - DNA, 20 bp, Artificial
  CRISPR gRNA sequence
cttgcagaaagtttctggag

SEQ ID NO: 373041 - DNA, 20 bp, Artificial
  CRISPR gRNA sequence
ttgcagaaagtttctggagg

SEQ ID NO: 373042 - DNA, 20 bp, Artificial
  CRISPR gRNA sequence
aacttctgtttgctattgat

SEQ ID NO: 373043 - DNA, 20 bp, Artificial
  CRISPR gRNA sequence
cttgtataatcgtcttccac

SEQ ID NO: 373044 - DNA, 20 bp, Artificial
  CRISPR gRNA sequence
tataatcgtcttccaccagt

SEQ ID NO: 373045 - DNA, 20 bp, Artificial
  CRISPR gRNA sequence
cttccaccagtgagaccact

SEQ ID NO: 373046 - DNA, 20 bp, Artificial
  CRISPR gRNA sequence
ttccaccagtgagaccactc

SEQ ID NO: 373047 - DNA, 20 bp, Artificial
  CRISPR gRNA sequence
caccagtgagaccactcagg

SEQ ID NO: 373048 - DNA, 20 bp, Artificial
  CRISPR gRNA sequence
accagtgagaccactcaggc

SEQ ID NO: 373049 - DNA, 20 bp, Artificial
  CRISPR gRNA sequence
accactcaggcgggaccatc

SEQ ID NO: 373050 - DNA, 20 bp, Artificial
  CRISPR gRNA sequence
ccactcaggcgggaccatca

SEQ ID NO: 373051 - DNA, 20 bp, Artificial
  CRISPR gRNA sequence
gggaccatcaaggttcaaat

SEQ ID NO: 373052 - DNA, 20 bp, Artificial
  CRISPR gRNA sequence
ggaccatcaaggttcaaatg

SEQ ID NO: 373053 - DNA, 20 bp, Artificial
  CRISPR gRNA sequence
tcaaatgaggcattgatgat

SEQ ID NO: 373054 - DNA, 20 bp, Artificial
  CRISPR gRNA sequence
aaatgaggcattgatgatta

SEQ ID NO: 373055 - DNA, 20 bp, Artificial
  CRISPR gRNA sequence
aggcattgatgattagagct

SEQ ID NO: 373056 - DNA, 20 bp, Artificial
  CRISPR gRNA sequence
ggcattgatgattagagctg

SEQ ID NO: 373057 - DNA, 20 bp, Artificial
  CRISPR gRNA sequence
agctgaggaatgacatgaaa

SEQ ID NO: 373058 - DNA, 20 bp, Artificial
  CRISPR gRNA sequence
gctgaggaatgacatgaaac

SEQ ID NO: 373059 - DNA, 20 bp, Artificial
  CRISPR gRNA sequence
atgacatgaaacaggttatg

SEQ ID NO: 373060 - DNA, 20 bp, Artificial
  CRISPR gRNA sequence
gacatgaaacaggttatgaa

SEQ ID NO: 373061 - DNA, 20 bp, Artificial
  CRISPR gRNA sequence
gaagagtaaccccaaatatg

SEQ ID NO: 373062 - DNA, 20 bp, Artificial
  CRISPR gRNA sequence
aagagtaaccccaaatatgc

SEQ ID NO: 373063 - DNA, 20 bp, Artificial
  CRISPR gRNA sequence
gagtaaccccaaatatgcag

SEQ ID NO: 373064 - DNA, 20 bp, Artificial
  CRISPR gRNA sequence
agtaaccccaaatatgcagg

SEQ ID NO: 373065 - DNA, 20 bp, Artificial
  CRISPR gRNA sequence
ccccaaatatgcaggaggaa

SEQ ID NO: 373066 - DNA, 20 bp, Artificial
  CRISPR gRNA sequence
cccaaatatgcaggaggaat

SEQ ID NO: 373067 - DNA, 20 bp, Artificial
  CRISPR gRNA sequence
ccaaatatgcaggaggaatg

SEQ ID NO: 373068 - DNA, 20 bp, Artificial
  CRISPR gRNA sequence
aaatatgcaggaggaatggg

SEQ ID NO: 373069 - DNA, 20 bp, Artificial
  CRISPR gRNA sequence
atgcaggaggaatggggaga

SEQ ID NO: 373070 - DNA, 20 bp, Artificial
  CRISPR gRNA sequence
aggaatggggagatggtgca

SEQ ID NO: 373071 - DNA, 20 bp, Artificial
  CRISPR gRNA sequence
ggaatggggagatggtgcat

SEQ ID NO: 373072 - DNA, 20 bp, Artificial
  CRISPR gRNA sequence
aatggggagatggtgcatgg

SEQ ID NO: 373073 - DNA, 20 bp, Artificial
  CRISPR gRNA sequence
agatggtgcatgggagactg

SEQ ID NO: 373074 - DNA, 20 bp, Artificial
  CRISPR gRNA sequence
ggagactgtagtcaaatgac

SEQ ID NO: 373075 - DNA, 20 bp, Artificial
  CRISPR gRNA sequence
gagactgtagtcaaatgact

SEQ ID NO: 373076 - DNA, 20 bp, Artificial
  CRISPR gRNA sequence
ctgtagtcaaatgactaggt

SEQ ID NO: 373077 - DNA, 20 bp, Artificial
  CRISPR gRNA sequence
gtcaaatgactaggttggta

SEQ ID NO: 373078 - DNA, 20 bp, Artificial
  CRISPR gRNA sequence
caaatgactaggttggtatg

SEQ ID NO: 373079 - DNA, 20 bp, Artificial
  CRISPR gRNA sequence
aatgactaggttggtatgga

SEQ ID NO: 373080 - DNA, 20 bp, Artificial
  CRISPR gRNA sequence
taggttggtatggagagtct

SEQ ID NO: 373081 - DNA, 20 bp, Artificial
  CRISPR gRNA sequence
gtctaagttatgtattaata

SEQ ID NO: 373082 - DNA, 20 bp, Artificial
  CRISPR gRNA sequence
tctaagttatgtattaatat

SEQ ID NO: 373083 - DNA, 20 bp, Artificial
  CRISPR gRNA sequence
gttatgtattaatatgggac

SEQ ID NO: 373084 - DNA, 20 bp, Artificial
  CRISPR gRNA sequence
ttatgtattaatatgggacg

SEQ ID NO: 373085 - DNA, 20 bp, Artificial
  CRISPR gRNA sequence
tgtattaatatgggacgagg

SEQ ID NO: 373086 - DNA, 20 bp, Artificial
  CRISPR gRNA sequence
gtattaatatgggacgaggt

SEQ ID NO: 373087 - DNA, 20 bp, Artificial
  CRISPR gRNA sequence
gggacgaggtaggttaaatt

SEQ ID NO: 373088 - DNA, 20 bp, Artificial
  CRISPR gRNA sequence
taggttaaattaagtgatga

SEQ ID NO: 373089 - DNA, 20 bp, Artificial
  CRISPR gRNA sequence
ctgcatctcatataattgtc

SEQ ID NO: 373090 - DNA, 20 bp, Artificial
  CRISPR gRNA sequence
tctcatataattgtcaagca

SEQ ID NO: 373091 - DNA, 20 bp, Artificial
  CRISPR gRNA sequence
ttgtcaagcaaagctaccat

SEQ ID NO: 373092 - DNA, 20 bp, Artificial
  CRISPR gRNA sequence
caaagctaccattagttctt

SEQ ID NO: 373093 - DNA, 20 bp, Artificial
  CRISPR gRNA sequence
ctaccattagttcttgagca

SEQ ID NO: 373094 - DNA, 20 bp, Artificial
  CRISPR gRNA sequence
cattagttcttgagcaaaga

SEQ ID NO: 373095 - DNA, 20 bp, Artificial
  CRISPR gRNA sequence
tggcaaaacaataatcatga

SEQ ID NO: 373096 - DNA, 20 bp, Artificial
  CRISPR gRNA sequence
aacaataatcatgaaagaat

SEQ ID NO: 373097 - DNA, 20 bp, Artificial
  CRISPR gRNA sequence
ataagttgctatatgatttt

SEQ ID NO: 373098 - DNA, 20 bp, Artificial
  CRISPR gRNA sequence
ctatatgattttcagtgtgc

SEQ ID NO: 373099 - DNA, 20 bp, Artificial
  CRISPR gRNA sequence
gtgcaagtctttaacatttt

SEQ ID NO: 373100 - DNA, 20 bp, Artificial
  CRISPR gRNA sequence
agtctttaacatttttggtt

SEQ ID NO: 373101 - DNA, 20 bp, Artificial
  CRISPR gRNA sequence
tttattccttttattgttat

SEQ ID NO: 373102 - DNA, 20 bp, Artificial
  CRISPR gRNA sequence
ttattccttttattgttatt

SEQ ID NO: 373103 - DNA, 20 bp, Artificial
  CRISPR gRNA sequence
tattccttttattgttattg

SEQ ID NO: 373104 - DNA, 20 bp, Artificial
  CRISPR gRNA sequence
ccttttattgttattgggga

SEQ ID NO: 373105 - DNA, 20 bp, Artificial
  CRISPR gRNA sequence
cttttattgttattggggat

SEQ ID NO: 373106 - DNA, 20 bp, Artificial
  CRISPR gRNA sequence
ttttgttttaattccttttt

SEQ ID NO: 373107 - DNA, 20 bp, Artificial
  CRISPR gRNA sequence
gttttaattccttttttgga

SEQ ID NO: 373108 - DNA, 20 bp, Artificial
  CRISPR gRNA sequence
gatagtttgctgtttgtgta

SEQ ID NO: 373109 - DNA, 20 bp, Artificial
  CRISPR gRNA sequence
tcttaactgaattcatttat

SEQ ID NO: 373110 - DNA, 20 bp, Artificial
  CRISPR gRNA sequence
aattcatttattagtttgaa

SEQ ID NO: 373111 - DNA, 20 bp, Artificial
  CRISPR gRNA sequence
attcatttattagtttgaac

SEQ ID NO: 373112 - DNA, 20 bp, Artificial
  CRISPR gRNA sequence
agtttgaacaggtttttttg

SEQ ID NO: 373113 - DNA, 20 bp, Artificial
  CRISPR gRNA sequence
aggtttttttgtggcacttt

SEQ ID NO: 373114 - DNA, 20 bp, Artificial
  CRISPR gRNA sequence
ggtttttttgtggcactttt

SEQ ID NO: 373115 - DNA, 20 bp, Artificial
  CRISPR gRNA sequence
gtttttttgtggcactttta

SEQ ID NO: 373116 - DNA, 20 bp, Artificial
  CRISPR gRNA sequence
tacatatatgattatgtcat

SEQ ID NO: 373117 - DNA, 20 bp, Artificial
  CRISPR gRNA sequence
atgattatgtcatcggcaaa

SEQ ID NO: 373118 - DNA, 20 bp, Artificial
  CRISPR gRNA sequence
gattatgtcatcggcaaaca

SEQ ID NO: 373119 - DNA, 20 bp, Artificial
  CRISPR gRNA sequence
gttttctttttcttgtttaa

SEQ ID NO: 373120 - DNA, 20 bp, Artificial
  CRISPR gRNA sequence
cttgtttaatggctctgatt

SEQ ID NO: 373121 - DNA, 20 bp, Artificial
  CRISPR gRNA sequence
aagacttcttgtactatgtt

SEQ ID NO: 373122 - DNA, 20 bp, Artificial
  CRISPR gRNA sequence
acttcttgtactatgttaag

SEQ ID NO: 373123 - DNA, 20 bp, Artificial
  CRISPR gRNA sequence
ttcttgtactatgttaagca

SEQ ID NO: 373124 - DNA, 20 bp, Artificial
  CRISPR gRNA sequence
tcttgtactatgttaagcag

SEQ ID NO: 373125 - DNA, 20 bp, Artificial
  CRISPR gRNA sequence
atgttaagcagaggtgttga

SEQ ID NO: 373126 - DNA, 20 bp, Artificial
  CRISPR gRNA sequence
ttaagcagaggtgttgaaag

SEQ ID NO: 373127 - DNA, 20 bp, Artificial
  CRISPR gRNA sequence
ctttgtctttttcctgatct

SEQ ID NO: 373128 - DNA, 20 bp, Artificial
  CRISPR gRNA sequence
ttgtctttttcctgatctta

SEQ ID NO: 373129 - DNA, 20 bp, Artificial
  CRISPR gRNA sequence
ttttcctgatcttagagcaa

SEQ ID NO: 373130 - DNA, 20 bp, Artificial
  CRISPR gRNA sequence
gatcttagagcaaaagttct

SEQ ID NO: 373131 - DNA, 20 bp, Artificial
  CRISPR gRNA sequence
gttctcagtcttacatgact

SEQ ID NO: 373132 - DNA, 20 bp, Artificial
  CRISPR gRNA sequence
tacatgacttggtatgatgt

SEQ ID NO: 373133 - DNA, 20 bp, Artificial
  CRISPR gRNA sequence
acttggtatgatgttagctg

SEQ ID NO: 373134 - DNA, 20 bp, Artificial
  CRISPR gRNA sequence
cttggtatgatgttagctgt

SEQ ID NO: 373135 - DNA, 20 bp, Artificial
  CRISPR gRNA sequence
tgttagctgtgggcttttca

SEQ ID NO: 373136 - DNA, 20 bp, Artificial
  CRISPR gRNA sequence
agctgtgggcttttcataga

SEQ ID NO: 373137 - DNA, 20 bp, Artificial
  CRISPR gRNA sequence
atagatggcctttattgtgt

SEQ ID NO: 373138 - DNA, 20 bp, Artificial
  CRISPR gRNA sequence
tagatggcctttattgtgtt

SEQ ID NO: 373139 - DNA, 20 bp, Artificial
  CRISPR gRNA sequence
agatggcctttattgtgttg

SEQ ID NO: 373140 - DNA, 20 bp, Artificial
  CRISPR gRNA sequence
ctttctgtacctaatttgtt

SEQ ID NO: 373141 - DNA, 20 bp, Artificial
  CRISPR gRNA sequence
ttctgtacctaatttgttga

SEQ ID NO: 373142 - DNA, 20 bp, Artificial
  CRISPR gRNA sequence
ttttttttttttaatcacac

SEQ ID NO: 373143 - DNA, 20 bp, Artificial
  CRISPR gRNA sequence
tttttttttttaatcacaca

SEQ ID NO: 373144 - DNA, 20 bp, Artificial
  CRISPR gRNA sequence
gctctattttgatgatcatg

SEQ ID NO: 373145 - DNA, 20 bp, Artificial
  CRISPR gRNA sequence
tttatatcactttgttaatg

SEQ ID NO: 373146 - DNA, 20 bp, Artificial
  CRISPR gRNA sequence
gttgaaccatctttgcatgc

SEQ ID NO: 373147 - DNA, 20 bp, Artificial
  CRISPR gRNA sequence
ttgaaccatctttgcatgcc

SEQ ID NO: 373148 - DNA, 20 bp, Artificial
  CRISPR gRNA sequence
tgaaccatctttgcatgcca

SEQ ID NO: 373149 - DNA, 20 bp, Artificial
  CRISPR gRNA sequence
tttgcatgccagggataaat

SEQ ID NO: 373150 - DNA, 20 bp, Artificial
  CRISPR gRNA sequence
agggataaatcagaattgat

SEQ ID NO: 373151 - DNA, 20 bp, Artificial
  CRISPR gRNA sequence
atacaatccatttaatgtga

SEQ ID NO: 373152 - DNA, 20 bp, Artificial
  CRISPR gRNA sequence
atttaatgtgatggtgaatt

SEQ ID NO: 373153 - DNA, 20 bp, Artificial
  CRISPR gRNA sequence
tgatggtgaatttagtttgc

SEQ ID NO: 373154 - DNA, 20 bp, Artificial
  CRISPR gRNA sequence
tagtttgctagtattttgtt

SEQ ID NO: 373155 - DNA, 20 bp, Artificial
  CRISPR gRNA sequence
agtttgctagtattttgttg

SEQ ID NO: 373156 - DNA, 20 bp, Artificial
  CRISPR gRNA sequence
attttttcatctgtgttcat

SEQ ID NO: 373157 - DNA, 20 bp, Artificial
  CRISPR gRNA sequence
ttttttcatctgtgttcatt

SEQ ID NO: 373158 - DNA, 20 bp, Artificial
  CRISPR gRNA sequence
tttttcatctgtgttcatta

SEQ ID NO: 373159 - DNA, 20 bp, Artificial
  CRISPR gRNA sequence
tctgtgttcattagggatgt

SEQ ID NO: 373160 - DNA, 20 bp, Artificial
  CRISPR gRNA sequence
tcattagggatgtcagcctg

SEQ ID NO: 373161 - DNA, 20 bp, Artificial
  CRISPR gRNA sequence
cattagggatgtcagcctgt

SEQ ID NO: 373162 - DNA, 20 bp, Artificial
  CRISPR gRNA sequence
aggttttttttttttttttg

SEQ ID NO: 373163 - DNA, 20 bp, Artificial
  CRISPR gRNA sequence
ttttttgtggtgtctttgtc

SEQ ID NO: 373164 - DNA, 20 bp, Artificial
  CRISPR gRNA sequence
gtggtgtctttgtctggttt

SEQ ID NO: 373165 - DNA, 20 bp, Artificial
  CRISPR gRNA sequence
tctttgtctggttttggtat

SEQ ID NO: 373166 - DNA, 20 bp, Artificial
  CRISPR gRNA sequence
ctttgtctggttttggtatc

SEQ ID NO: 373167 - DNA, 20 bp, Artificial
  CRISPR gRNA sequence
tttgtctggttttggtatca

SEQ ID NO: 373168 - DNA, 20 bp, Artificial
  CRISPR gRNA sequence
ttttggtatcagggtgatgc

SEQ ID NO: 373169 - DNA, 20 bp, Artificial
  CRISPR gRNA sequence
tgatgctggtctcataaact

SEQ ID NO: 373170 - DNA, 20 bp, Artificial
  CRISPR gRNA sequence
ctggtctcataaactgagtt

SEQ ID NO: 373171 - DNA, 20 bp, Artificial
  CRISPR gRNA sequence
aactgcttctttttttaaaa

SEQ ID NO: 373172 - DNA, 20 bp, Artificial
  CRISPR gRNA sequence
attgattacacatgataatg

SEQ ID NO: 373173 - DNA, 20 bp, Artificial
  CRISPR gRNA sequence
tgtagaactgtttctaaact

SEQ ID NO: 373174 - DNA, 20 bp, Artificial
  CRISPR gRNA sequence
gtagaactgtttctaaactc

SEQ ID NO: 373175 - DNA, 20 bp, Artificial
  CRISPR gRNA sequence
actgtttctaaactcaggat

SEQ ID NO: 373176 - DNA, 20 bp, Artificial
  CRISPR gRNA sequence
tcaggattggcattaattcc

SEQ ID NO: 373177 - DNA, 20 bp, Artificial
  CRISPR gRNA sequence
ttaattcctagaatgtttga

SEQ ID NO: 373178 - DNA, 20 bp, Artificial
  CRISPR gRNA sequence
tttgatagaattcatctgtg

SEQ ID NO: 373179 - DNA, 20 bp, Artificial
  CRISPR gRNA sequence
aattcatctgtgaagccacc

SEQ ID NO: 373180 - DNA, 20 bp, Artificial
  CRISPR gRNA sequence
tctgtgaagccacctggtcc

SEQ ID NO: 373181 - DNA, 20 bp, Artificial
  CRISPR gRNA sequence
ctgtgaagccacctggtcct

SEQ ID NO: 373182 - DNA, 20 bp, Artificial
  CRISPR gRNA sequence
aagccacctggtcctgggat

SEQ ID NO: 373183 - DNA, 20 bp, Artificial
  CRISPR gRNA sequence
cctggtcctgggatcagtga

SEQ ID NO: 373184 - DNA, 20 bp, Artificial
  CRISPR gRNA sequence
ctggtcctgggatcagtgat

SEQ ID NO: 373185 - DNA, 20 bp, Artificial
  CRISPR gRNA sequence
ctgggatcagtgatgggtca

SEQ ID NO: 373186 - DNA, 20 bp, Artificial
  CRISPR gRNA sequence
tgggatcagtgatgggtcat

SEQ ID NO: 373187 - DNA, 20 bp, Artificial
  CRISPR gRNA sequence
cactgatccacctacctttg

SEQ ID NO: 373188 - DNA, 20 bp, Artificial
  CRISPR gRNA sequence
actgatccacctacctttgt

SEQ ID NO: 373189 - DNA, 20 bp, Artificial
  CRISPR gRNA sequence
cacctacctttgtaggcaca

SEQ ID NO: 373190 - DNA, 20 bp, Artificial
  CRISPR gRNA sequence
acctacctttgtaggcacaa

SEQ ID NO: 373191 - DNA, 20 bp, Artificial
  CRISPR gRNA sequence
aggcacaaaggtgtcctaca

SEQ ID NO: 373192 - DNA, 20 bp, Artificial
  CRISPR gRNA sequence
ggcacaaaggtgtcctacac

SEQ ID NO: 373193 - DNA, 20 bp, Artificial
  CRISPR gRNA sequence
gcacaaaggtgtcctacaca

SEQ ID NO: 373194 - DNA, 20 bp, Artificial
  CRISPR gRNA sequence
caaaggtgtcctacacaggg

SEQ ID NO: 373195 - DNA, 20 bp, Artificial
  CRISPR gRNA sequence
aaggtgtcctacacagggta

SEQ ID NO: 373196 - DNA, 20 bp, Artificial
  CRISPR gRNA sequence
ggtgtcctacacagggtaga

SEQ ID NO: 373197 - DNA, 20 bp, Artificial
  CRISPR gRNA sequence
acagggtagagagatactgt

SEQ ID NO: 373198 - DNA, 20 bp, Artificial
  CRISPR gRNA sequence
tgtcagcatgatttgaatct

SEQ ID NO: 373199 - DNA, 20 bp, Artificial
  CRISPR gRNA sequence
tctcctttttctaactgact

SEQ ID NO: 373200 - DNA, 20 bp, Artificial
  CRISPR gRNA sequence
cacatttgctttctttccta

SEQ ID NO: 373201 - DNA, 20 bp, Artificial
  CRISPR gRNA sequence
catttgctttctttcctata

SEQ ID NO: 373202 - DNA, 20 bp, Artificial
  CRISPR gRNA sequence
ctttctttcctatagagttt

SEQ ID NO: 373203 - DNA, 20 bp, Artificial
  CRISPR gRNA sequence
gtctatgtttttttccacat

SEQ ID NO: 373204 - DNA, 20 bp, Artificial
  CRISPR gRNA sequence
ttccccatcattgaaatatt

SEQ ID NO: 373205 - DNA, 20 bp, Artificial
  CRISPR gRNA sequence
cattgaaatattaagcatct

SEQ ID NO: 373206 - DNA, 20 bp, Artificial
  CRISPR gRNA sequence
ttggatttctcaaactttta

SEQ ID NO: 373207 - DNA, 20 bp, Artificial
  CRISPR gRNA sequence
gtctgaaaattgctaccctc

SEQ ID NO: 373208 - DNA, 20 bp, Artificial
  CRISPR gRNA sequence
tatttatttatttatttttt

SEQ ID NO: 373209 - DNA, 20 bp, Artificial
  CRISPR gRNA sequence
atttatttattttttgagac

SEQ ID NO: 373210 - DNA, 20 bp, Artificial
  CRISPR gRNA sequence
tttatttattttttgagacc

SEQ ID NO: 373211 - DNA, 20 bp, Artificial
  CRISPR gRNA sequence
attttttgagaccgggttat

SEQ ID NO: 373212 - DNA, 20 bp, Artificial
  CRISPR gRNA sequence
ttgagaccgggttatgagac

SEQ ID NO: 373213 - DNA, 20 bp, Artificial
  CRISPR gRNA sequence
ctggctaatttttgtatttt

SEQ ID NO: 373214 - DNA, 20 bp, Artificial
  CRISPR gRNA sequence
gctaatttttgtatttttgg

SEQ ID NO: 373215 - DNA, 20 bp, Artificial
  CRISPR gRNA sequence
taatttttgtatttttggta

SEQ ID NO: 373216 - DNA, 20 bp, Artificial
  CRISPR gRNA sequence
ttttgtatttttggtagaga

SEQ ID NO: 373217 - DNA, 20 bp, Artificial
  CRISPR gRNA sequence
tttgtatttttggtagagat

SEQ ID NO: 373218 - DNA, 20 bp, Artificial
  CRISPR gRNA sequence
ttgtatttttggtagagatg

SEQ ID NO: 373219 - DNA, 20 bp, Artificial
  CRISPR gRNA sequence
tttggtagagatggggtttc

SEQ ID NO: 373220 - DNA, 20 bp, Artificial
  CRISPR gRNA sequence
ttggtagagatggggtttca

SEQ ID NO: 373221 - DNA, 20 bp, Artificial
  CRISPR gRNA sequence
tagagatggggtttcaagga

SEQ ID NO: 373222 - DNA, 20 bp, Artificial
  CRISPR gRNA sequence
tggggtttcaaggatggtcc

SEQ ID NO: 373223 - DNA, 20 bp, Artificial
  CRISPR gRNA sequence
ggggtttcaaggatggtcct

SEQ ID NO: 373224 - DNA, 20 bp, Artificial
  CRISPR gRNA sequence
tcaaggatggtcctgggctc

SEQ ID NO: 373225 - DNA, 20 bp, Artificial
  CRISPR gRNA sequence
gctcaagcaatcccctgcct

SEQ ID NO: 373226 - DNA, 20 bp, Artificial
  CRISPR gRNA sequence
tcccctgcctcagcctccta

SEQ ID NO: 373227 - DNA, 20 bp, Artificial
  CRISPR gRNA sequence
gcctcagcctcctaaagtgc

SEQ ID NO: 373228 - DNA, 20 bp, Artificial
  CRISPR gRNA sequence
cctcagcctcctaaagtgct

SEQ ID NO: 373229 - DNA, 20 bp, Artificial
  CRISPR gRNA sequence
gcctcctaaagtgctgggat

SEQ ID NO: 373230 - DNA, 20 bp, Artificial
  CRISPR gRNA sequence
tcctaaagtgctgggattgg

SEQ ID NO: 373231 - DNA, 20 bp, Artificial
  CRISPR gRNA sequence
gtagtgtgaaccaccacacc

SEQ ID NO: 373232 - DNA, 20 bp, Artificial
  CRISPR gRNA sequence
atttgtaatgttccaaactc

SEQ ID NO: 373233 - DNA, 20 bp, Artificial
  CRISPR gRNA sequence
atgttccaaactctggttat

SEQ ID NO: 373234 - DNA, 20 bp, Artificial
  CRISPR gRNA sequence
ctggttatcagaaattaatt

SEQ ID NO: 373235 - DNA, 20 bp, Artificial
  CRISPR gRNA sequence
atcagaaattaattgagatt

SEQ ID NO: 373236 - DNA, 20 bp, Artificial
  CRISPR gRNA sequence
tcagaaattaattgagatta

SEQ ID NO: 373237 - DNA, 20 bp, Artificial
  CRISPR gRNA sequence
ttaattgagattaaggatta

SEQ ID NO: 373238 - DNA, 20 bp, Artificial
  CRISPR gRNA sequence
aggattatggcatctgctta

SEQ ID NO: 373239 - DNA, 20 bp, Artificial
  CRISPR gRNA sequence
gcatctgcttaaagttgtca

SEQ ID NO: 373240 - DNA, 20 bp, Artificial
  CRISPR gRNA sequence
aagttgtcaaagcatctttt

SEQ ID NO: 373241 - DNA, 20 bp, Artificial
  CRISPR gRNA sequence
gcatcttttcagaatatgcc

SEQ ID NO: 373242 - DNA, 20 bp, Artificial
  CRISPR gRNA sequence
cttttcagaatatgcccagt

SEQ ID NO: 373243 - DNA, 20 bp, Artificial
  CRISPR gRNA sequence
gttaatgtttctattcattc

SEQ ID NO: 373244 - DNA, 20 bp, Artificial
  CRISPR gRNA sequence
aatgtttctattcattctag

SEQ ID NO: 373245 - DNA, 20 bp, Artificial
  CRISPR gRNA sequence
atgtttctattcattctagt

SEQ ID NO: 373246 - DNA, 20 bp, Artificial
  CRISPR gRNA sequence
tgtttctattcattctagta

SEQ ID NO: 373247 - DNA, 20 bp, Artificial
  CRISPR gRNA sequence
gtttctattcattctagtag

SEQ ID NO: 373248 - DNA, 20 bp, Artificial
  CRISPR gRNA sequence
gctgtgtccattttaatttt

SEQ ID NO: 373249 - DNA, 20 bp, Artificial
  CRISPR gRNA sequence
ttttctacctcttttctttc

SEQ ID NO: 373250 - DNA, 20 bp, Artificial
  CRISPR gRNA sequence
ttcttcaacgtttaaccttt

SEQ ID NO: 373251 - DNA, 20 bp, Artificial
  CRISPR gRNA sequence
tcttcaacgtttaacctttg

SEQ ID NO: 373252 - DNA, 20 bp, Artificial
  CRISPR gRNA sequence
ggtttactgattgttgatca

SEQ ID NO: 373253 - DNA, 20 bp, Artificial
  CRISPR gRNA sequence
caaagaaactgaactttcaa

SEQ ID NO: 373254 - DNA, 20 bp, Artificial
  CRISPR gRNA sequence
aactttcaaaagatcaacta

SEQ ID NO: 373255 - DNA, 20 bp, Artificial
  CRISPR gRNA sequence
aaaagatcaactacagtgat

SEQ ID NO: 373256 - DNA, 20 bp, Artificial
  CRISPR gRNA sequence
aagatcaactacagtgattg

SEQ ID NO: 373257 - DNA, 20 bp, Artificial
  CRISPR gRNA sequence
ttgtttacatatataacttt

SEQ ID NO: 373258 - DNA, 20 bp, Artificial
  CRISPR gRNA sequence
ttacatatataactttcaga

SEQ ID NO: 373259 - DNA, 20 bp, Artificial
  CRISPR gRNA sequence
tacatatataactttcagat

SEQ ID NO: 373260 - DNA, 20 bp, Artificial
  CRISPR gRNA sequence
acatatataactttcagata

SEQ ID NO: 373261 - DNA, 20 bp, Artificial
  CRISPR gRNA sequence
ttattttgaatttttaatat

SEQ ID NO: 373262 - DNA, 20 bp, Artificial
  CRISPR gRNA sequence
ttttgaatttttaatataag

SEQ ID NO: 373263 - DNA, 20 bp, Artificial
  CRISPR gRNA sequence
tataagtggcacataattgc

SEQ ID NO: 373264 - DNA, 20 bp, Artificial
  CRISPR gRNA sequence
ataattgctggtcatctgaa

SEQ ID NO: 373265 - DNA, 20 bp, Artificial
  CRISPR gRNA sequence
attgctggtcatctgaatag

SEQ ID NO: 373266 - DNA, 20 bp, Artificial
  CRISPR gRNA sequence
ttgctggtcatctgaataga

SEQ ID NO: 373267 - DNA, 20 bp, Artificial
  CRISPR gRNA sequence
tggtcatctgaatagaagga

SEQ ID NO: 373268 - DNA, 20 bp, Artificial
  CRISPR gRNA sequence
ggtcatctgaatagaaggat

SEQ ID NO: 373269 - DNA, 20 bp, Artificial
  CRISPR gRNA sequence
tctgaatagaaggatgggat

SEQ ID NO: 373270 - DNA, 20 bp, Artificial
  CRISPR gRNA sequence
aaggatgggattagtaaatt

SEQ ID NO: 373271 - DNA, 20 bp, Artificial
  CRISPR gRNA sequence
aagattacaaaactattcac

SEQ ID NO: 373272 - DNA, 20 bp, Artificial
  CRISPR gRNA sequence
agattacaaaactattcact

SEQ ID NO: 373273 - DNA, 20 bp, Artificial
  CRISPR gRNA sequence
aactattcactaggaaatca

SEQ ID NO: 373274 - DNA, 20 bp, Artificial
  CRISPR gRNA sequence
actaggaaatcatagtgcca

SEQ ID NO: 373275 - DNA, 20 bp, Artificial
  CRISPR gRNA sequence
gaaatcatagtgccacagct

SEQ ID NO: 373276 - DNA, 20 bp, Artificial
  CRISPR gRNA sequence
aatcatagtgccacagctaa

SEQ ID NO: 373277 - DNA, 20 bp, Artificial
  CRISPR gRNA sequence
cacagctaagagaatcttcc

SEQ ID NO: 373278 - DNA, 20 bp, Artificial
  CRISPR gRNA sequence
atcttcccagatatttcctc

SEQ ID NO: 373279 - DNA, 20 bp, Artificial
  CRISPR gRNA sequence
tcttcccagatatttcctct

SEQ ID NO: 373280 - DNA, 20 bp, Artificial
  CRISPR gRNA sequence
tatttcctctgggacgatgt

SEQ ID NO: 373281 - DNA, 20 bp, Artificial
  CRISPR gRNA sequence
atttcctctgggacgatgtg

SEQ ID NO: 373282 - DNA, 20 bp, Artificial
  CRISPR gRNA sequence
ctctgggacgatgtgaggta

SEQ ID NO: 373283 - DNA, 20 bp, Artificial
  CRISPR gRNA sequence
tctgggacgatgtgaggtat

SEQ ID NO: 373284 - DNA, 20 bp, Artificial
  CRISPR gRNA sequence
atgtgaggtataggattgac

SEQ ID NO: 373285 - DNA, 20 bp, Artificial
  CRISPR gRNA sequence
tgtgaggtataggattgaca

SEQ ID NO: 373286 - DNA, 20 bp, Artificial
  CRISPR gRNA sequence
tgaggtataggattgacaag

SEQ ID NO: 373287 - DNA, 20 bp, Artificial
  CRISPR gRNA sequence
gaggtataggattgacaagg

SEQ ID NO: 373288 - DNA, 20 bp, Artificial
  CRISPR gRNA sequence
gtataggattgacaaggagg

SEQ ID NO: 373289 - DNA, 20 bp, Artificial
  CRISPR gRNA sequence
tataggattgacaaggagga

SEQ ID NO: 373290 - DNA, 20 bp, Artificial
  CRISPR gRNA sequence
ggattgacaaggaggaagga

SEQ ID NO: 373291 - DNA, 20 bp, Artificial
  CRISPR gRNA sequence
gattgacaaggaggaaggac

SEQ ID NO: 373292 - DNA, 20 bp, Artificial
  CRISPR gRNA sequence
attgacaaggaggaaggaca

SEQ ID NO: 373293 - DNA, 20 bp, Artificial
  CRISPR gRNA sequence
ttgacaaggaggaaggacag

SEQ ID NO: 373294 - DNA, 20 bp, Artificial
  CRISPR gRNA sequence
aaggaggaaggacaggggaa

SEQ ID NO: 373295 - DNA, 20 bp, Artificial
  CRISPR gRNA sequence
ggaggaaggacaggggaata

SEQ ID NO: 373296 - DNA, 20 bp, Artificial
  CRISPR gRNA sequence
acaggggaatagagtgctgt

SEQ ID NO: 373297 - DNA, 20 bp, Artificial
  CRISPR gRNA sequence
gttataaatacatccgtata

SEQ ID NO: 373298 - DNA, 20 bp, Artificial
  CRISPR gRNA sequence
gatgatacatcttatttata

SEQ ID NO: 373299 - DNA, 20 bp, Artificial
  CRISPR gRNA sequence
cagattataaatcttgcctg

SEQ ID NO: 373300 - DNA, 20 bp, Artificial
  CRISPR gRNA sequence
ttataaatcttgcctgtaga

SEQ ID NO: 373301 - DNA, 20 bp, Artificial
  CRISPR gRNA sequence
tcttgcctgtagatggcttg

SEQ ID NO: 373302 - DNA, 20 bp, Artificial
  CRISPR gRNA sequence
cttgcctgtagatggcttgt

SEQ ID NO: 373303 - DNA, 20 bp, Artificial
  CRISPR gRNA sequence
tgcctgtagatggcttgtgg

SEQ ID NO: 373304 - DNA, 20 bp, Artificial
  CRISPR gRNA sequence
gcctgtagatggcttgtggg

SEQ ID NO: 373305 - DNA, 20 bp, Artificial
  CRISPR gRNA sequence
tgtgggaggttactgacttt

SEQ ID NO: 373306 - DNA, 20 bp, Artificial
  CRISPR gRNA sequence
ctttgagactctgtgctcct

SEQ ID NO: 373307 - DNA, 20 bp, Artificial
  CRISPR gRNA sequence
gagactctgtgctcctgagt

SEQ ID NO: 373308 - DNA, 20 bp, Artificial
  CRISPR gRNA sequence
gttggattataaaattattg

SEQ ID NO: 373309 - DNA, 20 bp, Artificial
  CRISPR gRNA sequence
gattataaaattattgaaga

SEQ ID NO: 373310 - DNA, 20 bp, Artificial
  CRISPR gRNA sequence
attataaaattattgaagaa

SEQ ID NO: 373311 - DNA, 20 bp, Artificial
  CRISPR gRNA sequence
ataaattttgcttatttcct

SEQ ID NO: 373312 - DNA, 20 bp, Artificial
  CRISPR gRNA sequence
tatttctgtcaaaaaccaac

SEQ ID NO: 373313 - DNA, 20 bp, Artificial
  CRISPR gRNA sequence
aaaaccaaccagtttgctcc

SEQ ID NO: 373314 - DNA, 20 bp, Artificial
  CRISPR gRNA sequence
cagtttgctcccagtccatt

SEQ ID NO: 373315 - DNA, 20 bp, Artificial
  CRISPR gRNA sequence
ctcccagtccatttggattc

SEQ ID NO: 373316 - DNA, 20 bp, Artificial
  CRISPR gRNA sequence
ccagtccatttggattccag

SEQ ID NO: 373317 - DNA, 20 bp, Artificial
  CRISPR gRNA sequence
agtccatttggattccagaa

SEQ ID NO: 373318 - DNA, 20 bp, Artificial
  CRISPR gRNA sequence
tttggattccagaagagttt

SEQ ID NO: 373319 - DNA, 20 bp, Artificial
  CRISPR gRNA sequence
ttggattccagaagagtttc

SEQ ID NO: 373320 - DNA, 20 bp, Artificial
  CRISPR gRNA sequence
tccagaagagtttcaggttg

SEQ ID NO: 373321 - DNA, 20 bp, Artificial
  CRISPR gRNA sequence
aagagtttcaggttgtagac

SEQ ID NO: 373322 - DNA, 20 bp, Artificial
  CRISPR gRNA sequence
gtttcaggttgtagacaaga

SEQ ID NO: 373323 - DNA, 20 bp, Artificial
  CRISPR gRNA sequence
gacagttttttttttttttt

SEQ ID NO: 373324 - DNA, 20 bp, Artificial
  CRISPR gRNA sequence
acagttttttttttttttta

SEQ ID NO: 373325 - DNA, 20 bp, Artificial
  CRISPR gRNA sequence
ttttaaggattccattaatc

SEQ ID NO: 373326 - DNA, 20 bp, Artificial
  CRISPR gRNA sequence
ctgtcccactcctatgaatt

SEQ ID NO: 373327 - DNA, 20 bp, Artificial
  CRISPR gRNA sequence
ccactcctatgaatttagaa

SEQ ID NO: 373328 - DNA, 20 bp, Artificial
  CRISPR gRNA sequence
atgaatttagaatagatata

SEQ ID NO: 373329 - DNA, 20 bp, Artificial
  CRISPR gRNA sequence
tagaatagatataaagcttg

SEQ ID NO: 373330 - DNA, 20 bp, Artificial
  CRISPR gRNA sequence
gatataaagcttgtggacat

SEQ ID NO: 373331 - DNA, 20 bp, Artificial
  CRISPR gRNA sequence
atataaagcttgtggacatg

SEQ ID NO: 373332 - DNA, 20 bp, Artificial
  CRISPR gRNA sequence
gacatgaggattgtctgaac

SEQ ID NO: 373333 - DNA, 20 bp, Artificial
  CRISPR gRNA sequence
ttgtctgaactggtgtgcac

SEQ ID NO: 373334 - DNA, 20 bp, Artificial
  CRISPR gRNA sequence
tgtctgaactggtgtgcact

SEQ ID NO: 373335 - DNA, 20 bp, Artificial
  CRISPR gRNA sequence
actggtgtgcactgggctga

SEQ ID NO: 373336 - DNA, 20 bp, Artificial
  CRISPR gRNA sequence
tccctttccatgacattgtg

SEQ ID NO: 373337 - DNA, 20 bp, Artificial
  CRISPR gRNA sequence
tgacattgtgtggtgaacct

SEQ ID NO: 373338 - DNA, 20 bp, Artificial
  CRISPR gRNA sequence
ttttattatctttacctaca

SEQ ID NO: 373339 - DNA, 20 bp, Artificial
  CRISPR gRNA sequence
attatctttacctacatgga

SEQ ID NO: 373340 - DNA, 20 bp, Artificial
  CRISPR gRNA sequence
ggaaagtaaaatgtccatga

SEQ ID NO: 373341 - DNA, 20 bp, Artificial
  CRISPR gRNA sequence
atgacagttaatttatatga

SEQ ID NO: 373342 - DNA, 20 bp, Artificial
  CRISPR gRNA sequence
gacagttaatttatatgatg

SEQ ID NO: 373343 - DNA, 20 bp, Artificial
  CRISPR gRNA sequence
atatgatggagcaacacgac

SEQ ID NO: 373344 - DNA, 20 bp, Artificial
  CRISPR gRNA sequence
gagcaacacgaccagaatcc

SEQ ID NO: 373345 - DNA, 20 bp, Artificial
  CRISPR gRNA sequence
gcaacacgaccagaatccca

SEQ ID NO: 373346 - DNA, 20 bp, Artificial
  CRISPR gRNA sequence
agcaccgtgtcactgctcac

SEQ ID NO: 373347 - DNA, 20 bp, Artificial
  CRISPR gRNA sequence
taaaataacctctactcaaa

SEQ ID NO: 373348 - DNA, 20 bp, Artificial
  CRISPR gRNA sequence
aacagatcaaccacaatttt

SEQ ID NO: 373349 - DNA, 20 bp, Artificial
  CRISPR gRNA sequence
ccacaattttcagcccaatt

SEQ ID NO: 373350 - DNA, 20 bp, Artificial
  CRISPR gRNA sequence
tcagcccaatttagttttct

SEQ ID NO: 373351 - DNA, 20 bp, Artificial
  CRISPR gRNA sequence
tttagttttctcggtgaaac

SEQ ID NO: 373352 - DNA, 20 bp, Artificial
  CRISPR gRNA sequence
ttagttttctcggtgaaact

SEQ ID NO: 373353 - DNA, 20 bp, Artificial
  CRISPR gRNA sequence
tctcggtgaaactgggtatc

SEQ ID NO: 373354 - DNA, 20 bp, Artificial
  CRISPR gRNA sequence
ctgggtatccagatgaaaca

SEQ ID NO: 373355 - DNA, 20 bp, Artificial
  CRISPR gRNA sequence
tccagatgaaacatagtttc

SEQ ID NO: 373356 - DNA, 20 bp, Artificial
  CRISPR gRNA sequence
aacatagtttccagcatcac

SEQ ID NO: 373357 - DNA, 20 bp, Artificial
  CRISPR gRNA sequence
tagtttccagcatcacaagt

SEQ ID NO: 373358 - DNA, 20 bp, Artificial
  CRISPR gRNA sequence
gtgagttgattactcaatca

SEQ ID NO: 373359 - DNA, 20 bp, Artificial
  CRISPR gRNA sequence
actcaatcatggctattatg

SEQ ID NO: 373360 - DNA, 20 bp, Artificial
  CRISPR gRNA sequence
actttactgttgcctctgcc

SEQ ID NO: 373361 - DNA, 20 bp, Artificial
  CRISPR gRNA sequence
tgcattcaaaaaaatgcaac

SEQ ID NO: 373362 - DNA, 20 bp, Artificial
  CRISPR gRNA sequence
ttcaaaaaaatgcaaccggt

SEQ ID NO: 373363 - DNA, 20 bp, Artificial
  CRISPR gRNA sequence
ggtcagttaatttgttttgt

SEQ ID NO: 373364 - DNA, 20 bp, Artificial
  CRISPR gRNA sequence
ttaatttgttttgtaagccc

SEQ ID NO: 373365 - DNA, 20 bp, Artificial
  CRISPR gRNA sequence
tttttgaacacacaaaaacc

SEQ ID NO: 373366 - DNA, 20 bp, Artificial
  CRISPR gRNA sequence
aaacctagaatgtttgcctg

SEQ ID NO: 373367 - DNA, 20 bp, Artificial
  CRISPR gRNA sequence
ttatacatactattattgta

SEQ ID NO: 373368 - DNA, 20 bp, Artificial
  CRISPR gRNA sequence
catactattattgtatagat

SEQ ID NO: 373369 - DNA, 20 bp, Artificial
  CRISPR gRNA sequence
ctattattgtatagataagt

SEQ ID NO: 373370 - DNA, 20 bp, Artificial
  CRISPR gRNA sequence
ataagtaagatattgaataa

SEQ ID NO: 373371 - DNA, 20 bp, Artificial
  CRISPR gRNA sequence
agatattgaataatagtgat

SEQ ID NO: 373372 - DNA, 20 bp, Artificial
  CRISPR gRNA sequence
taatagtgataagttattgt

SEQ ID NO: 373373 - DNA, 20 bp, Artificial
  CRISPR gRNA sequence
atagtgataagttattgtca

SEQ ID NO: 373374 - DNA, 20 bp, Artificial
  CRISPR gRNA sequence
tagtgataagttattgtcag

SEQ ID NO: 373375 - DNA, 20 bp, Artificial
  CRISPR gRNA sequence
agtgataagttattgtcaga

SEQ ID NO: 373376 - DNA, 20 bp, Artificial
  CRISPR gRNA sequence
cagagggaatgaaactctaa

SEQ ID NO: 373377 - DNA, 20 bp, Artificial
  CRISPR gRNA sequence
agagggaatgaaactctaaa

SEQ ID NO: 373378 - DNA, 20 bp, Artificial
  CRISPR gRNA sequence
ctgatgacactattatattg

SEQ ID NO: 373379 - DNA, 20 bp, Artificial
  CRISPR gRNA sequence
attgctacctcatgtacata

SEQ ID NO: 373380 - DNA, 20 bp, Artificial
  CRISPR gRNA sequence
ctacctcatgtacataaagc

SEQ ID NO: 373381 - DNA, 20 bp, Artificial
  CRISPR gRNA sequence
gtacataaagcaagttctaa

SEQ ID NO: 373382 - DNA, 20 bp, Artificial
  CRISPR gRNA sequence
aacaccactataaacaatgc

SEQ ID NO: 373383 - DNA, 20 bp, Artificial
  CRISPR gRNA sequence
ctataaacaatgcaagtttg

SEQ ID NO: 373384 - DNA, 20 bp, Artificial
  CRISPR gRNA sequence
acaatgcaagtttgtagaat

SEQ ID NO: 373385 - DNA, 20 bp, Artificial
  CRISPR gRNA sequence
tgcaagtttgtagaattaga

SEQ ID NO: 373386 - DNA, 20 bp, Artificial
  CRISPR gRNA sequence
aagtttgtagaattagaaag

SEQ ID NO: 373387 - DNA, 20 bp, Artificial
  CRISPR gRNA sequence
aattagaaagcagttgatcc

SEQ ID NO: 373388 - DNA, 20 bp, Artificial
  CRISPR gRNA sequence
attagaaagcagttgatcct

SEQ ID NO: 373389 - DNA, 20 bp, Artificial
  CRISPR gRNA sequence
tcctaggaactgctgttcta

SEQ ID NO: 373390 - DNA, 20 bp, Artificial
  CRISPR gRNA sequence
cctaggaactgctgttctac

SEQ ID NO: 373391 - DNA, 20 bp, Artificial
  CRISPR gRNA sequence
aggaactgctgttctacagg

SEQ ID NO: 373392 - DNA, 20 bp, Artificial
  CRISPR gRNA sequence
aattttcaactcttttcata

SEQ ID NO: 373393 - DNA, 20 bp, Artificial
  CRISPR gRNA sequence
tcataaagtttttctctccc

SEQ ID NO: 373394 - DNA, 20 bp, Artificial
  CRISPR gRNA sequence
cataaagtttttctctccct

SEQ ID NO: 373395 - DNA, 20 bp, Artificial
  CRISPR gRNA sequence
tttttctctccctgggaact

SEQ ID NO: 373396 - DNA, 20 bp, Artificial
  CRISPR gRNA sequence
tccctgggaacttagactac

SEQ ID NO: 373397 - DNA, 20 bp, Artificial
  CRISPR gRNA sequence
tgggaacttagactacaagt

SEQ ID NO: 373398 - DNA, 20 bp, Artificial
  CRISPR gRNA sequence
gggaacttagactacaagtc

SEQ ID NO: 373399 - DNA, 20 bp, Artificial
  CRISPR gRNA sequence
tacaagtcaggattcacatt

SEQ ID NO: 373400 - DNA, 20 bp, Artificial
  CRISPR gRNA sequence
tcctacttaaaattcacaca

SEQ ID NO: 373401 - DNA, 20 bp, Artificial
  CRISPR gRNA sequence
aaaattcacacatggtgctt

SEQ ID NO: 373402 - DNA, 20 bp, Artificial
  CRISPR gRNA sequence
aaattcacacatggtgcttt

SEQ ID NO: 373403 - DNA, 20 bp, Artificial
  CRISPR gRNA sequence
attcacacatggtgctttgg

SEQ ID NO: 373404 - DNA, 20 bp, Artificial
  CRISPR gRNA sequence
ttcacacatggtgctttggg

SEQ ID NO: 373405 - DNA, 20 bp, Artificial
  CRISPR gRNA sequence
acatggtgctttgggaggct

SEQ ID NO: 373406 - DNA, 20 bp, Artificial
  CRISPR gRNA sequence
catggtgctttgggaggctg

SEQ ID NO: 373407 - DNA, 20 bp, Artificial
  CRISPR gRNA sequence
ggtgctttgggaggctgagg

SEQ ID NO: 373408 - DNA, 20 bp, Artificial
  CRISPR gRNA sequence
gctttgggaggctgaggcgg

SEQ ID NO: 373409 - DNA, 20 bp, Artificial
  CRISPR gRNA sequence
ctttgggaggctgaggcggt

SEQ ID NO: 373410 - DNA, 20 bp, Artificial
  CRISPR gRNA sequence
ttgggaggctgaggcggtag

SEQ ID NO: 373411 - DNA, 20 bp, Artificial
  CRISPR gRNA sequence
ctgaggcggtaggagtcctt

SEQ ID NO: 373412 - DNA, 20 bp, Artificial
  CRISPR gRNA sequence
cggtaggagtccttgagccc

SEQ ID NO: 373413 - DNA, 20 bp, Artificial
  CRISPR gRNA sequence
gagtccttgagcccaagaat

SEQ ID NO: 373414 - DNA, 20 bp, Artificial
  CRISPR gRNA sequence
tccttgagcccaagaattag

SEQ ID NO: 373415 - DNA, 20 bp, Artificial
  CRISPR gRNA sequence
agcccaagaattagtggctg

SEQ ID NO: 373416 - DNA, 20 bp, Artificial
  CRISPR gRNA sequence
caagaattagtggctgcagt

SEQ ID NO: 373417 - DNA, 20 bp, Artificial
  CRISPR gRNA sequence
atgactgcaccattgcactg

SEQ ID NO: 373418 - DNA, 20 bp, Artificial
  CRISPR gRNA sequence
tgcaccattgcactgcagcc

SEQ ID NO: 373419 - DNA, 20 bp, Artificial
  CRISPR gRNA sequence
gcaccattgcactgcagcct

SEQ ID NO: 373420 - DNA, 20 bp, Artificial
  CRISPR gRNA sequence
ttgcactgcagcctgggcaa

SEQ ID NO: 373421 - DNA, 20 bp, Artificial
  CRISPR gRNA sequence
gcactgcagcctgggcaaca

SEQ ID NO: 373422 - DNA, 20 bp, Artificial
  CRISPR gRNA sequence
tgcagcctgggcaacagagc

SEQ ID NO: 373423 - DNA, 20 bp, Artificial
  CRISPR gRNA sequence
tccaaaaaaaaaaaaaaaaa

SEQ ID NO: 373424 - DNA, 20 bp, Artificial
  CRISPR gRNA sequence
caaaaaaaaaaaaaaaaaaa

SEQ ID NO: 373425 - DNA, 20 bp, Artificial
  CRISPR gRNA sequence
aaaaaaaaaaaaaaaagaga

SEQ ID NO: 373426 - DNA, 20 bp, Artificial
  CRISPR gRNA sequence
aaaaaaaaaaaaaaagagaa

SEQ ID NO: 373427 - DNA, 20 bp, Artificial
  CRISPR gRNA sequence
aaaaagagaaaggaaaaaaa

SEQ ID NO: 373428 - DNA, 20 bp, Artificial
  CRISPR gRNA sequence
agagaaaggaaaaaaatagt

SEQ ID NO: 373429 - DNA, 20 bp, Artificial
  CRISPR gRNA sequence
ggaaaaaaatagtcagtgca

SEQ ID NO: 373430 - DNA, 20 bp, Artificial
  CRISPR gRNA sequence
gtgcatggctacatttattt

SEQ ID NO: 373431 - DNA, 20 bp, Artificial
  CRISPR gRNA sequence
ttatactttattgtcgtata

SEQ ID NO: 373432 - DNA, 20 bp, Artificial
  CRISPR gRNA sequence
atatggaatttacattctaa

SEQ ID NO: 373433 - DNA, 20 bp, Artificial
  CRISPR gRNA sequence
atttacattctaaaagcacc

SEQ ID NO: 373434 - DNA, 20 bp, Artificial
  CRISPR gRNA sequence
tttacattctaaaagcacct

SEQ ID NO: 373435 - DNA, 20 bp, Artificial
  CRISPR gRNA sequence
aagcacctgggaattgttaa

SEQ ID NO: 373436 - DNA, 20 bp, Artificial
  CRISPR gRNA sequence
ctgggaattgttaacagctt

SEQ ID NO: 373437 - DNA, 20 bp, Artificial
  CRISPR gRNA sequence
tgggaattgttaacagcttg

SEQ ID NO: 373438 - DNA, 20 bp, Artificial
  CRISPR gRNA sequence
aacagcttgaggttgtctct

SEQ ID NO: 373439 - DNA, 20 bp, Artificial
  CRISPR gRNA sequence
cagcttgaggttgtctctta

SEQ ID NO: 373440 - DNA, 20 bp, Artificial
  CRISPR gRNA sequence
tgaacataaatgattgatca

SEQ ID NO: 373441 - DNA, 20 bp, Artificial
  CRISPR gRNA sequence
ttgatcaaagatttctccaa

SEQ ID NO: 373442 - DNA, 20 bp, Artificial
  CRISPR gRNA sequence
tcaaagatttctccaaaagc

SEQ ID NO: 373443 - DNA, 20 bp, Artificial
  CRISPR gRNA sequence
aagatttctccaaaagcaag

SEQ ID NO: 373444 - DNA, 20 bp, Artificial
  CRISPR gRNA sequence
aattacttaaaatgtaaaat

SEQ ID NO: 373445 - DNA, 20 bp, Artificial
  CRISPR gRNA sequence
gtaaaataagttattcttat

SEQ ID NO: 373446 - DNA, 20 bp, Artificial
  CRISPR gRNA sequence
agttattcttataagattaa

SEQ ID NO: 373447 - DNA, 20 bp, Artificial
  CRISPR gRNA sequence
taatagcatttcattcttaa

SEQ ID NO: 373448 - DNA, 20 bp, Artificial
  CRISPR gRNA sequence
cttaatagaaattctaattt

SEQ ID NO: 373449 - DNA, 20 bp, Artificial
  CRISPR gRNA sequence
tttaagtattacaactcaat

SEQ ID NO: 373450 - DNA, 20 bp, Artificial
  CRISPR gRNA sequence
attactttgaacttcatctg

SEQ ID NO: 373451 - DNA, 20 bp, Artificial
  CRISPR gRNA sequence
tatttcaaacattattgaca

SEQ ID NO: 373452 - DNA, 20 bp, Artificial
  CRISPR gRNA sequence
tggatcctgataaatattca

SEQ ID NO: 373453 - DNA, 20 bp, Artificial
  CRISPR gRNA sequence
ggatcctgataaatattcaa

SEQ ID NO: 373454 - DNA, 20 bp, Artificial
  CRISPR gRNA sequence
aatattcaaaggcgatgtac

SEQ ID NO: 373455 - DNA, 20 bp, Artificial
  CRISPR gRNA sequence
atattcaaaggcgatgtact

SEQ ID NO: 373456 - DNA, 20 bp, Artificial
  CRISPR gRNA sequence
aaggcgatgtactaggtttc

SEQ ID NO: 373457 - DNA, 20 bp, Artificial
  CRISPR gRNA sequence
ggcgatgtactaggtttctg

SEQ ID NO: 373458 - DNA, 20 bp, Artificial
  CRISPR gRNA sequence
gcgatgtactaggtttctgg

SEQ ID NO: 373459 - DNA, 20 bp, Artificial
  CRISPR gRNA sequence
tctggaggactatgttgttt

SEQ ID NO: 373460 - DNA, 20 bp, Artificial
  CRISPR gRNA sequence
tggaggactatgttgtttaa

SEQ ID NO: 373461 - DNA, 20 bp, Artificial
  CRISPR gRNA sequence
ggaggactatgttgtttaag

SEQ ID NO: 373462 - DNA, 20 bp, Artificial
  CRISPR gRNA sequence
gactatgttgtttaagagga

SEQ ID NO: 373463 - DNA, 20 bp, Artificial
  CRISPR gRNA sequence
gtttaagaggacggaaaatg

SEQ ID NO: 373464 - DNA, 20 bp, Artificial
  CRISPR gRNA sequence
gacggaaaatgaagaataaa

SEQ ID NO: 373465 - DNA, 20 bp, Artificial
  CRISPR gRNA sequence
agaataaacagatctgtcat

SEQ ID NO: 373466 - DNA, 20 bp, Artificial
  CRISPR gRNA sequence
ataaacagatctgtcataag

SEQ ID NO: 373467 - DNA, 20 bp, Artificial
  CRISPR gRNA sequence
aacagatctgtcataagtag

SEQ ID NO: 373468 - DNA, 20 bp, Artificial
  CRISPR gRNA sequence
gaaccccaatttctatcttt

SEQ ID NO: 373469 - DNA, 20 bp, Artificial
  CRISPR gRNA sequence
ttatttatactaaaatgatt

SEQ ID NO: 373470 - DNA, 20 bp, Artificial
  CRISPR gRNA sequence
tatttatactaaaatgattc

SEQ ID NO: 373471 - DNA, 20 bp, Artificial
  CRISPR gRNA sequence
atttatactaaaatgattca

SEQ ID NO: 373472 - DNA, 20 bp, Artificial
  CRISPR gRNA sequence
ttaaaaatacatttattcaa

SEQ ID NO: 373473 - DNA, 20 bp, Artificial
  CRISPR gRNA sequence
taaaaatacatttattcaac

SEQ ID NO: 373474 - DNA, 20 bp, Artificial
  CRISPR gRNA sequence
catttattcaacaggaatat

SEQ ID NO: 373475 - DNA, 20 bp, Artificial
  CRISPR gRNA sequence
aacaggaatataagtttttt

SEQ ID NO: 373476 - DNA, 20 bp, Artificial
  CRISPR gRNA sequence
aatattttgcaatcttcatt

SEQ ID NO: 373477 - DNA, 20 bp, Artificial
  CRISPR gRNA sequence
agcactctaaaattcatttc

SEQ ID NO: 373478 - DNA, 20 bp, Artificial
  CRISPR gRNA sequence
gcactctaaaattcatttcc

SEQ ID NO: 373479 - DNA, 20 bp, Artificial
  CRISPR gRNA sequence
taattcaatgtttttaactt

SEQ ID NO: 373480 - DNA, 20 bp, Artificial
  CRISPR gRNA sequence
ttcaatgtttttaactttgg

SEQ ID NO: 373481 - DNA, 20 bp, Artificial
  CRISPR gRNA sequence
tttaactttggtagaactca

SEQ ID NO: 373482 - DNA, 20 bp, Artificial
  CRISPR gRNA sequence
ttaactttggtagaactcaa

SEQ ID NO: 373483 - DNA, 20 bp, Artificial
  CRISPR gRNA sequence
actttggtagaactcaaagg

SEQ ID NO: 373484 - DNA, 20 bp, Artificial
  CRISPR gRNA sequence
ctttggtagaactcaaaggt

SEQ ID NO: 373485 - DNA, 20 bp, Artificial
  CRISPR gRNA sequence
tagaactcaaaggtaggcca

SEQ ID NO: 373486 - DNA, 20 bp, Artificial
  CRISPR gRNA sequence
ccatggtgttcacaatcctt

SEQ ID NO: 373487 - DNA, 20 bp, Artificial
  CRISPR gRNA sequence
gttcacaatcctttagatat

SEQ ID NO: 373488 - DNA, 20 bp, Artificial
  CRISPR gRNA sequence
cacaatcctttagatatgag

SEQ ID NO: 373489 - DNA, 20 bp, Artificial
  CRISPR gRNA sequence
cattttaattaattaactca

SEQ ID NO: 373490 - DNA, 20 bp, Artificial
  CRISPR gRNA sequence
attttaattaattaactcac

SEQ ID NO: 373491 - DNA, 20 bp, Artificial
  CRISPR gRNA sequence
ttttaattaattaactcaca

SEQ ID NO: 373492 - DNA, 20 bp, Artificial
  CRISPR gRNA sequence
ttaattaattaactcacagg

SEQ ID NO: 373493 - DNA, 20 bp, Artificial
  CRISPR gRNA sequence
aattaattaactcacaggga

SEQ ID NO: 373494 - DNA, 20 bp, Artificial
  CRISPR gRNA sequence
ttaattaactcacagggaga

SEQ ID NO: 373495 - DNA, 20 bp, Artificial
  CRISPR gRNA sequence
acagggagagagtctttcac

SEQ ID NO: 373496 - DNA, 20 bp, Artificial
  CRISPR gRNA sequence
gagagtctttcacaagtatc

SEQ ID NO: 373497 - DNA, 20 bp, Artificial
  CRISPR gRNA sequence
agttgaaatgttaatactct

SEQ ID NO: 373498 - DNA, 20 bp, Artificial
  CRISPR gRNA sequence
gaaatgttaatactctcagt

SEQ ID NO: 373499 - DNA, 20 bp, Artificial
  CRISPR gRNA sequence
gttaatactctcagttggat

SEQ ID NO: 373500 - DNA, 20 bp, Artificial
  CRISPR gRNA sequence
aatactctcagttggattgg

SEQ ID NO: 373501 - DNA, 20 bp, Artificial
  CRISPR gRNA sequence
ctctcagttggattggtgga

SEQ ID NO: 373502 - DNA, 20 bp, Artificial
  CRISPR gRNA sequence
ggattggtggaaagtgaaaa

SEQ ID NO: 373503 - DNA, 20 bp, Artificial
  CRISPR gRNA sequence
gtggaaagtgaaaatggctt

SEQ ID NO: 373504 - DNA, 20 bp, Artificial
  CRISPR gRNA sequence
gaaaatggctttagctatgt

SEQ ID NO: 373505 - DNA, 20 bp, Artificial
  CRISPR gRNA sequence
atggctttagctatgttgga

SEQ ID NO: 373506 - DNA, 20 bp, Artificial
  CRISPR gRNA sequence
ctttagctatgttggacagt

SEQ ID NO: 373507 - DNA, 20 bp, Artificial
  CRISPR gRNA sequence
aaaccttattgtgatgatga

SEQ ID NO: 373508 - DNA, 20 bp, Artificial
  CRISPR gRNA sequence
tattgtgatgatgatggaca

SEQ ID NO: 373509 - DNA, 20 bp, Artificial
  CRISPR gRNA sequence
attgtgatgatgatggacac

SEQ ID NO: 373510 - DNA, 20 bp, Artificial
  CRISPR gRNA sequence
atggacacgggtaaaataaa

SEQ ID NO: 373511 - DNA, 20 bp, Artificial
  CRISPR gRNA sequence
gacacgggtaaaataaaaag

SEQ ID NO: 373512 - DNA, 20 bp, Artificial
  CRISPR gRNA sequence
taaaataaaaagtagatgct

SEQ ID NO: 373513 - DNA, 20 bp, Artificial
  CRISPR gRNA sequence
taaaaagtagatgctgagtt

SEQ ID NO: 373514 - DNA, 20 bp, Artificial
  CRISPR gRNA sequence
aaagtagatgctgagttgag

SEQ ID NO: 373515 - DNA, 20 bp, Artificial
  CRISPR gRNA sequence
ttgagaagatttcattaaca

SEQ ID NO: 373516 - DNA, 20 bp, Artificial
  CRISPR gRNA sequence
tgagaagatttcattaacaa

SEQ ID NO: 373517 - DNA, 20 bp, Artificial
  CRISPR gRNA sequence
gagaagatttcattaacaaa

SEQ ID NO: 373518 - DNA, 20 bp, Artificial
  CRISPR gRNA sequence
aagatttcattaacaaaggg

SEQ ID NO: 373519 - DNA, 20 bp, Artificial
  CRISPR gRNA sequence
agatttcattaacaaagggt

SEQ ID NO: 373520 - DNA, 20 bp, Artificial
  CRISPR gRNA sequence
gatttcattaacaaagggtg

SEQ ID NO: 373521 - DNA, 20 bp, Artificial
  CRISPR gRNA sequence
aaagggtggggtattttctg

SEQ ID NO: 373522 - DNA, 20 bp, Artificial
  CRISPR gRNA sequence
aagggtggggtattttctgt

SEQ ID NO: 373523 - DNA, 20 bp, Artificial
  CRISPR gRNA sequence
gcaatgtgtaaatgaaccca

SEQ ID NO: 373524 - DNA, 20 bp, Artificial
  CRISPR gRNA sequence
caatgtgtaaatgaacccat

SEQ ID NO: 373525 - DNA, 20 bp, Artificial
  CRISPR gRNA sequence
atgtgtaaatgaacccatgg

SEQ ID NO: 373526 - DNA, 20 bp, Artificial
  CRISPR gRNA sequence
tgtgtaaatgaacccatggg

SEQ ID NO: 373527 - DNA, 20 bp, Artificial
  CRISPR gRNA sequence
gtgtaaatgaacccatggga

SEQ ID NO: 373528 - DNA, 20 bp, Artificial
  CRISPR gRNA sequence
taaatgaacccatgggaggg

SEQ ID NO: 373529 - DNA, 20 bp, Artificial
  CRISPR gRNA sequence
ccatgggagggaagtttata

SEQ ID NO: 373530 - DNA, 20 bp, Artificial
  CRISPR gRNA sequence
gaagtttatacagaaaaata

SEQ ID NO: 373531 - DNA, 20 bp, Artificial
  CRISPR gRNA sequence
aagtttatacagaaaaatac

SEQ ID NO: 373532 - DNA, 20 bp, Artificial
  CRISPR gRNA sequence
cagaaaaatacaggctcacc

SEQ ID NO: 373533 - DNA, 20 bp, Artificial
  CRISPR gRNA sequence
aaatacaggctcaccaagta

SEQ ID NO: 373534 - DNA, 20 bp, Artificial
  CRISPR gRNA sequence
tcctgatgtcactgtgtctt

SEQ ID NO: 373535 - DNA, 20 bp, Artificial
  CRISPR gRNA sequence
tcagtttttcacatcttatg

SEQ ID NO: 373536 - DNA, 20 bp, Artificial
  CRISPR gRNA sequence
agtttttcacatcttatgtg

SEQ ID NO: 373537 - DNA, 20 bp, Artificial
  CRISPR gRNA sequence
tcacatcttatgtggagcat

SEQ ID NO: 373538 - DNA, 20 bp, Artificial
  CRISPR gRNA sequence
cacatcttatgtggagcatt

SEQ ID NO: 373539 - DNA, 20 bp, Artificial
  CRISPR gRNA sequence
tgtgtgtgtgtgtgtatgtg

SEQ ID NO: 373540 - DNA, 20 bp, Artificial
  CRISPR gRNA sequence
gtgtgtgtgtgtgtatgtgt

SEQ ID NO: 373541 - DNA, 20 bp, Artificial
  CRISPR gRNA sequence
tatgtgtaggtgtatgaact

SEQ ID NO: 373542 - DNA, 20 bp, Artificial
  CRISPR gRNA sequence
agatatctatgaatatttgt

SEQ ID NO: 373543 - DNA, 20 bp, Artificial
  CRISPR gRNA sequence
gatatctatgaatatttgtt

SEQ ID NO: 373544 - DNA, 20 bp, Artificial
  CRISPR gRNA sequence
tatctatgaatatttgttag

SEQ ID NO: 373545 - DNA, 20 bp, Artificial
  CRISPR gRNA sequence
atctatgaatatttgttagg

SEQ ID NO: 373546 - DNA, 20 bp, Artificial
  CRISPR gRNA sequence
ctatgaatatttgttaggag

SEQ ID NO: 373547 - DNA, 20 bp, Artificial
  CRISPR gRNA sequence
tatttgttaggaggagtaac

SEQ ID NO: 373548 - DNA, 20 bp, Artificial
  CRISPR gRNA sequence
ttatttttcaacctgccgta

SEQ ID NO: 373549 - DNA, 20 bp, Artificial
  CRISPR gRNA sequence
aacaaatacacacgattgtg

SEQ ID NO: 373550 - DNA, 20 bp, Artificial
  CRISPR gRNA sequence
acaaatacacacgattgtgt

SEQ ID NO: 373551 - DNA, 20 bp, Artificial
  CRISPR gRNA sequence
ccaaatattttaatccaaac

SEQ ID NO: 373552 - DNA, 20 bp, Artificial
  CRISPR gRNA sequence
actattttctcttcctgatc

SEQ ID NO: 373553 - DNA, 20 bp, Artificial
  CRISPR gRNA sequence
attttctcttcctgatccag

SEQ ID NO: 373554 - DNA, 20 bp, Artificial
  CRISPR gRNA sequence
tcttcctgatccagcagata

SEQ ID NO: 373555 - DNA, 20 bp, Artificial
  CRISPR gRNA sequence
cttcctgatccagcagataa

SEQ ID NO: 373556 - DNA, 20 bp, Artificial
  CRISPR gRNA sequence
gatccagcagataaaggtat

SEQ ID NO: 373557 - DNA, 20 bp, Artificial
  CRISPR gRNA sequence
ataattcatttttaaattat

SEQ ID NO: 373558 - DNA, 20 bp, Artificial
  CRISPR gRNA sequence
attattggctctttttaaaa

SEQ ID NO: 373559 - DNA, 20 bp, Artificial
  CRISPR gRNA sequence
tattggctctttttaaaaaa

SEQ ID NO: 373560 - DNA, 20 bp, Artificial
  CRISPR gRNA sequence
ttggctctttttaaaaaaga

SEQ ID NO: 373561 - DNA, 20 bp, Artificial
  CRISPR gRNA sequence
tctttttaaaaaagagagat

SEQ ID NO: 373562 - DNA, 20 bp, Artificial
  CRISPR gRNA sequence
tttaaaaaagagagatgaga

SEQ ID NO: 373563 - DNA, 20 bp, Artificial
  CRISPR gRNA sequence
ttaaaaaagagagatgagat

SEQ ID NO: 373564 - DNA, 20 bp, Artificial
  CRISPR gRNA sequence
tgagatgggttattaaactc

SEQ ID NO: 373565 - DNA, 20 bp, Artificial
  CRISPR gRNA sequence
agatgggttattaaactcta

SEQ ID NO: 373566 - DNA, 20 bp, Artificial
  CRISPR gRNA sequence
ttattaaactctagagcata

SEQ ID NO: 373567 - DNA, 20 bp, Artificial
  CRISPR gRNA sequence
ttaaactctagagcataaag

SEQ ID NO: 373568 - DNA, 20 bp, Artificial
  CRISPR gRNA sequence
aactctagagcataaagcag

SEQ ID NO: 373569 - DNA, 20 bp, Artificial
  CRISPR gRNA sequence
gcagattttgaaattattcc

SEQ ID NO: 373570 - DNA, 20 bp, Artificial
  CRISPR gRNA sequence
ttcctagttattatttctta

SEQ ID NO: 373571 - DNA, 20 bp, Artificial
  CRISPR gRNA sequence
tagttattatttcttatagc

SEQ ID NO: 373572 - DNA, 20 bp, Artificial
  CRISPR gRNA sequence
agttattatttcttatagcc

SEQ ID NO: 373573 - DNA, 20 bp, Artificial
  CRISPR gRNA sequence
ttatttcttatagccaggca

SEQ ID NO: 373574 - DNA, 20 bp, Artificial
  CRISPR gRNA sequence
tatttcttatagccaggcat

SEQ ID NO: 373575 - DNA, 20 bp, Artificial
  CRISPR gRNA sequence
gcataggctttcatgttttg

SEQ ID NO: 373576 - DNA, 20 bp, Artificial
  CRISPR gRNA sequence
ataggctttcatgttttgta

SEQ ID NO: 373577 - DNA, 20 bp, Artificial
  CRISPR gRNA sequence
ttcatgttttgtagagcact

SEQ ID NO: 373578 - DNA, 20 bp, Artificial
  CRISPR gRNA sequence
tcatgttttgtagagcactt

SEQ ID NO: 373579 - DNA, 20 bp, Artificial
  CRISPR gRNA sequence
catgttttgtagagcactta

SEQ ID NO: 373580 - DNA, 20 bp, Artificial
  CRISPR gRNA sequence
agggaatttttttcataaaa

SEQ ID NO: 373581 - DNA, 20 bp, Artificial
  CRISPR gRNA sequence
ttcataaaatggtttaaaat

SEQ ID NO: 373582 - DNA, 20 bp, Artificial
  CRISPR gRNA sequence
taaaatggtttaaaattgga

SEQ ID NO: 373583 - DNA, 20 bp, Artificial
  CRISPR gRNA sequence
ttaaaattggatagtctatt

SEQ ID NO: 373584 - DNA, 20 bp, Artificial
  CRISPR gRNA sequence
aaaattggatagtctatttg

SEQ ID NO: 373585 - DNA, 20 bp, Artificial
  CRISPR gRNA sequence
aaattggatagtctatttgg

SEQ ID NO: 373586 - DNA, 20 bp, Artificial
  CRISPR gRNA sequence
atagtctatttggaggtatt

SEQ ID NO: 373587 - DNA, 20 bp, Artificial
  CRISPR gRNA sequence
tatttggaggtattcagcct

SEQ ID NO: 373588 - DNA, 20 bp, Artificial
  CRISPR gRNA sequence
atttggaggtattcagccta

SEQ ID NO: 373589 - DNA, 20 bp, Artificial
  CRISPR gRNA sequence
gctgaatttcatattctgaa

SEQ ID NO: 373590 - DNA, 20 bp, Artificial
  CRISPR gRNA sequence
tacaacatttataacacctt

SEQ ID NO: 373591 - DNA, 20 bp, Artificial
  CRISPR gRNA sequence
tttataacacctttagatat

SEQ ID NO: 373592 - DNA, 20 bp, Artificial
  CRISPR gRNA sequence
aagtctttgtaaatgctata

SEQ ID NO: 373593 - DNA, 20 bp, Artificial
  CRISPR gRNA sequence
gctatatggtttgcattttc

SEQ ID NO: 373594 - DNA, 20 bp, Artificial
  CRISPR gRNA sequence
tttatttttatttttttttt

SEQ ID NO: 373595 - DNA, 20 bp, Artificial
  CRISPR gRNA sequence
tttttattttttttttgaga

SEQ ID NO: 373596 - DNA, 20 bp, Artificial
  CRISPR gRNA sequence
ttttattttttttttgagac

SEQ ID NO: 373597 - DNA, 20 bp, Artificial
  CRISPR gRNA sequence
caggttctcactctgttgcc

SEQ ID NO: 373598 - DNA, 20 bp, Artificial
  CRISPR gRNA sequence
aggttctcactctgttgccc

SEQ ID NO: 373599 - DNA, 20 bp, Artificial
  CRISPR gRNA sequence
tctcactctgttgcccaggc

SEQ ID NO: 373600 - DNA, 20 bp, Artificial
  CRISPR gRNA sequence
tcactctgttgcccaggctg

SEQ ID NO: 373601 - DNA, 20 bp, Artificial
  CRISPR gRNA sequence
ttgcccaggctggagtgcaa

SEQ ID NO: 373602 - DNA, 20 bp, Artificial
  CRISPR gRNA sequence
ggagtgcaatggcacgatct

SEQ ID NO: 373603 - DNA, 20 bp, Artificial
  CRISPR gRNA sequence
tcactgcaacctcctcctcc

SEQ ID NO: 373604 - DNA, 20 bp, Artificial
  CRISPR gRNA sequence
cactgcaacctcctcctcct

SEQ ID NO: 373605 - DNA, 20 bp, Artificial
  CRISPR gRNA sequence
aacctcctcctcctgggttc

SEQ ID NO: 373606 - DNA, 20 bp, Artificial
  CRISPR gRNA sequence
ttcaagcgattcttctgcct

SEQ ID NO: 373607 - DNA, 20 bp, Artificial
  CRISPR gRNA sequence
ttcttctgcctcagcctccc

SEQ ID NO: 373608 - DNA, 20 bp, Artificial
  CRISPR gRNA sequence
ttctgcctcagcctcccaag

SEQ ID NO: 373609 - DNA, 20 bp, Artificial
  CRISPR gRNA sequence
gcctcagcctcccaagcagc

SEQ ID NO: 373610 - DNA, 20 bp, Artificial
  CRISPR gRNA sequence
cctcagcctcccaagcagct

SEQ ID NO: 373611 - DNA, 20 bp, Artificial
  CRISPR gRNA sequence
ctcccaagcagctgggatta

SEQ ID NO: 373612 - DNA, 20 bp, Artificial
  CRISPR gRNA sequence
tcccaagcagctgggattac

SEQ ID NO: 373613 - DNA, 20 bp, Artificial
  CRISPR gRNA sequence
caggcacctgccaccatgcc

SEQ ID NO: 373614 - DNA, 20 bp, Artificial
  CRISPR gRNA sequence
ccagctaatttttgtatttt

SEQ ID NO: 373615 - DNA, 20 bp, Artificial
  CRISPR gRNA sequence
gctaatttttgtatttttag

SEQ ID NO: 373616 - DNA, 20 bp, Artificial
  CRISPR gRNA sequence
taatttttgtatttttagaa

SEQ ID NO: 373617 - DNA, 20 bp, Artificial
  CRISPR gRNA sequence
ttttgtatttttagaagaga

SEQ ID NO: 373618 - DNA, 20 bp, Artificial
  CRISPR gRNA sequence
tttgtatttttagaagagac

SEQ ID NO: 373619 - DNA, 20 bp, Artificial
  CRISPR gRNA sequence
ttgtatttttagaagagacg

SEQ ID NO: 373620 - DNA, 20 bp, Artificial
  CRISPR gRNA sequence
gagacggggtttcaccacat

SEQ ID NO: 373621 - DNA, 20 bp, Artificial
  CRISPR gRNA sequence
ggggtttcaccacattggtc

SEQ ID NO: 373622 - DNA, 20 bp, Artificial
  CRISPR gRNA sequence
tttcaccacattggtcaagc

SEQ ID NO: 373623 - DNA, 20 bp, Artificial
  CRISPR gRNA sequence
cattggtcaagctggtctcg

SEQ ID NO: 373624 - DNA, 20 bp, Artificial
  CRISPR gRNA sequence
tggtctcgaagtcctgacct

SEQ ID NO: 373625 - DNA, 20 bp, Artificial
  CRISPR gRNA sequence
ggtctcgaagtcctgacctc

SEQ ID NO: 373626 - DNA, 20 bp, Artificial
  CRISPR gRNA sequence
ctcaggtgatccacccacct

SEQ ID NO: 373627 - DNA, 20 bp, Artificial
  CRISPR gRNA sequence
ccacccacctcggccttcca

SEQ ID NO: 373628 - DNA, 20 bp, Artificial
  CRISPR gRNA sequence
acctcggccttccaaagtgc

SEQ ID NO: 373629 - DNA, 20 bp, Artificial
  CRISPR gRNA sequence
cctcggccttccaaagtgcc

SEQ ID NO: 373630 - DNA, 20 bp, Artificial
  CRISPR gRNA sequence
cttccaaagtgccgggattg

SEQ ID NO: 373631 - DNA, 20 bp, Artificial
  CRISPR gRNA sequence
agtgccgggattgcagacgt

SEQ ID NO: 373632 - DNA, 20 bp, Artificial
  CRISPR gRNA sequence
cagacgtgagccactgcacc

SEQ ID NO: 373633 - DNA, 20 bp, Artificial
  CRISPR gRNA sequence
ctgcacctggtcacattttg

SEQ ID NO: 373634 - DNA, 20 bp, Artificial
  CRISPR gRNA sequence
gtcacattttgaagttttct

SEQ ID NO: 373635 - DNA, 20 bp, Artificial
  CRISPR gRNA sequence
tcacattttgaagttttcta

SEQ ID NO: 373636 - DNA, 20 bp, Artificial
  CRISPR gRNA sequence
ttgaagttttctaaggaccc

SEQ ID NO: 373637 - DNA, 20 bp, Artificial
  CRISPR gRNA sequence
tgaagttttctaaggaccca

SEQ ID NO: 373638 - DNA, 20 bp, Artificial
  CRISPR gRNA sequence
gttttctaaggacccaagga

SEQ ID NO: 373639 - DNA, 20 bp, Artificial
  CRISPR gRNA sequence
tttctaaggacccaaggaaa

SEQ ID NO: 373640 - DNA, 20 bp, Artificial
  CRISPR gRNA sequence
ggacccaaggaaagagttat

SEQ ID NO: 373641 - DNA, 20 bp, Artificial
  CRISPR gRNA sequence
cccaaggaaagagttataag

SEQ ID NO: 373642 - DNA, 20 bp, Artificial
  CRISPR gRNA sequence
gagttataagtagctgttct

SEQ ID NO: 373643 - DNA, 20 bp, Artificial
  CRISPR gRNA sequence
gttctaagaattacgtgtca

SEQ ID NO: 373644 - DNA, 20 bp, Artificial
  CRISPR gRNA sequence
ttctaagaattacgtgtcac

SEQ ID NO: 373645 - DNA, 20 bp, Artificial
  CRISPR gRNA sequence
tctaagaattacgtgtcaca

SEQ ID NO: 373646 - DNA, 20 bp, Artificial
  CRISPR gRNA sequence
cgtgtcacagggctttgtct

SEQ ID NO: 373647 - DNA, 20 bp, Artificial
  CRISPR gRNA sequence
taccatgtttctatgtgtgc

SEQ ID NO: 373648 - DNA, 20 bp, Artificial
  CRISPR gRNA sequence
catgtttctatgtgtgccag

SEQ ID NO: 373649 - DNA, 20 bp, Artificial
  CRISPR gRNA sequence
tgtgtgccagtggctgttct

SEQ ID NO: 373650 - DNA, 20 bp, Artificial
  CRISPR gRNA sequence
ctgttctgagaatttactcg

SEQ ID NO: 373651 - DNA, 20 bp, Artificial
  CRISPR gRNA sequence
agttactgatttacttgtca

SEQ ID NO: 373652 - DNA, 20 bp, Artificial
  CRISPR gRNA sequence
tactgatttacttgtcacag

SEQ ID NO: 373653 - DNA, 20 bp, Artificial
  CRISPR gRNA sequence
ctgcccacgtttgacgtctg

SEQ ID NO: 373654 - DNA, 20 bp, Artificial
  CRISPR gRNA sequence
ccacgtttgacgtctgtgga

SEQ ID NO: 373655 - DNA, 20 bp, Artificial
  CRISPR gRNA sequence
gtttgacgtctgtggaaagt

SEQ ID NO: 373656 - DNA, 20 bp, Artificial
  CRISPR gRNA sequence
tttgacgtctgtggaaagtg

SEQ ID NO: 373657 - DNA, 20 bp, Artificial
  CRISPR gRNA sequence
cgtctgtggaaagtgaggta

SEQ ID NO: 373658 - DNA, 20 bp, Artificial
  CRISPR gRNA sequence
tctgtggaaagtgaggtatg

SEQ ID NO: 373659 - DNA, 20 bp, Artificial
  CRISPR gRNA sequence
tgtggaaagtgaggtatgga

SEQ ID NO: 373660 - DNA, 20 bp, Artificial
  CRISPR gRNA sequence
agtgaggtatggagagttga

SEQ ID NO: 373661 - DNA, 20 bp, Artificial
  CRISPR gRNA sequence
gtgaggtatggagagttgac

SEQ ID NO: 373662 - DNA, 20 bp, Artificial
  CRISPR gRNA sequence
agagttgacgggacttatct

SEQ ID NO: 373663 - DNA, 20 bp, Artificial
  CRISPR gRNA sequence
gagttgacgggacttatctc

SEQ ID NO: 373664 - DNA, 20 bp, Artificial
  CRISPR gRNA sequence
gacgggacttatctcaggct

SEQ ID NO: 373665 - DNA, 20 bp, Artificial
  CRISPR gRNA sequence
caggcttggtaactaataaa

SEQ ID NO: 373666 - DNA, 20 bp, Artificial
  CRISPR gRNA sequence
ggcttggtaactaataaata

SEQ ID NO: 373667 - DNA, 20 bp, Artificial
  CRISPR gRNA sequence
gcttggtaactaataaatag

SEQ ID NO: 373668 - DNA, 20 bp, Artificial
  CRISPR gRNA sequence
cttggtaactaataaataga

SEQ ID NO: 373669 - DNA, 20 bp, Artificial
  CRISPR gRNA sequence
ttggtaactaataaatagag

SEQ ID NO: 373670 - DNA, 20 bp, Artificial
  CRISPR gRNA sequence
gtaactaataaatagagggg

SEQ ID NO: 373671 - DNA, 20 bp, Artificial
  CRISPR gRNA sequence
taactaataaatagaggggc

SEQ ID NO: 373672 - DNA, 20 bp, Artificial
  CRISPR gRNA sequence
aactaataaatagaggggca

SEQ ID NO: 373673 - DNA, 20 bp, Artificial
  CRISPR gRNA sequence
taaatagaggggcagggatt

SEQ ID NO: 373674 - DNA, 20 bp, Artificial
  CRISPR gRNA sequence
gaggggcagggattcagatg

SEQ ID NO: 373675 - DNA, 20 bp, Artificial
  CRISPR gRNA sequence
aggggcagggattcagatgc

SEQ ID NO: 373676 - DNA, 20 bp, Artificial
  CRISPR gRNA sequence
ggattcagatgcgggctgac

SEQ ID NO: 373677 - DNA, 20 bp, Artificial
  CRISPR gRNA sequence
agatgcgggctgactggctt

SEQ ID NO: 373678 - DNA, 20 bp, Artificial
  CRISPR gRNA sequence
atgcgggctgactggcttca

SEQ ID NO: 373679 - DNA, 20 bp, Artificial
  CRISPR gRNA sequence
ggcttcagagttcctattct

SEQ ID NO: 373680 - DNA, 20 bp, Artificial
  CRISPR gRNA sequence
agagttcctattcttggccc

SEQ ID NO: 373681 - DNA, 20 bp, Artificial
  CRISPR gRNA sequence
cagcactacttttctgctca

SEQ ID NO: 373682 - DNA, 20 bp, Artificial
  CRISPR gRNA sequence
cactacttttctgctcaaag

SEQ ID NO: 373683 - DNA, 20 bp, Artificial
  CRISPR gRNA sequence
tacttttctgctcaaagtgg

SEQ ID NO: 373684 - DNA, 20 bp, Artificial
  CRISPR gRNA sequence
cttttctgctcaaagtggaa

SEQ ID NO: 373685 - DNA, 20 bp, Artificial
  CRISPR gRNA sequence
aagagaaaaactactctcat

SEQ ID NO: 373686 - DNA, 20 bp, Artificial
  CRISPR gRNA sequence
agagaaaaactactctcatc

SEQ ID NO: 373687 - DNA, 20 bp, Artificial
  CRISPR gRNA sequence
agaaaaactactctcatcag

SEQ ID NO: 373688 - DNA, 20 bp, Artificial
  CRISPR gRNA sequence
catcaggagactcatcacaa

SEQ ID NO: 373689 - DNA, 20 bp, Artificial
  CRISPR gRNA sequence
caggagactcatcacaacag

SEQ ID NO: 373690 - DNA, 20 bp, Artificial
  CRISPR gRNA sequence
agactcatcacaacagaagc

SEQ ID NO: 373691 - DNA, 20 bp, Artificial
  CRISPR gRNA sequence
atcacaacagaagctggtga

SEQ ID NO: 373692 - DNA, 20 bp, Artificial
  CRISPR gRNA sequence
acaacagaagctggtgacgg

SEQ ID NO: 373693 - DNA, 20 bp, Artificial
  CRISPR gRNA sequence
aacagaagctggtgacggtg

SEQ ID NO: 373694 - DNA, 20 bp, Artificial
  CRISPR gRNA sequence
agctggtgacggtggagcta

SEQ ID NO: 373695 - DNA, 20 bp, Artificial
  CRISPR gRNA sequence
ctggtgacggtggagctaca

SEQ ID NO: 373696 - DNA, 20 bp, Artificial
  CRISPR gRNA sequence
gctacagagcgtccttcttc

SEQ ID NO: 373697 - DNA, 20 bp, Artificial
  CRISPR gRNA sequence
tacagagcgtccttcttcaa

SEQ ID NO: 373698 - DNA, 20 bp, Artificial
  CRISPR gRNA sequence
acagagcgtccttcttcaag

SEQ ID NO: 373699 - DNA, 20 bp, Artificial
  CRISPR gRNA sequence
cttcttcaagaggtttatac

SEQ ID NO: 373700 - DNA, 20 bp, Artificial
  CRISPR gRNA sequence
caagaggtttatacaagtga

SEQ ID NO: 373701 - DNA, 20 bp, Artificial
  CRISPR gRNA sequence
aagaggtttatacaagtgat

SEQ ID NO: 373702 - DNA, 20 bp, Artificial
  CRISPR gRNA sequence
tttatacaagtgataggttt

SEQ ID NO: 373703 - DNA, 20 bp, Artificial
  CRISPR gRNA sequence
ttatacaagtgataggtttc

SEQ ID NO: 373704 - DNA, 20 bp, Artificial
  CRISPR gRNA sequence
tttcaggctgaaccaatgtc

SEQ ID NO: 373705 - DNA, 20 bp, Artificial
  CRISPR gRNA sequence
tcaggctgaaccaatgtcta

SEQ ID NO: 373706 - DNA, 20 bp, Artificial
  CRISPR gRNA sequence
gctgaaccaatgtctagagc

SEQ ID NO: 373707 - DNA, 20 bp, Artificial
  CRISPR gRNA sequence
accaatgtctagagcaagtt

SEQ ID NO: 373708 - DNA, 20 bp, Artificial
  CRISPR gRNA sequence
ccaatgtctagagcaagttt

SEQ ID NO: 373709 - DNA, 20 bp, Artificial
  CRISPR gRNA sequence
gtctagagcaagtttaggca

SEQ ID NO: 373710 - DNA, 20 bp, Artificial
  CRISPR gRNA sequence
tctagagcaagtttaggcaa

SEQ ID NO: 373711 - DNA, 20 bp, Artificial
  CRISPR gRNA sequence
tagagcaagtttaggcaaag

SEQ ID NO: 373712 - DNA, 20 bp, Artificial
  CRISPR gRNA sequence
gcaagtttaggcaaaggagt

SEQ ID NO: 373713 - DNA, 20 bp, Artificial
  CRISPR gRNA sequence
caagtttaggcaaaggagtc

SEQ ID NO: 373714 - DNA, 20 bp, Artificial
  CRISPR gRNA sequence
aagtttaggcaaaggagtcg

SEQ ID NO: 373715 - DNA, 20 bp, Artificial
  CRISPR gRNA sequence
gtttaggcaaaggagtcggg

SEQ ID NO: 373716 - DNA, 20 bp, Artificial
  CRISPR gRNA sequence
taggcaaaggagtcggggag

SEQ ID NO: 373717 - DNA, 20 bp, Artificial
  CRISPR gRNA sequence
aggcaaaggagtcggggagc

SEQ ID NO: 373718 - DNA, 20 bp, Artificial
  CRISPR gRNA sequence
ggcaaaggagtcggggagcg

SEQ ID NO: 373719 - DNA, 20 bp, Artificial
  CRISPR gRNA sequence
gcaaaggagtcggggagcgg

SEQ ID NO: 373720 - DNA, 20 bp, Artificial
  CRISPR gRNA sequence
aaggagtcggggagcggggg

SEQ ID NO: 373721 - DNA, 20 bp, Artificial
  CRISPR gRNA sequence
cggggagcgggggtggttcg

SEQ ID NO: 373722 - DNA, 20 bp, Artificial
  CRISPR gRNA sequence
ggtctcccgctactttattt

SEQ ID NO: 373723 - DNA, 20 bp, Artificial
  CRISPR gRNA sequence
cccgctactttatttcagct

SEQ ID NO: 373724 - DNA, 20 bp, Artificial
  CRISPR gRNA sequence
ccgctactttatttcagctc

SEQ ID NO: 373725 - DNA, 20 bp, Artificial
  CRISPR gRNA sequence
ttcgctgacgccaatgctat

SEQ ID NO: 373726 - DNA, 20 bp, Artificial
  CRISPR gRNA sequence
tcgctgacgccaatgctatg

SEQ ID NO: 373727 - DNA, 20 bp, Artificial
  CRISPR gRNA sequence
cgctgacgccaatgctatga

SEQ ID NO: 373728 - DNA, 20 bp, Artificial
  CRISPR gRNA sequence
gctgacgccaatgctatgag

SEQ ID NO: 373729 - DNA, 20 bp, Artificial
  CRISPR gRNA sequence
cttccttcctgtcttccttc

SEQ ID NO: 373730 - DNA, 20 bp, Artificial
  CRISPR gRNA sequence
ttccttcctgtcttccttct

SEQ ID NO: 373731 - DNA, 20 bp, Artificial
  CRISPR gRNA sequence
tccttcctgtcttccttcta

SEQ ID NO: 373732 - DNA, 20 bp, Artificial
  CRISPR gRNA sequence
ccttcctgtcttccttctag

SEQ ID NO: 373733 - DNA, 20 bp, Artificial
  CRISPR gRNA sequence
ctaggggcttgtgcacatca

SEQ ID NO: 373734 - DNA, 20 bp, Artificial
  CRISPR gRNA sequence
aggggcttgtgcacatcatg

SEQ ID NO: 373735 - DNA, 20 bp, Artificial
  CRISPR gRNA sequence
tgcacatcatggagtcacgt

SEQ ID NO: 373736 - DNA, 20 bp, Artificial
  CRISPR gRNA sequence
gcacatcatggagtcacgtg

SEQ ID NO: 373737 - DNA, 20 bp, Artificial
  CRISPR gRNA sequence
catcatggagtcacgtgagg

SEQ ID NO: 373738 - DNA, 20 bp, Artificial
  CRISPR gRNA sequence
atcatggagtcacgtgaggc

SEQ ID NO: 373739 - DNA, 20 bp, Artificial
  CRISPR gRNA sequence
cgtgaggcaggctgtccaca

SEQ ID NO: 373740 - DNA, 20 bp, Artificial
  CRISPR gRNA sequence
ggctgtccacacagtgccat

SEQ ID NO: 373741 - DNA, 20 bp, Artificial
  CRISPR gRNA sequence
gctgtccacacagtgccatg

SEQ ID NO: 373742 - DNA, 20 bp, Artificial
  CRISPR gRNA sequence
ctgtccacacagtgccatga

SEQ ID NO: 373743 - DNA, 20 bp, Artificial
  CRISPR gRNA sequence
ccacacagtgccatgaggga

SEQ ID NO: 373744 - DNA, 20 bp, Artificial
  CRISPR gRNA sequence
cacacagtgccatgagggac

SEQ ID NO: 373745 - DNA, 20 bp, Artificial
  CRISPR gRNA sequence
ccatgagggacaggcacaat

SEQ ID NO: 373746 - DNA, 20 bp, Artificial
  CRISPR gRNA sequence
catgagggacaggcacaatc

SEQ ID NO: 373747 - DNA, 20 bp, Artificial
  CRISPR gRNA sequence
gagggacaggcacaatcagg

SEQ ID NO: 373748 - DNA, 20 bp, Artificial
  CRISPR gRNA sequence
ggacaggcacaatcaggtag

SEQ ID NO: 373749 - DNA, 20 bp, Artificial
  CRISPR gRNA sequence
gacaggcacaatcaggtagc

SEQ ID NO: 373750 - DNA, 20 bp, Artificial
  CRISPR gRNA sequence
acaatcaggtagcaggtgtg

SEQ ID NO: 373751 - DNA, 20 bp, Artificial
  CRISPR gRNA sequence
caatcaggtagcaggtgtga

SEQ ID NO: 373752 - DNA, 20 bp, Artificial
  CRISPR gRNA sequence
aggtagcaggtgtgaaggcc

SEQ ID NO: 373753 - DNA, 20 bp, Artificial
  CRISPR gRNA sequence
gtagcaggtgtgaaggcctg

SEQ ID NO: 373754 - DNA, 20 bp, Artificial
  CRISPR gRNA sequence
tagcaggtgtgaaggcctgg

SEQ ID NO: 373755 - DNA, 20 bp, Artificial
  CRISPR gRNA sequence
agcaggtgtgaaggcctgga

SEQ ID NO: 373756 - DNA, 20 bp, Artificial
  CRISPR gRNA sequence
gcaggtgtgaaggcctggag

SEQ ID NO: 373757 - DNA, 20 bp, Artificial
  CRISPR gRNA sequence
aggtgtgaaggcctggaggg

SEQ ID NO: 373758 - DNA, 20 bp, Artificial
  CRISPR gRNA sequence
ggtgtgaaggcctggagggg

SEQ ID NO: 373759 - DNA, 20 bp, Artificial
  CRISPR gRNA sequence
aaggcctggaggggaggtgc

SEQ ID NO: 373760 - DNA, 20 bp, Artificial
  CRISPR gRNA sequence
ggaggggaggtgctggttgc

SEQ ID NO: 373761 - DNA, 20 bp, Artificial
  CRISPR gRNA sequence
ggaggtgctggttgctggtg

SEQ ID NO: 373762 - DNA, 20 bp, Artificial
  CRISPR gRNA sequence
tggtgaagtcaaatccacac

SEQ ID NO: 373763 - DNA, 20 bp, Artificial
  CRISPR gRNA sequence
ggtgaagtcaaatccacacc

SEQ ID NO: 373764 - DNA, 20 bp, Artificial
  CRISPR gRNA sequence
agtcaaatccacaccaggaa

SEQ ID NO: 373765 - DNA, 20 bp, Artificial
  CRISPR gRNA sequence
aatccacaccaggaacagat

SEQ ID NO: 373766 - DNA, 20 bp, Artificial
  CRISPR gRNA sequence
atccacaccaggaacagatt

SEQ ID NO: 373767 - DNA, 20 bp, Artificial
  CRISPR gRNA sequence
tccacaccaggaacagatta

SEQ ID NO: 373768 - DNA, 20 bp, Artificial
  CRISPR gRNA sequence
ccacaccaggaacagattag

SEQ ID NO: 373769 - DNA, 20 bp, Artificial
  CRISPR gRNA sequence
ggaacagattaggggaactt

SEQ ID NO: 373770 - DNA, 20 bp, Artificial
  CRISPR gRNA sequence
gaacagattaggggaacttt

SEQ ID NO: 373771 - DNA, 20 bp, Artificial
  CRISPR gRNA sequence
acagattaggggaactttag

SEQ ID NO: 373772 - DNA, 20 bp, Artificial
  CRISPR gRNA sequence
gattaggggaactttaggag

SEQ ID NO: 373773 - DNA, 20 bp, Artificial
  CRISPR gRNA sequence
ttaggagtagcctctgcgca

SEQ ID NO: 373774 - DNA, 20 bp, Artificial
  CRISPR gRNA sequence
taggagtagcctctgcgcaa

SEQ ID NO: 373775 - DNA, 20 bp, Artificial
  CRISPR gRNA sequence
ggagtagcctctgcgcaaag

SEQ ID NO: 373776 - DNA, 20 bp, Artificial
  CRISPR gRNA sequence
gcctctgcgcaaaggagacc

SEQ ID NO: 373777 - DNA, 20 bp, Artificial
  CRISPR gRNA sequence
gcgcaaaggagacctggtga

SEQ ID NO: 373778 - DNA, 20 bp, Artificial
  CRISPR gRNA sequence
aaggagacctggtgatggct

SEQ ID NO: 373779 - DNA, 20 bp, Artificial
  CRISPR gRNA sequence
aggagacctggtgatggctc

SEQ ID NO: 373780 - DNA, 20 bp, Artificial
  CRISPR gRNA sequence
tggtgatggctcaggtctca

SEQ ID NO: 373781 - DNA, 20 bp, Artificial
  CRISPR gRNA sequence
ggtgatggctcaggtctcat

SEQ ID NO: 373782 - DNA, 20 bp, Artificial
  CRISPR gRNA sequence
tggctcaggtctcataggca

SEQ ID NO: 373783 - DNA, 20 bp, Artificial
  CRISPR gRNA sequence
ggtctcataggcacagcttc

SEQ ID NO: 373784 - DNA, 20 bp, Artificial
  CRISPR gRNA sequence
cacagcttctggccactaca

SEQ ID NO: 373785 - DNA, 20 bp, Artificial
  CRISPR gRNA sequence
ctacaaagcacctgttctca

SEQ ID NO: 373786 - DNA, 20 bp, Artificial
  CRISPR gRNA sequence
acctgttctcatggcctcac

SEQ ID NO: 373787 - DNA, 20 bp, Artificial
  CRISPR gRNA sequence
gcctcaccagatccacccac

SEQ ID NO: 373788 - DNA, 20 bp, Artificial
  CRISPR gRNA sequence
cccactggacgcttcctgtg

SEQ ID NO: 373789 - DNA, 20 bp, Artificial
  CRISPR gRNA sequence
ccactggacgcttcctgtgt

SEQ ID NO: 373790 - DNA, 20 bp, Artificial
  CRISPR gRNA sequence
tggacgcttcctgtgtggga

SEQ ID NO: 373791 - DNA, 20 bp, Artificial
  CRISPR gRNA sequence
ggaaagtccactcccttgaa

SEQ ID NO: 373792 - DNA, 20 bp, Artificial
  CRISPR gRNA sequence
cactcccttgaacagctttc

SEQ ID NO: 373793 - DNA, 20 bp, Artificial
  CRISPR gRNA sequence
actcccttgaacagctttcc

SEQ ID NO: 373794 - DNA, 20 bp, Artificial
  CRISPR gRNA sequence
gctttccaggaatctgctaa

SEQ ID NO: 373795 - DNA, 20 bp, Artificial
  CRISPR gRNA sequence
ggaatctgctaaaagttccc

SEQ ID NO: 373796 - DNA, 20 bp, Artificial
  CRISPR gRNA sequence
cgcccttccttcctccttct

SEQ ID NO: 373797 - DNA, 20 bp, Artificial
  CRISPR gRNA sequence
gcccttccttcctccttctg

SEQ ID NO: 373798 - DNA, 20 bp, Artificial
  CRISPR gRNA sequence
tgctctcttgctcttgtgcc

SEQ ID NO: 373799 - DNA, 20 bp, Artificial
  CRISPR gRNA sequence
ctcttgtgcccagaccgtaa

SEQ ID NO: 373800 - DNA, 20 bp, Artificial
  CRISPR gRNA sequence
ccgtaatggcttcttgaaac

SEQ ID NO: 373801 - DNA, 20 bp, Artificial
  CRISPR gRNA sequence
gtaatggcttcttgaaacca

SEQ ID NO: 373802 - DNA, 20 bp, Artificial
  CRISPR gRNA sequence
tggcttcttgaaaccagagc

SEQ ID NO: 373803 - DNA, 20 bp, Artificial
  CRISPR gRNA sequence
gcttcttgaaaccagagctg

SEQ ID NO: 373804 - DNA, 20 bp, Artificial
  CRISPR gRNA sequence
gaaaccagagctggagtaat

SEQ ID NO: 373805 - DNA, 20 bp, Artificial
  CRISPR gRNA sequence
agctggagtaatcagaatac

SEQ ID NO: 373806 - DNA, 20 bp, Artificial
  CRISPR gRNA sequence
aatactagtccctccttcct

SEQ ID NO: 373807 - DNA, 20 bp, Artificial
  CRISPR gRNA sequence
atactagtccctccttcctt

SEQ ID NO: 373808 - DNA, 20 bp, Artificial
  CRISPR gRNA sequence
tactagtccctccttcctta

SEQ ID NO: 373809 - DNA, 20 bp, Artificial
  CRISPR gRNA sequence
agtccctccttccttaggga

SEQ ID NO: 373810 - DNA, 20 bp, Artificial
  CRISPR gRNA sequence
cctccttccttagggacagt

SEQ ID NO: 373811 - DNA, 20 bp, Artificial
  CRISPR gRNA sequence
ctccttccttagggacagtg

SEQ ID NO: 373812 - DNA, 20 bp, Artificial
  CRISPR gRNA sequence
tccttccttagggacagtga

SEQ ID NO: 373813 - DNA, 20 bp, Artificial
  CRISPR gRNA sequence
aatctcccttccaaaaacaa

SEQ ID NO: 373814 - DNA, 20 bp, Artificial
  CRISPR gRNA sequence
tatgttctctcatgtttatg

SEQ ID NO: 373815 - DNA, 20 bp, Artificial
  CRISPR gRNA sequence
tttatgtagtttatattgta

SEQ ID NO: 373816 - DNA, 20 bp, Artificial
  CRISPR gRNA sequence
aaatacataatatatttaaa

SEQ ID NO: 373817 - DNA, 20 bp, Artificial
  CRISPR gRNA sequence
cataatatatttaaatggta

SEQ ID NO: 373818 - DNA, 20 bp, Artificial
  CRISPR gRNA sequence
gtgtgtcctgttgcaacctg

SEQ ID NO: 373819 - DNA, 20 bp, Artificial
  CRISPR gRNA sequence
ctgttgcaacctgcagacac

SEQ ID NO: 373820 - DNA, 20 bp, Artificial
  CRISPR gRNA sequence
tgttgcaacctgcagacacc

SEQ ID NO: 373821 - DNA, 20 bp, Artificial
  CRISPR gRNA sequence
tgaaaaatttcctatttcct

SEQ ID NO: 373822 - DNA, 20 bp, Artificial
  CRISPR gRNA sequence
gaaaaatttcctatttcctg

SEQ ID NO: 373823 - DNA, 20 bp, Artificial
  CRISPR gRNA sequence
atttcctatttcctgaggat

SEQ ID NO: 373824 - DNA, 20 bp, Artificial
  CRISPR gRNA sequence
tttcctgaggataagcataa

SEQ ID NO: 373825 - DNA, 20 bp, Artificial
  CRISPR gRNA sequence
cctgaggataagcataatgg

SEQ ID NO: 373826 - DNA, 20 bp, Artificial
  CRISPR gRNA sequence
ataatggtagcactgtaatg

SEQ ID NO: 373827 - DNA, 20 bp, Artificial
  CRISPR gRNA sequence
aatggtagcactgtaatgta

SEQ ID NO: 373828 - DNA, 20 bp, Artificial
  CRISPR gRNA sequence
agttatacctgattaaacaa

SEQ ID NO: 373829 - DNA, 20 bp, Artificial
  CRISPR gRNA sequence
ttaaacaacagtaataataa

SEQ ID NO: 373830 - DNA, 20 bp, Artificial
  CRISPR gRNA sequence
cagtaataataaaagtgtgc

SEQ ID NO: 373831 - DNA, 20 bp, Artificial
  CRISPR gRNA sequence
gtaataataaaagtgtgccg

SEQ ID NO: 373832 - DNA, 20 bp, Artificial
  CRISPR gRNA sequence
gtgtgccggagaaatataat

SEQ ID NO: 373833 - DNA, 20 bp, Artificial
  CRISPR gRNA sequence
aacaaaatctcctccctacc

SEQ ID NO: 373834 - DNA, 20 bp, Artificial
  CRISPR gRNA sequence
acccagaaaactgctccaca

SEQ ID NO: 373835 - DNA, 20 bp, Artificial
  CRISPR gRNA sequence
cccagaaaactgctccacaa

SEQ ID NO: 373836 - DNA, 20 bp, Artificial
  CRISPR gRNA sequence
agaaaactgctccacaaagg

SEQ ID NO: 373837 - DNA, 20 bp, Artificial
  CRISPR gRNA sequence
aaataattttgttattgaat

SEQ ID NO: 373838 - DNA, 20 bp, Artificial
  CRISPR gRNA sequence
ttattgaataagcactaaat

SEQ ID NO: 373839 - DNA, 20 bp, Artificial
  CRISPR gRNA sequence
tcagaatgtaatgcatgtca

SEQ ID NO: 373840 - DNA, 20 bp, Artificial
  CRISPR gRNA sequence
cagaatgtaatgcatgtcac

SEQ ID NO: 373841 - DNA, 20 bp, Artificial
  CRISPR gRNA sequence
catgtcacaggcaacctcct

SEQ ID NO: 373842 - DNA, 20 bp, Artificial
  CRISPR gRNA sequence
tgtcacaggcaacctcctaa

SEQ ID NO: 373843 - DNA, 20 bp, Artificial
  CRISPR gRNA sequence
caacctcctaagagactgca

SEQ ID NO: 373844 - DNA, 20 bp, Artificial
  CRISPR gRNA sequence
cctaagagactgcaaagaca

SEQ ID NO: 373845 - DNA, 20 bp, Artificial
  CRISPR gRNA sequence
agaaatctcactctctcata

SEQ ID NO: 373846 - DNA, 20 bp, Artificial
  CRISPR gRNA sequence
tctcactctctcatacagcc

SEQ ID NO: 373847 - DNA, 20 bp, Artificial
  CRISPR gRNA sequence
cactctctcatacagccaag

SEQ ID NO: 373848 - DNA, 20 bp, Artificial
  CRISPR gRNA sequence
cccattacatacatgctcta

SEQ ID NO: 373849 - DNA, 20 bp, Artificial
  CRISPR gRNA sequence
ctctaaagatgaatgataac

SEQ ID NO: 373850 - DNA, 20 bp, Artificial
  CRISPR gRNA sequence
atgaatgataactagtcttc

SEQ ID NO: 373851 - DNA, 20 bp, Artificial
  CRISPR gRNA sequence
atgataactagtcttcaagt

SEQ ID NO: 373852 - DNA, 20 bp, Artificial
  CRISPR gRNA sequence
gataactagtcttcaagtaa

SEQ ID NO: 373853 - DNA, 20 bp, Artificial
  CRISPR gRNA sequence
ataactagtcttcaagtaag

SEQ ID NO: 373854 - DNA, 20 bp, Artificial
  CRISPR gRNA sequence
taactagtcttcaagtaaga

SEQ ID NO: 373855 - DNA, 20 bp, Artificial
  CRISPR gRNA sequence
cttcaagtaagagggcttgt

SEQ ID NO: 373856 - DNA, 20 bp, Artificial
  CRISPR gRNA sequence
ttgtcacacatgcttcatcc

SEQ ID NO: 373857 - DNA, 20 bp, Artificial
  CRISPR gRNA sequence
tgcttcatcctagattcaac

SEQ ID NO: 373858 - DNA, 20 bp, Artificial
  CRISPR gRNA sequence
tcctagattcaactggtaat

SEQ ID NO: 373859 - DNA, 20 bp, Artificial
  CRISPR gRNA sequence
cctagattcaactggtaatt

SEQ ID NO: 373860 - DNA, 20 bp, Artificial
  CRISPR gRNA sequence
ctagattcaactggtaattg

SEQ ID NO: 373861 - DNA, 20 bp, Artificial
  CRISPR gRNA sequence
ttggggatgactgtgtgtgt

SEQ ID NO: 373862 - DNA, 20 bp, Artificial
  CRISPR gRNA sequence
tgtgtgtgttagctaataat

SEQ ID NO: 373863 - DNA, 20 bp, Artificial
  CRISPR gRNA sequence
ctaataattggctttatcca

SEQ ID NO: 373864 - DNA, 20 bp, Artificial
  CRISPR gRNA sequence
taataattggctttatccaa

SEQ ID NO: 373865 - DNA, 20 bp, Artificial
  CRISPR gRNA sequence
aacttctcacatctttatga

SEQ ID NO: 373866 - DNA, 20 bp, Artificial
  CRISPR gRNA sequence
acttctcacatctttatgac

SEQ ID NO: 373867 - DNA, 20 bp, Artificial
  CRISPR gRNA sequence
ttctcacatctttatgacag

SEQ ID NO: 373868 - DNA, 20 bp, Artificial
  CRISPR gRNA sequence
tctcacatctttatgacagg

SEQ ID NO: 373869 - DNA, 20 bp, Artificial
  CRISPR gRNA sequence
aggaggtacttttgcacctt

SEQ ID NO: 373870 - DNA, 20 bp, Artificial
  CRISPR gRNA sequence
ggtacttttgcaccttgagt

SEQ ID NO: 373871 - DNA, 20 bp, Artificial
  CRISPR gRNA sequence
gtacttttgcaccttgagtg

SEQ ID NO: 373872 - DNA, 20 bp, Artificial
  CRISPR gRNA sequence
caccttgagtgaggtgcttg

SEQ ID NO: 373873 - DNA, 20 bp, Artificial
  CRISPR gRNA sequence
cttgagtgaggtgcttgtgg

SEQ ID NO: 373874 - DNA, 20 bp, Artificial
  CRISPR gRNA sequence
gtggtagttttctaccctct

SEQ ID NO: 373875 - DNA, 20 bp, Artificial
  CRISPR gRNA sequence
ttttctaccctctcagaaat

SEQ ID NO: 373876 - DNA, 20 bp, Artificial
  CRISPR gRNA sequence
tttctaccctctcagaaatt

SEQ ID NO: 373877 - DNA, 20 bp, Artificial
  CRISPR gRNA sequence
tctaccctctcagaaattgg

SEQ ID NO: 373878 - DNA, 20 bp, Artificial
  CRISPR gRNA sequence
ctaccctctcagaaattggg

SEQ ID NO: 373879 - DNA, 20 bp, Artificial
  CRISPR gRNA sequence
cctctcagaaattgggaggt

SEQ ID NO: 373880 - DNA, 20 bp, Artificial
  CRISPR gRNA sequence
ctctcagaaattgggaggta

SEQ ID NO: 373881 - DNA, 20 bp, Artificial
  CRISPR gRNA sequence
tctcagaaattgggaggtaa

SEQ ID NO: 373882 - DNA, 20 bp, Artificial
  CRISPR gRNA sequence
aagggtgctgtcttccttga

SEQ ID NO: 373883 - DNA, 20 bp, Artificial
  CRISPR gRNA sequence
tccttgatggttacatttca

SEQ ID NO: 373884 - DNA, 20 bp, Artificial
  CRISPR gRNA sequence
ccttgatggttacatttcaa

SEQ ID NO: 373885 - DNA, 20 bp, Artificial
  CRISPR gRNA sequence
cttgatggttacatttcaaa

SEQ ID NO: 373886 - DNA, 20 bp, Artificial
  CRISPR gRNA sequence
atggttacatttcaaaggga

SEQ ID NO: 373887 - DNA, 20 bp, Artificial
  CRISPR gRNA sequence
catttcaaagggatggctcc

SEQ ID NO: 373888 - DNA, 20 bp, Artificial
  CRISPR gRNA sequence
atttcaaagggatggctccc

SEQ ID NO: 373889 - DNA, 20 bp, Artificial
  CRISPR gRNA sequence
gggatggctcccaggtcctc

SEQ ID NO: 373890 - DNA, 20 bp, Artificial
  CRISPR gRNA sequence
tggctcccaggtcctcgaga

SEQ ID NO: 373891 - DNA, 20 bp, Artificial
  CRISPR gRNA sequence
gaaagacatttctccatcaa

SEQ ID NO: 373892 - DNA, 20 bp, Artificial
  CRISPR gRNA sequence
tctccatcaaaagctgacaa

SEQ ID NO: 373893 - DNA, 20 bp, Artificial
  CRISPR gRNA sequence
aagctgacaaaagacttatc

SEQ ID NO: 373894 - DNA, 20 bp, Artificial
  CRISPR gRNA sequence
agacttatctggccgttaaa

SEQ ID NO: 373895 - DNA, 20 bp, Artificial
  CRISPR gRNA sequence
aaagatgtgcatgtctttca

SEQ ID NO: 373896 - DNA, 20 bp, Artificial
  CRISPR gRNA sequence
agatgtgcatgtctttcaaa

SEQ ID NO: 373897 - DNA, 20 bp, Artificial
  CRISPR gRNA sequence
gtgcatgtctttcaaagaga

SEQ ID NO: 373898 - DNA, 20 bp, Artificial
  CRISPR gRNA sequence
gcatgtctttcaaagagaca

SEQ ID NO: 373899 - DNA, 20 bp, Artificial
  CRISPR gRNA sequence
gtctttcaaagagacagaga

SEQ ID NO: 373900 - DNA, 20 bp, Artificial
  CRISPR gRNA sequence
gagacagaactgccaattac

SEQ ID NO: 373901 - DNA, 20 bp, Artificial
  CRISPR gRNA sequence
tgccaattacaagttttcta

SEQ ID NO: 373902 - DNA, 20 bp, Artificial
  CRISPR gRNA sequence
ttttctaaagtcaataccct

SEQ ID NO: 373903 - DNA, 20 bp, Artificial
  CRISPR gRNA sequence
ctaaagtcaataccctaaga

SEQ ID NO: 373904 - DNA, 20 bp, Artificial
  CRISPR gRNA sequence
taaagtcaataccctaagaa

SEQ ID NO: 373905 - DNA, 20 bp, Artificial
  CRISPR gRNA sequence
aagtcaataccctaagaaag

SEQ ID NO: 373906 - DNA, 20 bp, Artificial
  CRISPR gRNA sequence
agtcaataccctaagaaagg

SEQ ID NO: 373907 - DNA, 20 bp, Artificial
  CRISPR gRNA sequence
gtcaataccctaagaaagga

SEQ ID NO: 373908 - DNA, 20 bp, Artificial
  CRISPR gRNA sequence
caataccctaagaaaggagg

SEQ ID NO: 373909 - DNA, 20 bp, Artificial
  CRISPR gRNA sequence
aataccctaagaaaggaggg

SEQ ID NO: 373910 - DNA, 20 bp, Artificial
  CRISPR gRNA sequence
taccctaagaaaggagggag

SEQ ID NO: 373911 - DNA, 20 bp, Artificial
  CRISPR gRNA sequence
aggagggaggagaaatccac

SEQ ID NO: 373912 - DNA, 20 bp, Artificial
  CRISPR gRNA sequence
agggaggagaaatccactgg

SEQ ID NO: 373913 - DNA, 20 bp, Artificial
  CRISPR gRNA sequence
ggagaaatccactggcagac

SEQ ID NO: 373914 - DNA, 20 bp, Artificial
  CRISPR gRNA sequence
gagaaatccactggcagact

SEQ ID NO: 373915 - DNA, 20 bp, Artificial
  CRISPR gRNA sequence
agaaatccactggcagactg

SEQ ID NO: 373916 - DNA, 20 bp, Artificial
  CRISPR gRNA sequence
tccactggcagactggggct

SEQ ID NO: 373917 - DNA, 20 bp, Artificial
  CRISPR gRNA sequence
actggcagactggggctcag

SEQ ID NO: 373918 - DNA, 20 bp, Artificial
  CRISPR gRNA sequence
gcagactggggctcagcagc

SEQ ID NO: 373919 - DNA, 20 bp, Artificial
  CRISPR gRNA sequence
agactggggctcagcagctg

SEQ ID NO: 373920 - DNA, 20 bp, Artificial
  CRISPR gRNA sequence
ctcagcagctggagctcccc

SEQ ID NO: 373921 - DNA, 20 bp, Artificial
  CRISPR gRNA sequence
agcagctggagctcccctgg

SEQ ID NO: 373922 - DNA, 20 bp, Artificial
  CRISPR gRNA sequence
gcagctggagctcccctgga

SEQ ID NO: 373923 - DNA, 20 bp, Artificial
  CRISPR gRNA sequence
ctcccctggaaggtgctttc

SEQ ID NO: 373924 - DNA, 20 bp, Artificial
  CRISPR gRNA sequence
cccctggaaggtgctttcta

SEQ ID NO: 373925 - DNA, 20 bp, Artificial
  CRISPR gRNA sequence
ctggaaggtgctttctagag

SEQ ID NO: 373926 - DNA, 20 bp, Artificial
  CRISPR gRNA sequence
ggaaggtgctttctagagta

SEQ ID NO: 373927 - DNA, 20 bp, Artificial
  CRISPR gRNA sequence
aggtgctttctagagtagag

SEQ ID NO: 373928 - DNA, 20 bp, Artificial
  CRISPR gRNA sequence
tgtttctcaatgccattctg

SEQ ID NO: 373929 - DNA, 20 bp, Artificial
  CRISPR gRNA sequence
attctgtggaacaccaacat

SEQ ID NO: 373930 - DNA, 20 bp, Artificial
  CRISPR gRNA sequence
ttctgtggaacaccaacatc

SEQ ID NO: 373931 - DNA, 20 bp, Artificial
  CRISPR gRNA sequence
acaccaacatcaggatcatc

SEQ ID NO: 373932 - DNA, 20 bp, Artificial
  CRISPR gRNA sequence
tcatctggtatgcttgctga

SEQ ID NO: 373933 - DNA, 20 bp, Artificial
  CRISPR gRNA sequence
ggtatgcttgctgaaagaca

SEQ ID NO: 373934 - DNA, 20 bp, Artificial
  CRISPR gRNA sequence
tgctgaaagacatggattcc

SEQ ID NO: 373935 - DNA, 20 bp, Artificial
  CRISPR gRNA sequence
gctgaaagacatggattcct

SEQ ID NO: 373936 - DNA, 20 bp, Artificial
  CRISPR gRNA sequence
ggattcctgggacttgttcc

SEQ ID NO: 373937 - DNA, 20 bp, Artificial
  CRISPR gRNA sequence
gattcctgggacttgttccc

SEQ ID NO: 373938 - DNA, 20 bp, Artificial
  CRISPR gRNA sequence
ctgggacttgttcccaggcc

SEQ ID NO: 373939 - DNA, 20 bp, Artificial
  CRISPR gRNA sequence
tgggacttgttcccaggcct

SEQ ID NO: 373940 - DNA, 20 bp, Artificial
  CRISPR gRNA sequence
ttgttcccaggcctaggaat

SEQ ID NO: 373941 - DNA, 20 bp, Artificial
  CRISPR gRNA sequence
tgttcccaggcctaggaatc

SEQ ID NO: 373942 - DNA, 20 bp, Artificial
  CRISPR gRNA sequence
gttcccaggcctaggaatca

SEQ ID NO: 373943 - DNA, 20 bp, Artificial
  CRISPR gRNA sequence
gaatcagggtgatattccac

SEQ ID NO: 373944 - DNA, 20 bp, Artificial
  CRISPR gRNA sequence
aatcagggtgatattccaca

SEQ ID NO: 373945 - DNA, 20 bp, Artificial
  CRISPR gRNA sequence
atattccacaaggctccatg

SEQ ID NO: 373946 - DNA, 20 bp, Artificial
  CRISPR gRNA sequence
tcatttgtattgttttgttt

SEQ ID NO: 373947 - DNA, 20 bp, Artificial
  CRISPR gRNA sequence
atttgtattgttttgtttta

SEQ ID NO: 373948 - DNA, 20 bp, Artificial
  CRISPR gRNA sequence
gtattgttttgttttagaga

SEQ ID NO: 373949 - DNA, 20 bp, Artificial
  CRISPR gRNA sequence
tattgttttgttttagagac

SEQ ID NO: 373950 - DNA, 20 bp, Artificial
  CRISPR gRNA sequence
attgttttgttttagagaca

SEQ ID NO: 373951 - DNA, 20 bp, Artificial
  CRISPR gRNA sequence
cagggtcttgctctgtcatc

SEQ ID NO: 373952 - DNA, 20 bp, Artificial
  CRISPR gRNA sequence
agggtcttgctctgtcatcc

SEQ ID NO: 373953 - DNA, 20 bp, Artificial
  CRISPR gRNA sequence
cttgctctgtcatccaggcc

SEQ ID NO: 373954 - DNA, 20 bp, Artificial
  CRISPR gRNA sequence
ttgctctgtcatccaggcct

SEQ ID NO: 373955 - DNA, 20 bp, Artificial
  CRISPR gRNA sequence
gtcatccaggcctgggacta

SEQ ID NO: 373956 - DNA, 20 bp, Artificial
  CRISPR gRNA sequence
aggcctgggactacagtcct

SEQ ID NO: 373957 - DNA, 20 bp, Artificial
  CRISPR gRNA sequence
ggcctgggactacagtcctt

SEQ ID NO: 373958 - DNA, 20 bp, Artificial
  CRISPR gRNA sequence
tgggactacagtccttagga

SEQ ID NO: 373959 - DNA, 20 bp, Artificial
  CRISPR gRNA sequence
ccttaggacggcctgcctgc

SEQ ID NO: 373960 - DNA, 20 bp, Artificial
  CRISPR gRNA sequence
cttaggacggcctgcctgca

SEQ ID NO: 373961 - DNA, 20 bp, Artificial
  CRISPR gRNA sequence
ggacggcctgcctgcaaggt

SEQ ID NO: 373962 - DNA, 20 bp, Artificial
  CRISPR gRNA sequence
cctgcaaggttggctctctg

SEQ ID NO: 373963 - DNA, 20 bp, Artificial
  CRISPR gRNA sequence
ctgcaaggttggctctctgt

SEQ ID NO: 373964 - DNA, 20 bp, Artificial
  CRISPR gRNA sequence
ttggctctctgtgggcatgt

SEQ ID NO: 373965 - DNA, 20 bp, Artificial
  CRISPR gRNA sequence
tctgtgggcatgtgagaact

SEQ ID NO: 373966 - DNA, 20 bp, Artificial
  CRISPR gRNA sequence
catgtgagaacttggatttt

SEQ ID NO: 373967 - DNA, 20 bp, Artificial
  CRISPR gRNA sequence
tgtgagaacttggatttttg

SEQ ID NO: 373968 - DNA, 20 bp, Artificial
  CRISPR gRNA sequence
gtgagaacttggatttttgg

SEQ ID NO: 373969 - DNA, 20 bp, Artificial
  CRISPR gRNA sequence
ttcaacaattctctgactgc

SEQ ID NO: 373970 - DNA, 20 bp, Artificial
  CRISPR gRNA sequence
tcaacaattctctgactgct

SEQ ID NO: 373971 - DNA, 20 bp, Artificial
  CRISPR gRNA sequence
caacaattctctgactgctg

SEQ ID NO: 373972 - DNA, 20 bp, Artificial
  CRISPR gRNA sequence
caattctctgactgctgggg

SEQ ID NO: 373973 - DNA, 20 bp, Artificial
  CRISPR gRNA sequence
aaatgtttatacaacccatg

SEQ ID NO: 373974 - DNA, 20 bp, Artificial
  CRISPR gRNA sequence
gctaaacacctgcttttctt

SEQ ID NO: 373975 - DNA, 20 bp, Artificial
  CRISPR gRNA sequence
ctaaacacctgcttttcttc

SEQ ID NO: 373976 - DNA, 20 bp, Artificial
  CRISPR gRNA sequence
taaacacctgcttttcttca

SEQ ID NO: 373977 - DNA, 20 bp, Artificial
  CRISPR gRNA sequence
ctgcttttcttcagggacat

SEQ ID NO: 373978 - DNA, 20 bp, Artificial
  CRISPR gRNA sequence
ttttcttcagggacatcagc

SEQ ID NO: 373979 - DNA, 20 bp, Artificial
  CRISPR gRNA sequence
ccagtccttctgactttgcc

SEQ ID NO: 373980 - DNA, 20 bp, Artificial
  CRISPR gRNA sequence
cagtccttctgactttgccc

SEQ ID NO: 373981 - DNA, 20 bp, Artificial
  CRISPR gRNA sequence
tccttctgactttgcccagg

SEQ ID NO: 373982 - DNA, 20 bp, Artificial
  CRISPR gRNA sequence
atccctttgctgatttgctt

SEQ ID NO: 373983 - DNA, 20 bp, Artificial
  CRISPR gRNA sequence
ccttctgctgtcataaacct

SEQ ID NO: 373984 - DNA, 20 bp, Artificial
  CRISPR gRNA sequence
cataaacctgagctgtgacg

SEQ ID NO: 373985 - DNA, 20 bp, Artificial
  CRISPR gRNA sequence
ataaacctgagctgtgacgt

SEQ ID NO: 373986 - DNA, 20 bp, Artificial
  CRISPR gRNA sequence
cctgagctgtgacgtgggta

SEQ ID NO: 373987 - DNA, 20 bp, Artificial
  CRISPR gRNA sequence
ctgagctgtgacgtgggtac

SEQ ID NO: 373988 - DNA, 20 bp, Artificial
  CRISPR gRNA sequence
gtgacgtgggtacaggctga

SEQ ID NO: 373989 - DNA, 20 bp, Artificial
  CRISPR gRNA sequence
ctgaaagctgtgtgtccttc

SEQ ID NO: 373990 - DNA, 20 bp, Artificial
  CRISPR gRNA sequence
tgtgtccttccagcaaatcc

SEQ ID NO: 373991 - DNA, 20 bp, Artificial
  CRISPR gRNA sequence
ttccagcaaatcccagatcc

SEQ ID NO: 373992 - DNA, 20 bp, Artificial
  CRISPR gRNA sequence
tccagcaaatcccagatcct

SEQ ID NO: 373993 - DNA, 20 bp, Artificial
  CRISPR gRNA sequence
ccagcaaatcccagatcctg

SEQ ID NO: 373994 - DNA, 20 bp, Artificial
  CRISPR gRNA sequence
agcaaatcccagatcctggg

SEQ ID NO: 373995 - DNA, 20 bp, Artificial
  CRISPR gRNA sequence
gcaaatcccagatcctgggg

SEQ ID NO: 373996 - DNA, 20 bp, Artificial
  CRISPR gRNA sequence
caaatcccagatcctgggga

SEQ ID NO: 373997 - DNA, 20 bp, Artificial
  CRISPR gRNA sequence
aaatcccagatcctggggag

SEQ ID NO: 373998 - DNA, 20 bp, Artificial
  CRISPR gRNA sequence
aatcccagatcctggggagg

SEQ ID NO: 373999 - DNA, 20 bp, Artificial
  CRISPR gRNA sequence
ccctgaacacaaccgtgaaa

SEQ ID NO: 374000 - DNA, 20 bp, Artificial
  CRISPR gRNA sequence
acaaccgtgaaatagtgtgt

SEQ ID NO: 374001 - DNA, 20 bp, Artificial
  CRISPR gRNA sequence
tggttgccttttaatactga

SEQ ID NO: 374002 - DNA, 20 bp, Artificial
  CRISPR gRNA sequence
taatactgatggctcatttt

SEQ ID NO: 374003 - DNA, 20 bp, Artificial
  CRISPR gRNA sequence
gatgatatttctattgttat

SEQ ID NO: 374004 - DNA, 20 bp, Artificial
  CRISPR gRNA sequence
gaacatatacattctcatac

SEQ ID NO: 374005 - DNA, 20 bp, Artificial
  CRISPR gRNA sequence
tactagttttatttgaaaca

SEQ ID NO: 374006 - DNA, 20 bp, Artificial
  CRISPR gRNA sequence
aacacagtttgcatatacaa

SEQ ID NO: 374007 - DNA, 20 bp, Artificial
  CRISPR gRNA sequence
acacagtttgcatatacaat

SEQ ID NO: 374008 - DNA, 20 bp, Artificial
  CRISPR gRNA sequence
tacaataggccttatttctg

SEQ ID NO: 374009 - DNA, 20 bp, Artificial
  CRISPR gRNA sequence
acaataggccttatttctgt

SEQ ID NO: 374010 - DNA, 20 bp, Artificial
  CRISPR gRNA sequence
gccttatttctgtaggcaat

SEQ ID NO: 374011 - DNA, 20 bp, Artificial
  CRISPR gRNA sequence
cttatatacatacatcttct

SEQ ID NO: 374012 - DNA, 20 bp, Artificial
  CRISPR gRNA sequence
atacatacatcttctaagtt

SEQ ID NO: 374013 - DNA, 20 bp, Artificial
  CRISPR gRNA sequence
tacatcttctaagtttagta

SEQ ID NO: 374014 - DNA, 20 bp, Artificial
  CRISPR gRNA sequence
gcttattccttttatgtacc

SEQ ID NO: 374015 - DNA, 20 bp, Artificial
  CRISPR gRNA sequence
agtttttaaattatcatttt

SEQ ID NO: 374016 - DNA, 20 bp, Artificial
  CRISPR gRNA sequence
tttaaattatcatttttaga

SEQ ID NO: 374017 - DNA, 20 bp, Artificial
  CRISPR gRNA sequence
aattatcatttttagatgga

SEQ ID NO: 374018 - DNA, 20 bp, Artificial
  CRISPR gRNA sequence
ttttagatggaaagaattcg

SEQ ID NO: 374019 - DNA, 20 bp, Artificial
  CRISPR gRNA sequence
agatggaaagaattcgaagc

SEQ ID NO: 374020 - DNA, 20 bp, Artificial
  CRISPR gRNA sequence
ggaaagaattcgaagctgga

SEQ ID NO: 374021 - DNA, 20 bp, Artificial
  CRISPR gRNA sequence
tgtttctttgccttactaaa

SEQ ID NO: 374022 - DNA, 20 bp, Artificial
  CRISPR gRNA sequence
tttctttgccttactaaaca

SEQ ID NO: 374023 - DNA, 20 bp, Artificial
  CRISPR gRNA sequence
ttctttgccttactaaacag

SEQ ID NO: 374024 - DNA, 20 bp, Artificial
  CRISPR gRNA sequence
ccttactaaacagaggacaa

SEQ ID NO: 374025 - DNA, 20 bp, Artificial
  CRISPR gRNA sequence
caatagatataaccatcctg

SEQ ID NO: 374026 - DNA, 20 bp, Artificial
  CRISPR gRNA sequence
taaccatcctgtggctgtcc

SEQ ID NO: 374027 - DNA, 20 bp, Artificial
  CRISPR gRNA sequence
tggctgtcctggtgtcctct

SEQ ID NO: 374028 - DNA, 20 bp, Artificial
  CRISPR gRNA sequence
cctggtgtcctctgagcacc

SEQ ID NO: 374029 - DNA, 20 bp, Artificial
  CRISPR gRNA sequence
gtcttgcgctttgctctatg

SEQ ID NO: 374030 - DNA, 20 bp, Artificial
  CRISPR gRNA sequence
ttgcgctttgctctatgtgg

SEQ ID NO: 374031 - DNA, 20 bp, Artificial
  CRISPR gRNA sequence
tgcgctttgctctatgtggt

SEQ ID NO: 374032 - DNA, 20 bp, Artificial
  CRISPR gRNA sequence
tctatgtggtgggatataat

SEQ ID NO: 374033 - DNA, 20 bp, Artificial
  CRISPR gRNA sequence
atgtggtgggatataatgag

SEQ ID NO: 374034 - DNA, 20 bp, Artificial
  CRISPR gRNA sequence
ggtgggatataatgagaagc

SEQ ID NO: 374035 - DNA, 20 bp, Artificial
  CRISPR gRNA sequence
ggatataatgagaagcaaga

SEQ ID NO: 374036 - DNA, 20 bp, Artificial
  CRISPR gRNA sequence
tatgtttgtttgtttgaatt

SEQ ID NO: 374037 - DNA, 20 bp, Artificial
  CRISPR gRNA sequence
tggtcccctcgctcactaca

SEQ ID NO: 374038 - DNA, 20 bp, Artificial
  CRISPR gRNA sequence
ttgttttcctcaatattcca

SEQ ID NO: 374039 - DNA, 20 bp, Artificial
  CRISPR gRNA sequence
tctattttttgccatttttc

SEQ ID NO: 374040 - DNA, 20 bp, Artificial
  CRISPR gRNA sequence
ctattttttgccatttttct

SEQ ID NO: 374041 - DNA, 20 bp, Artificial
  CRISPR gRNA sequence
tttattgttataaaaaacaa

SEQ ID NO: 374042 - DNA, 20 bp, Artificial
  CRISPR gRNA sequence
tataaaaaacaacggtttta

SEQ ID NO: 374043 - DNA, 20 bp, Artificial
  CRISPR gRNA sequence
aaacaacggttttaaagtta

SEQ ID NO: 374044 - DNA, 20 bp, Artificial
  CRISPR gRNA sequence
aaaaataacttctgttatga

SEQ ID NO: 374045 - DNA, 20 bp, Artificial
  CRISPR gRNA sequence
aaaataacttctgttatgac

SEQ ID NO: 374046 - DNA, 20 bp, Artificial
  CRISPR gRNA sequence
ataacttctgttatgacagg

SEQ ID NO: 374047 - DNA, 20 bp, Artificial
  CRISPR gRNA sequence
cttctgttatgacaggaagc

SEQ ID NO: 374048 - DNA, 20 bp, Artificial
  CRISPR gRNA sequence
tgacaggaagccagattccc

SEQ ID NO: 374049 - DNA, 20 bp, Artificial
  CRISPR gRNA sequence
acaggaagccagattcccaa

SEQ ID NO: 374050 - DNA, 20 bp, Artificial
  CRISPR gRNA sequence
attcccaagagacactttat

SEQ ID NO: 374051 - DNA, 20 bp, Artificial
  CRISPR gRNA sequence
aagagacactttatgagtca

SEQ ID NO: 374052 - DNA, 20 bp, Artificial
  CRISPR gRNA sequence
agagacactttatgagtcaa

SEQ ID NO: 374053 - DNA, 20 bp, Artificial
  CRISPR gRNA sequence
actttatgagtcaaaggtga

SEQ ID NO: 374054 - DNA, 20 bp, Artificial
  CRISPR gRNA sequence
aaaggtgacagtatctatga

SEQ ID NO: 374055 - DNA, 20 bp, Artificial
  CRISPR gRNA sequence
tctcactgctatgcttatcc

SEQ ID NO: 374056 - DNA, 20 bp, Artificial
  CRISPR gRNA sequence
cactgctatgcttatccaag

SEQ ID NO: 374057 - DNA, 20 bp, Artificial
  CRISPR gRNA sequence
ctgctatgcttatccaagca

SEQ ID NO: 374058 - DNA, 20 bp, Artificial
  CRISPR gRNA sequence
ctacttcatcttctttttta

SEQ ID NO: 374059 - DNA, 20 bp, Artificial
  CRISPR gRNA sequence
catcttcttttttatggact

SEQ ID NO: 374060 - DNA, 20 bp, Artificial
  CRISPR gRNA sequence
tctaattcctgatttcaatc

SEQ ID NO: 374061 - DNA, 20 bp, Artificial
  CRISPR gRNA sequence
tttcaatcaagacatgtcta

SEQ ID NO: 374062 - DNA, 20 bp, Artificial
  CRISPR gRNA sequence
gtctacagacatgaacacaa

SEQ ID NO: 374063 - DNA, 20 bp, Artificial
  CRISPR gRNA sequence
agacatgaacacaaaagcac

SEQ ID NO: 374064 - DNA, 20 bp, Artificial
  CRISPR gRNA sequence
acacaaaagcactagaaata

SEQ ID NO: 374065 - DNA, 20 bp, Artificial
  CRISPR gRNA sequence
gcactagaaataaagctaaa

SEQ ID NO: 374066 - DNA, 20 bp, Artificial
  CRISPR gRNA sequence
gaaataaagctaaacagaaa

SEQ ID NO: 374067 - DNA, 20 bp, Artificial
  CRISPR gRNA sequence
aagctaaacagaaacagtct

SEQ ID NO: 374068 - DNA, 20 bp, Artificial
  CRISPR gRNA sequence
taaacagaaacagtcttggc

SEQ ID NO: 374069 - DNA, 20 bp, Artificial
  CRISPR gRNA sequence
aaacagaaacagtcttggct

SEQ ID NO: 374070 - DNA, 20 bp, Artificial
  CRISPR gRNA sequence
gtcttggctaggctttgact

SEQ ID NO: 374071 - DNA, 20 bp, Artificial
  CRISPR gRNA sequence
cttggctaggctttgactca

SEQ ID NO: 374072 - DNA, 20 bp, Artificial
  CRISPR gRNA sequence
ctaggctttgactcagagtc

SEQ ID NO: 374073 - DNA, 20 bp, Artificial
  CRISPR gRNA sequence
aagtgtccataataatccct

SEQ ID NO: 374074 - DNA, 20 bp, Artificial
  CRISPR gRNA sequence
gtgtccataataatcccttg

SEQ ID NO: 374075 - DNA, 20 bp, Artificial
  CRISPR gRNA sequence
ccataataatcccttggagc

SEQ ID NO: 374076 - DNA, 20 bp, Artificial
  CRISPR gRNA sequence
cataataatcccttggagcc

SEQ ID NO: 374077 - DNA, 20 bp, Artificial
  CRISPR gRNA sequence
taatcccttggagccaggcg

SEQ ID NO: 374078 - DNA, 20 bp, Artificial
  CRISPR gRNA sequence
tcccttggagccaggcgtgg

SEQ ID NO: 374079 - DNA, 20 bp, Artificial
  CRISPR gRNA sequence
tgcctgtaatcccaatgctt

SEQ ID NO: 374080 - DNA, 20 bp, Artificial
  CRISPR gRNA sequence
gcctgtaatcccaatgcttt

SEQ ID NO: 374081 - DNA, 20 bp, Artificial
  CRISPR gRNA sequence
ctgtaatcccaatgctttgg

SEQ ID NO: 374082 - DNA, 20 bp, Artificial
  CRISPR gRNA sequence
tgtaatcccaatgctttggg

SEQ ID NO: 374083 - DNA, 20 bp, Artificial
  CRISPR gRNA sequence
aatgctttgggaggccattt

SEQ ID NO: 374084 - DNA, 20 bp, Artificial
  CRISPR gRNA sequence
gctttgggaggccatttcag

SEQ ID NO: 374085 - DNA, 20 bp, Artificial
  CRISPR gRNA sequence
ctttgggaggccatttcagt

SEQ ID NO: 374086 - DNA, 20 bp, Artificial
  CRISPR gRNA sequence
ccatttcagtaggactgctt

SEQ ID NO: 374087 - DNA, 20 bp, Artificial
  CRISPR gRNA sequence
catttcagtaggactgcttg

SEQ ID NO: 374088 - DNA, 20 bp, Artificial
  CRISPR gRNA sequence
cagtaggactgcttgaggtc

SEQ ID NO: 374089 - DNA, 20 bp, Artificial
  CRISPR gRNA sequence
gtaggactgcttgaggtcta

SEQ ID NO: 374090 - DNA, 20 bp, Artificial
  CRISPR gRNA sequence
tgaggtctagagttcaaccc

SEQ ID NO: 374091 - DNA, 20 bp, Artificial
  CRISPR gRNA sequence
ctagagttcaaccccagcct

SEQ ID NO: 374092 - DNA, 20 bp, Artificial
  CRISPR gRNA sequence
caaccccagcctgagcaaca

SEQ ID NO: 374093 - DNA, 20 bp, Artificial
  CRISPR gRNA sequence
cccagcctgagcaacatagc

SEQ ID NO: 374094 - DNA, 20 bp, Artificial
  CRISPR gRNA sequence
caaacaatttaaaaaaatgt

SEQ ID NO: 374095 - DNA, 20 bp, Artificial
  CRISPR gRNA sequence
caatttaaaaaaatgttagc

SEQ ID NO: 374096 - DNA, 20 bp, Artificial
  CRISPR gRNA sequence
aatttaaaaaaatgttagct

SEQ ID NO: 374097 - DNA, 20 bp, Artificial
  CRISPR gRNA sequence
aaaaaaatgttagctgggcc

SEQ ID NO: 374098 - DNA, 20 bp, Artificial
  CRISPR gRNA sequence
aaaatgttagctgggcctgg

SEQ ID NO: 374099 - DNA, 20 bp, Artificial
  CRISPR gRNA sequence
ggcctggtggcatgtgcctg

SEQ ID NO: 374100 - DNA, 20 bp, Artificial
  CRISPR gRNA sequence
gtggcatgtgcctgtggtcc

SEQ ID NO: 374101 - DNA, 20 bp, Artificial
  CRISPR gRNA sequence
tgcctgtggtcccagctact

SEQ ID NO: 374102 - DNA, 20 bp, Artificial
  CRISPR gRNA sequence
gcctgtggtcccagctactt

SEQ ID NO: 374103 - DNA, 20 bp, Artificial
  CRISPR gRNA sequence
ctgtggtcccagctacttgg

SEQ ID NO: 374104 - DNA, 20 bp, Artificial
  CRISPR gRNA sequence
tgtggtcccagctacttggg

SEQ ID NO: 374105 - DNA, 20 bp, Artificial
  CRISPR gRNA sequence
tcccagctacttgggaggct

SEQ ID NO: 374106 - DNA, 20 bp, Artificial
  CRISPR gRNA sequence
cccagctacttgggaggctg

SEQ ID NO: 374107 - DNA, 20 bp, Artificial
  CRISPR gRNA sequence
agctacttgggaggctgagg

SEQ ID NO: 374108 - DNA, 20 bp, Artificial
  CRISPR gRNA sequence
gctacttgggaggctgaggc

SEQ ID NO: 374109 - DNA, 20 bp, Artificial
  CRISPR gRNA sequence
tacttgggaggctgaggcag

SEQ ID NO: 374110 - DNA, 20 bp, Artificial
  CRISPR gRNA sequence
acttgggaggctgaggcagg

SEQ ID NO: 374111 - DNA, 20 bp, Artificial
  CRISPR gRNA sequence
gctgaggcaggaggatcacc

SEQ ID NO: 374112 - DNA, 20 bp, Artificial
  CRISPR gRNA sequence
aggaggatcacccagaatcc

SEQ ID NO: 374113 - DNA, 20 bp, Artificial
  CRISPR gRNA sequence
tttctgcacactaattcact

SEQ ID NO: 374114 - DNA, 20 bp, Artificial
  CRISPR gRNA sequence
tgcacactaattcactaaga

SEQ ID NO: 374115 - DNA, 20 bp, Artificial
  CRISPR gRNA sequence
cactaattcactaagacagt

SEQ ID NO: 374116 - DNA, 20 bp, Artificial
  CRISPR gRNA sequence
aattcactaagacagtgaga

SEQ ID NO: 374117 - DNA, 20 bp, Artificial
  CRISPR gRNA sequence
attcactaagacagtgagaa

SEQ ID NO: 374118 - DNA, 20 bp, Artificial
  CRISPR gRNA sequence
gacagtgagaaaggtatgtg

SEQ ID NO: 374119 - DNA, 20 bp, Artificial
  CRISPR gRNA sequence
tcttgacattctgacttttg

SEQ ID NO: 374120 - DNA, 20 bp, Artificial
  CRISPR gRNA sequence
tgacttttgaagcatctata

SEQ ID NO: 374121 - DNA, 20 bp, Artificial
  CRISPR gRNA sequence
ataatatgttcataaaaatt

SEQ ID NO: 374122 - DNA, 20 bp, Artificial
  CRISPR gRNA sequence
taatatgttcataaaaattg

SEQ ID NO: 374123 - DNA, 20 bp, Artificial
  CRISPR gRNA sequence
aaaaattgaggtaaatgtgc

SEQ ID NO: 374124 - DNA, 20 bp, Artificial
  CRISPR gRNA sequence
aattgaggtaaatgtgcaag

SEQ ID NO: 374125 - DNA, 20 bp, Artificial
  CRISPR gRNA sequence
ggtaaatgtgcaagaagtat

SEQ ID NO: 374126 - DNA, 20 bp, Artificial
  CRISPR gRNA sequence
tgtgcaagaagtataagact

SEQ ID NO: 374127 - DNA, 20 bp, Artificial
  CRISPR gRNA sequence
gtataagactcagaaatatt

SEQ ID NO: 374128 - DNA, 20 bp, Artificial
  CRISPR gRNA sequence
tataagactcagaaatattt

SEQ ID NO: 374129 - DNA, 20 bp, Artificial
  CRISPR gRNA sequence
aaatatttgggtaaaaatat

SEQ ID NO: 374130 - DNA, 20 bp, Artificial
  CRISPR gRNA sequence
aatatgagatatctaataca

SEQ ID NO: 374131 - DNA, 20 bp, Artificial
  CRISPR gRNA sequence
atatgagatatctaatacaa

SEQ ID NO: 374132 - DNA, 20 bp, Artificial
  CRISPR gRNA sequence
atgagatatctaatacaaag

SEQ ID NO: 374133 - DNA, 20 bp, Artificial
  CRISPR gRNA sequence
gatatctaatacaaaggagt

SEQ ID NO: 374134 - DNA, 20 bp, Artificial
  CRISPR gRNA sequence
tcaataaatgtgtcaatttg

SEQ ID NO: 374135 - DNA, 20 bp, Artificial
  CRISPR gRNA sequence
ttgccatacaccaatcactg

SEQ ID NO: 374136 - DNA, 20 bp, Artificial
  CRISPR gRNA sequence
gccatacaccaatcactgtg

SEQ ID NO: 374137 - DNA, 20 bp, Artificial
  CRISPR gRNA sequence
caatcactgtggagaactta

SEQ ID NO: 374138 - DNA, 20 bp, Artificial
  CRISPR gRNA sequence
tgtggagaacttatggccca

SEQ ID NO: 374139 - DNA, 20 bp, Artificial
  CRISPR gRNA sequence
atgatgctacattatcgcac

SEQ ID NO: 374140 - DNA, 20 bp, Artificial
  CRISPR gRNA sequence
atgctacattatcgcaccag

SEQ ID NO: 374141 - DNA, 20 bp, Artificial
  CRISPR gRNA sequence
ctacattatcgcaccagaag

SEQ ID NO: 374142 - DNA, 20 bp, Artificial
  CRISPR gRNA sequence
cattatcgcaccagaagaag

SEQ ID NO: 374143 - DNA, 20 bp, Artificial
  CRISPR gRNA sequence
accagaagaagtagctaata

SEQ ID NO: 374144 - DNA, 20 bp, Artificial
  CRISPR gRNA sequence
tacagtcattctatattgtg

SEQ ID NO: 374145 - DNA, 20 bp, Artificial
  CRISPR gRNA sequence
acagtcattctatattgtgt

SEQ ID NO: 374146 - DNA, 20 bp, Artificial
  CRISPR gRNA sequence
tgtaggtaaaacgtacacac

SEQ ID NO: 374147 - DNA, 20 bp, Artificial
  CRISPR gRNA sequence
aacgtacacacaagctatct

SEQ ID NO: 374148 - DNA, 20 bp, Artificial
  CRISPR gRNA sequence
acgtacacacaagctatctt

SEQ ID NO: 374149 - DNA, 20 bp, Artificial
  CRISPR gRNA sequence
cgtacacacaagctatctta

SEQ ID NO: 374150 - DNA, 20 bp, Artificial
  CRISPR gRNA sequence
tcaactgacataaaccttta

SEQ ID NO: 374151 - DNA, 20 bp, Artificial
  CRISPR gRNA sequence
tttaaagtgtttaaactatt

SEQ ID NO: 374152 - DNA, 20 bp, Artificial
  CRISPR gRNA sequence
ttaaagtgtttaaactattt

SEQ ID NO: 374153 - DNA, 20 bp, Artificial
  CRISPR gRNA sequence
gtgtttaaactatttgggac

SEQ ID NO: 374154 - DNA, 20 bp, Artificial
  CRISPR gRNA sequence
ggacaagtattttcaacata

SEQ ID NO: 374155 - DNA, 20 bp, Artificial
  CRISPR gRNA sequence
aagtattttcaacataaaga

SEQ ID NO: 374156 - DNA, 20 bp, Artificial
  CRISPR gRNA sequence
ttttgctataatttgccatc

SEQ ID NO: 374157 - DNA, 20 bp, Artificial
  CRISPR gRNA sequence
ttgctataatttgccatcaa

SEQ ID NO: 374158 - DNA, 20 bp, Artificial
  CRISPR gRNA sequence
gctataatttgccatcaaga

SEQ ID NO: 374159 - DNA, 20 bp, Artificial
  CRISPR gRNA sequence
ctataatttgccatcaagag

SEQ ID NO: 374160 - DNA, 20 bp, Artificial
  CRISPR gRNA sequence
ccatcaagagaggcaaattg

SEQ ID NO: 374161 - DNA, 20 bp, Artificial
  CRISPR gRNA sequence
ttgtagcaaaatttctacat

SEQ ID NO: 374162 - DNA, 20 bp, Artificial
  CRISPR gRNA sequence
agcaaaatttctacatcagc

SEQ ID NO: 374163 - DNA, 20 bp, Artificial
  CRISPR gRNA sequence
gcaaaatttctacatcagct

SEQ ID NO: 374164 - DNA, 20 bp, Artificial
  CRISPR gRNA sequence
aaatttctacatcagctagg

SEQ ID NO: 374165 - DNA, 20 bp, Artificial
  CRISPR gRNA sequence
aggaagcttgcttccctcac

SEQ ID NO: 374166 - DNA, 20 bp, Artificial
  CRISPR gRNA sequence
actggtttgctctataatga

SEQ ID NO: 374167 - DNA, 20 bp, Artificial
  CRISPR gRNA sequence
ataatgacagaaaaattatt

SEQ ID NO: 374168 - DNA, 20 bp, Artificial
  CRISPR gRNA sequence
gaaaaattatttagattctc

SEQ ID NO: 374169 - DNA, 20 bp, Artificial
  CRISPR gRNA sequence
aaaaattatttagattctct

SEQ ID NO: 374170 - DNA, 20 bp, Artificial
  CRISPR gRNA sequence
tctctgggccttatgtttct

SEQ ID NO: 374171 - DNA, 20 bp, Artificial
  CRISPR gRNA sequence
cctgataatacttttatttt

SEQ ID NO: 374172 - DNA, 20 bp, Artificial
  CRISPR gRNA sequence
ctgataatacttttattttg

SEQ ID NO: 374173 - DNA, 20 bp, Artificial
  CRISPR gRNA sequence
aatacttttattttgaggaa

SEQ ID NO: 374174 - DNA, 20 bp, Artificial
  CRISPR gRNA sequence
acttttattttgaggaaaag

SEQ ID NO: 374175 - DNA, 20 bp, Artificial
  CRISPR gRNA sequence
aaaagtagttgctatttact

SEQ ID NO: 374176 - DNA, 20 bp, Artificial
  CRISPR gRNA sequence
agtagttgctatttactcag

SEQ ID NO: 374177 - DNA, 20 bp, Artificial
  CRISPR gRNA sequence
agttgctatttactcagaag

SEQ ID NO: 374178 - DNA, 20 bp, Artificial
  CRISPR gRNA sequence
gttgctatttactcagaaga

SEQ ID NO: 374179 - DNA, 20 bp, Artificial
  CRISPR gRNA sequence
tatttactcagaagaaggat

SEQ ID NO: 374180 - DNA, 20 bp, Artificial
  CRISPR gRNA sequence
tttactcagaagaaggatta

SEQ ID NO: 374181 - DNA, 20 bp, Artificial
  CRISPR gRNA sequence
ttactcagaagaaggattag

SEQ ID NO: 374182 - DNA, 20 bp, Artificial
  CRISPR gRNA sequence
agaagaaggattagaggttg

SEQ ID NO: 374183 - DNA, 20 bp, Artificial
  CRISPR gRNA sequence
aggattagaggttgaagcca

SEQ ID NO: 374184 - DNA, 20 bp, Artificial
  CRISPR gRNA sequence
tctgaaaataatttacactc

SEQ ID NO: 374185 - DNA, 20 bp, Artificial
  CRISPR gRNA sequence
ctgaaaataatttacactct

SEQ ID NO: 374186 - DNA, 20 bp, Artificial
  CRISPR gRNA sequence
atttacactctaggaccttc

SEQ ID NO: 374187 - DNA, 20 bp, Artificial
  CRISPR gRNA sequence
gaccttctagctataaaaca

SEQ ID NO: 374188 - DNA, 20 bp, Artificial
  CRISPR gRNA sequence
ttctagctataaaacacaga

SEQ ID NO: 374189 - DNA, 20 bp, Artificial
  CRISPR gRNA sequence
tctagctataaaacacagaa

SEQ ID NO: 374190 - DNA, 20 bp, Artificial
  CRISPR gRNA sequence
acagaaaggtttctgaaata

SEQ ID NO: 374191 - DNA, 20 bp, Artificial
  CRISPR gRNA sequence
agaaaggtttctgaaataca

SEQ ID NO: 374192 - DNA, 20 bp, Artificial
  CRISPR gRNA sequence
gagtataaaactgatttatc

SEQ ID NO: 374193 - DNA, 20 bp, Artificial
  CRISPR gRNA sequence
aaaactgatttatctggaca

SEQ ID NO: 374194 - DNA, 20 bp, Artificial
  CRISPR gRNA sequence
ctgatttatctggacaaaga

SEQ ID NO: 374195 - DNA, 20 bp, Artificial
  CRISPR gRNA sequence
aaagttgacctttgaaaact

SEQ ID NO: 374196 - DNA, 20 bp, Artificial
  CRISPR gRNA sequence
tatccacgtgatgcgtattt

SEQ ID NO: 374197 - DNA, 20 bp, Artificial
  CRISPR gRNA sequence
atccacgtgatgcgtatttc

SEQ ID NO: 374198 - DNA, 20 bp, Artificial
  CRISPR gRNA sequence
tgatgcgtatttcaggcata

SEQ ID NO: 374199 - DNA, 20 bp, Artificial
  CRISPR gRNA sequence
gatgcgtatttcaggcatac

SEQ ID NO: 374200 - DNA, 20 bp, Artificial
  CRISPR gRNA sequence
cgtatttcaggcatacagga

SEQ ID NO: 374201 - DNA, 20 bp, Artificial
  CRISPR gRNA sequence
ctttgtgctactattatttc

SEQ ID NO: 374202 - DNA, 20 bp, Artificial
  CRISPR gRNA sequence
tgtgctactattatttccgg

SEQ ID NO: 374203 - DNA, 20 bp, Artificial
  CRISPR gRNA sequence
attatttccggtggtctgcc

SEQ ID NO: 374204 - DNA, 20 bp, Artificial
  CRISPR gRNA sequence
ttatttccggtggtctgcca

SEQ ID NO: 374205 - DNA, 20 bp, Artificial
  CRISPR gRNA sequence
ccggtggtctgccaaggcaa

SEQ ID NO: 374206 - DNA, 20 bp, Artificial
  CRISPR gRNA sequence
ccaaggcaacagttattgta

SEQ ID NO: 374207 - DNA, 20 bp, Artificial
  CRISPR gRNA sequence
attgtatagatgtttaccaa

SEQ ID NO: 374208 - DNA, 20 bp, Artificial
  CRISPR gRNA sequence
acagtacctgtgcctttccc

SEQ ID NO: 374209 - DNA, 20 bp, Artificial
  CRISPR gRNA sequence
cagtacctgtgcctttcccc

SEQ ID NO: 374210 - DNA, 20 bp, Artificial
  CRISPR gRNA sequence
tacctgtgcctttccccagg

SEQ ID NO: 374211 - DNA, 20 bp, Artificial
  CRISPR gRNA sequence
acctgtgcctttccccagga

SEQ ID NO: 374212 - DNA, 20 bp, Artificial
  CRISPR gRNA sequence
gtgcctttccccaggaaggc

SEQ ID NO: 374213 - DNA, 20 bp, Artificial
  CRISPR gRNA sequence
tttccccaggaaggcgagtc

SEQ ID NO: 374214 - DNA, 20 bp, Artificial
  CRISPR gRNA sequence
caggaaggcgagtctagctg

SEQ ID NO: 374215 - DNA, 20 bp, Artificial
  CRISPR gRNA sequence
aggaaggcgagtctagctgc

SEQ ID NO: 374216 - DNA, 20 bp, Artificial
  CRISPR gRNA sequence
gaaggcgagtctagctgcag

SEQ ID NO: 374217 - DNA, 20 bp, Artificial
  CRISPR gRNA sequence
gcgagtctagctgcaggagc

SEQ ID NO: 374218 - DNA, 20 bp, Artificial
  CRISPR gRNA sequence
acatctcaacatgaaaaaaa

SEQ ID NO: 374219 - DNA, 20 bp, Artificial
  CRISPR gRNA sequence
aacatgaaaaaaatagaaac

SEQ ID NO: 374220 - DNA, 20 bp, Artificial
  CRISPR gRNA sequence
ttatctgattaaccctcatt

SEQ ID NO: 374221 - DNA, 20 bp, Artificial
  CRISPR gRNA sequence
gattaataacctaaatcgtt

SEQ ID NO: 374222 - DNA, 20 bp, Artificial
  CRISPR gRNA sequence
catgcttgatttaaatctca

SEQ ID NO: 374223 - DNA, 20 bp, Artificial
  CRISPR gRNA sequence
aaatctcatagctacccttg

SEQ ID NO: 374224 - DNA, 20 bp, Artificial
  CRISPR gRNA sequence
ttaattttatcatcattatg

SEQ ID NO: 374225 - DNA, 20 bp, Artificial
  CRISPR gRNA sequence
aaaaaactgtttaaaacatt

SEQ ID NO: 374226 - DNA, 20 bp, Artificial
  CRISPR gRNA sequence
aacattaagtgtcctatgtg

SEQ ID NO: 374227 - DNA, 20 bp, Artificial
  CRISPR gRNA sequence
gtgtcctatgtgaagtcttc

SEQ ID NO: 374228 - DNA, 20 bp, Artificial
  CRISPR gRNA sequence
tgtcctatgtgaagtcttcc

SEQ ID NO: 374229 - DNA, 20 bp, Artificial
  CRISPR gRNA sequence
gtcctatgtgaagtcttcca

SEQ ID NO: 374230 - DNA, 20 bp, Artificial
  CRISPR gRNA sequence
tcctatgtgaagtcttccag

SEQ ID NO: 374231 - DNA, 20 bp, Artificial
  CRISPR gRNA sequence
atgtgaagtcttccagggga

SEQ ID NO: 374232 - DNA, 20 bp, Artificial
  CRISPR gRNA sequence
agtcttccaggggaaagaat

SEQ ID NO: 374233 - DNA, 20 bp, Artificial
  CRISPR gRNA sequence
cttccaggggaaagaattag

SEQ ID NO: 374234 - DNA, 20 bp, Artificial
  CRISPR gRNA sequence
caggggaaagaattagaaga

SEQ ID NO: 374235 - DNA, 20 bp, Artificial
  CRISPR gRNA sequence
aggggaaagaattagaagac

SEQ ID NO: 374236 - DNA, 20 bp, Artificial
  CRISPR gRNA sequence
aaagaattagaagacaggac

SEQ ID NO: 374237 - DNA, 20 bp, Artificial
  CRISPR gRNA sequence
aagaattagaagacaggact

SEQ ID NO: 374238 - DNA, 20 bp, Artificial
  CRISPR gRNA sequence
agaagacaggactaggcccc

SEQ ID NO: 374239 - DNA, 20 bp, Artificial
  CRISPR gRNA sequence
gaagacaggactaggcccca

SEQ ID NO: 374240 - DNA, 20 bp, Artificial
  CRISPR gRNA sequence
ggccccaaggcttttctcct

SEQ ID NO: 374241 - DNA, 20 bp, Artificial
  CRISPR gRNA sequence
tttcaataaaccaatgtcta

SEQ ID NO: 374242 - DNA, 20 bp, Artificial
  CRISPR gRNA sequence
caataaaccaatgtctaaag

SEQ ID NO: 374243 - DNA, 20 bp, Artificial
  CRISPR gRNA sequence
aataaaccaatgtctaaagt

SEQ ID NO: 374244 - DNA, 20 bp, Artificial
  CRISPR gRNA sequence
ccaatgtctaaagtgggaca

SEQ ID NO: 374245 - DNA, 20 bp, Artificial
  CRISPR gRNA sequence
caatgtctaaagtgggacaa

SEQ ID NO: 374246 - DNA, 20 bp, Artificial
  CRISPR gRNA sequence
gaatatttgtttacattata

SEQ ID NO: 374247 - DNA, 20 bp, Artificial
  CRISPR gRNA sequence
tatttgtttacattatatag

SEQ ID NO: 374248 - DNA, 20 bp, Artificial
  CRISPR gRNA sequence
atttgtttacattatataga

SEQ ID NO: 374249 - DNA, 20 bp, Artificial
  CRISPR gRNA sequence
ctttgtatgacctgataatg

SEQ ID NO: 374250 - DNA, 20 bp, Artificial
  CRISPR gRNA sequence
cctgataatgcagaatctgt

SEQ ID NO: 374251 - DNA, 20 bp, Artificial
  CRISPR gRNA sequence
ctgtgtgaactcactcatta

SEQ ID NO: 374252 - DNA, 20 bp, Artificial
  CRISPR gRNA sequence
ggtccatctgtacacaaaac

SEQ ID NO: 374253 - DNA, 20 bp, Artificial
  CRISPR gRNA sequence
gtccatctgtacacaaaaca

SEQ ID NO: 374254 - DNA, 20 bp, Artificial
  CRISPR gRNA sequence
caaaacaaggtctaatattt

SEQ ID NO: 374255 - DNA, 20 bp, Artificial
  CRISPR gRNA sequence
attttcttaaaatctaaaaa

SEQ ID NO: 374256 - DNA, 20 bp, Artificial
  CRISPR gRNA sequence
aaaaaaagttaattttattt

SEQ ID NO: 374257 - DNA, 20 bp, Artificial
  CRISPR gRNA sequence
aataatatttgtgcatattt

SEQ ID NO: 374258 - DNA, 20 bp, Artificial
  CRISPR gRNA sequence
ataatatttgtgcatatttt

SEQ ID NO: 374259 - DNA, 20 bp, Artificial
  CRISPR gRNA sequence
taatatttgtgcatattttg

SEQ ID NO: 374260 - DNA, 20 bp, Artificial
  CRISPR gRNA sequence
aatatttgtgcatattttgg

SEQ ID NO: 374261 - DNA, 20 bp, Artificial
  CRISPR gRNA sequence
tttgacatatgtatacaatg

SEQ ID NO: 374262 - DNA, 20 bp, Artificial
  CRISPR gRNA sequence
tgacatatgtatacaatgta

SEQ ID NO: 374263 - DNA, 20 bp, Artificial
  CRISPR gRNA sequence
caatgtagagtgattaaatc

SEQ ID NO: 374264 - DNA, 20 bp, Artificial
  CRISPR gRNA sequence
ttacctatgatttctactgt

SEQ ID NO: 374265 - DNA, 20 bp, Artificial
  CRISPR gRNA sequence
tgagatatttgaaatttact

SEQ ID NO: 374266 - DNA, 20 bp, Artificial
  CRISPR gRNA sequence
aaatttactcagtcactttg

SEQ ID NO: 374267 - DNA, 20 bp, Artificial
  CRISPR gRNA sequence
gtatacattattattgacta

SEQ ID NO: 374268 - DNA, 20 bp, Artificial
  CRISPR gRNA sequence
atacattattattgactata

SEQ ID NO: 374269 - DNA, 20 bp, Artificial
  CRISPR gRNA sequence
gtatgataaatcttaaaact

SEQ ID NO: 374270 - DNA, 20 bp, Artificial
  CRISPR gRNA sequence
gataaatcttaaaacttggc

SEQ ID NO: 374271 - DNA, 20 bp, Artificial
  CRISPR gRNA sequence
ataaatcttaaaacttggct

SEQ ID NO: 374272 - DNA, 20 bp, Artificial
  CRISPR gRNA sequence
taaaacttggctgggtgctg

SEQ ID NO: 374273 - DNA, 20 bp, Artificial
  CRISPR gRNA sequence
gtggctcacgcctgtaattc

SEQ ID NO: 374274 - DNA, 20 bp, Artificial
  CRISPR gRNA sequence
cgcctgtaattccagcactt

SEQ ID NO: 374275 - DNA, 20 bp, Artificial
  CRISPR gRNA sequence
gcctgtaattccagcacttt

SEQ ID NO: 374276 - DNA, 20 bp, Artificial
  CRISPR gRNA sequence
ctgtaattccagcactttag

SEQ ID NO: 374277 - DNA, 20 bp, Artificial
  CRISPR gRNA sequence
ttccagcactttaggagacc

SEQ ID NO: 374278 - DNA, 20 bp, Artificial
  CRISPR gRNA sequence
tccagcactttaggagaccg

SEQ ID NO: 374279 - DNA, 20 bp, Artificial
  CRISPR gRNA sequence
agcactttaggagaccgagg

SEQ ID NO: 374280 - DNA, 20 bp, Artificial
  CRISPR gRNA sequence
gcactttaggagaccgaggc

SEQ ID NO: 374281 - DNA, 20 bp, Artificial
  CRISPR gRNA sequence
ctttaggagaccgaggcagg

SEQ ID NO: 374282 - DNA, 20 bp, Artificial
  CRISPR gRNA sequence
ccgaggcaggtggatccctc

SEQ ID NO: 374283 - DNA, 20 bp, Artificial
  CRISPR gRNA sequence
cgaggcaggtggatccctcg

SEQ ID NO: 374284 - DNA, 20 bp, Artificial
  CRISPR gRNA sequence
gcaggtggatccctcgaggt

SEQ ID NO: 374285 - DNA, 20 bp, Artificial
  CRISPR gRNA sequence
caggtggatccctcgaggtc

SEQ ID NO: 374286 - DNA, 20 bp, Artificial
  CRISPR gRNA sequence
ggtggatccctcgaggtcag

SEQ ID NO: 374287 - DNA, 20 bp, Artificial
  CRISPR gRNA sequence
tccctcgaggtcaggagttc

SEQ ID NO: 374288 - DNA, 20 bp, Artificial
  CRISPR gRNA sequence
cgaggtcaggagttcgagac

SEQ ID NO: 374289 - DNA, 20 bp, Artificial
  CRISPR gRNA sequence
tcaggagttcgagaccagca

SEQ ID NO: 374290 - DNA, 20 bp, Artificial
  CRISPR gRNA sequence
cgagaccagcatggccaaca

SEQ ID NO: 374291 - DNA, 20 bp, Artificial
  CRISPR gRNA sequence
ctctactaaaatataaaaat

SEQ ID NO: 374292 - DNA, 20 bp, Artificial
  CRISPR gRNA sequence
actaaaatataaaaattagc

SEQ ID NO: 374293 - DNA, 20 bp, Artificial
  CRISPR gRNA sequence
ctaaaatataaaaattagct

SEQ ID NO: 374294 - DNA, 20 bp, Artificial
  CRISPR gRNA sequence
taaaaattagctgggcattg

SEQ ID NO: 374295 - DNA, 20 bp, Artificial
  CRISPR gRNA sequence
aaattagctgggcattgtgg

SEQ ID NO: 374296 - DNA, 20 bp, Artificial
  CRISPR gRNA sequence
aattagctgggcattgtggc

SEQ ID NO: 374297 - DNA, 20 bp, Artificial
  CRISPR gRNA sequence
ggcattgtggcgggcgcctg

SEQ ID NO: 374298 - DNA, 20 bp, Artificial
  CRISPR gRNA sequence
gtggcgggcgcctgtagtcc

SEQ ID NO: 374299 - DNA, 20 bp, Artificial
  CRISPR gRNA sequence
cgcctgtagtcccagctact

SEQ ID NO: 374300 - DNA, 20 bp, Artificial
  CRISPR gRNA sequence
gcctgtagtcccagctactc

SEQ ID NO: 374301 - DNA, 20 bp, Artificial
  CRISPR gRNA sequence
cctgtagtcccagctactca

SEQ ID NO: 374302 - DNA, 20 bp, Artificial
  CRISPR gRNA sequence
ctgtagtcccagctactcag

SEQ ID NO: 374303 - DNA, 20 bp, Artificial
  CRISPR gRNA sequence
tgtagtcccagctactcagg

SEQ ID NO: 374304 - DNA, 20 bp, Artificial
  CRISPR gRNA sequence
tcccagctactcagggggct

SEQ ID NO: 374305 - DNA, 20 bp, Artificial
  CRISPR gRNA sequence
cccagctactcagggggctg

SEQ ID NO: 374306 - DNA, 20 bp, Artificial
  CRISPR gRNA sequence
agctactcagggggctgagg

SEQ ID NO: 374307 - DNA, 20 bp, Artificial
  CRISPR gRNA sequence
gctactcagggggctgaggc

SEQ ID NO: 374308 - DNA, 20 bp, Artificial
  CRISPR gRNA sequence
tactcagggggctgaggcag

SEQ ID NO: 374309 - DNA, 20 bp, Artificial
  CRISPR gRNA sequence
gcaggagaatcgcttgaacc

SEQ ID NO: 374310 - DNA, 20 bp, Artificial
  CRISPR gRNA sequence
caggagaatcgcttgaaccc

SEQ ID NO: 374311 - DNA, 20 bp, Artificial
  CRISPR gRNA sequence
ggagaatcgcttgaacccag

SEQ ID NO: 374312 - DNA, 20 bp, Artificial
  CRISPR gRNA sequence
gagaatcgcttgaacccagg

SEQ ID NO: 374313 - DNA, 20 bp, Artificial
  CRISPR gRNA sequence
aatcgcttgaacccaggagg

SEQ ID NO: 374314 - DNA, 20 bp, Artificial
  CRISPR gRNA sequence
tcgcttgaacccaggaggcg

SEQ ID NO: 374315 - DNA, 20 bp, Artificial
  CRISPR gRNA sequence
cgcttgaacccaggaggcgg

SEQ ID NO: 374316 - DNA, 20 bp, Artificial
  CRISPR gRNA sequence
aacccaggaggcggaggttg

SEQ ID NO: 374317 - DNA, 20 bp, Artificial
  CRISPR gRNA sequence
caggaggcggaggttgcagt

SEQ ID NO: 374318 - DNA, 20 bp, Artificial
  CRISPR gRNA sequence
ggcggaggttgcagtgagcc

SEQ ID NO: 374319 - DNA, 20 bp, Artificial
  CRISPR gRNA sequence
gagatcgtgccactgcactc

SEQ ID NO: 374320 - DNA, 20 bp, Artificial
  CRISPR gRNA sequence
cgtgccactgcactccagcc

SEQ ID NO: 374321 - DNA, 20 bp, Artificial
  CRISPR gRNA sequence
gtgccactgcactccagcct

SEQ ID NO: 374322 - DNA, 20 bp, Artificial
  CRISPR gRNA sequence
tccagcctgggtgacaaaac

SEQ ID NO: 374323 - DNA, 20 bp, Artificial
  CRISPR gRNA sequence
tgtctcaaaaaaaaaaaaaa

SEQ ID NO: 374324 - DNA, 20 bp, Artificial
  CRISPR gRNA sequence
aaaaaaaaaaaagaaatctt

SEQ ID NO: 374325 - DNA, 20 bp, Artificial
  CRISPR gRNA sequence
tccctccccattctcttgca

SEQ ID NO: 374326 - DNA, 20 bp, Artificial
  CRISPR gRNA sequence
ccattctcttgcacagcctc

SEQ ID NO: 374327 - DNA, 20 bp, Artificial
  CRISPR gRNA sequence
tcattctactttctacttct

SEQ ID NO: 374328 - DNA, 20 bp, Artificial
  CRISPR gRNA sequence
ttctaagacattaatttttt

SEQ ID NO: 374329 - DNA, 20 bp, Artificial
  CRISPR gRNA sequence
tctaagacattaattttttt

SEQ ID NO: 374330 - DNA, 20 bp, Artificial
  CRISPR gRNA sequence
tttttttaggttccatattt

SEQ ID NO: 374331 - DNA, 20 bp, Artificial
  CRISPR gRNA sequence
tttaggttccatatttaagt

SEQ ID NO: 374332 - DNA, 20 bp, Artificial
  CRISPR gRNA sequence
catatttaagtgagattatg

SEQ ID NO: 374333 - DNA, 20 bp, Artificial
  CRISPR gRNA sequence
atgtggtatttgtctttcaa

SEQ ID NO: 374334 - DNA, 20 bp, Artificial
  CRISPR gRNA sequence
tttgtctttcaacagtgtgc

SEQ ID NO: 374335 - DNA, 20 bp, Artificial
  CRISPR gRNA sequence
ttgtctttcaacagtgtgcg

SEQ ID NO: 374336 - DNA, 20 bp, Artificial
  CRISPR gRNA sequence
tgtctttcaacagtgtgcga

SEQ ID NO: 374337 - DNA, 20 bp, Artificial
  CRISPR gRNA sequence
ttcttcttttactgaaacaa

SEQ ID NO: 374338 - DNA, 20 bp, Artificial
  CRISPR gRNA sequence
ttattactgaacctacctac

SEQ ID NO: 374339 - DNA, 20 bp, Artificial
  CRISPR gRNA sequence
actgaacctacctactagtg

SEQ ID NO: 374340 - DNA, 20 bp, Artificial
  CRISPR gRNA sequence
tgaacctacctactagtgca

SEQ ID NO: 374341 - DNA, 20 bp, Artificial
  CRISPR gRNA sequence
tagtgcagagcatataaaca

SEQ ID NO: 374342 - DNA, 20 bp, Artificial
  CRISPR gRNA sequence
gtgcagagcatataaacaaa

SEQ ID NO: 374343 - DNA, 20 bp, Artificial
  CRISPR gRNA sequence
ataaaacatgttcgactgtc

SEQ ID NO: 374344 - DNA, 20 bp, Artificial
  CRISPR gRNA sequence
aacatgttcgactgtccaga

SEQ ID NO: 374345 - DNA, 20 bp, Artificial
  CRISPR gRNA sequence
atgttcgactgtccagatag

SEQ ID NO: 374346 - DNA, 20 bp, Artificial
  CRISPR gRNA sequence
ccagatagtggtgacattca

SEQ ID NO: 374347 - DNA, 20 bp, Artificial
  CRISPR gRNA sequence
gtgacattcacagatcgata

SEQ ID NO: 374348 - DNA, 20 bp, Artificial
  CRISPR gRNA sequence
acatgatcatgactttgaca

SEQ ID NO: 374349 - DNA, 20 bp, Artificial
  CRISPR gRNA sequence
cgtacaattccgtataaacc

SEQ ID NO: 374350 - DNA, 20 bp, Artificial
  CRISPR gRNA sequence
aattccgtataaacccagct

SEQ ID NO: 374351 - DNA, 20 bp, Artificial
  CRISPR gRNA sequence
aacccagcttggttcttctt

SEQ ID NO: 374352 - DNA, 20 bp, Artificial
  CRISPR gRNA sequence
ccagcttggttcttcttcag

SEQ ID NO: 374353 - DNA, 20 bp, Artificial
  CRISPR gRNA sequence
cttcttcagtggctccgttt

SEQ ID NO: 374354 - DNA, 20 bp, Artificial
  CRISPR gRNA sequence
tcttcagtggctccgttttg

SEQ ID NO: 374355 - DNA, 20 bp, Artificial
  CRISPR gRNA sequence
ctccgttttggagctgtaac

SEQ ID NO: 374356 - DNA, 20 bp, Artificial
  CRISPR gRNA sequence
gctgtaactggttgtattac

SEQ ID NO: 374357 - DNA, 20 bp, Artificial
  CRISPR gRNA sequence
cagctgtcatctgaatccac

SEQ ID NO: 374358 - DNA, 20 bp, Artificial
  CRISPR gRNA sequence
agctgtcatctgaatccact

SEQ ID NO: 374359 - DNA, 20 bp, Artificial
  CRISPR gRNA sequence
catctgaatccactgggaaa

SEQ ID NO: 374360 - DNA, 20 bp, Artificial
  CRISPR gRNA sequence
tccactgggaaatggtgctg

SEQ ID NO: 374361 - DNA, 20 bp, Artificial
  CRISPR gRNA sequence
ccactgggaaatggtgctgt

SEQ ID NO: 374362 - DNA, 20 bp, Artificial
  CRISPR gRNA sequence
ctgggaaatggtgctgtggg

SEQ ID NO: 374363 - DNA, 20 bp, Artificial
  CRISPR gRNA sequence
gaaatggtgctgtgggaagt

SEQ ID NO: 374364 - DNA, 20 bp, Artificial
  CRISPR gRNA sequence
aaatggtgctgtgggaagtc

SEQ ID NO: 374365 - DNA, 20 bp, Artificial
  CRISPR gRNA sequence
aatggtgctgtgggaagtca

SEQ ID NO: 374366 - DNA, 20 bp, Artificial
  CRISPR gRNA sequence
gggaagtcagggaacctgaa

SEQ ID NO: 374367 - DNA, 20 bp, Artificial
  CRISPR gRNA sequence
gaagtcagggaacctgaacg

SEQ ID NO: 374368 - DNA, 20 bp, Artificial
  CRISPR gRNA sequence
aagtcagggaacctgaacgg

SEQ ID NO: 374369 - DNA, 20 bp, Artificial
  CRISPR gRNA sequence
agtcagggaacctgaacgga

SEQ ID NO: 374370 - DNA, 20 bp, Artificial
  CRISPR gRNA sequence
gggaacctgaacggagggac

SEQ ID NO: 374371 - DNA, 20 bp, Artificial
  CRISPR gRNA sequence
ctgaacggagggactggctg

SEQ ID NO: 374372 - DNA, 20 bp, Artificial
  CRISPR gRNA sequence
ggagggactggctgaagcca

SEQ ID NO: 374373 - DNA, 20 bp, Artificial
  CRISPR gRNA sequence
gggactggctgaagccatgg

SEQ ID NO: 374374 - DNA, 20 bp, Artificial
  CRISPR gRNA sequence
actggctgaagccatggcag

SEQ ID NO: 374375 - DNA, 20 bp, Artificial
  CRISPR gRNA sequence
gcagaagaatttaaattgtg

SEQ ID NO: 374376 - DNA, 20 bp, Artificial
  CRISPR gRNA sequence
tttaaattgtgaagatttca

SEQ ID NO: 374377 - DNA, 20 bp, Artificial
  CRISPR gRNA sequence
atggacatttatcacttccc

SEQ ID NO: 374378 - DNA, 20 bp, Artificial
  CRISPR gRNA sequence
cttaatcccgtcatcttcgt

SEQ ID NO: 374379 - DNA, 20 bp, Artificial
  CRISPR gRNA sequence
tcccgtcatcttcgtaagct

SEQ ID NO: 374380 - DNA, 20 bp, Artificial
  CRISPR gRNA sequence
cccgtcatcttcgtaagctg

SEQ ID NO: 374381 - DNA, 20 bp, Artificial
  CRISPR gRNA sequence
gctgaggatgtatgtcacct

SEQ ID NO: 374382 - DNA, 20 bp, Artificial
  CRISPR gRNA sequence
ctgaggatgtatgtcacctc

SEQ ID NO: 374383 - DNA, 20 bp, Artificial
  CRISPR gRNA sequence
gtcacctcaggaccctgtga

SEQ ID NO: 374384 - DNA, 20 bp, Artificial
  CRISPR gRNA sequence
aactgcacaaattgtttgta

SEQ ID NO: 374385 - DNA, 20 bp, Artificial
  CRISPR gRNA sequence
tgtttgaacaatatgaaatc

SEQ ID NO: 374386 - DNA, 20 bp, Artificial
  CRISPR gRNA sequence
gtttgaacaatatgaaatct

SEQ ID NO: 374387 - DNA, 20 bp, Artificial
  CRISPR gRNA sequence
atatgaaatctgggcacctt

SEQ ID NO: 374388 - DNA, 20 bp, Artificial
  CRISPR gRNA sequence
aaatctgggcaccttaagaa

SEQ ID NO: 374389 - DNA, 20 bp, Artificial
  CRISPR gRNA sequence
aatctgggcaccttaagaac

SEQ ID NO: 374390 - DNA, 20 bp, Artificial
  CRISPR gRNA sequence
aacaggataactgtgatttt

SEQ ID NO: 374391 - DNA, 20 bp, Artificial
  CRISPR gRNA sequence
caggataactgtgattttca

SEQ ID NO: 374392 - DNA, 20 bp, Artificial
  CRISPR gRNA sequence
aactgtgattttcagagaac

SEQ ID NO: 374393 - DNA, 20 bp, Artificial
  CRISPR gRNA sequence
actgtgattttcagagaaca

SEQ ID NO: 374394 - DNA, 20 bp, Artificial
  CRISPR gRNA sequence
ctgtgattttcagagaacaa

SEQ ID NO: 374395 - DNA, 20 bp, Artificial
  CRISPR gRNA sequence
gtgattttcagagaacaagg

SEQ ID NO: 374396 - DNA, 20 bp, Artificial
  CRISPR gRNA sequence
gaacaagggagataacctta

SEQ ID NO: 374397 - DNA, 20 bp, Artificial
  CRISPR gRNA sequence
agggagataaccttaaagtc

SEQ ID NO: 374398 - DNA, 20 bp, Artificial
  CRISPR gRNA sequence
ccttaaagtctggctgcctg

SEQ ID NO: 374399 - DNA, 20 bp, Artificial
  CRISPR gRNA sequence
cttaaagtctggctgcctgt

SEQ ID NO: 374400 - DNA, 20 bp, Artificial
  CRISPR gRNA sequence
aagtctggctgcctgtaggc

SEQ ID NO: 374401 - DNA, 20 bp, Artificial
  CRISPR gRNA sequence
ctggctgcctgtaggccagt

SEQ ID NO: 374402 - DNA, 20 bp, Artificial
  CRISPR gRNA sequence
tggctgcctgtaggccagtc

SEQ ID NO: 374403 - DNA, 20 bp, Artificial
  CRISPR gRNA sequence
tgcctgtaggccagtcagga

SEQ ID NO: 374404 - DNA, 20 bp, Artificial
  CRISPR gRNA sequence
cctgtaggccagtcaggaca

SEQ ID NO: 374405 - DNA, 20 bp, Artificial
  CRISPR gRNA sequence
atttctcttattatcgaaaa

SEQ ID NO: 374406 - DNA, 20 bp, Artificial
  CRISPR gRNA sequence
tttctcttattatcgaaaat

SEQ ID NO: 374407 - DNA, 20 bp, Artificial
  CRISPR gRNA sequence
tcttattatcgaaaatgggt

SEQ ID NO: 374408 - DNA, 20 bp, Artificial
  CRISPR gRNA sequence
ttattatcgaaaatgggtaa

SEQ ID NO: 374409 - DNA, 20 bp, Artificial
  CRISPR gRNA sequence
atatcgctgaattccttccc

SEQ ID NO: 374410 - DNA, 20 bp, Artificial
  CRISPR gRNA sequence
cgctgaattccttccccagt

SEQ ID NO: 374411 - DNA, 20 bp, Artificial
  CRISPR gRNA sequence
gctgaattccttccccagta

SEQ ID NO: 374412 - DNA, 20 bp, Artificial
  CRISPR gRNA sequence
taaggaatattaataattca

SEQ ID NO: 374413 - DNA, 20 bp, Artificial
  CRISPR gRNA sequence
atattaataattcacagccc

SEQ ID NO: 374414 - DNA, 20 bp, Artificial
  CRISPR gRNA sequence
tattaataattcacagccct

SEQ ID NO: 374415 - DNA, 20 bp, Artificial
  CRISPR gRNA sequence
ataattcacagccctgggaa

SEQ ID NO: 374416 - DNA, 20 bp, Artificial
  CRISPR gRNA sequence
ctgggaaaagaatgctttcc

SEQ ID NO: 374417 - DNA, 20 bp, Artificial
  CRISPR gRNA sequence
tgggaaaagaatgctttcct

SEQ ID NO: 374418 - DNA, 20 bp, Artificial
  CRISPR gRNA sequence
gggaaaagaatgctttcctg

SEQ ID NO: 374419 - DNA, 20 bp, Artificial
  CRISPR gRNA sequence
ggaaaagaatgctttcctgg

SEQ ID NO: 374420 - DNA, 20 bp, Artificial
  CRISPR gRNA sequence
gaaaagaatgctttcctggg

SEQ ID NO: 374421 - DNA, 20 bp, Artificial
  CRISPR gRNA sequence
aaagaatgctttcctggggg

SEQ ID NO: 374422 - DNA, 20 bp, Artificial
  CRISPR gRNA sequence
aagaatgctttcctgggggg

SEQ ID NO: 374423 - DNA, 20 bp, Artificial
  CRISPR gRNA sequence
gaatgctttcctggggggag

SEQ ID NO: 374424 - DNA, 20 bp, Artificial
  CRISPR gRNA sequence
atgctttcctggggggagga

SEQ ID NO: 374425 - DNA, 20 bp, Artificial
  CRISPR gRNA sequence
gggaggagagccctctataa

SEQ ID NO: 374426 - DNA, 20 bp, Artificial
  CRISPR gRNA sequence
agccctctataatggcctct

SEQ ID NO: 374427 - DNA, 20 bp, Artificial
  CRISPR gRNA sequence
cctctataatggcctctcag

SEQ ID NO: 374428 - DNA, 20 bp, Artificial
  CRISPR gRNA sequence
ctctataatggcctctcagc

SEQ ID NO: 374429 - DNA, 20 bp, Artificial
  CRISPR gRNA sequence
tctataatggcctctcagcg

SEQ ID NO: 374430 - DNA, 20 bp, Artificial
  CRISPR gRNA sequence
ctataatggcctctcagcgg

SEQ ID NO: 374431 - DNA, 20 bp, Artificial
  CRISPR gRNA sequence
tataatggcctctcagcggg

SEQ ID NO: 374432 - DNA, 20 bp, Artificial
  CRISPR gRNA sequence
cggggggtgtctgccttatg

SEQ ID NO: 374433 - DNA, 20 bp, Artificial
  CRISPR gRNA sequence
gtgtctgccttatgcagttg

SEQ ID NO: 374434 - DNA, 20 bp, Artificial
  CRISPR gRNA sequence
tgccttatgcagttgcagat

SEQ ID NO: 374435 - DNA, 20 bp, Artificial
  CRISPR gRNA sequence
gccttatgcagttgcagata

SEQ ID NO: 374436 - DNA, 20 bp, Artificial
  CRISPR gRNA sequence
ccttatgcagttgcagataa

SEQ ID NO: 374437 - DNA, 20 bp, Artificial
  CRISPR gRNA sequence
ataagggatgaaacatgccc

SEQ ID NO: 374438 - DNA, 20 bp, Artificial
  CRISPR gRNA sequence
aaacatgccctggcctcctg

SEQ ID NO: 374439 - DNA, 20 bp, Artificial
  CRISPR gRNA sequence
ctggcctcctgcagcacccc

SEQ ID NO: 374440 - DNA, 20 bp, Artificial
  CRISPR gRNA sequence
tggcctcctgcagcaccccc

SEQ ID NO: 374441 - DNA, 20 bp, Artificial
  CRISPR gRNA sequence
tgcagcacccccaggcttgc

SEQ ID NO: 374442 - DNA, 20 bp, Artificial
  CRISPR gRNA sequence
gcagcacccccaggcttgct

SEQ ID NO: 374443 - DNA, 20 bp, Artificial
  CRISPR gRNA sequence
acccccaggcttgctaggat

SEQ ID NO: 374444 - DNA, 20 bp, Artificial
  CRISPR gRNA sequence
cccccaggcttgctaggatt

SEQ ID NO: 374445 - DNA, 20 bp, Artificial
  CRISPR gRNA sequence
ttgctaggattaggaaattc

SEQ ID NO: 374446 - DNA, 20 bp, Artificial
  CRISPR gRNA sequence
aggattaggaaattccagcc

SEQ ID NO: 374447 - DNA, 20 bp, Artificial
  CRISPR gRNA sequence
aattccagcctggcgaattc

SEQ ID NO: 374448 - DNA, 20 bp, Artificial
  CRISPR gRNA sequence
ccagcctggcgaattctagt

SEQ ID NO: 374449 - DNA, 20 bp, Artificial
  CRISPR gRNA sequence
ctggcgaattctagtcagac

SEQ ID NO: 374450 - DNA, 20 bp, Artificial
  CRISPR gRNA sequence
ctctgctcttgaaccctgtt

SEQ ID NO: 374451 - DNA, 20 bp, Artificial
  CRISPR gRNA sequence
aaccctgttaagatgtttat

SEQ ID NO: 374452 - DNA, 20 bp, Artificial
  CRISPR gRNA sequence
gttaagatgtttatcagtga

SEQ ID NO: 374453 - DNA, 20 bp, Artificial
  CRISPR gRNA sequence
gtgtgttcctgaaacttcat

SEQ ID NO: 374454 - DNA, 20 bp, Artificial
  CRISPR gRNA sequence
gtgatcttttgttgcccttg

SEQ ID NO: 374455 - DNA, 20 bp, Artificial
  CRISPR gRNA sequence
aattgctaataaaaacttgc

SEQ ID NO: 374456 - DNA, 20 bp, Artificial
  CRISPR gRNA sequence
ataaaaacttgctggtttta

SEQ ID NO: 374457 - DNA, 20 bp, Artificial
  CRISPR gRNA sequence
aacttgctggttttacggct

SEQ ID NO: 374458 - DNA, 20 bp, Artificial
  CRISPR gRNA sequence
acttgctggttttacggctc

SEQ ID NO: 374459 - DNA, 20 bp, Artificial
  CRISPR gRNA sequence
ttgctggttttacggctcag

SEQ ID NO: 374460 - DNA, 20 bp, Artificial
  CRISPR gRNA sequence
tgctggttttacggctcagg

SEQ ID NO: 374461 - DNA, 20 bp, Artificial
  CRISPR gRNA sequence
ttacggctcaggaggcatca

SEQ ID NO: 374462 - DNA, 20 bp, Artificial
  CRISPR gRNA sequence
ccaacatgtgatgtctcccc

SEQ ID NO: 374463 - DNA, 20 bp, Artificial
  CRISPR gRNA sequence
tgatgtctcccctagacacc

SEQ ID NO: 374464 - DNA, 20 bp, Artificial
  CRISPR gRNA sequence
tactctttccctttatttct

SEQ ID NO: 374465 - DNA, 20 bp, Artificial
  CRISPR gRNA sequence
tttccctttatttctcagac

SEQ ID NO: 374466 - DNA, 20 bp, Artificial
  CRISPR gRNA sequence
ttctcagactggccaacact

SEQ ID NO: 374467 - DNA, 20 bp, Artificial
  CRISPR gRNA sequence
tctcagactggccaacactt

SEQ ID NO: 374468 - DNA, 20 bp, Artificial
  CRISPR gRNA sequence
ctcagactggccaacactta

SEQ ID NO: 374469 - DNA, 20 bp, Artificial
  CRISPR gRNA sequence
tggccaacacttagggaaaa

SEQ ID NO: 374470 - DNA, 20 bp, Artificial
  CRISPR gRNA sequence
aacacttagggaaaatagaa

SEQ ID NO: 374471 - DNA, 20 bp, Artificial
  CRISPR gRNA sequence
aagaacctacattgaattat

SEQ ID NO: 374472 - DNA, 20 bp, Artificial
  CRISPR gRNA sequence
agaacctacattgaattatc

SEQ ID NO: 374473 - DNA, 20 bp, Artificial
  CRISPR gRNA sequence
gaacctacattgaattatca

SEQ ID NO: 374474 - DNA, 20 bp, Artificial
  CRISPR gRNA sequence
aacctacattgaattatcag

SEQ ID NO: 374475 - DNA, 20 bp, Artificial
  CRISPR gRNA sequence
ctacattgaattatcagggg

SEQ ID NO: 374476 - DNA, 20 bp, Artificial
  CRISPR gRNA sequence
tacattgaattatcaggggc

SEQ ID NO: 374477 - DNA, 20 bp, Artificial
  CRISPR gRNA sequence
ggcaggttcccccgataaaa

SEQ ID NO: 374478 - DNA, 20 bp, Artificial
  CRISPR gRNA sequence
gcaggttcccccgataaaat

SEQ ID NO: 374479 - DNA, 20 bp, Artificial
  CRISPR gRNA sequence
ttttgcttttgtttcttgac

SEQ ID NO: 374480 - DNA, 20 bp, Artificial
  CRISPR gRNA sequence
tttgcttttgtttcttgacc

SEQ ID NO: 374481 - DNA, 20 bp, Artificial
  CRISPR gRNA sequence
caggaattgcttgaccctga

SEQ ID NO: 374482 - DNA, 20 bp, Artificial
  CRISPR gRNA sequence
ttgcttgaccctgaaagtct

SEQ ID NO: 374483 - DNA, 20 bp, Artificial
  CRISPR gRNA sequence
tgcttgaccctgaaagtctt

SEQ ID NO: 374484 - DNA, 20 bp, Artificial
  CRISPR gRNA sequence
cttgaccctgaaagtcttgg

SEQ ID NO: 374485 - DNA, 20 bp, Artificial
  CRISPR gRNA sequence
gaccctgaaagtcttgggag

SEQ ID NO: 374486 - DNA, 20 bp, Artificial
  CRISPR gRNA sequence
gaaagtcttgggagaagaca

SEQ ID NO: 374487 - DNA, 20 bp, Artificial
  CRISPR gRNA sequence
gtcttgggagaagacatggt

SEQ ID NO: 374488 - DNA, 20 bp, Artificial
  CRISPR gRNA sequence
tcttgggagaagacatggtg

SEQ ID NO: 374489 - DNA, 20 bp, Artificial
  CRISPR gRNA sequence
ggagaagacatggtgaggaa

SEQ ID NO: 374490 - DNA, 20 bp, Artificial
  CRISPR gRNA sequence
agaagacatggtgaggaatg

SEQ ID NO: 374491 - DNA, 20 bp, Artificial
  CRISPR gRNA sequence
gtcaaccacacacaccatga

SEQ ID NO: 374492 - DNA, 20 bp, Artificial
  CRISPR gRNA sequence
aaccacacacaccatgatgg

SEQ ID NO: 374493 - DNA, 20 bp, Artificial
  CRISPR gRNA sequence
atgttttctttcatcttttt

SEQ ID NO: 374494 - DNA, 20 bp, Artificial
  CRISPR gRNA sequence
ttctttcatctttttgagaa

SEQ ID NO: 374495 - DNA, 20 bp, Artificial
  CRISPR gRNA sequence
tttgagaaaagccattcaaa

SEQ ID NO: 374496 - DNA, 20 bp, Artificial
  CRISPR gRNA sequence
ttgagaaaagccattcaaaa

SEQ ID NO: 374497 - DNA, 20 bp, Artificial
  CRISPR gRNA sequence
aaagccattcaaaaaggtgt

SEQ ID NO: 374498 - DNA, 20 bp, Artificial
  CRISPR gRNA sequence
aagccattcaaaaaggtgtg

SEQ ID NO: 374499 - DNA, 20 bp, Artificial
  CRISPR gRNA sequence
ccattcaaaaaggtgtgagg

SEQ ID NO: 374500 - DNA, 20 bp, Artificial
  CRISPR gRNA sequence
tgtgaggtggtctctcattg

SEQ ID NO: 374501 - DNA, 20 bp, Artificial
  CRISPR gRNA sequence
ctcattgtggttttaatttg

SEQ ID NO: 374502 - DNA, 20 bp, Artificial
  CRISPR gRNA sequence
tggttttaatttgcagtttc

SEQ ID NO: 374503 - DNA, 20 bp, Artificial
  CRISPR gRNA sequence
tccagcctaacgcttgatgt

SEQ ID NO: 374504 - DNA, 20 bp, Artificial
  CRISPR gRNA sequence
cagcctaacgcttgatgtta

SEQ ID NO: 374505 - DNA, 20 bp, Artificial
  CRISPR gRNA sequence
gcctaacgcttgatgttaga

SEQ ID NO: 374506 - DNA, 20 bp, Artificial
  CRISPR gRNA sequence
aacgcttgatgttagagagt

SEQ ID NO: 374507 - DNA, 20 bp, Artificial
  CRISPR gRNA sequence
acgcttgatgttagagagtc

SEQ ID NO: 374508 - DNA, 20 bp, Artificial
  CRISPR gRNA sequence
tgttagagagtcaggacctg

SEQ ID NO: 374509 - DNA, 20 bp, Artificial
  CRISPR gRNA sequence
gttagagagtcaggacctgc

SEQ ID NO: 374510 - DNA, 20 bp, Artificial
  CRISPR gRNA sequence
caggacctgcgggttttccc

SEQ ID NO: 374511 - DNA, 20 bp, Artificial
  CRISPR gRNA sequence
gttttccctggcatattctt

SEQ ID NO: 374512 - DNA, 20 bp, Artificial
  CRISPR gRNA sequence
ccctggcatattctttggcc

SEQ ID NO: 374513 - DNA, 20 bp, Artificial
  CRISPR gRNA sequence
tattctttggcccagttatt

SEQ ID NO: 374514 - DNA, 20 bp, Artificial
  CRISPR gRNA sequence
attctttggcccagttattt

SEQ ID NO: 374515 - DNA, 20 bp, Artificial
  CRISPR gRNA sequence
ggcccagttatttaggttct

SEQ ID NO: 374516 - DNA, 20 bp, Artificial
  CRISPR gRNA sequence
taactccacccccaccctaa

SEQ ID NO: 374517 - DNA, 20 bp, Artificial
  CRISPR gRNA sequence
actccacccccaccctaata

SEQ ID NO: 374518 - DNA, 20 bp, Artificial
  CRISPR gRNA sequence
ctccacccccaccctaatag

SEQ ID NO: 374519 - DNA, 20 bp, Artificial
  CRISPR gRNA sequence
ccctaatagaggataaacta

SEQ ID NO: 374520 - DNA, 20 bp, Artificial
  CRISPR gRNA sequence
ggataaactatagacattaa

SEQ ID NO: 374521 - DNA, 20 bp, Artificial
  CRISPR gRNA sequence
actcttgcctgccgaactct

SEQ ID NO: 374522 - DNA, 20 bp, Artificial
  CRISPR gRNA sequence
ctcttgcctgccgaactctg

SEQ ID NO: 374523 - DNA, 20 bp, Artificial
  CRISPR gRNA sequence
tcttgcctgccgaactctga

SEQ ID NO: 374524 - DNA, 20 bp, Artificial
  CRISPR gRNA sequence
tgcctgccgaactctgaggg

SEQ ID NO: 374525 - DNA, 20 bp, Artificial
  CRISPR gRNA sequence
ctgccgaactctgagggaag

SEQ ID NO: 374526 - DNA, 20 bp, Artificial
  CRISPR gRNA sequence
tgccgaactctgagggaaga

SEQ ID NO: 374527 - DNA, 20 bp, Artificial
  CRISPR gRNA sequence
gccgaactctgagggaagaa

SEQ ID NO: 374528 - DNA, 20 bp, Artificial
  CRISPR gRNA sequence
actctgagggaagaagggac

SEQ ID NO: 374529 - DNA, 20 bp, Artificial
  CRISPR gRNA sequence
actggcaatatttctatcat

SEQ ID NO: 374530 - DNA, 20 bp, Artificial
  CRISPR gRNA sequence
ttctatcatgagccttttct

SEQ ID NO: 374531 - DNA, 20 bp, Artificial
  CRISPR gRNA sequence
ctatcatgagccttttctaa

SEQ ID NO: 374532 - DNA, 20 bp, Artificial
  CRISPR gRNA sequence
ttttctaagagtgtataact

SEQ ID NO: 374533 - DNA, 20 bp, Artificial
  CRISPR gRNA sequence
ccataaatacttgtcattgc

SEQ ID NO: 374534 - DNA, 20 bp, Artificial
  CRISPR gRNA sequence
acttgtcattgccagaaact

SEQ ID NO: 374535 - DNA, 20 bp, Artificial
  CRISPR gRNA sequence
tcattgccagaaacttagcc

SEQ ID NO: 374536 - DNA, 20 bp, Artificial
  CRISPR gRNA sequence
attgccagaaacttagccta

SEQ ID NO: 374537 - DNA, 20 bp, Artificial
  CRISPR gRNA sequence
ttgccagaaacttagcctag

SEQ ID NO: 374538 - DNA, 20 bp, Artificial
  CRISPR gRNA sequence
tgccagaaacttagcctaga

SEQ ID NO: 374539 - DNA, 20 bp, Artificial
  CRISPR gRNA sequence
agcctagagggtcacaatcc

SEQ ID NO: 374540 - DNA, 20 bp, Artificial
  CRISPR gRNA sequence
cctagagggtcacaatcctg

SEQ ID NO: 374541 - DNA, 20 bp, Artificial
  CRISPR gRNA sequence
gtatttatcttctgtgatgt

SEQ ID NO: 374542 - DNA, 20 bp, Artificial
  CRISPR gRNA sequence
tatttatcttctgtgatgta

SEQ ID NO: 374543 - DNA, 20 bp, Artificial
  CRISPR gRNA sequence
tcttctgtgatgtaaggtaa

SEQ ID NO: 374544 - DNA, 20 bp, Artificial
  CRISPR gRNA sequence
gatgtaaggtaatggtttta

SEQ ID NO: 374545 - DNA, 20 bp, Artificial
  CRISPR gRNA sequence
aggtaatggttttacagttc

SEQ ID NO: 374546 - DNA, 20 bp, Artificial
  CRISPR gRNA sequence
tctcctcctatgaatcaaca

SEQ ID NO: 374547 - DNA, 20 bp, Artificial
  CRISPR gRNA sequence
cctatgaatcaacacagcat

SEQ ID NO: 374548 - DNA, 20 bp, Artificial
  CRISPR gRNA sequence
ctatgaatcaacacagcatt

SEQ ID NO: 374549 - DNA, 20 bp, Artificial
  CRISPR gRNA sequence
tcaacacagcattgggatat

SEQ ID NO: 374550 - DNA, 20 bp, Artificial
  CRISPR gRNA sequence
cattgggatataagtgaaaa

SEQ ID NO: 374551 - DNA, 20 bp, Artificial
  CRISPR gRNA sequence
gggatataagtgaaaaaagt

SEQ ID NO: 374552 - DNA, 20 bp, Artificial
  CRISPR gRNA sequence
gaaaaaagttagcaaaaaaa

SEQ ID NO: 374553 - DNA, 20 bp, Artificial
  CRISPR gRNA sequence
gttagcaaaaaaatggcttc

SEQ ID NO: 374554 - DNA, 20 bp, Artificial
  CRISPR gRNA sequence
gaaacaattcttctttttta

SEQ ID NO: 374555 - DNA, 20 bp, Artificial
  CRISPR gRNA sequence
aattcttcttttttaaagaa

SEQ ID NO: 374556 - DNA, 20 bp, Artificial
  CRISPR gRNA sequence
attcttcttttttaaagaaa

SEQ ID NO: 374557 - DNA, 20 bp, Artificial
  CRISPR gRNA sequence
ttcttcttttttaaagaaaa

SEQ ID NO: 374558 - DNA, 20 bp, Artificial
  CRISPR gRNA sequence
agaaaagggcttccttttta

SEQ ID NO: 374559 - DNA, 20 bp, Artificial
  CRISPR gRNA sequence
agggcttcctttttaaagaa

SEQ ID NO: 374560 - DNA, 20 bp, Artificial
  CRISPR gRNA sequence
gggcttcctttttaaagaaa

SEQ ID NO: 374561 - DNA, 20 bp, Artificial
  CRISPR gRNA sequence
ggcttcctttttaaagaaaa

SEQ ID NO: 374562 - DNA, 20 bp, Artificial
  CRISPR gRNA sequence
ctttttaaagaaaagggctt

SEQ ID NO: 374563 - DNA, 20 bp, Artificial
  CRISPR gRNA sequence
tttttaaagaaaagggcttc

SEQ ID NO: 374564 - DNA, 20 bp, Artificial
  CRISPR gRNA sequence
ttttaaagaaaagggcttca

SEQ ID NO: 374565 - DNA, 20 bp, Artificial
  CRISPR gRNA sequence
ttactcaatctgacatctat

SEQ ID NO: 374566 - DNA, 20 bp, Artificial
  CRISPR gRNA sequence
gaactgttgattaactccca

SEQ ID NO: 374567 - DNA, 20 bp, Artificial
  CRISPR gRNA sequence
cttttcctttttattttccc

SEQ ID NO: 374568 - DNA, 20 bp, Artificial
  CRISPR gRNA sequence
ttttattttccccagccata

SEQ ID NO: 374569 - DNA, 20 bp, Artificial
  CRISPR gRNA sequence
tttattttccccagccatac

SEQ ID NO: 374570 - DNA, 20 bp, Artificial
  CRISPR gRNA sequence
ttattttccccagccataca

SEQ ID NO: 374571 - DNA, 20 bp, Artificial
  CRISPR gRNA sequence
ttccccagccatacagggcc

SEQ ID NO: 374572 - DNA, 20 bp, Artificial
  CRISPR gRNA sequence
ccagccatacagggcccagc

SEQ ID NO: 374573 - DNA, 20 bp, Artificial
  CRISPR gRNA sequence
cagccatacagggcccagca

SEQ ID NO: 374574 - DNA, 20 bp, Artificial
  CRISPR gRNA sequence
tacagggcccagcaaggtgc

SEQ ID NO: 374575 - DNA, 20 bp, Artificial
  CRISPR gRNA sequence
agcaaggtgcaagccctgta

SEQ ID NO: 374576 - DNA, 20 bp, Artificial
  CRISPR gRNA sequence
gcaaggtgcaagccctgtat

SEQ ID NO: 374577 - DNA, 20 bp, Artificial
  CRISPR gRNA sequence
ggtgcaagccctgtataggc

SEQ ID NO: 374578 - DNA, 20 bp, Artificial
  CRISPR gRNA sequence
gcaagccctgtataggccag

SEQ ID NO: 374579 - DNA, 20 bp, Artificial
  CRISPR gRNA sequence
taggccagtggtcattcatg

SEQ ID NO: 374580 - DNA, 20 bp, Artificial
  CRISPR gRNA sequence
gccagtggtcattcatgtgg

SEQ ID NO: 374581 - DNA, 20 bp, Artificial
  CRISPR gRNA sequence
ggtcattcatgtggaagctg

SEQ ID NO: 374582 - DNA, 20 bp, Artificial
  CRISPR gRNA sequence
gtcattcatgtggaagctgc

SEQ ID NO: 374583 - DNA, 20 bp, Artificial
  CRISPR gRNA sequence
ttcatgtggaagctgcaggc

SEQ ID NO: 374584 - DNA, 20 bp, Artificial
  CRISPR gRNA sequence
tcatgtggaagctgcaggca

SEQ ID NO: 374585 - DNA, 20 bp, Artificial
  CRISPR gRNA sequence
tgtggaagctgcaggcaagg

SEQ ID NO: 374586 - DNA, 20 bp, Artificial
  CRISPR gRNA sequence
gtggaagctgcaggcaaggc

SEQ ID NO: 374587 - DNA, 20 bp, Artificial
  CRISPR gRNA sequence
tggaagctgcaggcaaggca

SEQ ID NO: 374588 - DNA, 20 bp, Artificial
  CRISPR gRNA sequence
gctgcaggcaaggcagggaa

SEQ ID NO: 374589 - DNA, 20 bp, Artificial
  CRISPR gRNA sequence
ggcaaggcagggaatggact

SEQ ID NO: 374590 - DNA, 20 bp, Artificial
  CRISPR gRNA sequence
aaggcagggaatggactgag

SEQ ID NO: 374591 - DNA, 20 bp, Artificial
  CRISPR gRNA sequence
aatggactgagaagccatgt

SEQ ID NO: 374592 - DNA, 20 bp, Artificial
  CRISPR gRNA sequence
ctgagaagccatgtcagcta

SEQ ID NO: 374593 - DNA, 20 bp, Artificial
  CRISPR gRNA sequence
tgagaagccatgtcagctac

SEQ ID NO: 374594 - DNA, 20 bp, Artificial
  CRISPR gRNA sequence
aagccatgtcagctacaggc

SEQ ID NO: 374595 - DNA, 20 bp, Artificial
  CRISPR gRNA sequence
agccatgtcagctacaggct

SEQ ID NO: 374596 - DNA, 20 bp, Artificial
  CRISPR gRNA sequence
agctacaggctgggccactc

SEQ ID NO: 374597 - DNA, 20 bp, Artificial
  CRISPR gRNA sequence
actctagattgaaatgtctc

SEQ ID NO: 374598 - DNA, 20 bp, Artificial
  CRISPR gRNA sequence
ttatttcacctttatttctt

SEQ ID NO: 374599 - DNA, 20 bp, Artificial
  CRISPR gRNA sequence
ctaactatttttaaattgtc

SEQ ID NO: 374600 - DNA, 20 bp, Artificial
  CRISPR gRNA sequence
taactatttttaaattgtct

SEQ ID NO: 374601 - DNA, 20 bp, Artificial
  CRISPR gRNA sequence
caatatatgttccactaaat

SEQ ID NO: 374602 - DNA, 20 bp, Artificial
  CRISPR gRNA sequence
aatatatgttccactaaatc

SEQ ID NO: 374603 - DNA, 20 bp, Artificial
  CRISPR gRNA sequence
ttccactaaatcaggtattg

SEQ ID NO: 374604 - DNA, 20 bp, Artificial
  CRISPR gRNA sequence
taaatcaggtattgtggtat

SEQ ID NO: 374605 - DNA, 20 bp, Artificial
  CRISPR gRNA sequence
aaatcaggtattgtggtatt

SEQ ID NO: 374606 - DNA, 20 bp, Artificial
  CRISPR gRNA sequence
tattgtggtattaggatatg

SEQ ID NO: 374607 - DNA, 20 bp, Artificial
  CRISPR gRNA sequence
tattaggatatgcagatcta

SEQ ID NO: 374608 - DNA, 20 bp, Artificial
  CRISPR gRNA sequence
attaggatatgcagatctat

SEQ ID NO: 374609 - DNA, 20 bp, Artificial
  CRISPR gRNA sequence
gatctataggttttcatcca

SEQ ID NO: 374610 - DNA, 20 bp, Artificial
  CRISPR gRNA sequence
atctataggttttcatccac

SEQ ID NO: 374611 - DNA, 20 bp, Artificial
  CRISPR gRNA sequence
aggttttcatccacgggtcc

SEQ ID NO: 374612 - DNA, 20 bp, Artificial
  CRISPR gRNA sequence
gtcctggctcaaaattcaca

SEQ ID NO: 374613 - DNA, 20 bp, Artificial
  CRISPR gRNA sequence
catggtccttgttataatgt

SEQ ID NO: 374614 - DNA, 20 bp, Artificial
  CRISPR gRNA sequence
atggtccttgttataatgtt

SEQ ID NO: 374615 - DNA, 20 bp, Artificial
  CRISPR gRNA sequence
tggtccttgttataatgttg

SEQ ID NO: 374616 - DNA, 20 bp, Artificial
  CRISPR gRNA sequence
gttataatgttggggcactt

SEQ ID NO: 374617 - DNA, 20 bp, Artificial
  CRISPR gRNA sequence
ttataatgttggggcacttc

SEQ ID NO: 374618 - DNA, 20 bp, Artificial
  CRISPR gRNA sequence
tgttggggcacttcaggcct

SEQ ID NO: 374619 - DNA, 20 bp, Artificial
  CRISPR gRNA sequence
gttggggcacttcaggcctc

SEQ ID NO: 374620 - DNA, 20 bp, Artificial
  CRISPR gRNA sequence
gcacttcaggcctcaggaaa

SEQ ID NO: 374621 - DNA, 20 bp, Artificial
  CRISPR gRNA sequence
cttcaggcctcaggaaacag

SEQ ID NO: 374622 - DNA, 20 bp, Artificial
  CRISPR gRNA sequence
tcctgtcctttctcctgacc

SEQ ID NO: 374623 - DNA, 20 bp, Artificial
  CRISPR gRNA sequence
cctgtcctttctcctgacca

SEQ ID NO: 374624 - DNA, 20 bp, Artificial
  CRISPR gRNA sequence
tcctttctcctgaccaaggt

SEQ ID NO: 374625 - DNA, 20 bp, Artificial
  CRISPR gRNA sequence
gtaagactctaatctgaatg

SEQ ID NO: 374626 - DNA, 20 bp, Artificial
  CRISPR gRNA sequence
taagactctaatctgaatgt

SEQ ID NO: 374627 - DNA, 20 bp, Artificial
  CRISPR gRNA sequence
ctaatctgaatgtgggtcaa

SEQ ID NO: 374628 - DNA, 20 bp, Artificial
  CRISPR gRNA sequence
gggtcaaaagaccctcattc

SEQ ID NO: 374629 - DNA, 20 bp, Artificial
  CRISPR gRNA sequence
gtcaaaagaccctcattcca

SEQ ID NO: 374630 - DNA, 20 bp, Artificial
  CRISPR gRNA sequence
caaaagaccctcattccaga

SEQ ID NO: 374631 - DNA, 20 bp, Artificial
  CRISPR gRNA sequence
aaaagaccctcattccagag

SEQ ID NO: 374632 - DNA, 20 bp, Artificial
  CRISPR gRNA sequence
aggatcccaccccatatcta

SEQ ID NO: 374633 - DNA, 20 bp, Artificial
  CRISPR gRNA sequence
cccaccccatatctaaagtc

SEQ ID NO: 374634 - DNA, 20 bp, Artificial
  CRISPR gRNA sequence
ccccatatctaaagtctgga

SEQ ID NO: 374635 - DNA, 20 bp, Artificial
  CRISPR gRNA sequence
cccatatctaaagtctggac

SEQ ID NO: 374636 - DNA, 20 bp, Artificial
  CRISPR gRNA sequence
aaagtctggacaggacttgc

SEQ ID NO: 374637 - DNA, 20 bp, Artificial
  CRISPR gRNA sequence
aagtctggacaggacttgct

SEQ ID NO: 374638 - DNA, 20 bp, Artificial
  CRISPR gRNA sequence
tggacaggacttgctgggtt

SEQ ID NO: 374639 - DNA, 20 bp, Artificial
  CRISPR gRNA sequence
tagatgatatgctttttgcc

SEQ ID NO: 374640 - DNA, 20 bp, Artificial
  CRISPR gRNA sequence
ttgcccagtcccatttctac

SEQ ID NO: 374641 - DNA, 20 bp, Artificial
  CRISPR gRNA sequence
tgcccagtcccatttctaca

SEQ ID NO: 374642 - DNA, 20 bp, Artificial
  CRISPR gRNA sequence
tcccatttctacaaggttgt

SEQ ID NO: 374643 - DNA, 20 bp, Artificial
  CRISPR gRNA sequence
tcagtcatacctacgtaatg

SEQ ID NO: 374644 - DNA, 20 bp, Artificial
  CRISPR gRNA sequence
tgaagcctccataaaaatcc

SEQ ID NO: 374645 - DNA, 20 bp, Artificial
  CRISPR gRNA sequence
aagcctccataaaaatccaa

SEQ ID NO: 374646 - DNA, 20 bp, Artificial
  CRISPR gRNA sequence
agcctccataaaaatccaag

SEQ ID NO: 374647 - DNA, 20 bp, Artificial
  CRISPR gRNA sequence
tccataaaaatccaagagga

SEQ ID NO: 374648 - DNA, 20 bp, Artificial
  CRISPR gRNA sequence
ccataaaaatccaagaggat

SEQ ID NO: 374649 - DNA, 20 bp, Artificial
  CRISPR gRNA sequence
cataaaaatccaagaggatg

SEQ ID NO: 374650 - DNA, 20 bp, Artificial
  CRISPR gRNA sequence
aaatccaagaggatggggtt

SEQ ID NO: 374651 - DNA, 20 bp, Artificial
  CRISPR gRNA sequence
atccaagaggatggggtttg

SEQ ID NO: 374652 - DNA, 20 bp, Artificial
  CRISPR gRNA sequence
ccaagaggatggggtttgga

SEQ ID NO: 374653 - DNA, 20 bp, Artificial
  CRISPR gRNA sequence
gatggggtttggagagtttc

SEQ ID NO: 374654 - DNA, 20 bp, Artificial
  CRISPR gRNA sequence
gggtttggagagtttctgga

SEQ ID NO: 374655 - DNA, 20 bp, Artificial
  CRISPR gRNA sequence
tttctggacagctgaacatg

SEQ ID NO: 374656 - DNA, 20 bp, Artificial
  CRISPR gRNA sequence
tctggacagctgaacatgtg

SEQ ID NO: 374657 - DNA, 20 bp, Artificial
  CRISPR gRNA sequence
gctgaacatgtggagcctcc

SEQ ID NO: 374658 - DNA, 20 bp, Artificial
  CRISPR gRNA sequence
tgaacatgtggagcctcctg

SEQ ID NO: 374659 - DNA, 20 bp, Artificial
  CRISPR gRNA sequence
gaacatgtggagcctcctgg

SEQ ID NO: 374660 - DNA, 20 bp, Artificial
  CRISPR gRNA sequence
aacatgtggagcctcctgga

SEQ ID NO: 374661 - DNA, 20 bp, Artificial
  CRISPR gRNA sequence
gagcctcctggagggtgatg

SEQ ID NO: 374662 - DNA, 20 bp, Artificial
  CRISPR gRNA sequence
ctcctggagggtgatgtgga

SEQ ID NO: 374663 - DNA, 20 bp, Artificial
  CRISPR gRNA sequence
tcctggagggtgatgtggac

SEQ ID NO: 374664 - DNA, 20 bp, Artificial
  CRISPR gRNA sequence
cctggagggtgatgtggaca

SEQ ID NO: 374665 - DNA, 20 bp, Artificial
  CRISPR gRNA sequence
tggagggtgatgtggacagg

SEQ ID NO: 374666 - DNA, 20 bp, Artificial
  CRISPR gRNA sequence
ggagggtgatgtggacaggg

SEQ ID NO: 374667 - DNA, 20 bp, Artificial
  CRISPR gRNA sequence
gagggtgatgtggacaggga

SEQ ID NO: 374668 - DNA, 20 bp, Artificial
  CRISPR gRNA sequence
tgatgtggacagggagggca

SEQ ID NO: 374669 - DNA, 20 bp, Artificial
  CRISPR gRNA sequence
gatgtggacagggagggcat

SEQ ID NO: 374670 - DNA, 20 bp, Artificial
  CRISPR gRNA sequence
actgacaaatgtgttttctt

SEQ ID NO: 374671 - DNA, 20 bp, Artificial
  CRISPR gRNA sequence
gttttcttgagctctataac

SEQ ID NO: 374672 - DNA, 20 bp, Artificial
  CRISPR gRNA sequence
agctctataactggctccac

SEQ ID NO: 374673 - DNA, 20 bp, Artificial
  CRISPR gRNA sequence
cagattaaccaaacctgaaa

SEQ ID NO: 374674 - DNA, 20 bp, Artificial
  CRISPR gRNA sequence
agattaaccaaacctgaaaa

SEQ ID NO: 374675 - DNA, 20 bp, Artificial
  CRISPR gRNA sequence
gattaaccaaacctgaaaaa

SEQ ID NO: 374676 - DNA, 20 bp, Artificial
  CRISPR gRNA sequence
attaaccaaacctgaaaaag

SEQ ID NO: 374677 - DNA, 20 bp, Artificial
  CRISPR gRNA sequence
caaacctgaaaaaggggtct

SEQ ID NO: 374678 - DNA, 20 bp, Artificial
  CRISPR gRNA sequence
aaacctgaaaaaggggtctt

SEQ ID NO: 374679 - DNA, 20 bp, Artificial
  CRISPR gRNA sequence
aaaaggggtcttgggaaccc

SEQ ID NO: 374680 - DNA, 20 bp, Artificial
  CRISPR gRNA sequence
ggtcttgggaaccccagctt

SEQ ID NO: 374681 - DNA, 20 bp, Artificial
  CRISPR gRNA sequence
gtcttgggaaccccagcttg

SEQ ID NO: 374682 - DNA, 20 bp, Artificial
  CRISPR gRNA sequence
aaccccagcttgaggcccat

SEQ ID NO: 374683 - DNA, 20 bp, Artificial
  CRISPR gRNA sequence
gcttgaggcccattggtccg

SEQ ID NO: 374684 - DNA, 20 bp, Artificial
  CRISPR gRNA sequence
ggcccattggtccgaagttc

SEQ ID NO: 374685 - DNA, 20 bp, Artificial
  CRISPR gRNA sequence
cccattggtccgaagttcta

SEQ ID NO: 374686 - DNA, 20 bp, Artificial
  CRISPR gRNA sequence
ccattggtccgaagttctag

SEQ ID NO: 374687 - DNA, 20 bp, Artificial
  CRISPR gRNA sequence
ggtccgaagttctagaggcc

SEQ ID NO: 374688 - DNA, 20 bp, Artificial
  CRISPR gRNA sequence
gtccgaagttctagaggcct

SEQ ID NO: 374689 - DNA, 20 bp, Artificial
  CRISPR gRNA sequence
aagttctagaggcctgggac

SEQ ID NO: 374690 - DNA, 20 bp, Artificial
  CRISPR gRNA sequence
agttctagaggcctgggact

SEQ ID NO: 374691 - DNA, 20 bp, Artificial
  CRISPR gRNA sequence
tagaggcctgggactgggca

SEQ ID NO: 374692 - DNA, 20 bp, Artificial
  CRISPR gRNA sequence
aggcctgggactgggcacgg

SEQ ID NO: 374693 - DNA, 20 bp, Artificial
  CRISPR gRNA sequence
gtggctcacgcctgcaatcc

SEQ ID NO: 374694 - DNA, 20 bp, Artificial
  CRISPR gRNA sequence
cgcctgcaatcccagcactt

SEQ ID NO: 374695 - DNA, 20 bp, Artificial
  CRISPR gRNA sequence
gcctgcaatcccagcacttt

SEQ ID NO: 374696 - DNA, 20 bp, Artificial
  CRISPR gRNA sequence
ctgcaatcccagcactttgg

SEQ ID NO: 374697 - DNA, 20 bp, Artificial
  CRISPR gRNA sequence
tgcaatcccagcactttggg

SEQ ID NO: 374698 - DNA, 20 bp, Artificial
  CRISPR gRNA sequence
tcccagcactttgggaggcc

SEQ ID NO: 374699 - DNA, 20 bp, Artificial
  CRISPR gRNA sequence
cccagcactttgggaggccg

SEQ ID NO: 374700 - DNA, 20 bp, Artificial
  CRISPR gRNA sequence
cagcactttgggaggccgag

SEQ ID NO: 374701 - DNA, 20 bp, Artificial
  CRISPR gRNA sequence
agcactttgggaggccgagg

SEQ ID NO: 374702 - DNA, 20 bp, Artificial
  CRISPR gRNA sequence
gcactttgggaggccgagga

SEQ ID NO: 374703 - DNA, 20 bp, Artificial
  CRISPR gRNA sequence
ctttgggaggccgaggaggg

SEQ ID NO: 374704 - DNA, 20 bp, Artificial
  CRISPR gRNA sequence
ccgaggagggcggatcacct

SEQ ID NO: 374705 - DNA, 20 bp, Artificial
  CRISPR gRNA sequence
cgaggagggcggatcacctt

SEQ ID NO: 374706 - DNA, 20 bp, Artificial
  CRISPR gRNA sequence
gagggcggatcaccttaggt

SEQ ID NO: 374707 - DNA, 20 bp, Artificial
  CRISPR gRNA sequence
agggcggatcaccttaggtg

SEQ ID NO: 374708 - DNA, 20 bp, Artificial
  CRISPR gRNA sequence
ggcggatcaccttaggtgag

SEQ ID NO: 374709 - DNA, 20 bp, Artificial
  CRISPR gRNA sequence
tcaccttaggtgaggagttc

SEQ ID NO: 374710 - DNA, 20 bp, Artificial
  CRISPR gRNA sequence
ttaggtgaggagttcgagac

SEQ ID NO: 374711 - DNA, 20 bp, Artificial
  CRISPR gRNA sequence
cgagaccagcctgactaaca

SEQ ID NO: 374712 - DNA, 20 bp, Artificial
  CRISPR gRNA sequence
tctactaaaaatacaaaaat

SEQ ID NO: 374713 - DNA, 20 bp, Artificial
  CRISPR gRNA sequence
ctaaaaatacaaaaattagc

SEQ ID NO: 374714 - DNA, 20 bp, Artificial
  CRISPR gRNA sequence
atacaaaaattagctggacg

SEQ ID NO: 374715 - DNA, 20 bp, Artificial
  CRISPR gRNA sequence
caaaaattagctggacgtag

SEQ ID NO: 374716 - DNA, 20 bp, Artificial
  CRISPR gRNA sequence
aaattagctggacgtagtgg

SEQ ID NO: 374717 - DNA, 20 bp, Artificial
  CRISPR gRNA sequence
aattagctggacgtagtggc

SEQ ID NO: 374718 - DNA, 20 bp, Artificial
  CRISPR gRNA sequence
gtggcgggtgcctgtaatcc

SEQ ID NO: 374719 - DNA, 20 bp, Artificial
  CRISPR gRNA sequence
tgcctgtaatcccagctact

SEQ ID NO: 374720 - DNA, 20 bp, Artificial
  CRISPR gRNA sequence
gcctgtaatcccagctactc

SEQ ID NO: 374721 - DNA, 20 bp, Artificial
  CRISPR gRNA sequence
ctgtaatcccagctactcag

SEQ ID NO: 374722 - DNA, 20 bp, Artificial
  CRISPR gRNA sequence
tgtaatcccagctactcagg

SEQ ID NO: 374723 - DNA, 20 bp, Artificial
  CRISPR gRNA sequence
tcccagctactcaggaggct

SEQ ID NO: 374724 - DNA, 20 bp, Artificial
  CRISPR gRNA sequence
cccagctactcaggaggctg

SEQ ID NO: 374725 - DNA, 20 bp, Artificial
  CRISPR gRNA sequence
agctactcaggaggctgagg

SEQ ID NO: 374726 - DNA, 20 bp, Artificial
  CRISPR gRNA sequence
gctactcaggaggctgaggc

SEQ ID NO: 374727 - DNA, 20 bp, Artificial
  CRISPR gRNA sequence
tactcaggaggctgaggcag

SEQ ID NO: 374728 - DNA, 20 bp, Artificial
  CRISPR gRNA sequence
gcaggagaatcacttgaacc

SEQ ID NO: 374729 - DNA, 20 bp, Artificial
  CRISPR gRNA sequence
caggagaatcacttgaacct

SEQ ID NO: 374730 - DNA, 20 bp, Artificial
  CRISPR gRNA sequence
ggagaatcacttgaacctgg

SEQ ID NO: 374731 - DNA, 20 bp, Artificial
  CRISPR gRNA sequence
gagaatcacttgaacctggg

SEQ ID NO: 374732 - DNA, 20 bp, Artificial
  CRISPR gRNA sequence
aatcacttgaacctgggagg

SEQ ID NO: 374733 - DNA, 20 bp, Artificial
  CRISPR gRNA sequence
tcacttgaacctgggaggcg

SEQ ID NO: 374734 - DNA, 20 bp, Artificial
  CRISPR gRNA sequence
aacctgggaggcggagattg

SEQ ID NO: 374735 - DNA, 20 bp, Artificial
  CRISPR gRNA sequence
tgggaggcggagattgcagc

SEQ ID NO: 374736 - DNA, 20 bp, Artificial
  CRISPR gRNA sequence
ggcggagattgcagcgagcc

SEQ ID NO: 374737 - DNA, 20 bp, Artificial
  CRISPR gRNA sequence
gagatcctgccattgtactc

SEQ ID NO: 374738 - DNA, 20 bp, Artificial
  CRISPR gRNA sequence
cctgccattgtactccagcc

SEQ ID NO: 374739 - DNA, 20 bp, Artificial
  CRISPR gRNA sequence
ctgccattgtactccagcct

SEQ ID NO: 374740 - DNA, 20 bp, Artificial
  CRISPR gRNA sequence
ttgtactccagcctgggtga

SEQ ID NO: 374741 - DNA, 20 bp, Artificial
  CRISPR gRNA sequence
gtactccagcctgggtgaca

SEQ ID NO: 374742 - DNA, 20 bp, Artificial
  CRISPR gRNA sequence
tccagcctgggtgacagagc

SEQ ID NO: 374743 - DNA, 20 bp, Artificial
  CRISPR gRNA sequence
aaaaaaaaaaaaaaaaaaaa

SEQ ID NO: 374744 - DNA, 20 bp, Artificial
  CRISPR gRNA sequence
aaaaaaaaaaaaaaaagttc

SEQ ID NO: 374745 - DNA, 20 bp, Artificial
  CRISPR gRNA sequence
aaaaaaaaaaaaaagttcta

SEQ ID NO: 374746 - DNA, 20 bp, Artificial
  CRISPR gRNA sequence
aaaaaaaaaaaaagttctag

SEQ ID NO: 374747 - DNA, 20 bp, Artificial
  CRISPR gRNA sequence
aaaaaaaagttctagaggcc

SEQ ID NO: 374748 - DNA, 20 bp, Artificial
  CRISPR gRNA sequence
tagaggcctggacttgcaat

SEQ ID NO: 374749 - DNA, 20 bp, Artificial
  CRISPR gRNA sequence
ggacttgcaattggtgtctg

SEQ ID NO: 374750 - DNA, 20 bp, Artificial
  CRISPR gRNA sequence
gacttgcaattggtgtctga

SEQ ID NO: 374751 - DNA, 20 bp, Artificial
  CRISPR gRNA sequence
acttgcaattggtgtctgaa

SEQ ID NO: 374752 - DNA, 20 bp, Artificial
  CRISPR gRNA sequence
tgcaattggtgtctgaaggg

SEQ ID NO: 374753 - DNA, 20 bp, Artificial
  CRISPR gRNA sequence
gcaattggtgtctgaagggc

SEQ ID NO: 374754 - DNA, 20 bp, Artificial
  CRISPR gRNA sequence
caattggtgtctgaagggca

SEQ ID NO: 374755 - DNA, 20 bp, Artificial
  CRISPR gRNA sequence
tggtgtctgaagggcagggt

SEQ ID NO: 374756 - DNA, 20 bp, Artificial
  CRISPR gRNA sequence
ctgaagggcagggttagcaa

SEQ ID NO: 374757 - DNA, 20 bp, Artificial
  CRISPR gRNA sequence
gaagggcagggttagcaatg

SEQ ID NO: 374758 - DNA, 20 bp, Artificial
  CRISPR gRNA sequence
aagggcagggttagcaatgg

SEQ ID NO: 374759 - DNA, 20 bp, Artificial
  CRISPR gRNA sequence
gggcagggttagcaatggag

SEQ ID NO: 374760 - DNA, 20 bp, Artificial
  CRISPR gRNA sequence
ggcagggttagcaatggagg

SEQ ID NO: 374761 - DNA, 20 bp, Artificial
  CRISPR gRNA sequence
gcagggttagcaatggagga

SEQ ID NO: 374762 - DNA, 20 bp, Artificial
  CRISPR gRNA sequence
cagggttagcaatggaggag

SEQ ID NO: 374763 - DNA, 20 bp, Artificial
  CRISPR gRNA sequence
agggttagcaatggaggagg

SEQ ID NO: 374764 - DNA, 20 bp, Artificial
  CRISPR gRNA sequence
ttagcaatggaggagggggt

SEQ ID NO: 374765 - DNA, 20 bp, Artificial
  CRISPR gRNA sequence
aggagggggtgagatgtctt

SEQ ID NO: 374766 - DNA, 20 bp, Artificial
  CRISPR gRNA sequence
ggagggggtgagatgtcttt

SEQ ID NO: 374767 - DNA, 20 bp, Artificial
  CRISPR gRNA sequence
ggtgagatgtctttgggact

SEQ ID NO: 374768 - DNA, 20 bp, Artificial
  CRISPR gRNA sequence
tgtctttgggactgagcccc

SEQ ID NO: 374769 - DNA, 20 bp, Artificial
  CRISPR gRNA sequence
gggactgagcccccagcctg

SEQ ID NO: 374770 - DNA, 20 bp, Artificial
  CRISPR gRNA sequence
ggactgagcccccagcctgt

SEQ ID NO: 374771 - DNA, 20 bp, Artificial
  CRISPR gRNA sequence
gtgggatctgatactgtcct

SEQ ID NO: 374772 - DNA, 20 bp, Artificial
  CRISPR gRNA sequence
tgggatctgatactgtcctt

SEQ ID NO: 374773 - DNA, 20 bp, Artificial
  CRISPR gRNA sequence
gatctgatactgtccttggg

SEQ ID NO: 374774 - DNA, 20 bp, Artificial
  CRISPR gRNA sequence
tgtccttgggtagatcatgt

SEQ ID NO: 374775 - DNA, 20 bp, Artificial
  CRISPR gRNA sequence
agatcatgtcagaattgaat

SEQ ID NO: 374776 - DNA, 20 bp, Artificial
  CRISPR gRNA sequence
tcatgtcagaattgaattgg

SEQ ID NO: 374777 - DNA, 20 bp, Artificial
  CRISPR gRNA sequence
gaattgaattggcggacact

SEQ ID NO: 374778 - DNA, 20 bp, Artificial
  CRISPR gRNA sequence
tgaattggcggacactcagc

SEQ ID NO: 374779 - DNA, 20 bp, Artificial
  CRISPR gRNA sequence
tcagctggtgcctgttactg

SEQ ID NO: 374780 - DNA, 20 bp, Artificial
  CRISPR gRNA sequence
cagctggtgcctgttactgt

SEQ ID NO: 374781 - DNA, 20 bp, Artificial
  CRISPR gRNA sequence
agctggtgcctgttactgtg

SEQ ID NO: 374782 - DNA, 20 bp, Artificial
  CRISPR gRNA sequence
gctggtgcctgttactgtgg

SEQ ID NO: 374783 - DNA, 20 bp, Artificial
  CRISPR gRNA sequence
gggaaaaccacccacacctt

SEQ ID NO: 374784 - DNA, 20 bp, Artificial
  CRISPR gRNA sequence
accacccacacctttggtca

SEQ ID NO: 374785 - DNA, 20 bp, Artificial
  CRISPR gRNA sequence
acccacacctttggtcacag

SEQ ID NO: 374786 - DNA, 20 bp, Artificial
  CRISPR gRNA sequence
aagtctgttgacgattgctg

SEQ ID NO: 374787 - DNA, 20 bp, Artificial
  CRISPR gRNA sequence
tctgttgacgattgctgtgg

SEQ ID NO: 374788 - DNA, 20 bp, Artificial
  CRISPR gRNA sequence
gacgattgctgtggtagtgt

SEQ ID NO: 374789 - DNA, 20 bp, Artificial
  CRISPR gRNA sequence
cgattgctgtggtagtgtga

SEQ ID NO: 374790 - DNA, 20 bp, Artificial
  CRISPR gRNA sequence
ttgctgtggtagtgtgagag

SEQ ID NO: 374791 - DNA, 20 bp, Artificial
  CRISPR gRNA sequence
gctgtggtagtgtgagagca

SEQ ID NO: 374792 - DNA, 20 bp, Artificial
  CRISPR gRNA sequence
gagcagagaaaaaacacaat

SEQ ID NO: 374793 - DNA, 20 bp, Artificial
  CRISPR gRNA sequence
gcagagaaaaaacacaattg

SEQ ID NO: 374794 - DNA, 20 bp, Artificial
  CRISPR gRNA sequence
agagaaaaaacacaattgga

SEQ ID NO: 374795 - DNA, 20 bp, Artificial
  CRISPR gRNA sequence
tggagagttttttttctaca

SEQ ID NO: 374796 - DNA, 20 bp, Artificial
  CRISPR gRNA sequence
ggagagttttttttctacac

SEQ ID NO: 374797 - DNA, 20 bp, Artificial
  CRISPR gRNA sequence
tttacctaccactttgtctg

SEQ ID NO: 374798 - DNA, 20 bp, Artificial
  CRISPR gRNA sequence
taccactttgtctgtagtac

SEQ ID NO: 374799 - DNA, 20 bp, Artificial
  CRISPR gRNA sequence
accactttgtctgtagtacc

SEQ ID NO: 374800 - DNA, 20 bp, Artificial
  CRISPR gRNA sequence
tgtctgtagtaccaggcata

SEQ ID NO: 374801 - DNA, 20 bp, Artificial
  CRISPR gRNA sequence
cttgaaatactttgtgttta

SEQ ID NO: 374802 - DNA, 20 bp, Artificial
  CRISPR gRNA sequence
atactttgtgtttaaagact

SEQ ID NO: 374803 - DNA, 20 bp, Artificial
  CRISPR gRNA sequence
ttaaagactgagtgaataaa

SEQ ID NO: 374804 - DNA, 20 bp, Artificial
  CRISPR gRNA sequence
tgaataaatggatctgatcc

SEQ ID NO: 374805 - DNA, 20 bp, Artificial
  CRISPR gRNA sequence
aataaatggatctgatccaa

SEQ ID NO: 374806 - DNA, 20 bp, Artificial
  CRISPR gRNA sequence
ataaatggatctgatccaag

SEQ ID NO: 374807 - DNA, 20 bp, Artificial
  CRISPR gRNA sequence
aggccaaacattactaaaaa

SEQ ID NO: 374808 - DNA, 20 bp, Artificial
  CRISPR gRNA sequence
ggccaaacattactaaaaac

SEQ ID NO: 374809 - DNA, 20 bp, Artificial
  CRISPR gRNA sequence
tactaaaaacgggttacaaa

SEQ ID NO: 374810 - DNA, 20 bp, Artificial
  CRISPR gRNA sequence
actaaaaacgggttacaaat

SEQ ID NO: 374811 - DNA, 20 bp, Artificial
  CRISPR gRNA sequence
gaaacaatgcatctgaaatt

SEQ ID NO: 374812 - DNA, 20 bp, Artificial
  CRISPR gRNA sequence
aatttggatttataattgaa

SEQ ID NO: 374813 - DNA, 20 bp, Artificial
  CRISPR gRNA sequence
ataattgaacagtgtgtcac

SEQ ID NO: 374814 - DNA, 20 bp, Artificial
  CRISPR gRNA sequence
attgaacagtgtgtcacaag

SEQ ID NO: 374815 - DNA, 20 bp, Artificial
  CRISPR gRNA sequence
tcacaagtggtcgtactttc

SEQ ID NO: 374816 - DNA, 20 bp, Artificial
  CRISPR gRNA sequence
caagtggtcgtactttcaag

SEQ ID NO: 374817 - DNA, 20 bp, Artificial
  CRISPR gRNA sequence
aagtggtcgtactttcaagc

SEQ ID NO: 374818 - DNA, 20 bp, Artificial
  CRISPR gRNA sequence
actgttaaattcatataaat

SEQ ID NO: 374819 - DNA, 20 bp, Artificial
  CRISPR gRNA sequence
atataaattagaccttcata

SEQ ID NO: 374820 - DNA, 20 bp, Artificial
  CRISPR gRNA sequence
aaattagaccttcataaaga

SEQ ID NO: 374821 - DNA, 20 bp, Artificial
  CRISPR gRNA sequence
agaaagccatcttaattgtt

SEQ ID NO: 374822 - DNA, 20 bp, Artificial
  CRISPR gRNA sequence
tgttaagtattctatttcta

SEQ ID NO: 374823 - DNA, 20 bp, Artificial
  CRISPR gRNA sequence
agtattctatttctaaagaa

SEQ ID NO: 374824 - DNA, 20 bp, Artificial
  CRISPR gRNA sequence
catcctgtactttaaccact

SEQ ID NO: 374825 - DNA, 20 bp, Artificial
  CRISPR gRNA sequence
ttgataaaatattctttttt

SEQ ID NO: 374826 - DNA, 20 bp, Artificial
  CRISPR gRNA sequence
aatattcttttttaagcctg

SEQ ID NO: 374827 - DNA, 20 bp, Artificial
  CRISPR gRNA sequence
cctgcagatctttatttttt

SEQ ID NO: 374828 - DNA, 20 bp, Artificial
  CRISPR gRNA sequence
cacaaaatgaacacatcgtc

SEQ ID NO: 374829 - DNA, 20 bp, Artificial
  CRISPR gRNA sequence
aacacatcgtctagaaaatt

SEQ ID NO: 374830 - DNA, 20 bp, Artificial
  CRISPR gRNA sequence
aaaatttggaaaatataaaa

SEQ ID NO: 374831 - DNA, 20 bp, Artificial
  CRISPR gRNA sequence
ggaaaatataaaaaagccca

SEQ ID NO: 374832 - DNA, 20 bp, Artificial
  CRISPR gRNA sequence
aaataattaactgtcaaata

SEQ ID NO: 374833 - DNA, 20 bp, Artificial
  CRISPR gRNA sequence
aaataaagattgaatatatt

SEQ ID NO: 374834 - DNA, 20 bp, Artificial
  CRISPR gRNA sequence
aataaagattgaatatattc

SEQ ID NO: 374835 - DNA, 20 bp, Artificial
  CRISPR gRNA sequence
ataaagattgaatatattca

SEQ ID NO: 374836 - DNA, 20 bp, Artificial
  CRISPR gRNA sequence
ttgaatatattcagggcata

SEQ ID NO: 374837 - DNA, 20 bp, Artificial
  CRISPR gRNA sequence
ttatttgatgtatataaaca

SEQ ID NO: 374838 - DNA, 20 bp, Artificial
  CRISPR gRNA sequence
tgatgtatataaacatggtg

SEQ ID NO: 374839 - DNA, 20 bp, Artificial
  CRISPR gRNA sequence
gtatcaccatccatactgta

SEQ ID NO: 374840 - DNA, 20 bp, Artificial
  CRISPR gRNA sequence
tcaccatccatactgtatag

SEQ ID NO: 374841 - DNA, 20 bp, Artificial
  CRISPR gRNA sequence
caccatccatactgtatagt

SEQ ID NO: 374842 - DNA, 20 bp, Artificial
  CRISPR gRNA sequence
taggtccccattataaccaa

SEQ ID NO: 374843 - DNA, 20 bp, Artificial
  CRISPR gRNA sequence
tccccattataaccaaaagt

SEQ ID NO: 374844 - DNA, 20 bp, Artificial
  CRISPR gRNA sequence
aaccaaaagttggtaccctt

SEQ ID NO: 374845 - DNA, 20 bp, Artificial
  CRISPR gRNA sequence
aaaagttggtaccctttagc

SEQ ID NO: 374846 - DNA, 20 bp, Artificial
  CRISPR gRNA sequence
tcttctgccctcccacctcc

SEQ ID NO: 374847 - DNA, 20 bp, Artificial
  CRISPR gRNA sequence
gttctattccctgcttctat

SEQ ID NO: 374848 - DNA, 20 bp, Artificial
  CRISPR gRNA sequence
ttctataagtttgacttttt

SEQ ID NO: 374849 - DNA, 20 bp, Artificial
  CRISPR gRNA sequence
acttttttagattccacata

SEQ ID NO: 374850 - DNA, 20 bp, Artificial
  CRISPR gRNA sequence
cttttttagattccacatac

SEQ ID NO: 374851 - DNA, 20 bp, Artificial
  CRISPR gRNA sequence
tttagattccacatacaggt

SEQ ID NO: 374852 - DNA, 20 bp, Artificial
  CRISPR gRNA sequence
cacatacaggtgagattata

SEQ ID NO: 374853 - DNA, 20 bp, Artificial
  CRISPR gRNA sequence
agtatttgtctttctatgtc

SEQ ID NO: 374854 - DNA, 20 bp, Artificial
  CRISPR gRNA sequence
ttcatccatgctgtcgcaaa

SEQ ID NO: 374855 - DNA, 20 bp, Artificial
  CRISPR gRNA sequence
atccatgctgtcgcaaatgg

SEQ ID NO: 374856 - DNA, 20 bp, Artificial
  CRISPR gRNA sequence
tccatgctgtcgcaaatggc

SEQ ID NO: 374857 - DNA, 20 bp, Artificial
  CRISPR gRNA sequence
tcgcaaatggcaggatttca

SEQ ID NO: 374858 - DNA, 20 bp, Artificial
  CRISPR gRNA sequence
atggcaggatttcacagcaa

SEQ ID NO: 374859 - DNA, 20 bp, Artificial
  CRISPR gRNA sequence
ggcaggatttcacagcaaaa

SEQ ID NO: 374860 - DNA, 20 bp, Artificial
  CRISPR gRNA sequence
aaaagagcaacccaattaaa

SEQ ID NO: 374861 - DNA, 20 bp, Artificial
  CRISPR gRNA sequence
agagcaacccaattaaaaag

SEQ ID NO: 374862 - DNA, 20 bp, Artificial
  CRISPR gRNA sequence
gagcaacccaattaaaaagt

SEQ ID NO: 374863 - DNA, 20 bp, Artificial
  CRISPR gRNA sequence
aattaaaaagtgggcaaaaa

SEQ ID NO: 374864 - DNA, 20 bp, Artificial
  CRISPR gRNA sequence
caaaaacagacatctttcca

SEQ ID NO: 374865 - DNA, 20 bp, Artificial
  CRISPR gRNA sequence
aaacagacatctttccaaag

SEQ ID NO: 374866 - DNA, 20 bp, Artificial
  CRISPR gRNA sequence
ttccaaagaagacataacac

SEQ ID NO: 374867 - DNA, 20 bp, Artificial
  CRISPR gRNA sequence
gaagacataacactggccaa

SEQ ID NO: 374868 - DNA, 20 bp, Artificial
  CRISPR gRNA sequence
aagacataacactggccaat

SEQ ID NO: 374869 - DNA, 20 bp, Artificial
  CRISPR gRNA sequence
aacactggccaataggtata

SEQ ID NO: 374870 - DNA, 20 bp, Artificial
  CRISPR gRNA sequence
ctggccaataggtatatgga

SEQ ID NO: 374871 - DNA, 20 bp, Artificial
  CRISPR gRNA sequence
ggaaagctgctcaacattac

SEQ ID NO: 374872 - DNA, 20 bp, Artificial
  CRISPR gRNA sequence
tgctcaacattactggtcat

SEQ ID NO: 374873 - DNA, 20 bp, Artificial
  CRISPR gRNA sequence
gctcaacattactggtcatc

SEQ ID NO: 374874 - DNA, 20 bp, Artificial
  CRISPR gRNA sequence
ctcaacattactggtcatca

SEQ ID NO: 374875 - DNA, 20 bp, Artificial
  CRISPR gRNA sequence
ggaaatgcaaatcaaaaccc

SEQ ID NO: 374876 - DNA, 20 bp, Artificial
  CRISPR gRNA sequence
atgcaaatcaaaaccccagt

SEQ ID NO: 374877 - DNA, 20 bp, Artificial
  CRISPR gRNA sequence
agctctcacctcacacctat

SEQ ID NO: 374878 - DNA, 20 bp, Artificial
  CRISPR gRNA sequence
tcacctcacacctattagaa

SEQ ID NO: 374879 - DNA, 20 bp, Artificial
  CRISPR gRNA sequence
ttagaatggctgttatcaaa

SEQ ID NO: 374880 - DNA, 20 bp, Artificial
  CRISPR gRNA sequence
tagaatggctgttatcaaaa

SEQ ID NO: 374881 - DNA, 20 bp, Artificial
  CRISPR gRNA sequence
atggctgttatcaaaaaggc

SEQ ID NO: 374882 - DNA, 20 bp, Artificial
  CRISPR gRNA sequence
ggctgttatcaaaaaggcaa

SEQ ID NO: 374883 - DNA, 20 bp, Artificial
  CRISPR gRNA sequence
gttatcaaaaaggcaagaga

SEQ ID NO: 374884 - DNA, 20 bp, Artificial
  CRISPR gRNA sequence
tcaaaaaggcaagagatagc

SEQ ID NO: 374885 - DNA, 20 bp, Artificial
  CRISPR gRNA sequence
aggcaagagatagcaagtgt

SEQ ID NO: 374886 - DNA, 20 bp, Artificial
  CRISPR gRNA sequence
aagagatagcaagtgttggt

SEQ ID NO: 374887 - DNA, 20 bp, Artificial
  CRISPR gRNA sequence
agagatagcaagtgttggtg

SEQ ID NO: 374888 - DNA, 20 bp, Artificial
  CRISPR gRNA sequence
agcaagtgttggtgaggatg

SEQ ID NO: 374889 - DNA, 20 bp, Artificial
  CRISPR gRNA sequence
caagtgttggtgaggatgtg

SEQ ID NO: 374890 - DNA, 20 bp, Artificial
  CRISPR gRNA sequence
gttggtgaggatgtggagaa

SEQ ID NO: 374891 - DNA, 20 bp, Artificial
  CRISPR gRNA sequence
ttggtgaggatgtggagaaa

SEQ ID NO: 374892 - DNA, 20 bp, Artificial
  CRISPR gRNA sequence
aggcaacccttgtacactgt

SEQ ID NO: 374893 - DNA, 20 bp, Artificial
  CRISPR gRNA sequence
caacccttgtacactgttgg

SEQ ID NO: 374894 - DNA, 20 bp, Artificial
  CRISPR gRNA sequence
aacccttgtacactgttggc

SEQ ID NO: 374895 - DNA, 20 bp, Artificial
  CRISPR gRNA sequence
actgttggcgggaatgtaaa

SEQ ID NO: 374896 - DNA, 20 bp, Artificial
  CRISPR gRNA sequence
ctgttggcgggaatgtaaat

SEQ ID NO: 374897 - DNA, 20 bp, Artificial
  CRISPR gRNA sequence
taaatgggtacactcgttat

SEQ ID NO: 374898 - DNA, 20 bp, Artificial
  CRISPR gRNA sequence
gggtacactcgttattggta

SEQ ID NO: 374899 - DNA, 20 bp, Artificial
  CRISPR gRNA sequence
ggtacactcgttattggtac

SEQ ID NO: 374900 - DNA, 20 bp, Artificial
  CRISPR gRNA sequence
acactcgttattggtacagg

SEQ ID NO: 374901 - DNA, 20 bp, Artificial
  CRISPR gRNA sequence
ctcgttattggtacaggtag

SEQ ID NO: 374902 - DNA, 20 bp, Artificial
  CRISPR gRNA sequence
tcgttattggtacaggtagt

SEQ ID NO: 374903 - DNA, 20 bp, Artificial
  CRISPR gRNA sequence
gtacaggtagtaggttcctc

SEQ ID NO: 374904 - DNA, 20 bp, Artificial
  CRISPR gRNA sequence
gttcctcaagaaattaaaaa

SEQ ID NO: 374905 - DNA, 20 bp, Artificial
  CRISPR gRNA sequence
ttcctcaagaaattaaaaat

SEQ ID NO: 374906 - DNA, 20 bp, Artificial
  CRISPR gRNA sequence
tcaagaaattaaaaataggc

SEQ ID NO: 374907 - DNA, 20 bp, Artificial
  CRISPR gRNA sequence
caagaaattaaaaataggcc

SEQ ID NO: 374908 - DNA, 20 bp, Artificial
  CRISPR gRNA sequence
aattaaaaataggccaggtg

SEQ ID NO: 374909 - DNA, 20 bp, Artificial
  CRISPR gRNA sequence
taaaaataggccaggtgcgg

SEQ ID NO: 374910 - DNA, 20 bp, Artificial
  CRISPR gRNA sequence
gtggctcatgcctgtaatcc

SEQ ID NO: 374911 - DNA, 20 bp, Artificial
  CRISPR gRNA sequence
tgcctgtaatcccagcactt

SEQ ID NO: 374912 - DNA, 20 bp, Artificial
  CRISPR gRNA sequence
gcctgtaatcccagcacttt

SEQ ID NO: 374913 - DNA, 20 bp, Artificial
  CRISPR gRNA sequence
ctgtaatcccagcactttgg

SEQ ID NO: 374914 - DNA, 20 bp, Artificial
  CRISPR gRNA sequence
tgtaatcccagcactttggg

SEQ ID NO: 374915 - DNA, 20 bp, Artificial
  CRISPR gRNA sequence
tcccagcactttgggaggcc

SEQ ID NO: 374916 - DNA, 20 bp, Artificial
  CRISPR gRNA sequence
cccagcactttgggaggcca

SEQ ID NO: 374917 - DNA, 20 bp, Artificial
  CRISPR gRNA sequence
agcactttgggaggccaagg

SEQ ID NO: 374918 - DNA, 20 bp, Artificial
  CRISPR gRNA sequence
ctttgggaggccaaggcaga

SEQ ID NO: 374919 - DNA, 20 bp, Artificial
  CRISPR gRNA sequence
ccaaggcagatggatcacct

SEQ ID NO: 374920 - DNA, 20 bp, Artificial
  CRISPR gRNA sequence
caaggcagatggatcacctg

SEQ ID NO: 374921 - DNA, 20 bp, Artificial
  CRISPR gRNA sequence
gcagatggatcacctgaggt

SEQ ID NO: 374922 - DNA, 20 bp, Artificial
  CRISPR gRNA sequence
cagatggatcacctgaggtc

SEQ ID NO: 374923 - DNA, 20 bp, Artificial
  CRISPR gRNA sequence
gatggatcacctgaggtcag

SEQ ID NO: 374924 - DNA, 20 bp, Artificial
  CRISPR gRNA sequence
tcacctgaggtcaggagttc

SEQ ID NO: 374925 - DNA, 20 bp, Artificial
  CRISPR gRNA sequence
tgaggtcaggagttcgagac

SEQ ID NO: 374926 - DNA, 20 bp, Artificial
  CRISPR gRNA sequence
tcaggagttcgagaccagcc

SEQ ID NO: 374927 - DNA, 20 bp, Artificial
  CRISPR gRNA sequence
ttcgagaccagcctggccaa

SEQ ID NO: 374928 - DNA, 20 bp, Artificial
  CRISPR gRNA sequence
tcgagaccagcctggccaac

SEQ ID NO: 374929 - DNA, 20 bp, Artificial
  CRISPR gRNA sequence
cgagaccagcctggccaaca

SEQ ID NO: 374930 - DNA, 20 bp, Artificial
  CRISPR gRNA sequence
tctactaaaaatacaaaaat

SEQ ID NO: 374931 - DNA, 20 bp, Artificial
  CRISPR gRNA sequence
ctaaaaatacaaaaattagc

SEQ ID NO: 374932 - DNA, 20 bp, Artificial
  CRISPR gRNA sequence
taaaaatacaaaaattagct

SEQ ID NO: 374933 - DNA, 20 bp, Artificial
  CRISPR gRNA sequence
atacaaaaattagctgggtg

SEQ ID NO: 374934 - DNA, 20 bp, Artificial
  CRISPR gRNA sequence
caaaaattagctgggtgtgg

SEQ ID NO: 374935 - DNA, 20 bp, Artificial
  CRISPR gRNA sequence
aaattagctgggtgtggtgg

SEQ ID NO: 374936 - DNA, 20 bp, Artificial
  CRISPR gRNA sequence
aattagctgggtgtggtggc

SEQ ID NO: 374937 - DNA, 20 bp, Artificial
  CRISPR gRNA sequence
gtggcaggtgcctgtaatcc

SEQ ID NO: 374938 - DNA, 20 bp, Artificial
  CRISPR gRNA sequence
tgcctgtaatcccagctact

SEQ ID NO: 374939 - DNA, 20 bp, Artificial
  CRISPR gRNA sequence
cctgtaatcccagctacttg

SEQ ID NO: 374940 - DNA, 20 bp, Artificial
  CRISPR gRNA sequence
ctgtaatcccagctacttgg

SEQ ID NO: 374941 - DNA, 20 bp, Artificial
  CRISPR gRNA sequence
atcccagctacttggaggct

SEQ ID NO: 374942 - DNA, 20 bp, Artificial
  CRISPR gRNA sequence
tcccagctacttggaggctg

SEQ ID NO: 374943 - DNA, 20 bp, Artificial
  CRISPR gRNA sequence
cagctacttggaggctgagg

SEQ ID NO: 374944 - DNA, 20 bp, Artificial
  CRISPR gRNA sequence
agctacttggaggctgaggc

SEQ ID NO: 374945 - DNA, 20 bp, Artificial
  CRISPR gRNA sequence
ctacttggaggctgaggcag

SEQ ID NO: 374946 - DNA, 20 bp, Artificial
  CRISPR gRNA sequence
gcaggagaattgcttgaacc

SEQ ID NO: 374947 - DNA, 20 bp, Artificial
  CRISPR gRNA sequence
caggagaattgcttgaacct

SEQ ID NO: 374948 - DNA, 20 bp, Artificial
  CRISPR gRNA sequence
gagaattgcttgaacctggg

SEQ ID NO: 374949 - DNA, 20 bp, Artificial
  CRISPR gRNA sequence
aattgcttgaacctgggaag

SEQ ID NO: 374950 - DNA, 20 bp, Artificial
  CRISPR gRNA sequence
ttgcttgaacctgggaagtg

SEQ ID NO: 374951 - DNA, 20 bp, Artificial
  CRISPR gRNA sequence
aacctgggaagtggagcttg

SEQ ID NO: 374952 - DNA, 20 bp, Artificial
  CRISPR gRNA sequence
tgggaagtggagcttgcagc

SEQ ID NO: 374953 - DNA, 20 bp, Artificial
  CRISPR gRNA sequence
agtggagcttgcagcgagct

SEQ ID NO: 374954 - DNA, 20 bp, Artificial
  CRISPR gRNA sequence
gagattgtgccactgcactc

SEQ ID NO: 374955 - DNA, 20 bp, Artificial
  CRISPR gRNA sequence
tgtgccactgcactccagcc

SEQ ID NO: 374956 - DNA, 20 bp, Artificial
  CRISPR gRNA sequence
gtgccactgcactccagcct

SEQ ID NO: 374957 - DNA, 20 bp, Artificial
  CRISPR gRNA sequence
tgcactccagcctgggtgac

SEQ ID NO: 374958 - DNA, 20 bp, Artificial
  CRISPR gRNA sequence
cactccagcctgggtgacaa

SEQ ID NO: 374959 - DNA, 20 bp, Artificial
  CRISPR gRNA sequence
aaattaaaataaaataaata

SEQ ID NO: 374960 - DNA, 20 bp, Artificial
  CRISPR gRNA sequence
aataaagctatcatatgaac

SEQ ID NO: 374961 - DNA, 20 bp, Artificial
  CRISPR gRNA sequence
catatgaaccagcaatctga

SEQ ID NO: 374962 - DNA, 20 bp, Artificial
  CRISPR gRNA sequence
atatgaaccagcaatctgat

SEQ ID NO: 374963 - DNA, 20 bp, Artificial
  CRISPR gRNA sequence
tctgatgggtattatataca

SEQ ID NO: 374964 - DNA, 20 bp, Artificial
  CRISPR gRNA sequence
ctgatgggtattatatacaa

SEQ ID NO: 374965 - DNA, 20 bp, Artificial
  CRISPR gRNA sequence
gtattatatacaaaggaaat

SEQ ID NO: 374966 - DNA, 20 bp, Artificial
  CRISPR gRNA sequence
tattatatacaaaggaaatg

SEQ ID NO: 374967 - DNA, 20 bp, Artificial
  CRISPR gRNA sequence
atatacaaaggaaatgaggt

SEQ ID NO: 374968 - DNA, 20 bp, Artificial
  CRISPR gRNA sequence
gaaatgaggtcagtatcttg

SEQ ID NO: 374969 - DNA, 20 bp, Artificial
  CRISPR gRNA sequence
atgtattgcatcattgtcta

SEQ ID NO: 374970 - DNA, 20 bp, Artificial
  CRISPR gRNA sequence
tattgcatcattgtctacag

SEQ ID NO: 374971 - DNA, 20 bp, Artificial
  CRISPR gRNA sequence
catcattgtctacagtagtc

SEQ ID NO: 374972 - DNA, 20 bp, Artificial
  CRISPR gRNA sequence
tgtctacagtagtcaagatg

SEQ ID NO: 374973 - DNA, 20 bp, Artificial
  CRISPR gRNA sequence
gtcaagatgtggatgcaacc

SEQ ID NO: 374974 - DNA, 20 bp, Artificial
  CRISPR gRNA sequence
tcaagatgtggatgcaacct

SEQ ID NO: 374975 - DNA, 20 bp, Artificial
  CRISPR gRNA sequence
gcaacctaggtgtccatcaa

SEQ ID NO: 374976 - DNA, 20 bp, Artificial
  CRISPR gRNA sequence
ggtgtccatcaacagatgaa

SEQ ID NO: 374977 - DNA, 20 bp, Artificial
  CRISPR gRNA sequence
catcaacagatgaatagata

SEQ ID NO: 374978 - DNA, 20 bp, Artificial
  CRISPR gRNA sequence
atgaatagataaagaaaatg

SEQ ID NO: 374979 - DNA, 20 bp, Artificial
  CRISPR gRNA sequence
gataaagaaaatgtggtaca

SEQ ID NO: 374980 - DNA, 20 bp, Artificial
  CRISPR gRNA sequence
tgtggtacatagacacaatg

SEQ ID NO: 374981 - DNA, 20 bp, Artificial
  CRISPR gRNA sequence
gtactattaaccctttaaaa

SEQ ID NO: 374982 - DNA, 20 bp, Artificial
  CRISPR gRNA sequence
ctattaaccctttaaaaaag

SEQ ID NO: 374983 - DNA, 20 bp, Artificial
  CRISPR gRNA sequence
tattaaccctttaaaaaaga

SEQ ID NO: 374984 - DNA, 20 bp, Artificial
  CRISPR gRNA sequence
ggaaatcatatcatgtgtga

SEQ ID NO: 374985 - DNA, 20 bp, Artificial
  CRISPR gRNA sequence
gaaatcatatcatgtgtgac

SEQ ID NO: 374986 - DNA, 20 bp, Artificial
  CRISPR gRNA sequence
aaatcatatcatgtgtgaca

SEQ ID NO: 374987 - DNA, 20 bp, Artificial
  CRISPR gRNA sequence
tcatatcatgtgtgacaggg

SEQ ID NO: 374988 - DNA, 20 bp, Artificial
  CRISPR gRNA sequence
tgacagggtggataaacctt

SEQ ID NO: 374989 - DNA, 20 bp, Artificial
  CRISPR gRNA sequence
gacagggtggataaaccttg

SEQ ID NO: 374990 - DNA, 20 bp, Artificial
  CRISPR gRNA sequence
aaccttgaggacattatgaa

SEQ ID NO: 374991 - DNA, 20 bp, Artificial
  CRISPR gRNA sequence
gacattatgaaaagtgaaat

SEQ ID NO: 374992 - DNA, 20 bp, Artificial
  CRISPR gRNA sequence
ttatgaaaagtgaaataagc

SEQ ID NO: 374993 - DNA, 20 bp, Artificial
  CRISPR gRNA sequence
tgaaataagccagacacaaa

SEQ ID NO: 374994 - DNA, 20 bp, Artificial
  CRISPR gRNA sequence
tgtatgacttcacttatttg

SEQ ID NO: 374995 - DNA, 20 bp, Artificial
  CRISPR gRNA sequence
cttcacttatttgtggaatc

SEQ ID NO: 374996 - DNA, 20 bp, Artificial
  CRISPR gRNA sequence
ttcacttatttgtggaatct

SEQ ID NO: 374997 - DNA, 20 bp, Artificial
  CRISPR gRNA sequence
aaatgtttgcttatttgtct

SEQ ID NO: 374998 - DNA, 20 bp, Artificial
  CRISPR gRNA sequence
tttgtcttagtttctctttg

SEQ ID NO: 374999 - DNA, 20 bp, Artificial
  CRISPR gRNA sequence
cttagtttctctttgcagta

SEQ ID NO: 375000 - DNA, 20 bp, Artificial
  CRISPR gRNA sequence
ctttgcagtaaagtttgtga

SEQ ID NO: 375001 - DNA, 20 bp, Artificial
  CRISPR gRNA sequence
agtaaagtttgtgaaagaat

SEQ ID NO: 375002 - DNA, 20 bp, Artificial
  CRISPR gRNA sequence
aaagtttgtgaaagaataag

SEQ ID NO: 375003 - DNA, 20 bp, Artificial
  CRISPR gRNA sequence
aagtttgtgaaagaataagt

SEQ ID NO: 375004 - DNA, 20 bp, Artificial
  CRISPR gRNA sequence
aataagtgggtctatacttt

SEQ ID NO: 375005 - DNA, 20 bp, Artificial
  CRISPR gRNA sequence
gagttcttatgaaaaaaatg

SEQ ID NO: 375006 - DNA, 20 bp, Artificial
  CRISPR gRNA sequence
atgaaaaaaatgcagctaca

SEQ ID NO: 375007 - DNA, 20 bp, Artificial
  CRISPR gRNA sequence
aaaaaaatgcagctacatag

SEQ ID NO: 375008 - DNA, 20 bp, Artificial
  CRISPR gRNA sequence
atgcagctacatagtggata

SEQ ID NO: 375009 - DNA, 20 bp, Artificial
  CRISPR gRNA sequence
agctacatagtggataaagt

SEQ ID NO: 375010 - DNA, 20 bp, Artificial
  CRISPR gRNA sequence
tacatagtggataaagtgag

SEQ ID NO: 375011 - DNA, 20 bp, Artificial
  CRISPR gRNA sequence
aaagtgagaagaaattttct

SEQ ID NO: 375012 - DNA, 20 bp, Artificial
  CRISPR gRNA sequence
aagtgagaagaaattttctg

SEQ ID NO: 375013 - DNA, 20 bp, Artificial
  CRISPR gRNA sequence
agaagaaattttctgaggaa

SEQ ID NO: 375014 - DNA, 20 bp, Artificial
  CRISPR gRNA sequence
gaaattttctgaggaaaaga

SEQ ID NO: 375015 - DNA, 20 bp, Artificial
  CRISPR gRNA sequence
aaattttctgaggaaaagat

SEQ ID NO: 375016 - DNA, 20 bp, Artificial
  CRISPR gRNA sequence
aattttctgaggaaaagatg

SEQ ID NO: 375017 - DNA, 20 bp, Artificial
  CRISPR gRNA sequence
tttctgaggaaaagatgggg

SEQ ID NO: 375018 - DNA, 20 bp, Artificial
  CRISPR gRNA sequence
aggaaaagatggggaagaat

SEQ ID NO: 375019 - DNA, 20 bp, Artificial
  CRISPR gRNA sequence
gatggggaagaattggttga

SEQ ID NO: 375020 - DNA, 20 bp, Artificial
  CRISPR gRNA sequence
gaagaattggttgaaagtca

SEQ ID NO: 375021 - DNA, 20 bp, Artificial
  CRISPR gRNA sequence
tggttgaaagtcatggtttt

SEQ ID NO: 375022 - DNA, 20 bp, Artificial
  CRISPR gRNA sequence
ggttgaaagtcatggttttc

SEQ ID NO: 375023 - DNA, 20 bp, Artificial
  CRISPR gRNA sequence
tcatggttttcaggctgcaa

SEQ ID NO: 375024 - DNA, 20 bp, Artificial
  CRISPR gRNA sequence
catggttttcaggctgcaat

SEQ ID NO: 375025 - DNA, 20 bp, Artificial
  CRISPR gRNA sequence
ttcaggctgcaataggattc

SEQ ID NO: 375026 - DNA, 20 bp, Artificial
  CRISPR gRNA sequence
ggctgcaataggattccaga

SEQ ID NO: 375027 - DNA, 20 bp, Artificial
  CRISPR gRNA sequence
gcaataggattccagacagc

SEQ ID NO: 375028 - DNA, 20 bp, Artificial
  CRISPR gRNA sequence
caataggattccagacagcc

SEQ ID NO: 375029 - DNA, 20 bp, Artificial
  CRISPR gRNA sequence
aataggattccagacagccg

SEQ ID NO: 375030 - DNA, 20 bp, Artificial
  CRISPR gRNA sequence
tccagacagccggggtgtca

SEQ ID NO: 375031 - DNA, 20 bp, Artificial
  CRISPR gRNA sequence
gtgtcacagtacaaacattc

SEQ ID NO: 375032 - DNA, 20 bp, Artificial
  CRISPR gRNA sequence
aaacattcaagctttgattt

SEQ ID NO: 375033 - DNA, 20 bp, Artificial
  CRISPR gRNA sequence
aacattcaagctttgatttc

SEQ ID NO: 375034 - DNA, 20 bp, Artificial
  CRISPR gRNA sequence
cattcaagctttgatttcag

SEQ ID NO: 375035 - DNA, 20 bp, Artificial
  CRISPR gRNA sequence
attcaagctttgatttcagg

SEQ ID NO: 375036 - DNA, 20 bp, Artificial
  CRISPR gRNA sequence
caagctttgatttcaggagg

SEQ ID NO: 375037 - DNA, 20 bp, Artificial
  CRISPR gRNA sequence
aagctttgatttcaggagga

SEQ ID NO: 375038 - DNA, 20 bp, Artificial
  CRISPR gRNA sequence
agctttgatttcaggaggaa

SEQ ID NO: 375039 - DNA, 20 bp, Artificial
  CRISPR gRNA sequence
gggaaattgtgctgccctct

SEQ ID NO: 375040 - DNA, 20 bp, Artificial
  CRISPR gRNA sequence
gaaattgtgctgccctctca

SEQ ID NO: 375041 - DNA, 20 bp, Artificial
  CRISPR gRNA sequence
tgtgctgccctctcagagcc

SEQ ID NO: 375042 - DNA, 20 bp, Artificial
  CRISPR gRNA sequence
agagcctggcatcatcctaa

SEQ ID NO: 375043 - DNA, 20 bp, Artificial
  CRISPR gRNA sequence
gcctggcatcatcctaatgg

SEQ ID NO: 375044 - DNA, 20 bp, Artificial
  CRISPR gRNA sequence
cctggcatcatcctaatggt

SEQ ID NO: 375045 - DNA, 20 bp, Artificial
  CRISPR gRNA sequence
ctggcatcatcctaatggtg

SEQ ID NO: 375046 - DNA, 20 bp, Artificial
  CRISPR gRNA sequence
cctaatggtggggtgattga

SEQ ID NO: 375047 - DNA, 20 bp, Artificial
  CRISPR gRNA sequence
ctaatggtggggtgattgac

SEQ ID NO: 375048 - DNA, 20 bp, Artificial
  CRISPR gRNA sequence
ttgacaggttcgctttcccg

SEQ ID NO: 375049 - DNA, 20 bp, Artificial
  CRISPR gRNA sequence
gacaggttcgctttcccgaa

SEQ ID NO: 375050 - DNA, 20 bp, Artificial
  CRISPR gRNA sequence
caggttcgctttcccgaaga

SEQ ID NO: 375051 - DNA, 20 bp, Artificial
  CRISPR gRNA sequence
ttcgctttcccgaagagaga

SEQ ID NO: 375052 - DNA, 20 bp, Artificial
  CRISPR gRNA sequence
cccgaagagagacagcaatg

SEQ ID NO: 375053 - DNA, 20 bp, Artificial
  CRISPR gRNA sequence
gagacagcaatgaagaccat

SEQ ID NO: 375054 - DNA, 20 bp, Artificial
  CRISPR gRNA sequence
agacagcaatgaagaccatt

SEQ ID NO: 375055 - DNA, 20 bp, Artificial
  CRISPR gRNA sequence
aagaccattgggtttcattt

SEQ ID NO: 375056 - DNA, 20 bp, Artificial
  CRISPR gRNA sequence
tttcatttcagtcctattcc

SEQ ID NO: 375057 - DNA, 20 bp, Artificial
  CRISPR gRNA sequence
catttcagtcctattcccag

SEQ ID NO: 375058 - DNA, 20 bp, Artificial
  CRISPR gRNA sequence
ttcagtcctattcccagcag

SEQ ID NO: 375059 - DNA, 20 bp, Artificial
  CRISPR gRNA sequence
ttcccagcagcagatgttga

SEQ ID NO: 375060 - DNA, 20 bp, Artificial
  CRISPR gRNA sequence
tcccagcagcagatgttgat

SEQ ID NO: 375061 - DNA, 20 bp, Artificial
  CRISPR gRNA sequence
gttgatgggattcttccctg

SEQ ID NO: 375062 - DNA, 20 bp, Artificial
  CRISPR gRNA sequence
ttgatgggattcttccctgt

SEQ ID NO: 375063 - DNA, 20 bp, Artificial
  CRISPR gRNA sequence
gatgggattcttccctgtgg

SEQ ID NO: 375064 - DNA, 20 bp, Artificial
  CRISPR gRNA sequence
atgggattcttccctgtggg

SEQ ID NO: 375065 - DNA, 20 bp, Artificial
  CRISPR gRNA sequence
ggcactcacaacatgctctg

SEQ ID NO: 375066 - DNA, 20 bp, Artificial
  CRISPR gRNA sequence
gcactcacaacatgctctgt

SEQ ID NO: 375067 - DNA, 20 bp, Artificial
  CRISPR gRNA sequence
acaacatgctctgtgggttg

SEQ ID NO: 375068 - DNA, 20 bp, Artificial
  CRISPR gRNA sequence
caacatgctctgtgggttga

SEQ ID NO: 375069 - DNA, 20 bp, Artificial
  CRISPR gRNA sequence
aacatgctctgtgggttgaa

SEQ ID NO: 375070 - DNA, 20 bp, Artificial
  CRISPR gRNA sequence
tgctctgtgggttgaagggt

SEQ ID NO: 375071 - DNA, 20 bp, Artificial
  CRISPR gRNA sequence
ctctgtgggttgaagggtga

SEQ ID NO: 375072 - DNA, 20 bp, Artificial
  CRISPR gRNA sequence
tctgtgggttgaagggtgag

SEQ ID NO: 375073 - DNA, 20 bp, Artificial
  CRISPR gRNA sequence
gaagggtgagaggtgtgttg

SEQ ID NO: 375074 - DNA, 20 bp, Artificial
  CRISPR gRNA sequence
aagggtgagaggtgtgttgt

SEQ ID NO: 375075 - DNA, 20 bp, Artificial
  CRISPR gRNA sequence
ggtgagaggtgtgttgtggg

SEQ ID NO: 375076 - DNA, 20 bp, Artificial
  CRISPR gRNA sequence
gtgagaggtgtgttgtgggc

SEQ ID NO: 375077 - DNA, 20 bp, Artificial
  CRISPR gRNA sequence
gagaggtgtgttgtgggcag

SEQ ID NO: 375078 - DNA, 20 bp, Artificial
  CRISPR gRNA sequence
agaggtgtgttgtgggcagg

SEQ ID NO: 375079 - DNA, 20 bp, Artificial
  CRISPR gRNA sequence
gggcaggaggatgtaacaaa

SEQ ID NO: 375080 - DNA, 20 bp, Artificial
  CRISPR gRNA sequence
aaaatgttctctgacctcac

SEQ ID NO: 375081 - DNA, 20 bp, Artificial
  CRISPR gRNA sequence
aaatgttctctgacctcact

SEQ ID NO: 375082 - DNA, 20 bp, Artificial
  CRISPR gRNA sequence
acctcactgggctcacactc

SEQ ID NO: 375083 - DNA, 20 bp, Artificial
  CRISPR gRNA sequence
ctcactgggctcacactcca

SEQ ID NO: 375084 - DNA, 20 bp, Artificial
  CRISPR gRNA sequence
tcactgggctcacactccag

SEQ ID NO: 375085 - DNA, 20 bp, Artificial
  CRISPR gRNA sequence
cactgggctcacactccaga

SEQ ID NO: 375086 - DNA, 20 bp, Artificial
  CRISPR gRNA sequence
actgggctcacactccagag

SEQ ID NO: 375087 - DNA, 20 bp, Artificial
  CRISPR gRNA sequence
aggggacatttctctaatcg

SEQ ID NO: 375088 - DNA, 20 bp, Artificial
  CRISPR gRNA sequence
tcttgtgaatattgactcat

SEQ ID NO: 375089 - DNA, 20 bp, Artificial
  CRISPR gRNA sequence
ttgtgaatattgactcatga

SEQ ID NO: 375090 - DNA, 20 bp, Artificial
  CRISPR gRNA sequence
tcacaattctgtgatgtaat

SEQ ID NO: 375091 - DNA, 20 bp, Artificial
  CRISPR gRNA sequence
cacaattctgtgatgtaatt

SEQ ID NO: 375092 - DNA, 20 bp, Artificial
  CRISPR gRNA sequence
acaattctgtgatgtaatta

SEQ ID NO: 375093 - DNA, 20 bp, Artificial
  CRISPR gRNA sequence
agggctgctgccattgccat

SEQ ID NO: 375094 - DNA, 20 bp, Artificial
  CRISPR gRNA sequence
ttgccatcagttgacaaatg

SEQ ID NO: 375095 - DNA, 20 bp, Artificial
  CRISPR gRNA sequence
gccatcagttgacaaatgaa

SEQ ID NO: 375096 - DNA, 20 bp, Artificial
  CRISPR gRNA sequence
caaatgaagagacacatcca

SEQ ID NO: 375097 - DNA, 20 bp, Artificial
  CRISPR gRNA sequence
tgaagagacacatccacagt

SEQ ID NO: 375098 - DNA, 20 bp, Artificial
  CRISPR gRNA sequence
gaagagacacatccacagta

SEQ ID NO: 375099 - DNA, 20 bp, Artificial
  CRISPR gRNA sequence
atccacagtaaggaatttgc

SEQ ID NO: 375100 - DNA, 20 bp, Artificial
  CRISPR gRNA sequence
ccacagtaaggaatttgctg

SEQ ID NO: 375101 - DNA, 20 bp, Artificial
  CRISPR gRNA sequence
agtaaggaatttgctggagt

SEQ ID NO: 375102 - DNA, 20 bp, Artificial
  CRISPR gRNA sequence
aggaatttgctggagtcggt

SEQ ID NO: 375103 - DNA, 20 bp, Artificial
  CRISPR gRNA sequence
gtcggtcagttgaattgtga

SEQ ID NO: 375104 - DNA, 20 bp, Artificial
  CRISPR gRNA sequence
cagttgaattgtgaaagatt

SEQ ID NO: 375105 - DNA, 20 bp, Artificial
  CRISPR gRNA sequence
agttgaattgtgaaagattt

SEQ ID NO: 375106 - DNA, 20 bp, Artificial
  CRISPR gRNA sequence
aattgtgaaagatttaggat

SEQ ID NO: 375107 - DNA, 20 bp, Artificial
  CRISPR gRNA sequence
aagatttaggatgagaattt

SEQ ID NO: 375108 - DNA, 20 bp, Artificial
  CRISPR gRNA sequence
ggatgagaatttcagattac

SEQ ID NO: 375109 - DNA, 20 bp, Artificial
  CRISPR gRNA sequence
aatttcagattactggacca

SEQ ID NO: 375110 - DNA, 20 bp, Artificial
  CRISPR gRNA sequence
actggaccatggtaaacttt

SEQ ID NO: 375111 - DNA, 20 bp, Artificial
  CRISPR gRNA sequence
atggtaaactttcagacatt

SEQ ID NO: 375112 - DNA, 20 bp, Artificial
  CRISPR gRNA sequence
taaactttcagacattgagt

SEQ ID NO: 375113 - DNA, 20 bp, Artificial
  CRISPR gRNA sequence
aactttcagacattgagttg

SEQ ID NO: 375114 - DNA, 20 bp, Artificial
  CRISPR gRNA sequence
tgtatcattaccaaattgaa

SEQ ID NO: 375115 - DNA, 20 bp, Artificial
  CRISPR gRNA sequence
taaattatacttataaacat

SEQ ID NO: 375116 - DNA, 20 bp, Artificial
  CRISPR gRNA sequence
aattatacttataaacatca

SEQ ID NO: 375117 - DNA, 20 bp, Artificial
  CRISPR gRNA sequence
gttgaatgtacttaatatat

SEQ ID NO: 375118 - DNA, 20 bp, Artificial
  CRISPR gRNA sequence
ttgaatgtacttaatatatc

SEQ ID NO: 375119 - DNA, 20 bp, Artificial
  CRISPR gRNA sequence
acttaatatatcaggcataa

SEQ ID NO: 375120 - DNA, 20 bp, Artificial
  CRISPR gRNA sequence
ctattttatttatttttaca

SEQ ID NO: 375121 - DNA, 20 bp, Artificial
  CRISPR gRNA sequence
attttatttatttttacata

SEQ ID NO: 375122 - DNA, 20 bp, Artificial
  CRISPR gRNA sequence
tagagtctctctctgttgcc

SEQ ID NO: 375123 - DNA, 20 bp, Artificial
  CRISPR gRNA sequence
agagtctctctctgttgccc

SEQ ID NO: 375124 - DNA, 20 bp, Artificial
  CRISPR gRNA sequence
tctctctctgttgcccaggc

SEQ ID NO: 375125 - DNA, 20 bp, Artificial
  CRISPR gRNA sequence
tctctctgttgcccaggctg

SEQ ID NO: 375126 - DNA, 20 bp, Artificial
  CRISPR gRNA sequence
ctgttgcccaggctggagtg

SEQ ID NO: 375127 - DNA, 20 bp, Artificial
  CRISPR gRNA sequence
ttgcccaggctggagtgcag

SEQ ID NO: 375128 - DNA, 20 bp, Artificial
  CRISPR gRNA sequence
ccaggctggagtgcagtggc

SEQ ID NO: 375129 - DNA, 20 bp, Artificial
  CRISPR gRNA sequence
tggagtgcagtggcaagatc

SEQ ID NO: 375130 - DNA, 20 bp, Artificial
  CRISPR gRNA sequence
ggagtgcagtggcaagatcc

SEQ ID NO: 375131 - DNA, 20 bp, Artificial
  CRISPR gRNA sequence
gcaagatccgggctcactgc

SEQ ID NO: 375132 - DNA, 20 bp, Artificial
  CRISPR gRNA sequence
ctcactgcaagctccgcctc

SEQ ID NO: 375133 - DNA, 20 bp, Artificial
  CRISPR gRNA sequence
tcactgcaagctccgcctct

SEQ ID NO: 375134 - DNA, 20 bp, Artificial
  CRISPR gRNA sequence
cactgcaagctccgcctctg

SEQ ID NO: 375135 - DNA, 20 bp, Artificial
  CRISPR gRNA sequence
tccgcctctggggttcaaat

SEQ ID NO: 375136 - DNA, 20 bp, Artificial
  CRISPR gRNA sequence
ttcaaatgagtctcgtgcct

SEQ ID NO: 375137 - DNA, 20 bp, Artificial
  CRISPR gRNA sequence
gtctcgtgcctcagcctaat

SEQ ID NO: 375138 - DNA, 20 bp, Artificial
  CRISPR gRNA sequence
tcgtgcctcagcctaatgag

SEQ ID NO: 375139 - DNA, 20 bp, Artificial
  CRISPR gRNA sequence
gcctcagcctaatgagtagc

SEQ ID NO: 375140 - DNA, 20 bp, Artificial
  CRISPR gRNA sequence
cctcagcctaatgagtagct

SEQ ID NO: 375141 - DNA, 20 bp, Artificial
  CRISPR gRNA sequence
ctaatgagtagctgggatta

SEQ ID NO: 375142 - DNA, 20 bp, Artificial
  CRISPR gRNA sequence
taatgagtagctgggattat

SEQ ID NO: 375143 - DNA, 20 bp, Artificial
  CRISPR gRNA sequence
ataggcatgcaccaccacac

SEQ ID NO: 375144 - DNA, 20 bp, Artificial
  CRISPR gRNA sequence
taggcatgcaccaccacact

SEQ ID NO: 375145 - DNA, 20 bp, Artificial
  CRISPR gRNA sequence
gggatcactttttgtgtttt

SEQ ID NO: 375146 - DNA, 20 bp, Artificial
  CRISPR gRNA sequence
atcactttttgtgtttttag

SEQ ID NO: 375147 - DNA, 20 bp, Artificial
  CRISPR gRNA sequence
cactttttgtgtttttagta

SEQ ID NO: 375148 - DNA, 20 bp, Artificial
  CRISPR gRNA sequence
ttttgtgtttttagtagaga

SEQ ID NO: 375149 - DNA, 20 bp, Artificial
  CRISPR gRNA sequence
tttgtgtttttagtagagac

SEQ ID NO: 375150 - DNA, 20 bp, Artificial
  CRISPR gRNA sequence
ttgtgtttttagtagagacg

SEQ ID NO: 375151 - DNA, 20 bp, Artificial
  CRISPR gRNA sequence
tttcaccatgttgcccatgc

SEQ ID NO: 375152 - DNA, 20 bp, Artificial
  CRISPR gRNA sequence
ccatgctggtcttgaactcc

SEQ ID NO: 375153 - DNA, 20 bp, Artificial
  CRISPR gRNA sequence
ggtcttgaactcctggcctc

SEQ ID NO: 375154 - DNA, 20 bp, Artificial
  CRISPR gRNA sequence
ctcctaaacctctgtgatta

SEQ ID NO: 375155 - DNA, 20 bp, Artificial
  CRISPR gRNA sequence
tcctaaacctctgtgattac

SEQ ID NO: 375156 - DNA, 20 bp, Artificial
  CRISPR gRNA sequence
acctctgtgattacaggcct

SEQ ID NO: 375157 - DNA, 20 bp, Artificial
  CRISPR gRNA sequence
caggcctgagccactacacc

SEQ ID NO: 375158 - DNA, 20 bp, Artificial
  CRISPR gRNA sequence
tggcctatttcctattttaa

SEQ ID NO: 375159 - DNA, 20 bp, Artificial
  CRISPR gRNA sequence
tagtttttttttttctacaa

SEQ ID NO: 375160 - DNA, 20 bp, Artificial
  CRISPR gRNA sequence
agtttttttttttctacaaa

SEQ ID NO: 375161 - DNA, 20 bp, Artificial
  CRISPR gRNA sequence
aaaggttttgtgtatatgat

SEQ ID NO: 375162 - DNA, 20 bp, Artificial
  CRISPR gRNA sequence
ggttttgtgtatatgattgg

SEQ ID NO: 375163 - DNA, 20 bp, Artificial
  CRISPR gRNA sequence
gattggcagcttatttgaat

SEQ ID NO: 375164 - DNA, 20 bp, Artificial
  CRISPR gRNA sequence
attggcagcttatttgaatg

SEQ ID NO: 375165 - DNA, 20 bp, Artificial
  CRISPR gRNA sequence
gcttatttgaatgaggtctt

SEQ ID NO: 375166 - DNA, 20 bp, Artificial
  CRISPR gRNA sequence
tttttgtaatgtgtaaaact

SEQ ID NO: 375167 - DNA, 20 bp, Artificial
  CRISPR gRNA sequence
aaaaacaaataaaaatctat

SEQ ID NO: 375168 - DNA, 20 bp, Artificial
  CRISPR gRNA sequence
aaaacaaataaaaatctatt

SEQ ID NO: 375169 - DNA, 20 bp, Artificial
  CRISPR gRNA sequence
aacaaataaaaatctattag

SEQ ID NO: 375170 - DNA, 20 bp, Artificial
  CRISPR gRNA sequence
aataaaaatctattaggagt

SEQ ID NO: 375171 - DNA, 20 bp, Artificial
  CRISPR gRNA sequence
tattaggagttagaaatatt

SEQ ID NO: 375172 - DNA, 20 bp, Artificial
  CRISPR gRNA sequence
attaggagttagaaatattt

SEQ ID NO: 375173 - DNA, 20 bp, Artificial
  CRISPR gRNA sequence
taggagttagaaatatttag

SEQ ID NO: 375174 - DNA, 20 bp, Artificial
  CRISPR gRNA sequence
aaatatttaggagactctaa

SEQ ID NO: 375175 - DNA, 20 bp, Artificial
  CRISPR gRNA sequence
actcattctattttttttgt

SEQ ID NO: 375176 - DNA, 20 bp, Artificial
  CRISPR gRNA sequence
gccttactttttactgcctt

SEQ ID NO: 375177 - DNA, 20 bp, Artificial
  CRISPR gRNA sequence
acaatattttttttctctcc

SEQ ID NO: 375178 - DNA, 20 bp, Artificial
  CRISPR gRNA sequence
caatattttttttctctcct

SEQ ID NO: 375179 - DNA, 20 bp, Artificial
  CRISPR gRNA sequence
taaccaatataccctctttg

SEQ ID NO: 375180 - DNA, 20 bp, Artificial
  CRISPR gRNA sequence
caatataccctctttgtggc

SEQ ID NO: 375181 - DNA, 20 bp, Artificial
  CRISPR gRNA sequence
atataccctctttgtggctg

SEQ ID NO: 375182 - DNA, 20 bp, Artificial
  CRISPR gRNA sequence
tataccctctttgtggctgg

SEQ ID NO: 375183 - DNA, 20 bp, Artificial
  CRISPR gRNA sequence
ataccctctttgtggctgga

SEQ ID NO: 375184 - DNA, 20 bp, Artificial
  CRISPR gRNA sequence
cctctttgtggctggaggga

SEQ ID NO: 375185 - DNA, 20 bp, Artificial
  CRISPR gRNA sequence
atcattgtcattttccttaa

SEQ ID NO: 375186 - DNA, 20 bp, Artificial
  CRISPR gRNA sequence
tcattgtcattttccttaac

SEQ ID NO: 375187 - DNA, 20 bp, Artificial
  CRISPR gRNA sequence
tgtcattttccttaacaggt

SEQ ID NO: 375188 - DNA, 20 bp, Artificial
  CRISPR gRNA sequence
cattttccttaacaggtgag

SEQ ID NO: 375189 - DNA, 20 bp, Artificial
  CRISPR gRNA sequence
ctgaatcttattcaccatgt

SEQ ID NO: 375190 - DNA, 20 bp, Artificial
  CRISPR gRNA sequence
gaatcttattcaccatgtta

SEQ ID NO: 375191 - DNA, 20 bp, Artificial
  CRISPR gRNA sequence
aatcttattcaccatgttag

SEQ ID NO: 375192 - DNA, 20 bp, Artificial
  CRISPR gRNA sequence
gaggttctctattaataacc

SEQ ID NO: 375193 - DNA, 20 bp, Artificial
  CRISPR gRNA sequence
taataacccagtaatttgtc

SEQ ID NO: 375194 - DNA, 20 bp, Artificial
  CRISPR gRNA sequence
agtaatttgtcaagctgtct

SEQ ID NO: 375195 - DNA, 20 bp, Artificial
  CRISPR gRNA sequence
attcacatatatatttttgt

SEQ ID NO: 375196 - DNA, 20 bp, Artificial
  CRISPR gRNA sequence
gtgagtactgttctaacaca

SEQ ID NO: 375197 - DNA, 20 bp, Artificial
  CRISPR gRNA sequence
tgagtactgttctaacacaa

SEQ ID NO: 375198 - DNA, 20 bp, Artificial
  CRISPR gRNA sequence
agtactgttctaacacaaag

SEQ ID NO: 375199 - DNA, 20 bp, Artificial
  CRISPR gRNA sequence
gtactgttctaacacaaagg

SEQ ID NO: 375200 - DNA, 20 bp, Artificial
  CRISPR gRNA sequence
actgttctaacacaaaggag

SEQ ID NO: 375201 - DNA, 20 bp, Artificial
  CRISPR gRNA sequence
gttctaacacaaaggaggag

SEQ ID NO: 375202 - DNA, 20 bp, Artificial
  CRISPR gRNA sequence
ctaacacaaaggaggagaag

SEQ ID NO: 375203 - DNA, 20 bp, Artificial
  CRISPR gRNA sequence
caaaggaggagaagtagctg

SEQ ID NO: 375204 - DNA, 20 bp, Artificial
  CRISPR gRNA sequence
aagtagctgtggtaatgtta

SEQ ID NO: 375205 - DNA, 20 bp, Artificial
  CRISPR gRNA sequence
agtagctgtggtaatgttac

SEQ ID NO: 375206 - DNA, 20 bp, Artificial
  CRISPR gRNA sequence
gtagctgtggtaatgttaca

SEQ ID NO: 375207 - DNA, 20 bp, Artificial
  CRISPR gRNA sequence
agctgtggtaatgttacagg

SEQ ID NO: 375208 - DNA, 20 bp, Artificial
  CRISPR gRNA sequence
ctgtggtaatgttacaggga

SEQ ID NO: 375209 - DNA, 20 bp, Artificial
  CRISPR gRNA sequence
ggtaatgttacagggagagc

SEQ ID NO: 375210 - DNA, 20 bp, Artificial
  CRISPR gRNA sequence
tgttacagggagagctggaa

SEQ ID NO: 375211 - DNA, 20 bp, Artificial
  CRISPR gRNA sequence
agagctggaatagttcattt

SEQ ID NO: 375212 - DNA, 20 bp, Artificial
  CRISPR gRNA sequence
ggaatagttcatttaagaat

SEQ ID NO: 375213 - DNA, 20 bp, Artificial
  CRISPR gRNA sequence
atagttcatttaagaattgg

SEQ ID NO: 375214 - DNA, 20 bp, Artificial
  CRISPR gRNA sequence
gttcatttaagaattggtag

SEQ ID NO: 375215 - DNA, 20 bp, Artificial
  CRISPR gRNA sequence
atttaagaattggtagaagc

SEQ ID NO: 375216 - DNA, 20 bp, Artificial
  CRISPR gRNA sequence
taagaattggtagaagctgg

SEQ ID NO: 375217 - DNA, 20 bp, Artificial
  CRISPR gRNA sequence
ctgccctgtcttcctcctcc

SEQ ID NO: 375218 - DNA, 20 bp, Artificial
  CRISPR gRNA sequence
tgccctgtcttcctcctcca

SEQ ID NO: 375219 - DNA, 20 bp, Artificial
  CRISPR gRNA sequence
gtcttcctcctccaaggaaa

SEQ ID NO: 375220 - DNA, 20 bp, Artificial
  CRISPR gRNA sequence
tcctccaaggaaaaagctga

SEQ ID NO: 375221 - DNA, 20 bp, Artificial
  CRISPR gRNA sequence
ccaaggaaaaagctgacagc

SEQ ID NO: 375222 - DNA, 20 bp, Artificial
  CRISPR gRNA sequence
caaggaaaaagctgacagcg

SEQ ID NO: 375223 - DNA, 20 bp, Artificial
  CRISPR gRNA sequence
aaggaaaaagctgacagcga

SEQ ID NO: 375224 - DNA, 20 bp, Artificial
  CRISPR gRNA sequence
aggaaaaagctgacagcgag

SEQ ID NO: 375225 - DNA, 20 bp, Artificial
  CRISPR gRNA sequence
ggaaaaagctgacagcgagg

SEQ ID NO: 375226 - DNA, 20 bp, Artificial
  CRISPR gRNA sequence
aaaagctgacagcgaggggg

SEQ ID NO: 375227 - DNA, 20 bp, Artificial
  CRISPR gRNA sequence
gtgtgtgtgcgtgtatgaca

SEQ ID NO: 375228 - DNA, 20 bp, Artificial
  CRISPR gRNA sequence
gtgcgtgtatgacacagcgc

SEQ ID NO: 375229 - DNA, 20 bp, Artificial
  CRISPR gRNA sequence
gtgtatgacacagcgcgaga

SEQ ID NO: 375230 - DNA, 20 bp, Artificial
  CRISPR gRNA sequence
gacacagcgcgagatggata

SEQ ID NO: 375231 - DNA, 20 bp, Artificial
  CRISPR gRNA sequence
gcgagatggatacagattct

SEQ ID NO: 375232 - DNA, 20 bp, Artificial
  CRISPR gRNA sequence
agatggatacagattctgag

SEQ ID NO: 375233 - DNA, 20 bp, Artificial
  CRISPR gRNA sequence
gatggatacagattctgaga

SEQ ID NO: 375234 - DNA, 20 bp, Artificial
  CRISPR gRNA sequence
atggatacagattctgagaa

SEQ ID NO: 375235 - DNA, 20 bp, Artificial
  CRISPR gRNA sequence
tggatacagattctgagaag

SEQ ID NO: 375236 - DNA, 20 bp, Artificial
  CRISPR gRNA sequence
atacagattctgagaagggg

SEQ ID NO: 375237 - DNA, 20 bp, Artificial
  CRISPR gRNA sequence
attctgagaaggggaagaac

SEQ ID NO: 375238 - DNA, 20 bp, Artificial
  CRISPR gRNA sequence
ttctgagaaggggaagaaca

SEQ ID NO: 375239 - DNA, 20 bp, Artificial
  CRISPR gRNA sequence
aggggaagaacaaggtttaa

SEQ ID NO: 375240 - DNA, 20 bp, Artificial
  CRISPR gRNA sequence
aacaaggtttaacagtgata

SEQ ID NO: 375241 - DNA, 20 bp, Artificial
  CRISPR gRNA sequence
catcaaatatttattgtgca

SEQ ID NO: 375242 - DNA, 20 bp, Artificial
  CRISPR gRNA sequence
caaatatttattgtgcacag

SEQ ID NO: 375243 - DNA, 20 bp, Artificial
  CRISPR gRNA sequence
tattgtgcacagcagtgaac

SEQ ID NO: 375244 - DNA, 20 bp, Artificial
  CRISPR gRNA sequence
gcagtgaacaagacataatg

SEQ ID NO: 375245 - DNA, 20 bp, Artificial
  CRISPR gRNA sequence
aatgaagctcacatcccaat

SEQ ID NO: 375246 - DNA, 20 bp, Artificial
  CRISPR gRNA sequence
ctcacatcccaataagcaaa

SEQ ID NO: 375247 - DNA, 20 bp, Artificial
  CRISPR gRNA sequence
gcaaacagcataatttcaaa

SEQ ID NO: 375248 - DNA, 20 bp, Artificial
  CRISPR gRNA sequence
ttcaaatagttgtatattct

SEQ ID NO: 375249 - DNA, 20 bp, Artificial
  CRISPR gRNA sequence
agttgtatattctcagaacc

SEQ ID NO: 375250 - DNA, 20 bp, Artificial
  CRISPR gRNA sequence
attctcagaaccaagaaatc

SEQ ID NO: 375251 - DNA, 20 bp, Artificial
  CRISPR gRNA sequence
ttctcagaaccaagaaatct

SEQ ID NO: 375252 - DNA, 20 bp, Artificial
  CRISPR gRNA sequence
tctaggtgcttaaaattact

SEQ ID NO: 375253 - DNA, 20 bp, Artificial
  CRISPR gRNA sequence
aggtgcttaaaattactgag

SEQ ID NO: 375254 - DNA, 20 bp, Artificial
  CRISPR gRNA sequence
tgcttaaaattactgagaag

SEQ ID NO: 375255 - DNA, 20 bp, Artificial
  CRISPR gRNA sequence
gcttaaaattactgagaaga

SEQ ID NO: 375256 - DNA, 20 bp, Artificial
  CRISPR gRNA sequence
aattactgagaagaaggaat

SEQ ID NO: 375257 - DNA, 20 bp, Artificial
  CRISPR gRNA sequence
ttactgagaagaaggaattg

SEQ ID NO: 375258 - DNA, 20 bp, Artificial
  CRISPR gRNA sequence
tactgagaagaaggaattgg

SEQ ID NO: 375259 - DNA, 20 bp, Artificial
  CRISPR gRNA sequence
actgagaagaaggaattgga

SEQ ID NO: 375260 - DNA, 20 bp, Artificial
  CRISPR gRNA sequence
ggaattggagggtgctgcct

SEQ ID NO: 375261 - DNA, 20 bp, Artificial
  CRISPR gRNA sequence
aattggagggtgctgcctta

SEQ ID NO: 375262 - DNA, 20 bp, Artificial
  CRISPR gRNA sequence
ggagggtgctgccttagaga

SEQ ID NO: 375263 - DNA, 20 bp, Artificial
  CRISPR gRNA sequence
gggtgctgccttagagacag

SEQ ID NO: 375264 - DNA, 20 bp, Artificial
  CRISPR gRNA sequence
ggtgctgccttagagacagc

SEQ ID NO: 375265 - DNA, 20 bp, Artificial
  CRISPR gRNA sequence
gtgctgccttagagacagca

SEQ ID NO: 375266 - DNA, 20 bp, Artificial
  CRISPR gRNA sequence
gctgccttagagacagcagg

SEQ ID NO: 375267 - DNA, 20 bp, Artificial
  CRISPR gRNA sequence
agagacagcagggagccatt

SEQ ID NO: 375268 - DNA, 20 bp, Artificial
  CRISPR gRNA sequence
aattttttttaatcttttat

SEQ ID NO: 375269 - DNA, 20 bp, Artificial
  CRISPR gRNA sequence
ttttttaatcttttattggc

SEQ ID NO: 375270 - DNA, 20 bp, Artificial
  CRISPR gRNA sequence
aatcttttattggctggtca

SEQ ID NO: 375271 - DNA, 20 bp, Artificial
  CRISPR gRNA sequence
gtcacagtgatatgtgcctg

SEQ ID NO: 375272 - DNA, 20 bp, Artificial
  CRISPR gRNA sequence
gtgatatgtgcctgaagttc

SEQ ID NO: 375273 - DNA, 20 bp, Artificial
  CRISPR gRNA sequence
tgcctgaagttccagctact

SEQ ID NO: 375274 - DNA, 20 bp, Artificial
  CRISPR gRNA sequence
gcctgaagttccagctactc

SEQ ID NO: 375275 - DNA, 20 bp, Artificial
  CRISPR gRNA sequence
ctgaagttccagctactcag

SEQ ID NO: 375276 - DNA, 20 bp, Artificial
  CRISPR gRNA sequence
tgaagttccagctactcagg

SEQ ID NO: 375277 - DNA, 20 bp, Artificial
  CRISPR gRNA sequence
ttccagctactcaggaggct

SEQ ID NO: 375278 - DNA, 20 bp, Artificial
  CRISPR gRNA sequence
tccagctactcaggaggctg

SEQ ID NO: 375279 - DNA, 20 bp, Artificial
  CRISPR gRNA sequence
gctactcaggaggctgaggc

SEQ ID NO: 375280 - DNA, 20 bp, Artificial
  CRISPR gRNA sequence
tactcaggaggctgaggctg

SEQ ID NO: 375281 - DNA, 20 bp, Artificial
  CRISPR gRNA sequence
actcaggaggctgaggctgg

SEQ ID NO: 375282 - DNA, 20 bp, Artificial
  CRISPR gRNA sequence
ctgaggctggaggattgctt

SEQ ID NO: 375283 - DNA, 20 bp, Artificial
  CRISPR gRNA sequence
ctggaggattgcttgagtcc

SEQ ID NO: 375284 - DNA, 20 bp, Artificial
  CRISPR gRNA sequence
ggaggattgcttgagtccaa

SEQ ID NO: 375285 - DNA, 20 bp, Artificial
  CRISPR gRNA sequence
ttgcttgagtccaagagttc

SEQ ID NO: 375286 - DNA, 20 bp, Artificial
  CRISPR gRNA sequence
tgagtccaagagttcgagtc

SEQ ID NO: 375287 - DNA, 20 bp, Artificial
  CRISPR gRNA sequence
ccaagagttcgagtccagcc

SEQ ID NO: 375288 - DNA, 20 bp, Artificial
  CRISPR gRNA sequence
caagagttcgagtccagcct

SEQ ID NO: 375289 - DNA, 20 bp, Artificial
  CRISPR gRNA sequence
cgagtccagcctgggcaaca

SEQ ID NO: 375290 - DNA, 20 bp, Artificial
  CRISPR gRNA sequence
tccagcctgggcaacatagc

SEQ ID NO: 375291 - DNA, 20 bp, Artificial
  CRISPR gRNA sequence
aaaaaccttttactgtattg

SEQ ID NO: 375292 - DNA, 20 bp, Artificial
  CRISPR gRNA sequence
ccttttactgtattgtagca

SEQ ID NO: 375293 - DNA, 20 bp, Artificial
  CRISPR gRNA sequence
ttactgtattgtagcacagt

SEQ ID NO: 375294 - DNA, 20 bp, Artificial
  CRISPR gRNA sequence
tactgtattgtagcacagtt

SEQ ID NO: 375295 - DNA, 20 bp, Artificial
  CRISPR gRNA sequence
tagcacagttgggaattttc

SEQ ID NO: 375296 - DNA, 20 bp, Artificial
  CRISPR gRNA sequence
agcacagttgggaattttct

SEQ ID NO: 375297 - DNA, 20 bp, Artificial
  CRISPR gRNA sequence
ggaattttctaggatattct

SEQ ID NO: 375298 - DNA, 20 bp, Artificial
  CRISPR gRNA sequence
tttctaggatattcttggct

SEQ ID NO: 375299 - DNA, 20 bp, Artificial
  CRISPR gRNA sequence
ctgagtttttcttccccttc

SEQ ID NO: 375300 - DNA, 20 bp, Artificial
  CRISPR gRNA sequence
tctagttctcctgtgcttat

SEQ ID NO: 375301 - DNA, 20 bp, Artificial
  CRISPR gRNA sequence
tgcttatcagctcacttgtg

SEQ ID NO: 375302 - DNA, 20 bp, Artificial
  CRISPR gRNA sequence
gcttatcagctcacttgtgt

SEQ ID NO: 375303 - DNA, 20 bp, Artificial
  CRISPR gRNA sequence
ttacatatctgctgtaatca

SEQ ID NO: 375304 - DNA, 20 bp, Artificial
  CRISPR gRNA sequence
catatctgctgtaatcatag

SEQ ID NO: 375305 - DNA, 20 bp, Artificial
  CRISPR gRNA sequence
atatctgctgtaatcatagc

SEQ ID NO: 375306 - DNA, 20 bp, Artificial
  CRISPR gRNA sequence
ttattccttataatgtatta

SEQ ID NO: 375307 - DNA, 20 bp, Artificial
  CRISPR gRNA sequence
cttataatgtattacagcta

SEQ ID NO: 375308 - DNA, 20 bp, Artificial
  CRISPR gRNA sequence
cagctaaagtgttatcttct

SEQ ID NO: 375309 - DNA, 20 bp, Artificial
  CRISPR gRNA sequence
agctaaagtgttatcttctt

SEQ ID NO: 375310 - DNA, 20 bp, Artificial
  CRISPR gRNA sequence
gctaaagtgttatcttctta

SEQ ID NO: 375311 - DNA, 20 bp, Artificial
  CRISPR gRNA sequence
ctaaagtgttatcttcttag

SEQ ID NO: 375312 - DNA, 20 bp, Artificial
  CRISPR gRNA sequence
aaagtgttatcttcttaggg

SEQ ID NO: 375313 - DNA, 20 bp, Artificial
  CRISPR gRNA sequence
aagtgttatcttcttagggg

SEQ ID NO: 375314 - DNA, 20 bp, Artificial
  CRISPR gRNA sequence
tgttatcttcttaggggagg

SEQ ID NO: 375315 - DNA, 20 bp, Artificial
  CRISPR gRNA sequence
gttatcttcttaggggagga

SEQ ID NO: 375316 - DNA, 20 bp, Artificial
  CRISPR gRNA sequence
ttatcttcttaggggaggaa

SEQ ID NO: 375317 - DNA, 20 bp, Artificial
  CRISPR gRNA sequence
atgtctatatttttcatgtc

SEQ ID NO: 375318 - DNA, 20 bp, Artificial
  CRISPR gRNA sequence
ttttcatgtctggcatatca

SEQ ID NO: 375319 - DNA, 20 bp, Artificial
  CRISPR gRNA sequence
gatacttaatatatgtttgc

SEQ ID NO: 375320 - DNA, 20 bp, Artificial
  CRISPR gRNA sequence
atacttaatatatgtttgct

SEQ ID NO: 375321 - DNA, 20 bp, Artificial
  CRISPR gRNA sequence
cttaatatatgtttgctggg

SEQ ID NO: 375322 - DNA, 20 bp, Artificial
  CRISPR gRNA sequence
ttaatatatgtttgctgggt

SEQ ID NO: 375323 - DNA, 20 bp, Artificial
  CRISPR gRNA sequence
ccatctgcactcctctcctt

SEQ ID NO: 375324 - DNA, 20 bp, Artificial
  CRISPR gRNA sequence
acacacacaccccttgttaa

SEQ ID NO: 375325 - DNA, 20 bp, Artificial
  CRISPR gRNA sequence
cacacacaccccttgttaat

SEQ ID NO: 375326 - DNA, 20 bp, Artificial
  CRISPR gRNA sequence
ccccttgttaataggatttc

SEQ ID NO: 375327 - DNA, 20 bp, Artificial
  CRISPR gRNA sequence
gtctcttcatccttgacctc

SEQ ID NO: 375328 - DNA, 20 bp, Artificial
  CRISPR gRNA sequence
atccttgacctctggctctt

SEQ ID NO: 375329 - DNA, 20 bp, Artificial
  CRISPR gRNA sequence
cttgacctctggctctttag

SEQ ID NO: 375330 - DNA, 20 bp, Artificial
  CRISPR gRNA sequence
cagctgtcatcactgctccc

SEQ ID NO: 375331 - DNA, 20 bp, Artificial
  CRISPR gRNA sequence
tcatcactgctccctggttt

SEQ ID NO: 375332 - DNA, 20 bp, Artificial
  CRISPR gRNA sequence
cctggttttggtaacgtctc

SEQ ID NO: 375333 - DNA, 20 bp, Artificial
  CRISPR gRNA sequence
taacgtctccagcctgctct

SEQ ID NO: 375334 - DNA, 20 bp, Artificial
  CRISPR gRNA sequence
ctccagcctgctctcagctg

SEQ ID NO: 375335 - DNA, 20 bp, Artificial
  CRISPR gRNA sequence
gcctctttctctaacccatc

SEQ ID NO: 375336 - DNA, 20 bp, Artificial
  CRISPR gRNA sequence
tctaacccatccagtttccc

SEQ ID NO: 375337 - DNA, 20 bp, Artificial
  CRISPR gRNA sequence
ctaacccatccagtttccct

SEQ ID NO: 375338 - DNA, 20 bp, Artificial
  CRISPR gRNA sequence
tttccctgggtcttcttctg

SEQ ID NO: 375339 - DNA, 20 bp, Artificial
  CRISPR gRNA sequence
ttccctgggtcttcttctga

SEQ ID NO: 375340 - DNA, 20 bp, Artificial
  CRISPR gRNA sequence
ctgggtcttcttctgaaggc

SEQ ID NO: 375341 - DNA, 20 bp, Artificial
  CRISPR gRNA sequence
tgggtcttcttctgaaggct

SEQ ID NO: 375342 - DNA, 20 bp, Artificial
  CRISPR gRNA sequence
tcttcttctgaaggctgggt

SEQ ID NO: 375343 - DNA, 20 bp, Artificial
  CRISPR gRNA sequence
atcttcctgttcaatatctt

SEQ ID NO: 375344 - DNA, 20 bp, Artificial
  CRISPR gRNA sequence
ggttatcttcccactcctac

SEQ ID NO: 375345 - DNA, 20 bp, Artificial
  CRISPR gRNA sequence
cctgtcattaaccctgactg

SEQ ID NO: 375346 - DNA, 20 bp, Artificial
  CRISPR gRNA sequence
ttctactttatttaatctcc

SEQ ID NO: 375347 - DNA, 20 bp, Artificial
  CRISPR gRNA sequence
ccggatgttgataaattttg

SEQ ID NO: 375348 - DNA, 20 bp, Artificial
  CRISPR gRNA sequence
gataaattttgtggaaactg

SEQ ID NO: 375349 - DNA, 20 bp, Artificial
  CRISPR gRNA sequence
cacccattgctctccccatc

SEQ ID NO: 375350 - DNA, 20 bp, Artificial
  CRISPR gRNA sequence
ccccatctggtttgctacca

SEQ ID NO: 375351 - DNA, 20 bp, Artificial
  CRISPR gRNA sequence
aagtgctgtttccccacatt

SEQ ID NO: 375352 - DNA, 20 bp, Artificial
  CRISPR gRNA sequence
tgcattcctatgtatcattc

SEQ ID NO: 375353 - DNA, 20 bp, Artificial
  CRISPR gRNA sequence
gcattcctatgtatcattca

SEQ ID NO: 375354 - DNA, 20 bp, Artificial
  CRISPR gRNA sequence
gaaacacctgtcccctctgt

SEQ ID NO: 375355 - DNA, 20 bp, Artificial
  CRISPR gRNA sequence
ctgttctctgtccctgcaaa

SEQ ID NO: 375356 - DNA, 20 bp, Artificial
  CRISPR gRNA sequence
atagacatgatgtcaccatc

SEQ ID NO: 375357 - DNA, 20 bp, Artificial
  CRISPR gRNA sequence
gccatcccttctattcataa

SEQ ID NO: 375358 - DNA, 20 bp, Artificial
  CRISPR gRNA sequence
atcccttctattcataatgg

SEQ ID NO: 375359 - DNA, 20 bp, Artificial
  CRISPR gRNA sequence
cccttctattcataatggca

SEQ ID NO: 375360 - DNA, 20 bp, Artificial
  CRISPR gRNA sequence
tttgtgtttcattcattttt

SEQ ID NO: 375361 - DNA, 20 bp, Artificial
  CRISPR gRNA sequence
ttcattcattttttagcatt

SEQ ID NO: 375362 - DNA, 20 bp, Artificial
  CRISPR gRNA sequence
attcattttttagcatttgg

SEQ ID NO: 375363 - DNA, 20 bp, Artificial
  CRISPR gRNA sequence
ttttagcatttggtagcatt

SEQ ID NO: 375364 - DNA, 20 bp, Artificial
  CRISPR gRNA sequence
tttgtctaattaaactaaaa

SEQ ID NO: 375365 - DNA, 20 bp, Artificial
  CRISPR gRNA sequence
ttgtctaattaaactaaaac

SEQ ID NO: 375366 - DNA, 20 bp, Artificial
  CRISPR gRNA sequence
gtctaattaaactaaaacag

SEQ ID NO: 375367 - DNA, 20 bp, Artificial
  CRISPR gRNA sequence
tctaattaaactaaaacagg

SEQ ID NO: 375368 - DNA, 20 bp, Artificial
  CRISPR gRNA sequence
attaaactaaaacaggaggt

SEQ ID NO: 375369 - DNA, 20 bp, Artificial
  CRISPR gRNA sequence
ttaaactaaaacaggaggtc

SEQ ID NO: 375370 - DNA, 20 bp, Artificial
  CRISPR gRNA sequence
tttcacctttttccccatca

SEQ ID NO: 375371 - DNA, 20 bp, Artificial
  CRISPR gRNA sequence
ccccatcacggactgccctt

SEQ ID NO: 375372 - DNA, 20 bp, Artificial
  CRISPR gRNA sequence
cccttaagtctttccctgaa

SEQ ID NO: 375373 - DNA, 20 bp, Artificial
  CRISPR gRNA sequence
gtctttccctgaacagaaat

SEQ ID NO: 375374 - DNA, 20 bp, Artificial
  CRISPR gRNA sequence
gaacagaaattagcaaattg

SEQ ID NO: 375375 - DNA, 20 bp, Artificial
  CRISPR gRNA sequence
agaaattagcaaattgaagt

SEQ ID NO: 375376 - DNA, 20 bp, Artificial
  CRISPR gRNA sequence
gaaattagcaaattgaagta

SEQ ID NO: 375377 - DNA, 20 bp, Artificial
  CRISPR gRNA sequence
gcaaattgaagtaaggaacc

SEQ ID NO: 375378 - DNA, 20 bp, Artificial
  CRISPR gRNA sequence
caaattgaagtaaggaaccg

SEQ ID NO: 375379 - DNA, 20 bp, Artificial
  CRISPR gRNA sequence
gaagtaaggaaccgaggtgt

SEQ ID NO: 375380 - DNA, 20 bp, Artificial
  CRISPR gRNA sequence
gtaaggaaccgaggtgttag

SEQ ID NO: 375381 - DNA, 20 bp, Artificial
  CRISPR gRNA sequence
ccgaggtgttagtagcacca

SEQ ID NO: 375382 - DNA, 20 bp, Artificial
  CRISPR gRNA sequence
actcttccactttttcacct

SEQ ID NO: 375383 - DNA, 20 bp, Artificial
  CRISPR gRNA sequence
ccactttttcaccttggcaa

SEQ ID NO: 375384 - DNA, 20 bp, Artificial
  CRISPR gRNA sequence
cactttttcaccttggcaat

SEQ ID NO: 375385 - DNA, 20 bp, Artificial
  CRISPR gRNA sequence
cttggcaatgggaaacatcc

SEQ ID NO: 375386 - DNA, 20 bp, Artificial
  CRISPR gRNA sequence
ttggcaatgggaaacatcct

SEQ ID NO: 375387 - DNA, 20 bp, Artificial
  CRISPR gRNA sequence
tggcaatgggaaacatcctg

SEQ ID NO: 375388 - DNA, 20 bp, Artificial
  CRISPR gRNA sequence
ggcaatgggaaacatcctgg

SEQ ID NO: 375389 - DNA, 20 bp, Artificial
  CRISPR gRNA sequence
aatgggaaacatcctggggg

SEQ ID NO: 375390 - DNA, 20 bp, Artificial
  CRISPR gRNA sequence
tgggaaacatcctgggggca

SEQ ID NO: 375391 - DNA, 20 bp, Artificial
  CRISPR gRNA sequence
aaacatcctgggggcagaga

SEQ ID NO: 375392 - DNA, 20 bp, Artificial
  CRISPR gRNA sequence
catcctgggggcagagatgg

SEQ ID NO: 375393 - DNA, 20 bp, Artificial
  CRISPR gRNA sequence
tcctgggggcagagatggca

SEQ ID NO: 375394 - DNA, 20 bp, Artificial
  CRISPR gRNA sequence
cctgggggcagagatggcag

SEQ ID NO: 375395 - DNA, 20 bp, Artificial
  CRISPR gRNA sequence
ctgggggcagagatggcaga

SEQ ID NO: 375396 - DNA, 20 bp, Artificial
  CRISPR gRNA sequence
gggggcagagatggcagagg

SEQ ID NO: 375397 - DNA, 20 bp, Artificial
  CRISPR gRNA sequence
gagatggcagagggagcaca

SEQ ID NO: 375398 - DNA, 20 bp, Artificial
  CRISPR gRNA sequence
agatggcagagggagcacat

SEQ ID NO: 375399 - DNA, 20 bp, Artificial
  CRISPR gRNA sequence
cagagggagcacatgggaac

SEQ ID NO: 375400 - DNA, 20 bp, Artificial
  CRISPR gRNA sequence
agagggagcacatgggaacc

SEQ ID NO: 375401 - DNA, 20 bp, Artificial
  CRISPR gRNA sequence
ggaaccgggcaaatgtgact

SEQ ID NO: 375402 - DNA, 20 bp, Artificial
  CRISPR gRNA sequence
aaccgggcaaatgtgactaa

SEQ ID NO: 375403 - DNA, 20 bp, Artificial
  CRISPR gRNA sequence
gggcaaatgtgactaagaga

SEQ ID NO: 375404 - DNA, 20 bp, Artificial
  CRISPR gRNA sequence
aaatgtgactaagagacagc

SEQ ID NO: 375405 - DNA, 20 bp, Artificial
  CRISPR gRNA sequence
tgtgactaagagacagcgag

SEQ ID NO: 375406 - DNA, 20 bp, Artificial
  CRISPR gRNA sequence
cgagtggtgacaaacctcca

SEQ ID NO: 375407 - DNA, 20 bp, Artificial
  CRISPR gRNA sequence
gagtggtgacaaacctccac

SEQ ID NO: 375408 - DNA, 20 bp, Artificial
  CRISPR gRNA sequence
agtggtgacaaacctccaca

SEQ ID NO: 375409 - DNA, 20 bp, Artificial
  CRISPR gRNA sequence
gacaaacctccacagggtca

SEQ ID NO: 375410 - DNA, 20 bp, Artificial
  CRISPR gRNA sequence
ctccacagggtcacagatgt

SEQ ID NO: 375411 - DNA, 20 bp, Artificial
  CRISPR gRNA sequence
gtcacagatgttggacatga

SEQ ID NO: 375412 - DNA, 20 bp, Artificial
  CRISPR gRNA sequence
atgcattacttttacatgaa

SEQ ID NO: 375413 - DNA, 20 bp, Artificial
  CRISPR gRNA sequence
acatgaatagctaaattgaa

SEQ ID NO: 375414 - DNA, 20 bp, Artificial
  CRISPR gRNA sequence
tgaatagctaaattgaacgg

SEQ ID NO: 375415 - DNA, 20 bp, Artificial
  CRISPR gRNA sequence
gtagaatacattgtcccact

SEQ ID NO: 375416 - DNA, 20 bp, Artificial
  CRISPR gRNA sequence
cacttggttaaatgtgataa

SEQ ID NO: 375417 - DNA, 20 bp, Artificial
  CRISPR gRNA sequence
acttggttaaatgtgataaa

SEQ ID NO: 375418 - DNA, 20 bp, Artificial
  CRISPR gRNA sequence
ttggttaaatgtgataaaag

SEQ ID NO: 375419 - DNA, 20 bp, Artificial
  CRISPR gRNA sequence
taaatgtgataaaaggagat

SEQ ID NO: 375420 - DNA, 20 bp, Artificial
  CRISPR gRNA sequence
atgtgataaaaggagattag

SEQ ID NO: 375421 - DNA, 20 bp, Artificial
  CRISPR gRNA sequence
tggacttgaatttgtaatca

SEQ ID NO: 375422 - DNA, 20 bp, Artificial
  CRISPR gRNA sequence
taatcatggatgcacaccac

SEQ ID NO: 375423 - DNA, 20 bp, Artificial
  CRISPR gRNA sequence
aatcatggatgcacaccaca

SEQ ID NO: 375424 - DNA, 20 bp, Artificial
  CRISPR gRNA sequence
atcatggatgcacaccacaa

SEQ ID NO: 375425 - DNA, 20 bp, Artificial
  CRISPR gRNA sequence
ggatgcacaccacaagggaa

SEQ ID NO: 375426 - DNA, 20 bp, Artificial
  CRISPR gRNA sequence
tgttccttctgcctcgtcac

SEQ ID NO: 375427 - DNA, 20 bp, Artificial
  CRISPR gRNA sequence
ttctgcctcgtcactagtat

SEQ ID NO: 375428 - DNA, 20 bp, Artificial
  CRISPR gRNA sequence
tcgtcactagtatcagtttg

SEQ ID NO: 375429 - DNA, 20 bp, Artificial
  CRISPR gRNA sequence
tttgtggttgttacttccaa

SEQ ID NO: 375430 - DNA, 20 bp, Artificial
  CRISPR gRNA sequence
ttccaatagaaatgcttcga

SEQ ID NO: 375431 - DNA, 20 bp, Artificial
  CRISPR gRNA sequence
aatgcttcgaaagatgaccc

SEQ ID NO: 375432 - DNA, 20 bp, Artificial
  CRISPR gRNA sequence
atgcttcgaaagatgaccca

SEQ ID NO: 375433 - DNA, 20 bp, Artificial
  CRISPR gRNA sequence
tgcttcgaaagatgacccaa

SEQ ID NO: 375434 - DNA, 20 bp, Artificial
  CRISPR gRNA sequence
gactgtttaaaataatcctg

SEQ ID NO: 375435 - DNA, 20 bp, Artificial
  CRISPR gRNA sequence
ttaaaataatcctgcagctt

SEQ ID NO: 375436 - DNA, 20 bp, Artificial
  CRISPR gRNA sequence
cagcttcagatgtattgact

SEQ ID NO: 375437 - DNA, 20 bp, Artificial
  CRISPR gRNA sequence
ttcagatgtattgacttgga

SEQ ID NO: 375438 - DNA, 20 bp, Artificial
  CRISPR gRNA sequence
agatgtattgacttggatag

SEQ ID NO: 375439 - DNA, 20 bp, Artificial
  CRISPR gRNA sequence
ggatagaagccaacataaat

SEQ ID NO: 375440 - DNA, 20 bp, Artificial
  CRISPR gRNA sequence
agaagccaacataaatcaga

SEQ ID NO: 375441 - DNA, 20 bp, Artificial
  CRISPR gRNA sequence
aaaactgaatacttcacact

SEQ ID NO: 375442 - DNA, 20 bp, Artificial
  CRISPR gRNA sequence
aatacttcacactcagtgcc

SEQ ID NO: 375443 - DNA, 20 bp, Artificial
  CRISPR gRNA sequence
acttcacactcagtgcctgg

SEQ ID NO: 375444 - DNA, 20 bp, Artificial
  CRISPR gRNA sequence
gtgcctggtagcctgtgtgt

SEQ ID NO: 375445 - DNA, 20 bp, Artificial
  CRISPR gRNA sequence
gcctggtagcctgtgtgttg

SEQ ID NO: 375446 - DNA, 20 bp, Artificial
  CRISPR gRNA sequence
cctggtagcctgtgtgttgg

SEQ ID NO: 375447 - DNA, 20 bp, Artificial
  CRISPR gRNA sequence
ctggtagcctgtgtgttgga

SEQ ID NO: 375448 - DNA, 20 bp, Artificial
  CRISPR gRNA sequence
agcctgtgtgttggagggat

SEQ ID NO: 375449 - DNA, 20 bp, Artificial
  CRISPR gRNA sequence
ctgtgtgttggagggattgg

SEQ ID NO: 375450 - DNA, 20 bp, Artificial
  CRISPR gRNA sequence
tgtgttggagggattggcgg

SEQ ID NO: 375451 - DNA, 20 bp, Artificial
  CRISPR gRNA sequence
ggcggcagcttctctgctcc

SEQ ID NO: 375452 - DNA, 20 bp, Artificial
  CRISPR gRNA sequence
tggtttgtgctgttttcatg

SEQ ID NO: 375453 - DNA, 20 bp, Artificial
  CRISPR gRNA sequence
gtttgtgctgttttcatgca

SEQ ID NO: 375454 - DNA, 20 bp, Artificial
  CRISPR gRNA sequence
gtgctgttttcatgcagaga

SEQ ID NO: 375455 - DNA, 20 bp, Artificial
  CRISPR gRNA sequence
ttttcatgcagagatagcaa

SEQ ID NO: 375456 - DNA, 20 bp, Artificial
  CRISPR gRNA sequence
atagcaacagtaacacgact

SEQ ID NO: 375457 - DNA, 20 bp, Artificial
  CRISPR gRNA sequence
gtaacacgactaagtgacca

SEQ ID NO: 375458 - DNA, 20 bp, Artificial
  CRISPR gRNA sequence
cacgactaagtgaccatggc

SEQ ID NO: 375459 - DNA, 20 bp, Artificial
  CRISPR gRNA sequence
acgactaagtgaccatggct

SEQ ID NO: 375460 - DNA, 20 bp, Artificial
  CRISPR gRNA sequence
cgactaagtgaccatggcta

SEQ ID NO: 375461 - DNA, 20 bp, Artificial
  CRISPR gRNA sequence
agtgaccatggctagggaaa

SEQ ID NO: 375462 - DNA, 20 bp, Artificial
  CRISPR gRNA sequence
ctagggaaacagcctcacat

SEQ ID NO: 375463 - DNA, 20 bp, Artificial
  CRISPR gRNA sequence
ggaaacagcctcacattggc

SEQ ID NO: 375464 - DNA, 20 bp, Artificial
  CRISPR gRNA sequence
cctcacattggcaagtgtga

SEQ ID NO: 375465 - DNA, 20 bp, Artificial
  CRISPR gRNA sequence
ctcacattggcaagtgtgaa

SEQ ID NO: 375466 - DNA, 20 bp, Artificial
  CRISPR gRNA sequence
cacattggcaagtgtgaaag

SEQ ID NO: 375467 - DNA, 20 bp, Artificial
  CRISPR gRNA sequence
gtgtgaaaggagccaaaata

SEQ ID NO: 375468 - DNA, 20 bp, Artificial
  CRISPR gRNA sequence
gaaaggagccaaaatatggc

SEQ ID NO: 375469 - DNA, 20 bp, Artificial
  CRISPR gRNA sequence
aaaggagccaaaatatggcc

SEQ ID NO: 375470 - DNA, 20 bp, Artificial
  CRISPR gRNA sequence
agccaaaatatggccaggca

SEQ ID NO: 375471 - DNA, 20 bp, Artificial
  CRISPR gRNA sequence
caaaatatggccaggcatgg

SEQ ID NO: 375472 - DNA, 20 bp, Artificial
  CRISPR gRNA sequence
gtggctcacgcctgtaatcc

SEQ ID NO: 375473 - DNA, 20 bp, Artificial
  CRISPR gRNA sequence
cgcctgtaatcccagcactt

SEQ ID NO: 375474 - DNA, 20 bp, Artificial
  CRISPR gRNA sequence
gcctgtaatcccagcacttt

SEQ ID NO: 375475 - DNA, 20 bp, Artificial
  CRISPR gRNA sequence
ctgtaatcccagcactttgg

SEQ ID NO: 375476 - DNA, 20 bp, Artificial
  CRISPR gRNA sequence
tgtaatcccagcactttggg

SEQ ID NO: 375477 - DNA, 20 bp, Artificial
  CRISPR gRNA sequence
tcccagcactttgggaggat

SEQ ID NO: 375478 - DNA, 20 bp, Artificial
  CRISPR gRNA sequence
cccagcactttgggaggatg

SEQ ID NO: 375479 - DNA, 20 bp, Artificial
  CRISPR gRNA sequence
agcactttgggaggatgagg

SEQ ID NO: 375480 - DNA, 20 bp, Artificial
  CRISPR gRNA sequence
gcactttgggaggatgaggt

SEQ ID NO: 375481 - DNA, 20 bp, Artificial
  CRISPR gRNA sequence
ctttgggaggatgaggtggg

SEQ ID NO: 375482 - DNA, 20 bp, Artificial
  CRISPR gRNA sequence
atgaggtgggtggatcattt

SEQ ID NO: 375483 - DNA, 20 bp, Artificial
  CRISPR gRNA sequence
tgaggtgggtggatcatttg

SEQ ID NO: 375484 - DNA, 20 bp, Artificial
  CRISPR gRNA sequence
gtgggtggatcatttgaggt

SEQ ID NO: 375485 - DNA, 20 bp, Artificial
  CRISPR gRNA sequence
tgggtggatcatttgaggtc

SEQ ID NO: 375486 - DNA, 20 bp, Artificial
  CRISPR gRNA sequence
ggtggatcatttgaggtcag

SEQ ID NO: 375487 - DNA, 20 bp, Artificial
  CRISPR gRNA sequence
tcatttgaggtcaggagttc

SEQ ID NO: 375488 - DNA, 20 bp, Artificial
  CRISPR gRNA sequence
tgaggtcaggagttcgagac

SEQ ID NO: 375489 - DNA, 20 bp, Artificial
  CRISPR gRNA sequence
tcaggagttcgagaccagcc

SEQ ID NO: 375490 - DNA, 20 bp, Artificial
  CRISPR gRNA sequence
cgagaccagcctggccaaca

SEQ ID NO: 375491 - DNA, 20 bp, Artificial
  CRISPR gRNA sequence
tctactaaaactgcaaaaat

SEQ ID NO: 375492 - DNA, 20 bp, Artificial
  CRISPR gRNA sequence
ctaaaactgcaaaaattggc

SEQ ID NO: 375493 - DNA, 20 bp, Artificial
  CRISPR gRNA sequence
taaaactgcaaaaattggct

SEQ ID NO: 375494 - DNA, 20 bp, Artificial
  CRISPR gRNA sequence
ctgcaaaaattggctgggcg

SEQ ID NO: 375495 - DNA, 20 bp, Artificial
  CRISPR gRNA sequence
caaaaattggctgggcgtgg

SEQ ID NO: 375496 - DNA, 20 bp, Artificial
  CRISPR gRNA sequence
aaattggctgggcgtggtgg

SEQ ID NO: 375497 - DNA, 20 bp, Artificial
  CRISPR gRNA sequence
aattggctgggcgtggtggt

SEQ ID NO: 375498 - DNA, 20 bp, Artificial
  CRISPR gRNA sequence
ggcgtggtggtgggtgcctg

SEQ ID NO: 375499 - DNA, 20 bp, Artificial
  CRISPR gRNA sequence
gtggtgggtgcctgtagtct

SEQ ID NO: 375500 - DNA, 20 bp, Artificial
  CRISPR gRNA sequence
tgcctgtagtctcagctact

SEQ ID NO: 375501 - DNA, 20 bp, Artificial
  CRISPR gRNA sequence
gcctgtagtctcagctactc

SEQ ID NO: 375502 - DNA, 20 bp, Artificial
  CRISPR gRNA sequence
ctgtagtctcagctactcag

SEQ ID NO: 375503 - DNA, 20 bp, Artificial
  CRISPR gRNA sequence
tgtagtctcagctactcagg

SEQ ID NO: 375504 - DNA, 20 bp, Artificial
  CRISPR gRNA sequence
tctcagctactcaggaggct

SEQ ID NO: 375505 - DNA, 20 bp, Artificial
  CRISPR gRNA sequence
agctactcaggaggctgaga

SEQ ID NO: 375506 - DNA, 20 bp, Artificial
  CRISPR gRNA sequence
gctactcaggaggctgagac

SEQ ID NO: 375507 - DNA, 20 bp, Artificial
  CRISPR gRNA sequence
tactcaggaggctgagacag

SEQ ID NO: 375508 - DNA, 20 bp, Artificial
  CRISPR gRNA sequence
acaggagaatcacttgaacc

SEQ ID NO: 375509 - DNA, 20 bp, Artificial
  CRISPR gRNA sequence
caggagaatcacttgaaccc

SEQ ID NO: 375510 - DNA, 20 bp, Artificial
  CRISPR gRNA sequence
ggagaatcacttgaacccgg

SEQ ID NO: 375511 - DNA, 20 bp, Artificial
  CRISPR gRNA sequence
aatcacttgaacccgggaga

SEQ ID NO: 375512 - DNA, 20 bp, Artificial
  CRISPR gRNA sequence
tcacttgaacccgggagatg

SEQ ID NO: 375513 - DNA, 20 bp, Artificial
  CRISPR gRNA sequence
cacttgaacccgggagatgg

SEQ ID NO: 375514 - DNA, 20 bp, Artificial
  CRISPR gRNA sequence
aacccgggagatggaggttg

SEQ ID NO: 375515 - DNA, 20 bp, Artificial
  CRISPR gRNA sequence
cgggagatggaggttgcagt

SEQ ID NO: 375516 - DNA, 20 bp, Artificial
  CRISPR gRNA sequence
gatggaggttgcagtgagcc

SEQ ID NO: 375517 - DNA, 20 bp, Artificial
  CRISPR gRNA sequence
aagattgcaccactgtactc

SEQ ID NO: 375518 - DNA, 20 bp, Artificial
  CRISPR gRNA sequence
tgcaccactgtactccagcc

SEQ ID NO: 375519 - DNA, 20 bp, Artificial
  CRISPR gRNA sequence
gcaccactgtactccagcct

SEQ ID NO: 375520 - DNA, 20 bp, Artificial
  CRISPR gRNA sequence
ctgtactccagcctgggtaa

SEQ ID NO: 375521 - DNA, 20 bp, Artificial
  CRISPR gRNA sequence
gtactccagcctgggtaaca

SEQ ID NO: 375522 - DNA, 20 bp, Artificial
  CRISPR gRNA sequence
tccagcctgggtaacagagt

SEQ ID NO: 375523 - DNA, 20 bp, Artificial
  CRISPR gRNA sequence
tcaaaaaaaaaaaaaaaaaa

SEQ ID NO: 375524 - DNA, 20 bp, Artificial
  CRISPR gRNA sequence
caaaaaaaaaaaaaaaaaaa

SEQ ID NO: 375525 - DNA, 20 bp, Artificial
  CRISPR gRNA sequence
aaaaaaaaaaaaaaaaaaaa

SEQ ID NO: 375526 - DNA, 20 bp, Artificial
  CRISPR gRNA sequence
aaaaaaaaaaaaaaaaaaag

SEQ ID NO: 375527 - DNA, 20 bp, Artificial
  CRISPR gRNA sequence
aaaaaaaaaaaaaaaaaagg

SEQ ID NO: 375528 - DNA, 20 bp, Artificial
  CRISPR gRNA sequence
aaaaaaaaaaaaaaaagggg

SEQ ID NO: 375529 - DNA, 20 bp, Artificial
  CRISPR gRNA sequence
gggagccaaactgtgttcta

SEQ ID NO: 375530 - DNA, 20 bp, Artificial
  CRISPR gRNA sequence
tgttctatagatgtgcacct

SEQ ID NO: 375531 - DNA, 20 bp, Artificial
  CRISPR gRNA sequence
tatagatgtgcacctgagtg

SEQ ID NO: 375532 - DNA, 20 bp, Artificial
  CRISPR gRNA sequence
atagatgtgcacctgagtgt

SEQ ID NO: 375533 - DNA, 20 bp, Artificial
  CRISPR gRNA sequence
gatgtgcacctgagtgtagg

SEQ ID NO: 375534 - DNA, 20 bp, Artificial
  CRISPR gRNA sequence
gtaggaagaaatttaatatt

SEQ ID NO: 375535 - DNA, 20 bp, Artificial
  CRISPR gRNA sequence
taggaagaaatttaatattt

SEQ ID NO: 375536 - DNA, 20 bp, Artificial
  CRISPR gRNA sequence
aggaagaaatttaatattta

SEQ ID NO: 375537 - DNA, 20 bp, Artificial
  CRISPR gRNA sequence
gaagaaatttaatatttagg

SEQ ID NO: 375538 - DNA, 20 bp, Artificial
  CRISPR gRNA sequence
atatttagggagaaaaatgt

SEQ ID NO: 375539 - DNA, 20 bp, Artificial
  CRISPR gRNA sequence
tttacattccttgtgaacac

SEQ ID NO: 375540 - DNA, 20 bp, Artificial
  CRISPR gRNA sequence
cttgtgaacactggcattaa

SEQ ID NO: 375541 - DNA, 20 bp, Artificial
  CRISPR gRNA sequence
tgaacactggcattaatgga

SEQ ID NO: 375542 - DNA, 20 bp, Artificial
  CRISPR gRNA sequence
gaacactggcattaatggat

SEQ ID NO: 375543 - DNA, 20 bp, Artificial
  CRISPR gRNA sequence
aacactggcattaatggata

SEQ ID NO: 375544 - DNA, 20 bp, Artificial
  CRISPR gRNA sequence
cattaatggatagggaacct

SEQ ID NO: 375545 - DNA, 20 bp, Artificial
  CRISPR gRNA sequence
ggatagggaaccttggtttt

SEQ ID NO: 375546 - DNA, 20 bp, Artificial
  CRISPR gRNA sequence
gatagggaaccttggttttc

SEQ ID NO: 375547 - DNA, 20 bp, Artificial
  CRISPR gRNA sequence
atagggaaccttggttttcg

SEQ ID NO: 375548 - DNA, 20 bp, Artificial
  CRISPR gRNA sequence
ccttggttttcggggctctc

SEQ ID NO: 375549 - DNA, 20 bp, Artificial
  CRISPR gRNA sequence
cttggttttcggggctctct

SEQ ID NO: 375550 - DNA, 20 bp, Artificial
  CRISPR gRNA sequence
tttcggggctctctgggttt

SEQ ID NO: 375551 - DNA, 20 bp, Artificial
  CRISPR gRNA sequence
ttttggcattgaaaatctct

SEQ ID NO: 375552 - DNA, 20 bp, Artificial
  CRISPR gRNA sequence
ggcattgaaaatctcttggc

SEQ ID NO: 375553 - DNA, 20 bp, Artificial
  CRISPR gRNA sequence
gcattgaaaatctcttggct

SEQ ID NO: 375554 - DNA, 20 bp, Artificial
  CRISPR gRNA sequence
aatctcttggctgggtgcga

SEQ ID NO: 375555 - DNA, 20 bp, Artificial
  CRISPR gRNA sequence
atggctcacgcctgtaatcc

SEQ ID NO: 375556 - DNA, 20 bp, Artificial
  CRISPR gRNA sequence
cgcctgtaatcccagcactt

SEQ ID NO: 375557 - DNA, 20 bp, Artificial
  CRISPR gRNA sequence
gcctgtaatcccagcacttt

SEQ ID NO: 375558 - DNA, 20 bp, Artificial
  CRISPR gRNA sequence
ctgtaatcccagcactttgg

SEQ ID NO: 375559 - DNA, 20 bp, Artificial
  CRISPR gRNA sequence
tgtaatcccagcactttggg

SEQ ID NO: 375560 - DNA, 20 bp, Artificial
  CRISPR gRNA sequence
tcccagcactttgggaggcc

SEQ ID NO: 375561 - DNA, 20 bp, Artificial
  CRISPR gRNA sequence
cccagcactttgggaggccg

SEQ ID NO: 375562 - DNA, 20 bp, Artificial
  CRISPR gRNA sequence
agcactttgggaggccgagg

SEQ ID NO: 375563 - DNA, 20 bp, Artificial
  CRISPR gRNA sequence
gcactttgggaggccgaggt

SEQ ID NO: 375564 - DNA, 20 bp, Artificial
  CRISPR gRNA sequence
ctttgggaggccgaggtggg

SEQ ID NO: 375565 - DNA, 20 bp, Artificial
  CRISPR gRNA sequence
ggccgaggtgggcagatcat

SEQ ID NO: 375566 - DNA, 20 bp, Artificial
  CRISPR gRNA sequence
gccgaggtgggcagatcatg

SEQ ID NO: 375567 - DNA, 20 bp, Artificial
  CRISPR gRNA sequence
aggtgggcagatcatgaggt

SEQ ID NO: 375568 - DNA, 20 bp, Artificial
  CRISPR gRNA sequence
ggtgggcagatcatgaggtc

SEQ ID NO: 375569 - DNA, 20 bp, Artificial
  CRISPR gRNA sequence
tgggcagatcatgaggtcag

SEQ ID NO: 375570 - DNA, 20 bp, Artificial
  CRISPR gRNA sequence
gatcatgaggtcaggagttc

SEQ ID NO: 375571 - DNA, 20 bp, Artificial
  CRISPR gRNA sequence
tgaggtcaggagttcaagac

SEQ ID NO: 375572 - DNA, 20 bp, Artificial
  CRISPR gRNA sequence
caagaccagcctgaccaaca

SEQ ID NO: 375573 - DNA, 20 bp, Artificial
  CRISPR gRNA sequence
actaaaaataaaaaaaaaat

SEQ ID NO: 375574 - DNA, 20 bp, Artificial
  CRISPR gRNA sequence
aaaataaaaaaaaaattagc

SEQ ID NO: 375575 - DNA, 20 bp, Artificial
  CRISPR gRNA sequence
aaataaaaaaaaaattagcc

SEQ ID NO: 375576 - DNA, 20 bp, Artificial
  CRISPR gRNA sequence
aaaaaaaaattagccaggca

SEQ ID NO: 375577 - DNA, 20 bp, Artificial
  CRISPR gRNA sequence
aaaaaattagccaggcatgg

SEQ ID NO: 375578 - DNA, 20 bp, Artificial
  CRISPR gRNA sequence
aaattagccaggcatggtgg

SEQ ID NO: 375579 - DNA, 20 bp, Artificial
  CRISPR gRNA sequence
aattagccaggcatggtggc

SEQ ID NO: 375580 - DNA, 20 bp, Artificial
  CRISPR gRNA sequence
gtggcgggcgcctgtaatcc

SEQ ID NO: 375581 - DNA, 20 bp, Artificial
  CRISPR gRNA sequence
cgcctgtaatcccagctact

SEQ ID NO: 375582 - DNA, 20 bp, Artificial
  CRISPR gRNA sequence
gcctgtaatcccagctactc

SEQ ID NO: 375583 - DNA, 20 bp, Artificial
  CRISPR gRNA sequence
ctgtaatcccagctactcag

SEQ ID NO: 375584 - DNA, 20 bp, Artificial
  CRISPR gRNA sequence
tgtaatcccagctactcagg

SEQ ID NO: 375585 - DNA, 20 bp, Artificial
  CRISPR gRNA sequence
tcccagctactcaggaggct

SEQ ID NO: 375586 - DNA, 20 bp, Artificial
  CRISPR gRNA sequence
cccagctactcaggaggctg

SEQ ID NO: 375587 - DNA, 20 bp, Artificial
  CRISPR gRNA sequence
agctactcaggaggctgagg

SEQ ID NO: 375588 - DNA, 20 bp, Artificial
  CRISPR gRNA sequence
gctactcaggaggctgaggc

SEQ ID NO: 375589 - DNA, 20 bp, Artificial
  CRISPR gRNA sequence
tactcaggaggctgaggcag

SEQ ID NO: 375590 - DNA, 20 bp, Artificial
  CRISPR gRNA sequence
gcaggagaatcacttgaacc

SEQ ID NO: 375591 - DNA, 20 bp, Artificial
  CRISPR gRNA sequence
caggagaatcacttgaaccc

SEQ ID NO: 375592 - DNA, 20 bp, Artificial
  CRISPR gRNA sequence
ggagaatcacttgaacccgg

SEQ ID NO: 375593 - DNA, 20 bp, Artificial
  CRISPR gRNA sequence
gagaatcacttgaacccggg

SEQ ID NO: 375594 - DNA, 20 bp, Artificial
  CRISPR gRNA sequence
aatcacttgaacccgggagg

SEQ ID NO: 375595 - DNA, 20 bp, Artificial
  CRISPR gRNA sequence
tcacttgaacccgggaggcg

SEQ ID NO: 375596 - DNA, 20 bp, Artificial
  CRISPR gRNA sequence
cacttgaacccgggaggcgg

SEQ ID NO: 375597 - DNA, 20 bp, Artificial
  CRISPR gRNA sequence
aacccgggaggcggaggttg

SEQ ID NO: 375598 - DNA, 20 bp, Artificial
  CRISPR gRNA sequence
cgggaggcggaggttgcagt

SEQ ID NO: 375599 - DNA, 20 bp, Artificial
  CRISPR gRNA sequence
ggcggaggttgcagtgagct

SEQ ID NO: 375600 - DNA, 20 bp, Artificial
  CRISPR gRNA sequence
gttgcagtgagctgagattg

SEQ ID NO: 375601 - DNA, 20 bp, Artificial
  CRISPR gRNA sequence
gagattgcagcattgcatcc

SEQ ID NO: 375602 - DNA, 20 bp, Artificial
  CRISPR gRNA sequence
tgcagcattgcatcccagcc

SEQ ID NO: 375603 - DNA, 20 bp, Artificial
  CRISPR gRNA sequence
gcagcattgcatcccagcct

SEQ ID NO: 375604 - DNA, 20 bp, Artificial
  CRISPR gRNA sequence
ttgcatcccagcctgggtga

SEQ ID NO: 375605 - DNA, 20 bp, Artificial
  CRISPR gRNA sequence
gcatcccagcctgggtgaca

SEQ ID NO: 375606 - DNA, 20 bp, Artificial
  CRISPR gRNA sequence
cccagcctgggtgacagagc

SEQ ID NO: 375607 - DNA, 20 bp, Artificial
  CRISPR gRNA sequence
ctcaaaaaaaaaaaaaaaaa

SEQ ID NO: 375608 - DNA, 20 bp, Artificial
  CRISPR gRNA sequence
aaaaaaaaaaaaagaaaaaa

SEQ ID NO: 375609 - DNA, 20 bp, Artificial
  CRISPR gRNA sequence
aaaaagaaaatctctcatcc

SEQ ID NO: 375610 - DNA, 20 bp, Artificial
  CRISPR gRNA sequence
aaaagaaaatctctcatcct

SEQ ID NO: 375611 - DNA, 20 bp, Artificial
  CRISPR gRNA sequence
tctcatcctgggaaactcct

SEQ ID NO: 375612 - DNA, 20 bp, Artificial
  CRISPR gRNA sequence
cctgggaaactccttagtcc

SEQ ID NO: 375613 - DNA, 20 bp, Artificial
  CRISPR gRNA sequence
ctgggaaactccttagtccc

SEQ ID NO: 375614 - DNA, 20 bp, Artificial
  CRISPR gRNA sequence
ctccttagtcccaggcaaac

SEQ ID NO: 375615 - DNA, 20 bp, Artificial
  CRISPR gRNA sequence
tagtcccaggcaaaccagaa

SEQ ID NO: 375616 - DNA, 20 bp, Artificial
  CRISPR gRNA sequence
cccaggcaaaccagaatggc

SEQ ID NO: 375617 - DNA, 20 bp, Artificial
  CRISPR gRNA sequence
attttcttaacatttatttt

SEQ ID NO: 375618 - DNA, 20 bp, Artificial
  CRISPR gRNA sequence
cttaacatttattttaagtt

SEQ ID NO: 375619 - DNA, 20 bp, Artificial
  CRISPR gRNA sequence
ttaacatttattttaagttc

SEQ ID NO: 375620 - DNA, 20 bp, Artificial
  CRISPR gRNA sequence
taacatttattttaagttca

SEQ ID NO: 375621 - DNA, 20 bp, Artificial
  CRISPR gRNA sequence
taagttcagggatacatgtg

SEQ ID NO: 375622 - DNA, 20 bp, Artificial
  CRISPR gRNA sequence
aagttcagggatacatgtgc

SEQ ID NO: 375623 - DNA, 20 bp, Artificial
  CRISPR gRNA sequence
ggatacatgtgcaggatgtg

SEQ ID NO: 375624 - DNA, 20 bp, Artificial
  CRISPR gRNA sequence
gatacatgtgcaggatgtgc

SEQ ID NO: 375625 - DNA, 20 bp, Artificial
  CRISPR gRNA sequence
ggatgtgcaggtttgttaca

SEQ ID NO: 375626 - DNA, 20 bp, Artificial
  CRISPR gRNA sequence
gatgtgcaggtttgttacat

SEQ ID NO: 375627 - DNA, 20 bp, Artificial
  CRISPR gRNA sequence
acataggcaaacatgtgtca

SEQ ID NO: 375628 - DNA, 20 bp, Artificial
  CRISPR gRNA sequence
cataggcaaacatgtgtcat

SEQ ID NO: 375629 - DNA, 20 bp, Artificial
  CRISPR gRNA sequence
ataggcaaacatgtgtcatg

SEQ ID NO: 375630 - DNA, 20 bp, Artificial
  CRISPR gRNA sequence
gtgtcatggggtttgttgta

SEQ ID NO: 375631 - DNA, 20 bp, Artificial
  CRISPR gRNA sequence
gtatagcatattgcatcacc

SEQ ID NO: 375632 - DNA, 20 bp, Artificial
  CRISPR gRNA sequence
tatagcatattgcatcaccc

SEQ ID NO: 375633 - DNA, 20 bp, Artificial
  CRISPR gRNA sequence
tattgcatcacccaggtatt

SEQ ID NO: 375634 - DNA, 20 bp, Artificial
  CRISPR gRNA sequence
gtattaagccttatacccaa

SEQ ID NO: 375635 - DNA, 20 bp, Artificial
  CRISPR gRNA sequence
ttctcccaccctctgccctc

SEQ ID NO: 375636 - DNA, 20 bp, Artificial
  CRISPR gRNA sequence
tcccaccctctgccctccag

SEQ ID NO: 375637 - DNA, 20 bp, Artificial
  CRISPR gRNA sequence
cccaccctctgccctccagt

SEQ ID NO: 375638 - DNA, 20 bp, Artificial
  CRISPR gRNA sequence
ctctgccctccagtaggctc

SEQ ID NO: 375639 - DNA, 20 bp, Artificial
  CRISPR gRNA sequence
gtccatgtgttctcatcatt

SEQ ID NO: 375640 - DNA, 20 bp, Artificial
  CRISPR gRNA sequence
catcatttagctcccactta

SEQ ID NO: 375641 - DNA, 20 bp, Artificial
  CRISPR gRNA sequence
atcatttagctcccacttat

SEQ ID NO: 375642 - DNA, 20 bp, Artificial
  CRISPR gRNA sequence
tttagctcccacttataggt

SEQ ID NO: 375643 - DNA, 20 bp, Artificial
  CRISPR gRNA sequence
cacttataggtgagaacatg

SEQ ID NO: 375644 - DNA, 20 bp, Artificial
  CRISPR gRNA sequence
aggtgagaacatgtggtatt

SEQ ID NO: 375645 - DNA, 20 bp, Artificial
  CRISPR gRNA sequence
ttggttttctgttcctgcat

SEQ ID NO: 375646 - DNA, 20 bp, Artificial
  CRISPR gRNA sequence
tgttcctgcatgagtttgct

SEQ ID NO: 375647 - DNA, 20 bp, Artificial
  CRISPR gRNA sequence
gttcctgcatgagtttgcta

SEQ ID NO: 375648 - DNA, 20 bp, Artificial
  CRISPR gRNA sequence
catgagtttgctaaggataa

SEQ ID NO: 375649 - DNA, 20 bp, Artificial
  CRISPR gRNA sequence
ttgctaaggataatggcctc

SEQ ID NO: 375650 - DNA, 20 bp, Artificial
  CRISPR gRNA sequence
gctctatccgtgtccctgca

SEQ ID NO: 375651 - DNA, 20 bp, Artificial
  CRISPR gRNA sequence
ctctatccgtgtccctgcaa

SEQ ID NO: 375652 - DNA, 20 bp, Artificial
  CRISPR gRNA sequence
catgatctcatttctttctg

SEQ ID NO: 375653 - DNA, 20 bp, Artificial
  CRISPR gRNA sequence
catttctttctgtggctgta

SEQ ID NO: 375654 - DNA, 20 bp, Artificial
  CRISPR gRNA sequence
tgtggctgtatagtgttcta

SEQ ID NO: 375655 - DNA, 20 bp, Artificial
  CRISPR gRNA sequence
tgtaccacattttctttatc

SEQ ID NO: 375656 - DNA, 20 bp, Artificial
  CRISPR gRNA sequence
tttatccagtctatcattga

SEQ ID NO: 375657 - DNA, 20 bp, Artificial
  CRISPR gRNA sequence
ttatccagtctatcattgac

SEQ ID NO: 375658 - DNA, 20 bp, Artificial
  CRISPR gRNA sequence
gtctatcattgacgggtatt

SEQ ID NO: 375659 - DNA, 20 bp, Artificial
  CRISPR gRNA sequence
tctatcattgacgggtattg

SEQ ID NO: 375660 - DNA, 20 bp, Artificial
  CRISPR gRNA sequence
catgtctttgctatcatgaa

SEQ ID NO: 375661 - DNA, 20 bp, Artificial
  CRISPR gRNA sequence
acatgcttgcatgtgtctta

SEQ ID NO: 375662 - DNA, 20 bp, Artificial
  CRISPR gRNA sequence
tgcttgcatgtgtcttatag

SEQ ID NO: 375663 - DNA, 20 bp, Artificial
  CRISPR gRNA sequence
tagaatgatttatattcctt

SEQ ID NO: 375664 - DNA, 20 bp, Artificial
  CRISPR gRNA sequence
agaatgatttatattccttt

SEQ ID NO: 375665 - DNA, 20 bp, Artificial
  CRISPR gRNA sequence
tattcctttgggcatatacc

SEQ ID NO: 375666 - DNA, 20 bp, Artificial
  CRISPR gRNA sequence
tttgggcatatacccagtaa

SEQ ID NO: 375667 - DNA, 20 bp, Artificial
  CRISPR gRNA sequence
atacccagtaatggcgctgc

SEQ ID NO: 375668 - DNA, 20 bp, Artificial
  CRISPR gRNA sequence
tacccagtaatggcgctgct

SEQ ID NO: 375669 - DNA, 20 bp, Artificial
  CRISPR gRNA sequence
aatggcgctgctgggtcaaa

SEQ ID NO: 375670 - DNA, 20 bp, Artificial
  CRISPR gRNA sequence
caaatggtatttctgtctgt

SEQ ID NO: 375671 - DNA, 20 bp, Artificial
  CRISPR gRNA sequence
atttctgtctgtaagttttt

SEQ ID NO: 375672 - DNA, 20 bp, Artificial
  CRISPR gRNA sequence
tttctgtctgtaagtttttg

SEQ ID NO: 375673 - DNA, 20 bp, Artificial
  CRISPR gRNA sequence
ctaatttacattcccaccaa

SEQ ID NO: 375674 - DNA, 20 bp, Artificial
  CRISPR gRNA sequence
cattcccaccaacagcgtaa

SEQ ID NO: 375675 - DNA, 20 bp, Artificial
  CRISPR gRNA sequence
tttttcctccacaaccttgc

SEQ ID NO: 375676 - DNA, 20 bp, Artificial
  CRISPR gRNA sequence
tttttgactttttaataata

SEQ ID NO: 375677 - DNA, 20 bp, Artificial
  CRISPR gRNA sequence
gactttttaataatacagat

SEQ ID NO: 375678 - DNA, 20 bp, Artificial
  CRISPR gRNA sequence
ctttttaataatacagatga

SEQ ID NO: 375679 - DNA, 20 bp, Artificial
  CRISPR gRNA sequence
tttttaataatacagatgag

SEQ ID NO: 375680 - DNA, 20 bp, Artificial
  CRISPR gRNA sequence
gatgagaggactgaacttta

SEQ ID NO: 375681 - DNA, 20 bp, Artificial
  CRISPR gRNA sequence
ctttaaagacataaataact

SEQ ID NO: 375682 - DNA, 20 bp, Artificial
  CRISPR gRNA sequence
aaagacataaataactcagc

SEQ ID NO: 375683 - DNA, 20 bp, Artificial
  CRISPR gRNA sequence
ataactcagctagtaaattg

SEQ ID NO: 375684 - DNA, 20 bp, Artificial
  CRISPR gRNA sequence
aactcagctagtaaattgca

SEQ ID NO: 375685 - DNA, 20 bp, Artificial
  CRISPR gRNA sequence
gctagtaaattgcagagtgc

SEQ ID NO: 375686 - DNA, 20 bp, Artificial
  CRISPR gRNA sequence
tgcagagtgcaagttaaaca

SEQ ID NO: 375687 - DNA, 20 bp, Artificial
  CRISPR gRNA sequence
aacatagatcatttgactct

SEQ ID NO: 375688 - DNA, 20 bp, Artificial
  CRISPR gRNA sequence
tttcatcacattgtatgctc

SEQ ID NO: 375689 - DNA, 20 bp, Artificial
  CRISPR gRNA sequence
ttcatcacattgtatgctcc

SEQ ID NO: 375690 - DNA, 20 bp, Artificial
  CRISPR gRNA sequence
catgtgcatgtgcgtgcatt

SEQ ID NO: 375691 - DNA, 20 bp, Artificial
  CRISPR gRNA sequence
atgtgcatgtgcgtgcattt

SEQ ID NO: 375692 - DNA, 20 bp, Artificial
  CRISPR gRNA sequence
catgtgcgtgcatttgggcc

SEQ ID NO: 375693 - DNA, 20 bp, Artificial
  CRISPR gRNA sequence
tgcgtgcatttgggcctggt

SEQ ID NO: 375694 - DNA, 20 bp, Artificial
  CRISPR gRNA sequence
gcgtgcatttgggcctggtt

SEQ ID NO: 375695 - DNA, 20 bp, Artificial
  CRISPR gRNA sequence
gaacgttaactgcacgttgt

SEQ ID NO: 375696 - DNA, 20 bp, Artificial
  CRISPR gRNA sequence
gttaactgcacgttgtgaga

SEQ ID NO: 375697 - DNA, 20 bp, Artificial
  CRISPR gRNA sequence
actgcacgttgtgagatagc

SEQ ID NO: 375698 - DNA, 20 bp, Artificial
  CRISPR gRNA sequence
tgtgaaccacaatttaataa

SEQ ID NO: 375699 - DNA, 20 bp, Artificial
  CRISPR gRNA sequence
gtgaaccacaatttaataaa

SEQ ID NO: 375700 - DNA, 20 bp, Artificial
  CRISPR gRNA sequence
cacaatttaataaaaggtca

SEQ ID NO: 375701 - DNA, 20 bp, Artificial
  CRISPR gRNA sequence
taataaaaggtcaaagatca

SEQ ID NO: 375702 - DNA, 20 bp, Artificial
  CRISPR gRNA sequence
cttttccttatctttaaaat

SEQ ID NO: 375703 - DNA, 20 bp, Artificial
  CRISPR gRNA sequence
ttttccttatctttaaaatg

SEQ ID NO: 375704 - DNA, 20 bp, Artificial
  CRISPR gRNA sequence
ctttaaaatgaggataataa

SEQ ID NO: 375705 - DNA, 20 bp, Artificial
  CRISPR gRNA sequence
taataatagcatctatatca

SEQ ID NO: 375706 - DNA, 20 bp, Artificial
  CRISPR gRNA sequence
ctatatcatagatttatttt

SEQ ID NO: 375707 - DNA, 20 bp, Artificial
  CRISPR gRNA sequence
tatatcatagatttattttg

SEQ ID NO: 375708 - DNA, 20 bp, Artificial
  CRISPR gRNA sequence
tatcatagatttattttgag

SEQ ID NO: 375709 - DNA, 20 bp, Artificial
  CRISPR gRNA sequence
tctaatttatataaaacacc

SEQ ID NO: 375710 - DNA, 20 bp, Artificial
  CRISPR gRNA sequence
ctagccatatgccttgtgta

SEQ ID NO: 375711 - DNA, 20 bp, Artificial
  CRISPR gRNA sequence
gtgtatagtaaatttacaca

SEQ ID NO: 375712 - DNA, 20 bp, Artificial
  CRISPR gRNA sequence
taaacaaataaatgaataat

SEQ ID NO: 375713 - DNA, 20 bp, Artificial
  CRISPR gRNA sequence
tggtcaaaataataataaat

SEQ ID NO: 375714 - DNA, 20 bp, Artificial
  CRISPR gRNA sequence
aataagaaaataaatgcaca

SEQ ID NO: 375715 - DNA, 20 bp, Artificial
  CRISPR gRNA sequence
aaaataaatgcacatagaat

SEQ ID NO: 375716 - DNA, 20 bp, Artificial
  CRISPR gRNA sequence
aaataaatgcacatagaata

SEQ ID NO: 375717 - DNA, 20 bp, Artificial
  CRISPR gRNA sequence
aaatgcacatagaataaggt

SEQ ID NO: 375718 - DNA, 20 bp, Artificial
  CRISPR gRNA sequence
gtaagattatattgacatga

SEQ ID NO: 375719 - DNA, 20 bp, Artificial
  CRISPR gRNA sequence
taagattatattgacatgat

SEQ ID NO: 375720 - DNA, 20 bp, Artificial
  CRISPR gRNA sequence
agattatattgacatgatag

SEQ ID NO: 375721 - DNA, 20 bp, Artificial
  CRISPR gRNA sequence
gattatattgacatgatagg

SEQ ID NO: 375722 - DNA, 20 bp, Artificial
  CRISPR gRNA sequence
gacatgataggaggatttca

SEQ ID NO: 375723 - DNA, 20 bp, Artificial
  CRISPR gRNA sequence
taggaggatttcaaagcaac

SEQ ID NO: 375724 - DNA, 20 bp, Artificial
  CRISPR gRNA sequence
gaggatttcaaagcaactag

SEQ ID NO: 375725 - DNA, 20 bp, Artificial
  CRISPR gRNA sequence
ggatttcaaagcaactagaa

SEQ ID NO: 375726 - DNA, 20 bp, Artificial
  CRISPR gRNA sequence
aagcaactagaagagacaat

SEQ ID NO: 375727 - DNA, 20 bp, Artificial
  CRISPR gRNA sequence
gcaactagaagagacaattg

SEQ ID NO: 375728 - DNA, 20 bp, Artificial
  CRISPR gRNA sequence
tttcctgcataacctttccc

SEQ ID NO: 375729 - DNA, 20 bp, Artificial
  CRISPR gRNA sequence
tcctgcataacctttccctg

SEQ ID NO: 375730 - DNA, 20 bp, Artificial
  CRISPR gRNA sequence
gcataacctttccctggaga

SEQ ID NO: 375731 - DNA, 20 bp, Artificial
  CRISPR gRNA sequence
agaaagaccatcttattttc

SEQ ID NO: 375732 - DNA, 20 bp, Artificial
  CRISPR gRNA sequence
ttattttcaagatattcaca

SEQ ID NO: 375733 - DNA, 20 bp, Artificial
  CRISPR gRNA sequence
tattttcaagatattcacaa

SEQ ID NO: 375734 - DNA, 20 bp, Artificial
  CRISPR gRNA sequence
ggaattacaacctcacctta

SEQ ID NO: 375735 - DNA, 20 bp, Artificial
  CRISPR gRNA sequence
aattacaacctcaccttaaa

SEQ ID NO: 375736 - DNA, 20 bp, Artificial
  CRISPR gRNA sequence
tctgtatcttctgtatctaa

SEQ ID NO: 375737 - DNA, 20 bp, Artificial
  CRISPR gRNA sequence
tgtatcttctgtatctaaca

SEQ ID NO: 375738 - DNA, 20 bp, Artificial
  CRISPR gRNA sequence
gtatcttctgtatctaacag

SEQ ID NO: 375739 - DNA, 20 bp, Artificial
  CRISPR gRNA sequence
atcttctgtatctaacagag

SEQ ID NO: 375740 - DNA, 20 bp, Artificial
  CRISPR gRNA sequence
agaggagtctgttgttcaat

SEQ ID NO: 375741 - DNA, 20 bp, Artificial
  CRISPR gRNA sequence
ttcaataagaatcttttcct

SEQ ID NO: 375742 - DNA, 20 bp, Artificial
  CRISPR gRNA sequence
tcaataagaatcttttcctt

SEQ ID NO: 375743 - DNA, 20 bp, Artificial
  CRISPR gRNA sequence
caataagaatcttttcctta

SEQ ID NO: 375744 - DNA, 20 bp, Artificial
  CRISPR gRNA sequence
ataagaatcttttccttagg

SEQ ID NO: 375745 - DNA, 20 bp, Artificial
  CRISPR gRNA sequence
cttttccttagggagataaa

SEQ ID NO: 375746 - DNA, 20 bp, Artificial
  CRISPR gRNA sequence
tttccttagggagataaaaa

SEQ ID NO: 375747 - DNA, 20 bp, Artificial
  CRISPR gRNA sequence
cctataataactattttata

SEQ ID NO: 375748 - DNA, 20 bp, Artificial
  CRISPR gRNA sequence
taataactattttatatagt

SEQ ID NO: 375749 - DNA, 20 bp, Artificial
  CRISPR gRNA sequence
ctattttatatagttggata

SEQ ID NO: 375750 - DNA, 20 bp, Artificial
  CRISPR gRNA sequence
atagttggatacagttatat

SEQ ID NO: 375751 - DNA, 20 bp, Artificial
  CRISPR gRNA sequence
gttatatcagctcttgcatt

SEQ ID NO: 375752 - DNA, 20 bp, Artificial
  CRISPR gRNA sequence
tcagctcttgcattcagtta

SEQ ID NO: 375753 - DNA, 20 bp, Artificial
  CRISPR gRNA sequence
gctcttgcattcagttacag

SEQ ID NO: 375754 - DNA, 20 bp, Artificial
  CRISPR gRNA sequence
tagcctcttttcttcttctc

SEQ ID NO: 375755 - DNA, 20 bp, Artificial
  CRISPR gRNA sequence
tttctcttctatgattcccc

SEQ ID NO: 375756 - DNA, 20 bp, Artificial
  CRISPR gRNA sequence
tcttctatgattcccctggt

SEQ ID NO: 375757 - DNA, 20 bp, Artificial
  CRISPR gRNA sequence
cttctatgattcccctggtt

SEQ ID NO: 375758 - DNA, 20 bp, Artificial
  CRISPR gRNA sequence
ttcccctggttaggttttta

SEQ ID NO: 375759 - DNA, 20 bp, Artificial
  CRISPR gRNA sequence
tcccctggttaggtttttat

SEQ ID NO: 375760 - DNA, 20 bp, Artificial
  CRISPR gRNA sequence
taggtttttatgggtttcat

SEQ ID NO: 375761 - DNA, 20 bp, Artificial
  CRISPR gRNA sequence
tatgggtttcattggaactg

SEQ ID NO: 375762 - DNA, 20 bp, Artificial
  CRISPR gRNA sequence
tgggtttcattggaactgtg

SEQ ID NO: 375763 - DNA, 20 bp, Artificial
  CRISPR gRNA sequence
ggagcgtttattgaatactg

SEQ ID NO: 375764 - DNA, 20 bp, Artificial
  CRISPR gRNA sequence
tttattgaatactgtggttg

SEQ ID NO: 375765 - DNA, 20 bp, Artificial
  CRISPR gRNA sequence
ttgaatactgtggttgcaga

SEQ ID NO: 375766 - DNA, 20 bp, Artificial
  CRISPR gRNA sequence
gtggttgcagatggtccttt

SEQ ID NO: 375767 - DNA, 20 bp, Artificial
  CRISPR gRNA sequence
gcagatggtcctttcagtca

SEQ ID NO: 375768 - DNA, 20 bp, Artificial
  CRISPR gRNA sequence
tggtcctttcagtcacggcg

SEQ ID NO: 375769 - DNA, 20 bp, Artificial
  CRISPR gRNA sequence
cagtcacggcgaagtgattc

SEQ ID NO: 375770 - DNA, 20 bp, Artificial
  CRISPR gRNA sequence
tcacggcgaagtgattccag

SEQ ID NO: 375771 - DNA, 20 bp, Artificial
  CRISPR gRNA sequence
ggcgaagtgattccagaagt

SEQ ID NO: 375772 - DNA, 20 bp, Artificial
  CRISPR gRNA sequence
cgaagtgattccagaagttg

SEQ ID NO: 375773 - DNA, 20 bp, Artificial
  CRISPR gRNA sequence
aagtgattccagaagttgga

SEQ ID NO: 375774 - DNA, 20 bp, Artificial
  CRISPR gRNA sequence
ccagaagttggagagcttaa

SEQ ID NO: 375775 - DNA, 20 bp, Artificial
  CRISPR gRNA sequence
agttggagagcttaatagtc

SEQ ID NO: 375776 - DNA, 20 bp, Artificial
  CRISPR gRNA sequence
ttggagagcttaatagtcaa

SEQ ID NO: 375777 - DNA, 20 bp, Artificial
  CRISPR gRNA sequence
tggagagcttaatagtcaag

SEQ ID NO: 375778 - DNA, 20 bp, Artificial
  CRISPR gRNA sequence
ggagagcttaatagtcaaga

SEQ ID NO: 375779 - DNA, 20 bp, Artificial
  CRISPR gRNA sequence
agagcttaatagtcaagagg

SEQ ID NO: 375780 - DNA, 20 bp, Artificial
  CRISPR gRNA sequence
gagcttaatagtcaagaggg

SEQ ID NO: 375781 - DNA, 20 bp, Artificial
  CRISPR gRNA sequence
agcttaatagtcaagaggga

SEQ ID NO: 375782 - DNA, 20 bp, Artificial
  CRISPR gRNA sequence
atagtcaagagggagggcga

SEQ ID NO: 375783 - DNA, 20 bp, Artificial
  CRISPR gRNA sequence
agggcgatggatttaaattc

SEQ ID NO: 375784 - DNA, 20 bp, Artificial
  CRISPR gRNA sequence
caccaaccgatcatgtgatt

SEQ ID NO: 375785 - DNA, 20 bp, Artificial
  CRISPR gRNA sequence
accaaccgatcatgtgattt

SEQ ID NO: 375786 - DNA, 20 bp, Artificial
  CRISPR gRNA sequence
ccgatcatgtgatttgggac

SEQ ID NO: 375787 - DNA, 20 bp, Artificial
  CRISPR gRNA sequence
tactcttcctcttcacacct

SEQ ID NO: 375788 - DNA, 20 bp, Artificial
  CRISPR gRNA sequence
cttaataaaataatctacat

SEQ ID NO: 375789 - DNA, 20 bp, Artificial
  CRISPR gRNA sequence
tttaataaaataatccatac

SEQ ID NO: 375790 - DNA, 20 bp, Artificial
  CRISPR gRNA sequence
aataatccatacgagtgatt

SEQ ID NO: 375791 - DNA, 20 bp, Artificial
  CRISPR gRNA sequence
tgatttagaataacacccaa

SEQ ID NO: 375792 - DNA, 20 bp, Artificial
  CRISPR gRNA sequence
aacacccaaaagattttata

SEQ ID NO: 375793 - DNA, 20 bp, Artificial
  CRISPR gRNA sequence
gcttcattatattgtcatcc

SEQ ID NO: 375794 - DNA, 20 bp, Artificial
  CRISPR gRNA sequence
tcattatattgtcatccaag

SEQ ID NO: 375795 - DNA, 20 bp, Artificial
  CRISPR gRNA sequence
catccaagaagttacactgc

SEQ ID NO: 375796 - DNA, 20 bp, Artificial
  CRISPR gRNA sequence
tttaaaataaattttaattg

SEQ ID NO: 375797 - DNA, 20 bp, Artificial
  CRISPR gRNA sequence
gtggaaaatgtcttaaatgt

SEQ ID NO: 375798 - DNA, 20 bp, Artificial
  CRISPR gRNA sequence
tggaaaatgtcttaaatgtg

SEQ ID NO: 375799 - DNA, 20 bp, Artificial
  CRISPR gRNA sequence
gtcttaaatgtgaggttatt

SEQ ID NO: 375800 - DNA, 20 bp, Artificial
  CRISPR gRNA sequence
cttaaatgtgaggttatttg

SEQ ID NO: 375801 - DNA, 20 bp, Artificial
  CRISPR gRNA sequence
aatgtgaggttatttggaga

SEQ ID NO: 375802 - DNA, 20 bp, Artificial
  CRISPR gRNA sequence
ggttatttggagaaagctat

SEQ ID NO: 375803 - DNA, 20 bp, Artificial
  CRISPR gRNA sequence
ctataagtcatttatgtaat

SEQ ID NO: 375804 - DNA, 20 bp, Artificial
  CRISPR gRNA sequence
agtcactataaatcattctt

SEQ ID NO: 375805 - DNA, 20 bp, Artificial
  CRISPR gRNA sequence
cattctttagtaaaatcact

SEQ ID NO: 375806 - DNA, 20 bp, Artificial
  CRISPR gRNA sequence
tgagattaattactaatgca

SEQ ID NO: 375807 - DNA, 20 bp, Artificial
  CRISPR gRNA sequence
gattaattactaatgcacag

SEQ ID NO: 375808 - DNA, 20 bp, Artificial
  CRISPR gRNA sequence
aattactaatgcacagtggt

SEQ ID NO: 375809 - DNA, 20 bp, Artificial
  CRISPR gRNA sequence
acagtggttagatatccatt

SEQ ID NO: 375810 - DNA, 20 bp, Artificial
  CRISPR gRNA sequence
atttagttgccctcaccatc

SEQ ID NO: 375811 - DNA, 20 bp, Artificial
  CRISPR gRNA sequence
tttagttgccctcaccatct

SEQ ID NO: 375812 - DNA, 20 bp, Artificial
  CRISPR gRNA sequence
tagttgccctcaccatctgg

SEQ ID NO: 375813 - DNA, 20 bp, Artificial
  CRISPR gRNA sequence
ctcaccatctgggagcaatt

SEQ ID NO: 375814 - DNA, 20 bp, Artificial
  CRISPR gRNA sequence
caccatctgggagcaatttg

SEQ ID NO: 375815 - DNA, 20 bp, Artificial
  CRISPR gRNA sequence
catctgggagcaatttggag

SEQ ID NO: 375816 - DNA, 20 bp, Artificial
  CRISPR gRNA sequence
tgggagcaatttggagaaga

SEQ ID NO: 375817 - DNA, 20 bp, Artificial
  CRISPR gRNA sequence
gggagcaatttggagaagac

SEQ ID NO: 375818 - DNA, 20 bp, Artificial
  CRISPR gRNA sequence
ggagcaatttggagaagaca

SEQ ID NO: 375819 - DNA, 20 bp, Artificial
  CRISPR gRNA sequence
agggaaaatgaaaaaaactg

SEQ ID NO: 375820 - DNA, 20 bp, Artificial
  CRISPR gRNA sequence
gggaaaatgaaaaaaactgt

SEQ ID NO: 375821 - DNA, 20 bp, Artificial
  CRISPR gRNA sequence
ggaaaatgaaaaaaactgta

SEQ ID NO: 375822 - DNA, 20 bp, Artificial
  CRISPR gRNA sequence
tgaaaaaaactgtagggtaa

SEQ ID NO: 375823 - DNA, 20 bp, Artificial
  CRISPR gRNA sequence
actgtagggtaacagaattt

SEQ ID NO: 375824 - DNA, 20 bp, Artificial
  CRISPR gRNA sequence
attttggataaatgtgcata

SEQ ID NO: 375825 - DNA, 20 bp, Artificial
  CRISPR gRNA sequence
ataaagctacttcaacatat

SEQ ID NO: 375826 - DNA, 20 bp, Artificial
  CRISPR gRNA sequence
aagctacttcaacatattag

SEQ ID NO: 375827 - DNA, 20 bp, Artificial
  CRISPR gRNA sequence
agctacttcaacatattaga

SEQ ID NO: 375828 - DNA, 20 bp, Artificial
  CRISPR gRNA sequence
aacatattagaaggtgcatg

SEQ ID NO: 375829 - DNA, 20 bp, Artificial
  CRISPR gRNA sequence
acatattagaaggtgcatgt

SEQ ID NO: 375830 - DNA, 20 bp, Artificial
  CRISPR gRNA sequence
attagaaggtgcatgtgggc

SEQ ID NO: 375831 - DNA, 20 bp, Artificial
  CRISPR gRNA sequence
ttagaaggtgcatgtgggct

SEQ ID NO: 375832 - DNA, 20 bp, Artificial
  CRISPR gRNA sequence
tagaaggtgcatgtgggcta

SEQ ID NO: 375833 - DNA, 20 bp, Artificial
  CRISPR gRNA sequence
agaaggtgcatgtgggctag

SEQ ID NO: 375834 - DNA, 20 bp, Artificial
  CRISPR gRNA sequence
gtgcatgtgggctaggggta

SEQ ID NO: 375835 - DNA, 20 bp, Artificial
  CRISPR gRNA sequence
atgtgggctaggggtacagt

SEQ ID NO: 375836 - DNA, 20 bp, Artificial
  CRISPR gRNA sequence
tgtgggctaggggtacagtg

SEQ ID NO: 375837 - DNA, 20 bp, Artificial
  CRISPR gRNA sequence
gctaggggtacagtgaggta

SEQ ID NO: 375838 - DNA, 20 bp, Artificial
  CRISPR gRNA sequence
taggggtacagtgaggtata

SEQ ID NO: 375839 - DNA, 20 bp, Artificial
  CRISPR gRNA sequence
tagagtcttcgaaataatat

SEQ ID NO: 375840 - DNA, 20 bp, Artificial
  CRISPR gRNA sequence
cttcgaaataatattagtac

SEQ ID NO: 375841 - DNA, 20 bp, Artificial
  CRISPR gRNA sequence
cctttattgaatatgcattc

SEQ ID NO: 375842 - DNA, 20 bp, Artificial
  CRISPR gRNA sequence
ttattgaatatgcattccag

SEQ ID NO: 375843 - DNA, 20 bp, Artificial
  CRISPR gRNA sequence
tattgaatatgcattccaga

SEQ ID NO: 375844 - DNA, 20 bp, Artificial
  CRISPR gRNA sequence
ttgaatatgcattccagaag

SEQ ID NO: 375845 - DNA, 20 bp, Artificial
  CRISPR gRNA sequence
aatatgcattccagaaggag

SEQ ID NO: 375846 - DNA, 20 bp, Artificial
  CRISPR gRNA sequence
atatgcattccagaaggaga

SEQ ID NO: 375847 - DNA, 20 bp, Artificial
  CRISPR gRNA sequence
atgcattccagaaggagaag

SEQ ID NO: 375848 - DNA, 20 bp, Artificial
  CRISPR gRNA sequence
gcattccagaaggagaagga

SEQ ID NO: 375849 - DNA, 20 bp, Artificial
  CRISPR gRNA sequence
attccagaaggagaaggaga

SEQ ID NO: 375850 - DNA, 20 bp, Artificial
  CRISPR gRNA sequence
tccagaaggagaaggagaga

SEQ ID NO: 375851 - DNA, 20 bp, Artificial
  CRISPR gRNA sequence
agaaggagaaggagagagag

SEQ ID NO: 375852 - DNA, 20 bp, Artificial
  CRISPR gRNA sequence
aaggagaaggagagagagaa

SEQ ID NO: 375853 - DNA, 20 bp, Artificial
  CRISPR gRNA sequence
agagagaagagatctattta

SEQ ID NO: 375854 - DNA, 20 bp, Artificial
  CRISPR gRNA sequence
agagaagagatctatttaca

SEQ ID NO: 375855 - DNA, 20 bp, Artificial
  CRISPR gRNA sequence
gagatctatttacagagtcc

SEQ ID NO: 375856 - DNA, 20 bp, Artificial
  CRISPR gRNA sequence
agatctatttacagagtcct

SEQ ID NO: 375857 - DNA, 20 bp, Artificial
  CRISPR gRNA sequence
ttacagagtcctgggataca

SEQ ID NO: 375858 - DNA, 20 bp, Artificial
  CRISPR gRNA sequence
cagagtcctgggatacacag

SEQ ID NO: 375859 - DNA, 20 bp, Artificial
  CRISPR gRNA sequence
agagtcctgggatacacaga

SEQ ID NO: 375860 - DNA, 20 bp, Artificial
  CRISPR gRNA sequence
tcctgggatacacagaaggt

SEQ ID NO: 375861 - DNA, 20 bp, Artificial
  CRISPR gRNA sequence
acacagaaggtaagtttata

SEQ ID NO: 375862 - DNA, 20 bp, Artificial
  CRISPR gRNA sequence
tttttttcttttgtaattta

SEQ ID NO: 375863 - DNA, 20 bp, Artificial
  CRISPR gRNA sequence
ttttgtaatttacagatgca

SEQ ID NO: 375864 - DNA, 20 bp, Artificial
  CRISPR gRNA sequence
gtaatttacagatgcaaagt

SEQ ID NO: 375865 - DNA, 20 bp, Artificial
  CRISPR gRNA sequence
tgcaaagtcagtctcttttg

SEQ ID NO: 375866 - DNA, 20 bp, Artificial
  CRISPR gRNA sequence
aagtcagtctcttttgcagt

SEQ ID NO: 375867 - DNA, 20 bp, Artificial
  CRISPR gRNA sequence
cttatattttattgtccttt

SEQ ID NO: 375868 - DNA, 20 bp, Artificial
  CRISPR gRNA sequence
ctttcagtaacctgaccatg

SEQ ID NO: 375869 - DNA, 20 bp, Artificial
  CRISPR gRNA sequence
gttgcctgtaatttaaatat

SEQ ID NO: 375870 - DNA, 20 bp, Artificial
  CRISPR gRNA sequence
taatttaaatatcagctatt

SEQ ID NO: 375871 - DNA, 20 bp, Artificial
  CRISPR gRNA sequence
atttaaatatcagctatttg

SEQ ID NO: 375872 - DNA, 20 bp, Artificial
  CRISPR gRNA sequence
aaatatcagctatttggaga

SEQ ID NO: 375873 - DNA, 20 bp, Artificial
  CRISPR gRNA sequence
ttttaataccctttgaaact

SEQ ID NO: 375874 - DNA, 20 bp, Artificial
  CRISPR gRNA sequence
tttttatatgaatataaata

SEQ ID NO: 375875 - DNA, 20 bp, Artificial
  CRISPR gRNA sequence
ttttatatgaatataaataa

SEQ ID NO: 375876 - DNA, 20 bp, Artificial
  CRISPR gRNA sequence
ttatatgaatataaataaag

SEQ ID NO: 375877 - DNA, 20 bp, Artificial
  CRISPR gRNA sequence
aaataaaggagcaattaccc

SEQ ID NO: 375878 - DNA, 20 bp, Artificial
  CRISPR gRNA sequence
ctaaatctttgttccttttc

SEQ ID NO: 375879 - DNA, 20 bp, Artificial
  CRISPR gRNA sequence
taaatctttgttccttttct

SEQ ID NO: 375880 - DNA, 20 bp, Artificial
  CRISPR gRNA sequence
aaatctttgttccttttcta

SEQ ID NO: 375881 - DNA, 20 bp, Artificial
  CRISPR gRNA sequence
gctgtgacaaattaccaaaa

SEQ ID NO: 375882 - DNA, 20 bp, Artificial
  CRISPR gRNA sequence
ctgtgacaaattaccaaaac

SEQ ID NO: 375883 - DNA, 20 bp, Artificial
  CRISPR gRNA sequence
tgtgacaaattaccaaaacg

SEQ ID NO: 375884 - DNA, 20 bp, Artificial
  CRISPR gRNA sequence
gacaaattaccaaaacgggg

SEQ ID NO: 375885 - DNA, 20 bp, Artificial
  CRISPR gRNA sequence
aacggggtggcttaaaacaa

SEQ ID NO: 375886 - DNA, 20 bp, Artificial
  CRISPR gRNA sequence
aatctattcttccataattc

SEQ ID NO: 375887 - DNA, 20 bp, Artificial
  CRISPR gRNA sequence
tctattcttccataattctg

SEQ ID NO: 375888 - DNA, 20 bp, Artificial
  CRISPR gRNA sequence
ctattcttccataattctgg

SEQ ID NO: 375889 - DNA, 20 bp, Artificial
  CRISPR gRNA sequence
tattcttccataattctgga

SEQ ID NO: 375890 - DNA, 20 bp, Artificial
  CRISPR gRNA sequence
tccataattctggagggttg

SEQ ID NO: 375891 - DNA, 20 bp, Artificial
  CRISPR gRNA sequence
attctggagggttgaagtac

SEQ ID NO: 375892 - DNA, 20 bp, Artificial
  CRISPR gRNA sequence
gagggttgaagtacaagaaa

SEQ ID NO: 375893 - DNA, 20 bp, Artificial
  CRISPR gRNA sequence
tgaagtacaagaaacagtgt

SEQ ID NO: 375894 - DNA, 20 bp, Artificial
  CRISPR gRNA sequence
agtacaagaaacagtgtcag

SEQ ID NO: 375895 - DNA, 20 bp, Artificial
  CRISPR gRNA sequence
agaaacagtgtcagaagtac

SEQ ID NO: 375896 - DNA, 20 bp, Artificial
  CRISPR gRNA sequence
cagaagtactggtttcttcg

SEQ ID NO: 375897 - DNA, 20 bp, Artificial
  CRISPR gRNA sequence
agaagtactggtttcttcgt

SEQ ID NO: 375898 - DNA, 20 bp, Artificial
  CRISPR gRNA sequence
tactggtttcttcgtgggat

SEQ ID NO: 375899 - DNA, 20 bp, Artificial
  CRISPR gRNA sequence
atccatcccatgcttctatc

SEQ ID NO: 375900 - DNA, 20 bp, Artificial
  CRISPR gRNA sequence
ccatgcttctatccagcttc

SEQ ID NO: 375901 - DNA, 20 bp, Artificial
  CRISPR gRNA sequence
tgcttctatccagcttctag

SEQ ID NO: 375902 - DNA, 20 bp, Artificial
  CRISPR gRNA sequence
cttctatccagcttctagtg

SEQ ID NO: 375903 - DNA, 20 bp, Artificial
  CRISPR gRNA sequence
ctagtggagctgtcgatcct

SEQ ID NO: 375904 - DNA, 20 bp, Artificial
  CRISPR gRNA sequence
tggagctgtcgatccttggc

SEQ ID NO: 375905 - DNA, 20 bp, Artificial
  CRISPR gRNA sequence
agctgtcgatccttggctgg

SEQ ID NO: 375906 - DNA, 20 bp, Artificial
  CRISPR gRNA sequence
gcccctctcatcactgttct

SEQ ID NO: 375907 - DNA, 20 bp, Artificial
  CRISPR gRNA sequence
ctgccttccttcttttctta

SEQ ID NO: 375908 - DNA, 20 bp, Artificial
  CRISPR gRNA sequence
gccttccttcttttcttatg

SEQ ID NO: 375909 - DNA, 20 bp, Artificial
  CRISPR gRNA sequence
ttcttttcttatggagaccc

SEQ ID NO: 375910 - DNA, 20 bp, Artificial
  CRISPR gRNA sequence
tatggagaccccagttatct

SEQ ID NO: 375911 - DNA, 20 bp, Artificial
  CRISPR gRNA sequence
ccccagttatcttggactta

SEQ ID NO: 375912 - DNA, 20 bp, Artificial
  CRISPR gRNA sequence
cccagttatcttggacttaa

SEQ ID NO: 375913 - DNA, 20 bp, Artificial
  CRISPR gRNA sequence
cttaaaggcccacccctctc

SEQ ID NO: 375914 - DNA, 20 bp, Artificial
  CRISPR gRNA sequence
aggcccacccctctccagca

SEQ ID NO: 375915 - DNA, 20 bp, Artificial
  CRISPR gRNA sequence
tctccagcacagcgttgttt

SEQ ID NO: 375916 - DNA, 20 bp, Artificial
  CRISPR gRNA sequence
agcacagcgttgtttgagct

SEQ ID NO: 375917 - DNA, 20 bp, Artificial
  CRISPR gRNA sequence
gtttgagcttagctaattac

SEQ ID NO: 375918 - DNA, 20 bp, Artificial
  CRISPR gRNA sequence
tttgagcttagctaattaca

SEQ ID NO: 375919 - DNA, 20 bp, Artificial
  CRISPR gRNA sequence
caaggatcctattttcaaat

SEQ ID NO: 375920 - DNA, 20 bp, Artificial
  CRISPR gRNA sequence
aaggatcctattttcaaatg

SEQ ID NO: 375921 - DNA, 20 bp, Artificial
  CRISPR gRNA sequence
ttcaaatgaggtcacattat

SEQ ID NO: 375922 - DNA, 20 bp, Artificial
  CRISPR gRNA sequence
tcaaatgaggtcacattatg

SEQ ID NO: 375923 - DNA, 20 bp, Artificial
  CRISPR gRNA sequence
aggtcacattatgaggttct

SEQ ID NO: 375924 - DNA, 20 bp, Artificial
  CRISPR gRNA sequence
ggtcacattatgaggttctg

SEQ ID NO: 375925 - DNA, 20 bp, Artificial
  CRISPR gRNA sequence
tcacattatgaggttctgag

SEQ ID NO: 375926 - DNA, 20 bp, Artificial
  CRISPR gRNA sequence
cacattatgaggttctgagg

SEQ ID NO: 375927 - DNA, 20 bp, Artificial
  CRISPR gRNA sequence
ctgaggaggacatgaatttg

SEQ ID NO: 375928 - DNA, 20 bp, Artificial
  CRISPR gRNA sequence
tgaggaggacatgaatttgc

SEQ ID NO: 375929 - DNA, 20 bp, Artificial
  CRISPR gRNA sequence
gaggaggacatgaatttgca

SEQ ID NO: 375930 - DNA, 20 bp, Artificial
  CRISPR gRNA sequence
aggaggacatgaatttgcag

SEQ ID NO: 375931 - DNA, 20 bp, Artificial
  CRISPR gRNA sequence
ggacatgaatttgcagggga

SEQ ID NO: 375932 - DNA, 20 bp, Artificial
  CRISPR gRNA sequence
gcaggggacagtatccaacc

SEQ ID NO: 375933 - DNA, 20 bp, Artificial
  CRISPR gRNA sequence
caggggacagtatccaaccc

SEQ ID NO: 375934 - DNA, 20 bp, Artificial
  CRISPR gRNA sequence
ggggacagtatccaacccag

SEQ ID NO: 375935 - DNA, 20 bp, Artificial
  CRISPR gRNA sequence
ggacagtatccaacccagga

SEQ ID NO: 375936 - DNA, 20 bp, Artificial
  CRISPR gRNA sequence
gacagtatccaacccaggag

SEQ ID NO: 375937 - DNA, 20 bp, Artificial
  CRISPR gRNA sequence
acataatatttttatgtcat

SEQ ID NO: 375938 - DNA, 20 bp, Artificial
  CRISPR gRNA sequence
cataatatttttatgtcata

SEQ ID NO: 375939 - DNA, 20 bp, Artificial
  CRISPR gRNA sequence
atgtcataaggttattgtga

SEQ ID NO: 375940 - DNA, 20 bp, Artificial
  CRISPR gRNA sequence
gtgatggttaaattgcataa

SEQ ID NO: 375941 - DNA, 20 bp, Artificial
  CRISPR gRNA sequence
gttaaattgcataaaagaac

SEQ ID NO: 375942 - DNA, 20 bp, Artificial
  CRISPR gRNA sequence
aaattgcataaaagaaccag

SEQ ID NO: 375943 - DNA, 20 bp, Artificial
  CRISPR gRNA sequence
gcataaaagaaccagaagcg

SEQ ID NO: 375944 - DNA, 20 bp, Artificial
  CRISPR gRNA sequence
aaaagaaccagaagcgtagc

SEQ ID NO: 375945 - DNA, 20 bp, Artificial
  CRISPR gRNA sequence
ccagaagcgtagcaagcaca

SEQ ID NO: 375946 - DNA, 20 bp, Artificial
  CRISPR gRNA sequence
gaagcgtagcaagcacatag

SEQ ID NO: 375947 - DNA, 20 bp, Artificial
  CRISPR gRNA sequence
ttcattattattattatctt

SEQ ID NO: 375948 - DNA, 20 bp, Artificial
  CRISPR gRNA sequence
cattattattattatctttg

SEQ ID NO: 375949 - DNA, 20 bp, Artificial
  CRISPR gRNA sequence
attattattattatctttgg

SEQ ID NO: 375950 - DNA, 20 bp, Artificial
  CRISPR gRNA sequence
ttattattatctttggaggt

SEQ ID NO: 375951 - DNA, 20 bp, Artificial
  CRISPR gRNA sequence
tatctttggaggtaagttat

SEQ ID NO: 375952 - DNA, 20 bp, Artificial
  CRISPR gRNA sequence
agtgtatacttatacaacca

SEQ ID NO: 375953 - DNA, 20 bp, Artificial
  CRISPR gRNA sequence
agaacttttttatttcctta

SEQ ID NO: 375954 - DNA, 20 bp, Artificial
  CRISPR gRNA sequence
gaacttttttatttccttat

SEQ ID NO: 375955 - DNA, 20 bp, Artificial
  CRISPR gRNA sequence
ttttatttccttatgggctg

SEQ ID NO: 375956 - DNA, 20 bp, Artificial
  CRISPR gRNA sequence
tttatttccttatgggctgc

SEQ ID NO: 375957 - DNA, 20 bp, Artificial
  CRISPR gRNA sequence
tatttccttatgggctgcag

SEQ ID NO: 375958 - DNA, 20 bp, Artificial
  CRISPR gRNA sequence
atgggctgcaggagtttgat

SEQ ID NO: 375959 - DNA, 20 bp, Artificial
  CRISPR gRNA sequence
aggagtttgatgagctgtaa

SEQ ID NO: 375960 - DNA, 20 bp, Artificial
  CRISPR gRNA sequence
tctgccttgctgctgcccct

SEQ ID NO: 375961 - DNA, 20 bp, Artificial
  CRISPR gRNA sequence
gccccttagtgtttaactaa

SEQ ID NO: 375962 - DNA, 20 bp, Artificial
  CRISPR gRNA sequence
ttagtgtttaactaaaagac

SEQ ID NO: 375963 - DNA, 20 bp, Artificial
  CRISPR gRNA sequence
aaagactagaaacttccttc

SEQ ID NO: 375964 - DNA, 20 bp, Artificial
  CRISPR gRNA sequence
aagactagaaacttccttct

SEQ ID NO: 375965 - DNA, 20 bp, Artificial
  CRISPR gRNA sequence
gaaacttccttctgggtttg

SEQ ID NO: 375966 - DNA, 20 bp, Artificial
  CRISPR gRNA sequence
ttccttctgggtttgcagat

SEQ ID NO: 375967 - DNA, 20 bp, Artificial
  CRISPR gRNA sequence
ccttctgggtttgcagataa

SEQ ID NO: 375968 - DNA, 20 bp, Artificial
  CRISPR gRNA sequence
cttctgggtttgcagataag

SEQ ID NO: 375969 - DNA, 20 bp, Artificial
  CRISPR gRNA sequence
ttctgggtttgcagataaga

SEQ ID NO: 375970 - DNA, 20 bp, Artificial
  CRISPR gRNA sequence
aaatctcttcctttaatgca

SEQ ID NO: 375971 - DNA, 20 bp, Artificial
  CRISPR gRNA sequence
tttatgaaatttcacaaaaa

SEQ ID NO: 375972 - DNA, 20 bp, Artificial
  CRISPR gRNA sequence
tttcacaaaaaaagttgcta

SEQ ID NO: 375973 - DNA, 20 bp, Artificial
  CRISPR gRNA sequence
aatgcctaatgcgatgatat

SEQ ID NO: 375974 - DNA, 20 bp, Artificial
  CRISPR gRNA sequence
atgcctaatgcgatgatatt

SEQ ID NO: 375975 - DNA, 20 bp, Artificial
  CRISPR gRNA sequence
gcctaatgcgatgatattag

SEQ ID NO: 375976 - DNA, 20 bp, Artificial
  CRISPR gRNA sequence
cctaatgcgatgatattagg

SEQ ID NO: 375977 - DNA, 20 bp, Artificial
  CRISPR gRNA sequence
aatgcgatgatattaggagg

SEQ ID NO: 375978 - DNA, 20 bp, Artificial
  CRISPR gRNA sequence
tgcgatgatattaggaggtg

SEQ ID NO: 375979 - DNA, 20 bp, Artificial
  CRISPR gRNA sequence
atattaggaggtggagactt

SEQ ID NO: 375980 - DNA, 20 bp, Artificial
  CRISPR gRNA sequence
tattaggaggtggagacttt

SEQ ID NO: 375981 - DNA, 20 bp, Artificial
  CRISPR gRNA sequence
tggagactttgggatgtaat

SEQ ID NO: 375982 - DNA, 20 bp, Artificial
  CRISPR gRNA sequence
ttgggatgtaattagatcat

SEQ ID NO: 375983 - DNA, 20 bp, Artificial
  CRISPR gRNA sequence
tgggatgtaattagatcatg

SEQ ID NO: 375984 - DNA, 20 bp, Artificial
  CRISPR gRNA sequence
gggatgtaattagatcatga

SEQ ID NO: 375985 - DNA, 20 bp, Artificial
  CRISPR gRNA sequence
atgtaattagatcatgaggg

SEQ ID NO: 375986 - DNA, 20 bp, Artificial
  CRISPR gRNA sequence
gagggtggcgtcttcgtgaa

SEQ ID NO: 375987 - DNA, 20 bp, Artificial
  CRISPR gRNA sequence
agggtggcgtcttcgtgaat

SEQ ID NO: 375988 - DNA, 20 bp, Artificial
  CRISPR gRNA sequence
ggcgtcttcgtgaatgggat

SEQ ID NO: 375989 - DNA, 20 bp, Artificial
  CRISPR gRNA sequence
aatgggatcagtgccttttt

SEQ ID NO: 375990 - DNA, 20 bp, Artificial
  CRISPR gRNA sequence
atgggatcagtgccttttta

SEQ ID NO: 375991 - DNA, 20 bp, Artificial
  CRISPR gRNA sequence
gatcagtgcctttttaagga

SEQ ID NO: 375992 - DNA, 20 bp, Artificial
  CRISPR gRNA sequence
cagtgcctttttaaggacag

SEQ ID NO: 375993 - DNA, 20 bp, Artificial
  CRISPR gRNA sequence
gtgcctttttaaggacagaa

SEQ ID NO: 375994 - DNA, 20 bp, Artificial
  CRISPR gRNA sequence
ctttctgctctttgcaatgt

SEQ ID NO: 375995 - DNA, 20 bp, Artificial
  CRISPR gRNA sequence
tttctgctctttgcaatgtg

SEQ ID NO: 375996 - DNA, 20 bp, Artificial
  CRISPR gRNA sequence
ctttgcaatgtgaggatact

SEQ ID NO: 375997 - DNA, 20 bp, Artificial
  CRISPR gRNA sequence
tgcaatgtgaggatactgag

SEQ ID NO: 375998 - DNA, 20 bp, Artificial
  CRISPR gRNA sequence
atgtgaggatactgagaaga

SEQ ID NO: 375999 - DNA, 20 bp, Artificial
  CRISPR gRNA sequence
aagacagttgtctgcaaacc

SEQ ID NO: 376000 - DNA, 20 bp, Artificial
  CRISPR gRNA sequence
gttgtctgcaaaccaagaaa

SEQ ID NO: 376001 - DNA, 20 bp, Artificial
  CRISPR gRNA sequence
ttgtctgcaaaccaagaaac

SEQ ID NO: 376002 - DNA, 20 bp, Artificial
  CRISPR gRNA sequence
caaaccaagaaacaggcccg

SEQ ID NO: 376003 - DNA, 20 bp, Artificial
  CRISPR gRNA sequence
aaaccaagaaacaggcccgc

SEQ ID NO: 376004 - DNA, 20 bp, Artificial
  CRISPR gRNA sequence
acaggcccgcaggccctcac

SEQ ID NO: 376005 - DNA, 20 bp, Artificial
  CRISPR gRNA sequence
tggactcttttttttttctc

SEQ ID NO: 376006 - DNA, 20 bp, Artificial
  CRISPR gRNA sequence
ctcttttttttttctcaagt

SEQ ID NO: 376007 - DNA, 20 bp, Artificial
  CRISPR gRNA sequence
tcttttttttttctcaagtt

SEQ ID NO: 376008 - DNA, 20 bp, Artificial
  CRISPR gRNA sequence
ggaaaatattttcttaatct

SEQ ID NO: 376009 - DNA, 20 bp, Artificial
  CRISPR gRNA sequence
tttcttaatcttggacttcc

SEQ ID NO: 376010 - DNA, 20 bp, Artificial
  CRISPR gRNA sequence
atcttggacttcccagcctc

SEQ ID NO: 376011 - DNA, 20 bp, Artificial
  CRISPR gRNA sequence
ttcccagcctccagaactgt

SEQ ID NO: 376012 - DNA, 20 bp, Artificial
  CRISPR gRNA sequence
tcccagcctccagaactgtg

SEQ ID NO: 376013 - DNA, 20 bp, Artificial
  CRISPR gRNA sequence
cctccagaactgtgaggaat

SEQ ID NO: 376014 - DNA, 20 bp, Artificial
  CRISPR gRNA sequence
ctgtgaggaataagtgtttg

SEQ ID NO: 376015 - DNA, 20 bp, Artificial
  CRISPR gRNA sequence
ggaataagtgtttgtggttt

SEQ ID NO: 376016 - DNA, 20 bp, Artificial
  CRISPR gRNA sequence
tgtttgtggtttaagcaacc

SEQ ID NO: 376017 - DNA, 20 bp, Artificial
  CRISPR gRNA sequence
ggtttaagcaacccagtcta

SEQ ID NO: 376018 - DNA, 20 bp, Artificial
  CRISPR gRNA sequence
cagtctacagtattttgtta

SEQ ID NO: 376019 - DNA, 20 bp, Artificial
  CRISPR gRNA sequence
tctacagtattttgttacag

SEQ ID NO: 376020 - DNA, 20 bp, Artificial
  CRISPR gRNA sequence
ttgttacagcagcccaaact

SEQ ID NO: 376021 - DNA, 20 bp, Artificial
  CRISPR gRNA sequence
acaaaaaattccccaattcc

SEQ ID NO: 376022 - DNA, 20 bp, Artificial
  CRISPR gRNA sequence
attccccaattcctagccaa

SEQ ID NO: 376023 - DNA, 20 bp, Artificial
  CRISPR gRNA sequence
cttttcattttaactattcg

SEQ ID NO: 376024 - DNA, 20 bp, Artificial
  CRISPR gRNA sequence
ttcattttaactattcgcag

SEQ ID NO: 376025 - DNA, 20 bp, Artificial
  CRISPR gRNA sequence
attcgcagtggaattctaca

SEQ ID NO: 376026 - DNA, 20 bp, Artificial
  CRISPR gRNA sequence
gtggaattctacatggccac

SEQ ID NO: 376027 - DNA, 20 bp, Artificial
  CRISPR gRNA sequence
attctacatggccacaagcc

SEQ ID NO: 376028 - DNA, 20 bp, Artificial
  CRISPR gRNA sequence
gccacaagccaagtactaaa

SEQ ID NO: 376029 - DNA, 20 bp, Artificial
  CRISPR gRNA sequence
ccacaagccaagtactaaaa

SEQ ID NO: 376030 - DNA, 20 bp, Artificial
  CRISPR gRNA sequence
acaatccaacatgtgttcat

SEQ ID NO: 376031 - DNA, 20 bp, Artificial
  CRISPR gRNA sequence
cagatgccttcataatttat

SEQ ID NO: 376032 - DNA, 20 bp, Artificial
  CRISPR gRNA sequence
agtttaactttttatttatt

SEQ ID NO: 376033 - DNA, 20 bp, Artificial
  CRISPR gRNA sequence
ttaactttttatttattaag

SEQ ID NO: 376034 - DNA, 20 bp, Artificial
  CRISPR gRNA sequence
aaaatattttttttgtttgt

SEQ ID NO: 376035 - DNA, 20 bp, Artificial
  CRISPR gRNA sequence
ttgtttgttggcaaaaaaca

SEQ ID NO: 376036 - DNA, 20 bp, Artificial
  CRISPR gRNA sequence
ttgcttcttgatgccaactg

SEQ ID NO: 376037 - DNA, 20 bp, Artificial
  CRISPR gRNA sequence
ttgatgccaactgtagaatc

SEQ ID NO: 376038 - DNA, 20 bp, Artificial
  CRISPR gRNA sequence
gaaaccttgctttatttcat

SEQ ID NO: 376039 - DNA, 20 bp, Artificial
  CRISPR gRNA sequence
ctttatttcatcagccactt

SEQ ID NO: 376040 - DNA, 20 bp, Artificial
  CRISPR gRNA sequence
atttcatcagccacttcagc

SEQ ID NO: 376041 - DNA, 20 bp, Artificial
  CRISPR gRNA sequence
cacttcagcaagaaataaat

SEQ ID NO: 376042 - DNA, 20 bp, Artificial
  CRISPR gRNA sequence
tgctctgtcatacacaattt

SEQ ID NO: 376043 - DNA, 20 bp, Artificial
  CRISPR gRNA sequence
gctctgtcatacacaatttt

SEQ ID NO: 376044 - DNA, 20 bp, Artificial
  CRISPR gRNA sequence
gggattcccttcttcatcct

SEQ ID NO: 376045 - DNA, 20 bp, Artificial
  CRISPR gRNA sequence
tagcctttgtctactcatgc

SEQ ID NO: 376046 - DNA, 20 bp, Artificial
  CRISPR gRNA sequence
tttgtctactcatgccagtc

SEQ ID NO: 376047 - DNA, 20 bp, Artificial
  CRISPR gRNA sequence
cacatttattgttgtgaatt

SEQ ID NO: 376048 - DNA, 20 bp, Artificial
  CRISPR gRNA sequence
acatttattgttgtgaattt

SEQ ID NO: 376049 - DNA, 20 bp, Artificial
  CRISPR gRNA sequence
catttattgttgtgaatttg

SEQ ID NO: 376050 - DNA, 20 bp, Artificial
  CRISPR gRNA sequence
gttgtgaatttggggaatga

SEQ ID NO: 376051 - DNA, 20 bp, Artificial
  CRISPR gRNA sequence
ttgtgaatttggggaatgaa

SEQ ID NO: 376052 - DNA, 20 bp, Artificial
  CRISPR gRNA sequence
tgtgaatttggggaatgaaa

SEQ ID NO: 376053 - DNA, 20 bp, Artificial
  CRISPR gRNA sequence
tgaatttggggaatgaaagg

SEQ ID NO: 376054 - DNA, 20 bp, Artificial
  CRISPR gRNA sequence
aatgaaagggagctttgcaa

SEQ ID NO: 376055 - DNA, 20 bp, Artificial
  CRISPR gRNA sequence
agctttgcaacggtctatat

SEQ ID NO: 376056 - DNA, 20 bp, Artificial
  CRISPR gRNA sequence
gctttgcaacggtctatatt

SEQ ID NO: 376057 - DNA, 20 bp, Artificial
  CRISPR gRNA sequence
tattaggtatccaacttttt

SEQ ID NO: 376058 - DNA, 20 bp, Artificial
  CRISPR gRNA sequence
attaggtatccaactttttc

SEQ ID NO: 376059 - DNA, 20 bp, Artificial
  CRISPR gRNA sequence
ccaactttttcaggtttttg

SEQ ID NO: 376060 - DNA, 20 bp, Artificial
  CRISPR gRNA sequence
ttttgtagaataatattttg

SEQ ID NO: 376061 - DNA, 20 bp, Artificial
  CRISPR gRNA sequence
tttgtagaataatattttga

SEQ ID NO: 376062 - DNA, 20 bp, Artificial
  CRISPR gRNA sequence
aatattttgaaggattatta

SEQ ID NO: 376063 - DNA, 20 bp, Artificial
  CRISPR gRNA sequence
tattttgaaggattattaaa

SEQ ID NO: 376064 - DNA, 20 bp, Artificial
  CRISPR gRNA sequence
aaggattattaaagagttaa

SEQ ID NO: 376065 - DNA, 20 bp, Artificial
  CRISPR gRNA sequence
aggattattaaagagttaat

SEQ ID NO: 376066 - DNA, 20 bp, Artificial
  CRISPR gRNA sequence
ttattaaagagttaataggt

SEQ ID NO: 376067 - DNA, 20 bp, Artificial
  CRISPR gRNA sequence
ataggttggactgtcaaaaa

SEQ ID NO: 376068 - DNA, 20 bp, Artificial
  CRISPR gRNA sequence
ggactgtcaaaaaaagacat

SEQ ID NO: 376069 - DNA, 20 bp, Artificial
  CRISPR gRNA sequence
tacttcattctcttttttaa

SEQ ID NO: 376070 - DNA, 20 bp, Artificial
  CRISPR gRNA sequence
ttttaaaagataacctctat

SEQ ID NO: 376071 - DNA, 20 bp, Artificial
  CRISPR gRNA sequence
ataacctctataagtaatca

SEQ ID NO: 376072 - DNA, 20 bp, Artificial
  CRISPR gRNA sequence
ttcttaaaaacactaacatc

SEQ ID NO: 376073 - DNA, 20 bp, Artificial
  CRISPR gRNA sequence
taaaaacactaacatctggc

SEQ ID NO: 376074 - DNA, 20 bp, Artificial
  CRISPR gRNA sequence
cactaacatctggctggtca

SEQ ID NO: 376075 - DNA, 20 bp, Artificial
  CRISPR gRNA sequence
taacatctggctggtcatgg

SEQ ID NO: 376076 - DNA, 20 bp, Artificial
  CRISPR gRNA sequence
cgcttgtaatcccaacactt

SEQ ID NO: 376077 - DNA, 20 bp, Artificial
  CRISPR gRNA sequence
gcttgtaatcccaacacttt

SEQ ID NO: 376078 - DNA, 20 bp, Artificial
  CRISPR gRNA sequence
ttgtaatcccaacactttgg

SEQ ID NO: 376079 - DNA, 20 bp, Artificial
  CRISPR gRNA sequence
tgtaatcccaacactttggg

SEQ ID NO: 376080 - DNA, 20 bp, Artificial
  CRISPR gRNA sequence
tcccaacactttgggaggct

SEQ ID NO: 376081 - DNA, 20 bp, Artificial
  CRISPR gRNA sequence
cccaacactttgggaggctg

SEQ ID NO: 376082 - DNA, 20 bp, Artificial
  CRISPR gRNA sequence
aacactttgggaggctgagg

SEQ ID NO: 376083 - DNA, 20 bp, Artificial
  CRISPR gRNA sequence
acactttgggaggctgaggt

SEQ ID NO: 376084 - DNA, 20 bp, Artificial
  CRISPR gRNA sequence
ctttgggaggctgaggtggg

SEQ ID NO: 376085 - DNA, 20 bp, Artificial
  CRISPR gRNA sequence
ctgaggtgggcggatcgtct

SEQ ID NO: 376086 - DNA, 20 bp, Artificial
  CRISPR gRNA sequence
tgaggtgggcggatcgtctg

SEQ ID NO: 376087 - DNA, 20 bp, Artificial
  CRISPR gRNA sequence
gtgggcggatcgtctgaggt

SEQ ID NO: 376088 - DNA, 20 bp, Artificial
  CRISPR gRNA sequence
tgggcggatcgtctgaggtc

SEQ ID NO: 376089 - DNA, 20 bp, Artificial
  CRISPR gRNA sequence
ggcggatcgtctgaggtcag

SEQ ID NO: 376090 - DNA, 20 bp, Artificial
  CRISPR gRNA sequence
tcgtctgaggtcaggagttt

SEQ ID NO: 376091 - DNA, 20 bp, Artificial
  CRISPR gRNA sequence
tgaggtcaggagtttgagac

SEQ ID NO: 376092 - DNA, 20 bp, Artificial
  CRISPR gRNA sequence
tcaggagtttgagaccagcc

SEQ ID NO: 376093 - DNA, 20 bp, Artificial
  CRISPR gRNA sequence
tgagaccagcctggccaaca

SEQ ID NO: 376094 - DNA, 20 bp, Artificial
  CRISPR gRNA sequence
tctactaaaaatacaaaaat

SEQ ID NO: 376095 - DNA, 20 bp, Artificial
  CRISPR gRNA sequence
ctaaaaatacaaaaattagc

SEQ ID NO: 376096 - DNA, 20 bp, Artificial
  CRISPR gRNA sequence
taaaaatacaaaaattagct

SEQ ID NO: 376097 - DNA, 20 bp, Artificial
  CRISPR gRNA sequence
caaaaattagctgggcgtga

SEQ ID NO: 376098 - DNA, 20 bp, Artificial
  CRISPR gRNA sequence
atggtgcttgcctgtaatcc

SEQ ID NO: 376099 - DNA, 20 bp, Artificial
  CRISPR gRNA sequence
ctgtaatcccagctactcgt

SEQ ID NO: 376100 - DNA, 20 bp, Artificial
  CRISPR gRNA sequence
tgtaatcccagctactcgtg

SEQ ID NO: 376101 - DNA, 20 bp, Artificial
  CRISPR gRNA sequence
tcccagctactcgtgaggct

SEQ ID NO: 376102 - DNA, 20 bp, Artificial
  CRISPR gRNA sequence
cccagctactcgtgaggctg

SEQ ID NO: 376103 - DNA, 20 bp, Artificial
  CRISPR gRNA sequence
agctactcgtgaggctgagg

SEQ ID NO: 376104 - DNA, 20 bp, Artificial
  CRISPR gRNA sequence
gaggcagaattgcttgaacc

SEQ ID NO: 376105 - DNA, 20 bp, Artificial
  CRISPR gRNA sequence
aggcagaattgcttgaacct

SEQ ID NO: 376106 - DNA, 20 bp, Artificial
  CRISPR gRNA sequence
gcagaattgcttgaacctgg

SEQ ID NO: 376107 - DNA, 20 bp, Artificial
  CRISPR gRNA sequence
cagaattgcttgaacctggg

SEQ ID NO: 376108 - DNA, 20 bp, Artificial
  CRISPR gRNA sequence
aattgcttgaacctgggagg

SEQ ID NO: 376109 - DNA, 20 bp, Artificial
  CRISPR gRNA sequence
attgcttgaacctgggaggt

SEQ ID NO: 376110 - DNA, 20 bp, Artificial
  CRISPR gRNA sequence
ttgcttgaacctgggaggtg

SEQ ID NO: 376111 - DNA, 20 bp, Artificial
  CRISPR gRNA sequence
tgcttgaacctgggaggtgg

SEQ ID NO: 376112 - DNA, 20 bp, Artificial
  CRISPR gRNA sequence
aacctgggaggtgggggttg

SEQ ID NO: 376113 - DNA, 20 bp, Artificial
  CRISPR gRNA sequence
tgggaggtgggggttgcagt

SEQ ID NO: 376114 - DNA, 20 bp, Artificial
  CRISPR gRNA sequence
ggtgggggttgcagtgagcc

SEQ ID NO: 376115 - DNA, 20 bp, Artificial
  CRISPR gRNA sequence
tagattgcgccactgcactc

SEQ ID NO: 376116 - DNA, 20 bp, Artificial
  CRISPR gRNA sequence
tgcgccactgcactccagct

SEQ ID NO: 376117 - DNA, 20 bp, Artificial
  CRISPR gRNA sequence
gcgccactgcactccagctt

SEQ ID NO: 376118 - DNA, 20 bp, Artificial
  CRISPR gRNA sequence
ctgcactccagcttgggcaa

SEQ ID NO: 376119 - DNA, 20 bp, Artificial
  CRISPR gRNA sequence
gcactccagcttgggcaaca

SEQ ID NO: 376120 - DNA, 20 bp, Artificial
  CRISPR gRNA sequence
tccagcttgggcaacagagc

SEQ ID NO: 376121 - DNA, 20 bp, Artificial
  CRISPR gRNA sequence
tcaaaaaaaccaacaacact

SEQ ID NO: 376122 - DNA, 20 bp, Artificial
  CRISPR gRNA sequence
caaaaaaaccaacaacacta

SEQ ID NO: 376123 - DNA, 20 bp, Artificial
  CRISPR gRNA sequence
atttttaaattactcatcaa

SEQ ID NO: 376124 - DNA, 20 bp, Artificial
  CRISPR gRNA sequence
ctcatcaaaagacctttctc

SEQ ID NO: 376125 - DNA, 20 bp, Artificial
  CRISPR gRNA sequence
ctgttacatacatacatatg

SEQ ID NO: 376126 - DNA, 20 bp, Artificial
  CRISPR gRNA sequence
catacatacatatgtggtca

SEQ ID NO: 376127 - DNA, 20 bp, Artificial
  CRISPR gRNA sequence
tggtcaaagtgacttgatta

SEQ ID NO: 376128 - DNA, 20 bp, Artificial
  CRISPR gRNA sequence
tcaaagtgacttgattacgg

SEQ ID NO: 376129 - DNA, 20 bp, Artificial
  CRISPR gRNA sequence
aaagtgacttgattacggta

SEQ ID NO: 376130 - DNA, 20 bp, Artificial
  CRISPR gRNA sequence
gtgacttgattacggtagag

SEQ ID NO: 376131 - DNA, 20 bp, Artificial
  CRISPR gRNA sequence
atacaatatcatcttgatgt

SEQ ID NO: 376132 - DNA, 20 bp, Artificial
  CRISPR gRNA sequence
ttgttaactttttatatgtt

SEQ ID NO: 376133 - DNA, 20 bp, Artificial
  CRISPR gRNA sequence
gttaagttgcttatttttta

SEQ ID NO: 376134 - DNA, 20 bp, Artificial
  CRISPR gRNA sequence
gttgcttattttttaaagtt

SEQ ID NO: 376135 - DNA, 20 bp, Artificial
  CRISPR gRNA sequence
ttaaagttcagacactgtgt

SEQ ID NO: 376136 - DNA, 20 bp, Artificial
  CRISPR gRNA sequence
gaatttccatataaaaatga

SEQ ID NO: 376137 - DNA, 20 bp, Artificial
  CRISPR gRNA sequence
agtaattgttcttatcaaaa

SEQ ID NO: 376138 - DNA, 20 bp, Artificial
  CRISPR gRNA sequence
ttatcaaaatagcttaacat

SEQ ID NO: 376139 - DNA, 20 bp, Artificial
  CRISPR gRNA sequence
tatcaaaatagcttaacatt

SEQ ID NO: 376140 - DNA, 20 bp, Artificial
  CRISPR gRNA sequence
tcaaaatagcttaacattgg

SEQ ID NO: 376141 - DNA, 20 bp, Artificial
  CRISPR gRNA sequence
aaaatagcttaacattggga

SEQ ID NO: 376142 - DNA, 20 bp, Artificial
  CRISPR gRNA sequence
aaatagcttaacattgggag

SEQ ID NO: 376143 - DNA, 20 bp, Artificial
  CRISPR gRNA sequence
aatagcttaacattgggaga

SEQ ID NO: 376144 - DNA, 20 bp, Artificial
  CRISPR gRNA sequence
tagcttaacattgggagagg

SEQ ID NO: 376145 - DNA, 20 bp, Artificial
  CRISPR gRNA sequence
gagggagttctacattgaaa

SEQ ID NO: 376146 - DNA, 20 bp, Artificial
  CRISPR gRNA sequence
agggagttctacattgaaac

SEQ ID NO: 376147 - DNA, 20 bp, Artificial
  CRISPR gRNA sequence
acattgaaacaggtaattca

SEQ ID NO: 376148 - DNA, 20 bp, Artificial
  CRISPR gRNA sequence
aggtaattcatagcacaata

SEQ ID NO: 376149 - DNA, 20 bp, Artificial
  CRISPR gRNA sequence
aattcatagcacaatacagc

SEQ ID NO: 376150 - DNA, 20 bp, Artificial
  CRISPR gRNA sequence
caatacagcaagtattaatc

SEQ ID NO: 376151 - DNA, 20 bp, Artificial
  CRISPR gRNA sequence
cagcaagtattaatctagac

SEQ ID NO: 376152 - DNA, 20 bp, Artificial
  CRISPR gRNA sequence
actagatttctgttgcatct

SEQ ID NO: 376153 - DNA, 20 bp, Artificial
  CRISPR gRNA sequence
atttctgttgcatctcagtc

SEQ ID NO: 376154 - DNA, 20 bp, Artificial
  CRISPR gRNA sequence
gtcaagaatatgatttccaa

SEQ ID NO: 376155 - DNA, 20 bp, Artificial
  CRISPR gRNA sequence
aagaatatgatttccaacag

SEQ ID NO: 376156 - DNA, 20 bp, Artificial
  CRISPR gRNA sequence
caacagaagttcaatacaat

SEQ ID NO: 376157 - DNA, 20 bp, Artificial
  CRISPR gRNA sequence
ttttatcaaattaattataa

SEQ ID NO: 376158 - DNA, 20 bp, Artificial
  CRISPR gRNA sequence
catatcatgcctgcatttat

SEQ ID NO: 376159 - DNA, 20 bp, Artificial
  CRISPR gRNA sequence
tatcatgcctgcatttatga

SEQ ID NO: 376160 - DNA, 20 bp, Artificial
  CRISPR gRNA sequence
atcatgcctgcatttatgag

SEQ ID NO: 376161 - DNA, 20 bp, Artificial
  CRISPR gRNA sequence
tatgttttgaatgtcttcat

SEQ ID NO: 376162 - DNA, 20 bp, Artificial
  CRISPR gRNA sequence
cttcattagttgttgaaatg

SEQ ID NO: 376163 - DNA, 20 bp, Artificial
  CRISPR gRNA sequence
ctctctgctgtttgtctttc

SEQ ID NO: 376164 - DNA, 20 bp, Artificial
  CRISPR gRNA sequence
tctctgctgtttgtctttct

SEQ ID NO: 376165 - DNA, 20 bp, Artificial
  CRISPR gRNA sequence
ttctaggcacccaataacta

SEQ ID NO: 376166 - DNA, 20 bp, Artificial
  CRISPR gRNA sequence
taggcacccaataactatag

SEQ ID NO: 376167 - DNA, 20 bp, Artificial
  CRISPR gRNA sequence
tatagaagtcccatctctac

SEQ ID NO: 376168 - DNA, 20 bp, Artificial
  CRISPR gRNA sequence
tcaacctaccaatcaatcca

SEQ ID NO: 376169 - DNA, 20 bp, Artificial
  CRISPR gRNA sequence
aatcaatccatggatgatac

SEQ ID NO: 376170 - DNA, 20 bp, Artificial
  CRISPR gRNA sequence
tcaatccatggatgatacaa

SEQ ID NO: 376171 - DNA, 20 bp, Artificial
  CRISPR gRNA sequence
aatccatggatgatacaaga

SEQ ID NO: 376172 - DNA, 20 bp, Artificial
  CRISPR gRNA sequence
atccatggatgatacaagag

SEQ ID NO: 376173 - DNA, 20 bp, Artificial
  CRISPR gRNA sequence
aactatccaaccttctctcg

SEQ ID NO: 376174 - DNA, 20 bp, Artificial
  CRISPR gRNA sequence
caaccttctctcgcagacca

SEQ ID NO: 376175 - DNA, 20 bp, Artificial
  CRISPR gRNA sequence
ttctctcgcagaccaaagac

SEQ ID NO: 376176 - DNA, 20 bp, Artificial
  CRISPR gRNA sequence
ctctcgcagaccaaagacta

SEQ ID NO: 376177 - DNA, 20 bp, Artificial
  CRISPR gRNA sequence
cagaccaaagactagagttt

SEQ ID NO: 376178 - DNA, 20 bp, Artificial
  CRISPR gRNA sequence
tttaagcttattcttgacat

SEQ ID NO: 376179 - DNA, 20 bp, Artificial
  CRISPR gRNA sequence
tattcttgacatgagtgcat

SEQ ID NO: 376180 - DNA, 20 bp, Artificial
  CRISPR gRNA sequence
gactcttatgtactcatgca

SEQ ID NO: 376181 - DNA, 20 bp, Artificial
  CRISPR gRNA sequence
gcaatttttttccactaccc

SEQ ID NO: 376182 - DNA, 20 bp, Artificial
  CRISPR gRNA sequence
caatttttttccactaccca

SEQ ID NO: 376183 - DNA, 20 bp, Artificial
  CRISPR gRNA sequence
ccactacccaaggtctacct

SEQ ID NO: 376184 - DNA, 20 bp, Artificial
  CRISPR gRNA sequence
ccaaggtctaccttagatac

SEQ ID NO: 376185 - DNA, 20 bp, Artificial
  CRISPR gRNA sequence
agatactagttgtctgaatt

SEQ ID NO: 376186 - DNA, 20 bp, Artificial
  CRISPR gRNA sequence
tctgaattgagttactttga

SEQ ID NO: 376187 - DNA, 20 bp, Artificial
  CRISPR gRNA sequence
ctgaattgagttactttgat

SEQ ID NO: 376188 - DNA, 20 bp, Artificial
  CRISPR gRNA sequence
ttacctaaaatcatttttca

SEQ ID NO: 376189 - DNA, 20 bp, Artificial
  CRISPR gRNA sequence
catttttcatagaactgttt

SEQ ID NO: 376190 - DNA, 20 bp, Artificial
  CRISPR gRNA sequence
tcagaaaacctgactctaac

SEQ ID NO: 376191 - DNA, 20 bp, Artificial
  CRISPR gRNA sequence
tctaactggtttatatacaa

SEQ ID NO: 376192 - DNA, 20 bp, Artificial
  CRISPR gRNA sequence
aaacttactgtatcatataa

SEQ ID NO: 376193 - DNA, 20 bp, Artificial
  CRISPR gRNA sequence
tatcatataacagaatgatc

SEQ ID NO: 376194 - DNA, 20 bp, Artificial
  CRISPR gRNA sequence
atcatataacagaatgatcc

SEQ ID NO: 376195 - DNA, 20 bp, Artificial
  CRISPR gRNA sequence
tcatataacagaatgatcca

SEQ ID NO: 376196 - DNA, 20 bp, Artificial
  CRISPR gRNA sequence
catataacagaatgatccag

SEQ ID NO: 376197 - DNA, 20 bp, Artificial
  CRISPR gRNA sequence
tataacagaatgatccaggg

SEQ ID NO: 376198 - DNA, 20 bp, Artificial
  CRISPR gRNA sequence
agaatgatccaggggagatt

SEQ ID NO: 376199 - DNA, 20 bp, Artificial
  CRISPR gRNA sequence
atccaggggagattaagctt

SEQ ID NO: 376200 - DNA, 20 bp, Artificial
  CRISPR gRNA sequence
tccaggggagattaagcttt

SEQ ID NO: 376201 - DNA, 20 bp, Artificial
  CRISPR gRNA sequence
ggggagattaagctttgggc

SEQ ID NO: 376202 - DNA, 20 bp, Artificial
  CRISPR gRNA sequence
gggagattaagctttgggca

SEQ ID NO: 376203 - DNA, 20 bp, Artificial
  CRISPR gRNA sequence
ggagattaagctttgggcaa

SEQ ID NO: 376204 - DNA, 20 bp, Artificial
  CRISPR gRNA sequence
tttgggcaagggctatttac

SEQ ID NO: 376205 - DNA, 20 bp, Artificial
  CRISPR gRNA sequence
ttgggcaagggctatttacc

SEQ ID NO: 376206 - DNA, 20 bp, Artificial
  CRISPR gRNA sequence
tgggcaagggctatttacca

SEQ ID NO: 376207 - DNA, 20 bp, Artificial
  CRISPR gRNA sequence
cagggcttaaatgttgtgtc

SEQ ID NO: 376208 - DNA, 20 bp, Artificial
  CRISPR gRNA sequence
taaatgttgtgtctagaatt

SEQ ID NO: 376209 - DNA, 20 bp, Artificial
  CRISPR gRNA sequence
gttgtgtctagaattaagta

SEQ ID NO: 376210 - DNA, 20 bp, Artificial
  CRISPR gRNA sequence
ttgtgtctagaattaagtat

SEQ ID NO: 376211 - DNA, 20 bp, Artificial
  CRISPR gRNA sequence
aattaagtatgggcataaac

SEQ ID NO: 376212 - DNA, 20 bp, Artificial
  CRISPR gRNA sequence
ctggcttctgaatccctttc

SEQ ID NO: 376213 - DNA, 20 bp, Artificial
  CRISPR gRNA sequence
ggcttctgaatccctttcca

SEQ ID NO: 376214 - DNA, 20 bp, Artificial
  CRISPR gRNA sequence
tgaatccctttccagagtgt

SEQ ID NO: 376215 - DNA, 20 bp, Artificial
  CRISPR gRNA sequence
gagtgttggatccatttccc

SEQ ID NO: 376216 - DNA, 20 bp, Artificial
  CRISPR gRNA sequence
tggatccatttccctggtct

SEQ ID NO: 376217 - DNA, 20 bp, Artificial
  CRISPR gRNA sequence
gtcttggcctcactctcatg

SEQ ID NO: 376218 - DNA, 20 bp, Artificial
  CRISPR gRNA sequence
tcttggcctcactctcatgc

SEQ ID NO: 376219 - DNA, 20 bp, Artificial
  CRISPR gRNA sequence
tgcaggctttcctcttgtgt

SEQ ID NO: 376220 - DNA, 20 bp, Artificial
  CRISPR gRNA sequence
ggctttcctcttgtgttggc

SEQ ID NO: 376221 - DNA, 20 bp, Artificial
  CRISPR gRNA sequence
ttcctcttgtgttggcaaga

SEQ ID NO: 376222 - DNA, 20 bp, Artificial
  CRISPR gRNA sequence
gcaagatggctgccaactct

SEQ ID NO: 376223 - DNA, 20 bp, Artificial
  CRISPR gRNA sequence
catacatccttgtttctgtc

SEQ ID NO: 376224 - DNA, 20 bp, Artificial
  CRISPR gRNA sequence
acatccttgtttctgtctgg

SEQ ID NO: 376225 - DNA, 20 bp, Artificial
  CRISPR gRNA sequence
atccttgtttctgtctggta

SEQ ID NO: 376226 - DNA, 20 bp, Artificial
  CRISPR gRNA sequence
ccttgtttctgtctggtaga

SEQ ID NO: 376227 - DNA, 20 bp, Artificial
  CRISPR gRNA sequence
tagagagtttgcttctcaaa

SEQ ID NO: 376228 - DNA, 20 bp, Artificial
  CRISPR gRNA sequence
gagagtttgcttctcaaatg

SEQ ID NO: 376229 - DNA, 20 bp, Artificial
  CRISPR gRNA sequence
attattttttcattgttaaa

SEQ ID NO: 376230 - DNA, 20 bp, Artificial
  CRISPR gRNA sequence
ttattttttcattgttaaat

SEQ ID NO: 376231 - DNA, 20 bp, Artificial
  CRISPR gRNA sequence
tgttaaataggcaacatgac

SEQ ID NO: 376232 - DNA, 20 bp, Artificial
  CRISPR gRNA sequence
aaataggcaacatgaccaga

SEQ ID NO: 376233 - DNA, 20 bp, Artificial
  CRISPR gRNA sequence
aataggcaacatgaccagaa

SEQ ID NO: 376234 - DNA, 20 bp, Artificial
  CRISPR gRNA sequence
ggcaacatgaccagaaagga

SEQ ID NO: 376235 - DNA, 20 bp, Artificial
  CRISPR gRNA sequence
catgaccagaaaggatggaa

SEQ ID NO: 376236 - DNA, 20 bp, Artificial
  CRISPR gRNA sequence
cagaaaggatggaatggctt

SEQ ID NO: 376237 - DNA, 20 bp, Artificial
  CRISPR gRNA sequence
tggaatggcttaagtaaact

SEQ ID NO: 376238 - DNA, 20 bp, Artificial
  CRISPR gRNA sequence
ggaatggcttaagtaaacta

SEQ ID NO: 376239 - DNA, 20 bp, Artificial
  CRISPR gRNA sequence
gaatggcttaagtaaactaa

SEQ ID NO: 376240 - DNA, 20 bp, Artificial
  CRISPR gRNA sequence
gtaaactaagggttcacttc

SEQ ID NO: 376241 - DNA, 20 bp, Artificial
  CRISPR gRNA sequence
aaactaagggttcacttcta

SEQ ID NO: 376242 - DNA, 20 bp, Artificial
  CRISPR gRNA sequence
aagggttcacttctagagct

SEQ ID NO: 376243 - DNA, 20 bp, Artificial
  CRISPR gRNA sequence
ggttcacttctagagctgag

SEQ ID NO: 376244 - DNA, 20 bp, Artificial
  CRISPR gRNA sequence
tcacttctagagctgagaag

SEQ ID NO: 376245 - DNA, 20 bp, Artificial
  CRISPR gRNA sequence
cacttctagagctgagaagc

SEQ ID NO: 376246 - DNA, 20 bp, Artificial
  CRISPR gRNA sequence
acttctagagctgagaagca

SEQ ID NO: 376247 - DNA, 20 bp, Artificial
  CRISPR gRNA sequence
agagctgagaagcagggtca

SEQ ID NO: 376248 - DNA, 20 bp, Artificial
  CRISPR gRNA sequence
gcagggtcaaagcacaatac

SEQ ID NO: 376249 - DNA, 20 bp, Artificial
  CRISPR gRNA sequence
cagggtcaaagcacaatact

SEQ ID NO: 376250 - DNA, 20 bp, Artificial
  CRISPR gRNA sequence
aagcacaatactgggcaatt

SEQ ID NO: 376251 - DNA, 20 bp, Artificial
  CRISPR gRNA sequence
gcacaatactgggcaattca

SEQ ID NO: 376252 - DNA, 20 bp, Artificial
  CRISPR gRNA sequence
atactgggcaattcagagca

SEQ ID NO: 376253 - DNA, 20 bp, Artificial
  CRISPR gRNA sequence
tgggcaattcagagcatggt

SEQ ID NO: 376254 - DNA, 20 bp, Artificial
  CRISPR gRNA sequence
gcaattcagagcatggttag

SEQ ID NO: 376255 - DNA, 20 bp, Artificial
  CRISPR gRNA sequence
aattcagagcatggttagaa

SEQ ID NO: 376256 - DNA, 20 bp, Artificial
  CRISPR gRNA sequence
attcagagcatggttagaag

SEQ ID NO: 376257 - DNA, 20 bp, Artificial
  CRISPR gRNA sequence
agagcatggttagaagagga

SEQ ID NO: 376258 - DNA, 20 bp, Artificial
  CRISPR gRNA sequence
gagcatggttagaagaggaa

SEQ ID NO: 376259 - DNA, 20 bp, Artificial
  CRISPR gRNA sequence
agcatggttagaagaggaaa

SEQ ID NO: 376260 - DNA, 20 bp, Artificial
  CRISPR gRNA sequence
gcatggttagaagaggaaag

SEQ ID NO: 376261 - DNA, 20 bp, Artificial
  CRISPR gRNA sequence
atggttagaagaggaaaggg

SEQ ID NO: 376262 - DNA, 20 bp, Artificial
  CRISPR gRNA sequence
aagaggaaaggggagtctca

SEQ ID NO: 376263 - DNA, 20 bp, Artificial
  CRISPR gRNA sequence
ggaaaggggagtctcaaagc

SEQ ID NO: 376264 - DNA, 20 bp, Artificial
  CRISPR gRNA sequence
aaaggggagtctcaaagctg

SEQ ID NO: 376265 - DNA, 20 bp, Artificial
  CRISPR gRNA sequence
aggggagtctcaaagctgga

SEQ ID NO: 376266 - DNA, 20 bp, Artificial
  CRISPR gRNA sequence
ttaccaacaaatattgactg

SEQ ID NO: 376267 - DNA, 20 bp, Artificial
  CRISPR gRNA sequence
attgactgcagtgattaacc

SEQ ID NO: 376268 - DNA, 20 bp, Artificial
  CRISPR gRNA sequence
agacatttttgttaactaaa

SEQ ID NO: 376269 - DNA, 20 bp, Artificial
  CRISPR gRNA sequence
gttaactaaaaagtgaaata

SEQ ID NO: 376270 - DNA, 20 bp, Artificial
  CRISPR gRNA sequence
ttaactaaaaagtgaaatat

SEQ ID NO: 376271 - DNA, 20 bp, Artificial
  CRISPR gRNA sequence
ctaaaaagtgaaatatggga

SEQ ID NO: 376272 - DNA, 20 bp, Artificial
  CRISPR gRNA sequence
gtgaaatatgggatggattc

SEQ ID NO: 376273 - DNA, 20 bp, Artificial
  CRISPR gRNA sequence
tatgggatggattctagaaa

SEQ ID NO: 376274 - DNA, 20 bp, Artificial
  CRISPR gRNA sequence
atgggatggattctagaaat

SEQ ID NO: 376275 - DNA, 20 bp, Artificial
  CRISPR gRNA sequence
tgggatggattctagaaatg

SEQ ID NO: 376276 - DNA, 20 bp, Artificial
  CRISPR gRNA sequence
ggtatctctgtccatacttc

SEQ ID NO: 376277 - DNA, 20 bp, Artificial
  CRISPR gRNA sequence
acttctagaatccactctat

SEQ ID NO: 376278 - DNA, 20 bp, Artificial
  CRISPR gRNA sequence
tagaatccactctatcagca

SEQ ID NO: 376279 - DNA, 20 bp, Artificial
  CRISPR gRNA sequence
tccactctatcagcatagtc

SEQ ID NO: 376280 - DNA, 20 bp, Artificial
  CRISPR gRNA sequence
actctatcagcatagtccag

SEQ ID NO: 376281 - DNA, 20 bp, Artificial
  CRISPR gRNA sequence
gcatagtccagaagaatacc

SEQ ID NO: 376282 - DNA, 20 bp, Artificial
  CRISPR gRNA sequence
tagtccagaagaatacctgg

SEQ ID NO: 376283 - DNA, 20 bp, Artificial
  CRISPR gRNA sequence
tccagaagaatacctggcag

SEQ ID NO: 376284 - DNA, 20 bp, Artificial
  CRISPR gRNA sequence
agaagaatacctggcagtag

SEQ ID NO: 376285 - DNA, 20 bp, Artificial
  CRISPR gRNA sequence
agtagaagaaatgaatattc

SEQ ID NO: 376286 - DNA, 20 bp, Artificial
  CRISPR gRNA sequence
tagaagaaatgaatattcaa

SEQ ID NO: 376287 - DNA, 20 bp, Artificial
  CRISPR gRNA sequence
agaagaaatgaatattcaag

SEQ ID NO: 376288 - DNA, 20 bp, Artificial
  CRISPR gRNA sequence
agaaatgaatattcaagagg

SEQ ID NO: 376289 - DNA, 20 bp, Artificial
  CRISPR gRNA sequence
ttcaagaggaagataaatgc

SEQ ID NO: 376290 - DNA, 20 bp, Artificial
  CRISPR gRNA sequence
caagaggaagataaatgcga

SEQ ID NO: 376291 - DNA, 20 bp, Artificial
  CRISPR gRNA sequence
aagaggaagataaatgcgag

SEQ ID NO: 376292 - DNA, 20 bp, Artificial
  CRISPR gRNA sequence
agaggaagataaatgcgaga

SEQ ID NO: 376293 - DNA, 20 bp, Artificial
  CRISPR gRNA sequence
tatttatctctcattctgta

SEQ ID NO: 376294 - DNA, 20 bp, Artificial
  CRISPR gRNA sequence
tagaattcttgccgccatcc

SEQ ID NO: 376295 - DNA, 20 bp, Artificial
  CRISPR gRNA sequence
agaattcttgccgccatccc

SEQ ID NO: 376296 - DNA, 20 bp, Artificial
  CRISPR gRNA sequence
tcttgccgccatcccaggtc

SEQ ID NO: 376297 - DNA, 20 bp, Artificial
  CRISPR gRNA sequence
cgccatcccaggtctagcct

SEQ ID NO: 376298 - DNA, 20 bp, Artificial
  CRISPR gRNA sequence
gccatcccaggtctagcctt

SEQ ID NO: 376299 - DNA, 20 bp, Artificial
  CRISPR gRNA sequence
catcccaggtctagccttag

SEQ ID NO: 376300 - DNA, 20 bp, Artificial
  CRISPR gRNA sequence
tctagccttaggagcaaatg

SEQ ID NO: 376301 - DNA, 20 bp, Artificial
  CRISPR gRNA sequence
agccttaggagcaaatgtag

SEQ ID NO: 376302 - DNA, 20 bp, Artificial
  CRISPR gRNA sequence
ttaggagcaaatgtagtaga

SEQ ID NO: 376303 - DNA, 20 bp, Artificial
  CRISPR gRNA sequence
taataaataacttaatgttt

SEQ ID NO: 376304 - DNA, 20 bp, Artificial
  CRISPR gRNA sequence
gacatattttgtctactttt

SEQ ID NO: 376305 - DNA, 20 bp, Artificial
  CRISPR gRNA sequence
taatatgtaaattctctcaa

SEQ ID NO: 376306 - DNA, 20 bp, Artificial
  CRISPR gRNA sequence
aatatgtaaattctctcaaa

SEQ ID NO: 376307 - DNA, 20 bp, Artificial
  CRISPR gRNA sequence
atatgtaaattctctcaaaa

SEQ ID NO: 376308 - DNA, 20 bp, Artificial
  CRISPR gRNA sequence
gtaaattctctcaaaagggt

SEQ ID NO: 376309 - DNA, 20 bp, Artificial
  CRISPR gRNA sequence
taaattctctcaaaagggtc

SEQ ID NO: 376310 - DNA, 20 bp, Artificial
  CRISPR gRNA sequence
tctcaaaagggtcaggcacc

SEQ ID NO: 376311 - DNA, 20 bp, Artificial
  CRISPR gRNA sequence
attttttaatgattatgtga

SEQ ID NO: 376312 - DNA, 20 bp, Artificial
  CRISPR gRNA sequence
tgaatataatataccactaa

SEQ ID NO: 376313 - DNA, 20 bp, Artificial
  CRISPR gRNA sequence
taatataccactaaaagtga

SEQ ID NO: 376314 - DNA, 20 bp, Artificial
  CRISPR gRNA sequence
ccactaaaagtgacagttga

SEQ ID NO: 376315 - DNA, 20 bp, Artificial
  CRISPR gRNA sequence
ctaaaagtgacagttgaaag

SEQ ID NO: 376316 - DNA, 20 bp, Artificial
  CRISPR gRNA sequence
aaagtgacagttgaaagtgg

SEQ ID NO: 376317 - DNA, 20 bp, Artificial
  CRISPR gRNA sequence
gacagttgaaagtggtggca

SEQ ID NO: 376318 - DNA, 20 bp, Artificial
  CRISPR gRNA sequence
acagttgaaagtggtggcat

SEQ ID NO: 376319 - DNA, 20 bp, Artificial
  CRISPR gRNA sequence
ttgaaagtggtggcatagga

SEQ ID NO: 376320 - DNA, 20 bp, Artificial
  CRISPR gRNA sequence
aaagtggtggcataggacgg

SEQ ID NO: 376321 - DNA, 20 bp, Artificial
  CRISPR gRNA sequence
aagtggtggcataggacggt

SEQ ID NO: 376322 - DNA, 20 bp, Artificial
  CRISPR gRNA sequence
agtggtggcataggacggta

SEQ ID NO: 376323 - DNA, 20 bp, Artificial
  CRISPR gRNA sequence
ggtggcataggacggtaggg

SEQ ID NO: 376324 - DNA, 20 bp, Artificial
  CRISPR gRNA sequence
aggacggtagggtagaaatt

SEQ ID NO: 376325 - DNA, 20 bp, Artificial
  CRISPR gRNA sequence
ggacggtagggtagaaattt

SEQ ID NO: 376326 - DNA, 20 bp, Artificial
  CRISPR gRNA sequence
acggtagggtagaaatttgg

SEQ ID NO: 376327 - DNA, 20 bp, Artificial
  CRISPR gRNA sequence
cggtagggtagaaatttggg

SEQ ID NO: 376328 - DNA, 20 bp, Artificial
  CRISPR gRNA sequence
ggtagggtagaaatttggga

SEQ ID NO: 376329 - DNA, 20 bp, Artificial
  CRISPR gRNA sequence
tagaaatttgggagggaaaa

SEQ ID NO: 376330 - DNA, 20 bp, Artificial
  CRISPR gRNA sequence
ttgggagggaaaaaagaaat

SEQ ID NO: 376331 - DNA, 20 bp, Artificial
  CRISPR gRNA sequence
tgggagggaaaaaagaaatt

SEQ ID NO: 376332 - DNA, 20 bp, Artificial
  CRISPR gRNA sequence
ggagggaaaaaagaaattgg

SEQ ID NO: 376333 - DNA, 20 bp, Artificial
  CRISPR gRNA sequence
gagggaaaaaagaaattggg

SEQ ID NO: 376334 - DNA, 20 bp, Artificial
  CRISPR gRNA sequence
agggaaaaaagaaattggga

SEQ ID NO: 376335 - DNA, 20 bp, Artificial
  CRISPR gRNA sequence
aaaaagaaattgggagggta

SEQ ID NO: 376336 - DNA, 20 bp, Artificial
  CRISPR gRNA sequence
aaaagaaattgggagggtac

SEQ ID NO: 376337 - DNA, 20 bp, Artificial
  CRISPR gRNA sequence
aattgggagggtacaggcaa

SEQ ID NO: 376338 - DNA, 20 bp, Artificial
  CRISPR gRNA sequence
attgggagggtacaggcaac

SEQ ID NO: 376339 - DNA, 20 bp, Artificial
  CRISPR gRNA sequence
tgggagggtacaggcaacag

SEQ ID NO: 376340 - DNA, 20 bp, Artificial
  CRISPR gRNA sequence
agggtacaggcaacaggaga

SEQ ID NO: 376341 - DNA, 20 bp, Artificial
  CRISPR gRNA sequence
gggtacaggcaacaggagaa

SEQ ID NO: 376342 - DNA, 20 bp, Artificial
  CRISPR gRNA sequence
aggagaaaggaatcaaacca

SEQ ID NO: 376343 - DNA, 20 bp, Artificial
  CRISPR gRNA sequence
tcaaaccacagaaaaataca

SEQ ID NO: 376344 - DNA, 20 bp, Artificial
  CRISPR gRNA sequence
caaaccacagaaaaatacaa

SEQ ID NO: 376345 - DNA, 20 bp, Artificial
  CRISPR gRNA sequence
aaaccacagaaaaatacaaa

SEQ ID NO: 376346 - DNA, 20 bp, Artificial
  CRISPR gRNA sequence
gaaacttctgcttcactatt

SEQ ID NO: 376347 - DNA, 20 bp, Artificial
  CRISPR gRNA sequence
tctgcttcactattcagaca

SEQ ID NO: 376348 - DNA, 20 bp, Artificial
  CRISPR gRNA sequence
cttcactattcagacaaaga

SEQ ID NO: 376349 - DNA, 20 bp, Artificial
  CRISPR gRNA sequence
agccctaatgacatcaccaa

SEQ ID NO: 376350 - DNA, 20 bp, Artificial
  CRISPR gRNA sequence
aatgacatcaccaacagtca

SEQ ID NO: 376351 - DNA, 20 bp, Artificial
  CRISPR gRNA sequence
tcaccaacagtcaaagcaat

SEQ ID NO: 376352 - DNA, 20 bp, Artificial
  CRISPR gRNA sequence
accaacagtcaaagcaatta

SEQ ID NO: 376353 - DNA, 20 bp, Artificial
  CRISPR gRNA sequence
acctaatattgtttaaattc

SEQ ID NO: 376354 - DNA, 20 bp, Artificial
  CRISPR gRNA sequence
tattgtttaaattctagatg

SEQ ID NO: 376355 - DNA, 20 bp, Artificial
  CRISPR gRNA sequence
attgtttaaattctagatgt

SEQ ID NO: 376356 - DNA, 20 bp, Artificial
  CRISPR gRNA sequence
agatgtaggctaacaatgaa

SEQ ID NO: 376357 - DNA, 20 bp, Artificial
  CRISPR gRNA sequence
caaactgaataaaactgtca

SEQ ID NO: 376358 - DNA, 20 bp, Artificial
  CRISPR gRNA sequence
aactgtcatggttaccttga

SEQ ID NO: 376359 - DNA, 20 bp, Artificial
  CRISPR gRNA sequence
actgtcatggttaccttgaa

SEQ ID NO: 376360 - DNA, 20 bp, Artificial
  CRISPR gRNA sequence
tggttaccttgaaaggacaa

SEQ ID NO: 376361 - DNA, 20 bp, Artificial
  CRISPR gRNA sequence
acaatggttattgttaaata

SEQ ID NO: 376362 - DNA, 20 bp, Artificial
  CRISPR gRNA sequence
tagtgatcattcatgtctaa

SEQ ID NO: 376363 - DNA, 20 bp, Artificial
  CRISPR gRNA sequence
agattcattatttatctcta

SEQ ID NO: 376364 - DNA, 20 bp, Artificial
  CRISPR gRNA sequence
tttatctctaaagatttcta

SEQ ID NO: 376365 - DNA, 20 bp, Artificial
  CRISPR gRNA sequence
gatttctaaagaccaccatc

SEQ ID NO: 376366 - DNA, 20 bp, Artificial
  CRISPR gRNA sequence
ctaaagaccaccatctagaa

SEQ ID NO: 376367 - DNA, 20 bp, Artificial
  CRISPR gRNA sequence
tctagaaaagattcattatg

SEQ ID NO: 376368 - DNA, 20 bp, Artificial
  CRISPR gRNA sequence
ctagaaaagattcattatga

SEQ ID NO: 376369 - DNA, 20 bp, Artificial
  CRISPR gRNA sequence
aaggctgtatttaaatatca

SEQ ID NO: 376370 - DNA, 20 bp, Artificial
  CRISPR gRNA sequence
gtatttaaatatcaaagttg

SEQ ID NO: 376371 - DNA, 20 bp, Artificial
  CRISPR gRNA sequence
cttcatgataatcttaaata

SEQ ID NO: 376372 - DNA, 20 bp, Artificial
  CRISPR gRNA sequence
atccaaattctcctgttgcc

SEQ ID NO: 376373 - DNA, 20 bp, Artificial
  CRISPR gRNA sequence
aaattctcctgttgcctaga

SEQ ID NO: 376374 - DNA, 20 bp, Artificial
  CRISPR gRNA sequence
ctgttgcctagacagattct

SEQ ID NO: 376375 - DNA, 20 bp, Artificial
  CRISPR gRNA sequence
aagatgtaatttacactttt

SEQ ID NO: 376376 - DNA, 20 bp, Artificial
  CRISPR gRNA sequence
atttacacttttaagctaat

SEQ ID NO: 376377 - DNA, 20 bp, Artificial
  CRISPR gRNA sequence
acacttttaagctaattagt

SEQ ID NO: 376378 - DNA, 20 bp, Artificial
  CRISPR gRNA sequence
tagtgagtattttatgattt

SEQ ID NO: 376379 - DNA, 20 bp, Artificial
  CRISPR gRNA sequence
tgcacttgttttgtgaatta

SEQ ID NO: 376380 - DNA, 20 bp, Artificial
  CRISPR gRNA sequence
tgttttgtgaattacagaaa

SEQ ID NO: 376381 - DNA, 20 bp, Artificial
  CRISPR gRNA sequence
ttgtgaattacagaaatggt

SEQ ID NO: 376382 - DNA, 20 bp, Artificial
  CRISPR gRNA sequence
ctgtgaattataaaatttgt

SEQ ID NO: 376383 - DNA, 20 bp, Artificial
  CRISPR gRNA sequence
gagtttcttttaaccctttt

SEQ ID NO: 376384 - DNA, 20 bp, Artificial
  CRISPR gRNA sequence
agtttcttttaacccttttc

SEQ ID NO: 376385 - DNA, 20 bp, Artificial
  CRISPR gRNA sequence
tttcttttaacccttttcag

SEQ ID NO: 376386 - DNA, 20 bp, Artificial
  CRISPR gRNA sequence
aaataaaaacgaccatttcc

SEQ ID NO: 376387 - DNA, 20 bp, Artificial
  CRISPR gRNA sequence
accatttcctggttgtgctt

SEQ ID NO: 376388 - DNA, 20 bp, Artificial
  CRISPR gRNA sequence
ggttgtgcttaagtatatgc

SEQ ID NO: 376389 - DNA, 20 bp, Artificial
  CRISPR gRNA sequence
tgtgcttaagtatatgcaag

SEQ ID NO: 376390 - DNA, 20 bp, Artificial
  CRISPR gRNA sequence
gtgcttaagtatatgcaaga

SEQ ID NO: 376391 - DNA, 20 bp, Artificial
  CRISPR gRNA sequence
tgcttaagtatatgcaagaa

SEQ ID NO: 376392 - DNA, 20 bp, Artificial
  CRISPR gRNA sequence
atttttattatgtttgctta

SEQ ID NO: 376393 - DNA, 20 bp, Artificial
  CRISPR gRNA sequence
cttaaagatctttttatacc

SEQ ID NO: 376394 - DNA, 20 bp, Artificial
  CRISPR gRNA sequence
aaatgtttccacaaatatat

SEQ ID NO: 376395 - DNA, 20 bp, Artificial
  CRISPR gRNA sequence
tattagtgtaacaaacttga

SEQ ID NO: 376396 - DNA, 20 bp, Artificial
  CRISPR gRNA sequence
attagtgtaacaaacttgaa

SEQ ID NO: 376397 - DNA, 20 bp, Artificial
  CRISPR gRNA sequence
agtgtaacaaacttgaaagg

SEQ ID NO: 376398 - DNA, 20 bp, Artificial
  CRISPR gRNA sequence
aaacttgaaaggcagtttac

SEQ ID NO: 376399 - DNA, 20 bp, Artificial
  CRISPR gRNA sequence
ttgaaaggcagtttacaaga

SEQ ID NO: 376400 - DNA, 20 bp, Artificial
  CRISPR gRNA sequence
acaagaaagcactctactat

SEQ ID NO: 376401 - DNA, 20 bp, Artificial
  CRISPR gRNA sequence
ctctactatcagatcaatca

SEQ ID NO: 376402 - DNA, 20 bp, Artificial
  CRISPR gRNA sequence
agatcaatcaaagattctgt

SEQ ID NO: 376403 - DNA, 20 bp, Artificial
  CRISPR gRNA sequence
gattctgtgagtgaatttat

SEQ ID NO: 376404 - DNA, 20 bp, Artificial
  CRISPR gRNA sequence
agtgaatttattggtttgca

SEQ ID NO: 376405 - DNA, 20 bp, Artificial
  CRISPR gRNA sequence
atttattggtttgcatggtg

SEQ ID NO: 376406 - DNA, 20 bp, Artificial
  CRISPR gRNA sequence
attggtttgcatggtgaagc

SEQ ID NO: 376407 - DNA, 20 bp, Artificial
  CRISPR gRNA sequence
tttgcatggtgaagcaagct

SEQ ID NO: 376408 - DNA, 20 bp, Artificial
  CRISPR gRNA sequence
gcaagcttagcatcaattaa

SEQ ID NO: 376409 - DNA, 20 bp, Artificial
  CRISPR gRNA sequence
caagcttagcatcaattaaa

SEQ ID NO: 376410 - DNA, 20 bp, Artificial
  CRISPR gRNA sequence
taaataatttcttttctgaa

SEQ ID NO: 376411 - DNA, 20 bp, Artificial
  CRISPR gRNA sequence
aatttcttttctgaatggta

SEQ ID NO: 376412 - DNA, 20 bp, Artificial
  CRISPR gRNA sequence
acaatcaaaatattactttc

SEQ ID NO: 376413 - DNA, 20 bp, Artificial
  CRISPR gRNA sequence
ataaccaaattctcaatgat

SEQ ID NO: 376414 - DNA, 20 bp, Artificial
  CRISPR gRNA sequence
tctcaatgattagtgtatgt

SEQ ID NO: 376415 - DNA, 20 bp, Artificial
  CRISPR gRNA sequence
caatgattagtgtatgtgag

SEQ ID NO: 376416 - DNA, 20 bp, Artificial
  CRISPR gRNA sequence
aatgattagtgtatgtgagc

SEQ ID NO: 376417 - DNA, 20 bp, Artificial
  CRISPR gRNA sequence
tgagcaggaaaacattttta

SEQ ID NO: 376418 - DNA, 20 bp, Artificial
  CRISPR gRNA sequence
ggaaaacatttttacagttg

SEQ ID NO: 376419 - DNA, 20 bp, Artificial
  CRISPR gRNA sequence
acatttttacagttgtagta

SEQ ID NO: 376420 - DNA, 20 bp, Artificial
  CRISPR gRNA sequence
catttttacagttgtagtat

SEQ ID NO: 376421 - DNA, 20 bp, Artificial
  CRISPR gRNA sequence
atttttacagttgtagtatg

SEQ ID NO: 376422 - DNA, 20 bp, Artificial
  CRISPR gRNA sequence
ggaaatataaatccaatttt

SEQ ID NO: 376423 - DNA, 20 bp, Artificial
  CRISPR gRNA sequence
aaatataaatccaattttaa

SEQ ID NO: 376424 - DNA, 20 bp, Artificial
  CRISPR gRNA sequence
atataaatccaattttaaga

SEQ ID NO: 376425 - DNA, 20 bp, Artificial
  CRISPR gRNA sequence
ttaagagagaaaattatgac

SEQ ID NO: 376426 - DNA, 20 bp, Artificial
  CRISPR gRNA sequence
taagagagaaaattatgact

SEQ ID NO: 376427 - DNA, 20 bp, Artificial
  CRISPR gRNA sequence
gagaaaattatgactgggtg

SEQ ID NO: 376428 - DNA, 20 bp, Artificial
  CRISPR gRNA sequence
aaaattatgactgggtgtgg

SEQ ID NO: 376429 - DNA, 20 bp, Artificial
  CRISPR gRNA sequence
aaattatgactgggtgtgga

SEQ ID NO: 376430 - DNA, 20 bp, Artificial
  CRISPR gRNA sequence
aattatgactgggtgtggaa

SEQ ID NO: 376431 - DNA, 20 bp, Artificial
  CRISPR gRNA sequence
atgactgggtgtggaaggga

SEQ ID NO: 376432 - DNA, 20 bp, Artificial
  CRISPR gRNA sequence
tgggtgtggaagggacagta

SEQ ID NO: 376433 - DNA, 20 bp, Artificial
  CRISPR gRNA sequence
tgtggaagggacagtatagt

SEQ ID NO: 376434 - DNA, 20 bp, Artificial
  CRISPR gRNA sequence
atagtcagataccattgtca

SEQ ID NO: 376435 - DNA, 20 bp, Artificial
  CRISPR gRNA sequence
gtcagataccattgtcatgg

SEQ ID NO: 376436 - DNA, 20 bp, Artificial
  CRISPR gRNA sequence
attgtcatggtggtttttac

SEQ ID NO: 376437 - DNA, 20 bp, Artificial
  CRISPR gRNA sequence
ttgtcatggtggtttttact

SEQ ID NO: 376438 - DNA, 20 bp, Artificial
  CRISPR gRNA sequence
ttttactgggaacttcatga

SEQ ID NO: 376439 - DNA, 20 bp, Artificial
  CRISPR gRNA sequence
aacttcatgaaagacttttg

SEQ ID NO: 376440 - DNA, 20 bp, Artificial
  CRISPR gRNA sequence
acttttgtagcaaaccactg

SEQ ID NO: 376441 - DNA, 20 bp, Artificial
  CRISPR gRNA sequence
caaaccactgcagtattgca

SEQ ID NO: 376442 - DNA, 20 bp, Artificial
  CRISPR gRNA sequence
ctgcagtattgcaaagcctc

SEQ ID NO: 376443 - DNA, 20 bp, Artificial
  CRISPR gRNA sequence
tgcaaagcctccagaacatt

SEQ ID NO: 376444 - DNA, 20 bp, Artificial
  CRISPR gRNA sequence
cttgtgtgtgtttgtgtttt

SEQ ID NO: 376445 - DNA, 20 bp, Artificial
  CRISPR gRNA sequence
ctctcattcaaaatattgat

SEQ ID NO: 376446 - DNA, 20 bp, Artificial
  CRISPR gRNA sequence
ctctatatattcttcctcta

SEQ ID NO: 376447 - DNA, 20 bp, Artificial
  CRISPR gRNA sequence
ctatatattcttcctctaca

SEQ ID NO: 376448 - DNA, 20 bp, Artificial
  CRISPR gRNA sequence
tattcttcctctacagagtg

SEQ ID NO: 376449 - DNA, 20 bp, Artificial
  CRISPR gRNA sequence
attcttcctctacagagtgt

SEQ ID NO: 376450 - DNA, 20 bp, Artificial
  CRISPR gRNA sequence
ttcttcctctacagagtgta

SEQ ID NO: 376451 - DNA, 20 bp, Artificial
  CRISPR gRNA sequence
tacagagtgtagggtttttt

SEQ ID NO: 376452 - DNA, 20 bp, Artificial
  CRISPR gRNA sequence
acagagtgtagggttttttc

SEQ ID NO: 376453 - DNA, 20 bp, Artificial
  CRISPR gRNA sequence
gtagggttttttcaggaatt

SEQ ID NO: 376454 - DNA, 20 bp, Artificial
  CRISPR gRNA sequence
agggttttttcaggaatttg

SEQ ID NO: 376455 - DNA, 20 bp, Artificial
  CRISPR gRNA sequence
caggaatttggagccatctg

SEQ ID NO: 376456 - DNA, 20 bp, Artificial
  CRISPR gRNA sequence
tgatgctcctgttataccct

SEQ ID NO: 376457 - DNA, 20 bp, Artificial
  CRISPR gRNA sequence
gatgctcctgttataccctc

SEQ ID NO: 376458 - DNA, 20 bp, Artificial
  CRISPR gRNA sequence
atgctcctgttataccctca

SEQ ID NO: 376459 - DNA, 20 bp, Artificial
  CRISPR gRNA sequence
tgctcctgttataccctcag

SEQ ID NO: 376460 - DNA, 20 bp, Artificial
  CRISPR gRNA sequence
attcattcattttctttctc

SEQ ID NO: 376461 - DNA, 20 bp, Artificial
  CRISPR gRNA sequence
ctggacatctttacttacca

SEQ ID NO: 376462 - DNA, 20 bp, Artificial
  CRISPR gRNA sequence
acatcattcttaattcgtga

SEQ ID NO: 376463 - DNA, 20 bp, Artificial
  CRISPR gRNA sequence
ttcttaattcgtgatagttt

SEQ ID NO: 376464 - DNA, 20 bp, Artificial
  CRISPR gRNA sequence
tcttaattcgtgatagtttt

SEQ ID NO: 376465 - DNA, 20 bp, Artificial
  CRISPR gRNA sequence
gatagttttgggactctccc

SEQ ID NO: 376466 - DNA, 20 bp, Artificial
  CRISPR gRNA sequence
ctatgattctgattgttact

SEQ ID NO: 376467 - DNA, 20 bp, Artificial
  CRISPR gRNA sequence
gattctgattgttactaaga

SEQ ID NO: 376468 - DNA, 20 bp, Artificial
  CRISPR gRNA sequence
tctgattgttactaagaaag

SEQ ID NO: 376469 - DNA, 20 bp, Artificial
  CRISPR gRNA sequence
ctaagaaagcagatgaaaaa

SEQ ID NO: 376470 - DNA, 20 bp, Artificial
  CRISPR gRNA sequence
gcagatgaaaaacagatcca

SEQ ID NO: 376471 - DNA, 20 bp, Artificial
  CRISPR gRNA sequence
agatccacagaataaacgat

SEQ ID NO: 376472 - DNA, 20 bp, Artificial
  CRISPR gRNA sequence
agaataaacgatcagaattc

SEQ ID NO: 376473 - DNA, 20 bp, Artificial
  CRISPR gRNA sequence
agtaaattctattttaaata

SEQ ID NO: 376474 - DNA, 20 bp, Artificial
  CRISPR gRNA sequence
taaatacagatactttttac

SEQ ID NO: 376475 - DNA, 20 bp, Artificial
  CRISPR gRNA sequence
ctttttacaagttgctgctt

SEQ ID NO: 376476 - DNA, 20 bp, Artificial
  CRISPR gRNA sequence
tttacaagttgctgctttgg

SEQ ID NO: 376477 - DNA, 20 bp, Artificial
  CRISPR gRNA sequence
ttggaagcaaaatgcttctt

SEQ ID NO: 376478 - DNA, 20 bp, Artificial
  CRISPR gRNA sequence
acacatataatttatatcga

SEQ ID NO: 376479 - DNA, 20 bp, Artificial
  CRISPR gRNA sequence
atatcgatggataatacatt

SEQ ID NO: 376480 - DNA, 20 bp, Artificial
  CRISPR gRNA sequence
tgccattaatatttatgtta

SEQ ID NO: 376481 - DNA, 20 bp, Artificial
  CRISPR gRNA sequence
tatgttaaagtaaccaatga

SEQ ID NO: 376482 - DNA, 20 bp, Artificial
  CRISPR gRNA sequence
atgttaaagtaaccaatgaa

SEQ ID NO: 376483 - DNA, 20 bp, Artificial
  CRISPR gRNA sequence
ggaaattactttgttataat

SEQ ID NO: 376484 - DNA, 20 bp, Artificial
  CRISPR gRNA sequence
attactttgttataataaga

SEQ ID NO: 376485 - DNA, 20 bp, Artificial
  CRISPR gRNA sequence
ttactttgttataataagat

SEQ ID NO: 376486 - DNA, 20 bp, Artificial
  CRISPR gRNA sequence
ctttgttataataagatagg

SEQ ID NO: 376487 - DNA, 20 bp, Artificial
  CRISPR gRNA sequence
aagataggaagacttgttaa

SEQ ID NO: 376488 - DNA, 20 bp, Artificial
  CRISPR gRNA sequence
gataggaagacttgttaatg

SEQ ID NO: 376489 - DNA, 20 bp, Artificial
  CRISPR gRNA sequence
agacttgttaatggagtaca

SEQ ID NO: 376490 - DNA, 20 bp, Artificial
  CRISPR gRNA sequence
aatggagtacacagttttgt

SEQ ID NO: 376491 - DNA, 20 bp, Artificial
  CRISPR gRNA sequence
atggagtacacagttttgtc

SEQ ID NO: 376492 - DNA, 20 bp, Artificial
  CRISPR gRNA sequence
tggagtacacagttttgtca

SEQ ID NO: 376493 - DNA, 20 bp, Artificial
  CRISPR gRNA sequence
gtacacagttttgtcaggga

SEQ ID NO: 376494 - DNA, 20 bp, Artificial
  CRISPR gRNA sequence
tgcattgactatattattat

SEQ ID NO: 376495 - DNA, 20 bp, Artificial
  CRISPR gRNA sequence
cattgactatattattataa

SEQ ID NO: 376496 - DNA, 20 bp, Artificial
  CRISPR gRNA sequence
ataccttcaaactttattta

SEQ ID NO: 376497 - DNA, 20 bp, Artificial
  CRISPR gRNA sequence
aaactttatttaaagaactt

SEQ ID NO: 376498 - DNA, 20 bp, Artificial
  CRISPR gRNA sequence
aactttatttaaagaacttt

SEQ ID NO: 376499 - DNA, 20 bp, Artificial
  CRISPR gRNA sequence
aactttaggtataatatgtt

SEQ ID NO: 376500 - DNA, 20 bp, Artificial
  CRISPR gRNA sequence
aatatgttgagaaaataaaa

SEQ ID NO: 376501 - DNA, 20 bp, Artificial
  CRISPR gRNA sequence
acttgtaatcatgcttaaaa

SEQ ID NO: 376502 - DNA, 20 bp, Artificial
  CRISPR gRNA sequence
cttgtaatcatgcttaaaat

SEQ ID NO: 376503 - DNA, 20 bp, Artificial
  CRISPR gRNA sequence
tgtaatcatgcttaaaatgg

SEQ ID NO: 376504 - DNA, 20 bp, Artificial
  CRISPR gRNA sequence
gtaatcatgcttaaaatggg

SEQ ID NO: 376505 - DNA, 20 bp, Artificial
  CRISPR gRNA sequence
atcatgcttaaaatgggagg

SEQ ID NO: 376506 - DNA, 20 bp, Artificial
  CRISPR gRNA sequence
tcatgcttaaaatgggaggc

SEQ ID NO: 376507 - DNA, 20 bp, Artificial
  CRISPR gRNA sequence
tgcttaaaatgggaggcagg

SEQ ID NO: 376508 - DNA, 20 bp, Artificial
  CRISPR gRNA sequence
gcttaaaatgggaggcaggt

SEQ ID NO: 376509 - DNA, 20 bp, Artificial
  CRISPR gRNA sequence
aaatgggaggcaggtaggtg

SEQ ID NO: 376510 - DNA, 20 bp, Artificial
  CRISPR gRNA sequence
gtaggtgaagatataatttt

SEQ ID NO: 376511 - DNA, 20 bp, Artificial
  CRISPR gRNA sequence
aaaactccaatttatgtttt

SEQ ID NO: 376512 - DNA, 20 bp, Artificial
  CRISPR gRNA sequence
aatttatgttttaagtaatt

SEQ ID NO: 376513 - DNA, 20 bp, Artificial
  CRISPR gRNA sequence
atatataaacttaaaataca

SEQ ID NO: 376514 - DNA, 20 bp, Artificial
  CRISPR gRNA sequence
tatataaacttaaaatacat

SEQ ID NO: 376515 - DNA, 20 bp, Artificial
  CRISPR gRNA sequence
tacatgggttatcaatttaa

SEQ ID NO: 376516 - DNA, 20 bp, Artificial
  CRISPR gRNA sequence
ggttatcaatttaaaagaca

SEQ ID NO: 376517 - DNA, 20 bp, Artificial
  CRISPR gRNA sequence
atcaatttaaaagacaaagt

SEQ ID NO: 376518 - DNA, 20 bp, Artificial
  CRISPR gRNA sequence
aaagtaagtaaaaatacttt

SEQ ID NO: 376519 - DNA, 20 bp, Artificial
  CRISPR gRNA sequence
gtaagtaaaaatacttttag

SEQ ID NO: 376520 - DNA, 20 bp, Artificial
  CRISPR gRNA sequence
taagtaaaaatacttttagt

SEQ ID NO: 376521 - DNA, 20 bp, Artificial
  CRISPR gRNA sequence
atacttttagtaggcattcg

SEQ ID NO: 376522 - DNA, 20 bp, Artificial
  CRISPR gRNA sequence
ttcgtggattgtgaacatcc

SEQ ID NO: 376523 - DNA, 20 bp, Artificial
  CRISPR gRNA sequence
tgtgaacatccaagttatat

SEQ ID NO: 376524 - DNA, 20 bp, Artificial
  CRISPR gRNA sequence
ccaagttatattggtttgta

SEQ ID NO: 376525 - DNA, 20 bp, Artificial
  CRISPR gRNA sequence
ttatattggtttgtatagaa

SEQ ID NO: 376526 - DNA, 20 bp, Artificial
  CRISPR gRNA sequence
ggtttgtatagaatggcatt

SEQ ID NO: 376527 - DNA, 20 bp, Artificial
  CRISPR gRNA sequence
atggcattaagtaaaaatta

SEQ ID NO: 376528 - DNA, 20 bp, Artificial
  CRISPR gRNA sequence
taaaaattacagctgtataa

SEQ ID NO: 376529 - DNA, 20 bp, Artificial
  CRISPR gRNA sequence
aaattacagctgtataacag

SEQ ID NO: 376530 - DNA, 20 bp, Artificial
  CRISPR gRNA sequence
taacagtagttttctaaatt

SEQ ID NO: 376531 - DNA, 20 bp, Artificial
  CRISPR gRNA sequence
acagtagttttctaaattga

SEQ ID NO: 376532 - DNA, 20 bp, Artificial
  CRISPR gRNA sequence
agtagttttctaaattgaga

SEQ ID NO: 376533 - DNA, 20 bp, Artificial
  CRISPR gRNA sequence
gagagagtccacattgtaat

SEQ ID NO: 376534 - DNA, 20 bp, Artificial
  CRISPR gRNA sequence
gagagtccacattgtaatta

SEQ ID NO: 376535 - DNA, 20 bp, Artificial
  CRISPR gRNA sequence
gtactgcttatatgaaattt

SEQ ID NO: 376536 - DNA, 20 bp, Artificial
  CRISPR gRNA sequence
tgcttatatgaaatttcagc

SEQ ID NO: 376537 - DNA, 20 bp, Artificial
  CRISPR gRNA sequence
gcaagattgacgatattata

SEQ ID NO: 376538 - DNA, 20 bp, Artificial
  CRISPR gRNA sequence
atattataaagatgcttata

SEQ ID NO: 376539 - DNA, 20 bp, Artificial
  CRISPR gRNA sequence
taaagatgcttataaagtgt

SEQ ID NO: 376540 - DNA, 20 bp, Artificial
  CRISPR gRNA sequence
agatgcttataaagtgtaag

SEQ ID NO: 376541 - DNA, 20 bp, Artificial
  CRISPR gRNA sequence
atgcttataaagtgtaagtg

SEQ ID NO: 376542 - DNA, 20 bp, Artificial
  CRISPR gRNA sequence
aagtggagacgctaaattgt

SEQ ID NO: 376543 - DNA, 20 bp, Artificial
  CRISPR gRNA sequence
gacgctaaattgtgagtaca

SEQ ID NO: 376544 - DNA, 20 bp, Artificial
  CRISPR gRNA sequence
acaaagtttctttttcacaa

SEQ ID NO: 376545 - DNA, 20 bp, Artificial
  CRISPR gRNA sequence
ttctttttcacaacagtgat

SEQ ID NO: 376546 - DNA, 20 bp, Artificial
  CRISPR gRNA sequence
aaaatatctttaaaaaatat

SEQ ID NO: 376547 - DNA, 20 bp, Artificial
  CRISPR gRNA sequence
caatataaacatgtcatcat

SEQ ID NO: 376548 - DNA, 20 bp, Artificial
  CRISPR gRNA sequence
taaacatgtcatcattagtt

SEQ ID NO: 376549 - DNA, 20 bp, Artificial
  CRISPR gRNA sequence
tactattaaaatgtaacatc

SEQ ID NO: 376550 - DNA, 20 bp, Artificial
  CRISPR gRNA sequence
attaaaatgtaacatctaga

SEQ ID NO: 376551 - DNA, 20 bp, Artificial
  CRISPR gRNA sequence
aaagtactgatctccacctt

SEQ ID NO: 376552 - DNA, 20 bp, Artificial
  CRISPR gRNA sequence
ccaccttcagacttctgtat

SEQ ID NO: 376553 - DNA, 20 bp, Artificial
  CRISPR gRNA sequence
tttttcactgatctgttcat

SEQ ID NO: 376554 - DNA, 20 bp, Artificial
  CRISPR gRNA sequence
tttcactgatctgttcatta

SEQ ID NO: 376555 - DNA, 20 bp, Artificial
  CRISPR gRNA sequence
tctgttcattagagttcttc

SEQ ID NO: 376556 - DNA, 20 bp, Artificial
  CRISPR gRNA sequence
tcattagagttcttccagcc

SEQ ID NO: 376557 - DNA, 20 bp, Artificial
  CRISPR gRNA sequence
agttcttccagccaagactc

SEQ ID NO: 376558 - DNA, 20 bp, Artificial
  CRISPR gRNA sequence
gttcttccagccaagactct

SEQ ID NO: 376559 - DNA, 20 bp, Artificial
  CRISPR gRNA sequence
tgtatctgaaaactaaaaac

SEQ ID NO: 376560 - DNA, 20 bp, Artificial
  CRISPR gRNA sequence
aaacaagttaatttttttaa

SEQ ID NO: 376561 - DNA, 20 bp, Artificial
  CRISPR gRNA sequence
tttaaaagcttctctatttc

SEQ ID NO: 376562 - DNA, 20 bp, Artificial
  CRISPR gRNA sequence
ctctatttctagtgattcaa

SEQ ID NO: 376563 - DNA, 20 bp, Artificial
  CRISPR gRNA sequence
tctatttctagtgattcaat

SEQ ID NO: 376564 - DNA, 20 bp, Artificial
  CRISPR gRNA sequence
atttctagtgattcaatagg

SEQ ID NO: 376565 - DNA, 20 bp, Artificial
  CRISPR gRNA sequence
tgattcaataggtagaaaaa

SEQ ID NO: 376566 - DNA, 20 bp, Artificial
  CRISPR gRNA sequence
ataggtagaaaaatagcttc

SEQ ID NO: 376567 - DNA, 20 bp, Artificial
  CRISPR gRNA sequence
aattaactgcaatgctttct

SEQ ID NO: 376568 - DNA, 20 bp, Artificial
  CRISPR gRNA sequence
attaactgcaatgctttcta

SEQ ID NO: 376569 - DNA, 20 bp, Artificial
  CRISPR gRNA sequence
aggaaattttataaatcctc

SEQ ID NO: 376570 - DNA, 20 bp, Artificial
  CRISPR gRNA sequence
ggaaattttataaatcctca

SEQ ID NO: 376571 - DNA, 20 bp, Artificial
  CRISPR gRNA sequence
attttataaatcctcaaggt

SEQ ID NO: 376572 - DNA, 20 bp, Artificial
  CRISPR gRNA sequence
tcggtttacacatatttttc

SEQ ID NO: 376573 - DNA, 20 bp, Artificial
  CRISPR gRNA sequence
tacacatatttttccagatt

SEQ ID NO: 376574 - DNA, 20 bp, Artificial
  CRISPR gRNA sequence
cacatatttttccagattca

SEQ ID NO: 376575 - DNA, 20 bp, Artificial
  CRISPR gRNA sequence
cagagcactaactatcttgt

SEQ ID NO: 376576 - DNA, 20 bp, Artificial
  CRISPR gRNA sequence
ctaactatcttgtaagatgt

SEQ ID NO: 376577 - DNA, 20 bp, Artificial
  CRISPR gRNA sequence
tatcttgtaagatgtaagaa

SEQ ID NO: 376578 - DNA, 20 bp, Artificial
  CRISPR gRNA sequence
atcttgtaagatgtaagaaa

SEQ ID NO: 376579 - DNA, 20 bp, Artificial
  CRISPR gRNA sequence
gatgtaagaaaaggtccatt

SEQ ID NO: 376580 - DNA, 20 bp, Artificial
  CRISPR gRNA sequence
gtaagaaaaggtccatttgg

SEQ ID NO: 376581 - DNA, 20 bp, Artificial
  CRISPR gRNA sequence
aaaggtccatttggaagtat

SEQ ID NO: 376582 - DNA, 20 bp, Artificial
  CRISPR gRNA sequence
aagtatgagtaataaatgtc

SEQ ID NO: 376583 - DNA, 20 bp, Artificial
  CRISPR gRNA sequence
agtatgagtaataaatgtct

SEQ ID NO: 376584 - DNA, 20 bp, Artificial
  CRISPR gRNA sequence
ataaatgtctgggataattc

SEQ ID NO: 376585 - DNA, 20 bp, Artificial
  CRISPR gRNA sequence
ttatttcgtattatccttgt

SEQ ID NO: 376586 - DNA, 20 bp, Artificial
  CRISPR gRNA sequence
cgtattatccttgttagaat

SEQ ID NO: 376587 - DNA, 20 bp, Artificial
  CRISPR gRNA sequence
ccttgttagaataagttata

SEQ ID NO: 376588 - DNA, 20 bp, Artificial
  CRISPR gRNA sequence
agttatatggtcaacctgtt

SEQ ID NO: 376589 - DNA, 20 bp, Artificial
  CRISPR gRNA sequence
cctgttcagaacactttttc

SEQ ID NO: 376590 - DNA, 20 bp, Artificial
  CRISPR gRNA sequence
cagaacactttttctagtgt

SEQ ID NO: 376591 - DNA, 20 bp, Artificial
  CRISPR gRNA sequence
ctagtgttagtgtgtacttt

SEQ ID NO: 376592 - DNA, 20 bp, Artificial
  CRISPR gRNA sequence
agtgtgtacttttggatttt

SEQ ID NO: 376593 - DNA, 20 bp, Artificial
  CRISPR gRNA sequence
ttttggatttttggttcttg

SEQ ID NO: 376594 - DNA, 20 bp, Artificial
  CRISPR gRNA sequence
tttggatttttggttcttgt

SEQ ID NO: 376595 - DNA, 20 bp, Artificial
  CRISPR gRNA sequence
ttggatttttggttcttgta

SEQ ID NO: 376596 - DNA, 20 bp, Artificial
  CRISPR gRNA sequence
tttttggttcttgtagggta

SEQ ID NO: 376597 - DNA, 20 bp, Artificial
  CRISPR gRNA sequence
atcactactttcatttgcca

SEQ ID NO: 376598 - DNA, 20 bp, Artificial
  CRISPR gRNA sequence
cactactttcatttgccatg

SEQ ID NO: 376599 - DNA, 20 bp, Artificial
  CRISPR gRNA sequence
tttcatttgccatggagaaa

SEQ ID NO: 376600 - DNA, 20 bp, Artificial
  CRISPR gRNA sequence
catttgccatggagaaatag

SEQ ID NO: 376601 - DNA, 20 bp, Artificial
  CRISPR gRNA sequence
atttgccatggagaaatagc

SEQ ID NO: 376602 - DNA, 20 bp, Artificial
  CRISPR gRNA sequence
tttgccatggagaaatagca

SEQ ID NO: 376603 - DNA, 20 bp, Artificial
  CRISPR gRNA sequence
atagcagggaaaaatttcta

SEQ ID NO: 376604 - DNA, 20 bp, Artificial
  CRISPR gRNA sequence
attaactgatgaattacatg

SEQ ID NO: 376605 - DNA, 20 bp, Artificial
  CRISPR gRNA sequence
tattttattattattttttt

SEQ ID NO: 376606 - DNA, 20 bp, Artificial
  CRISPR gRNA sequence
ttattattatttttttgaga

SEQ ID NO: 376607 - DNA, 20 bp, Artificial
  CRISPR gRNA sequence
attattatttttttgagacg

SEQ ID NO: 376608 - DNA, 20 bp, Artificial
  CRISPR gRNA sequence
ggagtttcacttttgttgcc

SEQ ID NO: 376609 - DNA, 20 bp, Artificial
  CRISPR gRNA sequence
gagtttcacttttgttgccc

SEQ ID NO: 376610 - DNA, 20 bp, Artificial
  CRISPR gRNA sequence
ttcacttttgttgcccgggc

SEQ ID NO: 376611 - DNA, 20 bp, Artificial
  CRISPR gRNA sequence
cacttttgttgcccgggctg

SEQ ID NO: 376612 - DNA, 20 bp, Artificial
  CRISPR gRNA sequence
ttgcccgggctggagtgcaa

SEQ ID NO: 376613 - DNA, 20 bp, Artificial
  CRISPR gRNA sequence
ggagtgcaatggcacaatct

SEQ ID NO: 376614 - DNA, 20 bp, Artificial
  CRISPR gRNA sequence
tcaccacaacctctgcctcc

SEQ ID NO: 376615 - DNA, 20 bp, Artificial
  CRISPR gRNA sequence
aacctctgcctcccggattc

SEQ ID NO: 376616 - DNA, 20 bp, Artificial
  CRISPR gRNA sequence
ttcaagtgattctcctgcct

SEQ ID NO: 376617 - DNA, 20 bp, Artificial
  CRISPR gRNA sequence
tcctgcctcagcctcctgaa

SEQ ID NO: 376618 - DNA, 20 bp, Artificial
  CRISPR gRNA sequence
gcctcagcctcctgaatagc

SEQ ID NO: 376619 - DNA, 20 bp, Artificial
  CRISPR gRNA sequence
cctcagcctcctgaatagct

SEQ ID NO: 376620 - DNA, 20 bp, Artificial
  CRISPR gRNA sequence
ctcctgaatagctgggatta

SEQ ID NO: 376621 - DNA, 20 bp, Artificial
  CRISPR gRNA sequence
tcctgaatagctgggattac

SEQ ID NO: 376622 - DNA, 20 bp, Artificial
  CRISPR gRNA sequence
caggcatatgccaacatgcc

SEQ ID NO: 376623 - DNA, 20 bp, Artificial
  CRISPR gRNA sequence
cctggctaattttgtatttt

SEQ ID NO: 376624 - DNA, 20 bp, Artificial
  CRISPR gRNA sequence
ggctaattttgtatttttag

SEQ ID NO: 376625 - DNA, 20 bp, Artificial
  CRISPR gRNA sequence
ctaattttgtatttttagtg

SEQ ID NO: 376626 - DNA, 20 bp, Artificial
  CRISPR gRNA sequence
ttttgtatttttagtggaga

SEQ ID NO: 376627 - DNA, 20 bp, Artificial
  CRISPR gRNA sequence
tttgtatttttagtggagac

SEQ ID NO: 376628 - DNA, 20 bp, Artificial
  CRISPR gRNA sequence
ttgtatttttagtggagacg

SEQ ID NO: 376629 - DNA, 20 bp, Artificial
  CRISPR gRNA sequence
gagacggggtttctccacgt

SEQ ID NO: 376630 - DNA, 20 bp, Artificial
  CRISPR gRNA sequence
cggggtttctccacgttggt

SEQ ID NO: 376631 - DNA, 20 bp, Artificial
  CRISPR gRNA sequence
gtcagacttgtcttgaactc

SEQ ID NO: 376632 - DNA, 20 bp, Artificial
  CRISPR gRNA sequence
ttgtcttgaactctggacct

SEQ ID NO: 376633 - DNA, 20 bp, Artificial
  CRISPR gRNA sequence
tgtcttgaactctggacctc

SEQ ID NO: 376634 - DNA, 20 bp, Artificial
  CRISPR gRNA sequence
ctcaggtgatccacctgcct

SEQ ID NO: 376635 - DNA, 20 bp, Artificial
  CRISPR gRNA sequence
gcctcagcctcctaaattgc

SEQ ID NO: 376636 - DNA, 20 bp, Artificial
  CRISPR gRNA sequence
cctcagcctcctaaattgct

SEQ ID NO: 376637 - DNA, 20 bp, Artificial
  CRISPR gRNA sequence
ctcctaaattgctgggatta

SEQ ID NO: 376638 - DNA, 20 bp, Artificial
  CRISPR gRNA sequence
tcctaaattgctgggattac

SEQ ID NO: 376639 - DNA, 20 bp, Artificial
  CRISPR gRNA sequence
attgctgggattacaggcat

SEQ ID NO: 376640 - DNA, 20 bp, Artificial
  CRISPR gRNA sequence
caggcatgagcgaccactcc

SEQ ID NO: 376641 - DNA, 20 bp, Artificial
  CRISPR gRNA sequence
ccttgttctttgtattttat

SEQ ID NO: 376642 - DNA, 20 bp, Artificial
  CRISPR gRNA sequence
ttgtattttataagtgcatg

SEQ ID NO: 376643 - DNA, 20 bp, Artificial
  CRISPR gRNA sequence
ttataagtgcatgtagtgca

SEQ ID NO: 376644 - DNA, 20 bp, Artificial
  CRISPR gRNA sequence
tataagtgcatgtagtgcaa

SEQ ID NO: 376645 - DNA, 20 bp, Artificial
  CRISPR gRNA sequence
ataagtgcatgtagtgcaaa

SEQ ID NO: 376646 - DNA, 20 bp, Artificial
  CRISPR gRNA sequence
gcatgtagtgcaaagggtca

SEQ ID NO: 376647 - DNA, 20 bp, Artificial
  CRISPR gRNA sequence
catgtagtgcaaagggtcaa

SEQ ID NO: 376648 - DNA, 20 bp, Artificial
  CRISPR gRNA sequence
atgtagtgcaaagggtcaaa

SEQ ID NO: 376649 - DNA, 20 bp, Artificial
  CRISPR gRNA sequence
caaagggtcaaagggcttta

SEQ ID NO: 376650 - DNA, 20 bp, Artificial
  CRISPR gRNA sequence
aaagggtcaaagggctttac

SEQ ID NO: 376651 - DNA, 20 bp, Artificial
  CRISPR gRNA sequence
tttttgtttttcccgaaaca

SEQ ID NO: 376652 - DNA, 20 bp, Artificial
  CRISPR gRNA sequence
ttgtttttcccgaaacatag

SEQ ID NO: 376653 - DNA, 20 bp, Artificial
  CRISPR gRNA sequence
ttcctcatttttgttacctt

SEQ ID NO: 376654 - DNA, 20 bp, Artificial
  CRISPR gRNA sequence
tttatgttcacttttctgaa

SEQ ID NO: 376655 - DNA, 20 bp, Artificial
  CRISPR gRNA sequence
aatactttttttttcaattt

SEQ ID NO: 376656 - DNA, 20 bp, Artificial
  CRISPR gRNA sequence
ttagacattcattattcatt

SEQ ID NO: 376657 - DNA, 20 bp, Artificial
  CRISPR gRNA sequence
tactcttctcatgtctcttt

SEQ ID NO: 376658 - DNA, 20 bp, Artificial
  CRISPR gRNA sequence
aatatgattatatcaatatt

SEQ ID NO: 376659 - DNA, 20 bp, Artificial
  CRISPR gRNA sequence
tttatttcttatgaccttgc

SEQ ID NO: 376660 - DNA, 20 bp, Artificial
  CRISPR gRNA sequence
tatgaccttgccagtactct

SEQ ID NO: 376661 - DNA, 20 bp, Artificial
  CRISPR gRNA sequence
gtactcttagttaaactaca

SEQ ID NO: 376662 - DNA, 20 bp, Artificial
  CRISPR gRNA sequence
ttttaccatgtagtttaact

SEQ ID NO: 376663 - DNA, 20 bp, Artificial
  CRISPR gRNA sequence
atttctgaaagagacatgag

SEQ ID NO: 376664 - DNA, 20 bp, Artificial
  CRISPR gRNA sequence
tgagaagagtattttatgtg

SEQ ID NO: 376665 - DNA, 20 bp, Artificial
  CRISPR gRNA sequence
ggggagagaaagacatctaa

SEQ ID NO: 376666 - DNA, 20 bp, Artificial
  CRISPR gRNA sequence
gaaagacatctaaatgaata

SEQ ID NO: 376667 - DNA, 20 bp, Artificial
  CRISPR gRNA sequence
aagtgaacataaataaaata

SEQ ID NO: 376668 - DNA, 20 bp, Artificial
  CRISPR gRNA sequence
aaaatacaaagaacaaggcc

SEQ ID NO: 376669 - DNA, 20 bp, Artificial
  CRISPR gRNA sequence
aatttaggaggctgaggcag

SEQ ID NO: 376670 - DNA, 20 bp, Artificial
  CRISPR gRNA sequence
caggtggatcacctgaggtc

SEQ ID NO: 376671 - DNA, 20 bp, Artificial
  CRISPR gRNA sequence
tattcaggaggctgaggcag

SEQ ID NO: 376672 - DNA, 20 bp, Artificial
  CRISPR gRNA sequence
ggctgaggcaggagaatcac

SEQ ID NO: 376673 - DNA, 20 bp, Artificial
  CRISPR gRNA sequence
aattacaatgtatcattgat

SEQ ID NO: 376674 - DNA, 20 bp, Artificial
  CRISPR gRNA sequence
gttttattcattcaaaacaa

SEQ ID NO: 376675 - DNA, 20 bp, Artificial
  CRISPR gRNA sequence
accatataacttattctaac

SEQ ID NO: 376676 - DNA, 20 bp, Artificial
  CRISPR gRNA sequence
aaggataatacgaaataaac

SEQ ID NO: 376677 - DNA, 20 bp, Artificial
  CRISPR gRNA sequence
cttacaagatagttagtgct

SEQ ID NO: 376678 - DNA, 20 bp, Artificial
  CRISPR gRNA sequence
aatatgtgtaaaccgacctt

SEQ ID NO: 376679 - DNA, 20 bp, Artificial
  CRISPR gRNA sequence
agaagctatttttctaccta

SEQ ID NO: 376680 - DNA, 20 bp, Artificial
  CRISPR gRNA sequence
agatacatgttttaagagcc

SEQ ID NO: 376681 - DNA, 20 bp, Artificial
  CRISPR gRNA sequence
tctatacaaaccaatataac

SEQ ID NO: 376682 - DNA, 20 bp, Artificial
  CRISPR gRNA sequence
aacttggatgttcacaatcc

SEQ ID NO: 376683 - DNA, 20 bp, Artificial
  CRISPR gRNA sequence
tatagtattttagtaataca

SEQ ID NO: 376684 - DNA, 20 bp, Artificial
  CRISPR gRNA sequence
gaattacttaaaacataaat

SEQ ID NO: 376685 - DNA, 20 bp, Artificial
  CRISPR gRNA sequence
aaaagtatctgtatttaaaa

SEQ ID NO: 376686 - DNA, 20 bp, Artificial
  CRISPR gRNA sequence
gtatttaaaatagaatttac

SEQ ID NO: 376687 - DNA, 20 bp, Artificial
  CRISPR gRNA sequence
gaattctgatcgtttattct

SEQ ID NO: 376688 - DNA, 20 bp, Artificial
  CRISPR gRNA sequence
tctgctttcttagtaacaat

SEQ ID NO: 376689 - DNA, 20 bp, Artificial
  CRISPR gRNA sequence
aatcagaatcataggtgcaa

SEQ ID NO: 376690 - DNA, 20 bp, Artificial
  CRISPR gRNA sequence
ggggagaaacatacactagg

SEQ ID NO: 376691 - DNA, 20 bp, Artificial
  CRISPR gRNA sequence
gggagagtcccaaaactatc

SEQ ID NO: 376692 - DNA, 20 bp, Artificial
  CRISPR gRNA sequence
tcccaaaactatcacgaatt

SEQ ID NO: 376693 - DNA, 20 bp, Artificial
  CRISPR gRNA sequence
aagatgtccagagaaagaaa

SEQ ID NO: 376694 - DNA, 20 bp, Artificial
  CRISPR gRNA sequence
tgtccagagaaagaaaatga

SEQ ID NO: 376695 - DNA, 20 bp, Artificial
  CRISPR gRNA sequence
agagaaagaaaatgaatgaa

SEQ ID NO: 376696 - DNA, 20 bp, Artificial
  CRISPR gRNA sequence
atttcacaagcattacccct

SEQ ID NO: 376697 - DNA, 20 bp, Artificial
  CRISPR gRNA sequence
aggagcatcagaagacgtca

SEQ ID NO: 376698 - DNA, 20 bp, Artificial
  CRISPR gRNA sequence
aaccctacactctgtagagg

SEQ ID NO: 376699 - DNA, 20 bp, Artificial
  CRISPR gRNA sequence
aatatatagagaagaaagga

SEQ ID NO: 376700 - DNA, 20 bp, Artificial
  CRISPR gRNA sequence
aaatagttctcatcaatatt

SEQ ID NO: 376701 - DNA, 20 bp, Artificial
  CRISPR gRNA sequence
cataattttctctcttaaaa

SEQ ID NO: 376702 - DNA, 20 bp, Artificial
  CRISPR gRNA sequence
gctcacatacactaatcatt

SEQ ID NO: 376703 - DNA, 20 bp, Artificial
  CRISPR gRNA sequence
atcattgagaatttggttat

SEQ ID NO: 376704 - DNA, 20 bp, Artificial
  CRISPR gRNA sequence
caaaccaataaattcactca

SEQ ID NO: 376705 - DNA, 20 bp, Artificial
  CRISPR gRNA sequence
atctttgattgatctgatag

SEQ ID NO: 376706 - DNA, 20 bp, Artificial
  CRISPR gRNA sequence
tatatttgtggaaacatttc

SEQ ID NO: 376707 - DNA, 20 bp, Artificial
  CRISPR gRNA sequence
taagcaaacataataaaaat

SEQ ID NO: 376708 - DNA, 20 bp, Artificial
  CRISPR gRNA sequence
tttattttttcactcctgaa

SEQ ID NO: 376709 - DNA, 20 bp, Artificial
  CRISPR gRNA sequence
taaaagtgtaaattacatct

SEQ ID NO: 376710 - DNA, 20 bp, Artificial
  CRISPR gRNA sequence
agaatctgtctaggcaacag

SEQ ID NO: 376711 - DNA, 20 bp, Artificial
  CRISPR gRNA sequence
tgtctaggcaacaggagaat

SEQ ID NO: 376712 - DNA, 20 bp, Artificial
  CRISPR gRNA sequence
atttaaatacagccttcata

SEQ ID NO: 376713 - DNA, 20 bp, Artificial
  CRISPR gRNA sequence
gaaatctttagagataaata

SEQ ID NO: 376714 - DNA, 20 bp, Artificial
  CRISPR gRNA sequence
aaataatgaatcttttagac

SEQ ID NO: 376715 - DNA, 20 bp, Artificial
  CRISPR gRNA sequence
tttcattgttagcctacatc

SEQ ID NO: 376716 - DNA, 20 bp, Artificial
  CRISPR gRNA sequence
gtcattagggctgtctttgt

SEQ ID NO: 376717 - DNA, 20 bp, Artificial
  CRISPR gRNA sequence
taggtgcctgacccttttga

SEQ ID NO: 376718 - DNA, 20 bp, Artificial
  CRISPR gRNA sequence
tttgctcctaaggctagacc

SEQ ID NO: 376719 - DNA, 20 bp, Artificial
  CRISPR gRNA sequence
gctagacctgggatggcggc

SEQ ID NO: 376720 - DNA, 20 bp, Artificial
  CRISPR gRNA sequence
atggcggcaagaattctata

SEQ ID NO: 376721 - DNA, 20 bp, Artificial
  CRISPR gRNA sequence
aatgagagataaataaatat

SEQ ID NO: 376722 - DNA, 20 bp, Artificial
  CRISPR gRNA sequence
aaataaatatgagaatagta

SEQ ID NO: 376723 - DNA, 20 bp, Artificial
  CRISPR gRNA sequence
ctctcgcatttatcttcctc

SEQ ID NO: 376724 - DNA, 20 bp, Artificial
  CRISPR gRNA sequence
attcttctggactatgctga

SEQ ID NO: 376725 - DNA, 20 bp, Artificial
  CRISPR gRNA sequence
ttctggactatgctgataga

SEQ ID NO: 376726 - DNA, 20 bp, Artificial
  CRISPR gRNA sequence
ggacagagataccccatttc

SEQ ID NO: 376727 - DNA, 20 bp, Artificial
  CRISPR gRNA sequence
tttcctcttctaaccatgct

SEQ ID NO: 376728 - DNA, 20 bp, Artificial
  CRISPR gRNA sequence
actctctaccagacagaaac

SEQ ID NO: 376729 - DNA, 20 bp, Artificial
  CRISPR gRNA sequence
ccagacagaaacaaggatgt

SEQ ID NO: 376730 - DNA, 20 bp, Artificial
  CRISPR gRNA sequence
acaaggatgtatgaattgcc

SEQ ID NO: 376731 - DNA, 20 bp, Artificial
  CRISPR gRNA sequence
cacaagaggaaagcctgcat

SEQ ID NO: 376732 - DNA, 20 bp, Artificial
  CRISPR gRNA sequence
gtgaggccaagaccagggaa

SEQ ID NO: 376733 - DNA, 20 bp, Artificial
  CRISPR gRNA sequence
atggatccaacactctggaa

SEQ ID NO: 376734 - DNA, 20 bp, Artificial
  CRISPR gRNA sequence
tgcccaaagcttaatctccc

SEQ ID NO: 376735 - DNA, 20 bp, Artificial
  CRISPR gRNA sequence
tcttttgtatataaaccagt

SEQ ID NO: 376736 - DNA, 20 bp, Artificial
  CRISPR gRNA sequence
actagtatctaaggtagacc

SEQ ID NO: 376737 - DNA, 20 bp, Artificial
  CRISPR gRNA sequence
aattgcataaagatccatgc

SEQ ID NO: 376738 - DNA, 20 bp, Artificial
  CRISPR gRNA sequence
agatccatgcatgagtacat

SEQ ID NO: 376739 - DNA, 20 bp, Artificial
  CRISPR gRNA sequence
attactaatgcactcatgtc

SEQ ID NO: 376740 - DNA, 20 bp, Artificial
  CRISPR gRNA sequence
ctttggtctgcgagagaagg

SEQ ID NO: 376741 - DNA, 20 bp, Artificial
  CRISPR gRNA sequence
tatcctctcttgtatcatcc

SEQ ID NO: 376742 - DNA, 20 bp, Artificial
  CRISPR gRNA sequence
agatgggacttctatagtta

SEQ ID NO: 376743 - DNA, 20 bp, Artificial
  CRISPR gRNA sequence
gcctagaaagacaaacagca

SEQ ID NO: 376744 - DNA, 20 bp, Artificial
  CRISPR gRNA sequence
aatacttgctgtattgtgct

SEQ ID NO: 376745 - DNA, 20 bp, Artificial
  CRISPR gRNA sequence
aactagagaaaggtcttttg

SEQ ID NO: 376746 - DNA, 20 bp, Artificial
  CRISPR gRNA sequence
ccttagtgttgttggttttt

SEQ ID NO: 376747 - DNA, 20 bp, Artificial
  CRISPR gRNA sequence
tgttgttggtttttttgagt

SEQ ID NO: 376748 - DNA, 20 bp, Artificial
  CRISPR gRNA sequence
tctcgctctgttgcccaagc

SEQ ID NO: 376749 - DNA, 20 bp, Artificial
  CRISPR gRNA sequence
agcaattctgcctcagcctc

SEQ ID NO: 376750 - DNA, 20 bp, Artificial
  CRISPR gRNA sequence
gcctcagcctcacgagtagc

SEQ ID NO: 376751 - DNA, 20 bp, Artificial
  CRISPR gRNA sequence
ttttgtatttttagtagaga

SEQ ID NO: 376752 - DNA, 20 bp, Artificial
  CRISPR gRNA sequence
acctcagcctcccaaagtgt

SEQ ID NO: 376753 - DNA, 20 bp, Artificial
  CRISPR gRNA sequence
agaggttatcttttaaaaaa

SEQ ID NO: 376754 - DNA, 20 bp, Artificial
  CRISPR gRNA sequence
tctacaaaaacctgaaaaag

SEQ ID NO: 376755 - DNA, 20 bp, Artificial
  CRISPR gRNA sequence
ataaatgtgactagactggc

SEQ ID NO: 376756 - DNA, 20 bp, Artificial
  CRISPR gRNA sequence
ggcatgagtagacaaaggct

SEQ ID NO: 376757 - DNA, 20 bp, Artificial
  CRISPR gRNA sequence
caaaggctaaggatgaagaa

SEQ ID NO: 376758 - DNA, 20 bp, Artificial
  CRISPR gRNA sequence
aggcatctgatgaacacatg

SEQ ID NO: 376759 - DNA, 20 bp, Artificial
  CRISPR gRNA sequence
gtacttggcttgtggccatg

SEQ ID NO: 376760 - DNA, 20 bp, Artificial
  CRISPR gRNA sequence
tggccatgtagaattccact

SEQ ID NO: 376761 - DNA, 20 bp, Artificial
  CRISPR gRNA sequence
aaatttatatacttttggct

SEQ ID NO: 376762 - DNA, 20 bp, Artificial
  CRISPR gRNA sequence
atacttttggctaggaattg

SEQ ID NO: 376763 - DNA, 20 bp, Artificial
  CRISPR gRNA sequence
ctgtaacaaaatactgtaga

SEQ ID NO: 376764 - DNA, 20 bp, Artificial
  CRISPR gRNA sequence
tcctaacttgagaaaaaaaa

SEQ ID NO: 376765 - DNA, 20 bp, Artificial
  CRISPR gRNA sequence
aatatcatcgcattaggcat

SEQ ID NO: 376766 - DNA, 20 bp, Artificial
  CRISPR gRNA sequence
aggcattaggatttcaacat

SEQ ID NO: 376767 - DNA, 20 bp, Artificial
  CRISPR gRNA sequence
tttttgtgaaatttcataaa

SEQ ID NO: 376768 - DNA, 20 bp, Artificial
  CRISPR gRNA sequence
gaagagatttgaagtatagt

SEQ ID NO: 376769 - DNA, 20 bp, Artificial
  CRISPR gRNA sequence
actaaggggcagcagcaagg

SEQ ID NO: 376770 - DNA, 20 bp, Artificial
  CRISPR gRNA sequence
ctccaaagataataataata

SEQ ID NO: 376771 - DNA, 20 bp, Artificial
  CRISPR gRNA sequence
taaaaatattatgtcctctc

SEQ ID NO: 376772 - DNA, 20 bp, Artificial
  CRISPR gRNA sequence
atattatgtcctctcctggg

SEQ ID NO: 376773 - DNA, 20 bp, Artificial
  CRISPR gRNA sequence
aatgtgacctcatttgaaaa

SEQ ID NO: 376774 - DNA, 20 bp, Artificial
  CRISPR gRNA sequence
caaacaacgctgtgctggag

SEQ ID NO: 376775 - DNA, 20 bp, Artificial
  CRISPR gRNA sequence
gcctttaagtccaagataac

SEQ ID NO: 376776 - DNA, 20 bp, Artificial
  CRISPR gRNA sequence
gagcgatgtgtctaccagcc

SEQ ID NO: 376777 - DNA, 20 bp, Artificial
  CRISPR gRNA sequence
atcgacagctccactagaag

SEQ ID NO: 376778 - DNA, 20 bp, Artificial
  CRISPR gRNA sequence
ctagaagctggatagaagca

SEQ ID NO: 376779 - DNA, 20 bp, Artificial
  CRISPR gRNA sequence
aagctggatagaagcatggg

SEQ ID NO: 376780 - DNA, 20 bp, Artificial
  CRISPR gRNA sequence
tttcttgtacttcaaccctc

SEQ ID NO: 376781 - DNA, 20 bp, Artificial
  CRISPR gRNA sequence
tcaaccctccagaattatgg

SEQ ID NO: 376782 - DNA, 20 bp, Artificial
  CRISPR gRNA sequence
agtgttgattgttattacgc

SEQ ID NO: 376783 - DNA, 20 bp, Artificial
  CRISPR gRNA sequence
atataaaaaacttagtttca

SEQ ID NO: 376784 - DNA, 20 bp, Artificial
  CRISPR gRNA sequence
gtttcaaagggtattaaaaa

SEQ ID NO: 376785 - DNA, 20 bp, Artificial
  CRISPR gRNA sequence
tctctctctccttctccttc

SEQ ID NO: 376786 - DNA, 20 bp, Artificial
  CRISPR gRNA sequence
tctggaatgcatattcaata

SEQ ID NO: 376787 - DNA, 20 bp, Artificial
  CRISPR gRNA sequence
cagatggtgagggcaactaa

SEQ ID NO: 376788 - DNA, 20 bp, Artificial
  CRISPR gRNA sequence
taatctcagtgattttacta

SEQ ID NO: 376789 - DNA, 20 bp, Artificial
  CRISPR gRNA sequence
aatgccagcagtgtaacttc

SEQ ID NO: 376790 - DNA, 20 bp, Artificial
  CRISPR gRNA sequence
atgaagctttataaaatctt

SEQ ID NO: 376791 - DNA, 20 bp, Artificial
  CRISPR gRNA sequence
tgttattctaaatcactcgt

SEQ ID NO: 376792 - DNA, 20 bp, Artificial
  CRISPR gRNA sequence
gaaactaaggtgtgaagagg

SEQ ID NO: 376793 - DNA, 20 bp, Artificial
  CRISPR gRNA sequence
atgatcggttggtgtagtgc

SEQ ID NO: 376794 - DNA, 20 bp, Artificial
  CRISPR gRNA sequence
ctattaagctctccaacttc

SEQ ID NO: 376795 - DNA, 20 bp, Artificial
  CRISPR gRNA sequence
acccataaaaacctaaccag

SEQ ID NO: 376796 - DNA, 20 bp, Artificial
  CRISPR gRNA sequence
aagaaaagaggctactgtaa

SEQ ID NO: 376797 - DNA, 20 bp, Artificial
  CRISPR gRNA sequence
atacagaaatgtaatgtttt

SEQ ID NO: 376798 - DNA, 20 bp, Artificial
  CRISPR gRNA sequence
ggtgaggttgtaattccttt

SEQ ID NO: 376799 - DNA, 20 bp, Artificial
  CRISPR gRNA sequence
agggaaaggttatgcaggaa

SEQ ID NO: 376800 - DNA, 20 bp, Artificial
  CRISPR gRNA sequence
acaaaagagaacatggaact

SEQ ID NO: 376801 - DNA, 20 bp, Artificial
  CRISPR gRNA sequence
tgcactctgcaatttactag

SEQ ID NO: 376802 - DNA, 20 bp, Artificial
  CRISPR gRNA sequence
aacacttttacgctgttggt

SEQ ID NO: 376803 - DNA, 20 bp, Artificial
  CRISPR gRNA sequence
ttgacccagcagcgccatta

SEQ ID NO: 376804 - DNA, 20 bp, Artificial
  CRISPR gRNA sequence
attactgggtatatgcccaa

SEQ ID NO: 376805 - DNA, 20 bp, Artificial
  CRISPR gRNA sequence
tattcatgatagcaaagaca

SEQ ID NO: 376806 - DNA, 20 bp, Artificial
  CRISPR gRNA sequence
caatacccgtcaatgataga

SEQ ID NO: 376807 - DNA, 20 bp, Artificial
  CRISPR gRNA sequence
atcatgtcctttgcagggac

SEQ ID NO: 376808 - DNA, 20 bp, Artificial
  CRISPR gRNA sequence
ctggagcctactggagggca

SEQ ID NO: 376809 - DNA, 20 bp, Artificial
  CRISPR gRNA sequence
gcagagggtgggagaaggga

SEQ ID NO: 376810 - DNA, 20 bp, Artificial
  CRISPR gRNA sequence
aggatcaggaaaaataacta

SEQ ID NO: 376811 - DNA, 20 bp, Artificial
  CRISPR gRNA sequence
ttgggtataaggcttaatac

SEQ ID NO: 376812 - DNA, 20 bp, Artificial
  CRISPR gRNA sequence
aatgaaaataaaaaaataaa

SEQ ID NO: 376813 - DNA, 20 bp, Artificial
  CRISPR gRNA sequence
agagagtaaacatatcacaa

SEQ ID NO: 376814 - DNA, 20 bp, Artificial
  CRISPR gRNA sequence
ttctggtttgcctgggacta

SEQ ID NO: 376815 - DNA, 20 bp, Artificial
  CRISPR gRNA sequence
cctgggactaaggagtttcc

SEQ ID NO: 376816 - DNA, 20 bp, Artificial
  CRISPR gRNA sequence
ttttttttttttttttgaga

SEQ ID NO: 376817 - DNA, 20 bp, Artificial
  CRISPR gRNA sequence
tctcgctctgtcacccaggc

SEQ ID NO: 376818 - DNA, 20 bp, Artificial
  CRISPR gRNA sequence
ctcactgcaacctccgcctc

SEQ ID NO: 376819 - DNA, 20 bp, Artificial
  CRISPR gRNA sequence
gattctcctgcctcagcctc

SEQ ID NO: 376820 - DNA, 20 bp, Artificial
  CRISPR gRNA sequence
gcctcagcctcctgagtagc

SEQ ID NO: 376821 - DNA, 20 bp, Artificial
  CRISPR gRNA sequence
ttttttatttttagtagaga

SEQ ID NO: 376822 - DNA, 20 bp, Artificial
  CRISPR gRNA sequence
acctcggcctcccaaagtgc

SEQ ID NO: 376823 - DNA, 20 bp, Artificial
  CRISPR gRNA sequence
cattaatgccagtgttcaca

SEQ ID NO: 376824 - DNA, 20 bp, Artificial
  CRISPR gRNA sequence
ttttttttttttttttgaga

SEQ ID NO: 376825 - DNA, 20 bp, Artificial
  CRISPR gRNA sequence
tcttactctgttacccaggc

SEQ ID NO: 376826 - DNA, 20 bp, Artificial
  CRISPR gRNA sequence
ctcactgcaacctccatctc

SEQ ID NO: 376827 - DNA, 20 bp, Artificial
  CRISPR gRNA sequence
gattctcctgtctcagcctc

SEQ ID NO: 376828 - DNA, 20 bp, Artificial
  CRISPR gRNA sequence
ttttgcagttttagtagaga

SEQ ID NO: 376829 - DNA, 20 bp, Artificial
  CRISPR gRNA sequence
acctcatcctcccaaagtgc

SEQ ID NO: 376830 - DNA, 20 bp, Artificial
  CRISPR gRNA sequence
aacacacaggctaccaggca

SEQ ID NO: 376831 - DNA, 20 bp, Artificial
  CRISPR gRNA sequence
agtcaatacatctgaagctg

SEQ ID NO: 376832 - DNA, 20 bp, Artificial
  CRISPR gRNA sequence
attttaaacagtcagtaaaa

SEQ ID NO: 376833 - DNA, 20 bp, Artificial
  CRISPR gRNA sequence
gaaggtcattgttggagccc

SEQ ID NO: 376834 - DNA, 20 bp, Artificial
  CRISPR gRNA sequence
ccctctgccatctctgcccc

SEQ ID NO: 376835 - DNA, 20 bp, Artificial
  CRISPR gRNA sequence
ttgccaaggtgaaaaagtgg

SEQ ID NO: 376836 - DNA, 20 bp, Artificial
  CRISPR gRNA sequence
atgctaccaaatgctaaaaa

SEQ ID NO: 376837 - DNA, 20 bp, Artificial
  CRISPR gRNA sequence
gaaacacaaactctgccatt

SEQ ID NO: 376838 - DNA, 20 bp, Artificial
  CRISPR gRNA sequence
actctgccattatgaataga

SEQ ID NO: 376839 - DNA, 20 bp, Artificial
  CRISPR gRNA sequence
aaagtgattaaaatacaaag

SEQ ID NO: 376840 - DNA, 20 bp, Artificial
  CRISPR gRNA sequence
aaaatacaaagcaggatgtg

SEQ ID NO: 376841 - DNA, 20 bp, Artificial
  CRISPR gRNA sequence
ggggacaggtgtttcacacc

SEQ ID NO: 376842 - DNA, 20 bp, Artificial
  CRISPR gRNA sequence
tcacaccttgaatgatacat

SEQ ID NO: 376843 - DNA, 20 bp, Artificial
  CRISPR gRNA sequence
caaaccagatggggagagca

SEQ ID NO: 376844 - DNA, 20 bp, Artificial
  CRISPR gRNA sequence
gattaaataaagtagaaagt

SEQ ID NO: 376845 - DNA, 20 bp, Artificial
  CRISPR gRNA sequence
aataaaaattaggcttcagt

SEQ ID NO: 376846 - DNA, 20 bp, Artificial
  CRISPR gRNA sequence
gcttcagtcagggttaatga

SEQ ID NO: 376847 - DNA, 20 bp, Artificial
  CRISPR gRNA sequence
cagggttaatgacagggtta

SEQ ID NO: 376848 - DNA, 20 bp, Artificial
  CRISPR gRNA sequence
agttttaacattattctggt

SEQ ID NO: 376849 - DNA, 20 bp, Artificial
  CRISPR gRNA sequence
cagaagaagacccagggaaa

SEQ ID NO: 376850 - DNA, 20 bp, Artificial
  CRISPR gRNA sequence
agaagacccagggaaactgg

SEQ ID NO: 376851 - DNA, 20 bp, Artificial
  CRISPR gRNA sequence
ctgctaaagagccagaggtc

SEQ ID NO: 376852 - DNA, 20 bp, Artificial
  CRISPR gRNA sequence
cactggaaatcctattaaca

SEQ ID NO: 376853 - DNA, 20 bp, Artificial
  CRISPR gRNA sequence
tggtaacattactgaaggag

SEQ ID NO: 376854 - DNA, 20 bp, Artificial
  CRISPR gRNA sequence
tttagctgtaatacattata

SEQ ID NO: 376855 - DNA, 20 bp, Artificial
  CRISPR gRNA sequence
aggggaagaaaaactcagcc

SEQ ID NO: 376856 - DNA, 20 bp, Artificial
  CRISPR gRNA sequence
tttttaatttttgttattga

SEQ ID NO: 376857 - DNA, 20 bp, Artificial
  CRISPR gRNA sequence
aatcctccagcctcagcctc

SEQ ID NO: 376858 - DNA, 20 bp, Artificial
  CRISPR gRNA sequence
cacctagatttcttggttct

SEQ ID NO: 376859 - DNA, 20 bp, Artificial
  CRISPR gRNA sequence
aaattatgctgtttgcttat

SEQ ID NO: 376860 - DNA, 20 bp, Artificial
  CRISPR gRNA sequence
ctgtgcacaataaatatttg

SEQ ID NO: 376861 - DNA, 20 bp, Artificial
  CRISPR gRNA sequence
gcacaataaatatttgatga

SEQ ID NO: 376862 - DNA, 20 bp, Artificial
  CRISPR gRNA sequence
aaccttgttcttccccttct

SEQ ID NO: 376863 - DNA, 20 bp, Artificial
  CRISPR gRNA sequence
cttggaggaggaagacaggg

SEQ ID NO: 376864 - DNA, 20 bp, Artificial
  CRISPR gRNA sequence
taaagagcagaggcatcagg

SEQ ID NO: 376865 - DNA, 20 bp, Artificial
  CRISPR gRNA sequence
gtactcacaaaaatatatat

SEQ ID NO: 376866 - DNA, 20 bp, Artificial
  CRISPR gRNA sequence
tgagacagcttgacaaatta

SEQ ID NO: 376867 - DNA, 20 bp, Artificial
  CRISPR gRNA sequence
aatagagaacctctaacatg

SEQ ID NO: 376868 - DNA, 20 bp, Artificial
  CRISPR gRNA sequence
actgtccctccagccacaaa

SEQ ID NO: 376869 - DNA, 20 bp, Artificial
  CRISPR gRNA sequence
ggagagaaaaaaaatattgt

SEQ ID NO: 376870 - DNA, 20 bp, Artificial
  CRISPR gRNA sequence
aaaaaaatattgtaggaatt

SEQ ID NO: 376871 - DNA, 20 bp, Artificial
  CRISPR gRNA sequence
aagaaaagatacattaatta

SEQ ID NO: 376872 - DNA, 20 bp, Artificial
  CRISPR gRNA sequence
attattgagtaacaaaaaca

SEQ ID NO: 376873 - DNA, 20 bp, Artificial
  CRISPR gRNA sequence
aaagaatccaacaaaaaaaa

SEQ ID NO: 376874 - DNA, 20 bp, Artificial
  CRISPR gRNA sequence
aatccaacaaaaaaaataga

SEQ ID NO: 376875 - DNA, 20 bp, Artificial
  CRISPR gRNA sequence
agaatgagttacaggaaaaa

SEQ ID NO: 376876 - DNA, 20 bp, Artificial
  CRISPR gRNA sequence
gaaaaagagaatttttcttt

SEQ ID NO: 376877 - DNA, 20 bp, Artificial
  CRISPR gRNA sequence
ttatttgttttttgattaag

SEQ ID NO: 376878 - DNA, 20 bp, Artificial
  CRISPR gRNA sequence
aatcacagaggtttaggaga

SEQ ID NO: 376879 - DNA, 20 bp, Artificial
  CRISPR gRNA sequence
agaggggatcacttgaggcc

SEQ ID NO: 376880 - DNA, 20 bp, Artificial
  CRISPR gRNA sequence
aggcggagcttgcagtgagc

SEQ ID NO: 376881 - DNA, 20 bp, Artificial
  CRISPR gRNA sequence
taagtacattcaacatacaa

SEQ ID NO: 376882 - DNA, 20 bp, Artificial
  CRISPR gRNA sequence
actccagcaaattccttact

SEQ ID NO: 376883 - DNA, 20 bp, Artificial
  CRISPR gRNA sequence
cagcagccctaattacatca

SEQ ID NO: 376884 - DNA, 20 bp, Artificial
  CRISPR gRNA sequence
agaattgtgatgagactctc

SEQ ID NO: 376885 - DNA, 20 bp, Artificial
  CRISPR gRNA sequence
gattagagaaatgtcccctc

SEQ ID NO: 376886 - DNA, 20 bp, Artificial
  CRISPR gRNA sequence
ttcaacccacagagcatgtt

SEQ ID NO: 376887 - DNA, 20 bp, Artificial
  CRISPR gRNA sequence
tgtgagtgcctcccacaggg

SEQ ID NO: 376888 - DNA, 20 bp, Artificial
  CRISPR gRNA sequence
tcccatcaacatctgctgct

SEQ ID NO: 376889 - DNA, 20 bp, Artificial
  CRISPR gRNA sequence
cctgtcaatcaccccaccat

SEQ ID NO: 376890 - DNA, 20 bp, Artificial
  CRISPR gRNA sequence
cttcctcctgaaatcaaagc

SEQ ID NO: 376891 - DNA, 20 bp, Artificial
  CRISPR gRNA sequence
actgtgacaccccggctgtc

SEQ ID NO: 376892 - DNA, 20 bp, Artificial
  CRISPR gRNA sequence
tatgatttccttctttttta

SEQ ID NO: 376893 - DNA, 20 bp, Artificial
  CRISPR gRNA sequence
attttattttatttttggga

SEQ ID NO: 376894 - DNA, 20 bp, Artificial
  CRISPR gRNA sequence
ttcactcttgtcacccaggc

SEQ ID NO: 376895 - DNA, 20 bp, Artificial
  CRISPR gRNA sequence
tgcctcagcctccaagtagc

SEQ ID NO: 376896 - DNA, 20 bp, Artificial
  CRISPR gRNA sequence
ttttgtatttttagtagaga

SEQ ID NO: 376897 - DNA, 20 bp, Artificial
  CRISPR gRNA sequence
gccttggcctcccaaagtgc

SEQ ID NO: 376898 - DNA, 20 bp, Artificial
  CRISPR gRNA sequence
acctactacctgtaccaata

SEQ ID NO: 376899 - DNA, 20 bp, Artificial
  CRISPR gRNA sequence
cattcccgccaacagtgtac

SEQ ID NO: 376900 - DNA, 20 bp, Artificial
  CRISPR gRNA sequence
ggtgtgaggtgagagctcac

SEQ ID NO: 376901 - DNA, 20 bp, Artificial
  CRISPR gRNA sequence
tgtttttgcccactttttaa

SEQ ID NO: 376902 - DNA, 20 bp, Artificial
  CRISPR gRNA sequence
atcctgccatttgcgacagc

SEQ ID NO: 376903 - DNA, 20 bp, Artificial
  CRISPR gRNA sequence
tgccatttgcgacagcatgg

SEQ ID NO: 376904 - DNA, 20 bp, Artificial
  CRISPR gRNA sequence
tgtataatctcacctgtatg

SEQ ID NO: 376905 - DNA, 20 bp, Artificial
  CRISPR gRNA sequence
aagtcaaacttatagaagca

SEQ ID NO: 376906 - DNA, 20 bp, Artificial
  CRISPR gRNA sequence
agatagggagacgctggcta

SEQ ID NO: 376907 - DNA, 20 bp, Artificial
  CRISPR gRNA sequence
atggggacctactatacagt

SEQ ID NO: 376908 - DNA, 20 bp, Artificial
  CRISPR gRNA sequence
tacagtatggatggtgatac

SEQ ID NO: 376909 - DNA, 20 bp, Artificial
  CRISPR gRNA sequence
aaataatcacactgtatgcc

SEQ ID NO: 376910 - DNA, 20 bp, Artificial
  CRISPR gRNA sequence
aaagatctgcaggcttaaaa

SEQ ID NO: 376911 - DNA, 20 bp, Artificial
  CRISPR gRNA sequence
aaatcttagtggttaaagta

SEQ ID NO: 376912 - DNA, 20 bp, Artificial
  CRISPR gRNA sequence
agaaatcttttctttagaaa

SEQ ID NO: 376913 - DNA, 20 bp, Artificial
  CRISPR gRNA sequence
tttatgaaggtctaatttat

SEQ ID NO: 376914 - DNA, 20 bp, Artificial
  CRISPR gRNA sequence
ttttagtaatgtttggcctc

SEQ ID NO: 376915 - DNA, 20 bp, Artificial
  CRISPR gRNA sequence
agacttctgtgaccaaaggt

SEQ ID NO: 376916 - DNA, 20 bp, Artificial
  CRISPR gRNA sequence
cccacagtaacaggcaccag

SEQ ID NO: 376917 - DNA, 20 bp, Artificial
  CRISPR gRNA sequence
ttttttttttttttttgaga

SEQ ID NO: 376918 - DNA, 20 bp, Artificial
  CRISPR gRNA sequence
tctcgctctgtcacccaggc

SEQ ID NO: 376919 - DNA, 20 bp, Artificial
  CRISPR gRNA sequence
cccaggctggagtacaatgg

SEQ ID NO: 376920 - DNA, 20 bp, Artificial
  CRISPR gRNA sequence
gattctcctgcctcagcctc

SEQ ID NO: 376921 - DNA, 20 bp, Artificial
  CRISPR gRNA sequence
gcctcagcctcctgagtagc

SEQ ID NO: 376922 - DNA, 20 bp, Artificial
  CRISPR gRNA sequence
ttttgtatttttagtagaga

SEQ ID NO: 376923 - DNA, 20 bp, Artificial
  CRISPR gRNA sequence
tcctcggcctcccaaagtgc

SEQ ID NO: 376924 - DNA, 20 bp, Artificial
  CRISPR gRNA sequence
cggaccaatgggcctcaagc

SEQ ID NO: 376925 - DNA, 20 bp, Artificial
  CRISPR gRNA sequence
acatttgtcagtttaatatc

SEQ ID NO: 376926 - DNA, 20 bp, Artificial
  CRISPR gRNA sequence
ttaatatcaaggatattgca

SEQ ID NO: 376927 - DNA, 20 bp, Artificial
  CRISPR gRNA sequence
gatacagatgaagagattgg

SEQ ID NO: 376928 - DNA, 20 bp, Artificial
  CRISPR gRNA sequence
gaggcatgtgtaaaggggca

SEQ ID NO: 376929 - DNA, 20 bp, Artificial
  CRISPR gRNA sequence
actctccaaaccccatcctc

SEQ ID NO: 376930 - DNA, 20 bp, Artificial
  CRISPR gRNA sequence
tcctgtccagactttagata

SEQ ID NO: 376931 - DNA, 20 bp, Artificial
  CRISPR gRNA sequence
tccagactttagatatgggg

SEQ ID NO: 376932 - DNA, 20 bp, Artificial
  CRISPR gRNA sequence
atatggggtgggatcctctc

SEQ ID NO: 376933 - DNA, 20 bp, Artificial
  CRISPR gRNA sequence
ggtgggatcctctctggaat

SEQ ID NO: 376934 - DNA, 20 bp, Artificial
  CRISPR gRNA sequence
cttttgacccacattcagat

SEQ ID NO: 376935 - DNA, 20 bp, Artificial
  CRISPR gRNA sequence
aacattataacaaggaccat

SEQ ID NO: 376936 - DNA, 20 bp, Artificial
  CRISPR gRNA sequence
tgaattttgagccaggaccc

SEQ ID NO: 376937 - DNA, 20 bp, Artificial
  CRISPR gRNA sequence
tttaaaaatagttagggaaa

SEQ ID NO: 376938 - DNA, 20 bp, Artificial
  CRISPR gRNA sequence
aataaaggtgaaataaagca

SEQ ID NO: 376939 - DNA, 20 bp, Artificial
  CRISPR gRNA sequence
aatccagagacatttcaatc

SEQ ID NO: 376940 - DNA, 20 bp, Artificial
  CRISPR gRNA sequence
gccttgcctgcagcttccac

SEQ ID NO: 376941 - DNA, 20 bp, Artificial
  CRISPR gRNA sequence
aaaataaaaaggaaaagcaa

SEQ ID NO: 376942 - DNA, 20 bp, Artificial
  CRISPR gRNA sequence
aaaaggaaaagcaaatgggt

SEQ ID NO: 376943 - DNA, 20 bp, Artificial
  CRISPR gRNA sequence
caaatgggtacggatgcttt

SEQ ID NO: 376944 - DNA, 20 bp, Artificial
  CRISPR gRNA sequence
ttttgctaatagatgtcaga

SEQ ID NO: 376945 - DNA, 20 bp, Artificial
  CRISPR gRNA sequence
agcccttttctttaaaaaag

SEQ ID NO: 376946 - DNA, 20 bp, Artificial
  CRISPR gRNA sequence
caagtcagtgaaatatataa

SEQ ID NO: 376947 - DNA, 20 bp, Artificial
  CRISPR gRNA sequence
tataaaagaataatttactc

SEQ ID NO: 376948 - DNA, 20 bp, Artificial
  CRISPR gRNA sequence
gcaatgacaagtatttatgg

SEQ ID NO: 376949 - DNA, 20 bp, Artificial
  CRISPR gRNA sequence
ttgccagtcccttcttccct

SEQ ID NO: 376950 - DNA, 20 bp, Artificial
  CRISPR gRNA sequence
tccctcagagttcggcaggc

SEQ ID NO: 376951 - DNA, 20 bp, Artificial
  CRISPR gRNA sequence
gtctatagtttatcctctat

SEQ ID NO: 376952 - DNA, 20 bp, Artificial
  CRISPR gRNA sequence
agtttatcctctattagggt

SEQ ID NO: 376953 - DNA, 20 bp, Artificial
  CRISPR gRNA sequence
atcctctattagggtggggg

SEQ ID NO: 376954 - DNA, 20 bp, Artificial
  CRISPR gRNA sequence
ttagggtgggggtggagtta

SEQ ID NO: 376955 - DNA, 20 bp, Artificial
  CRISPR gRNA sequence
gaacctaaataactgggcca

SEQ ID NO: 376956 - DNA, 20 bp, Artificial
  CRISPR gRNA sequence
agagaccacctcacaccttt

SEQ ID NO: 376957 - DNA, 20 bp, Artificial
  CRISPR gRNA sequence
atgtcttctcccaagacttt

SEQ ID NO: 376958 - DNA, 20 bp, Artificial
  CRISPR gRNA sequence
cagtctgagaaataaaggga

SEQ ID NO: 376959 - DNA, 20 bp, Artificial
  CRISPR gRNA sequence
aaaagacagaaattttaaag

SEQ ID NO: 376960 - DNA, 20 bp, Artificial
  CRISPR gRNA sequence
ttagcaattttcaaagggga

SEQ ID NO: 376961 - DNA, 20 bp, Artificial
  CRISPR gRNA sequence
tttcaaaggggagggagtgt

SEQ ID NO: 376962 - DNA, 20 bp, Artificial
  CRISPR gRNA sequence
aaggggagggagtgtatgaa

SEQ ID NO: 376963 - DNA, 20 bp, Artificial
  CRISPR gRNA sequence
agggagtgtatgaatagggt

SEQ ID NO: 376964 - DNA, 20 bp, Artificial
  CRISPR gRNA sequence
atggaggcagagcgagatca

SEQ ID NO: 376965 - DNA, 20 bp, Artificial
  CRISPR gRNA sequence
ggcagagcgagatcacagga

SEQ ID NO: 376966 - DNA, 20 bp, Artificial
  CRISPR gRNA sequence
gtcactgataaacatcttaa

SEQ ID NO: 376967 - DNA, 20 bp, Artificial
  CRISPR gRNA sequence
gagcagagaaccagtctgac

SEQ ID NO: 376968 - DNA, 20 bp, Artificial
  CRISPR gRNA sequence
ctgactagaattcgccaggc

SEQ ID NO: 376969 - DNA, 20 bp, Artificial
  CRISPR gRNA sequence
ttcctaatcctagcaagcct

SEQ ID NO: 376970 - DNA, 20 bp, Artificial
  CRISPR gRNA sequence
agcattcttttcccagggct

SEQ ID NO: 376971 - DNA, 20 bp, Artificial
  CRISPR gRNA sequence
ttaatattccttactgggga

SEQ ID NO: 376972 - DNA, 20 bp, Artificial
  CRISPR gRNA sequence
tgcagttaacacaaccatca

SEQ ID NO: 376973 - DNA, 20 bp, Artificial
  CRISPR gRNA sequence
tcctcagcttacgaagatga

SEQ ID NO: 376974 - DNA, 20 bp, Artificial
  CRISPR gRNA sequence
agacaagcataggaaatcac

SEQ ID NO: 376975 - DNA, 20 bp, Artificial
  CRISPR gRNA sequence
tcccacagcaccatttccca

SEQ ID NO: 376976 - DNA, 20 bp, Artificial
  CRISPR gRNA sequence
gccactgaagaagaaccaag

SEQ ID NO: 376977 - DNA, 20 bp, Artificial
  CRISPR gRNA sequence
agaaccaagctgggtttata

SEQ ID NO: 376978 - DNA, 20 bp, Artificial
  CRISPR gRNA sequence
tcatgtcaccatatcgatct

SEQ ID NO: 376979 - DNA, 20 bp, Artificial
  CRISPR gRNA sequence
acagtcgaacatgttttatt

SEQ ID NO: 376980 - DNA, 20 bp, Artificial
  CRISPR gRNA sequence
gagagagagagaaagaggaa

SEQ ID NO: 376981 - DNA, 20 bp, Artificial
  CRISPR gRNA sequence
aggaaaggggagaaagaaga

SEQ ID NO: 376982 - DNA, 20 bp, Artificial
  CRISPR gRNA sequence
agaaagaagaaagagttggc

SEQ ID NO: 376983 - DNA, 20 bp, Artificial
  CRISPR gRNA sequence
aatgtcttagaagtagaaag

SEQ ID NO: 376984 - DNA, 20 bp, Artificial
  CRISPR gRNA sequence
ggttaccagaggctgtgcaa

SEQ ID NO: 376985 - DNA, 20 bp, Artificial
  CRISPR gRNA sequence
agaatggggagggagataat

SEQ ID NO: 376986 - DNA, 20 bp, Artificial
  CRISPR gRNA sequence
ataatgggagttgttggtca

SEQ ID NO: 376987 - DNA, 20 bp, Artificial
  CRISPR gRNA sequence
caaaatttcagatacacgag

SEQ ID NO: 376988 - DNA, 20 bp, Artificial
  CRISPR gRNA sequence
ttttttttttttttttgaga

SEQ ID NO: 376989 - DNA, 20 bp, Artificial
  CRISPR gRNA sequence
tctcgttttgtcacccaggc

SEQ ID NO: 376990 - DNA, 20 bp, Artificial
  CRISPR gRNA sequence
ctcactgcaacctccgcctc

SEQ ID NO: 376991 - DNA, 20 bp, Artificial
  CRISPR gRNA sequence
gattctcctgcctcagcccc

SEQ ID NO: 376992 - DNA, 20 bp, Artificial
  CRISPR gRNA sequence
tttttatattttagtagaga

SEQ ID NO: 376993 - DNA, 20 bp, Artificial
  CRISPR gRNA sequence
gtctcgaactcctgacctcg

SEQ ID NO: 376994 - DNA, 20 bp, Artificial
  CRISPR gRNA sequence
gcctcggtctcctaaagtgc

SEQ ID NO: 376995 - DNA, 20 bp, Artificial
  CRISPR gRNA sequence
ttttaagatttatcatacag

SEQ ID NO: 376996 - DNA, 20 bp, Artificial
  CRISPR gRNA sequence
taatgtatacttcaaagtga

SEQ ID NO: 376997 - DNA, 20 bp, Artificial
  CRISPR gRNA sequence
aatcataggtaaatgaagtg

SEQ ID NO: 376998 - DNA, 20 bp, Artificial
  CRISPR gRNA sequence
ttgtgtacagatggaccata

SEQ ID NO: 376999 - DNA, 20 bp, Artificial
  CRISPR gRNA sequence
gtacagatggaccataatga

SEQ ID NO: 377000 - DNA, 20 bp, Artificial
  CRISPR gRNA sequence
tgagttcacacagagcagat

SEQ ID NO: 377001 - DNA, 20 bp, Artificial
  CRISPR gRNA sequence
atgatgataaaattaaccac

SEQ ID NO: 377002 - DNA, 20 bp, Artificial
  CRISPR gRNA sequence
tacgtagacacattccaaat

SEQ ID NO: 377003 - DNA, 20 bp, Artificial
  CRISPR gRNA sequence
atgcctgaaatacgcatcac

SEQ ID NO: 377004 - DNA, 20 bp, Artificial
  CRISPR gRNA sequence
gttttatagctagaaggtcc

SEQ ID NO: 377005 - DNA, 20 bp, Artificial
  CRISPR gRNA sequence
tagagtgtaaattattttca

SEQ ID NO: 377006 - DNA, 20 bp, Artificial
  CRISPR gRNA sequence
ttcaacctctaatccttctt

SEQ ID NO: 377007 - DNA, 20 bp, Artificial
  CRISPR gRNA sequence
actaagaaacataaggccca

SEQ ID NO: 377008 - DNA, 20 bp, Artificial
  CRISPR gRNA sequence
tacgttttacctacacaata

SEQ ID NO: 377009 - DNA, 20 bp, Artificial
  CRISPR gRNA sequence
cacagtgattggtgtatggc

SEQ ID NO: 377010 - DNA, 20 bp, Artificial
  CRISPR gRNA sequence
atatttttacccaaatattt

SEQ ID NO: 377011 - DNA, 20 bp, Artificial
  CRISPR gRNA sequence
tatatagatgcttcaaaagt

SEQ ID NO: 377012 - DNA, 20 bp, Artificial
  CRISPR gRNA sequence
atacctttctcactgtctta

SEQ ID NO: 377013 - DNA, 20 bp, Artificial
  CRISPR gRNA sequence
tagtgaattagtgtgcagaa

SEQ ID NO: 377014 - DNA, 20 bp, Artificial
  CRISPR gRNA sequence
aaagagttcatgtagcaggc

SEQ ID NO: 377015 - DNA, 20 bp, Artificial
  CRISPR gRNA sequence
tcatgtagcaggcttggatt

SEQ ID NO: 377016 - DNA, 20 bp, Artificial
  CRISPR gRNA sequence
tctcgctatgttgctcaggc

SEQ ID NO: 377017 - DNA, 20 bp, Artificial
  CRISPR gRNA sequence
gaaatggcctcccaaagcat

SEQ ID NO: 377018 - DNA, 20 bp, Artificial
  CRISPR gRNA sequence
agccaccacgcctggctcca

SEQ ID NO: 377019 - DNA, 20 bp, Artificial
  CRISPR gRNA sequence
attattatggacacttgact

SEQ ID NO: 377020 - DNA, 20 bp, Artificial
  CRISPR gRNA sequence
gacatgtcttgattgaaatc

SEQ ID NO: 377021 - DNA, 20 bp, Artificial
  CRISPR gRNA sequence
agatgcaacaagttctctgc

SEQ ID NO: 377022 - DNA, 20 bp, Artificial
  CRISPR gRNA sequence
tgactcataaagtgtctctt

SEQ ID NO: 377023 - DNA, 20 bp, Artificial
  CRISPR gRNA sequence
aaatggcaaaaaatagacta

SEQ ID NO: 377024 - DNA, 20 bp, Artificial
  CRISPR gRNA sequence
attcaaacaaacaaacatac

SEQ ID NO: 377025 - DNA, 20 bp, Artificial
  CRISPR gRNA sequence
ggcacaaggtaatttaaagc

SEQ ID NO: 377026 - DNA, 20 bp, Artificial
  CRISPR gRNA sequence
agaggacaccaggacagcca

SEQ ID NO: 377027 - DNA, 20 bp, Artificial
  CRISPR gRNA sequence
aagaaacatgctatccagct

SEQ ID NO: 377028 - DNA, 20 bp, Artificial
  CRISPR gRNA sequence
ttaaaaacttggtacataaa

SEQ ID NO: 377029 - DNA, 20 bp, Artificial
  CRISPR gRNA sequence
gtttcaaataaaactagtat

SEQ ID NO: 377030 - DNA, 20 bp, Artificial
  CRISPR gRNA sequence
cactatttcacggttgtgtt

SEQ ID NO: 377031 - DNA, 20 bp, Artificial
  CRISPR gRNA sequence
tgttcagggtgccccctccc

SEQ ID NO: 377032 - DNA, 20 bp, Artificial
  CRISPR gRNA sequence
ggtgccccctccccaggatc

SEQ ID NO: 377033 - DNA, 20 bp, Artificial
  CRISPR gRNA sequence
gctcaggtttatgacagcag

SEQ ID NO: 377034 - DNA, 20 bp, Artificial
  CRISPR gRNA sequence
gatccaaagcaaatcagcaa

SEQ ID NO: 377035 - DNA, 20 bp, Artificial
  CRISPR gRNA sequence
aggtgtttagcataaaccac

SEQ ID NO: 377036 - DNA, 20 bp, Artificial
  CRISPR gRNA sequence
gggttgtataaacatttaga

SEQ ID NO: 377037 - DNA, 20 bp, Artificial
  CRISPR gRNA sequence
ataagccaccccagcagtca

SEQ ID NO: 377038 - DNA, 20 bp, Artificial
  CRISPR gRNA sequence
taaggactgtagtcccaggc

SEQ ID NO: 377039 - DNA, 20 bp, Artificial
  CRISPR gRNA sequence
aatgaccacatggagccttg

SEQ ID NO: 377040 - DNA, 20 bp, Artificial
  CRISPR gRNA sequence
taggcctgggaacaagtccc

SEQ ID NO: 377041 - DNA, 20 bp, Artificial
  CRISPR gRNA sequence
atcctgatgttggtgttcca

SEQ ID NO: 377042 - DNA, 20 bp, Artificial
  CRISPR gRNA sequence
tgctgagccccagtctgcca

SEQ ID NO: 377043 - DNA, 20 bp, Artificial
  CRISPR gRNA sequence
atttctcctccctcctttct

SEQ ID NO: 377044 - DNA, 20 bp, Artificial
  CRISPR gRNA sequence
ccttacctcccaatttctga

SEQ ID NO: 377045 - DNA, 20 bp, Artificial
  CRISPR gRNA sequence
gtgagaagtttgtttttcct

SEQ ID NO: 377046 - DNA, 20 bp, Artificial
  CRISPR gRNA sequence
cagtcatccccaattaccag

SEQ ID NO: 377047 - DNA, 20 bp, Artificial
  CRISPR gRNA sequence
ccccaattaccagttgaatc

SEQ ID NO: 377048 - DNA, 20 bp, Artificial
  CRISPR gRNA sequence
atctttagagcatgtatgta

SEQ ID NO: 377049 - DNA, 20 bp, Artificial
  CRISPR gRNA sequence
gtatctacttggctgtatga

SEQ ID NO: 377050 - DNA, 20 bp, Artificial
  CRISPR gRNA sequence
tacctttgtggagcagtttt

SEQ ID NO: 377051 - DNA, 20 bp, Artificial
  CRISPR gRNA sequence
catgagagaacataagtgtt

SEQ ID NO: 377052 - DNA, 20 bp, Artificial
  CRISPR gRNA sequence
tgggcacaagagcaagagag

SEQ ID NO: 377053 - DNA, 20 bp, Artificial
  CRISPR gRNA sequence
attcctggaaagctgttcaa

SEQ ID NO: 377054 - DNA, 20 bp, Artificial
  CRISPR gRNA sequence
tcccacacaggaagcgtcca

SEQ ID NO: 377055 - DNA, 20 bp, Artificial
  CRISPR gRNA sequence
acacaggaagcgtccagtgg

SEQ ID NO: 377056 - DNA, 20 bp, Artificial
  CRISPR gRNA sequence
tcccctaatctgttcctggt

SEQ ID NO: 377057 - DNA, 20 bp, Artificial
  CRISPR gRNA sequence
tcatagcattggcgtcagcg

SEQ ID NO: 377058 - DNA, 20 bp, Artificial
  CRISPR gRNA sequence
cgtcaccagcttctgttgtg

SEQ ID NO: 377059 - DNA, 20 bp, Artificial
  CRISPR gRNA sequence
gttgtgatgagtctcctgat

SEQ ID NO: 377060 - DNA, 20 bp, Artificial
  CRISPR gRNA sequence
agaaaagtagtgctggggcc

SEQ ID NO: 377061 - DNA, 20 bp, Artificial
  CRISPR gRNA sequence
tgaagccagtcagcccgcat

SEQ ID NO: 377062 - DNA, 20 bp, Artificial
  CRISPR gRNA sequence
tgacaagtaaatcagtaact

SEQ ID NO: 377063 - DNA, 20 bp, Artificial
  CRISPR gRNA sequence
agctacttataactctttcc

SEQ ID NO: 377064 - DNA, 20 bp, Artificial
  CRISPR gRNA sequence
cggcactttggaaggccgag

SEQ ID NO: 377065 - DNA, 20 bp, Artificial
  CRISPR gRNA sequence
actttggaaggccgaggtgg

SEQ ID NO: 377066 - DNA, 20 bp, Artificial
  CRISPR gRNA sequence
tgcttgggaggctgaggcag

SEQ ID NO: 377067 - DNA, 20 bp, Artificial
  CRISPR gRNA sequence
ttgcactccagcctgggcaa

SEQ ID NO: 377068 - DNA, 20 bp, Artificial
  CRISPR gRNA sequence
aaatgttgtacagatctttt

SEQ ID NO: 377069 - DNA, 20 bp, Artificial
  CRISPR gRNA sequence
gaaattcagcaagccttagg

SEQ ID NO: 377070 - DNA, 20 bp, Artificial
  CRISPR gRNA sequence
ggctataagaaataataact

SEQ ID NO: 377071 - DNA, 20 bp, Artificial
  CRISPR gRNA sequence
aaatctgctgctttatgctc

SEQ ID NO: 377072 - DNA, 20 bp, Artificial
  CRISPR gRNA sequence
aaagagccaataatttaaaa

SEQ ID NO: 377073 - DNA, 20 bp, Artificial
  CRISPR gRNA sequence
aaaactgatacctttatctg

SEQ ID NO: 377074 - DNA, 20 bp, Artificial
  CRISPR gRNA sequence
ataaaagcaaaatgacttgt

SEQ ID NO: 377075 - DNA, 20 bp, Artificial
  CRISPR gRNA sequence
cttgtttggattaaaatatt

SEQ ID NO: 377076 - DNA, 20 bp, Artificial
  CRISPR gRNA sequence
cacacaatcgtgtgtatttg

SEQ ID NO: 377077 - DNA, 20 bp, Artificial
  CRISPR gRNA sequence
cacacacacacacaaattaa

SEQ ID NO: 377078 - DNA, 20 bp, Artificial
  CRISPR gRNA sequence
cacacacacaaattaaaaga

SEQ ID NO: 377079 - DNA, 20 bp, Artificial
  CRISPR gRNA sequence
aactgaagacacagtgacat

SEQ ID NO: 377080 - DNA, 20 bp, Artificial
  CRISPR gRNA sequence
tctgtataaacttccctccc

SEQ ID NO: 377081 - DNA, 20 bp, Artificial
  CRISPR gRNA sequence
cactttccaccaatccaact

SEQ ID NO: 377082 - DNA, 20 bp, Artificial
  CRISPR gRNA sequence
ttgtgaaagactctctccct

SEQ ID NO: 377083 - DNA, 20 bp, Artificial
  CRISPR gRNA sequence
taaaatgccactcatatcta

SEQ ID NO: 377084 - DNA, 20 bp, Artificial
  CRISPR gRNA sequence
gtgaacaccatggcctacct

SEQ ID NO: 377085 - DNA, 20 bp, Artificial
  CRISPR gRNA sequence
ttctaccaaagttaaaaaca

SEQ ID NO: 377086 - DNA, 20 bp, Artificial
  CRISPR gRNA sequence
acattgaattaatcctggaa

SEQ ID NO: 377087 - DNA, 20 bp, Artificial
  CRISPR gRNA sequence
ttaatcctggaaatgaattt

SEQ ID NO: 377088 - DNA, 20 bp, Artificial
  CRISPR gRNA sequence
caaaaaaacttatattcctg

SEQ ID NO: 377089 - DNA, 20 bp, Artificial
  CRISPR gRNA sequence
taaatgtatttttaaaatcc

SEQ ID NO: 377090 - DNA, 20 bp, Artificial
  CRISPR gRNA sequence
aatagcttaaagatagaaat

SEQ ID NO: 377091 - DNA, 20 bp, Artificial
  CRISPR gRNA sequence
agaaacctagtacatcgcct

SEQ ID NO: 377092 - DNA, 20 bp, Artificial
  CRISPR gRNA sequence
catcgcctttgaatatttat

SEQ ID NO: 377093 - DNA, 20 bp, Artificial
  CRISPR gRNA sequence
agttcaaagtaatcgactga

SEQ ID NO: 377094 - DNA, 20 bp, Artificial
  CRISPR gRNA sequence
ttgagttgtaatacttaaat

SEQ ID NO: 377095 - DNA, 20 bp, Artificial
  CRISPR gRNA sequence
cttaaattagaatttctatt

SEQ ID NO: 377096 - DNA, 20 bp, Artificial
  CRISPR gRNA sequence
tgaaatgctattaatcttat

SEQ ID NO: 377097 - DNA, 20 bp, Artificial
  CRISPR gRNA sequence
taacaattcccaggtgcttt

SEQ ID NO: 377098 - DNA, 20 bp, Artificial
  CRISPR gRNA sequence
ataaatggttatttcacagt

SEQ ID NO: 377099 - DNA, 20 bp, Artificial
  CRISPR gRNA sequence
agcctcccaaagcaccatgt

SEQ ID NO: 377100 - DNA, 20 bp, Artificial
  CRISPR gRNA sequence
aagaaaatcagtacatttgt

SEQ ID NO: 377101 - DNA, 20 bp, Artificial
  CRISPR gRNA sequence
atcagtacatttgtctgaat

SEQ ID NO: 377102 - DNA, 20 bp, Artificial
  CRISPR gRNA sequence
ggagagaaaaactttatgaa

SEQ ID NO: 377103 - DNA, 20 bp, Artificial
  CRISPR gRNA sequence
acctgtagaacagcagttcc

SEQ ID NO: 377104 - DNA, 20 bp, Artificial
  CRISPR gRNA sequence
aaattcagcatgtaaccttt

SEQ ID NO: 377105 - DNA, 20 bp, Artificial
  CRISPR gRNA sequence
ggtttttgtgtgttcaaaaa

SEQ ID NO: 377106 - DNA, 20 bp, Artificial
  CRISPR gRNA sequence
aactgaccggttgcattttt

SEQ ID NO: 377107 - DNA, 20 bp, Artificial
  CRISPR gRNA sequence
caaccacataatagccatga

SEQ ID NO: 377108 - DNA, 20 bp, Artificial
  CRISPR gRNA sequence
tgctggaaactatgtttcat

SEQ ID NO: 377109 - DNA, 20 bp, Artificial
  CRISPR gRNA sequence
gaaaattgtggttgatctgt

SEQ ID NO: 377110 - DNA, 20 bp, Artificial
  CRISPR gRNA sequence
tgagcagtgacacggtgctc

SEQ ID NO: 377111 - DNA, 20 bp, Artificial
  CRISPR gRNA sequence
tatatctattctaaattcat

SEQ ID NO: 377112 - DNA, 20 bp, Artificial
  CRISPR gRNA sequence
taggagtgggacagaaggtt

SEQ ID NO: 377113 - DNA, 20 bp, Artificial
  CRISPR gRNA sequence
gacagaaggttctggattaa

SEQ ID NO: 377114 - DNA, 20 bp, Artificial
  CRISPR gRNA sequence
tctacaacctgaaactcttc

SEQ ID NO: 377115 - DNA, 20 bp, Artificial
  CRISPR gRNA sequence
tataatccaactcaggagca

SEQ ID NO: 377116 - DNA, 20 bp, Artificial
  CRISPR gRNA sequence
ataagatgtatcatctatat

SEQ ID NO: 377117 - DNA, 20 bp, Artificial
  CRISPR gRNA sequence
tgtggcactatgatttccta

SEQ ID NO: 377118 - DNA, 20 bp, Artificial
  CRISPR gRNA sequence
tgaaagttatatatgtaaac

SEQ ID NO: 377119 - DNA, 20 bp, Artificial
  CRISPR gRNA sequence
aaaatggacacagcccctac

SEQ ID NO: 377120 - DNA, 20 bp, Artificial
  CRISPR gRNA sequence
tggacacagcccctactaga

SEQ ID NO: 377121 - DNA, 20 bp, Artificial
  CRISPR gRNA sequence
ctcaattaatttctgataac

SEQ ID NO: 377122 - DNA, 20 bp, Artificial
  CRISPR gRNA sequence
cactttaggaggctgaggca

SEQ ID NO: 377123 - DNA, 20 bp, Artificial
  CRISPR gRNA sequence
tggaagttaataagtcactc

SEQ ID NO: 377124 - DNA, 20 bp, Artificial
  CRISPR gRNA sequence
aaaggagaaagtaggaaagt

SEQ ID NO: 377125 - DNA, 20 bp, Artificial
  CRISPR gRNA sequence
ctttgtgcctacaaaggtag

SEQ ID NO: 377126 - DNA, 20 bp, Artificial
  CRISPR gRNA sequence
aggaccaggtggcttcacag

SEQ ID NO: 377127 - DNA, 20 bp, Artificial
  CRISPR gRNA sequence
tgaattctatcaaacattct

SEQ ID NO: 377128 - DNA, 20 bp, Artificial
  CRISPR gRNA sequence
tctaggaattaatgccaatc

SEQ ID NO: 377129 - DNA, 20 bp, Artificial
  CRISPR gRNA sequence
taaattcaccatcacattaa

SEQ ID NO: 377130 - DNA, 20 bp, Artificial
  CRISPR gRNA sequence
ctcaacaaattaggtacaga

SEQ ID NO: 377131 - DNA, 20 bp, Artificial
  CRISPR gRNA sequence
aaacctgttcaaactaataa

SEQ ID NO: 377132 - DNA, 20 bp, Artificial
  CRISPR gRNA sequence
aaatgaattcagttaagagg

SEQ ID NO: 377133 - DNA, 20 bp, Artificial
  CRISPR gRNA sequence
aacagcaaactatccaaaaa

SEQ ID NO: 377134 - DNA, 20 bp, Artificial
  CRISPR gRNA sequence
ccatccccaataacaataaa

SEQ ID NO: 377135 - DNA, 20 bp, Artificial
  CRISPR gRNA sequence
ataaaaggaataaagtattt

SEQ ID NO: 377136 - DNA, 20 bp, Artificial
  CRISPR gRNA sequence
ccccattcctcctgcatatt

SEQ ID NO: 377137 - DNA, 20 bp, Artificial
  CRISPR gRNA sequence
ttgaaccttgatggtcccgc

SEQ ID NO: 377138 - DNA, 20 bp, Artificial
  CRISPR gRNA sequence
gaagacgattatacaaggac

SEQ ID NO: 377139 - DNA, 20 bp, Artificial
  CRISPR gRNA sequence
ttatgacaaatgaaaatcca

SEQ ID NO: 377140 - DNA, 20 bp, Artificial
  CRISPR gRNA sequence
caaattcagaaaagtcagtc

SEQ ID NO: 377141 - DNA, 20 bp, Artificial
  CRISPR gRNA sequence
aaagaaagtcagtggtaaat

SEQ ID NO: 377142 - DNA, 20 bp, Artificial
  CRISPR gRNA sequence
tgttcaaaaccaatcaaggc

SEQ ID NO: 377143 - DNA, 20 bp, Artificial
  CRISPR gRNA sequence
tacttgacctgctggttggc

SEQ ID NO: 377144 - DNA, 20 bp, Artificial
  CRISPR gRNA sequence
tggttggcaggggtcctctg

SEQ ID NO: 377145 - DNA, 20 bp, Artificial
  CRISPR gRNA sequence
gacctggtacttgtctgaag

SEQ ID NO: 377146 - DNA, 20 bp, Artificial
  CRISPR gRNA sequence
gaagatgaatgcaggcaggt

SEQ ID NO: 377147 - DNA, 20 bp, Artificial
  CRISPR gRNA sequence
gtgcatgtgtgtgtgtgtgt

SEQ ID NO: 377148 - DNA, 20 bp, Artificial
  CRISPR gRNA sequence
gtgtgtgtgtgtatgaatat

SEQ ID NO: 377149 - DNA, 20 bp, Artificial
  CRISPR gRNA sequence
cacttataaaaattgaaaaa

SEQ ID NO: 377150 - DNA, 20 bp, Artificial
  CRISPR gRNA sequence
tcaatgataactttttacta

SEQ ID NO: 377151 - DNA, 20 bp, Artificial
  CRISPR gRNA sequence
acattctttcaatctgtcaa

SEQ ID NO: 377152 - DNA, 20 bp, Artificial
  CRISPR gRNA sequence
agtcatcttcatttcattgg

SEQ ID NO: 377153 - DNA, 20 bp, Artificial
  CRISPR gRNA sequence
acttagtcatctttggacag

SEQ ID NO: 377154 - DNA, 20 bp, Artificial
  CRISPR gRNA sequence
tgacatttttattaattaat

SEQ ID NO: 377155 - DNA, 20 bp, Artificial
  CRISPR gRNA sequence
tgattctttatgacactttt

SEQ ID NO: 377156 - DNA, 20 bp, Artificial
  CRISPR gRNA sequence
aaaaatacttccataatgca

SEQ ID NO: 377157 - DNA, 20 bp, Artificial
  CRISPR gRNA sequence
tttgtctgtgtctgaaggaa

SEQ ID NO: 377158 - DNA, 20 bp, Artificial
  CRISPR gRNA sequence
cagagtcaacatttaaaatg

SEQ ID NO: 377159 - DNA, 20 bp, Artificial
  CRISPR gRNA sequence
agggaaggaagaaaagaaaa

SEQ ID NO: 377160 - DNA, 20 bp, Artificial
  CRISPR gRNA sequence
gaaaagaaaagggaatggaa

SEQ ID NO: 377161 - DNA, 20 bp, Artificial
  CRISPR gRNA sequence
gaagggaaggaaagatggaa

SEQ ID NO: 377162 - DNA, 20 bp, Artificial
  CRISPR gRNA sequence
ttttctcacaatcatacaaa

SEQ ID NO: 377163 - DNA, 20 bp, Artificial
  CRISPR gRNA sequence
gatctaggttttgtgggggc

SEQ ID NO: 377164 - DNA, 20 bp, Artificial
  CRISPR gRNA sequence
gctggaatcttacacaattt

SEQ ID NO: 377165 - DNA, 20 bp, Artificial
  CRISPR gRNA sequence
gaggcagagctgggagagcc

SEQ ID NO: 377166 - DNA, 20 bp, Artificial
  CRISPR gRNA sequence
ttttctcatactcatgcaaa

SEQ ID NO: 377167 - DNA, 20 bp, Artificial
  CRISPR gRNA sequence
gtggttcttatagtatgttt

SEQ ID NO: 377168 - DNA, 20 bp, Artificial
  CRISPR gRNA sequence
tagtatgtttgggggtccct

SEQ ID NO: 377169 - DNA, 20 bp, Artificial
  CRISPR gRNA sequence
aggatccctgtgtccctttt

SEQ ID NO: 377170 - DNA, 20 bp, Artificial
  CRISPR gRNA sequence
ctagcactgtcttgtattgc

SEQ ID NO: 377171 - DNA, 20 bp, Artificial
  CRISPR gRNA sequence
cttgtattgctggggtatgt

SEQ ID NO: 377172 - DNA, 20 bp, Artificial
  CRISPR gRNA sequence
attcatgtaattgggaagat

SEQ ID NO: 377173 - DNA, 20 bp, Artificial
  CRISPR gRNA sequence
catatgtttttcagcccttt

SEQ ID NO: 377174 - DNA, 20 bp, Artificial
  CRISPR gRNA sequence
cgaatttcttttttaagctt

SEQ ID NO: 377175 - DNA, 20 bp, Artificial
  CRISPR gRNA sequence
tttattgctgtatctgattg

SEQ ID NO: 377176 - DNA, 20 bp, Artificial
  CRISPR gRNA sequence
gataaagaaaccctcaatac

SEQ ID NO: 377177 - DNA, 20 bp, Artificial
  CRISPR gRNA sequence
ttcagccatttaaaaaaatg

SEQ ID NO: 377178 - DNA, 20 bp, Artificial
  CRISPR gRNA sequence
caagtagcagcggtaaagcc

SEQ ID NO: 377179 - DNA, 20 bp, Artificial
  CRISPR gRNA sequence
gagtctgagactgtgacatc

SEQ ID NO: 377180 - DNA, 20 bp, Artificial
  CRISPR gRNA sequence
aagaggtcgatctgacgggg

SEQ ID NO: 377181 - DNA, 20 bp, Artificial
  CRISPR gRNA sequence
acgtcatctgaggctgacaa

SEQ ID NO: 377182 - DNA, 20 bp, Artificial
  CRISPR gRNA sequence
cctaacacagttcttccgtt

SEQ ID NO: 377183 - DNA, 20 bp, Artificial
  CRISPR gRNA sequence
tttttttttttttcctgaga

SEQ ID NO: 377184 - DNA, 20 bp, Artificial
  CRISPR gRNA sequence
tcttgctctgtcacccagac

SEQ ID NO: 377185 - DNA, 20 bp, Artificial
  CRISPR gRNA sequence
cattctcctgcctcagcctc

SEQ ID NO: 377186 - DNA, 20 bp, Artificial
  CRISPR gRNA sequence
cgggctttcaccgtgttagc

SEQ ID NO: 377187 - DNA, 20 bp, Artificial
  CRISPR gRNA sequence
acctcggcctcccaaagtgc

SEQ ID NO: 377188 - DNA, 20 bp, Artificial
  CRISPR gRNA sequence
atgagccaccgcacccagtt

SEQ ID NO: 377189 - DNA, 20 bp, Artificial
  CRISPR gRNA sequence
tgacacattcttgtaagaga

SEQ ID NO: 377190 - DNA, 20 bp, Artificial
  CRISPR gRNA sequence
tccgggagataaatagaaaa

SEQ ID NO: 377191 - DNA, 20 bp, Artificial
  CRISPR gRNA sequence
cttggtatcatatcaagagg

SEQ ID NO: 377192 - DNA, 20 bp, Artificial
  CRISPR gRNA sequence
aagataccaaatcattctca

SEQ ID NO: 377193 - DNA, 20 bp, Artificial
  CRISPR gRNA sequence
gatctcattcttcagatata

SEQ ID NO: 377194 - DNA, 20 bp, Artificial
  CRISPR gRNA sequence
tatacagggttgtcttacac

SEQ ID NO: 377195 - DNA, 20 bp, Artificial
  CRISPR gRNA sequence
agggttgtcttacacatggg

SEQ ID NO: 377196 - DNA, 20 bp, Artificial
  CRISPR gRNA sequence
caccttcctcacaccatttc

SEQ ID NO: 377197 - DNA, 20 bp, Artificial
  CRISPR gRNA sequence
atatctaagtccatggtcct

SEQ ID NO: 377198 - DNA, 20 bp, Artificial
  CRISPR gRNA sequence
ggcatctctgtgtcccttta

SEQ ID NO: 377199 - DNA, 20 bp, Artificial
  CRISPR gRNA sequence
taatttttaaaatagcataa

SEQ ID NO: 377200 - DNA, 20 bp, Artificial
  CRISPR gRNA sequence
aagtttgggaacccgatcta

SEQ ID NO: 377201 - DNA, 20 bp, Artificial
  CRISPR gRNA sequence
ataacccagcaaggtaacaa

SEQ ID NO: 377202 - DNA, 20 bp, Artificial
  CRISPR gRNA sequence
atcctgacctgctatttcag

SEQ ID NO: 377203 - DNA, 20 bp, Artificial
  CRISPR gRNA sequence
agatgtcacatttcgaaaga

SEQ ID NO: 377204 - DNA, 20 bp, Artificial
  CRISPR gRNA sequence
agatttgccatctattgaac

SEQ ID NO: 377205 - DNA, 20 bp, Artificial
  CRISPR gRNA sequence
cctgggaagtaagaggcagc

SEQ ID NO: 377206 - DNA, 20 bp, Artificial
  CRISPR gRNA sequence
tgtttttcttcttcttctct

SEQ ID NO: 377207 - DNA, 20 bp, Artificial
  CRISPR gRNA sequence
atgccgccccgtccaatctc

SEQ ID NO: 377208 - DNA, 20 bp, Artificial
  CRISPR gRNA sequence
ctgccgactcaggtagaaac

SEQ ID NO: 377209 - DNA, 20 bp, Artificial
  CRISPR gRNA sequence
gcaatggggaaaatcctaga

SEQ ID NO: 377210 - DNA, 20 bp, Artificial
  CRISPR gRNA sequence
agccaggtggttcagaagct

SEQ ID NO: 377211 - DNA, 20 bp, Artificial
  CRISPR gRNA sequence
gattaacctttcctgacaaa

SEQ ID NO: 377212 - DNA, 20 bp, Artificial
  CRISPR gRNA sequence
ccacacaaacaagagaaccg

SEQ ID NO: 377213 - DNA, 20 bp, Artificial
  CRISPR gRNA sequence
ccgtgggatcctgatgaact

SEQ ID NO: 377214 - DNA, 20 bp, Artificial
  CRISPR gRNA sequence
gatgaacttggaattggaaa

SEQ ID NO: 377215 - DNA, 20 bp, Artificial
  CRISPR gRNA sequence
tgtagctacgtattaatact

SEQ ID NO: 377216 - DNA, 20 bp, Artificial
  CRISPR gRNA sequence
attaatacttagaataaaca

SEQ ID NO: 377217 - DNA, 20 bp, Artificial
  CRISPR gRNA sequence
ttttcccatgatttttattg

SEQ ID NO: 377218 - DNA, 20 bp, Artificial
  CRISPR gRNA sequence
ttccaaccactgctcatgtc

SEQ ID NO: 377219 - DNA, 20 bp, Artificial
  CRISPR gRNA sequence
cctgggtaccccaaacattg

SEQ ID NO: 377220 - DNA, 20 bp, Artificial
  CRISPR gRNA sequence
ttcacccacttcacaaaacc

SEQ ID NO: 377221 - DNA, 20 bp, Artificial
  CRISPR gRNA sequence
gagaagtcaatcaatatttt

SEQ ID NO: 377222 - DNA, 20 bp, Artificial
  CRISPR gRNA sequence
ataaaaaatttgccaaccta

SEQ ID NO: 377223 - DNA, 20 bp, Artificial
  CRISPR gRNA sequence
gaaaacgaccccattaaaaa

SEQ ID NO: 377224 - DNA, 20 bp, Artificial
  CRISPR gRNA sequence
agacaccatctcataccagt

SEQ ID NO: 377225 - DNA, 20 bp, Artificial
  CRISPR gRNA sequence
aacacttatacactgttggt

SEQ ID NO: 377226 - DNA, 20 bp, Artificial
  CRISPR gRNA sequence
attcctgggcatatacccag

SEQ ID NO: 377227 - DNA, 20 bp, Artificial
  CRISPR gRNA sequence
ctataaagacacatatgtac

SEQ ID NO: 377228 - DNA, 20 bp, Artificial
  CRISPR gRNA sequence
aaacgtccatcagtgacaga

SEQ ID NO: 377229 - DNA, 20 bp, Artificial
  CRISPR gRNA sequence
aatgtgttacatattcatca

SEQ ID NO: 377230 - DNA, 20 bp, Artificial
  CRISPR gRNA sequence
aatactatgcagccataaaa

SEQ ID NO: 377231 - DNA, 20 bp, Artificial
  CRISPR gRNA sequence
atcatatgttttgtgggaac

SEQ ID NO: 377232 - DNA, 20 bp, Artificial
  CRISPR gRNA sequence
tatcctcagtaaactaatgc

SEQ ID NO: 377233 - DNA, 20 bp, Artificial
  CRISPR gRNA sequence
tcactttcaaatgggagcta

SEQ ID NO: 377234 - DNA, 20 bp, Artificial
  CRISPR gRNA sequence
aaagaaggaaacaacagaca

SEQ ID NO: 377235 - DNA, 20 bp, Artificial
  CRISPR gRNA sequence
actgggtctagttgagagcg

SEQ ID NO: 377236 - DNA, 20 bp, Artificial
  CRISPR gRNA sequence
actttgcgaggccgaggcgg

SEQ ID NO: 377237 - DNA, 20 bp, Artificial
  CRISPR gRNA sequence
tactcgggaggctgaggcag

SEQ ID NO: 377238 - DNA, 20 bp, Artificial
  CRISPR gRNA sequence
atagtattagtcatgcctaa

SEQ ID NO: 377239 - DNA, 20 bp, Artificial
  CRISPR gRNA sequence
tagtcatgcctaaacgaatt

SEQ ID NO: 377240 - DNA, 20 bp, Artificial
  CRISPR gRNA sequence
accatgggaaagcagcccac

SEQ ID NO: 377241 - DNA, 20 bp, Artificial
  CRISPR gRNA sequence
caaaaaaatgaaaggtggag

SEQ ID NO: 377242 - DNA, 20 bp, Artificial
  CRISPR gRNA sequence
gaaattattgctgttttgtg

SEQ ID NO: 377243 - DNA, 20 bp, Artificial
  CRISPR gRNA sequence
tgatgagatgacttaatggc

SEQ ID NO: 377244 - DNA, 20 bp, Artificial
  CRISPR gRNA sequence
caaattaatcaagggaaaga

SEQ ID NO: 377245 - DNA, 20 bp, Artificial
  CRISPR gRNA sequence
tactcaggaggctgaggcag

SEQ ID NO: 377246 - DNA, 20 bp, Artificial
  CRISPR gRNA sequence
gcaagagaaggaacctaaat

SEQ ID NO: 377247 - DNA, 20 bp, Artificial
  CRISPR gRNA sequence
agagctgagctggcaaagaa

SEQ ID NO: 377248 - DNA, 20 bp, Artificial
  CRISPR gRNA sequence
ttctctctctcacctctaaa

SEQ ID NO: 377249 - DNA, 20 bp, Artificial
  CRISPR gRNA sequence
ccctattcattcaaaattcc

SEQ ID NO: 377250 - DNA, 20 bp, Artificial
  CRISPR gRNA sequence
attcattcaaaattccagga

SEQ ID NO: 377251 - DNA, 20 bp, Artificial
  CRISPR gRNA sequence
atgtcatcagtgttcttgac

SEQ ID NO: 377252 - DNA, 20 bp, Artificial
  CRISPR gRNA sequence
cagtgttcttgacctgaatg

SEQ ID NO: 377253 - DNA, 20 bp, Artificial
  CRISPR gRNA sequence
aaaatgtgtgttgtgccccc

SEQ ID NO: 377254 - DNA, 20 bp, Artificial
  CRISPR gRNA sequence
tccctgtctactcaccatcg

SEQ ID NO: 377255 - DNA, 20 bp, Artificial
  CRISPR gRNA sequence
tgctcagtcagacctctccc

SEQ ID NO: 377256 - DNA, 20 bp, Artificial
  CRISPR gRNA sequence
ttcccaactgtgcctagact

SEQ ID NO: 377257 - DNA, 20 bp, Artificial
  CRISPR gRNA sequence
agaaacacagacacaaaagg

SEQ ID NO: 377258 - DNA, 20 bp, Artificial
  CRISPR gRNA sequence
cacaaaaggcagaattttcc

SEQ ID NO: 377259 - DNA, 20 bp, Artificial
  CRISPR gRNA sequence
agctgtcaggcagcttcaag

SEQ ID NO: 377260 - DNA, 20 bp, Artificial
  CRISPR gRNA sequence
cgcatcagcattcccagaaa

SEQ ID NO: 377261 - DNA, 20 bp, Artificial
  CRISPR gRNA sequence
catagacagcaatgacagta

SEQ ID NO: 377262 - DNA, 20 bp, Artificial
  CRISPR gRNA sequence
gttcccagatggccaagttt

SEQ ID NO: 377263 - DNA, 20 bp, Artificial
  CRISPR gRNA sequence
aagtttggggatgttacagg

SEQ ID NO: 377264 - DNA, 20 bp, Artificial
  CRISPR gRNA sequence
tagttaacatgaagtcatcc

SEQ ID NO: 377265 - DNA, 20 bp, Artificial
  CRISPR gRNA sequence
aacatgaagtcatcctggaa

SEQ ID NO: 377266 - DNA, 20 bp, Artificial
  CRISPR gRNA sequence
ggggaaattctgacacaggc

SEQ ID NO: 377267 - DNA, 20 bp, Artificial
  CRISPR gRNA sequence
aagcagaacgccatgtgaag

SEQ ID NO: 377268 - DNA, 20 bp, Artificial
  CRISPR gRNA sequence
tgtgaagatgaatgcagaga

SEQ ID NO: 377269 - DNA, 20 bp, Artificial
  CRISPR gRNA sequence
gcagctctaggacactaata

SEQ ID NO: 377270 - DNA, 20 bp, Artificial
  CRISPR gRNA sequence
aggaccatcaggacgacatc

SEQ ID NO: 377271 - DNA, 20 bp, Artificial
  CRISPR gRNA sequence
aaaggcacagataaagtggg

SEQ ID NO: 377272 - DNA, 20 bp, Artificial
  CRISPR gRNA sequence
gcacagataaagtgggaaga

SEQ ID NO: 377273 - DNA, 20 bp, Artificial
  CRISPR gRNA sequence
gcgtgtcctgcatggcaaat

SEQ ID NO: 377274 - DNA, 20 bp, Artificial
  CRISPR gRNA sequence
ctttgtgattcagattaccc

SEQ ID NO: 377275 - DNA, 20 bp, Artificial
  CRISPR gRNA sequence
ggggcagctccgtggagctc

SEQ ID NO: 377276 - DNA, 20 bp, Artificial
  CRISPR gRNA sequence
ttggctcctgaaaggtaacc

SEQ ID NO: 377277 - DNA, 20 bp, Artificial
  CRISPR gRNA sequence
tctctccaccatggtacaat

SEQ ID NO: 377278 - DNA, 20 bp, Artificial
  CRISPR gRNA sequence
agtcagtatcataagatttg

SEQ ID NO: 377279 - DNA, 20 bp, Artificial
  CRISPR gRNA sequence
ccagaaaaattactgactaa

SEQ ID NO: 377280 - DNA, 20 bp, Artificial
  CRISPR gRNA sequence
attactgactaatgggatat

SEQ ID NO: 377281 - DNA, 20 bp, Artificial
  CRISPR gRNA sequence
tctctaatgattctgtacta

SEQ ID NO: 377282 - DNA, 20 bp, Artificial
  CRISPR gRNA sequence
agtaaaataataagccttga

SEQ ID NO: 377283 - DNA, 20 bp, Artificial
  CRISPR gRNA sequence
cacaaataagtcacccagct

SEQ ID NO: 377284 - DNA, 20 bp, Artificial
  CRISPR gRNA sequence
gaagggactccggtgacagc

SEQ ID NO: 377285 - DNA, 20 bp, Artificial
  CRISPR gRNA sequence
ttttccaccctgcagcaggg

SEQ ID NO: 377286 - DNA, 20 bp, Artificial
  CRISPR gRNA sequence
tcagaggcaacatcagctcc

SEQ ID NO: 377287 - DNA, 20 bp, Artificial
  CRISPR gRNA sequence
aaggaagatgtttcccacag

SEQ ID NO: 377288 - DNA, 20 bp, Artificial
  CRISPR gRNA sequence
ctagccttgtccctgccaag

SEQ ID NO: 377289 - DNA, 20 bp, Artificial
  CRISPR gRNA sequence
cggggcagagggcagagaag

SEQ ID NO: 377290 - DNA, 20 bp, Artificial
  CRISPR gRNA sequence
gcagagggcagagaaggaga

SEQ ID NO: 377291 - DNA, 20 bp, Artificial
  CRISPR gRNA sequence
aaggagagtgagtggaagtg

SEQ ID NO: 377292 - DNA, 20 bp, Artificial
  CRISPR gRNA sequence
tccttcatccacaaagatta

SEQ ID NO: 377293 - DNA, 20 bp, Artificial
  CRISPR gRNA sequence
gggtgtaaataaaacacaga

SEQ ID NO: 377294 - DNA, 20 bp, Artificial
  CRISPR gRNA sequence
agacccaaagagacagagct

SEQ ID NO: 377295 - DNA, 20 bp, Artificial
  CRISPR gRNA sequence
aagattctctcaccaaacac

SEQ ID NO: 377296 - DNA, 20 bp, Artificial
  CRISPR gRNA sequence
agcgctgcaaaaatctcgtc

SEQ ID NO: 377297 - DNA, 20 bp, Artificial
  CRISPR gRNA sequence
tatggctctctcctgaaaat

SEQ ID NO: 377298 - DNA, 20 bp, Artificial
  CRISPR gRNA sequence
tggccgcaggcaagaaaggt

SEQ ID NO: 377299 - DNA, 20 bp, Artificial
  CRISPR gRNA sequence
tgaggatttcttggaggact

SEQ ID NO: 377300 - DNA, 20 bp, Artificial
  CRISPR gRNA sequence
gtaagggaaaatggcaaatg

SEQ ID NO: 377301 - DNA, 20 bp, Artificial
  CRISPR gRNA sequence
ctgaaagatgaaatctttgc

SEQ ID NO: 377302 - DNA, 20 bp, Artificial
  CRISPR gRNA sequence
cgctaggttggagcactgcc

SEQ ID NO: 377303 - DNA, 20 bp, Artificial
  CRISPR gRNA sequence
agggtggctggagcctgcct

SEQ ID NO: 377304 - DNA, 20 bp, Artificial
  CRISPR gRNA sequence
gatccagtgactgaccctgg

SEQ ID NO: 377305 - DNA, 20 bp, Artificial
  CRISPR gRNA sequence
ggcagcttccctagacttcg

SEQ ID NO: 377306 - DNA, 20 bp, Artificial
  CRISPR gRNA sequence
cgctggatcctgtgcccttg

SEQ ID NO: 377307 - DNA, 20 bp, Artificial
  CRISPR gRNA sequence
tttccaatccagatcccctg

SEQ ID NO: 377308 - DNA, 20 bp, Artificial
  CRISPR gRNA sequence
ttccctgcgaacacttccta

SEQ ID NO: 377309 - DNA, 20 bp, Artificial
  CRISPR gRNA sequence
cttctcagggactgcttctg

SEQ ID NO: 377310 - DNA, 20 bp, Artificial
  CRISPR gRNA sequence
actaaattgtacttggagcc

SEQ ID NO: 377311 - DNA, 20 bp, Artificial
  CRISPR gRNA sequence
ttttttgtttgtttttcaga

SEQ ID NO: 377312 - DNA, 20 bp, Artificial
  CRISPR gRNA sequence
tcccactctgttgcccaggc

SEQ ID NO: 377313 - DNA, 20 bp, Artificial
  CRISPR gRNA sequence
gtatcttgactcagcacctc

SEQ ID NO: 377314 - DNA, 20 bp, Artificial
  CRISPR gRNA sequence
aattctgctgcctcagcctc

SEQ ID NO: 377315 - DNA, 20 bp, Artificial
  CRISPR gRNA sequence
gcctcagcctcccgagtaac

SEQ ID NO: 377316 - DNA, 20 bp, Artificial
  CRISPR gRNA sequence
ttttgtatttttagtagaga

SEQ ID NO: 377317 - DNA, 20 bp, Artificial
  CRISPR gRNA sequence
acctcggcctcccaaagtgc

SEQ ID NO: 377318 - DNA, 20 bp, Artificial
  CRISPR gRNA sequence
tgtgccaccacacctggccc

SEQ ID NO: 377319 - DNA, 20 bp, Artificial
  CRISPR gRNA sequence
tgtcttcttgataacatgac

SEQ ID NO: 377320 - DNA, 20 bp, Artificial
  CRISPR gRNA sequence
aaatctctctcatagaagca

SEQ ID NO: 377321 - DNA, 20 bp, Artificial
  CRISPR gRNA sequence
tctctcatagaagcagaggg

SEQ ID NO: 377322 - DNA, 20 bp, Artificial
  CRISPR gRNA sequence
ggatggtgcttacagtggct

SEQ ID NO: 377323 - DNA, 20 bp, Artificial
  CRISPR gRNA sequence
ttacagtggctggggattgg

SEQ ID NO: 377324 - DNA, 20 bp, Artificial
  CRISPR gRNA sequence
gctggggattgggagaatga

SEQ ID NO: 377325 - DNA, 20 bp, Artificial
  CRISPR gRNA sequence
aatgaggggataacggttaa

SEQ ID NO: 377326 - DNA, 20 bp, Artificial
  CRISPR gRNA sequence
cctcagtcagacagaagaca

SEQ ID NO: 377327 - DNA, 20 bp, Artificial
  CRISPR gRNA sequence
agcttgatgcatataaataa

SEQ ID NO: 377328 - DNA, 20 bp, Artificial
  CRISPR gRNA sequence
tgcccatttcaaaatttcta

SEQ ID NO: 377329 - DNA, 20 bp, Artificial
  CRISPR gRNA sequence
catttcaaaatttctagaga

SEQ ID NO: 377330 - DNA, 20 bp, Artificial
  CRISPR gRNA sequence
aaaaaaagttaagtatttga

SEQ ID NO: 377331 - DNA, 20 bp, Artificial
  CRISPR gRNA sequence
aaagttaagtatttgagagg

SEQ ID NO: 377332 - DNA, 20 bp, Artificial
  CRISPR gRNA sequence
gtttgtaccctataaattta

SEQ ID NO: 377333 - DNA, 20 bp, Artificial
  CRISPR gRNA sequence
ccacagtaatctctcagcca

SEQ ID NO: 377334 - DNA, 20 bp, Artificial
  CRISPR gRNA sequence
ctttccacatttttgtgtaa

SEQ ID NO: 377335 - DNA, 20 bp, Artificial
  CRISPR gRNA sequence
aaaagcttgccagttaattg

SEQ ID NO: 377336 - DNA, 20 bp, Artificial
  CRISPR gRNA sequence
gcttgccagttaattgtagg

SEQ ID NO: 377337 - DNA, 20 bp, Artificial
  CRISPR gRNA sequence
tatataatagcttgtacata

SEQ ID NO: 377338 - DNA, 20 bp, Artificial
  CRISPR gRNA sequence
tggatgattaataaatactt

SEQ ID NO: 377339 - DNA, 20 bp, Artificial
  CRISPR gRNA sequence
aattcatttactacatctgt

SEQ ID NO: 377340 - DNA, 20 bp, Artificial
  CRISPR gRNA sequence
aaagaaatctgcacaacagc

SEQ ID NO: 377341 - DNA, 20 bp, Artificial
  CRISPR gRNA sequence
gaacagtgttcttaaccaaa

SEQ ID NO: 377342 - DNA, 20 bp, Artificial
  CRISPR gRNA sequence
tctccattctcatctcctac

SEQ ID NO: 377343 - DNA, 20 bp, Artificial
  CRISPR gRNA sequence
gcatcagctatctcttcttc

SEQ ID NO: 377344 - DNA, 20 bp, Artificial
  CRISPR gRNA sequence
aataattttggggggactac

SEQ ID NO: 377345 - DNA, 20 bp, Artificial
  CRISPR gRNA sequence
gatgatgtgttgtaaattta

SEQ ID NO: 377346 - DNA, 20 bp, Artificial
  CRISPR gRNA sequence
ttttccagtccaggccctac

SEQ ID NO: 377347 - DNA, 20 bp, Artificial
  CRISPR gRNA sequence
agtccaggccctacatgagt

SEQ ID NO: 377348 - DNA, 20 bp, Artificial
  CRISPR gRNA sequence
aacaatattaaaaaaccagt

SEQ ID NO: 377349 - DNA, 20 bp, Artificial
  CRISPR gRNA sequence
gtgtgagtacagctattagc

SEQ ID NO: 377350 - DNA, 20 bp, Artificial
  CRISPR gRNA sequence
actaacagcaagagggaaac

SEQ ID NO: 377351 - DNA, 20 bp, Artificial
  CRISPR gRNA sequence
gagtgtccatggtatttatt

SEQ ID NO: 377352 - DNA, 20 bp, Artificial
  CRISPR gRNA sequence
ttggatttgcaatgaaattt

SEQ ID NO: 377353 - DNA, 20 bp, Artificial
  CRISPR gRNA sequence
accaagcattagttgaaata

SEQ ID NO: 377354 - DNA, 20 bp, Artificial
  CRISPR gRNA sequence
ttgaaatagagaatattgga

SEQ ID NO: 377355 - DNA, 20 bp, Artificial
  CRISPR gRNA sequence
agttagaacatgtgtgtgct

SEQ ID NO: 377356 - DNA, 20 bp, Artificial
  CRISPR gRNA sequence
aacatgtgtgtgctctgaat

SEQ ID NO: 377357 - DNA, 20 bp, Artificial
  CRISPR gRNA sequence
aaagaaggaggcagccctgt

SEQ ID NO: 377358 - DNA, 20 bp, Artificial
  CRISPR gRNA sequence
caacatctcagtgacgctgc

SEQ ID NO: 377359 - DNA, 20 bp, Artificial
  CRISPR gRNA sequence
cttgatatgatgtgatgaga

SEQ ID NO: 377360 - DNA, 20 bp, Artificial
  CRISPR gRNA sequence
tccatattcccagtctaatc

SEQ ID NO: 377361 - DNA, 20 bp, Artificial
  CRISPR gRNA sequence
ctagtattcctcaggcctca

SEQ ID NO: 377362 - DNA, 20 bp, Artificial
  CRISPR gRNA sequence
gaggacaaaacataatcact

SEQ ID NO: 377363 - DNA, 20 bp, Artificial
  CRISPR gRNA sequence
gatccaaataaagtctagag

SEQ ID NO: 377364 - DNA, 20 bp, Artificial
  CRISPR gRNA sequence
gatgttaacaatgggggaga

SEQ ID NO: 377365 - DNA, 20 bp, Artificial
  CRISPR gRNA sequence
acaatgggggagactggata

SEQ ID NO: 377366 - DNA, 20 bp, Artificial
  CRISPR gRNA sequence
taaaatttaaagattattag

SEQ ID NO: 377367 - DNA, 20 bp, Artificial
  CRISPR gRNA sequence
agggtaagagggccagattt

SEQ ID NO: 377368 - DNA, 20 bp, Artificial
  CRISPR gRNA sequence
aagacagatggtagagcaga

SEQ ID NO: 377369 - DNA, 20 bp, Artificial
  CRISPR gRNA sequence
aatgtttttgcaacaccatc

SEQ ID NO: 377370 - DNA, 20 bp, Artificial
  CRISPR gRNA sequence
tcttgagtggtacaaggcaa

SEQ ID NO: 377371 - DNA, 20 bp, Artificial
  CRISPR gRNA sequence
actgcagtcggttaggaaag

SEQ ID NO: 377372 - DNA, 20 bp, Artificial
  CRISPR gRNA sequence
gttaggaaagaggaataata

SEQ ID NO: 377373 - DNA, 20 bp, Artificial
  CRISPR gRNA sequence
aggaataataatgagttctc

SEQ ID NO: 377374 - DNA, 20 bp, Artificial
  CRISPR gRNA sequence
ccgaggccataaatagcaaa

SEQ ID NO: 377375 - DNA, 20 bp, Artificial
  CRISPR gRNA sequence
gcaaactgggtgttggcgaa

SEQ ID NO: 377376 - DNA, 20 bp, Artificial
  CRISPR gRNA sequence
ataggtccatgttggcacat

SEQ ID NO: 377377 - DNA, 20 bp, Artificial
  CRISPR gRNA sequence
agttaatcttattttttgaa

SEQ ID NO: 377378 - DNA, 20 bp, Artificial
  CRISPR gRNA sequence
aggcttcagtggaacaggtt

SEQ ID NO: 377379 - DNA, 20 bp, Artificial
  CRISPR gRNA sequence
gccccatctttcccttgagg

SEQ ID NO: 377380 - DNA, 20 bp, Artificial
  CRISPR gRNA sequence
tttcccttgaggaagggtaa

SEQ ID NO: 377381 - DNA, 20 bp, Artificial
  CRISPR gRNA sequence
ccttgaggaagggtaataga

SEQ ID NO: 377382 - DNA, 20 bp, Artificial
  CRISPR gRNA sequence
aatgctgacatttatccaac

SEQ ID NO: 377383 - DNA, 20 bp, Artificial
  CRISPR gRNA sequence
gaccttaaagtccatgttca

SEQ ID NO: 377384 - DNA, 20 bp, Artificial
  CRISPR gRNA sequence
tcggcaatactcacacacac

SEQ ID NO: 377385 - DNA, 20 bp, Artificial
  CRISPR gRNA sequence
tgctaacactcatataagtt

SEQ ID NO: 377386 - DNA, 20 bp, Artificial
  CRISPR gRNA sequence
caattcactcaaaatgaggc

SEQ ID NO: 377387 - DNA, 20 bp, Artificial
  CRISPR gRNA sequence
attcttttctcaaaataaaa

SEQ ID NO: 377388 - DNA, 20 bp, Artificial
  CRISPR gRNA sequence
actaataagcatactgaact

SEQ ID NO: 377389 - DNA, 20 bp, Artificial
  CRISPR gRNA sequence
ggacttaactttttgttcag

SEQ ID NO: 377390 - DNA, 20 bp, Artificial
  CRISPR gRNA sequence
ttttattatactttaagttc

SEQ ID NO: 377391 - DNA, 20 bp, Artificial
  CRISPR gRNA sequence
ccatatgtagaaagctgaaa

SEQ ID NO: 377392 - DNA, 20 bp, Artificial
  CRISPR gRNA sequence
tatacaaaaattaattcaag

SEQ ID NO: 377393 - DNA, 20 bp, Artificial
  CRISPR gRNA sequence
atctgcaatgttgtcataaa

SEQ ID NO: 377394 - DNA, 20 bp, Artificial
  CRISPR gRNA sequence
atccacatatcttttccttc

SEQ ID NO: 377395 - DNA, 20 bp, Artificial
  CRISPR gRNA sequence
ttccttcctgagttctgaga

SEQ ID NO: 377396 - DNA, 20 bp, Artificial
  CRISPR gRNA sequence
atgtcacctctgatttgctc

SEQ ID NO: 377397 - DNA, 20 bp, Artificial
  CRISPR gRNA sequence
catttacaattcagtgaagt

SEQ ID NO: 377398 - DNA, 20 bp, Artificial
  CRISPR gRNA sequence
gattattgtatcattttata

SEQ ID NO: 377399 - DNA, 20 bp, Artificial
  CRISPR gRNA sequence
attttatagaggatgaaatt

SEQ ID NO: 377400 - DNA, 20 bp, Artificial
  CRISPR gRNA sequence
cagggtagagaagtaaagag

SEQ ID NO: 377401 - DNA, 20 bp, Artificial
  CRISPR gRNA sequence
gtaaagagaagaatcagtct

SEQ ID NO: 377402 - DNA, 20 bp, Artificial
  CRISPR gRNA sequence
atctaatcacttgtaacaaa

SEQ ID NO: 377403 - DNA, 20 bp, Artificial
  CRISPR gRNA sequence
tctcactggtttcttataac

SEQ ID NO: 377404 - DNA, 20 bp, Artificial
  CRISPR gRNA sequence
taaatgacactctgcttatt

SEQ ID NO: 377405 - DNA, 20 bp, Artificial
  CRISPR gRNA sequence
ctagcaccagcaccagatgg

SEQ ID NO: 377406 - DNA, 20 bp, Artificial
  CRISPR gRNA sequence
atggtgggataaacgggctc

SEQ ID NO: 377407 - DNA, 20 bp, Artificial
  CRISPR gRNA sequence
agaagagagagagacatcac

SEQ ID NO: 377408 - DNA, 20 bp, Artificial
  CRISPR gRNA sequence
agagacatcacaagaatacc

SEQ ID NO: 377409 - DNA, 20 bp, Artificial
  CRISPR gRNA sequence
tgaagagataagtgtgccta

SEQ ID NO: 377410 - DNA, 20 bp, Artificial
  CRISPR gRNA sequence
cacagagcacagatcaaaga

SEQ ID NO: 377411 - DNA, 20 bp, Artificial
  CRISPR gRNA sequence
tatttaagctttttatttct

SEQ ID NO: 377412 - DNA, 20 bp, Artificial
  CRISPR gRNA sequence
aaaactgcctaaagcaactc

SEQ ID NO: 377413 - DNA, 20 bp, Artificial
  CRISPR gRNA sequence
gtaaacgtatgccatactct

SEQ ID NO: 377414 - DNA, 20 bp, Artificial
  CRISPR gRNA sequence
tactgtttaaattacaagcg

SEQ ID NO: 377415 - DNA, 20 bp, Artificial
  CRISPR gRNA sequence
gcgtggggtaagttggtgct

SEQ ID NO: 377416 - DNA, 20 bp, Artificial
  CRISPR gRNA sequence
ggaggcaggagaagtctctg

SEQ ID NO: 377417 - DNA, 20 bp, Artificial
  CRISPR gRNA sequence
gatggacctcacgagcaggc

SEQ ID NO: 377418 - DNA, 20 bp, Artificial
  CRISPR gRNA sequence
atgggcttcagatgtgctaa

SEQ ID NO: 377419 - DNA, 20 bp, Artificial
  CRISPR gRNA sequence
cagatgtgctaaaagaattg

SEQ ID NO: 377420 - DNA, 20 bp, Artificial
  CRISPR gRNA sequence
atgaggtttctggaaacaaa

SEQ ID NO: 377421 - DNA, 20 bp, Artificial
  CRISPR gRNA sequence
cagtatttatactaccatct

SEQ ID NO: 377422 - DNA, 20 bp, Artificial
  CRISPR gRNA sequence
ttggcttgtatgtattatgt

SEQ ID NO: 377423 - DNA, 20 bp, Artificial
  CRISPR gRNA sequence
ctacgaccttgacatttttg

SEQ ID NO: 377424 - DNA, 20 bp, Artificial
  CRISPR gRNA sequence
accatatatcaattattcca

SEQ ID NO: 377425 - DNA, 20 bp, Artificial
  CRISPR gRNA sequence
ttgagttcatggaccaagag

SEQ ID NO: 377426 - DNA, 20 bp, Artificial
  CRISPR gRNA sequence
attttctcactgaagggcta

SEQ ID NO: 377427 - DNA, 20 bp, Artificial
  CRISPR gRNA sequence
ttttggccctccttctaatt

SEQ ID NO: 377428 - DNA, 20 bp, Artificial
  CRISPR gRNA sequence
aaattgcaaaggaaagtcaa

SEQ ID NO: 377429 - DNA, 20 bp, Artificial
  CRISPR gRNA sequence
ttgaagtattagagctttac

SEQ ID NO: 377430 - DNA, 20 bp, Artificial
  CRISPR gRNA sequence
taatgattgacaatgccatt

SEQ ID NO: 377431 - DNA, 20 bp, Artificial
  CRISPR gRNA sequence
atttattacagaagagaaca

SEQ ID NO: 377432 - DNA, 20 bp, Artificial
  CRISPR gRNA sequence
gaagagaacattggatctga

SEQ ID NO: 377433 - DNA, 20 bp, Artificial
  CRISPR gRNA sequence
gctatttgctttattagtag

SEQ ID NO: 377434 - DNA, 20 bp, Artificial
  CRISPR gRNA sequence
tttgctttattagtagcaga

SEQ ID NO: 377435 - DNA, 20 bp, Artificial
  CRISPR gRNA sequence
tacactttagcaaatgatca

SEQ ID NO: 377436 - DNA, 20 bp, Artificial
  CRISPR gRNA sequence
atgtatttttaatctaataa

SEQ ID NO: 377437 - DNA, 20 bp, Artificial
  CRISPR gRNA sequence
tgccatggttctccatttgc

SEQ ID NO: 377438 - DNA, 20 bp, Artificial
  CRISPR gRNA sequence
cttagataaatatgcttcct

SEQ ID NO: 377439 - DNA, 20 bp, Artificial
  CRISPR gRNA sequence
acacactctttttctaagtt

SEQ ID NO: 377440 - DNA, 20 bp, Artificial
  CRISPR gRNA sequence
gcttcctaactctactgtct

SEQ ID NO: 377441 - DNA, 20 bp, Artificial
  CRISPR gRNA sequence
acaaaaaagccataaaattt

SEQ ID NO: 377442 - DNA, 20 bp, Artificial
  CRISPR gRNA sequence
aagccataaaatttggggat

SEQ ID NO: 377443 - DNA, 20 bp, Artificial
  CRISPR gRNA sequence
tggggatcagaatcaaatca

SEQ ID NO: 377444 - DNA, 20 bp, Artificial
  CRISPR gRNA sequence
atttcagaggtatattactg

SEQ ID NO: 377445 - DNA, 20 bp, Artificial
  CRISPR gRNA sequence
ggttacttataaaatcatgt

SEQ ID NO: 377446 - DNA, 20 bp, Artificial
  CRISPR gRNA sequence
acaaaaccaattttaaataa

SEQ ID NO: 377447 - DNA, 20 bp, Artificial
  CRISPR gRNA sequence
aattttaaataatagaattt

SEQ ID NO: 377448 - DNA, 20 bp, Artificial
  CRISPR gRNA sequence
ttaagaatgctctagtccta

SEQ ID NO: 377449 - DNA, 20 bp, Artificial
  CRISPR gRNA sequence
ttcctctcccaaaatatagt

SEQ ID NO: 377450 - DNA, 20 bp, Artificial
  CRISPR gRNA sequence
ggctgtcagactaatctgta

SEQ ID NO: 377451 - DNA, 20 bp, Artificial
  CRISPR gRNA sequence
aaaccacacaatatttttta

SEQ ID NO: 377452 - DNA, 20 bp, Artificial
  CRISPR gRNA sequence
taaatacacggttcatccac

SEQ ID NO: 377453 - DNA, 20 bp, Artificial
  CRISPR gRNA sequence
tgctcatcaagtttgcttta

SEQ ID NO: 377454 - DNA, 20 bp, Artificial
  CRISPR gRNA sequence
agcagtataactttctgcat

SEQ ID NO: 377455 - DNA, 20 bp, Artificial
  CRISPR gRNA sequence
tatacattacatagtacagc

SEQ ID NO: 377456 - DNA, 20 bp, Artificial
  CRISPR gRNA sequence
ctatgtatccccaaagcctc

SEQ ID NO: 377457 - DNA, 20 bp, Artificial
  CRISPR gRNA sequence
gcctcttccattgagctttc

SEQ ID NO: 377458 - DNA, 20 bp, Artificial
  CRISPR gRNA sequence
cttttttaaaaataaagcac

SEQ ID NO: 377459 - DNA, 20 bp, Artificial
  CRISPR gRNA sequence
tgttctcctacctgatttta

SEQ ID NO: 377460 - DNA, 20 bp, Artificial
  CRISPR gRNA sequence
agtttagttaagttgatagt

SEQ ID NO: 377461 - DNA, 20 bp, Artificial
  CRISPR gRNA sequence
gtttgagtttacttttccaa

SEQ ID NO: 377462 - DNA, 20 bp, Artificial
  CRISPR gRNA sequence
tacagcttcttggacaaggg

SEQ ID NO: 377463 - DNA, 20 bp, Artificial
  CRISPR gRNA sequence
acaaggggggagtcattgaa

SEQ ID NO: 377464 - DNA, 20 bp, Artificial
  CRISPR gRNA sequence
tcattgaaaaggatcaaaga

SEQ ID NO: 377465 - DNA, 20 bp, Artificial
  CRISPR gRNA sequence
ggaagttatagtgaaggaaa

SEQ ID NO: 377466 - DNA, 20 bp, Artificial
  CRISPR gRNA sequence
agtgaaggaaaatgagtggt

SEQ ID NO: 377467 - DNA, 20 bp, Artificial
  CRISPR gRNA sequence
atttagtcttcaacatggag

SEQ ID NO: 377468 - DNA, 20 bp, Artificial
  CRISPR gRNA sequence
aattaaacaaatctactttt

SEQ ID NO: 377469 - DNA, 20 bp, Artificial
  CRISPR gRNA sequence
tccctgaaagagcttacaaa

SEQ ID NO: 377470 - DNA, 20 bp, Artificial
  CRISPR gRNA sequence
actttgggaggccgaggcag

SEQ ID NO: 377471 - DNA, 20 bp, Artificial
  CRISPR gRNA sequence
caggtggatcacctgaggtc

SEQ ID NO: 377472 - DNA, 20 bp, Artificial
  CRISPR gRNA sequence
tacttgggaggctgaggcag

SEQ ID NO: 377473 - DNA, 20 bp, Artificial
  CRISPR gRNA sequence
ttgcactccagctttggtga

SEQ ID NO: 377474 - DNA, 20 bp, Artificial
  CRISPR gRNA sequence
ttaattaaaaagcagctatt

SEQ ID NO: 377475 - DNA, 20 bp, Artificial
  CRISPR gRNA sequence
taaaaagcagctattaagga

SEQ ID NO: 377476 - DNA, 20 bp, Artificial
  CRISPR gRNA sequence
aagcagctattaaggataga

SEQ ID NO: 377477 - DNA, 20 bp, Artificial
  CRISPR gRNA sequence
agacacccctgtgcaaatag

SEQ ID NO: 377478 - DNA, 20 bp, Artificial
  CRISPR gRNA sequence
catctgtataatttcgtgga

SEQ ID NO: 377479 - DNA, 20 bp, Artificial
  CRISPR gRNA sequence
ttgctgcactgatacagaca

SEQ ID NO: 377480 - DNA, 20 bp, Artificial
  CRISPR gRNA sequence
ggcttcaagcactgcgtcca

SEQ ID NO: 377481 - DNA, 20 bp, Artificial
  CRISPR gRNA sequence
agcactgcgtccaatgagta

SEQ ID NO: 377482 - DNA, 20 bp, Artificial
  CRISPR gRNA sequence
aatttgccacttcgtttctc

SEQ ID NO: 377483 - DNA, 20 bp, Artificial
  CRISPR gRNA sequence
cattttcaccataatattta

SEQ ID NO: 377484 - DNA, 20 bp, Artificial
  CRISPR gRNA sequence
atgtctagtatcaaaagaaa

SEQ ID NO: 377485 - DNA, 20 bp, Artificial
  CRISPR gRNA sequence
aaggagattacctaaatttt

SEQ ID NO: 377486 - DNA, 20 bp, Artificial
  CRISPR gRNA sequence
tttcgctgaacaatgcaggc

SEQ ID NO: 377487 - DNA, 20 bp, Artificial
  CRISPR gRNA sequence
aggcaaattgtttatcatga

SEQ ID NO: 377488 - DNA, 20 bp, Artificial
  CRISPR gRNA sequence
ttactgaacagtaccaaaca

SEQ ID NO: 377489 - DNA, 20 bp, Artificial
  CRISPR gRNA sequence
aacagtaccaaacaccgaat

SEQ ID NO: 377490 - DNA, 20 bp, Artificial
  CRISPR gRNA sequence
taaatgaagttatttcaaaa

SEQ ID NO: 377491 - DNA, 20 bp, Artificial
  CRISPR gRNA sequence
agtcggttactataagaagc

SEQ ID NO: 377492 - DNA, 20 bp, Artificial
  CRISPR gRNA sequence
tcactgaagccccgaccttt

SEQ ID NO: 377493 - DNA, 20 bp, Artificial
  CRISPR gRNA sequence
tttatatttttttgtagcaa

SEQ ID NO: 377494 - DNA, 20 bp, Artificial
  CRISPR gRNA sequence
cccaggctggtctcgaactc

SEQ ID NO: 377495 - DNA, 20 bp, Artificial
  CRISPR gRNA sequence
ggtctcgaactctaggatca

SEQ ID NO: 377496 - DNA, 20 bp, Artificial
  CRISPR gRNA sequence
gcctcagcctcccaaagtgc

SEQ ID NO: 377497 - DNA, 20 bp, Artificial
  CRISPR gRNA sequence
tgttcttcacattatgaaac

SEQ ID NO: 377498 - DNA, 20 bp, Artificial
  CRISPR gRNA sequence
aagataaaaacaatgcttca

SEQ ID NO: 377499 - DNA, 20 bp, Artificial
  CRISPR gRNA sequence
gcttcatggagtttataata

SEQ ID NO: 377500 - DNA, 20 bp, Artificial
  CRISPR gRNA sequence
tgtgtgataaacactttgca

SEQ ID NO: 377501 - DNA, 20 bp, Artificial
  CRISPR gRNA sequence
cactttgcagcggatgttta

SEQ ID NO: 377502 - DNA, 20 bp, Artificial
  CRISPR gRNA sequence
cattttaaagatattgtaac

SEQ ID NO: 377503 - DNA, 20 bp, Artificial
  CRISPR gRNA sequence
agggttatgactagcgaaga

SEQ ID NO: 377504 - DNA, 20 bp, Artificial
  CRISPR gRNA sequence
atttgaacacagaaatttga

SEQ ID NO: 377505 - DNA, 20 bp, Artificial
  CRISPR gRNA sequence
cttacgtacccaaatagtag

SEQ ID NO: 377506 - DNA, 20 bp, Artificial
  CRISPR gRNA sequence
taactacaaattattaattc

SEQ ID NO: 377507 - DNA, 20 bp, Artificial
  CRISPR gRNA sequence
accctgaaggcctcctcgca

SEQ ID NO: 377508 - DNA, 20 bp, Artificial
  CRISPR gRNA sequence
taacacatcttattgggcca

SEQ ID NO: 377509 - DNA, 20 bp, Artificial
  CRISPR gRNA sequence
attgtaagcatctccacaga

SEQ ID NO: 377510 - DNA, 20 bp, Artificial
  CRISPR gRNA sequence
gaagacccatgaggcccttc

SEQ ID NO: 377511 - DNA, 20 bp, Artificial
  CRISPR gRNA sequence
tcgtggattggccttatctt

SEQ ID NO: 377512 - DNA, 20 bp, Artificial
  CRISPR gRNA sequence
agtaactgtaagtcaaaggg

SEQ ID NO: 377513 - DNA, 20 bp, Artificial
  CRISPR gRNA sequence
gctctactgacttctttcct

SEQ ID NO: 377514 - DNA, 20 bp, Artificial
  CRISPR gRNA sequence
tttgatttagtttgggcttt

SEQ ID NO: 377515 - DNA, 20 bp, Artificial
  CRISPR gRNA sequence
gtttgggctttggggatttt

SEQ ID NO: 377516 - DNA, 20 bp, Artificial
  CRISPR gRNA sequence
attttatgggtttttttaat

SEQ ID NO: 377517 - DNA, 20 bp, Artificial
  CRISPR gRNA sequence
actccacttgaggaagtacc

SEQ ID NO: 377518 - DNA, 20 bp, Artificial
  CRISPR gRNA sequence
attaatataggcctaattca

SEQ ID NO: 377519 - DNA, 20 bp, Artificial
  CRISPR gRNA sequence
cattgtcaagaagtaaggcc

SEQ ID NO: 377520 - DNA, 20 bp, Artificial
  CRISPR gRNA sequence
agtaaggccttgagtatttg

SEQ ID NO: 377521 - DNA, 20 bp, Artificial
  CRISPR gRNA sequence
cgtttgtttattttttgaga

SEQ ID NO: 377522 - DNA, 20 bp, Artificial
  CRISPR gRNA sequence
tctcactctggcacccagcc

SEQ ID NO: 377523 - DNA, 20 bp, Artificial
  CRISPR gRNA sequence
acagatgcataccaccacaa

SEQ ID NO: 377524 - DNA, 20 bp, Artificial
  CRISPR gRNA sequence
gaaacagaccaggccattgt

SEQ ID NO: 377525 - DNA, 20 bp, Artificial
  CRISPR gRNA sequence
agtgctgaaaacgaacccct

SEQ ID NO: 377526 - DNA, 20 bp, Artificial
  CRISPR gRNA sequence
caggcagatcgcctaaggtc

SEQ ID NO: 377527 - DNA, 20 bp, Artificial
  CRISPR gRNA sequence
tactcaggaggctgaggcag

SEQ ID NO: 377528 - DNA, 20 bp, Artificial
  CRISPR gRNA sequence
gtgtcgtgttgcaggaagac

SEQ ID NO: 377529 - DNA, 20 bp, Artificial
  CRISPR gRNA sequence
gaagacaagaattgggggcc

SEQ ID NO: 377530 - DNA, 20 bp, Artificial
  CRISPR gRNA sequence
caagaattgggggccaggag

SEQ ID NO: 377531 - DNA, 20 bp, Artificial
  CRISPR gRNA sequence
gggctgaagttctcactggt

SEQ ID NO: 377532 - DNA, 20 bp, Artificial
  CRISPR gRNA sequence
cagaggcctaaaaaaattaa

SEQ ID NO: 377533 - DNA, 20 bp, Artificial
  CRISPR gRNA sequence
tagaagtgacacatctgatt

SEQ ID NO: 377534 - DNA, 20 bp, Artificial
  CRISPR gRNA sequence
actttgggaggccgaggcgg

SEQ ID NO: 377535 - DNA, 20 bp, Artificial
  CRISPR gRNA sequence
tacttgggaggctgaggcag

SEQ ID NO: 377536 - DNA, 20 bp, Artificial
  CRISPR gRNA sequence
aaaaaaaaaaaaaaaatcaa

SEQ ID NO: 377537 - DNA, 20 bp, Artificial
  CRISPR gRNA sequence
cagatgcagcatcatttatc

SEQ ID NO: 377538 - DNA, 20 bp, Artificial
  CRISPR gRNA sequence
acaagggagaaacgagcttc

SEQ ID NO: 377539 - DNA, 20 bp, Artificial
  CRISPR gRNA sequence
tccattatctgcatcgtatc

SEQ ID NO: 377540 - DNA, 20 bp, Artificial
  CRISPR gRNA sequence
gtactacacataactggctc

SEQ ID NO: 377541 - DNA, 20 bp, Artificial
  CRISPR gRNA sequence
taactggctcctgaatttat

SEQ ID NO: 377542 - DNA, 20 bp, Artificial
  CRISPR gRNA sequence
tggaaatttatattgcattg

SEQ ID NO: 377543 - DNA, 20 bp, Artificial
  CRISPR gRNA sequence
agatatatacaatatgcact

SEQ ID NO: 377544 - DNA, 20 bp, Artificial
  CRISPR gRNA sequence
acaaagtcaaagggcaacag

SEQ ID NO: 377545 - DNA, 20 bp, Artificial
  CRISPR gRNA sequence
ccaaaaaaaaaaaaaaaaaa

SEQ ID NO: 377546 - DNA, 20 bp, Artificial
  CRISPR gRNA sequence
caaataagcagtgaggccca

SEQ ID NO: 377547 - DNA, 20 bp, Artificial
  CRISPR gRNA sequence
tacacaacaaaagtttttca

SEQ ID NO: 377548 - DNA, 20 bp, Artificial
  CRISPR gRNA sequence
agtttttcagtgaataaaaa

SEQ ID NO: 377549 - DNA, 20 bp, Artificial
  CRISPR gRNA sequence
cagagtaacaaggacactaa

SEQ ID NO: 377550 - DNA, 20 bp, Artificial
  CRISPR gRNA sequence
ctttttggaaaaagtgatta

SEQ ID NO: 377551 - DNA, 20 bp, Artificial
  CRISPR gRNA sequence
aaaaagtgattagagaattc

SEQ ID NO: 377552 - DNA, 20 bp, Artificial
  CRISPR gRNA sequence
tgcaaatggccaccatgctt

SEQ ID NO: 377553 - DNA, 20 bp, Artificial
  CRISPR gRNA sequence
aatggccaccatgcttcaga

SEQ ID NO: 377554 - DNA, 20 bp, Artificial
  CRISPR gRNA sequence
tcagaatgagtgtgttttca

SEQ ID NO: 377555 - DNA, 20 bp, Artificial
  CRISPR gRNA sequence
aggtcatgaaattaaagcca

SEQ ID NO: 377556 - DNA, 20 bp, Artificial
  CRISPR gRNA sequence
tgctatgtctaaaaaactga

SEQ ID NO: 377557 - DNA, 20 bp, Artificial
  CRISPR gRNA sequence
gtgcataaccaaatacaaac

SEQ ID NO: 377558 - DNA, 20 bp, Artificial
  CRISPR gRNA sequence
acaaactaggatcagaaatg

SEQ ID NO: 377559 - DNA, 20 bp, Artificial
  CRISPR gRNA sequence
gaatgatctctgcaaagaaa

SEQ ID NO: 377560 - DNA, 20 bp, Artificial
  CRISPR gRNA sequence
aagaatgcaaattcacctgc

SEQ ID NO: 377561 - DNA, 20 bp, Artificial
  CRISPR gRNA sequence
aattcacctgctagaatttc

SEQ ID NO: 377562 - DNA, 20 bp, Artificial
  CRISPR gRNA sequence
ctctccccactgttcagaaa

SEQ ID NO: 377563 - DNA, 20 bp, Artificial
  CRISPR gRNA sequence
ctcactcatccaatcagttg

SEQ ID NO: 377564 - DNA, 20 bp, Artificial
  CRISPR gRNA sequence
aaactctcagtccccttatg

SEQ ID NO: 377565 - DNA, 20 bp, Artificial
  CRISPR gRNA sequence
gcacttctcaccacagcaca

SEQ ID NO: 377566 - DNA, 20 bp, Artificial
  CRISPR gRNA sequence
cacttagcaggctggaaaca

SEQ ID NO: 377567 - DNA, 20 bp, Artificial
  CRISPR gRNA sequence
cgggcagaccacctgaggcc

SEQ ID NO: 377568 - DNA, 20 bp, Artificial
  CRISPR gRNA sequence
tactcgggaggctgaggaag

SEQ ID NO: 377569 - DNA, 20 bp, Artificial
  CRISPR gRNA sequence
gaaggagaatcactggaacc

SEQ ID NO: 377570 - DNA, 20 bp, Artificial
  CRISPR gRNA sequence
ctgcactccagactgggcga

SEQ ID NO: 377571 - DNA, 20 bp, Artificial
  CRISPR gRNA sequence
ccacctcatacattatgttt

SEQ ID NO: 377572 - DNA, 20 bp, Artificial
  CRISPR gRNA sequence
tccatccaacttgaacaatg

SEQ ID NO: 377573 - DNA, 20 bp, Artificial
  CRISPR gRNA sequence
acagtcatcttaaggactct

SEQ ID NO: 377574 - DNA, 20 bp, Artificial
  CRISPR gRNA sequence
ctaatatttccagttcctga

SEQ ID NO: 377575 - DNA, 20 bp, Artificial
  CRISPR gRNA sequence
ctaaatatgtgttagttgaa

SEQ ID NO: 377576 - DNA, 20 bp, Artificial
  CRISPR gRNA sequence
ttcttcagggaacatggaaa

SEQ ID NO: 377577 - DNA, 20 bp, Artificial
  CRISPR gRNA sequence
tccatgtgccaagtattata

SEQ ID NO: 377578 - DNA, 20 bp, Artificial
  CRISPR gRNA sequence
ccctaaggtacatattatac

SEQ ID NO: 377579 - DNA, 20 bp, Artificial
  CRISPR gRNA sequence
tacatgagtactttctatac

SEQ ID NO: 377580 - DNA, 20 bp, Artificial
  CRISPR gRNA sequence
aacttttcagacatcaccag

SEQ ID NO: 377581 - DNA, 20 bp, Artificial
  CRISPR gRNA sequence
gaaccaaaacaatagatagc

SEQ ID NO: 377582 - DNA, 20 bp, Artificial
  CRISPR gRNA sequence
agcaggaatttctctaaata

SEQ ID NO: 377583 - DNA, 20 bp, Artificial
  CRISPR gRNA sequence
actaagctcactgctatgat

SEQ ID NO: 377584 - DNA, 20 bp, Artificial
  CRISPR gRNA sequence
tggggacatcattaagtctt

SEQ ID NO: 377585 - DNA, 20 bp, Artificial
  CRISPR gRNA sequence
gtcttgagaattctgctttc

SEQ ID NO: 377586 - DNA, 20 bp, Artificial
  CRISPR gRNA sequence
tcagaactctttttatctca

SEQ ID NO: 377587 - DNA, 20 bp, Artificial
  CRISPR gRNA sequence
gacaactaccattccacttt

SEQ ID NO: 377588 - DNA, 20 bp, Artificial
  CRISPR gRNA sequence
ccattccactttctgaatca

SEQ ID NO: 377589 - DNA, 20 bp, Artificial
  CRISPR gRNA sequence
ctctgtgtacctcatataag

SEQ ID NO: 377590 - DNA, 20 bp, Artificial
  CRISPR gRNA sequence
tgtgactggctttgttcatt

SEQ ID NO: 377591 - DNA, 20 bp, Artificial
  CRISPR gRNA sequence
ttcatttggaataatgtccc

SEQ ID NO: 377592 - DNA, 20 bp, Artificial
  CRISPR gRNA sequence
ttcaaatagtcctcattttt

SEQ ID NO: 377593 - DNA, 20 bp, Artificial
  CRISPR gRNA sequence
agtcctcatttttaagaatg

SEQ ID NO: 377594 - DNA, 20 bp, Artificial
  CRISPR gRNA sequence
gcttcttctttttagctgtt

SEQ ID NO: 377595 - DNA, 20 bp, Artificial
  CRISPR gRNA sequence
tgaataatgctgttatgaac

SEQ ID NO: 377596 - DNA, 20 bp, Artificial
  CRISPR gRNA sequence
gcaaatgacactaaaccact

SEQ ID NO: 377597 - DNA, 20 bp, Artificial
  CRISPR gRNA sequence
agtggtaaaataacaaacta

SEQ ID NO: 377598 - DNA, 20 bp, Artificial
  CRISPR gRNA sequence
aactagtgggtgaaatactg

SEQ ID NO: 377599 - DNA, 20 bp, Artificial
  CRISPR gRNA sequence
aaacctttgttcccacccag

SEQ ID NO: 377600 - DNA, 20 bp, Artificial
  CRISPR gRNA sequence
ctattctacttaattacata

SEQ ID NO: 377601 - DNA, 20 bp, Artificial
  CRISPR gRNA sequence
agctctgttcccaacattat

SEQ ID NO: 377602 - DNA, 20 bp, Artificial
  CRISPR gRNA sequence
tgggatcatgaagagggaaa

SEQ ID NO: 377603 - DNA, 20 bp, Artificial
  CRISPR gRNA sequence
tggcaatggtaatcactaga

SEQ ID NO: 377604 - DNA, 20 bp, Artificial
  CRISPR gRNA sequence
tggccacaaacaacatccgg

SEQ ID NO: 377605 - DNA, 20 bp, Artificial
  CRISPR gRNA sequence
tccgggggaatgcaggaaac

SEQ ID NO: 377606 - DNA, 20 bp, Artificial
  CRISPR gRNA sequence
gaaacatggattcctgtttt

SEQ ID NO: 377607 - DNA, 20 bp, Artificial
  CRISPR gRNA sequence
ggacaatgtttccttagctg

SEQ ID NO: 377608 - DNA, 20 bp, Artificial
  CRISPR gRNA sequence
aatgtttccttagctgaaga

SEQ ID NO: 377609 - DNA, 20 bp, Artificial
  CRISPR gRNA sequence
agctgaagaatgagtacagg

SEQ ID NO: 377610 - DNA, 20 bp, Artificial
  CRISPR gRNA sequence
gaacataagtgtttcagatt

SEQ ID NO: 377611 - DNA, 20 bp, Artificial
  CRISPR gRNA sequence
gtttcagatttgggattctt

SEQ ID NO: 377612 - DNA, 20 bp, Artificial
  CRISPR gRNA sequence
tttgggattcttttggattt

SEQ ID NO: 377613 - DNA, 20 bp, Artificial
  CRISPR gRNA sequence
gagcatcatgttggcattca

SEQ ID NO: 377614 - DNA, 20 bp, Artificial
  CRISPR gRNA sequence
atgttggcattcaaagagtt

SEQ ID NO: 377615 - DNA, 20 bp, Artificial
  CRISPR gRNA sequence
agatttcagattttttgatt

SEQ ID NO: 377616 - DNA, 20 bp, Artificial
  CRISPR gRNA sequence
gatattcagtctgtagtaca

SEQ ID NO: 377617 - DNA, 20 bp, Artificial
  CRISPR gRNA sequence
gtctgtagtacacagagtga

SEQ ID NO: 377618 - DNA, 20 bp, Artificial
  CRISPR gRNA sequence
atctacaattcagaaatgca

SEQ ID NO: 377619 - DNA, 20 bp, Artificial
  CRISPR gRNA sequence
agaaatgcagaggatgccta

SEQ ID NO: 377620 - DNA, 20 bp, Artificial
  CRISPR gRNA sequence
accatgtttggctgaaaaaa

SEQ ID NO: 377621 - DNA, 20 bp, Artificial
  CRISPR gRNA sequence
agaccttgaacagcacttgt

SEQ ID NO: 377622 - DNA, 20 bp, Artificial
  CRISPR gRNA sequence
gctccaaagacaaattccca

SEQ ID NO: 377623 - DNA, 20 bp, Artificial
  CRISPR gRNA sequence
ccaaaggtattacaataggg

SEQ ID NO: 377624 - DNA, 20 bp, Artificial
  CRISPR gRNA sequence
gtattacaatagggaagagt

SEQ ID NO: 377625 - DNA, 20 bp, Artificial
  CRISPR gRNA sequence
aatagggaagagtggggatt

SEQ ID NO: 377626 - DNA, 20 bp, Artificial
  CRISPR gRNA sequence
gtggggattgtgggtgactc

SEQ ID NO: 377627 - DNA, 20 bp, Artificial
  CRISPR gRNA sequence
tagtccatccagatgtgcat

SEQ ID NO: 377628 - DNA, 20 bp, Artificial
  CRISPR gRNA sequence
aaatgtgttggtcaaatgaa

SEQ ID NO: 377629 - DNA, 20 bp, Artificial
  CRISPR gRNA sequence
acttgtttgcaaactgtggt

SEQ ID NO: 377630 - DNA, 20 bp, Artificial
  CRISPR gRNA sequence
gtgtggatcgtgaggacacc

SEQ ID NO: 377631 - DNA, 20 bp, Artificial
  CRISPR gRNA sequence
ctccctcacagggacaatgt

SEQ ID NO: 377632 - DNA, 20 bp, Artificial
  CRISPR gRNA sequence
ataataaacattcaacggtt

SEQ ID NO: 377633 - DNA, 20 bp, Artificial
  CRISPR gRNA sequence
tctccaacccaagttctctc

SEQ ID NO: 377634 - DNA, 20 bp, Artificial
  CRISPR gRNA sequence
tgcctgctagagagcttcac

SEQ ID NO: 377635 - DNA, 20 bp, Artificial
  CRISPR gRNA sequence
caatgacagcaccatctact

SEQ ID NO: 377636 - DNA, 20 bp, Artificial
  CRISPR gRNA sequence
agtaaaacctggtgccactc

SEQ ID NO: 377637 - DNA, 20 bp, Artificial
  CRISPR gRNA sequence
tttctatttcacacgcaaca

SEQ ID NO: 377638 - DNA, 20 bp, Artificial
  CRISPR gRNA sequence
tgccatctctggaggtgatc

SEQ ID NO: 377639 - DNA, 20 bp, Artificial
  CRISPR gRNA sequence
aaatcctactgggactggag

SEQ ID NO: 377640 - DNA, 20 bp, Artificial
  CRISPR gRNA sequence
ctggagaagagtccaaaaac

SEQ ID NO: 377641 - DNA, 20 bp, Artificial
  CRISPR gRNA sequence
aaaatacaaagaggtaaaag

SEQ ID NO: 377642 - DNA, 20 bp, Artificial
  CRISPR gRNA sequence
agaggtaaaagatgagtgtt

SEQ ID NO: 377643 - DNA, 20 bp, Artificial
  CRISPR gRNA sequence
tgcaatatggtttgagataa

SEQ ID NO: 377644 - DNA, 20 bp, Artificial
  CRISPR gRNA sequence
cttctatgtttttaagatgt

SEQ ID NO: 377645 - DNA, 20 bp, Artificial
  CRISPR gRNA sequence
acccaggacctacctgaagt

SEQ ID NO: 377646 - DNA, 20 bp, Artificial
  CRISPR gRNA sequence
gtgctcacccgcatccccag

SEQ ID NO: 377647 - DNA, 20 bp, Artificial
  CRISPR gRNA sequence
aagggaaagaaagaaaatcc

SEQ ID NO: 377648 - DNA, 20 bp, Artificial
  CRISPR gRNA sequence
aagcacaaatcagtcctcat

SEQ ID NO: 377649 - DNA, 20 bp, Artificial
  CRISPR gRNA sequence
tcccttcatgttagacttca

SEQ ID NO: 377650 - DNA, 20 bp, Artificial
  CRISPR gRNA sequence
aaatgtccaacaacgataga

SEQ ID NO: 377651 - DNA, 20 bp, Artificial
  CRISPR gRNA sequence
aatgtggcacatatacacca

SEQ ID NO: 377652 - DNA, 20 bp, Artificial
  CRISPR gRNA sequence
ctatgcagccataaaaaatg

SEQ ID NO: 377653 - DNA, 20 bp, Artificial
  CRISPR gRNA sequence
ttcatgtcctttgtagggac

SEQ ID NO: 377654 - DNA, 20 bp, Artificial
  CRISPR gRNA sequence
gcatgttctcactcataggt

SEQ ID NO: 377655 - DNA, 20 bp, Artificial
  CRISPR gRNA sequence
tcacacaccaggaactgttg

SEQ ID NO: 377656 - DNA, 20 bp, Artificial
  CRISPR gRNA sequence
gtggggtggggagagggggg

SEQ ID NO: 377657 - DNA, 20 bp, Artificial
  CRISPR gRNA sequence
taatgctaaatgacaagtta

SEQ ID NO: 377658 - DNA, 20 bp, Artificial
  CRISPR gRNA sequence
gtagagagaccgacagaacc

SEQ ID NO: 377659 - DNA, 20 bp, Artificial
  CRISPR gRNA sequence
agttttttaaaatgtaagac

SEQ ID NO: 377660 - DNA, 20 bp, Artificial
  CRISPR gRNA sequence
acctgaatcttcaagagggg

SEQ ID NO: 377661 - DNA, 20 bp, Artificial
  CRISPR gRNA sequence
tcttcaagaggggaagaatt

SEQ ID NO: 377662 - DNA, 20 bp, Artificial
  CRISPR gRNA sequence
agaataatgaagaacacact

SEQ ID NO: 377663 - DNA, 20 bp, Artificial
  CRISPR gRNA sequence
cactaggaataaaattcatc

SEQ ID NO: 377664 - DNA, 20 bp, Artificial
  CRISPR gRNA sequence
ccataataaagtaccacaga

SEQ ID NO: 377665 - DNA, 20 bp, Artificial
  CRISPR gRNA sequence
acccaaaattcaggtgccag

SEQ ID NO: 377666 - DNA, 20 bp, Artificial
  CRISPR gRNA sequence
ttatttggaaaccagtcata

SEQ ID NO: 377667 - DNA, 20 bp, Artificial
  CRISPR gRNA sequence
tagtcaccttctgagatatc

SEQ ID NO: 377668 - DNA, 20 bp, Artificial
  CRISPR gRNA sequence
atctctcttctaaaccctgt

SEQ ID NO: 377669 - DNA, 20 bp, Artificial
  CRISPR gRNA sequence
aatctaaagtcaaaatatct

SEQ ID NO: 377670 - DNA, 20 bp, Artificial
  CRISPR gRNA sequence
aaatgcatctaagtaagcat

SEQ ID NO: 377671 - DNA, 20 bp, Artificial
  CRISPR gRNA sequence
gcagttccaaatcaagtgtt

SEQ ID NO: 377672 - DNA, 20 bp, Artificial
  CRISPR gRNA sequence
tagcatgatttccctccagc

SEQ ID NO: 377673 - DNA, 20 bp, Artificial
  CRISPR gRNA sequence
gtccgttctcatcttccctc

SEQ ID NO: 377674 - DNA, 20 bp, Artificial
  CRISPR gRNA sequence
cttctgatctctgaagttcc

SEQ ID NO: 377675 - DNA, 20 bp, Artificial
  CRISPR gRNA sequence
agacattcaataaacattta

SEQ ID NO: 377676 - DNA, 20 bp, Artificial
  CRISPR gRNA sequence
atcatcctccgtgctgttgg

SEQ ID NO: 377677 - DNA, 20 bp, Artificial
  CRISPR gRNA sequence
cagatttaggtaagatttac

SEQ ID NO: 377678 - DNA, 20 bp, Artificial
  CRISPR gRNA sequence
tctgctattttcactgaaaa

SEQ ID NO: 377679 - DNA, 20 bp, Artificial
  CRISPR gRNA sequence
cagaataatcagaccatgtt

SEQ ID NO: 377680 - DNA, 20 bp, Artificial
  CRISPR gRNA sequence
tcagcacaaagaaacacaat

SEQ ID NO: 377681 - DNA, 20 bp, Artificial
  CRISPR gRNA sequence
gctctttccagaaacattta

SEQ ID NO: 377682 - DNA, 20 bp, Artificial
  CRISPR gRNA sequence
aaacatttataggatttaaa

SEQ ID NO: 377683 - DNA, 20 bp, Artificial
  CRISPR gRNA sequence
attttgagaaatctgatgtc

SEQ ID NO: 377684 - DNA, 20 bp, Artificial
  CRISPR gRNA sequence
ggagttaatgggactttaca

SEQ ID NO: 377685 - DNA, 20 bp, Artificial
  CRISPR gRNA sequence
taacattaccaatacaacaa

SEQ ID NO: 377686 - DNA, 20 bp, Artificial
  CRISPR gRNA sequence
aaatgtatcctattagtgaa

SEQ ID NO: 377687 - DNA, 20 bp, Artificial
  CRISPR gRNA sequence
acttaaaatttgctatagtc

SEQ ID NO: 377688 - DNA, 20 bp, Artificial
  CRISPR gRNA sequence
gaaatgatcctgtccacaca

SEQ ID NO: 377689 - DNA, 20 bp, Artificial
  CRISPR gRNA sequence
atatcggtgttggtagcata

SEQ ID NO: 377690 - DNA, 20 bp, Artificial
  CRISPR gRNA sequence
agaattttatgtagctggcc

SEQ ID NO: 377691 - DNA, 20 bp, Artificial
  CRISPR gRNA sequence
aagagcctgtctgctaaaat

SEQ ID NO: 377692 - DNA, 20 bp, Artificial
  CRISPR gRNA sequence
aatgagaatgttaagtttct

SEQ ID NO: 377693 - DNA, 20 bp, Artificial
  CRISPR gRNA sequence
atggtgcagctaaatgctcc

SEQ ID NO: 377694 - DNA, 20 bp, Artificial
  CRISPR gRNA sequence
tatttacaacactagtaagt

SEQ ID NO: 377695 - DNA, 20 bp, Artificial
  CRISPR gRNA sequence
aggaaaaattttctcacatt

SEQ ID NO: 377696 - DNA, 20 bp, Artificial
  CRISPR gRNA sequence
ttttctcacattaagagtta

SEQ ID NO: 377697 - DNA, 20 bp, Artificial
  CRISPR gRNA sequence
acattaagagttattggatt

SEQ ID NO: 377698 - DNA, 20 bp, Artificial
  CRISPR gRNA sequence
agtgccagaagccccatcaa

SEQ ID NO: 377699 - DNA, 20 bp, Artificial
  CRISPR gRNA sequence
ttatttaattaaaactgctc

SEQ ID NO: 377700 - DNA, 20 bp, Artificial
  CRISPR gRNA sequence
gtagaagagatgttgcctga

SEQ ID NO: 377701 - DNA, 20 bp, Artificial
  CRISPR gRNA sequence
taatttcacactgatccctg

SEQ ID NO: 377702 - DNA, 20 bp, Artificial
  CRISPR gRNA sequence
tattttctttttgtttgctt

SEQ ID NO: 377703 - DNA, 20 bp, Artificial
  CRISPR gRNA sequence
agctctcaacctttgaagtg

SEQ ID NO: 377704 - DNA, 20 bp, Artificial
  CRISPR gRNA sequence
gaagccgagatggtctgagg

SEQ ID NO: 377705 - DNA, 20 bp, Artificial
  CRISPR gRNA sequence
gttggcagccgccttcagtg

SEQ ID NO: 377706 - DNA, 20 bp, Artificial
  CRISPR gRNA sequence
acagctgttgtggtaaaggt

SEQ ID NO: 377707 - DNA, 20 bp, Artificial
  CRISPR gRNA sequence
tgtgagttgtcttgatcact

SEQ ID NO: 377708 - DNA, 20 bp, Artificial
  CRISPR gRNA sequence
gtagtttccagctatactca

SEQ ID NO: 377709 - DNA, 20 bp, Artificial
  CRISPR gRNA sequence
agaatgttctgaggtcacag

SEQ ID NO: 377710 - DNA, 20 bp, Artificial
  CRISPR gRNA sequence
atataaatacctacaataag

SEQ ID NO: 377711 - DNA, 20 bp, Artificial
  CRISPR gRNA sequence
gcccaaagtaaaagtttcct

SEQ ID NO: 377712 - DNA, 20 bp, Artificial
  CRISPR gRNA sequence
agctcagaagtgtcaaagac

SEQ ID NO: 377713 - DNA, 20 bp, Artificial
  CRISPR gRNA sequence
gcctgtacccgtgcctgtac

SEQ ID NO: 377714 - DNA, 20 bp, Artificial
  CRISPR gRNA sequence
ctgtatcagccattcgatta

SEQ ID NO: 377715 - DNA, 20 bp, Artificial
  CRISPR gRNA sequence
tttagtattatctggcttta

SEQ ID NO: 377716 - DNA, 20 bp, Artificial
  CRISPR gRNA sequence
agagctttgcctgaaagcct

SEQ ID NO: 377717 - DNA, 20 bp, Artificial
  CRISPR gRNA sequence
gcttagcacagggaaagcac

SEQ ID NO: 377718 - DNA, 20 bp, Artificial
  CRISPR gRNA sequence
tgaccataaccttgctttct

SEQ ID NO: 377719 - DNA, 20 bp, Artificial
  CRISPR gRNA sequence
tatactattttatttcatta

SEQ ID NO: 377720 - DNA, 20 bp, Artificial
  CRISPR gRNA sequence
atgtttctgcttcatccctt

SEQ ID NO: 377721 - DNA, 20 bp, Artificial
  CRISPR gRNA sequence
gtgcatgcatacacacacac

SEQ ID NO: 377722 - DNA, 20 bp, Artificial
  CRISPR gRNA sequence
tgacttatttctaatctcac

SEQ ID NO: 377723 - DNA, 20 bp, Artificial
  CRISPR gRNA sequence
cattctctaatcagttgact

SEQ ID NO: 377724 - DNA, 20 bp, Artificial
  CRISPR gRNA sequence
caaggactaaggaagctagc

SEQ ID NO: 377725 - DNA, 20 bp, Artificial
  CRISPR gRNA sequence
attggtgacccttataacag

SEQ ID NO: 377726 - DNA, 20 bp, Artificial
  CRISPR gRNA sequence
gtatgttttcttccttcctt

SEQ ID NO: 377727 - DNA, 20 bp, Artificial
  CRISPR gRNA sequence
ttcttccttccttctgaatt

SEQ ID NO: 377728 - DNA, 20 bp, Artificial
  CRISPR gRNA sequence
ttcaacatgtcaaccaagcc

SEQ ID NO: 377729 - DNA, 20 bp, Artificial
  CRISPR gRNA sequence
ccaagccatgaattgtaaac

SEQ ID NO: 377730 - DNA, 20 bp, Artificial
  CRISPR gRNA sequence
ggtttttggtgttttgttgt

SEQ ID NO: 377731 - DNA, 20 bp, Artificial
  CRISPR gRNA sequence
attttctaaagcaattctcc

SEQ ID NO: 377732 - DNA, 20 bp, Artificial
  CRISPR gRNA sequence
aatctcaacatccaaatttt

SEQ ID NO: 377733 - DNA, 20 bp, Artificial
  CRISPR gRNA sequence
actttttcagggactctgcc

SEQ ID NO: 377734 - DNA, 20 bp, Artificial
  CRISPR gRNA sequence
agattctcaggaaagacttg

SEQ ID NO: 377735 - DNA, 20 bp, Artificial
  CRISPR gRNA sequence
tctcaggaaagacttgatga

SEQ ID NO: 377736 - DNA, 20 bp, Artificial
  CRISPR gRNA sequence
aagacttgatgagtgaatta

SEQ ID NO: 377737 - DNA, 20 bp, Artificial
  CRISPR gRNA sequence
atgagtgaattaatggataa

SEQ ID NO: 377738 - DNA, 20 bp, Artificial
  CRISPR gRNA sequence
atataggccagcatgatctt

SEQ ID NO: 377739 - DNA, 20 bp, Artificial
  CRISPR gRNA sequence
ctttagaatccctttcatca

SEQ ID NO: 377740 - DNA, 20 bp, Artificial
  CRISPR gRNA sequence
tctggagcccttaatattaa

SEQ ID NO: 377741 - DNA, 20 bp, Artificial
  CRISPR gRNA sequence
actaaccagcagatatatac

SEQ ID NO: 377742 - DNA, 20 bp, Artificial
  CRISPR gRNA sequence
acagagaacacttgtccctg

SEQ ID NO: 377743 - DNA, 20 bp, Artificial
  CRISPR gRNA sequence
tgtagagataagagccttct

SEQ ID NO: 377744 - DNA, 20 bp, Artificial
  CRISPR gRNA sequence
agagccttctaagaatgagc

SEQ ID NO: 377745 - DNA, 20 bp, Artificial
  CRISPR gRNA sequence
gagcctcatcccacctggga

SEQ ID NO: 377746 - DNA, 20 bp, Artificial
  CRISPR gRNA sequence
ccagtttgagataaatggac

SEQ ID NO: 377747 - DNA, 20 bp, Artificial
  CRISPR gRNA sequence
gactggaatatgggagatca

SEQ ID NO: 377748 - DNA, 20 bp, Artificial
  CRISPR gRNA sequence
tctaaccctctactataaat

SEQ ID NO: 377749 - DNA, 20 bp, Artificial
  CRISPR gRNA sequence
accccatccatccacatgtg

SEQ ID NO: 377750 - DNA, 20 bp, Artificial
  CRISPR gRNA sequence
atcattcagatgacttcaaa

SEQ ID NO: 377751 - DNA, 20 bp, Artificial
  CRISPR gRNA sequence
aaatcatcattttttagtcc

SEQ ID NO: 377752 - DNA, 20 bp, Artificial
  CRISPR gRNA sequence
acctggcccccaggccatat

SEQ ID NO: 377753 - DNA, 20 bp, Artificial
  CRISPR gRNA sequence
agcactttgggaggccaagg

SEQ ID NO: 377754 - DNA, 20 bp, Artificial
  CRISPR gRNA sequence
ctttgggaggccaaggtggg

SEQ ID NO: 377755 - DNA, 20 bp, Artificial
  CRISPR gRNA sequence
ggggtggatcacctgaggtc

SEQ ID NO: 377756 - DNA, 20 bp, Artificial
  CRISPR gRNA sequence
tacaaaaatacaaaaattag

SEQ ID NO: 377757 - DNA, 20 bp, Artificial
  CRISPR gRNA sequence
ctgcactccagcctgggcaa

SEQ ID NO: 377758 - DNA, 20 bp, Artificial
  CRISPR gRNA sequence
attcactcattttagtgatg

SEQ ID NO: 377759 - DNA, 20 bp, Artificial
  CRISPR gRNA sequence
gatgtagagtatcctaatgt

SEQ ID NO: 377760 - DNA, 20 bp, Artificial
  CRISPR gRNA sequence
gcttttcggttctactgttg

SEQ ID NO: 377761 - DNA, 20 bp, Artificial
  CRISPR gRNA sequence
gttctactgttgatgggtat

SEQ ID NO: 377762 - DNA, 20 bp, Artificial
  CRISPR gRNA sequence
ctgttgctataaatattgtc

SEQ ID NO: 377763 - DNA, 20 bp, Artificial
  CRISPR gRNA sequence
tccctataatgagagaactc

SEQ ID NO: 377764 - DNA, 20 bp, Artificial
  CRISPR gRNA sequence
gagaactcttggataccaaa

SEQ ID NO: 377765 - DNA, 20 bp, Artificial
  CRISPR gRNA sequence
ctcttggataccaaacagag

SEQ ID NO: 377766 - DNA, 20 bp, Artificial
  CRISPR gRNA sequence
taccaaacagagtagaatta

SEQ ID NO: 377767 - DNA, 20 bp, Artificial
  CRISPR gRNA sequence
agagtagaattattggatca

SEQ ID NO: 377768 - DNA, 20 bp, Artificial
  CRISPR gRNA sequence
aattattggatcataggatt

SEQ ID NO: 377769 - DNA, 20 bp, Artificial
  CRISPR gRNA sequence
taattttacgtgtcaatttg

SEQ ID NO: 377770 - DNA, 20 bp, Artificial
  CRISPR gRNA sequence
tgtcaatttgaagggtgttt

SEQ ID NO: 377771 - DNA, 20 bp, Artificial
  CRISPR gRNA sequence
tgagattaacatttaaattg

SEQ ID NO: 377772 - DNA, 20 bp, Artificial
  CRISPR gRNA sequence
aacatttaaattggtgaatt

SEQ ID NO: 377773 - DNA, 20 bp, Artificial
  CRISPR gRNA sequence
gaccagcctccccaagcaag

SEQ ID NO: 377774 - DNA, 20 bp, Artificial
  CRISPR gRNA sequence
cacctgtaccatcggctctc

SEQ ID NO: 377775 - DNA, 20 bp, Artificial
  CRISPR gRNA sequence
gtgcccacccaaatctcatc

SEQ ID NO: 377776 - DNA, 20 bp, Artificial
  CRISPR gRNA sequence
gagagaccaggtggagataa

SEQ ID NO: 377777 - DNA, 20 bp, Artificial
  CRISPR gRNA sequence
ggtggagataactgaatcat

SEQ ID NO: 377778 - DNA, 20 bp, Artificial
  CRISPR gRNA sequence
cccatcctgttctcatgata

SEQ ID NO: 377779 - DNA, 20 bp, Artificial
  CRISPR gRNA sequence
ctccccacccatactgaact

SEQ ID NO: 377780 - DNA, 20 bp, Artificial
  CRISPR gRNA sequence
ctttattagcagcatgaaaa

SEQ ID NO: 377781 - DNA, 20 bp, Artificial
  CRISPR gRNA sequence
aaaactgagtaatacagtaa

SEQ ID NO: 377782 - DNA, 20 bp, Artificial
  CRISPR gRNA sequence
tacagtaaatgagtacagca

SEQ ID NO: 377783 - DNA, 20 bp, Artificial
  CRISPR gRNA sequence
aatgagtacagcagagagtg

SEQ ID NO: 377784 - DNA, 20 bp, Artificial
  CRISPR gRNA sequence
gtgtgaaagcaactttggaa

SEQ ID NO: 377785 - DNA, 20 bp, Artificial
  CRISPR gRNA sequence
gggaacttcctagaaatttg

SEQ ID NO: 377786 - DNA, 20 bp, Artificial
  CRISPR gRNA sequence
atgaggaactttttgggaaa

SEQ ID NO: 377787 - DNA, 20 bp, Artificial
  CRISPR gRNA sequence
aaggtcactcttgctatgca

SEQ ID NO: 377788 - DNA, 20 bp, Artificial
  CRISPR gRNA sequence
tgaacttgagagagataatt

SEQ ID NO: 377789 - DNA, 20 bp, Artificial
  CRISPR gRNA sequence
cagctcaggctgttgcttca

SEQ ID NO: 377790 - DNA, 20 bp, Artificial
  CRISPR gRNA sequence
ttacacgtggtgttgggcct

SEQ ID NO: 377791 - DNA, 20 bp, Artificial
  CRISPR gRNA sequence
cagaaaatgtacagaaacac

SEQ ID NO: 377792 - DNA, 20 bp, Artificial
  CRISPR gRNA sequence
ggcactgcagcagggaaatg

SEQ ID NO: 377793 - DNA, 20 bp, Artificial
  CRISPR gRNA sequence
gtggggttggagcccccaca

SEQ ID NO: 377794 - DNA, 20 bp, Artificial
  CRISPR gRNA sequence
catccttcagaccccacaat

SEQ ID NO: 377795 - DNA, 20 bp, Artificial
  CRISPR gRNA sequence
gctgtaccctgcatagccag

SEQ ID NO: 377796 - DNA, 20 bp, Artificial
  CRISPR gRNA sequence
gggtggagctgcccaagacc

SEQ ID NO: 377797 - DNA, 20 bp, Artificial
  CRISPR gRNA sequence
acctcttgcatcagcatgcc

SEQ ID NO: 377798 - DNA, 20 bp, Artificial
  CRISPR gRNA sequence
catgcccaggatgtgggaca

SEQ ID NO: 377799 - DNA, 20 bp, Artificial
  CRISPR gRNA sequence
aagttttaatgactgcccta

SEQ ID NO: 377800 - DNA, 20 bp, Artificial
  CRISPR gRNA sequence
tttggccaatttctctcatt

SEQ ID NO: 377801 - DNA, 20 bp, Artificial
  CRISPR gRNA sequence
gactttcagttaatgctgga

SEQ ID NO: 377802 - DNA, 20 bp, Artificial
  CRISPR gRNA sequence
agactttgggggactgttgg

SEQ ID NO: 377803 - DNA, 20 bp, Artificial
  CRISPR gRNA sequence
aaggacccggtgggaggtag

SEQ ID NO: 377804 - DNA, 20 bp, Artificial
  CRISPR gRNA sequence
ttcatgctgttctggtgaca

SEQ ID NO: 377805 - DNA, 20 bp, Artificial
  CRISPR gRNA sequence
tgctgttctggtgacagtga

SEQ ID NO: 377806 - DNA, 20 bp, Artificial
  CRISPR gRNA sequence
ctccccagccatactgaact

SEQ ID NO: 377807 - DNA, 20 bp, Artificial
  CRISPR gRNA sequence
gtatttcttcacagcagtgt

SEQ ID NO: 377808 - DNA, 20 bp, Artificial
  CRISPR gRNA sequence
ttaggcacatcaataacttt

SEQ ID NO: 377809 - DNA, 20 bp, Artificial
  CRISPR gRNA sequence
tgcaactcctttttcaagca

SEQ ID NO: 377810 - DNA, 20 bp, Artificial
  CRISPR gRNA sequence
tttgctggtgcatgcaggga

SEQ ID NO: 377811 - DNA, 20 bp, Artificial
  CRISPR gRNA sequence
ctgcctctcaggccacctct

SEQ ID NO: 377812 - DNA, 20 bp, Artificial
  CRISPR gRNA sequence
gtgtagggggcctcagagcc

SEQ ID NO: 377813 - DNA, 20 bp, Artificial
  CRISPR gRNA sequence
ccctccctggttcattccac

SEQ ID NO: 377814 - DNA, 20 bp, Artificial
  CRISPR gRNA sequence
ggctcttcagaaaaatcaac

SEQ ID NO: 377815 - DNA, 20 bp, Artificial
  CRISPR gRNA sequence
agcttgataaccttggacaa

SEQ ID NO: 377816 - DNA, 20 bp, Artificial
  CRISPR gRNA sequence
acctccccatagtgcttcat

SEQ ID NO: 377817 - DNA, 20 bp, Artificial
  CRISPR gRNA sequence
acactaggtggcagagcatt

SEQ ID NO: 377818 - DNA, 20 bp, Artificial
  CRISPR gRNA sequence
taggtggcagagcattctga

SEQ ID NO: 377819 - DNA, 20 bp, Artificial
  CRISPR gRNA sequence
ctgagtgggtcactcatttt

SEQ ID NO: 377820 - DNA, 20 bp, Artificial
  CRISPR gRNA sequence
aatgcatttattcttaccat

SEQ ID NO: 377821 - DNA, 20 bp, Artificial
  CRISPR gRNA sequence
tattagtagtaccatttatt

SEQ ID NO: 377822 - DNA, 20 bp, Artificial
  CRISPR gRNA sequence
ctctaggctgaaagctggag

SEQ ID NO: 377823 - DNA, 20 bp, Artificial
  CRISPR gRNA sequence
ctccttcttcaagggccctg

SEQ ID NO: 377824 - DNA, 20 bp, Artificial
  CRISPR gRNA sequence
ttacaatccattatacaaac

SEQ ID NO: 377825 - DNA, 20 bp, Artificial
  CRISPR gRNA sequence
aagctctcaaactctcaaaa

SEQ ID NO: 377826 - DNA, 20 bp, Artificial
  CRISPR gRNA sequence
ctcaaactctcaaaataggg

SEQ ID NO: 377827 - DNA, 20 bp, Artificial
  CRISPR gRNA sequence
aaataatcaaaacaagagca

SEQ ID NO: 377828 - DNA, 20 bp, Artificial
  CRISPR gRNA sequence
aagagcaatggatcatggct

SEQ ID NO: 377829 - DNA, 20 bp, Artificial
  CRISPR gRNA sequence
tggctaaggataccatcatg

SEQ ID NO: 377830 - DNA, 20 bp, Artificial
  CRISPR gRNA sequence
aactagcagtaatgacaaat

SEQ ID NO: 377831 - DNA, 20 bp, Artificial
  CRISPR gRNA sequence
taccacacaaggcagcagtg

SEQ ID NO: 377832 - DNA, 20 bp, Artificial
  CRISPR gRNA sequence
acacagtaaaaacttccaag

SEQ ID NO: 377833 - DNA, 20 bp, Artificial
  CRISPR gRNA sequence
tgaggacttgtatggtgaaa

SEQ ID NO: 377834 - DNA, 20 bp, Artificial
  CRISPR gRNA sequence
atgttcttctctgtacagcc

SEQ ID NO: 377835 - DNA, 20 bp, Artificial
  CRISPR gRNA sequence
aaatttcattattagtcctt

SEQ ID NO: 377836 - DNA, 20 bp, Artificial
  CRISPR gRNA sequence
tccctcagccattcaacaag

SEQ ID NO: 377837 - DNA, 20 bp, Artificial
  CRISPR gRNA sequence
ttcaggaacctgagattcag

SEQ ID NO: 377838 - DNA, 20 bp, Artificial
  CRISPR gRNA sequence
ataaagcaaaaaacactcca

SEQ ID NO: 377839 - DNA, 20 bp, Artificial
  CRISPR gRNA sequence
aaaaacactccaagggatca

SEQ ID NO: 377840 - DNA, 20 bp, Artificial
  CRISPR gRNA sequence
agtgtcctctctagctaaac

SEQ ID NO: 377841 - DNA, 20 bp, Artificial
  CRISPR gRNA sequence
actctgggaggccgaggcag

SEQ ID NO: 377842 - DNA, 20 bp, Artificial
  CRISPR gRNA sequence
cagttggatcacttgaactc

SEQ ID NO: 377843 - DNA, 20 bp, Artificial
  CRISPR gRNA sequence
aaggagaagtcacgtcttac

SEQ ID NO: 377844 - DNA, 20 bp, Artificial
  CRISPR gRNA sequence
aggtccctcccacaacacat

SEQ ID NO: 377845 - DNA, 20 bp, Artificial
  CRISPR gRNA sequence
tacttgcggggctgaggtag

SEQ ID NO: 377846 - DNA, 20 bp, Artificial
  CRISPR gRNA sequence
aggaagaaccttgaacacac

SEQ ID NO: 377847 - DNA, 20 bp, Artificial
  CRISPR gRNA sequence
ttgaacacacaggggttgat

SEQ ID NO: 377848 - DNA, 20 bp, Artificial
  CRISPR gRNA sequence
acaggggttgatgtgggtgc

SEQ ID NO: 377849 - DNA, 20 bp, Artificial
  CRISPR gRNA sequence
tgctggagtgtccagcagaa

SEQ ID NO: 377850 - DNA, 20 bp, Artificial
  CRISPR gRNA sequence
tcactgtgataaaaccctga

SEQ ID NO: 377851 - DNA, 20 bp, Artificial
  CRISPR gRNA sequence
aacatcaaagcatctagaaa

SEQ ID NO: 377852 - DNA, 20 bp, Artificial
  CRISPR gRNA sequence
agcatctagaaatggaattg

SEQ ID NO: 377853 - DNA, 20 bp, Artificial
  CRISPR gRNA sequence
tatagaaataaatgttgtaa

SEQ ID NO: 377854 - DNA, 20 bp, Artificial
  CRISPR gRNA sequence
aatgttgtaagtggataaaa

SEQ ID NO: 377855 - DNA, 20 bp, Artificial
  CRISPR gRNA sequence
caccttctgccaagttccct

SEQ ID NO: 377856 - DNA, 20 bp, Artificial
  CRISPR gRNA sequence
tgggtaagtgtaaagagagc

SEQ ID NO: 377857 - DNA, 20 bp, Artificial
  CRISPR gRNA sequence
tcagaggcattccgaaagaa

SEQ ID NO: 377858 - DNA, 20 bp, Artificial
  CRISPR gRNA sequence
catgttattggaagccatcg

SEQ ID NO: 377859 - DNA, 20 bp, Artificial
  CRISPR gRNA sequence
ggcttccttatgaccatgcc

SEQ ID NO: 377860 - DNA, 20 bp, Artificial
  CRISPR gRNA sequence
agtagggctgaaaatggcta

SEQ ID NO: 377861 - DNA, 20 bp, Artificial
  CRISPR gRNA sequence
aaaatggctatggaatcctg

SEQ ID NO: 377862 - DNA, 20 bp, Artificial
  CRISPR gRNA sequence
ctgtgttaagatgcccattg

SEQ ID NO: 377863 - DNA, 20 bp, Artificial
  CRISPR gRNA sequence
actaaagagcactgtaaatt

SEQ ID NO: 377864 - DNA, 20 bp, Artificial
  CRISPR gRNA sequence
aagaagagccaaaagtaaag

SEQ ID NO: 377865 - DNA, 20 bp, Artificial
  CRISPR gRNA sequence
agacaggtttgctcctttat

SEQ ID NO: 377866 - DNA, 20 bp, Artificial
  CRISPR gRNA sequence
ctttatgaggatgggcagat

SEQ ID NO: 377867 - DNA, 20 bp, Artificial
  CRISPR gRNA sequence
tcgggctttcattttctaca

SEQ ID NO: 377868 - DNA, 20 bp, Artificial
  CRISPR gRNA sequence
ctaactcagctgtaggcaat

SEQ ID NO: 377869 - DNA, 20 bp, Artificial
  CRISPR gRNA sequence
ttctgattttgaaataatta

SEQ ID NO: 377870 - DNA, 20 bp, Artificial
  CRISPR gRNA sequence
gagtcacagtaagtcacaaa

SEQ ID NO: 377871 - DNA, 20 bp, Artificial
  CRISPR gRNA sequence
ccctgtccccaggttctgtc

SEQ ID NO: 377872 - DNA, 20 bp, Artificial
  CRISPR gRNA sequence
attatagtacaatatcaaaa

SEQ ID NO: 377873 - DNA, 20 bp, Artificial
  CRISPR gRNA sequence
aagtatacccctacaaaaag

SEQ ID NO: 377874 - DNA, 20 bp, Artificial
  CRISPR gRNA sequence
taagactgtcaaaatagaag

SEQ ID NO: 377875 - DNA, 20 bp, Artificial
  CRISPR gRNA sequence
gcaagtgtcgactactcagc

SEQ ID NO: 377876 - DNA, 20 bp, Artificial
  CRISPR gRNA sequence
aacaattcctccaaattgta

SEQ ID NO: 377877 - DNA, 20 bp, Artificial
  CRISPR gRNA sequence
ccaaattgtactgagttatg

SEQ ID NO: 377878 - DNA, 20 bp, Artificial
  CRISPR gRNA sequence
ctcaggttatgcataatata

SEQ ID NO: 377879 - DNA, 20 bp, Artificial
  CRISPR gRNA sequence
gaaaacagaggcgtgacaat

SEQ ID NO: 377880 - DNA, 20 bp, Artificial
  CRISPR gRNA sequence
aatggtgtgactacagtcta

SEQ ID NO: 377881 - DNA, 20 bp, Artificial
  CRISPR gRNA sequence
ggaagtgaccgaaaatgaga

SEQ ID NO: 377882 - DNA, 20 bp, Artificial
  CRISPR gRNA sequence
agtctggactgaaaagtgac

SEQ ID NO: 377883 - DNA, 20 bp, Artificial
  CRISPR gRNA sequence
ggtcactgtacagaacaaac

SEQ ID NO: 377884 - DNA, 20 bp, Artificial
  CRISPR gRNA sequence
aggacatggaagacctccat

SEQ ID NO: 377885 - DNA, 20 bp, Artificial
  CRISPR gRNA sequence
gccgggctaaaccaagtcca

SEQ ID NO: 377886 - DNA, 20 bp, Artificial
  CRISPR gRNA sequence
aattcctgaggtcctgagga

SEQ ID NO: 377887 - DNA, 20 bp, Artificial
  CRISPR gRNA sequence
cttcacacacacacacacac

SEQ ID NO: 377888 - DNA, 20 bp, Artificial
  CRISPR gRNA sequence
catctggcgtgatctcaaaa

SEQ ID NO: 377889 - DNA, 20 bp, Artificial
  CRISPR gRNA sequence
caacacacacaggcatggga

SEQ ID NO: 377890 - DNA, 20 bp, Artificial
  CRISPR gRNA sequence
tcgggcagtgaagtgtgttc

SEQ ID NO: 377891 - DNA, 20 bp, Artificial
  CRISPR gRNA sequence
caggaggctgtggccacatg

SEQ ID NO: 377892 - DNA, 20 bp, Artificial
  CRISPR gRNA sequence
tgtgtgaacgagcagtccag

SEQ ID NO: 377893 - DNA, 20 bp, Artificial
  CRISPR gRNA sequence
aagtttttcaatcattgtag

SEQ ID NO: 377894 - DNA, 20 bp, Artificial
  CRISPR gRNA sequence
ggaaacagaaagatgtagag

SEQ ID NO: 377895 - DNA, 20 bp, Artificial
  CRISPR gRNA sequence
cagaaagatgtagagatgag

SEQ ID NO: 377896 - DNA, 20 bp, Artificial
  CRISPR gRNA sequence
gatgtagagatgagtggggt

SEQ ID NO: 377897 - DNA, 20 bp, Artificial
  CRISPR gRNA sequence
gattggagattgttaagcac

SEQ ID NO: 377898 - DNA, 20 bp, Artificial
  CRISPR gRNA sequence
cactcctagcagtactgtac

SEQ ID NO: 377899 - DNA, 20 bp, Artificial
  CRISPR gRNA sequence
tagcagtactgtacctgagt

SEQ ID NO: 377900 - DNA, 20 bp, Artificial
  CRISPR gRNA sequence
gaccctcccacttcagcctc

SEQ ID NO: 377901 - DNA, 20 bp, Artificial
  CRISPR gRNA sequence
aattattttttttttggaga

SEQ ID NO: 377902 - DNA, 20 bp, Artificial
  CRISPR gRNA sequence
tgttggcctcctaaagtgtt

SEQ ID NO: 377903 - DNA, 20 bp, Artificial
  CRISPR gRNA sequence
tgaaaactatgattgatttg

SEQ ID NO: 377904 - DNA, 20 bp, Artificial
  CRISPR gRNA sequence
tcagagaagccaactatggc

SEQ ID NO: 377905 - DNA, 20 bp, Artificial
  CRISPR gRNA sequence
tatggcctgagttggcccat

SEQ ID NO: 377906 - DNA, 20 bp, Artificial
  CRISPR gRNA sequence
tccatgccagaaaaacagca

SEQ ID NO: 377907 - DNA, 20 bp, Artificial
  CRISPR gRNA sequence
tcctctcattatgcatgaac

SEQ ID NO: 377908 - DNA, 20 bp, Artificial
  CRISPR gRNA sequence
gaaatcagcctgaggacaaa

SEQ ID NO: 377909 - DNA, 20 bp, Artificial
  CRISPR gRNA sequence
aacagggtggtagagagaga

SEQ ID NO: 377910 - DNA, 20 bp, Artificial
  CRISPR gRNA sequence
gggtggtagagagagacaga

SEQ ID NO: 377911 - DNA, 20 bp, Artificial
  CRISPR gRNA sequence
cagatggcattactgagcta

SEQ ID NO: 377912 - DNA, 20 bp, Artificial
  CRISPR gRNA sequence
tgaagtctgaacatattaca

SEQ ID NO: 377913 - DNA, 20 bp, Artificial
  CRISPR gRNA sequence
acatattacatagaattgca

SEQ ID NO: 377914 - DNA, 20 bp, Artificial
  CRISPR gRNA sequence
acatagaattgcaaggggtc

SEQ ID NO: 377915 - DNA, 20 bp, Artificial
  CRISPR gRNA sequence
gctacagtaatcaaaacagt

SEQ ID NO: 377916 - DNA, 20 bp, Artificial
  CRISPR gRNA sequence
tgatcaaaacagatgttagg

SEQ ID NO: 377917 - DNA, 20 bp, Artificial
  CRISPR gRNA sequence
aacatttatacactgttcat

SEQ ID NO: 377918 - DNA, 20 bp, Artificial
  CRISPR gRNA sequence
gttcctcaaagaactaaaaa

SEQ ID NO: 377919 - DNA, 20 bp, Artificial
  CRISPR gRNA sequence
tagatccggcagtctcacta

SEQ ID NO: 377920 - DNA, 20 bp, Artificial
  CRISPR gRNA sequence
tattcacaataaccaagata

SEQ ID NO: 377921 - DNA, 20 bp, Artificial
  CRISPR gRNA sequence
aacctaagtgcccatcaatg

SEQ ID NO: 377922 - DNA, 20 bp, Artificial
  CRISPR gRNA sequence
actgtggtatatatccacaa

SEQ ID NO: 377923 - DNA, 20 bp, Artificial
  CRISPR gRNA sequence
gaatactacacagccctaaa

SEQ ID NO: 377924 - DNA, 20 bp, Artificial
  CRISPR gRNA sequence
aatggacactggagacttgg

SEQ ID NO: 377925 - DNA, 20 bp, Artificial
  CRISPR gRNA sequence
ctggagacttggaagaatgg

SEQ ID NO: 377926 - DNA, 20 bp, Artificial
  CRISPR gRNA sequence
ggaagaatgggagagtagaa

SEQ ID NO: 377927 - DNA, 20 bp, Artificial
  CRISPR gRNA sequence
tgggagagtagaaaggggtg

SEQ ID NO: 377928 - DNA, 20 bp, Artificial
  CRISPR gRNA sequence
caaaactgcccttgtacccc

SEQ ID NO: 377929 - DNA, 20 bp, Artificial
  CRISPR gRNA sequence
tcaacaaggtgccaacccca

SEQ ID NO: 377930 - DNA, 20 bp, Artificial
  CRISPR gRNA sequence
ccaaccccactgagtgggga

SEQ ID NO: 377931 - DNA, 20 bp, Artificial
  CRISPR gRNA sequence
aataaatggtcctgggacaa

SEQ ID NO: 377932 - DNA, 20 bp, Artificial
  CRISPR gRNA sequence
ccacatgcaaaagcatgaaa

SEQ ID NO: 377933 - DNA, 20 bp, Artificial
  CRISPR gRNA sequence
aacacaaaaattaactcaaa

SEQ ID NO: 377934 - DNA, 20 bp, Artificial
  CRISPR gRNA sequence
acctcagactgtagaaatct

SEQ ID NO: 377935 - DNA, 20 bp, Artificial
  CRISPR gRNA sequence
agaaatcttagaataagcac

SEQ ID NO: 377936 - DNA, 20 bp, Artificial
  CRISPR gRNA sequence
ttaagacctggaagttgtca

SEQ ID NO: 377937 - DNA, 20 bp, Artificial
  CRISPR gRNA sequence
gaaagtgaaaagtcacccta

SEQ ID NO: 377938 - DNA, 20 bp, Artificial
  CRISPR gRNA sequence
ttttcaaatgggcaaagtac

SEQ ID NO: 377939 - DNA, 20 bp, Artificial
  CRISPR gRNA sequence
agaactcactttatatctac

SEQ ID NO: 377940 - DNA, 20 bp, Artificial
  CRISPR gRNA sequence
agattcttcaaaacgttcaa

SEQ ID NO: 377941 - DNA, 20 bp, Artificial
  CRISPR gRNA sequence
attcctaggtatatactcaa

SEQ ID NO: 377942 - DNA, 20 bp, Artificial
  CRISPR gRNA sequence
atccaagcgtctgccaacag

SEQ ID NO: 377943 - DNA, 20 bp, Artificial
  CRISPR gRNA sequence
aagcgtctgccaacaggtga

SEQ ID NO: 377944 - DNA, 20 bp, Artificial
  CRISPR gRNA sequence
gtctgccaacaggtgaatga

SEQ ID NO: 377945 - DNA, 20 bp, Artificial
  CRISPR gRNA sequence
ttgtgatcaaatccatacaa

SEQ ID NO: 377946 - DNA, 20 bp, Artificial
  CRISPR gRNA sequence
aatattactcagccataaaa

SEQ ID NO: 377947 - DNA, 20 bp, Artificial
  CRISPR gRNA sequence
gggctaatgcatgctacaac

SEQ ID NO: 377948 - DNA, 20 bp, Artificial
  CRISPR gRNA sequence
gataacattatgctaagtca

SEQ ID NO: 377949 - DNA, 20 bp, Artificial
  CRISPR gRNA sequence
aacaaaaggccacattttgt

SEQ ID NO: 377950 - DNA, 20 bp, Artificial
  CRISPR gRNA sequence
ttgattgactgttggaagga

SEQ ID NO: 377951 - DNA, 20 bp, Artificial
  CRISPR gRNA sequence
actgttggaaggagggaata

SEQ ID NO: 377952 - DNA, 20 bp, Artificial
  CRISPR gRNA sequence
gggagtgactgtttaaggta

SEQ ID NO: 377953 - DNA, 20 bp, Artificial
  CRISPR gRNA sequence
ttaaaatgatgaaaatgttt

SEQ ID NO: 377954 - DNA, 20 bp, Artificial
  CRISPR gRNA sequence
agcggtcatcacagaacact

SEQ ID NO: 377955 - DNA, 20 bp, Artificial
  CRISPR gRNA sequence
actttgggaggccaaggcag

SEQ ID NO: 377956 - DNA, 20 bp, Artificial
  CRISPR gRNA sequence
caggtggattgcttgaggtc

SEQ ID NO: 377957 - DNA, 20 bp, Artificial
  CRISPR gRNA sequence
tacttgggaggctgagacag

SEQ ID NO: 377958 - DNA, 20 bp, Artificial
  CRISPR gRNA sequence
tcttaggtgaacaatgttat

SEQ ID NO: 377959 - DNA, 20 bp, Artificial
  CRISPR gRNA sequence
atttttaaaaattgttacta

SEQ ID NO: 377960 - DNA, 20 bp, Artificial
  CRISPR gRNA sequence
aattgttactagtgaatagt

SEQ ID NO: 377961 - DNA, 20 bp, Artificial
  CRISPR gRNA sequence
attcaccccaggtcttacca

SEQ ID NO: 377962 - DNA, 20 bp, Artificial
  CRISPR gRNA sequence
aaagatgccaagtacattct

SEQ ID NO: 377963 - DNA, 20 bp, Artificial
  CRISPR gRNA sequence
agcatagtacagtctaagca

SEQ ID NO: 377964 - DNA, 20 bp, Artificial
  CRISPR gRNA sequence
acatatctattttctgaggg

SEQ ID NO: 377965 - DNA, 20 bp, Artificial
  CRISPR gRNA sequence
ctattttctgagggaggggt

SEQ ID NO: 377966 - DNA, 20 bp, Artificial
  CRISPR gRNA sequence
ttctgagggaggggtcaggg

SEQ ID NO: 377967 - DNA, 20 bp, Artificial
  CRISPR gRNA sequence
ggggtcagggttgggtaaag

SEQ ID NO: 377968 - DNA, 20 bp, Artificial
  CRISPR gRNA sequence
ccaaagtgaacttcctcacc

SEQ ID NO: 377969 - DNA, 20 bp, Artificial
  CRISPR gRNA sequence
catgggaggaggactggaaa

SEQ ID NO: 377970 - DNA, 20 bp, Artificial
  CRISPR gRNA sequence
gaacttgtgtatttgcaccc

SEQ ID NO: 377971 - DNA, 20 bp, Artificial
  CRISPR gRNA sequence
tgtatttgcaccctggaatt

SEQ ID NO: 377972 - DNA, 20 bp, Artificial
  CRISPR gRNA sequence
gggtcctagaggtcacagat

SEQ ID NO: 377973 - DNA, 20 bp, Artificial
  CRISPR gRNA sequence
attttttgcatgatttatga

SEQ ID NO: 377974 - DNA, 20 bp, Artificial
  CRISPR gRNA sequence
agtcattaatcaaaatatta

SEQ ID NO: 377975 - DNA, 20 bp, Artificial
  CRISPR gRNA sequence
tctcagctaaccacatgagc

SEQ ID NO: 377976 - DNA, 20 bp, Artificial
  CRISPR gRNA sequence
ttcatctcacaagcttgcct

SEQ ID NO: 377977 - DNA, 20 bp, Artificial
  CRISPR gRNA sequence
aatgcagactcctaggtggc

SEQ ID NO: 377978 - DNA, 20 bp, Artificial
  CRISPR gRNA sequence
cagactcctaggtggcctgg

SEQ ID NO: 377979 - DNA, 20 bp, Artificial
  CRISPR gRNA sequence
tatggtttctgagcattggg

SEQ ID NO: 377980 - DNA, 20 bp, Artificial
  CRISPR gRNA sequence
aacacctgatgtgtgtgatg

SEQ ID NO: 377981 - DNA, 20 bp, Artificial
  CRISPR gRNA sequence
ctccactccttctcagatgc

SEQ ID NO: 377982 - DNA, 20 bp, Artificial
  CRISPR gRNA sequence
agggtttgcctgccttctgc

SEQ ID NO: 377983 - DNA, 20 bp, Artificial
  CRISPR gRNA sequence
agtaagatttccacaggagg

SEQ ID NO: 377984 - DNA, 20 bp, Artificial
  CRISPR gRNA sequence
caaagtgaaggccgaggcgg

SEQ ID NO: 377985 - DNA, 20 bp, Artificial
  CRISPR gRNA sequence
ctaaaaatacaaaaaattag

SEQ ID NO: 377986 - DNA, 20 bp, Artificial
  CRISPR gRNA sequence
tactcaggaggctgaggcag

SEQ ID NO: 377987 - DNA, 20 bp, Artificial
  CRISPR gRNA sequence
ttcctcaggaacacaatagt

SEQ ID NO: 377988 - DNA, 20 bp, Artificial
  CRISPR gRNA sequence
caagtcatacacatgtcccc

SEQ ID NO: 377989 - DNA, 20 bp, Artificial
  CRISPR gRNA sequence
ccccaggagtgaggctactg

SEQ ID NO: 377990 - DNA, 20 bp, Artificial
  CRISPR gRNA sequence
gtcaacgcaaagactccagt

SEQ ID NO: 377991 - DNA, 20 bp, Artificial
  CRISPR gRNA sequence
gactccagttggggttcagc

SEQ ID NO: 377992 - DNA, 20 bp, Artificial
  CRISPR gRNA sequence
tcagcagggatcctctaaga

SEQ ID NO: 377993 - DNA, 20 bp, Artificial
  CRISPR gRNA sequence
cagaaaaagtttcccaaccc

SEQ ID NO: 377994 - DNA, 20 bp, Artificial
  CRISPR gRNA sequence
aaagtttcccaacccttgag

SEQ ID NO: 377995 - DNA, 20 bp, Artificial
  CRISPR gRNA sequence
ttgagtaggataataaatct

SEQ ID NO: 377996 - DNA, 20 bp, Artificial
  CRISPR gRNA sequence
aaggttactaaccttgagat

SEQ ID NO: 377997 - DNA, 20 bp, Artificial
  CRISPR gRNA sequence
ttcctcagatagcaactgaa

SEQ ID NO: 377998 - DNA, 20 bp, Artificial
  CRISPR gRNA sequence
atcactaatatttcatgaag

SEQ ID NO: 377999 - DNA, 20 bp, Artificial
  CRISPR gRNA sequence
tctgtccctcttttccccca

SEQ ID NO: 378000 - DNA, 20 bp, Artificial
  CRISPR gRNA sequence
gaaacaaactgatttcggcg

SEQ ID NO: 378001 - DNA, 20 bp, Artificial
  CRISPR gRNA sequence
aaagagggacagaactttat

SEQ ID NO: 378002 - DNA, 20 bp, Artificial
  CRISPR gRNA sequence
gacagaactttatctgagtt

SEQ ID NO: 378003 - DNA, 20 bp, Artificial
  CRISPR gRNA sequence
gaactttatctgagtttgga

SEQ ID NO: 378004 - DNA, 20 bp, Artificial
  CRISPR gRNA sequence
tatctgagtttggaatgagt

SEQ ID NO: 378005 - DNA, 20 bp, Artificial
  CRISPR gRNA sequence
gaagagctcaagagcatggg

SEQ ID NO: 378006 - DNA, 20 bp, Artificial
  CRISPR gRNA sequence
agcatgggcagagtcagctc

SEQ ID NO: 378007 - DNA, 20 bp, Artificial
  CRISPR gRNA sequence
ggggagcttgcagtgaccaa

SEQ ID NO: 378008 - DNA, 20 bp, Artificial
  CRISPR gRNA sequence
ggctaggaggccacgataaa

SEQ ID NO: 378009 - DNA, 20 bp, Artificial
  CRISPR gRNA sequence
taaccttctcagaaaaaaga

SEQ ID NO: 378010 - DNA, 20 bp, Artificial
  CRISPR gRNA sequence
gtctgagctcaactttttaa

SEQ ID NO: 378011 - DNA, 20 bp, Artificial
  CRISPR gRNA sequence
tttaaatgaatcgtgtgcga

SEQ ID NO: 378012 - DNA, 20 bp, Artificial
  CRISPR gRNA sequence
aagttgatgcagcaggacaa

SEQ ID NO: 378013 - DNA, 20 bp, Artificial
  CRISPR gRNA sequence
agagagttgccggaaaaagc

SEQ ID NO: 378014 - DNA, 20 bp, Artificial
  CRISPR gRNA sequence
tgtgaactgttagtttaatg

SEQ ID NO: 378015 - DNA, 20 bp, Artificial
  CRISPR gRNA sequence
aggggtgcagtttgtagtaa

SEQ ID NO: 378016 - DNA, 20 bp, Artificial
  CRISPR gRNA sequence
actttttctcagtctgtctc

SEQ ID NO: 378017 - DNA, 20 bp, Artificial
  CRISPR gRNA sequence
gatctgatcgtaaagttctt

SEQ ID NO: 378018 - DNA, 20 bp, Artificial
  CRISPR gRNA sequence
tctctccagcaagactgaac

SEQ ID NO: 378019 - DNA, 20 bp, Artificial
  CRISPR gRNA sequence
aaagatttattatcctactc

SEQ ID NO: 378020 - DNA, 20 bp, Artificial
  CRISPR gRNA sequence
attgcagcacaaaaacagcg

SEQ ID NO: 378021 - DNA, 20 bp, Artificial
  CRISPR gRNA sequence
agtttcagaaccctgtctta

SEQ ID NO: 378022 - DNA, 20 bp, Artificial
  CRISPR gRNA sequence
gatccctgctgaaccccaac

SEQ ID NO: 378023 - DNA, 20 bp, Artificial
  CRISPR gRNA sequence
gtctttgcgttgactggaag

SEQ ID NO: 378024 - DNA, 20 bp, Artificial
  CRISPR gRNA sequence
gtatgacttgccaaggttct

SEQ ID NO: 378025 - DNA, 20 bp, Artificial
  CRISPR gRNA sequence
ttttttttttttttttgaga

SEQ ID NO: 378026 - DNA, 20 bp, Artificial
  CRISPR gRNA sequence
tctcgctcctttgcccaggc

SEQ ID NO: 378027 - DNA, 20 bp, Artificial
  CRISPR gRNA sequence
ctcactgcaagctctgcctc

SEQ ID NO: 378028 - DNA, 20 bp, Artificial
  CRISPR gRNA sequence
cattctcctgcctcagcctc

SEQ ID NO: 378029 - DNA, 20 bp, Artificial
  CRISPR gRNA sequence
gcccgcctcggccttcactt

SEQ ID NO: 378030 - DNA, 20 bp, Artificial
  CRISPR gRNA sequence
gcaaaccctcgcatctgaga

SEQ ID NO: 378031 - DNA, 20 bp, Artificial
  CRISPR gRNA sequence
cccagccccagtcacttgtt

SEQ ID NO: 378032 - DNA, 20 bp, Artificial
  CRISPR gRNA sequence
agtcctctgctttccagcat

SEQ ID NO: 378033 - DNA, 20 bp, Artificial
  CRISPR gRNA sequence
tttgcataaactggggaagg

SEQ ID NO: 378034 - DNA, 20 bp, Artificial
  CRISPR gRNA sequence
aactggggaaggtggggtca

SEQ ID NO: 378035 - DNA, 20 bp, Artificial
  CRISPR gRNA sequence
ggtgacagggaaggttctac

SEQ ID NO: 378036 - DNA, 20 bp, Artificial
  CRISPR gRNA sequence
gaagaagaacagtgtggctg

SEQ ID NO: 378037 - DNA, 20 bp, Artificial
  CRISPR gRNA sequence
cccacccacccaggccacct

SEQ ID NO: 378038 - DNA, 20 bp, Artificial
  CRISPR gRNA sequence
ttcagaggcaagcttgtgag

SEQ ID NO: 378039 - DNA, 20 bp, Artificial
  CRISPR gRNA sequence
agtctttctgcccctttcat

SEQ ID NO: 378040 - DNA, 20 bp, Artificial
  CRISPR gRNA sequence
acctctaggaccctcaattc

SEQ ID NO: 378041 - DNA, 20 bp, Artificial
  CRISPR gRNA sequence
catctcttgactagttggct

SEQ ID NO: 378042 - DNA, 20 bp, Artificial
  CRISPR gRNA sequence
tagttggctctggatgcctt

SEQ ID NO: 378043 - DNA, 20 bp, Artificial
  CRISPR gRNA sequence
ctctggatgccttgggaata

SEQ ID NO: 378044 - DNA, 20 bp, Artificial
  CRISPR gRNA sequence
atgaacctcatttctttatc

SEQ ID NO: 378045 - DNA, 20 bp, Artificial
  CRISPR gRNA sequence
gcctgatcatagaaaccacc

SEQ ID NO: 378046 - DNA, 20 bp, Artificial
  CRISPR gRNA sequence
gatcatagaaaccaccgaga

SEQ ID NO: 378047 - DNA, 20 bp, Artificial
  CRISPR gRNA sequence
aggtttcatctcatttcctt

SEQ ID NO: 378048 - DNA, 20 bp, Artificial
  CRISPR gRNA sequence
ctgttatcacaaagttgtga

SEQ ID NO: 378049 - DNA, 20 bp, Artificial
  CRISPR gRNA sequence
atgctaatgtactgtattct

SEQ ID NO: 378050 - DNA, 20 bp, Artificial
  CRISPR gRNA sequence
tgtacttggcatctttggac

SEQ ID NO: 378051 - DNA, 20 bp, Artificial
  CRISPR gRNA sequence
tctttggaccggggtggttg

SEQ ID NO: 378052 - DNA, 20 bp, Artificial
  CRISPR gRNA sequence
atacgtggccaacagcaaga

SEQ ID NO: 378053 - DNA, 20 bp, Artificial
  CRISPR gRNA sequence
cctcattcattggtaagacc

SEQ ID NO: 378054 - DNA, 20 bp, Artificial
  CRISPR gRNA sequence
attcattggtaagacctggg

SEQ ID NO: 378055 - DNA, 20 bp, Artificial
  CRISPR gRNA sequence
ttttttttttttttttgaaa

SEQ ID NO: 378056 - DNA, 20 bp, Artificial
  CRISPR gRNA sequence
tcttgctctgttgacctggc

SEQ ID NO: 378057 - DNA, 20 bp, Artificial
  CRISPR gRNA sequence
ctcactgcaacctccacctc

SEQ ID NO: 378058 - DNA, 20 bp, Artificial
  CRISPR gRNA sequence
gtctcagcctcccaagtagc

SEQ ID NO: 378059 - DNA, 20 bp, Artificial
  CRISPR gRNA sequence
gctaatttttgtatttttag

SEQ ID NO: 378060 - DNA, 20 bp, Artificial
  CRISPR gRNA sequence
ttttgtatttttagtagagt

SEQ ID NO: 378061 - DNA, 20 bp, Artificial
  CRISPR gRNA sequence
ccatgttggccaggctggtt

SEQ ID NO: 378062 - DNA, 20 bp, Artificial
  CRISPR gRNA sequence
gccttggcctcccaaagtac

SEQ ID NO: 378063 - DNA, 20 bp, Artificial
  CRISPR gRNA sequence
ccaatctgctttccatctcc

SEQ ID NO: 378064 - DNA, 20 bp, Artificial
  CRISPR gRNA sequence
atctccatggatttaactat

SEQ ID NO: 378065 - DNA, 20 bp, Artificial
  CRISPR gRNA sequence
tatctggatatttcatataa

SEQ ID NO: 378066 - DNA, 20 bp, Artificial
  CRISPR gRNA sequence
cccttcattcctttttatgg

SEQ ID NO: 378067 - DNA, 20 bp, Artificial
  CRISPR gRNA sequence
gctgagtaatattccattgt

SEQ ID NO: 378068 - DNA, 20 bp, Artificial
  CRISPR gRNA sequence
attcacctgttggcagacgc

SEQ ID NO: 378069 - DNA, 20 bp, Artificial
  CRISPR gRNA sequence
gttaccaccttctggctttt

SEQ ID NO: 378070 - DNA, 20 bp, Artificial
  CRISPR gRNA sequence
attggtctacaaatattggt

SEQ ID NO: 378071 - DNA, 20 bp, Artificial
  CRISPR gRNA sequence
attggtttgagtatattctt

SEQ ID NO: 378072 - DNA, 20 bp, Artificial
  CRISPR gRNA sequence
attcttttgagtatatacct

SEQ ID NO: 378073 - DNA, 20 bp, Artificial
  CRISPR gRNA sequence
tatacctaggaataaaactt

SEQ ID NO: 378074 - DNA, 20 bp, Artificial
  CRISPR gRNA sequence
taatcctgttgaacgttttg

SEQ ID NO: 378075 - DNA, 20 bp, Artificial
  CRISPR gRNA sequence
acgcttgtgcaacagtacac

SEQ ID NO: 378076 - DNA, 20 bp, Artificial
  CRISPR gRNA sequence
gtgcaacagtacacaagggt

SEQ ID NO: 378077 - DNA, 20 bp, Artificial
  CRISPR gRNA sequence
tccatcctagtagatataaa

SEQ ID NO: 378078 - DNA, 20 bp, Artificial
  CRISPR gRNA sequence
gtactttgcccatttgaaaa

SEQ ID NO: 378079 - DNA, 20 bp, Artificial
  CRISPR gRNA sequence
tttcttttatgttaaagtgt

SEQ ID NO: 378080 - DNA, 20 bp, Artificial
  CRISPR gRNA sequence
gtgagagttccttatatatt

SEQ ID NO: 378081 - DNA, 20 bp, Artificial
  CRISPR gRNA sequence
aaatatttgcttgcattctg

SEQ ID NO: 378082 - DNA, 20 bp, Artificial
  CRISPR gRNA sequence
ataggtttgctgtcatgtct

SEQ ID NO: 378083 - DNA, 20 bp, Artificial
  CRISPR gRNA sequence
tatatttaggtcaacccatt

SEQ ID NO: 378084 - DNA, 20 bp, Artificial
  CRISPR gRNA sequence
tttttgtgtttcacggaggt

SEQ ID NO: 378085 - DNA, 20 bp, Artificial
  CRISPR gRNA sequence
gctattctttccccactcag

SEQ ID NO: 378086 - DNA, 20 bp, Artificial
  CRISPR gRNA sequence
tcagtggggttggcaccttg

SEQ ID NO: 378087 - DNA, 20 bp, Artificial
  CRISPR gRNA sequence
tttttatttgtataaattca

SEQ ID NO: 378088 - DNA, 20 bp, Artificial
  CRISPR gRNA sequence
acttttaatataaccatcac

SEQ ID NO: 378089 - DNA, 20 bp, Artificial
  CRISPR gRNA sequence
ttattgcatactgtatgtcc

SEQ ID NO: 378090 - DNA, 20 bp, Artificial
  CRISPR gRNA sequence
taagtgagaacatgtggttt

SEQ ID NO: 378091 - DNA, 20 bp, Artificial
  CRISPR gRNA sequence
tggtttttgagtttctgtgt

SEQ ID NO: 378092 - DNA, 20 bp, Artificial
  CRISPR gRNA sequence
gggctgtgtagtattccatt

SEQ ID NO: 378093 - DNA, 20 bp, Artificial
  CRISPR gRNA sequence
gattccatatcttggttatt

SEQ ID NO: 378094 - DNA, 20 bp, Artificial
  CRISPR gRNA sequence
atataatgatttcttttcct

SEQ ID NO: 378095 - DNA, 20 bp, Artificial
  CRISPR gRNA sequence
gataccctgtagtgagactg

SEQ ID NO: 378096 - DNA, 20 bp, Artificial
  CRISPR gRNA sequence
tatgtaatatgttcagactt

SEQ ID NO: 378097 - DNA, 20 bp, Artificial
  CRISPR gRNA sequence
atgttcagacttcagagttg

SEQ ID NO: 378098 - DNA, 20 bp, Artificial
  CRISPR gRNA sequence
gaggagataaagatagaaac

SEQ ID NO: 378099 - DNA, 20 bp, Artificial
  CRISPR gRNA sequence
tccatgctgtttttctggca

SEQ ID NO: 378100 - DNA, 20 bp, Artificial
  CRISPR gRNA sequence
ctgtttttctggcatggaat

SEQ ID NO: 378101 - DNA, 20 bp, Artificial
  CRISPR gRNA sequence
tagttttcaggctgggcatg

SEQ ID NO: 378102 - DNA, 20 bp, Artificial
  CRISPR gRNA sequence
atgtacaagtgcaaaattac

SEQ ID NO: 378103 - DNA, 20 bp, Artificial
  CRISPR gRNA sequence
aaataattttaaaaaattag

SEQ ID NO: 378104 - DNA, 20 bp, Artificial
  CRISPR gRNA sequence
agctgagtgtggtggctcag

SEQ ID NO: 378105 - DNA, 20 bp, Artificial
  CRISPR gRNA sequence
tacccaggaggctgaagtgg

SEQ ID NO: 378106 - DNA, 20 bp, Artificial
  CRISPR gRNA sequence
tgggagggtcacttgagacc

SEQ ID NO: 378107 - DNA, 20 bp, Artificial
  CRISPR gRNA sequence
tatctctgtggcgtgtggaa

SEQ ID NO: 378108 - DNA, 20 bp, Artificial
  CRISPR gRNA sequence
tctgtggcgtgtggaaaggg

SEQ ID NO: 378109 - DNA, 20 bp, Artificial
  CRISPR gRNA sequence
aactcaggtacagtactgct

SEQ ID NO: 378110 - DNA, 20 bp, Artificial
  CRISPR gRNA sequence
ctaggagtgaggaaagtgaa

SEQ ID NO: 378111 - DNA, 20 bp, Artificial
  CRISPR gRNA sequence
taacaatctccaatcgctct

SEQ ID NO: 378112 - DNA, 20 bp, Artificial
  CRISPR gRNA sequence
gtgtgagagagagagagaga

SEQ ID NO: 378113 - DNA, 20 bp, Artificial
  CRISPR gRNA sequence
gagagagagacagagtgtgt

SEQ ID NO: 378114 - DNA, 20 bp, Artificial
  CRISPR gRNA sequence
gcatgcatgtgtgcgtgcat

SEQ ID NO: 378115 - DNA, 20 bp, Artificial
  CRISPR gRNA sequence
gcatgtgagtgtatgcatgt

SEQ ID NO: 378116 - DNA, 20 bp, Artificial
  CRISPR gRNA sequence
atgcatgtacgagtgtgttt

SEQ ID NO: 378117 - DNA, 20 bp, Artificial
  CRISPR gRNA sequence
gcatgcgtgtgtgcatgtgt

SEQ ID NO: 378118 - DNA, 20 bp, Artificial
  CRISPR gRNA sequence
gagtgcatgtatacgtgttt

SEQ ID NO: 378119 - DNA, 20 bp, Artificial
  CRISPR gRNA sequence
gcatgtgattgtgtgtgtga

SEQ ID NO: 378120 - DNA, 20 bp, Artificial
  CRISPR gRNA sequence
gagagtgtgagaaacaaagt

SEQ ID NO: 378121 - DNA, 20 bp, Artificial
  CRISPR gRNA sequence
aagtgtgaatgtgtgcatat

SEQ ID NO: 378122 - DNA, 20 bp, Artificial
  CRISPR gRNA sequence
gtgtaagtgcatgcgtgtgt

SEQ ID NO: 378123 - DNA, 20 bp, Artificial
  CRISPR gRNA sequence
gtgtgtgtggatgtgtgttt

SEQ ID NO: 378124 - DNA, 20 bp, Artificial
  CRISPR gRNA sequence
gcacatgcatgtgattgaga

SEQ ID NO: 378125 - DNA, 20 bp, Artificial
  CRISPR gRNA sequence
gagtgagacagtgtgcatat

SEQ ID NO: 378126 - DNA, 20 bp, Artificial
  CRISPR gRNA sequence
gagtgataacgtgtaagtgc

SEQ ID NO: 378127 - DNA, 20 bp, Artificial
  CRISPR gRNA sequence
taacgtgtaagtgcatgagt

SEQ ID NO: 378128 - DNA, 20 bp, Artificial
  CRISPR gRNA sequence
gtgcatgagtgtgagtgtgc

SEQ ID NO: 378129 - DNA, 20 bp, Artificial
  CRISPR gRNA sequence
gtgtgagtgtgcgtggatgt

SEQ ID NO: 378130 - DNA, 20 bp, Artificial
  CRISPR gRNA sequence
gagactgtgagcatgtgtgt

SEQ ID NO: 378131 - DNA, 20 bp, Artificial
  CRISPR gRNA sequence
gtgtgtgggtgcatgtgtat

SEQ ID NO: 378132 - DNA, 20 bp, Artificial
  CRISPR gRNA sequence
tgtgggtgcatgttgtgtgt

SEQ ID NO: 378133 - DNA, 20 bp, Artificial
  CRISPR gRNA sequence
gaatgtgtgttagagcatgt

SEQ ID NO: 378134 - DNA, 20 bp, Artificial
  CRISPR gRNA sequence
atgtgagactgcatgtgtgt

SEQ ID NO: 378135 - DNA, 20 bp, Artificial
  CRISPR gRNA sequence
atgtttgggagacagcatgt

SEQ ID NO: 378136 - DNA, 20 bp, Artificial
  CRISPR gRNA sequence
gggttcatgcatttgagcac

SEQ ID NO: 378137 - DNA, 20 bp, Artificial
  CRISPR gRNA sequence
acaggcctgagacagaagat

SEQ ID NO: 378138 - DNA, 20 bp, Artificial
  CRISPR gRNA sequence
acagaagatatgaatgcagg

SEQ ID NO: 378139 - DNA, 20 bp, Artificial
  CRISPR gRNA sequence
gaccctgtcctcaggacctc

SEQ ID NO: 378140 - DNA, 20 bp, Artificial
  CRISPR gRNA sequence
ggcggctccatgttcctctc

SEQ ID NO: 378141 - DNA, 20 bp, Artificial
  CRISPR gRNA sequence
ctgagagcctgctttgcctg

SEQ ID NO: 378142 - DNA, 20 bp, Artificial
  CRISPR gRNA sequence
gctttgcctgaggaattgtg

SEQ ID NO: 378143 - DNA, 20 bp, Artificial
  CRISPR gRNA sequence
tgaggaattgtgctgggtgc

SEQ ID NO: 378144 - DNA, 20 bp, Artificial
  CRISPR gRNA sequence
aaaccttttccacaatctat

SEQ ID NO: 378145 - DNA, 20 bp, Artificial
  CRISPR gRNA sequence
cataactcagtacaatttgg

SEQ ID NO: 378146 - DNA, 20 bp, Artificial
  CRISPR gRNA sequence
agtacaatttggaggaattg

SEQ ID NO: 378147 - DNA, 20 bp, Artificial
  CRISPR gRNA sequence
tcccacattagatattcatg

SEQ ID NO: 378148 - DNA, 20 bp, Artificial
  CRISPR gRNA sequence
cttgctgatacactttgaga

SEQ ID NO: 378149 - DNA, 20 bp, Artificial
  CRISPR gRNA sequence
actgagtcacaaacaaagtt

SEQ ID NO: 378150 - DNA, 20 bp, Artificial
  CRISPR gRNA sequence
ttctattttgacagtcttac

SEQ ID NO: 378151 - DNA, 20 bp, Artificial
  CRISPR gRNA sequence
tatacaattcctctttttgt

SEQ ID NO: 378152 - DNA, 20 bp, Artificial
  CRISPR gRNA sequence
tatgttcctaacaagttctt

SEQ ID NO: 378153 - DNA, 20 bp, Artificial
  CRISPR gRNA sequence
cttgtacctaacaagttctt

SEQ ID NO: 378154 - DNA, 20 bp, Artificial
  CRISPR gRNA sequence
agcaatgatgaacctgaaaa

SEQ ID NO: 378155 - DNA, 20 bp, Artificial
  CRISPR gRNA sequence
aagaggtgaaaggaaggcca

SEQ ID NO: 378156 - DNA, 20 bp, Artificial
  CRISPR gRNA sequence
tagtttctgcctcctccaca

SEQ ID NO: 378157 - DNA, 20 bp, Artificial
  CRISPR gRNA sequence
tgtatcctcattgcctacag

SEQ ID NO: 378158 - DNA, 20 bp, Artificial
  CRISPR gRNA sequence
ctacagctgagttaggcaca

SEQ ID NO: 378159 - DNA, 20 bp, Artificial
  CRISPR gRNA sequence
atgcatgcagcacatgtttg

SEQ ID NO: 378160 - DNA, 20 bp, Artificial
  CRISPR gRNA sequence
atgcagcacatgtttgttga

SEQ ID NO: 378161 - DNA, 20 bp, Artificial
  CRISPR gRNA sequence
gaaggaaactgcattgtgct

SEQ ID NO: 378162 - DNA, 20 bp, Artificial
  CRISPR gRNA sequence
ctttcaaacagtttccagag

SEQ ID NO: 378163 - DNA, 20 bp, Artificial
  CRISPR gRNA sequence
tttgtacagtgtggcatatt

SEQ ID NO: 378164 - DNA, 20 bp, Artificial
  CRISPR gRNA sequence
tacagtgctctttagttggc

SEQ ID NO: 378165 - DNA, 20 bp, Artificial
  CRISPR gRNA sequence
ctttgccgagaacatgtctc

SEQ ID NO: 378166 - DNA, 20 bp, Artificial
  CRISPR gRNA sequence
aatgggcatcttaacacagg

SEQ ID NO: 378167 - DNA, 20 bp, Artificial
  CRISPR gRNA sequence
ggttcaagatcgggacccag

SEQ ID NO: 378168 - DNA, 20 bp, Artificial
  CRISPR gRNA sequence
ataaggaagccctatgctga

SEQ ID NO: 378169 - DNA, 20 bp, Artificial
  CRISPR gRNA sequence
atgctgagagggtttacttt

SEQ ID NO: 378170 - DNA, 20 bp, Artificial
  CRISPR gRNA sequence
ataacatgactcttttcttt

SEQ ID NO: 378171 - DNA, 20 bp, Artificial
  CRISPR gRNA sequence
taaagcccaagtagaagcta

SEQ ID NO: 378172 - DNA, 20 bp, Artificial
  CRISPR gRNA sequence
tgctttgaaggagcaatctt

SEQ ID NO: 378173 - DNA, 20 bp, Artificial
  CRISPR gRNA sequence
ttctgactgtgctgttgtgt

SEQ ID NO: 378174 - DNA, 20 bp, Artificial
  CRISPR gRNA sequence
agtagaagtgcctttcaaat

SEQ ID NO: 378175 - DNA, 20 bp, Artificial
  CRISPR gRNA sequence
taaactgatgttggcaacac

SEQ ID NO: 378176 - DNA, 20 bp, Artificial
  CRISPR gRNA sequence
atgttggcaacacatgggtt

SEQ ID NO: 378177 - DNA, 20 bp, Artificial
  CRISPR gRNA sequence
acatgggttcaggatccttt

SEQ ID NO: 378178 - DNA, 20 bp, Artificial
  CRISPR gRNA sequence
ttttttttttttttttttga

SEQ ID NO: 378179 - DNA, 20 bp, Artificial
  CRISPR gRNA sequence
gtcttgctctgtcaccaggc

SEQ ID NO: 378180 - DNA, 20 bp, Artificial
  CRISPR gRNA sequence
gcaccgccacgtgatatggt

SEQ ID NO: 378181 - DNA, 20 bp, Artificial
  CRISPR gRNA sequence
agggacctggtgggaggtaa

SEQ ID NO: 378182 - DNA, 20 bp, Artificial
  CRISPR gRNA sequence
gatctgatggtttaaaaaag

SEQ ID NO: 378183 - DNA, 20 bp, Artificial
  CRISPR gRNA sequence
tttgtaaattgcccagtctt

SEQ ID NO: 378184 - DNA, 20 bp, Artificial
  CRISPR gRNA sequence
cttgggaatatcttcatcag

SEQ ID NO: 378185 - DNA, 20 bp, Artificial
  CRISPR gRNA sequence
cccaggctggtcttggactc

SEQ ID NO: 378186 - DNA, 20 bp, Artificial
  CRISPR gRNA sequence
atccaactgcctcggcctcc

SEQ ID NO: 378187 - DNA, 20 bp, Artificial
  CRISPR gRNA sequence
gcctcggcctcccagagtgc

SEQ ID NO: 378188 - DNA, 20 bp, Artificial
  CRISPR gRNA sequence
gaaagaacccaatgatccct

SEQ ID NO: 378189 - DNA, 20 bp, Artificial
  CRISPR gRNA sequence
ttgtagtatattggaaacac

SEQ ID NO: 378190 - DNA, 20 bp, Artificial
  CRISPR gRNA sequence
gtgttagttgctcgatccct

SEQ ID NO: 378191 - DNA, 20 bp, Artificial
  CRISPR gRNA sequence
tcaggttcctgaagaggaaa

SEQ ID NO: 378192 - DNA, 20 bp, Artificial
  CRISPR gRNA sequence
tggtagtgccattctacttg

SEQ ID NO: 378193 - DNA, 20 bp, Artificial
  CRISPR gRNA sequence
aacttggtccatggtagtca

SEQ ID NO: 378194 - DNA, 20 bp, Artificial
  CRISPR gRNA sequence
attagtgacaatctaaagca

SEQ ID NO: 378195 - DNA, 20 bp, Artificial
  CRISPR gRNA sequence
ataatagtgctttattttta

SEQ ID NO: 378196 - DNA, 20 bp, Artificial
  CRISPR gRNA sequence
gtgctctaaaagaacaagta

SEQ ID NO: 378197 - DNA, 20 bp, Artificial
  CRISPR gRNA sequence
aacaagtacagaattatatg

SEQ ID NO: 378198 - DNA, 20 bp, Artificial
  CRISPR gRNA sequence
cctttctctttaggtgtagc

SEQ ID NO: 378199 - DNA, 20 bp, Artificial
  CRISPR gRNA sequence
gtgtatatagctgaggctta

SEQ ID NO: 378200 - DNA, 20 bp, Artificial
  CRISPR gRNA sequence
ctgagccaccaaagctagaa

SEQ ID NO: 378201 - DNA, 20 bp, Artificial
  CRISPR gRNA sequence
gtgtggtatgcctttaaagt

SEQ ID NO: 378202 - DNA, 20 bp, Artificial
  CRISPR gRNA sequence
ttgaaaacagctcaaccttt

SEQ ID NO: 378203 - DNA, 20 bp, Artificial
  CRISPR gRNA sequence
cagctcaacctttcaggata

SEQ ID NO: 378204 - DNA, 20 bp, Artificial
  CRISPR gRNA sequence
tgatggttgttatgcaaagg

SEQ ID NO: 378205 - DNA, 20 bp, Artificial
  CRISPR gRNA sequence
taggatttttaacatcacat

SEQ ID NO: 378206 - DNA, 20 bp, Artificial
  CRISPR gRNA sequence
catcacatatgaatagtctt

SEQ ID NO: 378207 - DNA, 20 bp, Artificial
  CRISPR gRNA sequence
gtcagttttcagtcagagga

SEQ ID NO: 378208 - DNA, 20 bp, Artificial
  CRISPR gRNA sequence
ataccggctgtccgtctagt

SEQ ID NO: 378209 - DNA, 20 bp, Artificial
  CRISPR gRNA sequence
agggcattctaccctatttt

SEQ ID NO: 378210 - DNA, 20 bp, Artificial
  CRISPR gRNA sequence
gagcttcacttttttaaact

SEQ ID NO: 378211 - DNA, 20 bp, Artificial
  CRISPR gRNA sequence
tttttaaactaagaatgata

SEQ ID NO: 378212 - DNA, 20 bp, Artificial
  CRISPR gRNA sequence
gtacttcagtaacaacatac

SEQ ID NO: 378213 - DNA, 20 bp, Artificial
  CRISPR gRNA sequence
acttttgtatactgtaaagg

SEQ ID NO: 378214 - DNA, 20 bp, Artificial
  CRISPR gRNA sequence
aaaaaaaaaaaaaaaagact

SEQ ID NO: 378215 - DNA, 20 bp, Artificial
  CRISPR gRNA sequence
tagaaatcctagtttgtata

SEQ ID NO: 378216 - DNA, 20 bp, Artificial
  CRISPR gRNA sequence
atggattgtaagaacttcag

SEQ ID NO: 378217 - DNA, 20 bp, Artificial
  CRISPR gRNA sequence
taagaacttcagaaggatga

SEQ ID NO: 378218 - DNA, 20 bp, Artificial
  CRISPR gRNA sequence
tattgatagcttattatgtg

SEQ ID NO: 378219 - DNA, 20 bp, Artificial
  CRISPR gRNA sequence
tgtgcggaattttacatagt

SEQ ID NO: 378220 - DNA, 20 bp, Artificial
  CRISPR gRNA sequence
gatcttcatagacttcctcc

SEQ ID NO: 378221 - DNA, 20 bp, Artificial
  CRISPR gRNA sequence
cccctctccagctttcagcc

SEQ ID NO: 378222 - DNA, 20 bp, Artificial
  CRISPR gRNA sequence
agcaaacaggacatcttatt

SEQ ID NO: 378223 - DNA, 20 bp, Artificial
  CRISPR gRNA sequence
gatttagagactctgatggt

SEQ ID NO: 378224 - DNA, 20 bp, Artificial
  CRISPR gRNA sequence
ttccagatagccctttctag

SEQ ID NO: 378225 - DNA, 20 bp, Artificial
  CRISPR gRNA sequence
tttacagaaatacccccaaa

SEQ ID NO: 378226 - DNA, 20 bp, Artificial
  CRISPR gRNA sequence
cccaaaatgagtgacccact

SEQ ID NO: 378227 - DNA, 20 bp, Artificial
  CRISPR gRNA sequence
gctctgccacctagtgttta

SEQ ID NO: 378228 - DNA, 20 bp, Artificial
  CRISPR gRNA sequence
tttactgggtgcctgctctg

SEQ ID NO: 378229 - DNA, 20 bp, Artificial
  CRISPR gRNA sequence
caacagaagacactgaggtt

SEQ ID NO: 378230 - DNA, 20 bp, Artificial
  CRISPR gRNA sequence
aagctgccaagtggcagcac

SEQ ID NO: 378231 - DNA, 20 bp, Artificial
  CRISPR gRNA sequence
gccagagatcttaactccag

SEQ ID NO: 378232 - DNA, 20 bp, Artificial
  CRISPR gRNA sequence
aaaagtcgtgctggaccttg

SEQ ID NO: 378233 - DNA, 20 bp, Artificial
  CRISPR gRNA sequence
ctggaccttgaagaattgga

SEQ ID NO: 378234 - DNA, 20 bp, Artificial
  CRISPR gRNA sequence
aatattttaattagagaggc

SEQ ID NO: 378235 - DNA, 20 bp, Artificial
  CRISPR gRNA sequence
aagagagaagacagagaggg

SEQ ID NO: 378236 - DNA, 20 bp, Artificial
  CRISPR gRNA sequence
cagagagggaagggtgtcct

SEQ ID NO: 378237 - DNA, 20 bp, Artificial
  CRISPR gRNA sequence
ggccttctctgactagggca

SEQ ID NO: 378238 - DNA, 20 bp, Artificial
  CRISPR gRNA sequence
ctctgactagggcactggat

SEQ ID NO: 378239 - DNA, 20 bp, Artificial
  CRISPR gRNA sequence
ccaggaaaggaagacactgt

SEQ ID NO: 378240 - DNA, 20 bp, Artificial
  CRISPR gRNA sequence
gggctcagcttatgatactt

SEQ ID NO: 378241 - DNA, 20 bp, Artificial
  CRISPR gRNA sequence
gtagattctgtgcttgaaaa

SEQ ID NO: 378242 - DNA, 20 bp, Artificial
  CRISPR gRNA sequence
gttgcagctcactagggcag

SEQ ID NO: 378243 - DNA, 20 bp, Artificial
  CRISPR gRNA sequence
aaagttattgatgtgcctaa

SEQ ID NO: 378244 - DNA, 20 bp, Artificial
  CRISPR gRNA sequence
cactagctgcagtcttttag

SEQ ID NO: 378245 - DNA, 20 bp, Artificial
  CRISPR gRNA sequence
ctgcagtcttttaggagagt

SEQ ID NO: 378246 - DNA, 20 bp, Artificial
  CRISPR gRNA sequence
cctttacacactgctagcag

SEQ ID NO: 378247 - DNA, 20 bp, Artificial
  CRISPR gRNA sequence
ctgtgaagaaatacttaaga

SEQ ID NO: 378248 - DNA, 20 bp, Artificial
  CRISPR gRNA sequence
ggcagcaggaaggagaagtg

SEQ ID NO: 378249 - DNA, 20 bp, Artificial
  CRISPR gRNA sequence
ataaaaccatcagattttgt

SEQ ID NO: 378250 - DNA, 20 bp, Artificial
  CRISPR gRNA sequence
catgattcagctacctccca

SEQ ID NO: 378251 - DNA, 20 bp, Artificial
  CRISPR gRNA sequence
gggtccttcccacaatacat

SEQ ID NO: 378252 - DNA, 20 bp, Artificial
  CRISPR gRNA sequence
tgggaactacaagatgagat

SEQ ID NO: 378253 - DNA, 20 bp, Artificial
  CRISPR gRNA sequence
agttacttcctagataaaag

SEQ ID NO: 378254 - DNA, 20 bp, Artificial
  CRISPR gRNA sequence
ataaaagaggggtacaggca

SEQ ID NO: 378255 - DNA, 20 bp, Artificial
  CRISPR gRNA sequence
gctccacccctctggctatg

SEQ ID NO: 378256 - DNA, 20 bp, Artificial
  CRISPR gRNA sequence
gctgctttcacaggctggtg

SEQ ID NO: 378257 - DNA, 20 bp, Artificial
  CRISPR gRNA sequence
ttgcatggtgcaagccgtct

SEQ ID NO: 378258 - DNA, 20 bp, Artificial
  CRISPR gRNA sequence
tgtggatcagattcagattg

SEQ ID NO: 378259 - DNA, 20 bp, Artificial
  CRISPR gRNA sequence
gattcagattgtggggtctg

SEQ ID NO: 378260 - DNA, 20 bp, Artificial
  CRISPR gRNA sequence
ctactagacagtgccccagt

SEQ ID NO: 378261 - DNA, 20 bp, Artificial
  CRISPR gRNA sequence
ctctgcccttgcagcaactt

SEQ ID NO: 378262 - DNA, 20 bp, Artificial
  CRISPR gRNA sequence
tcccgaggctgcatagagca

SEQ ID NO: 378263 - DNA, 20 bp, Artificial
  CRISPR gRNA sequence
tgcaaatttctgcagctggc

SEQ ID NO: 378264 - DNA, 20 bp, Artificial
  CRISPR gRNA sequence
tttttatgctctgcttcctc

SEQ ID NO: 378265 - DNA, 20 bp, Artificial
  CRISPR gRNA sequence
caccaaactctttgcatagc

SEQ ID NO: 378266 - DNA, 20 bp, Artificial
  CRISPR gRNA sequence
ccaaagttgctttcacactt

SEQ ID NO: 378267 - DNA, 20 bp, Artificial
  CRISPR gRNA sequence
taataaagacatacctgaga

SEQ ID NO: 378268 - DNA, 20 bp, Artificial
  CRISPR gRNA sequence
taattgattctcagttcagt

SEQ ID NO: 378269 - DNA, 20 bp, Artificial
  CRISPR gRNA sequence
cacatggtagcagggagaag

SEQ ID NO: 378270 - DNA, 20 bp, Artificial
  CRISPR gRNA sequence
tggtagcagggagaagaaga

SEQ ID NO: 378271 - DNA, 20 bp, Artificial
  CRISPR gRNA sequence
ctaactcactatcatgagaa

SEQ ID NO: 378272 - DNA, 20 bp, Artificial
  CRISPR gRNA sequence
tggtctctcccacgacacgt

SEQ ID NO: 378273 - DNA, 20 bp, Artificial
  CRISPR gRNA sequence
actacaactcaagatgagat

SEQ ID NO: 378274 - DNA, 20 bp, Artificial
  CRISPR gRNA sequence
gaagcccaggtcatctgctg

SEQ ID NO: 378275 - DNA, 20 bp, Artificial
  CRISPR gRNA sequence
tggggaggctggtctttttg

SEQ ID NO: 378276 - DNA, 20 bp, Artificial
  CRISPR gRNA sequence
ttctactctgtttggtatcc

SEQ ID NO: 378277 - DNA, 20 bp, Artificial
  CRISPR gRNA sequence
actgaggtctattcacacat

SEQ ID NO: 378278 - DNA, 20 bp, Artificial
  CRISPR gRNA sequence
ggatactctacatcactaaa

SEQ ID NO: 378279 - DNA, 20 bp, Artificial
  CRISPR gRNA sequence
actctacatcactaaaatga

SEQ ID NO: 378280 - DNA, 20 bp, Artificial
  CRISPR gRNA sequence
attatcacttgctcaccgac

SEQ ID NO: 378281 - DNA, 20 bp, Artificial
  CRISPR gRNA sequence
accaaaaaaaataggtaaac

SEQ ID NO: 378282 - DNA, 20 bp, Artificial
  CRISPR gRNA sequence
gttcagaaacatggtaggtg

SEQ ID NO: 378283 - DNA, 20 bp, Artificial
  CRISPR gRNA sequence
gaaacatggtaggtggggga

SEQ ID NO: 378284 - DNA, 20 bp, Artificial
  CRISPR gRNA sequence
atggtaggtgggggatagaa

SEQ ID NO: 378285 - DNA, 20 bp, Artificial
  CRISPR gRNA sequence
atagaatcaggaagggctga

SEQ ID NO: 378286 - DNA, 20 bp, Artificial
  CRISPR gRNA sequence
gggtctttaaggctcatagt

SEQ ID NO: 378287 - DNA, 20 bp, Artificial
  CRISPR gRNA sequence
tttcttttccttttttgaga

SEQ ID NO: 378288 - DNA, 20 bp, Artificial
  CRISPR gRNA sequence
tctcactctgttgcccaggc

SEQ ID NO: 378289 - DNA, 20 bp, Artificial
  CRISPR gRNA sequence
ctcattgcaacctctgcctc

SEQ ID NO: 378290 - DNA, 20 bp, Artificial
  CRISPR gRNA sequence
ggttctcctgcctcagcctc

SEQ ID NO: 378291 - DNA, 20 bp, Artificial
  CRISPR gRNA sequence
gcctcagcctcctgagtagc

SEQ ID NO: 378292 - DNA, 20 bp, Artificial
  CRISPR gRNA sequence
ttttgtatttttgtagagat

SEQ ID NO: 378293 - DNA, 20 bp, Artificial
  CRISPR gRNA sequence
accttggcctcccaaagtgc

SEQ ID NO: 378294 - DNA, 20 bp, Artificial
  CRISPR gRNA sequence
gcagttgaaagctctaaggt

SEQ ID NO: 378295 - DNA, 20 bp, Artificial
  CRISPR gRNA sequence
aagagaccaacttggctagc

SEQ ID NO: 378296 - DNA, 20 bp, Artificial
  CRISPR gRNA sequence
accaacttggctagcaagag

SEQ ID NO: 378297 - DNA, 20 bp, Artificial
  CRISPR gRNA sequence
gaaattatggaacaacaaac

SEQ ID NO: 378298 - DNA, 20 bp, Artificial
  CRISPR gRNA sequence
aatatccaatttgaagtcat

SEQ ID NO: 378299 - DNA, 20 bp, Artificial
  CRISPR gRNA sequence
tgaatgatcatccagcacat

SEQ ID NO: 378300 - DNA, 20 bp, Artificial
  CRISPR gRNA sequence
tgatcatccagcacatgtgg

SEQ ID NO: 378301 - DNA, 20 bp, Artificial
  CRISPR gRNA sequence
atccagcacatgtggatgga

SEQ ID NO: 378302 - DNA, 20 bp, Artificial
  CRISPR gRNA sequence
ggttaactaagaaagtacca

SEQ ID NO: 378303 - DNA, 20 bp, Artificial
  CRISPR gRNA sequence
aggtcatagcttgtggcttg

SEQ ID NO: 378304 - DNA, 20 bp, Artificial
  CRISPR gRNA sequence
taaagaaggtgttcatgtta

SEQ ID NO: 378305 - DNA, 20 bp, Artificial
  CRISPR gRNA sequence
gggcatagagaaaagagggg

SEQ ID NO: 378306 - DNA, 20 bp, Artificial
  CRISPR gRNA sequence
agggagaggaaagtgaacag

SEQ ID NO: 378307 - DNA, 20 bp, Artificial
  CRISPR gRNA sequence
tagaactcatatttatagta

SEQ ID NO: 378308 - DNA, 20 bp, Artificial
  CRISPR gRNA sequence
gttcctcactgtttcccttt

SEQ ID NO: 378309 - DNA, 20 bp, Artificial
  CRISPR gRNA sequence
gagtctcattctctcccagg

SEQ ID NO: 378310 - DNA, 20 bp, Artificial
  CRISPR gRNA sequence
tcctttaatattaagggctc

SEQ ID NO: 378311 - DNA, 20 bp, Artificial
  CRISPR gRNA sequence
cagaattgatggcagttctg

SEQ ID NO: 378312 - DNA, 20 bp, Artificial
  CRISPR gRNA sequence
ctgaggaatcctatgatgaa

SEQ ID NO: 378313 - DNA, 20 bp, Artificial
  CRISPR gRNA sequence
ggccaacatttttctaatgc

SEQ ID NO: 378314 - DNA, 20 bp, Artificial
  CRISPR gRNA sequence
ctcaaatctggcttttataa

SEQ ID NO: 378315 - DNA, 20 bp, Artificial
  CRISPR gRNA sequence
tcactcatcaagtctttcct

SEQ ID NO: 378316 - DNA, 20 bp, Artificial
  CRISPR gRNA sequence
acatagatcttagctctaaa

SEQ ID NO: 378317 - DNA, 20 bp, Artificial
  CRISPR gRNA sequence
tcttagctctaaataggatg

SEQ ID NO: 378318 - DNA, 20 bp, Artificial
  CRISPR gRNA sequence
ataagtcgcattgtagtcta

SEQ ID NO: 378319 - DNA, 20 bp, Artificial
  CRISPR gRNA sequence
tttacctaggaaattcaggg

SEQ ID NO: 378320 - DNA, 20 bp, Artificial
  CRISPR gRNA sequence
gggcagagtccctgaaaaag

SEQ ID NO: 378321 - DNA, 20 bp, Artificial
  CRISPR gRNA sequence
gaactgccaacccagaaaat

SEQ ID NO: 378322 - DNA, 20 bp, Artificial
  CRISPR gRNA sequence
attaataggcactattccag

SEQ ID NO: 378323 - DNA, 20 bp, Artificial
  CRISPR gRNA sequence
tctaaaattgaaccaacaca

SEQ ID NO: 378324 - DNA, 20 bp, Artificial
  CRISPR gRNA sequence
ttcatggcttggttgacatg

SEQ ID NO: 378325 - DNA, 20 bp, Artificial
  CRISPR gRNA sequence
ggttaagaaggccacagaga

SEQ ID NO: 378326 - DNA, 20 bp, Artificial
  CRISPR gRNA sequence
ctttcttattctcctgttat

SEQ ID NO: 378327 - DNA, 20 bp, Artificial
  CRISPR gRNA sequence
cattccaagtcaactgatta

SEQ ID NO: 378328 - DNA, 20 bp, Artificial
  CRISPR gRNA sequence
aatactaaatggtacctata

SEQ ID NO: 378329 - DNA, 20 bp, Artificial
  CRISPR gRNA sequence
gtacctataaggaatccaca

SEQ ID NO: 378330 - DNA, 20 bp, Artificial
  CRISPR gRNA sequence
ttatggtcactgcacttctc

SEQ ID NO: 378331 - DNA, 20 bp, Artificial
  CRISPR gRNA sequence
aagtaaatgggaaactgaaa

SEQ ID NO: 378332 - DNA, 20 bp, Artificial
  CRISPR gRNA sequence
acaagaacacatgtcactgt

SEQ ID NO: 378333 - DNA, 20 bp, Artificial
  CRISPR gRNA sequence
tactaaatttatatacacaa

SEQ ID NO: 378334 - DNA, 20 bp, Artificial
  CRISPR gRNA sequence
tacacaattgaattcaataa

SEQ ID NO: 378335 - DNA, 20 bp, Artificial
  CRISPR gRNA sequence
taatcgaatggctgatacag

SEQ ID NO: 378336 - DNA, 20 bp, Artificial
  CRISPR gRNA sequence
agtggaattcacgtacaggc

SEQ ID NO: 378337 - DNA, 20 bp, Artificial
  CRISPR gRNA sequence
gtacaggcacgggtacaggc

SEQ ID NO: 378338 - DNA, 20 bp, Artificial
  CRISPR gRNA sequence
gggtacaggcttggattttt

SEQ ID NO: 378339 - DNA, 20 bp, Artificial
  CRISPR gRNA sequence
ttgtccgtctgtctcgatgc

SEQ ID NO: 378340 - DNA, 20 bp, Artificial
  CRISPR gRNA sequence
cagtcaggcgagccagagca

SEQ ID NO: 378341 - DNA, 20 bp, Artificial
  CRISPR gRNA sequence
aggcgagccagagcagggag

SEQ ID NO: 378342 - DNA, 20 bp, Artificial
  CRISPR gRNA sequence
ttatattttcaagatgattg

SEQ ID NO: 378343 - DNA, 20 bp, Artificial
  CRISPR gRNA sequence
tttcaagatgattgtagagt

SEQ ID NO: 378344 - DNA, 20 bp, Artificial
  CRISPR gRNA sequence
tagagtaggggtatgcttgg

SEQ ID NO: 378345 - DNA, 20 bp, Artificial
  CRISPR gRNA sequence
tatgcttggctgaattgata

SEQ ID NO: 378346 - DNA, 20 bp, Artificial
  CRISPR gRNA sequence
ctgtgacctcagaacattct

SEQ ID NO: 378347 - DNA, 20 bp, Artificial
  CRISPR gRNA sequence
cggctgccaaccacaacatg

SEQ ID NO: 378348 - DNA, 20 bp, Artificial
  CRISPR gRNA sequence
tgaggaatacatttcctctt

SEQ ID NO: 378349 - DNA, 20 bp, Artificial
  CRISPR gRNA sequence
gaatacatttcctcttcaga

SEQ ID NO: 378350 - DNA, 20 bp, Artificial
  CRISPR gRNA sequence
agaatgggtgttggtggtgt

SEQ ID NO: 378351 - DNA, 20 bp, Artificial
  CRISPR gRNA sequence
tggggactgtggcctcacac

SEQ ID NO: 378352 - DNA, 20 bp, Artificial
  CRISPR gRNA sequence
tgctctgggaaacttcctta

SEQ ID NO: 378353 - DNA, 20 bp, Artificial
  CRISPR gRNA sequence
gaaacttccttataggatta

SEQ ID NO: 378354 - DNA, 20 bp, Artificial
  CRISPR gRNA sequence
tataggattagtgagtaggt

SEQ ID NO: 378355 - DNA, 20 bp, Artificial
  CRISPR gRNA sequence
gaccttcaaaaaggccttat

SEQ ID NO: 378356 - DNA, 20 bp, Artificial
  CRISPR gRNA sequence
gctcctctgtggctttatct

SEQ ID NO: 378357 - DNA, 20 bp, Artificial
  CRISPR gRNA sequence
tagggagaggaggttgcagg

SEQ ID NO: 378358 - DNA, 20 bp, Artificial
  CRISPR gRNA sequence
tttaagattttgaaactgtt

SEQ ID NO: 378359 - DNA, 20 bp, Artificial
  CRISPR gRNA sequence
gaccatcaagtcaatccttc

SEQ ID NO: 378360 - DNA, 20 bp, Artificial
  CRISPR gRNA sequence
agagaaagagccatgtttca

SEQ ID NO: 378361 - DNA, 20 bp, Artificial
  CRISPR gRNA sequence
actgatataagaagacttcc

SEQ ID NO: 378362 - DNA, 20 bp, Artificial
  CRISPR gRNA sequence
cagtggtgaccgtggccaaa

SEQ ID NO: 378363 - DNA, 20 bp, Artificial
  CRISPR gRNA sequence
tagctgcaccatttaatgag

SEQ ID NO: 378364 - DNA, 20 bp, Artificial
  CRISPR gRNA sequence
gctaccaacaccgatatttc

SEQ ID NO: 378365 - DNA, 20 bp, Artificial
  CRISPR gRNA sequence
tttccagaattgcttagtga

SEQ ID NO: 378366 - DNA, 20 bp, Artificial
  CRISPR gRNA sequence
gtgtgtatcctctgtgtgga

SEQ ID NO: 378367 - DNA, 20 bp, Artificial
  CRISPR gRNA sequence
tacctaattcatttcactaa

SEQ ID NO: 378368 - DNA, 20 bp, Artificial
  CRISPR gRNA sequence
ttgcaaactggaagctctag

SEQ ID NO: 378369 - DNA, 20 bp, Artificial
  CRISPR gRNA sequence
tttcatgtgagaaacagcca

SEQ ID NO: 378370 - DNA, 20 bp, Artificial
  CRISPR gRNA sequence
ttgctcatttaagtgaaata

SEQ ID NO: 378371 - DNA, 20 bp, Artificial
  CRISPR gRNA sequence
tctttgtgctgacacagtgt

SEQ ID NO: 378372 - DNA, 20 bp, Artificial
  CRISPR gRNA sequence
tctgttttcagtgaaaatag

SEQ ID NO: 378373 - DNA, 20 bp, Artificial
  CRISPR gRNA sequence
ctcaaatgacacagaggtaa

SEQ ID NO: 378374 - DNA, 20 bp, Artificial
  CRISPR gRNA sequence
aggtaattgaatctgcttta

SEQ ID NO: 378375 - DNA, 20 bp, Artificial
  CRISPR gRNA sequence
tgaatctgctttattggatg

SEQ ID NO: 378376 - DNA, 20 bp, Artificial
  CRISPR gRNA sequence
gtaaatcttacctaaatctg

SEQ ID NO: 378377 - DNA, 20 bp, Artificial
  CRISPR gRNA sequence
tgtttgctgtgaggaaaaga

SEQ ID NO: 378378 - DNA, 20 bp, Artificial
  CRISPR gRNA sequence
caagtgactgtaatgcaagg

SEQ ID NO: 378379 - DNA, 20 bp, Artificial
  CRISPR gRNA sequence
gtagcttaaagcaaggtttg

SEQ ID NO: 378380 - DNA, 20 bp, Artificial
  CRISPR gRNA sequence
cctggaaatataggtgtaat

SEQ ID NO: 378381 - DNA, 20 bp, Artificial
  CRISPR gRNA sequence
gaaatataggtgtaatttgg

SEQ ID NO: 378382 - DNA, 20 bp, Artificial
  CRISPR gRNA sequence
agaggcttaggggaaggtcg

SEQ ID NO: 378383 - DNA, 20 bp, Artificial
  CRISPR gRNA sequence
atgaccctaccaacagcacg

SEQ ID NO: 378384 - DNA, 20 bp, Artificial
  CRISPR gRNA sequence
tttaattctataaatgttta

SEQ ID NO: 378385 - DNA, 20 bp, Artificial
  CRISPR gRNA sequence
attgtttgtgtgcagaggac

SEQ ID NO: 378386 - DNA, 20 bp, Artificial
  CRISPR gRNA sequence
ggacgggaattggtggagct

SEQ ID NO: 378387 - DNA, 20 bp, Artificial
  CRISPR gRNA sequence
gggaattggtggagctagga

SEQ ID NO: 378388 - DNA, 20 bp, Artificial
  CRISPR gRNA sequence
atgtgtgtgcatgtgggaag

SEQ ID NO: 378389 - DNA, 20 bp, Artificial
  CRISPR gRNA sequence
gcatgtgggaaggagggttg

SEQ ID NO: 378390 - DNA, 20 bp, Artificial
  CRISPR gRNA sequence
gagggttgtggagtgaggga

SEQ ID NO: 378391 - DNA, 20 bp, Artificial
  CRISPR gRNA sequence
aagcgtggtcatgctgttag

SEQ ID NO: 378392 - DNA, 20 bp, Artificial
  CRISPR gRNA sequence
aaaatgaggctggtgtgctt

SEQ ID NO: 378393 - DNA, 20 bp, Artificial
  CRISPR gRNA sequence
gctggtgtgcttgggaattg

SEQ ID NO: 378394 - DNA, 20 bp, Artificial
  CRISPR gRNA sequence
gtgtgcttgggaattgcagg

SEQ ID NO: 378395 - DNA, 20 bp, Artificial
  CRISPR gRNA sequence
tgcaggatggatcataaagc

SEQ ID NO: 378396 - DNA, 20 bp, Artificial
  CRISPR gRNA sequence
ctgagtaaaagctaatttaa

SEQ ID NO: 378397 - DNA, 20 bp, Artificial
  CRISPR gRNA sequence
gtgccaggtggtgaacttgg

SEQ ID NO: 378398 - DNA, 20 bp, Artificial
  CRISPR gRNA sequence
caggtggtgaacttggaggg

SEQ ID NO: 378399 - DNA, 20 bp, Artificial
  CRISPR gRNA sequence
cattttctttgcagtgggct

SEQ ID NO: 378400 - DNA, 20 bp, Artificial
  CRISPR gRNA sequence
ttgactttagattttaggca

SEQ ID NO: 378401 - DNA, 20 bp, Artificial
  CRISPR gRNA sequence
agttagaaagagcactcaga

SEQ ID NO: 378402 - DNA, 20 bp, Artificial
  CRISPR gRNA sequence
aagagagattggaagtaaga

SEQ ID NO: 378403 - DNA, 20 bp, Artificial
  CRISPR gRNA sequence
atagaggaaagacaagtcag

SEQ ID NO: 378404 - DNA, 20 bp, Artificial
  CRISPR gRNA sequence
ttaagttaaaatgaggttat

SEQ ID NO: 378405 - DNA, 20 bp, Artificial
  CRISPR gRNA sequence
ttaaaatgaggttattaggg

SEQ ID NO: 378406 - DNA, 20 bp, Artificial
  CRISPR gRNA sequence
gaagaggagattaggacaca

SEQ ID NO: 378407 - DNA, 20 bp, Artificial
  CRISPR gRNA sequence
ccaaggagagaggcctcaaa

SEQ ID NO: 378408 - DNA, 20 bp, Artificial
  CRISPR gRNA sequence
ggaatcaaccctgctggcac

SEQ ID NO: 378409 - DNA, 20 bp, Artificial
  CRISPR gRNA sequence
accctgctggcacctgaatt

SEQ ID NO: 378410 - DNA, 20 bp, Artificial
  CRISPR gRNA sequence
aattttgggtttctagcctg

SEQ ID NO: 378411 - DNA, 20 bp, Artificial
  CRISPR gRNA sequence
caaactaatgcagaggtgat

SEQ ID NO: 378412 - DNA, 20 bp, Artificial
  CRISPR gRNA sequence
aagtcagacaagcgatgaaa

SEQ ID NO: 378413 - DNA, 20 bp, Artificial
  CRISPR gRNA sequence
taaactaaggcagcttaagt

SEQ ID NO: 378414 - DNA, 20 bp, Artificial
  CRISPR gRNA sequence
gcagatggggcatattcaag

SEQ ID NO: 378415 - DNA, 20 bp, Artificial
  CRISPR gRNA sequence
ctagtgtgttcttcattatt

SEQ ID NO: 378416 - DNA, 20 bp, Artificial
  CRISPR gRNA sequence
gcacacacctccatctttcc

SEQ ID NO: 378417 - DNA, 20 bp, Artificial
  CRISPR gRNA sequence
tattattatactttaagttt

SEQ ID NO: 378418 - DNA, 20 bp, Artificial
  CRISPR gRNA sequence
tcattgttcaattcccacct

SEQ ID NO: 378419 - DNA, 20 bp, Artificial
  CRISPR gRNA sequence
tgtctttgtgatagtttgct

SEQ ID NO: 378420 - DNA, 20 bp, Artificial
  CRISPR gRNA sequence
agtctatcgttgttggacat

SEQ ID NO: 378421 - DNA, 20 bp, Artificial
  CRISPR gRNA sequence
ggttccaagtctttgctact

SEQ ID NO: 378422 - DNA, 20 bp, Artificial
  CRISPR gRNA sequence
agtccttgataaagccttct

SEQ ID NO: 378423 - DNA, 20 bp, Artificial
  CRISPR gRNA sequence
gaagggacctttgttctcag

SEQ ID NO: 378424 - DNA, 20 bp, Artificial
  CRISPR gRNA sequence
gttctcagaggagtcgaaac

SEQ ID NO: 378425 - DNA, 20 bp, Artificial
  CRISPR gRNA sequence
ttatggagcacctgtactat

SEQ ID NO: 378426 - DNA, 20 bp, Artificial
  CRISPR gRNA sequence
atttgtgcttagaactactc

SEQ ID NO: 378427 - DNA, 20 bp, Artificial
  CRISPR gRNA sequence
tttctttcccttattcacct

SEQ ID NO: 378428 - DNA, 20 bp, Artificial
  CRISPR gRNA sequence
tcccttattcacctggggat

SEQ ID NO: 378429 - DNA, 20 bp, Artificial
  CRISPR gRNA sequence
ccaggtcattgttaccatga

SEQ ID NO: 378430 - DNA, 20 bp, Artificial
  CRISPR gRNA sequence
attctcacttcaggtaggtc

SEQ ID NO: 378431 - DNA, 20 bp, Artificial
  CRISPR gRNA sequence
gttgtatgaggttcaaaaat

SEQ ID NO: 378432 - DNA, 20 bp, Artificial
  CRISPR gRNA sequence
ctctagtttttcacttctac

SEQ ID NO: 378433 - DNA, 20 bp, Artificial
  CRISPR gRNA sequence
ctgctcccagtctttctcat

SEQ ID NO: 378434 - DNA, 20 bp, Artificial
  CRISPR gRNA sequence
cttttacctgaaagtctgat

SEQ ID NO: 378435 - DNA, 20 bp, Artificial
  CRISPR gRNA sequence
atgtagcccatcatcttccc

SEQ ID NO: 378436 - DNA, 20 bp, Artificial
  CRISPR gRNA sequence
ggactcttctccagtcccag

SEQ ID NO: 378437 - DNA, 20 bp, Artificial
  CRISPR gRNA sequence
cagagatggcatgcagcctg

SEQ ID NO: 378438 - DNA, 20 bp, Artificial
  CRISPR gRNA sequence
tgtggaatttccatatttct

SEQ ID NO: 378439 - DNA, 20 bp, Artificial
  CRISPR gRNA sequence
tgttgcgtgtgaaatagaaa

SEQ ID NO: 378440 - DNA, 20 bp, Artificial
  CRISPR gRNA sequence
gtgaaatagaaaagggattc

SEQ ID NO: 378441 - DNA, 20 bp, Artificial
  CRISPR gRNA sequence
gagtggcaccaggttttact

SEQ ID NO: 378442 - DNA, 20 bp, Artificial
  CRISPR gRNA sequence
accaggttttacttgggatc

SEQ ID NO: 378443 - DNA, 20 bp, Artificial
  CRISPR gRNA sequence
ctgtcattgactgcatcagg

SEQ ID NO: 378444 - DNA, 20 bp, Artificial
  CRISPR gRNA sequence
gagaatgagatgagaagctc

SEQ ID NO: 378445 - DNA, 20 bp, Artificial
  CRISPR gRNA sequence
tgagatgagaagctccggag

SEQ ID NO: 378446 - DNA, 20 bp, Artificial
  CRISPR gRNA sequence
tgagaagctccggagtgggg

SEQ ID NO: 378447 - DNA, 20 bp, Artificial
  CRISPR gRNA sequence
tgaagctctctagcaggcag

SEQ ID NO: 378448 - DNA, 20 bp, Artificial
  CRISPR gRNA sequence
atcagaacccaagagagaac

SEQ ID NO: 378449 - DNA, 20 bp, Artificial
  CRISPR gRNA sequence
gatgcaaatgtggtaaagtc

SEQ ID NO: 378450 - DNA, 20 bp, Artificial
  CRISPR gRNA sequence
tgtggtaaagtcatgggtgt

SEQ ID NO: 378451 - DNA, 20 bp, Artificial
  CRISPR gRNA sequence
ttccttcacattcataaccg

SEQ ID NO: 378452 - DNA, 20 bp, Artificial
  CRISPR gRNA sequence
aaaagcaaaatttaaaaagt

SEQ ID NO: 378453 - DNA, 20 bp, Artificial
  CRISPR gRNA sequence
agaaaaaggacctagcacat

SEQ ID NO: 378454 - DNA, 20 bp, Artificial
  CRISPR gRNA sequence
catgaagaaatcaagatgga

SEQ ID NO: 378455 - DNA, 20 bp, Artificial
  CRISPR gRNA sequence
ggaagggatgttactagatc

SEQ ID NO: 378456 - DNA, 20 bp, Artificial
  CRISPR gRNA sequence
agaaacactcatatgcacat

SEQ ID NO: 378457 - DNA, 20 bp, Artificial
  CRISPR gRNA sequence
gcttggcagcattttctagg

SEQ ID NO: 378458 - DNA, 20 bp, Artificial
  CRISPR gRNA sequence
tttttgtaaataatatattc

SEQ ID NO: 378459 - DNA, 20 bp, Artificial
  CRISPR gRNA sequence
atgatcttcctggaccctct

SEQ ID NO: 378460 - DNA, 20 bp, Artificial
  CRISPR gRNA sequence
cctaggcatcctctgcattt

SEQ ID NO: 378461 - DNA, 20 bp, Artificial
  CRISPR gRNA sequence
ttcactctgtgtactacaga

SEQ ID NO: 378462 - DNA, 20 bp, Artificial
  CRISPR gRNA sequence
gctccaaaatccaaaactct

SEQ ID NO: 378463 - DNA, 20 bp, Artificial
  CRISPR gRNA sequence
gcattttagatttcagattt

SEQ ID NO: 378464 - DNA, 20 bp, Artificial
  CRISPR gRNA sequence
agatttcagatttttggatt

SEQ ID NO: 378465 - DNA, 20 bp, Artificial
  CRISPR gRNA sequence
gtaaatattccaaaatccaa

SEQ ID NO: 378466 - DNA, 20 bp, Artificial
  CRISPR gRNA sequence
cacttatgttcccaagtatt

SEQ ID NO: 378467 - DNA, 20 bp, Artificial
  CRISPR gRNA sequence
gttcccaagtattttggata

SEQ ID NO: 378468 - DNA, 20 bp, Artificial
  CRISPR gRNA sequence
cattgtcccacccctaaaac

SEQ ID NO: 378469 - DNA, 20 bp, Artificial
  CRISPR gRNA sequence
tccatgtttcctgcattccc

SEQ ID NO: 378470 - DNA, 20 bp, Artificial
  CRISPR gRNA sequence
ctccctcaccgcctcctgtc

SEQ ID NO: 378471 - DNA, 20 bp, Artificial
  CRISPR gRNA sequence
catgctcaataaaacagcaa

SEQ ID NO: 378472 - DNA, 20 bp, Artificial
  CRISPR gRNA sequence
caataaaacagcaaaagagt

SEQ ID NO: 378473 - DNA, 20 bp, Artificial
  CRISPR gRNA sequence
aagagttggggtgaagtagg

SEQ ID NO: 378474 - DNA, 20 bp, Artificial
  CRISPR gRNA sequence
gatctgtacataggaaacgt

SEQ ID NO: 378475 - DNA, 20 bp, Artificial
  CRISPR gRNA sequence
gaattccatatgtaattaag

SEQ ID NO: 378476 - DNA, 20 bp, Artificial
  CRISPR gRNA sequence
gtagaatagaacagctgcct

SEQ ID NO: 378477 - DNA, 20 bp, Artificial
  CRISPR gRNA sequence
acagctgcctatgagtactt

SEQ ID NO: 378478 - DNA, 20 bp, Artificial
  CRISPR gRNA sequence
agtaagtgaaaagtattccc

SEQ ID NO: 378479 - DNA, 20 bp, Artificial
  CRISPR gRNA sequence
aaacatggtttgaagtgtat

SEQ ID NO: 378480 - DNA, 20 bp, Artificial
  CRISPR gRNA sequence
ggtttgaagtgtatttggat

SEQ ID NO: 378481 - DNA, 20 bp, Artificial
  CRISPR gRNA sequence
tagtttgttattttaccact

SEQ ID NO: 378482 - DNA, 20 bp, Artificial
  CRISPR gRNA sequence
gtcatttgcaagtttttgat

SEQ ID NO: 378483 - DNA, 20 bp, Artificial
  CRISPR gRNA sequence
agcaacctaagtgtctacgg

SEQ ID NO: 378484 - DNA, 20 bp, Artificial
  CRISPR gRNA sequence
aggaataaatggacaaaatg

SEQ ID NO: 378485 - DNA, 20 bp, Artificial
  CRISPR gRNA sequence
tataaaatgtatgtaacatg

SEQ ID NO: 378486 - DNA, 20 bp, Artificial
  CRISPR gRNA sequence
aacatgtagaatatatacaa

SEQ ID NO: 378487 - DNA, 20 bp, Artificial
  CRISPR gRNA sequence
atttgaacacatgctgcaac

SEQ ID NO: 378488 - DNA, 20 bp, Artificial
  CRISPR gRNA sequence
cacttatatgaggtacacag

SEQ ID NO: 378489 - DNA, 20 bp, Artificial
  CRISPR gRNA sequence
aaattcattgattcagaaag

SEQ ID NO: 378490 - DNA, 20 bp, Artificial
  CRISPR gRNA sequence
aaagtggaatggtagttgtc

SEQ ID NO: 378491 - DNA, 20 bp, Artificial
  CRISPR gRNA sequence
aatggtagttgtcgggggtg

SEQ ID NO: 378492 - DNA, 20 bp, Artificial
  CRISPR gRNA sequence
gggtgggggatgggagaaca

SEQ ID NO: 378493 - DNA, 20 bp, Artificial
  CRISPR gRNA sequence
ggagaacagggagttgttta

SEQ ID NO: 378494 - DNA, 20 bp, Artificial
  CRISPR gRNA sequence
acagggagttgtttaatggg

SEQ ID NO: 378495 - DNA, 20 bp, Artificial
  CRISPR gRNA sequence
tttcgattctgtgagataaa

SEQ ID NO: 378496 - DNA, 20 bp, Artificial
  CRISPR gRNA sequence
gataaaaagagttctgaaaa

SEQ ID NO: 378497 - DNA, 20 bp, Artificial
  CRISPR gRNA sequence
aaaattgggtatacaacaat

SEQ ID NO: 378498 - DNA, 20 bp, Artificial
  CRISPR gRNA sequence
gctataacaaagtaccttag

SEQ ID NO: 378499 - DNA, 20 bp, Artificial
  CRISPR gRNA sequence
gatgggtaatttataaataa

SEQ ID NO: 378500 - DNA, 20 bp, Artificial
  CRISPR gRNA sequence
agcaaatttactgtctagtg

SEQ ID NO: 378501 - DNA, 20 bp, Artificial
  CRISPR gRNA sequence
actaatcacattcatgaaag

SEQ ID NO: 378502 - DNA, 20 bp, Artificial
  CRISPR gRNA sequence
tctcttaataccaccacaat

SEQ ID NO: 378503 - DNA, 20 bp, Artificial
  CRISPR gRNA sequence
aatggggattaggtttcaat

SEQ ID NO: 378504 - DNA, 20 bp, Artificial
  CRISPR gRNA sequence
catagcagtgagcttagttc

SEQ ID NO: 378505 - DNA, 20 bp, Artificial
  CRISPR gRNA sequence
tttattacacgaaaacaaaa

SEQ ID NO: 378506 - DNA, 20 bp, Artificial
  CRISPR gRNA sequence
ggatttgttgacacagagct

SEQ ID NO: 378507 - DNA, 20 bp, Artificial
  CRISPR gRNA sequence
cccagcacatgatggttcca

SEQ ID NO: 378508 - DNA, 20 bp, Artificial
  CRISPR gRNA sequence
ttccctttccatgttccctg

SEQ ID NO: 378509 - DNA, 20 bp, Artificial
  CRISPR gRNA sequence
ctgaagaattagatatcttg

SEQ ID NO: 378510 - DNA, 20 bp, Artificial
  CRISPR gRNA sequence
ccatcaggaactggaaatat

SEQ ID NO: 378511 - DNA, 20 bp, Artificial
  CRISPR gRNA sequence
caggaactggaaatattagg

SEQ ID NO: 378512 - DNA, 20 bp, Artificial
  CRISPR gRNA sequence
gtatgaaataacgctctcat

SEQ ID NO: 378513 - DNA, 20 bp, Artificial
  CRISPR gRNA sequence
aatgccataaaggggactct

SEQ ID NO: 378514 - DNA, 20 bp, Artificial
  CRISPR gRNA sequence
gtcattcctcattgttcaag

SEQ ID NO: 378515 - DNA, 20 bp, Artificial
  CRISPR gRNA sequence
catctgacaactaaagaagt

SEQ ID NO: 378516 - DNA, 20 bp, Artificial
  CRISPR gRNA sequence
ggagttagccaaagaaaggg

SEQ ID NO: 378517 - DNA, 20 bp, Artificial
  CRISPR gRNA sequence
gggcagggtgtccttgcagt

SEQ ID NO: 378518 - DNA, 20 bp, Artificial
  CRISPR gRNA sequence
atacaaagcgggagatgtaa

SEQ ID NO: 378519 - DNA, 20 bp, Artificial
  CRISPR gRNA sequence
tgaaacataatgtatgaggt

SEQ ID NO: 378520 - DNA, 20 bp, Artificial
  CRISPR gRNA sequence
cataatgtatgaggtgggaa

SEQ ID NO: 378521 - DNA, 20 bp, Artificial
  CRISPR gRNA sequence
aggtaggcaaagacctgatg

SEQ ID NO: 378522 - DNA, 20 bp, Artificial
  CRISPR gRNA sequence
ttgttattgttgttttgaga

SEQ ID NO: 378523 - DNA, 20 bp, Artificial
  CRISPR gRNA sequence
tctcactctgtcgcccagtc

SEQ ID NO: 378524 - DNA, 20 bp, Artificial
  CRISPR gRNA sequence
cacactgcgacctccacatc

SEQ ID NO: 378525 - DNA, 20 bp, Artificial
  CRISPR gRNA sequence
gattctccttcctcagcctc

SEQ ID NO: 378526 - DNA, 20 bp, Artificial
  CRISPR gRNA sequence
tcctcagcctcccgagtagc

SEQ ID NO: 378527 - DNA, 20 bp, Artificial
  CRISPR gRNA sequence
ttttgtatatttggtagaga

SEQ ID NO: 378528 - DNA, 20 bp, Artificial
  CRISPR gRNA sequence
gcctcggcctcccaaagtgc

SEQ ID NO: 378529 - DNA, 20 bp, Artificial
  CRISPR gRNA sequence
caaagtgctgggattacagg

SEQ ID NO: 378530 - DNA, 20 bp, Artificial
  CRISPR gRNA sequence
atactcaccataaggggact

SEQ ID NO: 378531 - DNA, 20 bp, Artificial
  CRISPR gRNA sequence
aggggactgagagtttattg

SEQ ID NO: 378532 - DNA, 20 bp, Artificial
  CRISPR gRNA sequence
cgttcatatgggagcgagac

SEQ ID NO: 378533 - DNA, 20 bp, Artificial
  CRISPR gRNA sequence
gtctattttagtaatatagt

SEQ ID NO: 378534 - DNA, 20 bp, Artificial
  CRISPR gRNA sequence
gtaatatagtagggatggag

SEQ ID NO: 378535 - DNA, 20 bp, Artificial
  CRISPR gRNA sequence
agaatagggcaatttgtata

SEQ ID NO: 378536 - DNA, 20 bp, Artificial
  CRISPR gRNA sequence
ggcaatttgtatagagagtg

SEQ ID NO: 378537 - DNA, 20 bp, Artificial
  CRISPR gRNA sequence
tttgagagatgtttaaaagg

SEQ ID NO: 378538 - DNA, 20 bp, Artificial
  CRISPR gRNA sequence
tgtttaaaaggtagagttga

SEQ ID NO: 378539 - DNA, 20 bp, Artificial
  CRISPR gRNA sequence
tgacgggatccagcaactga

SEQ ID NO: 378540 - DNA, 20 bp, Artificial
  CRISPR gRNA sequence
gggatccagcaactgattgg

SEQ ID NO: 378541 - DNA, 20 bp, Artificial
  CRISPR gRNA sequence
gaaagggaagaggtgttaag

SEQ ID NO: 378542 - DNA, 20 bp, Artificial
  CRISPR gRNA sequence
cccagtttctgaacagtggg

SEQ ID NO: 378543 - DNA, 20 bp, Artificial
  CRISPR gRNA sequence
aaaggagccagtttggagag

SEQ ID NO: 378544 - DNA, 20 bp, Artificial
  CRISPR gRNA sequence
tggagaggggaatatggttt

SEQ ID NO: 378545 - DNA, 20 bp, Artificial
  CRISPR gRNA sequence
aatatggttttggaatatct

SEQ ID NO: 378546 - DNA, 20 bp, Artificial
  CRISPR gRNA sequence
aaaagagcttgaaaatctaa

SEQ ID NO: 378547 - DNA, 20 bp, Artificial
  CRISPR gRNA sequence
tacccaggaaattctagcag

SEQ ID NO: 378548 - DNA, 20 bp, Artificial
  CRISPR gRNA sequence
ctttaatttcatgacctacc

SEQ ID NO: 378549 - DNA, 20 bp, Artificial
  CRISPR gRNA sequence
acctacctagagttcccctt

SEQ ID NO: 378550 - DNA, 20 bp, Artificial
  CRISPR gRNA sequence
tgtagcacctgcaaagcaag

SEQ ID NO: 378551 - DNA, 20 bp, Artificial
  CRISPR gRNA sequence
cctgcaaagcaagctgagtg

SEQ ID NO: 378552 - DNA, 20 bp, Artificial
  CRISPR gRNA sequence
gagaacgttttgttcagttc

SEQ ID NO: 378553 - DNA, 20 bp, Artificial
  CRISPR gRNA sequence
tctgttctaatggaaaattc

SEQ ID NO: 378554 - DNA, 20 bp, Artificial
  CRISPR gRNA sequence
actttttccaaaaagatgaa

SEQ ID NO: 378555 - DNA, 20 bp, Artificial
  CRISPR gRNA sequence
aaacttctcagcatttactt

SEQ ID NO: 378556 - DNA, 20 bp, Artificial
  CRISPR gRNA sequence
gctttgcagttctccccagt

SEQ ID NO: 378557 - DNA, 20 bp, Artificial
  CRISPR gRNA sequence
actttgtcagttcagccata

SEQ ID NO: 378558 - DNA, 20 bp, Artificial
  CRISPR gRNA sequence
ttttttttttttgtaagtct

SEQ ID NO: 378559 - DNA, 20 bp, Artificial
  CRISPR gRNA sequence
tgtaagtctaggggtttctt

SEQ ID NO: 378560 - DNA, 20 bp, Artificial
  CRISPR gRNA sequence
tatacttttacttttttaac

SEQ ID NO: 378561 - DNA, 20 bp, Artificial
  CRISPR gRNA sequence
tttgactttgcctttctagt

SEQ ID NO: 378562 - DNA, 20 bp, Artificial
  CRISPR gRNA sequence
gtctgtagctttttcagagg

SEQ ID NO: 378563 - DNA, 20 bp, Artificial
  CRISPR gRNA sequence
ttggcagttgctatttagat

SEQ ID NO: 378564 - DNA, 20 bp, Artificial
  CRISPR gRNA sequence
ttttttttttttttttgaga

SEQ ID NO: 378565 - DNA, 20 bp, Artificial
  CRISPR gRNA sequence
tctcgctctgtcgcccaggc

SEQ ID NO: 378566 - DNA, 20 bp, Artificial
  CRISPR gRNA sequence
ctcactgcaagctccgcctc

SEQ ID NO: 378567 - DNA, 20 bp, Artificial
  CRISPR gRNA sequence
ttttgtatttttagtagaga

SEQ ID NO: 378568 - DNA, 20 bp, Artificial
  CRISPR gRNA sequence
ggggtttcaccgtttttagc

SEQ ID NO: 378569 - DNA, 20 bp, Artificial
  CRISPR gRNA sequence
gcctcggcctcccaaagtgc

SEQ ID NO: 378570 - DNA, 20 bp, Artificial
  CRISPR gRNA sequence
tcttaatttttttaggcctc

SEQ ID NO: 378571 - DNA, 20 bp, Artificial
  CRISPR gRNA sequence
ggatttctggagataaagtt

SEQ ID NO: 378572 - DNA, 20 bp, Artificial
  CRISPR gRNA sequence
tttaaaaaggccagagctga

SEQ ID NO: 378573 - DNA, 20 bp, Artificial
  CRISPR gRNA sequence
cagagctgatggggtaaggc

SEQ ID NO: 378574 - DNA, 20 bp, Artificial
  CRISPR gRNA sequence
agttggttttgaggaggggg

SEQ ID NO: 378575 - DNA, 20 bp, Artificial
  CRISPR gRNA sequence
cttctttgacttttttgaga

SEQ ID NO: 378576 - DNA, 20 bp, Artificial
  CRISPR gRNA sequence
agtctcactgttgcccaggc

SEQ ID NO: 378577 - DNA, 20 bp, Artificial
  CRISPR gRNA sequence
tggagtgtagtggcgcaatc

SEQ ID NO: 378578 - DNA, 20 bp, Artificial
  CRISPR gRNA sequence
atcactgcaacctctgcctc

SEQ ID NO: 378579 - DNA, 20 bp, Artificial
  CRISPR gRNA sequence
cattctcctgcctcagcctc

SEQ ID NO: 378580 - DNA, 20 bp, Artificial
  CRISPR gRNA sequence
gcctcagcctcctgagtagc

SEQ ID NO: 378581 - DNA, 20 bp, Artificial
  CRISPR gRNA sequence
tttgtaattttagtagagat

SEQ ID NO: 378582 - DNA, 20 bp, Artificial
  CRISPR gRNA sequence
ccttggcctcccaaagtgct

SEQ ID NO: 378583 - DNA, 20 bp, Artificial
  CRISPR gRNA sequence
tcactacttgaaagctgtat

SEQ ID NO: 378584 - DNA, 20 bp, Artificial
  CRISPR gRNA sequence
acttgaaagctgtatgaggg

SEQ ID NO: 378585 - DNA, 20 bp, Artificial
  CRISPR gRNA sequence
aaagctgtatgagggtggaa

SEQ ID NO: 378586 - DNA, 20 bp, Artificial
  CRISPR gRNA sequence
ctgcgaagggccccattccc

SEQ ID NO: 378587 - DNA, 20 bp, Artificial
  CRISPR gRNA sequence
tagataagatttgtggagag

SEQ ID NO: 378588 - DNA, 20 bp, Artificial
  CRISPR gRNA sequence
gtggctcacacctgtaatca

SEQ ID NO: 378589 - DNA, 20 bp, Artificial
  CRISPR gRNA sequence
attttgggaaaccgaggcag

SEQ ID NO: 378590 - DNA, 20 bp, Artificial
  CRISPR gRNA sequence
caggaggattgcttgagcct

SEQ ID NO: 378591 - DNA, 20 bp, Artificial
  CRISPR gRNA sequence
cctaggagtttgaaaccagc

SEQ ID NO: 378592 - DNA, 20 bp, Artificial
  CRISPR gRNA sequence
tcgcaccactggactccagg

SEQ ID NO: 378593 - DNA, 20 bp, Artificial
  CRISPR gRNA sequence
ctggactccaggctgggtgc

SEQ ID NO: 378594 - DNA, 20 bp, Artificial
  CRISPR gRNA sequence
atgaaatcatttgccattcc

SEQ ID NO: 378595 - DNA, 20 bp, Artificial
  CRISPR gRNA sequence
tgtaactagtcctttatcat

SEQ ID NO: 378596 - DNA, 20 bp, Artificial
  CRISPR gRNA sequence
attcttggtacttcctcaag

SEQ ID NO: 378597 - DNA, 20 bp, Artificial
  CRISPR gRNA sequence
gtcagtagagcagtaagact

SEQ ID NO: 378598 - DNA, 20 bp, Artificial
  CRISPR gRNA sequence
gagcagtaagactaagaata

SEQ ID NO: 378599 - DNA, 20 bp, Artificial
  CRISPR gRNA sequence
gcaaattatgccaaagagca

SEQ ID NO: 378600 - DNA, 20 bp, Artificial
  CRISPR gRNA sequence
aaagagcattggataaaact

SEQ ID NO: 378601 - DNA, 20 bp, Artificial
  CRISPR gRNA sequence
gccaatccacgaagggcctc

SEQ ID NO: 378602 - DNA, 20 bp, Artificial
  CRISPR gRNA sequence
cagccaccttattaaagaga

SEQ ID NO: 378603 - DNA, 20 bp, Artificial
  CRISPR gRNA sequence
tagcttctcacagagatggc

SEQ ID NO: 378604 - DNA, 20 bp, Artificial
  CRISPR gRNA sequence
agagatggccagagtgcaga

SEQ ID NO: 378605 - DNA, 20 bp, Artificial
  CRISPR gRNA sequence
tggccagagtgcagatagga

SEQ ID NO: 378606 - DNA, 20 bp, Artificial
  CRISPR gRNA sequence
atcccatgcgaggaggcctt

SEQ ID NO: 378607 - DNA, 20 bp, Artificial
  CRISPR gRNA sequence
cgaggaggccttcagggttt

SEQ ID NO: 378608 - DNA, 20 bp, Artificial
  CRISPR gRNA sequence
gaggtgaacacatgagggcc

SEQ ID NO: 378609 - DNA, 20 bp, Artificial
  CRISPR gRNA sequence
tagagagagattatacttgc

SEQ ID NO: 378610 - DNA, 20 bp, Artificial
  CRISPR gRNA sequence
tgatcagatttacatttggg

SEQ ID NO: 378611 - DNA, 20 bp, Artificial
  CRISPR gRNA sequence
ttgccctcccagaggaaaca

SEQ ID NO: 378612 - DNA, 20 bp, Artificial
  CRISPR gRNA sequence
aaaaagacaaatacacaggg

SEQ ID NO: 378613 - DNA, 20 bp, Artificial
  CRISPR gRNA sequence
cgagatgacttttttgtata

SEQ ID NO: 378614 - DNA, 20 bp, Artificial
  CRISPR gRNA sequence
cttttttgtataaaggattc

SEQ ID NO: 378615 - DNA, 20 bp, Artificial
  CRISPR gRNA sequence
agatgctattcatctactat

SEQ ID NO: 378616 - DNA, 20 bp, Artificial
  CRISPR gRNA sequence
tgttacaatatctttaaaat

SEQ ID NO: 378617 - DNA, 20 bp, Artificial
  CRISPR gRNA sequence
gcccaaataacaacatatag

SEQ ID NO: 378618 - DNA, 20 bp, Artificial
  CRISPR gRNA sequence
gcaaagttatttttcttttg

SEQ ID NO: 378619 - DNA, 20 bp, Artificial
  CRISPR gRNA sequence
aggagtaattgtaagtacta

SEQ ID NO: 378620 - DNA, 20 bp, Artificial
  CRISPR gRNA sequence
gggtataaagaaaaatacag

SEQ ID NO: 378621 - DNA, 20 bp, Artificial
  CRISPR gRNA sequence
ataaagaaaaatacagagga

SEQ ID NO: 378622 - DNA, 20 bp, Artificial
  CRISPR gRNA sequence
tcttatataaaaatgaagaa

SEQ ID NO: 378623 - DNA, 20 bp, Artificial
  CRISPR gRNA sequence
atggacatttcaaggcagta

SEQ ID NO: 378624 - DNA, 20 bp, Artificial
  CRISPR gRNA sequence
acatttcaaggcagtagggg

SEQ ID NO: 378625 - DNA, 20 bp, Artificial
  CRISPR gRNA sequence
agtttttcctgtttctattt

SEQ ID NO: 378626 - DNA, 20 bp, Artificial
  CRISPR gRNA sequence
tttgggtttgagcctgtgta

SEQ ID NO: 378627 - DNA, 20 bp, Artificial
  CRISPR gRNA sequence
gcaggcagatcccttgatcc

SEQ ID NO: 378628 - DNA, 20 bp, Artificial
  CRISPR gRNA sequence
caaaaaaatataaaaattag

SEQ ID NO: 378629 - DNA, 20 bp, Artificial
  CRISPR gRNA sequence
agctacttaggaggctgagg

SEQ ID NO: 378630 - DNA, 20 bp, Artificial
  CRISPR gRNA sequence
ctttggaaaaaaaaaaaaaa

SEQ ID NO: 378631 - DNA, 20 bp, Artificial
  CRISPR gRNA sequence
acaaaagtagatgaaagtaa

SEQ ID NO: 378632 - DNA, 20 bp, Artificial
  CRISPR gRNA sequence
ccttcagttctttcagaaag

SEQ ID NO: 378633 - DNA, 20 bp, Artificial
  CRISPR gRNA sequence
ttgatactagacattgtttg

SEQ ID NO: 378634 - DNA, 20 bp, Artificial
  CRISPR gRNA sequence
tgaagagttttgtctacttc

SEQ ID NO: 378635 - DNA, 20 bp, Artificial
  CRISPR gRNA sequence
aagctccctgacagcgtttc

SEQ ID NO: 378636 - DNA, 20 bp, Artificial
  CRISPR gRNA sequence
ttctggaatgtttaaattgc

SEQ ID NO: 378637 - DNA, 20 bp, Artificial
  CRISPR gRNA sequence
catgactcccctatttgcac

SEQ ID NO: 378638 - DNA, 20 bp, Artificial
  CRISPR gRNA sequence
caggggtgtctataagtgcc

SEQ ID NO: 378639 - DNA, 20 bp, Artificial
  CRISPR gRNA sequence
aattaatttattttttgaga

SEQ ID NO: 378640 - DNA, 20 bp, Artificial
  CRISPR gRNA sequence
tcccactctgtcaccaaagc

SEQ ID NO: 378641 - DNA, 20 bp, Artificial
  CRISPR gRNA sequence
gcctcagcctcccaagtagc

SEQ ID NO: 378642 - DNA, 20 bp, Artificial
  CRISPR gRNA sequence
ttttgtatttttagtagtga

SEQ ID NO: 378643 - DNA, 20 bp, Artificial
  CRISPR gRNA sequence
gcctcggcctcccaaagtgc

SEQ ID NO: 378644 - DNA, 20 bp, Artificial
  CRISPR gRNA sequence
ccttaccaaatatttttgaa

SEQ ID NO: 378645 - DNA, 20 bp, Artificial
  CRISPR gRNA sequence
taagctctttcagggacgtg

SEQ ID NO: 378646 - DNA, 20 bp, Artificial
  CRISPR gRNA sequence
aaatttaatctcatatggcc

SEQ ID NO: 378647 - DNA, 20 bp, Artificial
  CRISPR gRNA sequence
tctcatatggccttgggtag

SEQ ID NO: 378648 - DNA, 20 bp, Artificial
  CRISPR gRNA sequence
aaagctcttttgctcctctt

SEQ ID NO: 378649 - DNA, 20 bp, Artificial
  CRISPR gRNA sequence
ctcttttgctcctctttgga

SEQ ID NO: 378650 - DNA, 20 bp, Artificial
  CRISPR gRNA sequence
atctcaaagcataatcaaca

SEQ ID NO: 378651 - DNA, 20 bp, Artificial
  CRISPR gRNA sequence
gcataaagtgcatgtgttgg

SEQ ID NO: 378652 - DNA, 20 bp, Artificial
  CRISPR gRNA sequence
ggaaagatggtgctggggga

SEQ ID NO: 378653 - DNA, 20 bp, Artificial
  CRISPR gRNA sequence
ggggagggagtgtcctggtc

SEQ ID NO: 378654 - DNA, 20 bp, Artificial
  CRISPR gRNA sequence
tccagagttcagacgtgaga

SEQ ID NO: 378655 - DNA, 20 bp, Artificial
  CRISPR gRNA sequence
cgtgagatggagtgtatgtg

SEQ ID NO: 378656 - DNA, 20 bp, Artificial
  CRISPR gRNA sequence
ggagtgtatgtggtgagttg

SEQ ID NO: 378657 - DNA, 20 bp, Artificial
  CRISPR gRNA sequence
tgtggtgagttggaggatct

SEQ ID NO: 378658 - DNA, 20 bp, Artificial
  CRISPR gRNA sequence
agaatgagcccaggggcaag

SEQ ID NO: 378659 - DNA, 20 bp, Artificial
  CRISPR gRNA sequence
tgactacttctattaggcct

SEQ ID NO: 378660 - DNA, 20 bp, Artificial
  CRISPR gRNA sequence
tagaatatgtgctgagaagt

SEQ ID NO: 378661 - DNA, 20 bp, Artificial
  CRISPR gRNA sequence
aattttatcctggaggcttt

SEQ ID NO: 378662 - DNA, 20 bp, Artificial
  CRISPR gRNA sequence
ctggaggctttggggataca

SEQ ID NO: 378663 - DNA, 20 bp, Artificial
  CRISPR gRNA sequence
tgtactatgtaatgtatata

SEQ ID NO: 378664 - DNA, 20 bp, Artificial
  CRISPR gRNA sequence
tattaaggaggaggaagtga

SEQ ID NO: 378665 - DNA, 20 bp, Artificial
  CRISPR gRNA sequence
ggaggaggaagtgacaggat

SEQ ID NO: 378666 - DNA, 20 bp, Artificial
  CRISPR gRNA sequence
ggaagtgacaggatttgggt

SEQ ID NO: 378667 - DNA, 20 bp, Artificial
  CRISPR gRNA sequence
ttgggtgtgagtgaaatggg

SEQ ID NO: 378668 - DNA, 20 bp, Artificial
  CRISPR gRNA sequence
tgggagggatgcacaaagga

SEQ ID NO: 378669 - DNA, 20 bp, Artificial
  CRISPR gRNA sequence
accaagatagagattgtcag

SEQ ID NO: 378670 - DNA, 20 bp, Artificial
  CRISPR gRNA sequence
gataccatgtcacaaaggtt

SEQ ID NO: 378671 - DNA, 20 bp, Artificial
  CRISPR gRNA sequence
gcaaacttgatgagcatata

SEQ ID NO: 378672 - DNA, 20 bp, Artificial
  CRISPR gRNA sequence
gagcatataatgagtgccca

SEQ ID NO: 378673 - DNA, 20 bp, Artificial
  CRISPR gRNA sequence
gtgcccattgggtgctcata

SEQ ID NO: 378674 - DNA, 20 bp, Artificial
  CRISPR gRNA sequence
tgggtgctcatattgagtat

SEQ ID NO: 378675 - DNA, 20 bp, Artificial
  CRISPR gRNA sequence
cctagtaggttgatacccta

SEQ ID NO: 378676 - DNA, 20 bp, Artificial
  CRISPR gRNA sequence
tatactttttgtattacttt

SEQ ID NO: 378677 - DNA, 20 bp, Artificial
  CRISPR gRNA sequence
ttgttgagatgataaatgtt

SEQ ID NO: 378678 - DNA, 20 bp, Artificial
  CRISPR gRNA sequence
ttttgagtcatggctttccg

SEQ ID NO: 378679 - DNA, 20 bp, Artificial
  CRISPR gRNA sequence
tattttgggagaggaaatag

SEQ ID NO: 378680 - DNA, 20 bp, Artificial
  CRISPR gRNA sequence
tagatgtctaatttaaacct

SEQ ID NO: 378681 - DNA, 20 bp, Artificial
  CRISPR gRNA sequence
atttttgctgtaaaatgcaa

SEQ ID NO: 378682 - DNA, 20 bp, Artificial
  CRISPR gRNA sequence
aactgcaataaacctcacat

SEQ ID NO: 378683 - DNA, 20 bp, Artificial
  CRISPR gRNA sequence
aaaatgtaattccaagacag

SEQ ID NO: 378684 - DNA, 20 bp, Artificial
  CRISPR gRNA sequence
ggcaattgtagaggaaaatt

SEQ ID NO: 378685 - DNA, 20 bp, Artificial
  CRISPR gRNA sequence
agtcatccctaacttagaaa

SEQ ID NO: 378686 - DNA, 20 bp, Artificial
  CRISPR gRNA sequence
agtgagataaaagagccaag

SEQ ID NO: 378687 - DNA, 20 bp, Artificial
  CRISPR gRNA sequence
gaactaactgtaatctggaa

SEQ ID NO: 378688 - DNA, 20 bp, Artificial
  CRISPR gRNA sequence
aattttaatggggctgttag

SEQ ID NO: 378689 - DNA, 20 bp, Artificial
  CRISPR gRNA sequence
tttggttagttatattaaca

SEQ ID NO: 378690 - DNA, 20 bp, Artificial
  CRISPR gRNA sequence
tccaggtgctattgtgtgag

SEQ ID NO: 378691 - DNA, 20 bp, Artificial
  CRISPR gRNA sequence
gaaatgtgttcacctccatt

SEQ ID NO: 378692 - DNA, 20 bp, Artificial
  CRISPR gRNA sequence
gactagaagatgtgattacc

SEQ ID NO: 378693 - DNA, 20 bp, Artificial
  CRISPR gRNA sequence
tccctcactttaaactgaac

SEQ ID NO: 378694 - DNA, 20 bp, Artificial
  CRISPR gRNA sequence
cactttaaactgaacaagag

SEQ ID NO: 378695 - DNA, 20 bp, Artificial
  CRISPR gRNA sequence
gagtagaatttctagaaaat

SEQ ID NO: 378696 - DNA, 20 bp, Artificial
  CRISPR gRNA sequence
gatagtaaaaaaatattttt

SEQ ID NO: 378697 - DNA, 20 bp, Artificial
  CRISPR gRNA sequence
ttgtgccaatttactttcag

SEQ ID NO: 378698 - DNA, 20 bp, Artificial
  CRISPR gRNA sequence
aatttccttgagatttggct

SEQ ID NO: 378699 - DNA, 20 bp, Artificial
  CRISPR gRNA sequence
atgaacatttctgttttatt

SEQ ID NO: 378700 - DNA, 20 bp, Artificial
  CRISPR gRNA sequence
ttctgttttattgggagtaa

SEQ ID NO: 378701 - DNA, 20 bp, Artificial
  CRISPR gRNA sequence
tgggagtaacagaatgacag

SEQ ID NO: 378702 - DNA, 20 bp, Artificial
  CRISPR gRNA sequence
aaactggcagaactatcaca

SEQ ID NO: 378703 - DNA, 20 bp, Artificial
  CRISPR gRNA sequence
ctcttggtccatgaactcaa

SEQ ID NO: 378704 - DNA, 20 bp, Artificial
  CRISPR gRNA sequence
attgatatatggtgttcact

SEQ ID NO: 378705 - DNA, 20 bp, Artificial
  CRISPR gRNA sequence
catcaaaaatgtcaaggtcg

SEQ ID NO: 378706 - DNA, 20 bp, Artificial
  CRISPR gRNA sequence
tgaaatattatatagaaagg

SEQ ID NO: 378707 - DNA, 20 bp, Artificial
  CRISPR gRNA sequence
agaaacctcattaagatcaa

SEQ ID NO: 378708 - DNA, 20 bp, Artificial
  CRISPR gRNA sequence
atagaatgatagagaagtcg

SEQ ID NO: 378709 - DNA, 20 bp, Artificial
  CRISPR gRNA sequence
ggacacttgagccctgcaaa

SEQ ID NO: 378710 - DNA, 20 bp, Artificial
  CRISPR gRNA sequence
tttacaaaggttgttactct

SEQ ID NO: 378711 - DNA, 20 bp, Artificial
  CRISPR gRNA sequence
aagagtatggcatacgttta

SEQ ID NO: 378712 - DNA, 20 bp, Artificial
  CRISPR gRNA sequence
aacatagattaataaaattc

SEQ ID NO: 378713 - DNA, 20 bp, Artificial
  CRISPR gRNA sequence
ccactgctattgggaaaggt

SEQ ID NO: 378714 - DNA, 20 bp, Artificial
  CRISPR gRNA sequence
ccatctggtgctggtgctag

SEQ ID NO: 378715 - DNA, 20 bp, Artificial
  CRISPR gRNA sequence
ttgtccctattcataataag

SEQ ID NO: 378716 - DNA, 20 bp, Artificial
  CRISPR gRNA sequence
gcagagtgtcatttagatct

SEQ ID NO: 378717 - DNA, 20 bp, Artificial
  CRISPR gRNA sequence
gagacaaactgtttgttgca

SEQ ID NO: 378718 - DNA, 20 bp, Artificial
  CRISPR gRNA sequence
cttctctttacttctctacc

SEQ ID NO: 378719 - DNA, 20 bp, Artificial
  CRISPR gRNA sequence
atacaataatccatacttca

SEQ ID NO: 378720 - DNA, 20 bp, Artificial
  CRISPR gRNA sequence
agtactgcatatgcaaagca

SEQ ID NO: 378721 - DNA, 20 bp, Artificial
  CRISPR gRNA sequence
tgttctagccctcagtagag

SEQ ID NO: 378722 - DNA, 20 bp, Artificial
  CRISPR gRNA sequence
attttatgtccaaaaattta

SEQ ID NO: 378723 - DNA, 20 bp, Artificial
  CRISPR gRNA sequence
actcaggaaggaaaagatat

SEQ ID NO: 378724 - DNA, 20 bp, Artificial
  CRISPR gRNA sequence
attgcagattttgatgtctc

SEQ ID NO: 378725 - DNA, 20 bp, Artificial
  CRISPR gRNA sequence
cccttgcccatgcctatgtc

SEQ ID NO: 378726 - DNA, 20 bp, Artificial
  CRISPR gRNA sequence
gtaatgcctaggttttcttc

SEQ ID NO: 378727 - DNA, 20 bp, Artificial
  CRISPR gRNA sequence
atttaagtctttaatccatc

SEQ ID NO: 378728 - DNA, 20 bp, Artificial
  CRISPR gRNA sequence
ttttgtataaggtgtaagga

SEQ ID NO: 378729 - DNA, 20 bp, Artificial
  CRISPR gRNA sequence
taaaaaaagaaagaaacatt

SEQ ID NO: 378730 - DNA, 20 bp, Artificial
  CRISPR gRNA sequence
attctattttattttgagaa

SEQ ID NO: 378731 - DNA, 20 bp, Artificial
  CRISPR gRNA sequence
gcagataagtgtggtgaaaa

SEQ ID NO: 378732 - DNA, 20 bp, Artificial
  CRISPR gRNA sequence
gtggtgaaaagagagttgct

SEQ ID NO: 378733 - DNA, 20 bp, Artificial
  CRISPR gRNA sequence
aaaagagagttgctttggat

SEQ ID NO: 378734 - DNA, 20 bp, Artificial
  CRISPR gRNA sequence
agttgctttggattagagtt

SEQ ID NO: 378735 - DNA, 20 bp, Artificial
  CRISPR gRNA sequence
ttgagaattctggcctcatt

SEQ ID NO: 378736 - DNA, 20 bp, Artificial
  CRISPR gRNA sequence
gaattctggcctcattttga

SEQ ID NO: 378737 - DNA, 20 bp, Artificial
  CRISPR gRNA sequence
ctggcctcattttgagtgaa

SEQ ID NO: 378738 - DNA, 20 bp, Artificial
  CRISPR gRNA sequence
gggtattattccaaacttat

SEQ ID NO: 378739 - DNA, 20 bp, Artificial
  CRISPR gRNA sequence
gtgttagcattcccgtgtgt

SEQ ID NO: 378740 - DNA, 20 bp, Artificial
  CRISPR gRNA sequence
tgtgagtattgccgacctgc

SEQ ID NO: 378741 - DNA, 20 bp, Artificial
  CRISPR gRNA sequence
agtattgccgacctgcgggg

SEQ ID NO: 378742 - DNA, 20 bp, Artificial
  CRISPR gRNA sequence
acctgcggggatgggtgaag

SEQ ID NO: 378743 - DNA, 20 bp, Artificial
  CRISPR gRNA sequence
ggtttgtagcaatatctgtt

SEQ ID NO: 378744 - DNA, 20 bp, Artificial
  CRISPR gRNA sequence
ttaatagctcaatattctag

SEQ ID NO: 378745 - DNA, 20 bp, Artificial
  CRISPR gRNA sequence
taaatgtcagcatttggaga

SEQ ID NO: 378746 - DNA, 20 bp, Artificial
  CRISPR gRNA sequence
ctgttccactgaagccttct

SEQ ID NO: 378747 - DNA, 20 bp, Artificial
  CRISPR gRNA sequence
ttctaataatctttaaattt

SEQ ID NO: 378748 - DNA, 20 bp, Artificial
  CRISPR gRNA sequence
aactcagctctagactttat

SEQ ID NO: 378749 - DNA, 20 bp, Artificial
  CRISPR gRNA sequence
gttttgtcctctttcctttc

SEQ ID NO: 378750 - DNA, 20 bp, Artificial
  CRISPR gRNA sequence
caccaggccaccacattgca

SEQ ID NO: 378751 - DNA, 20 bp, Artificial
  CRISPR gRNA sequence
tcacaaccctgtgaggcctg

SEQ ID NO: 378752 - DNA, 20 bp, Artificial
  CRISPR gRNA sequence
cctgcagagcatctcccaat

SEQ ID NO: 378753 - DNA, 20 bp, Artificial
  CRISPR gRNA sequence
gtttcactcatgattagact

SEQ ID NO: 378754 - DNA, 20 bp, Artificial
  CRISPR gRNA sequence
tcatgattagactgggaata

SEQ ID NO: 378755 - DNA, 20 bp, Artificial
  CRISPR gRNA sequence
tgggaatatggaattttgga

SEQ ID NO: 378756 - DNA, 20 bp, Artificial
  CRISPR gRNA sequence
tggaattttggaaagaatac

SEQ ID NO: 378757 - DNA, 20 bp, Artificial
  CRISPR gRNA sequence
cttctcatcacatcatatca

SEQ ID NO: 378758 - DNA, 20 bp, Artificial
  CRISPR gRNA sequence
aactactaacacagtgcacc

SEQ ID NO: 378759 - DNA, 20 bp, Artificial
  CRISPR gRNA sequence
ttcacatatgtaatgcttta

SEQ ID NO: 378760 - DNA, 20 bp, Artificial
  CRISPR gRNA sequence
tttacagaattattgttgcg

SEQ ID NO: 378761 - DNA, 20 bp, Artificial
  CRISPR gRNA sequence
taaagaacacaaattaaatg

SEQ ID NO: 378762 - DNA, 20 bp, Artificial
  CRISPR gRNA sequence
tttctgggctacttgctttt

SEQ ID NO: 378763 - DNA, 20 bp, Artificial
  CRISPR gRNA sequence
tttcagcctcttctacctca

SEQ ID NO: 378764 - DNA, 20 bp, Artificial
  CRISPR gRNA sequence
aaagcacctggagctctttg

SEQ ID NO: 378765 - DNA, 20 bp, Artificial
  CRISPR gRNA sequence
tgcagtgctggctgatgctc

SEQ ID NO: 378766 - DNA, 20 bp, Artificial
  CRISPR gRNA sequence
gtgctggctgatgctcaggg

SEQ ID NO: 378767 - DNA, 20 bp, Artificial
  CRISPR gRNA sequence
ccaggagggaaagctgctgt

SEQ ID NO: 378768 - DNA, 20 bp, Artificial
  CRISPR gRNA sequence
ggtttccatttggcagaagt

SEQ ID NO: 378769 - DNA, 20 bp, Artificial
  CRISPR gRNA sequence
ctggactggaaaatattgct

SEQ ID NO: 378770 - DNA, 20 bp, Artificial
  CRISPR gRNA sequence
ctgaaggtacaatgtcttta

SEQ ID NO: 378771 - DNA, 20 bp, Artificial
  CRISPR gRNA sequence
aggtacaatgtctttaagga

SEQ ID NO: 378772 - DNA, 20 bp, Artificial
  CRISPR gRNA sequence
ggtagaggtaaaacagagga

SEQ ID NO: 378773 - DNA, 20 bp, Artificial
  CRISPR gRNA sequence
agtggttagcctattttgaa

SEQ ID NO: 378774 - DNA, 20 bp, Artificial
  CRISPR gRNA sequence
ccttgaaataggtgatgtca

SEQ ID NO: 378775 - DNA, 20 bp, Artificial
  CRISPR gRNA sequence
tcacagaataagtgatatca

SEQ ID NO: 378776 - DNA, 20 bp, Artificial
  CRISPR gRNA sequence
tcacaggataagtggcatca

SEQ ID NO: 378777 - DNA, 20 bp, Artificial
  CRISPR gRNA sequence
cacaggataaggtggcatca

SEQ ID NO: 378778 - DNA, 20 bp, Artificial
  CRISPR gRNA sequence
gcatcacaggataaattttg

SEQ ID NO: 378779 - DNA, 20 bp, Artificial
  CRISPR gRNA sequence
aggataaatagcagtgttct

SEQ ID NO: 378780 - DNA, 20 bp, Artificial
  CRISPR gRNA sequence
gtgttcttggaatgaagtgg

SEQ ID NO: 378781 - DNA, 20 bp, Artificial
  CRISPR gRNA sequence
gctgatgcaagatcataaag

SEQ ID NO: 378782 - DNA, 20 bp, Artificial
  CRISPR gRNA sequence
aataatgttcttggggaaac

SEQ ID NO: 378783 - DNA, 20 bp, Artificial
  CRISPR gRNA sequence
ggcagattctagtaggagat

SEQ ID NO: 378784 - DNA, 20 bp, Artificial
  CRISPR gRNA sequence
atgagaatggagacaaaggc

SEQ ID NO: 378785 - DNA, 20 bp, Artificial
  CRISPR gRNA sequence
aaggcaagaataaaatcata

SEQ ID NO: 378786 - DNA, 20 bp, Artificial
  CRISPR gRNA sequence
catgtgctttgtcctgtagt

SEQ ID NO: 378787 - DNA, 20 bp, Artificial
  CRISPR gRNA sequence
tatatagtctttgatgcaat

SEQ ID NO: 378788 - DNA, 20 bp, Artificial
  CRISPR gRNA sequence
gagggaaaaggggctacaat

SEQ ID NO: 378789 - DNA, 20 bp, Artificial
  CRISPR gRNA sequence
aactcctacagatgtagtaa

SEQ ID NO: 378790 - DNA, 20 bp, Artificial
  CRISPR gRNA sequence
aggtttttcctgagattaga

SEQ ID NO: 378791 - DNA, 20 bp, Artificial
  CRISPR gRNA sequence
ggcaagcttttgaaacatgg

SEQ ID NO: 378792 - DNA, 20 bp, Artificial
  CRISPR gRNA sequence
aatgtggaaagagagagccg

SEQ ID NO: 378793 - DNA, 20 bp, Artificial
  CRISPR gRNA sequence
tcagtggctgagagattact

SEQ ID NO: 378794 - DNA, 20 bp, Artificial
  CRISPR gRNA sequence
taggtcaagctgggacttga

SEQ ID NO: 378795 - DNA, 20 bp, Artificial
  CRISPR gRNA sequence
gagagtgatagagccaaaca

SEQ ID NO: 378796 - DNA, 20 bp, Artificial
  CRISPR gRNA sequence
gccaaacagagagtcaaaga

SEQ ID NO: 378797 - DNA, 20 bp, Artificial
  CRISPR gRNA sequence
tttataattctataaattta

SEQ ID NO: 378798 - DNA, 20 bp, Artificial
  CRISPR gRNA sequence
tacttaactttttttgtggt

SEQ ID NO: 378799 - DNA, 20 bp, Artificial
  CRISPR gRNA sequence
gtgacggagctcaaaaaagg

SEQ ID NO: 378800 - DNA, 20 bp, Artificial
  CRISPR gRNA sequence
tgggcggaccacttgagatc

SEQ ID NO: 378801 - DNA, 20 bp, Artificial
  CRISPR gRNA sequence
tactcgggaggctgaggcag

SEQ ID NO: 378802 - DNA, 20 bp, Artificial
  CRISPR gRNA sequence
ttgcttgaacccaggaggtg

SEQ ID NO: 378803 - DNA, 20 bp, Artificial
  CRISPR gRNA sequence
ctgcactccagcctgggcaa

SEQ ID NO: 378804 - DNA, 20 bp, Artificial
  CRISPR gRNA sequence
aacaaacaaaaaagacattt

SEQ ID NO: 378805 - DNA, 20 bp, Artificial
  CRISPR gRNA sequence
ccagaagcagtccctgagaa

SEQ ID NO: 378806 - DNA, 20 bp, Artificial
  CRISPR gRNA sequence
gttcgcagggaaacccatca

SEQ ID NO: 378807 - DNA, 20 bp, Artificial
  CRISPR gRNA sequence
agggaaacccatcaggggat

SEQ ID NO: 378808 - DNA, 20 bp, Artificial
  CRISPR gRNA sequence
ggagagatccagcaagggca

SEQ ID NO: 378809 - DNA, 20 bp, Artificial
  CRISPR gRNA sequence
tcaggaaaagcaaactctac

SEQ ID NO: 378810 - DNA, 20 bp, Artificial
  CRISPR gRNA sequence
aactctaccagggtcagtca

SEQ ID NO: 378811 - DNA, 20 bp, Artificial
  CRISPR gRNA sequence
accagggtcagtcactggat

SEQ ID NO: 378812 - DNA, 20 bp, Artificial
  CRISPR gRNA sequence
ggagaagagagcacagaagc

SEQ ID NO: 378813 - DNA, 20 bp, Artificial
  CRISPR gRNA sequence
tgacagcatctgctcactgt

SEQ ID NO: 378814 - DNA, 20 bp, Artificial
  CRISPR gRNA sequence
cggctcctgctccattttta

SEQ ID NO: 378815 - DNA, 20 bp, Artificial
  CRISPR gRNA sequence
ttatggagttccctgcattg

SEQ ID NO: 378816 - DNA, 20 bp, Artificial
  CRISPR gRNA sequence
cattttcccttacaacgaac

SEQ ID NO: 378817 - DNA, 20 bp, Artificial
  CRISPR gRNA sequence
cattttcaggagagagccat

SEQ ID NO: 378818 - DNA, 20 bp, Artificial
  CRISPR gRNA sequence
ttcaggagagagccataagg

SEQ ID NO: 378819 - DNA, 20 bp, Artificial
  CRISPR gRNA sequence
aatttttagtttgcttttct

SEQ ID NO: 378820 - DNA, 20 bp, Artificial
  CRISPR gRNA sequence
aattttcagagcaattttaa

SEQ ID NO: 378821 - DNA, 20 bp, Artificial
  CRISPR gRNA sequence
cagagcaattttaattggat

SEQ ID NO: 378822 - DNA, 20 bp, Artificial
  CRISPR gRNA sequence
tgtgttttaaaacttagttt

SEQ ID NO: 378823 - DNA, 20 bp, Artificial
  CRISPR gRNA sequence
ctaggcgtatatagtatgtg

SEQ ID NO: 378824 - DNA, 20 bp, Artificial
  CRISPR gRNA sequence
gtatgtgtagagtacattgt

SEQ ID NO: 378825 - DNA, 20 bp, Artificial
  CRISPR gRNA sequence
aagaggaaggaaattgaacc

SEQ ID NO: 378826 - DNA, 20 bp, Artificial
  CRISPR gRNA sequence
gcaatcgaacagcttaagtt

SEQ ID NO: 378827 - DNA, 20 bp, Artificial
  CRISPR gRNA sequence
aatacccttgtgtttggtga

SEQ ID NO: 378828 - DNA, 20 bp, Artificial
  CRISPR gRNA sequence
aaactcacagctctgtctct

SEQ ID NO: 378829 - DNA, 20 bp, Artificial
  CRISPR gRNA sequence
atgccatcagggcctcagtg

SEQ ID NO: 378830 - DNA, 20 bp, Artificial
  CRISPR gRNA sequence
atttacacccagtaatcttt

SEQ ID NO: 378831 - DNA, 20 bp, Artificial
  CRISPR gRNA sequence
ccagtaatctttgtggatga

SEQ ID NO: 378832 - DNA, 20 bp, Artificial
  CRISPR gRNA sequence
taatctttgtggatgaagga

SEQ ID NO: 378833 - DNA, 20 bp, Artificial
  CRISPR gRNA sequence
tgtggatgaaggaatgaatg

SEQ ID NO: 378834 - DNA, 20 bp, Artificial
  CRISPR gRNA sequence
gatgaaggaatgaatgttga

SEQ ID NO: 378835 - DNA, 20 bp, Artificial
  CRISPR gRNA sequence
tttgcagtccatctttctgc

SEQ ID NO: 378836 - DNA, 20 bp, Artificial
  CRISPR gRNA sequence
ctaatgtgttggtgcctgcc

SEQ ID NO: 378837 - DNA, 20 bp, Artificial
  CRISPR gRNA sequence
agaaattgatttctaattat

SEQ ID NO: 378838 - DNA, 20 bp, Artificial
  CRISPR gRNA sequence
tctgagatcctgccctgctg

SEQ ID NO: 378839 - DNA, 20 bp, Artificial
  CRISPR gRNA sequence
aagaaaactctggctgtcac

SEQ ID NO: 378840 - DNA, 20 bp, Artificial
  CRISPR gRNA sequence
cctagacgccctgcctaggt

SEQ ID NO: 378841 - DNA, 20 bp, Artificial
  CRISPR gRNA sequence
gaatgtcctgccattcacag

SEQ ID NO: 378842 - DNA, 20 bp, Artificial
  CRISPR gRNA sequence
taacaatctattctctagta

SEQ ID NO: 378843 - DNA, 20 bp, Artificial
  CRISPR gRNA sequence
tttctggttgagagaaactg

SEQ ID NO: 378844 - DNA, 20 bp, Artificial
  CRISPR gRNA sequence
ctcagcagttgctttgactc

SEQ ID NO: 378845 - DNA, 20 bp, Artificial
  CRISPR gRNA sequence
tgctttgactcctgggtaat

SEQ ID NO: 378846 - DNA, 20 bp, Artificial
  CRISPR gRNA sequence
gctgttcagtgcttagacag

SEQ ID NO: 378847 - DNA, 20 bp, Artificial
  CRISPR gRNA sequence
actgcaaatcatctcttaat

SEQ ID NO: 378848 - DNA, 20 bp, Artificial
  CRISPR gRNA sequence
cttaatatggattttctggg

SEQ ID NO: 378849 - DNA, 20 bp, Artificial
  CRISPR gRNA sequence
tgccatgcaggacacgcagc

SEQ ID NO: 378850 - DNA, 20 bp, Artificial
  CRISPR gRNA sequence
tttccttcatgatggctttg

SEQ ID NO: 378851 - DNA, 20 bp, Artificial
  CRISPR gRNA sequence
aagacggccgattttctcag

SEQ ID NO: 378852 - DNA, 20 bp, Artificial
  CRISPR gRNA sequence
ggatggacttgctgcttctg

SEQ ID NO: 378853 - DNA, 20 bp, Artificial
  CRISPR gRNA sequence
ctggcacatgataccaaaag

SEQ ID NO: 378854 - DNA, 20 bp, Artificial
  CRISPR gRNA sequence
gtccaaagtgaaggtatcag

SEQ ID NO: 378855 - DNA, 20 bp, Artificial
  CRISPR gRNA sequence
cagcagggttggttccctct

SEQ ID NO: 378856 - DNA, 20 bp, Artificial
  CRISPR gRNA sequence
gcttgtattcatgcctgtgt

SEQ ID NO: 378857 - DNA, 20 bp, Artificial
  CRISPR gRNA sequence
tttataaggacacggtcata

SEQ ID NO: 378858 - DNA, 20 bp, Artificial
  CRISPR gRNA sequence
gattaggggccaccctattc

SEQ ID NO: 378859 - DNA, 20 bp, Artificial
  CRISPR gRNA sequence
ggaggctaggacttcaccat

SEQ ID NO: 378860 - DNA, 20 bp, Artificial
  CRISPR gRNA sequence
cattgctgtctatgtttgaa

SEQ ID NO: 378861 - DNA, 20 bp, Artificial
  CRISPR gRNA sequence
gtttgaaatgaatgcacaca

SEQ ID NO: 378862 - DNA, 20 bp, Artificial
  CRISPR gRNA sequence
ggagcttgcattctctttct

SEQ ID NO: 378863 - DNA, 20 bp, Artificial
  CRISPR gRNA sequence
acatttcattttgcatttat

SEQ ID NO: 378864 - DNA, 20 bp, Artificial
  CRISPR gRNA sequence
catttatttgggtgactagt

SEQ ID NO: 378865 - DNA, 20 bp, Artificial
  CRISPR gRNA sequence
ttcatagtctaggcacagtt

SEQ ID NO: 378866 - DNA, 20 bp, Artificial
  CRISPR gRNA sequence
ctaagagatggttgaacaag

SEQ ID NO: 378867 - DNA, 20 bp, Artificial
  CRISPR gRNA sequence
gataggctcactcagcgatg

SEQ ID NO: 378868 - DNA, 20 bp, Artificial
  CRISPR gRNA sequence
gtgcaatgtcacggaagcca

SEQ ID NO: 378869 - DNA, 20 bp, Artificial
  CRISPR gRNA sequence
atgtcacggaagccaagggg

SEQ ID NO: 378870 - DNA, 20 bp, Artificial
  CRISPR gRNA sequence
gacatttgcagtcttggtag

SEQ ID NO: 378871 - DNA, 20 bp, Artificial
  CRISPR gRNA sequence
gtcttggtagaagggtggaa

SEQ ID NO: 378872 - DNA, 20 bp, Artificial
  CRISPR gRNA sequence
gtgtcgaagcacacatggga

SEQ ID NO: 378873 - DNA, 20 bp, Artificial
  CRISPR gRNA sequence
tgggaaagggtgaggccgag

SEQ ID NO: 378874 - DNA, 20 bp, Artificial
  CRISPR gRNA sequence
gcaggatgggaacccactcc

SEQ ID NO: 378875 - DNA, 20 bp, Artificial
  CRISPR gRNA sequence
gggaacccactcctggaatt

SEQ ID NO: 378876 - DNA, 20 bp, Artificial
  CRISPR gRNA sequence
acccactcctggaattttga

SEQ ID NO: 378877 - DNA, 20 bp, Artificial
  CRISPR gRNA sequence
tagggaagaagaaacaagga

SEQ ID NO: 378878 - DNA, 20 bp, Artificial
  CRISPR gRNA sequence
aaggtccaaagttggttttc

SEQ ID NO: 378879 - DNA, 20 bp, Artificial
  CRISPR gRNA sequence
gagagagagaacagtccact

SEQ ID NO: 378880 - DNA, 20 bp, Artificial
  CRISPR gRNA sequence
tggaggttaaagatacagga

SEQ ID NO: 378881 - DNA, 20 bp, Artificial
  CRISPR gRNA sequence
aacaggcacattaatactga

SEQ ID NO: 378882 - DNA, 20 bp, Artificial
  CRISPR gRNA sequence
tactgattggatgttattgt

SEQ ID NO: 378883 - DNA, 20 bp, Artificial
  CRISPR gRNA sequence
gttattgttaggattagaga

SEQ ID NO: 378884 - DNA, 20 bp, Artificial
  CRISPR gRNA sequence
aaatactttttttttttttt

SEQ ID NO: 378885 - DNA, 20 bp, Artificial
  CRISPR gRNA sequence
ttttttttttttttttgagt

SEQ ID NO: 378886 - DNA, 20 bp, Artificial
  CRISPR gRNA sequence
tcttgctctgtcgcccaggc

SEQ ID NO: 378887 - DNA, 20 bp, Artificial
  CRISPR gRNA sequence
ctcactgcaagctctgcctc

SEQ ID NO: 378888 - DNA, 20 bp, Artificial
  CRISPR gRNA sequence
cattcttctgcctcagcctc

SEQ ID NO: 378889 - DNA, 20 bp, Artificial
  CRISPR gRNA sequence
ttttgtatttttagtagaga

SEQ ID NO: 378890 - DNA, 20 bp, Artificial
  CRISPR gRNA sequence
cggggtttcaccatgttagc

SEQ ID NO: 378891 - DNA, 20 bp, Artificial
  CRISPR gRNA sequence
tgcctcggcctcccaaagtg

SEQ ID NO: 378892 - DNA, 20 bp, Artificial
  CRISPR gRNA sequence
caaacatatacaaaaataga

SEQ ID NO: 378893 - DNA, 20 bp, Artificial
  CRISPR gRNA sequence
agcttcgccgactatcaagt

SEQ ID NO: 378894 - DNA, 20 bp, Artificial
  CRISPR gRNA sequence
tcatcaataaatattttagc

SEQ ID NO: 378895 - DNA, 20 bp, Artificial
  CRISPR gRNA sequence
tttagcctgaatctcaaaag

SEQ ID NO: 378896 - DNA, 20 bp, Artificial
  CRISPR gRNA sequence
ctttgcatttctccagttct

SEQ ID NO: 378897 - DNA, 20 bp, Artificial
  CRISPR gRNA sequence
tttttgttgttgttgtcacc

SEQ ID NO: 378898 - DNA, 20 bp, Artificial
  CRISPR gRNA sequence
tggaaacataaatggcattt

SEQ ID NO: 378899 - DNA, 20 bp, Artificial
  CRISPR gRNA sequence
tttgtgaatttgcagacact

SEQ ID NO: 378900 - DNA, 20 bp, Artificial
  CRISPR gRNA sequence
ttaaatatatttcttaatat

SEQ ID NO: 378901 - DNA, 20 bp, Artificial
  CRISPR gRNA sequence
tcaataaaaatacatgcaca

SEQ ID NO: 378902 - DNA, 20 bp, Artificial
  CRISPR gRNA sequence
tacatgcacattgagtgcaa

SEQ ID NO: 378903 - DNA, 20 bp, Artificial
  CRISPR gRNA sequence
ttttttttttttttttgaga

SEQ ID NO: 378904 - DNA, 20 bp, Artificial
  CRISPR gRNA sequence
ctcactgcaagctccgcctc

SEQ ID NO: 378905 - DNA, 20 bp, Artificial
  CRISPR gRNA sequence
cattctcctgcctcagcctc

SEQ ID NO: 378906 - DNA, 20 bp, Artificial
  CRISPR gRNA sequence
ttttgtatttttagtagaga

SEQ ID NO: 378907 - DNA, 20 bp, Artificial
  CRISPR gRNA sequence
cggggtttcaccttgttagc

SEQ ID NO: 378908 - DNA, 20 bp, Artificial
  CRISPR gRNA sequence
gcctcggcctcgcaaagtgc

SEQ ID NO: 378909 - DNA, 20 bp, Artificial
  CRISPR gRNA sequence
ttaaaaaaacttttaggttt

SEQ ID NO: 378910 - DNA, 20 bp, Artificial
  CRISPR gRNA sequence
cataggtaaatatgtgtcac

SEQ ID NO: 378911 - DNA, 20 bp, Artificial
  CRISPR gRNA sequence
agttattaagctcagtaact

SEQ ID NO: 378912 - DNA, 20 bp, Artificial
  CRISPR gRNA sequence
aattcctgcattagtttact

SEQ ID NO: 378913 - DNA, 20 bp, Artificial
  CRISPR gRNA sequence
tggctgcatagtattccatg

SEQ ID NO: 378914 - DNA, 20 bp, Artificial
  CRISPR gRNA sequence
gtacatatgtgtctttatag

SEQ ID NO: 378915 - DNA, 20 bp, Artificial
  CRISPR gRNA sequence
gtgggatgatttatattcct

SEQ ID NO: 378916 - DNA, 20 bp, Artificial
  CRISPR gRNA sequence
attcctctgggtatatgccc

SEQ ID NO: 378917 - DNA, 20 bp, Artificial
  CRISPR gRNA sequence
tctgggtatatgcccaggaa

SEQ ID NO: 378918 - DNA, 20 bp, Artificial
  CRISPR gRNA sequence
tatgcccaggaatgggattg

SEQ ID NO: 378919 - DNA, 20 bp, Artificial
  CRISPR gRNA sequence
gttctgcttttatctctttg

SEQ ID NO: 378920 - DNA, 20 bp, Artificial
  CRISPR gRNA sequence
catactgctttccacaatgg

SEQ ID NO: 378921 - DNA, 20 bp, Artificial
  CRISPR gRNA sequence
tggtttgcctttctgtaatg

SEQ ID NO: 378922 - DNA, 20 bp, Artificial
  CRISPR gRNA sequence
gtcctttacccactttttaa

SEQ ID NO: 378923 - DNA, 20 bp, Artificial
  CRISPR gRNA sequence
gcttaacttccttatagatg

SEQ ID NO: 378924 - DNA, 20 bp, Artificial
  CRISPR gRNA sequence
tggtctagctatacagaggc

SEQ ID NO: 378925 - DNA, 20 bp, Artificial
  CRISPR gRNA sequence
aagctgacagtaaaatgact

SEQ ID NO: 378926 - DNA, 20 bp, Artificial
  CRISPR gRNA sequence
atgactcagggttttgtgaa

SEQ ID NO: 378927 - DNA, 20 bp, Artificial
  CRISPR gRNA sequence
agggttttgtgaagtgggtg

SEQ ID NO: 378928 - DNA, 20 bp, Artificial
  CRISPR gRNA sequence
atgcagaactgttgaccagt

SEQ ID NO: 378929 - DNA, 20 bp, Artificial
  CRISPR gRNA sequence
aagatgtacccagcaatgtt

SEQ ID NO: 378930 - DNA, 20 bp, Artificial
  CRISPR gRNA sequence
gaagcactgaaataatttcc

SEQ ID NO: 378931 - DNA, 20 bp, Artificial
  CRISPR gRNA sequence
gagaagccacatacaaaata

SEQ ID NO: 378932 - DNA, 20 bp, Artificial
  CRISPR gRNA sequence
gacattttggtctgtttcac

SEQ ID NO: 378933 - DNA, 20 bp, Artificial
  CRISPR gRNA sequence
ctttccaattccaagttcat

SEQ ID NO: 378934 - DNA, 20 bp, Artificial
  CRISPR gRNA sequence
gcttctgaaccacctggctc

SEQ ID NO: 378935 - DNA, 20 bp, Artificial
  CRISPR gRNA sequence
ccacttctttcacctccagg

SEQ ID NO: 378936 - DNA, 20 bp, Artificial
  CRISPR gRNA sequence
caggctgagtctattgagag

SEQ ID NO: 378937 - DNA, 20 bp, Artificial
  CRISPR gRNA sequence
aaagacagctgcatcccctc

SEQ ID NO: 378938 - DNA, 20 bp, Artificial
  CRISPR gRNA sequence
gtgaaaatgcagacacggct

SEQ ID NO: 378939 - DNA, 20 bp, Artificial
  CRISPR gRNA sequence
gagtagacccctgtttctac

SEQ ID NO: 378940 - DNA, 20 bp, Artificial
  CRISPR gRNA sequence
ttccttttttccctttttta

SEQ ID NO: 378941 - DNA, 20 bp, Artificial
  CRISPR gRNA sequence
acttagagacgaaatgtttt

SEQ ID NO: 378942 - DNA, 20 bp, Artificial
  CRISPR gRNA sequence
gttttccgggtgtgtgttat

SEQ ID NO: 378943 - DNA, 20 bp, Artificial
  CRISPR gRNA sequence
ggttgtacagaggagaaagc

SEQ ID NO: 378944 - DNA, 20 bp, Artificial
  CRISPR gRNA sequence
caatggctcctgggccagtc

SEQ ID NO: 378945 - DNA, 20 bp, Artificial
  CRISPR gRNA sequence
gcatttctcccttagtgcca

SEQ ID NO: 378946 - DNA, 20 bp, Artificial
  CRISPR gRNA sequence
actctactgaaatagcaggt

SEQ ID NO: 378947 - DNA, 20 bp, Artificial
  CRISPR gRNA sequence
tagatccacttgttaccttg

SEQ ID NO: 378948 - DNA, 20 bp, Artificial
  CRISPR gRNA sequence
gggttatcttaattttaaga

SEQ ID NO: 378949 - DNA, 20 bp, Artificial
  CRISPR gRNA sequence
accacagtttattctttaga

SEQ ID NO: 378950 - DNA, 20 bp, Artificial
  CRISPR gRNA sequence
aaaattactgaaggccctca

SEQ ID NO: 378951 - DNA, 20 bp, Artificial
  CRISPR gRNA sequence
ttgagcaaaatttaaaacac

SEQ ID NO: 378952 - DNA, 20 bp, Artificial
  CRISPR gRNA sequence
ctgtatacctgtgagagaac

SEQ ID NO: 378953 - DNA, 20 bp, Artificial
  CRISPR gRNA sequence
agagaactggagtgaagagg

SEQ ID NO: 378954 - DNA, 20 bp, Artificial
  CRISPR gRNA sequence
tagatatttagtgacaatta

SEQ ID NO: 378955 - DNA, 20 bp, Artificial
  CRISPR gRNA sequence
attactgagtactttatggt

SEQ ID NO: 378956 - DNA, 20 bp, Artificial
  CRISPR gRNA sequence
aaatggtgtgaggaaggtgg

SEQ ID NO: 378957 - DNA, 20 bp, Artificial
  CRISPR gRNA sequence
tactggactttcatggtatc

SEQ ID NO: 378958 - DNA, 20 bp, Artificial
  CRISPR gRNA sequence
aagacaaccctgtatatctg

SEQ ID NO: 378959 - DNA, 20 bp, Artificial
  CRISPR gRNA sequence
agatcatgtgtatattcagt

SEQ ID NO: 378960 - DNA, 20 bp, Artificial
  CRISPR gRNA sequence
ggtatctttttcataactgt

SEQ ID NO: 378961 - DNA, 20 bp, Artificial
  CRISPR gRNA sequence
ataactgtcagaatcttagc

SEQ ID NO: 378962 - DNA, 20 bp, Artificial
  CRISPR gRNA sequence
atgataccaagaaaagcacc

SEQ ID NO: 378963 - DNA, 20 bp, Artificial
  CRISPR gRNA sequence
aaaaaaaccctttctcttac

SEQ ID NO: 378964 - DNA, 20 bp, Artificial
  CRISPR gRNA sequence
caagaatgtgtcattcacaa

SEQ ID NO: 378965 - DNA, 20 bp, Artificial
  CRISPR gRNA sequence
actttgggaggccgaggtgg

SEQ ID NO: 378966 - DNA, 20 bp, Artificial
  CRISPR gRNA sequence
tactcaggaggctgaggcag

SEQ ID NO: 378967 - DNA, 20 bp, Artificial
  CRISPR gRNA sequence
tcacaccactgcactctagt

SEQ ID NO: 378968 - DNA, 20 bp, Artificial
  CRISPR gRNA sequence
tatgattaagtatcttccag

SEQ ID NO: 378969 - DNA, 20 bp, Artificial
  CRISPR gRNA sequence
acattgtttcggaacctgga

SEQ ID NO: 378970 - DNA, 20 bp, Artificial
  CRISPR gRNA sequence
tgatgagattgactgtagcc

SEQ ID NO: 378971 - DNA, 20 bp, Artificial
  CRISPR gRNA sequence
gagattgactgtagccgagg

SEQ ID NO: 378972 - DNA, 20 bp, Artificial
  CRISPR gRNA sequence
ttcagcatttttttaaatgg

SEQ ID NO: 378973 - DNA, 20 bp, Artificial
  CRISPR gRNA sequence
ttttaaatggctgaatttag

SEQ ID NO: 378974 - DNA, 20 bp, Artificial
  CRISPR gRNA sequence
ttggccattattctagtatt

SEQ ID NO: 378975 - DNA, 20 bp, Artificial
  CRISPR gRNA sequence
attgagggtttctttatctt

SEQ ID NO: 378976 - DNA, 20 bp, Artificial
  CRISPR gRNA sequence
actcctatcttcccaattac

SEQ ID NO: 378977 - DNA, 20 bp, Artificial
  CRISPR gRNA sequence
tgatggtggtgataaggtgt

SEQ ID NO: 378978 - DNA, 20 bp, Artificial
  CRISPR gRNA sequence
atggctgaagcagggctgcg

SEQ ID NO: 378979 - DNA, 20 bp, Artificial
  CRISPR gRNA sequence
gtgcatttcagcaggtgttt

SEQ ID NO: 378980 - DNA, 20 bp, Artificial
  CRISPR gRNA sequence
tctctcagtctttttcagat

SEQ ID NO: 378981 - DNA, 20 bp, Artificial
  CRISPR gRNA sequence
cagatccccaaaagggacac

SEQ ID NO: 378982 - DNA, 20 bp, Artificial
  CRISPR gRNA sequence
tagatctttggtgaccatta

SEQ ID NO: 378983 - DNA, 20 bp, Artificial
  CRISPR gRNA sequence
aaaacctagatccactttgc

SEQ ID NO: 378984 - DNA, 20 bp, Artificial
  CRISPR gRNA sequence
catttgtctcttttgtcaca

SEQ ID NO: 378985 - DNA, 20 bp, Artificial
  CRISPR gRNA sequence
tacaaatatagaggtccata

SEQ ID NO: 378986 - DNA, 20 bp, Artificial
  CRISPR gRNA sequence
taataaggagagcattttca

SEQ ID NO: 378987 - DNA, 20 bp, Artificial
  CRISPR gRNA sequence
ggtgagacatacattggact

SEQ ID NO: 378988 - DNA, 20 bp, Artificial
  CRISPR gRNA sequence
cttagaatttaatgaaaatg

SEQ ID NO: 378989 - DNA, 20 bp, Artificial
  CRISPR gRNA sequence
ctattcagaaaagtgtcata

SEQ ID NO: 378990 - DNA, 20 bp, Artificial
  CRISPR gRNA sequence
acattcagttgacagattga

SEQ ID NO: 378991 - DNA, 20 bp, Artificial
  CRISPR gRNA sequence
caatttttataagtgaaaga

SEQ ID NO: 378992 - DNA, 20 bp, Artificial
  CRISPR gRNA sequence
ttcttttatagcacatagta

SEQ ID NO: 378993 - DNA, 20 bp, Artificial
  CRISPR gRNA sequence
tttaccactgactttctttg

SEQ ID NO: 378994 - DNA, 20 bp, Artificial
  CRISPR gRNA sequence
tgcacttatgtcctgaaatg

SEQ ID NO: 378995 - DNA, 20 bp, Artificial
  CRISPR gRNA sequence
ataattccagactgactttt

SEQ ID NO: 378996 - DNA, 20 bp, Artificial
  CRISPR gRNA sequence
tggggacggggggagcacag

SEQ ID NO: 378997 - DNA, 20 bp, Artificial
  CRISPR gRNA sequence
tttttggcccttaacatcct

SEQ ID NO: 378998 - DNA, 20 bp, Artificial
  CRISPR gRNA sequence
ctgaccttattggctataaa

SEQ ID NO: 378999 - DNA, 20 bp, Artificial
  CRISPR gRNA sequence
ggcattgatgattagagctg

SEQ ID NO: 379000 - DNA, 20 bp, Artificial
  CRISPR gRNA sequence
atgacatgaaacaggttatg

SEQ ID NO: 379001 - DNA, 20 bp, Artificial
  CRISPR gRNA sequence
agtaaccccaaatatgcagg

SEQ ID NO: 379002 - DNA, 20 bp, Artificial
  CRISPR gRNA sequence
caaatgactaggttggtatg

SEQ ID NO: 379003 - DNA, 20 bp, Artificial
  CRISPR gRNA sequence
tggcaaaacaataatcatga

SEQ ID NO: 379004 - DNA, 20 bp, Artificial
  CRISPR gRNA sequence
ttattccttttattgttatt

SEQ ID NO: 379005 - DNA, 20 bp, Artificial
  CRISPR gRNA sequence
ccttttattgttattgggga

SEQ ID NO: 379006 - DNA, 20 bp, Artificial
  CRISPR gRNA sequence
attttgttttaattcctttt

SEQ ID NO: 379007 - DNA, 20 bp, Artificial
  CRISPR gRNA sequence
ttttgtatcctgcctcttaa

SEQ ID NO: 379008 - DNA, 20 bp, Artificial
  CRISPR gRNA sequence
aggtttttttgtggcacttt

SEQ ID NO: 379009 - DNA, 20 bp, Artificial
  CRISPR gRNA sequence
attacttcttcctttctgat

SEQ ID NO: 379010 - DNA, 20 bp, Artificial
  CRISPR gRNA sequence
atagatggcctttattgtgt

SEQ ID NO: 379011 - DNA, 20 bp, Artificial
  CRISPR gRNA sequence
ctttctgtacctaatttgtt

SEQ ID NO: 379012 - DNA, 20 bp, Artificial
  CRISPR gRNA sequence
ttttttttttttaatcacac

SEQ ID NO: 379013 - DNA, 20 bp, Artificial
  CRISPR gRNA sequence
tttttaatcacacaaggatg

SEQ ID NO: 379014 - DNA, 20 bp, Artificial
  CRISPR gRNA sequence
ttgaaccatctttgcatgcc

SEQ ID NO: 379015 - DNA, 20 bp, Artificial
  CRISPR gRNA sequence
tttgcatgccagggataaat

SEQ ID NO: 379016 - DNA, 20 bp, Artificial
  CRISPR gRNA sequence
agggataaatcagaattgat

SEQ ID NO: 379017 - DNA, 20 bp, Artificial
  CRISPR gRNA sequence
acaatccatttaatgtgatg

SEQ ID NO: 379018 - DNA, 20 bp, Artificial
  CRISPR gRNA sequence
tagtttgctagtattttgtt

SEQ ID NO: 379019 - DNA, 20 bp, Artificial
  CRISPR gRNA sequence
ttttttcatctgtgttcatt

SEQ ID NO: 379020 - DNA, 20 bp, Artificial
  CRISPR gRNA sequence
tctttgtctggttttggtat

SEQ ID NO: 379021 - DNA, 20 bp, Artificial
  CRISPR gRNA sequence
ggtgatgctggtctcataaa

SEQ ID NO: 379022 - DNA, 20 bp, Artificial
  CRISPR gRNA sequence
aactgcttctttttttaaaa

SEQ ID NO: 379023 - DNA, 20 bp, Artificial
  CRISPR gRNA sequence
tgtagaactgtttctaaact

SEQ ID NO: 379024 - DNA, 20 bp, Artificial
  CRISPR gRNA sequence
tcaggattggcattaattcc

SEQ ID NO: 379025 - DNA, 20 bp, Artificial
  CRISPR gRNA sequence
ttaattcctagaatgtttga

SEQ ID NO: 379026 - DNA, 20 bp, Artificial
  CRISPR gRNA sequence
tctgtgaagccacctggtcc

SEQ ID NO: 379027 - DNA, 20 bp, Artificial
  CRISPR gRNA sequence
acctggtcctgggatcagtg

SEQ ID NO: 379028 - DNA, 20 bp, Artificial
  CRISPR gRNA sequence
aggcacaaaggtgtcctaca

SEQ ID NO: 379029 - DNA, 20 bp, Artificial
  CRISPR gRNA sequence
agagatactgtcagcatgat

SEQ ID NO: 379030 - DNA, 20 bp, Artificial
  CRISPR gRNA sequence
cacatttgctttctttccta

SEQ ID NO: 379031 - DNA, 20 bp, Artificial
  CRISPR gRNA sequence
tcattgaaatattaagcatc

SEQ ID NO: 379032 - DNA, 20 bp, Artificial
  CRISPR gRNA sequence
tagtctgaaaattgctaccc

SEQ ID NO: 379033 - DNA, 20 bp, Artificial
  CRISPR gRNA sequence
tatttatttattttttgaga

SEQ ID NO: 379034 - DNA, 20 bp, Artificial
  CRISPR gRNA sequence
ttttgtatttttggtagaga

SEQ ID NO: 379035 - DNA, 20 bp, Artificial
  CRISPR gRNA sequence
tttggtagagatggggtttc

SEQ ID NO: 379036 - DNA, 20 bp, Artificial
  CRISPR gRNA sequence
gcctcagcctcctaaagtgc

SEQ ID NO: 379037 - DNA, 20 bp, Artificial
  CRISPR gRNA sequence
atcagaaattaattgagatt

SEQ ID NO: 379038 - DNA, 20 bp, Artificial
  CRISPR gRNA sequence
aagttgtcaaagcatctttt

SEQ ID NO: 379039 - DNA, 20 bp, Artificial
  CRISPR gRNA sequence
ttaactttcattttcttatt

SEQ ID NO: 379040 - DNA, 20 bp, Artificial
  CRISPR gRNA sequence
ggcacataattgctggtcat

SEQ ID NO: 379041 - DNA, 20 bp, Artificial
  CRISPR gRNA sequence
attgctggtcatctgaatag

SEQ ID NO: 379042 - DNA, 20 bp, Artificial
  CRISPR gRNA sequence
tggtcatctgaatagaagga

SEQ ID NO: 379043 - DNA, 20 bp, Artificial
  CRISPR gRNA sequence
aatcatagtgccacagctaa

SEQ ID NO: 379044 - DNA, 20 bp, Artificial
  CRISPR gRNA sequence
ctctgggacgatgtgaggta

SEQ ID NO: 379045 - DNA, 20 bp, Artificial
  CRISPR gRNA sequence
ttgacaaggaggaaggacag

SEQ ID NO: 379046 - DNA, 20 bp, Artificial
  CRISPR gRNA sequence
aaggaggaaggacaggggaa

SEQ ID NO: 379047 - DNA, 20 bp, Artificial
  CRISPR gRNA sequence
gactttgagactctgtgctc

SEQ ID NO: 379048 - DNA, 20 bp, Artificial
  CRISPR gRNA sequence
tgagactctgtgctcctgag

SEQ ID NO: 379049 - DNA, 20 bp, Artificial
  CRISPR gRNA sequence
ccagtttgctcccagtccat

SEQ ID NO: 379050 - DNA, 20 bp, Artificial
  CRISPR gRNA sequence
ccagtccatttggattccag

SEQ ID NO: 379051 - DNA, 20 bp, Artificial
  CRISPR gRNA sequence
gacagttttttttttttttt

SEQ ID NO: 379052 - DNA, 20 bp, Artificial
  CRISPR gRNA sequence
gaaccttctgtcccactcct

SEQ ID NO: 379053 - DNA, 20 bp, Artificial
  CRISPR gRNA sequence
ctgtcccactcctatgaatt

SEQ ID NO: 379054 - DNA, 20 bp, Artificial
  CRISPR gRNA sequence
gatataaagcttgtggacat

SEQ ID NO: 379055 - DNA, 20 bp, Artificial
  CRISPR gRNA sequence
atatgatggagcaacacgac

SEQ ID NO: 379056 - DNA, 20 bp, Artificial
  CRISPR gRNA sequence
atttagttttctcggtgaaa

SEQ ID NO: 379057 - DNA, 20 bp, Artificial
  CRISPR gRNA sequence
catagtttccagcatcacaa

SEQ ID NO: 379058 - DNA, 20 bp, Artificial
  CRISPR gRNA sequence
caatcatggctattatgtgg

SEQ ID NO: 379059 - DNA, 20 bp, Artificial
  CRISPR gRNA sequence
tttttgaacacacaaaaacc

SEQ ID NO: 379060 - DNA, 20 bp, Artificial
  CRISPR gRNA sequence
ttgtatagataagtaagata

SEQ ID NO: 379061 - DNA, 20 bp, Artificial
  CRISPR gRNA sequence
agtgataagttattgtcaga

SEQ ID NO: 379062 - DNA, 20 bp, Artificial
  CRISPR gRNA sequence
aaactctaaaaggttacatg

SEQ ID NO: 379063 - DNA, 20 bp, Artificial
  CRISPR gRNA sequence
ctataaacaatgcaagtttg

SEQ ID NO: 379064 - DNA, 20 bp, Artificial
  CRISPR gRNA sequence
ggtggacctttatcttctga

SEQ ID NO: 379065 - DNA, 20 bp, Artificial
  CRISPR gRNA sequence
tgggaacttagactacaagt

SEQ ID NO: 379066 - DNA, 20 bp, Artificial
  CRISPR gRNA sequence
ctttgggaggctgaggcggt

SEQ ID NO: 379067 - DNA, 20 bp, Artificial
  CRISPR gRNA sequence
cggtaggagtccttgagccc

SEQ ID NO: 379068 - DNA, 20 bp, Artificial
  CRISPR gRNA sequence
ttatactttattgtcgtata

SEQ ID NO: 379069 - DNA, 20 bp, Artificial
  CRISPR gRNA sequence
tttacattctaaaagcacct

SEQ ID NO: 379070 - DNA, 20 bp, Artificial
  CRISPR gRNA sequence
gtatttcaaacattattgac

SEQ ID NO: 379071 - DNA, 20 bp, Artificial
  CRISPR gRNA sequence
gtttaagaggacggaaaatg

SEQ ID NO: 379072 - DNA, 20 bp, Artificial
  CRISPR gRNA sequence
tatttatactaaaatgattc

SEQ ID NO: 379073 - DNA, 20 bp, Artificial
  CRISPR gRNA sequence
taaaaatacatttattcaac

SEQ ID NO: 379074 - DNA, 20 bp, Artificial
  CRISPR gRNA sequence
agcactctaaaattcatttc

SEQ ID NO: 379075 - DNA, 20 bp, Artificial
  CRISPR gRNA sequence
gtgttcacaatcctttagat

SEQ ID NO: 379076 - DNA, 20 bp, Artificial
  CRISPR gRNA sequence
aattaattaactcacaggga

SEQ ID NO: 379077 - DNA, 20 bp, Artificial
  CRISPR gRNA sequence
tgaaatgttaatactctcag

SEQ ID NO: 379078 - DNA, 20 bp, Artificial
  CRISPR gRNA sequence
ggctttagctatgttggaca

SEQ ID NO: 379079 - DNA, 20 bp, Artificial
  CRISPR gRNA sequence
ttattgtgatgatgatggac

SEQ ID NO: 379080 - DNA, 20 bp, Artificial
  CRISPR gRNA sequence
ggtaaaataaaaagtagatg

SEQ ID NO: 379081 - DNA, 20 bp, Artificial
  CRISPR gRNA sequence
ttgagaagatttcattaaca

SEQ ID NO: 379082 - DNA, 20 bp, Artificial
  CRISPR gRNA sequence
aagatttcattaacaaaggg

SEQ ID NO: 379083 - DNA, 20 bp, Artificial
  CRISPR gRNA sequence
tcacatcttatgtggagcat

SEQ ID NO: 379084 - DNA, 20 bp, Artificial
  CRISPR gRNA sequence
gtgtatgaactgagatatct

SEQ ID NO: 379085 - DNA, 20 bp, Artificial
  CRISPR gRNA sequence
atctatgaatatttgttagg

SEQ ID NO: 379086 - DNA, 20 bp, Artificial
  CRISPR gRNA sequence
ttttaaaaaagagagatgag

SEQ ID NO: 379087 - DNA, 20 bp, Artificial
  CRISPR gRNA sequence
catgttttgtagagcactta

SEQ ID NO: 379088 - DNA, 20 bp, Artificial
  CRISPR gRNA sequence
tttcataaaatggtttaaaa

SEQ ID NO: 379089 - DNA, 20 bp, Artificial
  CRISPR gRNA sequence
ggtattcagcctaaggcttg

SEQ ID NO: 379090 - DNA, 20 bp, Artificial
  CRISPR gRNA sequence
tctcactctgttgcccaggc

SEQ ID NO: 379091 - DNA, 20 bp, Artificial
  CRISPR gRNA sequence
ctcactgcaacctcctcctc

SEQ ID NO: 379092 - DNA, 20 bp, Artificial
  CRISPR gRNA sequence
gcctcagcctcccaagcagc

SEQ ID NO: 379093 - DNA, 20 bp, Artificial
  CRISPR gRNA sequence
ttttgtatttttagaagaga

SEQ ID NO: 379094 - DNA, 20 bp, Artificial
  CRISPR gRNA sequence
acctcggccttccaaagtgc

SEQ ID NO: 379095 - DNA, 20 bp, Artificial
  CRISPR gRNA sequence
gttttctaaggacccaagga

SEQ ID NO: 379096 - DNA, 20 bp, Artificial
  CRISPR gRNA sequence
gagttataagtagctgttct

SEQ ID NO: 379097 - DNA, 20 bp, Artificial
  CRISPR gRNA sequence
tgtgtgccagtggctgttct

SEQ ID NO: 379098 - DNA, 20 bp, Artificial
  CRISPR gRNA sequence
tctgtggaaagtgaggtatg

SEQ ID NO: 379099 - DNA, 20 bp, Artificial
  CRISPR gRNA sequence
taactaataaatagaggggc

SEQ ID NO: 379100 - DNA, 20 bp, Artificial
  CRISPR gRNA sequence
agatgcgggctgactggctt

SEQ ID NO: 379101 - DNA, 20 bp, Artificial
  CRISPR gRNA sequence
tctagagcaagtttaggcaa

SEQ ID NO: 379102 - DNA, 20 bp, Artificial
  CRISPR gRNA sequence
aggcaaaggagtcggggagc

SEQ ID NO: 379103 - DNA, 20 bp, Artificial
  CRISPR gRNA sequence
cccgctactttatttcagct

SEQ ID NO: 379104 - DNA, 20 bp, Artificial
  CRISPR gRNA sequence
ctaggggcttgtgcacatca

SEQ ID NO: 379105 - DNA, 20 bp, Artificial
  CRISPR gRNA sequence
gaacagattaggggaacttt

SEQ ID NO: 379106 - DNA, 20 bp, Artificial
  CRISPR gRNA sequence
actcccttgaacagctttcc

SEQ ID NO: 379107 - DNA, 20 bp, Artificial
  CRISPR gRNA sequence
tggcttcttgaaaccagagc

SEQ ID NO: 379108 - DNA, 20 bp, Artificial
  CRISPR gRNA sequence
gaaaccagagctggagtaat

SEQ ID NO: 379109 - DNA, 20 bp, Artificial
  CRISPR gRNA sequence
tgaaaaatttcctatttcct

SEQ ID NO: 379110 - DNA, 20 bp, Artificial
  CRISPR gRNA sequence
ataatggtagcactgtaatg

SEQ ID NO: 379111 - DNA, 20 bp, Artificial
  CRISPR gRNA sequence
aaaacaaaataattttgtta

SEQ ID NO: 379112 - DNA, 20 bp, Artificial
  CRISPR gRNA sequence
ttattgaataagcactaaat

SEQ ID NO: 379113 - DNA, 20 bp, Artificial
  CRISPR gRNA sequence
attacatacatgctctaaag

SEQ ID NO: 379114 - DNA, 20 bp, Artificial
  CRISPR gRNA sequence
cctagattcaactggtaatt

SEQ ID NO: 379115 - DNA, 20 bp, Artificial
  CRISPR gRNA sequence
acaggaggtacttttgcacc

SEQ ID NO: 379116 - DNA, 20 bp, Artificial
  CRISPR gRNA sequence
cctctcagaaattgggaggt

SEQ ID NO: 379117 - DNA, 20 bp, Artificial
  CRISPR gRNA sequence
ccttgatggttacatttcaa

SEQ ID NO: 379118 - DNA, 20 bp, Artificial
  CRISPR gRNA sequence
ctcccctggaaggtgctttc

SEQ ID NO: 379119 - DNA, 20 bp, Artificial
  CRISPR gRNA sequence
attctgtggaacaccaacat

SEQ ID NO: 379120 - DNA, 20 bp, Artificial
  CRISPR gRNA sequence
tggtatgcttgctgaaagac

SEQ ID NO: 379121 - DNA, 20 bp, Artificial
  CRISPR gRNA sequence
tgggacttgttcccaggcct

SEQ ID NO: 379122 - DNA, 20 bp, Artificial
  CRISPR gRNA sequence
ttgttcccaggcctaggaat

SEQ ID NO: 379123 - DNA, 20 bp, Artificial
  CRISPR gRNA sequence
gtattgttttgttttagaga

SEQ ID NO: 379124 - DNA, 20 bp, Artificial
  CRISPR gRNA sequence
ctctgtgggcatgtgagaac

SEQ ID NO: 379125 - DNA, 20 bp, Artificial
  CRISPR gRNA sequence
ttcaacaattctctgactgc

SEQ ID NO: 379126 - DNA, 20 bp, Artificial
  CRISPR gRNA sequence
tatccctttgctgatttgct

SEQ ID NO: 379127 - DNA, 20 bp, Artificial
  CRISPR gRNA sequence
tcataaacctgagctgtgac

SEQ ID NO: 379128 - DNA, 20 bp, Artificial
  CRISPR gRNA sequence
aattatcatttttagatgga

SEQ ID NO: 379129 - DNA, 20 bp, Artificial
  CRISPR gRNA sequence
tagatggaaagaattcgaag

SEQ ID NO: 379130 - DNA, 20 bp, Artificial
  CRISPR gRNA sequence
ttgcgctttgctctatgtgg

SEQ ID NO: 379131 - DNA, 20 bp, Artificial
  CRISPR gRNA sequence
actcttgtatgtttgtttgt

SEQ ID NO: 379132 - DNA, 20 bp, Artificial
  CRISPR gRNA sequence
agattcccaagagacacttt

SEQ ID NO: 379133 - DNA, 20 bp, Artificial
  CRISPR gRNA sequence
gtcttggctaggctttgact

SEQ ID NO: 379134 - DNA, 20 bp, Artificial
  CRISPR gRNA sequence
cagtaggactgcttgaggtc

SEQ ID NO: 379135 - DNA, 20 bp, Artificial
  CRISPR gRNA sequence
tacttgggaggctgaggcag

SEQ ID NO: 379136 - DNA, 20 bp, Artificial
  CRISPR gRNA sequence
gctgaggcaggaggatcacc

SEQ ID NO: 379137 - DNA, 20 bp, Artificial
  CRISPR gRNA sequence
agtataagactcagaaatat

SEQ ID NO: 379138 - DNA, 20 bp, Artificial
  CRISPR gRNA sequence
atatgagatatctaatacaa

SEQ ID NO: 379139 - DNA, 20 bp, Artificial
  CRISPR gRNA sequence
agaacttatggcccacagta

SEQ ID NO: 379140 - DNA, 20 bp, Artificial
  CRISPR gRNA sequence
aacgtacacacaagctatct

SEQ ID NO: 379141 - DNA, 20 bp, Artificial
  CRISPR gRNA sequence
agttgctatttactcagaag

SEQ ID NO: 379142 - DNA, 20 bp, Artificial
  CRISPR gRNA sequence
acagaaaggtttctgaaata

SEQ ID NO: 379143 - DNA, 20 bp, Artificial
  CRISPR gRNA sequence
aaagttgacctttgaaaact

SEQ ID NO: 379144 - DNA, 20 bp, Artificial
  CRISPR gRNA sequence
ctgtgcctttccccaggaag

SEQ ID NO: 379145 - DNA, 20 bp, Artificial
  CRISPR gRNA sequence
ttatctgattaaccctcatt

SEQ ID NO: 379146 - DNA, 20 bp, Artificial
  CRISPR gRNA sequence
atgtgaagtcttccagggga

SEQ ID NO: 379147 - DNA, 20 bp, Artificial
  CRISPR gRNA sequence
tgtctaaagtgggacaaagg

SEQ ID NO: 379148 - DNA, 20 bp, Artificial
  CRISPR gRNA sequence
ctttgtatgacctgataatg

SEQ ID NO: 379149 - DNA, 20 bp, Artificial
  CRISPR gRNA sequence
ataatatttgtgcatatttt

SEQ ID NO: 379150 - DNA, 20 bp, Artificial
  CRISPR gRNA sequence
tttgacatatgtatacaatg

SEQ ID NO: 379151 - DNA, 20 bp, Artificial
  CRISPR gRNA sequence
tgataaatcttaaaacttgg

SEQ ID NO: 379152 - DNA, 20 bp, Artificial
  CRISPR gRNA sequence
actttaggagaccgaggcag

SEQ ID NO: 379153 - DNA, 20 bp, Artificial
  CRISPR gRNA sequence
caggtggatccctcgaggtc

SEQ ID NO: 379154 - DNA, 20 bp, Artificial
  CRISPR gRNA sequence
tactcagggggctgaggcag

SEQ ID NO: 379155 - DNA, 20 bp, Artificial
  CRISPR gRNA sequence
tcgtgccactgcactccagc

SEQ ID NO: 379156 - DNA, 20 bp, Artificial
  CRISPR gRNA sequence
tttgtctttcaacagtgtgc

SEQ ID NO: 379157 - DNA, 20 bp, Artificial
  CRISPR gRNA sequence
gttgtattaccagctgtcat

SEQ ID NO: 379158 - DNA, 20 bp, Artificial
  CRISPR gRNA sequence
actggctgaagccatggcag

SEQ ID NO: 379159 - DNA, 20 bp, Artificial
  CRISPR gRNA sequence
tcccgtcatcttcgtaagct

SEQ ID NO: 379160 - DNA, 20 bp, Artificial
  CRISPR gRNA sequence
aaatctgggcaccttaagaa

SEQ ID NO: 379161 - DNA, 20 bp, Artificial
  CRISPR gRNA sequence
tatttctcttattatcgaaa

SEQ ID NO: 379162 - DNA, 20 bp, Artificial
  CRISPR gRNA sequence
aatgggtaagagaaatatcg

SEQ ID NO: 379163 - DNA, 20 bp, Artificial
  CRISPR gRNA sequence
gctgaattccttccccagta

SEQ ID NO: 379164 - DNA, 20 bp, Artificial
  CRISPR gRNA sequence
ataattcacagccctgggaa

SEQ ID NO: 379165 - DNA, 20 bp, Artificial
  CRISPR gRNA sequence
tctataatggcctctcagcg

SEQ ID NO: 379166 - DNA, 20 bp, Artificial
  CRISPR gRNA sequence
gccttatgcagttgcagata

SEQ ID NO: 379167 - DNA, 20 bp, Artificial
  CRISPR gRNA sequence
tgcagcacccccaggcttgc

SEQ ID NO: 379168 - DNA, 20 bp, Artificial
  CRISPR gRNA sequence
gattaggaaattccagcctg

SEQ ID NO: 379169 - DNA, 20 bp, Artificial
  CRISPR gRNA sequence
aaaatagaaaagaacctaca

SEQ ID NO: 379170 - DNA, 20 bp, Artificial
  CRISPR gRNA sequence
ggcaggttcccccgataaaa

SEQ ID NO: 379171 - DNA, 20 bp, Artificial
  CRISPR gRNA sequence
tttgcttttgtttcttgacc

SEQ ID NO: 379172 - DNA, 20 bp, Artificial
  CRISPR gRNA sequence
tcttgggagaagacatggtg

SEQ ID NO: 379173 - DNA, 20 bp, Artificial
  CRISPR gRNA sequence
ggagaagacatggtgaggaa

SEQ ID NO: 379174 - DNA, 20 bp, Artificial
  CRISPR gRNA sequence
cagcctaacgcttgatgtta

SEQ ID NO: 379175 - DNA, 20 bp, Artificial
  CRISPR gRNA sequence
atgttagagagtcaggacct

SEQ ID NO: 379176 - DNA, 20 bp, Artificial
  CRISPR gRNA sequence
actccacccccaccctaata

SEQ ID NO: 379177 - DNA, 20 bp, Artificial
  CRISPR gRNA sequence
ttctatcatgagccttttct

SEQ ID NO: 379178 - DNA, 20 bp, Artificial
  CRISPR gRNA sequence
attgccagaaacttagccta

SEQ ID NO: 379179 - DNA, 20 bp, Artificial
  CRISPR gRNA sequence
agcctagagggtcacaatcc

SEQ ID NO: 379180 - DNA, 20 bp, Artificial
  CRISPR gRNA sequence
ttcaagacacttctcctcct

SEQ ID NO: 379181 - DNA, 20 bp, Artificial
  CRISPR gRNA sequence
cctatgaatcaacacagcat

SEQ ID NO: 379182 - DNA, 20 bp, Artificial
  CRISPR gRNA sequence
tggaagctgcaggcaaggca

SEQ ID NO: 379183 - DNA, 20 bp, Artificial
  CRISPR gRNA sequence
cactctagattgaaatgtct

SEQ ID NO: 379184 - DNA, 20 bp, Artificial
  CRISPR gRNA sequence
tagattgaaatgtctctgga

SEQ ID NO: 379185 - DNA, 20 bp, Artificial
  CRISPR gRNA sequence
taaatcaggtattgtggtat

SEQ ID NO: 379186 - DNA, 20 bp, Artificial
  CRISPR gRNA sequence
agatctataggttttcatcc

SEQ ID NO: 379187 - DNA, 20 bp, Artificial
  CRISPR gRNA sequence
gaccaaggtaagactctaat

SEQ ID NO: 379188 - DNA, 20 bp, Artificial
  CRISPR gRNA sequence
ggtaagactctaatctgaat

SEQ ID NO: 379189 - DNA, 20 bp, Artificial
  CRISPR gRNA sequence
caaaagaccctcattccaga

SEQ ID NO: 379190 - DNA, 20 bp, Artificial
  CRISPR gRNA sequence
taaagtctggacaggacttg

SEQ ID NO: 379191 - DNA, 20 bp, Artificial
  CRISPR gRNA sequence
aagcctccataaaaatccaa

SEQ ID NO: 379192 - DNA, 20 bp, Artificial
  CRISPR gRNA sequence
tccataaaaatccaagagga

SEQ ID NO: 379193 - DNA, 20 bp, Artificial
  CRISPR gRNA sequence
atccaagaggatggggtttg

SEQ ID NO: 379194 - DNA, 20 bp, Artificial
  CRISPR gRNA sequence
tgaacatgtggagcctcctg

SEQ ID NO: 379195 - DNA, 20 bp, Artificial
  CRISPR gRNA sequence
agattaaccaaacctgaaaa

SEQ ID NO: 379196 - DNA, 20 bp, Artificial
  CRISPR gRNA sequence
actttgggaggccgaggagg

SEQ ID NO: 379197 - DNA, 20 bp, Artificial
  CRISPR gRNA sequence
agggcggatcaccttaggtg

SEQ ID NO: 379198 - DNA, 20 bp, Artificial
  CRISPR gRNA sequence
aaaattagctggacgtagtg

SEQ ID NO: 379199 - DNA, 20 bp, Artificial
  CRISPR gRNA sequence
tactcaggaggctgaggcag

SEQ ID NO: 379200 - DNA, 20 bp, Artificial
  CRISPR gRNA sequence
tcctgccattgtactccagc

SEQ ID NO: 379201 - DNA, 20 bp, Artificial
  CRISPR gRNA sequence
tgcaattggtgtctgaaggg

SEQ ID NO: 379202 - DNA, 20 bp, Artificial
  CRISPR gRNA sequence
gcagggttagcaatggagga

SEQ ID NO: 379203 - DNA, 20 bp, Artificial
  CRISPR gRNA sequence
gggactgagcccccagcctg

SEQ ID NO: 379204 - DNA, 20 bp, Artificial
  CRISPR gRNA sequence
tgtgggatctgatactgtcc

SEQ ID NO: 379205 - DNA, 20 bp, Artificial
  CRISPR gRNA sequence
tgtccttgggtagatcatgt

SEQ ID NO: 379206 - DNA, 20 bp, Artificial
  CRISPR gRNA sequence
ttgggtagatcatgtcagaa

SEQ ID NO: 379207 - DNA, 20 bp, Artificial
  CRISPR gRNA sequence
gcagagaaaaaacacaattg

SEQ ID NO: 379208 - DNA, 20 bp, Artificial
  CRISPR gRNA sequence
aaatactttgtgtttaaaga

SEQ ID NO: 379209 - DNA, 20 bp, Artificial
  CRISPR gRNA sequence
actttgtgtttaaagactga

SEQ ID NO: 379210 - DNA, 20 bp, Artificial
  CRISPR gRNA sequence
tttaaagactgagtgaataa

SEQ ID NO: 379211 - DNA, 20 bp, Artificial
  CRISPR gRNA sequence
gaggccaaacattactaaaa

SEQ ID NO: 379212 - DNA, 20 bp, Artificial
  CRISPR gRNA sequence
tgaaacaatgcatctgaaat

SEQ ID NO: 379213 - DNA, 20 bp, Artificial
  CRISPR gRNA sequence
aattaactgtcaaataaaga

SEQ ID NO: 379214 - DNA, 20 bp, Artificial
  CRISPR gRNA sequence
atccatgctgtcgcaaatgg

SEQ ID NO: 379215 - DNA, 20 bp, Artificial
  CRISPR gRNA sequence
agctctcacctcacacctat

SEQ ID NO: 379216 - DNA, 20 bp, Artificial
  CRISPR gRNA sequence
aagagatagcaagtgttggt

SEQ ID NO: 379217 - DNA, 20 bp, Artificial
  CRISPR gRNA sequence
aacccttgtacactgttggc

SEQ ID NO: 379218 - DNA, 20 bp, Artificial
  CRISPR gRNA sequence
cactgttggcgggaatgtaa

SEQ ID NO: 379219 - DNA, 20 bp, Artificial
  CRISPR gRNA sequence
actttgggaggccaaggcag

SEQ ID NO: 379220 - DNA, 20 bp, Artificial
  CRISPR gRNA sequence
cagatggatcacctgaggtc

SEQ ID NO: 379221 - DNA, 20 bp, Artificial
  CRISPR gRNA sequence
ttcgagaccagcctggccaa

SEQ ID NO: 379222 - DNA, 20 bp, Artificial
  CRISPR gRNA sequence
actaaaaatacaaaaattag

SEQ ID NO: 379223 - DNA, 20 bp, Artificial
  CRISPR gRNA sequence
ctacttggaggctgaggcag

SEQ ID NO: 379224 - DNA, 20 bp, Artificial
  CRISPR gRNA sequence
ttgtgccactgcactccagc

SEQ ID NO: 379225 - DNA, 20 bp, Artificial
  CRISPR gRNA sequence
tgcactccagcctgggtgac

SEQ ID NO: 379226 - DNA, 20 bp, Artificial
  CRISPR gRNA sequence
tcatatgaaccagcaatctg

SEQ ID NO: 379227 - DNA, 20 bp, Artificial
  CRISPR gRNA sequence
ttgtctacagtagtcaagat

SEQ ID NO: 379228 - DNA, 20 bp, Artificial
  CRISPR gRNA sequence
acctaggtgtccatcaacag

SEQ ID NO: 379229 - DNA, 20 bp, Artificial
  CRISPR gRNA sequence
ggaaatcatatcatgtgtga

SEQ ID NO: 379230 - DNA, 20 bp, Artificial
  CRISPR gRNA sequence
atcatatcatgtgtgacagg

SEQ ID NO: 379231 - DNA, 20 bp, Artificial
  CRISPR gRNA sequence
tgtatgacttcacttatttg

SEQ ID NO: 379232 - DNA, 20 bp, Artificial
  CRISPR gRNA sequence
ctttgcagtaaagtttgtga

SEQ ID NO: 379233 - DNA, 20 bp, Artificial
  CRISPR gRNA sequence
taaagtttgtgaaagaataa

SEQ ID NO: 379234 - DNA, 20 bp, Artificial
  CRISPR gRNA sequence
agaataagtgggtctatact

SEQ ID NO: 379235 - DNA, 20 bp, Artificial
  CRISPR gRNA sequence
gaaaaaaatgcagctacata

SEQ ID NO: 379236 - DNA, 20 bp, Artificial
  CRISPR gRNA sequence
tttctgaggaaaagatgggg

SEQ ID NO: 379237 - DNA, 20 bp, Artificial
  CRISPR gRNA sequence
tcatggttttcaggctgcaa

SEQ ID NO: 379238 - DNA, 20 bp, Artificial
  CRISPR gRNA sequence
gcaataggattccagacagc

SEQ ID NO: 379239 - DNA, 20 bp, Artificial
  CRISPR gRNA sequence
gcctggcatcatcctaatgg

SEQ ID NO: 379240 - DNA, 20 bp, Artificial
  CRISPR gRNA sequence
agagacagcaatgaagacca

SEQ ID NO: 379241 - DNA, 20 bp, Artificial
  CRISPR gRNA sequence
ttcccagcagcagatgttga

SEQ ID NO: 379242 - DNA, 20 bp, Artificial
  CRISPR gRNA sequence
aggcactcacaacatgctct

SEQ ID NO: 379243 - DNA, 20 bp, Artificial
  CRISPR gRNA sequence
acaacatgctctgtgggttg

SEQ ID NO: 379244 - DNA, 20 bp, Artificial
  CRISPR gRNA sequence
gagaggtgtgttgtgggcag

SEQ ID NO: 379245 - DNA, 20 bp, Artificial
  CRISPR gRNA sequence
aatcgcagttgattgttctt

SEQ ID NO: 379246 - DNA, 20 bp, Artificial
  CRISPR gRNA sequence
tcttgtgaatattgactcat

SEQ ID NO: 379247 - DNA, 20 bp, Artificial
  CRISPR gRNA sequence
gaagagacacatccacagta

SEQ ID NO: 379248 - DNA, 20 bp, Artificial
  CRISPR gRNA sequence
atccacagtaaggaatttgc

SEQ ID NO: 379249 - DNA, 20 bp, Artificial
  CRISPR gRNA sequence
aatttgctggagtcggtcag

SEQ ID NO: 379250 - DNA, 20 bp, Artificial
  CRISPR gRNA sequence
cagttgaattgtgaaagatt

SEQ ID NO: 379251 - DNA, 20 bp, Artificial
  CRISPR gRNA sequence
aattgtgaaagatttaggat

SEQ ID NO: 379252 - DNA, 20 bp, Artificial
  CRISPR gRNA sequence
ccatggtaaactttcagaca

SEQ ID NO: 379253 - DNA, 20 bp, Artificial
  CRISPR gRNA sequence
taaactttcagacattgagt

SEQ ID NO: 379254 - DNA, 20 bp, Artificial
  CRISPR gRNA sequence
ttttttgtatcattaccaaa

SEQ ID NO: 379255 - DNA, 20 bp, Artificial
  CRISPR gRNA sequence
taaattatacttataaacat

SEQ ID NO: 379256 - DNA, 20 bp, Artificial
  CRISPR gRNA sequence
gagttatattctgttgtatg

SEQ ID NO: 379257 - DNA, 20 bp, Artificial
  CRISPR gRNA sequence
ctattttatttatttttaca

SEQ ID NO: 379258 - DNA, 20 bp, Artificial
  CRISPR gRNA sequence
tctctctctgttgcccaggc

SEQ ID NO: 379259 - DNA, 20 bp, Artificial
  CRISPR gRNA sequence
ctcactgcaagctccgcctc

SEQ ID NO: 379260 - DNA, 20 bp, Artificial
  CRISPR gRNA sequence
gctccgcctctggggttcaa

SEQ ID NO: 379261 - DNA, 20 bp, Artificial
  CRISPR gRNA sequence
gagtctcgtgcctcagccta

SEQ ID NO: 379262 - DNA, 20 bp, Artificial
  CRISPR gRNA sequence
gcctcagcctaatgagtagc

SEQ ID NO: 379263 - DNA, 20 bp, Artificial
  CRISPR gRNA sequence
ataggcatgcaccaccacac

SEQ ID NO: 379264 - DNA, 20 bp, Artificial
  CRISPR gRNA sequence
ttttgtgtttttagtagaga

SEQ ID NO: 379265 - DNA, 20 bp, Artificial
  CRISPR gRNA sequence
gtatatgattggcagcttat

SEQ ID NO: 379266 - DNA, 20 bp, Artificial
  CRISPR gRNA sequence
aaaacaaataaaaatctatt

SEQ ID NO: 379267 - DNA, 20 bp, Artificial
  CRISPR gRNA sequence
aactcattctattttttttg

SEQ ID NO: 379268 - DNA, 20 bp, Artificial
  CRISPR gRNA sequence
ttactttttactgcctttgg

SEQ ID NO: 379269 - DNA, 20 bp, Artificial
  CRISPR gRNA sequence
attgtcattttccttaacag

SEQ ID NO: 379270 - DNA, 20 bp, Artificial
  CRISPR gRNA sequence
ggtgagtagtgcaacttatg

SEQ ID NO: 379271 - DNA, 20 bp, Artificial
  CRISPR gRNA sequence
gcattcacatatatattttt

SEQ ID NO: 379272 - DNA, 20 bp, Artificial
  CRISPR gRNA sequence
ggtaatgttacagggagagc

SEQ ID NO: 379273 - DNA, 20 bp, Artificial
  CRISPR gRNA sequence
agagctggaatagttcattt

SEQ ID NO: 379274 - DNA, 20 bp, Artificial
  CRISPR gRNA sequence
aaggaaaaagctgacagcga

SEQ ID NO: 379275 - DNA, 20 bp, Artificial
  CRISPR gRNA sequence
cgtgtatgacacagcgcgag

SEQ ID NO: 379276 - DNA, 20 bp, Artificial
  CRISPR gRNA sequence
gcttaaaattactgagaaga

SEQ ID NO: 379277 - DNA, 20 bp, Artificial
  CRISPR gRNA sequence
ttactgagaagaaggaattg

SEQ ID NO: 379278 - DNA, 20 bp, Artificial
  CRISPR gRNA sequence
tactcaggaggctgaggctg

SEQ ID NO: 379279 - DNA, 20 bp, Artificial
  CRISPR gRNA sequence
ggctgaggctggaggattgc

SEQ ID NO: 379280 - DNA, 20 bp, Artificial
  CRISPR gRNA sequence
ctggaggattgcttgagtcc

SEQ ID NO: 379281 - DNA, 20 bp, Artificial
  CRISPR gRNA sequence
gattgcttgagtccaagagt

SEQ ID NO: 379282 - DNA, 20 bp, Artificial
  CRISPR gRNA sequence
tactgtattgtagcacagtt

SEQ ID NO: 379283 - DNA, 20 bp, Artificial
  CRISPR gRNA sequence
tagcacagttgggaattttc

SEQ ID NO: 379284 - DNA, 20 bp, Artificial
  CRISPR gRNA sequence
attttctaggatattcttgg

SEQ ID NO: 379285 - DNA, 20 bp, Artificial
  CRISPR gRNA sequence
agatacttaatatatgtttg

SEQ ID NO: 379286 - DNA, 20 bp, Artificial
  CRISPR gRNA sequence
aatatatgtttgctgggtag

SEQ ID NO: 379287 - DNA, 20 bp, Artificial
  CRISPR gRNA sequence
acacacacaccccttgttaa

SEQ ID NO: 379288 - DNA, 20 bp, Artificial
  CRISPR gRNA sequence
ctctaacccatccagtttcc

SEQ ID NO: 379289 - DNA, 20 bp, Artificial
  CRISPR gRNA sequence
cctgggtcttcttctgaagg

SEQ ID NO: 379290 - DNA, 20 bp, Artificial
  CRISPR gRNA sequence
ggttatcttcccactcctac

SEQ ID NO: 379291 - DNA, 20 bp, Artificial
  CRISPR gRNA sequence
tttctactttatttaatctc

SEQ ID NO: 379292 - DNA, 20 bp, Artificial
  CRISPR gRNA sequence
atagacatgatgtcaccatc

SEQ ID NO: 379293 - DNA, 20 bp, Artificial
  CRISPR gRNA sequence
atcccttctattcataatgg

SEQ ID NO: 379294 - DNA, 20 bp, Artificial
  CRISPR gRNA sequence
agcactaatctgtccaaata

SEQ ID NO: 379295 - DNA, 20 bp, Artificial
  CRISPR gRNA sequence
gcaaatgtgactaagagaca

SEQ ID NO: 379296 - DNA, 20 bp, Artificial
  CRISPR gRNA sequence
cgagtggtgacaaacctcca

SEQ ID NO: 379297 - DNA, 20 bp, Artificial
  CRISPR gRNA sequence
gcattatgcattacttttac

SEQ ID NO: 379298 - DNA, 20 bp, Artificial
  CRISPR gRNA sequence
tgaatagctaaattgaacgg

SEQ ID NO: 379299 - DNA, 20 bp, Artificial
  CRISPR gRNA sequence
ataaaaggagattagtggac

SEQ ID NO: 379300 - DNA, 20 bp, Artificial
  CRISPR gRNA sequence
gtggacttgaatttgtaatc

SEQ ID NO: 379301 - DNA, 20 bp, Artificial
  CRISPR gRNA sequence
gcagcttcagatgtattgac

SEQ ID NO: 379302 - DNA, 20 bp, Artificial
  CRISPR gRNA sequence
gacagtgtccctgaacaaaa

SEQ ID NO: 379303 - DNA, 20 bp, Artificial
  CRISPR gRNA sequence
cctggtagcctgtgtgttgg

SEQ ID NO: 379304 - DNA, 20 bp, Artificial
  CRISPR gRNA sequence
ctgtaatcccagcactttgg

SEQ ID NO: 379305 - DNA, 20 bp, Artificial
  CRISPR gRNA sequence
cagcactttgggaggatgag

SEQ ID NO: 379306 - DNA, 20 bp, Artificial
  CRISPR gRNA sequence
actttgggaggatgaggtgg

SEQ ID NO: 379307 - DNA, 20 bp, Artificial
  CRISPR gRNA sequence
tgggtggatcatttgaggtc

SEQ ID NO: 379308 - DNA, 20 bp, Artificial
  CRISPR gRNA sequence
aaaattggctgggcgtggtg

SEQ ID NO: 379309 - DNA, 20 bp, Artificial
  CRISPR gRNA sequence
tactcaggaggctgagacag

SEQ ID NO: 379310 - DNA, 20 bp, Artificial
  CRISPR gRNA sequence
ttgcaccactgtactccagc

SEQ ID NO: 379311 - DNA, 20 bp, Artificial
  CRISPR gRNA sequence
ctgtactccagcctgggtaa

SEQ ID NO: 379312 - DNA, 20 bp, Artificial
  CRISPR gRNA sequence
tgtgttctatagatgtgcac

SEQ ID NO: 379313 - DNA, 20 bp, Artificial
  CRISPR gRNA sequence
ccttgtgaacactggcatta

SEQ ID NO: 379314 - DNA, 20 bp, Artificial
  CRISPR gRNA sequence
accttggttttcggggctct

SEQ ID NO: 379315 - DNA, 20 bp, Artificial
  CRISPR gRNA sequence
tggcattgaaaatctcttgg

SEQ ID NO: 379316 - DNA, 20 bp, Artificial
  CRISPR gRNA sequence
ggtgggcagatcatgaggtc

SEQ ID NO: 379317 - DNA, 20 bp, Artificial
  CRISPR gRNA sequence
tactcaggaggctgaggcag

SEQ ID NO: 379318 - DNA, 20 bp, Artificial
  CRISPR gRNA sequence
ttgcagcattgcatcccagc

SEQ ID NO: 379319 - DNA, 20 bp, Artificial
  CRISPR gRNA sequence
ctccttagtcccaggcaaac

SEQ ID NO: 379320 - DNA, 20 bp, Artificial
  CRISPR gRNA sequence
ttaacatttattttaagttc

SEQ ID NO: 379321 - DNA, 20 bp, Artificial
  CRISPR gRNA sequence
taagttcagggatacatgtg

SEQ ID NO: 379322 - DNA, 20 bp, Artificial
  CRISPR gRNA sequence
acataggcaaacatgtgtca

SEQ ID NO: 379323 - DNA, 20 bp, Artificial
  CRISPR gRNA sequence
atttggttttctgttcctgc

SEQ ID NO: 379324 - DNA, 20 bp, Artificial
  CRISPR gRNA sequence
tgttcctgcatgagtttgct

SEQ ID NO: 379325 - DNA, 20 bp, Artificial
  CRISPR gRNA sequence
ctttatccagtctatcattg

SEQ ID NO: 379326 - DNA, 20 bp, Artificial
  CRISPR gRNA sequence
gattccatgtctttgctatc

SEQ ID NO: 379327 - DNA, 20 bp, Artificial
  CRISPR gRNA sequence
tgcttgcatgtgtcttatag

SEQ ID NO: 379328 - DNA, 20 bp, Artificial
  CRISPR gRNA sequence
tatacccagtaatggcgctg

SEQ ID NO: 379329 - DNA, 20 bp, Artificial
  CRISPR gRNA sequence
tttctgtctgtaagtttttg

SEQ ID NO: 379330 - DNA, 20 bp, Artificial
  CRISPR gRNA sequence
ataactcagctagtaaattg

SEQ ID NO: 379331 - DNA, 20 bp, Artificial
  CRISPR gRNA sequence
cttttccttatctttaaaat

SEQ ID NO: 379332 - DNA, 20 bp, Artificial
  CRISPR gRNA sequence
tatatcatagatttattttg

SEQ ID NO: 379333 - DNA, 20 bp, Artificial
  CRISPR gRNA sequence
gtgtatagtaaatttacaca

SEQ ID NO: 379334 - DNA, 20 bp, Artificial
  CRISPR gRNA sequence
cacatagaataaacaaataa

SEQ ID NO: 379335 - DNA, 20 bp, Artificial
  CRISPR gRNA sequence
aataagaaaataaatgcaca

SEQ ID NO: 379336 - DNA, 20 bp, Artificial
  CRISPR gRNA sequence
agattatattgacatgatag

SEQ ID NO: 379337 - DNA, 20 bp, Artificial
  CRISPR gRNA sequence
aagcaactagaagagacaat

SEQ ID NO: 379338 - DNA, 20 bp, Artificial
  CRISPR gRNA sequence
tattttcaagatattcacaa

SEQ ID NO: 379339 - DNA, 20 bp, Artificial
  CRISPR gRNA sequence
gtatcttctgtatctaacag

SEQ ID NO: 379340 - DNA, 20 bp, Artificial
  CRISPR gRNA sequence
agaggagtctgttgttcaat

SEQ ID NO: 379341 - DNA, 20 bp, Artificial
  CRISPR gRNA sequence
cttttccttagggagataaa

SEQ ID NO: 379342 - DNA, 20 bp, Artificial
  CRISPR gRNA sequence
ataataactattttatatag

SEQ ID NO: 379343 - DNA, 20 bp, Artificial
  CRISPR gRNA sequence
attcccctggttaggttttt

SEQ ID NO: 379344 - DNA, 20 bp, Artificial
  CRISPR gRNA sequence
ttggaactgtggagcgttta

SEQ ID NO: 379345 - DNA, 20 bp, Artificial
  CRISPR gRNA sequence
aatagtcaagagggagggcg

SEQ ID NO: 379346 - DNA, 20 bp, Artificial
  CRISPR gRNA sequence
gatttaataaaataatccat

SEQ ID NO: 379347 - DNA, 20 bp, Artificial
  CRISPR gRNA sequence
aataatccatacgagtgatt

SEQ ID NO: 379348 - DNA, 20 bp, Artificial
  CRISPR gRNA sequence
agggaaaatgaaaaaaactg

SEQ ID NO: 379349 - DNA, 20 bp, Artificial
  CRISPR gRNA sequence
tgaaaaaaactgtagggtaa

SEQ ID NO: 379350 - DNA, 20 bp, Artificial
  CRISPR gRNA sequence
aactgtagggtaacagaatt

SEQ ID NO: 379351 - DNA, 20 bp, Artificial
  CRISPR gRNA sequence
ttagaaggtgcatgtgggct

SEQ ID NO: 379352 - DNA, 20 bp, Artificial
  CRISPR gRNA sequence
gctaggggtacagtgaggta

SEQ ID NO: 379353 - DNA, 20 bp, Artificial
  CRISPR gRNA sequence
cttcgaaataatattagtac

SEQ ID NO: 379354 - DNA, 20 bp, Artificial
  CRISPR gRNA sequence
tcatatctttatatccttta

SEQ ID NO: 379355 - DNA, 20 bp, Artificial
  CRISPR gRNA sequence
agagagaagagatctattta

SEQ ID NO: 379356 - DNA, 20 bp, Artificial
  CRISPR gRNA sequence
gagatctatttacagagtcc

SEQ ID NO: 379357 - DNA, 20 bp, Artificial
  CRISPR gRNA sequence
tttgaaactaagttttttat

SEQ ID NO: 379358 - DNA, 20 bp, Artificial
  CRISPR gRNA sequence
gctgtgacaaattaccaaaa

SEQ ID NO: 379359 - DNA, 20 bp, Artificial
  CRISPR gRNA sequence
tctattcttccataattctg

SEQ ID NO: 379360 - DNA, 20 bp, Artificial
  CRISPR gRNA sequence
cagaagtactggtttcttcg

SEQ ID NO: 379361 - DNA, 20 bp, Artificial
  CRISPR gRNA sequence
tactggtttcttcgtgggat

SEQ ID NO: 379362 - DNA, 20 bp, Artificial
  CRISPR gRNA sequence
gtttgagcttagctaattac

SEQ ID NO: 379363 - DNA, 20 bp, Artificial
  CRISPR gRNA sequence
tatgaggttctgaggaggac

SEQ ID NO: 379364 - DNA, 20 bp, Artificial
  CRISPR gRNA sequence
tttatttccttatgggctgc

SEQ ID NO: 379365 - DNA, 20 bp, Artificial
  CRISPR gRNA sequence
aaaagactagaaacttcctt

SEQ ID NO: 379366 - DNA, 20 bp, Artificial
  CRISPR gRNA sequence
cttctgggtttgcagataag

SEQ ID NO: 379367 - DNA, 20 bp, Artificial
  CRISPR gRNA sequence
atttcacaaaaaaagttgct

SEQ ID NO: 379368 - DNA, 20 bp, Artificial
  CRISPR gRNA sequence
atattaggaggtggagactt

SEQ ID NO: 379369 - DNA, 20 bp, Artificial
  CRISPR gRNA sequence
ttgggatgtaattagatcat

SEQ ID NO: 379370 - DNA, 20 bp, Artificial
  CRISPR gRNA sequence
atcatgagggtggcgtcttc

SEQ ID NO: 379371 - DNA, 20 bp, Artificial
  CRISPR gRNA sequence
gagggtggcgtcttcgtgaa

SEQ ID NO: 379372 - DNA, 20 bp, Artificial
  CRISPR gRNA sequence
ctttctgctctttgcaatgt

SEQ ID NO: 379373 - DNA, 20 bp, Artificial
  CRISPR gRNA sequence
tcccagcctccagaactgtg

SEQ ID NO: 379374 - DNA, 20 bp, Artificial
  CRISPR gRNA sequence
ttcattttaactattcgcag

SEQ ID NO: 379375 - DNA, 20 bp, Artificial
  CRISPR gRNA sequence
tttgtttgttggcaaaaaac

SEQ ID NO: 379376 - DNA, 20 bp, Artificial
  CRISPR gRNA sequence
ttgcttcttgatgccaactg

SEQ ID NO: 379377 - DNA, 20 bp, Artificial
  CRISPR gRNA sequence
tgctctgtcatacacaattt

SEQ ID NO: 379378 - DNA, 20 bp, Artificial
  CRISPR gRNA sequence
gtctagtcacatttattgtt

SEQ ID NO: 379379 - DNA, 20 bp, Artificial
  CRISPR gRNA sequence
catttattgttgtgaatttg

SEQ ID NO: 379380 - DNA, 20 bp, Artificial
  CRISPR gRNA sequence
ccaactttttcaggtttttg

SEQ ID NO: 379381 - DNA, 20 bp, Artificial
  CRISPR gRNA sequence
ttttgtagaataatattttg

SEQ ID NO: 379382 - DNA, 20 bp, Artificial
  CRISPR gRNA sequence
aatattttgaaggattatta

SEQ ID NO: 379383 - DNA, 20 bp, Artificial
  CRISPR gRNA sequence
tctataagtaatcatggcac

SEQ ID NO: 379384 - DNA, 20 bp, Artificial
  CRISPR gRNA sequence
actttgggaggctgaggtgg

SEQ ID NO: 379385 - DNA, 20 bp, Artificial
  CRISPR gRNA sequence
tgggcggatcgtctgaggtc

SEQ ID NO: 379386 - DNA, 20 bp, Artificial
  CRISPR gRNA sequence
agctactcgtgaggctgagg

SEQ ID NO: 379387 - DNA, 20 bp, Artificial
  CRISPR gRNA sequence
attgcttgaacctgggaggt

SEQ ID NO: 379388 - DNA, 20 bp, Artificial
  CRISPR gRNA sequence
ttaaagttcagacactgtgt

SEQ ID NO: 379389 - DNA, 20 bp, Artificial
  CRISPR gRNA sequence
aatagcttaacattgggaga

SEQ ID NO: 379390 - DNA, 20 bp, Artificial
  CRISPR gRNA sequence
atttctgttgcatctcagtc

SEQ ID NO: 379391 - DNA, 20 bp, Artificial
  CRISPR gRNA sequence
caacagaagttcaatacaat

SEQ ID NO: 379392 - DNA, 20 bp, Artificial
  CRISPR gRNA sequence
gcatttatgagaggtatgtt

SEQ ID NO: 379393 - DNA, 20 bp, Artificial
  CRISPR gRNA sequence
tcattagttgttgaaatgca

SEQ ID NO: 379394 - DNA, 20 bp, Artificial
  CRISPR gRNA sequence
gtcaacctaccaatcaatcc

SEQ ID NO: 379395 - DNA, 20 bp, Artificial
  CRISPR gRNA sequence
aatccatggatgatacaaga

SEQ ID NO: 379396 - DNA, 20 bp, Artificial
  CRISPR gRNA sequence
ttctctcgcagaccaaagac

SEQ ID NO: 379397 - DNA, 20 bp, Artificial
  CRISPR gRNA sequence
agtttaagcttattcttgac

SEQ ID NO: 379398 - DNA, 20 bp, Artificial
  CRISPR gRNA sequence
tgactcttatgtactcatgc

SEQ ID NO: 379399 - DNA, 20 bp, Artificial
  CRISPR gRNA sequence
ctaccttagatactagttgt

SEQ ID NO: 379400 - DNA, 20 bp, Artificial
  CRISPR gRNA sequence
ttagatactagttgtctgaa

SEQ ID NO: 379401 - DNA, 20 bp, Artificial
  CRISPR gRNA sequence
aaacttactgtatcatataa

SEQ ID NO: 379402 - DNA, 20 bp, Artificial
  CRISPR gRNA sequence
cagggcttaaatgttgtgtc

SEQ ID NO: 379403 - DNA, 20 bp, Artificial
  CRISPR gRNA sequence
gtatgggcataaactggctt

SEQ ID NO: 379404 - DNA, 20 bp, Artificial
  CRISPR gRNA sequence
ctggcttctgaatccctttc

SEQ ID NO: 379405 - DNA, 20 bp, Artificial
  CRISPR gRNA sequence
ctgaatccctttccagagtg

SEQ ID NO: 379406 - DNA, 20 bp, Artificial
  CRISPR gRNA sequence
atccttgtttctgtctggta

SEQ ID NO: 379407 - DNA, 20 bp, Artificial
  CRISPR gRNA sequence
aaataggcaacatgaccaga

SEQ ID NO: 379408 - DNA, 20 bp, Artificial
  CRISPR gRNA sequence
ggcaacatgaccagaaagga

SEQ ID NO: 379409 - DNA, 20 bp, Artificial
  CRISPR gRNA sequence
tggaatggcttaagtaaact

SEQ ID NO: 379410 - DNA, 20 bp, Artificial
  CRISPR gRNA sequence
tcacttctagagctgagaag

SEQ ID NO: 379411 - DNA, 20 bp, Artificial
  CRISPR gRNA sequence
gcatggttagaagaggaaag

SEQ ID NO: 379412 - DNA, 20 bp, Artificial
  CRISPR gRNA sequence
aaaggggagtctcaaagctg

SEQ ID NO: 379413 - DNA, 20 bp, Artificial
  CRISPR gRNA sequence
gttaactaaaaagtgaaata

SEQ ID NO: 379414 - DNA, 20 bp, Artificial
  CRISPR gRNA sequence
actaaaaagtgaaatatggg

SEQ ID NO: 379415 - DNA, 20 bp, Artificial
  CRISPR gRNA sequence
tatgggatggattctagaaa

SEQ ID NO: 379416 - DNA, 20 bp, Artificial
  CRISPR gRNA sequence
ggtatctctgtccatacttc

SEQ ID NO: 379417 - DNA, 20 bp, Artificial
  CRISPR gRNA sequence
actctatcagcatagtccag

SEQ ID NO: 379418 - DNA, 20 bp, Artificial
  CRISPR gRNA sequence
aatacctggcagtagaagaa

SEQ ID NO: 379419 - DNA, 20 bp, Artificial
  CRISPR gRNA sequence
tatttatctctcattctgta

SEQ ID NO: 379420 - DNA, 20 bp, Artificial
  CRISPR gRNA sequence
ggagcaaatgtagtagatag

SEQ ID NO: 379421 - DNA, 20 bp, Artificial
  CRISPR gRNA sequence
gacatattttgtctactttt

SEQ ID NO: 379422 - DNA, 20 bp, Artificial
  CRISPR gRNA sequence
taatatgtaaattctctcaa

SEQ ID NO: 379423 - DNA, 20 bp, Artificial
  CRISPR gRNA sequence
ttttaatgattatgtgaaag

SEQ ID NO: 379424 - DNA, 20 bp, Artificial
  CRISPR gRNA sequence
aaagtggtggcataggacgg

SEQ ID NO: 379425 - DNA, 20 bp, Artificial
  CRISPR gRNA sequence
ggagggaaaaaagaaattgg

SEQ ID NO: 379426 - DNA, 20 bp, Artificial
  CRISPR gRNA sequence
gggtacaggcaacaggagaa

SEQ ID NO: 379427 - DNA, 20 bp, Artificial
  CRISPR gRNA sequence
aatgaaaagtatttgccaaa

SEQ ID NO: 379428 - DNA, 20 bp, Artificial
  CRISPR gRNA sequence
ttacacttttaagctaatta

SEQ ID NO: 379429 - DNA, 20 bp, Artificial
  CRISPR gRNA sequence
ccaaataatgcacttgtttt

SEQ ID NO: 379430 - DNA, 20 bp, Artificial
  CRISPR gRNA sequence
tggtaagtgcccacatttct

SEQ ID NO: 379431 - DNA, 20 bp, Artificial
  CRISPR gRNA sequence
ttctgtgaattataaaattt

SEQ ID NO: 379432 - DNA, 20 bp, Artificial
  CRISPR gRNA sequence
agtttcttttaacccttttc

SEQ ID NO: 379433 - DNA, 20 bp, Artificial
  CRISPR gRNA sequence
tgtgcttaagtatatgcaag

SEQ ID NO: 379434 - DNA, 20 bp, Artificial
  CRISPR gRNA sequence
gcttaaagatctttttatac

SEQ ID NO: 379435 - DNA, 20 bp, Artificial
  CRISPR gRNA sequence
tcagatcaatcaaagattct

SEQ ID NO: 379436 - DNA, 20 bp, Artificial
  CRISPR gRNA sequence
atcaatcaaagattctgtga

SEQ ID NO: 379437 - DNA, 20 bp, Artificial
  CRISPR gRNA sequence
aaaggtaaataatttctttt

SEQ ID NO: 379438 - DNA, 20 bp, Artificial
  CRISPR gRNA sequence
tttaagagagaaaattatga

SEQ ID NO: 379439 - DNA, 20 bp, Artificial
  CRISPR gRNA sequence
ctctatatattcttcctcta

SEQ ID NO: 379440 - DNA, 20 bp, Artificial
  CRISPR gRNA sequence
tattcttcctctacagagtg

SEQ ID NO: 379441 - DNA, 20 bp, Artificial
  CRISPR gRNA sequence
acagagtgtagggttttttc

SEQ ID NO: 379442 - DNA, 20 bp, Artificial
  CRISPR gRNA sequence
gatgctcctgttataccctc

SEQ ID NO: 379443 - DNA, 20 bp, Artificial
  CRISPR gRNA sequence
gcagatgaaaaacagatcca

SEQ ID NO: 379444 - DNA, 20 bp, Artificial
  CRISPR gRNA sequence
agatccacagaataaacgat

SEQ ID NO: 379445 - DNA, 20 bp, Artificial
  CRISPR gRNA sequence
tacacatataatttatatcg

SEQ ID NO: 379446 - DNA, 20 bp, Artificial
  CRISPR gRNA sequence
atatcgatggataatacatt

SEQ ID NO: 379447 - DNA, 20 bp, Artificial
  CRISPR gRNA sequence
attaagaatctatgcttcct

SEQ ID NO: 379448 - DNA, 20 bp, Artificial
  CRISPR gRNA sequence
aagataggaagacttgttaa

SEQ ID NO: 379449 - DNA, 20 bp, Artificial
  CRISPR gRNA sequence
tatatataaacttaaaatac

SEQ ID NO: 379450 - DNA, 20 bp, Artificial
  CRISPR gRNA sequence
aatacttttagtaggcattc

SEQ ID NO: 379451 - DNA, 20 bp, Artificial
  CRISPR gRNA sequence
ccaagttatattggtttgta

SEQ ID NO: 379452 - DNA, 20 bp, Artificial
  CRISPR gRNA sequence
acagtagttttctaaattga

SEQ ID NO: 379453 - DNA, 20 bp, Artificial
  CRISPR gRNA sequence
gtaagtggagacgctaaatt

SEQ ID NO: 379454 - DNA, 20 bp, Artificial
  CRISPR gRNA sequence
tttttcactgatctgttcat

SEQ ID NO: 379455 - DNA, 20 bp, Artificial
  CRISPR gRNA sequence
ataggtagaaaaatagcttc

SEQ ID NO: 379456 - DNA, 20 bp, Artificial
  CRISPR gRNA sequence
gaaaaggtccatttggaagt

SEQ ID NO: 379457 - DNA, 20 bp, Artificial
  CRISPR gRNA sequence
aagtatgagtaataaatgtc

SEQ ID NO: 379458 - DNA, 20 bp, Artificial
  CRISPR gRNA sequence
ttatttcgtattatccttgt

SEQ ID NO: 379459 - DNA, 20 bp, Artificial
  CRISPR gRNA sequence
tctagtgttagtgtgtactt

SEQ ID NO: 379460 - DNA, 20 bp, Artificial
  CRISPR gRNA sequence
ttttggatttttggttcttg

SEQ ID NO: 379461 - DNA, 20 bp, Artificial
  CRISPR gRNA sequence
ttgtcttgtattctgttgtt

SEQ ID NO: 379462 - DNA, 20 bp, Artificial
  CRISPR gRNA sequence
cttgtattctgttgttttga

SEQ ID NO: 379463 - DNA, 20 bp, Artificial
  CRISPR gRNA sequence
atagcagggaaaaatttcta

SEQ ID NO: 379464 - DNA, 20 bp, Artificial
  CRISPR gRNA sequence
ctacagaataaaattaactg

SEQ ID NO: 379465 - DNA, 20 bp, Artificial
  CRISPR gRNA sequence
ttattattatttttttgaga

SEQ ID NO: 379466 - DNA, 20 bp, Artificial
  CRISPR gRNA sequence
ttcacttttgttgcccgggc

SEQ ID NO: 379467 - DNA, 20 bp, Artificial
  CRISPR gRNA sequence
ctcaccacaacctctgcctc

SEQ ID NO: 379468 - DNA, 20 bp, Artificial
  CRISPR gRNA sequence
gattctcctgcctcagcctc

SEQ ID NO: 379469 - DNA, 20 bp, Artificial
  CRISPR gRNA sequence
gcctcagcctcctgaatagc

SEQ ID NO: 379470 - DNA, 20 bp, Artificial
  CRISPR gRNA sequence
ttttgtatttttagtggaga

SEQ ID NO: 379471 - DNA, 20 bp, Artificial
  CRISPR gRNA sequence
gcctcagcctcctaaattgc

SEQ ID NO: 379472 - DNA, 20 bp, Artificial
  CRISPR gRNA sequence
ttataagtgcatgtagtgca

SEQ ID NO: 379473 - DNA, 20 bp, Artificial
  CRISPR gRNA sequence
ttttatttatgttcactttt

SEQ ID NO: 379474 - DNA, 20 bp, Artificial
  CRISPR gRNA sequence
aagcaaaatcatttttacca

SEQ ID NO: 379475 - DNA, 20 bp, Artificial
  CRISPR gRNA sequence
tgagaagagtattttatgtg

SEQ ID NO: 379476 - DNA, 20 bp, Artificial
  CRISPR gRNA sequence
tgaggaagggcaagggacta

SEQ ID NO: 379477 - DNA, 20 bp, Artificial
  CRISPR gRNA sequence
gaggcagaggttgtggtgag

SEQ ID NO: 379478 - DNA, 20 bp, Artificial
  CRISPR gRNA sequence
agataaaaattacaatgtat

SEQ ID NO: 379479 - DNA, 20 bp, Artificial
  CRISPR gRNA sequence
aaagtagtgatcgtgaaaca

SEQ ID NO: 379480 - DNA, 20 bp, Artificial
  CRISPR gRNA sequence
aaatatgtgtaaaccgacct

SEQ ID NO: 379481 - DNA, 20 bp, Artificial
  CRISPR gRNA sequence
tattgaatcactagaaatag

SEQ ID NO: 379482 - DNA, 20 bp, Artificial
  CRISPR gRNA sequence
agaagcttttaaaaaaatta

SEQ ID NO: 379483 - DNA, 20 bp, Artificial
  CRISPR gRNA sequence
tttaaaaaaattaacttgtt

SEQ ID NO: 379484 - DNA, 20 bp, Artificial
  CRISPR gRNA sequence
cttgtttttagttttcagat

SEQ ID NO: 379485 - DNA, 20 bp, Artificial
  CRISPR gRNA sequence
tagtagctaaactaatgatg

SEQ ID NO: 379486 - DNA, 20 bp, Artificial
  CRISPR gRNA sequence
aaattgataacccatgtatt

SEQ ID NO: 379487 - DNA, 20 bp, Artificial
  CRISPR gRNA sequence
gaattacttaaaacataaat

SEQ ID NO: 379488 - DNA, 20 bp, Artificial
  CRISPR gRNA sequence
ctacctgcctcccattttaa

SEQ ID NO: 379489 - DNA, 20 bp, Artificial
  CRISPR gRNA sequence
tatacctaaagttctttaaa

SEQ ID NO: 379490 - DNA, 20 bp, Artificial
  CRISPR gRNA sequence
ttaatggcattcaaaggaag

SEQ ID NO: 379491 - DNA, 20 bp, Artificial
  CRISPR gRNA sequence
tatgtaaaacttaagaagca

SEQ ID NO: 379492 - DNA, 20 bp, Artificial
  CRISPR gRNA sequence
atagaatttactggaattct

SEQ ID NO: 379493 - DNA, 20 bp, Artificial
  CRISPR gRNA sequence
tctgatcgtttattctgtgg

SEQ ID NO: 379494 - DNA, 20 bp, Artificial
  CRISPR gRNA sequence
attctgtggatctgtttttc

SEQ ID NO: 379495 - DNA, 20 bp, Artificial
  CRISPR gRNA sequence
tgttaaaaagatgacaatga

SEQ ID NO: 379496 - DNA, 20 bp, Artificial
  CRISPR gRNA sequence
agacaagttccaaatgttct

SEQ ID NO: 379497 - DNA, 20 bp, Artificial
  CRISPR gRNA sequence
tggaggctttgcaatactgc

SEQ ID NO: 379498 - DNA, 20 bp, Artificial
  CRISPR gRNA sequence
tcataattttctctcttaaa

SEQ ID NO: 379499 - DNA, 20 bp, Artificial
  CRISPR gRNA sequence
tccccatactacaactgtaa

SEQ ID NO: 379500 - DNA, 20 bp, Artificial
  CRISPR gRNA sequence
atcattgagaatttggttat

SEQ ID NO: 379501 - DNA, 20 bp, Artificial
  CRISPR gRNA sequence
gagttttccagaaagtaata

SEQ ID NO: 379502 - DNA, 20 bp, Artificial
  CRISPR gRNA sequence
tatttaccttttaattgatg

SEQ ID NO: 379503 - DNA, 20 bp, Artificial
  CRISPR gRNA sequence
taccttttaattgatgctaa

SEQ ID NO: 379504 - DNA, 20 bp, Artificial
  CRISPR gRNA sequence
aataaattcactcacagaat

SEQ ID NO: 379505 - DNA, 20 bp, Artificial
  CRISPR gRNA sequence
ctttgattgatctgatagta

SEQ ID NO: 379506 - DNA, 20 bp, Artificial
  CRISPR gRNA sequence
gctttcttgtaaactgcctt

SEQ ID NO: 379507 - DNA, 20 bp, Artificial
  CRISPR gRNA sequence
taagcaaacataataaaaat

SEQ ID NO: 379508 - DNA, 20 bp, Artificial
  CRISPR gRNA sequence
cttaagcacaaccaggaaat

SEQ ID NO: 379509 - DNA, 20 bp, Artificial
  CRISPR gRNA sequence
agtgcattatttggcataca

SEQ ID NO: 379510 - DNA, 20 bp, Artificial
  CRISPR gRNA sequence
aaatcataaaatactcacta

SEQ ID NO: 379511 - DNA, 20 bp, Artificial
  CRISPR gRNA sequence
ctgtctaggcaacaggagaa

SEQ ID NO: 379512 - DNA, 20 bp, Artificial
  CRISPR gRNA sequence
taggcaacaggagaatttgg

SEQ ID NO: 379513 - DNA, 20 bp, Artificial
  CRISPR gRNA sequence
agaatttggatttgctttat

SEQ ID NO: 379514 - DNA, 20 bp, Artificial
  CRISPR gRNA sequence
tgtcctttcaaggtaaccat

SEQ ID NO: 379515 - DNA, 20 bp, Artificial
  CRISPR gRNA sequence
aggtaaccatgacagtttta

SEQ ID NO: 379516 - DNA, 20 bp, Artificial
  CRISPR gRNA sequence
caatattaggtatggtctct

SEQ ID NO: 379517 - DNA, 20 bp, Artificial
  CRISPR gRNA sequence
ctttgtctgaatagtgaagc

SEQ ID NO: 379518 - DNA, 20 bp, Artificial
  CRISPR gRNA sequence
agtttccctttgtatttttc

SEQ ID NO: 379519 - DNA, 20 bp, Artificial
  CRISPR gRNA sequence
tccctttgtatttttctgtg

SEQ ID NO: 379520 - DNA, 20 bp, Artificial
  CRISPR gRNA sequence
taaataaatatgagaatagt

SEQ ID NO: 379521 - DNA, 20 bp, Artificial
  CRISPR gRNA sequence
cttctggactatgctgatag

SEQ ID NO: 379522 - DNA, 20 bp, Artificial
  CRISPR gRNA sequence
caatatttgttggtaaactc

SEQ ID NO: 379523 - DNA, 20 bp, Artificial
  CRISPR gRNA sequence
atgctctgaattgcccagta

SEQ ID NO: 379524 - DNA, 20 bp, Artificial
  CRISPR gRNA sequence
tgcccagtattgtgctttga

SEQ ID NO: 379525 - DNA, 20 bp, Artificial
  CRISPR gRNA sequence
ctcagctctagaagtgaacc

SEQ ID NO: 379526 - DNA, 20 bp, Artificial
  CRISPR gRNA sequence
aacaatgaaaaaataatcaa

SEQ ID NO: 379527 - DNA, 20 bp, Artificial
  CRISPR gRNA sequence
aatggatccaacactctgga

SEQ ID NO: 379528 - DNA, 20 bp, Artificial
  CRISPR gRNA sequence
ctctggaaagggattcagaa

SEQ ID NO: 379529 - DNA, 20 bp, Artificial
  CRISPR gRNA sequence
cctggtaaatagcccttgcc

SEQ ID NO: 379530 - DNA, 20 bp, Artificial
  CRISPR gRNA sequence
tcattctgttatatgataca

SEQ ID NO: 379531 - DNA, 20 bp, Artificial
  CRISPR gRNA sequence
tgtatataaaccagttagag

SEQ ID NO: 379532 - DNA, 20 bp, Artificial
  CRISPR gRNA sequence
ttctgaaacagttctatgaa

SEQ ID NO: 379533 - DNA, 20 bp, Artificial
  CRISPR gRNA sequence
ctaatgcactcatgtcaaga

SEQ ID NO: 379534 - DNA, 20 bp, Artificial
  CRISPR gRNA sequence
atatcctctcttgtatcatc

SEQ ID NO: 379535 - DNA, 20 bp, Artificial
  CRISPR gRNA sequence
cctctcttgtatcatccatg

SEQ ID NO: 379536 - DNA, 20 bp, Artificial
  CRISPR gRNA sequence
aaatgcaggcatgatatggg

SEQ ID NO: 379537 - DNA, 20 bp, Artificial
  CRISPR gRNA sequence
gagatgcaacagaaatctag

SEQ ID NO: 379538 - DNA, 20 bp, Artificial
  CRISPR gRNA sequence
gctgtattgtgctatgaatt

SEQ ID NO: 379539 - DNA, 20 bp, Artificial
  CRISPR gRNA sequence
tttgatgagtaatttaaaaa

SEQ ID NO: 379540 - DNA, 20 bp, Artificial
  CRISPR gRNA sequence
tttagattgaccttagtgtt

SEQ ID NO: 379541 - DNA, 20 bp, Artificial
  CRISPR gRNA sequence
tgcctcagcctcacgagtag

SEQ ID NO: 379542 - DNA, 20 bp, Artificial
  CRISPR gRNA sequence
ttttgtatttttagtagaga

SEQ ID NO: 379543 - DNA, 20 bp, Artificial
  CRISPR gRNA sequence
cacctcagcctcccaaagtg

SEQ ID NO: 379544 - DNA, 20 bp, Artificial
  CRISPR gRNA sequence
caccatgaccagccagatgt

SEQ ID NO: 379545 - DNA, 20 bp, Artificial
  CRISPR gRNA sequence
gcaaaatgaaaattcaagtg

SEQ ID NO: 379546 - DNA, 20 bp, Artificial
  CRISPR gRNA sequence
aagtggctgatgaaataaag

SEQ ID NO: 379547 - DNA, 20 bp, Artificial
  CRISPR gRNA sequence
tgatgaaataaagcaaggtt

SEQ ID NO: 379548 - DNA, 20 bp, Artificial
  CRISPR gRNA sequence
agttggcatcaagaagcaat

SEQ ID NO: 379549 - DNA, 20 bp, Artificial
  CRISPR gRNA sequence
aaggcatctgatgaacacat

SEQ ID NO: 379550 - DNA, 20 bp, Artificial
  CRISPR gRNA sequence
ttgtcagaacctttttagta

SEQ ID NO: 379551 - DNA, 20 bp, Artificial
  CRISPR gRNA sequence
ggaattggggaattttttgt

SEQ ID NO: 379552 - DNA, 20 bp, Artificial
  CRISPR gRNA sequence
taacaaaatactgtagactg

SEQ ID NO: 379553 - DNA, 20 bp, Artificial
  CRISPR gRNA sequence
agttctggaggctgggaagt

SEQ ID NO: 379554 - DNA, 20 bp, Artificial
  CRISPR gRNA sequence
agtccagtgagggcctgcgg

SEQ ID NO: 379555 - DNA, 20 bp, Artificial
  CRISPR gRNA sequence
gagggcctgcgggcctgttt

SEQ ID NO: 379556 - DNA, 20 bp, Artificial
  CRISPR gRNA sequence
taatatcatcgcattaggca

SEQ ID NO: 379557 - DNA, 20 bp, Artificial
  CRISPR gRNA sequence
aggatgctatgcattaaagg

SEQ ID NO: 379558 - DNA, 20 bp, Artificial
  CRISPR gRNA sequence
tcttatctgcaaacccagaa

SEQ ID NO: 379559 - DNA, 20 bp, Artificial
  CRISPR gRNA sequence
gaatatcattacgttcttct

SEQ ID NO: 379560 - DNA, 20 bp, Artificial
  CRISPR gRNA sequence
tacgttcttctatgtgcttg

SEQ ID NO: 379561 - DNA, 20 bp, Artificial
  CRISPR gRNA sequence
gagaacagtgatgagagggg

SEQ ID NO: 379562 - DNA, 20 bp, Artificial
  CRISPR gRNA sequence
gaagctggatagaagcatgg

SEQ ID NO: 379563 - DNA, 20 bp, Artificial
  CRISPR gRNA sequence
gaagaaaccagtacttctga

SEQ ID NO: 379564 - DNA, 20 bp, Artificial
  CRISPR gRNA sequence
accctccagaattatggaag

SEQ ID NO: 379565 - DNA, 20 bp, Artificial
  CRISPR gRNA sequence
attatggaagaatagatttc

SEQ ID NO: 379566 - DNA, 20 bp, Artificial
  CRISPR gRNA sequence
atttctgttgttttaagcca

SEQ ID NO: 379567 - DNA, 20 bp, Artificial
  CRISPR gRNA sequence
cagcagccctagaaaaggaa

SEQ ID NO: 379568 - DNA, 20 bp, Artificial
  CRISPR gRNA sequence
aagatttagggaaggcatag

SEQ ID NO: 379569 - DNA, 20 bp, Artificial
  CRISPR gRNA sequence
atttatattcatataaaaaa

SEQ ID NO: 379570 - DNA, 20 bp, Artificial
  CRISPR gRNA sequence
tactgaaaggacaataaaat

SEQ ID NO: 379571 - DNA, 20 bp, Artificial
  CRISPR gRNA sequence
tgcaccttctaatatgttga

SEQ ID NO: 379572 - DNA, 20 bp, Artificial
  CRISPR gRNA sequence
tatccaaaattctgttaccc

SEQ ID NO: 379573 - DNA, 20 bp, Artificial
  CRISPR gRNA sequence
tgtgcattagtaattaatct

SEQ ID NO: 379574 - DNA, 20 bp, Artificial
  CRISPR gRNA sequence
atctcagtgattttactaaa

SEQ ID NO: 379575 - DNA, 20 bp, Artificial
  CRISPR gRNA sequence
gacttattacataaatgact

SEQ ID NO: 379576 - DNA, 20 bp, Artificial
  CRISPR gRNA sequence
cttcttggatgacaatataa

SEQ ID NO: 379577 - DNA, 20 bp, Artificial
  CRISPR gRNA sequence
gtgttattctaaatcactcg

SEQ ID NO: 379578 - DNA, 20 bp, Artificial
  CRISPR gRNA sequence
ttattttattaaatcactta

SEQ ID NO: 379579 - DNA, 20 bp, Artificial
  CRISPR gRNA sequence
cacttatgtagattatttta

SEQ ID NO: 379580 - DNA, 20 bp, Artificial
  CRISPR gRNA sequence
tttattaagatttcatataa

SEQ ID NO: 379581 - DNA, 20 bp, Artificial
  CRISPR gRNA sequence
ctctttttatctccctaagg

SEQ ID NO: 379582 - DNA, 20 bp, Artificial
  CRISPR gRNA sequence
atacagaagatacagaaatg

SEQ ID NO: 379583 - DNA, 20 bp, Artificial
  CRISPR gRNA sequence
tgactccaattgtctcttct

SEQ ID NO: 379584 - DNA, 20 bp, Artificial
  CRISPR gRNA sequence
ttttgaccaattattcattt

SEQ ID NO: 379585 - DNA, 20 bp, Artificial
  CRISPR gRNA sequence
tatacacaaggcatatggct

SEQ ID NO: 379586 - DNA, 20 bp, Artificial
  CRISPR gRNA sequence
ttttattaaattgtggttca

SEQ ID NO: 379587 - DNA, 20 bp, Artificial
  CRISPR gRNA sequence
ggaacttagagtcaaatgat

SEQ ID NO: 379588 - DNA, 20 bp, Artificial
  CRISPR gRNA sequence
aggcattgtggaagacagtg

SEQ ID NO: 379589 - DNA, 20 bp, Artificial
  CRISPR gRNA sequence
ggaaaaataactattgggta

SEQ ID NO: 379590 - DNA, 20 bp, Artificial
  CRISPR gRNA sequence
tatacaacaaaccccatgac

SEQ ID NO: 379591 - DNA, 20 bp, Artificial
  CRISPR gRNA sequence
aagagagtaaacatatcaca

SEQ ID NO: 379592 - DNA, 20 bp, Artificial
  CRISPR gRNA sequence
gatttacgttgaccagccat

SEQ ID NO: 379593 - DNA, 20 bp, Artificial
  CRISPR gRNA sequence
ttctggtttgcctgggacta

SEQ ID NO: 379594 - DNA, 20 bp, Artificial
  CRISPR gRNA sequence
actaaggagtttcccaggat

SEQ ID NO: 379595 - DNA, 20 bp, Artificial
  CRISPR gRNA sequence
aacctccgcctcccgggttc

SEQ ID NO: 379596 - DNA, 20 bp, Artificial
  CRISPR gRNA sequence
tgcctcagcctcctgagtag

SEQ ID NO: 379597 - DNA, 20 bp, Artificial
  CRISPR gRNA sequence
ttttttatttttagtagaga

SEQ ID NO: 379598 - DNA, 20 bp, Artificial
  CRISPR gRNA sequence
cacctcggcctcccaaagtg

SEQ ID NO: 379599 - DNA, 20 bp, Artificial
  CRISPR gRNA sequence
gtgagccatcgcacccagcc

SEQ ID NO: 379600 - DNA, 20 bp, Artificial
  CRISPR gRNA sequence
tcaggtgcacatctatagaa

SEQ ID NO: 379601 - DNA, 20 bp, Artificial
  CRISPR gRNA sequence
aacctccatctcccgggttc

SEQ ID NO: 379602 - DNA, 20 bp, Artificial
  CRISPR gRNA sequence
caccacgcccagccaatttt

SEQ ID NO: 379603 - DNA, 20 bp, Artificial
  CRISPR gRNA sequence
ttttgcagttttagtagaga

SEQ ID NO: 379604 - DNA, 20 bp, Artificial
  CRISPR gRNA sequence
cacctcatcctcccaaagtg

SEQ ID NO: 379605 - DNA, 20 bp, Artificial
  CRISPR gRNA sequence
tttcacacttgccaatgtga

SEQ ID NO: 379606 - DNA, 20 bp, Artificial
  CRISPR gRNA sequence
caggcactgagtgtgaagta

SEQ ID NO: 379607 - DNA, 20 bp, Artificial
  CRISPR gRNA sequence
cagttttgttcagggacact

SEQ ID NO: 379608 - DNA, 20 bp, Artificial
  CRISPR gRNA sequence
agggacactgtctgatttat

SEQ ID NO: 379609 - DNA, 20 bp, Artificial
  CRISPR gRNA sequence
aagtcaatacatctgaagct

SEQ ID NO: 379610 - DNA, 20 bp, Artificial
  CRISPR gRNA sequence
agtgacgaggcagaaggaac

SEQ ID NO: 379611 - DNA, 20 bp, Artificial
  CRISPR gRNA sequence
ttttcccttgtggtgtgcat

SEQ ID NO: 379612 - DNA, 20 bp, Artificial
  CRISPR gRNA sequence
tccaacatctgtgaccctgt

SEQ ID NO: 379613 - DNA, 20 bp, Artificial
  CRISPR gRNA sequence
ctctgccatctctgccccca

SEQ ID NO: 379614 - DNA, 20 bp, Artificial
  CRISPR gRNA sequence
aaaggtgaaatgacctgacc

SEQ ID NO: 379615 - DNA, 20 bp, Artificial
  CRISPR gRNA sequence
gaaatgacctgacctcctgt

SEQ ID NO: 379616 - DNA, 20 bp, Artificial
  CRISPR gRNA sequence
ctgttttagtttaattagac

SEQ ID NO: 379617 - DNA, 20 bp, Artificial
  CRISPR gRNA sequence
tattgagcattcattatttg

SEQ ID NO: 379618 - DNA, 20 bp, Artificial
  CRISPR gRNA sequence
agaagggatggcaagcatga

SEQ ID NO: 379619 - DNA, 20 bp, Artificial
  CRISPR gRNA sequence
aggagtagcagagacgtaca

SEQ ID NO: 379620 - DNA, 20 bp, Artificial
  CRISPR gRNA sequence
acagagctcacagaggggac

SEQ ID NO: 379621 - DNA, 20 bp, Artificial
  CRISPR gRNA sequence
ccagatggggagagcaatgg

SEQ ID NO: 379622 - DNA, 20 bp, Artificial
  CRISPR gRNA sequence
ggggagagcaatgggtgtgc

SEQ ID NO: 379623 - DNA, 20 bp, Artificial
  CRISPR gRNA sequence
cacaaaatttatcaacatcc

SEQ ID NO: 379624 - DNA, 20 bp, Artificial
  CRISPR gRNA sequence
gtagaaagtatgaataaaaa

SEQ ID NO: 379625 - DNA, 20 bp, Artificial
  CRISPR gRNA sequence
cagggttaatgacagggtta

SEQ ID NO: 379626 - DNA, 20 bp, Artificial
  CRISPR gRNA sequence
taaggaataatttcaacctg

SEQ ID NO: 379627 - DNA, 20 bp, Artificial
  CRISPR gRNA sequence
aactgtgctacaatacagta

SEQ ID NO: 379628 - DNA, 20 bp, Artificial
  CRISPR gRNA sequence
tatcactgtgaccagccaat

SEQ ID NO: 379629 - DNA, 20 bp, Artificial
  CRISPR gRNA sequence
cttctcagtaattttaagca

SEQ ID NO: 379630 - DNA, 20 bp, Artificial
  CRISPR gRNA sequence
tatacaactatttgaaatta

SEQ ID NO: 379631 - DNA, 20 bp, Artificial
  CRISPR gRNA sequence
caactatttgaaattatgct

SEQ ID NO: 379632 - DNA, 20 bp, Artificial
  CRISPR gRNA sequence
tgctgtttgcttattgggat

SEQ ID NO: 379633 - DNA, 20 bp, Artificial
  CRISPR gRNA sequence
tatttgatgaatgaataaat

SEQ ID NO: 379634 - DNA, 20 bp, Artificial
  CRISPR gRNA sequence
acacacaccaccccctcgct

SEQ ID NO: 379635 - DNA, 20 bp, Artificial
  CRISPR gRNA sequence
gaatataaaaggggcagacc

SEQ ID NO: 379636 - DNA, 20 bp, Artificial
  CRISPR gRNA sequence
aatatatatgtgaatgctga

SEQ ID NO: 379637 - DNA, 20 bp, Artificial
  CRISPR gRNA sequence
gagaacctctaacatggtga

SEQ ID NO: 379638 - DNA, 20 bp, Artificial
  CRISPR gRNA sequence
acaaagagggtatattggtt

SEQ ID NO: 379639 - DNA, 20 bp, Artificial
  CRISPR gRNA sequence
cctaaatatttctaactcct

SEQ ID NO: 379640 - DNA, 20 bp, Artificial
  CRISPR gRNA sequence
ctaactcctaatagattttt

SEQ ID NO: 379641 - DNA, 20 bp, Artificial
  CRISPR gRNA sequence
ctaatagatttttatttgtt

SEQ ID NO: 379642 - DNA, 20 bp, Artificial
  CRISPR gRNA sequence
ttatttgttttttgattaag

SEQ ID NO: 379643 - DNA, 20 bp, Artificial
  CRISPR gRNA sequence
aaaaaaaaaatataaagagc

SEQ ID NO: 379644 - DNA, 20 bp, Artificial
  CRISPR gRNA sequence
tggctcaggcctgtaatcac

SEQ ID NO: 379645 - DNA, 20 bp, Artificial
  CRISPR gRNA sequence
actcatttgaaccccagagg

SEQ ID NO: 379646 - DNA, 20 bp, Artificial
  CRISPR gRNA sequence
taaataaaatagtaaataaa

SEQ ID NO: 379647 - DNA, 20 bp, Artificial
  CRISPR gRNA sequence
catacaacagaatataactc

SEQ ID NO: 379648 - DNA, 20 bp, Artificial
  CRISPR gRNA sequence
gttactccaactcaatgtct

SEQ ID NO: 379649 - DNA, 20 bp, Artificial
  CRISPR gRNA sequence
atattcacaagaacaatcaa

SEQ ID NO: 379650 - DNA, 20 bp, Artificial
  CRISPR gRNA sequence
atttcccttcctcctgaaat

SEQ ID NO: 379651 - DNA, 20 bp, Artificial
  CRISPR gRNA sequence
tcctcctgaaatcaaagctt

SEQ ID NO: 379652 - DNA, 20 bp, Artificial
  CRISPR gRNA sequence
taagcaaacattttattttt

SEQ ID NO: 379653 - DNA, 20 bp, Artificial
  CRISPR gRNA sequence
ttatttttaaacgttttaga

SEQ ID NO: 379654 - DNA, 20 bp, Artificial
  CRISPR gRNA sequence
caaaattttttctttttgtg

SEQ ID NO: 379655 - DNA, 20 bp, Artificial
  CRISPR gRNA sequence
ttcacttttcataatgtcct

SEQ ID NO: 379656 - DNA, 20 bp, Artificial
  CRISPR gRNA sequence
tatccaccctgtcacacatg

SEQ ID NO: 379657 - DNA, 20 bp, Artificial
  CRISPR gRNA sequence
ttcctttgtatataataccc

SEQ ID NO: 379658 - DNA, 20 bp, Artificial
  CRISPR gRNA sequence
atcagattgctggttcatat

SEQ ID NO: 379659 - DNA, 20 bp, Artificial
  CRISPR gRNA sequence
attttattttatttttggga

SEQ ID NO: 379660 - DNA, 20 bp, Artificial
  CRISPR gRNA sequence
ctgcctcagcctccaagtag

SEQ ID NO: 379661 - DNA, 20 bp, Artificial
  CRISPR gRNA sequence
ttttgtatttttagtagaga

SEQ ID NO: 379662 - DNA, 20 bp, Artificial
  CRISPR gRNA sequence
tgccttggcctcccaaagtg

SEQ ID NO: 379663 - DNA, 20 bp, Artificial
  CRISPR gRNA sequence
ggtgtgaggtgagagctcac

SEQ ID NO: 379664 - DNA, 20 bp, Artificial
  CRISPR gRNA sequence
gaggtgagagctcactgggg

SEQ ID NO: 379665 - DNA, 20 bp, Artificial
  CRISPR gRNA sequence
cctgatgaccagtaatgttg

SEQ ID NO: 379666 - DNA, 20 bp, Artificial
  CRISPR gRNA sequence
tatgtcttctttggaaagat

SEQ ID NO: 379667 - DNA, 20 bp, Artificial
  CRISPR gRNA sequence
atacatgagttaattaattg

SEQ ID NO: 379668 - DNA, 20 bp, Artificial
  CRISPR gRNA sequence
taattgtggtgattactaca

SEQ ID NO: 379669 - DNA, 20 bp, Artificial
  CRISPR gRNA sequence
tttaaaaaaaaatttaaagc

SEQ ID NO: 379670 - DNA, 20 bp, Artificial
  CRISPR gRNA sequence
atttaaagcaattgttttct

SEQ ID NO: 379671 - DNA, 20 bp, Artificial
  CRISPR gRNA sequence
taccaaaaaaataaagatct

SEQ ID NO: 379672 - DNA, 20 bp, Artificial
  CRISPR gRNA sequence
atagaatacttaacaattaa

SEQ ID NO: 379673 - DNA, 20 bp, Artificial
  CRISPR gRNA sequence
tatatgaatttaacagtata

SEQ ID NO: 379674 - DNA, 20 bp, Artificial
  CRISPR gRNA sequence
ataaatccaaatttcagatg

SEQ ID NO: 379675 - DNA, 20 bp, Artificial
  CRISPR gRNA sequence
aaatatgttacctatttgta

SEQ ID NO: 379676 - DNA, 20 bp, Artificial
  CRISPR gRNA sequence
tatttgtaacccgtttttag

SEQ ID NO: 379677 - DNA, 20 bp, Artificial
  CRISPR gRNA sequence
agacaaagtggtaggtaaaa

SEQ ID NO: 379678 - DNA, 20 bp, Artificial
  CRISPR gRNA sequence
gtagaaaaaaaactctccaa

SEQ ID NO: 379679 - DNA, 20 bp, Artificial
  CRISPR gRNA sequence
cttctgtgaccaaaggtgtg

SEQ ID NO: 379680 - DNA, 20 bp, Artificial
  CRISPR gRNA sequence
aatctccgcctcccaggttc

SEQ ID NO: 379681 - DNA, 20 bp, Artificial
  CRISPR gRNA sequence
tgcctcagcctcctgagtag

SEQ ID NO: 379682 - DNA, 20 bp, Artificial
  CRISPR gRNA sequence
ttttgtatttttagtagaga

SEQ ID NO: 379683 - DNA, 20 bp, Artificial
  CRISPR gRNA sequence
ctcctcggcctcccaaagtg

SEQ ID NO: 379684 - DNA, 20 bp, Artificial
  CRISPR gRNA sequence
gggttcccaagacccctttt

SEQ ID NO: 379685 - DNA, 20 bp, Artificial
  CRISPR gRNA sequence
gagctcaagaaaacacattt

SEQ ID NO: 379686 - DNA, 20 bp, Artificial
  CRISPR gRNA sequence
tattgcaagggatacagatg

SEQ ID NO: 379687 - DNA, 20 bp, Artificial
  CRISPR gRNA sequence
aactctccaaaccccatcct

SEQ ID NO: 379688 - DNA, 20 bp, Artificial
  CRISPR gRNA sequence
ccatcctcttggatttttat

SEQ ID NO: 379689 - DNA, 20 bp, Artificial
  CRISPR gRNA sequence
tgagggtcttttgacccaca

SEQ ID NO: 379690 - DNA, 20 bp, Artificial
  CRISPR gRNA sequence
aggagaaggtcagagagaac

SEQ ID NO: 379691 - DNA, 20 bp, Artificial
  CRISPR gRNA sequence
gcatatcctaataccacaat

SEQ ID NO: 379692 - DNA, 20 bp, Artificial
  CRISPR gRNA sequence
acctgatttagtggaacata

SEQ ID NO: 379693 - DNA, 20 bp, Artificial
  CRISPR gRNA sequence
atttaaaaatagttagggaa

SEQ ID NO: 379694 - DNA, 20 bp, Artificial
  CRISPR gRNA sequence
aaataaagcatggagtcagg

SEQ ID NO: 379695 - DNA, 20 bp, Artificial
  CRISPR gRNA sequence
gtggcccagcctgtagctga

SEQ ID NO: 379696 - DNA, 20 bp, Artificial
  CRISPR gRNA sequence
agtccattccctgccttgcc

SEQ ID NO: 379697 - DNA, 20 bp, Artificial
  CRISPR gRNA sequence
tgaatgaccactggcctata

SEQ ID NO: 379698 - DNA, 20 bp, Artificial
  CRISPR gRNA sequence
aaggaaaagcaaatgggtac

SEQ ID NO: 379699 - DNA, 20 bp, Artificial
  CRISPR gRNA sequence
ttaatcaacagttcataaca

SEQ ID NO: 379700 - DNA, 20 bp, Artificial
  CRISPR gRNA sequence
agttcataacatttagtttt

SEQ ID NO: 379701 - DNA, 20 bp, Artificial
  CRISPR gRNA sequence
tttaagttttgctaatagat

SEQ ID NO: 379702 - DNA, 20 bp, Artificial
  CRISPR gRNA sequence
ccttttctttaaaaaagaag

SEQ ID NO: 379703 - DNA, 20 bp, Artificial
  CRISPR gRNA sequence
tcacttatatcccaatgctg

SEQ ID NO: 379704 - DNA, 20 bp, Artificial
  CRISPR gRNA sequence
atataaaagaataatttact

SEQ ID NO: 379705 - DNA, 20 bp, Artificial
  CRISPR gRNA sequence
caggattgtgaccctctagg

SEQ ID NO: 379706 - DNA, 20 bp, Artificial
  CRISPR gRNA sequence
caagagtggccattaatgtc

SEQ ID NO: 379707 - DNA, 20 bp, Artificial
  CRISPR gRNA sequence
gaccacctcacacctttttg

SEQ ID NO: 379708 - DNA, 20 bp, Artificial
  CRISPR gRNA sequence
caaaaagatgaaagaaaaca

SEQ ID NO: 379709 - DNA, 20 bp, Artificial
  CRISPR gRNA sequence
cctcctgagccgtaaaacca

SEQ ID NO: 379710 - DNA, 20 bp, Artificial
  CRISPR gRNA sequence
gggtgtgggtcacagagatc

SEQ ID NO: 379711 - DNA, 20 bp, Artificial
  CRISPR gRNA sequence
ggtgaaattaaaattgctaa

SEQ ID NO: 379712 - DNA, 20 bp, Artificial
  CRISPR gRNA sequence
gggtgctgcaggaggccagg

SEQ ID NO: 379713 - DNA, 20 bp, Artificial
  CRISPR gRNA sequence
gttatcctgttcttaaggtg

SEQ ID NO: 379714 - DNA, 20 bp, Artificial
  CRISPR gRNA sequence
atttcatattgttcaaacat

SEQ ID NO: 379715 - DNA, 20 bp, Artificial
  CRISPR gRNA sequence
gtcctgaggtgacatacatc

SEQ ID NO: 379716 - DNA, 20 bp, Artificial
  CRISPR gRNA sequence
atcctcagcttacgaagatg

SEQ ID NO: 379717 - DNA, 20 bp, Artificial
  CRISPR gRNA sequence
cttacgaagatgacgggatt

SEQ ID NO: 379718 - DNA, 20 bp, Artificial
  CRISPR gRNA sequence
cacaatttaaattcttctgc

SEQ ID NO: 379719 - DNA, 20 bp, Artificial
  CRISPR gRNA sequence
ttcccacagcaccatttccc

SEQ ID NO: 379720 - DNA, 20 bp, Artificial
  CRISPR gRNA sequence
gccactgaagaagaaccaag

SEQ ID NO: 379721 - DNA, 20 bp, Artificial
  CRISPR gRNA sequence
aattgtacgtgagatggcac

SEQ ID NO: 379722 - DNA, 20 bp, Artificial
  CRISPR gRNA sequence
accactatctggacagtcga

SEQ ID NO: 379723 - DNA, 20 bp, Artificial
  CRISPR gRNA sequence
tcgaacatgttttattggga

SEQ ID NO: 379724 - DNA, 20 bp, Artificial
  CRISPR gRNA sequence
attgggaatatgttttttct

SEQ ID NO: 379725 - DNA, 20 bp, Artificial
  CRISPR gRNA sequence
agtaataaatatgtgagaac

SEQ ID NO: 379726 - DNA, 20 bp, Artificial
  CRISPR gRNA sequence
atacacgaggggaataagtc

SEQ ID NO: 379727 - DNA, 20 bp, Artificial
  CRISPR gRNA sequence
tttttttttttgagacagag

SEQ ID NO: 379728 - DNA, 20 bp, Artificial
  CRISPR gRNA sequence
aacctccgcctcctgggttc

SEQ ID NO: 379729 - DNA, 20 bp, Artificial
  CRISPR gRNA sequence
tttttatattttagtagaga

SEQ ID NO: 379730 - DNA, 20 bp, Artificial
  CRISPR gRNA sequence
gcgtgagccacagcacccag

SEQ ID NO: 379731 - DNA, 20 bp, Artificial
  CRISPR gRNA sequence
ccacagcacccagccaagtt

SEQ ID NO: 379732 - DNA, 20 bp, Artificial
  CRISPR gRNA sequence
atgaagtggtggatatgtta

SEQ ID NO: 379733 - DNA, 20 bp, Artificial
  CRISPR gRNA sequence
agtggtggatatgttaattg

SEQ ID NO: 379734 - DNA, 20 bp, Artificial
  CRISPR gRNA sequence
ctaaaataaaattaactttt

SEQ ID NO: 379735 - DNA, 20 bp, Artificial
  CRISPR gRNA sequence
aaataaactgaaatattaga

SEQ ID NO: 379736 - DNA, 20 bp, Artificial
  CRISPR gRNA sequence
agagcagatgtgggtgagct

SEQ ID NO: 379737 - DNA, 20 bp, Artificial
  CRISPR gRNA sequence
ttctgcattatcaggtcata

SEQ ID NO: 379738 - DNA, 20 bp, Artificial
  CRISPR gRNA sequence
acctttgtcccactttagac

SEQ ID NO: 379739 - DNA, 20 bp, Artificial
  CRISPR gRNA sequence
aagacttcacataggacact

SEQ ID NO: 379740 - DNA, 20 bp, Artificial
  CRISPR gRNA sequence
ataggacacttaatgtttta

SEQ ID NO: 379741 - DNA, 20 bp, Artificial
  CRISPR gRNA sequence
aattaaccacaagggtagct

SEQ ID NO: 379742 - DNA, 20 bp, Artificial
  CRISPR gRNA sequence
atttaaatcaagcatgcaga

SEQ ID NO: 379743 - DNA, 20 bp, Artificial
  CRISPR gRNA sequence
gtttcaacattttaagcgcc

SEQ ID NO: 379744 - DNA, 20 bp, Artificial
  CRISPR gRNA sequence
aaatgagggttaatcagata

SEQ ID NO: 379745 - DNA, 20 bp, Artificial
  CRISPR gRNA sequence
aagtagtcgtgtacagcaga

SEQ ID NO: 379746 - DNA, 20 bp, Artificial
  CRISPR gRNA sequence
attggtatggtaatattatt

SEQ ID NO: 379747 - DNA, 20 bp, Artificial
  CRISPR gRNA sequence
aactttctttgtccagataa

SEQ ID NO: 379748 - DNA, 20 bp, Artificial
  CRISPR gRNA sequence
tctgtatttcagaaaccttt

SEQ ID NO: 379749 - DNA, 20 bp, Artificial
  CRISPR gRNA sequence
ttttcagagaattaaagggc

SEQ ID NO: 379750 - DNA, 20 bp, Artificial
  CRISPR gRNA sequence
tcctcaaaataaaagtatta

SEQ ID NO: 379751 - DNA, 20 bp, Artificial
  CRISPR gRNA sequence
agagcaaaccagtgagggaa

SEQ ID NO: 379752 - DNA, 20 bp, Artificial
  CRISPR gRNA sequence
tgttgaaaatacttgtccca

SEQ ID NO: 379753 - DNA, 20 bp, Artificial
  CRISPR gRNA sequence
ccaaatagtttaaacacttt

SEQ ID NO: 379754 - DNA, 20 bp, Artificial
  CRISPR gRNA sequence
ttgagaaacatataccctaa

SEQ ID NO: 379755 - DNA, 20 bp, Artificial
  CRISPR gRNA sequence
taccctaagatagcttgtgt

SEQ ID NO: 379756 - DNA, 20 bp, Artificial
  CRISPR gRNA sequence
tgtgggccataagttctcca

SEQ ID NO: 379757 - DNA, 20 bp, Artificial
  CRISPR gRNA sequence
attatttaaagagactatat

SEQ ID NO: 379758 - DNA, 20 bp, Artificial
  CRISPR gRNA sequence
tgcagaaaagagttcatgta

SEQ ID NO: 379759 - DNA, 20 bp, Artificial
  CRISPR gRNA sequence
aaaagagttcatgtagcagg

SEQ ID NO: 379760 - DNA, 20 bp, Artificial
  CRISPR gRNA sequence
gcccagctaacattttttta

SEQ ID NO: 379761 - DNA, 20 bp, Artificial
  CRISPR gRNA sequence
tgaaatggcctcccaaagca

SEQ ID NO: 379762 - DNA, 20 bp, Artificial
  CRISPR gRNA sequence
gagccaccacgcctggctcc

SEQ ID NO: 379763 - DNA, 20 bp, Artificial
  CRISPR gRNA sequence
ctgagtcaaagcctagccaa

SEQ ID NO: 379764 - DNA, 20 bp, Artificial
  CRISPR gRNA sequence
caaagcctagccaagactgt

SEQ ID NO: 379765 - DNA, 20 bp, Artificial
  CRISPR gRNA sequence
cctagccaagactgtttctg

SEQ ID NO: 379766 - DNA, 20 bp, Artificial
  CRISPR gRNA sequence
tttctgtttagctttatttc

SEQ ID NO: 379767 - DNA, 20 bp, Artificial
  CRISPR gRNA sequence
tgttcatgtctgtagacatg

SEQ ID NO: 379768 - DNA, 20 bp, Artificial
  CRISPR gRNA sequence
tgaagtagatgcaacaagtt

SEQ ID NO: 379769 - DNA, 20 bp, Artificial
  CRISPR gRNA sequence
cataaagtgtctcttgggaa

SEQ ID NO: 379770 - DNA, 20 bp, Artificial
  CRISPR gRNA sequence
tttaactttaactttaaaac

SEQ ID NO: 379771 - DNA, 20 bp, Artificial
  CRISPR gRNA sequence
aggaaaacaaacgaggtagg

SEQ ID NO: 379772 - DNA, 20 bp, Artificial
  CRISPR gRNA sequence
tggcacaaggtaatttaaag

SEQ ID NO: 379773 - DNA, 20 bp, Artificial
  CRISPR gRNA sequence
tttaaagcggggattaacca

SEQ ID NO: 379774 - DNA, 20 bp, Artificial
  CRISPR gRNA sequence
ggatggttatatctattgtc

SEQ ID NO: 379775 - DNA, 20 bp, Artificial
  CRISPR gRNA sequence
taaggcaaagaaacatgcta

SEQ ID NO: 379776 - DNA, 20 bp, Artificial
  CRISPR gRNA sequence
aaacttggtacataaaagga

SEQ ID NO: 379777 - DNA, 20 bp, Artificial
  CRISPR gRNA sequence
aggcctattgtatatgcaaa

SEQ ID NO: 379778 - DNA, 20 bp, Artificial
  CRISPR gRNA sequence
gggtgccccctccccaggat

SEQ ID NO: 379779 - DNA, 20 bp, Artificial
  CRISPR gRNA sequence
tgggatttgctggaaggaca

SEQ ID NO: 379780 - DNA, 20 bp, Artificial
  CRISPR gRNA sequence
gcctgtacccacgtcacagc

SEQ ID NO: 379781 - DNA, 20 bp, Artificial
  CRISPR gRNA sequence
tgatgtccctgaagaaaagc

SEQ ID NO: 379782 - DNA, 20 bp, Artificial
  CRISPR gRNA sequence
tggagccttgtggaatatca

SEQ ID NO: 379783 - DNA, 20 bp, Artificial
  CRISPR gRNA sequence
ctgctgagccccagtctgcc

SEQ ID NO: 379784 - DNA, 20 bp, Artificial
  CRISPR gRNA sequence
aacggccagataagtctttt

SEQ ID NO: 379785 - DNA, 20 bp, Artificial
  CRISPR gRNA sequence
cctcctgtcataaagatgtg

SEQ ID NO: 379786 - DNA, 20 bp, Artificial
  CRISPR gRNA sequence
ctgtcataaagatgtgagaa

SEQ ID NO: 379787 - DNA, 20 bp, Artificial
  CRISPR gRNA sequence
ctacttggctgtatgagaga

SEQ ID NO: 379788 - DNA, 20 bp, Artificial
  CRISPR gRNA sequence
tgcctgtgacatgcattaca

SEQ ID NO: 379789 - DNA, 20 bp, Artificial
  CRISPR gRNA sequence
acatgcattacattctgatt

SEQ ID NO: 379790 - DNA, 20 bp, Artificial
  CRISPR gRNA sequence
cttattcaataacaaaatta

SEQ ID NO: 379791 - DNA, 20 bp, Artificial
  CRISPR gRNA sequence
tttgttttctacctttgtgg

SEQ ID NO: 379792 - DNA, 20 bp, Artificial
  CRISPR gRNA sequence
gagcagttttctgggtaggg

SEQ ID NO: 379793 - DNA, 20 bp, Artificial
  CRISPR gRNA sequence
ttttctgggtagggaggaga

SEQ ID NO: 379794 - DNA, 20 bp, Artificial
  CRISPR gRNA sequence
cggcacacttttattattac

SEQ ID NO: 379795 - DNA, 20 bp, Artificial
  CRISPR gRNA sequence
tctacattacagtgctacca

SEQ ID NO: 379796 - DNA, 20 bp, Artificial
  CRISPR gRNA sequence
tgagagaacataagtgttca

SEQ ID NO: 379797 - DNA, 20 bp, Artificial
  CRISPR gRNA sequence
ttttaatatggaaaataaac

SEQ ID NO: 379798 - DNA, 20 bp, Artificial
  CRISPR gRNA sequence
ataaacttttgtttttggaa

SEQ ID NO: 379799 - DNA, 20 bp, Artificial
  CRISPR gRNA sequence
taaggaaggagggactagta

SEQ ID NO: 379800 - DNA, 20 bp, Artificial
  CRISPR gRNA sequence
agtattctgattactccagc

SEQ ID NO: 379801 - DNA, 20 bp, Artificial
  CRISPR gRNA sequence
ctgggcacaagagcaagaga

SEQ ID NO: 379802 - DNA, 20 bp, Artificial
  CRISPR gRNA sequence
ctcagaaggaggaaggaagg

SEQ ID NO: 379803 - DNA, 20 bp, Artificial
  CRISPR gRNA sequence
gggcgtgcttgggaactttt

SEQ ID NO: 379804 - DNA, 20 bp, Artificial
  CRISPR gRNA sequence
tctggtgaggccatgagaac

SEQ ID NO: 379805 - DNA, 20 bp, Artificial
  CRISPR gRNA sequence
ttcccctaatctgttcctgg

SEQ ID NO: 379806 - DNA, 20 bp, Artificial
  CRISPR gRNA sequence
tccaggccttcacacctgct

SEQ ID NO: 379807 - DNA, 20 bp, Artificial
  CRISPR gRNA sequence
cgctctgtagctccaccgtc

SEQ ID NO: 379808 - DNA, 20 bp, Artificial
  CRISPR gRNA sequence
gtgatgagtctcctgatgag

SEQ ID NO: 379809 - DNA, 20 bp, Artificial
  CRISPR gRNA sequence
cacacatagaaacatggtat

SEQ ID NO: 379810 - DNA, 20 bp, Artificial
  CRISPR gRNA sequence
cctgaggtcaggacttcgag

SEQ ID NO: 379811 - DNA, 20 bp, Artificial
  CRISPR gRNA sequence
tggcaggtgcctgtaatccc

SEQ ID NO: 379812 - DNA, 20 bp, Artificial
  CRISPR gRNA sequence
ttgggaggctgaggcagaag

SEQ ID NO: 379813 - DNA, 20 bp, Artificial
  CRISPR gRNA sequence
ctaggaataatttcaaaatc

SEQ ID NO: 379814 - DNA, 20 bp, Artificial
  CRISPR gRNA sequence
aaatctgctgctttatgctc

SEQ ID NO: 379815 - DNA, 20 bp, Artificial
  CRISPR gRNA sequence
caataatttaaaaatgaatt

SEQ ID NO: 379816 - DNA, 20 bp, Artificial
  CRISPR gRNA sequence
atttaaaaatgaattatatg

SEQ ID NO: 379817 - DNA, 20 bp, Artificial
  CRISPR gRNA sequence
gtcaatataaaagcaaaatg

SEQ ID NO: 379818 - DNA, 20 bp, Artificial
  CRISPR gRNA sequence
tataaaagcaaaatgacttg

SEQ ID NO: 379819 - DNA, 20 bp, Artificial
  CRISPR gRNA sequence
acttgtttggattaaaatat

SEQ ID NO: 379820 - DNA, 20 bp, Artificial
  CRISPR gRNA sequence
cacaatcgtgtgtatttgtt

SEQ ID NO: 379821 - DNA, 20 bp, Artificial
  CRISPR gRNA sequence
cgtgtccatcatcatcacaa

SEQ ID NO: 379822 - DNA, 20 bp, Artificial
  CRISPR gRNA sequence
catcacaataaggttttttt

SEQ ID NO: 379823 - DNA, 20 bp, Artificial
  CRISPR gRNA sequence
ttaaaatgccactcatatct

SEQ ID NO: 379824 - DNA, 20 bp, Artificial
  CRISPR gRNA sequence
atgaattttagagtgctcaa

SEQ ID NO: 379825 - DNA, 20 bp, Artificial
  CRISPR gRNA sequence
tgaatcattttagtataaat

SEQ ID NO: 379826 - DNA, 20 bp, Artificial
  CRISPR gRNA sequence
tatacttctacttatgacag

SEQ ID NO: 379827 - DNA, 20 bp, Artificial
  CRISPR gRNA sequence
tttatcaggatccatgtcaa

SEQ ID NO: 379828 - DNA, 20 bp, Artificial
  CRISPR gRNA sequence
agatgaagttcaaagtaatc

SEQ ID NO: 379829 - DNA, 20 bp, Artificial
  CRISPR gRNA sequence
tacattttaagtaattttct

SEQ ID NO: 379830 - DNA, 20 bp, Artificial
  CRISPR gRNA sequence
tctttgatcaatcatttatg

SEQ ID NO: 379831 - DNA, 20 bp, Artificial
  CRISPR gRNA sequence
tcaagctgttaacaattccc

SEQ ID NO: 379832 - DNA, 20 bp, Artificial
  CRISPR gRNA sequence
gaacagcagttcctaggatc

SEQ ID NO: 379833 - DNA, 20 bp, Artificial
  CRISPR gRNA sequence
tttctaattctacaaacttg

SEQ ID NO: 379834 - DNA, 20 bp, Artificial
  CRISPR gRNA sequence
tatagtggtgttctgttaga

SEQ ID NO: 379835 - DNA, 20 bp, Artificial
  CRISPR gRNA sequence
aaattcagcatgtaaccttt

SEQ ID NO: 379836 - DNA, 20 bp, Artificial
  CRISPR gRNA sequence
aatgactgcaggcaaacatt

SEQ ID NO: 379837 - DNA, 20 bp, Artificial
  CRISPR gRNA sequence
aaaaatgaatagatcaatac

SEQ ID NO: 379838 - DNA, 20 bp, Artificial
  CRISPR gRNA sequence
gggcagaggcaacagtaaag

SEQ ID NO: 379839 - DNA, 20 bp, Artificial
  CRISPR gRNA sequence
aagattcaaccacataatag

SEQ ID NO: 379840 - DNA, 20 bp, Artificial
  CRISPR gRNA sequence
ctcacttgtgatgctggaaa

SEQ ID NO: 379841 - DNA, 20 bp, Artificial
  CRISPR gRNA sequence
aactatgtttcatctggata

SEQ ID NO: 379842 - DNA, 20 bp, Artificial
  CRISPR gRNA sequence
tgggctgaaaattgtggttg

SEQ ID NO: 379843 - DNA, 20 bp, Artificial
  CRISPR gRNA sequence
tctgtttgagtagaggttat

SEQ ID NO: 379844 - DNA, 20 bp, Artificial
  CRISPR gRNA sequence
gtgagcagtgacacggtgct

SEQ ID NO: 379845 - DNA, 20 bp, Artificial
  CRISPR gRNA sequence
ttcagacaatcctcatgtcc

SEQ ID NO: 379846 - DNA, 20 bp, Artificial
  CRISPR gRNA sequence
ataggagtgggacagaaggt

SEQ ID NO: 379847 - DNA, 20 bp, Artificial
  CRISPR gRNA sequence
aatggactgggagcaaactg

SEQ ID NO: 379848 - DNA, 20 bp, Artificial
  CRISPR gRNA sequence
ctcccacaagccatctacag

SEQ ID NO: 379849 - DNA, 20 bp, Artificial
  CRISPR gRNA sequence
cgtcccagaggaaatatctg

SEQ ID NO: 379850 - DNA, 20 bp, Artificial
  CRISPR gRNA sequence
agattctcttagctgtggca

SEQ ID NO: 379851 - DNA, 20 bp, Artificial
  CRISPR gRNA sequence
ggcactatgatttcctagtg

SEQ ID NO: 379852 - DNA, 20 bp, Artificial
  CRISPR gRNA sequence
atatgtaaacaagagttcat

SEQ ID NO: 379853 - DNA, 20 bp, Artificial
  CRISPR gRNA sequence
tgtagttgatcttttgaaag

SEQ ID NO: 379854 - DNA, 20 bp, Artificial
  CRISPR gRNA sequence
ttactgggcatattctgaaa

SEQ ID NO: 379855 - DNA, 20 bp, Artificial
  CRISPR gRNA sequence
ctcaattaatttctgataac

SEQ ID NO: 379856 - DNA, 20 bp, Artificial
  CRISPR gRNA sequence
gcactttaggaggctgaggc

SEQ ID NO: 379857 - DNA, 20 bp, Artificial
  CRISPR gRNA sequence
tttaggaggctgaggcaggg

SEQ ID NO: 379858 - DNA, 20 bp, Artificial
  CRISPR gRNA sequence
ggtagcaattttcagactat

SEQ ID NO: 379859 - DNA, 20 bp, Artificial
  CRISPR gRNA sequence
ataaaagtttgagaaatcca

SEQ ID NO: 379860 - DNA, 20 bp, Artificial
  CRISPR gRNA sequence
taatatttcaatgatgggga

SEQ ID NO: 379861 - DNA, 20 bp, Artificial
  CRISPR gRNA sequence
aggagaaagtaggaaagtgt

SEQ ID NO: 379862 - DNA, 20 bp, Artificial
  CRISPR gRNA sequence
gaggcagtggaaagcacaaa

SEQ ID NO: 379863 - DNA, 20 bp, Artificial
  CRISPR gRNA sequence
catcactgatcccaggacca

SEQ ID NO: 379864 - DNA, 20 bp, Artificial
  CRISPR gRNA sequence
tctaggaattaatgccaatc

SEQ ID NO: 379865 - DNA, 20 bp, Artificial
  CRISPR gRNA sequence
cattatcatgtgtaatcaat

SEQ ID NO: 379866 - DNA, 20 bp, Artificial
  CRISPR gRNA sequence
aaaaaagaagcagttctaaa

SEQ ID NO: 379867 - DNA, 20 bp, Artificial
  CRISPR gRNA sequence
ctaaattcaccatcacatta

SEQ ID NO: 379868 - DNA, 20 bp, Artificial
  CRISPR gRNA sequence
ggattgtatattctaatcaa

SEQ ID NO: 379869 - DNA, 20 bp, Artificial
  CRISPR gRNA sequence
ttgacaaattcaacatcctt

SEQ ID NO: 379870 - DNA, 20 bp, Artificial
  CRISPR gRNA sequence
aaggtggccactttcaacac

SEQ ID NO: 379871 - DNA, 20 bp, Artificial
  CRISPR gRNA sequence
aaaggaagaagtaatattat

SEQ ID NO: 379872 - DNA, 20 bp, Artificial
  CRISPR gRNA sequence
atcaacatataaaatatcag

SEQ ID NO: 379873 - DNA, 20 bp, Artificial
  CRISPR gRNA sequence
tcatatagcaacttattctt

SEQ ID NO: 379874 - DNA, 20 bp, Artificial
  CRISPR gRNA sequence
gcaacttattctttcatgat

SEQ ID NO: 379875 - DNA, 20 bp, Artificial
  CRISPR gRNA sequence
atctttgctcaagaactaat

SEQ ID NO: 379876 - DNA, 20 bp, Artificial
  CRISPR gRNA sequence
tgctcaagaactaatggtag

SEQ ID NO: 379877 - DNA, 20 bp, Artificial
  CRISPR gRNA sequence
gcttgacaattatatgagat

SEQ ID NO: 379878 - DNA, 20 bp, Artificial
  CRISPR gRNA sequence
atttggggttactcttcata

SEQ ID NO: 379879 - DNA, 20 bp, Artificial
  CRISPR gRNA sequence
tgagtggtctcactggtgga

SEQ ID NO: 379880 - DNA, 20 bp, Artificial
  CRISPR gRNA sequence
tatacttatcaatagcaaac

SEQ ID NO: 379881 - DNA, 20 bp, Artificial
  CRISPR gRNA sequence
ctccagaaactttctgcaag

SEQ ID NO: 379882 - DNA, 20 bp, Artificial
  CRISPR gRNA sequence
ttctttttatagccaataag

SEQ ID NO: 379883 - DNA, 20 bp, Artificial
  CRISPR gRNA sequence
ttccttgcccttcggtccag

SEQ ID NO: 379884 - DNA, 20 bp, Artificial
  CRISPR gRNA sequence
gtggtaaatgtgagttcagt

SEQ ID NO: 379885 - DNA, 20 bp, Artificial
  CRISPR gRNA sequence
cccacatcttatatctgtct

SEQ ID NO: 379886 - DNA, 20 bp, Artificial
  CRISPR gRNA sequence
tctctctgctttaatctcca

SEQ ID NO: 379887 - DNA, 20 bp, Artificial
  CRISPR gRNA sequence
caccagagaaaacacaaatg

SEQ ID NO: 379888 - DNA, 20 bp, Artificial
  CRISPR gRNA sequence
gagaaaacacaaatgatctg

SEQ ID NO: 379889 - DNA, 20 bp, Artificial
  CRISPR gRNA sequence
tgatctgttttgctttgcat

SEQ ID NO: 379890 - DNA, 20 bp, Artificial
  CRISPR gRNA sequence
agtcatcttcatttcattgg

SEQ ID NO: 379891 - DNA, 20 bp, Artificial
  CRISPR gRNA sequence
atttcattggcagagtttga

SEQ ID NO: 379892 - DNA, 20 bp, Artificial
  CRISPR gRNA sequence
ttataatttacatacaaaga

SEQ ID NO: 379893 - DNA, 20 bp, Artificial
  CRISPR gRNA sequence
ttcattttctctataattta

SEQ ID NO: 379894 - DNA, 20 bp, Artificial
  CRISPR gRNA sequence
tataatgggcaaaatcttat

SEQ ID NO: 379895 - DNA, 20 bp, Artificial
  CRISPR gRNA sequence
aaaatcttatacgtgtttga

SEQ ID NO: 379896 - DNA, 20 bp, Artificial
  CRISPR gRNA sequence
ttttcttgccttggtctcta

SEQ ID NO: 379897 - DNA, 20 bp, Artificial
  CRISPR gRNA sequence
cttggtctctaatctgtttt

SEQ ID NO: 379898 - DNA, 20 bp, Artificial
  CRISPR gRNA sequence
ttcactgtttctttttcctg

SEQ ID NO: 379899 - DNA, 20 bp, Artificial
  CRISPR gRNA sequence
aaaaaatacttccataatgc

SEQ ID NO: 379900 - DNA, 20 bp, Artificial
  CRISPR gRNA sequence
acagttcctagaggaacaag

SEQ ID NO: 379901 - DNA, 20 bp, Artificial
  CRISPR gRNA sequence
gggaggcttgatgtggtcca

SEQ ID NO: 379902 - DNA, 20 bp, Artificial
  CRISPR gRNA sequence
attatacacagagctatagt

SEQ ID NO: 379903 - DNA, 20 bp, Artificial
  CRISPR gRNA sequence
cacagagctatagtggaagc

SEQ ID NO: 379904 - DNA, 20 bp, Artificial
  CRISPR gRNA sequence
ttttcaacacaggaagaaat

SEQ ID NO: 379905 - DNA, 20 bp, Artificial
  CRISPR gRNA sequence
cacaatcatacaaagtggat

SEQ ID NO: 379906 - DNA, 20 bp, Artificial
  CRISPR gRNA sequence
ggctggaatcttacacaatt

SEQ ID NO: 379907 - DNA, 20 bp, Artificial
  CRISPR gRNA sequence
tgcctaatacacaaatagtg

SEQ ID NO: 379908 - DNA, 20 bp, Artificial
  CRISPR gRNA sequence
catactcatgcaaagtggat

SEQ ID NO: 379909 - DNA, 20 bp, Artificial
  CRISPR gRNA sequence
gcaggtcctgaaacacaatg

SEQ ID NO: 379910 - DNA, 20 bp, Artificial
  CRISPR gRNA sequence
aaaggccaatttcaccagca

SEQ ID NO: 379911 - DNA, 20 bp, Artificial
  CRISPR gRNA sequence
ctaagtcagtggttcttata

SEQ ID NO: 379912 - DNA, 20 bp, Artificial
  CRISPR gRNA sequence
aatattaagatgcaacatca

SEQ ID NO: 379913 - DNA, 20 bp, Artificial
  CRISPR gRNA sequence
ctgaaatgcactcaacgcag

SEQ ID NO: 379914 - DNA, 20 bp, Artificial
  CRISPR gRNA sequence
tcttgtattgctggggtatg

SEQ ID NO: 379915 - DNA, 20 bp, Artificial
  CRISPR gRNA sequence
acctgaaggctggtaatacc

SEQ ID NO: 379916 - DNA, 20 bp, Artificial
  CRISPR gRNA sequence
gccctttacgaatttctttt

SEQ ID NO: 379917 - DNA, 20 bp, Artificial
  CRISPR gRNA sequence
ggtggcagataagaaaattg

SEQ ID NO: 379918 - DNA, 20 bp, Artificial
  CRISPR gRNA sequence
ggaaagatttttattgctgt

SEQ ID NO: 379919 - DNA, 20 bp, Artificial
  CRISPR gRNA sequence
ttttattgctgtatctgatt

SEQ ID NO: 379920 - DNA, 20 bp, Artificial
  CRISPR gRNA sequence
tgaatatgcgcattaaatga

SEQ ID NO: 379921 - DNA, 20 bp, Artificial
  CRISPR gRNA sequence
aacagagaccagcccacggg

SEQ ID NO: 379922 - DNA, 20 bp, Artificial
  CRISPR gRNA sequence
gcccacggggctggcttttt

SEQ ID NO: 379923 - DNA, 20 bp, Artificial
  CRISPR gRNA sequence
gctacagtcaatctcatcac

SEQ ID NO: 379924 - DNA, 20 bp, Artificial
  CRISPR gRNA sequence
agtcaatctcatcacgaagg

SEQ ID NO: 379925 - DNA, 20 bp, Artificial
  CRISPR gRNA sequence
actatctgaaaagaagaagc

SEQ ID NO: 379926 - DNA, 20 bp, Artificial
  CRISPR gRNA sequence
tttttgtatttttagtagag

SEQ ID NO: 379927 - DNA, 20 bp, Artificial
  CRISPR gRNA sequence
cacctcggcctcccaaagtg

SEQ ID NO: 379928 - DNA, 20 bp, Artificial
  CRISPR gRNA sequence
tgacacattcttgtaagaga

SEQ ID NO: 379929 - DNA, 20 bp, Artificial
  CRISPR gRNA sequence
cttgtaagagaaagggtttt

SEQ ID NO: 379930 - DNA, 20 bp, Artificial
  CRISPR gRNA sequence
gagaaagggttttttttgtt

SEQ ID NO: 379931 - DNA, 20 bp, Artificial
  CRISPR gRNA sequence
ggttttttttgttttttgtt

SEQ ID NO: 379932 - DNA, 20 bp, Artificial
  CRISPR gRNA sequence
ggagataaatagaaaagagg

SEQ ID NO: 379933 - DNA, 20 bp, Artificial
  CRISPR gRNA sequence
agaaacacagccaaaacccc

SEQ ID NO: 379934 - DNA, 20 bp, Artificial
  CRISPR gRNA sequence
tcaggttataatcattctgg

SEQ ID NO: 379935 - DNA, 20 bp, Artificial
  CRISPR gRNA sequence
ctaagtccatggtccttaga

SEQ ID NO: 379936 - DNA, 20 bp, Artificial
  CRISPR gRNA sequence
gctctgccagctagtggtat

SEQ ID NO: 379937 - DNA, 20 bp, Artificial
  CRISPR gRNA sequence
gtatgcatgcttgaaaattc

SEQ ID NO: 379938 - DNA, 20 bp, Artificial
  CRISPR gRNA sequence
gtgttttaaattttgctcaa

SEQ ID NO: 379939 - DNA, 20 bp, Artificial
  CRISPR gRNA sequence
ataaaggggtcttgagacca

SEQ ID NO: 379940 - DNA, 20 bp, Artificial
  CRISPR gRNA sequence
atctgtcacttcaactatgt

SEQ ID NO: 379941 - DNA, 20 bp, Artificial
  CRISPR gRNA sequence
gaaagcaagtctaaagtgca

SEQ ID NO: 379942 - DNA, 20 bp, Artificial
  CRISPR gRNA sequence
aactagaatatcatggctac

SEQ ID NO: 379943 - DNA, 20 bp, Artificial
  CRISPR gRNA sequence
tagtttcagccgcaccaaaa

SEQ ID NO: 379944 - DNA, 20 bp, Artificial
  CRISPR gRNA sequence
taaaaagaaaaccacagcac

SEQ ID NO: 379945 - DNA, 20 bp, Artificial
  CRISPR gRNA sequence
tccagctttctcctctgtac

SEQ ID NO: 379946 - DNA, 20 bp, Artificial
  CRISPR gRNA sequence
aaaaagggaaaaaaggaaat

SEQ ID NO: 379947 - DNA, 20 bp, Artificial
  CRISPR gRNA sequence
tcctcagtgctcacacgcac

SEQ ID NO: 379948 - DNA, 20 bp, Artificial
  CRISPR gRNA sequence
tgctcacacgcacaactgtt

SEQ ID NO: 379949 - DNA, 20 bp, Artificial
  CRISPR gRNA sequence
atgccgccccgtccaatctc

SEQ ID NO: 379950 - DNA, 20 bp, Artificial
  CRISPR gRNA sequence
gttcagaagctcagagtagc

SEQ ID NO: 379951 - DNA, 20 bp, Artificial
  CRISPR gRNA sequence
cctttcctgacaaacagagt

SEQ ID NO: 379952 - DNA, 20 bp, Artificial
  CRISPR gRNA sequence
caaacctgccttgcctcaga

SEQ ID NO: 379953 - DNA, 20 bp, Artificial
  CRISPR gRNA sequence
gccttgcctcagatattgct

SEQ ID NO: 379954 - DNA, 20 bp, Artificial
  CRISPR gRNA sequence
tgatgaacttggaattggaa

SEQ ID NO: 379955 - DNA, 20 bp, Artificial
  CRISPR gRNA sequence
agttaattgggaagaaaaaa

SEQ ID NO: 379956 - DNA, 20 bp, Artificial
  CRISPR gRNA sequence
aacaaatacaaataatgaaa

SEQ ID NO: 379957 - DNA, 20 bp, Artificial
  CRISPR gRNA sequence
aataaacattgaatagactg

SEQ ID NO: 379958 - DNA, 20 bp, Artificial
  CRISPR gRNA sequence
gaatagactgtgttgttttc

SEQ ID NO: 379959 - DNA, 20 bp, Artificial
  CRISPR gRNA sequence
atgatttttattgcaggata

SEQ ID NO: 379960 - DNA, 20 bp, Artificial
  CRISPR gRNA sequence
taaatattctctattttgta

SEQ ID NO: 379961 - DNA, 20 bp, Artificial
  CRISPR gRNA sequence
tctattttgtatgtggcttc

SEQ ID NO: 379962 - DNA, 20 bp, Artificial
  CRISPR gRNA sequence
atcatccttggaaattattt

SEQ ID NO: 379963 - DNA, 20 bp, Artificial
  CRISPR gRNA sequence
ctggtcaacagttctgcata

SEQ ID NO: 379964 - DNA, 20 bp, Artificial
  CRISPR gRNA sequence
aaaccctgagtcattttact

SEQ ID NO: 379965 - DNA, 20 bp, Artificial
  CRISPR gRNA sequence
tctgtacttagcacctagaa

SEQ ID NO: 379966 - DNA, 20 bp, Artificial
  CRISPR gRNA sequence
ccataaaaaagaatgagatc

SEQ ID NO: 379967 - DNA, 20 bp, Artificial
  CRISPR gRNA sequence
gaaaagagaactcttagtta

SEQ ID NO: 379968 - DNA, 20 bp, Artificial
  CRISPR gRNA sequence
tcacatgtacccacaaacct

SEQ ID NO: 379969 - DNA, 20 bp, Artificial
  CRISPR gRNA sequence
aatggcgtgaacccgggagg

SEQ ID NO: 379970 - DNA, 20 bp, Artificial
  CRISPR gRNA sequence
gaggcggagcttgcagtgag

SEQ ID NO: 379971 - DNA, 20 bp, Artificial
  CRISPR gRNA sequence
actcaatgtgcatgtatttt

SEQ ID NO: 379972 - DNA, 20 bp, Artificial
  CRISPR gRNA sequence
tgtatttttattgattttgg

SEQ ID NO: 379973 - DNA, 20 bp, Artificial
  CRISPR gRNA sequence
tgcaaattcacaaatgccat

SEQ ID NO: 379974 - DNA, 20 bp, Artificial
  CRISPR gRNA sequence
taataattttaagaaattat

SEQ ID NO: 379975 - DNA, 20 bp, Artificial
  CRISPR gRNA sequence
gggtgaaggtaatgatggta

SEQ ID NO: 379976 - DNA, 20 bp, Artificial
  CRISPR gRNA sequence
ttaaaaagaaaactcatctt

SEQ ID NO: 379977 - DNA, 20 bp, Artificial
  CRISPR gRNA sequence
gagatgacttaatggctgga

SEQ ID NO: 379978 - DNA, 20 bp, Artificial
  CRISPR gRNA sequence
ctatatactggtcacagggg

SEQ ID NO: 379979 - DNA, 20 bp, Artificial
  CRISPR gRNA sequence
gctattctttctatttttgt

SEQ ID NO: 379980 - DNA, 20 bp, Artificial
  CRISPR gRNA sequence
atgtttgaaacttccattaa

SEQ ID NO: 379981 - DNA, 20 bp, Artificial
  CRISPR gRNA sequence
aatggcgtgaacccgggagg

SEQ ID NO: 379982 - DNA, 20 bp, Artificial
  CRISPR gRNA sequence
aaaaaaaagtatttgttagt

SEQ ID NO: 379983 - DNA, 20 bp, Artificial
  CRISPR gRNA sequence
gaaggaacctaaattggagt

SEQ ID NO: 379984 - DNA, 20 bp, Artificial
  CRISPR gRNA sequence
catccaatcagtattaatgt

SEQ ID NO: 379985 - DNA, 20 bp, Artificial
  CRISPR gRNA sequence
tgaaaaaataaatatactga

SEQ ID NO: 379986 - DNA, 20 bp, Artificial
  CRISPR gRNA sequence
tcagaaacgcaagaaactaa

SEQ ID NO: 379987 - DNA, 20 bp, Artificial
  CRISPR gRNA sequence
accttttggcgccatccagt

SEQ ID NO: 379988 - DNA, 20 bp, Artificial
  CRISPR gRNA sequence
tcggcctcaccctttcccat

SEQ ID NO: 379989 - DNA, 20 bp, Artificial
  CRISPR gRNA sequence
ctcctggaaatactctaccc

SEQ ID NO: 379990 - DNA, 20 bp, Artificial
  CRISPR gRNA sequence
acctccctctgctatctcct

SEQ ID NO: 379991 - DNA, 20 bp, Artificial
  CRISPR gRNA sequence
ctccttcatgctttctcttc

SEQ ID NO: 379992 - DNA, 20 bp, Artificial
  CRISPR gRNA sequence
tgctcagtcagacctctccc

SEQ ID NO: 379993 - DNA, 20 bp, Artificial
  CRISPR gRNA sequence
gagacgataacttgttctta

SEQ ID NO: 379994 - DNA, 20 bp, Artificial
  CRISPR gRNA sequence
atgatgatagtagtagctcc

SEQ ID NO: 379995 - DNA, 20 bp, Artificial
  CRISPR gRNA sequence
gacactgaactgagctgtca

SEQ ID NO: 379996 - DNA, 20 bp, Artificial
  CRISPR gRNA sequence
gctgcaatgttcccagatgg

SEQ ID NO: 379997 - DNA, 20 bp, Artificial
  CRISPR gRNA sequence
ctccagtacttcacaacctg

SEQ ID NO: 379998 - DNA, 20 bp, Artificial
  CRISPR gRNA sequence
acgccatgtgaagatgaatg

SEQ ID NO: 379999 - DNA, 20 bp, Artificial
  CRISPR gRNA sequence
gatgaatgcagagattgggt

SEQ ID NO: 380000 - DNA, 20 bp, Artificial
  CRISPR gRNA sequence
ttccacgagccaaggaaggc

SEQ ID NO: 380001 - DNA, 20 bp, Artificial
  CRISPR gRNA sequence
aacacatttctgttaagtta

SEQ ID NO: 380002 - DNA, 20 bp, Artificial
  CRISPR gRNA sequence
aaaatcggccgtcttcacaa

SEQ ID NO: 380003 - DNA, 20 bp, Artificial
  CRISPR gRNA sequence
agataaaaaataagctaaaa

SEQ ID NO: 380004 - DNA, 20 bp, Artificial
  CRISPR gRNA sequence
ggaaataaaaaaatgaaggg

SEQ ID NO: 380005 - DNA, 20 bp, Artificial
  CRISPR gRNA sequence
tgcgtgtcctgcatggcaaa

SEQ ID NO: 380006 - DNA, 20 bp, Artificial
  CRISPR gRNA sequence
cccagaaaatccatattaag

SEQ ID NO: 380007 - DNA, 20 bp, Artificial
  CRISPR gRNA sequence
tgatttgcagtatgtccaaa

SEQ ID NO: 380008 - DNA, 20 bp, Artificial
  CRISPR gRNA sequence
ggacttgcaatgcaggcccc

SEQ ID NO: 380009 - DNA, 20 bp, Artificial
  CRISPR gRNA sequence
caatgcaggccccggcagct

SEQ ID NO: 380010 - DNA, 20 bp, Artificial
  CRISPR gRNA sequence
aggccccggcagctttgtga

SEQ ID NO: 380011 - DNA, 20 bp, Artificial
  CRISPR gRNA sequence
ctgctgagaccaccggcctc

SEQ ID NO: 380012 - DNA, 20 bp, Artificial
  CRISPR gRNA sequence
ctccgtggagctccagaatc

SEQ ID NO: 380013 - DNA, 20 bp, Artificial
  CRISPR gRNA sequence
aaccgtgggtccccttggtg

SEQ ID NO: 380014 - DNA, 20 bp, Artificial
  CRISPR gRNA sequence
ccaccatggtacaatgagaa

SEQ ID NO: 380015 - DNA, 20 bp, Artificial
  CRISPR gRNA sequence
tttttattatagtcagtatc

SEQ ID NO: 380016 - DNA, 20 bp, Artificial
  CRISPR gRNA sequence
gtcaaacttttgagccattc

SEQ ID NO: 380017 - DNA, 20 bp, Artificial
  CRISPR gRNA sequence
taaaatgcccaagagcattg

SEQ ID NO: 380018 - DNA, 20 bp, Artificial
  CRISPR gRNA sequence
taatgtagactttctgcatg

SEQ ID NO: 380019 - DNA, 20 bp, Artificial
  CRISPR gRNA sequence
ttttaacagaaaaagacatc

SEQ ID NO: 380020 - DNA, 20 bp, Artificial
  CRISPR gRNA sequence
caagagattaacaccatctc

SEQ ID NO: 380021 - DNA, 20 bp, Artificial
  CRISPR gRNA sequence
ctaatgattctgtactagag

SEQ ID NO: 380022 - DNA, 20 bp, Artificial
  CRISPR gRNA sequence
gaagggactccggtgacagc

SEQ ID NO: 380023 - DNA, 20 bp, Artificial
  CRISPR gRNA sequence
caaggatgcctctgctccta

SEQ ID NO: 380024 - DNA, 20 bp, Artificial
  CRISPR gRNA sequence
acattagtgtgaaattgtcc

SEQ ID NO: 380025 - DNA, 20 bp, Artificial
  CRISPR gRNA sequence
tagtgtgaaattgtccatta

SEQ ID NO: 380026 - DNA, 20 bp, Artificial
  CRISPR gRNA sequence
ttccaagtagaaagcaagga

SEQ ID NO: 380027 - DNA, 20 bp, Artificial
  CRISPR gRNA sequence
gaaggagagtgagtggaagt

SEQ ID NO: 380028 - DNA, 20 bp, Artificial
  CRISPR gRNA sequence
aacattcattccttcatcca

SEQ ID NO: 380029 - DNA, 20 bp, Artificial
  CRISPR gRNA sequence
agacccaaagagacagagct

SEQ ID NO: 380030 - DNA, 20 bp, Artificial
  CRISPR gRNA sequence
cggtgctcaccaaggtctgt

SEQ ID NO: 380031 - DNA, 20 bp, Artificial
  CRISPR gRNA sequence
taggactccaaacttaagct

SEQ ID NO: 380032 - DNA, 20 bp, Artificial
  CRISPR gRNA sequence
aacttaagctgttcgattgc

SEQ ID NO: 380033 - DNA, 20 bp, Artificial
  CRISPR gRNA sequence
acatttctttggtatttcca

SEQ ID NO: 380034 - DNA, 20 bp, Artificial
  CRISPR gRNA sequence
aaattaagttaattctaaaa

SEQ ID NO: 380035 - DNA, 20 bp, Artificial
  CRISPR gRNA sequence
gaggttcaccattgctaaca

SEQ ID NO: 380036 - DNA, 20 bp, Artificial
  CRISPR gRNA sequence
attttgcctagcaaaatatt

SEQ ID NO: 380037 - DNA, 20 bp, Artificial
  CRISPR gRNA sequence
ctggccgcaggcaagaaagg

SEQ ID NO: 380038 - DNA, 20 bp, Artificial
  CRISPR gRNA sequence
tgaggatttcttggaggact

SEQ ID NO: 380039 - DNA, 20 bp, Artificial
  CRISPR gRNA sequence
gaagaactgaaagatgaaat

SEQ ID NO: 380040 - DNA, 20 bp, Artificial
  CRISPR gRNA sequence
ctgaaagatgaaatctttgc

SEQ ID NO: 380041 - DNA, 20 bp, Artificial
  CRISPR gRNA sequence
ccataaaaatggagcaggag

SEQ ID NO: 380042 - DNA, 20 bp, Artificial
  CRISPR gRNA sequence
tttctgccttcttgaagcac

SEQ ID NO: 380043 - DNA, 20 bp, Artificial
  CRISPR gRNA sequence
gatccagtgactgaccctgg

SEQ ID NO: 380044 - DNA, 20 bp, Artificial
  CRISPR gRNA sequence
cagtgactgaccctggtaga

SEQ ID NO: 380045 - DNA, 20 bp, Artificial
  CRISPR gRNA sequence
gagtttgcttttcctgacca

SEQ ID NO: 380046 - DNA, 20 bp, Artificial
  CRISPR gRNA sequence
tttccaatccagatcccctg

SEQ ID NO: 380047 - DNA, 20 bp, Artificial
  CRISPR gRNA sequence
acatttatcctcttctcagg

SEQ ID NO: 380048 - DNA, 20 bp, Artificial
  CRISPR gRNA sequence
tttccatcagtgtgcctgga

SEQ ID NO: 380049 - DNA, 20 bp, Artificial
  CRISPR gRNA sequence
accagattcctaaatgtctt

SEQ ID NO: 380050 - DNA, 20 bp, Artificial
  CRISPR gRNA sequence
gattcctaaatgtctttttt

SEQ ID NO: 380051 - DNA, 20 bp, Artificial
  CRISPR gRNA sequence
tgcctcagcctcccgagtaa

SEQ ID NO: 380052 - DNA, 20 bp, Artificial
  CRISPR gRNA sequence
ttttgtatttttagtagaga

SEQ ID NO: 380053 - DNA, 20 bp, Artificial
  CRISPR gRNA sequence
cacctcggcctcccaaagtg

SEQ ID NO: 380054 - DNA, 20 bp, Artificial
  CRISPR gRNA sequence
catagaagcagagggtagga

SEQ ID NO: 380055 - DNA, 20 bp, Artificial
  CRISPR gRNA sequence
aggatggtgcttacagtggc

SEQ ID NO: 380056 - DNA, 20 bp, Artificial
  CRISPR gRNA sequence
acctcagtcagacagaagac

SEQ ID NO: 380057 - DNA, 20 bp, Artificial
  CRISPR gRNA sequence
tccttttttgagctccgtca

SEQ ID NO: 380058 - DNA, 20 bp, Artificial
  CRISPR gRNA sequence
ttgagaggatggatacatga

SEQ ID NO: 380059 - DNA, 20 bp, Artificial
  CRISPR gRNA sequence
gaggatggatacatgaacta

SEQ ID NO: 380060 - DNA, 20 bp, Artificial
  CRISPR gRNA sequence
ttatatttataagttataac

SEQ ID NO: 380061 - DNA, 20 bp, Artificial
  CRISPR gRNA sequence
aaccgactctgtctttgact

SEQ ID NO: 380062 - DNA, 20 bp, Artificial
  CRISPR gRNA sequence
gctctatcactctctcaagt

SEQ ID NO: 380063 - DNA, 20 bp, Artificial
  CRISPR gRNA sequence
cacttgcaaaatataaactg

SEQ ID NO: 380064 - DNA, 20 bp, Artificial
  CRISPR gRNA sequence
tttctatttctgtggctatg

SEQ ID NO: 380065 - DNA, 20 bp, Artificial
  CRISPR gRNA sequence
gcaaaaataatttctaaaat

SEQ ID NO: 380066 - DNA, 20 bp, Artificial
  CRISPR gRNA sequence
aaataatttctaaaatattt

SEQ ID NO: 380067 - DNA, 20 bp, Artificial
  CRISPR gRNA sequence
gtttgtttcttgttactcca

SEQ ID NO: 380068 - DNA, 20 bp, Artificial
  CRISPR gRNA sequence
ttgttactccaccatgtttc

SEQ ID NO: 380069 - DNA, 20 bp, Artificial
  CRISPR gRNA sequence
tctcaggaaaaaccttatat

SEQ ID NO: 380070 - DNA, 20 bp, Artificial
  CRISPR gRNA sequence
tataatagcttgtacatatt

SEQ ID NO: 380071 - DNA, 20 bp, Artificial
  CRISPR gRNA sequence
aaatttgagatatggttatt

SEQ ID NO: 380072 - DNA, 20 bp, Artificial
  CRISPR gRNA sequence
agctgtactttgaaaggttc

SEQ ID NO: 380073 - DNA, 20 bp, Artificial
  CRISPR gRNA sequence
atgttctttagcaaaatcct

SEQ ID NO: 380074 - DNA, 20 bp, Artificial
  CRISPR gRNA sequence
tactagaatctgccatatac

SEQ ID NO: 380075 - DNA, 20 bp, Artificial
  CRISPR gRNA sequence
aataggctaaccactccctc

SEQ ID NO: 380076 - DNA, 20 bp, Artificial
  CRISPR gRNA sequence
tttacctctaccttctattg

SEQ ID NO: 380077 - DNA, 20 bp, Artificial
  CRISPR gRNA sequence
ttagcaaaatgccaggcaca

SEQ ID NO: 380078 - DNA, 20 bp, Artificial
  CRISPR gRNA sequence
ttttccagtccaggccctac

SEQ ID NO: 380079 - DNA, 20 bp, Artificial
  CRISPR gRNA sequence
tgccaaatggaaacccacac

SEQ ID NO: 380080 - DNA, 20 bp, Artificial
  CRISPR gRNA sequence
atcagccagcactgcaaatt

SEQ ID NO: 380081 - DNA, 20 bp, Artificial
  CRISPR gRNA sequence
ccaactctccaaagagctcc

SEQ ID NO: 380082 - DNA, 20 bp, Artificial
  CRISPR gRNA sequence
agggatagttgtaatcatca

SEQ ID NO: 380083 - DNA, 20 bp, Artificial
  CRISPR gRNA sequence
agagtgtccatggtatttat

SEQ ID NO: 380084 - DNA, 20 bp, Artificial
  CRISPR gRNA sequence
gatcagtctatcagtattgg

SEQ ID NO: 380085 - DNA, 20 bp, Artificial
  CRISPR gRNA sequence
cattttaaaatttctgtaaa

SEQ ID NO: 380086 - DNA, 20 bp, Artificial
  CRISPR gRNA sequence
tactcttggtgcactgtgtt

SEQ ID NO: 380087 - DNA, 20 bp, Artificial
  CRISPR gRNA sequence
agctgagttaacggtagtat

SEQ ID NO: 380088 - DNA, 20 bp, Artificial
  CRISPR gRNA sequence
gttaacggtagtatactagt

SEQ ID NO: 380089 - DNA, 20 bp, Artificial
  CRISPR gRNA sequence
agtatactagtttcagtttc

SEQ ID NO: 380090 - DNA, 20 bp, Artificial
  CRISPR gRNA sequence
ggtatatggaaactatctgt

SEQ ID NO: 380091 - DNA, 20 bp, Artificial
  CRISPR gRNA sequence
tctaaaaatattctaaaatt

SEQ ID NO: 380092 - DNA, 20 bp, Artificial
  CRISPR gRNA sequence
attattagaagggtaagagg

SEQ ID NO: 380093 - DNA, 20 bp, Artificial
  CRISPR gRNA sequence
gacagatggtagagcagaag

SEQ ID NO: 380094 - DNA, 20 bp, Artificial
  CRISPR gRNA sequence
gtactgtcaaaaaactcaga

SEQ ID NO: 380095 - DNA, 20 bp, Artificial
  CRISPR gRNA sequence
tcagagaaggcttcagtgga

SEQ ID NO: 380096 - DNA, 20 bp, Artificial
  CRISPR gRNA sequence
gtggaacaggtttggggtgc

SEQ ID NO: 380097 - DNA, 20 bp, Artificial
  CRISPR gRNA sequence
cccttgaggaagggtaatag

SEQ ID NO: 380098 - DNA, 20 bp, Artificial
  CRISPR gRNA sequence
acgggaatgctaacactcat

SEQ ID NO: 380099 - DNA, 20 bp, Artificial
  CRISPR gRNA sequence
ttttcatgtattttctaatc

SEQ ID NO: 380100 - DNA, 20 bp, Artificial
  CRISPR gRNA sequence
actttggtatacatttttaa

SEQ ID NO: 380101 - DNA, 20 bp, Artificial
  CRISPR gRNA sequence
cattttcttatatctattca

SEQ ID NO: 380102 - DNA, 20 bp, Artificial
  CRISPR gRNA sequence
tagggtacatgtgcacacgt

SEQ ID NO: 380103 - DNA, 20 bp, Artificial
  CRISPR gRNA sequence
ttatacaaaaattaattcaa

SEQ ID NO: 380104 - DNA, 20 bp, Artificial
  CRISPR gRNA sequence
ttcaggacataggcatgggc

SEQ ID NO: 380105 - DNA, 20 bp, Artificial
  CRISPR gRNA sequence
agcaatggcaacaaaagtca

SEQ ID NO: 380106 - DNA, 20 bp, Artificial
  CRISPR gRNA sequence
tttttaaaatgatgcccctt

SEQ ID NO: 380107 - DNA, 20 bp, Artificial
  CRISPR gRNA sequence
aaatgatgccccttctatgt

SEQ ID NO: 380108 - DNA, 20 bp, Artificial
  CRISPR gRNA sequence
gatgccccttctatgttttt

SEQ ID NO: 380109 - DNA, 20 bp, Artificial
  CRISPR gRNA sequence
ccccttctatgtttttgttt

SEQ ID NO: 380110 - DNA, 20 bp, Artificial
  CRISPR gRNA sequence
tatacaaagctctgtacatt

SEQ ID NO: 380111 - DNA, 20 bp, Artificial
  CRISPR gRNA sequence
agggctagaacaaatgtcac

SEQ ID NO: 380112 - DNA, 20 bp, Artificial
  CRISPR gRNA sequence
aatgtcacctctgatttgct

SEQ ID NO: 380113 - DNA, 20 bp, Artificial
  CRISPR gRNA sequence
gataataatctagtctttag

SEQ ID NO: 380114 - DNA, 20 bp, Artificial
  CRISPR gRNA sequence
tgattaataataataacagc

SEQ ID NO: 380115 - DNA, 20 bp, Artificial
  CRISPR gRNA sequence
ctatagtttgaggacttatt

SEQ ID NO: 380116 - DNA, 20 bp, Artificial
  CRISPR gRNA sequence
tatctgcttgtgactatatt

SEQ ID NO: 380117 - DNA, 20 bp, Artificial
  CRISPR gRNA sequence
acatttacaattcagtgaag

SEQ ID NO: 380118 - DNA, 20 bp, Artificial
  CRISPR gRNA sequence
aatcacttgtaacaaatggg

SEQ ID NO: 380119 - DNA, 20 bp, Artificial
  CRISPR gRNA sequence
gatctgtttctctctctctc

SEQ ID NO: 380120 - DNA, 20 bp, Artificial
  CRISPR gRNA sequence
ttagggaactcagtgcaaca

SEQ ID NO: 380121 - DNA, 20 bp, Artificial
  CRISPR gRNA sequence
tgcaacaaacagtttgtctc

SEQ ID NO: 380122 - DNA, 20 bp, Artificial
  CRISPR gRNA sequence
actcccagatctaaatgaca

SEQ ID NO: 380123 - DNA, 20 bp, Artificial
  CRISPR gRNA sequence
agaaaagatcacttctgatg

SEQ ID NO: 380124 - DNA, 20 bp, Artificial
  CRISPR gRNA sequence
ttgaagagataagtgtgcct

SEQ ID NO: 380125 - DNA, 20 bp, Artificial
  CRISPR gRNA sequence
tcacagagcacagatcaaag

SEQ ID NO: 380126 - DNA, 20 bp, Artificial
  CRISPR gRNA sequence
cagatcaaagatgggattat

SEQ ID NO: 380127 - DNA, 20 bp, Artificial
  CRISPR gRNA sequence
aaactttttattttctaaac

SEQ ID NO: 380128 - DNA, 20 bp, Artificial
  CRISPR gRNA sequence
aactctagaattttattaat

SEQ ID NO: 380129 - DNA, 20 bp, Artificial
  CRISPR gRNA sequence
gagtaacaacctttgtaaat

SEQ ID NO: 380130 - DNA, 20 bp, Artificial
  CRISPR gRNA sequence
attacaagcgtggggtaagt

SEQ ID NO: 380131 - DNA, 20 bp, Artificial
  CRISPR gRNA sequence
agggaccagccctctgaaag

SEQ ID NO: 380132 - DNA, 20 bp, Artificial
  CRISPR gRNA sequence
gaaagggagaaaaaggaaga

SEQ ID NO: 380133 - DNA, 20 bp, Artificial
  CRISPR gRNA sequence
tatcattctattgatcttaa

SEQ ID NO: 380134 - DNA, 20 bp, Artificial
  CRISPR gRNA sequence
gaaatgcactacttctatta

SEQ ID NO: 380135 - DNA, 20 bp, Artificial
  CRISPR gRNA sequence
actgtgatcatattttcata

SEQ ID NO: 380136 - DNA, 20 bp, Artificial
  CRISPR gRNA sequence
tttatactaccatctatgaa

SEQ ID NO: 380137 - DNA, 20 bp, Artificial
  CRISPR gRNA sequence
ctacgaccttgacatttttg

SEQ ID NO: 380138 - DNA, 20 bp, Artificial
  CRISPR gRNA sequence
atgagtttgatgagatcttc

SEQ ID NO: 380139 - DNA, 20 bp, Artificial
  CRISPR gRNA sequence
gcaatttgaggaagacaaag

SEQ ID NO: 380140 - DNA, 20 bp, Artificial
  CRISPR gRNA sequence
acaaagaggagcttggttca

SEQ ID NO: 380141 - DNA, 20 bp, Artificial
  CRISPR gRNA sequence
caagaggagaatatttattt

SEQ ID NO: 380142 - DNA, 20 bp, Artificial
  CRISPR gRNA sequence
caattccttgtgatagttct

SEQ ID NO: 380143 - DNA, 20 bp, Artificial
  CRISPR gRNA sequence
ttttttactatcttagcata

SEQ ID NO: 380144 - DNA, 20 bp, Artificial
  CRISPR gRNA sequence
ttctagaaattctactcttg

SEQ ID NO: 380145 - DNA, 20 bp, Artificial
  CRISPR gRNA sequence
cttgttcagtttaaagtgag

SEQ ID NO: 380146 - DNA, 20 bp, Artificial
  CRISPR gRNA sequence
aagattttactttgaagtat

SEQ ID NO: 380147 - DNA, 20 bp, Artificial
  CRISPR gRNA sequence
cattttggaaacagtatcgt

SEQ ID NO: 380148 - DNA, 20 bp, Artificial
  CRISPR gRNA sequence
catcttctagtcatagttca

SEQ ID NO: 380149 - DNA, 20 bp, Artificial
  CRISPR gRNA sequence
tctcacacaatagcacctgg

SEQ ID NO: 380150 - DNA, 20 bp, Artificial
  CRISPR gRNA sequence
tagggttgacaatcattgct

SEQ ID NO: 380151 - DNA, 20 bp, Artificial
  CRISPR gRNA sequence
gagaaaacaaacaattcttt

SEQ ID NO: 380152 - DNA, 20 bp, Artificial
  CRISPR gRNA sequence
gtcagaaagaacttagataa

SEQ ID NO: 380153 - DNA, 20 bp, Artificial
  CRISPR gRNA sequence
atgcggaaactaattgaaat

SEQ ID NO: 380154 - DNA, 20 bp, Artificial
  CRISPR gRNA sequence
tgctttgaaatatttaagct

SEQ ID NO: 380155 - DNA, 20 bp, Artificial
  CRISPR gRNA sequence
tcctctacaattgccttcat

SEQ ID NO: 380156 - DNA, 20 bp, Artificial
  CRISPR gRNA sequence
gaattacatttttcacattt

SEQ ID NO: 380157 - DNA, 20 bp, Artificial
  CRISPR gRNA sequence
ggatgtgccagagccagtgg

SEQ ID NO: 380158 - DNA, 20 bp, Artificial
  CRISPR gRNA sequence
attacagatataccctaatg

SEQ ID NO: 380159 - DNA, 20 bp, Artificial
  CRISPR gRNA sequence
aagcatattttttgcctgtc

SEQ ID NO: 380160 - DNA, 20 bp, Artificial
  CRISPR gRNA sequence
acagcaaaaataatttactc

SEQ ID NO: 380161 - DNA, 20 bp, Artificial
  CRISPR gRNA sequence
gatgcaaataaataaatcac

SEQ ID NO: 380162 - DNA, 20 bp, Artificial
  CRISPR gRNA sequence
accagagataaccacacaga

SEQ ID NO: 380163 - DNA, 20 bp, Artificial
  CRISPR gRNA sequence
ataaccacacagatactgat

SEQ ID NO: 380164 - DNA, 20 bp, Artificial
  CRISPR gRNA sequence
acttcaatgtatatttcagg

SEQ ID NO: 380165 - DNA, 20 bp, Artificial
  CRISPR gRNA sequence
catctcaacaagaaacaatg

SEQ ID NO: 380166 - DNA, 20 bp, Artificial
  CRISPR gRNA sequence
tcaacaagaaacaatgatgt

SEQ ID NO: 380167 - DNA, 20 bp, Artificial
  CRISPR gRNA sequence
taaagtaatacaaaaagtat

SEQ ID NO: 380168 - DNA, 20 bp, Artificial
  CRISPR gRNA sequence
aaaaagtatatttgttttcc

SEQ ID NO: 380169 - DNA, 20 bp, Artificial
  CRISPR gRNA sequence
tgagtcattggactagaaat

SEQ ID NO: 380170 - DNA, 20 bp, Artificial
  CRISPR gRNA sequence
ttttgtacataagggaacag

SEQ ID NO: 380171 - DNA, 20 bp, Artificial
  CRISPR gRNA sequence
gggcactcattatatgctca

SEQ ID NO: 380172 - DNA, 20 bp, Artificial
  CRISPR gRNA sequence
actcattatatgctcatcaa

SEQ ID NO: 380173 - DNA, 20 bp, Artificial
  CRISPR gRNA sequence
tctccccacatgacctgcta

SEQ ID NO: 380174 - DNA, 20 bp, Artificial
  CRISPR gRNA sequence
cctgctatcaagatttgaag

SEQ ID NO: 380175 - DNA, 20 bp, Artificial
  CRISPR gRNA sequence
agccttacatctgcctactt

SEQ ID NO: 380176 - DNA, 20 bp, Artificial
  CRISPR gRNA sequence
cagatctggccctattagtc

SEQ ID NO: 380177 - DNA, 20 bp, Artificial
  CRISPR gRNA sequence
taaggcctaatagaagtagt

SEQ ID NO: 380178 - DNA, 20 bp, Artificial
  CRISPR gRNA sequence
catctttccttccctccttc

SEQ ID NO: 380179 - DNA, 20 bp, Artificial
  CRISPR gRNA sequence
gctgctttctgcctcttcca

SEQ ID NO: 380180 - DNA, 20 bp, Artificial
  CRISPR gRNA sequence
aggaatttatatgttctcct

SEQ ID NO: 380181 - DNA, 20 bp, Artificial
  CRISPR gRNA sequence
gattttagtgagttagcgct

SEQ ID NO: 380182 - DNA, 20 bp, Artificial
  CRISPR gRNA sequence
gctgtcagtttagttaagtt

SEQ ID NO: 380183 - DNA, 20 bp, Artificial
  CRISPR gRNA sequence
agtttagttaagttgatagt

SEQ ID NO: 380184 - DNA, 20 bp, Artificial
  CRISPR gRNA sequence
ttgagtttacttttccaaat

SEQ ID NO: 380185 - DNA, 20 bp, Artificial
  CRISPR gRNA sequence
aatatatctttaagtcttca

SEQ ID NO: 380186 - DNA, 20 bp, Artificial
  CRISPR gRNA sequence
ggggagtcattgaaaaggat

SEQ ID NO: 380187 - DNA, 20 bp, Artificial
  CRISPR gRNA sequence
ctgtctaatacttaatccat

SEQ ID NO: 380188 - DNA, 20 bp, Artificial
  CRISPR gRNA sequence
aatacttaatccattgttga

SEQ ID NO: 380189 - DNA, 20 bp, Artificial
  CRISPR gRNA sequence
agttatagtgaaggaaaatg

SEQ ID NO: 380190 - DNA, 20 bp, Artificial
  CRISPR gRNA sequence
ttcactccaaagaggagcaa

SEQ ID NO: 380191 - DNA, 20 bp, Artificial
  CRISPR gRNA sequence
acccacctacccaaggccat

SEQ ID NO: 380192 - DNA, 20 bp, Artificial
  CRISPR gRNA sequence
aagacccatcacgtccctga

SEQ ID NO: 380193 - DNA, 20 bp, Artificial
  CRISPR gRNA sequence
caggtggatcacctgaggtc

SEQ ID NO: 380194 - DNA, 20 bp, Artificial
  CRISPR gRNA sequence
caggtggaggttgcggtgag

SEQ ID NO: 380195 - DNA, 20 bp, Artificial
  CRISPR gRNA sequence
ccgagattgtgccattgcac

SEQ ID NO: 380196 - DNA, 20 bp, Artificial
  CRISPR gRNA sequence
aggcatggtctcggtcctca

SEQ ID NO: 380197 - DNA, 20 bp, Artificial
  CRISPR gRNA sequence
aggaagccataaaactaaac

SEQ ID NO: 380198 - DNA, 20 bp, Artificial
  CRISPR gRNA sequence
tagtgatacttcaggaaggg

SEQ ID NO: 380199 - DNA, 20 bp, Artificial
  CRISPR gRNA sequence
acagaaaatgttcggacagt

SEQ ID NO: 380200 - DNA, 20 bp, Artificial
  CRISPR gRNA sequence
ttatctcagctaatttgcca

SEQ ID NO: 380201 - DNA, 20 bp, Artificial
  CRISPR gRNA sequence
ccaagaactggttgtggcct

SEQ ID NO: 380202 - DNA, 20 bp, Artificial
  CRISPR gRNA sequence
acattccagaaacgctgtca

SEQ ID NO: 380203 - DNA, 20 bp, Artificial
  CRISPR gRNA sequence
aacataggaaggaaaaaact

SEQ ID NO: 380204 - DNA, 20 bp, Artificial
  CRISPR gRNA sequence
ttctgaaagaactgaaggca

SEQ ID NO: 380205 - DNA, 20 bp, Artificial
  CRISPR gRNA sequence
ttattaagtctgacaaggca

SEQ ID NO: 380206 - DNA, 20 bp, Artificial
  CRISPR gRNA sequence
ataaatactagtaccaagag

SEQ ID NO: 380207 - DNA, 20 bp, Artificial
  CRISPR gRNA sequence
gaacagtaccaaacaccgaa

SEQ ID NO: 380208 - DNA, 20 bp, Artificial
  CRISPR gRNA sequence
tttatatttttttgtagcaa

SEQ ID NO: 380209 - DNA, 20 bp, Artificial
  CRISPR gRNA sequence
tgcctcagcctcccaaagtg

SEQ ID NO: 380210 - DNA, 20 bp, Artificial
  CRISPR gRNA sequence
aaaactgaagatatttttta

SEQ ID NO: 380211 - DNA, 20 bp, Artificial
  CRISPR gRNA sequence
tgaagatattttttaaactg

SEQ ID NO: 380212 - DNA, 20 bp, Artificial
  CRISPR gRNA sequence
gaacttacttctctacttcc

SEQ ID NO: 380213 - DNA, 20 bp, Artificial
  CRISPR gRNA sequence
atttatatacaagataaaaa

SEQ ID NO: 380214 - DNA, 20 bp, Artificial
  CRISPR gRNA sequence
aagataaaaacaatgcttca

SEQ ID NO: 380215 - DNA, 20 bp, Artificial
  CRISPR gRNA sequence
actcctcaaaagaaaaataa

SEQ ID NO: 380216 - DNA, 20 bp, Artificial
  CRISPR gRNA sequence
tgtgataaacactttgcagc

SEQ ID NO: 380217 - DNA, 20 bp, Artificial
  CRISPR gRNA sequence
tcctttatacaaaaaagtca

SEQ ID NO: 380218 - DNA, 20 bp, Artificial
  CRISPR gRNA sequence
aggcaatgaaaacttatacc

SEQ ID NO: 380219 - DNA, 20 bp, Artificial
  CRISPR gRNA sequence
gtaaatctgatcatggacct

SEQ ID NO: 380220 - DNA, 20 bp, Artificial
  CRISPR gRNA sequence
atggacctctctgcttgcaa

SEQ ID NO: 380221 - DNA, 20 bp, Artificial
  CRISPR gRNA sequence
tgcaaaccagtttcaatact

SEQ ID NO: 380222 - DNA, 20 bp, Artificial
  CRISPR gRNA sequence
tcctcgcatgggatcatctg

SEQ ID NO: 380223 - DNA, 20 bp, Artificial
  CRISPR gRNA sequence
gggatcatctgggaagcttc

SEQ ID NO: 380224 - DNA, 20 bp, Artificial
  CRISPR gRNA sequence
agcttcgccagctttggggg

SEQ ID NO: 380225 - DNA, 20 bp, Artificial
  CRISPR gRNA sequence
ctaacacatcttattgggcc

SEQ ID NO: 380226 - DNA, 20 bp, Artificial
  CRISPR gRNA sequence
ggaagacccatgaggccctt

SEQ ID NO: 380227 - DNA, 20 bp, Artificial
  CRISPR gRNA sequence
aatcacttgtctccttgtta

SEQ ID NO: 380228 - DNA, 20 bp, Artificial
  CRISPR gRNA sequence
agaatgcaaatctacacact

SEQ ID NO: 380229 - DNA, 20 bp, Artificial
  CRISPR gRNA sequence
gctctactgacttctttcct

SEQ ID NO: 380230 - DNA, 20 bp, Artificial
  CRISPR gRNA sequence
tgacttctttcctccgggtt

SEQ ID NO: 380231 - DNA, 20 bp, Artificial
  CRISPR gRNA sequence
tctttcctccgggttttttg

SEQ ID NO: 380232 - DNA, 20 bp, Artificial
  CRISPR gRNA sequence
ctccgggttttttgttttga

SEQ ID NO: 380233 - DNA, 20 bp, Artificial
  CRISPR gRNA sequence
gttttttgttttgatttagt

SEQ ID NO: 380234 - DNA, 20 bp, Artificial
  CRISPR gRNA sequence
ttttgatttagtttgggctt

SEQ ID NO: 380235 - DNA, 20 bp, Artificial
  CRISPR gRNA sequence
gtttgggctttggggatttt

SEQ ID NO: 380236 - DNA, 20 bp, Artificial
  CRISPR gRNA sequence
tgggtttttttaatttgaat

SEQ ID NO: 380237 - DNA, 20 bp, Artificial
  CRISPR gRNA sequence
tttaatttgaatttttgttt

SEQ ID NO: 380238 - DNA, 20 bp, Artificial
  CRISPR gRNA sequence
gaggaagtaccaagaatctt

SEQ ID NO: 380239 - DNA, 20 bp, Artificial
  CRISPR gRNA sequence
tctggaaaaataaacatgca

SEQ ID NO: 380240 - DNA, 20 bp, Artificial
  CRISPR gRNA sequence
aaatgtggcaaatgtattgc

SEQ ID NO: 380241 - DNA, 20 bp, Artificial
  CRISPR gRNA sequence
ggcctaattcaaggaatggc

SEQ ID NO: 380242 - DNA, 20 bp, Artificial
  CRISPR gRNA sequence
atttgttgaatgtctataat

SEQ ID NO: 380243 - DNA, 20 bp, Artificial
  CRISPR gRNA sequence
gttgaatgtctataattttc

SEQ ID NO: 380244 - DNA, 20 bp, Artificial
  CRISPR gRNA sequence
gtggtgcgatcatagctcac

SEQ ID NO: 380245 - DNA, 20 bp, Artificial
  CRISPR gRNA sequence
agtctcactatgttacccag

SEQ ID NO: 380246 - DNA, 20 bp, Artificial
  CRISPR gRNA sequence
ggctcaagcaatcctcctgc

SEQ ID NO: 380247 - DNA, 20 bp, Artificial
  CRISPR gRNA sequence
tgcctcggtttcccaaaatt

SEQ ID NO: 380248 - DNA, 20 bp, Artificial
  CRISPR gRNA sequence
tacaggtgtgagccactgtg

SEQ ID NO: 380249 - DNA, 20 bp, Artificial
  CRISPR gRNA sequence
ccactgtgcccggctttgta

SEQ ID NO: 380250 - DNA, 20 bp, Artificial
  CRISPR gRNA sequence
tctacccaattccaccctca

SEQ ID NO: 380251 - DNA, 20 bp, Artificial
  CRISPR gRNA sequence
ctgataaacactggcatgag

SEQ ID NO: 380252 - DNA, 20 bp, Artificial
  CRISPR gRNA sequence
aaagaaaatctcataactgg

SEQ ID NO: 380253 - DNA, 20 bp, Artificial
  CRISPR gRNA sequence
tcaggaggctgaggcaggag

SEQ ID NO: 380254 - DNA, 20 bp, Artificial
  CRISPR gRNA sequence
gaggcagaggttgcagtgat

SEQ ID NO: 380255 - DNA, 20 bp, Artificial
  CRISPR gRNA sequence
ccagaggcctaaaaaaatta

SEQ ID NO: 380256 - DNA, 20 bp, Artificial
  CRISPR gRNA sequence
aacctcgatagaagtgacac

SEQ ID NO: 380257 - DNA, 20 bp, Artificial
  CRISPR gRNA sequence
aatggcatgaacccaggagg

SEQ ID NO: 380258 - DNA, 20 bp, Artificial
  CRISPR gRNA sequence
atgcagcatcatttatcgag

SEQ ID NO: 380259 - DNA, 20 bp, Artificial
  CRISPR gRNA sequence
caacactttacaagggagaa

SEQ ID NO: 380260 - DNA, 20 bp, Artificial
  CRISPR gRNA sequence
tgtcatgatcaaatgacaaa

SEQ ID NO: 380261 - DNA, 20 bp, Artificial
  CRISPR gRNA sequence
acaaaaaaaaaaaaaccaaa

SEQ ID NO: 380262 - DNA, 20 bp, Artificial
  CRISPR gRNA sequence
gccaacagatctaaagggcc

SEQ ID NO: 380263 - DNA, 20 bp, Artificial
  CRISPR gRNA sequence
aataagcagtgaggcccaaa

SEQ ID NO: 380264 - DNA, 20 bp, Artificial
  CRISPR gRNA sequence
gcactccaaagtaaatgctg

SEQ ID NO: 380265 - DNA, 20 bp, Artificial
  CRISPR gRNA sequence
ttgaaaacaacatacacaac

SEQ ID NO: 380266 - DNA, 20 bp, Artificial
  CRISPR gRNA sequence
acagagtaacaaggacacta

SEQ ID NO: 380267 - DNA, 20 bp, Artificial
  CRISPR gRNA sequence
gtaacaaggacactaaaggg

SEQ ID NO: 380268 - DNA, 20 bp, Artificial
  CRISPR gRNA sequence
tcgtttcatctttttggaaa

SEQ ID NO: 380269 - DNA, 20 bp, Artificial
  CRISPR gRNA sequence
ccgggaacaaaaatcctcca

SEQ ID NO: 380270 - DNA, 20 bp, Artificial
  CRISPR gRNA sequence
gaacaaaaatcctccactca

SEQ ID NO: 380271 - DNA, 20 bp, Artificial
  CRISPR gRNA sequence
ccgatatttgcaaatggcca

SEQ ID NO: 380272 - DNA, 20 bp, Artificial
  CRISPR gRNA sequence
gccaccatgcttcagaatga

SEQ ID NO: 380273 - DNA, 20 bp, Artificial
  CRISPR gRNA sequence
aaggagaaacaaaagaaaaa

SEQ ID NO: 380274 - DNA, 20 bp, Artificial
  CRISPR gRNA sequence
gaaacaaaagaaaaaactcg

SEQ ID NO: 380275 - DNA, 20 bp, Artificial
  CRISPR gRNA sequence
gatgtggaggtcgcagtgtg

SEQ ID NO: 380276 - DNA, 20 bp, Artificial
  CRISPR gRNA sequence
catcaggtctttgcctacct

SEQ ID NO: 380277 - DNA, 20 bp, Artificial
  CRISPR gRNA sequence
tcccattcccacctcataca

SEQ ID NO: 380278 - DNA, 20 bp, Artificial
  CRISPR gRNA sequence
cattatgtttcaggatgatg

SEQ ID NO: 380279 - DNA, 20 bp, Artificial
  CRISPR gRNA sequence
cttttccatcctcttacatc

SEQ ID NO: 380280 - DNA, 20 bp, Artificial
  CRISPR gRNA sequence
cctacttctttagttgtcag

SEQ ID NO: 380281 - DNA, 20 bp, Artificial
  CRISPR gRNA sequence
atgtgttagttgaaatgagt

SEQ ID NO: 380282 - DNA, 20 bp, Artificial
  CRISPR gRNA sequence
ctctgtgtcaacaaatcctt

SEQ ID NO: 380283 - DNA, 20 bp, Artificial
  CRISPR gRNA sequence
taagctcactgctatgatct

SEQ ID NO: 380284 - DNA, 20 bp, Artificial
  CRISPR gRNA sequence
attgtggtggtattaagaga

SEQ ID NO: 380285 - DNA, 20 bp, Artificial
  CRISPR gRNA sequence
acatcattaagtcttgagaa

SEQ ID NO: 380286 - DNA, 20 bp, Artificial
  CRISPR gRNA sequence
tgagaattctgctttcatga

SEQ ID NO: 380287 - DNA, 20 bp, Artificial
  CRISPR gRNA sequence
ttcagaaagatgttgaaggg

SEQ ID NO: 380288 - DNA, 20 bp, Artificial
  CRISPR gRNA sequence
tcactagacagtaaatttgc

SEQ ID NO: 380289 - DNA, 20 bp, Artificial
  CRISPR gRNA sequence
aaagtatttgttgtcttgtg

SEQ ID NO: 380290 - DNA, 20 bp, Artificial
  CRISPR gRNA sequence
tattcctccgtagacactta

SEQ ID NO: 380291 - DNA, 20 bp, Artificial
  CRISPR gRNA sequence
gagtgtactaagttcacata

SEQ ID NO: 380292 - DNA, 20 bp, Artificial
  CRISPR gRNA sequence
aatatgcagaaaagcggtag

SEQ ID NO: 380293 - DNA, 20 bp, Artificial
  CRISPR gRNA sequence
atatccaaatacacttcaaa

SEQ ID NO: 380294 - DNA, 20 bp, Artificial
  CRISPR gRNA sequence
cttaattacatatggaattc

SEQ ID NO: 380295 - DNA, 20 bp, Artificial
  CRISPR gRNA sequence
ctacttcaccccaactcttt

SEQ ID NO: 380296 - DNA, 20 bp, Artificial
  CRISPR gRNA sequence
atccgggggaatgcaggaaa

SEQ ID NO: 380297 - DNA, 20 bp, Artificial
  CRISPR gRNA sequence
ggaatgcaggaaacatggat

SEQ ID NO: 380298 - DNA, 20 bp, Artificial
  CRISPR gRNA sequence
ttcctgttttaggggtggga

SEQ ID NO: 380299 - DNA, 20 bp, Artificial
  CRISPR gRNA sequence
tccaaaatacttgggaacat

SEQ ID NO: 380300 - DNA, 20 bp, Artificial
  CRISPR gRNA sequence
atacttgggaacataagtgt

SEQ ID NO: 380301 - DNA, 20 bp, Artificial
  CRISPR gRNA sequence
ggaacataagtgtttcagat

SEQ ID NO: 380302 - DNA, 20 bp, Artificial
  CRISPR gRNA sequence
tgtttcagatttgggattct

SEQ ID NO: 380303 - DNA, 20 bp, Artificial
  CRISPR gRNA sequence
gagcatcatgttggcattca

SEQ ID NO: 380304 - DNA, 20 bp, Artificial
  CRISPR gRNA sequence
catgttggcattcaaagagt

SEQ ID NO: 380305 - DNA, 20 bp, Artificial
  CRISPR gRNA sequence
agttttggattttggagcat

SEQ ID NO: 380306 - DNA, 20 bp, Artificial
  CRISPR gRNA sequence
gattttggagcatttcagat

SEQ ID NO: 380307 - DNA, 20 bp, Artificial
  CRISPR gRNA sequence
agcatttcagatttcagatt

SEQ ID NO: 380308 - DNA, 20 bp, Artificial
  CRISPR gRNA sequence
cctagggaatttgcacttaa

SEQ ID NO: 380309 - DNA, 20 bp, Artificial
  CRISPR gRNA sequence
ttgaacagcacttgtaagaa

SEQ ID NO: 380310 - DNA, 20 bp, Artificial
  CRISPR gRNA sequence
ggtattacaatagggaagag

SEQ ID NO: 380311 - DNA, 20 bp, Artificial
  CRISPR gRNA sequence
gtccatccagatgtgcatat

SEQ ID NO: 380312 - DNA, 20 bp, Artificial
  CRISPR gRNA sequence
tgaaatgggtgttacaggcc

SEQ ID NO: 380313 - DNA, 20 bp, Artificial
  CRISPR gRNA sequence
atctagtaacatcccttcca

SEQ ID NO: 380314 - DNA, 20 bp, Artificial
  CRISPR gRNA sequence
gtctatcctcactttttaaa

SEQ ID NO: 380315 - DNA, 20 bp, Artificial
  CRISPR gRNA sequence
aacccaagttctctcttggg

SEQ ID NO: 380316 - DNA, 20 bp, Artificial
  CRISPR gRNA sequence
aaaaatcctcctgcctgcta

SEQ ID NO: 380317 - DNA, 20 bp, Artificial
  CRISPR gRNA sequence
tcacttggatgtctaaacct

SEQ ID NO: 380318 - DNA, 20 bp, Artificial
  CRISPR gRNA sequence
taaacgattcaaccccactc

SEQ ID NO: 380319 - DNA, 20 bp, Artificial
  CRISPR gRNA sequence
aatacaaagaggtaaaagat

SEQ ID NO: 380320 - DNA, 20 bp, Artificial
  CRISPR gRNA sequence
ttgaatgaaggctgttgcaa

SEQ ID NO: 380321 - DNA, 20 bp, Artificial
  CRISPR gRNA sequence
caaagcataaaagatgactt

SEQ ID NO: 380322 - DNA, 20 bp, Artificial
  CRISPR gRNA sequence
atgagaaagactgggagcag

SEQ ID NO: 380323 - DNA, 20 bp, Artificial
  CRISPR gRNA sequence
gccagtctaagcaacgtgaa

SEQ ID NO: 380324 - DNA, 20 bp, Artificial
  CRISPR gRNA sequence
taagcacaaatcagtcctca

SEQ ID NO: 380325 - DNA, 20 bp, Artificial
  CRISPR gRNA sequence
aagctcaggctgaaagtaat

SEQ ID NO: 380326 - DNA, 20 bp, Artificial
  CRISPR gRNA sequence
tagacttcagagaatcccca

SEQ ID NO: 380327 - DNA, 20 bp, Artificial
  CRISPR gRNA sequence
caaatgtccaacaacgatag

SEQ ID NO: 380328 - DNA, 20 bp, Artificial
  CRISPR gRNA sequence
tttaatattacagcatcagg

SEQ ID NO: 380329 - DNA, 20 bp, Artificial
  CRISPR gRNA sequence
gccaaagctctggcagttgt

SEQ ID NO: 380330 - DNA, 20 bp, Artificial
  CRISPR gRNA sequence
attcatcttgaatatgcccc

SEQ ID NO: 380331 - DNA, 20 bp, Artificial
  CRISPR gRNA sequence
tttatccccacttaagctgc

SEQ ID NO: 380332 - DNA, 20 bp, Artificial
  CRISPR gRNA sequence
gccttagtttaattcttttt

SEQ ID NO: 380333 - DNA, 20 bp, Artificial
  CRISPR gRNA sequence
cttattcccatcacctctgc

SEQ ID NO: 380334 - DNA, 20 bp, Artificial
  CRISPR gRNA sequence
taataaagtaccacagactg

SEQ ID NO: 380335 - DNA, 20 bp, Artificial
  CRISPR gRNA sequence
caaaattcaggtgccagcag

SEQ ID NO: 380336 - DNA, 20 bp, Artificial
  CRISPR gRNA sequence
ttccttttgaggcctctctc

SEQ ID NO: 380337 - DNA, 20 bp, Artificial
  CRISPR gRNA sequence
cttatttggaaaccagtcat

SEQ ID NO: 380338 - DNA, 20 bp, Artificial
  CRISPR gRNA sequence
aaatgcatctaagtaagcat

SEQ ID NO: 380339 - DNA, 20 bp, Artificial
  CRISPR gRNA sequence
tggcaccactacccacttaa

SEQ ID NO: 380340 - DNA, 20 bp, Artificial
  CRISPR gRNA sequence
ccacttaaattagcttttac

SEQ ID NO: 380341 - DNA, 20 bp, Artificial
  CRISPR gRNA sequence
tcccaagcacaccagcctca

SEQ ID NO: 380342 - DNA, 20 bp, Artificial
  CRISPR gRNA sequence
attttgcttttgcgccatta

SEQ ID NO: 380343 - DNA, 20 bp, Artificial
  CRISPR gRNA sequence
ccatccagctaacagcatga

SEQ ID NO: 380344 - DNA, 20 bp, Artificial
  CRISPR gRNA sequence
gcatcaagtcacacagagcc

SEQ ID NO: 380345 - DNA, 20 bp, Artificial
  CRISPR gRNA sequence
gaaggagaaacttgcagcag

SEQ ID NO: 380346 - DNA, 20 bp, Artificial
  CRISPR gRNA sequence
cacaggcctcccactttctt

SEQ ID NO: 380347 - DNA, 20 bp, Artificial
  CRISPR gRNA sequence
tgttttcgtgtctcctatct

SEQ ID NO: 380348 - DNA, 20 bp, Artificial
  CRISPR gRNA sequence
tcccctaagcctctggccaa

SEQ ID NO: 380349 - DNA, 20 bp, Artificial
  CRISPR gRNA sequence
aagagcatctccctggtatg

SEQ ID NO: 380350 - DNA, 20 bp, Artificial
  CRISPR gRNA sequence
atgtttcttgtgatgcactt

SEQ ID NO: 380351 - DNA, 20 bp, Artificial
  CRISPR gRNA sequence
ttacacctatatttccaggc

SEQ ID NO: 380352 - DNA, 20 bp, Artificial
  CRISPR gRNA sequence
gtcacctccaactccccaaa

SEQ ID NO: 380353 - DNA, 20 bp, Artificial
  CRISPR gRNA sequence
gcattacagtcacttggccc

SEQ ID NO: 380354 - DNA, 20 bp, Artificial
  CRISPR gRNA sequence
gcaaacaataatatctattc

SEQ ID NO: 380355 - DNA, 20 bp, Artificial
  CRISPR gRNA sequence
tatctattcaacagatttag

SEQ ID NO: 380356 - DNA, 20 bp, Artificial
  CRISPR gRNA sequence
acagatttaggtaagattta

SEQ ID NO: 380357 - DNA, 20 bp, Artificial
  CRISPR gRNA sequence
tatcatccttcatccaataa

SEQ ID NO: 380358 - DNA, 20 bp, Artificial
  CRISPR gRNA sequence
ctgtgtcatttgagcaacaa

SEQ ID NO: 380359 - DNA, 20 bp, Artificial
  CRISPR gRNA sequence
gaaaatattttcatcttatt

SEQ ID NO: 380360 - DNA, 20 bp, Artificial
  CRISPR gRNA sequence
tgctctttccagaaacattt

SEQ ID NO: 380361 - DNA, 20 bp, Artificial
  CRISPR gRNA sequence
tatttcacttaaatgagcaa

SEQ ID NO: 380362 - DNA, 20 bp, Artificial
  CRISPR gRNA sequence
atacaacaactgaattcttt

SEQ ID NO: 380363 - DNA, 20 bp, Artificial
  CRISPR gRNA sequence
gaaaaaggtatacattcaac

SEQ ID NO: 380364 - DNA, 20 bp, Artificial
  CRISPR gRNA sequence
gtatacattcaactagagct

SEQ ID NO: 380365 - DNA, 20 bp, Artificial
  CRISPR gRNA sequence
tgtctgctaaaatgagaatg

SEQ ID NO: 380366 - DNA, 20 bp, Artificial
  CRISPR gRNA sequence
aaatgagaatgttaagtttc

SEQ ID NO: 380367 - DNA, 20 bp, Artificial
  CRISPR gRNA sequence
aaatgctcccagaattaatg

SEQ ID NO: 380368 - DNA, 20 bp, Artificial
  CRISPR gRNA sequence
gaattaatgcccagatttta

SEQ ID NO: 380369 - DNA, 20 bp, Artificial
  CRISPR gRNA sequence
aacactagtaagtatgaata

SEQ ID NO: 380370 - DNA, 20 bp, Artificial
  CRISPR gRNA sequence
aacatggctctttctctcga

SEQ ID NO: 380371 - DNA, 20 bp, Artificial
  CRISPR gRNA sequence
tctctcgaggcagattacaa

SEQ ID NO: 380372 - DNA, 20 bp, Artificial
  CRISPR gRNA sequence
attttctcacattaagagtt

SEQ ID NO: 380373 - DNA, 20 bp, Artificial
  CRISPR gRNA sequence
ataatttcacactgatccct

SEQ ID NO: 380374 - DNA, 20 bp, Artificial
  CRISPR gRNA sequence
ttgatggtcttgaaattctt

SEQ ID NO: 380375 - DNA, 20 bp, Artificial
  CRISPR gRNA sequence
tccaagcatcagtaaaaact

SEQ ID NO: 380376 - DNA, 20 bp, Artificial
  CRISPR gRNA sequence
aactgagagctttaccagct

SEQ ID NO: 380377 - DNA, 20 bp, Artificial
  CRISPR gRNA sequence
tcttcagttacttattttct

SEQ ID NO: 380378 - DNA, 20 bp, Artificial
  CRISPR gRNA sequence
cagttacttattttcttttt

SEQ ID NO: 380379 - DNA, 20 bp, Artificial
  CRISPR gRNA sequence
cctactcactaatcctataa

SEQ ID NO: 380380 - DNA, 20 bp, Artificial
  CRISPR gRNA sequence
ggaggaaaaaccaagaactg

SEQ ID NO: 380381 - DNA, 20 bp, Artificial
  CRISPR gRNA sequence
gtcacaggagaatcagtgtc

SEQ ID NO: 380382 - DNA, 20 bp, Artificial
  CRISPR gRNA sequence
aatacctacaataagaaggg

SEQ ID NO: 380383 - DNA, 20 bp, Artificial
  CRISPR gRNA sequence
acaataagaagggtacagtt

SEQ ID NO: 380384 - DNA, 20 bp, Artificial
  CRISPR gRNA sequence
tttgacaacaagcccaaagt

SEQ ID NO: 380385 - DNA, 20 bp, Artificial
  CRISPR gRNA sequence
agcccaaagtaaaagtttcc

SEQ ID NO: 380386 - DNA, 20 bp, Artificial
  CRISPR gRNA sequence
tgaattccactgtatcagcc

SEQ ID NO: 380387 - DNA, 20 bp, Artificial
  CRISPR gRNA sequence
tgtatataaatttagtatta

SEQ ID NO: 380388 - DNA, 20 bp, Artificial
  CRISPR gRNA sequence
tttagtattatctggcttta

SEQ ID NO: 380389 - DNA, 20 bp, Artificial
  CRISPR gRNA sequence
tttttaaactttctcttttt

SEQ ID NO: 380390 - DNA, 20 bp, Artificial
  CRISPR gRNA sequence
actttctctttttttttgat

SEQ ID NO: 380391 - DNA, 20 bp, Artificial
  CRISPR gRNA sequence
ttttttttgatttttgatta

SEQ ID NO: 380392 - DNA, 20 bp, Artificial
  CRISPR gRNA sequence
gctttgcctgaaagcctgag

SEQ ID NO: 380393 - DNA, 20 bp, Artificial
  CRISPR gRNA sequence
gttcttgtgcctgttccttc

SEQ ID NO: 380394 - DNA, 20 bp, Artificial
  CRISPR gRNA sequence
cgttctggtaaccatccact

SEQ ID NO: 380395 - DNA, 20 bp, Artificial
  CRISPR gRNA sequence
gagaagtgcagtgaccataa

SEQ ID NO: 380396 - DNA, 20 bp, Artificial
  CRISPR gRNA sequence
cttgctttctgtgagtctta

SEQ ID NO: 380397 - DNA, 20 bp, Artificial
  CRISPR gRNA sequence
ctattttatttcattacgga

SEQ ID NO: 380398 - DNA, 20 bp, Artificial
  CRISPR gRNA sequence
gtgagatttttaagccttta

SEQ ID NO: 380399 - DNA, 20 bp, Artificial
  CRISPR gRNA sequence
tttttaagcctttaaaatgt

SEQ ID NO: 380400 - DNA, 20 bp, Artificial
  CRISPR gRNA sequence
aatgtttctgcttcatccct

SEQ ID NO: 380401 - DNA, 20 bp, Artificial
  CRISPR gRNA sequence
caccagaatgggcctgaaga

SEQ ID NO: 380402 - DNA, 20 bp, Artificial
  CRISPR gRNA sequence
atgggcctgaagagagagct

SEQ ID NO: 380403 - DNA, 20 bp, Artificial
  CRISPR gRNA sequence
tttctctgtggccttcttaa

SEQ ID NO: 380404 - DNA, 20 bp, Artificial
  CRISPR gRNA sequence
gatatgatagtgtcattttc

SEQ ID NO: 380405 - DNA, 20 bp, Artificial
  CRISPR gRNA sequence
aaatacaattgcatagtgca

SEQ ID NO: 380406 - DNA, 20 bp, Artificial
  CRISPR gRNA sequence
atgaattgtaaaccggaata

SEQ ID NO: 380407 - DNA, 20 bp, Artificial
  CRISPR gRNA sequence
ctatgtgttggttcaatttt

SEQ ID NO: 380408 - DNA, 20 bp, Artificial
  CRISPR gRNA sequence
ggttcaattttagaggtttt

SEQ ID NO: 380409 - DNA, 20 bp, Artificial
  CRISPR gRNA sequence
ctgaacattacattgtacat

SEQ ID NO: 380410 - DNA, 20 bp, Artificial
  CRISPR gRNA sequence
cagcacacccatttataaaa

SEQ ID NO: 380411 - DNA, 20 bp, Artificial
  CRISPR gRNA sequence
atttgagacacttccctctc

SEQ ID NO: 380412 - DNA, 20 bp, Artificial
  CRISPR gRNA sequence
ctttaaatcaaatttaaagg

SEQ ID NO: 380413 - DNA, 20 bp, Artificial
  CRISPR gRNA sequence
tctttagaatccctttcatc

SEQ ID NO: 380414 - DNA, 20 bp, Artificial
  CRISPR gRNA sequence
cagtgaggaacatctctgtg

SEQ ID NO: 380415 - DNA, 20 bp, Artificial
  CRISPR gRNA sequence
tcaaattggatattttcaat

SEQ ID NO: 380416 - DNA, 20 bp, Artificial
  CRISPR gRNA sequence
gcccccaggccatatcagaa

SEQ ID NO: 380417 - DNA, 20 bp, Artificial
  CRISPR gRNA sequence
tgaagatttcatccttacct

SEQ ID NO: 380418 - DNA, 20 bp, Artificial
  CRISPR gRNA sequence
tcttttcaccattagaaatc

SEQ ID NO: 380419 - DNA, 20 bp, Artificial
  CRISPR gRNA sequence
ggggtggatcacctgaggtc

SEQ ID NO: 380420 - DNA, 20 bp, Artificial
  CRISPR gRNA sequence
aaggaaaagaaaaagaaatc

SEQ ID NO: 380421 - DNA, 20 bp, Artificial
  CRISPR gRNA sequence
ttaaagaccctttcagccct

SEQ ID NO: 380422 - DNA, 20 bp, Artificial
  CRISPR gRNA sequence
tctattctatcccccaccta

SEQ ID NO: 380423 - DNA, 20 bp, Artificial
  CRISPR gRNA sequence
ccacctaccatgtttctgaa

SEQ ID NO: 380424 - DNA, 20 bp, Artificial
  CRISPR gRNA sequence
ttctgaactttgcttttctt

SEQ ID NO: 380425 - DNA, 20 bp, Artificial
  CRISPR gRNA sequence
tgcttttctttatagtttta

SEQ ID NO: 380426 - DNA, 20 bp, Artificial
  CRISPR gRNA sequence
gtttgtatctataaataacg

SEQ ID NO: 380427 - DNA, 20 bp, Artificial
  CRISPR gRNA sequence
aacctttaaagaaaaggaac

SEQ ID NO: 380428 - DNA, 20 bp, Artificial
  CRISPR gRNA sequence
tttctttcaacacaaagttc

SEQ ID NO: 380429 - DNA, 20 bp, Artificial
  CRISPR gRNA sequence
taatgtgtgaatagacctca

SEQ ID NO: 380430 - DNA, 20 bp, Artificial
  CRISPR gRNA sequence
cagagtagaattattggatc

SEQ ID NO: 380431 - DNA, 20 bp, Artificial
  CRISPR gRNA sequence
aattattggatcataggatt

SEQ ID NO: 380432 - DNA, 20 bp, Artificial
  CRISPR gRNA sequence
attttacgtgtcaatttgaa

SEQ ID NO: 380433 - DNA, 20 bp, Artificial
  CRISPR gRNA sequence
aatttgaagggtgttttggg

SEQ ID NO: 380434 - DNA, 20 bp, Artificial
  CRISPR gRNA sequence
aaattggtgaattttgaata

SEQ ID NO: 380435 - DNA, 20 bp, Artificial
  CRISPR gRNA sequence
agaccagcctccccaagcaa

SEQ ID NO: 380436 - DNA, 20 bp, Artificial
  CRISPR gRNA sequence
gggattctgcagcagatgac

SEQ ID NO: 380437 - DNA, 20 bp, Artificial
  CRISPR gRNA sequence
tgcaagcccacactgcaaat

SEQ ID NO: 380438 - DNA, 20 bp, Artificial
  CRISPR gRNA sequence
ggagataactgaatcatggg

SEQ ID NO: 380439 - DNA, 20 bp, Artificial
  CRISPR gRNA sequence
agttagttctcatgagatct

SEQ ID NO: 380440 - DNA, 20 bp, Artificial
  CRISPR gRNA sequence
tgagatctgatggttttata

SEQ ID NO: 380441 - DNA, 20 bp, Artificial
  CRISPR gRNA sequence
tgctaccatgtgaaggacat

SEQ ID NO: 380442 - DNA, 20 bp, Artificial
  CRISPR gRNA sequence
catatttgcttccccttcca

SEQ ID NO: 380443 - DNA, 20 bp, Artificial
  CRISPR gRNA sequence
cttccccttccaccatgatt

SEQ ID NO: 380444 - DNA, 20 bp, Artificial
  CRISPR gRNA sequence
gggtaacaggtagaggttgg

SEQ ID NO: 380445 - DNA, 20 bp, Artificial
  CRISPR gRNA sequence
aaggtcactcttgctatgca

SEQ ID NO: 380446 - DNA, 20 bp, Artificial
  CRISPR gRNA sequence
atcataagcctaggagggaa

SEQ ID NO: 380447 - DNA, 20 bp, Artificial
  CRISPR gRNA sequence
ggccaacatacagctcaggc

SEQ ID NO: 380448 - DNA, 20 bp, Artificial
  CRISPR gRNA sequence
gggtgcaagccccaagcctt

SEQ ID NO: 380449 - DNA, 20 bp, Artificial
  CRISPR gRNA sequence
ggtgcacagaagtcaagaac

SEQ ID NO: 380450 - DNA, 20 bp, Artificial
  CRISPR gRNA sequence
caatctgaatctgatccaca

SEQ ID NO: 380451 - DNA, 20 bp, Artificial
  CRISPR gRNA sequence
aggagatcatttttggaact

SEQ ID NO: 380452 - DNA, 20 bp, Artificial
  CRISPR gRNA sequence
gaagttttaatgactgccct

SEQ ID NO: 380453 - DNA, 20 bp, Artificial
  CRISPR gRNA sequence
ttgcatggagctagtagccc

SEQ ID NO: 380454 - DNA, 20 bp, Artificial
  CRISPR gRNA sequence
ttttatctaggaagtaacta

SEQ ID NO: 380455 - DNA, 20 bp, Artificial
  CRISPR gRNA sequence
ctaggaagtaactaacttgc

SEQ ID NO: 380456 - DNA, 20 bp, Artificial
  CRISPR gRNA sequence
gtattttgaaatgtgagggc

SEQ ID NO: 380457 - DNA, 20 bp, Artificial
  CRISPR gRNA sequence
ggggcaaaatgatataattt

SEQ ID NO: 380458 - DNA, 20 bp, Artificial
  CRISPR gRNA sequence
agtgaattctcacaaaatct

SEQ ID NO: 380459 - DNA, 20 bp, Artificial
  CRISPR gRNA sequence
caaaatctgatggttttata

SEQ ID NO: 380460 - DNA, 20 bp, Artificial
  CRISPR gRNA sequence
ctgctgccatgtgaagaagg

SEQ ID NO: 380461 - DNA, 20 bp, Artificial
  CRISPR gRNA sequence
catgtttgctccccttttca

SEQ ID NO: 380462 - DNA, 20 bp, Artificial
  CRISPR gRNA sequence
ctccccttttcaccatgatt

SEQ ID NO: 380463 - DNA, 20 bp, Artificial
  CRISPR gRNA sequence
gttccaatctacagatgcct

SEQ ID NO: 380464 - DNA, 20 bp, Artificial
  CRISPR gRNA sequence
tttaggtggtgaaagaaaaa

SEQ ID NO: 380465 - DNA, 20 bp, Artificial
  CRISPR gRNA sequence
ttaggcacatcaataacttt

SEQ ID NO: 380466 - DNA, 20 bp, Artificial
  CRISPR gRNA sequence
aagcacagaatctactgtac

SEQ ID NO: 380467 - DNA, 20 bp, Artificial
  CRISPR gRNA sequence
tcattctggtgctgccactt

SEQ ID NO: 380468 - DNA, 20 bp, Artificial
  CRISPR gRNA sequence
gggaacatattacctcccca

SEQ ID NO: 380469 - DNA, 20 bp, Artificial
  CRISPR gRNA sequence
tacctccccatagtgcttca

SEQ ID NO: 380470 - DNA, 20 bp, Artificial
  CRISPR gRNA sequence
atttctgtaaatgcaactat

SEQ ID NO: 380471 - DNA, 20 bp, Artificial
  CRISPR gRNA sequence
gccagagacacgtaggtgac

SEQ ID NO: 380472 - DNA, 20 bp, Artificial
  CRISPR gRNA sequence
catttattcagaataagatg

SEQ ID NO: 380473 - DNA, 20 bp, Artificial
  CRISPR gRNA sequence
acaaacgttcaagtgcacac

SEQ ID NO: 380474 - DNA, 20 bp, Artificial
  CRISPR gRNA sequence
cttacaatccattatacaaa

SEQ ID NO: 380475 - DNA, 20 bp, Artificial
  CRISPR gRNA sequence
ccattatacaaactaggatt

SEQ ID NO: 380476 - DNA, 20 bp, Artificial
  CRISPR gRNA sequence
tttttaaactcactatcatt

SEQ ID NO: 380477 - DNA, 20 bp, Artificial
  CRISPR gRNA sequence
tcctctatcctgaaaggttg

SEQ ID NO: 380478 - DNA, 20 bp, Artificial
  CRISPR gRNA sequence
cagtggggagtgcatcctgt

SEQ ID NO: 380479 - DNA, 20 bp, Artificial
  CRISPR gRNA sequence
tctagctttggtggctcagg

SEQ ID NO: 380480 - DNA, 20 bp, Artificial
  CRISPR gRNA sequence
ccaatggctcagtctatgtt

SEQ ID NO: 380481 - DNA, 20 bp, Artificial
  CRISPR gRNA sequence
atcttctacttcgcctgcct

SEQ ID NO: 380482 - DNA, 20 bp, Artificial
  CRISPR gRNA sequence
tacacagtaaaaacttccaa

SEQ ID NO: 380483 - DNA, 20 bp, Artificial
  CRISPR gRNA sequence
agggaaaactaaatatatga

SEQ ID NO: 380484 - DNA, 20 bp, Artificial
  CRISPR gRNA sequence
cacacagttccaaaaatatt

SEQ ID NO: 380485 - DNA, 20 bp, Artificial
  CRISPR gRNA sequence
gttccaaaaatattccctgc

SEQ ID NO: 380486 - DNA, 20 bp, Artificial
  CRISPR gRNA sequence
cccatttcctcttcaggaac

SEQ ID NO: 380487 - DNA, 20 bp, Artificial
  CRISPR gRNA sequence
aaagtgatgactataaaccc

SEQ ID NO: 380488 - DNA, 20 bp, Artificial
  CRISPR gRNA sequence
ggtgaaagatagagccaggg

SEQ ID NO: 380489 - DNA, 20 bp, Artificial
  CRISPR gRNA sequence
cagcctggcatggtgtatta

SEQ ID NO: 380490 - DNA, 20 bp, Artificial
  CRISPR gRNA sequence
ctgggcaatttacaaaagaa

SEQ ID NO: 380491 - DNA, 20 bp, Artificial
  CRISPR gRNA sequence
agcatgggaaagacttgccc

SEQ ID NO: 380492 - DNA, 20 bp, Artificial
  CRISPR gRNA sequence
ttgcggggctgaggtaggag

SEQ ID NO: 380493 - DNA, 20 bp, Artificial
  CRISPR gRNA sequence
aaagaaagaaagaaaacaaa

SEQ ID NO: 380494 - DNA, 20 bp, Artificial
  CRISPR gRNA sequence
tgaacccatgtgttgccaac

SEQ ID NO: 380495 - DNA, 20 bp, Artificial
  CRISPR gRNA sequence
tcattaagacaacaaaaaac

SEQ ID NO: 380496 - DNA, 20 bp, Artificial
  CRISPR gRNA sequence
cagaaaaatgaaacagactc

SEQ ID NO: 380497 - DNA, 20 bp, Artificial
  CRISPR gRNA sequence
agaaatacgagaagacattc

SEQ ID NO: 380498 - DNA, 20 bp, Artificial
  CRISPR gRNA sequence
agacattctatagcttctac

SEQ ID NO: 380499 - DNA, 20 bp, Artificial
  CRISPR gRNA sequence
aaatgttgtaagtggataaa

SEQ ID NO: 380500 - DNA, 20 bp, Artificial
  CRISPR gRNA sequence
aaaagtaaaccctctcagca

SEQ ID NO: 380501 - DNA, 20 bp, Artificial
  CRISPR gRNA sequence
ggaaacaccaaatcaatatc

SEQ ID NO: 380502 - DNA, 20 bp, Artificial
  CRISPR gRNA sequence
ttgagatcacagtaaaggct

SEQ ID NO: 380503 - DNA, 20 bp, Artificial
  CRISPR gRNA sequence
gataattggaaaatgtaact

SEQ ID NO: 380504 - DNA, 20 bp, Artificial
  CRISPR gRNA sequence
taggataatccatctctgga

SEQ ID NO: 380505 - DNA, 20 bp, Artificial
  CRISPR gRNA sequence
ctggttctattaaaaaaaaa

SEQ ID NO: 380506 - DNA, 20 bp, Artificial
  CRISPR gRNA sequence
catgcagatccccagcacaa

SEQ ID NO: 380507 - DNA, 20 bp, Artificial
  CRISPR gRNA sequence
tatgaacacaggaaaaaggc

SEQ ID NO: 380508 - DNA, 20 bp, Artificial
  CRISPR gRNA sequence
aaaaggccttagcttaaaag

SEQ ID NO: 380509 - DNA, 20 bp, Artificial
  CRISPR gRNA sequence
tttgctcctttatgaggatg

SEQ ID NO: 380510 - DNA, 20 bp, Artificial
  CRISPR gRNA sequence
ctttatgaggatgggcagat

SEQ ID NO: 380511 - DNA, 20 bp, Artificial
  CRISPR gRNA sequence
tcttctctctcggggaacca

SEQ ID NO: 380512 - DNA, 20 bp, Artificial
  CRISPR gRNA sequence
gggaaccagtcggcttattt

SEQ ID NO: 380513 - DNA, 20 bp, Artificial
  CRISPR gRNA sequence
cctccttgctgatctcagac

SEQ ID NO: 380514 - DNA, 20 bp, Artificial
  CRISPR gRNA sequence
atatgcagatctaccattat

SEQ ID NO: 380515 - DNA, 20 bp, Artificial
  CRISPR gRNA sequence
accattatgagagatttaac

SEQ ID NO: 380516 - DNA, 20 bp, Artificial
  CRISPR gRNA sequence
aattatagtacaatatcaaa

SEQ ID NO: 380517 - DNA, 20 bp, Artificial
  CRISPR gRNA sequence
tatctaatgccgaccctgaa

SEQ ID NO: 380518 - DNA, 20 bp, Artificial
  CRISPR gRNA sequence
taatcaagcatggtgtcacc

SEQ ID NO: 380519 - DNA, 20 bp, Artificial
  CRISPR gRNA sequence
tatatggcattatattttct

SEQ ID NO: 380520 - DNA, 20 bp, Artificial
  CRISPR gRNA sequence
atgatattatttgtgcctct

SEQ ID NO: 380521 - DNA, 20 bp, Artificial
  CRISPR gRNA sequence
tcaaaagaggcatctgttat

SEQ ID NO: 380522 - DNA, 20 bp, Artificial
  CRISPR gRNA sequence
gtactgagttatgctgggtc

SEQ ID NO: 380523 - DNA, 20 bp, Artificial
  CRISPR gRNA sequence
atctctatacaagtcatttg

SEQ ID NO: 380524 - DNA, 20 bp, Artificial
  CRISPR gRNA sequence
cagagagaacaaatcattct

SEQ ID NO: 380525 - DNA, 20 bp, Artificial
  CRISPR gRNA sequence
tcattctaatagattgtgga

SEQ ID NO: 380526 - DNA, 20 bp, Artificial
  CRISPR gRNA sequence
aaacagaggcgtgacaatgc

SEQ ID NO: 380527 - DNA, 20 bp, Artificial
  CRISPR gRNA sequence
agaaagcggtgcacacaact

SEQ ID NO: 380528 - DNA, 20 bp, Artificial
  CRISPR gRNA sequence
tgtcctattatgtcctaatg

SEQ ID NO: 380529 - DNA, 20 bp, Artificial
  CRISPR gRNA sequence
cacatatgcacacattcaca

SEQ ID NO: 380530 - DNA, 20 bp, Artificial
  CRISPR gRNA sequence
tcacatgcacgcacacatgc

SEQ ID NO: 380531 - DNA, 20 bp, Artificial
  CRISPR gRNA sequence
cacaaagtcagagactttgt

SEQ ID NO: 380532 - DNA, 20 bp, Artificial
  CRISPR gRNA sequence
acttcctggtacaattctaa

SEQ ID NO: 380533 - DNA, 20 bp, Artificial
  CRISPR gRNA sequence
ggtacaattctaagagcgat

SEQ ID NO: 380534 - DNA, 20 bp, Artificial
  CRISPR gRNA sequence
ttaagcaccagaatgatata

SEQ ID NO: 380535 - DNA, 20 bp, Artificial
  CRISPR gRNA sequence
cactcctagcagtactgtac

SEQ ID NO: 380536 - DNA, 20 bp, Artificial
  CRISPR gRNA sequence
agaagctattgtactgaaaa

SEQ ID NO: 380537 - DNA, 20 bp, Artificial
  CRISPR gRNA sequence
acagggtcttgctacattgc

SEQ ID NO: 380538 - DNA, 20 bp, Artificial
  CRISPR gRNA sequence
ggtcttgctacattgccaag

SEQ ID NO: 380539 - DNA, 20 bp, Artificial
  CRISPR gRNA sequence
ctacattgccaaggcttgct

SEQ ID NO: 380540 - DNA, 20 bp, Artificial
  CRISPR gRNA sequence
caccatgcccagcctgaaaa

SEQ ID NO: 380541 - DNA, 20 bp, Artificial
  CRISPR gRNA sequence
atgcccagcctgaaaactat

SEQ ID NO: 380542 - DNA, 20 bp, Artificial
  CRISPR gRNA sequence
acaatttctcttctctccat

SEQ ID NO: 380543 - DNA, 20 bp, Artificial
  CRISPR gRNA sequence
ttaaaaatatacctgccctt

SEQ ID NO: 380544 - DNA, 20 bp, Artificial
  CRISPR gRNA sequence
accccactgagtggggaaag

SEQ ID NO: 380545 - DNA, 20 bp, Artificial
  CRISPR gRNA sequence
tttaagacctggaagttgtc

SEQ ID NO: 380546 - DNA, 20 bp, Artificial
  CRISPR gRNA sequence
caaatatttgcaaataatct

SEQ ID NO: 380547 - DNA, 20 bp, Artificial
  CRISPR gRNA sequence
atgatgcagctgctgtgaag

SEQ ID NO: 380548 - DNA, 20 bp, Artificial
  CRISPR gRNA sequence
agctgctgtgaagaacagtt

SEQ ID NO: 380549 - DNA, 20 bp, Artificial
  CRISPR gRNA sequence
gagattcttcaaaacgttca

SEQ ID NO: 380550 - DNA, 20 bp, Artificial
  CRISPR gRNA sequence
acaggattactgtatgaccc

SEQ ID NO: 380551 - DNA, 20 bp, Artificial
  CRISPR gRNA sequence
tcaaaccaatatttgtagac

SEQ ID NO: 380552 - DNA, 20 bp, Artificial
  CRISPR gRNA sequence
ttaaatccatggagatggaa

SEQ ID NO: 380553 - DNA, 20 bp, Artificial
  CRISPR gRNA sequence
catggagatggaaagcagat

SEQ ID NO: 380554 - DNA, 20 bp, Artificial
  CRISPR gRNA sequence
aagcagattggtgatttgcc

SEQ ID NO: 380555 - DNA, 20 bp, Artificial
  CRISPR gRNA sequence
ggaaggagggaatagggagt

SEQ ID NO: 380556 - DNA, 20 bp, Artificial
  CRISPR gRNA sequence
gggagtgactgtttaaggta

SEQ ID NO: 380557 - DNA, 20 bp, Artificial
  CRISPR gRNA sequence
ggttttctttaaaatgatga

SEQ ID NO: 380558 - DNA, 20 bp, Artificial
  CRISPR gRNA sequence
tactttgggaggccaaggca

SEQ ID NO: 380559 - DNA, 20 bp, Artificial
  CRISPR gRNA sequence
ttgggaggccaaggcaggtg

SEQ ID NO: 380560 - DNA, 20 bp, Artificial
  CRISPR gRNA sequence
ttgggaggctgagacaggag

SEQ ID NO: 380561 - DNA, 20 bp, Artificial
  CRISPR gRNA sequence
gaggtggaggttgcagtgag

SEQ ID NO: 380562 - DNA, 20 bp, Artificial
  CRISPR gRNA sequence
gccaggtcaacagagcaaga

SEQ ID NO: 380563 - DNA, 20 bp, Artificial
  CRISPR gRNA sequence
ccgtttcaaaaaaaaaaaaa

SEQ ID NO: 380564 - DNA, 20 bp, Artificial
  CRISPR gRNA sequence
cttgctgttggccacgtatt

SEQ ID NO: 380565 - DNA, 20 bp, Artificial
  CRISPR gRNA sequence
gatagtcgaggttgtcagat

SEQ ID NO: 380566 - DNA, 20 bp, Artificial
  CRISPR gRNA sequence
agatatttttaaaaatcatt

SEQ ID NO: 380567 - DNA, 20 bp, Artificial
  CRISPR gRNA sequence
acctagcatcatccactctc

SEQ ID NO: 380568 - DNA, 20 bp, Artificial
  CRISPR gRNA sequence
gaattgagggtcctagaggt

SEQ ID NO: 380569 - DNA, 20 bp, Artificial
  CRISPR gRNA sequence
taaccaaagacaaatagaga

SEQ ID NO: 380570 - DNA, 20 bp, Artificial
  CRISPR gRNA sequence
tgtgtcagcagccatttttt

SEQ ID NO: 380571 - DNA, 20 bp, Artificial
  CRISPR gRNA sequence
cattttttgcatgatttatg

SEQ ID NO: 380572 - DNA, 20 bp, Artificial
  CRISPR gRNA sequence
tgcatgatttatgaagggat

SEQ ID NO: 380573 - DNA, 20 bp, Artificial
  CRISPR gRNA sequence
tttatgaagggattttggct

SEQ ID NO: 380574 - DNA, 20 bp, Artificial
  CRISPR gRNA sequence
taatagagctgtctgtataa

SEQ ID NO: 380575 - DNA, 20 bp, Artificial
  CRISPR gRNA sequence
aagtcattaatcaaaatatt

SEQ ID NO: 380576 - DNA, 20 bp, Artificial
  CRISPR gRNA sequence
catgagcatgaattcatctc

SEQ ID NO: 380577 - DNA, 20 bp, Artificial
  CRISPR gRNA sequence
ggtagaaccttccctgtcac

SEQ ID NO: 380578 - DNA, 20 bp, Artificial
  CRISPR gRNA sequence
cttccctgtcacctcagttt

SEQ ID NO: 380579 - DNA, 20 bp, Artificial
  CRISPR gRNA sequence
tttctgctacctacaatatg

SEQ ID NO: 380580 - DNA, 20 bp, Artificial
  CRISPR gRNA sequence
cctgcttccccagatgtctc

SEQ ID NO: 380581 - DNA, 20 bp, Artificial
  CRISPR gRNA sequence
tactcaatgaccccaccttc

SEQ ID NO: 380582 - DNA, 20 bp, Artificial
  CRISPR gRNA sequence
ctgctctgatacctttcgac

SEQ ID NO: 380583 - DNA, 20 bp, Artificial
  CRISPR gRNA sequence
agaacaagtgactggggctg

SEQ ID NO: 380584 - DNA, 20 bp, Artificial
  CRISPR gRNA sequence
gggaagattatagtgtgaga

SEQ ID NO: 380585 - DNA, 20 bp, Artificial
  CRISPR gRNA sequence
ctccactccttctcagatgc

SEQ ID NO: 380586 - DNA, 20 bp, Artificial
  CRISPR gRNA sequence
ttaagaggctcatacttcca

SEQ ID NO: 380587 - DNA, 20 bp, Artificial
  CRISPR gRNA sequence
aatggcgtgaacccaggagg

SEQ ID NO: 380588 - DNA, 20 bp, Artificial
  CRISPR gRNA sequence
ttcctcaggaacacaatagt

SEQ ID NO: 380589 - DNA, 20 bp, Artificial
  CRISPR gRNA sequence
cctgagggctgggcgcagcc

SEQ ID NO: 380590 - DNA, 20 bp, Artificial
  CRISPR gRNA sequence
gcagcccactgatttccata

SEQ ID NO: 380591 - DNA, 20 bp, Artificial
  CRISPR gRNA sequence
cttggttacataccatccac

SEQ ID NO: 380592 - DNA, 20 bp, Artificial
  CRISPR gRNA sequence
actatctggccctttacaga

SEQ ID NO: 380593 - DNA, 20 bp, Artificial
  CRISPR gRNA sequence
ttcagtcttgctggagagaa

SEQ ID NO: 380594 - DNA, 20 bp, Artificial
  CRISPR gRNA sequence
ttgctggagagaaggaagat

SEQ ID NO: 380595 - DNA, 20 bp, Artificial
  CRISPR gRNA sequence
ccagatgccggtaaaattag

SEQ ID NO: 380596 - DNA, 20 bp, Artificial
  CRISPR gRNA sequence
acaccgagcacttaacttac

SEQ ID NO: 380597 - DNA, 20 bp, Artificial
  CRISPR gRNA sequence
gtcctgctgcatcaacttgc

SEQ ID NO: 380598 - DNA, 20 bp, Artificial
  CRISPR gRNA sequence
ggcagcccccaccctttcgc

SEQ ID NO: 380599 - DNA, 20 bp, Artificial
  CRISPR gRNA sequence
gatgtgagtgctgctcgctc

SEQ ID NO: 380600 - DNA, 20 bp, Artificial
  CRISPR gRNA sequence
ggttaaggacttttatcgta

SEQ ID NO: 380601 - DNA, 20 bp, Artificial
  CRISPR gRNA sequence
atcactaatatttcatgaag

SEQ ID NO: 380602 - DNA, 20 bp, Artificial
  CRISPR gRNA sequence
tgaagcggggttttttgaag

SEQ ID NO: 380603 - DNA, 20 bp, Artificial
  CRISPR gRNA sequence
ggttttttgaagtcaagttt

SEQ ID NO: 380604 - DNA, 20 bp, Artificial
  CRISPR gRNA sequence
aaactacactccccgccgaa

SEQ ID NO: 380605 - DNA, 20 bp, Artificial
  CRISPR gRNA sequence
tacactccccgccgaaatca

SEQ ID NO: 380606 - DNA, 20 bp, Artificial
  CRISPR gRNA sequence
gtttctttgccttttcttcc

SEQ ID NO: 380607 - DNA, 20 bp, Artificial
  CRISPR gRNA sequence
tttcctgccaatcaaagcac

SEQ ID NO: 380608 - DNA, 20 bp, Artificial
  CRISPR gRNA sequence
gaagaaaaggcaaagaaaca

SEQ ID NO: 380609 - DNA, 20 bp, Artificial
  CRISPR gRNA sequence
aaactgatttcggcggggag

SEQ ID NO: 380610 - DNA, 20 bp, Artificial
  CRISPR gRNA sequence
agaagtgcgtcctttcaaat

SEQ ID NO: 380611 - DNA, 20 bp, Artificial
  CRISPR gRNA sequence
aaagagggacagaactttat

SEQ ID NO: 380612 - DNA, 20 bp, Artificial
  CRISPR gRNA sequence
ctgagtagctgcaatagtaa

SEQ ID NO: 380613 - DNA, 20 bp, Artificial
  CRISPR gRNA sequence
gtaaacttgacttcaaaaaa

SEQ ID NO: 380614 - DNA, 20 bp, Artificial
  CRISPR gRNA sequence
aaccccgcttcatgaaatat

SEQ ID NO: 380615 - DNA, 20 bp, Artificial
  CRISPR gRNA sequence
aattaagggagggagcagcg

SEQ ID NO: 380616 - DNA, 20 bp, Artificial
  CRISPR gRNA sequence
tgctcggtgttctgtgaact

SEQ ID NO: 380617 - DNA, 20 bp, Artificial
  CRISPR gRNA sequence
actgttagtttaatgagggg

SEQ ID NO: 380618 - DNA, 20 bp, Artificial
  CRISPR gRNA sequence
ttttaccggcatctggtctg

SEQ ID NO: 380619 - DNA, 20 bp, Artificial
  CRISPR gRNA sequence
aataataaatgtccatgatc

SEQ ID NO: 380620 - DNA, 20 bp, Artificial
  CRISPR gRNA sequence
agggccagatagttaatatt

SEQ ID NO: 380621 - DNA, 20 bp, Artificial
  CRISPR gRNA sequence
agcatggctgtctccaacca

SEQ ID NO: 380622 - DNA, 20 bp, Artificial
  CRISPR gRNA sequence
gctgcgcccagccctcaggc

SEQ ID NO: 380623 - DNA, 20 bp, Artificial
  CRISPR gRNA sequence
acattggaaaggttctctta

SEQ ID NO: 380624 - DNA, 20 bp, Artificial
  CRISPR gRNA sequence
ttttgtatttttagcagaga

SEQ ID NO: 380625 - DNA, 20 bp, Artificial
  CRISPR gRNA sequence
cgcccgcctcggccttcact

SEQ ID NO: 380626 - DNA, 20 bp, Artificial
  CRISPR gRNA sequence
cccagccccagtcacttgtt

SEQ ID NO: 380627 - DNA, 20 bp, Artificial
  CRISPR gRNA sequence
agtcacttgttctgagttta

SEQ ID NO: 380628 - DNA, 20 bp, Artificial
  CRISPR gRNA sequence
tagattttctgttcacagtc

SEQ ID NO: 380629 - DNA, 20 bp, Artificial
  CRISPR gRNA sequence
cctctgctttccagcatgtg

SEQ ID NO: 380630 - DNA, 20 bp, Artificial
  CRISPR gRNA sequence
caagtgtcgaaaggtatcag

SEQ ID NO: 380631 - DNA, 20 bp, Artificial
  CRISPR gRNA sequence
gattctccatcacacacatc

SEQ ID NO: 380632 - DNA, 20 bp, Artificial
  CRISPR gRNA sequence
ctaggagtctgcattcagag

SEQ ID NO: 380633 - DNA, 20 bp, Artificial
  CRISPR gRNA sequence
agtagagaaatccagtaata

SEQ ID NO: 380634 - DNA, 20 bp, Artificial
  CRISPR gRNA sequence
accaccgagagtggatgatg

SEQ ID NO: 380635 - DNA, 20 bp, Artificial
  CRISPR gRNA sequence
taggtttcatctcatttcct

SEQ ID NO: 380636 - DNA, 20 bp, Artificial
  CRISPR gRNA sequence
ggcagcacggtgttgcagat

SEQ ID NO: 380637 - DNA, 20 bp, Artificial
  CRISPR gRNA sequence
acccctccctcagaaaatag

SEQ ID NO: 380638 - DNA, 20 bp, Artificial
  CRISPR gRNA sequence
gaaaatagatatgttttggc

SEQ ID NO: 380639 - DNA, 20 bp, Artificial
  CRISPR gRNA sequence
gcatttgtttaataagcaca

SEQ ID NO: 380640 - DNA, 20 bp, Artificial
  CRISPR gRNA sequence
actatcatgatcttttgcat

SEQ ID NO: 380641 - DNA, 20 bp, Artificial
  CRISPR gRNA sequence
acagagtgtgtctgtggact

SEQ ID NO: 380642 - DNA, 20 bp, Artificial
  CRISPR gRNA sequence
attcacataacattgttcac

SEQ ID NO: 380643 - DNA, 20 bp, Artificial
  CRISPR gRNA sequence
tcacctaagatttagtcaac

SEQ ID NO: 380644 - DNA, 20 bp, Artificial
  CRISPR gRNA sequence
aacctccacctcctgggttc

SEQ ID NO: 380645 - DNA, 20 bp, Artificial
  CRISPR gRNA sequence
tgtctcagcctcccaagtag

SEQ ID NO: 380646 - DNA, 20 bp, Artificial
  CRISPR gRNA sequence
ttttgtatttttagtagagt

SEQ ID NO: 380647 - DNA, 20 bp, Artificial
  CRISPR gRNA sequence
ggtttcaccatgttggccag

SEQ ID NO: 380648 - DNA, 20 bp, Artificial
  CRISPR gRNA sequence
tgccttggcctcccaaagta

SEQ ID NO: 380649 - DNA, 20 bp, Artificial
  CRISPR gRNA sequence
gtgtgagccaccacaccagg

SEQ ID NO: 380650 - DNA, 20 bp, Artificial
  CRISPR gRNA sequence
catccacagtgttctgtgat

SEQ ID NO: 380651 - DNA, 20 bp, Artificial
  CRISPR gRNA sequence
gttctgtgatgaccgctttt

SEQ ID NO: 380652 - DNA, 20 bp, Artificial
  CRISPR gRNA sequence
aatcaattggcaaatcacca

SEQ ID NO: 380653 - DNA, 20 bp, Artificial
  CRISPR gRNA sequence
accaatctgctttccatctc

SEQ ID NO: 380654 - DNA, 20 bp, Artificial
  CRISPR gRNA sequence
ctatctggatatttcatata

SEQ ID NO: 380655 - DNA, 20 bp, Artificial
  CRISPR gRNA sequence
gattcttacaaaatgtggcc

SEQ ID NO: 380656 - DNA, 20 bp, Artificial
  CRISPR gRNA sequence
ttgacttagcataatgttat

SEQ ID NO: 380657 - DNA, 20 bp, Artificial
  CRISPR gRNA sequence
ggctgagtaatattccattg

SEQ ID NO: 380658 - DNA, 20 bp, Artificial
  CRISPR gRNA sequence
tcattcattcacctgttggc

SEQ ID NO: 380659 - DNA, 20 bp, Artificial
  CRISPR gRNA sequence
cgcttggatcgttaccacct

SEQ ID NO: 380660 - DNA, 20 bp, Artificial
  CRISPR gRNA sequence
gtaaacattggtctacaaat

SEQ ID NO: 380661 - DNA, 20 bp, Artificial
  CRISPR gRNA sequence
ggtcatacagtaatcctgtt

SEQ ID NO: 380662 - DNA, 20 bp, Artificial
  CRISPR gRNA sequence
catcattttacatttcttta

SEQ ID NO: 380663 - DNA, 20 bp, Artificial
  CRISPR gRNA sequence
taacatattaatttttctct

SEQ ID NO: 380664 - DNA, 20 bp, Artificial
  CRISPR gRNA sequence
gttctcattgtggttcttat

SEQ ID NO: 380665 - DNA, 20 bp, Artificial
  CRISPR gRNA sequence
ctttgcccatttgaaaattg

SEQ ID NO: 380666 - DNA, 20 bp, Artificial
  CRISPR gRNA sequence
tggatattagaccataatca

SEQ ID NO: 380667 - DNA, 20 bp, Artificial
  CRISPR gRNA sequence
cagatagattatttgcaaat

SEQ ID NO: 380668 - DNA, 20 bp, Artificial
  CRISPR gRNA sequence
gaaaatgtcctttgatgcac

SEQ ID NO: 380669 - DNA, 20 bp, Artificial
  CRISPR gRNA sequence
atttttttcttttgttgccc

SEQ ID NO: 380670 - DNA, 20 bp, Artificial
  CRISPR gRNA sequence
caggtcttaaaaatttaccc

SEQ ID NO: 380671 - DNA, 20 bp, Artificial
  CRISPR gRNA sequence
aatttacccctgtgcttatt

SEQ ID NO: 380672 - DNA, 20 bp, Artificial
  CRISPR gRNA sequence
aacccattttgagttaattt

SEQ ID NO: 380673 - DNA, 20 bp, Artificial
  CRISPR gRNA sequence
acggaggtagggatccaatt

SEQ ID NO: 380674 - DNA, 20 bp, Artificial
  CRISPR gRNA sequence
tatcaattgttcatagatgt

SEQ ID NO: 380675 - DNA, 20 bp, Artificial
  CRISPR gRNA sequence
ataaattcaaggggtacaag

SEQ ID NO: 380676 - DNA, 20 bp, Artificial
  CRISPR gRNA sequence
caagggcagttttgtacaag

SEQ ID NO: 380677 - DNA, 20 bp, Artificial
  CRISPR gRNA sequence
cccatttataagtgagaaca

SEQ ID NO: 380678 - DNA, 20 bp, Artificial
  CRISPR gRNA sequence
taagtgagaacatgtggttt

SEQ ID NO: 380679 - DNA, 20 bp, Artificial
  CRISPR gRNA sequence
tttttgagtttctgtgtctg

SEQ ID NO: 380680 - DNA, 20 bp, Artificial
  CRISPR gRNA sequence
tgagttgtttcatttaatat

SEQ ID NO: 380681 - DNA, 20 bp, Artificial
  CRISPR gRNA sequence
tatctatgttgctgcaaaag

SEQ ID NO: 380682 - DNA, 20 bp, Artificial
  CRISPR gRNA sequence
attccattgtggatatatac

SEQ ID NO: 380683 - DNA, 20 bp, Artificial
  CRISPR gRNA sequence
ccttcattgatgggcactta

SEQ ID NO: 380684 - DNA, 20 bp, Artificial
  CRISPR gRNA sequence
gggcaggtatatttttaata

SEQ ID NO: 380685 - DNA, 20 bp, Artificial
  CRISPR gRNA sequence
tcctccacatcctacctaac

SEQ ID NO: 380686 - DNA, 20 bp, Artificial
  CRISPR gRNA sequence
tatgtatatgccaataccca

SEQ ID NO: 380687 - DNA, 20 bp, Artificial
  CRISPR gRNA sequence
atatgccaatacccacactg

SEQ ID NO: 380688 - DNA, 20 bp, Artificial
  CRISPR gRNA sequence
tgattactgtagctgtgtac

SEQ ID NO: 380689 - DNA, 20 bp, Artificial
  CRISPR gRNA sequence
gaaatgggaaatgttagtct

SEQ ID NO: 380690 - DNA, 20 bp, Artificial
  CRISPR gRNA sequence
tatgttcagacttcagagtt

SEQ ID NO: 380691 - DNA, 20 bp, Artificial
  CRISPR gRNA sequence
cattctgtctctctctacca

SEQ ID NO: 380692 - DNA, 20 bp, Artificial
  CRISPR gRNA sequence
taccaccctgtttgtcctca

SEQ ID NO: 380693 - DNA, 20 bp, Artificial
  CRISPR gRNA sequence
gagaaattgttcacattcca

SEQ ID NO: 380694 - DNA, 20 bp, Artificial
  CRISPR gRNA sequence
atgggccaactcaggccata

SEQ ID NO: 380695 - DNA, 20 bp, Artificial
  CRISPR gRNA sequence
ctctgacccctcaaatcaat

SEQ ID NO: 380696 - DNA, 20 bp, Artificial
  CRISPR gRNA sequence
tgggagggtcacttgagacc

SEQ ID NO: 380697 - DNA, 20 bp, Artificial
  CRISPR gRNA sequence
cacacacacacacacaaaat

SEQ ID NO: 380698 - DNA, 20 bp, Artificial
  CRISPR gRNA sequence
aaaatcatagttttcagtac

SEQ ID NO: 380699 - DNA, 20 bp, Artificial
  CRISPR gRNA sequence
ttatctttctaataattgaa

SEQ ID NO: 380700 - DNA, 20 bp, Artificial
  CRISPR gRNA sequence
gaaatctgattatatcattc

SEQ ID NO: 380701 - DNA, 20 bp, Artificial
  CRISPR gRNA sequence
ccccactcatctctacatct

SEQ ID NO: 380702 - DNA, 20 bp, Artificial
  CRISPR gRNA sequence
cccctcaatgtatccagcta

SEQ ID NO: 380703 - DNA, 20 bp, Artificial
  CRISPR gRNA sequence
ccctgcatgtggccacagcc

SEQ ID NO: 380704 - DNA, 20 bp, Artificial
  CRISPR gRNA sequence
tggccacagcctcctgcttc

SEQ ID NO: 380705 - DNA, 20 bp, Artificial
  CRISPR gRNA sequence
gaccaccaacctgacacagc

SEQ ID NO: 380706 - DNA, 20 bp, Artificial
  CRISPR gRNA sequence
ttctctcccatgcctgtgtg

SEQ ID NO: 380707 - DNA, 20 bp, Artificial
  CRISPR gRNA sequence
caactagactgggggcatga

SEQ ID NO: 380708 - DNA, 20 bp, Artificial
  CRISPR gRNA sequence
tgttagactttggccgtaca

SEQ ID NO: 380709 - DNA, 20 bp, Artificial
  CRISPR gRNA sequence
gtgagtgtatgcatgtacga

SEQ ID NO: 380710 - DNA, 20 bp, Artificial
  CRISPR gRNA sequence
ttgagagtacgtgcagatgc

SEQ ID NO: 380711 - DNA, 20 bp, Artificial
  CRISPR gRNA sequence
gtgcagatgcatgtgattgt

SEQ ID NO: 380712 - DNA, 20 bp, Artificial
  CRISPR gRNA sequence
atgtgtgtgagtgcatgtat

SEQ ID NO: 380713 - DNA, 20 bp, Artificial
  CRISPR gRNA sequence
gagagtatgtgtgcacctgc

SEQ ID NO: 380714 - DNA, 20 bp, Artificial
  CRISPR gRNA sequence
gtgcatgcgtgtgtgtggat

SEQ ID NO: 380715 - DNA, 20 bp, Artificial
  CRISPR gRNA sequence
gagagtatatgtgcacatgc

SEQ ID NO: 380716 - DNA, 20 bp, Artificial
  CRISPR gRNA sequence
gagagtatgtgtgcacatgc

SEQ ID NO: 380717 - DNA, 20 bp, Artificial
  CRISPR gRNA sequence
gcatgtgtgtgtgagtgcat

SEQ ID NO: 380718 - DNA, 20 bp, Artificial
  CRISPR gRNA sequence
gacctcaggaattctctgga

SEQ ID NO: 380719 - DNA, 20 bp, Artificial
  CRISPR gRNA sequence
acttggtttagcccggcatt

SEQ ID NO: 380720 - DNA, 20 bp, Artificial
  CRISPR gRNA sequence
ggtttagcccggcatttgta

SEQ ID NO: 380721 - DNA, 20 bp, Artificial
  CRISPR gRNA sequence
gtcttccatgtccttgccac

SEQ ID NO: 380722 - DNA, 20 bp, Artificial
  CRISPR gRNA sequence
cagtttgttctgtacagtga

SEQ ID NO: 380723 - DNA, 20 bp, Artificial
  CRISPR gRNA sequence
ccaaaacgcgaagttgtgtg

SEQ ID NO: 380724 - DNA, 20 bp, Artificial
  CRISPR gRNA sequence
cgtcacaggcgttactgaga

SEQ ID NO: 380725 - DNA, 20 bp, Artificial
  CRISPR gRNA sequence
tacagaagttagcatgacgc

SEQ ID NO: 380726 - DNA, 20 bp, Artificial
  CRISPR gRNA sequence
agttagcatgacgccgcggt

SEQ ID NO: 380727 - DNA, 20 bp, Artificial
  CRISPR gRNA sequence
gacgccgcggtttctgattg

SEQ ID NO: 380728 - DNA, 20 bp, Artificial
  CRISPR gRNA sequence
aaacacccgcattgtcacgc

SEQ ID NO: 380729 - DNA, 20 bp, Artificial
  CRISPR gRNA sequence
accttttccacaatctatta

SEQ ID NO: 380730 - DNA, 20 bp, Artificial
  CRISPR gRNA sequence
tattagaatgatttgttctc

SEQ ID NO: 380731 - DNA, 20 bp, Artificial
  CRISPR gRNA sequence
aatgacttgtatagagatga

SEQ ID NO: 380732 - DNA, 20 bp, Artificial
  CRISPR gRNA sequence
gatcatgttttgctacaata

SEQ ID NO: 380733 - DNA, 20 bp, Artificial
  CRISPR gRNA sequence
agagcagagatgtgtcctct

SEQ ID NO: 380734 - DNA, 20 bp, Artificial
  CRISPR gRNA sequence
catataaacacaaggtgaca

SEQ ID NO: 380735 - DNA, 20 bp, Artificial
  CRISPR gRNA sequence
taaacacaaggtgacaccat

SEQ ID NO: 380736 - DNA, 20 bp, Artificial
  CRISPR gRNA sequence
atgtacacattacaattttg

SEQ ID NO: 380737 - DNA, 20 bp, Artificial
  CRISPR gRNA sequence
tgttctgattatcattgcat

SEQ ID NO: 380738 - DNA, 20 bp, Artificial
  CRISPR gRNA sequence
cattagataaaattgtcttc

SEQ ID NO: 380739 - DNA, 20 bp, Artificial
  CRISPR gRNA sequence
tgatgaacctgaaaaatgaa

SEQ ID NO: 380740 - DNA, 20 bp, Artificial
  CRISPR gRNA sequence
ccagcatacttttgtatctg

SEQ ID NO: 380741 - DNA, 20 bp, Artificial
  CRISPR gRNA sequence
ttgtatctgatgggcttttg

SEQ ID NO: 380742 - DNA, 20 bp, Artificial
  CRISPR gRNA sequence
ttatatttttacatctttat

SEQ ID NO: 380743 - DNA, 20 bp, Artificial
  CRISPR gRNA sequence
gcacagagaatgcatgcagc

SEQ ID NO: 380744 - DNA, 20 bp, Artificial
  CRISPR gRNA sequence
ttaatagaaccagcctttca

SEQ ID NO: 380745 - DNA, 20 bp, Artificial
  CRISPR gRNA sequence
cctttcaaacagtttccaga

SEQ ID NO: 380746 - DNA, 20 bp, Artificial
  CRISPR gRNA sequence
tgatctttatattttcattt

SEQ ID NO: 380747 - DNA, 20 bp, Artificial
  CRISPR gRNA sequence
ttttcatttaaaagttttgc

SEQ ID NO: 380748 - DNA, 20 bp, Artificial
  CRISPR gRNA sequence
tttaaaagttttgctcctgt

SEQ ID NO: 380749 - DNA, 20 bp, Artificial
  CRISPR gRNA sequence
tctcaatgcactaggtcttc

SEQ ID NO: 380750 - DNA, 20 bp, Artificial
  CRISPR gRNA sequence
aggtcttcaaaagcttaaga

SEQ ID NO: 380751 - DNA, 20 bp, Artificial
  CRISPR gRNA sequence
aaaagcttaagatattgatt

SEQ ID NO: 380752 - DNA, 20 bp, Artificial
  CRISPR gRNA sequence
tatttcagctctatgtgaag

SEQ ID NO: 380753 - DNA, 20 bp, Artificial
  CRISPR gRNA sequence
tggttcaagatcgggaccca

SEQ ID NO: 380754 - DNA, 20 bp, Artificial
  CRISPR gRNA sequence
ataaggaagccctatgctga

SEQ ID NO: 380755 - DNA, 20 bp, Artificial
  CRISPR gRNA sequence
gtttactttttgaattcaac

SEQ ID NO: 380756 - DNA, 20 bp, Artificial
  CRISPR gRNA sequence
ggtggttcagtcaggtaagg

SEQ ID NO: 380757 - DNA, 20 bp, Artificial
  CRISPR gRNA sequence
cattctccaattccatttct

SEQ ID NO: 380758 - DNA, 20 bp, Artificial
  CRISPR gRNA sequence
atttctagatgctttgatgt

SEQ ID NO: 380759 - DNA, 20 bp, Artificial
  CRISPR gRNA sequence
ttgaaggagcaatcttggga

SEQ ID NO: 380760 - DNA, 20 bp, Artificial
  CRISPR gRNA sequence
tgaatgtagtagaagaaagc

SEQ ID NO: 380761 - DNA, 20 bp, Artificial
  CRISPR gRNA sequence
tgtcttaatgataacctgag

SEQ ID NO: 380762 - DNA, 20 bp, Artificial
  CRISPR gRNA sequence
acatgggttcaggatccttt

SEQ ID NO: 380763 - DNA, 20 bp, Artificial
  CRISPR gRNA sequence
ttcttcctacagtaccaaat

SEQ ID NO: 380764 - DNA, 20 bp, Artificial
  CRISPR gRNA sequence
tcctacagtaccaaatctaa

SEQ ID NO: 380765 - DNA, 20 bp, Artificial
  CRISPR gRNA sequence
aacctccagctcctgggctc

SEQ ID NO: 380766 - DNA, 20 bp, Artificial
  CRISPR gRNA sequence
aggtgtgcaccgccacgtga

SEQ ID NO: 380767 - DNA, 20 bp, Artificial
  CRISPR gRNA sequence
gcataagtctcatgagatct

SEQ ID NO: 380768 - DNA, 20 bp, Artificial
  CRISPR gRNA sequence
agttcccctgcactagctct

SEQ ID NO: 380769 - DNA, 20 bp, Artificial
  CRISPR gRNA sequence
tgacttctccttgccttcca

SEQ ID NO: 380770 - DNA, 20 bp, Artificial
  CRISPR gRNA sequence
cttgccttccaccttgattg

SEQ ID NO: 380771 - DNA, 20 bp, Artificial
  CRISPR gRNA sequence
cggactaatacaccatgcca

SEQ ID NO: 380772 - DNA, 20 bp, Artificial
  CRISPR gRNA sequence
tgttgtattttttgtagaga

SEQ ID NO: 380773 - DNA, 20 bp, Artificial
  CRISPR gRNA sequence
tgcctcggcctcccagagtg

SEQ ID NO: 380774 - DNA, 20 bp, Artificial
  CRISPR gRNA sequence
aggattactggcatgaacca

SEQ ID NO: 380775 - DNA, 20 bp, Artificial
  CRISPR gRNA sequence
ggctctatctttcacctcat

SEQ ID NO: 380776 - DNA, 20 bp, Artificial
  CRISPR gRNA sequence
aagaacccaatgatcccttg

SEQ ID NO: 380777 - DNA, 20 bp, Artificial
  CRISPR gRNA sequence
caatgatcccttggagtgtt

SEQ ID NO: 380778 - DNA, 20 bp, Artificial
  CRISPR gRNA sequence
gtgttttttgctttatctac

SEQ ID NO: 380779 - DNA, 20 bp, Artificial
  CRISPR gRNA sequence
ttgctttatctaccagagat

SEQ ID NO: 380780 - DNA, 20 bp, Artificial
  CRISPR gRNA sequence
ttgtagtatattggaaacac

SEQ ID NO: 380781 - DNA, 20 bp, Artificial
  CRISPR gRNA sequence
atgatacatcttattatttc

SEQ ID NO: 380782 - DNA, 20 bp, Artificial
  CRISPR gRNA sequence
cagggaatatttttggaact

SEQ ID NO: 380783 - DNA, 20 bp, Artificial
  CRISPR gRNA sequence
ttttatgacatctgacataa

SEQ ID NO: 380784 - DNA, 20 bp, Artificial
  CRISPR gRNA sequence
ataagaaacatcttcatata

SEQ ID NO: 380785 - DNA, 20 bp, Artificial
  CRISPR gRNA sequence
actaattttgtgtatatagc

SEQ ID NO: 380786 - DNA, 20 bp, Artificial
  CRISPR gRNA sequence
gcttatagagtgtcaattta

SEQ ID NO: 380787 - DNA, 20 bp, Artificial
  CRISPR gRNA sequence
tttacaatgtttctttagtt

SEQ ID NO: 380788 - DNA, 20 bp, Artificial
  CRISPR gRNA sequence
aaatgtttatttattaaaga

SEQ ID NO: 380789 - DNA, 20 bp, Artificial
  CRISPR gRNA sequence
gtatgtagacacctgttaaa

SEQ ID NO: 380790 - DNA, 20 bp, Artificial
  CRISPR gRNA sequence
acacctgttaaatcctgctt

SEQ ID NO: 380791 - DNA, 20 bp, Artificial
  CRISPR gRNA sequence
ctgcttggaagtttttactg

SEQ ID NO: 380792 - DNA, 20 bp, Artificial
  CRISPR gRNA sequence
atcagtcaggcaggcgaagt

SEQ ID NO: 380793 - DNA, 20 bp, Artificial
  CRISPR gRNA sequence
caggcgaagtagaagattgg

SEQ ID NO: 380794 - DNA, 20 bp, Artificial
  CRISPR gRNA sequence
tgccttgtgtggtatgcctt

SEQ ID NO: 380795 - DNA, 20 bp, Artificial
  CRISPR gRNA sequence
taaagtttgggttccaaatt

SEQ ID NO: 380796 - DNA, 20 bp, Artificial
  CRISPR gRNA sequence
ttgggttccaaattagctgt

SEQ ID NO: 380797 - DNA, 20 bp, Artificial
  CRISPR gRNA sequence
atgatggttgttatgcaaag

SEQ ID NO: 380798 - DNA, 20 bp, Artificial
  CRISPR gRNA sequence
atagtcttcggaatatttcc

SEQ ID NO: 380799 - DNA, 20 bp, Artificial
  CRISPR gRNA sequence
aatatttcctgttgttttca

SEQ ID NO: 380800 - DNA, 20 bp, Artificial
  CRISPR gRNA sequence
catccagatttgtcattact

SEQ ID NO: 380801 - DNA, 20 bp, Artificial
  CRISPR gRNA sequence
aaagagagctgtcaccttca

SEQ ID NO: 380802 - DNA, 20 bp, Artificial
  CRISPR gRNA sequence
gggcttaaaaaaatacaatg

SEQ ID NO: 380803 - DNA, 20 bp, Artificial
  CRISPR gRNA sequence
atacaatgtggagattttca

SEQ ID NO: 380804 - DNA, 20 bp, Artificial
  CRISPR gRNA sequence
gaaggaataccggctgtccg

SEQ ID NO: 380805 - DNA, 20 bp, Artificial
  CRISPR gRNA sequence
ccttagccatgatccattgc

SEQ ID NO: 380806 - DNA, 20 bp, Artificial
  CRISPR gRNA sequence
gccatgatccattgctcttg

SEQ ID NO: 380807 - DNA, 20 bp, Artificial
  CRISPR gRNA sequence
tgattatttgtattttaaag

SEQ ID NO: 380808 - DNA, 20 bp, Artificial
  CRISPR gRNA sequence
agggcattctaccctatttt

SEQ ID NO: 380809 - DNA, 20 bp, Artificial
  CRISPR gRNA sequence
ctaccctattttgagagttt

SEQ ID NO: 380810 - DNA, 20 bp, Artificial
  CRISPR gRNA sequence
tttttaaactaagaatgata

SEQ ID NO: 380811 - DNA, 20 bp, Artificial
  CRISPR gRNA sequence
tatttcaaaattaaccttag

SEQ ID NO: 380812 - DNA, 20 bp, Artificial
  CRISPR gRNA sequence
tgtacttcagtaacaacata

SEQ ID NO: 380813 - DNA, 20 bp, Artificial
  CRISPR gRNA sequence
aagacttggaatctagaaat

SEQ ID NO: 380814 - DNA, 20 bp, Artificial
  CRISPR gRNA sequence
ctagaaatcctagtttgtat

SEQ ID NO: 380815 - DNA, 20 bp, Artificial
  CRISPR gRNA sequence
ggccctatgctctgtaaata

SEQ ID NO: 380816 - DNA, 20 bp, Artificial
  CRISPR gRNA sequence
ttgattttttgctatttatt

SEQ ID NO: 380817 - DNA, 20 bp, Artificial
  CRISPR gRNA sequence
tgaatctcctgtgtgcactt

SEQ ID NO: 380818 - DNA, 20 bp, Artificial
  CRISPR gRNA sequence
tgcacttgaacgtttgtatt

SEQ ID NO: 380819 - DNA, 20 bp, Artificial
  CRISPR gRNA sequence
ctagtagtctttccaaggcc

SEQ ID NO: 380820 - DNA, 20 bp, Artificial
  CRISPR gRNA sequence
tcctatcaatgctacccctc

SEQ ID NO: 380821 - DNA, 20 bp, Artificial
  CRISPR gRNA sequence
cccctctccagctttcagcc

SEQ ID NO: 380822 - DNA, 20 bp, Artificial
  CRISPR gRNA sequence
acaggcatttcttcattagc

SEQ ID NO: 380823 - DNA, 20 bp, Artificial
  CRISPR gRNA sequence
ctgatggtaagaataaatgc

SEQ ID NO: 380824 - DNA, 20 bp, Artificial
  CRISPR gRNA sequence
aataaatgcatttgttttta

SEQ ID NO: 380825 - DNA, 20 bp, Artificial
  CRISPR gRNA sequence
ttccagatagccctttctag

SEQ ID NO: 380826 - DNA, 20 bp, Artificial
  CRISPR gRNA sequence
actactgtcacctacgtgtc

SEQ ID NO: 380827 - DNA, 20 bp, Artificial
  CRISPR gRNA sequence
actcagaatgctctgccacc

SEQ ID NO: 380828 - DNA, 20 bp, Artificial
  CRISPR gRNA sequence
ggcagcaccagaatgacccc

SEQ ID NO: 380829 - DNA, 20 bp, Artificial
  CRISPR gRNA sequence
aagggtgtcctgggggtact

SEQ ID NO: 380830 - DNA, 20 bp, Artificial
  CRISPR gRNA sequence
tggccttctctgactagggc

SEQ ID NO: 380831 - DNA, 20 bp, Artificial
  CRISPR gRNA sequence
tgcatgcaccagcaaagggg

SEQ ID NO: 380832 - DNA, 20 bp, Artificial
  CRISPR gRNA sequence
gggctcagcttatgatactt

SEQ ID NO: 380833 - DNA, 20 bp, Artificial
  CRISPR gRNA sequence
tgatactttagagtttcagg

SEQ ID NO: 380834 - DNA, 20 bp, Artificial
  CRISPR gRNA sequence
ttcaggaaaagctttagtac

SEQ ID NO: 380835 - DNA, 20 bp, Artificial
  CRISPR gRNA sequence
aagctttagtacagtagatt

SEQ ID NO: 380836 - DNA, 20 bp, Artificial
  CRISPR gRNA sequence
cagaccaggggacatctctg

SEQ ID NO: 380837 - DNA, 20 bp, Artificial
  CRISPR gRNA sequence
agagagacacacaaaataaa

SEQ ID NO: 380838 - DNA, 20 bp, Artificial
  CRISPR gRNA sequence
agatttttctttcaccacct

SEQ ID NO: 380839 - DNA, 20 bp, Artificial
  CRISPR gRNA sequence
ctgcagtcttttaggagagt

SEQ ID NO: 380840 - DNA, 20 bp, Artificial
  CRISPR gRNA sequence
aaggtaagcaaataggcatc

SEQ ID NO: 380841 - DNA, 20 bp, Artificial
  CRISPR gRNA sequence
acctttacacactgctagca

SEQ ID NO: 380842 - DNA, 20 bp, Artificial
  CRISPR gRNA sequence
tggtatctctattattttag

SEQ ID NO: 380843 - DNA, 20 bp, Artificial
  CRISPR gRNA sequence
agaaccaatgtgtatataca

SEQ ID NO: 380844 - DNA, 20 bp, Artificial
  CRISPR gRNA sequence
ctgggtaatttataagggaa

SEQ ID NO: 380845 - DNA, 20 bp, Artificial
  CRISPR gRNA sequence
gaaaagccccttataaaacc

SEQ ID NO: 380846 - DNA, 20 bp, Artificial
  CRISPR gRNA sequence
cagcatgaaggtgactggcc

SEQ ID NO: 380847 - DNA, 20 bp, Artificial
  CRISPR gRNA sequence
cgggtccttcccacaataca

SEQ ID NO: 380848 - DNA, 20 bp, Artificial
  CRISPR gRNA sequence
gggattatgggaactacaag

SEQ ID NO: 380849 - DNA, 20 bp, Artificial
  CRISPR gRNA sequence
agggtacagcctcccctctt

SEQ ID NO: 380850 - DNA, 20 bp, Artificial
  CRISPR gRNA sequence
acaggctggtgttgagtgtc

SEQ ID NO: 380851 - DNA, 20 bp, Artificial
  CRISPR gRNA sequence
atggtgcaagccgtctgtgg

SEQ ID NO: 380852 - DNA, 20 bp, Artificial
  CRISPR gRNA sequence
caagccgtctgtggatcaga

SEQ ID NO: 380853 - DNA, 20 bp, Artificial
  CRISPR gRNA sequence
tctactagacagtgccccag

SEQ ID NO: 380854 - DNA, 20 bp, Artificial
  CRISPR gRNA sequence
caacttctgaatggacaccc

SEQ ID NO: 380855 - DNA, 20 bp, Artificial
  CRISPR gRNA sequence
caacaccacgtgtaagctgt

SEQ ID NO: 380856 - DNA, 20 bp, Artificial
  CRISPR gRNA sequence
acgtgtaagctgtcaaggct

SEQ ID NO: 380857 - DNA, 20 bp, Artificial
  CRISPR gRNA sequence
gctgcatagagcagggggtc

SEQ ID NO: 380858 - DNA, 20 bp, Artificial
  CRISPR gRNA sequence
caggaaatcacttttccctc

SEQ ID NO: 380859 - DNA, 20 bp, Artificial
  CRISPR gRNA sequence
agacattttccccattgtct

SEQ ID NO: 380860 - DNA, 20 bp, Artificial
  CRISPR gRNA sequence
ggctggaatttcttcccaga

SEQ ID NO: 380861 - DNA, 20 bp, Artificial
  CRISPR gRNA sequence
aattttccaaattttttatg

SEQ ID NO: 380862 - DNA, 20 bp, Artificial
  CRISPR gRNA sequence
tttatgctctgcttcctctt

SEQ ID NO: 380863 - DNA, 20 bp, Artificial
  CRISPR gRNA sequence
tcttgaatgctttgcccctt

SEQ ID NO: 380864 - DNA, 20 bp, Artificial
  CRISPR gRNA sequence
gaccacctcagcctggactt

SEQ ID NO: 380865 - DNA, 20 bp, Artificial
  CRISPR gRNA sequence
tacctgttacccagttccaa

SEQ ID NO: 380866 - DNA, 20 bp, Artificial
  CRISPR gRNA sequence
tgtactcatttactgtatta

SEQ ID NO: 380867 - DNA, 20 bp, Artificial
  CRISPR gRNA sequence
cagggtaatttataaaggaa

SEQ ID NO: 380868 - DNA, 20 bp, Artificial
  CRISPR gRNA sequence
tttataaaggaaagaggttt

SEQ ID NO: 380869 - DNA, 20 bp, Artificial
  CRISPR gRNA sequence
caggatgggggaaaccaccc

SEQ ID NO: 380870 - DNA, 20 bp, Artificial
  CRISPR gRNA sequence
tatgggaactacaactcaag

SEQ ID NO: 380871 - DNA, 20 bp, Artificial
  CRISPR gRNA sequence
gataagcccaaatttgcagt

SEQ ID NO: 380872 - DNA, 20 bp, Artificial
  CRISPR gRNA sequence
gtcatctgctgcagaatccc

SEQ ID NO: 380873 - DNA, 20 bp, Artificial
  CRISPR gRNA sequence
tcacctacattatggaggca

SEQ ID NO: 380874 - DNA, 20 bp, Artificial
  CRISPR gRNA sequence
cacgtaaaattaaccatcat

SEQ ID NO: 380875 - DNA, 20 bp, Artificial
  CRISPR gRNA sequence
cctatgatccaataattcta

SEQ ID NO: 380876 - DNA, 20 bp, Artificial
  CRISPR gRNA sequence
cctgacaatatttatagcaa

SEQ ID NO: 380877 - DNA, 20 bp, Artificial
  CRISPR gRNA sequence
aactagggttccttttcttt

SEQ ID NO: 380878 - DNA, 20 bp, Artificial
  CRISPR gRNA sequence
gtctttaaggctcatagtca

SEQ ID NO: 380879 - DNA, 20 bp, Artificial
  CRISPR gRNA sequence
tcagggtgttttccttatac

SEQ ID NO: 380880 - DNA, 20 bp, Artificial
  CRISPR gRNA sequence
tttattttgcatttgtctca

SEQ ID NO: 380881 - DNA, 20 bp, Artificial
  CRISPR gRNA sequence
catttgtctcaaaatgtttt

SEQ ID NO: 380882 - DNA, 20 bp, Artificial
  CRISPR gRNA sequence
tagaagatttctttcaaatc

SEQ ID NO: 380883 - DNA, 20 bp, Artificial
  CRISPR gRNA sequence
tgcctcagcctcctgagtag

SEQ ID NO: 380884 - DNA, 20 bp, Artificial
  CRISPR gRNA sequence
ttttgtatttttgtagagat

SEQ ID NO: 380885 - DNA, 20 bp, Artificial
  CRISPR gRNA sequence
ccaccttgcctggccaaatc

SEQ ID NO: 380886 - DNA, 20 bp, Artificial
  CRISPR gRNA sequence
atttctaatggtgaaaagag

SEQ ID NO: 380887 - DNA, 20 bp, Artificial
  CRISPR gRNA sequence
ggcctgggggccaggtagag

SEQ ID NO: 380888 - DNA, 20 bp, Artificial
  CRISPR gRNA sequence
aggtagaggtaagtttcagc

SEQ ID NO: 380889 - DNA, 20 bp, Artificial
  CRISPR gRNA sequence
atgatccaaggactaaaaaa

SEQ ID NO: 380890 - DNA, 20 bp, Artificial
  CRISPR gRNA sequence
gctagcaagagtggaattaa

SEQ ID NO: 380891 - DNA, 20 bp, Artificial
  CRISPR gRNA sequence
tgaaattatggaacaacaaa

SEQ ID NO: 380892 - DNA, 20 bp, Artificial
  CRISPR gRNA sequence
tgggggcagaagtctaaggt

SEQ ID NO: 380893 - DNA, 20 bp, Artificial
  CRISPR gRNA sequence
agaagtctaaggtcatagct

SEQ ID NO: 380894 - DNA, 20 bp, Artificial
  CRISPR gRNA sequence
actcatatttatagtagagg

SEQ ID NO: 380895 - DNA, 20 bp, Artificial
  CRISPR gRNA sequence
tactttgtgttggctgtatt

SEQ ID NO: 380896 - DNA, 20 bp, Artificial
  CRISPR gRNA sequence
ctgggcacagagatgttcct

SEQ ID NO: 380897 - DNA, 20 bp, Artificial
  CRISPR gRNA sequence
ccagcagctgacatagcagc

SEQ ID NO: 380898 - DNA, 20 bp, Artificial
  CRISPR gRNA sequence
tctgctggttagtggcacta

SEQ ID NO: 380899 - DNA, 20 bp, Artificial
  CRISPR gRNA sequence
tctgaggaatcctatgatga

SEQ ID NO: 380900 - DNA, 20 bp, Artificial
  CRISPR gRNA sequence
ggtataatctcagcctttaa

SEQ ID NO: 380901 - DNA, 20 bp, Artificial
  CRISPR gRNA sequence
ggagagggaagtgtctcaaa

SEQ ID NO: 380902 - DNA, 20 bp, Artificial
  CRISPR gRNA sequence
ctggcttttataaatgggtg

SEQ ID NO: 380903 - DNA, 20 bp, Artificial
  CRISPR gRNA sequence
caatgtacaatgtaatgttc

SEQ ID NO: 380904 - DNA, 20 bp, Artificial
  CRISPR gRNA sequence
tgtagaatattgggagagag

SEQ ID NO: 380905 - DNA, 20 bp, Artificial
  CRISPR gRNA sequence
caacccagaaaatttggatg

SEQ ID NO: 380906 - DNA, 20 bp, Artificial
  CRISPR gRNA sequence
aataggcactattccaggag

SEQ ID NO: 380907 - DNA, 20 bp, Artificial
  CRISPR gRNA sequence
aacaaattaaagcaatttat

SEQ ID NO: 380908 - DNA, 20 bp, Artificial
  CRISPR gRNA sequence
atttattccggtttacaatt

SEQ ID NO: 380909 - DNA, 20 bp, Artificial
  CRISPR gRNA sequence
gcttggttgacatgttgaat

SEQ ID NO: 380910 - DNA, 20 bp, Artificial
  CRISPR gRNA sequence
cggtatttgcacactttcat

SEQ ID NO: 380911 - DNA, 20 bp, Artificial
  CRISPR gRNA sequence
ttgcacactttcatttcggc

SEQ ID NO: 380912 - DNA, 20 bp, Artificial
  CRISPR gRNA sequence
acaggtgaaagtgatggagg

SEQ ID NO: 380913 - DNA, 20 bp, Artificial
  CRISPR gRNA sequence
tataagggtcaccaattcct

SEQ ID NO: 380914 - DNA, 20 bp, Artificial
  CRISPR gRNA sequence
tagtccttgtgtagaccttt

SEQ ID NO: 380915 - DNA, 20 bp, Artificial
  CRISPR gRNA sequence
aaaaaaagtcattccaagtc

SEQ ID NO: 380916 - DNA, 20 bp, Artificial
  CRISPR gRNA sequence
ctctcttcaggcccattctg

SEQ ID NO: 380917 - DNA, 20 bp, Artificial
  CRISPR gRNA sequence
tgagattagaaataagtcat

SEQ ID NO: 380918 - DNA, 20 bp, Artificial
  CRISPR gRNA sequence
actaaaaaatgttacatttt

SEQ ID NO: 380919 - DNA, 20 bp, Artificial
  CRISPR gRNA sequence
ggatgaagcagaaacatttt

SEQ ID NO: 380920 - DNA, 20 bp, Artificial
  CRISPR gRNA sequence
gttaccagaacgtgtgccaa

SEQ ID NO: 380921 - DNA, 20 bp, Artificial
  CRISPR gRNA sequence
tgccaaggttgtttttatcc

SEQ ID NO: 380922 - DNA, 20 bp, Artificial
  CRISPR gRNA sequence
gtcactgtgggaatcaaccc

SEQ ID NO: 380923 - DNA, 20 bp, Artificial
  CRISPR gRNA sequence
tcaaaaatcaaaaaaaaaga

SEQ ID NO: 380924 - DNA, 20 bp, Artificial
  CRISPR gRNA sequence
attcacgtacaggcacgggt

SEQ ID NO: 380925 - DNA, 20 bp, Artificial
  CRISPR gRNA sequence
cgtacaggcacgggtacagg

SEQ ID NO: 380926 - DNA, 20 bp, Artificial
  CRISPR gRNA sequence
cgggtacaggcttggatttt

SEQ ID NO: 380927 - DNA, 20 bp, Artificial
  CRISPR gRNA sequence
caggcttggatttttgggga

SEQ ID NO: 380928 - DNA, 20 bp, Artificial
  CRISPR gRNA sequence
ttgtccgtctgtctcgatgc

SEQ ID NO: 380929 - DNA, 20 bp, Artificial
  CRISPR gRNA sequence
atccagaggaaacttttact

SEQ ID NO: 380930 - DNA, 20 bp, Artificial
  CRISPR gRNA sequence
gccatctttgtgtgcagcca

SEQ ID NO: 380931 - DNA, 20 bp, Artificial
  CRISPR gRNA sequence
tgtaggtatttatattttca

SEQ ID NO: 380932 - DNA, 20 bp, Artificial
  CRISPR gRNA sequence
aagatgattgtagagtaggg

SEQ ID NO: 380933 - DNA, 20 bp, Artificial
  CRISPR gRNA sequence
gatagagaatgggctacagc

SEQ ID NO: 380934 - DNA, 20 bp, Artificial
  CRISPR gRNA sequence
gctacagctgaagcttcgga

SEQ ID NO: 380935 - DNA, 20 bp, Artificial
  CRISPR gRNA sequence
tagctggaaactacacagtt

SEQ ID NO: 380936 - DNA, 20 bp, Artificial
  CRISPR gRNA sequence
actcacacctttaccacaac

SEQ ID NO: 380937 - DNA, 20 bp, Artificial
  CRISPR gRNA sequence
gagactcctcctcagaccat

SEQ ID NO: 380938 - DNA, 20 bp, Artificial
  CRISPR gRNA sequence
ttgctctgggaaacttcctt

SEQ ID NO: 380939 - DNA, 20 bp, Artificial
  CRISPR gRNA sequence
cattttgtaaaataaaaaat

SEQ ID NO: 380940 - DNA, 20 bp, Artificial
  CRISPR gRNA sequence
agctcttagctggtaaagct

SEQ ID NO: 380941 - DNA, 20 bp, Artificial
  CRISPR gRNA sequence
gtaaagctctcagtttttac

SEQ ID NO: 380942 - DNA, 20 bp, Artificial
  CRISPR gRNA sequence
actgatgcttggagctcctc

SEQ ID NO: 380943 - DNA, 20 bp, Artificial
  CRISPR gRNA sequence
ttgagttaatgctgtcctgt

SEQ ID NO: 380944 - DNA, 20 bp, Artificial
  CRISPR gRNA sequence
aggtagcgtcgataaaaaga

SEQ ID NO: 380945 - DNA, 20 bp, Artificial
  CRISPR gRNA sequence
aaaagatctggtttctaagt

SEQ ID NO: 380946 - DNA, 20 bp, Artificial
  CRISPR gRNA sequence
tctaagttatggtttttgtt

SEQ ID NO: 380947 - DNA, 20 bp, Artificial
  CRISPR gRNA sequence
ttatggtttttgttgctggt

SEQ ID NO: 380948 - DNA, 20 bp, Artificial
  CRISPR gRNA sequence
tttttgttgctggtttttgt

SEQ ID NO: 380949 - DNA, 20 bp, Artificial
  CRISPR gRNA sequence
gttgctggtttttgtttttg

SEQ ID NO: 380950 - DNA, 20 bp, Artificial
  CRISPR gRNA sequence
ggagaggaggttgcaggcag

SEQ ID NO: 380951 - DNA, 20 bp, Artificial
  CRISPR gRNA sequence
gagactatttctgaagacat

SEQ ID NO: 380952 - DNA, 20 bp, Artificial
  CRISPR gRNA sequence
atctcttctacttactcctg

SEQ ID NO: 380953 - DNA, 20 bp, Artificial
  CRISPR gRNA sequence
taattaaataactcagttga

SEQ ID NO: 380954 - DNA, 20 bp, Artificial
  CRISPR gRNA sequence
gggcttctggcacttccctt

SEQ ID NO: 380955 - DNA, 20 bp, Artificial
  CRISPR gRNA sequence
atctgcctcgagagaaagag

SEQ ID NO: 380956 - DNA, 20 bp, Artificial
  CRISPR gRNA sequence
accaacaccgatatttccag

SEQ ID NO: 380957 - DNA, 20 bp, Artificial
  CRISPR gRNA sequence
aagtcccattaactcctgac

SEQ ID NO: 380958 - DNA, 20 bp, Artificial
  CRISPR gRNA sequence
gaaataaagaatacttaaca

SEQ ID NO: 380959 - DNA, 20 bp, Artificial
  CRISPR gRNA sequence
ttattctctttaaatcctat

SEQ ID NO: 380960 - DNA, 20 bp, Artificial
  CRISPR gRNA sequence
aatattttcaactactcaca

SEQ ID NO: 380961 - DNA, 20 bp, Artificial
  CRISPR gRNA sequence
tgtgtttctttgtgctgaca

SEQ ID NO: 380962 - DNA, 20 bp, Artificial
  CRISPR gRNA sequence
gaattttcattcttaacatg

SEQ ID NO: 380963 - DNA, 20 bp, Artificial
  CRISPR gRNA sequence
ttcttaacatggtctgatta

SEQ ID NO: 380964 - DNA, 20 bp, Artificial
  CRISPR gRNA sequence
aatgacacagaggtaattga

SEQ ID NO: 380965 - DNA, 20 bp, Artificial
  CRISPR gRNA sequence
taaatctgttgaatagatat

SEQ ID NO: 380966 - DNA, 20 bp, Artificial
  CRISPR gRNA sequence
gtatgcctatacgccatgta

SEQ ID NO: 380967 - DNA, 20 bp, Artificial
  CRISPR gRNA sequence
atgcaaggtggaatttggaa

SEQ ID NO: 380968 - DNA, 20 bp, Artificial
  CRISPR gRNA sequence
atttggaaagtagcttaaag

SEQ ID NO: 380969 - DNA, 20 bp, Artificial
  CRISPR gRNA sequence
tggaggtgacagaggttact

SEQ ID NO: 380970 - DNA, 20 bp, Artificial
  CRISPR gRNA sequence
gcataccagggagatgctct

SEQ ID NO: 380971 - DNA, 20 bp, Artificial
  CRISPR gRNA sequence
catgaaaaacaaatttggcc

SEQ ID NO: 380972 - DNA, 20 bp, Artificial
  CRISPR gRNA sequence
gaaggtcggagggtggaagg

SEQ ID NO: 380973 - DNA, 20 bp, Artificial
  CRISPR gRNA sequence
ggacttcatttggttgttag

SEQ ID NO: 380974 - DNA, 20 bp, Artificial
  CRISPR gRNA sequence
tagtgaaagtctcatgttgg

SEQ ID NO: 380975 - DNA, 20 bp, Artificial
  CRISPR gRNA sequence
accaggaaagctcccctgct

SEQ ID NO: 380976 - DNA, 20 bp, Artificial
  CRISPR gRNA sequence
tccccgctctttaattctat

SEQ ID NO: 380977 - DNA, 20 bp, Artificial
  CRISPR gRNA sequence
gctcaaggctctgtgtgact

SEQ ID NO: 380978 - DNA, 20 bp, Artificial
  CRISPR gRNA sequence
tctgtgtgacttgatgctta

SEQ ID NO: 380979 - DNA, 20 bp, Artificial
  CRISPR gRNA sequence
cttcagagatcagaagacac

SEQ ID NO: 380980 - DNA, 20 bp, Artificial
  CRISPR gRNA sequence
gcaaaagcaaaatgaggctg

SEQ ID NO: 380981 - DNA, 20 bp, Artificial
  CRISPR gRNA sequence
gatgtgtgatcagcaggagc

SEQ ID NO: 380982 - DNA, 20 bp, Artificial
  CRISPR gRNA sequence
gatcagcaggagctccagat

SEQ ID NO: 380983 - DNA, 20 bp, Artificial
  CRISPR gRNA sequence
gaagagggggcattcagaac

SEQ ID NO: 380984 - DNA, 20 bp, Artificial
  CRISPR gRNA sequence
tgcatgttcacagcaaaccc

SEQ ID NO: 380985 - DNA, 20 bp, Artificial
  CRISPR gRNA sequence
ctttgcagtgggctgggagt

SEQ ID NO: 380986 - DNA, 20 bp, Artificial
  CRISPR gRNA sequence
ctattctaagatattttgac

SEQ ID NO: 380987 - DNA, 20 bp, Artificial
  CRISPR gRNA sequence
tttgactttagattttaggc

SEQ ID NO: 380988 - DNA, 20 bp, Artificial
  CRISPR gRNA sequence
tttagattttaggcaaggga

SEQ ID NO: 380989 - DNA, 20 bp, Artificial
  CRISPR gRNA sequence
agttagaaagagcactcaga

SEQ ID NO: 380990 - DNA, 20 bp, Artificial
  CRISPR gRNA sequence
cactcagacagggtttagaa

SEQ ID NO: 380991 - DNA, 20 bp, Artificial
  CRISPR gRNA sequence
aagtcaggagaattgtgtcc

SEQ ID NO: 380992 - DNA, 20 bp, Artificial
  CRISPR gRNA sequence
agaaggtgactatttggaaa

SEQ ID NO: 380993 - DNA, 20 bp, Artificial
  CRISPR gRNA sequence
gtgggatctaatccaatatg

SEQ ID NO: 380994 - DNA, 20 bp, Artificial
  CRISPR gRNA sequence
actggtttccaaataagaag

SEQ ID NO: 380995 - DNA, 20 bp, Artificial
  CRISPR gRNA sequence
accctgctggcacctgaatt

SEQ ID NO: 380996 - DNA, 20 bp, Artificial
  CRISPR gRNA sequence
gcctgcagaattgcgataaa

SEQ ID NO: 380997 - DNA, 20 bp, Artificial
  CRISPR gRNA sequence
attgcgataaaataagtttc

SEQ ID NO: 380998 - DNA, 20 bp, Artificial
  CRISPR gRNA sequence
atgaaaaagaattaaactaa

SEQ ID NO: 380999 - DNA, 20 bp, Artificial
  CRISPR gRNA sequence
attctgaattcttcccctct

SEQ ID NO: 381000 - DNA, 20 bp, Artificial
  CRISPR gRNA sequence
taaaaaactattacaactgc

SEQ ID NO: 381001 - DNA, 20 bp, Artificial
  CRISPR gRNA sequence
tggaacactgctccctgcct

SEQ ID NO: 381002 - DNA, 20 bp, Artificial
  CRISPR gRNA sequence
tccctgcctacttgctttgt

SEQ ID NO: 381003 - DNA, 20 bp, Artificial
  CRISPR gRNA sequence
gtcggtctctctaccttaat

SEQ ID NO: 381004 - DNA, 20 bp, Artificial
  CRISPR gRNA sequence
aaagtagttctatctctgtt

SEQ ID NO: 381005 - DNA, 20 bp, Artificial
  CRISPR gRNA sequence
gtctgtttttttcttctttg

SEQ ID NO: 381006 - DNA, 20 bp, Artificial
  CRISPR gRNA sequence
aattttattattattatact

SEQ ID NO: 381007 - DNA, 20 bp, Artificial
  CRISPR gRNA sequence
agggtacatgtgcacaacat

SEQ ID NO: 381008 - DNA, 20 bp, Artificial
  CRISPR gRNA sequence
cacctatgagtgagaacatg

SEQ ID NO: 381009 - DNA, 20 bp, Artificial
  CRISPR gRNA sequence
atgagtgagaacatgcggtg

SEQ ID NO: 381010 - DNA, 20 bp, Artificial
  CRISPR gRNA sequence
tgtttggtttttgtctttgt

SEQ ID NO: 381011 - DNA, 20 bp, Artificial
  CRISPR gRNA sequence
tgtgatagtttgctgagaat

SEQ ID NO: 381012 - DNA, 20 bp, Artificial
  CRISPR gRNA sequence
gtttgctgagaatgatggtt

SEQ ID NO: 381013 - DNA, 20 bp, Artificial
  CRISPR gRNA sequence
tgctactgtgaatagtgccg

SEQ ID NO: 381014 - DNA, 20 bp, Artificial
  CRISPR gRNA sequence
tagtccttgataaagccttc

SEQ ID NO: 381015 - DNA, 20 bp, Artificial
  CRISPR gRNA sequence
tgttctcagaggagtcgaaa

SEQ ID NO: 381016 - DNA, 20 bp, Artificial
  CRISPR gRNA sequence
aaacctggattactttcagc

SEQ ID NO: 381017 - DNA, 20 bp, Artificial
  CRISPR gRNA sequence
aggctataaatccacatgag

SEQ ID NO: 381018 - DNA, 20 bp, Artificial
  CRISPR gRNA sequence
aaatccacatgaggactgat

SEQ ID NO: 381019 - DNA, 20 bp, Artificial
  CRISPR gRNA sequence
gatttgtgcttagaactact

SEQ ID NO: 381020 - DNA, 20 bp, Artificial
  CRISPR gRNA sequence
acctggggatgcgggtgagc

SEQ ID NO: 381021 - DNA, 20 bp, Artificial
  CRISPR gRNA sequence
attctcacttcaggtaggtc

SEQ ID NO: 381022 - DNA, 20 bp, Artificial
  CRISPR gRNA sequence
ggttcaaaaatcagagttca

SEQ ID NO: 381023 - DNA, 20 bp, Artificial
  CRISPR gRNA sequence
gcaggtgtgctcagggcaga

SEQ ID NO: 381024 - DNA, 20 bp, Artificial
  CRISPR gRNA sequence
ggcttccacgtccctatgtc

SEQ ID NO: 381025 - DNA, 20 bp, Artificial
  CRISPR gRNA sequence
tctctagtttttcacttcta

SEQ ID NO: 381026 - DNA, 20 bp, Artificial
  CRISPR gRNA sequence
tccggtggtccctgtgttct

SEQ ID NO: 381027 - DNA, 20 bp, Artificial
  CRISPR gRNA sequence
tccctgtgttctcagagatt

SEQ ID NO: 381028 - DNA, 20 bp, Artificial
  CRISPR gRNA sequence
aaaaacatagaagtcatctt

SEQ ID NO: 381029 - DNA, 20 bp, Artificial
  CRISPR gRNA sequence
catagaagtcatcttttatg

SEQ ID NO: 381030 - DNA, 20 bp, Artificial
  CRISPR gRNA sequence
ttaaaaaatatttgtcatct

SEQ ID NO: 381031 - DNA, 20 bp, Artificial
  CRISPR gRNA sequence
aggaatgatgtatcaaatac

SEQ ID NO: 381032 - DNA, 20 bp, Artificial
  CRISPR gRNA sequence
tggactcttctccagtccca

SEQ ID NO: 381033 - DNA, 20 bp, Artificial
  CRISPR gRNA sequence
cttctccagtcccagtagga

SEQ ID NO: 381034 - DNA, 20 bp, Artificial
  CRISPR gRNA sequence
agagagagaaattgagaaat

SEQ ID NO: 381035 - DNA, 20 bp, Artificial
  CRISPR gRNA sequence
atgttgcgtgtgaaatagaa

SEQ ID NO: 381036 - DNA, 20 bp, Artificial
  CRISPR gRNA sequence
aaagggattcaagagtggca

SEQ ID NO: 381037 - DNA, 20 bp, Artificial
  CRISPR gRNA sequence
gaagctccggagtggggttg

SEQ ID NO: 381038 - DNA, 20 bp, Artificial
  CRISPR gRNA sequence
ccggagtggggttgaatcgt

SEQ ID NO: 381039 - DNA, 20 bp, Artificial
  CRISPR gRNA sequence
gtgaagctctctagcaggca

SEQ ID NO: 381040 - DNA, 20 bp, Artificial
  CRISPR gRNA sequence
tgggtgtacgagtatgcaca

SEQ ID NO: 381041 - DNA, 20 bp, Artificial
  CRISPR gRNA sequence
ccttcacattcataaccgtt

SEQ ID NO: 381042 - DNA, 20 bp, Artificial
  CRISPR gRNA sequence
gcagccctgggcagggctct

SEQ ID NO: 381043 - DNA, 20 bp, Artificial
  CRISPR gRNA sequence
gcagggctctaaaggcttta

SEQ ID NO: 381044 - DNA, 20 bp, Artificial
  CRISPR gRNA sequence
ggtgtcctcacgatccacac

SEQ ID NO: 381045 - DNA, 20 bp, Artificial
  CRISPR gRNA sequence
gatggactattaatactgcc

SEQ ID NO: 381046 - DNA, 20 bp, Artificial
  CRISPR gRNA sequence
tattaatactgccataagtt

SEQ ID NO: 381047 - DNA, 20 bp, Artificial
  CRISPR gRNA sequence
gccctcacctacgtggttaa

SEQ ID NO: 381048 - DNA, 20 bp, Artificial
  CRISPR gRNA sequence
aagtgctgttcaaggtcttc

SEQ ID NO: 381049 - DNA, 20 bp, Artificial
  CRISPR gRNA sequence
catttctgaattgtagatat

SEQ ID NO: 381050 - DNA, 20 bp, Artificial
  CRISPR gRNA sequence
ggaaatgctcattggagcat

SEQ ID NO: 381051 - DNA, 20 bp, Artificial
  CRISPR gRNA sequence
ctcattggagcattttagat

SEQ ID NO: 381052 - DNA, 20 bp, Artificial
  CRISPR gRNA sequence
agcattttagatttcagatt

SEQ ID NO: 381053 - DNA, 20 bp, Artificial
  CRISPR gRNA sequence
cccacccctaaaacaggaat

SEQ ID NO: 381054 - DNA, 20 bp, Artificial
  CRISPR gRNA sequence
gtttcctgcattcccccgga

SEQ ID NO: 381055 - DNA, 20 bp, Artificial
  CRISPR gRNA sequence
tattttccttgcattccatc

SEQ ID NO: 381056 - DNA, 20 bp, Artificial
  CRISPR gRNA sequence
gatcccaataatgttgggaa

SEQ ID NO: 381057 - DNA, 20 bp, Artificial
  CRISPR gRNA sequence
gtattcccctgggtgggaac

SEQ ID NO: 381058 - DNA, 20 bp, Artificial
  CRISPR gRNA sequence
atagctcatcatatgtgaaa

SEQ ID NO: 381059 - DNA, 20 bp, Artificial
  CRISPR gRNA sequence
gatatgaatttgtctttcta

SEQ ID NO: 381060 - DNA, 20 bp, Artificial
  CRISPR gRNA sequence
taaatggtttgaaacttatc

SEQ ID NO: 381061 - DNA, 20 bp, Artificial
  CRISPR gRNA sequence
taccgcttttctgcatattt

SEQ ID NO: 381062 - DNA, 20 bp, Artificial
  CRISPR gRNA sequence
tctgcatatttcatagctta

SEQ ID NO: 381063 - DNA, 20 bp, Artificial
  CRISPR gRNA sequence
gattcttcagtatttcaccc

SEQ ID NO: 381064 - DNA, 20 bp, Artificial
  CRISPR gRNA sequence
tttgttattttaccactcag

SEQ ID NO: 381065 - DNA, 20 bp, Artificial
  CRISPR gRNA sequence
agagtggtttagtgtcattt

SEQ ID NO: 381066 - DNA, 20 bp, Artificial
  CRISPR gRNA sequence
gtcacaagacaacaaatact

SEQ ID NO: 381067 - DNA, 20 bp, Artificial
  CRISPR gRNA sequence
gtacacagaggagtcaaatt

SEQ ID NO: 381068 - DNA, 20 bp, Artificial
  CRISPR gRNA sequence
tgggggatgggagaacaggg

SEQ ID NO: 381069 - DNA, 20 bp, Artificial
  CRISPR gRNA sequence
aacagggagttgtttaatgg

SEQ ID NO: 381070 - DNA, 20 bp, Artificial
  CRISPR gRNA sequence
gagttgtttaatgggtagga

SEQ ID NO: 381071 - DNA, 20 bp, Artificial
  CRISPR gRNA sequence
gatggtatatgtgtgtgtgt

SEQ ID NO: 381072 - DNA, 20 bp, Artificial
  CRISPR gRNA sequence
ctgtctagtgaggggttgct

SEQ ID NO: 381073 - DNA, 20 bp, Artificial
  CRISPR gRNA sequence
atctcttaataccaccacaa

SEQ ID NO: 381074 - DNA, 20 bp, Artificial
  CRISPR gRNA sequence
taataccaccacaatgggga

SEQ ID NO: 381075 - DNA, 20 bp, Artificial
  CRISPR gRNA sequence
gaaacattcagatcatagca

SEQ ID NO: 381076 - DNA, 20 bp, Artificial
  CRISPR gRNA sequence
tcatagcagtgagcttagtt

SEQ ID NO: 381077 - DNA, 20 bp, Artificial
  CRISPR gRNA sequence
ttagagaaattcctgctatc

SEQ ID NO: 381078 - DNA, 20 bp, Artificial
  CRISPR gRNA sequence
ctttattacacgaaaacaaa

SEQ ID NO: 381079 - DNA, 20 bp, Artificial
  CRISPR gRNA sequence
caaaaaaggatttgttgaca

SEQ ID NO: 381080 - DNA, 20 bp, Artificial
  CRISPR gRNA sequence
aactcatctggtgatgtctg

SEQ ID NO: 381081 - DNA, 20 bp, Artificial
  CRISPR gRNA sequence
tgaaaagtttcttcattttt

SEQ ID NO: 381082 - DNA, 20 bp, Artificial
  CRISPR gRNA sequence
gtttcttcatttttctgagc

SEQ ID NO: 381083 - DNA, 20 bp, Artificial
  CRISPR gRNA sequence
gagtggttctttgttgttat

SEQ ID NO: 381084 - DNA, 20 bp, Artificial
  CRISPR gRNA sequence
gacctccacatcctgggttc

SEQ ID NO: 381085 - DNA, 20 bp, Artificial
  CRISPR gRNA sequence
tctccttcctcagcctcccg

SEQ ID NO: 381086 - DNA, 20 bp, Artificial
  CRISPR gRNA sequence
ttcctcagcctcccgagtag

SEQ ID NO: 381087 - DNA, 20 bp, Artificial
  CRISPR gRNA sequence
cgcctcggcctcccaaagtg

SEQ ID NO: 381088 - DNA, 20 bp, Artificial
  CRISPR gRNA sequence
ctgggattacaggcaggatc

SEQ ID NO: 381089 - DNA, 20 bp, Artificial
  CRISPR gRNA sequence
tccactgtttccagcctgct

SEQ ID NO: 381090 - DNA, 20 bp, Artificial
  CRISPR gRNA sequence
atactcaccataaggggact

SEQ ID NO: 381091 - DNA, 20 bp, Artificial
  CRISPR gRNA sequence
aggggactgagagtttattg

SEQ ID NO: 381092 - DNA, 20 bp, Artificial
  CRISPR gRNA sequence
tttaatgtcttgagagagag

SEQ ID NO: 381093 - DNA, 20 bp, Artificial
  CRISPR gRNA sequence
ttgtatagagagtgtagggt

SEQ ID NO: 381094 - DNA, 20 bp, Artificial
  CRISPR gRNA sequence
gtgtagggtccatgtttgag

SEQ ID NO: 381095 - DNA, 20 bp, Artificial
  CRISPR gRNA sequence
tagagttgacgggatccagc

SEQ ID NO: 381096 - DNA, 20 bp, Artificial
  CRISPR gRNA sequence
aagaggtgttaagaaggata

SEQ ID NO: 381097 - DNA, 20 bp, Artificial
  CRISPR gRNA sequence
agtggggagagtaaaaagga

SEQ ID NO: 381098 - DNA, 20 bp, Artificial
  CRISPR gRNA sequence
agccagtttggagaggggaa

SEQ ID NO: 381099 - DNA, 20 bp, Artificial
  CRISPR gRNA sequence
aatagaaagtggaaaaaaaa

SEQ ID NO: 381100 - DNA, 20 bp, Artificial
  CRISPR gRNA sequence
aaaagagcttgaaaatctaa

SEQ ID NO: 381101 - DNA, 20 bp, Artificial
  CRISPR gRNA sequence
aaatctaaacgagttttttc

SEQ ID NO: 381102 - DNA, 20 bp, Artificial
  CRISPR gRNA sequence
tcttttgtttctcctttgac

SEQ ID NO: 381103 - DNA, 20 bp, Artificial
  CRISPR gRNA sequence
gatcattctgcatttctgat

SEQ ID NO: 381104 - DNA, 20 bp, Artificial
  CRISPR gRNA sequence
tacttgtcccagcacattct

SEQ ID NO: 381105 - DNA, 20 bp, Artificial
  CRISPR gRNA sequence
tagacatagcagtgagactc

SEQ ID NO: 381106 - DNA, 20 bp, Artificial
  CRISPR gRNA sequence
acctgcaaagcaagctgagt

SEQ ID NO: 381107 - DNA, 20 bp, Artificial
  CRISPR gRNA sequence
aggatttttgttcccggtga

SEQ ID NO: 381108 - DNA, 20 bp, Artificial
  CRISPR gRNA sequence
ttcagttcatgagttaggtc

SEQ ID NO: 381109 - DNA, 20 bp, Artificial
  CRISPR gRNA sequence
tatttatttaaagtaatata

SEQ ID NO: 381110 - DNA, 20 bp, Artificial
  CRISPR gRNA sequence
tccctttagtgtccttgtta

SEQ ID NO: 381111 - DNA, 20 bp, Artificial
  CRISPR gRNA sequence
tgaaaaacttttgttgtgta

SEQ ID NO: 381112 - DNA, 20 bp, Artificial
  CRISPR gRNA sequence
tatgttgttttcaaatgcca

SEQ ID NO: 381113 - DNA, 20 bp, Artificial
  CRISPR gRNA sequence
tactttggagtgctatgtga

SEQ ID NO: 381114 - DNA, 20 bp, Artificial
  CRISPR gRNA sequence
ttcaaacactctttgggcct

SEQ ID NO: 381115 - DNA, 20 bp, Artificial
  CRISPR gRNA sequence
ctcactgcttatttgtacct

SEQ ID NO: 381116 - DNA, 20 bp, Artificial
  CRISPR gRNA sequence
ctctgggctttgcagttctc

SEQ ID NO: 381117 - DNA, 20 bp, Artificial
  CRISPR gRNA sequence
tttgcagttctccccagttt

SEQ ID NO: 381118 - DNA, 20 bp, Artificial
  CRISPR gRNA sequence
actttgtcagttcagccata

SEQ ID NO: 381119 - DNA, 20 bp, Artificial
  CRISPR gRNA sequence
ttttccctggactttcaaaa

SEQ ID NO: 381120 - DNA, 20 bp, Artificial
  CRISPR gRNA sequence
ctggactttcaaaaacatgt

SEQ ID NO: 381121 - DNA, 20 bp, Artificial
  CRISPR gRNA sequence
ttttttttttttgtaagtct

SEQ ID NO: 381122 - DNA, 20 bp, Artificial
  CRISPR gRNA sequence
ttgtaagtctaggggtttct

SEQ ID NO: 381123 - DNA, 20 bp, Artificial
  CRISPR gRNA sequence
ccagaatatttgcattttat

SEQ ID NO: 381124 - DNA, 20 bp, Artificial
  CRISPR gRNA sequence
ttttgtcatttgatcatgac

SEQ ID NO: 381125 - DNA, 20 bp, Artificial
  CRISPR gRNA sequence
tagtacaaatgtagtgtgtc

SEQ ID NO: 381126 - DNA, 20 bp, Artificial
  CRISPR gRNA sequence
tctatggtataattcaagaa

SEQ ID NO: 381127 - DNA, 20 bp, Artificial
  CRISPR gRNA sequence
gtttctcccttgtaaagtgt

SEQ ID NO: 381128 - DNA, 20 bp, Artificial
  CRISPR gRNA sequence
ttggcagttgctatttagat

SEQ ID NO: 381129 - DNA, 20 bp, Artificial
  CRISPR gRNA sequence
tcctcgataaatgatgctgc

SEQ ID NO: 381130 - DNA, 20 bp, Artificial
  CRISPR gRNA sequence
agtctgaggacacaatactc

SEQ ID NO: 381131 - DNA, 20 bp, Artificial
  CRISPR gRNA sequence
ttttgtatttttagtagaga

SEQ ID NO: 381132 - DNA, 20 bp, Artificial
  CRISPR gRNA sequence
ttttagtagagacggggttt

SEQ ID NO: 381133 - DNA, 20 bp, Artificial
  CRISPR gRNA sequence
cgcctcggcctcccaaagtg

SEQ ID NO: 381134 - DNA, 20 bp, Artificial
  CRISPR gRNA sequence
ggcgtgagccaccgcgcccg

SEQ ID NO: 381135 - DNA, 20 bp, Artificial
  CRISPR gRNA sequence
atcgaggttgtcactttctt

SEQ ID NO: 381136 - DNA, 20 bp, Artificial
  CRISPR gRNA sequence
ctcttaatttttttaggcct

SEQ ID NO: 381137 - DNA, 20 bp, Artificial
  CRISPR gRNA sequence
tctcagatagagaaggtgat

SEQ ID NO: 381138 - DNA, 20 bp, Artificial
  CRISPR gRNA sequence
aggcttcactagagaacaac

SEQ ID NO: 381139 - DNA, 20 bp, Artificial
  CRISPR gRNA sequence
gtaaggcagggataaaaaga

SEQ ID NO: 381140 - DNA, 20 bp, Artificial
  CRISPR gRNA sequence
aaaaagaggacgttttcgca

SEQ ID NO: 381141 - DNA, 20 bp, Artificial
  CRISPR gRNA sequence
cagttggttttgaggagggg

SEQ ID NO: 381142 - DNA, 20 bp, Artificial
  CRISPR gRNA sequence
tgccttccaacattatgatg

SEQ ID NO: 381143 - DNA, 20 bp, Artificial
  CRISPR gRNA sequence
ccatgttttgctattttgtt

SEQ ID NO: 381144 - DNA, 20 bp, Artificial
  CRISPR gRNA sequence
tgcctcagcctcctgagtag

SEQ ID NO: 381145 - DNA, 20 bp, Artificial
  CRISPR gRNA sequence
gggattacaggtgcccgcca

SEQ ID NO: 381146 - DNA, 20 bp, Artificial
  CRISPR gRNA sequence
tttgtaattttagtagagat

SEQ ID NO: 381147 - DNA, 20 bp, Artificial
  CRISPR gRNA sequence
gccaccaagcctggccagtt

SEQ ID NO: 381148 - DNA, 20 bp, Artificial
  CRISPR gRNA sequence
tttcaaaactgctctcatgc

SEQ ID NO: 381149 - DNA, 20 bp, Artificial
  CRISPR gRNA sequence
gaagggccccattcccaggg

SEQ ID NO: 381150 - DNA, 20 bp, Artificial
  CRISPR gRNA sequence
tgcatcctcacaatggcctg

SEQ ID NO: 381151 - DNA, 20 bp, Artificial
  CRISPR gRNA sequence
ctggtctgtttcttgactag

SEQ ID NO: 381152 - DNA, 20 bp, Artificial
  CRISPR gRNA sequence
taattgttccatttacagaa

SEQ ID NO: 381153 - DNA, 20 bp, Artificial
  CRISPR gRNA sequence
aattttgggaaaccgaggca

SEQ ID NO: 381154 - DNA, 20 bp, Artificial
  CRISPR gRNA sequence
ttgggaaaccgaggcaggag

SEQ ID NO: 381155 - DNA, 20 bp, Artificial
  CRISPR gRNA sequence
caggaggattgcttgagcct

SEQ ID NO: 381156 - DNA, 20 bp, Artificial
  CRISPR gRNA sequence
ggtaacatagtgagactgtg

SEQ ID NO: 381157 - DNA, 20 bp, Artificial
  CRISPR gRNA sequence
caggaggactgcctgtgccc

SEQ ID NO: 381158 - DNA, 20 bp, Artificial
  CRISPR gRNA sequence
tattaatattttttaaatat

SEQ ID NO: 381159 - DNA, 20 bp, Artificial
  CRISPR gRNA sequence
tgctgttagaaaaacctcct

SEQ ID NO: 381160 - DNA, 20 bp, Artificial
  CRISPR gRNA sequence
gacttttgtacaccttagtg

SEQ ID NO: 381161 - DNA, 20 bp, Artificial
  CRISPR gRNA sequence
gtgtaactagtcctttatca

SEQ ID NO: 381162 - DNA, 20 bp, Artificial
  CRISPR gRNA sequence
tcctttatcatggggatttc

SEQ ID NO: 381163 - DNA, 20 bp, Artificial
  CRISPR gRNA sequence
taacgaggtccctaaaacag

SEQ ID NO: 381164 - DNA, 20 bp, Artificial
  CRISPR gRNA sequence
attcttggtacttcctcaag

SEQ ID NO: 381165 - DNA, 20 bp, Artificial
  CRISPR gRNA sequence
agttttccaaagacaaaaat

SEQ ID NO: 381166 - DNA, 20 bp, Artificial
  CRISPR gRNA sequence
ttccaaagacaaaaatggga

SEQ ID NO: 381167 - DNA, 20 bp, Artificial
  CRISPR gRNA sequence
attggataaaacttggagtg

SEQ ID NO: 381168 - DNA, 20 bp, Artificial
  CRISPR gRNA sequence
aaactgactaacaaggagac

SEQ ID NO: 381169 - DNA, 20 bp, Artificial
  CRISPR gRNA sequence
ggaggacagccaccttatta

SEQ ID NO: 381170 - DNA, 20 bp, Artificial
  CRISPR gRNA sequence
agaagtcattccttctgtgg

SEQ ID NO: 381171 - DNA, 20 bp, Artificial
  CRISPR gRNA sequence
ccaatggcccaataagatgt

SEQ ID NO: 381172 - DNA, 20 bp, Artificial
  CRISPR gRNA sequence
aactgcgcccccaaagctgg

SEQ ID NO: 381173 - DNA, 20 bp, Artificial
  CRISPR gRNA sequence
atcccatgcgaggaggcctt

SEQ ID NO: 381174 - DNA, 20 bp, Artificial
  CRISPR gRNA sequence
cacatgagggcctggagtgg

SEQ ID NO: 381175 - DNA, 20 bp, Artificial
  CRISPR gRNA sequence
ggagtggtggtgattaatgg

SEQ ID NO: 381176 - DNA, 20 bp, Artificial
  CRISPR gRNA sequence
agaggtgagggcagagagaa

SEQ ID NO: 381177 - DNA, 20 bp, Artificial
  CRISPR gRNA sequence
cagagagaaggaggcttaga

SEQ ID NO: 381178 - DNA, 20 bp, Artificial
  CRISPR gRNA sequence
aagaagctccaagtattgaa

SEQ ID NO: 381179 - DNA, 20 bp, Artificial
  CRISPR gRNA sequence
tgcaagcagagaggtccatg

SEQ ID NO: 381180 - DNA, 20 bp, Artificial
  CRISPR gRNA sequence
tcccagaggaaacattgggt

SEQ ID NO: 381181 - DNA, 20 bp, Artificial
  CRISPR gRNA sequence
gcgagatgacttttttgtat

SEQ ID NO: 381182 - DNA, 20 bp, Artificial
  CRISPR gRNA sequence
ttcatctactatttgggtac

SEQ ID NO: 381183 - DNA, 20 bp, Artificial
  CRISPR gRNA sequence
aacagtgcctcaaatgaaag

SEQ ID NO: 381184 - DNA, 20 bp, Artificial
  CRISPR gRNA sequence
ttcaataaacatccgctgca

SEQ ID NO: 381185 - DNA, 20 bp, Artificial
  CRISPR gRNA sequence
agtatatattaaatttttta

SEQ ID NO: 381186 - DNA, 20 bp, Artificial
  CRISPR gRNA sequence
gtaagtaaaaaggagaagtg

SEQ ID NO: 381187 - DNA, 20 bp, Artificial
  CRISPR gRNA sequence
gaatgcattggtgaggcaat

SEQ ID NO: 381188 - DNA, 20 bp, Artificial
  CRISPR gRNA sequence
atattataaactccatgaag

SEQ ID NO: 381189 - DNA, 20 bp, Artificial
  CRISPR gRNA sequence
gacatttcaaggcagtaggg

SEQ ID NO: 381190 - DNA, 20 bp, Artificial
  CRISPR gRNA sequence
atggattttctatggaaaat

SEQ ID NO: 381191 - DNA, 20 bp, Artificial
  CRISPR gRNA sequence
tatcttccccaggaaagcaa

SEQ ID NO: 381192 - DNA, 20 bp, Artificial
  CRISPR gRNA sequence
aaagcagtttaaaaaatatc

SEQ ID NO: 381193 - DNA, 20 bp, Artificial
  CRISPR gRNA sequence
taaaaaatatcttcagtttt

SEQ ID NO: 381194 - DNA, 20 bp, Artificial
  CRISPR gRNA sequence
agtttttcctgtttctattt

SEQ ID NO: 381195 - DNA, 20 bp, Artificial
  CRISPR gRNA sequence
ttaggaggctgaggtgggat

SEQ ID NO: 381196 - DNA, 20 bp, Artificial
  CRISPR gRNA sequence
atggtttgatcctgaaaggt

SEQ ID NO: 381197 - DNA, 20 bp, Artificial
  CRISPR gRNA sequence
aaggtcggggcttcagtgac

SEQ ID NO: 381198 - DNA, 20 bp, Artificial
  CRISPR gRNA sequence
gatgaaagtaagaggataac

SEQ ID NO: 381199 - DNA, 20 bp, Artificial
  CRISPR gRNA sequence
tcatttaaaaaatcctcatt

SEQ ID NO: 381200 - DNA, 20 bp, Artificial
  CRISPR gRNA sequence
ttcagcgaaataagatgaaa

SEQ ID NO: 381201 - DNA, 20 bp, Artificial
  CRISPR gRNA sequence
atttacttcacagacagata

SEQ ID NO: 381202 - DNA, 20 bp, Artificial
  CRISPR gRNA sequence
cactttcttttgatactaga

SEQ ID NO: 381203 - DNA, 20 bp, Artificial
  CRISPR gRNA sequence
ttgatactagacattgtttg

SEQ ID NO: 381204 - DNA, 20 bp, Artificial
  CRISPR gRNA sequence
aaatattatggtgaaaatga

SEQ ID NO: 381205 - DNA, 20 bp, Artificial
  CRISPR gRNA sequence
tttttgtagctatgtaaacg

SEQ ID NO: 381206 - DNA, 20 bp, Artificial
  CRISPR gRNA sequence
aacggtcagttttttccttc

SEQ ID NO: 381207 - DNA, 20 bp, Artificial
  CRISPR gRNA sequence
gtttgaaaaaagctccctga

SEQ ID NO: 381208 - DNA, 20 bp, Artificial
  CRISPR gRNA sequence
gctccctgacagcgtttctg

SEQ ID NO: 381209 - DNA, 20 bp, Artificial
  CRISPR gRNA sequence
gggttgctccgttatttttc

SEQ ID NO: 381210 - DNA, 20 bp, Artificial
  CRISPR gRNA sequence
tatccagtactcattggacg

SEQ ID NO: 381211 - DNA, 20 bp, Artificial
  CRISPR gRNA sequence
gcctcaactgtccgaacatt

SEQ ID NO: 381212 - DNA, 20 bp, Artificial
  CRISPR gRNA sequence
tttaaagtgttaaccttttt

SEQ ID NO: 381213 - DNA, 20 bp, Artificial
  CRISPR gRNA sequence
gggcccatggcccccacctc

SEQ ID NO: 381214 - DNA, 20 bp, Artificial
  CRISPR gRNA sequence
gtgcattttacattgtaaac

SEQ ID NO: 381215 - DNA, 20 bp, Artificial
  CRISPR gRNA sequence
ttttacattgtaaacatctg

SEQ ID NO: 381216 - DNA, 20 bp, Artificial
  CRISPR gRNA sequence
tgtaaacatctgtttagttt

SEQ ID NO: 381217 - DNA, 20 bp, Artificial
  CRISPR gRNA sequence
ttatccactctatccttaat

SEQ ID NO: 381218 - DNA, 20 bp, Artificial
  CRISPR gRNA sequence
aacctccacctgccaagttc

SEQ ID NO: 381219 - DNA, 20 bp, Artificial
  CRISPR gRNA sequence
tgcctcagcctcccaagtag

SEQ ID NO: 381220 - DNA, 20 bp, Artificial
  CRISPR gRNA sequence
ttttgtatttttagtagtga

SEQ ID NO: 381221 - DNA, 20 bp, Artificial
  CRISPR gRNA sequence
tgcctcggcctcccaaagtg

SEQ ID NO: 381222 - DNA, 20 bp, Artificial
  CRISPR gRNA sequence
gagccaccgtgcctggccct

SEQ ID NO: 381223 - DNA, 20 bp, Artificial
  CRISPR gRNA sequence
ttttacaatagacccttaaa

SEQ ID NO: 381224 - DNA, 20 bp, Artificial
  CRISPR gRNA sequence
caatagacccttaaaagtag

SEQ ID NO: 381225 - DNA, 20 bp, Artificial
  CRISPR gRNA sequence
taaattggctgtgcccttct

SEQ ID NO: 381226 - DNA, 20 bp, Artificial
  CRISPR gRNA sequence
gtgggttcagtgggcagctg

SEQ ID NO: 381227 - DNA, 20 bp, Artificial
  CRISPR gRNA sequence
gtgggcagctgacttgtttt

SEQ ID NO: 381228 - DNA, 20 bp, Artificial
  CRISPR gRNA sequence
gatctcaaagcataatcaac

SEQ ID NO: 381229 - DNA, 20 bp, Artificial
  CRISPR gRNA sequence
gtaggagaacatataaattc

SEQ ID NO: 381230 - DNA, 20 bp, Artificial
  CRISPR gRNA sequence
tgtgttgggggggtgtgtaa

SEQ ID NO: 381231 - DNA, 20 bp, Artificial
  CRISPR gRNA sequence
aggccttagaatatgtgctg

SEQ ID NO: 381232 - DNA, 20 bp, Artificial
  CRISPR gRNA sequence
agaagtttgaattttatcct

SEQ ID NO: 381233 - DNA, 20 bp, Artificial
  CRISPR gRNA sequence
ctagggactaatagggccag

SEQ ID NO: 381234 - DNA, 20 bp, Artificial
  CRISPR gRNA sequence
atagggccagatctgtttta

SEQ ID NO: 381235 - DNA, 20 bp, Artificial
  CRISPR gRNA sequence
ctattaaggaggaggaagtg

SEQ ID NO: 381236 - DNA, 20 bp, Artificial
  CRISPR gRNA sequence
gggatgcacaaaggaaggag

SEQ ID NO: 381237 - DNA, 20 bp, Artificial
  CRISPR gRNA sequence
gcacaaaggaaggagtgaag

SEQ ID NO: 381238 - DNA, 20 bp, Artificial
  CRISPR gRNA sequence
ggagatggtattaaccaaga

SEQ ID NO: 381239 - DNA, 20 bp, Artificial
  CRISPR gRNA sequence
atttagtatgaaagataaag

SEQ ID NO: 381240 - DNA, 20 bp, Artificial
  CRISPR gRNA sequence
tgactcattaaaaaatattg

SEQ ID NO: 381241 - DNA, 20 bp, Artificial
  CRISPR gRNA sequence
ttaaaaaatattgtgtggtt

SEQ ID NO: 381242 - DNA, 20 bp, Artificial
  CRISPR gRNA sequence
actttatgaatcaaacacat

SEQ ID NO: 381243 - DNA, 20 bp, Artificial
  CRISPR gRNA sequence
ttgtttcttgttgagatgat

SEQ ID NO: 381244 - DNA, 20 bp, Artificial
  CRISPR gRNA sequence
agatgataaatgttttgagt

SEQ ID NO: 381245 - DNA, 20 bp, Artificial
  CRISPR gRNA sequence
ccggagggtattttattcag

SEQ ID NO: 381246 - DNA, 20 bp, Artificial
  CRISPR gRNA sequence
cttaaattctattatttaaa

SEQ ID NO: 381247 - DNA, 20 bp, Artificial
  CRISPR gRNA sequence
ggttttgtcttgttactctt

SEQ ID NO: 381248 - DNA, 20 bp, Artificial
  CRISPR gRNA sequence
tcttttcctgaaatatacat

SEQ ID NO: 381249 - DNA, 20 bp, Artificial
  CRISPR gRNA sequence
ctgaaatatacattgaagtt

SEQ ID NO: 381250 - DNA, 20 bp, Artificial
  CRISPR gRNA sequence
atatacattgaagtttttag

SEQ ID NO: 381251 - DNA, 20 bp, Artificial
  CRISPR gRNA sequence
tctctggttgctgaaatcat

SEQ ID NO: 381252 - DNA, 20 bp, Artificial
  CRISPR gRNA sequence
aatctattgacaggcaaaaa

SEQ ID NO: 381253 - DNA, 20 bp, Artificial
  CRISPR gRNA sequence
accactggctctggcacatc

SEQ ID NO: 381254 - DNA, 20 bp, Artificial
  CRISPR gRNA sequence
tggctctggcacatcctgtg

SEQ ID NO: 381255 - DNA, 20 bp, Artificial
  CRISPR gRNA sequence
tgattctgatccccaaattt

SEQ ID NO: 381256 - DNA, 20 bp, Artificial
  CRISPR gRNA sequence
atccccaaattttatggctt

SEQ ID NO: 381257 - DNA, 20 bp, Artificial
  CRISPR gRNA sequence
caaattttatggcttttttg

SEQ ID NO: 381258 - DNA, 20 bp, Artificial
  CRISPR gRNA sequence
tttatggcttttttgttttg

SEQ ID NO: 381259 - DNA, 20 bp, Artificial
  CRISPR gRNA sequence
gccaaggagaatggcaaaca

SEQ ID NO: 381260 - DNA, 20 bp, Artificial
  CRISPR gRNA sequence
atttcaaagcaactatttca

SEQ ID NO: 381261 - DNA, 20 bp, Artificial
  CRISPR gRNA sequence
tttatctaagttctttctga

SEQ ID NO: 381262 - DNA, 20 bp, Artificial
  CRISPR gRNA sequence
ctaactgtaatctggaaaag

SEQ ID NO: 381263 - DNA, 20 bp, Artificial
  CRISPR gRNA sequence
ctgtaatctggaaaagaatt

SEQ ID NO: 381264 - DNA, 20 bp, Artificial
  CRISPR gRNA sequence
gtttgttttctccatttcat

SEQ ID NO: 381265 - DNA, 20 bp, Artificial
  CRISPR gRNA sequence
ctccatttcatctttgcttc

SEQ ID NO: 381266 - DNA, 20 bp, Artificial
  CRISPR gRNA sequence
tattaacattgaattcattt

SEQ ID NO: 381267 - DNA, 20 bp, Artificial
  CRISPR gRNA sequence
gctactaataaagcaaatag

SEQ ID NO: 381268 - DNA, 20 bp, Artificial
  CRISPR gRNA sequence
ccgtgaactatgactagaag

SEQ ID NO: 381269 - DNA, 20 bp, Artificial
  CRISPR gRNA sequence
gcattgtcaatcattaacga

SEQ ID NO: 381270 - DNA, 20 bp, Artificial
  CRISPR gRNA sequence
tagtaaaaaaatattttttt

SEQ ID NO: 381271 - DNA, 20 bp, Artificial
  CRISPR gRNA sequence
cgagtcaggacctattgcat

SEQ ID NO: 381272 - DNA, 20 bp, Artificial
  CRISPR gRNA sequence
gactttcctttgcaatttcc

SEQ ID NO: 381273 - DNA, 20 bp, Artificial
  CRISPR gRNA sequence
ttactttagagcatgaacat

SEQ ID NO: 381274 - DNA, 20 bp, Artificial
  CRISPR gRNA sequence
tttccaatttacttcagtag

SEQ ID NO: 381275 - DNA, 20 bp, Artificial
  CRISPR gRNA sequence
attgatatatggtgttcact

SEQ ID NO: 381276 - DNA, 20 bp, Artificial
  CRISPR gRNA sequence
ttgccaatggcactgatatg

SEQ ID NO: 381277 - DNA, 20 bp, Artificial
  CRISPR gRNA sequence
caaaaatgtcaaggtcgtag

SEQ ID NO: 381278 - DNA, 20 bp, Artificial
  CRISPR gRNA sequence
gaaaggtagaatttcagagc

SEQ ID NO: 381279 - DNA, 20 bp, Artificial
  CRISPR gRNA sequence
gtagtataaatactggacat

SEQ ID NO: 381280 - DNA, 20 bp, Artificial
  CRISPR gRNA sequence
tgaaaatatgatcacagtga

SEQ ID NO: 381281 - DNA, 20 bp, Artificial
  CRISPR gRNA sequence
agtgcatttcccccaactca

SEQ ID NO: 381282 - DNA, 20 bp, Artificial
  CRISPR gRNA sequence
ggtcccttgctccataatat

SEQ ID NO: 381283 - DNA, 20 bp, Artificial
  CRISPR gRNA sequence
actctaagcaccaacttacc

SEQ ID NO: 381284 - DNA, 20 bp, Artificial
  CRISPR gRNA sequence
tgttactctaagagtatggc

SEQ ID NO: 381285 - DNA, 20 bp, Artificial
  CRISPR gRNA sequence
aagagtatggcatacgttta

SEQ ID NO: 381286 - DNA, 20 bp, Artificial
  CRISPR gRNA sequence
gttcacatgtaatgcataaa

SEQ ID NO: 381287 - DNA, 20 bp, Artificial
  CRISPR gRNA sequence
atagattaataaaattctag

SEQ ID NO: 381288 - DNA, 20 bp, Artificial
  CRISPR gRNA sequence
aaaattctagagttgcttta

SEQ ID NO: 381289 - DNA, 20 bp, Artificial
  CRISPR gRNA sequence
tttttcatttagaaaaaagc

SEQ ID NO: 381290 - DNA, 20 bp, Artificial
  CRISPR gRNA sequence
aagcacatgtttagaaaata

SEQ ID NO: 381291 - DNA, 20 bp, Artificial
  CRISPR gRNA sequence
tttagaaaataaaaagttta

SEQ ID NO: 381292 - DNA, 20 bp, Artificial
  CRISPR gRNA sequence
ttttctcactctgagaaata

SEQ ID NO: 381293 - DNA, 20 bp, Artificial
  CRISPR gRNA sequence
atctcttcaataaggacttt

SEQ ID NO: 381294 - DNA, 20 bp, Artificial
  CRISPR gRNA sequence
ctctggcgatctattttcta

SEQ ID NO: 381295 - DNA, 20 bp, Artificial
  CRISPR gRNA sequence
gtatgacggcgcatcccaga

SEQ ID NO: 381296 - DNA, 20 bp, Artificial
  CRISPR gRNA sequence
tataagaaaccagtgagaca

SEQ ID NO: 381297 - DNA, 20 bp, Artificial
  CRISPR gRNA sequence
aaacagatcccatttgttac

SEQ ID NO: 381298 - DNA, 20 bp, Artificial
  CRISPR gRNA sequence
tacaagtgattagatccaaa

SEQ ID NO: 381299 - DNA, 20 bp, Artificial
  CRISPR gRNA sequence
attattaatcagacctaaag

SEQ ID NO: 381300 - DNA, 20 bp, Artificial
  CRISPR gRNA sequence
catctcaatctcaaaatgta

SEQ ID NO: 381301 - DNA, 20 bp, Artificial
  CRISPR gRNA sequence
cactcactttatgacaacat

SEQ ID NO: 381302 - DNA, 20 bp, Artificial
  CRISPR gRNA sequence
attgcagattttgatgtctc

SEQ ID NO: 381303 - DNA, 20 bp, Artificial
  CRISPR gRNA sequence
tgtaagaaggctcaaccatt

SEQ ID NO: 381304 - DNA, 20 bp, Artificial
  CRISPR gRNA sequence
aacactttgacttttgttgc

SEQ ID NO: 381305 - DNA, 20 bp, Artificial
  CRISPR gRNA sequence
acttttgttgccattgcttt

SEQ ID NO: 381306 - DNA, 20 bp, Artificial
  CRISPR gRNA sequence
tatgtcctgaatggtaatgc

SEQ ID NO: 381307 - DNA, 20 bp, Artificial
  CRISPR gRNA sequence
gtaatgcctaggttttcttc

SEQ ID NO: 381308 - DNA, 20 bp, Artificial
  CRISPR gRNA sequence
aggttttcttctagggtttt

SEQ ID NO: 381309 - DNA, 20 bp, Artificial
  CRISPR gRNA sequence
tataaggtgtaaggaaggga

SEQ ID NO: 381310 - DNA, 20 bp, Artificial
  CRISPR gRNA sequence
gtgtaaggaagggatccagt

SEQ ID NO: 381311 - DNA, 20 bp, Artificial
  CRISPR gRNA sequence
cagctttctacatatggcta

SEQ ID NO: 381312 - DNA, 20 bp, Artificial
  CRISPR gRNA sequence
tttgaatagatataagaaaa

SEQ ID NO: 381313 - DNA, 20 bp, Artificial
  CRISPR gRNA sequence
gttaagtccacagccaagaa

SEQ ID NO: 381314 - DNA, 20 bp, Artificial
  CRISPR gRNA sequence
gggcaaagactcttagttca

SEQ ID NO: 381315 - DNA, 20 bp, Artificial
  CRISPR gRNA sequence
tttacctctttattttaatc

SEQ ID NO: 381316 - DNA, 20 bp, Artificial
  CRISPR gRNA sequence
gataagtgtggtgaaaagag

SEQ ID NO: 381317 - DNA, 20 bp, Artificial
  CRISPR gRNA sequence
tgtggtgaaaagagagttgc

SEQ ID NO: 381318 - DNA, 20 bp, Artificial
  CRISPR gRNA sequence
ctttaaggtcgctcttcata

SEQ ID NO: 381319 - DNA, 20 bp, Artificial
  CRISPR gRNA sequence
catatgtggtttgtagcaat

SEQ ID NO: 381320 - DNA, 20 bp, Artificial
  CRISPR gRNA sequence
ggtttgtagcaatatctgtt

SEQ ID NO: 381321 - DNA, 20 bp, Artificial
  CRISPR gRNA sequence
ctgtttagggtttattttca

SEQ ID NO: 381322 - DNA, 20 bp, Artificial
  CRISPR gRNA sequence
aaaatgaagaaggcagttcc

SEQ ID NO: 381323 - DNA, 20 bp, Artificial
  CRISPR gRNA sequence
ctgttccactgaagccttct

SEQ ID NO: 381324 - DNA, 20 bp, Artificial
  CRISPR gRNA sequence
gacagtactcacttcaaaaa

SEQ ID NO: 381325 - DNA, 20 bp, Artificial
  CRISPR gRNA sequence
tgttggaccatttcaattaa

SEQ ID NO: 381326 - DNA, 20 bp, Artificial
  CRISPR gRNA sequence
gctaactcacttcgccaaca

SEQ ID NO: 381327 - DNA, 20 bp, Artificial
  CRISPR gRNA sequence
agtgtagtcccagcgtcttg

SEQ ID NO: 381328 - DNA, 20 bp, Artificial
  CRISPR gRNA sequence
cttctgctctaccatctgtc

SEQ ID NO: 381329 - DNA, 20 bp, Artificial
  CRISPR gRNA sequence
tctttaaattttagaatatt

SEQ ID NO: 381330 - DNA, 20 bp, Artificial
  CRISPR gRNA sequence
aaagtggaaaaactagtaca

SEQ ID NO: 381331 - DNA, 20 bp, Artificial
  CRISPR gRNA sequence
taacatctcacattattgtg

SEQ ID NO: 381332 - DNA, 20 bp, Artificial
  CRISPR gRNA sequence
ctagactttatttggatcca

SEQ ID NO: 381333 - DNA, 20 bp, Artificial
  CRISPR gRNA sequence
tttatttggatccaaagtga

SEQ ID NO: 381334 - DNA, 20 bp, Artificial
  CRISPR gRNA sequence
gcattgagttgccacttctc

SEQ ID NO: 381335 - DNA, 20 bp, Artificial
  CRISPR gRNA sequence
cccagtttcctctgatctgt

SEQ ID NO: 381336 - DNA, 20 bp, Artificial
  CRISPR gRNA sequence
ctgtgacagtttctatctct

SEQ ID NO: 381337 - DNA, 20 bp, Artificial
  CRISPR gRNA sequence
cctgcagagcatctcccaat

SEQ ID NO: 381338 - DNA, 20 bp, Artificial
  CRISPR gRNA sequence
tctcccaattagggtttgtc

SEQ ID NO: 381339 - DNA, 20 bp, Artificial
  CRISPR gRNA sequence
gggtttgtctgatgtttcac

SEQ ID NO: 381340 - DNA, 20 bp, Artificial
  CRISPR gRNA sequence
gtctccatcatgtggttaag

SEQ ID NO: 381341 - DNA, 20 bp, Artificial
  CRISPR gRNA sequence
atgtggttaaggtgtgtttg

SEQ ID NO: 381342 - DNA, 20 bp, Artificial
  CRISPR gRNA sequence
aaaagttcaggctgccgttc

SEQ ID NO: 381343 - DNA, 20 bp, Artificial
  CRISPR gRNA sequence
gccgttcttgtgtttcctct

SEQ ID NO: 381344 - DNA, 20 bp, Artificial
  CRISPR gRNA sequence
gatagactgatctttacttt

SEQ ID NO: 381345 - DNA, 20 bp, Artificial
  CRISPR gRNA sequence
actgatctttacttttcatg

SEQ ID NO: 381346 - DNA, 20 bp, Artificial
  CRISPR gRNA sequence
tcatgatttgcttcaccttg

SEQ ID NO: 381347 - DNA, 20 bp, Artificial
  CRISPR gRNA sequence
ccttgttaagtttctggaca

SEQ ID NO: 381348 - DNA, 20 bp, Artificial
  CRISPR gRNA sequence
ccaatattctctatttcaac

SEQ ID NO: 381349 - DNA, 20 bp, Artificial
  CRISPR gRNA sequence
tgtagtcatcttcacatatg

SEQ ID NO: 381350 - DNA, 20 bp, Artificial
  CRISPR gRNA sequence
ctttacagaattattgttgc

SEQ ID NO: 381351 - DNA, 20 bp, Artificial
  CRISPR gRNA sequence
aaaataaataccatggacac

SEQ ID NO: 381352 - DNA, 20 bp, Artificial
  CRISPR gRNA sequence
actcttgtttccctcttgct

SEQ ID NO: 381353 - DNA, 20 bp, Artificial
  CRISPR gRNA sequence
ctgttagttttttctgggct

SEQ ID NO: 381354 - DNA, 20 bp, Artificial
  CRISPR gRNA sequence
cttgcttttctgaatcgatg

SEQ ID NO: 381355 - DNA, 20 bp, Artificial
  CRISPR gRNA sequence
ctgctaatagctgtactcac

SEQ ID NO: 381356 - DNA, 20 bp, Artificial
  CRISPR gRNA sequence
atttttcattttaacttcat

SEQ ID NO: 381357 - DNA, 20 bp, Artificial
  CRISPR gRNA sequence
agaaatactgttgatctttc

SEQ ID NO: 381358 - DNA, 20 bp, Artificial
  CRISPR gRNA sequence
ccaggagggaaagctgctgt

SEQ ID NO: 381359 - DNA, 20 bp, Artificial
  CRISPR gRNA sequence
ttacaacacatcatctttgg

SEQ ID NO: 381360 - DNA, 20 bp, Artificial
  CRISPR gRNA sequence
ttaatgtgcctggcattttg

SEQ ID NO: 381361 - DNA, 20 bp, Artificial
  CRISPR gRNA sequence
tacaatgtctttaaggagtg

SEQ ID NO: 381362 - DNA, 20 bp, Artificial
  CRISPR gRNA sequence
agtgttcttggaatgaagtg

SEQ ID NO: 381363 - DNA, 20 bp, Artificial
  CRISPR gRNA sequence
ttggggaaactggagtatat

SEQ ID NO: 381364 - DNA, 20 bp, Artificial
  CRISPR gRNA sequence
aaaggcaagaataaaatcat

SEQ ID NO: 381365 - DNA, 20 bp, Artificial
  CRISPR gRNA sequence
ataggattttgctaaagaac

SEQ ID NO: 381366 - DNA, 20 bp, Artificial
  CRISPR gRNA sequence
caaagtacagctgtagcctg

SEQ ID NO: 381367 - DNA, 20 bp, Artificial
  CRISPR gRNA sequence
aaccatatctcaaattttca

SEQ ID NO: 381368 - DNA, 20 bp, Artificial
  CRISPR gRNA sequence
gttagtcattcttgctgttg

SEQ ID NO: 381369 - DNA, 20 bp, Artificial
  CRISPR gRNA sequence
ttgctgttgtgcagatttct

SEQ ID NO: 381370 - DNA, 20 bp, Artificial
  CRISPR gRNA sequence
ttgtgcagatttctttgaga

SEQ ID NO: 381371 - DNA, 20 bp, Artificial
  CRISPR gRNA sequence
aatatgtacaagctattata

SEQ ID NO: 381372 - DNA, 20 bp, Artificial
  CRISPR gRNA sequence
gctattatataaggtttttc

SEQ ID NO: 381373 - DNA, 20 bp, Artificial
  CRISPR gRNA sequence
attcaccctacaattaactg

SEQ ID NO: 381374 - DNA, 20 bp, Artificial
  CRISPR gRNA sequence
agaaattatttttgcctcca

SEQ ID NO: 381375 - DNA, 20 bp, Artificial
  CRISPR gRNA sequence
gccacagaaatagaaaacac

SEQ ID NO: 381376 - DNA, 20 bp, Artificial
  CRISPR gRNA sequence
aaatgtggaaagagagagcc

SEQ ID NO: 381377 - DNA, 20 bp, Artificial
  CRISPR gRNA sequence
agccgtaggattcagtggct

SEQ ID NO: 381378 - DNA, 20 bp, Artificial
  CRISPR gRNA sequence
aacagagagtcaaagacaga

SEQ ID NO: 381379 - DNA, 20 bp, Artificial
  CRISPR gRNA sequence
agagtcaaagacagagtcgg

SEQ ID NO: 381380 - DNA, 20 bp, Artificial
  CRISPR gRNA sequence
tcctatgtcttctgtctgac

SEQ ID NO: 381381 - DNA, 20 bp, Artificial
  CRISPR gRNA sequence
actgtaagcaccatcctacc

SEQ ID NO: 381382 - DNA, 20 bp, Artificial
  CRISPR gRNA sequence
cctaccctctgcttctatga

SEQ ID NO: 381383 - DNA, 20 bp, Artificial
  CRISPR gRNA sequence
tcgggaggctgaggcagcag

SEQ ID NO: 381384 - DNA, 20 bp, Artificial
  CRISPR gRNA sequence
tccaggcacactgatggaaa

SEQ ID NO: 381385 - DNA, 20 bp, Artificial
  CRISPR gRNA sequence
aatttagtaaagttctacaa

SEQ ID NO: 381386 - DNA, 20 bp, Artificial
  CRISPR gRNA sequence
tagtaaagttctacaattgt

SEQ ID NO: 381387 - DNA, 20 bp, Artificial
  CRISPR gRNA sequence
agttctacaattgtgcttgc

SEQ ID NO: 381388 - DNA, 20 bp, Artificial
  CRISPR gRNA sequence
cagggaaacccatcagggga

SEQ ID NO: 381389 - DNA, 20 bp, Artificial
  CRISPR gRNA sequence
agaagagagcacagaagctg

SEQ ID NO: 381390 - DNA, 20 bp, Artificial
  CRISPR gRNA sequence
atggagttccctgcattgca

SEQ ID NO: 381391 - DNA, 20 bp, Artificial
  CRISPR gRNA sequence
attgcagggtgtttggaact

SEQ ID NO: 381392 - DNA, 20 bp, Artificial
  CRISPR gRNA sequence
attgcttagcgaaacccaag

SEQ ID NO: 381393 - DNA, 20 bp, Artificial
  CRISPR gRNA sequence
gagagccataagggtgaatt

SEQ ID NO: 381394 - DNA, 20 bp, Artificial
  CRISPR gRNA sequence
gccataagggtgaattttta

SEQ ID NO: 381395 - DNA, 20 bp, Artificial
  CRISPR gRNA sequence
gagtcctgttgctattcctg

SEQ ID NO: 381396 - DNA, 20 bp, Artificial
  CRISPR gRNA sequence
gttctcctttccctacagaa

SEQ ID NO: 381397 - DNA, 20 bp, Artificial
  CRISPR gRNA sequence
cactgttagcaatggtgaac

SEQ ID NO: 381398 - DNA, 20 bp, Artificial
  CRISPR gRNA sequence
aacctctgatttcctgagca

SEQ ID NO: 381399 - DNA, 20 bp, Artificial
  CRISPR gRNA sequence
ctgagcagtgtgttttaaaa

SEQ ID NO: 381400 - DNA, 20 bp, Artificial
  CRISPR gRNA sequence
acattgtgagggtgtgcagg

SEQ ID NO: 381401 - DNA, 20 bp, Artificial
  CRISPR gRNA sequence
agggtgtgcaggtactgttt

SEQ ID NO: 381402 - DNA, 20 bp, Artificial
  CRISPR gRNA sequence
gcatcaaacttatgcaatcg

SEQ ID NO: 381403 - DNA, 20 bp, Artificial
  CRISPR gRNA sequence
aacttatgcaatcgaacagc

SEQ ID NO: 381404 - DNA, 20 bp, Artificial
  CRISPR gRNA sequence
agcttaagtttggagtccta

SEQ ID NO: 381405 - DNA, 20 bp, Artificial
  CRISPR gRNA sequence
ttttcttctggcaaataccc

SEQ ID NO: 381406 - DNA, 20 bp, Artificial
  CRISPR gRNA sequence
ggtgagcaccgtcgggcaat

SEQ ID NO: 381407 - DNA, 20 bp, Artificial
  CRISPR gRNA sequence
ggaatttctacaggctctct

SEQ ID NO: 381408 - DNA, 20 bp, Artificial
  CRISPR gRNA sequence
atcgtctttttacagcaatt

SEQ ID NO: 381409 - DNA, 20 bp, Artificial
  CRISPR gRNA sequence
tgtctctcccctaacccagt

SEQ ID NO: 381410 - DNA, 20 bp, Artificial
  CRISPR gRNA sequence
ggaggtaaaatttcaccgcc

SEQ ID NO: 381411 - DNA, 20 bp, Artificial
  CRISPR gRNA sequence
tctcctgtgggaaacatctt

SEQ ID NO: 381412 - DNA, 20 bp, Artificial
  CRISPR gRNA sequence
ttaacaaggacaagtgcaga

SEQ ID NO: 381413 - DNA, 20 bp, Artificial
  CRISPR gRNA sequence
caccggagtcccttctcagg

SEQ ID NO: 381414 - DNA, 20 bp, Artificial
  CRISPR gRNA sequence
tatttgtggggactaaatgc

SEQ ID NO: 381415 - DNA, 20 bp, Artificial
  CRISPR gRNA sequence
gcacttagtaaggactcgtt

SEQ ID NO: 381416 - DNA, 20 bp, Artificial
  CRISPR gRNA sequence
atttttaagtatatgggaca

SEQ ID NO: 381417 - DNA, 20 bp, Artificial
  CRISPR gRNA sequence
tgctcttgggcattttattt

SEQ ID NO: 381418 - DNA, 20 bp, Artificial
  CRISPR gRNA sequence
gagaaactgcagaatggctc

SEQ ID NO: 381419 - DNA, 20 bp, Artificial
  CRISPR gRNA sequence
ctcaaaagtttgacttttcc

SEQ ID NO: 381420 - DNA, 20 bp, Artificial
  CRISPR gRNA sequence
attctcattgtaccatggtg

SEQ ID NO: 381421 - DNA, 20 bp, Artificial
  CRISPR gRNA sequence
ttacctttcaggagccaatc

SEQ ID NO: 381422 - DNA, 20 bp, Artificial
  CRISPR gRNA sequence
gggaggccggtggtctcagc

SEQ ID NO: 381423 - DNA, 20 bp, Artificial
  CRISPR gRNA sequence
attgcaagtcctttgctgtt

SEQ ID NO: 381424 - DNA, 20 bp, Artificial
  CRISPR gRNA sequence
tactgcaaatcatctcttaa

SEQ ID NO: 381425 - DNA, 20 bp, Artificial
  CRISPR gRNA sequence
tatggattttctgggctgaa

SEQ ID NO: 381426 - DNA, 20 bp, Artificial
  CRISPR gRNA sequence
tatttccacaaatggccttg

SEQ ID NO: 381427 - DNA, 20 bp, Artificial
  CRISPR gRNA sequence
cttgcctggctttccttcat

SEQ ID NO: 381428 - DNA, 20 bp, Artificial
  CRISPR gRNA sequence
ttcatgatggctttgtcggg

SEQ ID NO: 381429 - DNA, 20 bp, Artificial
  CRISPR gRNA sequence
gcctttcagttaagcggtct

SEQ ID NO: 381430 - DNA, 20 bp, Artificial
  CRISPR gRNA sequence
gtcttttagcttatttttta

SEQ ID NO: 381431 - DNA, 20 bp, Artificial
  CRISPR gRNA sequence
ggaagcagtgttgtgaagac

SEQ ID NO: 381432 - DNA, 20 bp, Artificial
  CRISPR gRNA sequence
ttttctcagcaggatggact

SEQ ID NO: 381433 - DNA, 20 bp, Artificial
  CRISPR gRNA sequence
ttaacagaaatgtgttgtct

SEQ ID NO: 381434 - DNA, 20 bp, Artificial
  CRISPR gRNA sequence
ggttgcaaggagaggtctca

SEQ ID NO: 381435 - DNA, 20 bp, Artificial
  CRISPR gRNA sequence
gcattcatcttcacatggcg

SEQ ID NO: 381436 - DNA, 20 bp, Artificial
  CRISPR gRNA sequence
ttttataaggacacggtcat

SEQ ID NO: 381437 - DNA, 20 bp, Artificial
  CRISPR gRNA sequence
acttggccatctgggaacat

SEQ ID NO: 381438 - DNA, 20 bp, Artificial
  CRISPR gRNA sequence
tccaatactgtcattgctgt

SEQ ID NO: 381439 - DNA, 20 bp, Artificial
  CRISPR gRNA sequence
agggagtctacagtgtaggc

SEQ ID NO: 381440 - DNA, 20 bp, Artificial
  CRISPR gRNA sequence
atgctgatgcgttctaggga

SEQ ID NO: 381441 - DNA, 20 bp, Artificial
  CRISPR gRNA sequence
atgcgttctagggaagaggc

SEQ ID NO: 381442 - DNA, 20 bp, Artificial
  CRISPR gRNA sequence
ggaagaggcttctgtttcta

SEQ ID NO: 381443 - DNA, 20 bp, Artificial
  CRISPR gRNA sequence
gaaaattctgccttttgtgt

SEQ ID NO: 381444 - DNA, 20 bp, Artificial
  CRISPR gRNA sequence
cctcccacactgcatgccct

SEQ ID NO: 381445 - DNA, 20 bp, Artificial
  CRISPR gRNA sequence
tttttccactttctggactt

SEQ ID NO: 381446 - DNA, 20 bp, Artificial
  CRISPR gRNA sequence
tccactttctggactttgtt

SEQ ID NO: 381447 - DNA, 20 bp, Artificial
  CRISPR gRNA sequence
ggaacttgcctttctatttc

SEQ ID NO: 381448 - DNA, 20 bp, Artificial
  CRISPR gRNA sequence
cttgcctttctatttctttt

SEQ ID NO: 381449 - DNA, 20 bp, Artificial
  CRISPR gRNA sequence
catttatttgggtgactagt

SEQ ID NO: 381450 - DNA, 20 bp, Artificial
  CRISPR gRNA sequence
gtaataatagtgctcctgca

SEQ ID NO: 381451 - DNA, 20 bp, Artificial
  CRISPR gRNA sequence
gatggcttagggcaatgctg

SEQ ID NO: 381452 - DNA, 20 bp, Artificial
  CRISPR gRNA sequence
cgtaagaacaagttatcgtc

SEQ ID NO: 381453 - DNA, 20 bp, Artificial
  CRISPR gRNA sequence
aggtctgactgagcaggcgc

SEQ ID NO: 381454 - DNA, 20 bp, Artificial
  CRISPR gRNA sequence
gtagaagggtggaaatggat

SEQ ID NO: 381455 - DNA, 20 bp, Artificial
  CRISPR gRNA sequence
atggcgccaaaaggtccaaa

SEQ ID NO: 381456 - DNA, 20 bp, Artificial
  CRISPR gRNA sequence
tttcaggaatgggagaaaga

SEQ ID NO: 381457 - DNA, 20 bp, Artificial
  CRISPR gRNA sequence
tggaggttaaagatacagga

SEQ ID NO: 381458 - DNA, 20 bp, Artificial
  CRISPR gRNA sequence
tgttctggcatgaaaaatgt

SEQ ID NO: 381459 - DNA, 20 bp, Artificial
  CRISPR gRNA sequence
tgtatgagctttaaaaccaa

SEQ ID NO: 381460 - DNA, 20 bp, Artificial
  CRISPR gRNA sequence
tttaaaaccaaattagtttc

SEQ ID NO: 381461 - DNA, 20 bp, Artificial
  CRISPR gRNA sequence
accaaattagtttcttgcgt

SEQ ID NO: 381462 - DNA, 20 bp, Artificial
  CRISPR gRNA sequence
ctgtgaaacaggcacattaa

SEQ ID NO: 381463 - DNA, 20 bp, Artificial
  CRISPR gRNA sequence
atactgattggatgttattg

SEQ ID NO: 381464 - DNA, 20 bp, Artificial
  CRISPR gRNA sequence
ttggatgttattgttaggat

SEQ ID NO: 381465 - DNA, 20 bp, Artificial
  CRISPR gRNA sequence
actccaatttaggttccttc

SEQ ID NO: 381466 - DNA, 20 bp, Artificial
  CRISPR gRNA sequence
ttttgtatttttagtagaga

SEQ ID NO: 381467 - DNA, 20 bp, Artificial
  CRISPR gRNA sequence
ctgcctcggcctcccaaagt

SEQ ID NO: 381468 - DNA, 20 bp, Artificial
  CRISPR gRNA sequence
cgggcacaaataaatacttt

SEQ ID NO: 381469 - DNA, 20 bp, Artificial
  CRISPR gRNA sequence
acttttaaagcttttttaat

SEQ ID NO: 381470 - DNA, 20 bp, Artificial
  CRISPR gRNA sequence
cagttcccctgtgaccagta

SEQ ID NO: 381471 - DNA, 20 bp, Artificial
  CRISPR gRNA sequence
gtatatagcttcgccgacta

SEQ ID NO: 381472 - DNA, 20 bp, Artificial
  CRISPR gRNA sequence
tttctcacactctctctttc

SEQ ID NO: 381473 - DNA, 20 bp, Artificial
  CRISPR gRNA sequence
tttagcctgaatctcaaaag

SEQ ID NO: 381474 - DNA, 20 bp, Artificial
  CRISPR gRNA sequence
atacctccctttaacctgta

SEQ ID NO: 381475 - DNA, 20 bp, Artificial
  CRISPR gRNA sequence
tttttgttgttgttgtcacc

SEQ ID NO: 381476 - DNA, 20 bp, Artificial
  CRISPR gRNA sequence
gagtttttcatattcccgtg

SEQ ID NO: 381477 - DNA, 20 bp, Artificial
  CRISPR gRNA sequence
ctttcccatggtggcatttg

SEQ ID NO: 381478 - DNA, 20 bp, Artificial
  CRISPR gRNA sequence
tgcagttctgtaagttggtg

SEQ ID NO: 381479 - DNA, 20 bp, Artificial
  CRISPR gRNA sequence
gtaagttggtggttagattt

SEQ ID NO: 381480 - DNA, 20 bp, Artificial
  CRISPR gRNA sequence
gttggtggttagatttggag

SEQ ID NO: 381481 - DNA, 20 bp, Artificial
  CRISPR gRNA sequence
atttggaggcttgattagca

SEQ ID NO: 381482 - DNA, 20 bp, Artificial
  CRISPR gRNA sequence
ggaggcttgattagcatcag

SEQ ID NO: 381483 - DNA, 20 bp, Artificial
  CRISPR gRNA sequence
atttgtgaatttgcagacac

SEQ ID NO: 381484 - DNA, 20 bp, Artificial
  CRISPR gRNA sequence
attgttgcctagaactctca

SEQ ID NO: 381485 - DNA, 20 bp, Artificial
  CRISPR gRNA sequence
aattgcaaattaattttttc

SEQ ID NO: 381486 - DNA, 20 bp, Artificial
  CRISPR gRNA sequence
caagtgtttaaagtcagaaa

SEQ ID NO: 381487 - DNA, 20 bp, Artificial
  CRISPR gRNA sequence
ttttgtatttttagtagaga

SEQ ID NO: 381488 - DNA, 20 bp, Artificial
  CRISPR gRNA sequence
cgcctcggcctcgcaaagtg

SEQ ID NO: 381489 - DNA, 20 bp, Artificial
  CRISPR gRNA sequence
aaaaatttttaaaaaaactt

SEQ ID NO: 381490 - DNA, 20 bp, Artificial
  CRISPR gRNA sequence
ttaggtttgtgggtacatgt

SEQ ID NO: 381491 - DNA, 20 bp, Artificial
  CRISPR gRNA sequence
cagtaactaagagttctctt

SEQ ID NO: 381492 - DNA, 20 bp, Artificial
  CRISPR gRNA sequence
tctcaactagacccagtgtc

SEQ ID NO: 381493 - DNA, 20 bp, Artificial
  CRISPR gRNA sequence
gaaagtgagaacatgtggta

SEQ ID NO: 381494 - DNA, 20 bp, Artificial
  CRISPR gRNA sequence
atttggttttcaattcctgc

SEQ ID NO: 381495 - DNA, 20 bp, Artificial
  CRISPR gRNA sequence
ttatcccatctgtcactgat

SEQ ID NO: 381496 - DNA, 20 bp, Artificial
  CRISPR gRNA sequence
ctgtcactgatggacgttta

SEQ ID NO: 381497 - DNA, 20 bp, Artificial
  CRISPR gRNA sequence
ttgatttcatgtctttgcta

SEQ ID NO: 381498 - DNA, 20 bp, Artificial
  CRISPR gRNA sequence
acatatgtgtctttatagtg

SEQ ID NO: 381499 - DNA, 20 bp, Artificial
  CRISPR gRNA sequence
ctctgggtatatgcccagga

SEQ ID NO: 381500 - DNA, 20 bp, Artificial
  CRISPR gRNA sequence
attgctgggtcaaatggtag

SEQ ID NO: 381501 - DNA, 20 bp, Artificial
  CRISPR gRNA sequence
atctctttgaggaattgcca

SEQ ID NO: 381502 - DNA, 20 bp, Artificial
  CRISPR gRNA sequence
tgcaacctcaccagcatctg

SEQ ID NO: 381503 - DNA, 20 bp, Artificial
  CRISPR gRNA sequence
agatggtgtctcattgtcat

SEQ ID NO: 381504 - DNA, 20 bp, Artificial
  CRISPR gRNA sequence
ttctgtaatgatgagtgata

SEQ ID NO: 381505 - DNA, 20 bp, Artificial
  CRISPR gRNA sequence
gtgatattgagctttttgtc

SEQ ID NO: 381506 - DNA, 20 bp, Artificial
  CRISPR gRNA sequence
tatgtcttcttttgagaagt

SEQ ID NO: 381507 - DNA, 20 bp, Artificial
  CRISPR gRNA sequence
ctttacccactttttaatgg

SEQ ID NO: 381508 - DNA, 20 bp, Artificial
  CRISPR gRNA sequence
gggtcgttttcctcttgtaa

SEQ ID NO: 381509 - DNA, 20 bp, Artificial
  CRISPR gRNA sequence
tattagacctttgtcagatg

SEQ ID NO: 381510 - DNA, 20 bp, Artificial
  CRISPR gRNA sequence
caaattttttatccaaaaaa

SEQ ID NO: 381511 - DNA, 20 bp, Artificial
  CRISPR gRNA sequence
gtaaaatggtctagctatac

SEQ ID NO: 381512 - DNA, 20 bp, Artificial
  CRISPR gRNA sequence
tggtctagctatacagaggc

SEQ ID NO: 381513 - DNA, 20 bp, Artificial
  CRISPR gRNA sequence
aagctgacagtaaaatgact

SEQ ID NO: 381514 - DNA, 20 bp, Artificial
  CRISPR gRNA sequence
cagggttttgtgaagtgggt

SEQ ID NO: 381515 - DNA, 20 bp, Artificial
  CRISPR gRNA sequence
tgatgtgaagatgtacccag

SEQ ID NO: 381516 - DNA, 20 bp, Artificial
  CRISPR gRNA sequence
agcactgaaataatttccaa

SEQ ID NO: 381517 - DNA, 20 bp, Artificial
  CRISPR gRNA sequence
ggaaaacaacacagtctatt

SEQ ID NO: 381518 - DNA, 20 bp, Artificial
  CRISPR gRNA sequence
gtagctacatataagtataa

SEQ ID NO: 381519 - DNA, 20 bp, Artificial
  CRISPR gRNA sequence
agctggttttcattatttgt

SEQ ID NO: 381520 - DNA, 20 bp, Artificial
  CRISPR gRNA sequence
caattaactacgacattttg

SEQ ID NO: 381521 - DNA, 20 bp, Artificial
  CRISPR gRNA sequence
tcatcaggatcccacggttc

SEQ ID NO: 381522 - DNA, 20 bp, Artificial
  CRISPR gRNA sequence
tcattttgagctgccttcca

SEQ ID NO: 381523 - DNA, 20 bp, Artificial
  CRISPR gRNA sequence
caagcaatatctgaggcaag

SEQ ID NO: 381524 - DNA, 20 bp, Artificial
  CRISPR gRNA sequence
ttggccgacctcgtaatagg

SEQ ID NO: 381525 - DNA, 20 bp, Artificial
  CRISPR gRNA sequence
catctaacaccaatcagtta

SEQ ID NO: 381526 - DNA, 20 bp, Artificial
  CRISPR gRNA sequence
aaggttaatcaggggctact

SEQ ID NO: 381527 - DNA, 20 bp, Artificial
  CRISPR gRNA sequence
caaagacagctgcatcccct

SEQ ID NO: 381528 - DNA, 20 bp, Artificial
  CRISPR gRNA sequence
atcccctctaggattttccc

SEQ ID NO: 381529 - DNA, 20 bp, Artificial
  CRISPR gRNA sequence
agacacggctatgagtagac

SEQ ID NO: 381530 - DNA, 20 bp, Artificial
  CRISPR gRNA sequence
ggttcacgggggcctgacag

SEQ ID NO: 381531 - DNA, 20 bp, Artificial
  CRISPR gRNA sequence
taggcagacaaaggaaactc

SEQ ID NO: 381532 - DNA, 20 bp, Artificial
  CRISPR gRNA sequence
accagaagggctcacatgaa

SEQ ID NO: 381533 - DNA, 20 bp, Artificial
  CRISPR gRNA sequence
tctccacatggtgtgctagc

SEQ ID NO: 381534 - DNA, 20 bp, Artificial
  CRISPR gRNA sequence
cttttctcacgtcttccttt

SEQ ID NO: 381535 - DNA, 20 bp, Artificial
  CRISPR gRNA sequence
aatttttattttaattttcc

SEQ ID NO: 381536 - DNA, 20 bp, Artificial
  CRISPR gRNA sequence
taattttccttttgtttctt

SEQ ID NO: 381537 - DNA, 20 bp, Artificial
  CRISPR gRNA sequence
ttttttaatgaattttcttc

SEQ ID NO: 381538 - DNA, 20 bp, Artificial
  CRISPR gRNA sequence
tctttcttccccttttcttg

SEQ ID NO: 381539 - DNA, 20 bp, Artificial
  CRISPR gRNA sequence
tgctttattacttagagacg

SEQ ID NO: 381540 - DNA, 20 bp, Artificial
  CRISPR gRNA sequence
agaggagaaagctggagtgc

SEQ ID NO: 381541 - DNA, 20 bp, Artificial
  CRISPR gRNA sequence
ccgcatgctgaagatgagaa

SEQ ID NO: 381542 - DNA, 20 bp, Artificial
  CRISPR gRNA sequence
caaatcttactgcactttag

SEQ ID NO: 381543 - DNA, 20 bp, Artificial
  CRISPR gRNA sequence
ctttcgaaatgtgacatctc

SEQ ID NO: 381544 - DNA, 20 bp, Artificial
  CRISPR gRNA sequence
ctttctctatttcttttttc

SEQ ID NO: 381545 - DNA, 20 bp, Artificial
  CRISPR gRNA sequence
gcatttctcccttagtgcca

SEQ ID NO: 381546 - DNA, 20 bp, Artificial
  CRISPR gRNA sequence
cactctactgaaatagcagg

SEQ ID NO: 381547 - DNA, 20 bp, Artificial
  CRISPR gRNA sequence
taattttaagaaagagttac

SEQ ID NO: 381548 - DNA, 20 bp, Artificial
  CRISPR gRNA sequence
aattactgaaggccctcagg

SEQ ID NO: 381549 - DNA, 20 bp, Artificial
  CRISPR gRNA sequence
actgaaggccctcagggagt

SEQ ID NO: 381550 - DNA, 20 bp, Artificial
  CRISPR gRNA sequence
gtttatgtacgctatatctg

SEQ ID NO: 381551 - DNA, 20 bp, Artificial
  CRISPR gRNA sequence
cctctcaatatcactaggaa

SEQ ID NO: 381552 - DNA, 20 bp, Artificial
  CRISPR gRNA sequence
atcatgtgtatattcagtga

SEQ ID NO: 381553 - DNA, 20 bp, Artificial
  CRISPR gRNA sequence
aactgtcagaatcttagcca

SEQ ID NO: 381554 - DNA, 20 bp, Artificial
  CRISPR gRNA sequence
atgataccaagaaaagcacc

SEQ ID NO: 381555 - DNA, 20 bp, Artificial
  CRISPR gRNA sequence
aaaagcaccaggggttttgg

SEQ ID NO: 381556 - DNA, 20 bp, Artificial
  CRISPR gRNA sequence
ggtgggcggatcacaaggtc

SEQ ID NO: 381557 - DNA, 20 bp, Artificial
  CRISPR gRNA sequence
ggtaacatcaccaattattt

SEQ ID NO: 381558 - DNA, 20 bp, Artificial
  CRISPR gRNA sequence
ttgacaacctgtatctaatc

SEQ ID NO: 381559 - DNA, 20 bp, Artificial
  CRISPR gRNA sequence
tcatttgcttcttcttttca

SEQ ID NO: 381560 - DNA, 20 bp, Artificial
  CRISPR gRNA sequence
gctgtgccatcaaatagcca

SEQ ID NO: 381561 - DNA, 20 bp, Artificial
  CRISPR gRNA sequence
cgatgtcacagtctcagact

SEQ ID NO: 381562 - DNA, 20 bp, Artificial
  CRISPR gRNA sequence
gagaaaacgaaaccttcgtg

SEQ ID NO: 381563 - DNA, 20 bp, Artificial
  CRISPR gRNA sequence
agccagccccgtgggctggt

SEQ ID NO: 381564 - DNA, 20 bp, Artificial
  CRISPR gRNA sequence
ttggccattattctagtatt

SEQ ID NO: 381565 - DNA, 20 bp, Artificial
  CRISPR gRNA sequence
tttcttatctgccaccatcc

SEQ ID NO: 381566 - DNA, 20 bp, Artificial
  CRISPR gRNA sequence
acatatggtattaccagcct

SEQ ID NO: 381567 - DNA, 20 bp, Artificial
  CRISPR gRNA sequence
tgcgttgagtgcatttcagc

SEQ ID NO: 381568 - DNA, 20 bp, Artificial
  CRISPR gRNA sequence
aggtgtttgagaatgcggtt

SEQ ID NO: 381569 - DNA, 20 bp, Artificial
  CRISPR gRNA sequence
atcttaatattactaggaaa

SEQ ID NO: 381570 - DNA, 20 bp, Artificial
  CRISPR gRNA sequence
gtgctggtgaaattggcctt

SEQ ID NO: 381571 - DNA, 20 bp, Artificial
  CRISPR gRNA sequence
tgtcacaatgaagcctttca

SEQ ID NO: 381572 - DNA, 20 bp, Artificial
  CRISPR gRNA sequence
tctcccagctctgcctctgg

SEQ ID NO: 381573 - DNA, 20 bp, Artificial
  CRISPR gRNA sequence
acaatgaatccttaaattgt

SEQ ID NO: 381574 - DNA, 20 bp, Artificial
  CRISPR gRNA sequence
acaaaacctagatccacttt

SEQ ID NO: 381575 - DNA, 20 bp, Artificial
  CRISPR gRNA sequence
ctttgtatgattgtgagaaa

SEQ ID NO: 381576 - DNA, 20 bp, Artificial
  CRISPR gRNA sequence
ttccttcccttctcccttcc

SEQ ID NO: 381577 - DNA, 20 bp, Artificial
  CRISPR gRNA sequence
ttatgttagacttgtagagc

SEQ ID NO: 381578 - DNA, 20 bp, Artificial
  CRISPR gRNA sequence
acttgtagagccaacgcttg

SEQ ID NO: 381579 - DNA, 20 bp, Artificial
  CRISPR gRNA sequence
agaaaaggtcttgtataaac

SEQ ID NO: 381580 - DNA, 20 bp, Artificial
  CRISPR gRNA sequence
caggaaaaagaaacagtgaa

SEQ ID NO: 381581 - DNA, 20 bp, Artificial
  CRISPR gRNA sequence
agaatcattttcaaacacgt

SEQ ID NO: 381582 - DNA, 20 bp, Artificial
  CRISPR gRNA sequence
attatagagaaaatgaaggt

SEQ ID NO: 381583 - DNA, 20 bp, Artificial
  CRISPR gRNA sequence
attcatctgtccaaagatga

SEQ ID NO: 381584 - DNA, 20 bp, Artificial
  CRISPR gRNA sequence
ggtcagtagtgttagtgtcc

SEQ ID NO: 381585 - DNA, 20 bp, Artificial
  CRISPR gRNA sequence
atgtgttttgaacagttgca

SEQ ID NO: 381586 - DNA, 20 bp, Artificial
  CRISPR gRNA sequence
tggctttttgacattcagtt

SEQ ID NO: 381587 - DNA, 20 bp, Artificial
  CRISPR gRNA sequence
gaagatgacagccattgact

SEQ ID NO: 381588 - DNA, 20 bp, Artificial
  CRISPR gRNA sequence
gacagccattgactgtatgt

SEQ ID NO: 381589 - DNA, 20 bp, Artificial
  CRISPR gRNA sequence
ttttttcaatttttataagt

SEQ ID NO: 381590 - DNA, 20 bp, Artificial
  CRISPR gRNA sequence
tgcaaagcaaaacagatcat

SEQ ID NO: 381591 - DNA, 20 bp, Artificial
  CRISPR gRNA sequence
tttgtgttttctctggtgca

SEQ ID NO: 381592 - DNA, 20 bp, Artificial
  CRISPR gRNA sequence
tctttggtcaaaaatcaatg

SEQ ID NO: 381593 - DNA, 20 bp, Artificial
  CRISPR gRNA sequence
gagacagatataagatgtgg

SEQ ID NO: 381594 - DNA, 20 bp, Artificial
  CRISPR gRNA sequence
tatttcaactgccaagggaa

SEQ ID NO: 381595 - DNA, 20 bp, Artificial
  CRISPR gRNA sequence
gccaagggaaaggtgattgt

SEQ ID NO: 381596 - DNA, 20 bp, Artificial
  CRISPR gRNA sequence
acatagtattggatctaaaa

SEQ ID NO: 381597 - DNA, 20 bp, Artificial
  CRISPR gRNA sequence
cagcaggtcaagtatccagg

SEQ ID NO: 381598 - DNA, 20 bp, Artificial
  CRISPR gRNA sequence
ggtcaagtatccaggccttg

SEQ ID NO: 381599 - DNA, 20 bp, Artificial
  CRISPR gRNA sequence
cggggggagcacaggggaat

SEQ ID NO: 381600 - DNA, 20 bp, Artificial
  CRISPR gRNA sequence
atttttggcccttaacatcc

SEQ ID NO: 381601 - DNA, 20 bp, Artificial
  CRISPR gRNA sequence
caaatattttaatattagct

SEQ ID NO: 381602 - DNA, 20 bp, Artificial
  CRISPR gRNA sequence
ctaaatgatttgcagactac

SEQ ID NO: 381603 - DNA, 20 bp, Artificial
  CRISPR gRNA sequence
aaataaaatcagctcttgca

SEQ ID NO: 381604 - DNA, 20 bp, Artificial
  CRISPR gRNA sequence
gaggctaatattgaaaaaac

SEQ ID NO: 381605 - DNA, 20 bp, Artificial
  CRISPR gRNA sequence
tcaaggttcaaatgaggcat

SEQ ID NO: 381606 - DNA, 20 bp, Artificial
  CRISPR gRNA sequence
tcatgaaagaataagttgct

SEQ ID NO: 381607 - DNA, 20 bp, Artificial
  CRISPR gRNA sequence
caagtctttaacatttttgg

SEQ ID NO: 381608 - DNA, 20 bp, Artificial
  CRISPR gRNA sequence
tccttttattgttattgggg

SEQ ID NO: 381609 - DNA, 20 bp, Artificial
  CRISPR gRNA sequence
tattgttattggggatggga

SEQ ID NO: 381610 - DNA, 20 bp, Artificial
  CRISPR gRNA sequence
ttgttttaattccttttttg

SEQ ID NO: 381611 - DNA, 20 bp, Artificial
  CRISPR gRNA sequence
aattccttttttggatagtt

SEQ ID NO: 381612 - DNA, 20 bp, Artificial
  CRISPR gRNA sequence
aacctgactgatattttata

SEQ ID NO: 381613 - DNA, 20 bp, Artificial
  CRISPR gRNA sequence
cctcttaactgaattcattt

SEQ ID NO: 381614 - DNA, 20 bp, Artificial
  CRISPR gRNA sequence
gaattcatttattagtttga

SEQ ID NO: 381615 - DNA, 20 bp, Artificial
  CRISPR gRNA sequence
aggtttttttgtggcacttt

SEQ ID NO: 381616 - DNA, 20 bp, Artificial
  CRISPR gRNA sequence
acttttagggttttatacat

SEQ ID NO: 381617 - DNA, 20 bp, Artificial
  CRISPR gRNA sequence
agataatattacttcttcct

SEQ ID NO: 381618 - DNA, 20 bp, Artificial
  CRISPR gRNA sequence
tcctttctgatttgaatgcc

SEQ ID NO: 381619 - DNA, 20 bp, Artificial
  CRISPR gRNA sequence
aatgccttttgttttctttt

SEQ ID NO: 381620 - DNA, 20 bp, Artificial
  CRISPR gRNA sequence
ttctttttcttgtttaatgg

SEQ ID NO: 381621 - DNA, 20 bp, Artificial
  CRISPR gRNA sequence
gacttggtatgatgttagct

SEQ ID NO: 381622 - DNA, 20 bp, Artificial
  CRISPR gRNA sequence
ctttctgtacctaatttgtt

SEQ ID NO: 381623 - DNA, 20 bp, Artificial
  CRISPR gRNA sequence
acaaggatgttgaatttgtc

SEQ ID NO: 381624 - DNA, 20 bp, Artificial
  CRISPR gRNA sequence
tttgttaatgtggtgtatta

SEQ ID NO: 381625 - DNA, 20 bp, Artificial
  CRISPR gRNA sequence
ttaatgtggtgtattacatt

SEQ ID NO: 381626 - DNA, 20 bp, Artificial
  CRISPR gRNA sequence
gcatgccagggataaatcag

SEQ ID NO: 381627 - DNA, 20 bp, Artificial
  CRISPR gRNA sequence
ccatttaatgtgatggtgaa

SEQ ID NO: 381628 - DNA, 20 bp, Artificial
  CRISPR gRNA sequence
ttagtttgctagtattttgt

SEQ ID NO: 381629 - DNA, 20 bp, Artificial
  CRISPR gRNA sequence
ttcattagggatgtcagcct

SEQ ID NO: 381630 - DNA, 20 bp, Artificial
  CRISPR gRNA sequence
ttttttttgtggtgtctttg

SEQ ID NO: 381631 - DNA, 20 bp, Artificial
  CRISPR gRNA sequence
ggtgatgctggtctcataaa

SEQ ID NO: 381632 - DNA, 20 bp, Artificial
  CRISPR gRNA sequence
gtctcataaactgagtttag

SEQ ID NO: 381633 - DNA, 20 bp, Artificial
  CRISPR gRNA sequence
taaaaaagaattaaatcatt

SEQ ID NO: 381634 - DNA, 20 bp, Artificial
  CRISPR gRNA sequence
gattacacatgataatgtag

SEQ ID NO: 381635 - DNA, 20 bp, Artificial
  CRISPR gRNA sequence
atgtagaactgtttctaaac

SEQ ID NO: 381636 - DNA, 20 bp, Artificial
  CRISPR gRNA sequence
aggattggcattaattccta

SEQ ID NO: 381637 - DNA, 20 bp, Artificial
  CRISPR gRNA sequence
agggtagagagatactgtca

SEQ ID NO: 381638 - DNA, 20 bp, Artificial
  CRISPR gRNA sequence
actgtcagcatgatttgaat

SEQ ID NO: 381639 - DNA, 20 bp, Artificial
  CRISPR gRNA sequence
agcatgatttgaatctcagt

SEQ ID NO: 381640 - DNA, 20 bp, Artificial
  CRISPR gRNA sequence
tttctcctttttctaactga

SEQ ID NO: 381641 - DNA, 20 bp, Artificial
  CRISPR gRNA sequence
actgactaagtttccatcac

SEQ ID NO: 381642 - DNA, 20 bp, Artificial
  CRISPR gRNA sequence
cacatttgctttctttccta

SEQ ID NO: 381643 - DNA, 20 bp, Artificial
  CRISPR gRNA sequence
agtttcagccgtctcaatgt

SEQ ID NO: 381644 - DNA, 20 bp, Artificial
  CRISPR gRNA sequence
tttttttccacatcagacca

SEQ ID NO: 381645 - DNA, 20 bp, Artificial
  CRISPR gRNA sequence
atcattgaaatattaagcat

SEQ ID NO: 381646 - DNA, 20 bp, Artificial
  CRISPR gRNA sequence
ttttgtatttttggtagaga

SEQ ID NO: 381647 - DNA, 20 bp, Artificial
  CRISPR gRNA sequence
tgcctcagcctcctaaagtg

SEQ ID NO: 381648 - DNA, 20 bp, Artificial
  CRISPR gRNA sequence
ctctggttatcagaaattaa

SEQ ID NO: 381649 - DNA, 20 bp, Artificial
  CRISPR gRNA sequence
tatcagaaattaattgagat

SEQ ID NO: 381650 - DNA, 20 bp, Artificial
  CRISPR gRNA sequence
ttgagattaaggattatggc

SEQ ID NO: 381651 - DNA, 20 bp, Artificial
  CRISPR gRNA sequence
tatgcccagtaagtgttctt

SEQ ID NO: 381652 - DNA, 20 bp, Artificial
  CRISPR gRNA sequence
gtgttcttgaccgattatgt

SEQ ID NO: 381653 - DNA, 20 bp, Artificial
  CRISPR gRNA sequence
gggctgtgtccattttaatt

SEQ ID NO: 381654 - DNA, 20 bp, Artificial
  CRISPR gRNA sequence
agttttctacctcttttctt

SEQ ID NO: 381655 - DNA, 20 bp, Artificial
  CRISPR gRNA sequence
ctttccagattttttttctt

SEQ ID NO: 381656 - DNA, 20 bp, Artificial
  CRISPR gRNA sequence
tttcttcaacgtttaacctt

SEQ ID NO: 381657 - DNA, 20 bp, Artificial
  CRISPR gRNA sequence
aacgtttaacctttgaggtt

SEQ ID NO: 381658 - DNA, 20 bp, Artificial
  CRISPR gRNA sequence
aactttcaaaagatcaacta

SEQ ID NO: 381659 - DNA, 20 bp, Artificial
  CRISPR gRNA sequence
gagaaaaaactttcatgaac

SEQ ID NO: 381660 - DNA, 20 bp, Artificial
  CRISPR gRNA sequence
ctggtcatctgaatagaagg

SEQ ID NO: 381661 - DNA, 20 bp, Artificial
  CRISPR gRNA sequence
agaaggatgggattagtaaa

SEQ ID NO: 381662 - DNA, 20 bp, Artificial
  CRISPR gRNA sequence
cctctgggacgatgtgaggt

SEQ ID NO: 381663 - DNA, 20 bp, Artificial
  CRISPR gRNA sequence
tagatgatacatcttattta

SEQ ID NO: 381664 - DNA, 20 bp, Artificial
  CRISPR gRNA sequence
gattataaatcttgcctgta

SEQ ID NO: 381665 - DNA, 20 bp, Artificial
  CRISPR gRNA sequence
ttgagactctgtgctcctga

SEQ ID NO: 381666 - DNA, 20 bp, Artificial
  CRISPR gRNA sequence
tattgaagaaaggaaataaa

SEQ ID NO: 381667 - DNA, 20 bp, Artificial
  CRISPR gRNA sequence
tttatttctgtcaaaaacca

SEQ ID NO: 381668 - DNA, 20 bp, Artificial
  CRISPR gRNA sequence
accagtttgctcccagtcca

SEQ ID NO: 381669 - DNA, 20 bp, Artificial
  CRISPR gRNA sequence
ccagtccatttggattccag

SEQ ID NO: 381670 - DNA, 20 bp, Artificial
  CRISPR gRNA sequence
gagtttcaggttgtagacaa

SEQ ID NO: 381671 - DNA, 20 bp, Artificial
  CRISPR gRNA sequence
agacagtttttttttttttt

SEQ ID NO: 381672 - DNA, 20 bp, Artificial
  CRISPR gRNA sequence
ctatgaatttagaatagata

SEQ ID NO: 381673 - DNA, 20 bp, Artificial
  CRISPR gRNA sequence
agatataaagcttgtggaca

SEQ ID NO: 381674 - DNA, 20 bp, Artificial
  CRISPR gRNA sequence
aaccacaattttcagcccaa

SEQ ID NO: 381675 - DNA, 20 bp, Artificial
  CRISPR gRNA sequence
aactgggtatccagatgaaa

SEQ ID NO: 381676 - DNA, 20 bp, Artificial
  CRISPR gRNA sequence
agtttccagcatcacaagtg

SEQ ID NO: 381677 - DNA, 20 bp, Artificial
  CRISPR gRNA sequence
aaaatgcaaccggtcagtta

SEQ ID NO: 381678 - DNA, 20 bp, Artificial
  CRISPR gRNA sequence
tttgaacacacaaaaaccta

SEQ ID NO: 381679 - DNA, 20 bp, Artificial
  CRISPR gRNA sequence
agaacaccactataaacaat

SEQ ID NO: 381680 - DNA, 20 bp, Artificial
  CRISPR gRNA sequence
tctacaggtggacctttatc

SEQ ID NO: 381681 - DNA, 20 bp, Artificial
  CRISPR gRNA sequence
tgaattttcaactcttttca

SEQ ID NO: 381682 - DNA, 20 bp, Artificial
  CRISPR gRNA sequence
ctgggaacttagactacaag

SEQ ID NO: 381683 - DNA, 20 bp, Artificial
  CRISPR gRNA sequence
gattcacattcagacaaatg

SEQ ID NO: 381684 - DNA, 20 bp, Artificial
  CRISPR gRNA sequence
tcctacttaaaattcacaca

SEQ ID NO: 381685 - DNA, 20 bp, Artificial
  CRISPR gRNA sequence
aaaagcacctgggaattgtt

SEQ ID NO: 381686 - DNA, 20 bp, Artificial
  CRISPR gRNA sequence
ccttattaaaaactgaacat

SEQ ID NO: 381687 - DNA, 20 bp, Artificial
  CRISPR gRNA sequence
actgaacataaatgattgat

SEQ ID NO: 381688 - DNA, 20 bp, Artificial
  CRISPR gRNA sequence
atgtaaaataagttattctt

SEQ ID NO: 381689 - DNA, 20 bp, Artificial
  CRISPR gRNA sequence
ttaagtattacaactcaatc

SEQ ID NO: 381690 - DNA, 20 bp, Artificial
  CRISPR gRNA sequence
aaatattcaaaggcgatgta

SEQ ID NO: 381691 - DNA, 20 bp, Artificial
  CRISPR gRNA sequence
actaggtttctggaggacta

SEQ ID NO: 381692 - DNA, 20 bp, Artificial
  CRISPR gRNA sequence
ttaagctattatttatacta

SEQ ID NO: 381693 - DNA, 20 bp, Artificial
  CRISPR gRNA sequence
ttatttatactaaaatgatt

SEQ ID NO: 381694 - DNA, 20 bp, Artificial
  CRISPR gRNA sequence
tacatttattcaacaggaat

SEQ ID NO: 381695 - DNA, 20 bp, Artificial
  CRISPR gRNA sequence
gagcactctaaaattcattt

SEQ ID NO: 381696 - DNA, 20 bp, Artificial
  CRISPR gRNA sequence
attcatttccaggattaatt

SEQ ID NO: 381697 - DNA, 20 bp, Artificial
  CRISPR gRNA sequence
ttgaaatgttaatactctca

SEQ ID NO: 381698 - DNA, 20 bp, Artificial
  CRISPR gRNA sequence
ttggattggtggaaagtgaa

SEQ ID NO: 381699 - DNA, 20 bp, Artificial
  CRISPR gRNA sequence
aaaaagtagatgctgagttg

SEQ ID NO: 381700 - DNA, 20 bp, Artificial
  CRISPR gRNA sequence
tgtaaatgaacccatgggag

SEQ ID NO: 381701 - DNA, 20 bp, Artificial
  CRISPR gRNA sequence
tatcctgatgtcactgtgtc

SEQ ID NO: 381702 - DNA, 20 bp, Artificial
  CRISPR gRNA sequence
ttcacatcttatgtggagca

SEQ ID NO: 381703 - DNA, 20 bp, Artificial
  CRISPR gRNA sequence
catcttatgtggagcattag

SEQ ID NO: 381704 - DNA, 20 bp, Artificial
  CRISPR gRNA sequence
aatatttgttaggaggagta

SEQ ID NO: 381705 - DNA, 20 bp, Artificial
  CRISPR gRNA sequence
ggtaaacactcaacaaatac

SEQ ID NO: 381706 - DNA, 20 bp, Artificial
  CRISPR gRNA sequence
attttaatccaaacaagtca

SEQ ID NO: 381707 - DNA, 20 bp, Artificial
  CRISPR gRNA sequence
ctgatccagcagataaaggt

SEQ ID NO: 381708 - DNA, 20 bp, Artificial
  CRISPR gRNA sequence
taaactctagagcataaagc

SEQ ID NO: 381709 - DNA, 20 bp, Artificial
  CRISPR gRNA sequence
attatttcttatagccaggc

SEQ ID NO: 381710 - DNA, 20 bp, Artificial
  CRISPR gRNA sequence
ttatagccaggcataggctt

SEQ ID NO: 381711 - DNA, 20 bp, Artificial
  CRISPR gRNA sequence
ttagggaatttttttcataa

SEQ ID NO: 381712 - DNA, 20 bp, Artificial
  CRISPR gRNA sequence
ctatttggaggtattcagcc

SEQ ID NO: 381713 - DNA, 20 bp, Artificial
  CRISPR gRNA sequence
ataagtctttgtaaatgcta

SEQ ID NO: 381714 - DNA, 20 bp, Artificial
  CRISPR gRNA sequence
atgctatatggtttgcattt

SEQ ID NO: 381715 - DNA, 20 bp, Artificial
  CRISPR gRNA sequence
aacctcctcctcctgggttc

SEQ ID NO: 381716 - DNA, 20 bp, Artificial
  CRISPR gRNA sequence
tgcctcagcctcccaagcag

SEQ ID NO: 381717 - DNA, 20 bp, Artificial
  CRISPR gRNA sequence
ttttgtatttttagaagaga

SEQ ID NO: 381718 - DNA, 20 bp, Artificial
  CRISPR gRNA sequence
cacctcggccttccaaagtg

SEQ ID NO: 381719 - DNA, 20 bp, Artificial
  CRISPR gRNA sequence
cactgcacctggtcacattt

SEQ ID NO: 381720 - DNA, 20 bp, Artificial
  CRISPR gRNA sequence
gttctaagaattacgtgtca

SEQ ID NO: 381721 - DNA, 20 bp, Artificial
  CRISPR gRNA sequence
ctatatgataaacacacata

SEQ ID NO: 381722 - DNA, 20 bp, Artificial
  CRISPR gRNA sequence
tctgagaatttactcgtagt

SEQ ID NO: 381723 - DNA, 20 bp, Artificial
  CRISPR gRNA sequence
tgtcacagcagcctgactgc

SEQ ID NO: 381724 - DNA, 20 bp, Artificial
  CRISPR gRNA sequence
gagagttgacgggacttatc

SEQ ID NO: 381725 - DNA, 20 bp, Artificial
  CRISPR gRNA sequence
gtaactaataaatagagggg

SEQ ID NO: 381726 - DNA, 20 bp, Artificial
  CRISPR gRNA sequence
agggattcagatgcgggctg

SEQ ID NO: 381727 - DNA, 20 bp, Artificial
  CRISPR gRNA sequence
ctacagagcgtccttcttca

SEQ ID NO: 381728 - DNA, 20 bp, Artificial
  CRISPR gRNA sequence
tcaagaggtttatacaagtg

SEQ ID NO: 381729 - DNA, 20 bp, Artificial
  CRISPR gRNA sequence
aggctgaaccaatgtctaga

SEQ ID NO: 381730 - DNA, 20 bp, Artificial
  CRISPR gRNA sequence
ttccttcctgtcttccttct

SEQ ID NO: 381731 - DNA, 20 bp, Artificial
  CRISPR gRNA sequence
gaagtcaaatccacaccagg

SEQ ID NO: 381732 - DNA, 20 bp, Artificial
  CRISPR gRNA sequence
gatggctcaggtctcatagg

SEQ ID NO: 381733 - DNA, 20 bp, Artificial
  CRISPR gRNA sequence
cctcaccagatccacccact

SEQ ID NO: 381734 - DNA, 20 bp, Artificial
  CRISPR gRNA sequence
tgggaaagtccactcccttg

SEQ ID NO: 381735 - DNA, 20 bp, Artificial
  CRISPR gRNA sequence
acgcccttccttcctccttc

SEQ ID NO: 381736 - DNA, 20 bp, Artificial
  CRISPR gRNA sequence
tgctcttgtgcccagaccgt

SEQ ID NO: 381737 - DNA, 20 bp, Artificial
  CRISPR gRNA sequence
cctccttccttagggacagt

SEQ ID NO: 381738 - DNA, 20 bp, Artificial
  CRISPR gRNA sequence
aaaatctcccttccaaaaac

SEQ ID NO: 381739 - DNA, 20 bp, Artificial
  CRISPR gRNA sequence
ttctgaacacttatgttctc

SEQ ID NO: 381740 - DNA, 20 bp, Artificial
  CRISPR gRNA sequence
cttatgttctctcatgttta

SEQ ID NO: 381741 - DNA, 20 bp, Artificial
  CRISPR gRNA sequence
gttgcaacctgcagacacca

SEQ ID NO: 381742 - DNA, 20 bp, Artificial
  CRISPR gRNA sequence
tgcagacaccaggttgttta

SEQ ID NO: 381743 - DNA, 20 bp, Artificial
  CRISPR gRNA sequence
gcactgtaatgtagagttat

SEQ ID NO: 381744 - DNA, 20 bp, Artificial
  CRISPR gRNA sequence
gataactagtcttcaagtaa

SEQ ID NO: 381745 - DNA, 20 bp, Artificial
  CRISPR gRNA sequence
gcttgtcagacatttgtcac

SEQ ID NO: 381746 - DNA, 20 bp, Artificial
  CRISPR gRNA sequence
atttgtcacacatgcttcat

SEQ ID NO: 381747 - DNA, 20 bp, Artificial
  CRISPR gRNA sequence
actgtgtgtgttagctaata

SEQ ID NO: 381748 - DNA, 20 bp, Artificial
  CRISPR gRNA sequence
gtacttttgcaccttgagtg

SEQ ID NO: 381749 - DNA, 20 bp, Artificial
  CRISPR gRNA sequence
accttgagtgaggtgcttgt

SEQ ID NO: 381750 - DNA, 20 bp, Artificial
  CRISPR gRNA sequence
cagagacagaactgccaatt

SEQ ID NO: 381751 - DNA, 20 bp, Artificial
  CRISPR gRNA sequence
gcagctggagctcccctgga

SEQ ID NO: 381752 - DNA, 20 bp, Artificial
  CRISPR gRNA sequence
aggtgctttctagagtagag

SEQ ID NO: 381753 - DNA, 20 bp, Artificial
  CRISPR gRNA sequence
accaacatcaggatcatctg

SEQ ID NO: 381754 - DNA, 20 bp, Artificial
  CRISPR gRNA sequence
ctggtatgcttgctgaaaga

SEQ ID NO: 381755 - DNA, 20 bp, Artificial
  CRISPR gRNA sequence
aggctccatgtggtcatttg

SEQ ID NO: 381756 - DNA, 20 bp, Artificial
  CRISPR gRNA sequence
ccatgtggtcatttgtattg

SEQ ID NO: 381757 - DNA, 20 bp, Artificial
  CRISPR gRNA sequence
tctctgtgggcatgtgagaa

SEQ ID NO: 381758 - DNA, 20 bp, Artificial
  CRISPR gRNA sequence
atgtgagaacttggattttt

SEQ ID NO: 381759 - DNA, 20 bp, Artificial
  CRISPR gRNA sequence
aacaattctctgactgctgg

SEQ ID NO: 381760 - DNA, 20 bp, Artificial
  CRISPR gRNA sequence
tggggtggcttattctgtct

SEQ ID NO: 381761 - DNA, 20 bp, Artificial
  CRISPR gRNA sequence
ctaaatgtttatacaaccca

SEQ ID NO: 381762 - DNA, 20 bp, Artificial
  CRISPR gRNA sequence
ccatgtggtttatgctaaac

SEQ ID NO: 381763 - DNA, 20 bp, Artificial
  CRISPR gRNA sequence
agtccttctgactttgccca

SEQ ID NO: 381764 - DNA, 20 bp, Artificial
  CRISPR gRNA sequence
gcccaggcagtttatccctt

SEQ ID NO: 381765 - DNA, 20 bp, Artificial
  CRISPR gRNA sequence
ggcagtttatccctttgctg

SEQ ID NO: 381766 - DNA, 20 bp, Artificial
  CRISPR gRNA sequence
aagaacatatacattctcat

SEQ ID NO: 381767 - DNA, 20 bp, Artificial
  CRISPR gRNA sequence
catactagttttatttgaaa

SEQ ID NO: 381768 - DNA, 20 bp, Artificial
  CRISPR gRNA sequence
gtcttatatacatacatctt

SEQ ID NO: 381769 - DNA, 20 bp, Artificial
  CRISPR gRNA sequence
catacatcttctaagtttag

SEQ ID NO: 381770 - DNA, 20 bp, Artificial
  CRISPR gRNA sequence
aagcttattccttttatgta

SEQ ID NO: 381771 - DNA, 20 bp, Artificial
  CRISPR gRNA sequence
aaagaattcgaagctggata

SEQ ID NO: 381772 - DNA, 20 bp, Artificial
  CRISPR gRNA sequence
tgtcctctgagcaccaagtc

SEQ ID NO: 381773 - DNA, 20 bp, Artificial
  CRISPR gRNA sequence
tgagaagcaagatggttaat

SEQ ID NO: 381774 - DNA, 20 bp, Artificial
  CRISPR gRNA sequence
ccttgtgccattatactctt

SEQ ID NO: 381775 - DNA, 20 bp, Artificial
  CRISPR gRNA sequence
gtgccattatactcttgtat

SEQ ID NO: 381776 - DNA, 20 bp, Artificial
  CRISPR gRNA sequence
cattatactcttgtatgttt

SEQ ID NO: 381777 - DNA, 20 bp, Artificial
  CRISPR gRNA sequence
tcactacaaagcatcaccta

SEQ ID NO: 381778 - DNA, 20 bp, Artificial
  CRISPR gRNA sequence
tacaaagcatcacctacctc

SEQ ID NO: 381779 - DNA, 20 bp, Artificial
  CRISPR gRNA sequence
gtctattttttgccattttt

SEQ ID NO: 381780 - DNA, 20 bp, Artificial
  CRISPR gRNA sequence
tttttattgttataaaaaac

SEQ ID NO: 381781 - DNA, 20 bp, Artificial
  CRISPR gRNA sequence
aacttctgttatgacaggaa

SEQ ID NO: 381782 - DNA, 20 bp, Artificial
  CRISPR gRNA sequence
tatctatgacagtctcactg

SEQ ID NO: 381783 - DNA, 20 bp, Artificial
  CRISPR gRNA sequence
cttggcatttaatttctaat

SEQ ID NO: 381784 - DNA, 20 bp, Artificial
  CRISPR gRNA sequence
ctaaacagaaacagtcttgg

SEQ ID NO: 381785 - DNA, 20 bp, Artificial
  CRISPR gRNA sequence
gtggctcctgcctgtaatcc

SEQ ID NO: 381786 - DNA, 20 bp, Artificial
  CRISPR gRNA sequence
ttgggaggccatttcagtag

SEQ ID NO: 381787 - DNA, 20 bp, Artificial
  CRISPR gRNA sequence
cacacaagctatcttagggt

SEQ ID NO: 381788 - DNA, 20 bp, Artificial
  CRISPR gRNA sequence
tcaactgacataaaccttta

SEQ ID NO: 381789 - DNA, 20 bp, Artificial
  CRISPR gRNA sequence
acaagtattttcaacataaa

SEQ ID NO: 381790 - DNA, 20 bp, Artificial
  CRISPR gRNA sequence
caaaatttctacatcagcta

SEQ ID NO: 381791 - DNA, 20 bp, Artificial
  CRISPR gRNA sequence
atttctacatcagctaggaa

SEQ ID NO: 381792 - DNA, 20 bp, Artificial
  CRISPR gRNA sequence
ctaggaagcttgcttccctc

SEQ ID NO: 381793 - DNA, 20 bp, Artificial
  CRISPR gRNA sequence
ctataatgacagaaaaatta

SEQ ID NO: 381794 - DNA, 20 bp, Artificial
  CRISPR gRNA sequence
ttatttagattctctgggcc

SEQ ID NO: 381795 - DNA, 20 bp, Artificial
  CRISPR gRNA sequence
tagttgctatttactcagaa

SEQ ID NO: 381796 - DNA, 20 bp, Artificial
  CRISPR gRNA sequence
cttctagctataaaacacag

SEQ ID NO: 381797 - DNA, 20 bp, Artificial
  CRISPR gRNA sequence
ttctgaaatacagagtataa

SEQ ID NO: 381798 - DNA, 20 bp, Artificial
  CRISPR gRNA sequence
caaggcaacagttattgtat

SEQ ID NO: 381799 - DNA, 20 bp, Artificial
  CRISPR gRNA sequence
gaaaaaaatagaaacaagtt

SEQ ID NO: 381800 - DNA, 20 bp, Artificial
  CRISPR gRNA sequence
tataaatgcatattaaatat

SEQ ID NO: 381801 - DNA, 20 bp, Artificial
  CRISPR gRNA sequence
tatgcatgattaataaccta

SEQ ID NO: 381802 - DNA, 20 bp, Artificial
  CRISPR gRNA sequence
gattaataacctaaatcgtt

SEQ ID NO: 381803 - DNA, 20 bp, Artificial
  CRISPR gRNA sequence
aaaatgttgaaaccacctct

SEQ ID NO: 381804 - DNA, 20 bp, Artificial
  CRISPR gRNA sequence
tgttgaaaccacctctgcat

SEQ ID NO: 381805 - DNA, 20 bp, Artificial
  CRISPR gRNA sequence
attatgcagttgccaaaaaa

SEQ ID NO: 381806 - DNA, 20 bp, Artificial
  CRISPR gRNA sequence
tagaagacaggactaggccc

SEQ ID NO: 381807 - DNA, 20 bp, Artificial
  CRISPR gRNA sequence
ccaaggcttttctcctcagt

SEQ ID NO: 381808 - DNA, 20 bp, Artificial
  CRISPR gRNA sequence
aagtgggacaaaggttgaat

SEQ ID NO: 381809 - DNA, 20 bp, Artificial
  CRISPR gRNA sequence
cacaaaacaaggtctaatat

SEQ ID NO: 381810 - DNA, 20 bp, Artificial
  CRISPR gRNA sequence
tgacatatgtatacaatgta

SEQ ID NO: 381811 - DNA, 20 bp, Artificial
  CRISPR gRNA sequence
atatccaccacttcatttac

SEQ ID NO: 381812 - DNA, 20 bp, Artificial
  CRISPR gRNA sequence
tcagggggctgaggcaggag

SEQ ID NO: 381813 - DNA, 20 bp, Artificial
  CRISPR gRNA sequence
tttttaggttccatatttaa

SEQ ID NO: 381814 - DNA, 20 bp, Artificial
  CRISPR gRNA sequence
cctgcctgcctgccttcctc

SEQ ID NO: 381815 - DNA, 20 bp, Artificial
  CRISPR gRNA sequence
cacgtacaattccgtataaa

SEQ ID NO: 381816 - DNA, 20 bp, Artificial
  CRISPR gRNA sequence
gcttggttcttcttcagtgg

SEQ ID NO: 381817 - DNA, 20 bp, Artificial
  CRISPR gRNA sequence
tggcagaagaatttaaattg

SEQ ID NO: 381818 - DNA, 20 bp, Artificial
  CRISPR gRNA sequence
cacttccccagtcaatactc

SEQ ID NO: 381819 - DNA, 20 bp, Artificial
  CRISPR gRNA sequence
gtcaatactcttgtgatttc

SEQ ID NO: 381820 - DNA, 20 bp, Artificial
  CRISPR gRNA sequence
atggttgtgttaactgcaca

SEQ ID NO: 381821 - DNA, 20 bp, Artificial
  CRISPR gRNA sequence
acaaattgtttgtaaagcat

SEQ ID NO: 381822 - DNA, 20 bp, Artificial
  CRISPR gRNA sequence
gcaccttaagaacaggataa

SEQ ID NO: 381823 - DNA, 20 bp, Artificial
  CRISPR gRNA sequence
aattcacagccctgggaaaa

SEQ ID NO: 381824 - DNA, 20 bp, Artificial
  CRISPR gRNA sequence
cctggcctcctgcagcaccc

SEQ ID NO: 381825 - DNA, 20 bp, Artificial
  CRISPR gRNA sequence
ctgcagcacccccaggcttg

SEQ ID NO: 381826 - DNA, 20 bp, Artificial
  CRISPR gRNA sequence
tctgctcttgaaccctgtta

SEQ ID NO: 381827 - DNA, 20 bp, Artificial
  CRISPR gRNA sequence
aaaattgctaataaaaactt

SEQ ID NO: 381828 - DNA, 20 bp, Artificial
  CRISPR gRNA sequence
tgtgatgtctcccctagaca

SEQ ID NO: 381829 - DNA, 20 bp, Artificial
  CRISPR gRNA sequence
caggttcccccgataaaatg

SEQ ID NO: 381830 - DNA, 20 bp, Artificial
  CRISPR gRNA sequence
cccccgataaaatgggatga

SEQ ID NO: 381831 - DNA, 20 bp, Artificial
  CRISPR gRNA sequence
ataaaatgggatgattttgc

SEQ ID NO: 381832 - DNA, 20 bp, Artificial
  CRISPR gRNA sequence
gcttttgtttcttgaccagg

SEQ ID NO: 381833 - DNA, 20 bp, Artificial
  CRISPR gRNA sequence
ccatgatggcggcgaaaacc

SEQ ID NO: 381834 - DNA, 20 bp, Artificial
  CRISPR gRNA sequence
ggtgtgaggtggtctctcat

SEQ ID NO: 381835 - DNA, 20 bp, Artificial
  CRISPR gRNA sequence
ctctcattgtggttttaatt

SEQ ID NO: 381836 - DNA, 20 bp, Artificial
  CRISPR gRNA sequence
ttaatttgcagtttccagcc

SEQ ID NO: 381837 - DNA, 20 bp, Artificial
  CRISPR gRNA sequence
atgttagagagtcaggacct

SEQ ID NO: 381838 - DNA, 20 bp, Artificial
  CRISPR gRNA sequence
agttatttaggttctaagtg

SEQ ID NO: 381839 - DNA, 20 bp, Artificial
  CRISPR gRNA sequence
ttcttttatatatttcactg

SEQ ID NO: 381840 - DNA, 20 bp, Artificial
  CRISPR gRNA sequence
tatttcactgacttgcttta

SEQ ID NO: 381841 - DNA, 20 bp, Artificial
  CRISPR gRNA sequence
tatcttctgtgatgtaaggt

SEQ ID NO: 381842 - DNA, 20 bp, Artificial
  CRISPR gRNA sequence
gtgaaaaaagttagcaaaaa

SEQ ID NO: 381843 - DNA, 20 bp, Artificial
  CRISPR gRNA sequence
aattcttcttttttaaagaa

SEQ ID NO: 381844 - DNA, 20 bp, Artificial
  CRISPR gRNA sequence
agggcttcctttttaaagaa

SEQ ID NO: 381845 - DNA, 20 bp, Artificial
  CRISPR gRNA sequence
aaaaactaaatgttatgaac

SEQ ID NO: 381846 - DNA, 20 bp, Artificial
  CRISPR gRNA sequence
ctcccaaagcatccgtaccc

SEQ ID NO: 381847 - DNA, 20 bp, Artificial
  CRISPR gRNA sequence
tcagctacaggctgggccac

SEQ ID NO: 381848 - DNA, 20 bp, Artificial
  CRISPR gRNA sequence
ccactctagattgaaatgtc

SEQ ID NO: 381849 - DNA, 20 bp, Artificial
  CRISPR gRNA sequence
gattgaatctctacctgact

SEQ ID NO: 381850 - DNA, 20 bp, Artificial
  CRISPR gRNA sequence
gtattaggatatgcagatct

SEQ ID NO: 381851 - DNA, 20 bp, Artificial
  CRISPR gRNA sequence
taaagtctggacaggacttg

SEQ ID NO: 381852 - DNA, 20 bp, Artificial
  CRISPR gRNA sequence
ggacttgctgggtttagatg

SEQ ID NO: 381853 - DNA, 20 bp, Artificial
  CRISPR gRNA sequence
tccataaaaatccaagagga

SEQ ID NO: 381854 - DNA, 20 bp, Artificial
  CRISPR gRNA sequence
atccaagaggatggggtttg

SEQ ID NO: 381855 - DNA, 20 bp, Artificial
  CRISPR gRNA sequence
ccttgatattaaactgacaa

SEQ ID NO: 381856 - DNA, 20 bp, Artificial
  CRISPR gRNA sequence
tgagctctataactggctcc

SEQ ID NO: 381857 - DNA, 20 bp, Artificial
  CRISPR gRNA sequence
gaaaaaggggtcttgggaac

SEQ ID NO: 381858 - DNA, 20 bp, Artificial
  CRISPR gRNA sequence
aatcacttgaacctgggagg

SEQ ID NO: 381859 - DNA, 20 bp, Artificial
  CRISPR gRNA sequence
ctttggtcacagaagtctgt

SEQ ID NO: 381860 - DNA, 20 bp, Artificial
  CRISPR gRNA sequence
gcagagaaaaaacacaattg

SEQ ID NO: 381861 - DNA, 20 bp, Artificial
  CRISPR gRNA sequence
tttttctacacaggtgtcaa

SEQ ID NO: 381862 - DNA, 20 bp, Artificial
  CRISPR gRNA sequence
acagtacaccttgaaatact

SEQ ID NO: 381863 - DNA, 20 bp, Artificial
  CRISPR gRNA sequence
atgaaacaatgcatctgaaa

SEQ ID NO: 381864 - DNA, 20 bp, Artificial
  CRISPR gRNA sequence
taagtattctatttctaaag

SEQ ID NO: 381865 - DNA, 20 bp, Artificial
  CRISPR gRNA sequence
tacatcctgtactttaacca

SEQ ID NO: 381866 - DNA, 20 bp, Artificial
  CRISPR gRNA sequence
taaaaaagcccaaagaaaac

SEQ ID NO: 381867 - DNA, 20 bp, Artificial
  CRISPR gRNA sequence
ttaaataattaactgtcaaa

SEQ ID NO: 381868 - DNA, 20 bp, Artificial
  CRISPR gRNA sequence
gaatatattcagggcataca

SEQ ID NO: 381869 - DNA, 20 bp, Artificial
  CRISPR gRNA sequence
ctggcaaccactgttctatt

SEQ ID NO: 381870 - DNA, 20 bp, Artificial
  CRISPR gRNA sequence
ctgttctattccctgcttct

SEQ ID NO: 381871 - DNA, 20 bp, Artificial
  CRISPR gRNA sequence
gcttctataagtttgacttt

SEQ ID NO: 381872 - DNA, 20 bp, Artificial
  CRISPR gRNA sequence
tttttagattccacatacag

SEQ ID NO: 381873 - DNA, 20 bp, Artificial
  CRISPR gRNA sequence
acagtatttgtctttctatg

SEQ ID NO: 381874 - DNA, 20 bp, Artificial
  CRISPR gRNA sequence
catccatgctgtcgcaaatg

SEQ ID NO: 381875 - DNA, 20 bp, Artificial
  CRISPR gRNA sequence
cttggaggctgaggcaggag

SEQ ID NO: 381876 - DNA, 20 bp, Artificial
  CRISPR gRNA sequence
aattgcttgaacctgggaag

SEQ ID NO: 381877 - DNA, 20 bp, Artificial
  CRISPR gRNA sequence
gaagtggagcttgcagcgag

SEQ ID NO: 381878 - DNA, 20 bp, Artificial
  CRISPR gRNA sequence
atttgtggaatctaggtcta

SEQ ID NO: 381879 - DNA, 20 bp, Artificial
  CRISPR gRNA sequence
gtctaaaacgtttaaaaata

SEQ ID NO: 381880 - DNA, 20 bp, Artificial
  CRISPR gRNA sequence
aaaacgtttaaaaataaaat

SEQ ID NO: 381881 - DNA, 20 bp, Artificial
  CRISPR gRNA sequence
taaaatgtttgcttatttgt

SEQ ID NO: 381882 - DNA, 20 bp, Artificial
  CRISPR gRNA sequence
gtcttagtttctctttgcag

SEQ ID NO: 381883 - DNA, 20 bp, Artificial
  CRISPR gRNA sequence
gggaagaattggttgaaagt

SEQ ID NO: 381884 - DNA, 20 bp, Artificial
  CRISPR gRNA sequence
gtcatggttttcaggctgca

SEQ ID NO: 381885 - DNA, 20 bp, Artificial
  CRISPR gRNA sequence
gggtgtcacagtacaaacat

SEQ ID NO: 381886 - DNA, 20 bp, Artificial
  CRISPR gRNA sequence
tcacagtacaaacattcaag

SEQ ID NO: 381887 - DNA, 20 bp, Artificial
  CRISPR gRNA sequence
ctggcatcatcctaatggtg

SEQ ID NO: 381888 - DNA, 20 bp, Artificial
  CRISPR gRNA sequence
aatggtggggtgattgacag

SEQ ID NO: 381889 - DNA, 20 bp, Artificial
  CRISPR gRNA sequence
agagacagcaatgaagacca

SEQ ID NO: 381890 - DNA, 20 bp, Artificial
  CRISPR gRNA sequence
attcccagcagcagatgttg

SEQ ID NO: 381891 - DNA, 20 bp, Artificial
  CRISPR gRNA sequence
ggggacatttctctaatcgc

SEQ ID NO: 381892 - DNA, 20 bp, Artificial
  CRISPR gRNA sequence
gagtcggtcagttgaattgt

SEQ ID NO: 381893 - DNA, 20 bp, Artificial
  CRISPR gRNA sequence
gaaagatttaggatgagaat

SEQ ID NO: 381894 - DNA, 20 bp, Artificial
  CRISPR gRNA sequence
gttggagtaacatttttttt

SEQ ID NO: 381895 - DNA, 20 bp, Artificial
  CRISPR gRNA sequence
tatcaggcataaaagataat

SEQ ID NO: 381896 - DNA, 20 bp, Artificial
  CRISPR gRNA sequence
tgcctcagcctaatgagtag

SEQ ID NO: 381897 - DNA, 20 bp, Artificial
  CRISPR gRNA sequence
caccacactgggatcacttt

SEQ ID NO: 381898 - DNA, 20 bp, Artificial
  CRISPR gRNA sequence
ttttgtgtttttagtagaga

SEQ ID NO: 381899 - DNA, 20 bp, Artificial
  CRISPR gRNA sequence
tgatcccctctcctaaacct

SEQ ID NO: 381900 - DNA, 20 bp, Artificial
  CRISPR gRNA sequence
cctggcctatttcctatttt

SEQ ID NO: 381901 - DNA, 20 bp, Artificial
  CRISPR gRNA sequence
atagtttttttttttctaca

SEQ ID NO: 381902 - DNA, 20 bp, Artificial
  CRISPR gRNA sequence
ttctacaaaaggttttgtgt

SEQ ID NO: 381903 - DNA, 20 bp, Artificial
  CRISPR gRNA sequence
aaggttttgtgtatatgatt

SEQ ID NO: 381904 - DNA, 20 bp, Artificial
  CRISPR gRNA sequence
tttttttgtaatgtgtaaaa

SEQ ID NO: 381905 - DNA, 20 bp, Artificial
  CRISPR gRNA sequence
taactcattctatttttttt

SEQ ID NO: 381906 - DNA, 20 bp, Artificial
  CRISPR gRNA sequence
tctattttttttgttggatt

SEQ ID NO: 381907 - DNA, 20 bp, Artificial
  CRISPR gRNA sequence
accctctttgtggctggagg

SEQ ID NO: 381908 - DNA, 20 bp, Artificial
  CRISPR gRNA sequence
tggagggacagttttattgt

SEQ ID NO: 381909 - DNA, 20 bp, Artificial
  CRISPR gRNA sequence
atgacacagcgcgagatgga

SEQ ID NO: 381910 - DNA, 20 bp, Artificial
  CRISPR gRNA sequence
gattctgagaaggggaagaa

SEQ ID NO: 381911 - DNA, 20 bp, Artificial
  CRISPR gRNA sequence
ttctcagaaccaagaaatct

SEQ ID NO: 381912 - DNA, 20 bp, Artificial
  CRISPR gRNA sequence
ctactcaggaggctgaggct

SEQ ID NO: 381913 - DNA, 20 bp, Artificial
  CRISPR gRNA sequence
tcaggaggctgaggctggag

SEQ ID NO: 381914 - DNA, 20 bp, Artificial
  CRISPR gRNA sequence
attttctaggatattcttgg

SEQ ID NO: 381915 - DNA, 20 bp, Artificial
  CRISPR gRNA sequence
ttcttccccttctagttctc

SEQ ID NO: 381916 - DNA, 20 bp, Artificial
  CRISPR gRNA sequence
gcatatcatagatacttaat

SEQ ID NO: 381917 - DNA, 20 bp, Artificial
  CRISPR gRNA sequence
cacacacacaccccttgtta

SEQ ID NO: 381918 - DNA, 20 bp, Artificial
  CRISPR gRNA sequence
agcagctgtcatcactgctc

SEQ ID NO: 381919 - DNA, 20 bp, Artificial
  CRISPR gRNA sequence
tagcctctttctctaaccca

SEQ ID NO: 381920 - DNA, 20 bp, Artificial
  CRISPR gRNA sequence
cacacccattgctctcccca

SEQ ID NO: 381921 - DNA, 20 bp, Artificial
  CRISPR gRNA sequence
catctggtttgctaccaaag

SEQ ID NO: 381922 - DNA, 20 bp, Artificial
  CRISPR gRNA sequence
cgtctctgctactcctcaca

SEQ ID NO: 381923 - DNA, 20 bp, Artificial
  CRISPR gRNA sequence
gctttgtattttaatcactt

SEQ ID NO: 381924 - DNA, 20 bp, Artificial
  CRISPR gRNA sequence
atcccttctattcataatgg

SEQ ID NO: 381925 - DNA, 20 bp, Artificial
  CRISPR gRNA sequence
tctattcataatggcagagt

SEQ ID NO: 381926 - DNA, 20 bp, Artificial
  CRISPR gRNA sequence
gggtcacagatgttggacat

SEQ ID NO: 381927 - DNA, 20 bp, Artificial
  CRISPR gRNA sequence
cagatgttggacatgataga

SEQ ID NO: 381928 - DNA, 20 bp, Artificial
  CRISPR gRNA sequence
agattttgcttcatgaaaaa

SEQ ID NO: 381929 - DNA, 20 bp, Artificial
  CRISPR gRNA sequence
acttggttaaatgtgataaa

SEQ ID NO: 381930 - DNA, 20 bp, Artificial
  CRISPR gRNA sequence
ccttctgcctcgtcactagt

SEQ ID NO: 381931 - DNA, 20 bp, Artificial
  CRISPR gRNA sequence
gtggttgttacttccaatag

SEQ ID NO: 381932 - DNA, 20 bp, Artificial
  CRISPR gRNA sequence
tccaacaatgaccttctgaa

SEQ ID NO: 381933 - DNA, 20 bp, Artificial
  CRISPR gRNA sequence
cttctgaactccgttttact

SEQ ID NO: 381934 - DNA, 20 bp, Artificial
  CRISPR gRNA sequence
ctgactgtttaaaataatcc

SEQ ID NO: 381935 - DNA, 20 bp, Artificial
  CRISPR gRNA sequence
gcctggtagcctgtgtgttg

SEQ ID NO: 381936 - DNA, 20 bp, Artificial
  CRISPR gRNA sequence
tgtgtgttggagggattggc

SEQ ID NO: 381937 - DNA, 20 bp, Artificial
  CRISPR gRNA sequence
ttggcggcagcttctctgct

SEQ ID NO: 381938 - DNA, 20 bp, Artificial
  CRISPR gRNA sequence
gcttctctgctcctggtttg

SEQ ID NO: 381939 - DNA, 20 bp, Artificial
  CRISPR gRNA sequence
gagatggaggttgcagtgag

SEQ ID NO: 381940 - DNA, 20 bp, Artificial
  CRISPR gRNA sequence
ggcattaatggatagggaac

SEQ ID NO: 381941 - DNA, 20 bp, Artificial
  CRISPR gRNA sequence
accttggttttcggggctct

SEQ ID NO: 381942 - DNA, 20 bp, Artificial
  CRISPR gRNA sequence
gaggcggaggttgcagtgag

SEQ ID NO: 381943 - DNA, 20 bp, Artificial
  CRISPR gRNA sequence
tcaacgtaaatccaattgtg

SEQ ID NO: 381944 - DNA, 20 bp, Artificial
  CRISPR gRNA sequence
gggatacatgtgcaggatgt

SEQ ID NO: 381945 - DNA, 20 bp, Artificial
  CRISPR gRNA sequence
acataggcaaacatgtgtca

SEQ ID NO: 381946 - DNA, 20 bp, Artificial
  CRISPR gRNA sequence
ataggtgagaacatgtggta

SEQ ID NO: 381947 - DNA, 20 bp, Artificial
  CRISPR gRNA sequence
atttggttttctgttcctgc

SEQ ID NO: 381948 - DNA, 20 bp, Artificial
  CRISPR gRNA sequence
ctatcattgacgggtattga

SEQ ID NO: 381949 - DNA, 20 bp, Artificial
  CRISPR gRNA sequence
tgaatagtgctgcaatgaac

SEQ ID NO: 381950 - DNA, 20 bp, Artificial
  CRISPR gRNA sequence
cttgcatgtgtcttatagta

SEQ ID NO: 381951 - DNA, 20 bp, Artificial
  CRISPR gRNA sequence
gtcaaatggtatttctgtct

SEQ ID NO: 381952 - DNA, 20 bp, Artificial
  CRISPR gRNA sequence
actctaagttccatgttctc

SEQ ID NO: 381953 - DNA, 20 bp, Artificial
  CRISPR gRNA sequence
gtttcatcacattgtatgct

SEQ ID NO: 381954 - DNA, 20 bp, Artificial
  CRISPR gRNA sequence
gataataatagcatctatat

SEQ ID NO: 381955 - DNA, 20 bp, Artificial
  CRISPR gRNA sequence
ataaatgcacatagaataag

SEQ ID NO: 381956 - DNA, 20 bp, Artificial
  CRISPR gRNA sequence
aagattatattgacatgata

SEQ ID NO: 381957 - DNA, 20 bp, Artificial
  CRISPR gRNA sequence
cttctctggtattttctctt

SEQ ID NO: 381958 - DNA, 20 bp, Artificial
  CRISPR gRNA sequence
ctcttctatgattcccctgg

SEQ ID NO: 381959 - DNA, 20 bp, Artificial
  CRISPR gRNA sequence
attcccctggttaggttttt

SEQ ID NO: 381960 - DNA, 20 bp, Artificial
  CRISPR gRNA sequence
tgggtttcattggaactgtg

SEQ ID NO: 381961 - DNA, 20 bp, Artificial
  CRISPR gRNA sequence
tggtcctttcagtcacggcg

SEQ ID NO: 381962 - DNA, 20 bp, Artificial
  CRISPR gRNA sequence
cgaagtgattccagaagttg

SEQ ID NO: 381963 - DNA, 20 bp, Artificial
  CRISPR gRNA sequence
taatagtcaagagggagggc

SEQ ID NO: 381964 - DNA, 20 bp, Artificial
  CRISPR gRNA sequence
cagcactacaccaaccgatc

SEQ ID NO: 381965 - DNA, 20 bp, Artificial
  CRISPR gRNA sequence
gttactcttcctcttcacac

SEQ ID NO: 381966 - DNA, 20 bp, Artificial
  CRISPR gRNA sequence
cttcacaccttagtttctaa

SEQ ID NO: 381967 - DNA, 20 bp, Artificial
  CRISPR gRNA sequence
cttaataaaataatctacat

SEQ ID NO: 381968 - DNA, 20 bp, Artificial
  CRISPR gRNA sequence
tttaataaaataatccatac

SEQ ID NO: 381969 - DNA, 20 bp, Artificial
  CRISPR gRNA sequence
agtgatttagaataacaccc

SEQ ID NO: 381970 - DNA, 20 bp, Artificial
  CRISPR gRNA sequence
ataacacccaaaagatttta

SEQ ID NO: 381971 - DNA, 20 bp, Artificial
  CRISPR gRNA sequence
atcattctttagtaaaatca

SEQ ID NO: 381972 - DNA, 20 bp, Artificial
  CRISPR gRNA sequence
agtcctgggatacacagaag

SEQ ID NO: 381973 - DNA, 20 bp, Artificial
  CRISPR gRNA sequence
atttttaataccctttgaaa

SEQ ID NO: 381974 - DNA, 20 bp, Artificial
  CRISPR gRNA sequence
gtgacaaattaccaaaacgg

SEQ ID NO: 381975 - DNA, 20 bp, Artificial
  CRISPR gRNA sequence
caagaaacagtgtcagaagt

SEQ ID NO: 381976 - DNA, 20 bp, Artificial
  CRISPR gRNA sequence
tcgtgggatgagaatccatc

SEQ ID NO: 381977 - DNA, 20 bp, Artificial
  CRISPR gRNA sequence
gaatccatcccatgcttcta

SEQ ID NO: 381978 - DNA, 20 bp, Artificial
  CRISPR gRNA sequence
cccacccctctccagcacag

SEQ ID NO: 381979 - DNA, 20 bp, Artificial
  CRISPR gRNA sequence
cctctccagcacagcgttgt

SEQ ID NO: 381980 - DNA, 20 bp, Artificial
  CRISPR gRNA sequence
tttatttccttatgggctgc

SEQ ID NO: 381981 - DNA, 20 bp, Artificial
  CRISPR gRNA sequence
gcaggagtttgatgagctgt

SEQ ID NO: 381982 - DNA, 20 bp, Artificial
  CRISPR gRNA sequence
tctgccttgctgctgcccct

SEQ ID NO: 381983 - DNA, 20 bp, Artificial
  CRISPR gRNA sequence
aaaagactagaaacttcctt

SEQ ID NO: 381984 - DNA, 20 bp, Artificial
  CRISPR gRNA sequence
tcttcctttaatgcatagca

SEQ ID NO: 381985 - DNA, 20 bp, Artificial
  CRISPR gRNA sequence
aatttcacaaaaaaagttgc

SEQ ID NO: 381986 - DNA, 20 bp, Artificial
  CRISPR gRNA sequence
cagtgcctttttaaggacag

SEQ ID NO: 381987 - DNA, 20 bp, Artificial
  CRISPR gRNA sequence
gcctttttaaggacagaaga

SEQ ID NO: 381988 - DNA, 20 bp, Artificial
  CRISPR gRNA sequence
cctccagaactgtgaggaat

SEQ ID NO: 381989 - DNA, 20 bp, Artificial
  CRISPR gRNA sequence
aactgtgaggaataagtgtt

SEQ ID NO: 381990 - DNA, 20 bp, Artificial
  CRISPR gRNA sequence
atcagatgccttcataattt

SEQ ID NO: 381991 - DNA, 20 bp, Artificial
  CRISPR gRNA sequence
acttttgcaaaaaatatttt

SEQ ID NO: 381992 - DNA, 20 bp, Artificial
  CRISPR gRNA sequence
ttttgtttgttggcaaaaaa

SEQ ID NO: 381993 - DNA, 20 bp, Artificial
  CRISPR gRNA sequence
gtttgttggcaaaaaacatg

SEQ ID NO: 381994 - DNA, 20 bp, Artificial
  CRISPR gRNA sequence
ccaactgtagaatcaagaaa

SEQ ID NO: 381995 - DNA, 20 bp, Artificial
  CRISPR gRNA sequence
gtgctctgtcatacacaatt

SEQ ID NO: 381996 - DNA, 20 bp, Artificial
  CRISPR gRNA sequence
tgtgaatttggggaatgaaa

SEQ ID NO: 381997 - DNA, 20 bp, Artificial
  CRISPR gRNA sequence
atattaggtatccaactttt

SEQ ID NO: 381998 - DNA, 20 bp, Artificial
  CRISPR gRNA sequence
tttttgtagaataatatttt

SEQ ID NO: 381999 - DNA, 20 bp, Artificial
  CRISPR gRNA sequence
tcatggcacttgaattttca

SEQ ID NO: 382000 - DNA, 20 bp, Artificial
  CRISPR gRNA sequence
atctggctggtcatggtggc

SEQ ID NO: 382001 - DNA, 20 bp, Artificial
  CRISPR gRNA sequence
tgggcggatcgtctgaggtc

SEQ ID NO: 382002 - DNA, 20 bp, Artificial
  CRISPR gRNA sequence
caaaaattagctgggcgtga

SEQ ID NO: 382003 - DNA, 20 bp, Artificial
  CRISPR gRNA sequence
tactcgtgaggctgaggcag

SEQ ID NO: 382004 - DNA, 20 bp, Artificial
  CRISPR gRNA sequence
gaggtgggggttgcagtgag

SEQ ID NO: 382005 - DNA, 20 bp, Artificial
  CRISPR gRNA sequence
cctagattgcgccactgcac

SEQ ID NO: 382006 - DNA, 20 bp, Artificial
  CRISPR gRNA sequence
tactcatcaaaagacctttc

SEQ ID NO: 382007 - DNA, 20 bp, Artificial
  CRISPR gRNA sequence
atacatatgtggtcaaagtg

SEQ ID NO: 382008 - DNA, 20 bp, Artificial
  CRISPR gRNA sequence
aagtgacttgattacggtag

SEQ ID NO: 382009 - DNA, 20 bp, Artificial
  CRISPR gRNA sequence
ttgattacggtagagaagat

SEQ ID NO: 382010 - DNA, 20 bp, Artificial
  CRISPR gRNA sequence
ttatacaatatcatcttgat

SEQ ID NO: 382011 - DNA, 20 bp, Artificial
  CRISPR gRNA sequence
tgttaactttttatatgtta

SEQ ID NO: 382012 - DNA, 20 bp, Artificial
  CRISPR gRNA sequence
atagtaattgttcttatcaa

SEQ ID NO: 382013 - DNA, 20 bp, Artificial
  CRISPR gRNA sequence
tacagcaagtattaatctag

SEQ ID NO: 382014 - DNA, 20 bp, Artificial
  CRISPR gRNA sequence
ctgttgcatctcagtcaaga

SEQ ID NO: 382015 - DNA, 20 bp, Artificial
  CRISPR gRNA sequence
acagaagttcaatacaatga

SEQ ID NO: 382016 - DNA, 20 bp, Artificial
  CRISPR gRNA sequence
catgcctgcatttatgagag

SEQ ID NO: 382017 - DNA, 20 bp, Artificial
  CRISPR gRNA sequence
agtgaattattgacactctc

SEQ ID NO: 382018 - DNA, 20 bp, Artificial
  CRISPR gRNA sequence
ttctctcgcagaccaaagac

SEQ ID NO: 382019 - DNA, 20 bp, Artificial
  CRISPR gRNA sequence
cgcagaccaaagactagagt

SEQ ID NO: 382020 - DNA, 20 bp, Artificial
  CRISPR gRNA sequence
cctaaaatcatttttcatag

SEQ ID NO: 382021 - DNA, 20 bp, Artificial
  CRISPR gRNA sequence
tttcagaaaacctgactcta

SEQ ID NO: 382022 - DNA, 20 bp, Artificial
  CRISPR gRNA sequence
catataacagaatgatccag

SEQ ID NO: 382023 - DNA, 20 bp, Artificial
  CRISPR gRNA sequence
acagaatgatccaggggaga

SEQ ID NO: 382024 - DNA, 20 bp, Artificial
  CRISPR gRNA sequence
tttgggcaagggctatttac

SEQ ID NO: 382025 - DNA, 20 bp, Artificial
  CRISPR gRNA sequence
agaattaagtatgggcataa

SEQ ID NO: 382026 - DNA, 20 bp, Artificial
  CRISPR gRNA sequence
ggtcttggcctcactctcat

SEQ ID NO: 382027 - DNA, 20 bp, Artificial
  CRISPR gRNA sequence
actcttggcaattcatacat

SEQ ID NO: 382028 - DNA, 20 bp, Artificial
  CRISPR gRNA sequence
atccttgtttctgtctggta

SEQ ID NO: 382029 - DNA, 20 bp, Artificial
  CRISPR gRNA sequence
ttgtttctgtctggtagaga

SEQ ID NO: 382030 - DNA, 20 bp, Artificial
  CRISPR gRNA sequence
ttctcaaatggagcaaacaa

SEQ ID NO: 382031 - DNA, 20 bp, Artificial
  CRISPR gRNA sequence
aacatgaccagaaaggatgg

SEQ ID NO: 382032 - DNA, 20 bp, Artificial
  CRISPR gRNA sequence
aaaggggagtctcaaagctg

SEQ ID NO: 382033 - DNA, 20 bp, Artificial
  CRISPR gRNA sequence
ttaccaacaaatattgactg

SEQ ID NO: 382034 - DNA, 20 bp, Artificial
  CRISPR gRNA sequence
aactaaaaagtgaaatatgg

SEQ ID NO: 382035 - DNA, 20 bp, Artificial
  CRISPR gRNA sequence
tagtcgaataataaataact

SEQ ID NO: 382036 - DNA, 20 bp, Artificial
  CRISPR gRNA sequence
ggcacctagttattattttt

SEQ ID NO: 382037 - DNA, 20 bp, Artificial
  CRISPR gRNA sequence
agaaaaatacaaagggaaac

SEQ ID NO: 382038 - DNA, 20 bp, Artificial
  CRISPR gRNA sequence
caattagagaccatacctaa

SEQ ID NO: 382039 - DNA, 20 bp, Artificial
  CRISPR gRNA sequence
tatagtgatcattcatgtct

SEQ ID NO: 382040 - DNA, 20 bp, Artificial
  CRISPR gRNA sequence
aaagattcattatttatctc

SEQ ID NO: 382041 - DNA, 20 bp, Artificial
  CRISPR gRNA sequence
ttctaaagaccaccatctag

SEQ ID NO: 382042 - DNA, 20 bp, Artificial
  CRISPR gRNA sequence
ccaaattctcctgttgccta

SEQ ID NO: 382043 - DNA, 20 bp, Artificial
  CRISPR gRNA sequence
taagctaattagtgagtatt

SEQ ID NO: 382044 - DNA, 20 bp, Artificial
  CRISPR gRNA sequence
ccatgtatgccaaataatgc

SEQ ID NO: 382045 - DNA, 20 bp, Artificial
  CRISPR gRNA sequence
ttctgtgaattataaaattt

SEQ ID NO: 382046 - DNA, 20 bp, Artificial
  CRISPR gRNA sequence
taaaaacgaccatttcctgg

SEQ ID NO: 382047 - DNA, 20 bp, Artificial
  CRISPR gRNA sequence
agggtaaactctcattttta

SEQ ID NO: 382048 - DNA, 20 bp, Artificial
  CRISPR gRNA sequence
taaactctcatttttattat

SEQ ID NO: 382049 - DNA, 20 bp, Artificial
  CRISPR gRNA sequence
tgcttaaagatctttttata

SEQ ID NO: 382050 - DNA, 20 bp, Artificial
  CRISPR gRNA sequence
tttttatacctggattcatg

SEQ ID NO: 382051 - DNA, 20 bp, Artificial
  CRISPR gRNA sequence
ttagtgtaacaaacttgaaa

SEQ ID NO: 382052 - DNA, 20 bp, Artificial
  CRISPR gRNA sequence
cactctactatcagatcaat

SEQ ID NO: 382053 - DNA, 20 bp, Artificial
  CRISPR gRNA sequence
aagattctgtgagtgaattt

SEQ ID NO: 382054 - DNA, 20 bp, Artificial
  CRISPR gRNA sequence
ttattggtttgcatggtgaa

SEQ ID NO: 382055 - DNA, 20 bp, Artificial
  CRISPR gRNA sequence
aactccaataaccaaattct

SEQ ID NO: 382056 - DNA, 20 bp, Artificial
  CRISPR gRNA sequence
tagtcagataccattgtcat

SEQ ID NO: 382057 - DNA, 20 bp, Artificial
  CRISPR gRNA sequence
acttgtctctttttccttgt

SEQ ID NO: 382058 - DNA, 20 bp, Artificial
  CRISPR gRNA sequence
ctctttttccttgtgtgtgt

SEQ ID NO: 382059 - DNA, 20 bp, Artificial
  CRISPR gRNA sequence
tattcttcctctacagagtg

SEQ ID NO: 382060 - DNA, 20 bp, Artificial
  CRISPR gRNA sequence
tcctgttataccctcagggg

SEQ ID NO: 382061 - DNA, 20 bp, Artificial
  CRISPR gRNA sequence
taacatcattcttaattcgt

SEQ ID NO: 382062 - DNA, 20 bp, Artificial
  CRISPR gRNA sequence
gttttgggactctccctagt

SEQ ID NO: 382063 - DNA, 20 bp, Artificial
  CRISPR gRNA sequence
ccccctctactcttttgcac

SEQ ID NO: 382064 - DNA, 20 bp, Artificial
  CRISPR gRNA sequence
ctactcttttgcacctatga

SEQ ID NO: 382065 - DNA, 20 bp, Artificial
  CRISPR gRNA sequence
tacagatactttttacaagt

SEQ ID NO: 382066 - DNA, 20 bp, Artificial
  CRISPR gRNA sequence
aagttgctgctttggaagca

SEQ ID NO: 382067 - DNA, 20 bp, Artificial
  CRISPR gRNA sequence
ctttggaagcaaaatgcttc

SEQ ID NO: 382068 - DNA, 20 bp, Artificial
  CRISPR gRNA sequence
atggataatacattaagaat

SEQ ID NO: 382069 - DNA, 20 bp, Artificial
  CRISPR gRNA sequence
gaagacttgttaatggagta

SEQ ID NO: 382070 - DNA, 20 bp, Artificial
  CRISPR gRNA sequence
gaaatttcatttacttgtaa

SEQ ID NO: 382071 - DNA, 20 bp, Artificial
  CRISPR gRNA sequence
tttttagtaaaaactccaat

SEQ ID NO: 382072 - DNA, 20 bp, Artificial
  CRISPR gRNA sequence
aaatacttttagtaggcatt

SEQ ID NO: 382073 - DNA, 20 bp, Artificial
  CRISPR gRNA sequence
attgtgaacatccaagttat

SEQ ID NO: 382074 - DNA, 20 bp, Artificial
  CRISPR gRNA sequence
aaaaattacagctgtataac

SEQ ID NO: 382075 - DNA, 20 bp, Artificial
  CRISPR gRNA sequence
attagagatcactgtgacca

SEQ ID NO: 382076 - DNA, 20 bp, Artificial
  CRISPR gRNA sequence
actgtgaccaaaatgcttct

SEQ ID NO: 382077 - DNA, 20 bp, Artificial
  CRISPR gRNA sequence
taatgatgtactgtattttg

SEQ ID NO: 382078 - DNA, 20 bp, Artificial
  CRISPR gRNA sequence
actgcttatatgaaatttca

SEQ ID NO: 382079 - DNA, 20 bp, Artificial
  CRISPR gRNA sequence
caagattgacgatattataa

SEQ ID NO: 382080 - DNA, 20 bp, Artificial
  CRISPR gRNA sequence
gagacgctaaattgtgagta

SEQ ID NO: 382081 - DNA, 20 bp, Artificial
  CRISPR gRNA sequence
gacaatataaacatgtcatc

SEQ ID NO: 382082 - DNA, 20 bp, Artificial
  CRISPR gRNA sequence
aaaaacaagttaattttttt

SEQ ID NO: 382083 - DNA, 20 bp, Artificial
  CRISPR gRNA sequence
tttaaaagcttctctatttc

SEQ ID NO: 382084 - DNA, 20 bp, Artificial
  CRISPR gRNA sequence
agtgattcaataggtagaaa

SEQ ID NO: 382085 - DNA, 20 bp, Artificial
  CRISPR gRNA sequence
atagcttctagaattaactg

SEQ ID NO: 382086 - DNA, 20 bp, Artificial
  CRISPR gRNA sequence
aaattttataaatcctcaag

SEQ ID NO: 382087 - DNA, 20 bp, Artificial
  CRISPR gRNA sequence
ggtcggtttacacatatttt

SEQ ID NO: 382088 - DNA, 20 bp, Artificial
  CRISPR gRNA sequence
taataaatgtctgggataat

SEQ ID NO: 382089 - DNA, 20 bp, Artificial
  CRISPR gRNA sequence
ttctagtgttagtgtgtact

SEQ ID NO: 382090 - DNA, 20 bp, Artificial
  CRISPR gRNA sequence
ttttcctttgtcttgtattc

SEQ ID NO: 382091 - DNA, 20 bp, Artificial
  CRISPR gRNA sequence
tgttttgaatgaataaaaca

SEQ ID NO: 382092 - DNA, 20 bp, Artificial
  CRISPR gRNA sequence
ttattattatttttttgaga

SEQ ID NO: 382093 - DNA, 20 bp, Artificial
  CRISPR gRNA sequence
gctcaccacaacctctgcct

SEQ ID NO: 382094 - DNA, 20 bp, Artificial
  CRISPR gRNA sequence
aacctctgcctcccggattc

SEQ ID NO: 382095 - DNA, 20 bp, Artificial
  CRISPR gRNA sequence
tgcctcagcctcctgaatag

SEQ ID NO: 382096 - DNA, 20 bp, Artificial
  CRISPR gRNA sequence
ttttgtatttttagtggaga

SEQ ID NO: 382097 - DNA, 20 bp, Artificial
  CRISPR gRNA sequence
tgcctcagcctcctaaattg

SEQ ID NO: 382098 - DNA, 20 bp, Artificial
  CRISPR gRNA sequence
gcatgtagtgcaaagggtca

SEQ ID NO: 382099 - DNA, 20 bp, Artificial
  CRISPR gRNA sequence
gcaaagggtcaaagggcttt

SEQ ID NO: 382100 - DNA, 20 bp, Artificial
  CRISPR gRNA sequence
gtcaaagggctttacaggtt

SEQ ID NO: 382101 - DNA, 20 bp, Artificial
  CRISPR gRNA sequence
aagggctttacaggtttttt

SEQ ID NO: 382102 - DNA, 20 bp, Artificial
  CRISPR gRNA sequence
gctttacaggttttttgttt

SEQ ID NO: 382103 - DNA, 20 bp, Artificial
  CRISPR gRNA sequence
caggttttttgtttgtttgt

SEQ ID NO: 382104 - DNA, 20 bp, Artificial
  CRISPR gRNA sequence
tatgttcacttttctgaata

SEQ ID NO: 382105 - DNA, 20 bp, Artificial
  CRISPR gRNA sequence
tcagaaatatttgtattaaa

SEQ ID NO: 382106 - DNA, 20 bp, Artificial
  CRISPR gRNA sequence
ttagttaaactacatggtaa

SEQ ID NO: 382107 - DNA, 20 bp, Artificial
  CRISPR gRNA sequence
aaactacatggtaaaaatga

SEQ ID NO: 382108 - DNA, 20 bp, Artificial
  CRISPR gRNA sequence
taagagtactggcaaggtca

SEQ ID NO: 382109 - DNA, 20 bp, Artificial
  CRISPR gRNA sequence
tttatgtggtgagtttgggg

SEQ ID NO: 382110 - DNA, 20 bp, Artificial
  CRISPR gRNA sequence
tagtgtcataagcatgctat

SEQ ID NO: 382111 - DNA, 20 bp, Artificial
  CRISPR gRNA sequence
aagacaagtctgaccaacgt

SEQ ID NO: 382112 - DNA, 20 bp, Artificial
  CRISPR gRNA sequence
ctattcaggaggctgaggca

SEQ ID NO: 382113 - DNA, 20 bp, Artificial
  CRISPR gRNA sequence
tcatcagttaattttattct

SEQ ID NO: 382114 - DNA, 20 bp, Artificial
  CRISPR gRNA sequence
tgttttattcattcaaaaca

SEQ ID NO: 382115 - DNA, 20 bp, Artificial
  CRISPR gRNA sequence
tccaaaagtacacactaaca

SEQ ID NO: 382116 - DNA, 20 bp, Artificial
  CRISPR gRNA sequence
caaggataatacgaaataaa

SEQ ID NO: 382117 - DNA, 20 bp, Artificial
  CRISPR gRNA sequence
tgaggatttataaaatttcc

SEQ ID NO: 382118 - DNA, 20 bp, Artificial
  CRISPR gRNA sequence
tttttctacctattgaatca

SEQ ID NO: 382119 - DNA, 20 bp, Artificial
  CRISPR gRNA sequence
tttcttatcactgttgtgaa

SEQ ID NO: 382120 - DNA, 20 bp, Artificial
  CRISPR gRNA sequence
acaatgtggactctctcaat

SEQ ID NO: 382121 - DNA, 20 bp, Artificial
  CRISPR gRNA sequence
aaaaagtatctgtatttaaa

SEQ ID NO: 382122 - DNA, 20 bp, Artificial
  CRISPR gRNA sequence
atctgctttcttagtaacaa

SEQ ID NO: 382123 - DNA, 20 bp, Artificial
  CRISPR gRNA sequence
aggtgcaaaagagtagaggg

SEQ ID NO: 382124 - DNA, 20 bp, Artificial
  CRISPR gRNA sequence
gtcccaaaactatcacgaat

SEQ ID NO: 382125 - DNA, 20 bp, Artificial
  CRISPR gRNA sequence
tttggtaagtaaagatgtcc

SEQ ID NO: 382126 - DNA, 20 bp, Artificial
  CRISPR gRNA sequence
gtaagtaaagatgtccagag

SEQ ID NO: 382127 - DNA, 20 bp, Artificial
  CRISPR gRNA sequence
caggagcatcagaagacgtc

SEQ ID NO: 382128 - DNA, 20 bp, Artificial
  CRISPR gRNA sequence
aaaccctacactctgtagag

SEQ ID NO: 382129 - DNA, 20 bp, Artificial
  CRISPR gRNA sequence
gtagaggaagaatatataga

SEQ ID NO: 382130 - DNA, 20 bp, Artificial
  CRISPR gRNA sequence
tgctcacatacactaatcat

SEQ ID NO: 382131 - DNA, 20 bp, Artificial
  CRISPR gRNA sequence
aatttggttattggagtttt

SEQ ID NO: 382132 - DNA, 20 bp, Artificial
  CRISPR gRNA sequence
attttgattgtctttaccat

SEQ ID NO: 382133 - DNA, 20 bp, Artificial
  CRISPR gRNA sequence
gattgtctttaccattcaga

SEQ ID NO: 382134 - DNA, 20 bp, Artificial
  CRISPR gRNA sequence
gcaaaccaataaattcactc

SEQ ID NO: 382135 - DNA, 20 bp, Artificial
  CRISPR gRNA sequence
ttcactcctgaaaagggtta

SEQ ID NO: 382136 - DNA, 20 bp, Artificial
  CRISPR gRNA sequence
actcacaaattttataattc

SEQ ID NO: 382137 - DNA, 20 bp, Artificial
  CRISPR gRNA sequence
ttaaaagtgtaaattacatc

SEQ ID NO: 382138 - DNA, 20 bp, Artificial
  CRISPR gRNA sequence
tagaatctgtctaggcaaca

SEQ ID NO: 382139 - DNA, 20 bp, Artificial
  CRISPR gRNA sequence
tcttttctagatggtggtct

SEQ ID NO: 382140 - DNA, 20 bp, Artificial
  CRISPR gRNA sequence
ttttcattgttagcctacat

SEQ ID NO: 382141 - DNA, 20 bp, Artificial
  CRISPR gRNA sequence
ctaggtgcctgacccttttg

SEQ ID NO: 382142 - DNA, 20 bp, Artificial
  CRISPR gRNA sequence
ggctagacctgggatggcgg

SEQ ID NO: 382143 - DNA, 20 bp, Artificial
  CRISPR gRNA sequence
gatggcggcaagaattctat

SEQ ID NO: 382144 - DNA, 20 bp, Artificial
  CRISPR gRNA sequence
gaatgagagataaataaata

SEQ ID NO: 382145 - DNA, 20 bp, Artificial
  CRISPR gRNA sequence
tggacagagataccccattt

SEQ ID NO: 382146 - DNA, 20 bp, Artificial
  CRISPR gRNA sequence
agaagcaaactctctaccag

SEQ ID NO: 382147 - DNA, 20 bp, Artificial
  CRISPR gRNA sequence
cattactaatgcactcatgt

SEQ ID NO: 382148 - DNA, 20 bp, Artificial
  CRISPR gRNA sequence
cttctatagttattgggtgc

SEQ ID NO: 382149 - DNA, 20 bp, Artificial
  CRISPR gRNA sequence
atattcttgactgagatgca

SEQ ID NO: 382150 - DNA, 20 bp, Artificial
  CRISPR gRNA sequence
accacatatgtatgtatgta

SEQ ID NO: 382151 - DNA, 20 bp, Artificial
  CRISPR gRNA sequence
gaaaatatgcaggtgtgaaa

SEQ ID NO: 382152 - DNA, 20 bp, Artificial
  CRISPR gRNA sequence
gaaagacaaattaagagaca

SEQ ID NO: 382153 - DNA, 20 bp, Artificial
  CRISPR gRNA sequence
attaagagacaaaagaaact

SEQ ID NO: 382154 - DNA, 20 bp, Artificial
  CRISPR gRNA sequence
ccagatgttagtgtttttaa

SEQ ID NO: 382155 - DNA, 20 bp, Artificial
  CRISPR gRNA sequence
tagaggttatcttttaaaaa

SEQ ID NO: 382156 - DNA, 20 bp, Artificial
  CRISPR gRNA sequence
agtacttggcttgtggccat

SEQ ID NO: 382157 - DNA, 20 bp, Artificial
  CRISPR gRNA sequence
actgcgaatagttaaaatga

SEQ ID NO: 382158 - DNA, 20 bp, Artificial
  CRISPR gRNA sequence
gaggctgggaagtccaagat

SEQ ID NO: 382159 - DNA, 20 bp, Artificial
  CRISPR gRNA sequence
aagaaaatattttcctaact

SEQ ID NO: 382160 - DNA, 20 bp, Artificial
  CRISPR gRNA sequence
gtatcctcacattgcaaaga

SEQ ID NO: 382161 - DNA, 20 bp, Artificial
  CRISPR gRNA sequence
cactaaggggcagcagcaag

SEQ ID NO: 382162 - DNA, 20 bp, Artificial
  CRISPR gRNA sequence
cagcagcaaggcagaataag

SEQ ID NO: 382163 - DNA, 20 bp, Artificial
  CRISPR gRNA sequence
caagataactggggtctcca

SEQ ID NO: 382164 - DNA, 20 bp, Artificial
  CRISPR gRNA sequence
gggatggattctcatcccac

SEQ ID NO: 382165 - DNA, 20 bp, Artificial
  CRISPR gRNA sequence
gtttcttgtacttcaaccct

SEQ ID NO: 382166 - DNA, 20 bp, Artificial
  CRISPR gRNA sequence
ttcaaccctccagaattatg

SEQ ID NO: 382167 - DNA, 20 bp, Artificial
  CRISPR gRNA sequence
ggtaatttgtcacagcagcc

SEQ ID NO: 382168 - DNA, 20 bp, Artificial
  CRISPR gRNA sequence
agtttcaaagggtattaaaa

SEQ ID NO: 382169 - DNA, 20 bp, Artificial
  CRISPR gRNA sequence
ggtattaaaaatagaatagt

SEQ ID NO: 382170 - DNA, 20 bp, Artificial
  CRISPR gRNA sequence
ctttgcatctgtaaattaca

SEQ ID NO: 382171 - DNA, 20 bp, Artificial
  CRISPR gRNA sequence
ttaatctcagtgattttact

SEQ ID NO: 382172 - DNA, 20 bp, Artificial
  CRISPR gRNA sequence
aagatttcatataaacaggt

SEQ ID NO: 382173 - DNA, 20 bp, Artificial
  CRISPR gRNA sequence
ctaaccaggggaatcataga

SEQ ID NO: 382174 - DNA, 20 bp, Artificial
  CRISPR gRNA sequence
gaagagaaaataccagagaa

SEQ ID NO: 382175 - DNA, 20 bp, Artificial
  CRISPR gRNA sequence
ctctgttagatacagaagat

SEQ ID NO: 382176 - DNA, 20 bp, Artificial
  CRISPR gRNA sequence
gattcctcaaaaacttacag

SEQ ID NO: 382177 - DNA, 20 bp, Artificial
  CRISPR gRNA sequence
ccgtcaatgatagactggat

SEQ ID NO: 382178 - DNA, 20 bp, Artificial
  CRISPR gRNA sequence
ccatagaacactatacagcc

SEQ ID NO: 382179 - DNA, 20 bp, Artificial
  CRISPR gRNA sequence
agaacactatacagccacag

SEQ ID NO: 382180 - DNA, 20 bp, Artificial
  CRISPR gRNA sequence
cttagcaaactcatgcagga

SEQ ID NO: 382181 - DNA, 20 bp, Artificial
  CRISPR gRNA sequence
cctgaacttaaaataaatgt

SEQ ID NO: 382182 - DNA, 20 bp, Artificial
  CRISPR gRNA sequence
catccgggagattaaataaa

SEQ ID NO: 382183 - DNA, 20 bp, Artificial
  CRISPR gRNA sequence
ccagggaaactggatgggtt

SEQ ID NO: 382184 - DNA, 20 bp, Artificial
  CRISPR gRNA sequence
gcacaggagaactagaaggg

SEQ ID NO: 382185 - DNA, 20 bp, Artificial
  CRISPR gRNA sequence
aaggggaagaaaaactcagc

SEQ ID NO: 382186 - DNA, 20 bp, Artificial
  CRISPR gRNA sequence
aaaactcagccaagaatatc

SEQ ID NO: 382187 - DNA, 20 bp, Artificial
  CRISPR gRNA sequence
gcacctagatttcttggttc

SEQ ID NO: 382188 - DNA, 20 bp, Artificial
  CRISPR gRNA sequence
aaaccttgttcttccccttc

SEQ ID NO: 382189 - DNA, 20 bp, Artificial
  CRISPR gRNA sequence
ataaagagcagaggcatcag

SEQ ID NO: 382190 - DNA, 20 bp, Artificial
  CRISPR gRNA sequence
ggttatcggttttacctagg

SEQ ID NO: 382191 - DNA, 20 bp, Artificial
  CRISPR gRNA sequence
aaaaagtaaggcaggaaaat

SEQ ID NO: 382192 - DNA, 20 bp, Artificial
  CRISPR gRNA sequence
aattattgagtaacaaaaac

SEQ ID NO: 382193 - DNA, 20 bp, Artificial
  CRISPR gRNA sequence
caaagaatccaacaaaaaaa

SEQ ID NO: 382194 - DNA, 20 bp, Artificial
  CRISPR gRNA sequence
tagaatgagttacaggaaaa

SEQ ID NO: 382195 - DNA, 20 bp, Artificial
  CRISPR gRNA sequence
tcatatacacaaaacctttt

SEQ ID NO: 382196 - DNA, 20 bp, Artificial
  CRISPR gRNA sequence
ttaagtacattcaacataca

SEQ ID NO: 382197 - DNA, 20 bp, Artificial
  CRISPR gRNA sequence
tgatgtttataagtataatt

SEQ ID NO: 382198 - DNA, 20 bp, Artificial
  CRISPR gRNA sequence
tttggtaatgatacaaaaaa

SEQ ID NO: 382199 - DNA, 20 bp, Artificial
  CRISPR gRNA sequence
gcagcagccctaattacatc

SEQ ID NO: 382200 - DNA, 20 bp, Artificial
  CRISPR gRNA sequence
aagaacaatcaactgcgatt

SEQ ID NO: 382201 - DNA, 20 bp, Artificial
  CRISPR gRNA sequence
ttgtgagtgcctcccacagg

SEQ ID NO: 382202 - DNA, 20 bp, Artificial
  CRISPR gRNA sequence
aattcttccccatcttttcc

SEQ ID NO: 382203 - DNA, 20 bp, Artificial
  CRISPR gRNA sequence
tttcacaaactttactgcaa

SEQ ID NO: 382204 - DNA, 20 bp, Artificial
  CRISPR gRNA sequence
gtaagtgaaataagccagac

SEQ ID NO: 382205 - DNA, 20 bp, Artificial
  CRISPR gRNA sequence
taaagatctgcaggcttaaa

SEQ ID NO: 382206 - DNA, 20 bp, Artificial
  CRISPR gRNA sequence
tagtggttaaagtacaggat

SEQ ID NO: 382207 - DNA, 20 bp, Artificial
  CRISPR gRNA sequence
aggatgtagaaatcttttct

SEQ ID NO: 382208 - DNA, 20 bp, Artificial
  CRISPR gRNA sequence
tagaaatcttttctttagaa

SEQ ID NO: 382209 - DNA, 20 bp, Artificial
  CRISPR gRNA sequence
aaaacaagtttgacacctgt

SEQ ID NO: 382210 - DNA, 20 bp, Artificial
  CRISPR gRNA sequence
gtggagccagttatagagct

SEQ ID NO: 382211 - DNA, 20 bp, Artificial
  CRISPR gRNA sequence
ggctccacatgttcagctgt

SEQ ID NO: 382212 - DNA, 20 bp, Artificial
  CRISPR gRNA sequence
taggtatgactgacaacctt

SEQ ID NO: 382213 - DNA, 20 bp, Artificial
  CRISPR gRNA sequence
ttagagtcttaccttggtca

SEQ ID NO: 382214 - DNA, 20 bp, Artificial
  CRISPR gRNA sequence
agggaaaaaggattttttct

SEQ ID NO: 382215 - DNA, 20 bp, Artificial
  CRISPR gRNA sequence
aagcccttttctttaaaaaa

SEQ ID NO: 382216 - DNA, 20 bp, Artificial
  CRISPR gRNA sequence
gcaagtcagtgaaatatata

SEQ ID NO: 382217 - DNA, 20 bp, Artificial
  CRISPR gRNA sequence
tatggctgagttatacactc

SEQ ID NO: 382218 - DNA, 20 bp, Artificial
  CRISPR gRNA sequence
actcttagaaaaggctcatg

SEQ ID NO: 382219 - DNA, 20 bp, Artificial
  CRISPR gRNA sequence
tgggggtggagttagggagt

SEQ ID NO: 382220 - DNA, 20 bp, Artificial
  CRISPR gRNA sequence
agaacctaaataactgggcc

SEQ ID NO: 382221 - DNA, 20 bp, Artificial
  CRISPR gRNA sequence
tggcttttctcaaaaagatg

SEQ ID NO: 382222 - DNA, 20 bp, Artificial
  CRISPR gRNA sequence
agggtcaagcaattcctggt

SEQ ID NO: 382223 - DNA, 20 bp, Artificial
  CRISPR gRNA sequence
tccctaagtgttggccagtc

SEQ ID NO: 382224 - DNA, 20 bp, Artificial
  CRISPR gRNA sequence
aaagggaaagagtacaaaag

SEQ ID NO: 382225 - DNA, 20 bp, Artificial
  CRISPR gRNA sequence
agagcagagaaccagtctga

SEQ ID NO: 382226 - DNA, 20 bp, Artificial
  CRISPR gRNA sequence
cttacccattttcgataata

SEQ ID NO: 382227 - DNA, 20 bp, Artificial
  CRISPR gRNA sequence
gaacttttgtttcagtaaaa

SEQ ID NO: 382228 - DNA, 20 bp, Artificial
  CRISPR gRNA sequence
ttttgtttcagtaaaagaag

SEQ ID NO: 382229 - DNA, 20 bp, Artificial
  CRISPR gRNA sequence
gtttcagtaaaagaagaaag

SEQ ID NO: 382230 - DNA, 20 bp, Artificial
  CRISPR gRNA sequence
aagaaagaaaggagagagag

SEQ ID NO: 382231 - DNA, 20 bp, Artificial
  CRISPR gRNA sequence
ggcaggcaggcaggcaggga

SEQ ID NO: 382232 - DNA, 20 bp, Artificial
  CRISPR gRNA sequence
ggcaggcaggcagggaggag

SEQ ID NO: 382233 - DNA, 20 bp, Artificial
  CRISPR gRNA sequence
caggcagggaggagaaagaa

SEQ ID NO: 382234 - DNA, 20 bp, Artificial
  CRISPR gRNA sequence
agggaagggaaaggaagaga

SEQ ID NO: 382235 - DNA, 20 bp, Artificial
  CRISPR gRNA sequence
aagggaaaggaagagaagag

SEQ ID NO: 382236 - DNA, 20 bp, Artificial
  CRISPR gRNA sequence
gaaaggaagagaagagaaag

SEQ ID NO: 382237 - DNA, 20 bp, Artificial
  CRISPR gRNA sequence
ggaagagaagagaaagaaag

SEQ ID NO: 382238 - DNA, 20 bp, Artificial
  CRISPR gRNA sequence
gaagagaaagaaagaaagaa

SEQ ID NO: 382239 - DNA, 20 bp, Artificial
  CRISPR gRNA sequence
agaaagaaagaaaaagaaag

SEQ ID NO: 382240 - DNA, 20 bp, Artificial
  CRISPR gRNA sequence
agaaagaaaaagaaagagag

SEQ ID NO: 382241 - DNA, 20 bp, Artificial
  CRISPR gRNA sequence
agaaaaagaaagagagaaag

SEQ ID NO: 382242 - DNA, 20 bp, Artificial
  CRISPR gRNA sequence
aaagaaagagagaaagaaag

SEQ ID NO: 382243 - DNA, 20 bp, Artificial
  CRISPR gRNA sequence
aaagagagaaagaaagaaag

SEQ ID NO: 382244 - DNA, 20 bp, Artificial
  CRISPR gRNA sequence
agagaaagaaagaaagaaag

SEQ ID NO: 382245 - DNA, 20 bp, Artificial
  CRISPR gRNA sequence
aaagaaagaaagaaagaaag

SEQ ID NO: 382246 - DNA, 20 bp, Artificial
  CRISPR gRNA sequence
ggaaggaaggaaggaagggg

SEQ ID NO: 382247 - DNA, 20 bp, Artificial
  CRISPR gRNA sequence
ggaaggaaggaaggggaaag

SEQ ID NO: 382248 - DNA, 20 bp, Artificial
  CRISPR gRNA sequence
aagaaggagggaaggaaagg

SEQ ID NO: 382249 - DNA, 20 bp, Artificial
  CRISPR gRNA sequence
agggaaggaaaggggagaaa

SEQ ID NO: 382250 - DNA, 20 bp, Artificial
  CRISPR gRNA sequence
aaaaaattaatgtcttagaa

SEQ ID NO: 382251 - DNA, 20 bp, Artificial
  CRISPR gRNA sequence
taatgtcttagaagtagaaa

SEQ ID NO: 382252 - DNA, 20 bp, Artificial
  CRISPR gRNA sequence
tggttaccagaggctgtgca

SEQ ID NO: 382253 - DNA, 20 bp, Artificial
  CRISPR gRNA sequence
taaatttcaaatatctcaca

SEQ ID NO: 382254 - DNA, 20 bp, Artificial
  CRISPR gRNA sequence
aattaactttttttagattt

SEQ ID NO: 382255 - DNA, 20 bp, Artificial
  CRISPR gRNA sequence
ttattgaaaacagagactga

SEQ ID NO: 382256 - DNA, 20 bp, Artificial
  CRISPR gRNA sequence
tcagttttatactctgtatt

SEQ ID NO: 382257 - DNA, 20 bp, Artificial
  CRISPR gRNA sequence
ctagagtgtaaattattttc

SEQ ID NO: 382258 - DNA, 20 bp, Artificial
  CRISPR gRNA sequence
aagtattatcaggttttaac

SEQ ID NO: 382259 - DNA, 20 bp, Artificial
  CRISPR gRNA sequence
aactaagaaacataaggccc

SEQ ID NO: 382260 - DNA, 20 bp, Artificial
  CRISPR gRNA sequence
aagcaagcttcctagctgat

SEQ ID NO: 382261 - DNA, 20 bp, Artificial
  CRISPR gRNA sequence
ctttaaaggtttatgtcagt

SEQ ID NO: 382262 - DNA, 20 bp, Artificial
  CRISPR gRNA sequence
gtacgttttacctacacaat

SEQ ID NO: 382263 - DNA, 20 bp, Artificial
  CRISPR gRNA sequence
cttcaaattgacacatttat

SEQ ID NO: 382264 - DNA, 20 bp, Artificial
  CRISPR gRNA sequence
ctatatagatgcttcaaaag

SEQ ID NO: 382265 - DNA, 20 bp, Artificial
  CRISPR gRNA sequence
ctgtcttagtgaattagtgt

SEQ ID NO: 382266 - DNA, 20 bp, Artificial
  CRISPR gRNA sequence
gtcttgattgaaatcaggaa

SEQ ID NO: 382267 - DNA, 20 bp, Artificial
  CRISPR gRNA sequence
tttataacaataaaaaaaac

SEQ ID NO: 382268 - DNA, 20 bp, Artificial
  CRISPR gRNA sequence
tgtcctctgtttagtaaggc

SEQ ID NO: 382269 - DNA, 20 bp, Artificial
  CRISPR gRNA sequence
catgtcattacttattgcct

SEQ ID NO: 382270 - DNA, 20 bp, Artificial
  CRISPR gRNA sequence
tgtttcaaataaaactagta

SEQ ID NO: 382271 - DNA, 20 bp, Artificial
  CRISPR gRNA sequence
atgtatatgttcttataaca

SEQ ID NO: 382272 - DNA, 20 bp, Artificial
  CRISPR gRNA sequence
aaggactggctgatgtccct

SEQ ID NO: 382273 - DNA, 20 bp, Artificial
  CRISPR gRNA sequence
tgggttgtataaacatttag

SEQ ID NO: 382274 - DNA, 20 bp, Artificial
  CRISPR gRNA sequence
aataagccaccccagcagtc

SEQ ID NO: 382275 - DNA, 20 bp, Artificial
  CRISPR gRNA sequence
gatcctgatgttggtgttcc

SEQ ID NO: 382276 - DNA, 20 bp, Artificial
  CRISPR gRNA sequence
ggtgttccacagaatggcat

SEQ ID NO: 382277 - DNA, 20 bp, Artificial
  CRISPR gRNA sequence
ttgagaaacactgctctact

SEQ ID NO: 382278 - DNA, 20 bp, Artificial
  CRISPR gRNA sequence
cctttcttagggtattgact

SEQ ID NO: 382279 - DNA, 20 bp, Artificial
  CRISPR gRNA sequence
gtcttttgtcagcttttgat

SEQ ID NO: 382280 - DNA, 20 bp, Artificial
  CRISPR gRNA sequence
acctcccaatttctgagagg

SEQ ID NO: 382281 - DNA, 20 bp, Artificial
  CRISPR gRNA sequence
acatgagagaacataagtgt

SEQ ID NO: 382282 - DNA, 20 bp, Artificial
  CRISPR gRNA sequence
gtttttctcttccactttga

SEQ ID NO: 382283 - DNA, 20 bp, Artificial
  CRISPR gRNA sequence
cagaaaagtagtgctggggc

SEQ ID NO: 382284 - DNA, 20 bp, Artificial
  CRISPR gRNA sequence
cagaacagccactggcacac

SEQ ID NO: 382285 - DNA, 20 bp, Artificial
  CRISPR gRNA sequence
ataactctttccttgggtcc

SEQ ID NO: 382286 - DNA, 20 bp, Artificial
  CRISPR gRNA sequence
ctgcttgggaggctgaggca

SEQ ID NO: 382287 - DNA, 20 bp, Artificial
  CRISPR gRNA sequence
taaatgttgtacagatcttt

SEQ ID NO: 382288 - DNA, 20 bp, Artificial
  CRISPR gRNA sequence
tgaaagcctatgcctggcta

SEQ ID NO: 382289 - DNA, 20 bp, Artificial
  CRISPR gRNA sequence
ctttatctgctggatcagga

SEQ ID NO: 382290 - DNA, 20 bp, Artificial
  CRISPR gRNA sequence
tcatttacacattgcgtccc

SEQ ID NO: 382291 - DNA, 20 bp, Artificial
  CRISPR gRNA sequence
gtataaataatagcttaaag

SEQ ID NO: 382292 - DNA, 20 bp, Artificial
  CRISPR gRNA sequence
ctcttaaacaacatagtcct

SEQ ID NO: 382293 - DNA, 20 bp, Artificial
  CRISPR gRNA sequence
attgagttgtaatacttaaa

SEQ ID NO: 382294 - DNA, 20 bp, Artificial
  CRISPR gRNA sequence
acttaaattagaatttctat

SEQ ID NO: 382295 - DNA, 20 bp, Artificial
  CRISPR gRNA sequence
atgaaatgctattaatctta

SEQ ID NO: 382296 - DNA, 20 bp, Artificial
  CRISPR gRNA sequence
gtaattttctacttgctttt

SEQ ID NO: 382297 - DNA, 20 bp, Artificial
  CRISPR gRNA sequence
ttaacaattcccaggtgctt

SEQ ID NO: 382298 - DNA, 20 bp, Artificial
  CRISPR gRNA sequence
catgtgtgaattttaagtag

SEQ ID NO: 382299 - DNA, 20 bp, Artificial
  CRISPR gRNA sequence
tgtagtctaagttcccaggg

SEQ ID NO: 382300 - DNA, 20 bp, Artificial
  CRISPR gRNA sequence
atctggatacccagtttcac

SEQ ID NO: 382301 - DNA, 20 bp, Artificial
  CRISPR gRNA sequence
agcaaactggttggtttttg

SEQ ID NO: 382302 - DNA, 20 bp, Artificial
  CRISPR gRNA sequence
cttatattaaaaattcaaaa

SEQ ID NO: 382303 - DNA, 20 bp, Artificial
  CRISPR gRNA sequence
aacctcaaaggttaaacgtt

SEQ ID NO: 382304 - DNA, 20 bp, Artificial
  CRISPR gRNA sequence
gttgaagaaaaaaaatctgg

SEQ ID NO: 382305 - DNA, 20 bp, Artificial
  CRISPR gRNA sequence
aaaatctggaaagaaaagag

SEQ ID NO: 382306 - DNA, 20 bp, Artificial
  CRISPR gRNA sequence
taaaatggacacagccccta

SEQ ID NO: 382307 - DNA, 20 bp, Artificial
  CRISPR gRNA sequence
cacagcccctactagaatga

SEQ ID NO: 382308 - DNA, 20 bp, Artificial
  CRISPR gRNA sequence
attttcagactataaaagtt

SEQ ID NO: 382309 - DNA, 20 bp, Artificial
  CRISPR gRNA sequence
gacggctgaaactctatagg

SEQ ID NO: 382310 - DNA, 20 bp, Artificial
  CRISPR gRNA sequence
tgtgatggaaacttagtcag

SEQ ID NO: 382311 - DNA, 20 bp, Artificial
  CRISPR gRNA sequence
aacttagtcagttagaaaaa

SEQ ID NO: 382312 - DNA, 20 bp, Artificial
  CRISPR gRNA sequence
aattaatgccaatcctgagt

SEQ ID NO: 382313 - DNA, 20 bp, Artificial
  CRISPR gRNA sequence
aaactctcaacaaattaggt

SEQ ID NO: 382314 - DNA, 20 bp, Artificial
  CRISPR gRNA sequence
tctcaacaaattaggtacag

SEQ ID NO: 382315 - DNA, 20 bp, Artificial
  CRISPR gRNA sequence
tcttaatcagagccattaaa

SEQ ID NO: 382316 - DNA, 20 bp, Artificial
  CRISPR gRNA sequence
tcagagccattaaacaagaa

SEQ ID NO: 382317 - DNA, 20 bp, Artificial
  CRISPR gRNA sequence
gaaaacaaaaggcattcaaa

SEQ ID NO: 382318 - DNA, 20 bp, Artificial
  CRISPR gRNA sequence
aataaaaggaataaagtatt

SEQ ID NO: 382319 - DNA, 20 bp, Artificial
  CRISPR gRNA sequence
tttttcaatattagcctcct

SEQ ID NO: 382320 - DNA, 20 bp, Artificial
  CRISPR gRNA sequence
ggtccaggcaagtttcaaat

SEQ ID NO: 382321 - DNA, 20 bp, Artificial
  CRISPR gRNA sequence
ggacataagtgcaaaggaca

SEQ ID NO: 382322 - DNA, 20 bp, Artificial
  CRISPR gRNA sequence
tgtatttcttttcactcagc

SEQ ID NO: 382323 - DNA, 20 bp, Artificial
  CRISPR gRNA sequence
tgaaataatcaaattgcacc

SEQ ID NO: 382324 - DNA, 20 bp, Artificial
  CRISPR gRNA sequence
gctgtttataatttacatac

SEQ ID NO: 382325 - DNA, 20 bp, Artificial
  CRISPR gRNA sequence
tacaaagaaatagttttgtg

SEQ ID NO: 382326 - DNA, 20 bp, Artificial
  CRISPR gRNA sequence
cttcttcattttcaacacag

SEQ ID NO: 382327 - DNA, 20 bp, Artificial
  CRISPR gRNA sequence
tgtggaagggagaagggaag

SEQ ID NO: 382328 - DNA, 20 bp, Artificial
  CRISPR gRNA sequence
aagggagaagggaaggaaga

SEQ ID NO: 382329 - DNA, 20 bp, Artificial
  CRISPR gRNA sequence
gaaagatggaagagagtgag

SEQ ID NO: 382330 - DNA, 20 bp, Artificial
  CRISPR gRNA sequence
aagggaagggaggggagggg

SEQ ID NO: 382331 - DNA, 20 bp, Artificial
  CRISPR gRNA sequence
tattagcacttctgtaagtg

SEQ ID NO: 382332 - DNA, 20 bp, Artificial
  CRISPR gRNA sequence
tccacatctgaaaaagactg

SEQ ID NO: 382333 - DNA, 20 bp, Artificial
  CRISPR gRNA sequence
agcttcaggatggtggcaga

SEQ ID NO: 382334 - DNA, 20 bp, Artificial
  CRISPR gRNA sequence
gattgatggattcacaagat

SEQ ID NO: 382335 - DNA, 20 bp, Artificial
  CRISPR gRNA sequence
agataaagaaaccctcaata

SEQ ID NO: 382336 - DNA, 20 bp, Artificial
  CRISPR gRNA sequence
gtgaatgacacattcttgta

SEQ ID NO: 382337 - DNA, 20 bp, Artificial
  CRISPR gRNA sequence
tttttaagtccgggagataa

SEQ ID NO: 382338 - DNA, 20 bp, Artificial
  CRISPR gRNA sequence
ttacttggttaaccatgtag

SEQ ID NO: 382339 - DNA, 20 bp, Artificial
  CRISPR gRNA sequence
aaagtttgggaacccgatct

SEQ ID NO: 382340 - DNA, 20 bp, Artificial
  CRISPR gRNA sequence
caaaactctctggcactaag

SEQ ID NO: 382341 - DNA, 20 bp, Artificial
  CRISPR gRNA sequence
attgtcttggcatacaaaca

SEQ ID NO: 382342 - DNA, 20 bp, Artificial
  CRISPR gRNA sequence
tggcatacaaacaaaagaaa

SEQ ID NO: 382343 - DNA, 20 bp, Artificial
  CRISPR gRNA sequence
aaacaaaagaaaaaagaaat

SEQ ID NO: 382344 - DNA, 20 bp, Artificial
  CRISPR gRNA sequence
gaaaaaagaaatagagaaag

SEQ ID NO: 382345 - DNA, 20 bp, Artificial
  CRISPR gRNA sequence
gagagaaaggaaggagggaa

SEQ ID NO: 382346 - DNA, 20 bp, Artificial
  CRISPR gRNA sequence
gagggaaggagaaaaagaag

SEQ ID NO: 382347 - DNA, 20 bp, Artificial
  CRISPR gRNA sequence
aggagaaaaagaagagagaa

SEQ ID NO: 382348 - DNA, 20 bp, Artificial
  CRISPR gRNA sequence
aaaaagaaaaaaggagggag

SEQ ID NO: 382349 - DNA, 20 bp, Artificial
  CRISPR gRNA sequence
aaaaaggaaggaaaggagac

SEQ ID NO: 382350 - DNA, 20 bp, Artificial
  CRISPR gRNA sequence
gagatgtcacatttcgaaag

SEQ ID NO: 382351 - DNA, 20 bp, Artificial
  CRISPR gRNA sequence
aagatttgccatctattgaa

SEQ ID NO: 382352 - DNA, 20 bp, Artificial
  CRISPR gRNA sequence
catgtgtcaaaatgttgtaa

SEQ ID NO: 382353 - DNA, 20 bp, Artificial
  CRISPR gRNA sequence
ctctaagtaataaagcaaca

SEQ ID NO: 382354 - DNA, 20 bp, Artificial
  CRISPR gRNA sequence
aaagcaacacaagaaaaggg

SEQ ID NO: 382355 - DNA, 20 bp, Artificial
  CRISPR gRNA sequence
caacacaagaaaaggggaag

SEQ ID NO: 382356 - DNA, 20 bp, Artificial
  CRISPR gRNA sequence
gggaagaaagaaaagcaaag

SEQ ID NO: 382357 - DNA, 20 bp, Artificial
  CRISPR gRNA sequence
aaaaaggaaataaaagctta

SEQ ID NO: 382358 - DNA, 20 bp, Artificial
  CRISPR gRNA sequence
aaaacagggaaaggaagacg

SEQ ID NO: 382359 - DNA, 20 bp, Artificial
  CRISPR gRNA sequence
cagatgctagcacaccatgt

SEQ ID NO: 382360 - DNA, 20 bp, Artificial
  CRISPR gRNA sequence
tggagaaatgaaagaacata

SEQ ID NO: 382361 - DNA, 20 bp, Artificial
  CRISPR gRNA sequence
aaaagaaatgaaaaaaagga

SEQ ID NO: 382362 - DNA, 20 bp, Artificial
  CRISPR gRNA sequence
ccgtgaacctgccgactcag

SEQ ID NO: 382363 - DNA, 20 bp, Artificial
  CRISPR gRNA sequence
aatgaccttgaaaagaactg

SEQ ID NO: 382364 - DNA, 20 bp, Artificial
  CRISPR gRNA sequence
aaaatgtcgtagttaattgg

SEQ ID NO: 382365 - DNA, 20 bp, Artificial
  CRISPR gRNA sequence
atgtagctacgtattaatac

SEQ ID NO: 382366 - DNA, 20 bp, Artificial
  CRISPR gRNA sequence
gataaaaaatttgccaacct

SEQ ID NO: 382367 - DNA, 20 bp, Artificial
  CRISPR gRNA sequence
gctcaatatcactcatcatt

SEQ ID NO: 382368 - DNA, 20 bp, Artificial
  CRISPR gRNA sequence
gagacaccatctcataccag

SEQ ID NO: 382369 - DNA, 20 bp, Artificial
  CRISPR gRNA sequence
acagatgctggtgaggttgc

SEQ ID NO: 382370 - DNA, 20 bp, Artificial
  CRISPR gRNA sequence
ccatcagtgacagatgggat

SEQ ID NO: 382371 - DNA, 20 bp, Artificial
  CRISPR gRNA sequence
gaatactatgcagccataaa

SEQ ID NO: 382372 - DNA, 20 bp, Artificial
  CRISPR gRNA sequence
gggtgggaggagggagagaa

SEQ ID NO: 382373 - DNA, 20 bp, Artificial
  CRISPR gRNA sequence
ctactcgggaggctgaggca

SEQ ID NO: 382374 - DNA, 20 bp, Artificial
  CRISPR gRNA sequence
atctataataaccctaatat

SEQ ID NO: 382375 - DNA, 20 bp, Artificial
  CRISPR gRNA sequence
cttacagaactgcaaagagc

SEQ ID NO: 382376 - DNA, 20 bp, Artificial
  CRISPR gRNA sequence
aaggaaaaattcatagaact

SEQ ID NO: 382377 - DNA, 20 bp, Artificial
  CRISPR gRNA sequence
aagtagacacttaataattt

SEQ ID NO: 382378 - DNA, 20 bp, Artificial
  CRISPR gRNA sequence
tggtatcatgtttatgttaa

SEQ ID NO: 382379 - DNA, 20 bp, Artificial
  CRISPR gRNA sequence
atcaagggaaagagagagtg

SEQ ID NO: 382380 - DNA, 20 bp, Artificial
  CRISPR gRNA sequence
ctactcaggaggctgaggca

SEQ ID NO: 382381 - DNA, 20 bp, Artificial
  CRISPR gRNA sequence
aagagctgagctggcaaaga

SEQ ID NO: 382382 - DNA, 20 bp, Artificial
  CRISPR gRNA sequence
tgagctggcaaagaacagaa

SEQ ID NO: 382383 - DNA, 20 bp, Artificial
  CRISPR gRNA sequence
aaagaacagaatcagaaacg

SEQ ID NO: 382384 - DNA, 20 bp, Artificial
  CRISPR gRNA sequence
actattattacactagctaa

SEQ ID NO: 382385 - DNA, 20 bp, Artificial
  CRISPR gRNA sequence
ttctcaaaaataagcaagca

SEQ ID NO: 382386 - DNA, 20 bp, Artificial
  CRISPR gRNA sequence
aaaataagcaagcaaaagaa

SEQ ID NO: 382387 - DNA, 20 bp, Artificial
  CRISPR gRNA sequence
ttacaagcaagcaacaaagt

SEQ ID NO: 382388 - DNA, 20 bp, Artificial
  CRISPR gRNA sequence
aggacatactgaggacagaa

SEQ ID NO: 382389 - DNA, 20 bp, Artificial
  CRISPR gRNA sequence
gagaaacacagacacaaaag

SEQ ID NO: 382390 - DNA, 20 bp, Artificial
  CRISPR gRNA sequence
gagctgtcaggcagcttcaa

SEQ ID NO: 382391 - DNA, 20 bp, Artificial
  CRISPR gRNA sequence
gtcaggcagcttcaagcaga

SEQ ID NO: 382392 - DNA, 20 bp, Artificial
  CRISPR gRNA sequence
cctagaacgcatcagcattc

SEQ ID NO: 382393 - DNA, 20 bp, Artificial
  CRISPR gRNA sequence
acgcatcagcattcccagaa

SEQ ID NO: 382394 - DNA, 20 bp, Artificial
  CRISPR gRNA sequence
ccaaggaaggccaaagattg

SEQ ID NO: 382395 - DNA, 20 bp, Artificial
  CRISPR gRNA sequence
aagcagcaagtccatcctgc

SEQ ID NO: 382396 - DNA, 20 bp, Artificial
  CRISPR gRNA sequence
atggcaaatcaggattcagc

SEQ ID NO: 382397 - DNA, 20 bp, Artificial
  CRISPR gRNA sequence
aggggcagctccgtggagct

SEQ ID NO: 382398 - DNA, 20 bp, Artificial
  CRISPR gRNA sequence
atctctccaccatggtacaa

SEQ ID NO: 382399 - DNA, 20 bp, Artificial
  CRISPR gRNA sequence
cattctgcagtttctctcaa

SEQ ID NO: 382400 - DNA, 20 bp, Artificial
  CRISPR gRNA sequence
aattactgactaatgggata

SEQ ID NO: 382401 - DNA, 20 bp, Artificial
  CRISPR gRNA sequence
ttctgcatggcaggttttta

SEQ ID NO: 382402 - DNA, 20 bp, Artificial
  CRISPR gRNA sequence
atctctaatgattctgtact

SEQ ID NO: 382403 - DNA, 20 bp, Artificial
  CRISPR gRNA sequence
tgatgccttaactcttataa

SEQ ID NO: 382404 - DNA, 20 bp, Artificial
  CRISPR gRNA sequence
tccattagattgttttccaa

SEQ ID NO: 382405 - DNA, 20 bp, Artificial
  CRISPR gRNA sequence
gggattggtgggagactcat

SEQ ID NO: 382406 - DNA, 20 bp, Artificial
  CRISPR gRNA sequence
tgaaagcacaaagagagcct

SEQ ID NO: 382407 - DNA, 20 bp, Artificial
  CRISPR gRNA sequence
aaacacaagggtatttgcca

SEQ ID NO: 382408 - DNA, 20 bp, Artificial
  CRISPR gRNA sequence
aagaaccaactgatataatg

SEQ ID NO: 382409 - DNA, 20 bp, Artificial
  CRISPR gRNA sequence
taatgttagaaatgggaaac

SEQ ID NO: 382410 - DNA, 20 bp, Artificial
  CRISPR gRNA sequence
caggaatagcaacaggactc

SEQ ID NO: 382411 - DNA, 20 bp, Artificial
  CRISPR gRNA sequence
acgctttaactggccgcagg

SEQ ID NO: 382412 - DNA, 20 bp, Artificial
  CRISPR gRNA sequence
cagggtggctggagcctgcc

SEQ ID NO: 382413 - DNA, 20 bp, Artificial
  CRISPR gRNA sequence
tactaaattgtacttggagc

SEQ ID NO: 382414 - DNA, 20 bp, Artificial
  CRISPR gRNA sequence
cttacagtggctggggattg

SEQ ID NO: 382415 - DNA, 20 bp, Artificial
  CRISPR gRNA sequence
tgtttgtaccctataaattt

SEQ ID NO: 382416 - DNA, 20 bp, Artificial
  CRISPR gRNA sequence
ttggatgattaataaatact

SEQ ID NO: 382417 - DNA, 20 bp, Artificial
  CRISPR gRNA sequence
taggagttaagcacaatctc

SEQ ID NO: 382418 - DNA, 20 bp, Artificial
  CRISPR gRNA sequence
caaagaaatctgcacaacag

SEQ ID NO: 382419 - DNA, 20 bp, Artificial
  CRISPR gRNA sequence
tgaacagtgttcttaaccaa

SEQ ID NO: 382420 - DNA, 20 bp, Artificial
  CRISPR gRNA sequence
gtctccattctcatctccta

SEQ ID NO: 382421 - DNA, 20 bp, Artificial
  CRISPR gRNA sequence
ttgtcatttacttcctgccc

SEQ ID NO: 382422 - DNA, 20 bp, Artificial
  CRISPR gRNA sequence
ttttggggggactacatgga

SEQ ID NO: 382423 - DNA, 20 bp, Artificial
  CRISPR gRNA sequence
ctccaggtgcttttcaaacc

SEQ ID NO: 382424 - DNA, 20 bp, Artificial
  CRISPR gRNA sequence
gttgtaatcatcacatcgat

SEQ ID NO: 382425 - DNA, 20 bp, Artificial
  CRISPR gRNA sequence
gattcagaaaagcaagtagc

SEQ ID NO: 382426 - DNA, 20 bp, Artificial
  CRISPR gRNA sequence
caccaagcattagttgaaat

SEQ ID NO: 382427 - DNA, 20 bp, Artificial
  CRISPR gRNA sequence
gttgaaatagagaatattgg

SEQ ID NO: 382428 - DNA, 20 bp, Artificial
  CRISPR gRNA sequence
attggaaagaatctaaatgt

SEQ ID NO: 382429 - DNA, 20 bp, Artificial
  CRISPR gRNA sequence
aaatgcttatgacataatgt

SEQ ID NO: 382430 - DNA, 20 bp, Artificial
  CRISPR gRNA sequence
ttgcgtccaaagactagaac

SEQ ID NO: 382431 - DNA, 20 bp, Artificial
  CRISPR gRNA sequence
caaagactagaacacagaaa

SEQ ID NO: 382432 - DNA, 20 bp, Artificial
  CRISPR gRNA sequence
gttgtgaaaagcaaggagag

SEQ ID NO: 382433 - DNA, 20 bp, Artificial
  CRISPR gRNA sequence
gccagatttgggagtctata

SEQ ID NO: 382434 - DNA, 20 bp, Artificial
  CRISPR gRNA sequence
atttgggagtctataaaaga

SEQ ID NO: 382435 - DNA, 20 bp, Artificial
  CRISPR gRNA sequence
tagctcaacatactggtgca

SEQ ID NO: 382436 - DNA, 20 bp, Artificial
  CRISPR gRNA sequence
aaatgctgacatttatccaa

SEQ ID NO: 382437 - DNA, 20 bp, Artificial
  CRISPR gRNA sequence
ccaattcactcaaaatgagg

SEQ ID NO: 382438 - DNA, 20 bp, Artificial
  CRISPR gRNA sequence
tattcttttctcaaaataaa

SEQ ID NO: 382439 - DNA, 20 bp, Artificial
  CRISPR gRNA sequence
ggaaaactggctagccatat

SEQ ID NO: 382440 - DNA, 20 bp, Artificial
  CRISPR gRNA sequence
ctaaaaccataaaaacccta

SEQ ID NO: 382441 - DNA, 20 bp, Artificial
  CRISPR gRNA sequence
atggttgagccttcttacag

SEQ ID NO: 382442 - DNA, 20 bp, Artificial
  CRISPR gRNA sequence
atcttttccttcctgagttc

SEQ ID NO: 382443 - DNA, 20 bp, Artificial
  CRISPR gRNA sequence
ctatatttcatgatctttat

SEQ ID NO: 382444 - DNA, 20 bp, Artificial
  CRISPR gRNA sequence
tcagggtagagaagtaaaga

SEQ ID NO: 382445 - DNA, 20 bp, Artificial
  CRISPR gRNA sequence
gtctcactggtttcttataa

SEQ ID NO: 382446 - DNA, 20 bp, Artificial
  CRISPR gRNA sequence
gcttattatgaatagggaca

SEQ ID NO: 382447 - DNA, 20 bp, Artificial
  CRISPR gRNA sequence
gagaagagagagagacatca

SEQ ID NO: 382448 - DNA, 20 bp, Artificial
  CRISPR gRNA sequence
acaagaataccaaggatatc

SEQ ID NO: 382449 - DNA, 20 bp, Artificial
  CRISPR gRNA sequence
gaataccaaggatatcatag

SEQ ID NO: 382450 - DNA, 20 bp, Artificial
  CRISPR gRNA sequence
aaaatgaacgtggaaacatt

SEQ ID NO: 382451 - DNA, 20 bp, Artificial
  CRISPR gRNA sequence
aagctttttatttctcagag

SEQ ID NO: 382452 - DNA, 20 bp, Artificial
  CRISPR gRNA sequence
aaggacaggtctgttcataa

SEQ ID NO: 382453 - DNA, 20 bp, Artificial
  CRISPR gRNA sequence
aaaaactgcctaaagcaact

SEQ ID NO: 382454 - DNA, 20 bp, Artificial
  CRISPR gRNA sequence
gatgggcttcagatgtgcta

SEQ ID NO: 382455 - DNA, 20 bp, Artificial
  CRISPR gRNA sequence
tcagatgtgctaaaagaatt

SEQ ID NO: 382456 - DNA, 20 bp, Artificial
  CRISPR gRNA sequence
tagacaacctcaccggaaag

SEQ ID NO: 382457 - DNA, 20 bp, Artificial
  CRISPR gRNA sequence
tttggcttgtatgtattatg

SEQ ID NO: 382458 - DNA, 20 bp, Artificial
  CRISPR gRNA sequence
gttcaagttgattagcacta

SEQ ID NO: 382459 - DNA, 20 bp, Artificial
  CRISPR gRNA sequence
agttgattagcactaccaga

SEQ ID NO: 382460 - DNA, 20 bp, Artificial
  CRISPR gRNA sequence
attgagttcatggaccaaga

SEQ ID NO: 382461 - DNA, 20 bp, Artificial
  CRISPR gRNA sequence
actgaagtaaattggaaaaa

SEQ ID NO: 382462 - DNA, 20 bp, Artificial
  CRISPR gRNA sequence
cttttggccctccttctaat

SEQ ID NO: 382463 - DNA, 20 bp, Artificial
  CRISPR gRNA sequence
attctgttactcccaataaa

SEQ ID NO: 382464 - DNA, 20 bp, Artificial
  CRISPR gRNA sequence
cgcctgaaagtaaattggca

SEQ ID NO: 382465 - DNA, 20 bp, Artificial
  CRISPR gRNA sequence
tcttagcatactctgatttt

SEQ ID NO: 382466 - DNA, 20 bp, Artificial
  CRISPR gRNA sequence
tgctatttgctttattagta

SEQ ID NO: 382467 - DNA, 20 bp, Artificial
  CRISPR gRNA sequence
agcagaatgagtaaaaatat

SEQ ID NO: 382468 - DNA, 20 bp, Artificial
  CRISPR gRNA sequence
atgccatggttctccatttg

SEQ ID NO: 382469 - DNA, 20 bp, Artificial
  CRISPR gRNA sequence
actggaagcaaagatgaaat

SEQ ID NO: 382470 - DNA, 20 bp, Artificial
  CRISPR gRNA sequence
atatacctttggaagctagg

SEQ ID NO: 382471 - DNA, 20 bp, Artificial
  CRISPR gRNA sequence
aaagccataaaatttgggga

SEQ ID NO: 382472 - DNA, 20 bp, Artificial
  CRISPR gRNA sequence
catttcagaggtatattact

SEQ ID NO: 382473 - DNA, 20 bp, Artificial
  CRISPR gRNA sequence
gacaaaaccaattttaaata

SEQ ID NO: 382474 - DNA, 20 bp, Artificial
  CRISPR gRNA sequence
caattttaaataatagaatt

SEQ ID NO: 382475 - DNA, 20 bp, Artificial
  CRISPR gRNA sequence
tttaagaatgctctagtcct

SEQ ID NO: 382476 - DNA, 20 bp, Artificial
  CRISPR gRNA sequence
caaaacatttatcatctcaa

SEQ ID NO: 382477 - DNA, 20 bp, Artificial
  CRISPR gRNA sequence
ttttttaatgagtcattgga

SEQ ID NO: 382478 - DNA, 20 bp, Artificial
  CRISPR gRNA sequence
ctacttgggaggctgaggca

SEQ ID NO: 382479 - DNA, 20 bp, Artificial
  CRISPR gRNA sequence
gccatgggccctcccaaggc

SEQ ID NO: 382480 - DNA, 20 bp, Artificial
  CRISPR gRNA sequence
agaggacctggcagccaaat

SEQ ID NO: 382481 - DNA, 20 bp, Artificial
  CRISPR gRNA sequence
aaaggaaataaatggcaaac

SEQ ID NO: 382482 - DNA, 20 bp, Artificial
  CRISPR gRNA sequence
gaaaaaggttaacactttaa

SEQ ID NO: 382483 - DNA, 20 bp, Artificial
  CRISPR gRNA sequence
gtttccataatgctcaaact

SEQ ID NO: 382484 - DNA, 20 bp, Artificial
  CRISPR gRNA sequence
acccaggcaatttaaacatt

SEQ ID NO: 382485 - DNA, 20 bp, Artificial
  CRISPR gRNA sequence
tcaaacaatgtctagtatca

SEQ ID NO: 382486 - DNA, 20 bp, Artificial
  CRISPR gRNA sequence
acacaggctcaaacccaaaa

SEQ ID NO: 382487 - DNA, 20 bp, Artificial
  CRISPR gRNA sequence
ttatgaaacaggaattttcc

SEQ ID NO: 382488 - DNA, 20 bp, Artificial
  CRISPR gRNA sequence
tgcttcatggagtttataat

SEQ ID NO: 382489 - DNA, 20 bp, Artificial
  CRISPR gRNA sequence
ttcatttcttcatttttata

SEQ ID NO: 382490 - DNA, 20 bp, Artificial
  CRISPR gRNA sequence
gtacttacaattactcctca

SEQ ID NO: 382491 - DNA, 20 bp, Artificial
  CRISPR gRNA sequence
gacagagtcagtatttgaac

SEQ ID NO: 382492 - DNA, 20 bp, Artificial
  CRISPR gRNA sequence
aagtaactgtaagtcaaagg

SEQ ID NO: 382493 - DNA, 20 bp, Artificial
  CRISPR gRNA sequence
ttgtttctttgtttcttttg

SEQ ID NO: 382494 - DNA, 20 bp, Artificial
  CRISPR gRNA sequence
aactccacttgaggaagtac

SEQ ID NO: 382495 - DNA, 20 bp, Artificial
  CRISPR gRNA sequence
attaccagtcacatcaagca

SEQ ID NO: 382496 - DNA, 20 bp, Artificial
  CRISPR gRNA sequence
aggaggtttttctaacagca

SEQ ID NO: 382497 - DNA, 20 bp, Artificial
  CRISPR gRNA sequence
aattatggaaatgctggact

SEQ ID NO: 382498 - DNA, 20 bp, Artificial
  CRISPR gRNA sequence
ctccacaaatcttatctagt

SEQ ID NO: 382499 - DNA, 20 bp, Artificial
  CRISPR gRNA sequence
tggcatgagagcagttttga

SEQ ID NO: 382500 - DNA, 20 bp, Artificial
  CRISPR gRNA sequence
ctactcaggaggctgaggca

SEQ ID NO: 382501 - DNA, 20 bp, Artificial
  CRISPR gRNA sequence
tctgtctcaaaaaagtcaaa

SEQ ID NO: 382502 - DNA, 20 bp, Artificial
  CRISPR gRNA sequence
tctcaaaaaagtcaaagaag

SEQ ID NO: 382503 - DNA, 20 bp, Artificial
  CRISPR gRNA sequence
aaaaaagtcaaagaagaaag

SEQ ID NO: 382504 - DNA, 20 bp, Artificial
  CRISPR gRNA sequence
caaagaagaaagaaagaaag

SEQ ID NO: 382505 - DNA, 20 bp, Artificial
  CRISPR gRNA sequence
agaaagaaagaaagagagaa

SEQ ID NO: 382506 - DNA, 20 bp, Artificial
  CRISPR gRNA sequence
aaagagagaaagagaaaaag

SEQ ID NO: 382507 - DNA, 20 bp, Artificial
  CRISPR gRNA sequence
agagaaagagaaaaagagag

SEQ ID NO: 382508 - DNA, 20 bp, Artificial
  CRISPR gRNA sequence
aaagagaaaaagagagaaag

SEQ ID NO: 382509 - DNA, 20 bp, Artificial
  CRISPR gRNA sequence
aaggaaggaaggaaggaaag

SEQ ID NO: 382510 - DNA, 20 bp, Artificial
  CRISPR gRNA sequence
aaggaaggaaggaaagggag

SEQ ID NO: 382511 - DNA, 20 bp, Artificial
  CRISPR gRNA sequence
aaagggagaaagaaagagag

SEQ ID NO: 382512 - DNA, 20 bp, Artificial
  CRISPR gRNA sequence
ggagaaagaaagagagagag

SEQ ID NO: 382513 - DNA, 20 bp, Artificial
  CRISPR gRNA sequence
agagagagagagaaggaagg

SEQ ID NO: 382514 - DNA, 20 bp, Artificial
  CRISPR gRNA sequence
agtgtcgtgttgcaggaaga

SEQ ID NO: 382515 - DNA, 20 bp, Artificial
  CRISPR gRNA sequence
agggctgaagttctcactgg

SEQ ID NO: 382516 - DNA, 20 bp, Artificial
  CRISPR gRNA sequence
ggaaattcataactttatct

SEQ ID NO: 382517 - DNA, 20 bp, Artificial
  CRISPR gRNA sequence
gaggattaatgggaaacttg

SEQ ID NO: 382518 - DNA, 20 bp, Artificial
  CRISPR gRNA sequence
ctacttgggaggctgaggca

SEQ ID NO: 382519 - DNA, 20 bp, Artificial
  CRISPR gRNA sequence
tatctaaatagcaactgcca

SEQ ID NO: 382520 - DNA, 20 bp, Artificial
  CRISPR gRNA sequence
aaacctcaacactttacaag

SEQ ID NO: 382521 - DNA, 20 bp, Artificial
  CRISPR gRNA sequence
accaccgagccaacgtcata

SEQ ID NO: 382522 - DNA, 20 bp, Artificial
  CRISPR gRNA sequence
atgacaaaaggtgattctga

SEQ ID NO: 382523 - DNA, 20 bp, Artificial
  CRISPR gRNA sequence
gttgaaaaggtaaaaatccc

SEQ ID NO: 382524 - DNA, 20 bp, Artificial
  CRISPR gRNA sequence
gccaaaaaaaaaaaaaaaaa

SEQ ID NO: 382525 - DNA, 20 bp, Artificial
  CRISPR gRNA sequence
agtttttcagcacatcaaaa

SEQ ID NO: 382526 - DNA, 20 bp, Artificial
  CRISPR gRNA sequence
tcaaaaagagaaagagaggg

SEQ ID NO: 382527 - DNA, 20 bp, Artificial
  CRISPR gRNA sequence
tctttttggaaaaagtgatt

SEQ ID NO: 382528 - DNA, 20 bp, Artificial
  CRISPR gRNA sequence
ttgcaaatggccaccatgct

SEQ ID NO: 382529 - DNA, 20 bp, Artificial
  CRISPR gRNA sequence
ctgctatgtctaaaaaactg

SEQ ID NO: 382530 - DNA, 20 bp, Artificial
  CRISPR gRNA sequence
taaccaaatacaaactagga

SEQ ID NO: 382531 - DNA, 20 bp, Artificial
  CRISPR gRNA sequence
tacaaactaggatcagaaat

SEQ ID NO: 382532 - DNA, 20 bp, Artificial
  CRISPR gRNA sequence
aaatgcagaatgatctctgc

SEQ ID NO: 382533 - DNA, 20 bp, Artificial
  CRISPR gRNA sequence
agaatgatctctgcaaagaa

SEQ ID NO: 382534 - DNA, 20 bp, Artificial
  CRISPR gRNA sequence
aaagaatgcaaattcacctg

SEQ ID NO: 382535 - DNA, 20 bp, Artificial
  CRISPR gRNA sequence
tagataaatcacatgtcaaa

SEQ ID NO: 382536 - DNA, 20 bp, Artificial
  CRISPR gRNA sequence
cacatgtcaaaggagaaaca

SEQ ID NO: 382537 - DNA, 20 bp, Artificial
  CRISPR gRNA sequence
ctttttactctccccactgt

SEQ ID NO: 382538 - DNA, 20 bp, Artificial
  CRISPR gRNA sequence
tgcacttctcaccacagcac

SEQ ID NO: 382539 - DNA, 20 bp, Artificial
  CRISPR gRNA sequence
ctactcgggaggctgaggaa

SEQ ID NO: 382540 - DNA, 20 bp, Artificial
  CRISPR gRNA sequence
atacatgagtaaactgaagc

SEQ ID NO: 382541 - DNA, 20 bp, Artificial
  CRISPR gRNA sequence
aaactgaagctcagaaaaat

SEQ ID NO: 382542 - DNA, 20 bp, Artificial
  CRISPR gRNA sequence
tagcaggaatttctctaaat

SEQ ID NO: 382543 - DNA, 20 bp, Artificial
  CRISPR gRNA sequence
ttggggacatcattaagtct

SEQ ID NO: 382544 - DNA, 20 bp, Artificial
  CRISPR gRNA sequence
atgaatgtgattagtgccct

SEQ ID NO: 382545 - DNA, 20 bp, Artificial
  CRISPR gRNA sequence
ttcagaactctttttatctc

SEQ ID NO: 382546 - DNA, 20 bp, Artificial
  CRISPR gRNA sequence
gttcaaatagtcctcatttt

SEQ ID NO: 382547 - DNA, 20 bp, Artificial
  CRISPR gRNA sequence
tagtcctcatttttaagaat

SEQ ID NO: 382548 - DNA, 20 bp, Artificial
  CRISPR gRNA sequence
aaactagtgggtgaaatact

SEQ ID NO: 382549 - DNA, 20 bp, Artificial
  CRISPR gRNA sequence
ctcattaagctatgaaatat

SEQ ID NO: 382550 - DNA, 20 bp, Artificial
  CRISPR gRNA sequence
gtagataagtttcaaaccat

SEQ ID NO: 382551 - DNA, 20 bp, Artificial
  CRISPR gRNA sequence
gggacaatgtttccttagct

SEQ ID NO: 382552 - DNA, 20 bp, Artificial
  CRISPR gRNA sequence
acagagtgaaagagtaaggg

SEQ ID NO: 382553 - DNA, 20 bp, Artificial
  CRISPR gRNA sequence
caagcaaaaatatctacaat

SEQ ID NO: 382554 - DNA, 20 bp, Artificial
  CRISPR gRNA sequence
aagaccttgaacagcacttg

SEQ ID NO: 382555 - DNA, 20 bp, Artificial
  CRISPR gRNA sequence
aaaggttgctgctacccagc

SEQ ID NO: 382556 - DNA, 20 bp, Artificial
  CRISPR gRNA sequence
agcctagaaaatgctgccaa

SEQ ID NO: 382557 - DNA, 20 bp, Artificial
  CRISPR gRNA sequence
cctattgtctgagctcattc

SEQ ID NO: 382558 - DNA, 20 bp, Artificial
  CRISPR gRNA sequence
atgccatctctggaggtgat

SEQ ID NO: 382559 - DNA, 20 bp, Artificial
  CRISPR gRNA sequence
tgtgggaatattgactcaaa

SEQ ID NO: 382560 - DNA, 20 bp, Artificial
  CRISPR gRNA sequence
tttgaacctcatacaacacg

SEQ ID NO: 382561 - DNA, 20 bp, Artificial
  CRISPR gRNA sequence
aacccaggacctacctgaag

SEQ ID NO: 382562 - DNA, 20 bp, Artificial
  CRISPR gRNA sequence
catccccaggtgaataaggg

SEQ ID NO: 382563 - DNA, 20 bp, Artificial
  CRISPR gRNA sequence
cccaggtgaataagggaaag

SEQ ID NO: 382564 - DNA, 20 bp, Artificial
  CRISPR gRNA sequence
gtcccttcatgttagacttc

SEQ ID NO: 382565 - DNA, 20 bp, Artificial
  CRISPR gRNA sequence
ccaacaacgatagactggat

SEQ ID NO: 382566 - DNA, 20 bp, Artificial
  CRISPR gRNA sequence
ataataataaaatttaaaaa

SEQ ID NO: 382567 - DNA, 20 bp, Artificial
  CRISPR gRNA sequence
aataaaatttaaaaaaaaga

SEQ ID NO: 382568 - DNA, 20 bp, Artificial
  CRISPR gRNA sequence
agaaaagaaagtaatgacag

SEQ ID NO: 382569 - DNA, 20 bp, Artificial
  CRISPR gRNA sequence
aagaaaaaaaactgagcaaa

SEQ ID NO: 382570 - DNA, 20 bp, Artificial
  CRISPR gRNA sequence
gacctgaatcttcaagaggg

SEQ ID NO: 382571 - DNA, 20 bp, Artificial
  CRISPR gRNA sequence
atcttcaagaggggaagaat

SEQ ID NO: 382572 - DNA, 20 bp, Artificial
  CRISPR gRNA sequence
cagactggatggcttaaaca

SEQ ID NO: 382573 - DNA, 20 bp, Artificial
  CRISPR gRNA sequence
ttttatcgcaattctgcagg

SEQ ID NO: 382574 - DNA, 20 bp, Artificial
  CRISPR gRNA sequence
aaatctaaagtcaaaatatc

SEQ ID NO: 382575 - DNA, 20 bp, Artificial
  CRISPR gRNA sequence
tcctactcccagcccactgc

SEQ ID NO: 382576 - DNA, 20 bp, Artificial
  CRISPR gRNA sequence
cagacattcaataaacattt

SEQ ID NO: 382577 - DNA, 20 bp, Artificial
  CRISPR gRNA sequence
aaagagcggggaaatgggaa

SEQ ID NO: 382578 - DNA, 20 bp, Artificial
  CRISPR gRNA sequence
ttctgctattttcactgaaa

SEQ ID NO: 382579 - DNA, 20 bp, Artificial
  CRISPR gRNA sequence
acagaataatcagaccatgt

SEQ ID NO: 382580 - DNA, 20 bp, Artificial
  CRISPR gRNA sequence
ttcaaacactgtgtcagcac

SEQ ID NO: 382581 - DNA, 20 bp, Artificial
  CRISPR gRNA sequence
ttattaaatgtttgctcttt

SEQ ID NO: 382582 - DNA, 20 bp, Artificial
  CRISPR gRNA sequence
gaaacatttataggatttaa

SEQ ID NO: 382583 - DNA, 20 bp, Artificial
  CRISPR gRNA sequence
aagataataaagaggtattt

SEQ ID NO: 382584 - DNA, 20 bp, Artificial
  CRISPR gRNA sequence
ctagagcttccagtttgcaa

SEQ ID NO: 382585 - DNA, 20 bp, Artificial
  CRISPR gRNA sequence
aatatcggtgttggtagcat

SEQ ID NO: 382586 - DNA, 20 bp, Artificial
  CRISPR gRNA sequence
tagaattttatgtagctggc

SEQ ID NO: 382587 - DNA, 20 bp, Artificial
  CRISPR gRNA sequence
taagagcctgtctgctaaaa

SEQ ID NO: 382588 - DNA, 20 bp, Artificial
  CRISPR gRNA sequence
aatggtgcagctaaatgctc

SEQ ID NO: 382589 - DNA, 20 bp, Artificial
  CRISPR gRNA sequence
tttcaaaatcttaaatgtct

SEQ ID NO: 382590 - DNA, 20 bp, Artificial
  CRISPR gRNA sequence
tcctaccattttctccacgg

SEQ ID NO: 382591 - DNA, 20 bp, Artificial
  CRISPR gRNA sequence
ccagcaacaaaaaccataac

SEQ ID NO: 382592 - DNA, 20 bp, Artificial
  CRISPR gRNA sequence
tgtagtttccagctatactc

SEQ ID NO: 382593 - DNA, 20 bp, Artificial
  CRISPR gRNA sequence
cagaatgttctgaggtcaca

SEQ ID NO: 382594 - DNA, 20 bp, Artificial
  CRISPR gRNA sequence
aaaggaggtgaaggaggtag

SEQ ID NO: 382595 - DNA, 20 bp, Artificial
  CRISPR gRNA sequence
atgacttatttctaatctca

SEQ ID NO: 382596 - DNA, 20 bp, Artificial
  CRISPR gRNA sequence
tcttatttctccatctgact

SEQ ID NO: 382597 - DNA, 20 bp, Artificial
  CRISPR gRNA sequence
aattggtgacccttataaca

SEQ ID NO: 382598 - DNA, 20 bp, Artificial
  CRISPR gRNA sequence
tgacccttataacaggagaa

SEQ ID NO: 382599 - DNA, 20 bp, Artificial
  CRISPR gRNA sequence
gttacactggagcctactat

SEQ ID NO: 382600 - DNA, 20 bp, Artificial
  CRISPR gRNA sequence
gctgagattataccccagca

SEQ ID NO: 382601 - DNA, 20 bp, Artificial
  CRISPR gRNA sequence
tatataggccagcatgatct

SEQ ID NO: 382602 - DNA, 20 bp, Artificial
  CRISPR gRNA sequence
cactaaccagcagatatata

SEQ ID NO: 382603 - DNA, 20 bp, Artificial
  CRISPR gRNA sequence
agcagatatatacaagaatg

SEQ ID NO: 382604 - DNA, 20 bp, Artificial
  CRISPR gRNA sequence
gtgtagagataagagccttc

SEQ ID NO: 382605 - DNA, 20 bp, Artificial
  CRISPR gRNA sequence
ggagcctcatcccacctggg

SEQ ID NO: 382606 - DNA, 20 bp, Artificial
  CRISPR gRNA sequence
aagtacctgcatgtgtggag

SEQ ID NO: 382607 - DNA, 20 bp, Artificial
  CRISPR gRNA sequence
tacctggcccccaggccata

SEQ ID NO: 382608 - DNA, 20 bp, Artificial
  CRISPR gRNA sequence
aatcacatctcttttcacca

SEQ ID NO: 382609 - DNA, 20 bp, Artificial
  CRISPR gRNA sequence
gactctgtctcaaaaaagga

SEQ ID NO: 382610 - DNA, 20 bp, Artificial
  CRISPR gRNA sequence
gtctcaaaaaaggaaaagaa

SEQ ID NO: 382611 - DNA, 20 bp, Artificial
  CRISPR gRNA sequence
aaaagaaatcagtagatttg

SEQ ID NO: 382612 - DNA, 20 bp, Artificial
  CRISPR gRNA sequence
tgcatatttctaaaaccttt

SEQ ID NO: 382613 - DNA, 20 bp, Artificial
  CRISPR gRNA sequence
actcttggataccaaacaga

SEQ ID NO: 382614 - DNA, 20 bp, Artificial
  CRISPR gRNA sequence
cctccccacccatactgaac

SEQ ID NO: 382615 - DNA, 20 bp, Artificial
  CRISPR gRNA sequence
gtgggaaatttgggaacttc

SEQ ID NO: 382616 - DNA, 20 bp, Artificial
  CRISPR gRNA sequence
ataatttagggtatctggca

SEQ ID NO: 382617 - DNA, 20 bp, Artificial
  CRISPR gRNA sequence
atttgcagcctgatgatgcg

SEQ ID NO: 382618 - DNA, 20 bp, Artificial
  CRISPR gRNA sequence
cagcctgatgatgcgacaga

SEQ ID NO: 382619 - DNA, 20 bp, Artificial
  CRISPR gRNA sequence
aaaagaaaaacattttctgg

SEQ ID NO: 382620 - DNA, 20 bp, Artificial
  CRISPR gRNA sequence
ggaagaaattccagccagct

SEQ ID NO: 382621 - DNA, 20 bp, Artificial
  CRISPR gRNA sequence
tgagaacctctgcctagact

SEQ ID NO: 382622 - DNA, 20 bp, Artificial
  CRISPR gRNA sequence
gcctagacttcagaaaatgt

SEQ ID NO: 382623 - DNA, 20 bp, Artificial
  CRISPR gRNA sequence
tgtggggttggagcccccac

SEQ ID NO: 382624 - DNA, 20 bp, Artificial
  CRISPR gRNA sequence
ttttggccaatttctctcat

SEQ ID NO: 382625 - DNA, 20 bp, Artificial
  CRISPR gRNA sequence
agtatttcttcacagcagtg

SEQ ID NO: 382626 - DNA, 20 bp, Artificial
  CRISPR gRNA sequence
gtgtaatcttttaggtggtg

SEQ ID NO: 382627 - DNA, 20 bp, Artificial
  CRISPR gRNA sequence
ctgcaactcctttttcaagc

SEQ ID NO: 382628 - DNA, 20 bp, Artificial
  CRISPR gRNA sequence
gagttaagatctctggctct

SEQ ID NO: 382629 - DNA, 20 bp, Artificial
  CRISPR gRNA sequence
ccatgacctcacaaactctg

SEQ ID NO: 382630 - DNA, 20 bp, Artificial
  CRISPR gRNA sequence
tctctaaatcaattgctaat

SEQ ID NO: 382631 - DNA, 20 bp, Artificial
  CRISPR gRNA sequence
gtattagtagtaccatttat

SEQ ID NO: 382632 - DNA, 20 bp, Artificial
  CRISPR gRNA sequence
tatgttgttactgaagtaca

SEQ ID NO: 382633 - DNA, 20 bp, Artificial
  CRISPR gRNA sequence
tctcaaactctcaaaatagg

SEQ ID NO: 382634 - DNA, 20 bp, Artificial
  CRISPR gRNA sequence
atggctaaggataccatcat

SEQ ID NO: 382635 - DNA, 20 bp, Artificial
  CRISPR gRNA sequence
tttcaattggttgtcctgtg

SEQ ID NO: 382636 - DNA, 20 bp, Artificial
  CRISPR gRNA sequence
taataaataaacatttaact

SEQ ID NO: 382637 - DNA, 20 bp, Artificial
  CRISPR gRNA sequence
ttcaccctagctacacctaa

SEQ ID NO: 382638 - DNA, 20 bp, Artificial
  CRISPR gRNA sequence
ataatttgagagacaccaca

SEQ ID NO: 382639 - DNA, 20 bp, Artificial
  CRISPR gRNA sequence
gtccctcagccattcaacaa

SEQ ID NO: 382640 - DNA, 20 bp, Artificial
  CRISPR gRNA sequence
accagttcatgtagtcatca

SEQ ID NO: 382641 - DNA, 20 bp, Artificial
  CRISPR gRNA sequence
caccacagctcacaatttat

SEQ ID NO: 382642 - DNA, 20 bp, Artificial
  CRISPR gRNA sequence
ccaagactgggcaatttaca

SEQ ID NO: 382643 - DNA, 20 bp, Artificial
  CRISPR gRNA sequence
ctacttgcggggctgaggta

SEQ ID NO: 382644 - DNA, 20 bp, Artificial
  CRISPR gRNA sequence
aaaaaaaaaaaaagaaggaa

SEQ ID NO: 382645 - DNA, 20 bp, Artificial
  CRISPR gRNA sequence
aaaaaaaaagaaggaagaag

SEQ ID NO: 382646 - DNA, 20 bp, Artificial
  CRISPR gRNA sequence
gaagaagaaagaaagacagg

SEQ ID NO: 382647 - DNA, 20 bp, Artificial
  CRISPR gRNA sequence
agaaagacaggaaagaaagg

SEQ ID NO: 382648 - DNA, 20 bp, Artificial
  CRISPR gRNA sequence
gacaggaaagaaaggaaaga

SEQ ID NO: 382649 - DNA, 20 bp, Artificial
  CRISPR gRNA sequence
ggaaagaaaggaaagaaaag

SEQ ID NO: 382650 - DNA, 20 bp, Artificial
  CRISPR gRNA sequence
gaaaagaaagaaagagagag

SEQ ID NO: 382651 - DNA, 20 bp, Artificial
  CRISPR gRNA sequence
agaaagaaagagagagagag

SEQ ID NO: 382652 - DNA, 20 bp, Artificial
  CRISPR gRNA sequence
agaaagagagagagagaaag

SEQ ID NO: 382653 - DNA, 20 bp, Artificial
  CRISPR gRNA sequence
agagagagagaaagaaagaa

SEQ ID NO: 382654 - DNA, 20 bp, Artificial
  CRISPR gRNA sequence
agagaaagaaagaaagagaa

SEQ ID NO: 382655 - DNA, 20 bp, Artificial
  CRISPR gRNA sequence
aaagaaagaaagagaaaaag

SEQ ID NO: 382656 - DNA, 20 bp, Artificial
  CRISPR gRNA sequence
aaagaaagagaaaaagaaag

SEQ ID NO: 382657 - DNA, 20 bp, Artificial
  CRISPR gRNA sequence
actcggacacaacagcacag

SEQ ID NO: 382658 - DNA, 20 bp, Artificial
  CRISPR gRNA sequence
aagcagtaacatcaaagcat

SEQ ID NO: 382659 - DNA, 20 bp, Artificial
  CRISPR gRNA sequence
aagcatctagaaatggaatt

SEQ ID NO: 382660 - DNA, 20 bp, Artificial
  CRISPR gRNA sequence
aaatggaattggagaatgcc

SEQ ID NO: 382661 - DNA, 20 bp, Artificial
  CRISPR gRNA sequence
atagcttctacttgggcttt

SEQ ID NO: 382662 - DNA, 20 bp, Artificial
  CRISPR gRNA sequence
tcatcttcagaggcattccg

SEQ ID NO: 382663 - DNA, 20 bp, Artificial
  CRISPR gRNA sequence
ttttagtttttctgaacaag

SEQ ID NO: 382664 - DNA, 20 bp, Artificial
  CRISPR gRNA sequence
ttacattctatgtggaggag

SEQ ID NO: 382665 - DNA, 20 bp, Artificial
  CRISPR gRNA sequence
aaaaattgggaaaagtagga

SEQ ID NO: 382666 - DNA, 20 bp, Artificial
  CRISPR gRNA sequence
tagattgtggaaaaggtttt

SEQ ID NO: 382667 - DNA, 20 bp, Artificial
  CRISPR gRNA sequence
aaggaactgaaacgtagcaa

SEQ ID NO: 382668 - DNA, 20 bp, Artificial
  CRISPR gRNA sequence
ggagccgccgaggagctgat

SEQ ID NO: 382669 - DNA, 20 bp, Artificial
  CRISPR gRNA sequence
aaggacatggaagacctcca

SEQ ID NO: 382670 - DNA, 20 bp, Artificial
  CRISPR gRNA sequence
tgccgggctaaaccaagtcc

SEQ ID NO: 382671 - DNA, 20 bp, Artificial
  CRISPR gRNA sequence
aacataccacctgctctttt

SEQ ID NO: 382672 - DNA, 20 bp, Artificial
  CRISPR gRNA sequence
gcaacacacacaggcatggg

SEQ ID NO: 382673 - DNA, 20 bp, Artificial
  CRISPR gRNA sequence
tacattgaggggagatggaa

SEQ ID NO: 382674 - DNA, 20 bp, Artificial
  CRISPR gRNA sequence
cgattggagattgttaagca

SEQ ID NO: 382675 - DNA, 20 bp, Artificial
  CRISPR gRNA sequence
atataatcagatttcaatta

SEQ ID NO: 382676 - DNA, 20 bp, Artificial
  CRISPR gRNA sequence
gaagttattcacattccatg

SEQ ID NO: 382677 - DNA, 20 bp, Artificial
  CRISPR gRNA sequence
ctcctctcattatgcatgaa

SEQ ID NO: 382678 - DNA, 20 bp, Artificial
  CRISPR gRNA sequence
aaacagggtggtagagagag

SEQ ID NO: 382679 - DNA, 20 bp, Artificial
  CRISPR gRNA sequence
ctgaagtctgaacatattac

SEQ ID NO: 382680 - DNA, 20 bp, Artificial
  CRISPR gRNA sequence
gccaaaatggtattaaaaaa

SEQ ID NO: 382681 - DNA, 20 bp, Artificial
  CRISPR gRNA sequence
agttcctcaaagaactaaaa

SEQ ID NO: 382682 - DNA, 20 bp, Artificial
  CRISPR gRNA sequence
cagggtatctacccaaagga

SEQ ID NO: 382683 - DNA, 20 bp, Artificial
  CRISPR gRNA sequence
ccatcaatgaagggttagat

SEQ ID NO: 382684 - DNA, 20 bp, Artificial
  CRISPR gRNA sequence
ggaatactacacagccctaa

SEQ ID NO: 382685 - DNA, 20 bp, Artificial
  CRISPR gRNA sequence
ttaaatgaaacaactcagac

SEQ ID NO: 382686 - DNA, 20 bp, Artificial
  CRISPR gRNA sequence
taatggacactggagacttg

SEQ ID NO: 382687 - DNA, 20 bp, Artificial
  CRISPR gRNA sequence
agacttggaagaatgggaga

SEQ ID NO: 382688 - DNA, 20 bp, Artificial
  CRISPR gRNA sequence
agagtagaaaggggtgaggg

SEQ ID NO: 382689 - DNA, 20 bp, Artificial
  CRISPR gRNA sequence
gccaaccccactgagtgggg

SEQ ID NO: 382690 - DNA, 20 bp, Artificial
  CRISPR gRNA sequence
taaatataagacctcagact

SEQ ID NO: 382691 - DNA, 20 bp, Artificial
  CRISPR gRNA sequence
gacctcagactgtagaaatc

SEQ ID NO: 382692 - DNA, 20 bp, Artificial
  CRISPR gRNA sequence
cagcaaacctatgggcaaca

SEQ ID NO: 382693 - DNA, 20 bp, Artificial
  CRISPR gRNA sequence
tgtgcatcaaaggacatttt

SEQ ID NO: 382694 - DNA, 20 bp, Artificial
  CRISPR gRNA sequence
agaaagtgaaaagtcaccct

SEQ ID NO: 382695 - DNA, 20 bp, Artificial
  CRISPR gRNA sequence
aactctcacactttaacata

SEQ ID NO: 382696 - DNA, 20 bp, Artificial
  CRISPR gRNA sequence
taggatggacataatcaaaa

SEQ ID NO: 382697 - DNA, 20 bp, Artificial
  CRISPR gRNA sequence
taatatgttagggaaaatgt

SEQ ID NO: 382698 - DNA, 20 bp, Artificial
  CRISPR gRNA sequence
tactgttgcacaagcgttgt

SEQ ID NO: 382699 - DNA, 20 bp, Artificial
  CRISPR gRNA sequence
tattcctaggtatatactca

SEQ ID NO: 382700 - DNA, 20 bp, Artificial
  CRISPR gRNA sequence
tgataacattatgctaagtc

SEQ ID NO: 382701 - DNA, 20 bp, Artificial
  CRISPR gRNA sequence
attatgctaagtcaaagaat

SEQ ID NO: 382702 - DNA, 20 bp, Artificial
  CRISPR gRNA sequence
aaacaaaaggccacattttg

SEQ ID NO: 382703 - DNA, 20 bp, Artificial
  CRISPR gRNA sequence
ctacttgggaggctgagaca

SEQ ID NO: 382704 - DNA, 20 bp, Artificial
  CRISPR gRNA sequence
caaagatgccaagtacattc

SEQ ID NO: 382705 - DNA, 20 bp, Artificial
  CRISPR gRNA sequence
tgaacttcctcacccaggat

SEQ ID NO: 382706 - DNA, 20 bp, Artificial
  CRISPR gRNA sequence
cacagattcgaatgaaaggg

SEQ ID NO: 382707 - DNA, 20 bp, Artificial
  CRISPR gRNA sequence
aaacacctgatgtgtgtgat

SEQ ID NO: 382708 - DNA, 20 bp, Artificial
  CRISPR gRNA sequence
tggaaagcagaggactgtga

SEQ ID NO: 382709 - DNA, 20 bp, Artificial
  CRISPR gRNA sequence
ctactcaggaggctgaggca

SEQ ID NO: 382710 - DNA, 20 bp, Artificial
  CRISPR gRNA sequence
tattaactatctggcccttt

SEQ ID NO: 382711 - DNA, 20 bp, Artificial
  CRISPR gRNA sequence
atacaattctagagacagac

SEQ ID NO: 382712 - DNA, 20 bp, Artificial
  CRISPR gRNA sequence
ttctgtccctcttttccccc

SEQ ID NO: 382713 - DNA, 20 bp, Artificial
  CRISPR gRNA sequence
ctcctttgttctagctctaa

SEQ ID NO: 382714 - DNA, 20 bp, Artificial
  CRISPR gRNA sequence
ttggcaggaaaaaacacgag

SEQ ID NO: 382715 - DNA, 20 bp, Artificial
  CRISPR gRNA sequence
aaacacgaggaagaaaaggc

SEQ ID NO: 382716 - DNA, 20 bp, Artificial
  CRISPR gRNA sequence
tctcaaggttagtaaccttc

SEQ ID NO: 382717 - DNA, 20 bp, Artificial
  CRISPR gRNA sequence
tactttttctcagtctgtct

SEQ ID NO: 382718 - DNA, 20 bp, Artificial
  CRISPR gRNA sequence
agatctgatcgtaaagttct

SEQ ID NO: 382719 - DNA, 20 bp, Artificial
  CRISPR gRNA sequence
gatcgtaaagttcttgagaa

SEQ ID NO: 382720 - DNA, 20 bp, Artificial
  CRISPR gRNA sequence
gagattatttgaggaaggga

SEQ ID NO: 382721 - DNA, 20 bp, Artificial
  CRISPR gRNA sequence
taggagactcctcccaatgc

SEQ ID NO: 382722 - DNA, 20 bp, Artificial
  CRISPR gRNA sequence
agcaggacatattgtaggta

SEQ ID NO: 382723 - DNA, 20 bp, Artificial
  CRISPR gRNA sequence
gctgagacatttttaatagt

SEQ ID NO: 382724 - DNA, 20 bp, Artificial
  CRISPR gRNA sequence
cttttatacagacagctcta

SEQ ID NO: 382725 - DNA, 20 bp, Artificial
  CRISPR gRNA sequence
agttcactttgggcctgatc

SEQ ID NO: 382726 - DNA, 20 bp, Artificial
  CRISPR gRNA sequence
acccaaccctgacccctccc

SEQ ID NO: 382727 - DNA, 20 bp, Artificial
  CRISPR gRNA sequence
tatgctaatgtactgtattc

SEQ ID NO: 382728 - DNA, 20 bp, Artificial
  CRISPR gRNA sequence
caaaacattttcatcatttt

SEQ ID NO: 382729 - DNA, 20 bp, Artificial
  CRISPR gRNA sequence
gtaatcctgttgaacgtttt

SEQ ID NO: 382730 - DNA, 20 bp, Artificial
  CRISPR gRNA sequence
gataatgttgagcatctttt

SEQ ID NO: 382731 - DNA, 20 bp, Artificial
  CRISPR gRNA sequence
cataggtttgctgtcatgtc

SEQ ID NO: 382732 - DNA, 20 bp, Artificial
  CRISPR gRNA sequence
cataatgagaggagataaag

SEQ ID NO: 382733 - DNA, 20 bp, Artificial
  CRISPR gRNA sequence
tagaaacaaggatggagaga

SEQ ID NO: 382734 - DNA, 20 bp, Artificial
  CRISPR gRNA sequence
ttaacaatctccaatcgctc

SEQ ID NO: 382735 - DNA, 20 bp, Artificial
  CRISPR gRNA sequence
attgtgtgtgtgagagagtg

SEQ ID NO: 382736 - DNA, 20 bp, Artificial
  CRISPR gRNA sequence
aaaaccttttccacaatcta

SEQ ID NO: 382737 - DNA, 20 bp, Artificial
  CRISPR gRNA sequence
tatcatagatgtgaaaactt

SEQ ID NO: 382738 - DNA, 20 bp, Artificial
  CRISPR gRNA sequence
attgttgattttatgttccc

SEQ ID NO: 382739 - DNA, 20 bp, Artificial
  CRISPR gRNA sequence
atatgttcctaacaagttct

SEQ ID NO: 382740 - DNA, 20 bp, Artificial
  CRISPR gRNA sequence
acttgtacctaacaagttct

SEQ ID NO: 382741 - DNA, 20 bp, Artificial
  CRISPR gRNA sequence
attggaacttgtattttata

SEQ ID NO: 382742 - DNA, 20 bp, Artificial
  CRISPR gRNA sequence
ttagtttctgcctcctccac

SEQ ID NO: 382743 - DNA, 20 bp, Artificial
  CRISPR gRNA sequence
cctacagctgagttaggcac

SEQ ID NO: 382744 - DNA, 20 bp, Artificial
  CRISPR gRNA sequence
tgttgaatgaatgactcctt

SEQ ID NO: 382745 - DNA, 20 bp, Artificial
  CRISPR gRNA sequence
ccgactggttccccgagaga

SEQ ID NO: 382746 - DNA, 20 bp, Artificial
  CRISPR gRNA sequence
ctttttcctgtgttcatact

SEQ ID NO: 382747 - DNA, 20 bp, Artificial
  CRISPR gRNA sequence
gtttgtacagtgtggcatat

SEQ ID NO: 382748 - DNA, 20 bp, Artificial
  CRISPR gRNA sequence
taggataatttctcacttgt

SEQ ID NO: 382749 - DNA, 20 bp, Artificial
  CRISPR gRNA sequence
ggacgcctttttagacaaag

SEQ ID NO: 382750 - DNA, 20 bp, Artificial
  CRISPR gRNA sequence
cctttgccgagaacatgtct

SEQ ID NO: 382751 - DNA, 20 bp, Artificial
  CRISPR gRNA sequence
ataaagcccaagtagaagct

SEQ ID NO: 382752 - DNA, 20 bp, Artificial
  CRISPR gRNA sequence
tttcaaatttgaatgtagta

SEQ ID NO: 382753 - DNA, 20 bp, Artificial
  CRISPR gRNA sequence
ataaattgtgagctgtggtg

SEQ ID NO: 382754 - DNA, 20 bp, Artificial
  CRISPR gRNA sequence
gaacttggtccatggtagtc

SEQ ID NO: 382755 - DNA, 20 bp, Artificial
  CRISPR gRNA sequence
tgtgctctaaaagaacaagt

SEQ ID NO: 382756 - DNA, 20 bp, Artificial
  CRISPR gRNA sequence
aatatcaaatggtcaggaga

SEQ ID NO: 382757 - DNA, 20 bp, Artificial
  CRISPR gRNA sequence
agagcttcacttttttaaac

SEQ ID NO: 382758 - DNA, 20 bp, Artificial
  CRISPR gRNA sequence
aaaaaaaaaagacttggaat

SEQ ID NO: 382759 - DNA, 20 bp, Artificial
  CRISPR gRNA sequence
tgatttagagactctgatgg

SEQ ID NO: 382760 - DNA, 20 bp, Artificial
  CRISPR gRNA sequence
atttgtttttacctagtttg

SEQ ID NO: 382761 - DNA, 20 bp, Artificial
  CRISPR gRNA sequence
agcagagtttgtgaggtcat

SEQ ID NO: 382762 - DNA, 20 bp, Artificial
  CRISPR gRNA sequence
aagcaaatatagttgcattt

SEQ ID NO: 382763 - DNA, 20 bp, Artificial
  CRISPR gRNA sequence
ccccaaaatgagtgacccac

SEQ ID NO: 382764 - DNA, 20 bp, Artificial
  CRISPR gRNA sequence
caagctgccaagtggcagca

SEQ ID NO: 382765 - DNA, 20 bp, Artificial
  CRISPR gRNA sequence
gaaccagggagggccatggt

SEQ ID NO: 382766 - DNA, 20 bp, Artificial
  CRISPR gRNA sequence
gaaaagtcgtgctggacctt

SEQ ID NO: 382767 - DNA, 20 bp, Artificial
  CRISPR gRNA sequence
agttgcagctcactagggca

SEQ ID NO: 382768 - DNA, 20 bp, Artificial
  CRISPR gRNA sequence
ctcactagggcagcagaatg

SEQ ID NO: 382769 - DNA, 20 bp, Artificial
  CRISPR gRNA sequence
tattttagtcaggcttctcc

SEQ ID NO: 382770 - DNA, 20 bp, Artificial
  CRISPR gRNA sequence
atatacatggagatttatta

SEQ ID NO: 382771 - DNA, 20 bp, Artificial
  CRISPR gRNA sequence
gtctattctcacactgctgt

SEQ ID NO: 382772 - DNA, 20 bp, Artificial
  CRISPR gRNA sequence
tataaaaccatcagattttg

SEQ ID NO: 382773 - DNA, 20 bp, Artificial
  CRISPR gRNA sequence
aaatacaccaattctaaatg

SEQ ID NO: 382774 - DNA, 20 bp, Artificial
  CRISPR gRNA sequence
cagctggctggaatttcttc

SEQ ID NO: 382775 - DNA, 20 bp, Artificial
  CRISPR gRNA sequence
tgaagcccaggtcatctgct

SEQ ID NO: 382776 - DNA, 20 bp, Artificial
  CRISPR gRNA sequence
agctcatgaactttgtgttg

SEQ ID NO: 382777 - DNA, 20 bp, Artificial
  CRISPR gRNA sequence
gttccttttctttaaaggtt

SEQ ID NO: 382778 - DNA, 20 bp, Artificial
  CRISPR gRNA sequence
tacaaacgtggtaaaactat

SEQ ID NO: 382779 - DNA, 20 bp, Artificial
  CRISPR gRNA sequence
actataaagaaaagcaaagt

SEQ ID NO: 382780 - DNA, 20 bp, Artificial
  CRISPR gRNA sequence
agaaacatggtaggtggggg

SEQ ID NO: 382781 - DNA, 20 bp, Artificial
  CRISPR gRNA sequence
catggtaggtgggggataga

SEQ ID NO: 382782 - DNA, 20 bp, Artificial
  CRISPR gRNA sequence
tgtggatggatggggttaac

SEQ ID NO: 382783 - DNA, 20 bp, Artificial
  CRISPR gRNA sequence
ttaaagaaggtgttcatgtt

SEQ ID NO: 382784 - DNA, 20 bp, Artificial
  CRISPR gRNA sequence
ttaaagaatgtagagggcat

SEQ ID NO: 382785 - DNA, 20 bp, Artificial
  CRISPR gRNA sequence
ttcctttaatattaagggct

SEQ ID NO: 382786 - DNA, 20 bp, Artificial
  CRISPR gRNA sequence
ttcactcatcaagtctttcc

SEQ ID NO: 382787 - DNA, 20 bp, Artificial
  CRISPR gRNA sequence
aatgttcagtggtttggaag

SEQ ID NO: 382788 - DNA, 20 bp, Artificial
  CRISPR gRNA sequence
atcttagctctaaataggat

SEQ ID NO: 382789 - DNA, 20 bp, Artificial
  CRISPR gRNA sequence
aggatgtagaatattgggag

SEQ ID NO: 382790 - DNA, 20 bp, Artificial
  CRISPR gRNA sequence
gtggaatttgaactgccaac

SEQ ID NO: 382791 - DNA, 20 bp, Artificial
  CRISPR gRNA sequence
gattaataggcactattcca

SEQ ID NO: 382792 - DNA, 20 bp, Artificial
  CRISPR gRNA sequence
actattccaggagaattgct

SEQ ID NO: 382793 - DNA, 20 bp, Artificial
  CRISPR gRNA sequence
gaattgctttagaaaattat

SEQ ID NO: 382794 - DNA, 20 bp, Artificial
  CRISPR gRNA sequence
ctctaaaattgaaccaacac

SEQ ID NO: 382795 - DNA, 20 bp, Artificial
  CRISPR gRNA sequence
atcccaaattcagaaggaag

SEQ ID NO: 382796 - DNA, 20 bp, Artificial
  CRISPR gRNA sequence
aacaaggttaagaaggccac

SEQ ID NO: 382797 - DNA, 20 bp, Artificial
  CRISPR gRNA sequence
ttaattttcttaagtcagat

SEQ ID NO: 382798 - DNA, 20 bp, Artificial
  CRISPR gRNA sequence
tcttaagtcagatggagaaa

SEQ ID NO: 382799 - DNA, 20 bp, Artificial
  CRISPR gRNA sequence
tcattccaagtcaactgatt

SEQ ID NO: 382800 - DNA, 20 bp, Artificial
  CRISPR gRNA sequence
tcaggcccattctggtgaga

SEQ ID NO: 382801 - DNA, 20 bp, Artificial
  CRISPR gRNA sequence
attttagcagtttttcattt

SEQ ID NO: 382802 - DNA, 20 bp, Artificial
  CRISPR gRNA sequence
aggaatccacaagggatgaa

SEQ ID NO: 382803 - DNA, 20 bp, Artificial
  CRISPR gRNA sequence
taaaaaacattttaagactc

SEQ ID NO: 382804 - DNA, 20 bp, Artificial
  CRISPR gRNA sequence
taatcaaaaatcaaaaaaaa

SEQ ID NO: 382805 - DNA, 20 bp, Artificial
  CRISPR gRNA sequence
gtatgcttggctgaattgat

SEQ ID NO: 382806 - DNA, 20 bp, Artificial
  CRISPR gRNA sequence
atgaggaatacatttcctct

SEQ ID NO: 382807 - DNA, 20 bp, Artificial
  CRISPR gRNA sequence
agatattcaaaagcaaacaa

SEQ ID NO: 382808 - DNA, 20 bp, Artificial
  CRISPR gRNA sequence
caaaaagaaaataagtaact

SEQ ID NO: 382809 - DNA, 20 bp, Artificial
  CRISPR gRNA sequence
atagggagaggaggttgcag

SEQ ID NO: 382810 - DNA, 20 bp, Artificial
  CRISPR gRNA sequence
gaatggctttttctttccgt

SEQ ID NO: 382811 - DNA, 20 bp, Artificial
  CRISPR gRNA sequence
atttaagattttgaaactgt

SEQ ID NO: 382812 - DNA, 20 bp, Artificial
  CRISPR gRNA sequence
caatccaataactcttaatg

SEQ ID NO: 382813 - DNA, 20 bp, Artificial
  CRISPR gRNA sequence
cttctttgtaatctgcctcg

SEQ ID NO: 382814 - DNA, 20 bp, Artificial
  CRISPR gRNA sequence
gagagaaagagccatgtttc

SEQ ID NO: 382815 - DNA, 20 bp, Artificial
  CRISPR gRNA sequence
acagtggtgaccgtggccaa

SEQ ID NO: 382816 - DNA, 20 bp, Artificial
  CRISPR gRNA sequence
ttagctgcaccatttaatga

SEQ ID NO: 382817 - DNA, 20 bp, Artificial
  CRISPR gRNA sequence
ccatttaatgagcagaatcc

SEQ ID NO: 382818 - DNA, 20 bp, Artificial
  CRISPR gRNA sequence
tgctaccaacaccgatattt

SEQ ID NO: 382819 - DNA, 20 bp, Artificial
  CRISPR gRNA sequence
gaatgtatacctttttcatg

SEQ ID NO: 382820 - DNA, 20 bp, Artificial
  CRISPR gRNA sequence
ttttcatgtgagaaacagcc

SEQ ID NO: 382821 - DNA, 20 bp, Artificial
  CRISPR gRNA sequence
aatacctctttattatcttt

SEQ ID NO: 382822 - DNA, 20 bp, Artificial
  CRISPR gRNA sequence
gttgctcatttaagtgaaat

SEQ ID NO: 382823 - DNA, 20 bp, Artificial
  CRISPR gRNA sequence
ttctgttttcagtgaaaata

SEQ ID NO: 382824 - DNA, 20 bp, Artificial
  CRISPR gRNA sequence
attattgtttgctgtgagga

SEQ ID NO: 382825 - DNA, 20 bp, Artificial
  CRISPR gRNA sequence
ttgtttgctgtgaggaaaag

SEQ ID NO: 382826 - DNA, 20 bp, Artificial
  CRISPR gRNA sequence
tcaaacaggaaagtgcatca

SEQ ID NO: 382827 - DNA, 20 bp, Artificial
  CRISPR gRNA sequence
gatgatgtagaggtaggaag

SEQ ID NO: 382828 - DNA, 20 bp, Artificial
  CRISPR gRNA sequence
ataggagacacgaaaacagg

SEQ ID NO: 382829 - DNA, 20 bp, Artificial
  CRISPR gRNA sequence
tgtgaggttggaggcataca

SEQ ID NO: 382830 - DNA, 20 bp, Artificial
  CRISPR gRNA sequence
gaggggtggatagtggtgat

SEQ ID NO: 382831 - DNA, 20 bp, Artificial
  CRISPR gRNA sequence
ggatttcgattagtctgcag

SEQ ID NO: 382832 - DNA, 20 bp, Artificial
  CRISPR gRNA sequence
gaagagagattggaagtaag

SEQ ID NO: 382833 - DNA, 20 bp, Artificial
  CRISPR gRNA sequence
aatagaggaaagacaagtca

SEQ ID NO: 382834 - DNA, 20 bp, Artificial
  CRISPR gRNA sequence
gaattttgggtttctagcct

SEQ ID NO: 382835 - DNA, 20 bp, Artificial
  CRISPR gRNA sequence
taagtcagacaagcgatgaa

SEQ ID NO: 382836 - DNA, 20 bp, Artificial
  CRISPR gRNA sequence
acaactgccagagctttggc

SEQ ID NO: 382837 - DNA, 20 bp, Artificial
  CRISPR gRNA sequence
tgcacacacctccatctttc

SEQ ID NO: 382838 - DNA, 20 bp, Artificial
  CRISPR gRNA sequence
ttgtctttgtgatagtttgc

SEQ ID NO: 382839 - DNA, 20 bp, Artificial
  CRISPR gRNA sequence
agagacacacagagacagag

SEQ ID NO: 382840 - DNA, 20 bp, Artificial
  CRISPR gRNA sequence
acagagacagagagagaaat

SEQ ID NO: 382841 - DNA, 20 bp, Artificial
  CRISPR gRNA sequence
tattcgatgttgcgtgtgaa

SEQ ID NO: 382842 - DNA, 20 bp, Artificial
  CRISPR gRNA sequence
gctgtcattgactgcatcag

SEQ ID NO: 382843 - DNA, 20 bp, Artificial
  CRISPR gRNA sequence
atagactatggagcatatag

SEQ ID NO: 382844 - DNA, 20 bp, Artificial
  CRISPR gRNA sequence
aaatgatgttacaagtacat

SEQ ID NO: 382845 - DNA, 20 bp, Artificial
  CRISPR gRNA sequence
accaacacatttttggaaga

SEQ ID NO: 382846 - DNA, 20 bp, Artificial
  CRISPR gRNA sequence
tgtaaatattccaaaatcca

SEQ ID NO: 382847 - DNA, 20 bp, Artificial
  CRISPR gRNA sequence
ggggtgaagtagggggagtg

SEQ ID NO: 382848 - DNA, 20 bp, Artificial
  CRISPR gRNA sequence
tgaattccatatgtaattaa

SEQ ID NO: 382849 - DNA, 20 bp, Artificial
  CRISPR gRNA sequence
gaggaataaatggacaaaat

SEQ ID NO: 382850 - DNA, 20 bp, Artificial
  CRISPR gRNA sequence
atataaaatgtatgtaacat

SEQ ID NO: 382851 - DNA, 20 bp, Artificial
  CRISPR gRNA sequence
gaggagtcaaattcattgat

SEQ ID NO: 382852 - DNA, 20 bp, Artificial
  CRISPR gRNA sequence
cactaatcacattcatgaaa

SEQ ID NO: 382853 - DNA, 20 bp, Artificial
  CRISPR gRNA sequence
attaggtttcaatatgaatt

SEQ ID NO: 382854 - DNA, 20 bp, Artificial
  CRISPR gRNA sequence
ttgttaacaattctttattt

SEQ ID NO: 382855 - DNA, 20 bp, Artificial
  CRISPR gRNA sequence
gagcttcagtttactcatgt

SEQ ID NO: 382856 - DNA, 20 bp, Artificial
  CRISPR gRNA sequence
attccctttccatgttccct

SEQ ID NO: 382857 - DNA, 20 bp, Artificial
  CRISPR gRNA sequence
taaagaagtaggagttagcc

SEQ ID NO: 382858 - DNA, 20 bp, Artificial
  CRISPR gRNA sequence
agcaagtgcaaaggtcccga

SEQ ID NO: 382859 - DNA, 20 bp, Artificial
  CRISPR gRNA sequence
agtaatatagtagggatgga

SEQ ID NO: 382860 - DNA, 20 bp, Artificial
  CRISPR gRNA sequence
ccagcaactgattggatgag

SEQ ID NO: 382861 - DNA, 20 bp, Artificial
  CRISPR gRNA sequence
tggttttggaatatctgtga

SEQ ID NO: 382862 - DNA, 20 bp, Artificial
  CRISPR gRNA sequence
ctatacttttacttttttaa

SEQ ID NO: 382863 - DNA, 20 bp, Artificial
  CRISPR gRNA sequence
ttttgactttgcctttctag

SEQ ID NO: 382864 - DNA, 20 bp, Artificial
  CRISPR gRNA sequence
tgtctgtagctttttcagag

SEQ ID NO: 382865 - DNA, 20 bp, Artificial
  CRISPR gRNA sequence
agtggctcacacctgtaatc

SEQ ID NO: 382866 - DNA, 20 bp, Artificial
  CRISPR gRNA sequence
taaatatttatgctttttag

SEQ ID NO: 382867 - DNA, 20 bp, Artificial
  CRISPR gRNA sequence
ttgccacatttctgatgctg

SEQ ID NO: 382868 - DNA, 20 bp, Artificial
  CRISPR gRNA sequence
cttgtttttaatttctacca

SEQ ID NO: 382869 - DNA, 20 bp, Artificial
  CRISPR gRNA sequence
taatttctaccaaaagaaac

SEQ ID NO: 382870 - DNA, 20 bp, Artificial
  CRISPR gRNA sequence
agtcagtagagcagtaagac

SEQ ID NO: 382871 - DNA, 20 bp, Artificial
  CRISPR gRNA sequence
agagcagtaagactaagaat

SEQ ID NO: 382872 - DNA, 20 bp, Artificial
  CRISPR gRNA sequence
atgatcagatttacatttgg

SEQ ID NO: 382873 - DNA, 20 bp, Artificial
  CRISPR gRNA sequence
acttttttgtataaaggatt

SEQ ID NO: 382874 - DNA, 20 bp, Artificial
  CRISPR gRNA sequence
ggcccaaataacaacatata

SEQ ID NO: 382875 - DNA, 20 bp, Artificial
  CRISPR gRNA sequence
ttgtaagtactactgggtat

SEQ ID NO: 382876 - DNA, 20 bp, Artificial
  CRISPR gRNA sequence
aagttttcttatataaaaat

SEQ ID NO: 382877 - DNA, 20 bp, Artificial
  CRISPR gRNA sequence
tctccttgccttcagttctt

SEQ ID NO: 382878 - DNA, 20 bp, Artificial
  CRISPR gRNA sequence
gccttcagttctttcagaaa

SEQ ID NO: 382879 - DNA, 20 bp, Artificial
  CRISPR gRNA sequence
aaccagttcttggttatcct

SEQ ID NO: 382880 - DNA, 20 bp, Artificial
  CRISPR gRNA sequence
aggaaagctcaatggaagag

SEQ ID NO: 382881 - DNA, 20 bp, Artificial
  CRISPR gRNA sequence
atgtggtgagttggaggatc

SEQ ID NO: 382882 - DNA, 20 bp, Artificial
  CRISPR gRNA sequence
gtggaccagagctgacactt

SEQ ID NO: 382883 - DNA, 20 bp, Artificial
  CRISPR gRNA sequence
atgactacttctattaggcc

SEQ ID NO: 382884 - DNA, 20 bp, Artificial
  CRISPR gRNA sequence
cctggaggctttggggatac

SEQ ID NO: 382885 - DNA, 20 bp, Artificial
  CRISPR gRNA sequence
ctgtactatgtaatgtatat

SEQ ID NO: 382886 - DNA, 20 bp, Artificial
  CRISPR gRNA sequence
ggataccatgtcacaaaggt

SEQ ID NO: 382887 - DNA, 20 bp, Artificial
  CRISPR gRNA sequence
caaaggttcagaattcgtat

SEQ ID NO: 382888 - DNA, 20 bp, Artificial
  CRISPR gRNA sequence
ttgggtgctcatattgagta

SEQ ID NO: 382889 - DNA, 20 bp, Artificial
  CRISPR gRNA sequence
aaatggaagtcatccctaac

SEQ ID NO: 382890 - DNA, 20 bp, Artificial
  CRISPR gRNA sequence
tagtgagataaaagagccaa

SEQ ID NO: 382891 - DNA, 20 bp, Artificial
  CRISPR gRNA sequence
agaactaactgtaatctgga

SEQ ID NO: 382892 - DNA, 20 bp, Artificial
  CRISPR gRNA sequence
tgaaatgtgttcacctccat

SEQ ID NO: 382893 - DNA, 20 bp, Artificial
  CRISPR gRNA sequence
tcactttaaactgaacaaga

SEQ ID NO: 382894 - DNA, 20 bp, Artificial
  CRISPR gRNA sequence
actgaacaagagtagaattt

SEQ ID NO: 382895 - DNA, 20 bp, Artificial
  CRISPR gRNA sequence
caatttccttgagatttggc

SEQ ID NO: 382896 - DNA, 20 bp, Artificial
  CRISPR gRNA sequence
tttctgttttattgggagta

SEQ ID NO: 382897 - DNA, 20 bp, Artificial
  CRISPR gRNA sequence
tctttttccaatttacttca

SEQ ID NO: 382898 - DNA, 20 bp, Artificial
  CRISPR gRNA sequence
ggaactctgtagcccttcag

SEQ ID NO: 382899 - DNA, 20 bp, Artificial
  CRISPR gRNA sequence
ggtgtgatctgaaatattat

SEQ ID NO: 382900 - DNA, 20 bp, Artificial
  CRISPR gRNA sequence
ctgaaatattatatagaaag

SEQ ID NO: 382901 - DNA, 20 bp, Artificial
  CRISPR gRNA sequence
tcccccaactcattttgttt

SEQ ID NO: 382902 - DNA, 20 bp, Artificial
  CRISPR gRNA sequence
cagaaacctcattaagatca

SEQ ID NO: 382903 - DNA, 20 bp, Artificial
  CRISPR gRNA sequence
ttttccccttcacactttag

SEQ ID NO: 382904 - DNA, 20 bp, Artificial
  CRISPR gRNA sequence
tgctttaggcagtttttcat

SEQ ID NO: 382905 - DNA, 20 bp, Artificial
  CRISPR gRNA sequence
atttagaaaaaagcacatgt

SEQ ID NO: 382906 - DNA, 20 bp, Artificial
  CRISPR gRNA sequence
gacctgtccttttctcactc

SEQ ID NO: 382907 - DNA, 20 bp, Artificial
  CRISPR gRNA sequence
ggagtaccttattctagtta

SEQ ID NO: 382908 - DNA, 20 bp, Artificial
  CRISPR gRNA sequence
tcctaaagctgaggagagag

SEQ ID NO: 382909 - DNA, 20 bp, Artificial
  CRISPR gRNA sequence
aattttatgtccaaaaattt

SEQ ID NO: 382910 - DNA, 20 bp, Artificial
  CRISPR gRNA sequence
caaccattttatgtttaaat

SEQ ID NO: 382911 - DNA, 20 bp, Artificial
  CRISPR gRNA sequence
tatgtttaaatgaagaaatg

SEQ ID NO: 382912 - DNA, 20 bp, Artificial
  CRISPR gRNA sequence
gaacttaaagtataataaaa

SEQ ID NO: 382913 - DNA, 20 bp, Artificial
  CRISPR gRNA sequence
ttaaagtataataaaaaaag

SEQ ID NO: 382914 - DNA, 20 bp, Artificial
  CRISPR gRNA sequence
agaaacattttgaatagata

SEQ ID NO: 382915 - DNA, 20 bp, Artificial
  CRISPR gRNA sequence
caaaaagttaagtccacagc

SEQ ID NO: 382916 - DNA, 20 bp, Artificial
  CRISPR gRNA sequence
gagcatattctattttattt

SEQ ID NO: 382917 - DNA, 20 bp, Artificial
  CRISPR gRNA sequence
tattctattttattttgaga

SEQ ID NO: 382918 - DNA, 20 bp, Artificial
  CRISPR gRNA sequence
tctttattttaatcaagtga

SEQ ID NO: 382919 - DNA, 20 bp, Artificial
  CRISPR gRNA sequence
gagttgctttggattagagt

SEQ ID NO: 382920 - DNA, 20 bp, Artificial
  CRISPR gRNA sequence
ttggataaatgtcagcattt

SEQ ID NO: 382921 - DNA, 20 bp, Artificial
  CRISPR gRNA sequence
ggacctatctcaaggaagac

SEQ ID NO: 382922 - DNA, 20 bp, Artificial
  CRISPR gRNA sequence
cttctaataatctttaaatt

SEQ ID NO: 382923 - DNA, 20 bp, Artificial
  CRISPR gRNA sequence
tttagaatatttttagattt

SEQ ID NO: 382924 - DNA, 20 bp, Artificial
  CRISPR gRNA sequence
tgtggtatgtttgttaaacc

SEQ ID NO: 382925 - DNA, 20 bp, Artificial
  CRISPR gRNA sequence
ctgggaatatggaattttgg

SEQ ID NO: 382926 - DNA, 20 bp, Artificial
  CRISPR gRNA sequence
tcacagggctgcctccttct

SEQ ID NO: 382927 - DNA, 20 bp, Artificial
  CRISPR gRNA sequence
agagtatcaaaacaacattt

SEQ ID NO: 382928 - DNA, 20 bp, Artificial
  CRISPR gRNA sequence
cagaaattttaaaatgcata

SEQ ID NO: 382929 - DNA, 20 bp, Artificial
  CRISPR gRNA sequence
cttcacatatgtaatgcttt

SEQ ID NO: 382930 - DNA, 20 bp, Artificial
  CRISPR gRNA sequence
tcttctacctcagggagttg

SEQ ID NO: 382931 - DNA, 20 bp, Artificial
  CRISPR gRNA sequence
ttagcctattttgaaatgag

SEQ ID NO: 382932 - DNA, 20 bp, Artificial
  CRISPR gRNA sequence
tccttgaaataggtgatgtc

SEQ ID NO: 382933 - DNA, 20 bp, Artificial
  CRISPR gRNA sequence
tggcagattctagtaggaga

SEQ ID NO: 382934 - DNA, 20 bp, Artificial
  CRISPR gRNA sequence
gatgagaatggagacaaagg

SEQ ID NO: 382935 - DNA, 20 bp, Artificial
  CRISPR gRNA sequence
tttgaaacatggtggagtaa

SEQ ID NO: 382936 - DNA, 20 bp, Artificial
  CRISPR gRNA sequence
acaagaaacaaacaaatatt

SEQ ID NO: 382937 - DNA, 20 bp, Artificial
  CRISPR gRNA sequence
tccaaggagcttggcataac

SEQ ID NO: 382938 - DNA, 20 bp, Artificial
  CRISPR gRNA sequence
gagaaaagcaagacatagcc

SEQ ID NO: 382939 - DNA, 20 bp, Artificial
  CRISPR gRNA sequence
agcaagacatagccacagaa

SEQ ID NO: 382940 - DNA, 20 bp, Artificial
  CRISPR gRNA sequence
atacttaactttttttgtgg

SEQ ID NO: 382941 - DNA, 20 bp, Artificial
  CRISPR gRNA sequence
gaatatttgaaattcactct

SEQ ID NO: 382942 - DNA, 20 bp, Artificial
  CRISPR gRNA sequence
tgtgacggagctcaaaaaag

SEQ ID NO: 382943 - DNA, 20 bp, Artificial
  CRISPR gRNA sequence
ttactcgggaggctgaggca

SEQ ID NO: 382944 - DNA, 20 bp, Artificial
  CRISPR gRNA sequence
agctggggtgcttcaagaag

SEQ ID NO: 382945 - DNA, 20 bp, Artificial
  CRISPR gRNA sequence
gtctgaaactcgaagtcctc

SEQ ID NO: 382946 - DNA, 20 bp, Artificial
  CRISPR gRNA sequence
ccttgtgttctcctttccct

SEQ ID NO: 382947 - DNA, 20 bp, Artificial
  CRISPR gRNA sequence
ataggtcatgtcttttgcct

SEQ ID NO: 382948 - DNA, 20 bp, Artificial
  CRISPR gRNA sequence
tcttttgcctgcagaaattt

SEQ ID NO: 382949 - DNA, 20 bp, Artificial
  CRISPR gRNA sequence
gtgtgttttaaaacttagtt

SEQ ID NO: 382950 - DNA, 20 bp, Artificial
  CRISPR gRNA sequence
caaagccatctggaaatacc

SEQ ID NO: 382951 - DNA, 20 bp, Artificial
  CRISPR gRNA sequence
atactaaaatagtgacatgg

SEQ ID NO: 382952 - DNA, 20 bp, Artificial
  CRISPR gRNA sequence
aaatacccttgtgtttggtg

SEQ ID NO: 382953 - DNA, 20 bp, Artificial
  CRISPR gRNA sequence
gcattttaacaaggacaagt

SEQ ID NO: 382954 - DNA, 20 bp, Artificial
  CRISPR gRNA sequence
taattataagagttaaggca

SEQ ID NO: 382955 - DNA, 20 bp, Artificial
  CRISPR gRNA sequence
ctgccctgctgcagggtgga

SEQ ID NO: 382956 - DNA, 20 bp, Artificial
  CRISPR gRNA sequence
ccctagacgccctgcctagg

SEQ ID NO: 382957 - DNA, 20 bp, Artificial
  CRISPR gRNA sequence
ctaacaatctattctctagt

SEQ ID NO: 382958 - DNA, 20 bp, Artificial
  CRISPR gRNA sequence
ttctgttaaaaacctgccat

SEQ ID NO: 382959 - DNA, 20 bp, Artificial
  CRISPR gRNA sequence
caattggtaacattttagta

SEQ ID NO: 382960 - DNA, 20 bp, Artificial
  CRISPR gRNA sequence
gtcagtaatttttctggttg

SEQ ID NO: 382961 - DNA, 20 bp, Artificial
  CRISPR gRNA sequence
ttttctggttgagagaaact

SEQ ID NO: 382962 - DNA, 20 bp, Artificial
  CRISPR gRNA sequence
atctgcactttagatgaaag

SEQ ID NO: 382963 - DNA, 20 bp, Artificial
  CRISPR gRNA sequence
accaaaagctgggtaactta

SEQ ID NO: 382964 - DNA, 20 bp, Artificial
  CRISPR gRNA sequence
tgcttgtattcatgcctgtg

SEQ ID NO: 382965 - DNA, 20 bp, Artificial
  CRISPR gRNA sequence
tgggaacattgcagcttttt

SEQ ID NO: 382966 - DNA, 20 bp, Artificial
  CRISPR gRNA sequence
tgggtgactagtaagagttt

SEQ ID NO: 382967 - DNA, 20 bp, Artificial
  CRISPR gRNA sequence
acaagttatcgtctcgtgct

SEQ ID NO: 382968 - DNA, 20 bp, Artificial
  CRISPR gRNA sequence
ttttagggacaagcagaaga

SEQ ID NO: 382969 - DNA, 20 bp, Artificial
  CRISPR gRNA sequence
aaggagatagcagagggagg

SEQ ID NO: 382970 - DNA, 20 bp, Artificial
  CRISPR gRNA sequence
aattttgaatgaatagggaa

SEQ ID NO: 382971 - DNA, 20 bp, Artificial
  CRISPR gRNA sequence
aaagttggttttcaggaatg

SEQ ID NO: 382972 - DNA, 20 bp, Artificial
  CRISPR gRNA sequence
tgagagagagaacagtccac

SEQ ID NO: 382973 - DNA, 20 bp, Artificial
  CRISPR gRNA sequence
agtttcaaacatatacaaaa

SEQ ID NO: 382974 - DNA, 20 bp, Artificial
  CRISPR gRNA sequence
tcaaacatatacaaaaatag

SEQ ID NO: 382975 - DNA, 20 bp, Artificial
  CRISPR gRNA sequence
attttttcaagtgtttaaag

SEQ ID NO: 382976 - DNA, 20 bp, Artificial
  CRISPR gRNA sequence
agaaatacagttttatttta

SEQ ID NO: 382977 - DNA, 20 bp, Artificial
  CRISPR gRNA sequence
gcgtgagccaccgcgcccgg

SEQ ID NO: 382978 - DNA, 20 bp, Artificial
  CRISPR gRNA sequence
agagaagccacatacaaaat

SEQ ID NO: 382979 - DNA, 20 bp, Artificial
  CRISPR gRNA sequence
gcggcatccagagagaagaa

SEQ ID NO: 382980 - DNA, 20 bp, Artificial
  CRISPR gRNA sequence
ttggtaaacggttgtacaga

SEQ ID NO: 382981 - DNA, 20 bp, Artificial
  CRISPR gRNA sequence
tggcattagtgatgccatca

SEQ ID NO: 382982 - DNA, 20 bp, Artificial
  CRISPR gRNA sequence
ttgctgggttatcttaattt

SEQ ID NO: 382983 - DNA, 20 bp, Artificial
  CRISPR gRNA sequence
tatctgtcatgtttactgta

SEQ ID NO: 382984 - DNA, 20 bp, Artificial
  CRISPR gRNA sequence
attgagcaaaatttaaaaca

SEQ ID NO: 382985 - DNA, 20 bp, Artificial
  CRISPR gRNA sequence
agtactttatggtaggaatt

SEQ ID NO: 382986 - DNA, 20 bp, Artificial
  CRISPR gRNA sequence
gaaatggtgtgaggaaggtg

SEQ ID NO: 382987 - DNA, 20 bp, Artificial
  CRISPR gRNA sequence
atactggactttcatggtat

SEQ ID NO: 382988 - DNA, 20 bp, Artificial
  CRISPR gRNA sequence
taagacaaccctgtatatct

SEQ ID NO: 382989 - DNA, 20 bp, Artificial
  CRISPR gRNA sequence
gagatcatgtgtatattcag

SEQ ID NO: 382990 - DNA, 20 bp, Artificial
  CRISPR gRNA sequence
tggtatctttttcataactg

SEQ ID NO: 382991 - DNA, 20 bp, Artificial
  CRISPR gRNA sequence
cataactgtcagaatcttag

SEQ ID NO: 382992 - DNA, 20 bp, Artificial
  CRISPR gRNA sequence
tcagcctcttgatatgatac

SEQ ID NO: 382993 - DNA, 20 bp, Artificial
  CRISPR gRNA sequence
aaaaaaaaccctttctctta

SEQ ID NO: 382994 - DNA, 20 bp, Artificial
  CRISPR gRNA sequence
ctactcaggaggctgaggca

SEQ ID NO: 382995 - DNA, 20 bp, Artificial
  CRISPR gRNA sequence
cacattgtttcggaacctgg

SEQ ID NO: 382996 - DNA, 20 bp, Artificial
  CRISPR gRNA sequence
ttactgcaacttggtccatg

SEQ ID NO: 382997 - DNA, 20 bp, Artificial
  CRISPR gRNA sequence
gctacttgcaggccagcgca

SEQ ID NO: 382998 - DNA, 20 bp, Artificial
  CRISPR gRNA sequence
ccaccatcctgaagcttaaa

SEQ ID NO: 382999 - DNA, 20 bp, Artificial
  CRISPR gRNA sequence
ttgatggtggtgataaggtg

SEQ ID NO: 383000 - DNA, 20 bp, Artificial
  CRISPR gRNA sequence
agtgcatttcagcaggtgtt

SEQ ID NO: 383001 - DNA, 20 bp, Artificial
  CRISPR gRNA sequence
agtctttttcagatgtggat

SEQ ID NO: 383002 - DNA, 20 bp, Artificial
  CRISPR gRNA sequence
agatccactttgcatgagta

SEQ ID NO: 383003 - DNA, 20 bp, Artificial
  CRISPR gRNA sequence
cctcactgtcgggacacgga

SEQ ID NO: 383004 - DNA, 20 bp, Artificial
  CRISPR gRNA sequence
agatccactttgtatgattg

SEQ ID NO: 383005 - DNA, 20 bp, Artificial
  CRISPR gRNA sequence
cttcctgtgttgaaaatgaa

SEQ ID NO: 383006 - DNA, 20 bp, Artificial
  CRISPR gRNA sequence
tggtgagacatacattggac

SEQ ID NO: 383007 - DNA, 20 bp, Artificial
  CRISPR gRNA sequence
tttttgaaactggtcaggaa

SEQ ID NO: 383008 - DNA, 20 bp, Artificial
  CRISPR gRNA sequence
aaacagattagagaccaagg

SEQ ID NO: 383009 - DNA, 20 bp, Artificial
  CRISPR gRNA sequence
gcaagaaaaaaatgttctat

SEQ ID NO: 383010 - DNA, 20 bp, Artificial
  CRISPR gRNA sequence
tctattcagaaaagtgtcat

SEQ ID NO: 383011 - DNA, 20 bp, Artificial
  CRISPR gRNA sequence
ttgtaaacatcttaaattat

SEQ ID NO: 383012 - DNA, 20 bp, Artificial
  CRISPR gRNA sequence
gacattcagttgacagattg

SEQ ID NO: 383013 - DNA, 20 bp, Artificial
  CRISPR gRNA sequence
cttgattggttttgaacaga

SEQ ID NO: 383014 - DNA, 20 bp, Artificial
  CRISPR gRNA sequence
tgactttctttgctgagtga

SEQ ID NO: 383015 - DNA, 20 bp, Artificial
  CRISPR gRNA sequence
ttgcacttatgtcctgaaat

SEQ ID NO: 383016 - DNA, 20 bp, Artificial
  CRISPR gRNA sequence
actgaccttattggctataa

SEQ ID NO: 383017 - DNA, 20 bp, Artificial
  CRISPR gRNA sequence
ctataaaaagaatgaaggca

SEQ ID NO: 383018 - DNA, 20 bp, Artificial
  CRISPR gRNA sequence
aagaaataaaatcagctctt

SEQ ID NO: 383019 - DNA, 20 bp, Artificial
  CRISPR gRNA sequence
atggcaaaacaataatcatg

SEQ ID NO: 383020 - DNA, 20 bp, Artificial
  CRISPR gRNA sequence
ggatagtttgctgtttgtgt

SEQ ID NO: 383021 - DNA, 20 bp, Artificial
  CRISPR gRNA sequence
ctttgcatgccagggataaa

SEQ ID NO: 383022 - DNA, 20 bp, Artificial
  CRISPR gRNA sequence
cagggataaatcagaattga

SEQ ID NO: 383023 - DNA, 20 bp, Artificial
  CRISPR gRNA sequence
gaactgcttctttttttaaa

SEQ ID NO: 383024 - DNA, 20 bp, Artificial
  CRISPR gRNA sequence
ctcaggattggcattaattc

SEQ ID NO: 383025 - DNA, 20 bp, Artificial
  CRISPR gRNA sequence
attaattcctagaatgtttg

SEQ ID NO: 383026 - DNA, 20 bp, Artificial
  CRISPR gRNA sequence
aatgttccaaactctggtta

SEQ ID NO: 383027 - DNA, 20 bp, Artificial
  CRISPR gRNA sequence
aaagttgtcaaagcatcttt

SEQ ID NO: 383028 - DNA, 20 bp, Artificial
  CRISPR gRNA sequence
aggtttactgattgttgatc

SEQ ID NO: 383029 - DNA, 20 bp, Artificial
  CRISPR gRNA sequence
aaagatcaactacagtgatt

SEQ ID NO: 383030 - DNA, 20 bp, Artificial
  CRISPR gRNA sequence
aaatcatagtgccacagcta

SEQ ID NO: 383031 - DNA, 20 bp, Artificial
  CRISPR gRNA sequence
agttggattataaaattatt

SEQ ID NO: 383032 - DNA, 20 bp, Artificial
  CRISPR gRNA sequence
tctgtcccactcctatgaat

SEQ ID NO: 383033 - DNA, 20 bp, Artificial
  CRISPR gRNA sequence
tatatgatggagcaacacga

SEQ ID NO: 383034 - DNA, 20 bp, Artificial
  CRISPR gRNA sequence
ttttttgaacacacaaaaac

SEQ ID NO: 383035 - DNA, 20 bp, Artificial
  CRISPR gRNA sequence
actataaacaatgcaagttt

SEQ ID NO: 383036 - DNA, 20 bp, Artificial
  CRISPR gRNA sequence
aacaatgcaagtttgtagaa

SEQ ID NO: 383037 - DNA, 20 bp, Artificial
  CRISPR gRNA sequence
gcggtaggagtccttgagcc

SEQ ID NO: 383038 - DNA, 20 bp, Artificial
  CRISPR gRNA sequence
ccaaaaaaaaaaaaaaaaaa

SEQ ID NO: 383039 - DNA, 20 bp, Artificial
  CRISPR gRNA sequence
aaagatttctccaaaagcaa

SEQ ID NO: 383040 - DNA, 20 bp, Artificial
  CRISPR gRNA sequence
ttaatagcatttcattctta

SEQ ID NO: 383041 - DNA, 20 bp, Artificial
  CRISPR gRNA sequence
tgtttaagaggacggaaaat

SEQ ID NO: 383042 - DNA, 20 bp, Artificial
  CRISPR gRNA sequence
cccatgggagggaagtttat

SEQ ID NO: 383043 - DNA, 20 bp, Artificial
  CRISPR gRNA sequence
agagttataagtagctgttc

SEQ ID NO: 383044 - DNA, 20 bp, Artificial
  CRISPR gRNA sequence
atgtgtgccagtggctgttc

SEQ ID NO: 383045 - DNA, 20 bp, Artificial
  CRISPR gRNA sequence
acttttctgctcaaagtgga

SEQ ID NO: 383046 - DNA, 20 bp, Artificial
  CRISPR gRNA sequence
tgaaaccagagctggagtaa

SEQ ID NO: 383047 - DNA, 20 bp, Artificial
  CRISPR gRNA sequence
agtaataataaaagtgtgcc

SEQ ID NO: 383048 - DNA, 20 bp, Artificial
  CRISPR gRNA sequence
agtgtgccggagaaatataa

SEQ ID NO: 383049 - DNA, 20 bp, Artificial
  CRISPR gRNA sequence
aaacaaaatctcctccctac

SEQ ID NO: 383050 - DNA, 20 bp, Artificial
  CRISPR gRNA sequence
cagaaaactgctccacaaag

SEQ ID NO: 383051 - DNA, 20 bp, Artificial
  CRISPR gRNA sequence
gttattgaataagcactaaa

SEQ ID NO: 383052 - DNA, 20 bp, Artificial
  CRISPR gRNA sequence
tcctaagagactgcaaagac

SEQ ID NO: 383053 - DNA, 20 bp, Artificial
  CRISPR gRNA sequence
tgtggtagttttctaccctc

SEQ ID NO: 383054 - DNA, 20 bp, Artificial
  CRISPR gRNA sequence
agggatggctcccaggtcct

SEQ ID NO: 383055 - DNA, 20 bp, Artificial
  CRISPR gRNA sequence
gttttctaaagtcaataccc

SEQ ID NO: 383056 - DNA, 20 bp, Artificial
  CRISPR gRNA sequence
ataccctaagaaaggaggga

SEQ ID NO: 383057 - DNA, 20 bp, Artificial
  CRISPR gRNA sequence
aaattatcatttttagatgg

SEQ ID NO: 383058 - DNA, 20 bp, Artificial
  CRISPR gRNA sequence
cagacatgaacacaaaagca

SEQ ID NO: 383059 - DNA, 20 bp, Artificial
  CRISPR gRNA sequence
agcactagaaataaagctaa

SEQ ID NO: 383060 - DNA, 20 bp, Artificial
  CRISPR gRNA sequence
ggctgaggcaggaggatcac

SEQ ID NO: 383061 - DNA, 20 bp, Artificial
  CRISPR gRNA sequence
acactaattcactaagacag

SEQ ID NO: 383062 - DNA, 20 bp, Artificial
  CRISPR gRNA sequence
atgtgcaagaagtataagac

SEQ ID NO: 383063 - DNA, 20 bp, Artificial
  CRISPR gRNA sequence
gggacaagtattttcaacat

SEQ ID NO: 383064 - DNA, 20 bp, Artificial
  CRISPR gRNA sequence
cactggtttgctctataatg

SEQ ID NO: 383065 - DNA, 20 bp, Artificial
  CRISPR gRNA sequence
ggaccttctagctataaaac

SEQ ID NO: 383066 - DNA, 20 bp, Artificial
  CRISPR gRNA sequence
taaaactgatttatctggac

SEQ ID NO: 383067 - DNA, 20 bp, Artificial
  CRISPR gRNA sequence
gacatctcaacatgaaaaaa

SEQ ID NO: 383068 - DNA, 20 bp, Artificial
  CRISPR gRNA sequence
tatgtgaagtcttccagggg

SEQ ID NO: 383069 - DNA, 20 bp, Artificial
  CRISPR gRNA sequence
actttgtatgacctgataat

SEQ ID NO: 383070 - DNA, 20 bp, Artificial
  CRISPR gRNA sequence
ctactcagggggctgaggca

SEQ ID NO: 383071 - DNA, 20 bp, Artificial
  CRISPR gRNA sequence
ctgtctcaaaaaaaaaaaaa

SEQ ID NO: 383072 - DNA, 20 bp, Artificial
  CRISPR gRNA sequence
agtgcagagcatataaacaa

SEQ ID NO: 383073 - DNA, 20 bp, Artificial
  CRISPR gRNA sequence
gactggctgaagccatggca

SEQ ID NO: 383074 - DNA, 20 bp, Artificial
  CRISPR gRNA sequence
cttattatcgaaaatgggta

SEQ ID NO: 383075 - DNA, 20 bp, Artificial
  CRISPR gRNA sequence
aataattcacagccctggga

SEQ ID NO: 383076 - DNA, 20 bp, Artificial
  CRISPR gRNA sequence
ctggccaacacttagggaaa

SEQ ID NO: 383077 - DNA, 20 bp, Artificial
  CRISPR gRNA sequence
catgttttctttcatctttt

SEQ ID NO: 383078 - DNA, 20 bp, Artificial
  CRISPR gRNA sequence
gccataaatacttgtcattg

SEQ ID NO: 383079 - DNA, 20 bp, Artificial
  CRISPR gRNA sequence
ggaaacaattcttctttttt

SEQ ID NO: 383080 - DNA, 20 bp, Artificial
  CRISPR gRNA sequence
aagaaaagggcttccttttt

SEQ ID NO: 383081 - DNA, 20 bp, Artificial
  CRISPR gRNA sequence
tttatttcacctttatttct

SEQ ID NO: 383082 - DNA, 20 bp, Artificial
  CRISPR gRNA sequence
ctactcaggaggctgaggca

SEQ ID NO: 383083 - DNA, 20 bp, Artificial
  CRISPR gRNA sequence
ctgtccttgggtagatcatg

SEQ ID NO: 383084 - DNA, 20 bp, Artificial
  CRISPR gRNA sequence
tgctgtggtagtgtgagagc

SEQ ID NO: 383085 - DNA, 20 bp, Artificial
  CRISPR gRNA sequence
catataaattagaccttcat

SEQ ID NO: 383086 - DNA, 20 bp, Artificial
  CRISPR gRNA sequence
ttgttaagtattctatttct

SEQ ID NO: 383087 - DNA, 20 bp, Artificial
  CRISPR gRNA sequence
tcacaaaatgaacacatcgt

SEQ ID NO: 383088 - DNA, 20 bp, Artificial
  CRISPR gRNA sequence
tggaaaatataaaaaagccc

SEQ ID NO: 383089 - DNA, 20 bp, Artificial
  CRISPR gRNA sequence
gagctctcacctcacaccta

SEQ ID NO: 383090 - DNA, 20 bp, Artificial
  CRISPR gRNA sequence
gcaagtgttggtgaggatgt

SEQ ID NO: 383091 - DNA, 20 bp, Artificial
  CRISPR gRNA sequence
ggtacaggtagtaggttcct

SEQ ID NO: 383092 - DNA, 20 bp, Artificial
  CRISPR gRNA sequence
gctacttggaggctgaggca

SEQ ID NO: 383093 - DNA, 20 bp, Artificial
  CRISPR gRNA sequence
ggaaatgaggtcagtatctt

SEQ ID NO: 383094 - DNA, 20 bp, Artificial
  CRISPR gRNA sequence
ccatcaacagatgaatagat

SEQ ID NO: 383095 - DNA, 20 bp, Artificial
  CRISPR gRNA sequence
gtgaaataagccagacacaa

SEQ ID NO: 383096 - DNA, 20 bp, Artificial
  CRISPR gRNA sequence
tctttgcagtaaagtttgtg

SEQ ID NO: 383097 - DNA, 20 bp, Artificial
  CRISPR gRNA sequence
ctacatagtggataaagtga

SEQ ID NO: 383098 - DNA, 20 bp, Artificial
  CRISPR gRNA sequence
ttttctgaggaaaagatggg

SEQ ID NO: 383099 - DNA, 20 bp, Artificial
  CRISPR gRNA sequence
gaattgtgaaagatttagga

SEQ ID NO: 383100 - DNA, 20 bp, Artificial
  CRISPR gRNA sequence
ttgtatcattaccaaattga

SEQ ID NO: 383101 - DNA, 20 bp, Artificial
  CRISPR gRNA sequence
aaataaaaatctattaggag

SEQ ID NO: 383102 - DNA, 20 bp, Artificial
  CRISPR gRNA sequence
gaaatatttaggagactcta

SEQ ID NO: 383103 - DNA, 20 bp, Artificial
  CRISPR gRNA sequence
gagagctggaatagttcatt

SEQ ID NO: 383104 - DNA, 20 bp, Artificial
  CRISPR gRNA sequence
tagttgtatattctcagaac

SEQ ID NO: 383105 - DNA, 20 bp, Artificial
  CRISPR gRNA sequence
tggttatcttcccactccta

SEQ ID NO: 383106 - DNA, 20 bp, Artificial
  CRISPR gRNA sequence
gcccttaagtctttccctga

SEQ ID NO: 383107 - DNA, 20 bp, Artificial
  CRISPR gRNA sequence
atgaatagctaaattgaacg

SEQ ID NO: 383108 - DNA, 20 bp, Artificial
  CRISPR gRNA sequence
gtttgtggttgttacttcca

SEQ ID NO: 383109 - DNA, 20 bp, Artificial
  CRISPR gRNA sequence
ctactcaggaggctgagaca

SEQ ID NO: 383110 - DNA, 20 bp, Artificial
  CRISPR gRNA sequence
agatgtgcacctgagtgtag

SEQ ID NO: 383111 - DNA, 20 bp, Artificial
  CRISPR gRNA sequence
ggaagaaatttaatatttag

SEQ ID NO: 383112 - DNA, 20 bp, Artificial
  CRISPR gRNA sequence
ctactcaggaggctgaggca

SEQ ID NO: 383113 - DNA, 20 bp, Artificial
  CRISPR gRNA sequence
tctcaaaaaaaaaaaaaaaa

SEQ ID NO: 383114 - DNA, 20 bp, Artificial
  CRISPR gRNA sequence
aaaaaaaaaaaaaagaaaaa

SEQ ID NO: 383115 - DNA, 20 bp, Artificial
  CRISPR gRNA sequence
actccttagtcccaggcaaa

SEQ ID NO: 383116 - DNA, 20 bp, Artificial
  CRISPR gRNA sequence
atgcttgcatgtgtcttata

SEQ ID NO: 383117 - DNA, 20 bp, Artificial
  CRISPR gRNA sequence
tgtgtatagtaaatttacac

SEQ ID NO: 383118 - DNA, 20 bp, Artificial
  CRISPR gRNA sequence
ttggtcaaaataataataaa

SEQ ID NO: 383119 - DNA, 20 bp, Artificial
  CRISPR gRNA sequence
aaataagaaaataaatgcac

SEQ ID NO: 383120 - DNA, 20 bp, Artificial
  CRISPR gRNA sequence
ttcctgcataacctttccct

SEQ ID NO: 383121 - DNA, 20 bp, Artificial
  CRISPR gRNA sequence
cagaggagtctgttgttcaa

SEQ ID NO: 383122 - DNA, 20 bp, Artificial
  CRISPR gRNA sequence
aaataatccatacgagtgat

SEQ ID NO: 383123 - DNA, 20 bp, Artificial
  CRISPR gRNA sequence
tcttaaatgtgaggttattt

SEQ ID NO: 383124 - DNA, 20 bp, Artificial
  CRISPR gRNA sequence
atgaaaaaaactgtagggta

SEQ ID NO: 383125 - DNA, 20 bp, Artificial
  CRISPR gRNA sequence
aatttaaatatcagctattt

SEQ ID NO: 383126 - DNA, 20 bp, Artificial
  CRISPR gRNA sequence
aaacggggtggcttaaaaca

SEQ ID NO: 383127 - DNA, 20 bp, Artificial
  CRISPR gRNA sequence
aattctggagggttgaagta

SEQ ID NO: 383128 - DNA, 20 bp, Artificial
  CRISPR gRNA sequence
gtactggtttcttcgtggga

SEQ ID NO: 383129 - DNA, 20 bp, Artificial
  CRISPR gRNA sequence
cttagtgtttaactaaaaga

SEQ ID NO: 383130 - DNA, 20 bp, Artificial
  CRISPR gRNA sequence
gaagacagttgtctgcaaac

SEQ ID NO: 383131 - DNA, 20 bp, Artificial
  CRISPR gRNA sequence
attgcttcttgatgccaact

SEQ ID NO: 383132 - DNA, 20 bp, Artificial
  CRISPR gRNA sequence
cttgatgccaactgtagaat

SEQ ID NO: 383133 - DNA, 20 bp, Artificial
  CRISPR gRNA sequence
tatttcatcagccacttcag

SEQ ID NO: 383134 - DNA, 20 bp, Artificial
  CRISPR gRNA sequence
tccaactttttcaggttttt

SEQ ID NO: 383135 - DNA, 20 bp, Artificial
  CRISPR gRNA sequence
cagctactcgtgaggctgag

SEQ ID NO: 383136 - DNA, 20 bp, Artificial
  CRISPR gRNA sequence
tttaaagttcagacactgtg

SEQ ID NO: 383137 - DNA, 20 bp, Artificial
  CRISPR gRNA sequence
gatttctgttgcatctcagt

SEQ ID NO: 383138 - DNA, 20 bp, Artificial
  CRISPR gRNA sequence
ccaacagaagttcaatacaa

SEQ ID NO: 383139 - DNA, 20 bp, Artificial
  CRISPR gRNA sequence
tcatttttcatagaactgtt

SEQ ID NO: 383140 - DNA, 20 bp, Artificial
  CRISPR gRNA sequence
ctctaactggtttatataca

SEQ ID NO: 383141 - DNA, 20 bp, Artificial
  CRISPR gRNA sequence
aaaacttactgtatcatata

SEQ ID NO: 383142 - DNA, 20 bp, Artificial
  CRISPR gRNA sequence
ccagggcttaaatgttgtgt

SEQ ID NO: 383143 - DNA, 20 bp, Artificial
  CRISPR gRNA sequence
ttgttaaataggcaacatga

SEQ ID NO: 383144 - DNA, 20 bp, Artificial
  CRISPR gRNA sequence
agtgaaatatgggatggatt

SEQ ID NO: 383145 - DNA, 20 bp, Artificial
  CRISPR gRNA sequence
gggtatctctgtccatactt

SEQ ID NO: 383146 - DNA, 20 bp, Artificial
  CRISPR gRNA sequence
cactctatcagcatagtcca

SEQ ID NO: 383147 - DNA, 20 bp, Artificial
  CRISPR gRNA sequence
cagaagaatacctggcagta

SEQ ID NO: 383148 - DNA, 20 bp, Artificial
  CRISPR gRNA sequence
ttatttatctctcattctgt

SEQ ID NO: 383149 - DNA, 20 bp, Artificial
  CRISPR gRNA sequence
ggacatattttgtctacttt

SEQ ID NO: 383150 - DNA, 20 bp, Artificial
  CRISPR gRNA sequence
tggtggcataggacggtagg

SEQ ID NO: 383151 - DNA, 20 bp, Artificial
  CRISPR gRNA sequence
gtagaaatttgggagggaaa

SEQ ID NO: 383152 - DNA, 20 bp, Artificial
  CRISPR gRNA sequence
ttgggagggtacaggcaaca

SEQ ID NO: 383153 - DNA, 20 bp, Artificial
  CRISPR gRNA sequence
caggagaaaggaatcaaacc

SEQ ID NO: 383154 - DNA, 20 bp, Artificial
  CRISPR gRNA sequence
agatttctaaagaccaccat

SEQ ID NO: 383155 - DNA, 20 bp, Artificial
  CRISPR gRNA sequence
atgcacttgttttgtgaatt

SEQ ID NO: 383156 - DNA, 20 bp, Artificial
  CRISPR gRNA sequence
caaacttgaaaggcagttta

SEQ ID NO: 383157 - DNA, 20 bp, Artificial
  CRISPR gRNA sequence
aatataaatccaattttaag

SEQ ID NO: 383158 - DNA, 20 bp, Artificial
  CRISPR gRNA sequence
cctatgattctgattgttac

SEQ ID NO: 383159 - DNA, 20 bp, Artificial
  CRISPR gRNA sequence
agcagatgaaaaacagatcc

SEQ ID NO: 383160 - DNA, 20 bp, Artificial
  CRISPR gRNA sequence
cagatccacagaataaacga

SEQ ID NO: 383161 - DNA, 20 bp, Artificial
  CRISPR gRNA sequence
tatatcgatggataatacat

SEQ ID NO: 383162 - DNA, 20 bp, Artificial
  CRISPR gRNA sequence
gaactttaggtataatatgt

SEQ ID NO: 383163 - DNA, 20 bp, Artificial
  CRISPR gRNA sequence
taatatgttgagaaaataaa

SEQ ID NO: 383164 - DNA, 20 bp, Artificial
  CRISPR gRNA sequence
tccaagttatattggtttgt

SEQ ID NO: 383165 - DNA, 20 bp, Artificial
  CRISPR gRNA sequence
tttctttttcacaacagtga

SEQ ID NO: 383166 - DNA, 20 bp, Artificial
  CRISPR gRNA sequence
ctactattaaaatgtaacat

SEQ ID NO: 383167 - DNA, 20 bp, Artificial
  CRISPR gRNA sequence
tatttctagtgattcaatag

SEQ ID NO: 383168 - DNA, 20 bp, Artificial
  CRISPR gRNA sequence
aataggtagaaaaatagctt

SEQ ID NO: 383169 - DNA, 20 bp, Artificial
  CRISPR gRNA sequence
actaactatcttgtaagatg

SEQ ID NO: 383170 - DNA, 20 bp, Artificial
  CRISPR gRNA sequence
tttatttcgtattatccttg

SEQ ID NO: 383171 - DNA, 20 bp, Artificial
  CRISPR gRNA sequence
atttttggttcttgtagggt

SEQ ID NO: 383172 - DNA, 20 bp, Artificial
  CRISPR gRNA sequence
tcactactttcatttgccat

SEQ ID NO: 383173 - DNA, 20 bp, Artificial
  CRISPR gRNA sequence
aatagcagggaaaaatttct

SEQ ID NO: 383174 - DNA, 20 bp, Artificial
  CRISPR gRNA sequence
aattaactgatgaattacat

SEQ ID NO: 383175 - DNA, 20 bp, Artificial
  CRISPR gRNA sequence
atactcttctcatgtctctt

SEQ ID NO: 383176 - DNA, 20 bp, Artificial
  CRISPR gRNA sequence
agggactactatgtttcggg

SEQ ID NO: 383177 - DNA, 20 bp, Artificial
  CRISPR gRNA sequence
tactatgtttcgggaaaaac

SEQ ID NO: 383178 - DNA, 20 bp, Artificial
  CRISPR gRNA sequence
aaaacaaaaacaaacaaaca

SEQ ID NO: 383179 - DNA, 20 bp, Artificial
  CRISPR gRNA sequence
aacattgtgttttattcatt

SEQ ID NO: 383180 - DNA, 20 bp, Artificial
  CRISPR gRNA sequence
atgtggactctctcaattta

SEQ ID NO: 383181 - DNA, 20 bp, Artificial
  CRISPR gRNA sequence
tagtaatacactgaattact

SEQ ID NO: 383182 - DNA, 20 bp, Artificial
  CRISPR gRNA sequence
aagatgtgttctttccctga

SEQ ID NO: 383183 - DNA, 20 bp, Artificial
  CRISPR gRNA sequence
tatatatatatatatatatg

SEQ ID NO: 383184 - DNA, 20 bp, Artificial
  CRISPR gRNA sequence
acatacactagggagagtcc

SEQ ID NO: 383185 - DNA, 20 bp, Artificial
  CRISPR gRNA sequence
agatggctccaaattcctga

SEQ ID NO: 383186 - DNA, 20 bp, Artificial
  CRISPR gRNA sequence
aatattttgaatgagagacc

SEQ ID NO: 383187 - DNA, 20 bp, Artificial
  CRISPR gRNA sequence
tctttcatgaagttcccagt

SEQ ID NO: 383188 - DNA, 20 bp, Artificial
  CRISPR gRNA sequence
cttaccatttctgtaattca

SEQ ID NO: 383189 - DNA, 20 bp, Artificial
  CRISPR gRNA sequence
aaaagtagacaaaatatgtc

SEQ ID NO: 383190 - DNA, 20 bp, Artificial
  CRISPR gRNA sequence
caacaactaatgaagacatt

SEQ ID NO: 383191 - DNA, 20 bp, Artificial
  CRISPR gRNA sequence
ttccattataattaatttga

SEQ ID NO: 383192 - DNA, 20 bp, Artificial
  CRISPR gRNA sequence
cttaacatataaaaagttaa

SEQ ID NO: 383193 - DNA, 20 bp, Artificial
  CRISPR gRNA sequence
ccttcaaaatattattctac

SEQ ID NO: 383194 - DNA, 20 bp, Artificial
  CRISPR gRNA sequence
cctttatttatattcatata

SEQ ID NO: 383195 - DNA, 20 bp, Artificial
  CRISPR gRNA sequence
acagttccaatgaaacccat

SEQ ID NO: 383196 - DNA, 20 bp, Artificial
  CRISPR gRNA sequence
agacagtgtggtgattcctc

SEQ ID NO: 383197 - DNA, 20 bp, Artificial
  CRISPR gRNA sequence
agcaaactcatgcaggaaca

SEQ ID NO: 383198 - DNA, 20 bp, Artificial
  CRISPR gRNA sequence
agccaagagattttcaatgc

SEQ ID NO: 383199 - DNA, 20 bp, Artificial
  CRISPR gRNA sequence
gccaaaacccagagagcccc

SEQ ID NO: 383200 - DNA, 20 bp, Artificial
  CRISPR gRNA sequence
tactgttgctatctctgcat

SEQ ID NO: 383201 - DNA, 20 bp, Artificial
  CRISPR gRNA sequence
ggattattttaaacagtcag

SEQ ID NO: 383202 - DNA, 20 bp, Artificial
  CRISPR gRNA sequence
gagcaggctggagacgttac

SEQ ID NO: 383203 - DNA, 20 bp, Artificial
  CRISPR gRNA sequence
aggagaactagaaggggaag

SEQ ID NO: 383204 - DNA, 20 bp, Artificial
  CRISPR gRNA sequence
gagataacaaacaacaacaa

SEQ ID NO: 383205 - DNA, 20 bp, Artificial
  CRISPR gRNA sequence
tacattaattattgagtaac

SEQ ID NO: 383206 - DNA, 20 bp, Artificial
  CRISPR gRNA sequence
taagctgccaatcatataca

SEQ ID NO: 383207 - DNA, 20 bp, Artificial
  CRISPR gRNA sequence
aaaaccttttgtagaaaaaa

SEQ ID NO: 383208 - DNA, 20 bp, Artificial
  CRISPR gRNA sequence
ggtgaaaccccgtctctact

SEQ ID NO: 383209 - DNA, 20 bp, Artificial
  CRISPR gRNA sequence
ctggaatcctattgcagcct

SEQ ID NO: 383210 - DNA, 20 bp, Artificial
  CRISPR gRNA sequence
ctacagacaaagtggtaggt

SEQ ID NO: 383211 - DNA, 20 bp, Artificial
  CRISPR gRNA sequence
gtttgacacctgtgtagaaa

SEQ ID NO: 383212 - DNA, 20 bp, Artificial
  CRISPR gRNA sequence
gagccagttatagagctcaa

SEQ ID NO: 383213 - DNA, 20 bp, Artificial
  CRISPR gRNA sequence
ttgagccaggacccgtggat

SEQ ID NO: 383214 - DNA, 20 bp, Artificial
  CRISPR gRNA sequence
aggagaagtgtcttgaactg

SEQ ID NO: 383215 - DNA, 20 bp, Artificial
  CRISPR gRNA sequence
tcacagaagataaatacagt

SEQ ID NO: 383216 - DNA, 20 bp, Artificial
  CRISPR gRNA sequence
gggccaaagaatatgccagg

SEQ ID NO: 383217 - DNA, 20 bp, Artificial
  CRISPR gRNA sequence
ttaggctggaaactgcaaat

SEQ ID NO: 383218 - DNA, 20 bp, Artificial
  CRISPR gRNA sequence
cttttctcaaaaagatgaaa

SEQ ID NO: 383219 - DNA, 20 bp, Artificial
  CRISPR gRNA sequence
ccgtgatgcctcctgagccg

SEQ ID NO: 383220 - DNA, 20 bp, Artificial
  CRISPR gRNA sequence
aatacaaccagttacagctc

SEQ ID NO: 383221 - DNA, 20 bp, Artificial
  CRISPR gRNA sequence
actttagacattggtttatt

SEQ ID NO: 383222 - DNA, 20 bp, Artificial
  CRISPR gRNA sequence
ttattttttaactttaactt

SEQ ID NO: 383223 - DNA, 20 bp, Artificial
  CRISPR gRNA sequence
ttgttttttataacaataaa

SEQ ID NO: 383224 - DNA, 20 bp, Artificial
  CRISPR gRNA sequence
atagactatggaatattgag

SEQ ID NO: 383225 - DNA, 20 bp, Artificial
  CRISPR gRNA sequence
ccatctaaaaatgataattt

SEQ ID NO: 383226 - DNA, 20 bp, Artificial
  CRISPR gRNA sequence
tatgcaaactgtgtttcaaa

SEQ ID NO: 383227 - DNA, 20 bp, Artificial
  CRISPR gRNA sequence
acagagcaagaccctgtctc

SEQ ID NO: 383228 - DNA, 20 bp, Artificial
  CRISPR gRNA sequence
gcaagaccctgtctctaaaa

SEQ ID NO: 383229 - DNA, 20 bp, Artificial
  CRISPR gRNA sequence
ttcttagggtattgacttta

SEQ ID NO: 383230 - DNA, 20 bp, Artificial
  CRISPR gRNA sequence
tcccaatttctgagagggta

SEQ ID NO: 383231 - DNA, 20 bp, Artificial
  CRISPR gRNA sequence
actctttccttgggtcctta

SEQ ID NO: 383232 - DNA, 20 bp, Artificial
  CRISPR gRNA sequence
aaaattccctaagtgctcta

SEQ ID NO: 383233 - DNA, 20 bp, Artificial
  CRISPR gRNA sequence
tgaattatatgattagattt

SEQ ID NO: 383234 - DNA, 20 bp, Artificial
  CRISPR gRNA sequence
aatgctccacataagatgtg

SEQ ID NO: 383235 - DNA, 20 bp, Artificial
  CRISPR gRNA sequence
ctttgagttctaccaaagtt

SEQ ID NO: 383236 - DNA, 20 bp, Artificial
  CRISPR gRNA sequence
ttttataaaagttgcaccaa

SEQ ID NO: 383237 - DNA, 20 bp, Artificial
  CRISPR gRNA sequence
gtctaagttcccagggagag

SEQ ID NO: 383238 - DNA, 20 bp, Artificial
  CRISPR gRNA sequence
tagatcaatactagggctta

SEQ ID NO: 383239 - DNA, 20 bp, Artificial
  CRISPR gRNA sequence
tggatacccagtttcaccga

SEQ ID NO: 383240 - DNA, 20 bp, Artificial
  CRISPR gRNA sequence
tggaatccttaaaaaaaaaa

SEQ ID NO: 383241 - DNA, 20 bp, Artificial
  CRISPR gRNA sequence
atctggaaagaaaagaggta

SEQ ID NO: 383242 - DNA, 20 bp, Artificial
  CRISPR gRNA sequence
cagtttggtctgatgtggaa

SEQ ID NO: 383243 - DNA, 20 bp, Artificial
  CRISPR gRNA sequence
gaccagcatcaccctgatac

SEQ ID NO: 383244 - DNA, 20 bp, Artificial
  CRISPR gRNA sequence
agacaccacaaaaaaaaaaa

SEQ ID NO: 383245 - DNA, 20 bp, Artificial
  CRISPR gRNA sequence
tccttgtgtgattaaaaaaa

SEQ ID NO: 383246 - DNA, 20 bp, Artificial
  CRISPR gRNA sequence
gagccattaaacaagaaaaa

SEQ ID NO: 383247 - DNA, 20 bp, Artificial
  CRISPR gRNA sequence
atgacataatcatatatgta

SEQ ID NO: 383248 - DNA, 20 bp, Artificial
  CRISPR gRNA sequence
aaaccctaaaagtgccacaa

SEQ ID NO: 383249 - DNA, 20 bp, Artificial
  CRISPR gRNA sequence
aaactatccaaaaaaggaat

SEQ ID NO: 383250 - DNA, 20 bp, Artificial
  CRISPR gRNA sequence
ctgccattttctcctctgtt

SEQ ID NO: 383251 - DNA, 20 bp, Artificial
  CRISPR gRNA sequence
aataatcaaattgcaccaga

SEQ ID NO: 383252 - DNA, 20 bp, Artificial
  CRISPR gRNA sequence
aaaagccatttgcaactgtt

SEQ ID NO: 383253 - DNA, 20 bp, Artificial
  CRISPR gRNA sequence
tgaacatgtttaccataaat

SEQ ID NO: 383254 - DNA, 20 bp, Artificial
  CRISPR gRNA sequence
atttgatggcacagctgcct

SEQ ID NO: 383255 - DNA, 20 bp, Artificial
  CRISPR gRNA sequence
catgtagtgagaaacacagc

SEQ ID NO: 383256 - DNA, 20 bp, Artificial
  CRISPR gRNA sequence
cctgggcagtaatgatgtca

SEQ ID NO: 383257 - DNA, 20 bp, Artificial
  CRISPR gRNA sequence
acgatagtttcagccgcacc

SEQ ID NO: 383258 - DNA, 20 bp, Artificial
  CRISPR gRNA sequence
gtgtcaaaatgttgtaaaaa

SEQ ID NO: 383259 - DNA, 20 bp, Artificial
  CRISPR gRNA sequence
acccacataacacacacccg

SEQ ID NO: 383260 - DNA, 20 bp, Artificial
  CRISPR gRNA sequence
aggaaaattaaaataaaaat

SEQ ID NO: 383261 - DNA, 20 bp, Artificial
  CRISPR gRNA sequence
cctttgtctgcctatctaac

SEQ ID NO: 383262 - DNA, 20 bp, Artificial
  CRISPR gRNA sequence
agaaaaaaatttgatttcaa

SEQ ID NO: 383263 - DNA, 20 bp, Artificial
  CRISPR gRNA sequence
ataaaacaaatacaaataat

SEQ ID NO: 383264 - DNA, 20 bp, Artificial
  CRISPR gRNA sequence
aaaatccttcacccacttca

SEQ ID NO: 383265 - DNA, 20 bp, Artificial
  CRISPR gRNA sequence
gttaagcaaatttacaagag

SEQ ID NO: 383266 - DNA, 20 bp, Artificial
  CRISPR gRNA sequence
aatggctattactaaaaagg

SEQ ID NO: 383267 - DNA, 20 bp, Artificial
  CRISPR gRNA sequence
agtaaactaatgcaggaatt

SEQ ID NO: 383268 - DNA, 20 bp, Artificial
  CRISPR gRNA sequence
aaaaaaaatttctaataaaa

SEQ ID NO: 383269 - DNA, 20 bp, Artificial
  CRISPR gRNA sequence
aagcagcccacgggaatatg

SEQ ID NO: 383270 - DNA, 20 bp, Artificial
  CRISPR gRNA sequence
tatcatgtttatgttaaaaa

SEQ ID NO: 383271 - DNA, 20 bp, Artificial
  CRISPR gRNA sequence
gggatctttctcccattcct

SEQ ID NO: 383272 - DNA, 20 bp, Artificial
  CRISPR gRNA sequence
gtgagttacaataaagagat

SEQ ID NO: 383273 - DNA, 20 bp, Artificial
  CRISPR gRNA sequence
agtacatctctgaggtctca

SEQ ID NO: 383274 - DNA, 20 bp, Artificial
  CRISPR gRNA sequence
caaagattactgggtgtaaa

SEQ ID NO: 383275 - DNA, 20 bp, Artificial
  CRISPR gRNA sequence
taataaaattaagttaattc

SEQ ID NO: 383276 - DNA, 20 bp, Artificial
  CRISPR gRNA sequence
ttaattctaaaactaagttt

SEQ ID NO: 383277 - DNA, 20 bp, Artificial
  CRISPR gRNA sequence
ggataacggttaagagggta

SEQ ID NO: 383278 - DNA, 20 bp, Artificial
  CRISPR gRNA sequence
tacaatttaaaaattaataa

SEQ ID NO: 383279 - DNA, 20 bp, Artificial
  CRISPR gRNA sequence
tttaaaaattaataacaaaa

SEQ ID NO: 383280 - DNA, 20 bp, Artificial
  CRISPR gRNA sequence
gtactccttctaatctcagg

SEQ ID NO: 383281 - DNA, 20 bp, Artificial
  CRISPR gRNA sequence
tggggggactacatggatga

SEQ ID NO: 383282 - DNA, 20 bp, Artificial
  CRISPR gRNA sequence
tgaaaaatataacaatatta

SEQ ID NO: 383283 - DNA, 20 bp, Artificial
  CRISPR gRNA sequence
agaaaagcaagtagcccaga

SEQ ID NO: 383284 - DNA, 20 bp, Artificial
  CRISPR gRNA sequence
ggaacttgacttcacagtgg

SEQ ID NO: 383285 - DNA, 20 bp, Artificial
  CRISPR gRNA sequence
accctggaaaggaaagagga

SEQ ID NO: 383286 - DNA, 20 bp, Artificial
  CRISPR gRNA sequence
ttttgaagtgagtactgtca

SEQ ID NO: 383287 - DNA, 20 bp, Artificial
  CRISPR gRNA sequence
tcatttttggaagttgggac

SEQ ID NO: 383288 - DNA, 20 bp, Artificial
  CRISPR gRNA sequence
ttacatatgtatggtgctgg

SEQ ID NO: 383289 - DNA, 20 bp, Artificial
  CRISPR gRNA sequence
aaagacttaaatgttagacc

SEQ ID NO: 383290 - DNA, 20 bp, Artificial
  CRISPR gRNA sequence
aatgttagacctaaaaccat

SEQ ID NO: 383291 - DNA, 20 bp, Artificial
  CRISPR gRNA sequence
aaaccataaaaaccctagaa

SEQ ID NO: 383292 - DNA, 20 bp, Artificial
  CRISPR gRNA sequence
atgggcaagggcttcatgcc

SEQ ID NO: 383293 - DNA, 20 bp, Artificial
  CRISPR gRNA sequence
tcttacaggaagaaattagt

SEQ ID NO: 383294 - DNA, 20 bp, Artificial
  CRISPR gRNA sequence
aaatagatcgccagagctct

SEQ ID NO: 383295 - DNA, 20 bp, Artificial
  CRISPR gRNA sequence
gacaggtctgttcataatta

SEQ ID NO: 383296 - DNA, 20 bp, Artificial
  CRISPR gRNA sequence
catgtgcttttttctaaatg

SEQ ID NO: 383297 - DNA, 20 bp, Artificial
  CRISPR gRNA sequence
aatatttcagatcacacctg

SEQ ID NO: 383298 - DNA, 20 bp, Artificial
  CRISPR gRNA sequence
tgtcattctgttactcccaa

SEQ ID NO: 383299 - DNA, 20 bp, Artificial
  CRISPR gRNA sequence
ctgaaagtaaattggcacaa

SEQ ID NO: 383300 - DNA, 20 bp, Artificial
  CRISPR gRNA sequence
ggaagcaaagatgaaatgga

SEQ ID NO: 383301 - DNA, 20 bp, Artificial
  CRISPR gRNA sequence
ataggtttgtcttttaaaag

SEQ ID NO: 383302 - DNA, 20 bp, Artificial
  CRISPR gRNA sequence
tttgtcttttaaaagcaaaa

SEQ ID NO: 383303 - DNA, 20 bp, Artificial
  CRISPR gRNA sequence
tatttgtaatataccacaaa

SEQ ID NO: 383304 - DNA, 20 bp, Artificial
  CRISPR gRNA sequence
aatataccacaaacaaaact

SEQ ID NO: 383305 - DNA, 20 bp, Artificial
  CRISPR gRNA sequence
atcatgtaagagtaacaaga

SEQ ID NO: 383306 - DNA, 20 bp, Artificial
  CRISPR gRNA sequence
ccctccggaaagccatgact

SEQ ID NO: 383307 - DNA, 20 bp, Artificial
  CRISPR gRNA sequence
tacagccagagtaatctttg

SEQ ID NO: 383308 - DNA, 20 bp, Artificial
  CRISPR gRNA sequence
tgaccaagagcccctggctc

SEQ ID NO: 383309 - DNA, 20 bp, Artificial
  CRISPR gRNA sequence
gcccctggctctaaaacctt

SEQ ID NO: 383310 - DNA, 20 bp, Artificial
  CRISPR gRNA sequence
aggaactaataaggaagcca

SEQ ID NO: 383311 - DNA, 20 bp, Artificial
  CRISPR gRNA sequence
tttttcaaacataggaagga

SEQ ID NO: 383312 - DNA, 20 bp, Artificial
  CRISPR gRNA sequence
aggatcatccaggaagtaga

SEQ ID NO: 383313 - DNA, 20 bp, Artificial
  CRISPR gRNA sequence
gtaaataaatgctgaagaga

SEQ ID NO: 383314 - DNA, 20 bp, Artificial
  CRISPR gRNA sequence
aacccaaaaatagaaacagg

SEQ ID NO: 383315 - DNA, 20 bp, Artificial
  CRISPR gRNA sequence
tgtccatttatatacaagat

SEQ ID NO: 383316 - DNA, 20 bp, Artificial
  CRISPR gRNA sequence
atttcttcatttttatataa

SEQ ID NO: 383317 - DNA, 20 bp, Artificial
  CRISPR gRNA sequence
ttccttaaaagaacaaaaat

SEQ ID NO: 383318 - DNA, 20 bp, Artificial
  CRISPR gRNA sequence
gttcttcatgccgaggcaat

SEQ ID NO: 383319 - DNA, 20 bp, Artificial
  CRISPR gRNA sequence
tgtttcttttggtagaaatt

SEQ ID NO: 383320 - DNA, 20 bp, Artificial
  CRISPR gRNA sequence
agctcccatttttgtctttg

SEQ ID NO: 383321 - DNA, 20 bp, Artificial
  CRISPR gRNA sequence
tttgtataatgttttacact

SEQ ID NO: 383322 - DNA, 20 bp, Artificial
  CRISPR gRNA sequence
ttgtgaggatgcacagtgct

SEQ ID NO: 383323 - DNA, 20 bp, Artificial
  CRISPR gRNA sequence
aaaatctgataacaaaatag

SEQ ID NO: 383324 - DNA, 20 bp, Artificial
  CRISPR gRNA sequence
ttagaatcctgccccctcct

SEQ ID NO: 383325 - DNA, 20 bp, Artificial
  CRISPR gRNA sequence
ccctcctcaaaaccaactgc

SEQ ID NO: 383326 - DNA, 20 bp, Artificial
  CRISPR gRNA sequence
ccatcagctctggccttttt

SEQ ID NO: 383327 - DNA, 20 bp, Artificial
  CRISPR gRNA sequence
agatcgagaccatcccggct

SEQ ID NO: 383328 - DNA, 20 bp, Artificial
  CRISPR gRNA sequence
gtgtcctcagacttcaaaat

SEQ ID NO: 383329 - DNA, 20 bp, Artificial
  CRISPR gRNA sequence
tttatcgaggatggcttcca

SEQ ID NO: 383330 - DNA, 20 bp, Artificial
  CRISPR gRNA sequence
atttttgcataattacaaat

SEQ ID NO: 383331 - DNA, 20 bp, Artificial
  CRISPR gRNA sequence
ccctagacttacaaaaaaaa

SEQ ID NO: 383332 - DNA, 20 bp, Artificial
  CRISPR gRNA sequence
acttacaaaaaaaaaaaaac

SEQ ID NO: 383333 - DNA, 20 bp, Artificial
  CRISPR gRNA sequence
aaagggccaagtgcttcaaa

SEQ ID NO: 383334 - DNA, 20 bp, Artificial
  CRISPR gRNA sequence
gtgaggcccaaagagtgttt

SEQ ID NO: 383335 - DNA, 20 bp, Artificial
  CRISPR gRNA sequence
agagaaactgcatggcattt

SEQ ID NO: 383336 - DNA, 20 bp, Artificial
  CRISPR gRNA sequence
acaaaagtttttcagtgaat

SEQ ID NO: 383337 - DNA, 20 bp, Artificial
  CRISPR gRNA sequence
gacctaactcatgaactgaa

SEQ ID NO: 383338 - DNA, 20 bp, Artificial
  CRISPR gRNA sequence
gagtctcactgctatgtcta

SEQ ID NO: 383339 - DNA, 20 bp, Artificial
  CRISPR gRNA sequence
gtcaaaggagaaacaaaaga

SEQ ID NO: 383340 - DNA, 20 bp, Artificial
  CRISPR gRNA sequence
ctttctattcacagatattc

SEQ ID NO: 383341 - DNA, 20 bp, Artificial
  CRISPR gRNA sequence
tgatctctctctcaagacat

SEQ ID NO: 383342 - DNA, 20 bp, Artificial
  CRISPR gRNA sequence
gacagagtgagactccatct

SEQ ID NO: 383343 - DNA, 20 bp, Artificial
  CRISPR gRNA sequence
cgtgtaataaagacaagaac

SEQ ID NO: 383344 - DNA, 20 bp, Artificial
  CRISPR gRNA sequence
tgctaataaatatccctatc

SEQ ID NO: 383345 - DNA, 20 bp, Artificial
  CRISPR gRNA sequence
ctagaaaatgctgccaagca

SEQ ID NO: 383346 - DNA, 20 bp, Artificial
  CRISPR gRNA sequence
catctactcaggatcccaag

SEQ ID NO: 383347 - DNA, 20 bp, Artificial
  CRISPR gRNA sequence
ctgggactggagaagagtcc

SEQ ID NO: 383348 - DNA, 20 bp, Artificial
  CRISPR gRNA sequence
cttagatgtgaaaaatgagg

SEQ ID NO: 383349 - DNA, 20 bp, Artificial
  CRISPR gRNA sequence
gaaaaatccaggtagaagtg

SEQ ID NO: 383350 - DNA, 20 bp, Artificial
  CRISPR gRNA sequence
aacacgaaagaaataggtgt

SEQ ID NO: 383351 - DNA, 20 bp, Artificial
  CRISPR gRNA sequence
cagcaaactatcacaaagac

SEQ ID NO: 383352 - DNA, 20 bp, Artificial
  CRISPR gRNA sequence
catgttgtgcacatgtaccc

SEQ ID NO: 383353 - DNA, 20 bp, Artificial
  CRISPR gRNA sequence
aaagtaatgacaggaagaaa

SEQ ID NO: 383354 - DNA, 20 bp, Artificial
  CRISPR gRNA sequence
aaaaactgagcaaagaagaa

SEQ ID NO: 383355 - DNA, 20 bp, Artificial
  CRISPR gRNA sequence
agatggaggtgtgtgcactg

SEQ ID NO: 383356 - DNA, 20 bp, Artificial
  CRISPR gRNA sequence
acatgagactttcactattt

SEQ ID NO: 383357 - DNA, 20 bp, Artificial
  CRISPR gRNA sequence
tcaattctgctattttcact

SEQ ID NO: 383358 - DNA, 20 bp, Artificial
  CRISPR gRNA sequence
catcaactgagttatttaat

SEQ ID NO: 383359 - DNA, 20 bp, Artificial
  CRISPR gRNA sequence
cctgcaacctcctctcccta

SEQ ID NO: 383360 - DNA, 20 bp, Artificial
  CRISPR gRNA sequence
ctctccctataaaaccaaac

SEQ ID NO: 383361 - DNA, 20 bp, Artificial
  CRISPR gRNA sequence
ctataaaaccaaacaaaaac

SEQ ID NO: 383362 - DNA, 20 bp, Artificial
  CRISPR gRNA sequence
caaaaacaaaaaccagcaac

SEQ ID NO: 383363 - DNA, 20 bp, Artificial
  CRISPR gRNA sequence
gaggagctccaagcatcagt

SEQ ID NO: 383364 - DNA, 20 bp, Artificial
  CRISPR gRNA sequence
tcactgagagttgaaggagg

SEQ ID NO: 383365 - DNA, 20 bp, Artificial
  CRISPR gRNA sequence
cacagggaaagcacgtggat

SEQ ID NO: 383366 - DNA, 20 bp, Artificial
  CRISPR gRNA sequence
agtatttttttctttaaatg

SEQ ID NO: 383367 - DNA, 20 bp, Artificial
  CRISPR gRNA sequence
tacacacacacatggatata

SEQ ID NO: 383368 - DNA, 20 bp, Artificial
  CRISPR gRNA sequence
atagagatacatatgataga

SEQ ID NO: 383369 - DNA, 20 bp, Artificial
  CRISPR gRNA sequence
ccttctgaatttgggatagg

SEQ ID NO: 383370 - DNA, 20 bp, Artificial
  CRISPR gRNA sequence
agatatatacaagaatgaaa

SEQ ID NO: 383371 - DNA, 20 bp, Artificial
  CRISPR gRNA sequence
gatcagcctggccaacatgg

SEQ ID NO: 383372 - DNA, 20 bp, Artificial
  CRISPR gRNA sequence
tagatttgaaagaaatcttc

SEQ ID NO: 383373 - DNA, 20 bp, Artificial
  CRISPR gRNA sequence
attttgagacaaatgcaaaa

SEQ ID NO: 383374 - DNA, 20 bp, Artificial
  CRISPR gRNA sequence
aaataaaacacctgtataag

SEQ ID NO: 383375 - DNA, 20 bp, Artificial
  CRISPR gRNA sequence
tgtttaattatgcatatttc

SEQ ID NO: 383376 - DNA, 20 bp, Artificial
  CRISPR gRNA sequence
gctaatgccatatcattttc

SEQ ID NO: 383377 - DNA, 20 bp, Artificial
  CRISPR gRNA sequence
tatgtctttattagcagcat

SEQ ID NO: 383378 - DNA, 20 bp, Artificial
  CRISPR gRNA sequence
ctgatgatgcgacagaaaag

SEQ ID NO: 383379 - DNA, 20 bp, Artificial
  CRISPR gRNA sequence
tttattttgtgtgtctctct

SEQ ID NO: 383380 - DNA, 20 bp, Artificial
  CRISPR gRNA sequence
tattttctcacaaactaggt

SEQ ID NO: 383381 - DNA, 20 bp, Artificial
  CRISPR gRNA sequence
ctctttaaaatacaaataat

SEQ ID NO: 383382 - DNA, 20 bp, Artificial
  CRISPR gRNA sequence
cggtattccttcctctgact

SEQ ID NO: 383383 - DNA, 20 bp, Artificial
  CRISPR gRNA sequence
agctctcttttcctaacctc

SEQ ID NO: 383384 - DNA, 20 bp, Artificial
  CRISPR gRNA sequence
cagtaatgacaaatctggat

SEQ ID NO: 383385 - DNA, 20 bp, Artificial
  CRISPR gRNA sequence
ggttgtcctgtgacagaaac

SEQ ID NO: 383386 - DNA, 20 bp, Artificial
  CRISPR gRNA sequence
tttatagcaaactacacagt

SEQ ID NO: 383387 - DNA, 20 bp, Artificial
  CRISPR gRNA sequence
gctacacctaaagagaaagg

SEQ ID NO: 383388 - DNA, 20 bp, Artificial
  CRISPR gRNA sequence
tgtagtcatcactagaaaga

SEQ ID NO: 383389 - DNA, 20 bp, Artificial
  CRISPR gRNA sequence
aatctctggtagataaagca

SEQ ID NO: 383390 - DNA, 20 bp, Artificial
  CRISPR gRNA sequence
gaaagagaaaaagaaagaaa

SEQ ID NO: 383391 - DNA, 20 bp, Artificial
  CRISPR gRNA sequence
atggtgctatgtcactgtga

SEQ ID NO: 383392 - DNA, 20 bp, Artificial
  CRISPR gRNA sequence
aggttatcattaagacaaca

SEQ ID NO: 383393 - DNA, 20 bp, Artificial
  CRISPR gRNA sequence
aaaagggatttaaaaaaaaa

SEQ ID NO: 383394 - DNA, 20 bp, Artificial
  CRISPR gRNA sequence
atatgccacactgtacaaac

SEQ ID NO: 383395 - DNA, 20 bp, Artificial
  CRISPR gRNA sequence
tgtacaaacaaaaacaggag

SEQ ID NO: 383396 - DNA, 20 bp, Artificial
  CRISPR gRNA sequence
atttgctttgatgaggacca

SEQ ID NO: 383397 - DNA, 20 bp, Artificial
  CRISPR gRNA sequence
acataattatagtacaatat

SEQ ID NO: 383398 - DNA, 20 bp, Artificial
  CRISPR gRNA sequence
ttaaaagcaatttattgtag

SEQ ID NO: 383399 - DNA, 20 bp, Artificial
  CRISPR gRNA sequence
ttttatagaaaaagtggggg

SEQ ID NO: 383400 - DNA, 20 bp, Artificial
  CRISPR gRNA sequence
tactgcatctggcgtgatct

SEQ ID NO: 383401 - DNA, 20 bp, Artificial
  CRISPR gRNA sequence
taccacctgctcttttacag

SEQ ID NO: 383402 - DNA, 20 bp, Artificial
  CRISPR gRNA sequence
caaatagaagctattgtact

SEQ ID NO: 383403 - DNA, 20 bp, Artificial
  CRISPR gRNA sequence
tgatccaccatgcccagcct

SEQ ID NO: 383404 - DNA, 20 bp, Artificial
  CRISPR gRNA sequence
ttattcacattccatgccag

SEQ ID NO: 383405 - DNA, 20 bp, Artificial
  CRISPR gRNA sequence
aagactaacatttcccattt

SEQ ID NO: 383406 - DNA, 20 bp, Artificial
  CRISPR gRNA sequence
tagtacacagctacagtaat

SEQ ID NO: 383407 - DNA, 20 bp, Artificial
  CRISPR gRNA sequence
aaggaaattgaaatgatgat

SEQ ID NO: 383408 - DNA, 20 bp, Artificial
  CRISPR gRNA sequence
caactcagacacagaaactc

SEQ ID NO: 383409 - DNA, 20 bp, Artificial
  CRISPR gRNA sequence
cagacttcaccactacataa

SEQ ID NO: 383410 - DNA, 20 bp, Artificial
  CRISPR gRNA sequence
ataataaaactgcccttgta

SEQ ID NO: 383411 - DNA, 20 bp, Artificial
  CRISPR gRNA sequence
aaattggacttactaaaatt

SEQ ID NO: 383412 - DNA, 20 bp, Artificial
  CRISPR gRNA sequence
agaacagtttagagattctt

SEQ ID NO: 383413 - DNA, 20 bp, Artificial
  CRISPR gRNA sequence
attgcttgaggtcaggaatt

SEQ ID NO: 383414 - DNA, 20 bp, Artificial
  CRISPR gRNA sequence
tgtgcttattaaacaaatgc

SEQ ID NO: 383415 - DNA, 20 bp, Artificial
  CRISPR gRNA sequence
ccaccttccccagtttatgc

SEQ ID NO: 383416 - DNA, 20 bp, Artificial
  CRISPR gRNA sequence
tacctttcgacacttgcttg

SEQ ID NO: 383417 - DNA, 20 bp, Artificial
  CRISPR gRNA sequence
atgtgctttgattggcagga

SEQ ID NO: 383418 - DNA, 20 bp, Artificial
  CRISPR gRNA sequence
agcaggtaaacttgacttca

SEQ ID NO: 383419 - DNA, 20 bp, Artificial
  CRISPR gRNA sequence
cgtaaagttcttgagaataa

SEQ ID NO: 383420 - DNA, 20 bp, Artificial
  CRISPR gRNA sequence
tggttccagcattgcagcac

SEQ ID NO: 383421 - DNA, 20 bp, Artificial
  CRISPR gRNA sequence
acagacagctctattagaaa

SEQ ID NO: 383422 - DNA, 20 bp, Artificial
  CRISPR gRNA sequence
tgaccgcttttatcagattc

SEQ ID NO: 383423 - DNA, 20 bp, Artificial
  CRISPR gRNA sequence
aacattttcatcattttaaa

SEQ ID NO: 383424 - DNA, 20 bp, Artificial
  CRISPR gRNA sequence
tttgagtatatacctaggaa

SEQ ID NO: 383425 - DNA, 20 bp, Artificial
  CRISPR gRNA sequence
gtatccagctacaatgattg

SEQ ID NO: 383426 - DNA, 20 bp, Artificial
  CRISPR gRNA sequence
agtgaccaagattatctttc

SEQ ID NO: 383427 - DNA, 20 bp, Artificial
  CRISPR gRNA sequence
ttttccccccactttttcta

SEQ ID NO: 383428 - DNA, 20 bp, Artificial
  CRISPR gRNA sequence
tttgttctctctggctttca

SEQ ID NO: 383429 - DNA, 20 bp, Artificial
  CRISPR gRNA sequence
ttgttgggttgacttattta

SEQ ID NO: 383430 - DNA, 20 bp, Artificial
  CRISPR gRNA sequence
tgcctcttttgactacatca

SEQ ID NO: 383431 - DNA, 20 bp, Artificial
  CRISPR gRNA sequence
acaaataatatcatagatgt

SEQ ID NO: 383432 - DNA, 20 bp, Artificial
  CRISPR gRNA sequence
ataatttctcacttgttcag

SEQ ID NO: 383433 - DNA, 20 bp, Artificial
  CRISPR gRNA sequence
aatatcttcatcagcagggt

SEQ ID NO: 383434 - DNA, 20 bp, Artificial
  CRISPR gRNA sequence
ctgtcacaggacaaccaatt

SEQ ID NO: 383435 - DNA, 20 bp, Artificial
  CRISPR gRNA sequence
agagtttgtgaggtcatgga

SEQ ID NO: 383436 - DNA, 20 bp, Artificial
  CRISPR gRNA sequence
ttttagagagacacacaaaa

SEQ ID NO: 383437 - DNA, 20 bp, Artificial
  CRISPR gRNA sequence
ggtgggggaaaagcccctta

SEQ ID NO: 383438 - DNA, 20 bp, Artificial
  CRISPR gRNA sequence
tctaaatgagagaaattggc

SEQ ID NO: 383439 - DNA, 20 bp, Artificial
  CRISPR gRNA sequence
aaatcctgtagggcagtcat

SEQ ID NO: 383440 - DNA, 20 bp, Artificial
  CRISPR gRNA sequence
cctgtcttcttctgagccct

SEQ ID NO: 383441 - DNA, 20 bp, Artificial
  CRISPR gRNA sequence
agagcaggggaagcccctta

SEQ ID NO: 383442 - DNA, 20 bp, Artificial
  CRISPR gRNA sequence
tttaaatgttaatctcatcc

SEQ ID NO: 383443 - DNA, 20 bp, Artificial
  CRISPR gRNA sequence
tgatatggcattagctagtt

SEQ ID NO: 383444 - DNA, 20 bp, Artificial
  CRISPR gRNA sequence
atttatagatacaaacgtgg

SEQ ID NO: 383445 - DNA, 20 bp, Artificial
  CRISPR gRNA sequence
gttcaaaaggaccccaacaa

SEQ ID NO: 383446 - DNA, 20 bp, Artificial
  CRISPR gRNA sequence
gaccccaacaacaaaacacc

SEQ ID NO: 383447 - DNA, 20 bp, Artificial
  CRISPR gRNA sequence
ccaaattcagaaggaaggaa

SEQ ID NO: 383448 - DNA, 20 bp, Artificial
  CRISPR gRNA sequence
tataaagaaggcagacgata

SEQ ID NO: 383449 - DNA, 20 bp, Artificial
  CRISPR gRNA sequence
caaaaaaaaagagaaagttt

SEQ ID NO: 383450 - DNA, 20 bp, Artificial
  CRISPR gRNA sequence
gacttccaaggatggaggtg

SEQ ID NO: 383451 - DNA, 20 bp, Artificial
  CRISPR gRNA sequence
atgtatgcctatacgccatg

SEQ ID NO: 383452 - DNA, 20 bp, Artificial
  CRISPR gRNA sequence
ctttgtgtttgaggcacatg

SEQ ID NO: 383453 - DNA, 20 bp, Artificial
  CRISPR gRNA sequence
agcaggcagataggagacac

SEQ ID NO: 383454 - DNA, 20 bp, Artificial
  CRISPR gRNA sequence
gattcaggtcttacatttta

SEQ ID NO: 383455 - DNA, 20 bp, Artificial
  CRISPR gRNA sequence
agtcaatattcccacatctt

SEQ ID NO: 383456 - DNA, 20 bp, Artificial
  CRISPR gRNA sequence
atattgcaacagccttcatt

SEQ ID NO: 383457 - DNA, 20 bp, Artificial
  CRISPR gRNA sequence
atctgaaatgctccaaaatc

SEQ ID NO: 383458 - DNA, 20 bp, Artificial
  CRISPR gRNA sequence
aggaaacattgtcccacccc

SEQ ID NO: 383459 - DNA, 20 bp, Artificial
  CRISPR gRNA sequence
cccttaggagacatgctcaa

SEQ ID NO: 383460 - DNA, 20 bp, Artificial
  CRISPR gRNA sequence
ggttcttgtctttattacac

SEQ ID NO: 383461 - DNA, 20 bp, Artificial
  CRISPR gRNA sequence
ctcattgttcaagttggatg

SEQ ID NO: 383462 - DNA, 20 bp, Artificial
  CRISPR gRNA sequence
ccttttggatggcacccatt

SEQ ID NO: 383463 - DNA, 20 bp, Artificial
  CRISPR gRNA sequence
tactctgtttttattcactg

SEQ ID NO: 383464 - DNA, 20 bp, Artificial
  CRISPR gRNA sequence
tttctctttttgatgtgctg

SEQ ID NO: 383465 - DNA, 20 bp, Artificial
  CRISPR gRNA sequence
tatattttccctggactttc

SEQ ID NO: 383466 - DNA, 20 bp, Artificial
  CRISPR gRNA sequence
cagttatgagattttctttt

SEQ ID NO: 383467 - DNA, 20 bp, Artificial
  CRISPR gRNA sequence
acagaagtctgtttttagtg

SEQ ID NO: 383468 - DNA, 20 bp, Artificial
  CRISPR gRNA sequence
gctttttagatagaaaaaat

SEQ ID NO: 383469 - DNA, 20 bp, Artificial
  CRISPR gRNA sequence
cacatttctgatgctgttag

SEQ ID NO: 383470 - DNA, 20 bp, Artificial
  CRISPR gRNA sequence
actggtaataacgaggtccc

SEQ ID NO: 383471 - DNA, 20 bp, Artificial
  CRISPR gRNA sequence
gaaacaaaaattcaaattaa

SEQ ID NO: 383472 - DNA, 20 bp, Artificial
  CRISPR gRNA sequence
ccccaaagcccaaactaaat

SEQ ID NO: 383473 - DNA, 20 bp, Artificial
  CRISPR gRNA sequence
gcccaaactaaatcaaaaca

SEQ ID NO: 383474 - DNA, 20 bp, Artificial
  CRISPR gRNA sequence
ttatgccaaagagcattgga

SEQ ID NO: 383475 - DNA, 20 bp, Artificial
  CRISPR gRNA sequence
gaccagcctgggcaacttgg

SEQ ID NO: 383476 - DNA, 20 bp, Artificial
  CRISPR gRNA sequence
gatgcttgtctaaacatcag

SEQ ID NO: 383477 - DNA, 20 bp, Artificial
  CRISPR gRNA sequence
tcacaaggaattgctaacca

SEQ ID NO: 383478 - DNA, 20 bp, Artificial
  CRISPR gRNA sequence
gtggatataatcaaacaaac

SEQ ID NO: 383479 - DNA, 20 bp, Artificial
  CRISPR gRNA sequence
accactcaagatggtgttgc

SEQ ID NO: 383480 - DNA, 20 bp, Artificial
  CRISPR gRNA sequence
ttagatttacagaaaagtgg

SEQ ID NO: 383481 - DNA, 20 bp, Artificial
  CRISPR gRNA sequence
cagggctgcctccttcttta

SEQ ID NO: 383482 - DNA, 20 bp, Artificial
  CRISPR gRNA sequence
acacagtgcaccaagagtat

SEQ ID NO: 383483 - DNA, 20 bp, Artificial
  CRISPR gRNA sequence
gctctttggagagttggtat

SEQ ID NO: 383484 - DNA, 20 bp, Artificial
  CRISPR gRNA sequence
gaagtaaatgacaacaaata

SEQ ID NO: 383485 - DNA, 20 bp, Artificial
  CRISPR gRNA sequence
aacacaatagaaggtagagg

SEQ ID NO: 383486 - DNA, 20 bp, Artificial
  CRISPR gRNA sequence
aagacatagccacagaaata

SEQ ID NO: 383487 - DNA, 20 bp, Artificial
  CRISPR gRNA sequence
gaccagcctggccaacatgg

SEQ ID NO: 383488 - DNA, 20 bp, Artificial
  CRISPR gRNA sequence
acagagtgggactccatctg

SEQ ID NO: 383489 - DNA, 20 bp, Artificial
  CRISPR gRNA sequence
atttcctgagcagtgtgttt

SEQ ID NO: 383490 - DNA, 20 bp, Artificial
  CRISPR gRNA sequence
tcttccttgctttctacttg

SEQ ID NO: 383491 - DNA, 20 bp, Artificial
  CRISPR gRNA sequence
ccctgctgcagggtggaaaa

SEQ ID NO: 383492 - DNA, 20 bp, Artificial
  CRISPR gRNA sequence
tcttgatgtctttttctgtt

SEQ ID NO: 383493 - DNA, 20 bp, Artificial
  CRISPR gRNA sequence
cttatgatactgactataat

SEQ ID NO: 383494 - DNA, 20 bp, Artificial
  CRISPR gRNA sequence
catgaaaaatgtatgagctt

SEQ ID NO: 383495 - DNA, 20 bp, Artificial
  CRISPR gRNA sequence
atcattaccttcacccctca

SEQ ID NO: 383496 - DNA, 20 bp, Artificial
  CRISPR gRNA sequence
ccggccagaaaaatttttaa

SEQ ID NO: 383497 - DNA, 20 bp, Artificial
  CRISPR gRNA sequence
cagctgcatccatgttccca

SEQ ID NO: 383498 - DNA, 20 bp, Artificial
  CRISPR gRNA sequence
tcctgcaataaaaatcatgg

SEQ ID NO: 383499 - DNA, 20 bp, Artificial
  CRISPR gRNA sequence
catccagagagaagaagaag

SEQ ID NO: 383500 - DNA, 20 bp, Artificial
  CRISPR gRNA sequence
agagaagaagaagaaaaaca

SEQ ID NO: 383501 - DNA, 20 bp, Artificial
  CRISPR gRNA sequence
aatcaatattgagcaaaatt

SEQ ID NO: 383502 - DNA, 20 bp, Artificial
  CRISPR gRNA sequence
tctatttatctcccggactt

SEQ ID NO: 383503 - DNA, 20 bp, Artificial
  CRISPR gRNA sequence
atctcccggacttaaaaaca

SEQ ID NO: 383504 - DNA, 20 bp, Artificial
  CRISPR gRNA sequence
ggacttaaaaacaaaaaaca

SEQ ID NO: 383505 - DNA, 20 bp, Artificial
  CRISPR gRNA sequence
aacaaaaaacaaaaaacaaa

SEQ ID NO: 383506 - DNA, 20 bp, Artificial
  CRISPR gRNA sequence
acttgcaggccagcgcagga

SEQ ID NO: 383507 - DNA, 20 bp, Artificial
  CRISPR gRNA sequence
aagaaattcgtaaagggctg

SEQ ID NO: 383508 - DNA, 20 bp, Artificial
  CRISPR gRNA sequence
tcattgtgtttcaggacctg

SEQ ID NO: 383509 - DNA, 20 bp, Artificial
  CRISPR gRNA sequence
gtgtaagattccagccccca

SEQ ID NO: 383510 - DNA, 20 bp, Artificial
  CRISPR gRNA sequence
ggtcaggaaaaagaaacagt

SEQ ID NO: 383511 - DNA, 20 bp, Artificial
  CRISPR gRNA sequence
agatgactaagtttcttgca

SEQ ID NO: 383512 - DNA, 20 bp, Artificial
  CRISPR gRNA sequence
tataagtgaaagattgaata

SEQ ID NO: 383513 - DNA, 20 bp, Artificial
  CRISPR gRNA sequence
tataaaacttagatgcaaag

SEQ ID NO: 383514 - DNA, 20 bp, Artificial
  CRISPR gRNA sequence
ctggaggaggctaatattga

SEQ ID NO: 383515 - DNA, 20 bp, Artificial
  CRISPR gRNA sequence
ttaaattaagtgatgacagt

SEQ ID NO: 383516 - DNA, 20 bp, Artificial
  CRISPR gRNA sequence
tagttcttgagcaaagatgg

SEQ ID NO: 383517 - DNA, 20 bp, Artificial
  CRISPR gRNA sequence
gtttgtgctttccactgcct

SEQ ID NO: 383518 - DNA, 20 bp, Artificial
  CRISPR gRNA sequence
tcaactacagtgattggaga

SEQ ID NO: 383519 - DNA, 20 bp, Artificial
  CRISPR gRNA sequence
ggattagtaaattaagatta

SEQ ID NO: 383520 - DNA, 20 bp, Artificial
  CRISPR gRNA sequence
cttggccttttatttctgtc

SEQ ID NO: 383521 - DNA, 20 bp, Artificial
  CRISPR gRNA sequence
tattcattttttgaacacac

SEQ ID NO: 383522 - DNA, 20 bp, Artificial
  CRISPR gRNA sequence
ttgtctcttagagccttatt

SEQ ID NO: 383523 - DNA, 20 bp, Artificial
  CRISPR gRNA sequence
acagtgagtgaaacaataaa

SEQ ID NO: 383524 - DNA, 20 bp, Artificial
  CRISPR gRNA sequence
ttctgctcaaagtggaagag

SEQ ID NO: 383525 - DNA, 20 bp, Artificial
  CRISPR gRNA sequence
acctctaaaatctcccttcc

SEQ ID NO: 383526 - DNA, 20 bp, Artificial
  CRISPR gRNA sequence
caaaagtttattttccatat

SEQ ID NO: 383527 - DNA, 20 bp, Artificial
  CRISPR gRNA sequence
caaaatctcctccctaccca

SEQ ID NO: 383528 - DNA, 20 bp, Artificial
  CRISPR gRNA sequence
aaaactgctccacaaaggta

SEQ ID NO: 383529 - DNA, 20 bp, Artificial
  CRISPR gRNA sequence
taattggctttatccaaagg

SEQ ID NO: 383530 - DNA, 20 bp, Artificial
  CRISPR gRNA sequence
aggttttttttattgttata

SEQ ID NO: 383531 - DNA, 20 bp, Artificial
  CRISPR gRNA sequence
gtcattctatattgtgtagg

SEQ ID NO: 383532 - DNA, 20 bp, Artificial
  CRISPR gRNA sequence
tgggccttatgtttcttagt

SEQ ID NO: 383533 - DNA, 20 bp, Artificial
  CRISPR gRNA sequence
actctaggaccttctagcta

SEQ ID NO: 383534 - DNA, 20 bp, Artificial
  CRISPR gRNA sequence
ggtttctgaaatacagagta

SEQ ID NO: 383535 - DNA, 20 bp, Artificial
  CRISPR gRNA sequence
gacaaagaaagttgaccttt

SEQ ID NO: 383536 - DNA, 20 bp, Artificial
  CRISPR gRNA sequence
atcattatgcagttgccaaa

SEQ ID NO: 383537 - DNA, 20 bp, Artificial
  CRISPR gRNA sequence
agttgccaaaaaaaactgtt

SEQ ID NO: 383538 - DNA, 20 bp, Artificial
  CRISPR gRNA sequence
gtttacattatatagaaggt

SEQ ID NO: 383539 - DNA, 20 bp, Artificial
  CRISPR gRNA sequence
cattatggtccatctgtaca

SEQ ID NO: 383540 - DNA, 20 bp, Artificial
  CRISPR gRNA sequence
ctctgctgtatgataaatct

SEQ ID NO: 383541 - DNA, 20 bp, Artificial
  CRISPR gRNA sequence
ctgcactccagcctgggtga

SEQ ID NO: 383542 - DNA, 20 bp, Artificial
  CRISPR gRNA sequence
agagcatataaacaaagaga

SEQ ID NO: 383543 - DNA, 20 bp, Artificial
  CRISPR gRNA sequence
gagaaaaaacatattcccaa

SEQ ID NO: 383544 - DNA, 20 bp, Artificial
  CRISPR gRNA sequence
cccctttgaaaattgctaat

SEQ ID NO: 383545 - DNA, 20 bp, Artificial
  CRISPR gRNA sequence
acacacaccatgatggcggc

SEQ ID NO: 383546 - DNA, 20 bp, Artificial
  CRISPR gRNA sequence
ctcaatctgacatctattag

SEQ ID NO: 383547 - DNA, 20 bp, Artificial
  CRISPR gRNA sequence
acatctattagcaaaactta

SEQ ID NO: 383548 - DNA, 20 bp, Artificial
  CRISPR gRNA sequence
ttaaattgtctaggactttt

SEQ ID NO: 383549 - DNA, 20 bp, Artificial
  CRISPR gRNA sequence
tggtgcctgttactgtgggg

SEQ ID NO: 383550 - DNA, 20 bp, Artificial
  CRISPR gRNA sequence
tggtagtgtgagagcagaga

SEQ ID NO: 383551 - DNA, 20 bp, Artificial
  CRISPR gRNA sequence
ccaagaggccaaacattact

SEQ ID NO: 383552 - DNA, 20 bp, Artificial
  CRISPR gRNA sequence
aaaatataaaaaagcccaaa

SEQ ID NO: 383553 - DNA, 20 bp, Artificial
  CRISPR gRNA sequence
aacccaattaaaaagtgggc

SEQ ID NO: 383554 - DNA, 20 bp, Artificial
  CRISPR gRNA sequence
gtcatcagggaaatgcaaat

SEQ ID NO: 383555 - DNA, 20 bp, Artificial
  CRISPR gRNA sequence
ttatttgtggaatctaggtc

SEQ ID NO: 383556 - DNA, 20 bp, Artificial
  CRISPR gRNA sequence
ttttttttttttgtaatgtg

SEQ ID NO: 383557 - DNA, 20 bp, Artificial
  CRISPR gRNA sequence
tgtaaaactcagcttaatca

SEQ ID NO: 383558 - DNA, 20 bp, Artificial
  CRISPR gRNA sequence
tattttttttctctcctagg

SEQ ID NO: 383559 - DNA, 20 bp, Artificial
  CRISPR gRNA sequence
taacaaaaattaaaaattaa

SEQ ID NO: 383560 - DNA, 20 bp, Artificial
  CRISPR gRNA sequence
cactcctaccagaataatgt

SEQ ID NO: 383561 - DNA, 20 bp, Artificial
  CRISPR gRNA sequence
aaacatttgtctaattaaac

SEQ ID NO: 383562 - DNA, 20 bp, Artificial
  CRISPR gRNA sequence
aatcagacagtgtccctgaa

SEQ ID NO: 383563 - DNA, 20 bp, Artificial
  CRISPR gRNA sequence
tggtgaaaccccatctctac

SEQ ID NO: 383564 - DNA, 20 bp, Artificial
  CRISPR gRNA sequence
agtaaatgatctaatttata

SEQ ID NO: 383565 - DNA, 20 bp, Artificial
  CRISPR gRNA sequence
ctcaccttaaagagaactcc

SEQ ID NO: 383566 - DNA, 20 bp, Artificial
  CRISPR gRNA sequence
gagaagacagggaaaatgaa

SEQ ID NO: 383567 - DNA, 20 bp, Artificial
  CRISPR gRNA sequence
gggctgctgtgacaaattac

SEQ ID NO: 383568 - DNA, 20 bp, Artificial
  CRISPR gRNA sequence
attaccaaaacggggtggct

SEQ ID NO: 383569 - DNA, 20 bp, Artificial
  CRISPR gRNA sequence
attttttttgtttgttggca

SEQ ID NO: 383570 - DNA, 20 bp, Artificial
  CRISPR gRNA sequence
tttcattttgctttcttctt

SEQ ID NO: 383571 - DNA, 20 bp, Artificial
  CRISPR gRNA sequence
agagcgagactctgactcaa

SEQ ID NO: 383572 - DNA, 20 bp, Artificial
  CRISPR gRNA sequence
tttttcatagaactgtttca

SEQ ID NO: 383573 - DNA, 20 bp, Artificial
  CRISPR gRNA sequence
taactggtttatatacaaaa

SEQ ID NO: 383574 - DNA, 20 bp, Artificial
  CRISPR gRNA sequence
aaagtatttgccaaactgaa

SEQ ID NO: 383575 - DNA, 20 bp, Artificial
  CRISPR gRNA sequence
cttttcaggagtgaaaaaat

SEQ ID NO: 383576 - DNA, 20 bp, Artificial
  CRISPR gRNA sequence
aatcaaaatattactttctg

SEQ ID NO: 383577 - DNA, 20 bp, Artificial
  CRISPR gRNA sequence
tgattagtgtatgtgagcag

SEQ ID NO: 383578 - DNA, 20 bp, Artificial
  CRISPR gRNA sequence
tgttactaagaaagcagatg

SEQ ID NO: 383579 - DNA, 20 bp, Artificial
  CRISPR gRNA sequence
gtgaagatataatttttagt

SEQ ID NO: 383580 - DNA, 20 bp, Artificial
  CRISPR gRNA sequence
cagccaagactctgggctct

SEQ ID NO: 383581 - DNA, 20 bp, Artificial
  CRISPR gRNA sequence
ggctcttaaaacatgtatct

SEQ ID NO: 383582 - DNA, 20 bp, Artificial
  CRISPR gRNA sequence
aaaacatgtatctgaaaact

SEQ ID NO: 383583 - DNA, 20 bp, Artificial
  CRISPR gRNA sequence
attctgttgttttgaatgaa

SEQ ID NO: 383584 - DNA, 20 bp, Artificial
  CRISPR gRNA sequence
tgtaggagggaaagcaaaat

SEQ ID NO: 383585 - DNA, 20 bp, Artificial
  CRISPR gRNA sequence
ttaccatgtagtttaactaa

SEQ ID NO: 383586 - DNA, 20 bp, Artificial
  CRISPR gRNA sequence
taccatgtagtttaactaag

SEQ ID NO: 383587 - DNA, 20 bp, Artificial
  CRISPR gRNA sequence
accatgtagtttaactaaga

SEQ ID NO: 383588 - DNA, 20 bp, Artificial
  CRISPR gRNA sequence
ccatgtagtttaactaagag

SEQ ID NO: 383589 - DNA, 20 bp, Artificial
  CRISPR gRNA sequence
aactaagagtactggcaagg

SEQ ID NO: 383590 - DNA, 20 bp, Artificial
  CRISPR gRNA sequence
actaagagtactggcaaggt

SEQ ID NO: 383591 - DNA, 20 bp, Artificial
  CRISPR gRNA sequence
agagtactggcaaggtcata

SEQ ID NO: 383592 - DNA, 20 bp, Artificial
  CRISPR gRNA sequence
gcaaggtcataagaaataaa

SEQ ID NO: 383593 - DNA, 20 bp, Artificial
  CRISPR gRNA sequence
atataatcatattttaatac

SEQ ID NO: 383594 - DNA, 20 bp, Artificial
  CRISPR gRNA sequence
taatacaaatatttctgaaa

SEQ ID NO: 383595 - DNA, 20 bp, Artificial
  CRISPR gRNA sequence
aatacaaatatttctgaaag

SEQ ID NO: 383596 - DNA, 20 bp, Artificial
  CRISPR gRNA sequence
atacaaatatttctgaaaga

SEQ ID NO: 383597 - DNA, 20 bp, Artificial
  CRISPR gRNA sequence
ctgaaagagacatgagaaga

SEQ ID NO: 383598 - DNA, 20 bp, Artificial
  CRISPR gRNA sequence
tgaaagagacatgagaagag

SEQ ID NO: 383599 - DNA, 20 bp, Artificial
  CRISPR gRNA sequence
aaagagacatgagaagagta

SEQ ID NO: 383600 - DNA, 20 bp, Artificial
  CRISPR gRNA sequence
tatgtggtgagtttggggag

SEQ ID NO: 383601 - DNA, 20 bp, Artificial
  CRISPR gRNA sequence
atgtggtgagtttggggaga

SEQ ID NO: 383602 - DNA, 20 bp, Artificial
  CRISPR gRNA sequence
tgtggtgagtttggggagag

SEQ ID NO: 383603 - DNA, 20 bp, Artificial
  CRISPR gRNA sequence
ggggagagaaagacatctaa

SEQ ID NO: 383604 - DNA, 20 bp, Artificial
  CRISPR gRNA sequence
gggagagaaagacatctaaa

SEQ ID NO: 383605 - DNA, 20 bp, Artificial
  CRISPR gRNA sequence
aatgaataatgaatgtctaa

SEQ ID NO: 383606 - DNA, 20 bp, Artificial
  CRISPR gRNA sequence
aaattgaaaaaaaaagtatt

SEQ ID NO: 383607 - DNA, 20 bp, Artificial
  CRISPR gRNA sequence
aaaaaaaaagtattagtgtc

SEQ ID NO: 383608 - DNA, 20 bp, Artificial
  CRISPR gRNA sequence
gtgtcataagcatgctattc

SEQ ID NO: 383609 - DNA, 20 bp, Artificial
  CRISPR gRNA sequence
ttcagaaaagtgaacataaa

SEQ ID NO: 383610 - DNA, 20 bp, Artificial
  CRISPR gRNA sequence
agaaaagtgaacataaataa

SEQ ID NO: 383611 - DNA, 20 bp, Artificial
  CRISPR gRNA sequence
gaagtagtaaaatttgttgt

SEQ ID NO: 383612 - DNA, 20 bp, Artificial
  CRISPR gRNA sequence
gttgtctcaaggtaacaaaa

SEQ ID NO: 383613 - DNA, 20 bp, Artificial
  CRISPR gRNA sequence
ttgtctcaaggtaacaaaaa

SEQ ID NO: 383614 - DNA, 20 bp, Artificial
  CRISPR gRNA sequence
tctcaaggtaacaaaaatga

SEQ ID NO: 383615 - DNA, 20 bp, Artificial
  CRISPR gRNA sequence
aaggtaacaaaaatgaggaa

SEQ ID NO: 383616 - DNA, 20 bp, Artificial
  CRISPR gRNA sequence
ctatgtttcgggaaaaacaa

SEQ ID NO: 383617 - DNA, 20 bp, Artificial
  CRISPR gRNA sequence
tgtttcgggaaaaacaaaaa

SEQ ID NO: 383618 - DNA, 20 bp, Artificial
  CRISPR gRNA sequence
cgggaaaaacaaaaacaaac

SEQ ID NO: 383619 - DNA, 20 bp, Artificial
  CRISPR gRNA sequence
gggaaaaacaaaaacaaaca

SEQ ID NO: 383620 - DNA, 20 bp, Artificial
  CRISPR gRNA sequence
taaagccctttgaccctttg

SEQ ID NO: 383621 - DNA, 20 bp, Artificial
  CRISPR gRNA sequence
tgaccctttgcactacatgc

SEQ ID NO: 383622 - DNA, 20 bp, Artificial
  CRISPR gRNA sequence
gaccctttgcactacatgca

SEQ ID NO: 383623 - DNA, 20 bp, Artificial
  CRISPR gRNA sequence
accctttgcactacatgcac

SEQ ID NO: 383624 - DNA, 20 bp, Artificial
  CRISPR gRNA sequence
tgcactacatgcacttataa

SEQ ID NO: 383625 - DNA, 20 bp, Artificial
  CRISPR gRNA sequence
gcactacatgcacttataaa

SEQ ID NO: 383626 - DNA, 20 bp, Artificial
  CRISPR gRNA sequence
cactacatgcacttataaaa

SEQ ID NO: 383627 - DNA, 20 bp, Artificial
  CRISPR gRNA sequence
catgcacttataaaatacaa

SEQ ID NO: 383628 - DNA, 20 bp, Artificial
  CRISPR gRNA sequence
ataaaatacaaagaacaagg

SEQ ID NO: 383629 - DNA, 20 bp, Artificial
  CRISPR gRNA sequence
taaaatacaaagaacaaggc

SEQ ID NO: 383630 - DNA, 20 bp, Artificial
  CRISPR gRNA sequence
atgcctgtaatcccagcaat

SEQ ID NO: 383631 - DNA, 20 bp, Artificial
  CRISPR gRNA sequence
taatcccagcaatttaggag

SEQ ID NO: 383632 - DNA, 20 bp, Artificial
  CRISPR gRNA sequence
aggaggctgaggcaggtgga

SEQ ID NO: 383633 - DNA, 20 bp, Artificial
  CRISPR gRNA sequence
ggaggctgaggcaggtggat

SEQ ID NO: 383634 - DNA, 20 bp, Artificial
  CRISPR gRNA sequence
aggcaggtggatcacctgag

SEQ ID NO: 383635 - DNA, 20 bp, Artificial
  CRISPR gRNA sequence
aggtccagagttcaagacaa

SEQ ID NO: 383636 - DNA, 20 bp, Artificial
  CRISPR gRNA sequence
aagacaagtctgaccaacgt

SEQ ID NO: 383637 - DNA, 20 bp, Artificial
  CRISPR gRNA sequence
accaacgtggagaaaccccg

SEQ ID NO: 383638 - DNA, 20 bp, Artificial
  CRISPR gRNA sequence
cactaaaaatacaaaattag

SEQ ID NO: 383639 - DNA, 20 bp, Artificial
  CRISPR gRNA sequence
aaaatacaaaattagccagg

SEQ ID NO: 383640 - DNA, 20 bp, Artificial
  CRISPR gRNA sequence
gccaggcatgttggcatatg

SEQ ID NO: 383641 - DNA, 20 bp, Artificial
  CRISPR gRNA sequence
gcatatgcctgtaatcccag

SEQ ID NO: 383642 - DNA, 20 bp, Artificial
  CRISPR gRNA sequence
taatcccagctattcaggag

SEQ ID NO: 383643 - DNA, 20 bp, Artificial
  CRISPR gRNA sequence
ttcaggaggctgaggcagga

SEQ ID NO: 383644 - DNA, 20 bp, Artificial
  CRISPR gRNA sequence
aggaggctgaggcaggagaa

SEQ ID NO: 383645 - DNA, 20 bp, Artificial
  CRISPR gRNA sequence
aggcaggagaatcacttgaa

SEQ ID NO: 383646 - DNA, 20 bp, Artificial
  CRISPR gRNA sequence
gaatccgggaggcagaggtt

SEQ ID NO: 383647 - DNA, 20 bp, Artificial
  CRISPR gRNA sequence
aatccgggaggcagaggttg

SEQ ID NO: 383648 - DNA, 20 bp, Artificial
  CRISPR gRNA sequence
tggtgagccgagattgtgcc

SEQ ID NO: 383649 - DNA, 20 bp, Artificial
  CRISPR gRNA sequence
tgccattgcactccagcccg

SEQ ID NO: 383650 - DNA, 20 bp, Artificial
  CRISPR gRNA sequence
cactccagcccgggcaacaa

SEQ ID NO: 383651 - DNA, 20 bp, Artificial
  CRISPR gRNA sequence
cagcccgggcaacaaaagtg

SEQ ID NO: 383652 - DNA, 20 bp, Artificial
  CRISPR gRNA sequence
cgtctcaaaaaaataataat

SEQ ID NO: 383653 - DNA, 20 bp, Artificial
  CRISPR gRNA sequence
aaaaaaataataataaaata

SEQ ID NO: 383654 - DNA, 20 bp, Artificial
  CRISPR gRNA sequence
cattgagataaaaattacaa

SEQ ID NO: 383655 - DNA, 20 bp, Artificial
  CRISPR gRNA sequence
agataaaaattacaatgtat

SEQ ID NO: 383656 - DNA, 20 bp, Artificial
  CRISPR gRNA sequence
caatgtatcattgatttgaa

SEQ ID NO: 383657 - DNA, 20 bp, Artificial
  CRISPR gRNA sequence
atttgaattttttctgcatg

SEQ ID NO: 383658 - DNA, 20 bp, Artificial
  CRISPR gRNA sequence
gaattttttctgcatgtaat

SEQ ID NO: 383659 - DNA, 20 bp, Artificial
  CRISPR gRNA sequence
aattttttctgcatgtaatt

SEQ ID NO: 383660 - DNA, 20 bp, Artificial
  CRISPR gRNA sequence
tttctgcatgtaattcatca

SEQ ID NO: 383661 - DNA, 20 bp, Artificial
  CRISPR gRNA sequence
ttctgcatgtaattcatcag

SEQ ID NO: 383662 - DNA, 20 bp, Artificial
  CRISPR gRNA sequence
tctgcatgtaattcatcagt

SEQ ID NO: 383663 - DNA, 20 bp, Artificial
  CRISPR gRNA sequence
ctgcatgtaattcatcagtt

SEQ ID NO: 383664 - DNA, 20 bp, Artificial
  CRISPR gRNA sequence
tgcatgtaattcatcagtta

SEQ ID NO: 383665 - DNA, 20 bp, Artificial
  CRISPR gRNA sequence
catgtaattcatcagttaat

SEQ ID NO: 383666 - DNA, 20 bp, Artificial
  CRISPR gRNA sequence
atcagttaattttattctgt

SEQ ID NO: 383667 - DNA, 20 bp, Artificial
  CRISPR gRNA sequence
attttattctgtagaaattt

SEQ ID NO: 383668 - DNA, 20 bp, Artificial
  CRISPR gRNA sequence
tattctgtagaaatttttcc

SEQ ID NO: 383669 - DNA, 20 bp, Artificial
  CRISPR gRNA sequence
attctgtagaaatttttccc

SEQ ID NO: 383670 - DNA, 20 bp, Artificial
  CRISPR gRNA sequence
ttctgtagaaatttttccct

SEQ ID NO: 383671 - DNA, 20 bp, Artificial
  CRISPR gRNA sequence
tgtagaaatttttccctgct

SEQ ID NO: 383672 - DNA, 20 bp, Artificial
  CRISPR gRNA sequence
tagaaatttttccctgctat

SEQ ID NO: 383673 - DNA, 20 bp, Artificial
  CRISPR gRNA sequence
ttccctgctatttctccatg

SEQ ID NO: 383674 - DNA, 20 bp, Artificial
  CRISPR gRNA sequence
tccctgctatttctccatgg

SEQ ID NO: 383675 - DNA, 20 bp, Artificial
  CRISPR gRNA sequence
ccctgctatttctccatggc

SEQ ID NO: 383676 - DNA, 20 bp, Artificial
  CRISPR gRNA sequence
cctgctatttctccatggca

SEQ ID NO: 383677 - DNA, 20 bp, Artificial
  CRISPR gRNA sequence
ctatttctccatggcaaatg

SEQ ID NO: 383678 - DNA, 20 bp, Artificial
  CRISPR gRNA sequence
tttctccatggcaaatgaaa

SEQ ID NO: 383679 - DNA, 20 bp, Artificial
  CRISPR gRNA sequence
ctccatggcaaatgaaagta

SEQ ID NO: 383680 - DNA, 20 bp, Artificial
  CRISPR gRNA sequence
tccatggcaaatgaaagtag

SEQ ID NO: 383681 - DNA, 20 bp, Artificial
  CRISPR gRNA sequence
catggcaaatgaaagtagtg

SEQ ID NO: 383682 - DNA, 20 bp, Artificial
  CRISPR gRNA sequence
tgttttattcattcaaaaca

SEQ ID NO: 383683 - DNA, 20 bp, Artificial
  CRISPR gRNA sequence
tattcattcaaaacaacaga

SEQ ID NO: 383684 - DNA, 20 bp, Artificial
  CRISPR gRNA sequence
attcattcaaaacaacagaa

SEQ ID NO: 383685 - DNA, 20 bp, Artificial
  CRISPR gRNA sequence
ttcattcaaaacaacagaat

SEQ ID NO: 383686 - DNA, 20 bp, Artificial
  CRISPR gRNA sequence
attcaaaacaacagaataca

SEQ ID NO: 383687 - DNA, 20 bp, Artificial
  CRISPR gRNA sequence
aaaacaacagaatacaagac

SEQ ID NO: 383688 - DNA, 20 bp, Artificial
  CRISPR gRNA sequence
ctataccctacaagaaccaa

SEQ ID NO: 383689 - DNA, 20 bp, Artificial
  CRISPR gRNA sequence
tataccctacaagaaccaaa

SEQ ID NO: 383690 - DNA, 20 bp, Artificial
  CRISPR gRNA sequence
taccctacaagaaccaaaaa

SEQ ID NO: 383691 - DNA, 20 bp, Artificial
  CRISPR gRNA sequence
caagaaccaaaaatccaaaa

SEQ ID NO: 383692 - DNA, 20 bp, Artificial
  CRISPR gRNA sequence
acactagaaaaagtgttctg

SEQ ID NO: 383693 - DNA, 20 bp, Artificial
  CRISPR gRNA sequence
gaaaaagtgttctgaacagg

SEQ ID NO: 383694 - DNA, 20 bp, Artificial
  CRISPR gRNA sequence
tgaacaggttgaccatataa

SEQ ID NO: 383695 - DNA, 20 bp, Artificial
  CRISPR gRNA sequence
aacaggttgaccatataact

SEQ ID NO: 383696 - DNA, 20 bp, Artificial
  CRISPR gRNA sequence
accatataacttattctaac

SEQ ID NO: 383697 - DNA, 20 bp, Artificial
  CRISPR gRNA sequence
attctaacaaggataatacg

SEQ ID NO: 383698 - DNA, 20 bp, Artificial
  CRISPR gRNA sequence
ttctaacaaggataatacga

SEQ ID NO: 383699 - DNA, 20 bp, Artificial
  CRISPR gRNA sequence
taacaaggataatacgaaat

SEQ ID NO: 383700 - DNA, 20 bp, Artificial
  CRISPR gRNA sequence
acaaggataatacgaaataa

SEQ ID NO: 383701 - DNA, 20 bp, Artificial
  CRISPR gRNA sequence
tcccagacatttattactca

SEQ ID NO: 383702 - DNA, 20 bp, Artificial
  CRISPR gRNA sequence
attactcatacttccaaatg

SEQ ID NO: 383703 - DNA, 20 bp, Artificial
  CRISPR gRNA sequence
ttactcatacttccaaatgg

SEQ ID NO: 383704 - DNA, 20 bp, Artificial
  CRISPR gRNA sequence
ctcatacttccaaatggacc

SEQ ID NO: 383705 - DNA, 20 bp, Artificial
  CRISPR gRNA sequence
atacttccaaatggaccttt

SEQ ID NO: 383706 - DNA, 20 bp, Artificial
  CRISPR gRNA sequence
ccaaatggaccttttcttac

SEQ ID NO: 383707 - DNA, 20 bp, Artificial
  CRISPR gRNA sequence
caaatggaccttttcttaca

SEQ ID NO: 383708 - DNA, 20 bp, Artificial
  CRISPR gRNA sequence
ttcttacatcttacaagata

SEQ ID NO: 383709 - DNA, 20 bp, Artificial
  CRISPR gRNA sequence
tcttacatcttacaagatag

SEQ ID NO: 383710 - DNA, 20 bp, Artificial
  CRISPR gRNA sequence
cttacatcttacaagatagt

SEQ ID NO: 383711 - DNA, 20 bp, Artificial
  CRISPR gRNA sequence
ttacatcttacaagatagtt

SEQ ID NO: 383712 - DNA, 20 bp, Artificial
  CRISPR gRNA sequence
acatcttacaagatagttag

SEQ ID NO: 383713 - DNA, 20 bp, Artificial
  CRISPR gRNA sequence
catcttacaagatagttagt

SEQ ID NO: 383714 - DNA, 20 bp, Artificial
  CRISPR gRNA sequence
acaagatagttagtgctctg

SEQ ID NO: 383715 - DNA, 20 bp, Artificial
  CRISPR gRNA sequence
caagatagttagtgctctga

SEQ ID NO: 383716 - DNA, 20 bp, Artificial
  CRISPR gRNA sequence
gtgctctgaatctggaaaaa

SEQ ID NO: 383717 - DNA, 20 bp, Artificial
  CRISPR gRNA sequence
tgaatctggaaaaatatgtg

SEQ ID NO: 383718 - DNA, 20 bp, Artificial
  CRISPR gRNA sequence
aatctggaaaaatatgtgta

SEQ ID NO: 383719 - DNA, 20 bp, Artificial
  CRISPR gRNA sequence
gaaaaatatgtgtaaaccga

SEQ ID NO: 383720 - DNA, 20 bp, Artificial
  CRISPR gRNA sequence
gaggatttataaaatttcct

SEQ ID NO: 383721 - DNA, 20 bp, Artificial
  CRISPR gRNA sequence
aggatttataaaatttcctt

SEQ ID NO: 383722 - DNA, 20 bp, Artificial
  CRISPR gRNA sequence
ataaaatttccttagaaagc

SEQ ID NO: 383723 - DNA, 20 bp, Artificial
  CRISPR gRNA sequence
taaaatttccttagaaagca

SEQ ID NO: 383724 - DNA, 20 bp, Artificial
  CRISPR gRNA sequence
ccttagaaagcattgcagtt

SEQ ID NO: 383725 - DNA, 20 bp, Artificial
  CRISPR gRNA sequence
cttagaaagcattgcagtta

SEQ ID NO: 383726 - DNA, 20 bp, Artificial
  CRISPR gRNA sequence
agaaagcattgcagttaatt

SEQ ID NO: 383727 - DNA, 20 bp, Artificial
  CRISPR gRNA sequence
gaaagcattgcagttaattc

SEQ ID NO: 383728 - DNA, 20 bp, Artificial
  CRISPR gRNA sequence
cagttaattctagaagctat

SEQ ID NO: 383729 - DNA, 20 bp, Artificial
  CRISPR gRNA sequence
attctagaagctatttttct

SEQ ID NO: 383730 - DNA, 20 bp, Artificial
  CRISPR gRNA sequence
tagaagctatttttctacct

SEQ ID NO: 383731 - DNA, 20 bp, Artificial
  CRISPR gRNA sequence
gaagctatttttctacctat

SEQ ID NO: 383732 - DNA, 20 bp, Artificial
  CRISPR gRNA sequence
tttttctacctattgaatca

SEQ ID NO: 383733 - DNA, 20 bp, Artificial
  CRISPR gRNA sequence
ttctacctattgaatcacta

SEQ ID NO: 383734 - DNA, 20 bp, Artificial
  CRISPR gRNA sequence
tctacctattgaatcactag

SEQ ID NO: 383735 - DNA, 20 bp, Artificial
  CRISPR gRNA sequence
ctacctattgaatcactaga

SEQ ID NO: 383736 - DNA, 20 bp, Artificial
  CRISPR gRNA sequence
tacctattgaatcactagaa

SEQ ID NO: 383737 - DNA, 20 bp, Artificial
  CRISPR gRNA sequence
cctattgaatcactagaaat

SEQ ID NO: 383738 - DNA, 20 bp, Artificial
  CRISPR gRNA sequence
ttgaatcactagaaatagag

SEQ ID NO: 383739 - DNA, 20 bp, Artificial
  CRISPR gRNA sequence
aatcactagaaatagagaag

SEQ ID NO: 383740 - DNA, 20 bp, Artificial
  CRISPR gRNA sequence
gaaatagagaagcttttaaa

SEQ ID NO: 383741 - DNA, 20 bp, Artificial
  CRISPR gRNA sequence
ttaaaaaaattaacttgttt

SEQ ID NO: 383742 - DNA, 20 bp, Artificial
  CRISPR gRNA sequence
taaaaaaattaacttgtttt

SEQ ID NO: 383743 - DNA, 20 bp, Artificial
  CRISPR gRNA sequence
aaaaaaattaacttgttttt

SEQ ID NO: 383744 - DNA, 20 bp, Artificial
  CRISPR gRNA sequence
aaaaaattaacttgttttta

SEQ ID NO: 383745 - DNA, 20 bp, Artificial
  CRISPR gRNA sequence
acttgtttttagttttcaga

SEQ ID NO: 383746 - DNA, 20 bp, Artificial
  CRISPR gRNA sequence
gtttttagttttcagataca

SEQ ID NO: 383747 - DNA, 20 bp, Artificial
  CRISPR gRNA sequence
tttttagttttcagatacat

SEQ ID NO: 383748 - DNA, 20 bp, Artificial
  CRISPR gRNA sequence
ttagttttcagatacatgtt

SEQ ID NO: 383749 - DNA, 20 bp, Artificial
  CRISPR gRNA sequence
tagttttcagatacatgttt

SEQ ID NO: 383750 - DNA, 20 bp, Artificial
  CRISPR gRNA sequence
agttttcagatacatgtttt

SEQ ID NO: 383751 - DNA, 20 bp, Artificial
  CRISPR gRNA sequence
gttttcagatacatgtttta

SEQ ID NO: 383752 - DNA, 20 bp, Artificial
  CRISPR gRNA sequence
tcagatacatgttttaagag

SEQ ID NO: 383753 - DNA, 20 bp, Artificial
  CRISPR gRNA sequence
cagatacatgttttaagagc

SEQ ID NO: 383754 - DNA, 20 bp, Artificial
  CRISPR gRNA sequence
agatacatgttttaagagcc

SEQ ID NO: 383755 - DNA, 20 bp, Artificial
  CRISPR gRNA sequence
taagagcccagagtcttggc

SEQ ID NO: 383756 - DNA, 20 bp, Artificial
  CRISPR gRNA sequence
aagagcccagagtcttggct

SEQ ID NO: 383757 - DNA, 20 bp, Artificial
  CRISPR gRNA sequence
agagcccagagtcttggctg

SEQ ID NO: 383758 - DNA, 20 bp, Artificial
  CRISPR gRNA sequence
ggctggaagaactctaatga

SEQ ID NO: 383759 - DNA, 20 bp, Artificial
  CRISPR gRNA sequence
gctggaagaactctaatgaa

SEQ ID NO: 383760 - DNA, 20 bp, Artificial
  CRISPR gRNA sequence
gaagaactctaatgaacaga

SEQ ID NO: 383761 - DNA, 20 bp, Artificial
  CRISPR gRNA sequence
taatgaacagatcagtgaaa

SEQ ID NO: 383762 - DNA, 20 bp, Artificial
  CRISPR gRNA sequence
atgaacagatcagtgaaaaa

SEQ ID NO: 383763 - DNA, 20 bp, Artificial
  CRISPR gRNA sequence
atacagaagtctgaaggtgg

SEQ ID NO: 383764 - DNA, 20 bp, Artificial
  CRISPR gRNA sequence
tacagaagtctgaaggtgga

SEQ ID NO: 383765 - DNA, 20 bp, Artificial
  CRISPR gRNA sequence
aaggtggagatcagtacttt

SEQ ID NO: 383766 - DNA, 20 bp, Artificial
  CRISPR gRNA sequence
tctagatgttacattttaat

SEQ ID NO: 383767 - DNA, 20 bp, Artificial
  CRISPR gRNA sequence
ctagatgttacattttaata

SEQ ID NO: 383768 - DNA, 20 bp, Artificial
  CRISPR gRNA sequence
tagatgttacattttaatag

SEQ ID NO: 383769 - DNA, 20 bp, Artificial
  CRISPR gRNA sequence
gatgttacattttaatagta

SEQ ID NO: 383770 - DNA, 20 bp, Artificial
  CRISPR gRNA sequence
cattttaatagtagctaaac

SEQ ID NO: 383771 - DNA, 20 bp, Artificial
  CRISPR gRNA sequence
taatagtagctaaactaatg

SEQ ID NO: 383772 - DNA, 20 bp, Artificial
  CRISPR gRNA sequence
aatagtagctaaactaatga

SEQ ID NO: 383773 - DNA, 20 bp, Artificial
  CRISPR gRNA sequence
atagtagctaaactaatgat

SEQ ID NO: 383774 - DNA, 20 bp, Artificial
  CRISPR gRNA sequence
aactaatgatgacatgttta

SEQ ID NO: 383775 - DNA, 20 bp, Artificial
  CRISPR gRNA sequence
atgatgacatgtttatattg

SEQ ID NO: 383776 - DNA, 20 bp, Artificial
  CRISPR gRNA sequence
atattgtcttatatttttta

SEQ ID NO: 383777 - DNA, 20 bp, Artificial
  CRISPR gRNA sequence
tattgtcttatattttttaa

SEQ ID NO: 383778 - DNA, 20 bp, Artificial
  CRISPR gRNA sequence
tcttatattttttaaagata

SEQ ID NO: 383779 - DNA, 20 bp, Artificial
  CRISPR gRNA sequence
atattttttaaagatatttt

SEQ ID NO: 383780 - DNA, 20 bp, Artificial
  CRISPR gRNA sequence
tattttttaaagatattttc

SEQ ID NO: 383781 - DNA, 20 bp, Artificial
  CRISPR gRNA sequence
tttaaagatattttcttatc

SEQ ID NO: 383782 - DNA, 20 bp, Artificial
  CRISPR gRNA sequence
ttaaagatattttcttatca

SEQ ID NO: 383783 - DNA, 20 bp, Artificial
  CRISPR gRNA sequence
taaagatattttcttatcac

SEQ ID NO: 383784 - DNA, 20 bp, Artificial
  CRISPR gRNA sequence
aaagatattttcttatcact

SEQ ID NO: 383785 - DNA, 20 bp, Artificial
  CRISPR gRNA sequence
aagatattttcttatcactg

SEQ ID NO: 383786 - DNA, 20 bp, Artificial
  CRISPR gRNA sequence
tcttatcactgttgtgaaaa

SEQ ID NO: 383787 - DNA, 20 bp, Artificial
  CRISPR gRNA sequence
cttatcactgttgtgaaaaa

SEQ ID NO: 383788 - DNA, 20 bp, Artificial
  CRISPR gRNA sequence
ttatcactgttgtgaaaaag

SEQ ID NO: 383789 - DNA, 20 bp, Artificial
  CRISPR gRNA sequence
atcactgttgtgaaaaagaa

SEQ ID NO: 383790 - DNA, 20 bp, Artificial
  CRISPR gRNA sequence
tcactgttgtgaaaaagaaa

SEQ ID NO: 383791 - DNA, 20 bp, Artificial
  CRISPR gRNA sequence
ttgtgaaaaagaaactttgt

SEQ ID NO: 383792 - DNA, 20 bp, Artificial
  CRISPR gRNA sequence
tgaaaaagaaactttgtact

SEQ ID NO: 383793 - DNA, 20 bp, Artificial
  CRISPR gRNA sequence
tgtactcacaatttagcgtc

SEQ ID NO: 383794 - DNA, 20 bp, Artificial
  CRISPR gRNA sequence
gtactcacaatttagcgtct

SEQ ID NO: 383795 - DNA, 20 bp, Artificial
  CRISPR gRNA sequence
tactcacaatttagcgtctc

SEQ ID NO: 383796 - DNA, 20 bp, Artificial
  CRISPR gRNA sequence
acaatttagcgtctccactt

SEQ ID NO: 383797 - DNA, 20 bp, Artificial
  CRISPR gRNA sequence
agcgtctccacttacacttt

SEQ ID NO: 383798 - DNA, 20 bp, Artificial
  CRISPR gRNA sequence
gcgtctccacttacacttta

SEQ ID NO: 383799 - DNA, 20 bp, Artificial
  CRISPR gRNA sequence
cacttacactttataagcat

SEQ ID NO: 383800 - DNA, 20 bp, Artificial
  CRISPR gRNA sequence
acactttataagcatcttta

SEQ ID NO: 383801 - DNA, 20 bp, Artificial
  CRISPR gRNA sequence
cactttataagcatctttat

SEQ ID NO: 383802 - DNA, 20 bp, Artificial
  CRISPR gRNA sequence
tataagcatctttataatat

SEQ ID NO: 383803 - DNA, 20 bp, Artificial
  CRISPR gRNA sequence
ataagcatctttataatatc

SEQ ID NO: 383804 - DNA, 20 bp, Artificial
  CRISPR gRNA sequence
taagcatctttataatatcg

SEQ ID NO: 383805 - DNA, 20 bp, Artificial
  CRISPR gRNA sequence
tataatatcgtcaatcttgc

SEQ ID NO: 383806 - DNA, 20 bp, Artificial
  CRISPR gRNA sequence
ataatatcgtcaatcttgct

SEQ ID NO: 383807 - DNA, 20 bp, Artificial
  CRISPR gRNA sequence
taatatcgtcaatcttgctg

SEQ ID NO: 383808 - DNA, 20 bp, Artificial
  CRISPR gRNA sequence
gctgaaatttcatataagca

SEQ ID NO: 383809 - DNA, 20 bp, Artificial
  CRISPR gRNA sequence
ctgaaatttcatataagcag

SEQ ID NO: 383810 - DNA, 20 bp, Artificial
  CRISPR gRNA sequence
aaatttcatataagcagtac

SEQ ID NO: 383811 - DNA, 20 bp, Artificial
  CRISPR gRNA sequence
catataagcagtacaaaata

SEQ ID NO: 383812 - DNA, 20 bp, Artificial
  CRISPR gRNA sequence
atataagcagtacaaaatac

SEQ ID NO: 383813 - DNA, 20 bp, Artificial
  CRISPR gRNA sequence
taaatcaaggagaagcattt

SEQ ID NO: 383814 - DNA, 20 bp, Artificial
  CRISPR gRNA sequence
tggtcacagtgatctctaat

SEQ ID NO: 383815 - DNA, 20 bp, Artificial
  CRISPR gRNA sequence
ggtcacagtgatctctaatt

SEQ ID NO: 383816 - DNA, 20 bp, Artificial
  CRISPR gRNA sequence
gtcacagtgatctctaatta

SEQ ID NO: 383817 - DNA, 20 bp, Artificial
  CRISPR gRNA sequence
taattacaatgtggactctc

SEQ ID NO: 383818 - DNA, 20 bp, Artificial
  CRISPR gRNA sequence
attacaatgtggactctctc

SEQ ID NO: 383819 - DNA, 20 bp, Artificial
  CRISPR gRNA sequence
caatgtggactctctcaatt

SEQ ID NO: 383820 - DNA, 20 bp, Artificial
  CRISPR gRNA sequence
tctcaatttagaaaactact

SEQ ID NO: 383821 - DNA, 20 bp, Artificial
  CRISPR gRNA sequence
tcaatttagaaaactactgt

SEQ ID NO: 383822 - DNA, 20 bp, Artificial
  CRISPR gRNA sequence
aatttagaaaactactgtta

SEQ ID NO: 383823 - DNA, 20 bp, Artificial
  CRISPR gRNA sequence
agaaaactactgttatacag

SEQ ID NO: 383824 - DNA, 20 bp, Artificial
  CRISPR gRNA sequence
gaaaactactgttatacagc

SEQ ID NO: 383825 - DNA, 20 bp, Artificial
  CRISPR gRNA sequence
ctgttatacagctgtaattt

SEQ ID NO: 383826 - DNA, 20 bp, Artificial
  CRISPR gRNA sequence
ttatacagctgtaattttta

SEQ ID NO: 383827 - DNA, 20 bp, Artificial
  CRISPR gRNA sequence
tacagctgtaatttttactt

SEQ ID NO: 383828 - DNA, 20 bp, Artificial
  CRISPR gRNA sequence
taatttttacttaatgccat

SEQ ID NO: 383829 - DNA, 20 bp, Artificial
  CRISPR gRNA sequence
ttacttaatgccattctata

SEQ ID NO: 383830 - DNA, 20 bp, Artificial
  CRISPR gRNA sequence
tacttaatgccattctatac

SEQ ID NO: 383831 - DNA, 20 bp, Artificial
  CRISPR gRNA sequence
acttaatgccattctataca

SEQ ID NO: 383832 - DNA, 20 bp, Artificial
  CRISPR gRNA sequence
cttaatgccattctatacaa

SEQ ID NO: 383833 - DNA, 20 bp, Artificial
  CRISPR gRNA sequence
aatgccattctatacaaacc

SEQ ID NO: 383834 - DNA, 20 bp, Artificial
  CRISPR gRNA sequence
atgccattctatacaaacca

SEQ ID NO: 383835 - DNA, 20 bp, Artificial
  CRISPR gRNA sequence
tatacaaaccaatataactt

SEQ ID NO: 383836 - DNA, 20 bp, Artificial
  CRISPR gRNA sequence
tacaaaccaatataacttgg

SEQ ID NO: 383837 - DNA, 20 bp, Artificial
  CRISPR gRNA sequence
ggatgttcacaatccacgaa

SEQ ID NO: 383838 - DNA, 20 bp, Artificial
  CRISPR gRNA sequence
gatgttcacaatccacgaat

SEQ ID NO: 383839 - DNA, 20 bp, Artificial
  CRISPR gRNA sequence
acaatccacgaatgcctact

SEQ ID NO: 383840 - DNA, 20 bp, Artificial
  CRISPR gRNA sequence
ctaaaagtatttttacttac

SEQ ID NO: 383841 - DNA, 20 bp, Artificial
  CRISPR gRNA sequence
aaagtatttttacttacttt

SEQ ID NO: 383842 - DNA, 20 bp, Artificial
  CRISPR gRNA sequence
ttacttactttgtcttttaa

SEQ ID NO: 383843 - DNA, 20 bp, Artificial
  CRISPR gRNA sequence
tacttactttgtcttttaaa

SEQ ID NO: 383844 - DNA, 20 bp, Artificial
  CRISPR gRNA sequence
acttactttgtcttttaaat

SEQ ID NO: 383845 - DNA, 20 bp, Artificial
  CRISPR gRNA sequence
cttactttgtcttttaaatt

SEQ ID NO: 383846 - DNA, 20 bp, Artificial
  CRISPR gRNA sequence
actttgtcttttaaattgat

SEQ ID NO: 383847 - DNA, 20 bp, Artificial
  CRISPR gRNA sequence
ctttgtcttttaaattgata

SEQ ID NO: 383848 - DNA, 20 bp, Artificial
  CRISPR gRNA sequence
tgtcttttaaattgataacc

SEQ ID NO: 383849 - DNA, 20 bp, Artificial
  CRISPR gRNA sequence
gtcttttaaattgataaccc

SEQ ID NO: 383850 - DNA, 20 bp, Artificial
  CRISPR gRNA sequence
tcttttaaattgataaccca

SEQ ID NO: 383851 - DNA, 20 bp, Artificial
  CRISPR gRNA sequence
ttaaattgataacccatgta

SEQ ID NO: 383852 - DNA, 20 bp, Artificial
  CRISPR gRNA sequence
taaattgataacccatgtat

SEQ ID NO: 383853 - DNA, 20 bp, Artificial
  CRISPR gRNA sequence
aaattgataacccatgtatt

SEQ ID NO: 383854 - DNA, 20 bp, Artificial
  CRISPR gRNA sequence
aattgataacccatgtattt

SEQ ID NO: 383855 - DNA, 20 bp, Artificial
  CRISPR gRNA sequence
ataacccatgtattttaagt

SEQ ID NO: 383856 - DNA, 20 bp, Artificial
  CRISPR gRNA sequence
taagtttatatatatagtat

SEQ ID NO: 383857 - DNA, 20 bp, Artificial
  CRISPR gRNA sequence
aagtttatatatatagtatt

SEQ ID NO: 383858 - DNA, 20 bp, Artificial
  CRISPR gRNA sequence
agtttatatatatagtattt

SEQ ID NO: 383859 - DNA, 20 bp, Artificial
  CRISPR gRNA sequence
atatatatagtattttagta

SEQ ID NO: 383860 - DNA, 20 bp, Artificial
  CRISPR gRNA sequence
tatatatagtattttagtaa

SEQ ID NO: 383861 - DNA, 20 bp, Artificial
  CRISPR gRNA sequence
tagtaatacactgaattact

SEQ ID NO: 383862 - DNA, 20 bp, Artificial
  CRISPR gRNA sequence
agtaatacactgaattactt

SEQ ID NO: 383863 - DNA, 20 bp, Artificial
  CRISPR gRNA sequence
gtaatacactgaattactta

SEQ ID NO: 383864 - DNA, 20 bp, Artificial
  CRISPR gRNA sequence
aattacttaaaacataaatt

SEQ ID NO: 383865 - DNA, 20 bp, Artificial
  CRISPR gRNA sequence
cttaaaacataaattggagt

SEQ ID NO: 383866 - DNA, 20 bp, Artificial
  CRISPR gRNA sequence
aaaacataaattggagtttt

SEQ ID NO: 383867 - DNA, 20 bp, Artificial
  CRISPR gRNA sequence
aaacataaattggagttttt

SEQ ID NO: 383868 - DNA, 20 bp, Artificial
  CRISPR gRNA sequence
gagtttttactaaaaattat

SEQ ID NO: 383869 - DNA, 20 bp, Artificial
  CRISPR gRNA sequence
ttactaaaaattatatcttc

SEQ ID NO: 383870 - DNA, 20 bp, Artificial
  CRISPR gRNA sequence
tactaaaaattatatcttca

SEQ ID NO: 383871 - DNA, 20 bp, Artificial
  CRISPR gRNA sequence
actaaaaattatatcttcac

SEQ ID NO: 383872 - DNA, 20 bp, Artificial
  CRISPR gRNA sequence
ctaaaaattatatcttcacc

SEQ ID NO: 383873 - DNA, 20 bp, Artificial
  CRISPR gRNA sequence
aaaattatatcttcacctac

SEQ ID NO: 383874 - DNA, 20 bp, Artificial
  CRISPR gRNA sequence
tatcttcacctacctgcctc

SEQ ID NO: 383875 - DNA, 20 bp, Artificial
  CRISPR gRNA sequence
cacctacctgcctcccattt

SEQ ID NO: 383876 - DNA, 20 bp, Artificial
  CRISPR gRNA sequence
acctacctgcctcccatttt

SEQ ID NO: 383877 - DNA, 20 bp, Artificial
  CRISPR gRNA sequence
cctgcctcccattttaagca

SEQ ID NO: 383878 - DNA, 20 bp, Artificial
  CRISPR gRNA sequence
cctcccattttaagcatgat

SEQ ID NO: 383879 - DNA, 20 bp, Artificial
  CRISPR gRNA sequence
ccattttaagcatgattaca

SEQ ID NO: 383880 - DNA, 20 bp, Artificial
  CRISPR gRNA sequence
taagcatgattacaagtaaa

SEQ ID NO: 383881 - DNA, 20 bp, Artificial
  CRISPR gRNA sequence
aagcatgattacaagtaaat

SEQ ID NO: 383882 - DNA, 20 bp, Artificial
  CRISPR gRNA sequence
agcatgattacaagtaaatg

SEQ ID NO: 383883 - DNA, 20 bp, Artificial
  CRISPR gRNA sequence
caagtaaatgaaatttctat

SEQ ID NO: 383884 - DNA, 20 bp, Artificial
  CRISPR gRNA sequence
ctattttattttctcaacat

SEQ ID NO: 383885 - DNA, 20 bp, Artificial
  CRISPR gRNA sequence
tattttattttctcaacata

SEQ ID NO: 383886 - DNA, 20 bp, Artificial
  CRISPR gRNA sequence
ttttattttctcaacatatt

SEQ ID NO: 383887 - DNA, 20 bp, Artificial
  CRISPR gRNA sequence
tattttctcaacatattata

SEQ ID NO: 383888 - DNA, 20 bp, Artificial
  CRISPR gRNA sequence
attttctcaacatattatac

SEQ ID NO: 383889 - DNA, 20 bp, Artificial
  CRISPR gRNA sequence
ttttctcaacatattatacc

SEQ ID NO: 383890 - DNA, 20 bp, Artificial
  CRISPR gRNA sequence
tctcaacatattatacctaa

SEQ ID NO: 383891 - DNA, 20 bp, Artificial
  CRISPR gRNA sequence
ctcaacatattatacctaaa

SEQ ID NO: 383892 - DNA, 20 bp, Artificial
  CRISPR gRNA sequence
tcaacatattatacctaaag

SEQ ID NO: 383893 - DNA, 20 bp, Artificial
  CRISPR gRNA sequence
aacatattatacctaaagtt

SEQ ID NO: 383894 - DNA, 20 bp, Artificial
  CRISPR gRNA sequence
tacctaaagttctttaaata

SEQ ID NO: 383895 - DNA, 20 bp, Artificial
  CRISPR gRNA sequence
aagttctttaaataaagttt

SEQ ID NO: 383896 - DNA, 20 bp, Artificial
  CRISPR gRNA sequence
tttaaataaagtttgaaggt

SEQ ID NO: 383897 - DNA, 20 bp, Artificial
  CRISPR gRNA sequence
taaataaagtttgaaggtat

SEQ ID NO: 383898 - DNA, 20 bp, Artificial
  CRISPR gRNA sequence
aaataaagtttgaaggtatc

SEQ ID NO: 383899 - DNA, 20 bp, Artificial
  CRISPR gRNA sequence
aataaagtttgaaggtatct

SEQ ID NO: 383900 - DNA, 20 bp, Artificial
  CRISPR gRNA sequence
gaaggtatctcttataataa

SEQ ID NO: 383901 - DNA, 20 bp, Artificial
  CRISPR gRNA sequence
aaggtatctcttataataat

SEQ ID NO: 383902 - DNA, 20 bp, Artificial
  CRISPR gRNA sequence
ttataataatatagtcaatg

SEQ ID NO: 383903 - DNA, 20 bp, Artificial
  CRISPR gRNA sequence
ataataatatagtcaatgca

SEQ ID NO: 383904 - DNA, 20 bp, Artificial
  CRISPR gRNA sequence
taataatatagtcaatgcat

SEQ ID NO: 383905 - DNA, 20 bp, Artificial
  CRISPR gRNA sequence
aataagatgtgttctttccc

SEQ ID NO: 383906 - DNA, 20 bp, Artificial
  CRISPR gRNA sequence
tttccctgacaaaactgtgt

SEQ ID NO: 383907 - DNA, 20 bp, Artificial
  CRISPR gRNA sequence
tccctgacaaaactgtgtac

SEQ ID NO: 383908 - DNA, 20 bp, Artificial
  CRISPR gRNA sequence
ccctgacaaaactgtgtact

SEQ ID NO: 383909 - DNA, 20 bp, Artificial
  CRISPR gRNA sequence
cctgacaaaactgtgtactc

SEQ ID NO: 383910 - DNA, 20 bp, Artificial
  CRISPR gRNA sequence
acaaaactgtgtactccatt

SEQ ID NO: 383911 - DNA, 20 bp, Artificial
  CRISPR gRNA sequence
tgtactccattaacaagtct

SEQ ID NO: 383912 - DNA, 20 bp, Artificial
  CRISPR gRNA sequence
cattaacaagtcttcctatc

SEQ ID NO: 383913 - DNA, 20 bp, Artificial
  CRISPR gRNA sequence
acaagtcttcctatcttatt

SEQ ID NO: 383914 - DNA, 20 bp, Artificial
  CRISPR gRNA sequence
cctatcttattataacaaag

SEQ ID NO: 383915 - DNA, 20 bp, Artificial
  CRISPR gRNA sequence
ctatcttattataacaaagt

SEQ ID NO: 383916 - DNA, 20 bp, Artificial
  CRISPR gRNA sequence
tcttattataacaaagtaat

SEQ ID NO: 383917 - DNA, 20 bp, Artificial
  CRISPR gRNA sequence
attataacaaagtaatttcc

SEQ ID NO: 383918 - DNA, 20 bp, Artificial
  CRISPR gRNA sequence
ttataacaaagtaatttcct

SEQ ID NO: 383919 - DNA, 20 bp, Artificial
  CRISPR gRNA sequence
taacaaagtaatttcctttc

SEQ ID NO: 383920 - DNA, 20 bp, Artificial
  CRISPR gRNA sequence
cctttcattggttactttaa

SEQ ID NO: 383921 - DNA, 20 bp, Artificial
  CRISPR gRNA sequence
ctttcattggttactttaac

SEQ ID NO: 383922 - DNA, 20 bp, Artificial
  CRISPR gRNA sequence
tcattggttactttaacata

SEQ ID NO: 383923 - DNA, 20 bp, Artificial
  CRISPR gRNA sequence
cattggttactttaacataa

SEQ ID NO: 383924 - DNA, 20 bp, Artificial
  CRISPR gRNA sequence
attggttactttaacataaa

SEQ ID NO: 383925 - DNA, 20 bp, Artificial
  CRISPR gRNA sequence
gttactttaacataaatatt

SEQ ID NO: 383926 - DNA, 20 bp, Artificial
  CRISPR gRNA sequence
ctttaacataaatattaatg

SEQ ID NO: 383927 - DNA, 20 bp, Artificial
  CRISPR gRNA sequence
taacataaatattaatggca

SEQ ID NO: 383928 - DNA, 20 bp, Artificial
  CRISPR gRNA sequence
aacataaatattaatggcat

SEQ ID NO: 383929 - DNA, 20 bp, Artificial
  CRISPR gRNA sequence
acataaatattaatggcatt

SEQ ID NO: 383930 - DNA, 20 bp, Artificial
  CRISPR gRNA sequence
atggcattcaaaggaagcat

SEQ ID NO: 383931 - DNA, 20 bp, Artificial
  CRISPR gRNA sequence
aaaggaagcatagattctta

SEQ ID NO: 383932 - DNA, 20 bp, Artificial
  CRISPR gRNA sequence
ttaatgtattatccatcgat

SEQ ID NO: 383933 - DNA, 20 bp, Artificial
  CRISPR gRNA sequence
aatgtattatccatcgatat

SEQ ID NO: 383934 - DNA, 20 bp, Artificial
  CRISPR gRNA sequence
atgtattatccatcgatata

SEQ ID NO: 383935 - DNA, 20 bp, Artificial
  CRISPR gRNA sequence
tccatcgatataaattatat

SEQ ID NO: 383936 - DNA, 20 bp, Artificial
  CRISPR gRNA sequence
tatgtgtatatatatatgta

SEQ ID NO: 383937 - DNA, 20 bp, Artificial
  CRISPR gRNA sequence
aagaagcattttgcttccaa

SEQ ID NO: 383938 - DNA, 20 bp, Artificial
  CRISPR gRNA sequence
agaagcattttgcttccaaa

SEQ ID NO: 383939 - DNA, 20 bp, Artificial
  CRISPR gRNA sequence
tgcttccaaagcagcaactt

SEQ ID NO: 383940 - DNA, 20 bp, Artificial
  CRISPR gRNA sequence
gcttccaaagcagcaacttg

SEQ ID NO: 383941 - DNA, 20 bp, Artificial
  CRISPR gRNA sequence
cttccaaagcagcaacttgt

SEQ ID NO: 383942 - DNA, 20 bp, Artificial
  CRISPR gRNA sequence
ccaaagcagcaacttgtaaa

SEQ ID NO: 383943 - DNA, 20 bp, Artificial
  CRISPR gRNA sequence
caaagcagcaacttgtaaaa

SEQ ID NO: 383944 - DNA, 20 bp, Artificial
  CRISPR gRNA sequence
gtaaaaagtatctgtattta

SEQ ID NO: 383945 - DNA, 20 bp, Artificial
  CRISPR gRNA sequence
taaaaagtatctgtatttaa

SEQ ID NO: 383946 - DNA, 20 bp, Artificial
  CRISPR gRNA sequence
tatttaaaatagaatttact

SEQ ID NO: 383947 - DNA, 20 bp, Artificial
  CRISPR gRNA sequence
aaaatagaatttactggaat

SEQ ID NO: 383948 - DNA, 20 bp, Artificial
  CRISPR gRNA sequence
aaatagaatttactggaatt

SEQ ID NO: 383949 - DNA, 20 bp, Artificial
  CRISPR gRNA sequence
actggaattctgatcgttta

SEQ ID NO: 383950 - DNA, 20 bp, Artificial
  CRISPR gRNA sequence
ctggaattctgatcgtttat

SEQ ID NO: 383951 - DNA, 20 bp, Artificial
  CRISPR gRNA sequence
gaattctgatcgtttattct

SEQ ID NO: 383952 - DNA, 20 bp, Artificial
  CRISPR gRNA sequence
tgatcgtttattctgtggat

SEQ ID NO: 383953 - DNA, 20 bp, Artificial
  CRISPR gRNA sequence
atcgtttattctgtggatct

SEQ ID NO: 383954 - DNA, 20 bp, Artificial
  CRISPR gRNA sequence
attctgtggatctgtttttc

SEQ ID NO: 383955 - DNA, 20 bp, Artificial
  CRISPR gRNA sequence
ttctgtggatctgtttttca

SEQ ID NO: 383956 - DNA, 20 bp, Artificial
  CRISPR gRNA sequence
tgtggatctgtttttcatct

SEQ ID NO: 383957 - DNA, 20 bp, Artificial
  CRISPR gRNA sequence
tggatctgtttttcatctgc

SEQ ID NO: 383958 - DNA, 20 bp, Artificial
  CRISPR gRNA sequence
tttttcatctgctttcttag

SEQ ID NO: 383959 - DNA, 20 bp, Artificial
  CRISPR gRNA sequence
ttcatctgctttcttagtaa

SEQ ID NO: 383960 - DNA, 20 bp, Artificial
  CRISPR gRNA sequence
tcatctgctttcttagtaac

SEQ ID NO: 383961 - DNA, 20 bp, Artificial
  CRISPR gRNA sequence
catctgctttcttagtaaca

SEQ ID NO: 383962 - DNA, 20 bp, Artificial
  CRISPR gRNA sequence
atctgctttcttagtaacaa

SEQ ID NO: 383963 - DNA, 20 bp, Artificial
  CRISPR gRNA sequence
ctttcttagtaacaatcaga

SEQ ID NO: 383964 - DNA, 20 bp, Artificial
  CRISPR gRNA sequence
tcttagtaacaatcagaatc

SEQ ID NO: 383965 - DNA, 20 bp, Artificial
  CRISPR gRNA sequence
cttagtaacaatcagaatca

SEQ ID NO: 383966 - DNA, 20 bp, Artificial
  CRISPR gRNA sequence
ttagtaacaatcagaatcat

SEQ ID NO: 383967 - DNA, 20 bp, Artificial
  CRISPR gRNA sequence
agtaacaatcagaatcatag

SEQ ID NO: 383968 - DNA, 20 bp, Artificial
  CRISPR gRNA sequence
gtaacaatcagaatcatagg

SEQ ID NO: 383969 - DNA, 20 bp, Artificial
  CRISPR gRNA sequence
gggagagtcccaaaactatc

SEQ ID NO: 383970 - DNA, 20 bp, Artificial
  CRISPR gRNA sequence
tcacgaattaagaatgatgt

SEQ ID NO: 383971 - DNA, 20 bp, Artificial
  CRISPR gRNA sequence
agaatgatgttaaaaagatg

SEQ ID NO: 383972 - DNA, 20 bp, Artificial
  CRISPR gRNA sequence
aaaagatgacaatgaaagtg

SEQ ID NO: 383973 - DNA, 20 bp, Artificial
  CRISPR gRNA sequence
tggtaagtaaagatgtccag

SEQ ID NO: 383974 - DNA, 20 bp, Artificial
  CRISPR gRNA sequence
ggtaagtaaagatgtccaga

SEQ ID NO: 383975 - DNA, 20 bp, Artificial
  CRISPR gRNA sequence
gtaagtaaagatgtccagag

SEQ ID NO: 383976 - DNA, 20 bp, Artificial
  CRISPR gRNA sequence
cacaagcattacccctgagg

SEQ ID NO: 383977 - DNA, 20 bp, Artificial
  CRISPR gRNA sequence
acaagcattacccctgaggg

SEQ ID NO: 383978 - DNA, 20 bp, Artificial
  CRISPR gRNA sequence
cccctgagggtataacagga

SEQ ID NO: 383979 - DNA, 20 bp, Artificial
  CRISPR gRNA sequence
agggtataacaggagcatca

SEQ ID NO: 383980 - DNA, 20 bp, Artificial
  CRISPR gRNA sequence
ttgggaggacttcagatggc

SEQ ID NO: 383981 - DNA, 20 bp, Artificial
  CRISPR gRNA sequence
tgggaggacttcagatggct

SEQ ID NO: 383982 - DNA, 20 bp, Artificial
  CRISPR gRNA sequence
gggaggacttcagatggctc

SEQ ID NO: 383983 - DNA, 20 bp, Artificial
  CRISPR gRNA sequence
ggaggacttcagatggctcc

SEQ ID NO: 383984 - DNA, 20 bp, Artificial
  CRISPR gRNA sequence
cagatggctccaaattcctg

SEQ ID NO: 383985 - DNA, 20 bp, Artificial
  CRISPR gRNA sequence
agatggctccaaattcctga

SEQ ID NO: 383986 - DNA, 20 bp, Artificial
  CRISPR gRNA sequence
caaattcctgaaaaaaccct

SEQ ID NO: 383987 - DNA, 20 bp, Artificial
  CRISPR gRNA sequence
ctgaaaaaaccctacactct

SEQ ID NO: 383988 - DNA, 20 bp, Artificial
  CRISPR gRNA sequence
aaaaaaccctacactctgta

SEQ ID NO: 383989 - DNA, 20 bp, Artificial
  CRISPR gRNA sequence
cactctgtagaggaagaata

SEQ ID NO: 383990 - DNA, 20 bp, Artificial
  CRISPR gRNA sequence
tgtagaggaagaatatatag

SEQ ID NO: 383991 - DNA, 20 bp, Artificial
  CRISPR gRNA sequence
tagaggaagaatatatagag

SEQ ID NO: 383992 - DNA, 20 bp, Artificial
  CRISPR gRNA sequence
tcatcaatattttgaatgag

SEQ ID NO: 383993 - DNA, 20 bp, Artificial
  CRISPR gRNA sequence
atcaatattttgaatgagag

SEQ ID NO: 383994 - DNA, 20 bp, Artificial
  CRISPR gRNA sequence
tgaatgagagaccaaaaaca

SEQ ID NO: 383995 - DNA, 20 bp, Artificial
  CRISPR gRNA sequence
gaatgagagaccaaaaacac

SEQ ID NO: 383996 - DNA, 20 bp, Artificial
  CRISPR gRNA sequence
aatgagagaccaaaaacaca

SEQ ID NO: 383997 - DNA, 20 bp, Artificial
  CRISPR gRNA sequence
caaatgttctggaggctttg

SEQ ID NO: 383998 - DNA, 20 bp, Artificial
  CRISPR gRNA sequence
tggaggctttgcaatactgc

SEQ ID NO: 383999 - DNA, 20 bp, Artificial
  CRISPR gRNA sequence
gaggctttgcaatactgcag

SEQ ID NO: 384000 - DNA, 20 bp, Artificial
  CRISPR gRNA sequence
tgcaatactgcagtggtttg

SEQ ID NO: 384001 - DNA, 20 bp, Artificial
  CRISPR gRNA sequence
gcaatactgcagtggtttgc

SEQ ID NO: 384002 - DNA, 20 bp, Artificial
  CRISPR gRNA sequence
caatactgcagtggtttgct

SEQ ID NO: 384003 - DNA, 20 bp, Artificial
  CRISPR gRNA sequence
cagtggtttgctacaaaagt

SEQ ID NO: 384004 - DNA, 20 bp, Artificial
  CRISPR gRNA sequence
gctacaaaagtctttcatga

SEQ ID NO: 384005 - DNA, 20 bp, Artificial
  CRISPR gRNA sequence
ctacaaaagtctttcatgaa

SEQ ID NO: 384006 - DNA, 20 bp, Artificial
  CRISPR gRNA sequence
caaaagtctttcatgaagtt

SEQ ID NO: 384007 - DNA, 20 bp, Artificial
  CRISPR gRNA sequence
tcatgaagttcccagtaaaa

SEQ ID NO: 384008 - DNA, 20 bp, Artificial
  CRISPR gRNA sequence
catgaagttcccagtaaaaa

SEQ ID NO: 384009 - DNA, 20 bp, Artificial
  CRISPR gRNA sequence
atgaagttcccagtaaaaac

SEQ ID NO: 384010 - DNA, 20 bp, Artificial
  CRISPR gRNA sequence
ccagtaaaaaccaccatgac

SEQ ID NO: 384011 - DNA, 20 bp, Artificial
  CRISPR gRNA sequence
actatactgtcccttccaca

SEQ ID NO: 384012 - DNA, 20 bp, Artificial
  CRISPR gRNA sequence
tactgtcccttccacaccca

SEQ ID NO: 384013 - DNA, 20 bp, Artificial
  CRISPR gRNA sequence
tcccttccacacccagtcat

SEQ ID NO: 384014 - DNA, 20 bp, Artificial
  CRISPR gRNA sequence
ccacacccagtcataatttt

SEQ ID NO: 384015 - DNA, 20 bp, Artificial
  CRISPR gRNA sequence
cacacccagtcataattttc

SEQ ID NO: 384016 - DNA, 20 bp, Artificial
  CRISPR gRNA sequence
tctctcttaaaattggattt

SEQ ID NO: 384017 - DNA, 20 bp, Artificial
  CRISPR gRNA sequence
ctctcttaaaattggattta

SEQ ID NO: 384018 - DNA, 20 bp, Artificial
  CRISPR gRNA sequence
tctcttaaaattggatttat

SEQ ID NO: 384019 - DNA, 20 bp, Artificial
  CRISPR gRNA sequence
tcttaaaattggatttatat

SEQ ID NO: 384020 - DNA, 20 bp, Artificial
  CRISPR gRNA sequence
ttaaaattggatttatattt

SEQ ID NO: 384021 - DNA, 20 bp, Artificial
  CRISPR gRNA sequence
aaaattggatttatatttcc

SEQ ID NO: 384022 - DNA, 20 bp, Artificial
  CRISPR gRNA sequence
aaattggatttatatttccc

SEQ ID NO: 384023 - DNA, 20 bp, Artificial
  CRISPR gRNA sequence
gatttatatttccccatact

SEQ ID NO: 384024 - DNA, 20 bp, Artificial
  CRISPR gRNA sequence
atatttccccatactacaac

SEQ ID NO: 384025 - DNA, 20 bp, Artificial
  CRISPR gRNA sequence
tatttccccatactacaact

SEQ ID NO: 384026 - DNA, 20 bp, Artificial
  CRISPR gRNA sequence
ccccatactacaactgtaaa

SEQ ID NO: 384027 - DNA, 20 bp, Artificial
  CRISPR gRNA sequence
cccatactacaactgtaaaa

SEQ ID NO: 384028 - DNA, 20 bp, Artificial
  CRISPR gRNA sequence
caactgtaaaaatgttttcc

SEQ ID NO: 384029 - DNA, 20 bp, Artificial
  CRISPR gRNA sequence
taaaaatgttttcctgctca

SEQ ID NO: 384030 - DNA, 20 bp, Artificial
  CRISPR gRNA sequence
tcctgctcacatacactaat

SEQ ID NO: 384031 - DNA, 20 bp, Artificial
  CRISPR gRNA sequence
cctgctcacatacactaatc

SEQ ID NO: 384032 - DNA, 20 bp, Artificial
  CRISPR gRNA sequence
ctgctcacatacactaatca

SEQ ID NO: 384033 - DNA, 20 bp, Artificial
  CRISPR gRNA sequence
ctcacatacactaatcattg

SEQ ID NO: 384034 - DNA, 20 bp, Artificial
  CRISPR gRNA sequence
acatacactaatcattgaga

SEQ ID NO: 384035 - DNA, 20 bp, Artificial
  CRISPR gRNA sequence
atcattgagaatttggttat

SEQ ID NO: 384036 - DNA, 20 bp, Artificial
  CRISPR gRNA sequence
agaatttggttattggagtt

SEQ ID NO: 384037 - DNA, 20 bp, Artificial
  CRISPR gRNA sequence
ggttattggagttttccaga

SEQ ID NO: 384038 - DNA, 20 bp, Artificial
  CRISPR gRNA sequence
gttattggagttttccagaa

SEQ ID NO: 384039 - DNA, 20 bp, Artificial
  CRISPR gRNA sequence
ttggagttttccagaaagta

SEQ ID NO: 384040 - DNA, 20 bp, Artificial
  CRISPR gRNA sequence
gagttttccagaaagtaata

SEQ ID NO: 384041 - DNA, 20 bp, Artificial
  CRISPR gRNA sequence
tccagaaagtaatattttga

SEQ ID NO: 384042 - DNA, 20 bp, Artificial
  CRISPR gRNA sequence
ccagaaagtaatattttgat

SEQ ID NO: 384043 - DNA, 20 bp, Artificial
  CRISPR gRNA sequence
cagaaagtaatattttgatt

SEQ ID NO: 384044 - DNA, 20 bp, Artificial
  CRISPR gRNA sequence
tgattgtctttaccattcag

SEQ ID NO: 384045 - DNA, 20 bp, Artificial
  CRISPR gRNA sequence
gattgtctttaccattcaga

SEQ ID NO: 384046 - DNA, 20 bp, Artificial
  CRISPR gRNA sequence
attgtctttaccattcagaa

SEQ ID NO: 384047 - DNA, 20 bp, Artificial
  CRISPR gRNA sequence
tctttaccattcagaaaaga

SEQ ID NO: 384048 - DNA, 20 bp, Artificial
  CRISPR gRNA sequence
taccattcagaaaagaaatt

SEQ ID NO: 384049 - DNA, 20 bp, Artificial
  CRISPR gRNA sequence
accattcagaaaagaaatta

SEQ ID NO: 384050 - DNA, 20 bp, Artificial
  CRISPR gRNA sequence
ccattcagaaaagaaattat

SEQ ID NO: 384051 - DNA, 20 bp, Artificial
  CRISPR gRNA sequence
agaaaagaaattatttacct

SEQ ID NO: 384052 - DNA, 20 bp, Artificial
  CRISPR gRNA sequence
tttaccttttaattgatgct

SEQ ID NO: 384053 - DNA, 20 bp, Artificial
  CRISPR gRNA sequence
accttttaattgatgctaag

SEQ ID NO: 384054 - DNA, 20 bp, Artificial
  CRISPR gRNA sequence
ccttttaattgatgctaagc

SEQ ID NO: 384055 - DNA, 20 bp, Artificial
  CRISPR gRNA sequence
ttaattgatgctaagcttgc

SEQ ID NO: 384056 - DNA, 20 bp, Artificial
  CRISPR gRNA sequence
taattgatgctaagcttgct

SEQ ID NO: 384057 - DNA, 20 bp, Artificial
  CRISPR gRNA sequence
aattgatgctaagcttgctt

SEQ ID NO: 384058 - DNA, 20 bp, Artificial
  CRISPR gRNA sequence
attgatgctaagcttgcttc

SEQ ID NO: 384059 - DNA, 20 bp, Artificial
  CRISPR gRNA sequence
atgctaagcttgcttcacca

SEQ ID NO: 384060 - DNA, 20 bp, Artificial
  CRISPR gRNA sequence
agcttgcttcaccatgcaaa

SEQ ID NO: 384061 - DNA, 20 bp, Artificial
  CRISPR gRNA sequence
gcttcaccatgcaaaccaat

SEQ ID NO: 384062 - DNA, 20 bp, Artificial
  CRISPR gRNA sequence
cttcaccatgcaaaccaata

SEQ ID NO: 384063 - DNA, 20 bp, Artificial
  CRISPR gRNA sequence
caccatgcaaaccaataaat

SEQ ID NO: 384064 - DNA, 20 bp, Artificial
  CRISPR gRNA sequence
accatgcaaaccaataaatt

SEQ ID NO: 384065 - DNA, 20 bp, Artificial
  CRISPR gRNA sequence
actcacagaatctttgattg

SEQ ID NO: 384066 - DNA, 20 bp, Artificial
  CRISPR gRNA sequence
acagaatctttgattgatct

SEQ ID NO: 384067 - DNA, 20 bp, Artificial
  CRISPR gRNA sequence
tgattgatctgatagtagag

SEQ ID NO: 384068 - DNA, 20 bp, Artificial
  CRISPR gRNA sequence
gattgatctgatagtagagt

SEQ ID NO: 384069 - DNA, 20 bp, Artificial
  CRISPR gRNA sequence
attgatctgatagtagagtg

SEQ ID NO: 384070 - DNA, 20 bp, Artificial
  CRISPR gRNA sequence
atctgatagtagagtgcttt

SEQ ID NO: 384071 - DNA, 20 bp, Artificial
  CRISPR gRNA sequence
atagtagagtgctttcttgt

SEQ ID NO: 384072 - DNA, 20 bp, Artificial
  CRISPR gRNA sequence
tcttgtaaactgcctttcaa

SEQ ID NO: 384073 - DNA, 20 bp, Artificial
  CRISPR gRNA sequence
cttgtaaactgcctttcaag

SEQ ID NO: 384074 - DNA, 20 bp, Artificial
  CRISPR gRNA sequence
ttgtaaactgcctttcaagt

SEQ ID NO: 384075 - DNA, 20 bp, Artificial
  CRISPR gRNA sequence
gtaaactgcctttcaagttt

SEQ ID NO: 384076 - DNA, 20 bp, Artificial
  CRISPR gRNA sequence
taaactgcctttcaagtttg

SEQ ID NO: 384077 - DNA, 20 bp, Artificial
  CRISPR gRNA sequence
cctttcaagtttgttacact

SEQ ID NO: 384078 - DNA, 20 bp, Artificial
  CRISPR gRNA sequence
tcaagtttgttacactaata

SEQ ID NO: 384079 - DNA, 20 bp, Artificial
  CRISPR gRNA sequence
caagtttgttacactaatat

SEQ ID NO: 384080 - DNA, 20 bp, Artificial
  CRISPR gRNA sequence
aagtttgttacactaatata

SEQ ID NO: 384081 - DNA, 20 bp, Artificial
  CRISPR gRNA sequence
gttacactaatatatttgtg

SEQ ID NO: 384082 - DNA, 20 bp, Artificial
  CRISPR gRNA sequence
ttacactaatatatttgtgg

SEQ ID NO: 384083 - DNA, 20 bp, Artificial
  CRISPR gRNA sequence
cactaatatatttgtggaaa

SEQ ID NO: 384084 - DNA, 20 bp, Artificial
  CRISPR gRNA sequence
atatatttgtggaaacattt

SEQ ID NO: 384085 - DNA, 20 bp, Artificial
  CRISPR gRNA sequence
gtggaaacatttcatgaatc

SEQ ID NO: 384086 - DNA, 20 bp, Artificial
  CRISPR gRNA sequence
tggaaacatttcatgaatcc

SEQ ID NO: 384087 - DNA, 20 bp, Artificial
  CRISPR gRNA sequence
catgaatccaggtataaaaa

SEQ ID NO: 384088 - DNA, 20 bp, Artificial
  CRISPR gRNA sequence
atgaatccaggtataaaaag

SEQ ID NO: 384089 - DNA, 20 bp, Artificial
  CRISPR gRNA sequence
taagcaaacataataaaaat

SEQ ID NO: 384090 - DNA, 20 bp, Artificial
  CRISPR gRNA sequence
aagcaaacataataaaaatg

SEQ ID NO: 384091 - DNA, 20 bp, Artificial
  CRISPR gRNA sequence
agcaaacataataaaaatga

SEQ ID NO: 384092 - DNA, 20 bp, Artificial
  CRISPR gRNA sequence
acccttcttgcatatactta

SEQ ID NO: 384093 - DNA, 20 bp, Artificial
  CRISPR gRNA sequence
cccttcttgcatatacttaa

SEQ ID NO: 384094 - DNA, 20 bp, Artificial
  CRISPR gRNA sequence
cttgcatatacttaagcaca

SEQ ID NO: 384095 - DNA, 20 bp, Artificial
  CRISPR gRNA sequence
ttgcatatacttaagcacaa

SEQ ID NO: 384096 - DNA, 20 bp, Artificial
  CRISPR gRNA sequence
gcatatacttaagcacaacc

SEQ ID NO: 384097 - DNA, 20 bp, Artificial
  CRISPR gRNA sequence
catatacttaagcacaacca

SEQ ID NO: 384098 - DNA, 20 bp, Artificial
  CRISPR gRNA sequence
aagcacaaccaggaaatggt

SEQ ID NO: 384099 - DNA, 20 bp, Artificial
  CRISPR gRNA sequence
agcacaaccaggaaatggtc

SEQ ID NO: 384100 - DNA, 20 bp, Artificial
  CRISPR gRNA sequence
ttattttttcactcctgaaa

SEQ ID NO: 384101 - DNA, 20 bp, Artificial
  CRISPR gRNA sequence
tattttttcactcctgaaaa

SEQ ID NO: 384102 - DNA, 20 bp, Artificial
  CRISPR gRNA sequence
attttttcactcctgaaaag

SEQ ID NO: 384103 - DNA, 20 bp, Artificial
  CRISPR gRNA sequence
ttttttcactcctgaaaagg

SEQ ID NO: 384104 - DNA, 20 bp, Artificial
  CRISPR gRNA sequence
tttcactcctgaaaagggtt

SEQ ID NO: 384105 - DNA, 20 bp, Artificial
  CRISPR gRNA sequence
ttcactcctgaaaagggtta

SEQ ID NO: 384106 - DNA, 20 bp, Artificial
  CRISPR gRNA sequence
tcactcctgaaaagggttaa

SEQ ID NO: 384107 - DNA, 20 bp, Artificial
  CRISPR gRNA sequence
cactcctgaaaagggttaaa

SEQ ID NO: 384108 - DNA, 20 bp, Artificial
  CRISPR gRNA sequence
actcctgaaaagggttaaaa

SEQ ID NO: 384109 - DNA, 20 bp, Artificial
  CRISPR gRNA sequence
ctgaaaagggttaaaagaaa

SEQ ID NO: 384110 - DNA, 20 bp, Artificial
  CRISPR gRNA sequence
aaaagggttaaaagaaactc

SEQ ID NO: 384111 - DNA, 20 bp, Artificial
  CRISPR gRNA sequence
aaagaaactcacaaatttta

SEQ ID NO: 384112 - DNA, 20 bp, Artificial
  CRISPR gRNA sequence
acaaattttataattcacag

SEQ ID NO: 384113 - DNA, 20 bp, Artificial
  CRISPR gRNA sequence
tataattcacagaaatgtgg

SEQ ID NO: 384114 - DNA, 20 bp, Artificial
  CRISPR gRNA sequence
ataattcacagaaatgtggg

SEQ ID NO: 384115 - DNA, 20 bp, Artificial
  CRISPR gRNA sequence
taattcacagaaatgtgggc

SEQ ID NO: 384116 - DNA, 20 bp, Artificial
  CRISPR gRNA sequence
acagaaatgtgggcacttac

SEQ ID NO: 384117 - DNA, 20 bp, Artificial
  CRISPR gRNA sequence
accatttctgtaattcacaa

SEQ ID NO: 384118 - DNA, 20 bp, Artificial
  CRISPR gRNA sequence
ccatttctgtaattcacaaa

SEQ ID NO: 384119 - DNA, 20 bp, Artificial
  CRISPR gRNA sequence
ctgtaattcacaaaacaagt

SEQ ID NO: 384120 - DNA, 20 bp, Artificial
  CRISPR gRNA sequence
tgtaattcacaaaacaagtg

SEQ ID NO: 384121 - DNA, 20 bp, Artificial
  CRISPR gRNA sequence
taattcacaaaacaagtgca

SEQ ID NO: 384122 - DNA, 20 bp, Artificial
  CRISPR gRNA sequence
acaaaacaagtgcattattt

SEQ ID NO: 384123 - DNA, 20 bp, Artificial
  CRISPR gRNA sequence
tttggcatacatggtgttta

SEQ ID NO: 384124 - DNA, 20 bp, Artificial
  CRISPR gRNA sequence
ggcatacatggtgtttaagg

SEQ ID NO: 384125 - DNA, 20 bp, Artificial
  CRISPR gRNA sequence
gcatacatggtgtttaaggc

SEQ ID NO: 384126 - DNA, 20 bp, Artificial
  CRISPR gRNA sequence
aaggctaaaatcataaaata

SEQ ID NO: 384127 - DNA, 20 bp, Artificial
  CRISPR gRNA sequence
aggctaaaatcataaaatac

SEQ ID NO: 384128 - DNA, 20 bp, Artificial
  CRISPR gRNA sequence
aaatcataaaatactcacta

SEQ ID NO: 384129 - DNA, 20 bp, Artificial
  CRISPR gRNA sequence
actaattagcttaaaagtgt

SEQ ID NO: 384130 - DNA, 20 bp, Artificial
  CRISPR gRNA sequence
attagcttaaaagtgtaaat

SEQ ID NO: 384131 - DNA, 20 bp, Artificial
  CRISPR gRNA sequence
gcttaaaagtgtaaattaca

SEQ ID NO: 384132 - DNA, 20 bp, Artificial
  CRISPR gRNA sequence
aaaagtgtaaattacatctt

SEQ ID NO: 384133 - DNA, 20 bp, Artificial
  CRISPR gRNA sequence
aaagtgtaaattacatctta

SEQ ID NO: 384134 - DNA, 20 bp, Artificial
  CRISPR gRNA sequence
catcttagaatctgtctagg

SEQ ID NO: 384135 - DNA, 20 bp, Artificial
  CRISPR gRNA sequence
agaatctgtctaggcaacag

SEQ ID NO: 384136 - DNA, 20 bp, Artificial
  CRISPR gRNA sequence
gaatctgtctaggcaacagg

SEQ ID NO: 384137 - DNA, 20 bp, Artificial
  CRISPR gRNA sequence
tctaggcaacaggagaattt

SEQ ID NO: 384138 - DNA, 20 bp, Artificial
  CRISPR gRNA sequence
ggcaacaggagaatttggat

SEQ ID NO: 384139 - DNA, 20 bp, Artificial
  CRISPR gRNA sequence
ggatttgctttatttaagat

SEQ ID NO: 384140 - DNA, 20 bp, Artificial
  CRISPR gRNA sequence
gatttgctttatttaagatt

SEQ ID NO: 384141 - DNA, 20 bp, Artificial
  CRISPR gRNA sequence
gctttatttaagattatcat

SEQ ID NO: 384142 - DNA, 20 bp, Artificial
  CRISPR gRNA sequence
ctttatttaagattatcatg

SEQ ID NO: 384143 - DNA, 20 bp, Artificial
  CRISPR gRNA sequence
tatttaagattatcatgaag

SEQ ID NO: 384144 - DNA, 20 bp, Artificial
  CRISPR gRNA sequence
atttaagattatcatgaagt

SEQ ID NO: 384145 - DNA, 20 bp, Artificial
  CRISPR gRNA sequence
tttaagattatcatgaagtc

SEQ ID NO: 384146 - DNA, 20 bp, Artificial
  CRISPR gRNA sequence
aagattatcatgaagtccac

SEQ ID NO: 384147 - DNA, 20 bp, Artificial
  CRISPR gRNA sequence
agattatcatgaagtccaca

SEQ ID NO: 384148 - DNA, 20 bp, Artificial
  CRISPR gRNA sequence
tcatgaagtccacaactttg

SEQ ID NO: 384149 - DNA, 20 bp, Artificial
  CRISPR gRNA sequence
tgatatttaaatacagcctt

SEQ ID NO: 384150 - DNA, 20 bp, Artificial
  CRISPR gRNA sequence
gatatttaaatacagccttc

SEQ ID NO: 384151 - DNA, 20 bp, Artificial
  CRISPR gRNA sequence
atatttaaatacagccttca

SEQ ID NO: 384152 - DNA, 20 bp, Artificial
  CRISPR gRNA sequence
aaatacagccttcataatga

SEQ ID NO: 384153 - DNA, 20 bp, Artificial
  CRISPR gRNA sequence
aatacagccttcataatgaa

SEQ ID NO: 384154 - DNA, 20 bp, Artificial
  CRISPR gRNA sequence
cataatgaatcttttctaga

SEQ ID NO: 384155 - DNA, 20 bp, Artificial
  CRISPR gRNA sequence
ataatgaatcttttctagat

SEQ ID NO: 384156 - DNA, 20 bp, Artificial
  CRISPR gRNA sequence
ttctagatggtggtctttag

SEQ ID NO: 384157 - DNA, 20 bp, Artificial
  CRISPR gRNA sequence
tctagatggtggtctttaga

SEQ ID NO: 384158 - DNA, 20 bp, Artificial
  CRISPR gRNA sequence
ctagatggtggtctttagaa

SEQ ID NO: 384159 - DNA, 20 bp, Artificial
  CRISPR gRNA sequence
tagatggtggtctttagaaa

SEQ ID NO: 384160 - DNA, 20 bp, Artificial
  CRISPR gRNA sequence
gatggtggtctttagaaatc

SEQ ID NO: 384161 - DNA, 20 bp, Artificial
  CRISPR gRNA sequence
tagaaatctttagagataaa

SEQ ID NO: 384162 - DNA, 20 bp, Artificial
  CRISPR gRNA sequence
agaaatctttagagataaat

SEQ ID NO: 384163 - DNA, 20 bp, Artificial
  CRISPR gRNA sequence
gaaatctttagagataaata

SEQ ID NO: 384164 - DNA, 20 bp, Artificial
  CRISPR gRNA sequence
tagagataaataatgaatct

SEQ ID NO: 384165 - DNA, 20 bp, Artificial
  CRISPR gRNA sequence
agagataaataatgaatctt

SEQ ID NO: 384166 - DNA, 20 bp, Artificial
  CRISPR gRNA sequence
gagataaataatgaatcttt

SEQ ID NO: 384167 - DNA, 20 bp, Artificial
  CRISPR gRNA sequence
ttagacatgaatgatcacta

SEQ ID NO: 384168 - DNA, 20 bp, Artificial
  CRISPR gRNA sequence
tagacatgaatgatcactat

SEQ ID NO: 384169 - DNA, 20 bp, Artificial
  CRISPR gRNA sequence
agacatgaatgatcactata

SEQ ID NO: 384170 - DNA, 20 bp, Artificial
  CRISPR gRNA sequence
gacatgaatgatcactatat

SEQ ID NO: 384171 - DNA, 20 bp, Artificial
  CRISPR gRNA sequence
tatttaacaataaccattgt

SEQ ID NO: 384172 - DNA, 20 bp, Artificial
  CRISPR gRNA sequence
aacaataaccattgtccttt

SEQ ID NO: 384173 - DNA, 20 bp, Artificial
  CRISPR gRNA sequence
acaataaccattgtcctttc

SEQ ID NO: 384174 - DNA, 20 bp, Artificial
  CRISPR gRNA sequence
tcctttcaaggtaaccatga

SEQ ID NO: 384175 - DNA, 20 bp, Artificial
  CRISPR gRNA sequence
tcaaggtaaccatgacagtt

SEQ ID NO: 384176 - DNA, 20 bp, Artificial
  CRISPR gRNA sequence
caaggtaaccatgacagttt

SEQ ID NO: 384177 - DNA, 20 bp, Artificial
  CRISPR gRNA sequence
aaggtaaccatgacagtttt

SEQ ID NO: 384178 - DNA, 20 bp, Artificial
  CRISPR gRNA sequence
tattcagtttggcaaatact

SEQ ID NO: 384179 - DNA, 20 bp, Artificial
  CRISPR gRNA sequence
attcagtttggcaaatactt

SEQ ID NO: 384180 - DNA, 20 bp, Artificial
  CRISPR gRNA sequence
ttcagtttggcaaatacttt

SEQ ID NO: 384181 - DNA, 20 bp, Artificial
  CRISPR gRNA sequence
agtttggcaaatacttttca

SEQ ID NO: 384182 - DNA, 20 bp, Artificial
  CRISPR gRNA sequence
ggcaaatacttttcattgtt

SEQ ID NO: 384183 - DNA, 20 bp, Artificial
  CRISPR gRNA sequence
gcaaatacttttcattgtta

SEQ ID NO: 384184 - DNA, 20 bp, Artificial
  CRISPR gRNA sequence
ttcattgttagcctacatct

SEQ ID NO: 384185 - DNA, 20 bp, Artificial
  CRISPR gRNA sequence
tcattgttagcctacatcta

SEQ ID NO: 384186 - DNA, 20 bp, Artificial
  CRISPR gRNA sequence
cattgttagcctacatctag

SEQ ID NO: 384187 - DNA, 20 bp, Artificial
  CRISPR gRNA sequence
attgttagcctacatctaga

SEQ ID NO: 384188 - DNA, 20 bp, Artificial
  CRISPR gRNA sequence
ttagcctacatctagaattt

SEQ ID NO: 384189 - DNA, 20 bp, Artificial
  CRISPR gRNA sequence
gcctacatctagaatttaaa

SEQ ID NO: 384190 - DNA, 20 bp, Artificial
  CRISPR gRNA sequence
catctagaatttaaacaata

SEQ ID NO: 384191 - DNA, 20 bp, Artificial
  CRISPR gRNA sequence
gaatttaaacaatattaggt

SEQ ID NO: 384192 - DNA, 20 bp, Artificial
  CRISPR gRNA sequence
aaacaatattaggtatggtc

SEQ ID NO: 384193 - DNA, 20 bp, Artificial
  CRISPR gRNA sequence
aacaatattaggtatggtct

SEQ ID NO: 384194 - DNA, 20 bp, Artificial
  CRISPR gRNA sequence
ggtatggtctctaattgctt

SEQ ID NO: 384195 - DNA, 20 bp, Artificial
  CRISPR gRNA sequence
taattgctttgactgttggt

SEQ ID NO: 384196 - DNA, 20 bp, Artificial
  CRISPR gRNA sequence
attgctttgactgttggtga

SEQ ID NO: 384197 - DNA, 20 bp, Artificial
  CRISPR gRNA sequence
ctttgactgttggtgatgtc

SEQ ID NO: 384198 - DNA, 20 bp, Artificial
  CRISPR gRNA sequence
tgactgttggtgatgtcatt

SEQ ID NO: 384199 - DNA, 20 bp, Artificial
  CRISPR gRNA sequence
gactgttggtgatgtcatta

SEQ ID NO: 384200 - DNA, 20 bp, Artificial
  CRISPR gRNA sequence
actgttggtgatgtcattag

SEQ ID NO: 384201 - DNA, 20 bp, Artificial
  CRISPR gRNA sequence
ttggtgatgtcattagggct

SEQ ID NO: 384202 - DNA, 20 bp, Artificial
  CRISPR gRNA sequence
gtgatgtcattagggctgtc

SEQ ID NO: 384203 - DNA, 20 bp, Artificial
  CRISPR gRNA sequence
gggctgtctttgtctgaata

SEQ ID NO: 384204 - DNA, 20 bp, Artificial
  CRISPR gRNA sequence
tctttgtctgaatagtgaag

SEQ ID NO: 384205 - DNA, 20 bp, Artificial
  CRISPR gRNA sequence
tgtctgaatagtgaagcaga

SEQ ID NO: 384206 - DNA, 20 bp, Artificial
  CRISPR gRNA sequence
gtctgaatagtgaagcagaa

SEQ ID NO: 384207 - DNA, 20 bp, Artificial
  CRISPR gRNA sequence
tctgaatagtgaagcagaag

SEQ ID NO: 384208 - DNA, 20 bp, Artificial
  CRISPR gRNA sequence
aatagtgaagcagaagtttc

SEQ ID NO: 384209 - DNA, 20 bp, Artificial
  CRISPR gRNA sequence
ccctttgtatttttctgtgg

SEQ ID NO: 384210 - DNA, 20 bp, Artificial
  CRISPR gRNA sequence
cctttgtatttttctgtggt

SEQ ID NO: 384211 - DNA, 20 bp, Artificial
  CRISPR gRNA sequence
tgtatttttctgtggtttga

SEQ ID NO: 384212 - DNA, 20 bp, Artificial
  CRISPR gRNA sequence
gtatttttctgtggtttgat

SEQ ID NO: 384213 - DNA, 20 bp, Artificial
  CRISPR gRNA sequence
tatttttctgtggtttgatt

SEQ ID NO: 384214 - DNA, 20 bp, Artificial
  CRISPR gRNA sequence
ttctgtggtttgattccttt

SEQ ID NO: 384215 - DNA, 20 bp, Artificial
  CRISPR gRNA sequence
tctgtggtttgattcctttc

SEQ ID NO: 384216 - DNA, 20 bp, Artificial
  CRISPR gRNA sequence
ctgtggtttgattcctttct

SEQ ID NO: 384217 - DNA, 20 bp, Artificial
  CRISPR gRNA sequence
tgtggtttgattcctttctc

SEQ ID NO: 384218 - DNA, 20 bp, Artificial
  CRISPR gRNA sequence
tggtttgattcctttctcct

SEQ ID NO: 384219 - DNA, 20 bp, Artificial
  CRISPR gRNA sequence
gattcctttctcctgttgcc

SEQ ID NO: 384220 - DNA, 20 bp, Artificial
  CRISPR gRNA sequence
attcctttctcctgttgcct

SEQ ID NO: 384221 - DNA, 20 bp, Artificial
  CRISPR gRNA sequence
ctttctcctgttgcctgtac

SEQ ID NO: 384222 - DNA, 20 bp, Artificial
  CRISPR gRNA sequence
tctcctgttgcctgtaccct

SEQ ID NO: 384223 - DNA, 20 bp, Artificial
  CRISPR gRNA sequence
ctcctgttgcctgtaccctc

SEQ ID NO: 384224 - DNA, 20 bp, Artificial
  CRISPR gRNA sequence
tcctgttgcctgtaccctcc

SEQ ID NO: 384225 - DNA, 20 bp, Artificial
  CRISPR gRNA sequence
ctgttgcctgtaccctccca

SEQ ID NO: 384226 - DNA, 20 bp, Artificial
  CRISPR gRNA sequence
ttgcctgtaccctcccaatt

SEQ ID NO: 384227 - DNA, 20 bp, Artificial
  CRISPR gRNA sequence
cctgtaccctcccaatttct

SEQ ID NO: 384228 - DNA, 20 bp, Artificial
  CRISPR gRNA sequence
taccctcccaatttcttttt

SEQ ID NO: 384229 - DNA, 20 bp, Artificial
  CRISPR gRNA sequence
ccaatttcttttttccctcc

SEQ ID NO: 384230 - DNA, 20 bp, Artificial
  CRISPR gRNA sequence
cttttttccctcccaaattt

SEQ ID NO: 384231 - DNA, 20 bp, Artificial
  CRISPR gRNA sequence
ttttttccctcccaaatttc

SEQ ID NO: 384232 - DNA, 20 bp, Artificial
  CRISPR gRNA sequence
ttttccctcccaaatttcta

SEQ ID NO: 384233 - DNA, 20 bp, Artificial
  CRISPR gRNA sequence
tttccctcccaaatttctac

SEQ ID NO: 384234 - DNA, 20 bp, Artificial
  CRISPR gRNA sequence
ttccctcccaaatttctacc

SEQ ID NO: 384235 - DNA, 20 bp, Artificial
  CRISPR gRNA sequence
tccctcccaaatttctaccc

SEQ ID NO: 384236 - DNA, 20 bp, Artificial
  CRISPR gRNA sequence
ccctcccaaatttctaccct

SEQ ID NO: 384237 - DNA, 20 bp, Artificial
  CRISPR gRNA sequence
cctcccaaatttctacccta

SEQ ID NO: 384238 - DNA, 20 bp, Artificial
  CRISPR gRNA sequence
ccaaatttctaccctaccgt

SEQ ID NO: 384239 - DNA, 20 bp, Artificial
  CRISPR gRNA sequence
ctaccctaccgtcctatgcc

SEQ ID NO: 384240 - DNA, 20 bp, Artificial
  CRISPR gRNA sequence
taccctaccgtcctatgcca

SEQ ID NO: 384241 - DNA, 20 bp, Artificial
  CRISPR gRNA sequence
ccctaccgtcctatgccacc

SEQ ID NO: 384242 - DNA, 20 bp, Artificial
  CRISPR gRNA sequence
ccgtcctatgccaccacttt

SEQ ID NO: 384243 - DNA, 20 bp, Artificial
  CRISPR gRNA sequence
tgccaccactttcaactgtc

SEQ ID NO: 384244 - DNA, 20 bp, Artificial
  CRISPR gRNA sequence
tcaactgtcacttttagtgg

SEQ ID NO: 384245 - DNA, 20 bp, Artificial
  CRISPR gRNA sequence
caactgtcacttttagtggt

SEQ ID NO: 384246 - DNA, 20 bp, Artificial
  CRISPR gRNA sequence
aactgtcacttttagtggta

SEQ ID NO: 384247 - DNA, 20 bp, Artificial
  CRISPR gRNA sequence
tcacttttagtggtatatta

SEQ ID NO: 384248 - DNA, 20 bp, Artificial
  CRISPR gRNA sequence
ttagtggtatattatattca

SEQ ID NO: 384249 - DNA, 20 bp, Artificial
  CRISPR gRNA sequence
tagtggtatattatattcaa

SEQ ID NO: 384250 - DNA, 20 bp, Artificial
  CRISPR gRNA sequence
agtggtatattatattcaac

SEQ ID NO: 384251 - DNA, 20 bp, Artificial
  CRISPR gRNA sequence
gtggtatattatattcaact

SEQ ID NO: 384252 - DNA, 20 bp, Artificial
  CRISPR gRNA sequence
tattcaactttcacataatc

SEQ ID NO: 384253 - DNA, 20 bp, Artificial
  CRISPR gRNA sequence
aactttcacataatcattaa

SEQ ID NO: 384254 - DNA, 20 bp, Artificial
  CRISPR gRNA sequence
tcacataatcattaaaaaat

SEQ ID NO: 384255 - DNA, 20 bp, Artificial
  CRISPR gRNA sequence
cacataatcattaaaaaata

SEQ ID NO: 384256 - DNA, 20 bp, Artificial
  CRISPR gRNA sequence
acataatcattaaaaaataa

SEQ ID NO: 384257 - DNA, 20 bp, Artificial
  CRISPR gRNA sequence
aaaaataataactaggtgcc

SEQ ID NO: 384258 - DNA, 20 bp, Artificial
  CRISPR gRNA sequence
ggtgcctgacccttttgaga

SEQ ID NO: 384259 - DNA, 20 bp, Artificial
  CRISPR gRNA sequence
acccttttgagagaatttac

SEQ ID NO: 384260 - DNA, 20 bp, Artificial
  CRISPR gRNA sequence
ttgagagaatttacatatta

SEQ ID NO: 384261 - DNA, 20 bp, Artificial
  CRISPR gRNA sequence
tgagagaatttacatattaa

SEQ ID NO: 384262 - DNA, 20 bp, Artificial
  CRISPR gRNA sequence
gagagaatttacatattaaa

SEQ ID NO: 384263 - DNA, 20 bp, Artificial
  CRISPR gRNA sequence
agagaatttacatattaaaa

SEQ ID NO: 384264 - DNA, 20 bp, Artificial
  CRISPR gRNA sequence
acatattaaaaataattctc

SEQ ID NO: 384265 - DNA, 20 bp, Artificial
  CRISPR gRNA sequence
catattaaaaataattctca

SEQ ID NO: 384266 - DNA, 20 bp, Artificial
  CRISPR gRNA sequence
aaaataattctcaaaagtag

SEQ ID NO: 384267 - DNA, 20 bp, Artificial
  CRISPR gRNA sequence
tcaaaagtagacaaaatatg

SEQ ID NO: 384268 - DNA, 20 bp, Artificial
  CRISPR gRNA sequence
aaaagtagacaaaatatgtc

SEQ ID NO: 384269 - DNA, 20 bp, Artificial
  CRISPR gRNA sequence
agttatttattattcgacta

SEQ ID NO: 384270 - DNA, 20 bp, Artificial
  CRISPR gRNA sequence
tttattattcgactatctac

SEQ ID NO: 384271 - DNA, 20 bp, Artificial
  CRISPR gRNA sequence
attattcgactatctactac

SEQ ID NO: 384272 - DNA, 20 bp, Artificial
  CRISPR gRNA sequence
ttattcgactatctactaca

SEQ ID NO: 384273 - DNA, 20 bp, Artificial
  CRISPR gRNA sequence
ttcgactatctactacattt

SEQ ID NO: 384274 - DNA, 20 bp, Artificial
  CRISPR gRNA sequence
gactatctactacatttgct

SEQ ID NO: 384275 - DNA, 20 bp, Artificial
  CRISPR gRNA sequence
tctactacatttgctcctaa

SEQ ID NO: 384276 - DNA, 20 bp, Artificial
  CRISPR gRNA sequence
ctacatttgctcctaaggct

SEQ ID NO: 384277 - DNA, 20 bp, Artificial
  CRISPR gRNA sequence
catttgctcctaaggctaga

SEQ ID NO: 384278 - DNA, 20 bp, Artificial
  CRISPR gRNA sequence
gctcctaaggctagacctgg

SEQ ID NO: 384279 - DNA, 20 bp, Artificial
  CRISPR gRNA sequence
ctcctaaggctagacctggg

SEQ ID NO: 384280 - DNA, 20 bp, Artificial
  CRISPR gRNA sequence
ctaaggctagacctgggatg

SEQ ID NO: 384281 - DNA, 20 bp, Artificial
  CRISPR gRNA sequence
aggctagacctgggatggcg

SEQ ID NO: 384282 - DNA, 20 bp, Artificial
  CRISPR gRNA sequence
gacctgggatggcggcaaga

SEQ ID NO: 384283 - DNA, 20 bp, Artificial
  CRISPR gRNA sequence
ggatggcggcaagaattcta

SEQ ID NO: 384284 - DNA, 20 bp, Artificial
  CRISPR gRNA sequence
tatacagaatgagagataaa

SEQ ID NO: 384285 - DNA, 20 bp, Artificial
  CRISPR gRNA sequence
tacagaatgagagataaata

SEQ ID NO: 384286 - DNA, 20 bp, Artificial
  CRISPR gRNA sequence
ccctctcgcatttatcttcc

SEQ ID NO: 384287 - DNA, 20 bp, Artificial
  CRISPR gRNA sequence
tcgcatttatcttcctcttg

SEQ ID NO: 384288 - DNA, 20 bp, Artificial
  CRISPR gRNA sequence
gcatttatcttcctcttgaa

SEQ ID NO: 384289 - DNA, 20 bp, Artificial
  CRISPR gRNA sequence
atcttcctcttgaatattca

SEQ ID NO: 384290 - DNA, 20 bp, Artificial
  CRISPR gRNA sequence
tcttcctcttgaatattcat

SEQ ID NO: 384291 - DNA, 20 bp, Artificial
  CRISPR gRNA sequence
cctcttgaatattcatttct

SEQ ID NO: 384292 - DNA, 20 bp, Artificial
  CRISPR gRNA sequence
ctcttgaatattcatttctt

SEQ ID NO: 384293 - DNA, 20 bp, Artificial
  CRISPR gRNA sequence
ttgaatattcatttcttcta

SEQ ID NO: 384294 - DNA, 20 bp, Artificial
  CRISPR gRNA sequence
gaatattcatttcttctact

SEQ ID NO: 384295 - DNA, 20 bp, Artificial
  CRISPR gRNA sequence
aatattcatttcttctactg

SEQ ID NO: 384296 - DNA, 20 bp, Artificial
  CRISPR gRNA sequence
atttcttctactgccaggta

SEQ ID NO: 384297 - DNA, 20 bp, Artificial
  CRISPR gRNA sequence
cttctactgccaggtattct

SEQ ID NO: 384298 - DNA, 20 bp, Artificial
  CRISPR gRNA sequence
ttctactgccaggtattctt

SEQ ID NO: 384299 - DNA, 20 bp, Artificial
  CRISPR gRNA sequence
ctactgccaggtattcttct

SEQ ID NO: 384300 - DNA, 20 bp, Artificial
  CRISPR gRNA sequence
tactgccaggtattcttctg

SEQ ID NO: 384301 - DNA, 20 bp, Artificial
  CRISPR gRNA sequence
ctgccaggtattcttctgga

SEQ ID NO: 384302 - DNA, 20 bp, Artificial
  CRISPR gRNA sequence
ccaggtattcttctggacta

SEQ ID NO: 384303 - DNA, 20 bp, Artificial
  CRISPR gRNA sequence
ttctggactatgctgataga

SEQ ID NO: 384304 - DNA, 20 bp, Artificial
  CRISPR gRNA sequence
ctggactatgctgatagagt

SEQ ID NO: 384305 - DNA, 20 bp, Artificial
  CRISPR gRNA sequence
tggactatgctgatagagtg

SEQ ID NO: 384306 - DNA, 20 bp, Artificial
  CRISPR gRNA sequence
gactatgctgatagagtgga

SEQ ID NO: 384307 - DNA, 20 bp, Artificial
  CRISPR gRNA sequence
tgctgatagagtggattcta

SEQ ID NO: 384308 - DNA, 20 bp, Artificial
  CRISPR gRNA sequence
atagagtggattctagaagt

SEQ ID NO: 384309 - DNA, 20 bp, Artificial
  CRISPR gRNA sequence
tagaagtatggacagagata

SEQ ID NO: 384310 - DNA, 20 bp, Artificial
  CRISPR gRNA sequence
gaagtatggacagagatacc

SEQ ID NO: 384311 - DNA, 20 bp, Artificial
  CRISPR gRNA sequence
ctagaatccatcccatattt

SEQ ID NO: 384312 - DNA, 20 bp, Artificial
  CRISPR gRNA sequence
tagaatccatcccatatttc

SEQ ID NO: 384313 - DNA, 20 bp, Artificial
  CRISPR gRNA sequence
gaatccatcccatatttcac

SEQ ID NO: 384314 - DNA, 20 bp, Artificial
  CRISPR gRNA sequence
cactttttagttaacaaaaa

SEQ ID NO: 384315 - DNA, 20 bp, Artificial
  CRISPR gRNA sequence
actttttagttaacaaaaat

SEQ ID NO: 384316 - DNA, 20 bp, Artificial
  CRISPR gRNA sequence
tttagttaacaaaaatgtct

SEQ ID NO: 384317 - DNA, 20 bp, Artificial
  CRISPR gRNA sequence
ttagttaacaaaaatgtctt

SEQ ID NO: 384318 - DNA, 20 bp, Artificial
  CRISPR gRNA sequence
tagttaacaaaaatgtcttg

SEQ ID NO: 384319 - DNA, 20 bp, Artificial
  CRISPR gRNA sequence
agttaacaaaaatgtcttgg

SEQ ID NO: 384320 - DNA, 20 bp, Artificial
  CRISPR gRNA sequence
gttaacaaaaatgtcttggt

SEQ ID NO: 384321 - DNA, 20 bp, Artificial
  CRISPR gRNA sequence
acaaaaatgtcttggttaat

SEQ ID NO: 384322 - DNA, 20 bp, Artificial
  CRISPR gRNA sequence
ggttaatcactgcagtcaat

SEQ ID NO: 384323 - DNA, 20 bp, Artificial
  CRISPR gRNA sequence
gttaatcactgcagtcaata

SEQ ID NO: 384324 - DNA, 20 bp, Artificial
  CRISPR gRNA sequence
atcactgcagtcaatatttg

SEQ ID NO: 384325 - DNA, 20 bp, Artificial
  CRISPR gRNA sequence
cagtcaatatttgttggtaa

SEQ ID NO: 384326 - DNA, 20 bp, Artificial
  CRISPR gRNA sequence
gttggtaaactctccagctt

SEQ ID NO: 384327 - DNA, 20 bp, Artificial
  CRISPR gRNA sequence
ttggtaaactctccagcttt

SEQ ID NO: 384328 - DNA, 20 bp, Artificial
  CRISPR gRNA sequence
gtaaactctccagctttgag

SEQ ID NO: 384329 - DNA, 20 bp, Artificial
  CRISPR gRNA sequence
tccagctttgagactcccct

SEQ ID NO: 384330 - DNA, 20 bp, Artificial
  CRISPR gRNA sequence
cagctttgagactccccttt

SEQ ID NO: 384331 - DNA, 20 bp, Artificial
  CRISPR gRNA sequence
tgagactcccctttcctctt

SEQ ID NO: 384332 - DNA, 20 bp, Artificial
  CRISPR gRNA sequence
gagactcccctttcctcttc

SEQ ID NO: 384333 - DNA, 20 bp, Artificial
  CRISPR gRNA sequence
agactcccctttcctcttct

SEQ ID NO: 384334 - DNA, 20 bp, Artificial
  CRISPR gRNA sequence
ccctttcctcttctaaccat

SEQ ID NO: 384335 - DNA, 20 bp, Artificial
  CRISPR gRNA sequence
tcctcttctaaccatgctct

SEQ ID NO: 384336 - DNA, 20 bp, Artificial
  CRISPR gRNA sequence
cctcttctaaccatgctctg

SEQ ID NO: 384337 - DNA, 20 bp, Artificial
  CRISPR gRNA sequence
ctcttctaaccatgctctga

SEQ ID NO: 384338 - DNA, 20 bp, Artificial
  CRISPR gRNA sequence
ttctaaccatgctctgaatt

SEQ ID NO: 384339 - DNA, 20 bp, Artificial
  CRISPR gRNA sequence
ctaaccatgctctgaattgc

SEQ ID NO: 384340 - DNA, 20 bp, Artificial
  CRISPR gRNA sequence
taaccatgctctgaattgcc

SEQ ID NO: 384341 - DNA, 20 bp, Artificial
  CRISPR gRNA sequence
accatgctctgaattgccca

SEQ ID NO: 384342 - DNA, 20 bp, Artificial
  CRISPR gRNA sequence
tgaattgcccagtattgtgc

SEQ ID NO: 384343 - DNA, 20 bp, Artificial
  CRISPR gRNA sequence
aattgcccagtattgtgctt

SEQ ID NO: 384344 - DNA, 20 bp, Artificial
  CRISPR gRNA sequence
cccagtattgtgctttgacc

SEQ ID NO: 384345 - DNA, 20 bp, Artificial
  CRISPR gRNA sequence
tgctttgaccctgcttctca

SEQ ID NO: 384346 - DNA, 20 bp, Artificial
  CRISPR gRNA sequence
tgaccctgcttctcagctct

SEQ ID NO: 384347 - DNA, 20 bp, Artificial
  CRISPR gRNA sequence
gaccctgcttctcagctcta

SEQ ID NO: 384348 - DNA, 20 bp, Artificial
  CRISPR gRNA sequence
accctgcttctcagctctag

SEQ ID NO: 384349 - DNA, 20 bp, Artificial
  CRISPR gRNA sequence
cttctcagctctagaagtga

SEQ ID NO: 384350 - DNA, 20 bp, Artificial
  CRISPR gRNA sequence
ctcagctctagaagtgaacc

SEQ ID NO: 384351 - DNA, 20 bp, Artificial
  CRISPR gRNA sequence
tcagctctagaagtgaaccc

SEQ ID NO: 384352 - DNA, 20 bp, Artificial
  CRISPR gRNA sequence
agctctagaagtgaaccctt

SEQ ID NO: 384353 - DNA, 20 bp, Artificial
  CRISPR gRNA sequence
tagaagtgaacccttagttt

SEQ ID NO: 384354 - DNA, 20 bp, Artificial
  CRISPR gRNA sequence
gaagtgaacccttagtttac

SEQ ID NO: 384355 - DNA, 20 bp, Artificial
  CRISPR gRNA sequence
agtttacttaagccattcca

SEQ ID NO: 384356 - DNA, 20 bp, Artificial
  CRISPR gRNA sequence
gtttacttaagccattccat

SEQ ID NO: 384357 - DNA, 20 bp, Artificial
  CRISPR gRNA sequence
acttaagccattccatcctt

SEQ ID NO: 384358 - DNA, 20 bp, Artificial
  CRISPR gRNA sequence
cttaagccattccatccttt

SEQ ID NO: 384359 - DNA, 20 bp, Artificial
  CRISPR gRNA sequence
aagccattccatcctttctg

SEQ ID NO: 384360 - DNA, 20 bp, Artificial
  CRISPR gRNA sequence
agccattccatcctttctgg

SEQ ID NO: 384361 - DNA, 20 bp, Artificial
  CRISPR gRNA sequence
catcctttctggtcatgttg

SEQ ID NO: 384362 - DNA, 20 bp, Artificial
  CRISPR gRNA sequence
tctggtcatgttgcctattt

SEQ ID NO: 384363 - DNA, 20 bp, Artificial
  CRISPR gRNA sequence
ctggtcatgttgcctattta

SEQ ID NO: 384364 - DNA, 20 bp, Artificial
  CRISPR gRNA sequence
tggtcatgttgcctatttaa

SEQ ID NO: 384365 - DNA, 20 bp, Artificial
  CRISPR gRNA sequence
gtcatgttgcctatttaaca

SEQ ID NO: 384366 - DNA, 20 bp, Artificial
  CRISPR gRNA sequence
cctatttaacaatgaaaaaa

SEQ ID NO: 384367 - DNA, 20 bp, Artificial
  CRISPR gRNA sequence
tttaacaatgaaaaaataat

SEQ ID NO: 384368 - DNA, 20 bp, Artificial
  CRISPR gRNA sequence
aacaatgaaaaaataatcaa

SEQ ID NO: 384369 - DNA, 20 bp, Artificial
  CRISPR gRNA sequence
acaatgaaaaaataatcaaa

SEQ ID NO: 384370 - DNA, 20 bp, Artificial
  CRISPR gRNA sequence
gtttgctccatttgagaagc

SEQ ID NO: 384371 - DNA, 20 bp, Artificial
  CRISPR gRNA sequence
tttgctccatttgagaagca

SEQ ID NO: 384372 - DNA, 20 bp, Artificial
  CRISPR gRNA sequence
gctccatttgagaagcaaac

SEQ ID NO: 384373 - DNA, 20 bp, Artificial
  CRISPR gRNA sequence
ctccatttgagaagcaaact

SEQ ID NO: 384374 - DNA, 20 bp, Artificial
  CRISPR gRNA sequence
catttgagaagcaaactctc

SEQ ID NO: 384375 - DNA, 20 bp, Artificial
  CRISPR gRNA sequence
gagaagcaaactctctacca

SEQ ID NO: 384376 - DNA, 20 bp, Artificial
  CRISPR gRNA sequence
agaagcaaactctctaccag

SEQ ID NO: 384377 - DNA, 20 bp, Artificial
  CRISPR gRNA sequence
tctaccagacagaaacaagg

SEQ ID NO: 384378 - DNA, 20 bp, Artificial
  CRISPR gRNA sequence
taccagacagaaacaaggat

SEQ ID NO: 384379 - DNA, 20 bp, Artificial
  CRISPR gRNA sequence
ccagacagaaacaaggatgt

SEQ ID NO: 384380 - DNA, 20 bp, Artificial
  CRISPR gRNA sequence
ccaagagttggcagccatct

SEQ ID NO: 384381 - DNA, 20 bp, Artificial
  CRISPR gRNA sequence
gcagccatcttgccaacaca

SEQ ID NO: 384382 - DNA, 20 bp, Artificial
  CRISPR gRNA sequence
gccaacacaagaggaaagcc

SEQ ID NO: 384383 - DNA, 20 bp, Artificial
  CRISPR gRNA sequence
ccaacacaagaggaaagcct

SEQ ID NO: 384384 - DNA, 20 bp, Artificial
  CRISPR gRNA sequence
catgagagtgaggccaagac

SEQ ID NO: 384385 - DNA, 20 bp, Artificial
  CRISPR gRNA sequence
tggaaagggattcagaagcc

SEQ ID NO: 384386 - DNA, 20 bp, Artificial
  CRISPR gRNA sequence
gaaagggattcagaagccag

SEQ ID NO: 384387 - DNA, 20 bp, Artificial
  CRISPR gRNA sequence
agaagccagtttatgcccat

SEQ ID NO: 384388 - DNA, 20 bp, Artificial
  CRISPR gRNA sequence
atgcccatacttaattctag

SEQ ID NO: 384389 - DNA, 20 bp, Artificial
  CRISPR gRNA sequence
tgcccatacttaattctaga

SEQ ID NO: 384390 - DNA, 20 bp, Artificial
  CRISPR gRNA sequence
aattctagacacaacattta

SEQ ID NO: 384391 - DNA, 20 bp, Artificial
  CRISPR gRNA sequence
attctagacacaacatttaa

SEQ ID NO: 384392 - DNA, 20 bp, Artificial
  CRISPR gRNA sequence
tagacacaacatttaagccc

SEQ ID NO: 384393 - DNA, 20 bp, Artificial
  CRISPR gRNA sequence
gacacaacatttaagccctg

SEQ ID NO: 384394 - DNA, 20 bp, Artificial
  CRISPR gRNA sequence
aagccctggtaaatagccct

SEQ ID NO: 384395 - DNA, 20 bp, Artificial
  CRISPR gRNA sequence
agccctggtaaatagccctt

SEQ ID NO: 384396 - DNA, 20 bp, Artificial
  CRISPR gRNA sequence
gtaaatagcccttgcccaaa

SEQ ID NO: 384397 - DNA, 20 bp, Artificial
  CRISPR gRNA sequence
gcccaaagcttaatctcccc

SEQ ID NO: 384398 - DNA, 20 bp, Artificial
  CRISPR gRNA sequence
cccaaagcttaatctcccct

SEQ ID NO: 384399 - DNA, 20 bp, Artificial
  CRISPR gRNA sequence
aatctcccctggatcattct

SEQ ID NO: 384400 - DNA, 20 bp, Artificial
  CRISPR gRNA sequence
atctcccctggatcattctg

SEQ ID NO: 384401 - DNA, 20 bp, Artificial
  CRISPR gRNA sequence
ccctggatcattctgttata

SEQ ID NO: 384402 - DNA, 20 bp, Artificial
  CRISPR gRNA sequence
gatcattctgttatatgata

SEQ ID NO: 384403 - DNA, 20 bp, Artificial
  CRISPR gRNA sequence
tgttatatgatacagtaagt

SEQ ID NO: 384404 - DNA, 20 bp, Artificial
  CRISPR gRNA sequence
ttatatgatacagtaagttt

SEQ ID NO: 384405 - DNA, 20 bp, Artificial
  CRISPR gRNA sequence
tatgatacagtaagttttct

SEQ ID NO: 384406 - DNA, 20 bp, Artificial
  CRISPR gRNA sequence
tcttttgtatataaaccagt

SEQ ID NO: 384407 - DNA, 20 bp, Artificial
  CRISPR gRNA sequence
cttttgtatataaaccagtt

SEQ ID NO: 384408 - DNA, 20 bp, Artificial
  CRISPR gRNA sequence
ttttgtatataaaccagtta

SEQ ID NO: 384409 - DNA, 20 bp, Artificial
  CRISPR gRNA sequence
ttgtatataaaccagttaga

SEQ ID NO: 384410 - DNA, 20 bp, Artificial
  CRISPR gRNA sequence
tgtatataaaccagttagag

SEQ ID NO: 384411 - DNA, 20 bp, Artificial
  CRISPR gRNA sequence
gtatataaaccagttagagt

SEQ ID NO: 384412 - DNA, 20 bp, Artificial
  CRISPR gRNA sequence
tatataaaccagttagagtc

SEQ ID NO: 384413 - DNA, 20 bp, Artificial
  CRISPR gRNA sequence
gagtcaggttttctgaaaca

SEQ ID NO: 384414 - DNA, 20 bp, Artificial
  CRISPR gRNA sequence
tctgaaacagttctatgaaa

SEQ ID NO: 384415 - DNA, 20 bp, Artificial
  CRISPR gRNA sequence
ctgaaacagttctatgaaaa

SEQ ID NO: 384416 - DNA, 20 bp, Artificial
  CRISPR gRNA sequence
tgaaacagttctatgaaaaa

SEQ ID NO: 384417 - DNA, 20 bp, Artificial
  CRISPR gRNA sequence
aaacagttctatgaaaaatg

SEQ ID NO: 384418 - DNA, 20 bp, Artificial
  CRISPR gRNA sequence
tatgaaaaatgattttaggt

SEQ ID NO: 384419 - DNA, 20 bp, Artificial
  CRISPR gRNA sequence
tgaaaaatgattttaggtaa

SEQ ID NO: 384420 - DNA, 20 bp, Artificial
  CRISPR gRNA sequence
taggtaatgaagtatttttc

SEQ ID NO: 384421 - DNA, 20 bp, Artificial
  CRISPR gRNA sequence
aggtaatgaagtatttttcc

SEQ ID NO: 384422 - DNA, 20 bp, Artificial
  CRISPR gRNA sequence
ggtaatgaagtatttttcct

SEQ ID NO: 384423 - DNA, 20 bp, Artificial
  CRISPR gRNA sequence
ttcctatcaaagtaactcaa

SEQ ID NO: 384424 - DNA, 20 bp, Artificial
  CRISPR gRNA sequence
tcctatcaaagtaactcaat

SEQ ID NO: 384425 - DNA, 20 bp, Artificial
  CRISPR gRNA sequence
cctatcaaagtaactcaatt

SEQ ID NO: 384426 - DNA, 20 bp, Artificial
  CRISPR gRNA sequence
ctatcaaagtaactcaattc

SEQ ID NO: 384427 - DNA, 20 bp, Artificial
  CRISPR gRNA sequence
tcaaagtaactcaattcaga

SEQ ID NO: 384428 - DNA, 20 bp, Artificial
  CRISPR gRNA sequence
aattcagacaactagtatct

SEQ ID NO: 384429 - DNA, 20 bp, Artificial
  CRISPR gRNA sequence
agacaactagtatctaaggt

SEQ ID NO: 384430 - DNA, 20 bp, Artificial
  CRISPR gRNA sequence
gtatctaaggtagaccttgg

SEQ ID NO: 384431 - DNA, 20 bp, Artificial
  CRISPR gRNA sequence
aggtagaccttgggtagtgg

SEQ ID NO: 384432 - DNA, 20 bp, Artificial
  CRISPR gRNA sequence
gggtagtggaaaaaaattgc

SEQ ID NO: 384433 - DNA, 20 bp, Artificial
  CRISPR gRNA sequence
ggtagtggaaaaaaattgca

SEQ ID NO: 384434 - DNA, 20 bp, Artificial
  CRISPR gRNA sequence
cataaagatccatgcatgag

SEQ ID NO: 384435 - DNA, 20 bp, Artificial
  CRISPR gRNA sequence
ctaatgcactcatgtcaaga

SEQ ID NO: 384436 - DNA, 20 bp, Artificial
  CRISPR gRNA sequence
atgcactcatgtcaagaata

SEQ ID NO: 384437 - DNA, 20 bp, Artificial
  CRISPR gRNA sequence
atgtcaagaataagcttaaa

SEQ ID NO: 384438 - DNA, 20 bp, Artificial
  CRISPR gRNA sequence
aaactctagtctttggtctg

SEQ ID NO: 384439 - DNA, 20 bp, Artificial
  CRISPR gRNA sequence
aactctagtctttggtctgc

SEQ ID NO: 384440 - DNA, 20 bp, Artificial
  CRISPR gRNA sequence
tagtctttggtctgcgagag

SEQ ID NO: 384441 - DNA, 20 bp, Artificial
  CRISPR gRNA sequence
gtctttggtctgcgagagaa

SEQ ID NO: 384442 - DNA, 20 bp, Artificial
  CRISPR gRNA sequence
tggtctgcgagagaaggttg

SEQ ID NO: 384443 - DNA, 20 bp, Artificial
  CRISPR gRNA sequence
ggtctgcgagagaaggttgg

SEQ ID NO: 384444 - DNA, 20 bp, Artificial
  CRISPR gRNA sequence
gtctgcgagagaaggttgga

SEQ ID NO: 384445 - DNA, 20 bp, Artificial
  CRISPR gRNA sequence
cgagagaaggttggatagtt

SEQ ID NO: 384446 - DNA, 20 bp, Artificial
  CRISPR gRNA sequence
gatagttgacataaatatcc

SEQ ID NO: 384447 - DNA, 20 bp, Artificial
  CRISPR gRNA sequence
acataaatatcctctcttgt

SEQ ID NO: 384448 - DNA, 20 bp, Artificial
  CRISPR gRNA sequence
tcttgtatcatccatggatt

SEQ ID NO: 384449 - DNA, 20 bp, Artificial
  CRISPR gRNA sequence
ttgtatcatccatggattga

SEQ ID NO: 384450 - DNA, 20 bp, Artificial
  CRISPR gRNA sequence
gtatcatccatggattgatt

SEQ ID NO: 384451 - DNA, 20 bp, Artificial
  CRISPR gRNA sequence
tatcatccatggattgattg

SEQ ID NO: 384452 - DNA, 20 bp, Artificial
  CRISPR gRNA sequence
attggtaggttgactggtag

SEQ ID NO: 384453 - DNA, 20 bp, Artificial
  CRISPR gRNA sequence
gtaggttgactggtagagat

SEQ ID NO: 384454 - DNA, 20 bp, Artificial
  CRISPR gRNA sequence
actggtagagatgggacttc

SEQ ID NO: 384455 - DNA, 20 bp, Artificial
  CRISPR gRNA sequence
gtagagatgggacttctata

SEQ ID NO: 384456 - DNA, 20 bp, Artificial
  CRISPR gRNA sequence
ctatagttattgggtgccta

SEQ ID NO: 384457 - DNA, 20 bp, Artificial
  CRISPR gRNA sequence
tatagttattgggtgcctag

SEQ ID NO: 384458 - DNA, 20 bp, Artificial
  CRISPR gRNA sequence
tagttattgggtgcctagaa

SEQ ID NO: 384459 - DNA, 20 bp, Artificial
  CRISPR gRNA sequence
ttgggtgcctagaaagacaa

SEQ ID NO: 384460 - DNA, 20 bp, Artificial
  CRISPR gRNA sequence
ggtgcctagaaagacaaaca

SEQ ID NO: 384461 - DNA, 20 bp, Artificial
  CRISPR gRNA sequence
gaaagacaaacagcagagag

SEQ ID NO: 384462 - DNA, 20 bp, Artificial
  CRISPR gRNA sequence
actgcatttcaacaactaat

SEQ ID NO: 384463 - DNA, 20 bp, Artificial
  CRISPR gRNA sequence
catttcaacaactaatgaag

SEQ ID NO: 384464 - DNA, 20 bp, Artificial
  CRISPR gRNA sequence
caacaactaatgaagacatt

SEQ ID NO: 384465 - DNA, 20 bp, Artificial
  CRISPR gRNA sequence
aacaactaatgaagacattc

SEQ ID NO: 384466 - DNA, 20 bp, Artificial
  CRISPR gRNA sequence
atgaagacattcaaaacata

SEQ ID NO: 384467 - DNA, 20 bp, Artificial
  CRISPR gRNA sequence
aaaacatacctctcataaat

SEQ ID NO: 384468 - DNA, 20 bp, Artificial
  CRISPR gRNA sequence
tcataaatgcaggcatgata

SEQ ID NO: 384469 - DNA, 20 bp, Artificial
  CRISPR gRNA sequence
ataaatgcaggcatgatatg

SEQ ID NO: 384470 - DNA, 20 bp, Artificial
  CRISPR gRNA sequence
ccattataattaatttgata

SEQ ID NO: 384471 - DNA, 20 bp, Artificial
  CRISPR gRNA sequence
cattataattaatttgataa

SEQ ID NO: 384472 - DNA, 20 bp, Artificial
  CRISPR gRNA sequence
taattaatttgataaaacat

SEQ ID NO: 384473 - DNA, 20 bp, Artificial
  CRISPR gRNA sequence
atttgataaaacattctcat

SEQ ID NO: 384474 - DNA, 20 bp, Artificial
  CRISPR gRNA sequence
gataaaacattctcattgta

SEQ ID NO: 384475 - DNA, 20 bp, Artificial
  CRISPR gRNA sequence
ataaaacattctcattgtat

SEQ ID NO: 384476 - DNA, 20 bp, Artificial
  CRISPR gRNA sequence
tcattgtattgaacttctgt

SEQ ID NO: 384477 - DNA, 20 bp, Artificial
  CRISPR gRNA sequence
attgtattgaacttctgttg

SEQ ID NO: 384478 - DNA, 20 bp, Artificial
  CRISPR gRNA sequence
tattgaacttctgttggaaa

SEQ ID NO: 384479 - DNA, 20 bp, Artificial
  CRISPR gRNA sequence
aacttctgttggaaatcata

SEQ ID NO: 384480 - DNA, 20 bp, Artificial
  CRISPR gRNA sequence
ctgttggaaatcatattctt

SEQ ID NO: 384481 - DNA, 20 bp, Artificial
  CRISPR gRNA sequence
tgttggaaatcatattcttg

SEQ ID NO: 384482 - DNA, 20 bp, Artificial
  CRISPR gRNA sequence
ttggaaatcatattcttgac

SEQ ID NO: 384483 - DNA, 20 bp, Artificial
  CRISPR gRNA sequence
gaaatcatattcttgactga

SEQ ID NO: 384484 - DNA, 20 bp, Artificial
  CRISPR gRNA sequence
ttgactgagatgcaacagaa

SEQ ID NO: 384485 - DNA, 20 bp, Artificial
  CRISPR gRNA sequence
gactgagatgcaacagaaat

SEQ ID NO: 384486 - DNA, 20 bp, Artificial
  CRISPR gRNA sequence
actgagatgcaacagaaatc

SEQ ID NO: 384487 - DNA, 20 bp, Artificial
  CRISPR gRNA sequence
agatgcaacagaaatctagt

SEQ ID NO: 384488 - DNA, 20 bp, Artificial
  CRISPR gRNA sequence
gtctagattaatacttgctg

SEQ ID NO: 384489 - DNA, 20 bp, Artificial
  CRISPR gRNA sequence
gattaatacttgctgtattg

SEQ ID NO: 384490 - DNA, 20 bp, Artificial
  CRISPR gRNA sequence
atacttgctgtattgtgcta

SEQ ID NO: 384491 - DNA, 20 bp, Artificial
  CRISPR gRNA sequence
gctgtattgtgctatgaatt

SEQ ID NO: 384492 - DNA, 20 bp, Artificial
  CRISPR gRNA sequence
ctgtattgtgctatgaatta

SEQ ID NO: 384493 - DNA, 20 bp, Artificial
  CRISPR gRNA sequence
tattgtgctatgaattacct

SEQ ID NO: 384494 - DNA, 20 bp, Artificial
  CRISPR gRNA sequence
tgctatgaattacctgtttc

SEQ ID NO: 384495 - DNA, 20 bp, Artificial
  CRISPR gRNA sequence
tgaattacctgtttcaatgt

SEQ ID NO: 384496 - DNA, 20 bp, Artificial
  CRISPR gRNA sequence
cctgtttcaatgtagaactc

SEQ ID NO: 384497 - DNA, 20 bp, Artificial
  CRISPR gRNA sequence
tttcaatgtagaactccctc

SEQ ID NO: 384498 - DNA, 20 bp, Artificial
  CRISPR gRNA sequence
caatgtagaactccctctcc

SEQ ID NO: 384499 - DNA, 20 bp, Artificial
  CRISPR gRNA sequence
aatgtagaactccctctccc

SEQ ID NO: 384500 - DNA, 20 bp, Artificial
  CRISPR gRNA sequence
cctctcccaatgttaagcta

SEQ ID NO: 384501 - DNA, 20 bp, Artificial
  CRISPR gRNA sequence
tcccaatgttaagctatttt

SEQ ID NO: 384502 - DNA, 20 bp, Artificial
  CRISPR gRNA sequence
ccaatgttaagctattttga

SEQ ID NO: 384503 - DNA, 20 bp, Artificial
  CRISPR gRNA sequence
agctattttgataagaacaa

SEQ ID NO: 384504 - DNA, 20 bp, Artificial
  CRISPR gRNA sequence
ttttgataagaacaattact

SEQ ID NO: 384505 - DNA, 20 bp, Artificial
  CRISPR gRNA sequence
tgataagaacaattactatc

SEQ ID NO: 384506 - DNA, 20 bp, Artificial
  CRISPR gRNA sequence
gataagaacaattactatca

SEQ ID NO: 384507 - DNA, 20 bp, Artificial
  CRISPR gRNA sequence
ataagaacaattactatcat

SEQ ID NO: 384508 - DNA, 20 bp, Artificial
  CRISPR gRNA sequence
ctatcatttttatatggaaa

SEQ ID NO: 384509 - DNA, 20 bp, Artificial
  CRISPR gRNA sequence
tcatttttatatggaaattc

SEQ ID NO: 384510 - DNA, 20 bp, Artificial
  CRISPR gRNA sequence
ttatatggaaattctaacac

SEQ ID NO: 384511 - DNA, 20 bp, Artificial
  CRISPR gRNA sequence
tatatggaaattctaacaca

SEQ ID NO: 384512 - DNA, 20 bp, Artificial
  CRISPR gRNA sequence
atatggaaattctaacacag

SEQ ID NO: 384513 - DNA, 20 bp, Artificial
  CRISPR gRNA sequence
tatggaaattctaacacagt

SEQ ID NO: 384514 - DNA, 20 bp, Artificial
  CRISPR gRNA sequence
taacacagtgtctgaacttt

SEQ ID NO: 384515 - DNA, 20 bp, Artificial
  CRISPR gRNA sequence
acacagtgtctgaactttaa

SEQ ID NO: 384516 - DNA, 20 bp, Artificial
  CRISPR gRNA sequence
aactttaaaaaataagcaac

SEQ ID NO: 384517 - DNA, 20 bp, Artificial
  CRISPR gRNA sequence
taaaaaataagcaacttaac

SEQ ID NO: 384518 - DNA, 20 bp, Artificial
  CRISPR gRNA sequence
aaaaaataagcaacttaaca

SEQ ID NO: 384519 - DNA, 20 bp, Artificial
  CRISPR gRNA sequence
aaaaataagcaacttaacat

SEQ ID NO: 384520 - DNA, 20 bp, Artificial
  CRISPR gRNA sequence
aacatataaaaagttaacaa

SEQ ID NO: 384521 - DNA, 20 bp, Artificial
  CRISPR gRNA sequence
acatataaaaagttaacaaa

SEQ ID NO: 384522 - DNA, 20 bp, Artificial
  CRISPR gRNA sequence
acaaaactgacatcaagatg

SEQ ID NO: 384523 - DNA, 20 bp, Artificial
  CRISPR gRNA sequence
acatcaagatgatattgtat

SEQ ID NO: 384524 - DNA, 20 bp, Artificial
  CRISPR gRNA sequence
tataatcattaatcttctct

SEQ ID NO: 384525 - DNA, 20 bp, Artificial
  CRISPR gRNA sequence
atcttctctaccgtaatcaa

SEQ ID NO: 384526 - DNA, 20 bp, Artificial
  CRISPR gRNA sequence
ctctaccgtaatcaagtcac

SEQ ID NO: 384527 - DNA, 20 bp, Artificial
  CRISPR gRNA sequence
tctaccgtaatcaagtcact

SEQ ID NO: 384528 - DNA, 20 bp, Artificial
  CRISPR gRNA sequence
taccgtaatcaagtcacttt

SEQ ID NO: 384529 - DNA, 20 bp, Artificial
  CRISPR gRNA sequence
ccgtaatcaagtcactttga

SEQ ID NO: 384530 - DNA, 20 bp, Artificial
  CRISPR gRNA sequence
tgaccacatatgtatgtatg

SEQ ID NO: 384531 - DNA, 20 bp, Artificial
  CRISPR gRNA sequence
gaccacatatgtatgtatgt

SEQ ID NO: 384532 - DNA, 20 bp, Artificial
  CRISPR gRNA sequence
accacatatgtatgtatgta

SEQ ID NO: 384533 - DNA, 20 bp, Artificial
  CRISPR gRNA sequence
agagacaaaagaaactagag

SEQ ID NO: 384534 - DNA, 20 bp, Artificial
  CRISPR gRNA sequence
gagaaaggtcttttgatgag

SEQ ID NO: 384535 - DNA, 20 bp, Artificial
  CRISPR gRNA sequence
ttgatgagtaatttaaaaat

SEQ ID NO: 384536 - DNA, 20 bp, Artificial
  CRISPR gRNA sequence
tgatgagtaatttaaaaatt

SEQ ID NO: 384537 - DNA, 20 bp, Artificial
  CRISPR gRNA sequence
gatgagtaatttaaaaattt

SEQ ID NO: 384538 - DNA, 20 bp, Artificial
  CRISPR gRNA sequence
atgagtaatttaaaaattta

SEQ ID NO: 384539 - DNA, 20 bp, Artificial
  CRISPR gRNA sequence
aaaaatttagattgacctta

SEQ ID NO: 384540 - DNA, 20 bp, Artificial
  CRISPR gRNA sequence
aaaatttagattgaccttag

SEQ ID NO: 384541 - DNA, 20 bp, Artificial
  CRISPR gRNA sequence
agattgaccttagtgttgtt

SEQ ID NO: 384542 - DNA, 20 bp, Artificial
  CRISPR gRNA sequence
gattgaccttagtgttgttg

SEQ ID NO: 384543 - DNA, 20 bp, Artificial
  CRISPR gRNA sequence
accttagtgttgttggtttt

SEQ ID NO: 384544 - DNA, 20 bp, Artificial
  CRISPR gRNA sequence
agtgttgttggtttttttga

SEQ ID NO: 384545 - DNA, 20 bp, Artificial
  CRISPR gRNA sequence
gtgttgttggtttttttgag

SEQ ID NO: 384546 - DNA, 20 bp, Artificial
  CRISPR gRNA sequence
ttggtttttttgagtcagag

SEQ ID NO: 384547 - DNA, 20 bp, Artificial
  CRISPR gRNA sequence
gtttttttgagtcagagtct

SEQ ID NO: 384548 - DNA, 20 bp, Artificial
  CRISPR gRNA sequence
ttttgagtcagagtctcgct

SEQ ID NO: 384549 - DNA, 20 bp, Artificial
  CRISPR gRNA sequence
tttgagtcagagtctcgctc

SEQ ID NO: 384550 - DNA, 20 bp, Artificial
  CRISPR gRNA sequence
ttgagtcagagtctcgctct

SEQ ID NO: 384551 - DNA, 20 bp, Artificial
  CRISPR gRNA sequence
tgagtcagagtctcgctctg

SEQ ID NO: 384552 - DNA, 20 bp, Artificial
  CRISPR gRNA sequence
gagtcagagtctcgctctgt

SEQ ID NO: 384553 - DNA, 20 bp, Artificial
  CRISPR gRNA sequence
agtcagagtctcgctctgtt

SEQ ID NO: 384554 - DNA, 20 bp, Artificial
  CRISPR gRNA sequence
gctctgttgcccaagctgga

SEQ ID NO: 384555 - DNA, 20 bp, Artificial
  CRISPR gRNA sequence
tgttgcccaagctggagtgc

SEQ ID NO: 384556 - DNA, 20 bp, Artificial
  CRISPR gRNA sequence
ttgcccaagctggagtgcag

SEQ ID NO: 384557 - DNA, 20 bp, Artificial
  CRISPR gRNA sequence
cccaagctggagtgcagtgg

SEQ ID NO: 384558 - DNA, 20 bp, Artificial
  CRISPR gRNA sequence
gagtgcagtggcgcaatcta

SEQ ID NO: 384559 - DNA, 20 bp, Artificial
  CRISPR gRNA sequence
ggctcactgcaacccccacc

SEQ ID NO: 384560 - DNA, 20 bp, Artificial
  CRISPR gRNA sequence
actgcaacccccacctccca

SEQ ID NO: 384561 - DNA, 20 bp, Artificial
  CRISPR gRNA sequence
caacccccacctcccaggtt

SEQ ID NO: 384562 - DNA, 20 bp, Artificial
  CRISPR gRNA sequence
ccaggttcaagcaattctgc

SEQ ID NO: 384563 - DNA, 20 bp, Artificial
  CRISPR gRNA sequence
aagcaattctgcctcagcct

SEQ ID NO: 384564 - DNA, 20 bp, Artificial
  CRISPR gRNA sequence
tgcctcagcctcacgagtag

SEQ ID NO: 384565 - DNA, 20 bp, Artificial
  CRISPR gRNA sequence
cctcagcctcacgagtagct

SEQ ID NO: 384566 - DNA, 20 bp, Artificial
  CRISPR gRNA sequence
agcctcacgagtagctggga

SEQ ID NO: 384567 - DNA, 20 bp, Artificial
  CRISPR gRNA sequence
acgagtagctgggattacag

SEQ ID NO: 384568 - DNA, 20 bp, Artificial
  CRISPR gRNA sequence
ggattacaggcaagcaccat

SEQ ID NO: 384569 - DNA, 20 bp, Artificial
  CRISPR gRNA sequence
caggcaagcaccatcacgcc

SEQ ID NO: 384570 - DNA, 20 bp, Artificial
  CRISPR gRNA sequence
atttttgtatttttagtaga

SEQ ID NO: 384571 - DNA, 20 bp, Artificial
  CRISPR gRNA sequence
ttgtatttttagtagagatg

SEQ ID NO: 384572 - DNA, 20 bp, Artificial
  CRISPR gRNA sequence
tgtatttttagtagagatgg

SEQ ID NO: 384573 - DNA, 20 bp, Artificial
  CRISPR gRNA sequence
gtatttttagtagagatgga

SEQ ID NO: 384574 - DNA, 20 bp, Artificial
  CRISPR gRNA sequence
tatttttagtagagatggag

SEQ ID NO: 384575 - DNA, 20 bp, Artificial
  CRISPR gRNA sequence
ttagtagagatggagtttcg

SEQ ID NO: 384576 - DNA, 20 bp, Artificial
  CRISPR gRNA sequence
tagtagagatggagtttcgc

SEQ ID NO: 384577 - DNA, 20 bp, Artificial
  CRISPR gRNA sequence
agtagagatggagtttcgcc

SEQ ID NO: 384578 - DNA, 20 bp, Artificial
  CRISPR gRNA sequence
gtagagatggagtttcgcca

SEQ ID NO: 384579 - DNA, 20 bp, Artificial
  CRISPR gRNA sequence
cgccatgttggccaggctgg

SEQ ID NO: 384580 - DNA, 20 bp, Artificial
  CRISPR gRNA sequence
gccatgttggccaggctggt

SEQ ID NO: 384581 - DNA, 20 bp, Artificial
  CRISPR gRNA sequence
gccaggctggtctcaaactc

SEQ ID NO: 384582 - DNA, 20 bp, Artificial
  CRISPR gRNA sequence
gtctcaaactcctgacctca

SEQ ID NO: 384583 - DNA, 20 bp, Artificial
  CRISPR gRNA sequence
aaactcctgacctcagacga

SEQ ID NO: 384584 - DNA, 20 bp, Artificial
  CRISPR gRNA sequence
ctgacctcagacgatccgcc

SEQ ID NO: 384585 - DNA, 20 bp, Artificial
  CRISPR gRNA sequence
acctcagacgatccgcccac

SEQ ID NO: 384586 - DNA, 20 bp, Artificial
  CRISPR gRNA sequence
agacgatccgcccacctcag

SEQ ID NO: 384587 - DNA, 20 bp, Artificial
  CRISPR gRNA sequence
agcctcccaaagtgttggga

SEQ ID NO: 384588 - DNA, 20 bp, Artificial
  CRISPR gRNA sequence
ccaaagtgttgggattacaa

SEQ ID NO: 384589 - DNA, 20 bp, Artificial
  CRISPR gRNA sequence
ggattacaagcgtgagccac

SEQ ID NO: 384590 - DNA, 20 bp, Artificial
  CRISPR gRNA sequence
caagcgtgagccaccatgac

SEQ ID NO: 384591 - DNA, 20 bp, Artificial
  CRISPR gRNA sequence
gtgtttttaagaagaaagca

SEQ ID NO: 384592 - DNA, 20 bp, Artificial
  CRISPR gRNA sequence
ttaagaagaaagcaaaatga

SEQ ID NO: 384593 - DNA, 20 bp, Artificial
  CRISPR gRNA sequence
taagaagaaagcaaaatgaa

SEQ ID NO: 384594 - DNA, 20 bp, Artificial
  CRISPR gRNA sequence
aagaagaaagcaaaatgaaa

SEQ ID NO: 384595 - DNA, 20 bp, Artificial
  CRISPR gRNA sequence
agaagaaagcaaaatgaaaa

SEQ ID NO: 384596 - DNA, 20 bp, Artificial
  CRISPR gRNA sequence
aagtgccatgattacttata

SEQ ID NO: 384597 - DNA, 20 bp, Artificial
  CRISPR gRNA sequence
cttatagaggttatctttta

SEQ ID NO: 384598 - DNA, 20 bp, Artificial
  CRISPR gRNA sequence
atagaggttatcttttaaaa

SEQ ID NO: 384599 - DNA, 20 bp, Artificial
  CRISPR gRNA sequence
tagaggttatcttttaaaaa

SEQ ID NO: 384600 - DNA, 20 bp, Artificial
  CRISPR gRNA sequence
tcttttaaaaaagagaatga

SEQ ID NO: 384601 - DNA, 20 bp, Artificial
  CRISPR gRNA sequence
ttaaaaaagagaatgaagta

SEQ ID NO: 384602 - DNA, 20 bp, Artificial
  CRISPR gRNA sequence
taaaaaagagaatgaagtag

SEQ ID NO: 384603 - DNA, 20 bp, Artificial
  CRISPR gRNA sequence
aaaaaagagaatgaagtagt

SEQ ID NO: 384604 - DNA, 20 bp, Artificial
  CRISPR gRNA sequence
aaaaagagaatgaagtagtt

SEQ ID NO: 384605 - DNA, 20 bp, Artificial
  CRISPR gRNA sequence
taatgtctttttttgacagt

SEQ ID NO: 384606 - DNA, 20 bp, Artificial
  CRISPR gRNA sequence
atgtctttttttgacagtcc

SEQ ID NO: 384607 - DNA, 20 bp, Artificial
  CRISPR gRNA sequence
tttttgacagtccaacctat

SEQ ID NO: 384608 - DNA, 20 bp, Artificial
  CRISPR gRNA sequence
ttttgacagtccaacctatt

SEQ ID NO: 384609 - DNA, 20 bp, Artificial
  CRISPR gRNA sequence
tttgacagtccaacctatta

SEQ ID NO: 384610 - DNA, 20 bp, Artificial
  CRISPR gRNA sequence
ttgacagtccaacctattaa

SEQ ID NO: 384611 - DNA, 20 bp, Artificial
  CRISPR gRNA sequence
tgacagtccaacctattaac

SEQ ID NO: 384612 - DNA, 20 bp, Artificial
  CRISPR gRNA sequence
gacagtccaacctattaact

SEQ ID NO: 384613 - DNA, 20 bp, Artificial
  CRISPR gRNA sequence
acagtccaacctattaactc

SEQ ID NO: 384614 - DNA, 20 bp, Artificial
  CRISPR gRNA sequence
ttaactctttaataatcctt

SEQ ID NO: 384615 - DNA, 20 bp, Artificial
  CRISPR gRNA sequence
actctttaataatccttcaa

SEQ ID NO: 384616 - DNA, 20 bp, Artificial
  CRISPR gRNA sequence
tttaataatccttcaaaata

SEQ ID NO: 384617 - DNA, 20 bp, Artificial
  CRISPR gRNA sequence
taataatccttcaaaatatt

SEQ ID NO: 384618 - DNA, 20 bp, Artificial
  CRISPR gRNA sequence
aataatccttcaaaatatta

SEQ ID NO: 384619 - DNA, 20 bp, Artificial
  CRISPR gRNA sequence
ataatccttcaaaatattat

SEQ ID NO: 384620 - DNA, 20 bp, Artificial
  CRISPR gRNA sequence
caaaatattattctacaaaa

SEQ ID NO: 384621 - DNA, 20 bp, Artificial
  CRISPR gRNA sequence
aaaatattattctacaaaaa

SEQ ID NO: 384622 - DNA, 20 bp, Artificial
  CRISPR gRNA sequence
ttctacaaaaacctgaaaaa

SEQ ID NO: 384623 - DNA, 20 bp, Artificial
  CRISPR gRNA sequence
tacaaaaacctgaaaaagtt

SEQ ID NO: 384624 - DNA, 20 bp, Artificial
  CRISPR gRNA sequence
caaaaacctgaaaaagttgg

SEQ ID NO: 384625 - DNA, 20 bp, Artificial
  CRISPR gRNA sequence
aaaaagttggatacctaata

SEQ ID NO: 384626 - DNA, 20 bp, Artificial
  CRISPR gRNA sequence
gatacctaatatagaccgtt

SEQ ID NO: 384627 - DNA, 20 bp, Artificial
  CRISPR gRNA sequence
atatagaccgttgcaaagct

SEQ ID NO: 384628 - DNA, 20 bp, Artificial
  CRISPR gRNA sequence
caaagctccctttcattccc

SEQ ID NO: 384629 - DNA, 20 bp, Artificial
  CRISPR gRNA sequence
cctttcattccccaaattca

SEQ ID NO: 384630 - DNA, 20 bp, Artificial
  CRISPR gRNA sequence
tcattccccaaattcacaac

SEQ ID NO: 384631 - DNA, 20 bp, Artificial
  CRISPR gRNA sequence
cattccccaaattcacaaca

SEQ ID NO: 384632 - DNA, 20 bp, Artificial
  CRISPR gRNA sequence
attccccaaattcacaacaa

SEQ ID NO: 384633 - DNA, 20 bp, Artificial
  CRISPR gRNA sequence
cccaaattcacaacaataaa

SEQ ID NO: 384634 - DNA, 20 bp, Artificial
  CRISPR gRNA sequence
acaacaataaatgtgactag

SEQ ID NO: 384635 - DNA, 20 bp, Artificial
  CRISPR gRNA sequence
gactggcatgagtagacaaa

SEQ ID NO: 384636 - DNA, 20 bp, Artificial
  CRISPR gRNA sequence
gcatgagtagacaaaggcta

SEQ ID NO: 384637 - DNA, 20 bp, Artificial
  CRISPR gRNA sequence
aggatgaagaagggaatccc

SEQ ID NO: 384638 - DNA, 20 bp, Artificial
  CRISPR gRNA sequence
tgtatgacagagcaccaatt

SEQ ID NO: 384639 - DNA, 20 bp, Artificial
  CRISPR gRNA sequence
atttcttgctgaagtggctg

SEQ ID NO: 384640 - DNA, 20 bp, Artificial
  CRISPR gRNA sequence
tttcttgctgaagtggctga

SEQ ID NO: 384641 - DNA, 20 bp, Artificial
  CRISPR gRNA sequence
cttgctgaagtggctgatga

SEQ ID NO: 384642 - DNA, 20 bp, Artificial
  CRISPR gRNA sequence
ttgctgaagtggctgatgaa

SEQ ID NO: 384643 - DNA, 20 bp, Artificial
  CRISPR gRNA sequence
gctgaagtggctgatgaaat

SEQ ID NO: 384644 - DNA, 20 bp, Artificial
  CRISPR gRNA sequence
ctgaagtggctgatgaaata

SEQ ID NO: 384645 - DNA, 20 bp, Artificial
  CRISPR gRNA sequence
aagtggctgatgaaataaag

SEQ ID NO: 384646 - DNA, 20 bp, Artificial
  CRISPR gRNA sequence
atgaaataaagcaaggtttc

SEQ ID NO: 384647 - DNA, 20 bp, Artificial
  CRISPR gRNA sequence
cttgattctacagttggcat

SEQ ID NO: 384648 - DNA, 20 bp, Artificial
  CRISPR gRNA sequence
ttgattctacagttggcatc

SEQ ID NO: 384649 - DNA, 20 bp, Artificial
  CRISPR gRNA sequence
gattctacagttggcatcaa

SEQ ID NO: 384650 - DNA, 20 bp, Artificial
  CRISPR gRNA sequence
attctacagttggcatcaag

SEQ ID NO: 384651 - DNA, 20 bp, Artificial
  CRISPR gRNA sequence
tacagttggcatcaagaagc

SEQ ID NO: 384652 - DNA, 20 bp, Artificial
  CRISPR gRNA sequence
cagttggcatcaagaagcaa

SEQ ID NO: 384653 - DNA, 20 bp, Artificial
  CRISPR gRNA sequence
gcatcaagaagcaatccatg

SEQ ID NO: 384654 - DNA, 20 bp, Artificial
  CRISPR gRNA sequence
tttgccaacaaacaaaaaaa

SEQ ID NO: 384655 - DNA, 20 bp, Artificial
  CRISPR gRNA sequence
ttgccaacaaacaaaaaaaa

SEQ ID NO: 384656 - DNA, 20 bp, Artificial
  CRISPR gRNA sequence
tgccaacaaacaaaaaaaat

SEQ ID NO: 384657 - DNA, 20 bp, Artificial
  CRISPR gRNA sequence
gccaacaaacaaaaaaaata

SEQ ID NO: 384658 - DNA, 20 bp, Artificial
  CRISPR gRNA sequence
ccaacaaacaaaaaaaatat

SEQ ID NO: 384659 - DNA, 20 bp, Artificial
  CRISPR gRNA sequence
tttgcaaaagtaactactta

SEQ ID NO: 384660 - DNA, 20 bp, Artificial
  CRISPR gRNA sequence
ttgcaaaagtaactacttaa

SEQ ID NO: 384661 - DNA, 20 bp, Artificial
  CRISPR gRNA sequence
tgcaaaagtaactacttaat

SEQ ID NO: 384662 - DNA, 20 bp, Artificial
  CRISPR gRNA sequence
gcaaaagtaactacttaata

SEQ ID NO: 384663 - DNA, 20 bp, Artificial
  CRISPR gRNA sequence
caaaagtaactacttaataa

SEQ ID NO: 384664 - DNA, 20 bp, Artificial
  CRISPR gRNA sequence
cttaataaataaaaagttaa

SEQ ID NO: 384665 - DNA, 20 bp, Artificial
  CRISPR gRNA sequence
aataaataaaaagttaaact

SEQ ID NO: 384666 - DNA, 20 bp, Artificial
  CRISPR gRNA sequence
ataaataaaaagttaaactg

SEQ ID NO: 384667 - DNA, 20 bp, Artificial
  CRISPR gRNA sequence
aactgataaattatgaaggc

SEQ ID NO: 384668 - DNA, 20 bp, Artificial
  CRISPR gRNA sequence
ataaattatgaaggcatctg

SEQ ID NO: 384669 - DNA, 20 bp, Artificial
  CRISPR gRNA sequence
tgaaggcatctgatgaacac

SEQ ID NO: 384670 - DNA, 20 bp, Artificial
  CRISPR gRNA sequence
atgaacacatgttggattgt

SEQ ID NO: 384671 - DNA, 20 bp, Artificial
  CRISPR gRNA sequence
gattgtcagaacctttttag

SEQ ID NO: 384672 - DNA, 20 bp, Artificial
  CRISPR gRNA sequence
tcagaacctttttagtactt

SEQ ID NO: 384673 - DNA, 20 bp, Artificial
  CRISPR gRNA sequence
tttagtacttggcttgtggc

SEQ ID NO: 384674 - DNA, 20 bp, Artificial
  CRISPR gRNA sequence
ttagtacttggcttgtggcc

SEQ ID NO: 384675 - DNA, 20 bp, Artificial
  CRISPR gRNA sequence
tagtacttggcttgtggcca

SEQ ID NO: 384676 - DNA, 20 bp, Artificial
  CRISPR gRNA sequence
agtacttggcttgtggccat

SEQ ID NO: 384677 - DNA, 20 bp, Artificial
  CRISPR gRNA sequence
gtacttggcttgtggccatg

SEQ ID NO: 384678 - DNA, 20 bp, Artificial
  CRISPR gRNA sequence
ggcttgtggccatgtagaat

SEQ ID NO: 384679 - DNA, 20 bp, Artificial
  CRISPR gRNA sequence
gcttgtggccatgtagaatt

SEQ ID NO: 384680 - DNA, 20 bp, Artificial
  CRISPR gRNA sequence
gtggccatgtagaattccac

SEQ ID NO: 384681 - DNA, 20 bp, Artificial
  CRISPR gRNA sequence
tggccatgtagaattccact

SEQ ID NO: 384682 - DNA, 20 bp, Artificial
  CRISPR gRNA sequence
cactgcgaatagttaaaatg

SEQ ID NO: 384683 - DNA, 20 bp, Artificial
  CRISPR gRNA sequence
cgaatagttaaaatgaaaag

SEQ ID NO: 384684 - DNA, 20 bp, Artificial
  CRISPR gRNA sequence
aaatgaaaagaaatttatat

SEQ ID NO: 384685 - DNA, 20 bp, Artificial
  CRISPR gRNA sequence
atatacttttggctaggaat

SEQ ID NO: 384686 - DNA, 20 bp, Artificial
  CRISPR gRNA sequence
tatacttttggctaggaatt

SEQ ID NO: 384687 - DNA, 20 bp, Artificial
  CRISPR gRNA sequence
ttggctaggaattggggaat

SEQ ID NO: 384688 - DNA, 20 bp, Artificial
  CRISPR gRNA sequence
tggctaggaattggggaatt

SEQ ID NO: 384689 - DNA, 20 bp, Artificial
  CRISPR gRNA sequence
ggctaggaattggggaattt

SEQ ID NO: 384690 - DNA, 20 bp, Artificial
  CRISPR gRNA sequence
gctaggaattggggaatttt

SEQ ID NO: 384691 - DNA, 20 bp, Artificial
  CRISPR gRNA sequence
ggaattggggaattttttgt

SEQ ID NO: 384692 - DNA, 20 bp, Artificial
  CRISPR gRNA sequence
gggaattttttgtcttagtt

SEQ ID NO: 384693 - DNA, 20 bp, Artificial
  CRISPR gRNA sequence
tttgtcttagtttgggctgc

SEQ ID NO: 384694 - DNA, 20 bp, Artificial
  CRISPR gRNA sequence
ttgtcttagtttgggctgct

SEQ ID NO: 384695 - DNA, 20 bp, Artificial
  CRISPR gRNA sequence
tgtcttagtttgggctgctg

SEQ ID NO: 384696 - DNA, 20 bp, Artificial
  CRISPR gRNA sequence
gtcttagtttgggctgctgt

SEQ ID NO: 384697 - DNA, 20 bp, Artificial
  CRISPR gRNA sequence
tcttagtttgggctgctgta

SEQ ID NO: 384698 - DNA, 20 bp, Artificial
  CRISPR gRNA sequence
agtttgggctgctgtaacaa

SEQ ID NO: 384699 - DNA, 20 bp, Artificial
  CRISPR gRNA sequence
gtttgggctgctgtaacaaa

SEQ ID NO: 384700 - DNA, 20 bp, Artificial
  CRISPR gRNA sequence
gggctgctgtaacaaaatac

SEQ ID NO: 384701 - DNA, 20 bp, Artificial
  CRISPR gRNA sequence
ggctgctgtaacaaaatact

SEQ ID NO: 384702 - DNA, 20 bp, Artificial
  CRISPR gRNA sequence
ctgtaacaaaatactgtaga

SEQ ID NO: 384703 - DNA, 20 bp, Artificial
  CRISPR gRNA sequence
taacaaaatactgtagactg

SEQ ID NO: 384704 - DNA, 20 bp, Artificial
  CRISPR gRNA sequence
tagactgggttgcttaaacc

SEQ ID NO: 384705 - DNA, 20 bp, Artificial
  CRISPR gRNA sequence
ggttgcttaaaccacaaaca

SEQ ID NO: 384706 - DNA, 20 bp, Artificial
  CRISPR gRNA sequence
cttaaaccacaaacacttat

SEQ ID NO: 384707 - DNA, 20 bp, Artificial
  CRISPR gRNA sequence
aaaccacaaacacttattcc

SEQ ID NO: 384708 - DNA, 20 bp, Artificial
  CRISPR gRNA sequence
aaccacaaacacttattcct

SEQ ID NO: 384709 - DNA, 20 bp, Artificial
  CRISPR gRNA sequence
attcctcacagttctggagg

SEQ ID NO: 384710 - DNA, 20 bp, Artificial
  CRISPR gRNA sequence
ttcctcacagttctggaggc

SEQ ID NO: 384711 - DNA, 20 bp, Artificial
  CRISPR gRNA sequence
ctcacagttctggaggctgg

SEQ ID NO: 384712 - DNA, 20 bp, Artificial
  CRISPR gRNA sequence
acagttctggaggctgggaa

SEQ ID NO: 384713 - DNA, 20 bp, Artificial
  CRISPR gRNA sequence
tggaggctgggaagtccaag

SEQ ID NO: 384714 - DNA, 20 bp, Artificial
  CRISPR gRNA sequence
gaggctgggaagtccaagat

SEQ ID NO: 384715 - DNA, 20 bp, Artificial
  CRISPR gRNA sequence
ggaagtccaagattaagaaa

SEQ ID NO: 384716 - DNA, 20 bp, Artificial
  CRISPR gRNA sequence
agaaaatattttcctaactt

SEQ ID NO: 384717 - DNA, 20 bp, Artificial
  CRISPR gRNA sequence
tcctaacttgagaaaaaaaa

SEQ ID NO: 384718 - DNA, 20 bp, Artificial
  CRISPR gRNA sequence
cctaacttgagaaaaaaaaa

SEQ ID NO: 384719 - DNA, 20 bp, Artificial
  CRISPR gRNA sequence
ctaacttgagaaaaaaaaaa

SEQ ID NO: 384720 - DNA, 20 bp, Artificial
  CRISPR gRNA sequence
acttgagaaaaaaaaaagag

SEQ ID NO: 384721 - DNA, 20 bp, Artificial
  CRISPR gRNA sequence
gagaaaaaaaaaagagtcca

SEQ ID NO: 384722 - DNA, 20 bp, Artificial
  CRISPR gRNA sequence
agaaaaaaaaaagagtccag

SEQ ID NO: 384723 - DNA, 20 bp, Artificial
  CRISPR gRNA sequence
cgggcctgtttcttggtttg

SEQ ID NO: 384724 - DNA, 20 bp, Artificial
  CRISPR gRNA sequence
tttcttggtttgcagacaac

SEQ ID NO: 384725 - DNA, 20 bp, Artificial
  CRISPR gRNA sequence
cttggtttgcagacaactgt

SEQ ID NO: 384726 - DNA, 20 bp, Artificial
  CRISPR gRNA sequence
ttggtttgcagacaactgtc

SEQ ID NO: 384727 - DNA, 20 bp, Artificial
  CRISPR gRNA sequence
ggtttgcagacaactgtctt

SEQ ID NO: 384728 - DNA, 20 bp, Artificial
  CRISPR gRNA sequence
gtttgcagacaactgtcttc

SEQ ID NO: 384729 - DNA, 20 bp, Artificial
  CRISPR gRNA sequence
gcagacaactgtcttctcag

SEQ ID NO: 384730 - DNA, 20 bp, Artificial
  CRISPR gRNA sequence
cagacaactgtcttctcagt

SEQ ID NO: 384731 - DNA, 20 bp, Artificial
  CRISPR gRNA sequence
tcttctcagtatcctcacat

SEQ ID NO: 384732 - DNA, 20 bp, Artificial
  CRISPR gRNA sequence
ctcagtatcctcacattgca

SEQ ID NO: 384733 - DNA, 20 bp, Artificial
  CRISPR gRNA sequence
tcagtatcctcacattgcaa

SEQ ID NO: 384734 - DNA, 20 bp, Artificial
  CRISPR gRNA sequence
agtatcctcacattgcaaag

SEQ ID NO: 384735 - DNA, 20 bp, Artificial
  CRISPR gRNA sequence
acattgcaaagagcagaaag

SEQ ID NO: 384736 - DNA, 20 bp, Artificial
  CRISPR gRNA sequence
caaagagcagaaagaggaag

SEQ ID NO: 384737 - DNA, 20 bp, Artificial
  CRISPR gRNA sequence
ttctgtccttaaaaaggcac

SEQ ID NO: 384738 - DNA, 20 bp, Artificial
  CRISPR gRNA sequence
ctgtccttaaaaaggcactg

SEQ ID NO: 384739 - DNA, 20 bp, Artificial
  CRISPR gRNA sequence
tgtccttaaaaaggcactga

SEQ ID NO: 384740 - DNA, 20 bp, Artificial
  CRISPR gRNA sequence
tccttaaaaaggcactgatc

SEQ ID NO: 384741 - DNA, 20 bp, Artificial
  CRISPR gRNA sequence
aaaaaggcactgatcccatt

SEQ ID NO: 384742 - DNA, 20 bp, Artificial
  CRISPR gRNA sequence
aaaaggcactgatcccattc

SEQ ID NO: 384743 - DNA, 20 bp, Artificial
  CRISPR gRNA sequence
atcccattcacgaagacgcc

SEQ ID NO: 384744 - DNA, 20 bp, Artificial
  CRISPR gRNA sequence
acgaagacgccaccctcatg

SEQ ID NO: 384745 - DNA, 20 bp, Artificial
  CRISPR gRNA sequence
atgatctaattacatcccaa

SEQ ID NO: 384746 - DNA, 20 bp, Artificial
  CRISPR gRNA sequence
attacatcccaaagtctcca

SEQ ID NO: 384747 - DNA, 20 bp, Artificial
  CRISPR gRNA sequence
catcccaaagtctccacctc

SEQ ID NO: 384748 - DNA, 20 bp, Artificial
  CRISPR gRNA sequence
cacctcctaatatcatcgca

SEQ ID NO: 384749 - DNA, 20 bp, Artificial
  CRISPR gRNA sequence
ctaatatcatcgcattaggc

SEQ ID NO: 384750 - DNA, 20 bp, Artificial
  CRISPR gRNA sequence
atatcatcgcattaggcatt

SEQ ID NO: 384751 - DNA, 20 bp, Artificial
  CRISPR gRNA sequence
ggcattaggatttcaacata

SEQ ID NO: 384752 - DNA, 20 bp, Artificial
  CRISPR gRNA sequence
ggatttcaacatatgaatgt

SEQ ID NO: 384753 - DNA, 20 bp, Artificial
  CRISPR gRNA sequence
caacatatgaatgttgggaa

SEQ ID NO: 384754 - DNA, 20 bp, Artificial
  CRISPR gRNA sequence
aacatatgaatgttgggaag

SEQ ID NO: 384755 - DNA, 20 bp, Artificial
  CRISPR gRNA sequence
ggaagacataaatgttcaat

SEQ ID NO: 384756 - DNA, 20 bp, Artificial
  CRISPR gRNA sequence
aatccatagcaacttttttt

SEQ ID NO: 384757 - DNA, 20 bp, Artificial
  CRISPR gRNA sequence
tttttgtgaaatttcataaa

SEQ ID NO: 384758 - DNA, 20 bp, Artificial
  CRISPR gRNA sequence
ttttgtgaaatttcataaac

SEQ ID NO: 384759 - DNA, 20 bp, Artificial
  CRISPR gRNA sequence
tttgtgaaatttcataaaca

SEQ ID NO: 384760 - DNA, 20 bp, Artificial
  CRISPR gRNA sequence
ttgtgaaatttcataaacag

SEQ ID NO: 384761 - DNA, 20 bp, Artificial
  CRISPR gRNA sequence
tgtgaaatttcataaacagg

SEQ ID NO: 384762 - DNA, 20 bp, Artificial
  CRISPR gRNA sequence
gtgaaatttcataaacagga

SEQ ID NO: 384763 - DNA, 20 bp, Artificial
  CRISPR gRNA sequence
tgaaatttcataaacaggat

SEQ ID NO: 384764 - DNA, 20 bp, Artificial
  CRISPR gRNA sequence
cataaacaggatgctatgca

SEQ ID NO: 384765 - DNA, 20 bp, Artificial
  CRISPR gRNA sequence
ataaacaggatgctatgcat

SEQ ID NO: 384766 - DNA, 20 bp, Artificial
  CRISPR gRNA sequence
tgcattaaaggaagagattt

SEQ ID NO: 384767 - DNA, 20 bp, Artificial
  CRISPR gRNA sequence
aaggaagagatttgaagtat

SEQ ID NO: 384768 - DNA, 20 bp, Artificial
  CRISPR gRNA sequence
gaagtatagtggggataacg

SEQ ID NO: 384769 - DNA, 20 bp, Artificial
  CRISPR gRNA sequence
aagtatagtggggataacga

SEQ ID NO: 384770 - DNA, 20 bp, Artificial
  CRISPR gRNA sequence
ttatctgcaaacccagaagg

SEQ ID NO: 384771 - DNA, 20 bp, Artificial
  CRISPR gRNA sequence
atctgcaaacccagaaggaa

SEQ ID NO: 384772 - DNA, 20 bp, Artificial
  CRISPR gRNA sequence
tctgcaaacccagaaggaag

SEQ ID NO: 384773 - DNA, 20 bp, Artificial
  CRISPR gRNA sequence
caaacccagaaggaagtttc

SEQ ID NO: 384774 - DNA, 20 bp, Artificial
  CRISPR gRNA sequence
ctagtcttttagttaaacac

SEQ ID NO: 384775 - DNA, 20 bp, Artificial
  CRISPR gRNA sequence
tagtcttttagttaaacact

SEQ ID NO: 384776 - DNA, 20 bp, Artificial
  CRISPR gRNA sequence
gtcttttagttaaacactaa

SEQ ID NO: 384777 - DNA, 20 bp, Artificial
  CRISPR gRNA sequence
ttagttaaacactaaggggc

SEQ ID NO: 384778 - DNA, 20 bp, Artificial
  CRISPR gRNA sequence
tagttaaacactaaggggca

SEQ ID NO: 384779 - DNA, 20 bp, Artificial
  CRISPR gRNA sequence
agttaaacactaaggggcag

SEQ ID NO: 384780 - DNA, 20 bp, Artificial
  CRISPR gRNA sequence
gttaaacactaaggggcagc

SEQ ID NO: 384781 - DNA, 20 bp, Artificial
  CRISPR gRNA sequence
aacactaaggggcagcagca

SEQ ID NO: 384782 - DNA, 20 bp, Artificial
  CRISPR gRNA sequence
aggggcagcagcaaggcaga

SEQ ID NO: 384783 - DNA, 20 bp, Artificial
  CRISPR gRNA sequence
ttacagctcatcaaactcct

SEQ ID NO: 384784 - DNA, 20 bp, Artificial
  CRISPR gRNA sequence
tacagctcatcaaactcctg

SEQ ID NO: 384785 - DNA, 20 bp, Artificial
  CRISPR gRNA sequence
acagctcatcaaactcctgc

SEQ ID NO: 384786 - DNA, 20 bp, Artificial
  CRISPR gRNA sequence
cagctcatcaaactcctgca

SEQ ID NO: 384787 - DNA, 20 bp, Artificial
  CRISPR gRNA sequence
atcaaactcctgcagcccat

SEQ ID NO: 384788 - DNA, 20 bp, Artificial
  CRISPR gRNA sequence
ctgcagcccataaggaaata

SEQ ID NO: 384789 - DNA, 20 bp, Artificial
  CRISPR gRNA sequence
cagcccataaggaaataaaa

SEQ ID NO: 384790 - DNA, 20 bp, Artificial
  CRISPR gRNA sequence
tttggttgtataagtataca

SEQ ID NO: 384791 - DNA, 20 bp, Artificial
  CRISPR gRNA sequence
tggttgtataagtatacact

SEQ ID NO: 384792 - DNA, 20 bp, Artificial
  CRISPR gRNA sequence
ggttgtataagtatacacta

SEQ ID NO: 384793 - DNA, 20 bp, Artificial
  CRISPR gRNA sequence
gttgtataagtatacactaa

SEQ ID NO: 384794 - DNA, 20 bp, Artificial
  CRISPR gRNA sequence
tataagtatacactaataac

SEQ ID NO: 384795 - DNA, 20 bp, Artificial
  CRISPR gRNA sequence
ataacttacctccaaagata

SEQ ID NO: 384796 - DNA, 20 bp, Artificial
  CRISPR gRNA sequence
acctccaaagataataataa

SEQ ID NO: 384797 - DNA, 20 bp, Artificial
  CRISPR gRNA sequence
cctccaaagataataataat

SEQ ID NO: 384798 - DNA, 20 bp, Artificial
  CRISPR gRNA sequence
caaagataataataataatg

SEQ ID NO: 384799 - DNA, 20 bp, Artificial
  CRISPR gRNA sequence
cgttcttctatgtgcttgct

SEQ ID NO: 384800 - DNA, 20 bp, Artificial
  CRISPR gRNA sequence
ttctatgtgcttgctacgct

SEQ ID NO: 384801 - DNA, 20 bp, Artificial
  CRISPR gRNA sequence
ctatgtgcttgctacgcttc

SEQ ID NO: 384802 - DNA, 20 bp, Artificial
  CRISPR gRNA sequence
tatgtgcttgctacgcttct

SEQ ID NO: 384803 - DNA, 20 bp, Artificial
  CRISPR gRNA sequence
tgtgcttgctacgcttctgg

SEQ ID NO: 384804 - DNA, 20 bp, Artificial
  CRISPR gRNA sequence
gctacgcttctggttctttt

SEQ ID NO: 384805 - DNA, 20 bp, Artificial
  CRISPR gRNA sequence
ctacgcttctggttctttta

SEQ ID NO: 384806 - DNA, 20 bp, Artificial
  CRISPR gRNA sequence
cgcttctggttcttttatgc

SEQ ID NO: 384807 - DNA, 20 bp, Artificial
  CRISPR gRNA sequence
ctggttcttttatgcaattt

SEQ ID NO: 384808 - DNA, 20 bp, Artificial
  CRISPR gRNA sequence
tggttcttttatgcaattta

SEQ ID NO: 384809 - DNA, 20 bp, Artificial
  CRISPR gRNA sequence
gttcttttatgcaatttaac

SEQ ID NO: 384810 - DNA, 20 bp, Artificial
  CRISPR gRNA sequence
ttttatgcaatttaaccatc

SEQ ID NO: 384811 - DNA, 20 bp, Artificial
  CRISPR gRNA sequence
ttatgcaatttaaccatcac

SEQ ID NO: 384812 - DNA, 20 bp, Artificial
  CRISPR gRNA sequence
tatgcaatttaaccatcaca

SEQ ID NO: 384813 - DNA, 20 bp, Artificial
  CRISPR gRNA sequence
atgcaatttaaccatcacaa

SEQ ID NO: 384814 - DNA, 20 bp, Artificial
  CRISPR gRNA sequence
tgcaatttaaccatcacaat

SEQ ID NO: 384815 - DNA, 20 bp, Artificial
  CRISPR gRNA sequence
aaccatcacaataaccttat

SEQ ID NO: 384816 - DNA, 20 bp, Artificial
  CRISPR gRNA sequence
accatcacaataaccttatg

SEQ ID NO: 384817 - DNA, 20 bp, Artificial
  CRISPR gRNA sequence
atgacataaaaatattatgt

SEQ ID NO: 384818 - DNA, 20 bp, Artificial
  CRISPR gRNA sequence
tgacataaaaatattatgtc

SEQ ID NO: 384819 - DNA, 20 bp, Artificial
  CRISPR gRNA sequence
tgtcctctcctgggttggat

SEQ ID NO: 384820 - DNA, 20 bp, Artificial
  CRISPR gRNA sequence
tcctgggttggatactgtcc

SEQ ID NO: 384821 - DNA, 20 bp, Artificial
  CRISPR gRNA sequence
ctgggttggatactgtcccc

SEQ ID NO: 384822 - DNA, 20 bp, Artificial
  CRISPR gRNA sequence
ggttggatactgtcccctgc

SEQ ID NO: 384823 - DNA, 20 bp, Artificial
  CRISPR gRNA sequence
gatactgtcccctgcaaatt

SEQ ID NO: 384824 - DNA, 20 bp, Artificial
  CRISPR gRNA sequence
tcccctgcaaattcatgtcc

SEQ ID NO: 384825 - DNA, 20 bp, Artificial
  CRISPR gRNA sequence
caaattcatgtcctcctcag

SEQ ID NO: 384826 - DNA, 20 bp, Artificial
  CRISPR gRNA sequence
atgtcctcctcagaacctca

SEQ ID NO: 384827 - DNA, 20 bp, Artificial
  CRISPR gRNA sequence
ctcagaacctcataatgtga

SEQ ID NO: 384828 - DNA, 20 bp, Artificial
  CRISPR gRNA sequence
agaacctcataatgtgacct

SEQ ID NO: 384829 - DNA, 20 bp, Artificial
  CRISPR gRNA sequence
ataatgtgacctcatttgaa

SEQ ID NO: 384830 - DNA, 20 bp, Artificial
  CRISPR gRNA sequence
atttgaaaataggatccttg

SEQ ID NO: 384831 - DNA, 20 bp, Artificial
  CRISPR gRNA sequence
gaaaataggatccttgtaat

SEQ ID NO: 384832 - DNA, 20 bp, Artificial
  CRISPR gRNA sequence
aaaataggatccttgtaatt

SEQ ID NO: 384833 - DNA, 20 bp, Artificial
  CRISPR gRNA sequence
gtaattagctaagctcaaac

SEQ ID NO: 384834 - DNA, 20 bp, Artificial
  CRISPR gRNA sequence
taattagctaagctcaaaca

SEQ ID NO: 384835 - DNA, 20 bp, Artificial
  CRISPR gRNA sequence
gctaagctcaaacaacgctg

SEQ ID NO: 384836 - DNA, 20 bp, Artificial
  CRISPR gRNA sequence
agctcaaacaacgctgtgct

SEQ ID NO: 384837 - DNA, 20 bp, Artificial
  CRISPR gRNA sequence
aaacaacgctgtgctggaga

SEQ ID NO: 384838 - DNA, 20 bp, Artificial
  CRISPR gRNA sequence
tgctggagaggggtgggcct

SEQ ID NO: 384839 - DNA, 20 bp, Artificial
  CRISPR gRNA sequence
gagaggggtgggcctttaag

SEQ ID NO: 384840 - DNA, 20 bp, Artificial
  CRISPR gRNA sequence
taagtccaagataactgggg

SEQ ID NO: 384841 - DNA, 20 bp, Artificial
  CRISPR gRNA sequence
aagtccaagataactggggt

SEQ ID NO: 384842 - DNA, 20 bp, Artificial
  CRISPR gRNA sequence
agtccaagataactggggtc

SEQ ID NO: 384843 - DNA, 20 bp, Artificial
  CRISPR gRNA sequence
gggtctccataagaaaagaa

SEQ ID NO: 384844 - DNA, 20 bp, Artificial
  CRISPR gRNA sequence
cataagaaaagaaggaaggc

SEQ ID NO: 384845 - DNA, 20 bp, Artificial
  CRISPR gRNA sequence
agaacagtgatgagaggggc

SEQ ID NO: 384846 - DNA, 20 bp, Artificial
  CRISPR gRNA sequence
gagcgatgtgtctaccagcc

SEQ ID NO: 384847 - DNA, 20 bp, Artificial
  CRISPR gRNA sequence
ccagccaaggatcgacagct

SEQ ID NO: 384848 - DNA, 20 bp, Artificial
  CRISPR gRNA sequence
cactagaagctggatagaag

SEQ ID NO: 384849 - DNA, 20 bp, Artificial
  CRISPR gRNA sequence
gaagctggatagaagcatgg

SEQ ID NO: 384850 - DNA, 20 bp, Artificial
  CRISPR gRNA sequence
gatagaagcatgggatggat

SEQ ID NO: 384851 - DNA, 20 bp, Artificial
  CRISPR gRNA sequence
tcatcccacgaagaaaccag

SEQ ID NO: 384852 - DNA, 20 bp, Artificial
  CRISPR gRNA sequence
atcccacgaagaaaccagta

SEQ ID NO: 384853 - DNA, 20 bp, Artificial
  CRISPR gRNA sequence
ctgacactgtttcttgtact

SEQ ID NO: 384854 - DNA, 20 bp, Artificial
  CRISPR gRNA sequence
tgacactgtttcttgtactt

SEQ ID NO: 384855 - DNA, 20 bp, Artificial
  CRISPR gRNA sequence
acactgtttcttgtacttca

SEQ ID NO: 384856 - DNA, 20 bp, Artificial
  CRISPR gRNA sequence
tttcttgtacttcaaccctc

SEQ ID NO: 384857 - DNA, 20 bp, Artificial
  CRISPR gRNA sequence
cttgtacttcaaccctccag

SEQ ID NO: 384858 - DNA, 20 bp, Artificial
  CRISPR gRNA sequence
ttgtacttcaaccctccaga

SEQ ID NO: 384859 - DNA, 20 bp, Artificial
  CRISPR gRNA sequence
gtacttcaaccctccagaat

SEQ ID NO: 384860 - DNA, 20 bp, Artificial
  CRISPR gRNA sequence
tacttcaaccctccagaatt

SEQ ID NO: 384861 - DNA, 20 bp, Artificial
  CRISPR gRNA sequence
caaccctccagaattatgga

SEQ ID NO: 384862 - DNA, 20 bp, Artificial
  CRISPR gRNA sequence
aaccctccagaattatggaa

SEQ ID NO: 384863 - DNA, 20 bp, Artificial
  CRISPR gRNA sequence
cagaattatggaagaataga

SEQ ID NO: 384864 - DNA, 20 bp, Artificial
  CRISPR gRNA sequence
tggaagaatagatttctgtt

SEQ ID NO: 384865 - DNA, 20 bp, Artificial
  CRISPR gRNA sequence
ctgttgttttaagccacccc

SEQ ID NO: 384866 - DNA, 20 bp, Artificial
  CRISPR gRNA sequence
tgttgttttaagccaccccg

SEQ ID NO: 384867 - DNA, 20 bp, Artificial
  CRISPR gRNA sequence
ttgttttaagccaccccgtt

SEQ ID NO: 384868 - DNA, 20 bp, Artificial
  CRISPR gRNA sequence
ttttaagccaccccgttttg

SEQ ID NO: 384869 - DNA, 20 bp, Artificial
  CRISPR gRNA sequence
taagccaccccgttttggta

SEQ ID NO: 384870 - DNA, 20 bp, Artificial
  CRISPR gRNA sequence
aagccaccccgttttggtaa

SEQ ID NO: 384871 - DNA, 20 bp, Artificial
  CRISPR gRNA sequence
agccaccccgttttggtaat

SEQ ID NO: 384872 - DNA, 20 bp, Artificial
  CRISPR gRNA sequence
tggtaatttgtcacagcagc

SEQ ID NO: 384873 - DNA, 20 bp, Artificial
  CRISPR gRNA sequence
ggtaatttgtcacagcagcc

SEQ ID NO: 384874 - DNA, 20 bp, Artificial
  CRISPR gRNA sequence
gtaatttgtcacagcagccc

SEQ ID NO: 384875 - DNA, 20 bp, Artificial
  CRISPR gRNA sequence
gtcacagcagccctagaaaa

SEQ ID NO: 384876 - DNA, 20 bp, Artificial
  CRISPR gRNA sequence
tcacagcagccctagaaaag

SEQ ID NO: 384877 - DNA, 20 bp, Artificial
  CRISPR gRNA sequence
gaaaaggaacaaagatttag

SEQ ID NO: 384878 - DNA, 20 bp, Artificial
  CRISPR gRNA sequence
agggaaggcatagtgttgat

SEQ ID NO: 384879 - DNA, 20 bp, Artificial
  CRISPR gRNA sequence
gggaaggcatagtgttgatt

SEQ ID NO: 384880 - DNA, 20 bp, Artificial
  CRISPR gRNA sequence
attgttattacgccagggta

SEQ ID NO: 384881 - DNA, 20 bp, Artificial
  CRISPR gRNA sequence
ttattacgccagggtaattg

SEQ ID NO: 384882 - DNA, 20 bp, Artificial
  CRISPR gRNA sequence
ttacgccagggtaattgctc

SEQ ID NO: 384883 - DNA, 20 bp, Artificial
  CRISPR gRNA sequence
cgccagggtaattgctcctt

SEQ ID NO: 384884 - DNA, 20 bp, Artificial
  CRISPR gRNA sequence
ctcctttatttatattcata

SEQ ID NO: 384885 - DNA, 20 bp, Artificial
  CRISPR gRNA sequence
ctttatttatattcatataa

SEQ ID NO: 384886 - DNA, 20 bp, Artificial
  CRISPR gRNA sequence
tatttatattcatataaaaa

SEQ ID NO: 384887 - DNA, 20 bp, Artificial
  CRISPR gRNA sequence
atttatattcatataaaaaa

SEQ ID NO: 384888 - DNA, 20 bp, Artificial
  CRISPR gRNA sequence
tttatattcatataaaaaac

SEQ ID NO: 384889 - DNA, 20 bp, Artificial
  CRISPR gRNA sequence
atattcatataaaaaactta

SEQ ID NO: 384890 - DNA, 20 bp, Artificial
  CRISPR gRNA sequence
tattcatataaaaaacttag

SEQ ID NO: 384891 - DNA, 20 bp, Artificial
  CRISPR gRNA sequence
atataaaaaacttagtttca

SEQ ID NO: 384892 - DNA, 20 bp, Artificial
  CRISPR gRNA sequence
agtttcaaagggtattaaaa

SEQ ID NO: 384893 - DNA, 20 bp, Artificial
  CRISPR gRNA sequence
gtttcaaagggtattaaaaa

SEQ ID NO: 384894 - DNA, 20 bp, Artificial
  CRISPR gRNA sequence
caaagggtattaaaaataga

SEQ ID NO: 384895 - DNA, 20 bp, Artificial
  CRISPR gRNA sequence
aaagggtattaaaaatagaa

SEQ ID NO: 384896 - DNA, 20 bp, Artificial
  CRISPR gRNA sequence
aaaatagaatagttcagaaa

SEQ ID NO: 384897 - DNA, 20 bp, Artificial
  CRISPR gRNA sequence
agaaaataactttctccaaa

SEQ ID NO: 384898 - DNA, 20 bp, Artificial
  CRISPR gRNA sequence
tctccaaatagctgatattt

SEQ ID NO: 384899 - DNA, 20 bp, Artificial
  CRISPR gRNA sequence
ctccaaatagctgatattta

SEQ ID NO: 384900 - DNA, 20 bp, Artificial
  CRISPR gRNA sequence
tccaaatagctgatatttaa

SEQ ID NO: 384901 - DNA, 20 bp, Artificial
  CRISPR gRNA sequence
caaatagctgatatttaaat

SEQ ID NO: 384902 - DNA, 20 bp, Artificial
  CRISPR gRNA sequence
atatttaaattacaggcaac

SEQ ID NO: 384903 - DNA, 20 bp, Artificial
  CRISPR gRNA sequence
aaattacaggcaactgcatg

SEQ ID NO: 384904 - DNA, 20 bp, Artificial
  CRISPR gRNA sequence
aattacaggcaactgcatgg

SEQ ID NO: 384905 - DNA, 20 bp, Artificial
  CRISPR gRNA sequence
caggcaactgcatggtcagg

SEQ ID NO: 384906 - DNA, 20 bp, Artificial
  CRISPR gRNA sequence
catggtcaggttactgaaag

SEQ ID NO: 384907 - DNA, 20 bp, Artificial
  CRISPR gRNA sequence
ctgaaaggacaataaaatat

SEQ ID NO: 384908 - DNA, 20 bp, Artificial
  CRISPR gRNA sequence
aaaggacaataaaatataag

SEQ ID NO: 384909 - DNA, 20 bp, Artificial
  CRISPR gRNA sequence
ctaactgcaaaagagactga

SEQ ID NO: 384910 - DNA, 20 bp, Artificial
  CRISPR gRNA sequence
actgcaaaagagactgactt

SEQ ID NO: 384911 - DNA, 20 bp, Artificial
  CRISPR gRNA sequence
caaaagagactgactttgca

SEQ ID NO: 384912 - DNA, 20 bp, Artificial
  CRISPR gRNA sequence
actttgcatctgtaaattac

SEQ ID NO: 384913 - DNA, 20 bp, Artificial
  CRISPR gRNA sequence
tgcatctgtaaattacaaaa

SEQ ID NO: 384914 - DNA, 20 bp, Artificial
  CRISPR gRNA sequence
gcatctgtaaattacaaaag

SEQ ID NO: 384915 - DNA, 20 bp, Artificial
  CRISPR gRNA sequence
catctgtaaattacaaaaga

SEQ ID NO: 384916 - DNA, 20 bp, Artificial
  CRISPR gRNA sequence
taaattacaaaagaaaaaaa

SEQ ID NO: 384917 - DNA, 20 bp, Artificial
  CRISPR gRNA sequence
caaaagaaaaaaatgacagt

SEQ ID NO: 384918 - DNA, 20 bp, Artificial
  CRISPR gRNA sequence
cgtataaacttaccttctgt

SEQ ID NO: 384919 - DNA, 20 bp, Artificial
  CRISPR gRNA sequence
accttctgtgtatcccagga

SEQ ID NO: 384920 - DNA, 20 bp, Artificial
  CRISPR gRNA sequence
ccttctgtgtatcccaggac

SEQ ID NO: 384921 - DNA, 20 bp, Artificial
  CRISPR gRNA sequence
ctgtgtatcccaggactctg

SEQ ID NO: 384922 - DNA, 20 bp, Artificial
  CRISPR gRNA sequence
tgtgtatcccaggactctgt

SEQ ID NO: 384923 - DNA, 20 bp, Artificial
  CRISPR gRNA sequence
tgtatcccaggactctgtaa

SEQ ID NO: 384924 - DNA, 20 bp, Artificial
  CRISPR gRNA sequence
tgtaaatagatctcttctct

SEQ ID NO: 384925 - DNA, 20 bp, Artificial
  CRISPR gRNA sequence
taaatagatctcttctctct

SEQ ID NO: 384926 - DNA, 20 bp, Artificial
  CRISPR gRNA sequence
ttctctctctccttctcctt

SEQ ID NO: 384927 - DNA, 20 bp, Artificial
  CRISPR gRNA sequence
ctctctctccttctccttct

SEQ ID NO: 384928 - DNA, 20 bp, Artificial
  CRISPR gRNA sequence
tctctctccttctccttctg

SEQ ID NO: 384929 - DNA, 20 bp, Artificial
  CRISPR gRNA sequence
tctctccttctccttctgga

SEQ ID NO: 384930 - DNA, 20 bp, Artificial
  CRISPR gRNA sequence
tctccttctccttctggaat

SEQ ID NO: 384931 - DNA, 20 bp, Artificial
  CRISPR gRNA sequence
tccttctccttctggaatgc

SEQ ID NO: 384932 - DNA, 20 bp, Artificial
  CRISPR gRNA sequence
cttctccttctggaatgcat

SEQ ID NO: 384933 - DNA, 20 bp, Artificial
  CRISPR gRNA sequence
ctccttctggaatgcatatt

SEQ ID NO: 384934 - DNA, 20 bp, Artificial
  CRISPR gRNA sequence
tccttctggaatgcatattc

SEQ ID NO: 384935 - DNA, 20 bp, Artificial
  CRISPR gRNA sequence
cttctggaatgcatattcaa

SEQ ID NO: 384936 - DNA, 20 bp, Artificial
  CRISPR gRNA sequence
ctggaatgcatattcaataa

SEQ ID NO: 384937 - DNA, 20 bp, Artificial
  CRISPR gRNA sequence
tggaatgcatattcaataaa

SEQ ID NO: 384938 - DNA, 20 bp, Artificial
  CRISPR gRNA sequence
gaatgcatattcaataaagg

SEQ ID NO: 384939 - DNA, 20 bp, Artificial
  CRISPR gRNA sequence
aataaaggatataaagatat

SEQ ID NO: 384940 - DNA, 20 bp, Artificial
  CRISPR gRNA sequence
cagtactaatattatttcga

SEQ ID NO: 384941 - DNA, 20 bp, Artificial
  CRISPR gRNA sequence
atattatttcgaagactcta

SEQ ID NO: 384942 - DNA, 20 bp, Artificial
  CRISPR gRNA sequence
tttcgaagactctatacctc

SEQ ID NO: 384943 - DNA, 20 bp, Artificial
  CRISPR gRNA sequence
cgaagactctatacctcact

SEQ ID NO: 384944 - DNA, 20 bp, Artificial
  CRISPR gRNA sequence
gaagactctatacctcactg

SEQ ID NO: 384945 - DNA, 20 bp, Artificial
  CRISPR gRNA sequence
tatacctcactgtaccccta

SEQ ID NO: 384946 - DNA, 20 bp, Artificial
  CRISPR gRNA sequence
tacctcactgtacccctagc

SEQ ID NO: 384947 - DNA, 20 bp, Artificial
  CRISPR gRNA sequence
actgtacccctagcccacat

SEQ ID NO: 384948 - DNA, 20 bp, Artificial
  CRISPR gRNA sequence
tacccctagcccacatgcac

SEQ ID NO: 384949 - DNA, 20 bp, Artificial
  CRISPR gRNA sequence
gcccacatgcaccttctaat

SEQ ID NO: 384950 - DNA, 20 bp, Artificial
  CRISPR gRNA sequence
ctaatatgttgaagtagctt

SEQ ID NO: 384951 - DNA, 20 bp, Artificial
  CRISPR gRNA sequence
taatatgttgaagtagcttt

SEQ ID NO: 384952 - DNA, 20 bp, Artificial
  CRISPR gRNA sequence
atatgttgaagtagctttat

SEQ ID NO: 384953 - DNA, 20 bp, Artificial
  CRISPR gRNA sequence
aagtagctttatgcacattt

SEQ ID NO: 384954 - DNA, 20 bp, Artificial
  CRISPR gRNA sequence
tatgcacatttatccaaaat

SEQ ID NO: 384955 - DNA, 20 bp, Artificial
  CRISPR gRNA sequence
atgcacatttatccaaaatt

SEQ ID NO: 384956 - DNA, 20 bp, Artificial
  CRISPR gRNA sequence
tgcacatttatccaaaattc

SEQ ID NO: 384957 - DNA, 20 bp, Artificial
  CRISPR gRNA sequence
atccaaaattctgttaccct

SEQ ID NO: 384958 - DNA, 20 bp, Artificial
  CRISPR gRNA sequence
tccaaaattctgttacccta

SEQ ID NO: 384959 - DNA, 20 bp, Artificial
  CRISPR gRNA sequence
tgttaccctacagttttttt

SEQ ID NO: 384960 - DNA, 20 bp, Artificial
  CRISPR gRNA sequence
ttaccctacagtttttttca

SEQ ID NO: 384961 - DNA, 20 bp, Artificial
  CRISPR gRNA sequence
ccctacagtttttttcattt

SEQ ID NO: 384962 - DNA, 20 bp, Artificial
  CRISPR gRNA sequence
cagtttttttcattttccct

SEQ ID NO: 384963 - DNA, 20 bp, Artificial
  CRISPR gRNA sequence
ttttcattttccctgtcttc

SEQ ID NO: 384964 - DNA, 20 bp, Artificial
  CRISPR gRNA sequence
tttcattttccctgtcttct

SEQ ID NO: 384965 - DNA, 20 bp, Artificial
  CRISPR gRNA sequence
ttcattttccctgtcttctc

SEQ ID NO: 384966 - DNA, 20 bp, Artificial
  CRISPR gRNA sequence
tcattttccctgtcttctcc

SEQ ID NO: 384967 - DNA, 20 bp, Artificial
  CRISPR gRNA sequence
cattttccctgtcttctcca

SEQ ID NO: 384968 - DNA, 20 bp, Artificial
  CRISPR gRNA sequence
attttccctgtcttctccaa

SEQ ID NO: 384969 - DNA, 20 bp, Artificial
  CRISPR gRNA sequence
tccctgtcttctccaaattg

SEQ ID NO: 384970 - DNA, 20 bp, Artificial
  CRISPR gRNA sequence
ccctgtcttctccaaattgc

SEQ ID NO: 384971 - DNA, 20 bp, Artificial
  CRISPR gRNA sequence
cctgtcttctccaaattgct

SEQ ID NO: 384972 - DNA, 20 bp, Artificial
  CRISPR gRNA sequence
tcttctccaaattgctccca

SEQ ID NO: 384973 - DNA, 20 bp, Artificial
  CRISPR gRNA sequence
ctccaaattgctcccagatg

SEQ ID NO: 384974 - DNA, 20 bp, Artificial
  CRISPR gRNA sequence
tccaaattgctcccagatgg

SEQ ID NO: 384975 - DNA, 20 bp, Artificial
  CRISPR gRNA sequence
caaattgctcccagatggtg

SEQ ID NO: 384976 - DNA, 20 bp, Artificial
  CRISPR gRNA sequence
ctcccagatggtgagggcaa

SEQ ID NO: 384977 - DNA, 20 bp, Artificial
  CRISPR gRNA sequence
ccagatggtgagggcaacta

SEQ ID NO: 384978 - DNA, 20 bp, Artificial
  CRISPR gRNA sequence
aatggatatctaaccactgt

SEQ ID NO: 384979 - DNA, 20 bp, Artificial
  CRISPR gRNA sequence
accactgtgcattagtaatt

SEQ ID NO: 384980 - DNA, 20 bp, Artificial
  CRISPR gRNA sequence
tgcattagtaattaatctca

SEQ ID NO: 384981 - DNA, 20 bp, Artificial
  CRISPR gRNA sequence
gtaattaatctcagtgattt

SEQ ID NO: 384982 - DNA, 20 bp, Artificial
  CRISPR gRNA sequence
atctcagtgattttactaaa

SEQ ID NO: 384983 - DNA, 20 bp, Artificial
  CRISPR gRNA sequence
agtgattttactaaagaatg

SEQ ID NO: 384984 - DNA, 20 bp, Artificial
  CRISPR gRNA sequence
tactaaagaatgatttatag

SEQ ID NO: 384985 - DNA, 20 bp, Artificial
  CRISPR gRNA sequence
actaaagaatgatttatagt

SEQ ID NO: 384986 - DNA, 20 bp, Artificial
  CRISPR gRNA sequence
ctaaagaatgatttatagtg

SEQ ID NO: 384987 - DNA, 20 bp, Artificial
  CRISPR gRNA sequence
aagaatgatttatagtgact

SEQ ID NO: 384988 - DNA, 20 bp, Artificial
  CRISPR gRNA sequence
atagtgacttattacataaa

SEQ ID NO: 384989 - DNA, 20 bp, Artificial
  CRISPR gRNA sequence
tagtgacttattacataaat

SEQ ID NO: 384990 - DNA, 20 bp, Artificial
  CRISPR gRNA sequence
attacataaatgacttatag

SEQ ID NO: 384991 - DNA, 20 bp, Artificial
  CRISPR gRNA sequence
ttacataaatgacttatagc

SEQ ID NO: 384992 - DNA, 20 bp, Artificial
  CRISPR gRNA sequence
cataaatgacttatagcttt

SEQ ID NO: 384993 - DNA, 20 bp, Artificial
  CRISPR gRNA sequence
atagctttctccaaataacc

SEQ ID NO: 384994 - DNA, 20 bp, Artificial
  CRISPR gRNA sequence
tagctttctccaaataacct

SEQ ID NO: 384995 - DNA, 20 bp, Artificial
  CRISPR gRNA sequence
tctccaaataacctcacatt

SEQ ID NO: 384996 - DNA, 20 bp, Artificial
  CRISPR gRNA sequence
ctccaaataacctcacattt

SEQ ID NO: 384997 - DNA, 20 bp, Artificial
  CRISPR gRNA sequence
tccaaataacctcacattta

SEQ ID NO: 384998 - DNA, 20 bp, Artificial
  CRISPR gRNA sequence
caaataacctcacatttaag

SEQ ID NO: 384999 - DNA, 20 bp, Artificial
  CRISPR gRNA sequence
acatttaagacattttccac

SEQ ID NO: 385000 - DNA, 20 bp, Artificial
  CRISPR gRNA sequence
aagacattttccacaattaa

SEQ ID NO: 385001 - DNA, 20 bp, Artificial
  CRISPR gRNA sequence
agacattttccacaattaaa

SEQ ID NO: 385002 - DNA, 20 bp, Artificial
  CRISPR gRNA sequence
tccacaattaaaatttattt

SEQ ID NO: 385003 - DNA, 20 bp, Artificial
  CRISPR gRNA sequence
ccacaattaaaatttatttt

SEQ ID NO: 385004 - DNA, 20 bp, Artificial
  CRISPR gRNA sequence
cacaattaaaatttatttta

SEQ ID NO: 385005 - DNA, 20 bp, Artificial
  CRISPR gRNA sequence
aaatttattttaaatgccag

SEQ ID NO: 385006 - DNA, 20 bp, Artificial
  CRISPR gRNA sequence
attttaaatgccagcagtgt

SEQ ID NO: 385007 - DNA, 20 bp, Artificial
  CRISPR gRNA sequence
ttttaaatgccagcagtgta

SEQ ID NO: 385008 - DNA, 20 bp, Artificial
  CRISPR gRNA sequence
taaatgccagcagtgtaact

SEQ ID NO: 385009 - DNA, 20 bp, Artificial
  CRISPR gRNA sequence
aaatgccagcagtgtaactt

SEQ ID NO: 385010 - DNA, 20 bp, Artificial
  CRISPR gRNA sequence
aatgccagcagtgtaacttc

SEQ ID NO: 385011 - DNA, 20 bp, Artificial
  CRISPR gRNA sequence
cttggatgacaatataatga

SEQ ID NO: 385012 - DNA, 20 bp, Artificial
  CRISPR gRNA sequence
ttggatgacaatataatgaa

SEQ ID NO: 385013 - DNA, 20 bp, Artificial
  CRISPR gRNA sequence
ggatgacaatataatgaagc

SEQ ID NO: 385014 - DNA, 20 bp, Artificial
  CRISPR gRNA sequence
gatgacaatataatgaagct

SEQ ID NO: 385015 - DNA, 20 bp, Artificial
  CRISPR gRNA sequence
tataaaatcttttgggtgtt

SEQ ID NO: 385016 - DNA, 20 bp, Artificial
  CRISPR gRNA sequence
ataaaatcttttgggtgtta

SEQ ID NO: 385017 - DNA, 20 bp, Artificial
  CRISPR gRNA sequence
taaaatcttttgggtgttat

SEQ ID NO: 385018 - DNA, 20 bp, Artificial
  CRISPR gRNA sequence
ttgggtgttattctaaatca

SEQ ID NO: 385019 - DNA, 20 bp, Artificial
  CRISPR gRNA sequence
tgggtgttattctaaatcac

SEQ ID NO: 385020 - DNA, 20 bp, Artificial
  CRISPR gRNA sequence
gggtgttattctaaatcact

SEQ ID NO: 385021 - DNA, 20 bp, Artificial
  CRISPR gRNA sequence
ggtgttattctaaatcactc

SEQ ID NO: 385022 - DNA, 20 bp, Artificial
  CRISPR gRNA sequence
ttctaaatcactcgtatgga

SEQ ID NO: 385023 - DNA, 20 bp, Artificial
  CRISPR gRNA sequence
taaatcactcgtatggatta

SEQ ID NO: 385024 - DNA, 20 bp, Artificial
  CRISPR gRNA sequence
aatcactcgtatggattatt

SEQ ID NO: 385025 - DNA, 20 bp, Artificial
  CRISPR gRNA sequence
gtatggattattttattaaa

SEQ ID NO: 385026 - DNA, 20 bp, Artificial
  CRISPR gRNA sequence
ttttattaaatcacttatgt

SEQ ID NO: 385027 - DNA, 20 bp, Artificial
  CRISPR gRNA sequence
tattaaatcacttatgtaga

SEQ ID NO: 385028 - DNA, 20 bp, Artificial
  CRISPR gRNA sequence
attaaatcacttatgtagat

SEQ ID NO: 385029 - DNA, 20 bp, Artificial
  CRISPR gRNA sequence
ttaaatcacttatgtagatt

SEQ ID NO: 385030 - DNA, 20 bp, Artificial
  CRISPR gRNA sequence
aatcacttatgtagattatt

SEQ ID NO: 385031 - DNA, 20 bp, Artificial
  CRISPR gRNA sequence
atgtagattattttattaag

SEQ ID NO: 385032 - DNA, 20 bp, Artificial
  CRISPR gRNA sequence
tgtagattattttattaaga

SEQ ID NO: 385033 - DNA, 20 bp, Artificial
  CRISPR gRNA sequence
ttttattaagatttcatata

SEQ ID NO: 385034 - DNA, 20 bp, Artificial
  CRISPR gRNA sequence
tattaagatttcatataaac

SEQ ID NO: 385035 - DNA, 20 bp, Artificial
  CRISPR gRNA sequence
attaagatttcatataaaca

SEQ ID NO: 385036 - DNA, 20 bp, Artificial
  CRISPR gRNA sequence
ttaagatttcatataaacag

SEQ ID NO: 385037 - DNA, 20 bp, Artificial
  CRISPR gRNA sequence
agatttcatataaacaggtt

SEQ ID NO: 385038 - DNA, 20 bp, Artificial
  CRISPR gRNA sequence
catataaacaggtttagaaa

SEQ ID NO: 385039 - DNA, 20 bp, Artificial
  CRISPR gRNA sequence
atataaacaggtttagaaac

SEQ ID NO: 385040 - DNA, 20 bp, Artificial
  CRISPR gRNA sequence
agaaactaaggtgtgaagag

SEQ ID NO: 385041 - DNA, 20 bp, Artificial
  CRISPR gRNA sequence
gaaactaaggtgtgaagagg

SEQ ID NO: 385042 - DNA, 20 bp, Artificial
  CRISPR gRNA sequence
aggtgtgaagaggaagagta

SEQ ID NO: 385043 - DNA, 20 bp, Artificial
  CRISPR gRNA sequence
gtcccaaatcacatgatcgg

SEQ ID NO: 385044 - DNA, 20 bp, Artificial
  CRISPR gRNA sequence
tcccaaatcacatgatcggt

SEQ ID NO: 385045 - DNA, 20 bp, Artificial
  CRISPR gRNA sequence
gtgtagtgctggaatttaaa

SEQ ID NO: 385046 - DNA, 20 bp, Artificial
  CRISPR gRNA sequence
gaatttaaatccatcgccct

SEQ ID NO: 385047 - DNA, 20 bp, Artificial
  CRISPR gRNA sequence
aaatccatcgccctccctct

SEQ ID NO: 385048 - DNA, 20 bp, Artificial
  CRISPR gRNA sequence
aatccatcgccctccctctt

SEQ ID NO: 385049 - DNA, 20 bp, Artificial
  CRISPR gRNA sequence
cctcttgactattaagctct

SEQ ID NO: 385050 - DNA, 20 bp, Artificial
  CRISPR gRNA sequence
ttgactattaagctctccaa

SEQ ID NO: 385051 - DNA, 20 bp, Artificial
  CRISPR gRNA sequence
gactattaagctctccaact

SEQ ID NO: 385052 - DNA, 20 bp, Artificial
  CRISPR gRNA sequence
actattaagctctccaactt

SEQ ID NO: 385053 - DNA, 20 bp, Artificial
  CRISPR gRNA sequence
ttaagctctccaacttctgg

SEQ ID NO: 385054 - DNA, 20 bp, Artificial
  CRISPR gRNA sequence
agctctccaacttctggaat

SEQ ID NO: 385055 - DNA, 20 bp, Artificial
  CRISPR gRNA sequence
tccaacttctggaatcactt

SEQ ID NO: 385056 - DNA, 20 bp, Artificial
  CRISPR gRNA sequence
caacttctggaatcacttcg

SEQ ID NO: 385057 - DNA, 20 bp, Artificial
  CRISPR gRNA sequence
ctggaatcacttcgccgtga

SEQ ID NO: 385058 - DNA, 20 bp, Artificial
  CRISPR gRNA sequence
tggaatcacttcgccgtgac

SEQ ID NO: 385059 - DNA, 20 bp, Artificial
  CRISPR gRNA sequence
gaatcacttcgccgtgactg

SEQ ID NO: 385060 - DNA, 20 bp, Artificial
  CRISPR gRNA sequence
cgccgtgactgaaaggacca

SEQ ID NO: 385061 - DNA, 20 bp, Artificial
  CRISPR gRNA sequence
gccgtgactgaaaggaccat

SEQ ID NO: 385062 - DNA, 20 bp, Artificial
  CRISPR gRNA sequence
aaaggaccatctgcaaccac

SEQ ID NO: 385063 - DNA, 20 bp, Artificial
  CRISPR gRNA sequence
caaccacagtattcaataaa

SEQ ID NO: 385064 - DNA, 20 bp, Artificial
  CRISPR gRNA sequence
aataaacgctccacagttcc

SEQ ID NO: 385065 - DNA, 20 bp, Artificial
  CRISPR gRNA sequence
cacagttccaatgaaaccca

SEQ ID NO: 385066 - DNA, 20 bp, Artificial
  CRISPR gRNA sequence
caatgaaacccataaaaacc

SEQ ID NO: 385067 - DNA, 20 bp, Artificial
  CRISPR gRNA sequence
accaggggaatcatagaaga

SEQ ID NO: 385068 - DNA, 20 bp, Artificial
  CRISPR gRNA sequence
ctgtaactgaatgcaagagc

SEQ ID NO: 385069 - DNA, 20 bp, Artificial
  CRISPR gRNA sequence
taactgaatgcaagagctga

SEQ ID NO: 385070 - DNA, 20 bp, Artificial
  CRISPR gRNA sequence
aatgcaagagctgatataac

SEQ ID NO: 385071 - DNA, 20 bp, Artificial
  CRISPR gRNA sequence
atataactgtatccaactat

SEQ ID NO: 385072 - DNA, 20 bp, Artificial
  CRISPR gRNA sequence
tatccaactatataaaatag

SEQ ID NO: 385073 - DNA, 20 bp, Artificial
  CRISPR gRNA sequence
tataaaatagttattatagg

SEQ ID NO: 385074 - DNA, 20 bp, Artificial
  CRISPR gRNA sequence
ttatagggagatggtgactc

SEQ ID NO: 385075 - DNA, 20 bp, Artificial
  CRISPR gRNA sequence
tagggagatggtgactcttt

SEQ ID NO: 385076 - DNA, 20 bp, Artificial
  CRISPR gRNA sequence
tttttatctccctaaggaaa

SEQ ID NO: 385077 - DNA, 20 bp, Artificial
  CRISPR gRNA sequence
tttatctccctaaggaaaag

SEQ ID NO: 385078 - DNA, 20 bp, Artificial
  CRISPR gRNA sequence
ttatctccctaaggaaaaga

SEQ ID NO: 385079 - DNA, 20 bp, Artificial
  CRISPR gRNA sequence
tatctccctaaggaaaagat

SEQ ID NO: 385080 - DNA, 20 bp, Artificial
  CRISPR gRNA sequence
atctccctaaggaaaagatt

SEQ ID NO: 385081 - DNA, 20 bp, Artificial
  CRISPR gRNA sequence
tctccctaaggaaaagattc

SEQ ID NO: 385082 - DNA, 20 bp, Artificial
  CRISPR gRNA sequence
cctaaggaaaagattcttat

SEQ ID NO: 385083 - DNA, 20 bp, Artificial
  CRISPR gRNA sequence
aggaaaagattcttattgaa

SEQ ID NO: 385084 - DNA, 20 bp, Artificial
  CRISPR gRNA sequence
ttattgaacaacagactcct

SEQ ID NO: 385085 - DNA, 20 bp, Artificial
  CRISPR gRNA sequence
attgaacaacagactcctct

SEQ ID NO: 385086 - DNA, 20 bp, Artificial
  CRISPR gRNA sequence
ttgaacaacagactcctctg

SEQ ID NO: 385087 - DNA, 20 bp, Artificial
  CRISPR gRNA sequence
aacaacagactcctctgtta

SEQ ID NO: 385088 - DNA, 20 bp, Artificial
  CRISPR gRNA sequence
ctctgttagatacagaagat

SEQ ID NO: 385089 - DNA, 20 bp, Artificial
  CRISPR gRNA sequence
tgttagatacagaagataca

SEQ ID NO: 385090 - DNA, 20 bp, Artificial
  CRISPR gRNA sequence
ttagatacagaagatacaga

SEQ ID NO: 385091 - DNA, 20 bp, Artificial
  CRISPR gRNA sequence
gatacagaagatacagaaat

SEQ ID NO: 385092 - DNA, 20 bp, Artificial
  CRISPR gRNA sequence
tgggagttctctttaaggtg

SEQ ID NO: 385093 - DNA, 20 bp, Artificial
  CRISPR gRNA sequence
gggagttctctttaaggtga

SEQ ID NO: 385094 - DNA, 20 bp, Artificial
  CRISPR gRNA sequence
ggagttctctttaaggtgag

SEQ ID NO: 385095 - DNA, 20 bp, Artificial
  CRISPR gRNA sequence
tctttaaggtgaggttgtaa

SEQ ID NO: 385096 - DNA, 20 bp, Artificial
  CRISPR gRNA sequence
tttaaggtgaggttgtaatt

SEQ ID NO: 385097 - DNA, 20 bp, Artificial
  CRISPR gRNA sequence
taaggtgaggttgtaattcc

SEQ ID NO: 385098 - DNA, 20 bp, Artificial
  CRISPR gRNA sequence
aaggtgaggttgtaattcct

SEQ ID NO: 385099 - DNA, 20 bp, Artificial
  CRISPR gRNA sequence
aggtgaggttgtaattcctt

SEQ ID NO: 385100 - DNA, 20 bp, Artificial
  CRISPR gRNA sequence
taattcctttgtgaatatct

SEQ ID NO: 385101 - DNA, 20 bp, Artificial
  CRISPR gRNA sequence
ctttgtgaatatcttgaaaa

SEQ ID NO: 385102 - DNA, 20 bp, Artificial
  CRISPR gRNA sequence
tgtgaatatcttgaaaataa

SEQ ID NO: 385103 - DNA, 20 bp, Artificial
  CRISPR gRNA sequence
gtgaatatcttgaaaataag

SEQ ID NO: 385104 - DNA, 20 bp, Artificial
  CRISPR gRNA sequence
tgaatatcttgaaaataaga

SEQ ID NO: 385105 - DNA, 20 bp, Artificial
  CRISPR gRNA sequence
gaaaataagatggtctttct

SEQ ID NO: 385106 - DNA, 20 bp, Artificial
  CRISPR gRNA sequence
aaaataagatggtctttctc

SEQ ID NO: 385107 - DNA, 20 bp, Artificial
  CRISPR gRNA sequence
tctccagggaaaggttatgc

SEQ ID NO: 385108 - DNA, 20 bp, Artificial
  CRISPR gRNA sequence
ctccagggaaaggttatgca

SEQ ID NO: 385109 - DNA, 20 bp, Artificial
  CRISPR gRNA sequence
tccagggaaaggttatgcag

SEQ ID NO: 385110 - DNA, 20 bp, Artificial
  CRISPR gRNA sequence
cagggaaaggttatgcagga

SEQ ID NO: 385111 - DNA, 20 bp, Artificial
  CRISPR gRNA sequence
tgcaggaaatggatattgac

SEQ ID NO: 385112 - DNA, 20 bp, Artificial
  CRISPR gRNA sequence
actccaattgtctcttctag

SEQ ID NO: 385113 - DNA, 20 bp, Artificial
  CRISPR gRNA sequence
caattgtctcttctagttgc

SEQ ID NO: 385114 - DNA, 20 bp, Artificial
  CRISPR gRNA sequence
tctcttctagttgctttgaa

SEQ ID NO: 385115 - DNA, 20 bp, Artificial
  CRISPR gRNA sequence
ttctagttgctttgaaatcc

SEQ ID NO: 385116 - DNA, 20 bp, Artificial
  CRISPR gRNA sequence
ctagttgctttgaaatcctc

SEQ ID NO: 385117 - DNA, 20 bp, Artificial
  CRISPR gRNA sequence
tagttgctttgaaatcctcc

SEQ ID NO: 385118 - DNA, 20 bp, Artificial
  CRISPR gRNA sequence
gttgctttgaaatcctccta

SEQ ID NO: 385119 - DNA, 20 bp, Artificial
  CRISPR gRNA sequence
ctttgaaatcctcctatcat

SEQ ID NO: 385120 - DNA, 20 bp, Artificial
  CRISPR gRNA sequence
tgaaatcctcctatcatgtc

SEQ ID NO: 385121 - DNA, 20 bp, Artificial
  CRISPR gRNA sequence
gaaatcctcctatcatgtca

SEQ ID NO: 385122 - DNA, 20 bp, Artificial
  CRISPR gRNA sequence
aaatcctcctatcatgtcaa

SEQ ID NO: 385123 - DNA, 20 bp, Artificial
  CRISPR gRNA sequence
ctatcatgtcaatataatct

SEQ ID NO: 385124 - DNA, 20 bp, Artificial
  CRISPR gRNA sequence
tcatgtcaatataatcttac

SEQ ID NO: 385125 - DNA, 20 bp, Artificial
  CRISPR gRNA sequence
accttattctatgtgcattt

SEQ ID NO: 385126 - DNA, 20 bp, Artificial
  CRISPR gRNA sequence
ccttattctatgtgcattta

SEQ ID NO: 385127 - DNA, 20 bp, Artificial
  CRISPR gRNA sequence
attctatgtgcatttatttt

SEQ ID NO: 385128 - DNA, 20 bp, Artificial
  CRISPR gRNA sequence
ttctatgtgcatttattttc

SEQ ID NO: 385129 - DNA, 20 bp, Artificial
  CRISPR gRNA sequence
tatgtgcatttattttctta

SEQ ID NO: 385130 - DNA, 20 bp, Artificial
  CRISPR gRNA sequence
tgtgcatttattttcttatt

SEQ ID NO: 385131 - DNA, 20 bp, Artificial
  CRISPR gRNA sequence
attttcttatttattattat

SEQ ID NO: 385132 - DNA, 20 bp, Artificial
  CRISPR gRNA sequence
ttttcttatttattattatt

SEQ ID NO: 385133 - DNA, 20 bp, Artificial
  CRISPR gRNA sequence
tcttatttattattattttg

SEQ ID NO: 385134 - DNA, 20 bp, Artificial
  CRISPR gRNA sequence
cttatttattattattttga

SEQ ID NO: 385135 - DNA, 20 bp, Artificial
  CRISPR gRNA sequence
ttatttattattattttgac

SEQ ID NO: 385136 - DNA, 20 bp, Artificial
  CRISPR gRNA sequence
atttattattattttgacca

SEQ ID NO: 385137 - DNA, 20 bp, Artificial
  CRISPR gRNA sequence
tttattattattttgaccaa

SEQ ID NO: 385138 - DNA, 20 bp, Artificial
  CRISPR gRNA sequence
attattattttgaccaatta

SEQ ID NO: 385139 - DNA, 20 bp, Artificial
  CRISPR gRNA sequence
ttattattttgaccaattat

SEQ ID NO: 385140 - DNA, 20 bp, Artificial
  CRISPR gRNA sequence
ttattttgaccaattattca

SEQ ID NO: 385141 - DNA, 20 bp, Artificial
  CRISPR gRNA sequence
ttttgaccaattattcattt

SEQ ID NO: 385142 - DNA, 20 bp, Artificial
  CRISPR gRNA sequence
tgaccaattattcatttatt

SEQ ID NO: 385143 - DNA, 20 bp, Artificial
  CRISPR gRNA sequence
gaccaattattcatttattt

SEQ ID NO: 385144 - DNA, 20 bp, Artificial
  CRISPR gRNA sequence
accaattattcatttatttg

SEQ ID NO: 385145 - DNA, 20 bp, Artificial
  CRISPR gRNA sequence
ttcatttatttgtttattct

SEQ ID NO: 385146 - DNA, 20 bp, Artificial
  CRISPR gRNA sequence
atttatttgtttattctatg

SEQ ID NO: 385147 - DNA, 20 bp, Artificial
  CRISPR gRNA sequence
atttgtttattctatgtgta

SEQ ID NO: 385148 - DNA, 20 bp, Artificial
  CRISPR gRNA sequence
tttgtttattctatgtgtaa

SEQ ID NO: 385149 - DNA, 20 bp, Artificial
  CRISPR gRNA sequence
gtttattctatgtgtaaatt

SEQ ID NO: 385150 - DNA, 20 bp, Artificial
  CRISPR gRNA sequence
tttattctatgtgtaaattt

SEQ ID NO: 385151 - DNA, 20 bp, Artificial
  CRISPR gRNA sequence
attctatgtgtaaatttact

SEQ ID NO: 385152 - DNA, 20 bp, Artificial
  CRISPR gRNA sequence
ttctatgtgtaaatttacta

SEQ ID NO: 385153 - DNA, 20 bp, Artificial
  CRISPR gRNA sequence
tatgtgtaaatttactatac

SEQ ID NO: 385154 - DNA, 20 bp, Artificial
  CRISPR gRNA sequence
tgtgtaaatttactatacac

SEQ ID NO: 385155 - DNA, 20 bp, Artificial
  CRISPR gRNA sequence
actatacacaaggcatatgg

SEQ ID NO: 385156 - DNA, 20 bp, Artificial
  CRISPR gRNA sequence
ctatacacaaggcatatggc

SEQ ID NO: 385157 - DNA, 20 bp, Artificial
  CRISPR gRNA sequence
tacacaaggcatatggctag

SEQ ID NO: 385158 - DNA, 20 bp, Artificial
  CRISPR gRNA sequence
ggtgttttatataaattaga

SEQ ID NO: 385159 - DNA, 20 bp, Artificial
  CRISPR gRNA sequence
tatataaattagatcattta

SEQ ID NO: 385160 - DNA, 20 bp, Artificial
  CRISPR gRNA sequence
atataaattagatcatttac

SEQ ID NO: 385161 - DNA, 20 bp, Artificial
  CRISPR gRNA sequence
tataaattagatcatttact

SEQ ID NO: 385162 - DNA, 20 bp, Artificial
  CRISPR gRNA sequence
gatcatttactcctcaaaat

SEQ ID NO: 385163 - DNA, 20 bp, Artificial
  CRISPR gRNA sequence
actcctcaaaataaatctat

SEQ ID NO: 385164 - DNA, 20 bp, Artificial
  CRISPR gRNA sequence
ctcctcaaaataaatctatg

SEQ ID NO: 385165 - DNA, 20 bp, Artificial
  CRISPR gRNA sequence
ctcaaaataaatctatgata

SEQ ID NO: 385166 - DNA, 20 bp, Artificial
  CRISPR gRNA sequence
aaaataaatctatgatatag

SEQ ID NO: 385167 - DNA, 20 bp, Artificial
  CRISPR gRNA sequence
tgatatagatgctattatta

SEQ ID NO: 385168 - DNA, 20 bp, Artificial
  CRISPR gRNA sequence
ttattatcctcattttaaag

SEQ ID NO: 385169 - DNA, 20 bp, Artificial
  CRISPR gRNA sequence
ttatcctcattttaaagata

SEQ ID NO: 385170 - DNA, 20 bp, Artificial
  CRISPR gRNA sequence
tcctcattttaaagataagg

SEQ ID NO: 385171 - DNA, 20 bp, Artificial
  CRISPR gRNA sequence
attttaaagataaggaaaag

SEQ ID NO: 385172 - DNA, 20 bp, Artificial
  CRISPR gRNA sequence
taaagataaggaaaagatct

SEQ ID NO: 385173 - DNA, 20 bp, Artificial
  CRISPR gRNA sequence
aaagataaggaaaagatcta

SEQ ID NO: 385174 - DNA, 20 bp, Artificial
  CRISPR gRNA sequence
aagataaggaaaagatctat

SEQ ID NO: 385175 - DNA, 20 bp, Artificial
  CRISPR gRNA sequence
tgatctttgaccttttatta

SEQ ID NO: 385176 - DNA, 20 bp, Artificial
  CRISPR gRNA sequence
tgaccttttattaaattgtg

SEQ ID NO: 385177 - DNA, 20 bp, Artificial
  CRISPR gRNA sequence
gaccttttattaaattgtgg

SEQ ID NO: 385178 - DNA, 20 bp, Artificial
  CRISPR gRNA sequence
accttttattaaattgtggt

SEQ ID NO: 385179 - DNA, 20 bp, Artificial
  CRISPR gRNA sequence
ttattaaattgtggttcaca

SEQ ID NO: 385180 - DNA, 20 bp, Artificial
  CRISPR gRNA sequence
tattaaattgtggttcacaa

SEQ ID NO: 385181 - DNA, 20 bp, Artificial
  CRISPR gRNA sequence
attaaattgtggttcacaag

SEQ ID NO: 385182 - DNA, 20 bp, Artificial
  CRISPR gRNA sequence
ttaaattgtggttcacaagg

SEQ ID NO: 385183 - DNA, 20 bp, Artificial
  CRISPR gRNA sequence
aattgtggttcacaaggctt

SEQ ID NO: 385184 - DNA, 20 bp, Artificial
  CRISPR gRNA sequence
tggttcacaaggcttgctat

SEQ ID NO: 385185 - DNA, 20 bp, Artificial
  CRISPR gRNA sequence
acaaggcttgctatctcaca

SEQ ID NO: 385186 - DNA, 20 bp, Artificial
  CRISPR gRNA sequence
gctatctcacaacgtgcagt

SEQ ID NO: 385187 - DNA, 20 bp, Artificial
  CRISPR gRNA sequence
ctatctcacaacgtgcagtt

SEQ ID NO: 385188 - DNA, 20 bp, Artificial
  CRISPR gRNA sequence
tctcacaacgtgcagttaac

SEQ ID NO: 385189 - DNA, 20 bp, Artificial
  CRISPR gRNA sequence
acaacgtgcagttaacgttc

SEQ ID NO: 385190 - DNA, 20 bp, Artificial
  CRISPR gRNA sequence
acgttcccaaccaggcccaa

SEQ ID NO: 385191 - DNA, 20 bp, Artificial
  CRISPR gRNA sequence
ccaaccaggcccaaatgcac

SEQ ID NO: 385192 - DNA, 20 bp, Artificial
  CRISPR gRNA sequence
aaataagcctggagcataca

SEQ ID NO: 385193 - DNA, 20 bp, Artificial
  CRISPR gRNA sequence
aataagcctggagcatacaa

SEQ ID NO: 385194 - DNA, 20 bp, Artificial
  CRISPR gRNA sequence
gagcatacaatgtgatgaaa

SEQ ID NO: 385195 - DNA, 20 bp, Artificial
  CRISPR gRNA sequence
agagtcaaatgatctatgtt

SEQ ID NO: 385196 - DNA, 20 bp, Artificial
  CRISPR gRNA sequence
gagtcaaatgatctatgttt

SEQ ID NO: 385197 - DNA, 20 bp, Artificial
  CRISPR gRNA sequence
tgtttaacttgcactctgca

SEQ ID NO: 385198 - DNA, 20 bp, Artificial
  CRISPR gRNA sequence
aacttgcactctgcaattta

SEQ ID NO: 385199 - DNA, 20 bp, Artificial
  CRISPR gRNA sequence
acttgcactctgcaatttac

SEQ ID NO: 385200 - DNA, 20 bp, Artificial
  CRISPR gRNA sequence
gcactctgcaatttactagc

SEQ ID NO: 385201 - DNA, 20 bp, Artificial
  CRISPR gRNA sequence
cactctgcaatttactagct

SEQ ID NO: 385202 - DNA, 20 bp, Artificial
  CRISPR gRNA sequence
tgcaatttactagctgagtt

SEQ ID NO: 385203 - DNA, 20 bp, Artificial
  CRISPR gRNA sequence
caatttactagctgagttat

SEQ ID NO: 385204 - DNA, 20 bp, Artificial
  CRISPR gRNA sequence
actagctgagttatttatgt

SEQ ID NO: 385205 - DNA, 20 bp, Artificial
  CRISPR gRNA sequence
ctagctgagttatttatgtc

SEQ ID NO: 385206 - DNA, 20 bp, Artificial
  CRISPR gRNA sequence
gctgagttatttatgtcttt

SEQ ID NO: 385207 - DNA, 20 bp, Artificial
  CRISPR gRNA sequence
agttatttatgtctttaaag

SEQ ID NO: 385208 - DNA, 20 bp, Artificial
  CRISPR gRNA sequence
tttatgtctttaaagttcag

SEQ ID NO: 385209 - DNA, 20 bp, Artificial
  CRISPR gRNA sequence
atgtctttaaagttcagtcc

SEQ ID NO: 385210 - DNA, 20 bp, Artificial
  CRISPR gRNA sequence
tgtctttaaagttcagtcct

SEQ ID NO: 385211 - DNA, 20 bp, Artificial
  CRISPR gRNA sequence
taaagttcagtcctctcatc

SEQ ID NO: 385212 - DNA, 20 bp, Artificial
  CRISPR gRNA sequence
aaagttcagtcctctcatct

SEQ ID NO: 385213 - DNA, 20 bp, Artificial
  CRISPR gRNA sequence
aagttcagtcctctcatctg

SEQ ID NO: 385214 - DNA, 20 bp, Artificial
  CRISPR gRNA sequence
agtcctctcatctgtattat

SEQ ID NO: 385215 - DNA, 20 bp, Artificial
  CRISPR gRNA sequence
tcatctgtattattaaaaag

SEQ ID NO: 385216 - DNA, 20 bp, Artificial
  CRISPR gRNA sequence
atctgtattattaaaaagtc

SEQ ID NO: 385217 - DNA, 20 bp, Artificial
  CRISPR gRNA sequence
tattattaaaaagtcaaaaa

SEQ ID NO: 385218 - DNA, 20 bp, Artificial
  CRISPR gRNA sequence
ttaaaaagtcaaaaaatatt

SEQ ID NO: 385219 - DNA, 20 bp, Artificial
  CRISPR gRNA sequence
aaaagtcaaaaaatattaga

SEQ ID NO: 385220 - DNA, 20 bp, Artificial
  CRISPR gRNA sequence
gatgctggcaaggttgtgga

SEQ ID NO: 385221 - DNA, 20 bp, Artificial
  CRISPR gRNA sequence
gcaaggttgtggaggaaaaa

SEQ ID NO: 385222 - DNA, 20 bp, Artificial
  CRISPR gRNA sequence
tggaggaaaaagaacacttt

SEQ ID NO: 385223 - DNA, 20 bp, Artificial
  CRISPR gRNA sequence
ttacgctgttggtgggaatg

SEQ ID NO: 385224 - DNA, 20 bp, Artificial
  CRISPR gRNA sequence
tacgctgttggtgggaatgt

SEQ ID NO: 385225 - DNA, 20 bp, Artificial
  CRISPR gRNA sequence
acgctgttggtgggaatgta

SEQ ID NO: 385226 - DNA, 20 bp, Artificial
  CRISPR gRNA sequence
cgctgttggtgggaatgtaa

SEQ ID NO: 385227 - DNA, 20 bp, Artificial
  CRISPR gRNA sequence
ttggtgggaatgtaaattag

SEQ ID NO: 385228 - DNA, 20 bp, Artificial
  CRISPR gRNA sequence
gtgggaatgtaaattagttc

SEQ ID NO: 385229 - DNA, 20 bp, Artificial
  CRISPR gRNA sequence
gttcaggcattgtggaagac

SEQ ID NO: 385230 - DNA, 20 bp, Artificial
  CRISPR gRNA sequence
aggcattgtggaagacagtg

SEQ ID NO: 385231 - DNA, 20 bp, Artificial
  CRISPR gRNA sequence
tggaagacagtgtggtgatt

SEQ ID NO: 385232 - DNA, 20 bp, Artificial
  CRISPR gRNA sequence
ctcaaaaacttacagacaga

SEQ ID NO: 385233 - DNA, 20 bp, Artificial
  CRISPR gRNA sequence
aaaaacttacagacagaaat

SEQ ID NO: 385234 - DNA, 20 bp, Artificial
  CRISPR gRNA sequence
acagacagaaataccatttg

SEQ ID NO: 385235 - DNA, 20 bp, Artificial
  CRISPR gRNA sequence
cagacagaaataccatttga

SEQ ID NO: 385236 - DNA, 20 bp, Artificial
  CRISPR gRNA sequence
gacccagcagcgccattact

SEQ ID NO: 385237 - DNA, 20 bp, Artificial
  CRISPR gRNA sequence
acccagcagcgccattactg

SEQ ID NO: 385238 - DNA, 20 bp, Artificial
  CRISPR gRNA sequence
ctgggtatatgcccaaagga

SEQ ID NO: 385239 - DNA, 20 bp, Artificial
  CRISPR gRNA sequence
ggtatatgcccaaaggaata

SEQ ID NO: 385240 - DNA, 20 bp, Artificial
  CRISPR gRNA sequence
tactataagacacatgcaag

SEQ ID NO: 385241 - DNA, 20 bp, Artificial
  CRISPR gRNA sequence
ctataagacacatgcaagca

SEQ ID NO: 385242 - DNA, 20 bp, Artificial
  CRISPR gRNA sequence
taagacacatgcaagcatgt

SEQ ID NO: 385243 - DNA, 20 bp, Artificial
  CRISPR gRNA sequence
attgcagcactattcatgat

SEQ ID NO: 385244 - DNA, 20 bp, Artificial
  CRISPR gRNA sequence
cagcactattcatgatagca

SEQ ID NO: 385245 - DNA, 20 bp, Artificial
  CRISPR gRNA sequence
ttcatgatagcaaagacatg

SEQ ID NO: 385246 - DNA, 20 bp, Artificial
  CRISPR gRNA sequence
atgatagcaaagacatggaa

SEQ ID NO: 385247 - DNA, 20 bp, Artificial
  CRISPR gRNA sequence
aatacccgtcaatgatagac

SEQ ID NO: 385248 - DNA, 20 bp, Artificial
  CRISPR gRNA sequence
gataaagaaaatgtggtaca

SEQ ID NO: 385249 - DNA, 20 bp, Artificial
  CRISPR gRNA sequence
tacagccacagaaagaaatg

SEQ ID NO: 385250 - DNA, 20 bp, Artificial
  CRISPR gRNA sequence
tgcagggacacggatagagc

SEQ ID NO: 385251 - DNA, 20 bp, Artificial
  CRISPR gRNA sequence
gcagggacacggatagagct

SEQ ID NO: 385252 - DNA, 20 bp, Artificial
  CRISPR gRNA sequence
cagggacacggatagagctg

SEQ ID NO: 385253 - DNA, 20 bp, Artificial
  CRISPR gRNA sequence
gaggccattatccttagcaa

SEQ ID NO: 385254 - DNA, 20 bp, Artificial
  CRISPR gRNA sequence
tccttagcaaactcatgcag

SEQ ID NO: 385255 - DNA, 20 bp, Artificial
  CRISPR gRNA sequence
agcaaactcatgcaggaaca

SEQ ID NO: 385256 - DNA, 20 bp, Artificial
  CRISPR gRNA sequence
gcaaactcatgcaggaacag

SEQ ID NO: 385257 - DNA, 20 bp, Artificial
  CRISPR gRNA sequence
atgcaggaacagaaaaccaa

SEQ ID NO: 385258 - DNA, 20 bp, Artificial
  CRISPR gRNA sequence
tcacctataagtgggagcta

SEQ ID NO: 385259 - DNA, 20 bp, Artificial
  CRISPR gRNA sequence
acctataagtgggagctaaa

SEQ ID NO: 385260 - DNA, 20 bp, Artificial
  CRISPR gRNA sequence
taagtgggagctaaatgatg

SEQ ID NO: 385261 - DNA, 20 bp, Artificial
  CRISPR gRNA sequence
aatgatgagaacacatggac

SEQ ID NO: 385262 - DNA, 20 bp, Artificial
  CRISPR gRNA sequence
gagcctactggagggcagag

SEQ ID NO: 385263 - DNA, 20 bp, Artificial
  CRISPR gRNA sequence
ctggagggcagagggtggga

SEQ ID NO: 385264 - DNA, 20 bp, Artificial
  CRISPR gRNA sequence
gagggcagagggtgggagaa

SEQ ID NO: 385265 - DNA, 20 bp, Artificial
  CRISPR gRNA sequence
ttgggtataaggcttaatac

SEQ ID NO: 385266 - DNA, 20 bp, Artificial
  CRISPR gRNA sequence
ggtataaggcttaatacctg

SEQ ID NO: 385267 - DNA, 20 bp, Artificial
  CRISPR gRNA sequence
aatacctgggtgatgcaata

SEQ ID NO: 385268 - DNA, 20 bp, Artificial
  CRISPR gRNA sequence
atacctgggtgatgcaatat

SEQ ID NO: 385269 - DNA, 20 bp, Artificial
  CRISPR gRNA sequence
ggtgatgcaatatgctatac

SEQ ID NO: 385270 - DNA, 20 bp, Artificial
  CRISPR gRNA sequence
tacaacaaaccccatgacac

SEQ ID NO: 385271 - DNA, 20 bp, Artificial
  CRISPR gRNA sequence
gcctatgtaacaaacctgca

SEQ ID NO: 385272 - DNA, 20 bp, Artificial
  CRISPR gRNA sequence
cctatgtaacaaacctgcac

SEQ ID NO: 385273 - DNA, 20 bp, Artificial
  CRISPR gRNA sequence
tgtaacaaacctgcacatcc

SEQ ID NO: 385274 - DNA, 20 bp, Artificial
  CRISPR gRNA sequence
cacatcctgcacatgtatcc

SEQ ID NO: 385275 - DNA, 20 bp, Artificial
  CRISPR gRNA sequence
cacatgtatccctgaactta

SEQ ID NO: 385276 - DNA, 20 bp, Artificial
  CRISPR gRNA sequence
aacttaaaataaatgttaag

SEQ ID NO: 385277 - DNA, 20 bp, Artificial
  CRISPR gRNA sequence
aaaataaatgttaagaaaat

SEQ ID NO: 385278 - DNA, 20 bp, Artificial
  CRISPR gRNA sequence
aaataaatgttaagaaaata

SEQ ID NO: 385279 - DNA, 20 bp, Artificial
  CRISPR gRNA sequence
agaaaataaaaatgaaaata

SEQ ID NO: 385280 - DNA, 20 bp, Artificial
  CRISPR gRNA sequence
gatttacgttgaccagccat

SEQ ID NO: 385281 - DNA, 20 bp, Artificial
  CRISPR gRNA sequence
acgttgaccagccattctgg

SEQ ID NO: 385282 - DNA, 20 bp, Artificial
  CRISPR gRNA sequence
cgttgaccagccattctggt

SEQ ID NO: 385283 - DNA, 20 bp, Artificial
  CRISPR gRNA sequence
accagccattctggtttgcc

SEQ ID NO: 385284 - DNA, 20 bp, Artificial
  CRISPR gRNA sequence
tggtttgcctgggactaagg

SEQ ID NO: 385285 - DNA, 20 bp, Artificial
  CRISPR gRNA sequence
gtttgcctgggactaaggag

SEQ ID NO: 385286 - DNA, 20 bp, Artificial
  CRISPR gRNA sequence
gcctgggactaaggagtttc

SEQ ID NO: 385287 - DNA, 20 bp, Artificial
  CRISPR gRNA sequence
cctgggactaaggagtttcc

SEQ ID NO: 385288 - DNA, 20 bp, Artificial
  CRISPR gRNA sequence
ggactaaggagtttcccagg

SEQ ID NO: 385289 - DNA, 20 bp, Artificial
  CRISPR gRNA sequence
aggagtttcccaggatgaga

SEQ ID NO: 385290 - DNA, 20 bp, Artificial
  CRISPR gRNA sequence
cccaggatgagagattttct

SEQ ID NO: 385291 - DNA, 20 bp, Artificial
  CRISPR gRNA sequence
ccaggatgagagattttctt

SEQ ID NO: 385292 - DNA, 20 bp, Artificial
  CRISPR gRNA sequence
tcttttttttcttttttttt

SEQ ID NO: 385293 - DNA, 20 bp, Artificial
  CRISPR gRNA sequence
cttttttttctttttttttt

SEQ ID NO: 385294 - DNA, 20 bp, Artificial
  CRISPR gRNA sequence
ttttttttcttttttttttt

SEQ ID NO: 385295 - DNA, 20 bp, Artificial
  CRISPR gRNA sequence
ttttttcttttttttttttt

SEQ ID NO: 385296 - DNA, 20 bp, Artificial
  CRISPR gRNA sequence
tttttctttttttttttttt

SEQ ID NO: 385297 - DNA, 20 bp, Artificial
  CRISPR gRNA sequence
ttttcttttttttttttttt

SEQ ID NO: 385298 - DNA, 20 bp, Artificial
  CRISPR gRNA sequence
tttctttttttttttttttt

SEQ ID NO: 385299 - DNA, 20 bp, Artificial
  CRISPR gRNA sequence
ttcttttttttttttttttt

SEQ ID NO: 385300 - DNA, 20 bp, Artificial
  CRISPR gRNA sequence
tctttttttttttttttttt

SEQ ID NO: 385301 - DNA, 20 bp, Artificial
  CRISPR gRNA sequence
cttttttttttttttttttt

SEQ ID NO: 385302 - DNA, 20 bp, Artificial
  CRISPR gRNA sequence
tttttttttttttttttttg

SEQ ID NO: 385303 - DNA, 20 bp, Artificial
  CRISPR gRNA sequence
tttttttttttttttttgag

SEQ ID NO: 385304 - DNA, 20 bp, Artificial
  CRISPR gRNA sequence
ttttttttttttttttgaga

SEQ ID NO: 385305 - DNA, 20 bp, Artificial
  CRISPR gRNA sequence
tttttttttttttttgagat

SEQ ID NO: 385306 - DNA, 20 bp, Artificial
  CRISPR gRNA sequence
ttttttttttttttgagatg

SEQ ID NO: 385307 - DNA, 20 bp, Artificial
  CRISPR gRNA sequence
tttttttttttttgagatgg

SEQ ID NO: 385308 - DNA, 20 bp, Artificial
  CRISPR gRNA sequence
ttttttttttttgagatgga

SEQ ID NO: 385309 - DNA, 20 bp, Artificial
  CRISPR gRNA sequence
tttttttttttgagatggag

SEQ ID NO: 385310 - DNA, 20 bp, Artificial
  CRISPR gRNA sequence
ttttttttttgagatggagt

SEQ ID NO: 385311 - DNA, 20 bp, Artificial
  CRISPR gRNA sequence
tttttttttgagatggagtc

SEQ ID NO: 385312 - DNA, 20 bp, Artificial
  CRISPR gRNA sequence
ttttttttgagatggagtct

SEQ ID NO: 385313 - DNA, 20 bp, Artificial
  CRISPR gRNA sequence
tttttttgagatggagtctc

SEQ ID NO: 385314 - DNA, 20 bp, Artificial
  CRISPR gRNA sequence
ttttttgagatggagtctcg

SEQ ID NO: 385315 - DNA, 20 bp, Artificial
  CRISPR gRNA sequence
tttttgagatggagtctcgc

SEQ ID NO: 385316 - DNA, 20 bp, Artificial
  CRISPR gRNA sequence
ttttgagatggagtctcgct

SEQ ID NO: 385317 - DNA, 20 bp, Artificial
  CRISPR gRNA sequence
tttgagatggagtctcgctc

SEQ ID NO: 385318 - DNA, 20 bp, Artificial
  CRISPR gRNA sequence
ttgagatggagtctcgctct

SEQ ID NO: 385319 - DNA, 20 bp, Artificial
  CRISPR gRNA sequence
tgagatggagtctcgctctg

SEQ ID NO: 385320 - DNA, 20 bp, Artificial
  CRISPR gRNA sequence
gagatggagtctcgctctgt

SEQ ID NO: 385321 - DNA, 20 bp, Artificial
  CRISPR gRNA sequence
agatggagtctcgctctgtc

SEQ ID NO: 385322 - DNA, 20 bp, Artificial
  CRISPR gRNA sequence
gctctgtcacccaggctggg

SEQ ID NO: 385323 - DNA, 20 bp, Artificial
  CRISPR gRNA sequence
tgtcacccaggctgggatgc

SEQ ID NO: 385324 - DNA, 20 bp, Artificial
  CRISPR gRNA sequence
tcacccaggctgggatgcaa

SEQ ID NO: 385325 - DNA, 20 bp, Artificial
  CRISPR gRNA sequence
ggatgcaatgctgcaatctc

SEQ ID NO: 385326 - DNA, 20 bp, Artificial
  CRISPR gRNA sequence
caatctcagctcactgcaac

SEQ ID NO: 385327 - DNA, 20 bp, Artificial
  CRISPR gRNA sequence
agctcactgcaacctccgcc

SEQ ID NO: 385328 - DNA, 20 bp, Artificial
  CRISPR gRNA sequence
actgcaacctccgcctcccg

SEQ ID NO: 385329 - DNA, 20 bp, Artificial
  CRISPR gRNA sequence
caacctccgcctcccgggtt

SEQ ID NO: 385330 - DNA, 20 bp, Artificial
  CRISPR gRNA sequence
cgcctcccgggttcaagtga

SEQ ID NO: 385331 - DNA, 20 bp, Artificial
  CRISPR gRNA sequence
ccgggttcaagtgattctcc

SEQ ID NO: 385332 - DNA, 20 bp, Artificial
  CRISPR gRNA sequence
aagtgattctcctgcctcag

SEQ ID NO: 385333 - DNA, 20 bp, Artificial
  CRISPR gRNA sequence
tcctgcctcagcctcctgag

SEQ ID NO: 385334 - DNA, 20 bp, Artificial
  CRISPR gRNA sequence
ctgcctcagcctcctgagta

SEQ ID NO: 385335 - DNA, 20 bp, Artificial
  CRISPR gRNA sequence
cctcagcctcctgagtagct

SEQ ID NO: 385336 - DNA, 20 bp, Artificial
  CRISPR gRNA sequence
agcctcctgagtagctggga

SEQ ID NO: 385337 - DNA, 20 bp, Artificial
  CRISPR gRNA sequence
ctgagtagctgggattacag

SEQ ID NO: 385338 - DNA, 20 bp, Artificial
  CRISPR gRNA sequence
agtagctgggattacaggcg

SEQ ID NO: 385339 - DNA, 20 bp, Artificial
  CRISPR gRNA sequence
ggattacaggcgcccgccac

SEQ ID NO: 385340 - DNA, 20 bp, Artificial
  CRISPR gRNA sequence
caggcgcccgccaccatgcc

SEQ ID NO: 385341 - DNA, 20 bp, Artificial
  CRISPR gRNA sequence
gctaattttttttttatttt

SEQ ID NO: 385342 - DNA, 20 bp, Artificial
  CRISPR gRNA sequence
attttttttttatttttagt

SEQ ID NO: 385343 - DNA, 20 bp, Artificial
  CRISPR gRNA sequence
tttttttatttttagtagag

SEQ ID NO: 385344 - DNA, 20 bp, Artificial
  CRISPR gRNA sequence
ttttttatttttagtagaga

SEQ ID NO: 385345 - DNA, 20 bp, Artificial
  CRISPR gRNA sequence
tttttatttttagtagagat

SEQ ID NO: 385346 - DNA, 20 bp, Artificial
  CRISPR gRNA sequence
ttttatttttagtagagatg

SEQ ID NO: 385347 - DNA, 20 bp, Artificial
  CRISPR gRNA sequence
tttatttttagtagagatgg

SEQ ID NO: 385348 - DNA, 20 bp, Artificial
  CRISPR gRNA sequence
ttatttttagtagagatggg

SEQ ID NO: 385349 - DNA, 20 bp, Artificial
  CRISPR gRNA sequence
tatttttagtagagatgggg

SEQ ID NO: 385350 - DNA, 20 bp, Artificial
  CRISPR gRNA sequence
atttttagtagagatggggt

SEQ ID NO: 385351 - DNA, 20 bp, Artificial
  CRISPR gRNA sequence
tttttagtagagatggggtt

SEQ ID NO: 385352 - DNA, 20 bp, Artificial
  CRISPR gRNA sequence
ttagtagagatggggtttca

SEQ ID NO: 385353 - DNA, 20 bp, Artificial
  CRISPR gRNA sequence
tagtagagatggggtttcac

SEQ ID NO: 385354 - DNA, 20 bp, Artificial
  CRISPR gRNA sequence
agtagagatggggtttcacc

SEQ ID NO: 385355 - DNA, 20 bp, Artificial
  CRISPR gRNA sequence
gtagagatggggtttcacca

SEQ ID NO: 385356 - DNA, 20 bp, Artificial
  CRISPR gRNA sequence
caccatgttggtcaggctgg

SEQ ID NO: 385357 - DNA, 20 bp, Artificial
  CRISPR gRNA sequence
accatgttggtcaggctggt

SEQ ID NO: 385358 - DNA, 20 bp, Artificial
  CRISPR gRNA sequence
gtcaggctggtcttgaactc

SEQ ID NO: 385359 - DNA, 20 bp, Artificial
  CRISPR gRNA sequence
gtcttgaactcctgacctca

SEQ ID NO: 385360 - DNA, 20 bp, Artificial
  CRISPR gRNA sequence
gaactcctgacctcatgatc

SEQ ID NO: 385361 - DNA, 20 bp, Artificial
  CRISPR gRNA sequence
aactcctgacctcatgatct

SEQ ID NO: 385362 - DNA, 20 bp, Artificial
  CRISPR gRNA sequence
ctgacctcatgatctgccca

SEQ ID NO: 385363 - DNA, 20 bp, Artificial
  CRISPR gRNA sequence
acctcatgatctgcccacct

SEQ ID NO: 385364 - DNA, 20 bp, Artificial
  CRISPR gRNA sequence
atgatctgcccacctcggcc

SEQ ID NO: 385365 - DNA, 20 bp, Artificial
  CRISPR gRNA sequence
cccacctcggcctcccaaag

SEQ ID NO: 385366 - DNA, 20 bp, Artificial
  CRISPR gRNA sequence
ggcctcccaaagtgctggga

SEQ ID NO: 385367 - DNA, 20 bp, Artificial
  CRISPR gRNA sequence
ccaaagtgctgggattacag

SEQ ID NO: 385368 - DNA, 20 bp, Artificial
  CRISPR gRNA sequence
ggattacaggcgtgagccat

SEQ ID NO: 385369 - DNA, 20 bp, Artificial
  CRISPR gRNA sequence
caggcgtgagccatcgcacc

SEQ ID NO: 385370 - DNA, 20 bp, Artificial
  CRISPR gRNA sequence
tcaatgccaaaacccagaga

SEQ ID NO: 385371 - DNA, 20 bp, Artificial
  CRISPR gRNA sequence
caatgccaaaacccagagag

SEQ ID NO: 385372 - DNA, 20 bp, Artificial
  CRISPR gRNA sequence
aatgccaaaacccagagagc

SEQ ID NO: 385373 - DNA, 20 bp, Artificial
  CRISPR gRNA sequence
cctatccattaatgccagtg

SEQ ID NO: 385374 - DNA, 20 bp, Artificial
  CRISPR gRNA sequence
tccattaatgccagtgttca

SEQ ID NO: 385375 - DNA, 20 bp, Artificial
  CRISPR gRNA sequence
atgccagtgttcacaaggaa

SEQ ID NO: 385376 - DNA, 20 bp, Artificial
  CRISPR gRNA sequence
acaaggaatgtaaaaatata

SEQ ID NO: 385377 - DNA, 20 bp, Artificial
  CRISPR gRNA sequence
acatttttctccctaaatat

SEQ ID NO: 385378 - DNA, 20 bp, Artificial
  CRISPR gRNA sequence
ttctccctaaatattaaatt

SEQ ID NO: 385379 - DNA, 20 bp, Artificial
  CRISPR gRNA sequence
tctccctaaatattaaattt

SEQ ID NO: 385380 - DNA, 20 bp, Artificial
  CRISPR gRNA sequence
ctccctaaatattaaatttc

SEQ ID NO: 385381 - DNA, 20 bp, Artificial
  CRISPR gRNA sequence
tccctaaatattaaatttct

SEQ ID NO: 385382 - DNA, 20 bp, Artificial
  CRISPR gRNA sequence
cctaaatattaaatttcttc

SEQ ID NO: 385383 - DNA, 20 bp, Artificial
  CRISPR gRNA sequence
aatattaaatttcttcctac

SEQ ID NO: 385384 - DNA, 20 bp, Artificial
  CRISPR gRNA sequence
aatttcttcctacactcagg

SEQ ID NO: 385385 - DNA, 20 bp, Artificial
  CRISPR gRNA sequence
cttcctacactcaggtgcac

SEQ ID NO: 385386 - DNA, 20 bp, Artificial
  CRISPR gRNA sequence
ttcctacactcaggtgcaca

SEQ ID NO: 385387 - DNA, 20 bp, Artificial
  CRISPR gRNA sequence
cctacactcaggtgcacatc

SEQ ID NO: 385388 - DNA, 20 bp, Artificial
  CRISPR gRNA sequence
ctacactcaggtgcacatct

SEQ ID NO: 385389 - DNA, 20 bp, Artificial
  CRISPR gRNA sequence
cactcaggtgcacatctata

SEQ ID NO: 385390 - DNA, 20 bp, Artificial
  CRISPR gRNA sequence
aggtgcacatctatagaaca

SEQ ID NO: 385391 - DNA, 20 bp, Artificial
  CRISPR gRNA sequence
tagaacacagtttggctccc

SEQ ID NO: 385392 - DNA, 20 bp, Artificial
  CRISPR gRNA sequence
ggctcccccttttttttttt

SEQ ID NO: 385393 - DNA, 20 bp, Artificial
  CRISPR gRNA sequence
gctccccctttttttttttt

SEQ ID NO: 385394 - DNA, 20 bp, Artificial
  CRISPR gRNA sequence
cccctttttttttttttttt

SEQ ID NO: 385395 - DNA, 20 bp, Artificial
  CRISPR gRNA sequence
ttttttttttttttttttga

SEQ ID NO: 385396 - DNA, 20 bp, Artificial
  CRISPR gRNA sequence
tttttttttttttttttgag

SEQ ID NO: 385397 - DNA, 20 bp, Artificial
  CRISPR gRNA sequence
ttttttttttttttttgaga

SEQ ID NO: 385398 - DNA, 20 bp, Artificial
  CRISPR gRNA sequence
tttttttttttttttgagac

SEQ ID NO: 385399 - DNA, 20 bp, Artificial
  CRISPR gRNA sequence
ttttttttttttttgagaca

SEQ ID NO: 385400 - DNA, 20 bp, Artificial
  CRISPR gRNA sequence
tttttttttttttgagacag

SEQ ID NO: 385401 - DNA, 20 bp, Artificial
  CRISPR gRNA sequence
ttttttttttttgagacaga

SEQ ID NO: 385402 - DNA, 20 bp, Artificial
  CRISPR gRNA sequence
tttttttttttgagacagag

SEQ ID NO: 385403 - DNA, 20 bp, Artificial
  CRISPR gRNA sequence
ttttttttttgagacagagt

SEQ ID NO: 385404 - DNA, 20 bp, Artificial
  CRISPR gRNA sequence
tttttttttgagacagagtc

SEQ ID NO: 385405 - DNA, 20 bp, Artificial
  CRISPR gRNA sequence
ttttttttgagacagagtct

SEQ ID NO: 385406 - DNA, 20 bp, Artificial
  CRISPR gRNA sequence
tttttttgagacagagtctt

SEQ ID NO: 385407 - DNA, 20 bp, Artificial
  CRISPR gRNA sequence
ttttttgagacagagtctta

SEQ ID NO: 385408 - DNA, 20 bp, Artificial
  CRISPR gRNA sequence
tttttgagacagagtcttac

SEQ ID NO: 385409 - DNA, 20 bp, Artificial
  CRISPR gRNA sequence
ttttgagacagagtcttact

SEQ ID NO: 385410 - DNA, 20 bp, Artificial
  CRISPR gRNA sequence
tttgagacagagtcttactc

SEQ ID NO: 385411 - DNA, 20 bp, Artificial
  CRISPR gRNA sequence
ttgagacagagtcttactct

SEQ ID NO: 385412 - DNA, 20 bp, Artificial
  CRISPR gRNA sequence
tgagacagagtcttactctg

SEQ ID NO: 385413 - DNA, 20 bp, Artificial
  CRISPR gRNA sequence
gagacagagtcttactctgt

SEQ ID NO: 385414 - DNA, 20 bp, Artificial
  CRISPR gRNA sequence
agacagagtcttactctgtt

SEQ ID NO: 385415 - DNA, 20 bp, Artificial
  CRISPR gRNA sequence
actctgttacccaggctgga

SEQ ID NO: 385416 - DNA, 20 bp, Artificial
  CRISPR gRNA sequence
ctctgttacccaggctggag

SEQ ID NO: 385417 - DNA, 20 bp, Artificial
  CRISPR gRNA sequence
tgttacccaggctggagtac

SEQ ID NO: 385418 - DNA, 20 bp, Artificial
  CRISPR gRNA sequence
ttacccaggctggagtacag

SEQ ID NO: 385419 - DNA, 20 bp, Artificial
  CRISPR gRNA sequence
cccaggctggagtacagtgg

SEQ ID NO: 385420 - DNA, 20 bp, Artificial
  CRISPR gRNA sequence
gagtacagtggtgcaatctt

SEQ ID NO: 385421 - DNA, 20 bp, Artificial
  CRISPR gRNA sequence
ggctcactgcaacctccatc

SEQ ID NO: 385422 - DNA, 20 bp, Artificial
  CRISPR gRNA sequence
gctcactgcaacctccatct

SEQ ID NO: 385423 - DNA, 20 bp, Artificial
  CRISPR gRNA sequence
actgcaacctccatctcccg

SEQ ID NO: 385424 - DNA, 20 bp, Artificial
  CRISPR gRNA sequence
caacctccatctcccgggtt

SEQ ID NO: 385425 - DNA, 20 bp, Artificial
  CRISPR gRNA sequence
catctcccgggttcaagtga

SEQ ID NO: 385426 - DNA, 20 bp, Artificial
  CRISPR gRNA sequence
ccgggttcaagtgattctcc

SEQ ID NO: 385427 - DNA, 20 bp, Artificial
  CRISPR gRNA sequence
aagtgattctcctgtctcag

SEQ ID NO: 385428 - DNA, 20 bp, Artificial
  CRISPR gRNA sequence
tcctgtctcagcctcctgag

SEQ ID NO: 385429 - DNA, 20 bp, Artificial
  CRISPR gRNA sequence
ctgtctcagcctcctgagta

SEQ ID NO: 385430 - DNA, 20 bp, Artificial
  CRISPR gRNA sequence
tctcagcctcctgagtagct

SEQ ID NO: 385431 - DNA, 20 bp, Artificial
  CRISPR gRNA sequence
agcctcctgagtagctgaga

SEQ ID NO: 385432 - DNA, 20 bp, Artificial
  CRISPR gRNA sequence
ctgagtagctgagactacag

SEQ ID NO: 385433 - DNA, 20 bp, Artificial
  CRISPR gRNA sequence
agtagctgagactacaggca

SEQ ID NO: 385434 - DNA, 20 bp, Artificial
  CRISPR gRNA sequence
agactacaggcacccaccac

SEQ ID NO: 385435 - DNA, 20 bp, Artificial
  CRISPR gRNA sequence
caggcacccaccaccacgcc

SEQ ID NO: 385436 - DNA, 20 bp, Artificial
  CRISPR gRNA sequence
ttgcagttttagtagagatg

SEQ ID NO: 385437 - DNA, 20 bp, Artificial
  CRISPR gRNA sequence
tgcagttttagtagagatgg

SEQ ID NO: 385438 - DNA, 20 bp, Artificial
  CRISPR gRNA sequence
gcagttttagtagagatggg

SEQ ID NO: 385439 - DNA, 20 bp, Artificial
  CRISPR gRNA sequence
cagttttagtagagatgggg

SEQ ID NO: 385440 - DNA, 20 bp, Artificial
  CRISPR gRNA sequence
tagtagagatggggtttcac

SEQ ID NO: 385441 - DNA, 20 bp, Artificial
  CRISPR gRNA sequence
agtagagatggggtttcacc

SEQ ID NO: 385442 - DNA, 20 bp, Artificial
  CRISPR gRNA sequence
gtagagatggggtttcacca

SEQ ID NO: 385443 - DNA, 20 bp, Artificial
  CRISPR gRNA sequence
caccatgttggccaggctgg

SEQ ID NO: 385444 - DNA, 20 bp, Artificial
  CRISPR gRNA sequence
accatgttggccaggctggt

SEQ ID NO: 385445 - DNA, 20 bp, Artificial
  CRISPR gRNA sequence
gccaggctggtctcgaactc

SEQ ID NO: 385446 - DNA, 20 bp, Artificial
  CRISPR gRNA sequence
gtctcgaactcctgacctca

SEQ ID NO: 385447 - DNA, 20 bp, Artificial
  CRISPR gRNA sequence
gaactcctgacctcaaatga

SEQ ID NO: 385448 - DNA, 20 bp, Artificial
  CRISPR gRNA sequence
ctgacctcaaatgatccacc

SEQ ID NO: 385449 - DNA, 20 bp, Artificial
  CRISPR gRNA sequence
acctcaaatgatccacccac

SEQ ID NO: 385450 - DNA, 20 bp, Artificial
  CRISPR gRNA sequence
aaatgatccacccacctcat

SEQ ID NO: 385451 - DNA, 20 bp, Artificial
  CRISPR gRNA sequence
atcctcccaaagtgctggga

SEQ ID NO: 385452 - DNA, 20 bp, Artificial
  CRISPR gRNA sequence
ccaaagtgctgggattacag

SEQ ID NO: 385453 - DNA, 20 bp, Artificial
  CRISPR gRNA sequence
ggattacaggcgtgagccac

SEQ ID NO: 385454 - DNA, 20 bp, Artificial
  CRISPR gRNA sequence
caggcgtgagccaccatgcc

SEQ ID NO: 385455 - DNA, 20 bp, Artificial
  CRISPR gRNA sequence
gccatattttggctcctttc

SEQ ID NO: 385456 - DNA, 20 bp, Artificial
  CRISPR gRNA sequence
tggctcctttcacacttgcc

SEQ ID NO: 385457 - DNA, 20 bp, Artificial
  CRISPR gRNA sequence
ggctcctttcacacttgcca

SEQ ID NO: 385458 - DNA, 20 bp, Artificial
  CRISPR gRNA sequence
gctcctttcacacttgccaa

SEQ ID NO: 385459 - DNA, 20 bp, Artificial
  CRISPR gRNA sequence
ctttcacacttgccaatgtg

SEQ ID NO: 385460 - DNA, 20 bp, Artificial
  CRISPR gRNA sequence
tcacacttgccaatgtgagg

SEQ ID NO: 385461 - DNA, 20 bp, Artificial
  CRISPR gRNA sequence
cacacttgccaatgtgaggc

SEQ ID NO: 385462 - DNA, 20 bp, Artificial
  CRISPR gRNA sequence
acacttgccaatgtgaggct

SEQ ID NO: 385463 - DNA, 20 bp, Artificial
  CRISPR gRNA sequence
gccaatgtgaggctgtttcc

SEQ ID NO: 385464 - DNA, 20 bp, Artificial
  CRISPR gRNA sequence
ccaatgtgaggctgtttccc

SEQ ID NO: 385465 - DNA, 20 bp, Artificial
  CRISPR gRNA sequence
tttccctagccatggtcact

SEQ ID NO: 385466 - DNA, 20 bp, Artificial
  CRISPR gRNA sequence
ccctagccatggtcacttag

SEQ ID NO: 385467 - DNA, 20 bp, Artificial
  CRISPR gRNA sequence
cctagccatggtcacttagt

SEQ ID NO: 385468 - DNA, 20 bp, Artificial
  CRISPR gRNA sequence
gccatggtcacttagtcgtg

SEQ ID NO: 385469 - DNA, 20 bp, Artificial
  CRISPR gRNA sequence
agtcgtgttactgttgctat

SEQ ID NO: 385470 - DNA, 20 bp, Artificial
  CRISPR gRNA sequence
gtcgtgttactgttgctatc

SEQ ID NO: 385471 - DNA, 20 bp, Artificial
  CRISPR gRNA sequence
ctgttgctatctctgcatga

SEQ ID NO: 385472 - DNA, 20 bp, Artificial
  CRISPR gRNA sequence
ttgctatctctgcatgaaaa

SEQ ID NO: 385473 - DNA, 20 bp, Artificial
  CRISPR gRNA sequence
ctatctctgcatgaaaacag

SEQ ID NO: 385474 - DNA, 20 bp, Artificial
  CRISPR gRNA sequence
tctctgcatgaaaacagcac

SEQ ID NO: 385475 - DNA, 20 bp, Artificial
  CRISPR gRNA sequence
tgcatgaaaacagcacaaac

SEQ ID NO: 385476 - DNA, 20 bp, Artificial
  CRISPR gRNA sequence
catgaaaacagcacaaacca

SEQ ID NO: 385477 - DNA, 20 bp, Artificial
  CRISPR gRNA sequence
ccgccaatccctccaacaca

SEQ ID NO: 385478 - DNA, 20 bp, Artificial
  CRISPR gRNA sequence
caacacacaggctaccaggc

SEQ ID NO: 385479 - DNA, 20 bp, Artificial
  CRISPR gRNA sequence
ccaggcactgagtgtgaagt

SEQ ID NO: 385480 - DNA, 20 bp, Artificial
  CRISPR gRNA sequence
agtgtgaagtattcagtttt

SEQ ID NO: 385481 - DNA, 20 bp, Artificial
  CRISPR gRNA sequence
agttttgttcagggacactg

SEQ ID NO: 385482 - DNA, 20 bp, Artificial
  CRISPR gRNA sequence
tgttcagggacactgtctga

SEQ ID NO: 385483 - DNA, 20 bp, Artificial
  CRISPR gRNA sequence
gttcagggacactgtctgat

SEQ ID NO: 385484 - DNA, 20 bp, Artificial
  CRISPR gRNA sequence
ttcagggacactgtctgatt

SEQ ID NO: 385485 - DNA, 20 bp, Artificial
  CRISPR gRNA sequence
agggacactgtctgatttat

SEQ ID NO: 385486 - DNA, 20 bp, Artificial
  CRISPR gRNA sequence
tctgatttatgttggcttct

SEQ ID NO: 385487 - DNA, 20 bp, Artificial
  CRISPR gRNA sequence
atttatgttggcttctatcc

SEQ ID NO: 385488 - DNA, 20 bp, Artificial
  CRISPR gRNA sequence
atgttggcttctatccaagt

SEQ ID NO: 385489 - DNA, 20 bp, Artificial
  CRISPR gRNA sequence
tgttggcttctatccaagtc

SEQ ID NO: 385490 - DNA, 20 bp, Artificial
  CRISPR gRNA sequence
gcttctatccaagtcaatac

SEQ ID NO: 385491 - DNA, 20 bp, Artificial
  CRISPR gRNA sequence
ctatccaagtcaatacatct

SEQ ID NO: 385492 - DNA, 20 bp, Artificial
  CRISPR gRNA sequence
tatccaagtcaatacatctg

SEQ ID NO: 385493 - DNA, 20 bp, Artificial
  CRISPR gRNA sequence
tccaagtcaatacatctgaa

SEQ ID NO: 385494 - DNA, 20 bp, Artificial
  CRISPR gRNA sequence
aagctgcaggattattttaa

SEQ ID NO: 385495 - DNA, 20 bp, Artificial
  CRISPR gRNA sequence
caggattattttaaacagtc

SEQ ID NO: 385496 - DNA, 20 bp, Artificial
  CRISPR gRNA sequence
ttttaaacagtcagtaaaac

SEQ ID NO: 385497 - DNA, 20 bp, Artificial
  CRISPR gRNA sequence
taaacagtcagtaaaacgga

SEQ ID NO: 385498 - DNA, 20 bp, Artificial
  CRISPR gRNA sequence
aaacagtcagtaaaacggag

SEQ ID NO: 385499 - DNA, 20 bp, Artificial
  CRISPR gRNA sequence
aacagtcagtaaaacggagt

SEQ ID NO: 385500 - DNA, 20 bp, Artificial
  CRISPR gRNA sequence
agaaggtcattgttggagcc

SEQ ID NO: 385501 - DNA, 20 bp, Artificial
  CRISPR gRNA sequence
ttggagcccttgggtcatct

SEQ ID NO: 385502 - DNA, 20 bp, Artificial
  CRISPR gRNA sequence
gagcccttgggtcatctttc

SEQ ID NO: 385503 - DNA, 20 bp, Artificial
  CRISPR gRNA sequence
gggtcatctttcgaagcatt

SEQ ID NO: 385504 - DNA, 20 bp, Artificial
  CRISPR gRNA sequence
ggtcatctttcgaagcattt

SEQ ID NO: 385505 - DNA, 20 bp, Artificial
  CRISPR gRNA sequence
tcgaagcatttctattggaa

SEQ ID NO: 385506 - DNA, 20 bp, Artificial
  CRISPR gRNA sequence
cgaagcatttctattggaag

SEQ ID NO: 385507 - DNA, 20 bp, Artificial
  CRISPR gRNA sequence
gaagcatttctattggaagt

SEQ ID NO: 385508 - DNA, 20 bp, Artificial
  CRISPR gRNA sequence
ctattggaagtaacaaccac

SEQ ID NO: 385509 - DNA, 20 bp, Artificial
  CRISPR gRNA sequence
tattggaagtaacaaccaca

SEQ ID NO: 385510 - DNA, 20 bp, Artificial
  CRISPR gRNA sequence
ttggaagtaacaaccacaaa

SEQ ID NO: 385511 - DNA, 20 bp, Artificial
  CRISPR gRNA sequence
gaagtaacaaccacaaactg

SEQ ID NO: 385512 - DNA, 20 bp, Artificial
  CRISPR gRNA sequence
atactagtgacgaggcagaa

SEQ ID NO: 385513 - DNA, 20 bp, Artificial
  CRISPR gRNA sequence
gtgacgaggcagaaggaaca

SEQ ID NO: 385514 - DNA, 20 bp, Artificial
  CRISPR gRNA sequence
ttcccttgtggtgtgcatcc

SEQ ID NO: 385515 - DNA, 20 bp, Artificial
  CRISPR gRNA sequence
tcccttgtggtgtgcatcca

SEQ ID NO: 385516 - DNA, 20 bp, Artificial
  CRISPR gRNA sequence
cccttgtggtgtgcatccat

SEQ ID NO: 385517 - DNA, 20 bp, Artificial
  CRISPR gRNA sequence
ccttgtggtgtgcatccatg

SEQ ID NO: 385518 - DNA, 20 bp, Artificial
  CRISPR gRNA sequence
gtggtgtgcatccatgatta

SEQ ID NO: 385519 - DNA, 20 bp, Artificial
  CRISPR gRNA sequence
tggtgtgcatccatgattac

SEQ ID NO: 385520 - DNA, 20 bp, Artificial
  CRISPR gRNA sequence
caaattcaagtccactaatc

SEQ ID NO: 385521 - DNA, 20 bp, Artificial
  CRISPR gRNA sequence
aagtccactaatctcctttt

SEQ ID NO: 385522 - DNA, 20 bp, Artificial
  CRISPR gRNA sequence
atctccttttatcacattta

SEQ ID NO: 385523 - DNA, 20 bp, Artificial
  CRISPR gRNA sequence
cttttatcacatttaaccaa

SEQ ID NO: 385524 - DNA, 20 bp, Artificial
  CRISPR gRNA sequence
ttatcacatttaaccaagtg

SEQ ID NO: 385525 - DNA, 20 bp, Artificial
  CRISPR gRNA sequence
tatcacatttaaccaagtgg

SEQ ID NO: 385526 - DNA, 20 bp, Artificial
  CRISPR gRNA sequence
atcacatttaaccaagtggg

SEQ ID NO: 385527 - DNA, 20 bp, Artificial
  CRISPR gRNA sequence
tcacatttaaccaagtggga

SEQ ID NO: 385528 - DNA, 20 bp, Artificial
  CRISPR gRNA sequence
aaccaagtgggacaatgtat

SEQ ID NO: 385529 - DNA, 20 bp, Artificial
  CRISPR gRNA sequence
accaagtgggacaatgtatt

SEQ ID NO: 385530 - DNA, 20 bp, Artificial
  CRISPR gRNA sequence
taccgttcaatttagctatt

SEQ ID NO: 385531 - DNA, 20 bp, Artificial
  CRISPR gRNA sequence
ccgttcaatttagctattca

SEQ ID NO: 385532 - DNA, 20 bp, Artificial
  CRISPR gRNA sequence
aatttagctattcatgtaaa

SEQ ID NO: 385533 - DNA, 20 bp, Artificial
  CRISPR gRNA sequence
agctattcatgtaaaagtaa

SEQ ID NO: 385534 - DNA, 20 bp, Artificial
  CRISPR gRNA sequence
gctattcatgtaaaagtaat

SEQ ID NO: 385535 - DNA, 20 bp, Artificial
  CRISPR gRNA sequence
ttcatgtaaaagtaatgcat

SEQ ID NO: 385536 - DNA, 20 bp, Artificial
  CRISPR gRNA sequence
atgtaaaagtaatgcataat

SEQ ID NO: 385537 - DNA, 20 bp, Artificial
  CRISPR gRNA sequence
tcatgaagcaaaatttttca

SEQ ID NO: 385538 - DNA, 20 bp, Artificial
  CRISPR gRNA sequence
catgaagcaaaatttttcat

SEQ ID NO: 385539 - DNA, 20 bp, Artificial
  CRISPR gRNA sequence
atgaagcaaaatttttcatg

SEQ ID NO: 385540 - DNA, 20 bp, Artificial
  CRISPR gRNA sequence
ttcatgaagcaaaatctatc

SEQ ID NO: 385541 - DNA, 20 bp, Artificial
  CRISPR gRNA sequence
tcatgaagcaaaatctatca

SEQ ID NO: 385542 - DNA, 20 bp, Artificial
  CRISPR gRNA sequence
catgaagcaaaatctatcat

SEQ ID NO: 385543 - DNA, 20 bp, Artificial
  CRISPR gRNA sequence
atgaagcaaaatctatcatg

SEQ ID NO: 385544 - DNA, 20 bp, Artificial
  CRISPR gRNA sequence
tcatgtccaacatctgtgac

SEQ ID NO: 385545 - DNA, 20 bp, Artificial
  CRISPR gRNA sequence
tgaccctgtggaggtttgtc

SEQ ID NO: 385546 - DNA, 20 bp, Artificial
  CRISPR gRNA sequence
tggaggtttgtcaccactcg

SEQ ID NO: 385547 - DNA, 20 bp, Artificial
  CRISPR gRNA sequence
gtcaccactcgctgtctctt

SEQ ID NO: 385548 - DNA, 20 bp, Artificial
  CRISPR gRNA sequence
tcaccactcgctgtctctta

SEQ ID NO: 385549 - DNA, 20 bp, Artificial
  CRISPR gRNA sequence
gctgtctcttagtcacattt

SEQ ID NO: 385550 - DNA, 20 bp, Artificial
  CRISPR gRNA sequence
tctcttagtcacatttgccc

SEQ ID NO: 385551 - DNA, 20 bp, Artificial
  CRISPR gRNA sequence
ttagtcacatttgcccggtt

SEQ ID NO: 385552 - DNA, 20 bp, Artificial
  CRISPR gRNA sequence
agtcacatttgcccggttcc

SEQ ID NO: 385553 - DNA, 20 bp, Artificial
  CRISPR gRNA sequence
gtcacatttgcccggttccc

SEQ ID NO: 385554 - DNA, 20 bp, Artificial
  CRISPR gRNA sequence
gcccggttcccatgtgctcc

SEQ ID NO: 385555 - DNA, 20 bp, Artificial
  CRISPR gRNA sequence
cccggttcccatgtgctccc

SEQ ID NO: 385556 - DNA, 20 bp, Artificial
  CRISPR gRNA sequence
ccatgtgctccctctgccat

SEQ ID NO: 385557 - DNA, 20 bp, Artificial
  CRISPR gRNA sequence
cctctgccatctctgccccc

SEQ ID NO: 385558 - DNA, 20 bp, Artificial
  CRISPR gRNA sequence
tgccatctctgcccccagga

SEQ ID NO: 385559 - DNA, 20 bp, Artificial
  CRISPR gRNA sequence
ccatctctgcccccaggatg

SEQ ID NO: 385560 - DNA, 20 bp, Artificial
  CRISPR gRNA sequence
tgcccccaggatgtttccca

SEQ ID NO: 385561 - DNA, 20 bp, Artificial
  CRISPR gRNA sequence
cccccaggatgtttcccatt

SEQ ID NO: 385562 - DNA, 20 bp, Artificial
  CRISPR gRNA sequence
cccattgccaaggtgaaaaa

SEQ ID NO: 385563 - DNA, 20 bp, Artificial
  CRISPR gRNA sequence
ccattgccaaggtgaaaaag

SEQ ID NO: 385564 - DNA, 20 bp, Artificial
  CRISPR gRNA sequence
ccaaggtgaaaaagtggaag

SEQ ID NO: 385565 - DNA, 20 bp, Artificial
  CRISPR gRNA sequence
ctaacacctcggttccttac

SEQ ID NO: 385566 - DNA, 20 bp, Artificial
  CRISPR gRNA sequence
acacctcggttccttacttc

SEQ ID NO: 385567 - DNA, 20 bp, Artificial
  CRISPR gRNA sequence
ggttccttacttcaatttgc

SEQ ID NO: 385568 - DNA, 20 bp, Artificial
  CRISPR gRNA sequence
cttacttcaatttgctaatt

SEQ ID NO: 385569 - DNA, 20 bp, Artificial
  CRISPR gRNA sequence
acttcaatttgctaatttct

SEQ ID NO: 385570 - DNA, 20 bp, Artificial
  CRISPR gRNA sequence
cttcaatttgctaatttctg

SEQ ID NO: 385571 - DNA, 20 bp, Artificial
  CRISPR gRNA sequence
caatttgctaatttctgttc

SEQ ID NO: 385572 - DNA, 20 bp, Artificial
  CRISPR gRNA sequence
aatttgctaatttctgttca

SEQ ID NO: 385573 - DNA, 20 bp, Artificial
  CRISPR gRNA sequence
gctaatttctgttcagggaa

SEQ ID NO: 385574 - DNA, 20 bp, Artificial
  CRISPR gRNA sequence
ctaatttctgttcagggaaa

SEQ ID NO: 385575 - DNA, 20 bp, Artificial
  CRISPR gRNA sequence
atttctgttcagggaaagac

SEQ ID NO: 385576 - DNA, 20 bp, Artificial
  CRISPR gRNA sequence
ctgttcagggaaagacttaa

SEQ ID NO: 385577 - DNA, 20 bp, Artificial
  CRISPR gRNA sequence
tgttcagggaaagacttaag

SEQ ID NO: 385578 - DNA, 20 bp, Artificial
  CRISPR gRNA sequence
ttcagggaaagacttaaggg

SEQ ID NO: 385579 - DNA, 20 bp, Artificial
  CRISPR gRNA sequence
agggaaagacttaagggcag

SEQ ID NO: 385580 - DNA, 20 bp, Artificial
  CRISPR gRNA sequence
aagggcagtccgtgatgggg

SEQ ID NO: 385581 - DNA, 20 bp, Artificial
  CRISPR gRNA sequence
agggcagtccgtgatgggga

SEQ ID NO: 385582 - DNA, 20 bp, Artificial
  CRISPR gRNA sequence
acctcctgttttagtttaat

SEQ ID NO: 385583 - DNA, 20 bp, Artificial
  CRISPR gRNA sequence
ctgttttagtttaattagac

SEQ ID NO: 385584 - DNA, 20 bp, Artificial
  CRISPR gRNA sequence
ttttagtttaattagacaaa

SEQ ID NO: 385585 - DNA, 20 bp, Artificial
  CRISPR gRNA sequence
tagtttaattagacaaatgt

SEQ ID NO: 385586 - DNA, 20 bp, Artificial
  CRISPR gRNA sequence
agtttaattagacaaatgtt

SEQ ID NO: 385587 - DNA, 20 bp, Artificial
  CRISPR gRNA sequence
gtttaattagacaaatgttt

SEQ ID NO: 385588 - DNA, 20 bp, Artificial
  CRISPR gRNA sequence
aattagacaaatgtttattg

SEQ ID NO: 385589 - DNA, 20 bp, Artificial
  CRISPR gRNA sequence
attagacaaatgtttattga

SEQ ID NO: 385590 - DNA, 20 bp, Artificial
  CRISPR gRNA sequence
gacaaatgtttattgagcat

SEQ ID NO: 385591 - DNA, 20 bp, Artificial
  CRISPR gRNA sequence
attgagcattcattatttgg

SEQ ID NO: 385592 - DNA, 20 bp, Artificial
  CRISPR gRNA sequence
ttgagcattcattatttgga

SEQ ID NO: 385593 - DNA, 20 bp, Artificial
  CRISPR gRNA sequence
agcattcattatttggacag

SEQ ID NO: 385594 - DNA, 20 bp, Artificial
  CRISPR gRNA sequence
attatttggacagattagtg

SEQ ID NO: 385595 - DNA, 20 bp, Artificial
  CRISPR gRNA sequence
tttggacagattagtgctaa

SEQ ID NO: 385596 - DNA, 20 bp, Artificial
  CRISPR gRNA sequence
ggacagattagtgctaaatg

SEQ ID NO: 385597 - DNA, 20 bp, Artificial
  CRISPR gRNA sequence
gacagattagtgctaaatgc

SEQ ID NO: 385598 - DNA, 20 bp, Artificial
  CRISPR gRNA sequence
gtgctaaatgctaccaaatg

SEQ ID NO: 385599 - DNA, 20 bp, Artificial
  CRISPR gRNA sequence
aatgctaccaaatgctaaaa

SEQ ID NO: 385600 - DNA, 20 bp, Artificial
  CRISPR gRNA sequence
ccaaatgctaaaaaatgaat

SEQ ID NO: 385601 - DNA, 20 bp, Artificial
  CRISPR gRNA sequence
aaaaatgaatgaaacacaaa

SEQ ID NO: 385602 - DNA, 20 bp, Artificial
  CRISPR gRNA sequence
tgccattatgaatagaaggg

SEQ ID NO: 385603 - DNA, 20 bp, Artificial
  CRISPR gRNA sequence
ccattatgaatagaagggat

SEQ ID NO: 385604 - DNA, 20 bp, Artificial
  CRISPR gRNA sequence
tgaatagaagggatggcaag

SEQ ID NO: 385605 - DNA, 20 bp, Artificial
  CRISPR gRNA sequence
aaatacaaagcaggatgtga

SEQ ID NO: 385606 - DNA, 20 bp, Artificial
  CRISPR gRNA sequence
cagatggtgacatcatgtct

SEQ ID NO: 385607 - DNA, 20 bp, Artificial
  CRISPR gRNA sequence
tttgcagggacagagaacag

SEQ ID NO: 385608 - DNA, 20 bp, Artificial
  CRISPR gRNA sequence
gcagggacagagaacagtac

SEQ ID NO: 385609 - DNA, 20 bp, Artificial
  CRISPR gRNA sequence
cagggacagagaacagtaca

SEQ ID NO: 385610 - DNA, 20 bp, Artificial
  CRISPR gRNA sequence
acagaggggacaggtgtttc

SEQ ID NO: 385611 - DNA, 20 bp, Artificial
  CRISPR gRNA sequence
cacaccttgaatgatacata

SEQ ID NO: 385612 - DNA, 20 bp, Artificial
  CRISPR gRNA sequence
acaccttgaatgatacatag

SEQ ID NO: 385613 - DNA, 20 bp, Artificial
  CRISPR gRNA sequence
gaatgatacataggaatgca

SEQ ID NO: 385614 - DNA, 20 bp, Artificial
  CRISPR gRNA sequence
aatgatacataggaatgcag

SEQ ID NO: 385615 - DNA, 20 bp, Artificial
  CRISPR gRNA sequence
tggtagcaaaccagatgggg

SEQ ID NO: 385616 - DNA, 20 bp, Artificial
  CRISPR gRNA sequence
ggtagcaaaccagatgggga

SEQ ID NO: 385617 - DNA, 20 bp, Artificial
  CRISPR gRNA sequence
gtagcaaaccagatggggag

SEQ ID NO: 385618 - DNA, 20 bp, Artificial
  CRISPR gRNA sequence
cagtttccacaaaatttatc

SEQ ID NO: 385619 - DNA, 20 bp, Artificial
  CRISPR gRNA sequence
agtttccacaaaatttatca

SEQ ID NO: 385620 - DNA, 20 bp, Artificial
  CRISPR gRNA sequence
ccacaaaatttatcaacatc

SEQ ID NO: 385621 - DNA, 20 bp, Artificial
  CRISPR gRNA sequence
cacaaaatttatcaacatcc

SEQ ID NO: 385622 - DNA, 20 bp, Artificial
  CRISPR gRNA sequence
atcaacatccgggagattaa

SEQ ID NO: 385623 - DNA, 20 bp, Artificial
  CRISPR gRNA sequence
tcaacatccgggagattaaa

SEQ ID NO: 385624 - DNA, 20 bp, Artificial
  CRISPR gRNA sequence
aataaagtagaaagtatgaa

SEQ ID NO: 385625 - DNA, 20 bp, Artificial
  CRISPR gRNA sequence
ggcttcagtcagggttaatg

SEQ ID NO: 385626 - DNA, 20 bp, Artificial
  CRISPR gRNA sequence
cagtcagggttaatgacagg

SEQ ID NO: 385627 - DNA, 20 bp, Artificial
  CRISPR gRNA sequence
agtcagggttaatgacaggg

SEQ ID NO: 385628 - DNA, 20 bp, Artificial
  CRISPR gRNA sequence
atgacagggttaatgagttt

SEQ ID NO: 385629 - DNA, 20 bp, Artificial
  CRISPR gRNA sequence
atgagttttaacattattct

SEQ ID NO: 385630 - DNA, 20 bp, Artificial
  CRISPR gRNA sequence
taacattattctggtaggag

SEQ ID NO: 385631 - DNA, 20 bp, Artificial
  CRISPR gRNA sequence
aacattattctggtaggagt

SEQ ID NO: 385632 - DNA, 20 bp, Artificial
  CRISPR gRNA sequence
acattattctggtaggagtg

SEQ ID NO: 385633 - DNA, 20 bp, Artificial
  CRISPR gRNA sequence
ttctggtaggagtgggaaga

SEQ ID NO: 385634 - DNA, 20 bp, Artificial
  CRISPR gRNA sequence
tggtaggagtgggaagataa

SEQ ID NO: 385635 - DNA, 20 bp, Artificial
  CRISPR gRNA sequence
gtaggagtgggaagataacc

SEQ ID NO: 385636 - DNA, 20 bp, Artificial
  CRISPR gRNA sequence
aacaggaagatgacatgcca

SEQ ID NO: 385637 - DNA, 20 bp, Artificial
  CRISPR gRNA sequence
cagaagaagacccagggaaa

SEQ ID NO: 385638 - DNA, 20 bp, Artificial
  CRISPR gRNA sequence
agaagaagacccagggaaac

SEQ ID NO: 385639 - DNA, 20 bp, Artificial
  CRISPR gRNA sequence
gatgggttagagaaagaggc

SEQ ID NO: 385640 - DNA, 20 bp, Artificial
  CRISPR gRNA sequence
gagaaagaggctacagctga

SEQ ID NO: 385641 - DNA, 20 bp, Artificial
  CRISPR gRNA sequence
cagctgagagcaggctggag

SEQ ID NO: 385642 - DNA, 20 bp, Artificial
  CRISPR gRNA sequence
agagcaggctggagacgtta

SEQ ID NO: 385643 - DNA, 20 bp, Artificial
  CRISPR gRNA sequence
gagacgttaccaaaaccagg

SEQ ID NO: 385644 - DNA, 20 bp, Artificial
  CRISPR gRNA sequence
ccaaaaccagggagcagtga

SEQ ID NO: 385645 - DNA, 20 bp, Artificial
  CRISPR gRNA sequence
ctaaagagccagaggtcaag

SEQ ID NO: 385646 - DNA, 20 bp, Artificial
  CRISPR gRNA sequence
aagagccagaggtcaaggat

SEQ ID NO: 385647 - DNA, 20 bp, Artificial
  CRISPR gRNA sequence
gaaatcctattaacaagggg

SEQ ID NO: 385648 - DNA, 20 bp, Artificial
  CRISPR gRNA sequence
ttaacaaggggtgtgtgtgt

SEQ ID NO: 385649 - DNA, 20 bp, Artificial
  CRISPR gRNA sequence
acaaggggtgtgtgtgtgtg

SEQ ID NO: 385650 - DNA, 20 bp, Artificial
  CRISPR gRNA sequence
ggtaacattactgaaggaga

SEQ ID NO: 385651 - DNA, 20 bp, Artificial
  CRISPR gRNA sequence
gtaacattactgaaggagag

SEQ ID NO: 385652 - DNA, 20 bp, Artificial
  CRISPR gRNA sequence
ctgaaggagaggagtgcaga

SEQ ID NO: 385653 - DNA, 20 bp, Artificial
  CRISPR gRNA sequence
aaggagaggagtgcagatgg

SEQ ID NO: 385654 - DNA, 20 bp, Artificial
  CRISPR gRNA sequence
acctacccagcaaacatata

SEQ ID NO: 385655 - DNA, 20 bp, Artificial
  CRISPR gRNA sequence
cccagcaaacatatattaag

SEQ ID NO: 385656 - DNA, 20 bp, Artificial
  CRISPR gRNA sequence
agtatctatgatatgccaga

SEQ ID NO: 385657 - DNA, 20 bp, Artificial
  CRISPR gRNA sequence
tgatatgccagacatgaaaa

SEQ ID NO: 385658 - DNA, 20 bp, Artificial
  CRISPR gRNA sequence
cctcccctaagaagataaca

SEQ ID NO: 385659 - DNA, 20 bp, Artificial
  CRISPR gRNA sequence
ctcccctaagaagataacac

SEQ ID NO: 385660 - DNA, 20 bp, Artificial
  CRISPR gRNA sequence
ccctaagaagataacacttt

SEQ ID NO: 385661 - DNA, 20 bp, Artificial
  CRISPR gRNA sequence
agaagataacactttagctg

SEQ ID NO: 385662 - DNA, 20 bp, Artificial
  CRISPR gRNA sequence
tagctgtaatacattataag

SEQ ID NO: 385663 - DNA, 20 bp, Artificial
  CRISPR gRNA sequence
agctgtaatacattataagg

SEQ ID NO: 385664 - DNA, 20 bp, Artificial
  CRISPR gRNA sequence
gctgtaatacattataagga

SEQ ID NO: 385665 - DNA, 20 bp, Artificial
  CRISPR gRNA sequence
taatacattataaggaataa

SEQ ID NO: 385666 - DNA, 20 bp, Artificial
  CRISPR gRNA sequence
taaggaataatttcaacctg

SEQ ID NO: 385667 - DNA, 20 bp, Artificial
  CRISPR gRNA sequence
caacctgctatgattacagc

SEQ ID NO: 385668 - DNA, 20 bp, Artificial
  CRISPR gRNA sequence
aacctgctatgattacagca

SEQ ID NO: 385669 - DNA, 20 bp, Artificial
  CRISPR gRNA sequence
ctatgattacagcagatatg

SEQ ID NO: 385670 - DNA, 20 bp, Artificial
  CRISPR gRNA sequence
tgattacagcagatatgtaa

SEQ ID NO: 385671 - DNA, 20 bp, Artificial
  CRISPR gRNA sequence
cagcagatatgtaacaaata

SEQ ID NO: 385672 - DNA, 20 bp, Artificial
  CRISPR gRNA sequence
cacaagtgagctgataagca

SEQ ID NO: 385673 - DNA, 20 bp, Artificial
  CRISPR gRNA sequence
ataagcacaggagaactaga

SEQ ID NO: 385674 - DNA, 20 bp, Artificial
  CRISPR gRNA sequence
gaaggggaagaaaaactcag

SEQ ID NO: 385675 - DNA, 20 bp, Artificial
  CRISPR gRNA sequence
agccaagaatatcctagaaa

SEQ ID NO: 385676 - DNA, 20 bp, Artificial
  CRISPR gRNA sequence
gaaaattcccaactgtgcta

SEQ ID NO: 385677 - DNA, 20 bp, Artificial
  CRISPR gRNA sequence
ccaactgtgctacaatacag

SEQ ID NO: 385678 - DNA, 20 bp, Artificial
  CRISPR gRNA sequence
tgctacaatacagtaaaagg

SEQ ID NO: 385679 - DNA, 20 bp, Artificial
  CRISPR gRNA sequence
caatacagtaaaaggttttt

SEQ ID NO: 385680 - DNA, 20 bp, Artificial
  CRISPR gRNA sequence
ttttaatttttaatttttgt

SEQ ID NO: 385681 - DNA, 20 bp, Artificial
  CRISPR gRNA sequence
tttaatttttaatttttgtt

SEQ ID NO: 385682 - DNA, 20 bp, Artificial
  CRISPR gRNA sequence
ttaatttttaatttttgtta

SEQ ID NO: 385683 - DNA, 20 bp, Artificial
  CRISPR gRNA sequence
taatttttaatttttgttat

SEQ ID NO: 385684 - DNA, 20 bp, Artificial
  CRISPR gRNA sequence
aatttttaatttttgttatt

SEQ ID NO: 385685 - DNA, 20 bp, Artificial
  CRISPR gRNA sequence
atttttaatttttgttattg

SEQ ID NO: 385686 - DNA, 20 bp, Artificial
  CRISPR gRNA sequence
ttaatttttgttattgacag

SEQ ID NO: 385687 - DNA, 20 bp, Artificial
  CRISPR gRNA sequence
taatttttgttattgacagg

SEQ ID NO: 385688 - DNA, 20 bp, Artificial
  CRISPR gRNA sequence
aatttttgttattgacaggg

SEQ ID NO: 385689 - DNA, 20 bp, Artificial
  CRISPR gRNA sequence
atttttgttattgacagggt

SEQ ID NO: 385690 - DNA, 20 bp, Artificial
  CRISPR gRNA sequence
ttgttattgacagggtcttg

SEQ ID NO: 385691 - DNA, 20 bp, Artificial
  CRISPR gRNA sequence
tgttattgacagggtcttgc

SEQ ID NO: 385692 - DNA, 20 bp, Artificial
  CRISPR gRNA sequence
gttattgacagggtcttgct

SEQ ID NO: 385693 - DNA, 20 bp, Artificial
  CRISPR gRNA sequence
ttattgacagggtcttgcta

SEQ ID NO: 385694 - DNA, 20 bp, Artificial
  CRISPR gRNA sequence
ttgacagggtcttgctatgt

SEQ ID NO: 385695 - DNA, 20 bp, Artificial
  CRISPR gRNA sequence
acagggtcttgctatgttgc

SEQ ID NO: 385696 - DNA, 20 bp, Artificial
  CRISPR gRNA sequence
gctatgttgcccaggctgga

SEQ ID NO: 385697 - DNA, 20 bp, Artificial
  CRISPR gRNA sequence
ctatgttgcccaggctggac

SEQ ID NO: 385698 - DNA, 20 bp, Artificial
  CRISPR gRNA sequence
tgttgcccaggctggactcg

SEQ ID NO: 385699 - DNA, 20 bp, Artificial
  CRISPR gRNA sequence
cccaggctggactcgaactc

SEQ ID NO: 385700 - DNA, 20 bp, Artificial
  CRISPR gRNA sequence
gactcgaactcttggactca

SEQ ID NO: 385701 - DNA, 20 bp, Artificial
  CRISPR gRNA sequence
gaactcttggactcaagcaa

SEQ ID NO: 385702 - DNA, 20 bp, Artificial
  CRISPR gRNA sequence
ttggactcaagcaatcctcc

SEQ ID NO: 385703 - DNA, 20 bp, Artificial
  CRISPR gRNA sequence
ggactcaagcaatcctccag

SEQ ID NO: 385704 - DNA, 20 bp, Artificial
  CRISPR gRNA sequence
gactcaagcaatcctccagc

SEQ ID NO: 385705 - DNA, 20 bp, Artificial
  CRISPR gRNA sequence
aagcaatcctccagcctcag

SEQ ID NO: 385706 - DNA, 20 bp, Artificial
  CRISPR gRNA sequence
cagcctcagcctcctgagta

SEQ ID NO: 385707 - DNA, 20 bp, Artificial
  CRISPR gRNA sequence
agcctcctgagtagctggaa

SEQ ID NO: 385708 - DNA, 20 bp, Artificial
  CRISPR gRNA sequence
ctgagtagctggaacttcag

SEQ ID NO: 385709 - DNA, 20 bp, Artificial
  CRISPR gRNA sequence
agtagctggaacttcaggca

SEQ ID NO: 385710 - DNA, 20 bp, Artificial
  CRISPR gRNA sequence
gaacttcaggcacatatcac

SEQ ID NO: 385711 - DNA, 20 bp, Artificial
  CRISPR gRNA sequence
caggcacatatcactgtgac

SEQ ID NO: 385712 - DNA, 20 bp, Artificial
  CRISPR gRNA sequence
aggcacatatcactgtgacc

SEQ ID NO: 385713 - DNA, 20 bp, Artificial
  CRISPR gRNA sequence
tgaccagccaataaaagatt

SEQ ID NO: 385714 - DNA, 20 bp, Artificial
  CRISPR gRNA sequence
aaaaaaatttagtataggcc

SEQ ID NO: 385715 - DNA, 20 bp, Artificial
  CRISPR gRNA sequence
agtataggccaaatggctcc

SEQ ID NO: 385716 - DNA, 20 bp, Artificial
  CRISPR gRNA sequence
gtataggccaaatggctccc

SEQ ID NO: 385717 - DNA, 20 bp, Artificial
  CRISPR gRNA sequence
cctgctgtctctaaggcagc

SEQ ID NO: 385718 - DNA, 20 bp, Artificial
  CRISPR gRNA sequence
ctgtctctaaggcagcaccc

SEQ ID NO: 385719 - DNA, 20 bp, Artificial
  CRISPR gRNA sequence
tctctaaggcagcaccctcc

SEQ ID NO: 385720 - DNA, 20 bp, Artificial
  CRISPR gRNA sequence
taaggcagcaccctccaatt

SEQ ID NO: 385721 - DNA, 20 bp, Artificial
  CRISPR gRNA sequence
aggcagcaccctccaattcc

SEQ ID NO: 385722 - DNA, 20 bp, Artificial
  CRISPR gRNA sequence
caattccttcttctcagtaa

SEQ ID NO: 385723 - DNA, 20 bp, Artificial
  CRISPR gRNA sequence
cttcttctcagtaattttaa

SEQ ID NO: 385724 - DNA, 20 bp, Artificial
  CRISPR gRNA sequence
cttctcagtaattttaagca

SEQ ID NO: 385725 - DNA, 20 bp, Artificial
  CRISPR gRNA sequence
ttctcagtaattttaagcac

SEQ ID NO: 385726 - DNA, 20 bp, Artificial
  CRISPR gRNA sequence
ctcagtaattttaagcacct

SEQ ID NO: 385727 - DNA, 20 bp, Artificial
  CRISPR gRNA sequence
tcagtaattttaagcaccta

SEQ ID NO: 385728 - DNA, 20 bp, Artificial
  CRISPR gRNA sequence
agtaattttaagcacctaga

SEQ ID NO: 385729 - DNA, 20 bp, Artificial
  CRISPR gRNA sequence
taagcacctagatttcttgg

SEQ ID NO: 385730 - DNA, 20 bp, Artificial
  CRISPR gRNA sequence
aagcacctagatttcttggt

SEQ ID NO: 385731 - DNA, 20 bp, Artificial
  CRISPR gRNA sequence
agcacctagatttcttggtt

SEQ ID NO: 385732 - DNA, 20 bp, Artificial
  CRISPR gRNA sequence
gatttcttggttctgagaat

SEQ ID NO: 385733 - DNA, 20 bp, Artificial
  CRISPR gRNA sequence
cttggttctgagaatataca

SEQ ID NO: 385734 - DNA, 20 bp, Artificial
  CRISPR gRNA sequence
ttggttctgagaatatacaa

SEQ ID NO: 385735 - DNA, 20 bp, Artificial
  CRISPR gRNA sequence
ggttctgagaatatacaact

SEQ ID NO: 385736 - DNA, 20 bp, Artificial
  CRISPR gRNA sequence
gttctgagaatatacaacta

SEQ ID NO: 385737 - DNA, 20 bp, Artificial
  CRISPR gRNA sequence
tgagaatatacaactatttg

SEQ ID NO: 385738 - DNA, 20 bp, Artificial
  CRISPR gRNA sequence
agaatatacaactatttgaa

SEQ ID NO: 385739 - DNA, 20 bp, Artificial
  CRISPR gRNA sequence
tttgaaattatgctgtttgc

SEQ ID NO: 385740 - DNA, 20 bp, Artificial
  CRISPR gRNA sequence
gaaattatgctgtttgctta

SEQ ID NO: 385741 - DNA, 20 bp, Artificial
  CRISPR gRNA sequence
aaattatgctgtttgcttat

SEQ ID NO: 385742 - DNA, 20 bp, Artificial
  CRISPR gRNA sequence
tgctgtttgcttattgggat

SEQ ID NO: 385743 - DNA, 20 bp, Artificial
  CRISPR gRNA sequence
tttgcttattgggatgtgag

SEQ ID NO: 385744 - DNA, 20 bp, Artificial
  CRISPR gRNA sequence
gcttattgggatgtgagctt

SEQ ID NO: 385745 - DNA, 20 bp, Artificial
  CRISPR gRNA sequence
cttattgggatgtgagcttc

SEQ ID NO: 385746 - DNA, 20 bp, Artificial
  CRISPR gRNA sequence
attgggatgtgagcttcatt

SEQ ID NO: 385747 - DNA, 20 bp, Artificial
  CRISPR gRNA sequence
ttgggatgtgagcttcatta

SEQ ID NO: 385748 - DNA, 20 bp, Artificial
  CRISPR gRNA sequence
ggatgtgagcttcattatgt

SEQ ID NO: 385749 - DNA, 20 bp, Artificial
  CRISPR gRNA sequence
cattatgtcttgttcactgc

SEQ ID NO: 385750 - DNA, 20 bp, Artificial
  CRISPR gRNA sequence
attatgtcttgttcactgct

SEQ ID NO: 385751 - DNA, 20 bp, Artificial
  CRISPR gRNA sequence
tgtcttgttcactgctgtgc

SEQ ID NO: 385752 - DNA, 20 bp, Artificial
  CRISPR gRNA sequence
gttcactgctgtgcacaata

SEQ ID NO: 385753 - DNA, 20 bp, Artificial
  CRISPR gRNA sequence
ttcactgctgtgcacaataa

SEQ ID NO: 385754 - DNA, 20 bp, Artificial
  CRISPR gRNA sequence
actgctgtgcacaataaata

SEQ ID NO: 385755 - DNA, 20 bp, Artificial
  CRISPR gRNA sequence
ctgtgcacaataaatatttg

SEQ ID NO: 385756 - DNA, 20 bp, Artificial
  CRISPR gRNA sequence
tgcacaataaatatttgatg

SEQ ID NO: 385757 - DNA, 20 bp, Artificial
  CRISPR gRNA sequence
gatgaatgaataaatgaagg

SEQ ID NO: 385758 - DNA, 20 bp, Artificial
  CRISPR gRNA sequence
atgaatgaataaatgaaggc

SEQ ID NO: 385759 - DNA, 20 bp, Artificial
  CRISPR gRNA sequence
tatcactgttaaaccttgtt

SEQ ID NO: 385760 - DNA, 20 bp, Artificial
  CRISPR gRNA sequence
atcactgttaaaccttgttc

SEQ ID NO: 385761 - DNA, 20 bp, Artificial
  CRISPR gRNA sequence
tcactgttaaaccttgttct

SEQ ID NO: 385762 - DNA, 20 bp, Artificial
  CRISPR gRNA sequence
ttaaaccttgttcttcccct

SEQ ID NO: 385763 - DNA, 20 bp, Artificial
  CRISPR gRNA sequence
aaccttgttcttccccttct

SEQ ID NO: 385764 - DNA, 20 bp, Artificial
  CRISPR gRNA sequence
gttcttccccttctcagaat

SEQ ID NO: 385765 - DNA, 20 bp, Artificial
  CRISPR gRNA sequence
ttcttccccttctcagaatc

SEQ ID NO: 385766 - DNA, 20 bp, Artificial
  CRISPR gRNA sequence
ttccccttctcagaatctgt

SEQ ID NO: 385767 - DNA, 20 bp, Artificial
  CRISPR gRNA sequence
ccccttctcagaatctgtat

SEQ ID NO: 385768 - DNA, 20 bp, Artificial
  CRISPR gRNA sequence
cccttctcagaatctgtatc

SEQ ID NO: 385769 - DNA, 20 bp, Artificial
  CRISPR gRNA sequence
ctcagaatctgtatccatct

SEQ ID NO: 385770 - DNA, 20 bp, Artificial
  CRISPR gRNA sequence
tcagaatctgtatccatctc

SEQ ID NO: 385771 - DNA, 20 bp, Artificial
  CRISPR gRNA sequence
agaatctgtatccatctcgc

SEQ ID NO: 385772 - DNA, 20 bp, Artificial
  CRISPR gRNA sequence
tatccatctcgcgctgtgtc

SEQ ID NO: 385773 - DNA, 20 bp, Artificial
  CRISPR gRNA sequence
gcgctgtgtcatacacgcac

SEQ ID NO: 385774 - DNA, 20 bp, Artificial
  CRISPR gRNA sequence
tgtcatacacgcacacacac

SEQ ID NO: 385775 - DNA, 20 bp, Artificial
  CRISPR gRNA sequence
gctgtcagctttttccttgg

SEQ ID NO: 385776 - DNA, 20 bp, Artificial
  CRISPR gRNA sequence
tcagctttttccttggagga

SEQ ID NO: 385777 - DNA, 20 bp, Artificial
  CRISPR gRNA sequence
tttccttggaggaggaagac

SEQ ID NO: 385778 - DNA, 20 bp, Artificial
  CRISPR gRNA sequence
ttccttggaggaggaagaca

SEQ ID NO: 385779 - DNA, 20 bp, Artificial
  CRISPR gRNA sequence
tccttggaggaggaagacag

SEQ ID NO: 385780 - DNA, 20 bp, Artificial
  CRISPR gRNA sequence
ccttggaggaggaagacagg

SEQ ID NO: 385781 - DNA, 20 bp, Artificial
  CRISPR gRNA sequence
cttggaggaggaagacaggg

SEQ ID NO: 385782 - DNA, 20 bp, Artificial
  CRISPR gRNA sequence
ggaggaggaagacagggcag

SEQ ID NO: 385783 - DNA, 20 bp, Artificial
  CRISPR gRNA sequence
gaggaggaagacagggcagg

SEQ ID NO: 385784 - DNA, 20 bp, Artificial
  CRISPR gRNA sequence
ctaccaattcttaaatgaac

SEQ ID NO: 385785 - DNA, 20 bp, Artificial
  CRISPR gRNA sequence
taccaattcttaaatgaact

SEQ ID NO: 385786 - DNA, 20 bp, Artificial
  CRISPR gRNA sequence
ccaattcttaaatgaactat

SEQ ID NO: 385787 - DNA, 20 bp, Artificial
  CRISPR gRNA sequence
ttaaatgaactattccagct

SEQ ID NO: 385788 - DNA, 20 bp, Artificial
  CRISPR gRNA sequence
aaatgaactattccagctct

SEQ ID NO: 385789 - DNA, 20 bp, Artificial
  CRISPR gRNA sequence
aatgaactattccagctctc

SEQ ID NO: 385790 - DNA, 20 bp, Artificial
  CRISPR gRNA sequence
ttccagctctccctgtaaca

SEQ ID NO: 385791 - DNA, 20 bp, Artificial
  CRISPR gRNA sequence
cagctctccctgtaacatta

SEQ ID NO: 385792 - DNA, 20 bp, Artificial
  CRISPR gRNA sequence
tccctgtaacattaccacag

SEQ ID NO: 385793 - DNA, 20 bp, Artificial
  CRISPR gRNA sequence
cctgtaacattaccacagct

SEQ ID NO: 385794 - DNA, 20 bp, Artificial
  CRISPR gRNA sequence
taacattaccacagctactt

SEQ ID NO: 385795 - DNA, 20 bp, Artificial
  CRISPR gRNA sequence
ccacagctacttctcctcct

SEQ ID NO: 385796 - DNA, 20 bp, Artificial
  CRISPR gRNA sequence
cttctcctcctttgtgttag

SEQ ID NO: 385797 - DNA, 20 bp, Artificial
  CRISPR gRNA sequence
ctcctcctttgtgttagaac

SEQ ID NO: 385798 - DNA, 20 bp, Artificial
  CRISPR gRNA sequence
tcctcctttgtgttagaaca

SEQ ID NO: 385799 - DNA, 20 bp, Artificial
  CRISPR gRNA sequence
ctcctttgtgttagaacagt

SEQ ID NO: 385800 - DNA, 20 bp, Artificial
  CRISPR gRNA sequence
ctttgtgttagaacagtact

SEQ ID NO: 385801 - DNA, 20 bp, Artificial
  CRISPR gRNA sequence
tgtgttagaacagtactcac

SEQ ID NO: 385802 - DNA, 20 bp, Artificial
  CRISPR gRNA sequence
gtgttagaacagtactcaca

SEQ ID NO: 385803 - DNA, 20 bp, Artificial
  CRISPR gRNA sequence
tgttagaacagtactcacaa

SEQ ID NO: 385804 - DNA, 20 bp, Artificial
  CRISPR gRNA sequence
gaacagtactcacaaaaata

SEQ ID NO: 385805 - DNA, 20 bp, Artificial
  CRISPR gRNA sequence
acaaaaatatatatgtgaat

SEQ ID NO: 385806 - DNA, 20 bp, Artificial
  CRISPR gRNA sequence
agacagcttgacaaattact

SEQ ID NO: 385807 - DNA, 20 bp, Artificial
  CRISPR gRNA sequence
gacaaattactgggttatta

SEQ ID NO: 385808 - DNA, 20 bp, Artificial
  CRISPR gRNA sequence
acaaattactgggttattaa

SEQ ID NO: 385809 - DNA, 20 bp, Artificial
  CRISPR gRNA sequence
ctgggttattaatagagaac

SEQ ID NO: 385810 - DNA, 20 bp, Artificial
  CRISPR gRNA sequence
ggttattaatagagaacctc

SEQ ID NO: 385811 - DNA, 20 bp, Artificial
  CRISPR gRNA sequence
ttaatagagaacctctaaca

SEQ ID NO: 385812 - DNA, 20 bp, Artificial
  CRISPR gRNA sequence
atagagaacctctaacatgg

SEQ ID NO: 385813 - DNA, 20 bp, Artificial
  CRISPR gRNA sequence
taacatggtgaataagattc

SEQ ID NO: 385814 - DNA, 20 bp, Artificial
  CRISPR gRNA sequence
acatggtgaataagattcag

SEQ ID NO: 385815 - DNA, 20 bp, Artificial
  CRISPR gRNA sequence
agcataagttgcactactca

SEQ ID NO: 385816 - DNA, 20 bp, Artificial
  CRISPR gRNA sequence
cactactcacctgttaagga

SEQ ID NO: 385817 - DNA, 20 bp, Artificial
  CRISPR gRNA sequence
ctcacctgttaaggaaaatg

SEQ ID NO: 385818 - DNA, 20 bp, Artificial
  CRISPR gRNA sequence
acctgttaaggaaaatgaca

SEQ ID NO: 385819 - DNA, 20 bp, Artificial
  CRISPR gRNA sequence
ttaaggaaaatgacaatgat

SEQ ID NO: 385820 - DNA, 20 bp, Artificial
  CRISPR gRNA sequence
aggaaaatgacaatgatggt

SEQ ID NO: 385821 - DNA, 20 bp, Artificial
  CRISPR gRNA sequence
agataacaaacaacaacaat

SEQ ID NO: 385822 - DNA, 20 bp, Artificial
  CRISPR gRNA sequence
tccctccagccacaaagagg

SEQ ID NO: 385823 - DNA, 20 bp, Artificial
  CRISPR gRNA sequence
cagccacaaagagggtatat

SEQ ID NO: 385824 - DNA, 20 bp, Artificial
  CRISPR gRNA sequence
gttatcggttttacctagga

SEQ ID NO: 385825 - DNA, 20 bp, Artificial
  CRISPR gRNA sequence
tcggttttacctaggagaga

SEQ ID NO: 385826 - DNA, 20 bp, Artificial
  CRISPR gRNA sequence
tacctaggagagaaaaaaaa

SEQ ID NO: 385827 - DNA, 20 bp, Artificial
  CRISPR gRNA sequence
acctaggagagaaaaaaaat

SEQ ID NO: 385828 - DNA, 20 bp, Artificial
  CRISPR gRNA sequence
cctaggagagaaaaaaaata

SEQ ID NO: 385829 - DNA, 20 bp, Artificial
  CRISPR gRNA sequence
ggagagaaaaaaaatattgt

SEQ ID NO: 385830 - DNA, 20 bp, Artificial
  CRISPR gRNA sequence
taggaattaggaattcagcc

SEQ ID NO: 385831 - DNA, 20 bp, Artificial
  CRISPR gRNA sequence
ggaattcagccaaaggcagt

SEQ ID NO: 385832 - DNA, 20 bp, Artificial
  CRISPR gRNA sequence
agccaaaggcagtaaaaagt

SEQ ID NO: 385833 - DNA, 20 bp, Artificial
  CRISPR gRNA sequence
attattgagtaacaaaaaca

SEQ ID NO: 385834 - DNA, 20 bp, Artificial
  CRISPR gRNA sequence
ttgagtaacaaaaacaaaga

SEQ ID NO: 385835 - DNA, 20 bp, Artificial
  CRISPR gRNA sequence
agtaacaaaaacaaagaatc

SEQ ID NO: 385836 - DNA, 20 bp, Artificial
  CRISPR gRNA sequence
caggaaaaagagaatttttc

SEQ ID NO: 385837 - DNA, 20 bp, Artificial
  CRISPR gRNA sequence
ttcttttagagtctcctaaa

SEQ ID NO: 385838 - DNA, 20 bp, Artificial
  CRISPR gRNA sequence
tcttttagagtctcctaaat

SEQ ID NO: 385839 - DNA, 20 bp, Artificial
  CRISPR gRNA sequence
cttttagagtctcctaaata

SEQ ID NO: 385840 - DNA, 20 bp, Artificial
  CRISPR gRNA sequence
ttttagagtctcctaaatat

SEQ ID NO: 385841 - DNA, 20 bp, Artificial
  CRISPR gRNA sequence
ttagagtctcctaaatattt

SEQ ID NO: 385842 - DNA, 20 bp, Artificial
  CRISPR gRNA sequence
tagagtctcctaaatatttc

SEQ ID NO: 385843 - DNA, 20 bp, Artificial
  CRISPR gRNA sequence
agagtctcctaaatatttct

SEQ ID NO: 385844 - DNA, 20 bp, Artificial
  CRISPR gRNA sequence
gagtctcctaaatatttcta

SEQ ID NO: 385845 - DNA, 20 bp, Artificial
  CRISPR gRNA sequence
ctaaatatttctaactccta

SEQ ID NO: 385846 - DNA, 20 bp, Artificial
  CRISPR gRNA sequence
aatatttctaactcctaata

SEQ ID NO: 385847 - DNA, 20 bp, Artificial
  CRISPR gRNA sequence
ctaactcctaatagattttt

SEQ ID NO: 385848 - DNA, 20 bp, Artificial
  CRISPR gRNA sequence
taactcctaatagattttta

SEQ ID NO: 385849 - DNA, 20 bp, Artificial
  CRISPR gRNA sequence
actcctaatagatttttatt

SEQ ID NO: 385850 - DNA, 20 bp, Artificial
  CRISPR gRNA sequence
ctaatagatttttatttgtt

SEQ ID NO: 385851 - DNA, 20 bp, Artificial
  CRISPR gRNA sequence
atagatttttatttgttttt

SEQ ID NO: 385852 - DNA, 20 bp, Artificial
  CRISPR gRNA sequence
ttatttgttttttgattaag

SEQ ID NO: 385853 - DNA, 20 bp, Artificial
  CRISPR gRNA sequence
tatttgttttttgattaagc

SEQ ID NO: 385854 - DNA, 20 bp, Artificial
  CRISPR gRNA sequence
atttgttttttgattaagct

SEQ ID NO: 385855 - DNA, 20 bp, Artificial
  CRISPR gRNA sequence
tttgttttttgattaagctg

SEQ ID NO: 385856 - DNA, 20 bp, Artificial
  CRISPR gRNA sequence
gttttttgattaagctgagt

SEQ ID NO: 385857 - DNA, 20 bp, Artificial
  CRISPR gRNA sequence
ttttttgattaagctgagtt

SEQ ID NO: 385858 - DNA, 20 bp, Artificial
  CRISPR gRNA sequence
tttgattaagctgagtttta

SEQ ID NO: 385859 - DNA, 20 bp, Artificial
  CRISPR gRNA sequence
ttgattaagctgagttttac

SEQ ID NO: 385860 - DNA, 20 bp, Artificial
  CRISPR gRNA sequence
tgattaagctgagttttaca

SEQ ID NO: 385861 - DNA, 20 bp, Artificial
  CRISPR gRNA sequence
gattaagctgagttttacac

SEQ ID NO: 385862 - DNA, 20 bp, Artificial
  CRISPR gRNA sequence
attaagctgagttttacaca

SEQ ID NO: 385863 - DNA, 20 bp, Artificial
  CRISPR gRNA sequence
agctgagttttacacattac

SEQ ID NO: 385864 - DNA, 20 bp, Artificial
  CRISPR gRNA sequence
agttttacacattacaaaaa

SEQ ID NO: 385865 - DNA, 20 bp, Artificial
  CRISPR gRNA sequence
tacacattacaaaaaaaaaa

SEQ ID NO: 385866 - DNA, 20 bp, Artificial
  CRISPR gRNA sequence
acacattacaaaaaaaaaaa

SEQ ID NO: 385867 - DNA, 20 bp, Artificial
  CRISPR gRNA sequence
cacattacaaaaaaaaaaaa

SEQ ID NO: 385868 - DNA, 20 bp, Artificial
  CRISPR gRNA sequence
caaaaaaaaaaaatataaag

SEQ ID NO: 385869 - DNA, 20 bp, Artificial
  CRISPR gRNA sequence
gccaaagacctcattcaaat

SEQ ID NO: 385870 - DNA, 20 bp, Artificial
  CRISPR gRNA sequence
ccaaagacctcattcaaata

SEQ ID NO: 385871 - DNA, 20 bp, Artificial
  CRISPR gRNA sequence
attcaaataagctgccaatc

SEQ ID NO: 385872 - DNA, 20 bp, Artificial
  CRISPR gRNA sequence
aaataagctgccaatcatat

SEQ ID NO: 385873 - DNA, 20 bp, Artificial
  CRISPR gRNA sequence
ccaatcatatacacaaaacc

SEQ ID NO: 385874 - DNA, 20 bp, Artificial
  CRISPR gRNA sequence
ttgtagaaaaaaaaaaacta

SEQ ID NO: 385875 - DNA, 20 bp, Artificial
  CRISPR gRNA sequence
tgtagaaaaaaaaaaactat

SEQ ID NO: 385876 - DNA, 20 bp, Artificial
  CRISPR gRNA sequence
gtagaaaaaaaaaaactatt

SEQ ID NO: 385877 - DNA, 20 bp, Artificial
  CRISPR gRNA sequence
tagaaaaaaaaaaactatta

SEQ ID NO: 385878 - DNA, 20 bp, Artificial
  CRISPR gRNA sequence
ttaaaataggaaataggcca

SEQ ID NO: 385879 - DNA, 20 bp, Artificial
  CRISPR gRNA sequence
aaataggaaataggccaggt

SEQ ID NO: 385880 - DNA, 20 bp, Artificial
  CRISPR gRNA sequence
aggcctgtaatcacagaggt

SEQ ID NO: 385881 - DNA, 20 bp, Artificial
  CRISPR gRNA sequence
taatcacagaggtttaggag

SEQ ID NO: 385882 - DNA, 20 bp, Artificial
  CRISPR gRNA sequence
aggagaggggatcacttgag

SEQ ID NO: 385883 - DNA, 20 bp, Artificial
  CRISPR gRNA sequence
ggagaggggatcacttgagg

SEQ ID NO: 385884 - DNA, 20 bp, Artificial
  CRISPR gRNA sequence
gaggccaggagttcaagacc

SEQ ID NO: 385885 - DNA, 20 bp, Artificial
  CRISPR gRNA sequence
aggccaggagttcaagacca

SEQ ID NO: 385886 - DNA, 20 bp, Artificial
  CRISPR gRNA sequence
aagaccagcatgggcaacat

SEQ ID NO: 385887 - DNA, 20 bp, Artificial
  CRISPR gRNA sequence
tactaaaaacacaaaaagtg

SEQ ID NO: 385888 - DNA, 20 bp, Artificial
  CRISPR gRNA sequence
ctaaaaacacaaaaagtgat

SEQ ID NO: 385889 - DNA, 20 bp, Artificial
  CRISPR gRNA sequence
aaaacacaaaaagtgatccc

SEQ ID NO: 385890 - DNA, 20 bp, Artificial
  CRISPR gRNA sequence
taatcccagctactcattag

SEQ ID NO: 385891 - DNA, 20 bp, Artificial
  CRISPR gRNA sequence
ctcattaggctgaggcacga

SEQ ID NO: 385892 - DNA, 20 bp, Artificial
  CRISPR gRNA sequence
attaggctgaggcacgagac

SEQ ID NO: 385893 - DNA, 20 bp, Artificial
  CRISPR gRNA sequence
ggctgaggcacgagactcat

SEQ ID NO: 385894 - DNA, 20 bp, Artificial
  CRISPR gRNA sequence
aggcacgagactcatttgaa

SEQ ID NO: 385895 - DNA, 20 bp, Artificial
  CRISPR gRNA sequence
atttgaaccccagaggcgga

SEQ ID NO: 385896 - DNA, 20 bp, Artificial
  CRISPR gRNA sequence
gaaccccagaggcggagctt

SEQ ID NO: 385897 - DNA, 20 bp, Artificial
  CRISPR gRNA sequence
aaccccagaggcggagcttg

SEQ ID NO: 385898 - DNA, 20 bp, Artificial
  CRISPR gRNA sequence
gcagtgagcccggatcttgc

SEQ ID NO: 385899 - DNA, 20 bp, Artificial
  CRISPR gRNA sequence
cagtgagcccggatcttgcc

SEQ ID NO: 385900 - DNA, 20 bp, Artificial
  CRISPR gRNA sequence
gccactgcactccagcctgg

SEQ ID NO: 385901 - DNA, 20 bp, Artificial
  CRISPR gRNA sequence
ccactgcactccagcctggg

SEQ ID NO: 385902 - DNA, 20 bp, Artificial
  CRISPR gRNA sequence
cactccagcctgggcaacag

SEQ ID NO: 385903 - DNA, 20 bp, Artificial
  CRISPR gRNA sequence
cagcctgggcaacagagaga

SEQ ID NO: 385904 - DNA, 20 bp, Artificial
  CRISPR gRNA sequence
ggcaacagagagagactcta

SEQ ID NO: 385905 - DNA, 20 bp, Artificial
  CRISPR gRNA sequence
tatgtaaaaataaataaaat

SEQ ID NO: 385906 - DNA, 20 bp, Artificial
  CRISPR gRNA sequence
tgtaaaaataaataaaatag

SEQ ID NO: 385907 - DNA, 20 bp, Artificial
  CRISPR gRNA sequence
tcttttatgcctgatatatt

SEQ ID NO: 385908 - DNA, 20 bp, Artificial
  CRISPR gRNA sequence
ttatgcctgatatattaagt

SEQ ID NO: 385909 - DNA, 20 bp, Artificial
  CRISPR gRNA sequence
tatgcctgatatattaagta

SEQ ID NO: 385910 - DNA, 20 bp, Artificial
  CRISPR gRNA sequence
atgcctgatatattaagtac

SEQ ID NO: 385911 - DNA, 20 bp, Artificial
  CRISPR gRNA sequence
tgcctgatatattaagtaca

SEQ ID NO: 385912 - DNA, 20 bp, Artificial
  CRISPR gRNA sequence
atatattaagtacattcaac

SEQ ID NO: 385913 - DNA, 20 bp, Artificial
  CRISPR gRNA sequence
agtacattcaacatacaaca

SEQ ID NO: 385914 - DNA, 20 bp, Artificial
  CRISPR gRNA sequence
aacatacaacagaatataac

SEQ ID NO: 385915 - DNA, 20 bp, Artificial
  CRISPR gRNA sequence
tgatgtttataagtataatt

SEQ ID NO: 385916 - DNA, 20 bp, Artificial
  CRISPR gRNA sequence
atgtttataagtataattta

SEQ ID NO: 385917 - DNA, 20 bp, Artificial
  CRISPR gRNA sequence
ataagtataatttaagaaaa

SEQ ID NO: 385918 - DNA, 20 bp, Artificial
  CRISPR gRNA sequence
taagtataatttaagaaaaa

SEQ ID NO: 385919 - DNA, 20 bp, Artificial
  CRISPR gRNA sequence
aagaaaaatagatattttct

SEQ ID NO: 385920 - DNA, 20 bp, Artificial
  CRISPR gRNA sequence
agaaaaatagatattttcta

SEQ ID NO: 385921 - DNA, 20 bp, Artificial
  CRISPR gRNA sequence
tctattcaatttggtaatga

SEQ ID NO: 385922 - DNA, 20 bp, Artificial
  CRISPR gRNA sequence
ctattcaatttggtaatgat

SEQ ID NO: 385923 - DNA, 20 bp, Artificial
  CRISPR gRNA sequence
tattcaatttggtaatgata

SEQ ID NO: 385924 - DNA, 20 bp, Artificial
  CRISPR gRNA sequence
ttcaatttggtaatgataca

SEQ ID NO: 385925 - DNA, 20 bp, Artificial
  CRISPR gRNA sequence
aatttggtaatgatacaaaa

SEQ ID NO: 385926 - DNA, 20 bp, Artificial
  CRISPR gRNA sequence
ggtaatgatacaaaaaatca

SEQ ID NO: 385927 - DNA, 20 bp, Artificial
  CRISPR gRNA sequence
gtaatgatacaaaaaatcag

SEQ ID NO: 385928 - DNA, 20 bp, Artificial
  CRISPR gRNA sequence
ctccaactcaatgtctgaaa

SEQ ID NO: 385929 - DNA, 20 bp, Artificial
  CRISPR gRNA sequence
caactcaatgtctgaaagtt

SEQ ID NO: 385930 - DNA, 20 bp, Artificial
  CRISPR gRNA sequence
aatgtctgaaagtttaccat

SEQ ID NO: 385931 - DNA, 20 bp, Artificial
  CRISPR gRNA sequence
aaagtttaccatggtccagt

SEQ ID NO: 385932 - DNA, 20 bp, Artificial
  CRISPR gRNA sequence
accatggtccagtaatctga

SEQ ID NO: 385933 - DNA, 20 bp, Artificial
  CRISPR gRNA sequence
ccatggtccagtaatctgaa

SEQ ID NO: 385934 - DNA, 20 bp, Artificial
  CRISPR gRNA sequence
aaattctcatcctaaatctt

SEQ ID NO: 385935 - DNA, 20 bp, Artificial
  CRISPR gRNA sequence
tcatcctaaatctttcacaa

SEQ ID NO: 385936 - DNA, 20 bp, Artificial
  CRISPR gRNA sequence
atcctaaatctttcacaatt

SEQ ID NO: 385937 - DNA, 20 bp, Artificial
  CRISPR gRNA sequence
aatctttcacaattcaactg

SEQ ID NO: 385938 - DNA, 20 bp, Artificial
  CRISPR gRNA sequence
tcacaattcaactgaccgac

SEQ ID NO: 385939 - DNA, 20 bp, Artificial
  CRISPR gRNA sequence
cacaattcaactgaccgact

SEQ ID NO: 385940 - DNA, 20 bp, Artificial
  CRISPR gRNA sequence
acaattcaactgaccgactc

SEQ ID NO: 385941 - DNA, 20 bp, Artificial
  CRISPR gRNA sequence
aactgaccgactccagcaaa

SEQ ID NO: 385942 - DNA, 20 bp, Artificial
  CRISPR gRNA sequence
accgactccagcaaattcct

SEQ ID NO: 385943 - DNA, 20 bp, Artificial
  CRISPR gRNA sequence
cagcaaattccttactgtgg

SEQ ID NO: 385944 - DNA, 20 bp, Artificial
  CRISPR gRNA sequence
cttactgtggatgtgtctct

SEQ ID NO: 385945 - DNA, 20 bp, Artificial
  CRISPR gRNA sequence
actgtggatgtgtctcttca

SEQ ID NO: 385946 - DNA, 20 bp, Artificial
  CRISPR gRNA sequence
ctgtggatgtgtctcttcat

SEQ ID NO: 385947 - DNA, 20 bp, Artificial
  CRISPR gRNA sequence
tggatgtgtctcttcatttg

SEQ ID NO: 385948 - DNA, 20 bp, Artificial
  CRISPR gRNA sequence
ttcatttgtcaactgatggc

SEQ ID NO: 385949 - DNA, 20 bp, Artificial
  CRISPR gRNA sequence
catttgtcaactgatggcaa

SEQ ID NO: 385950 - DNA, 20 bp, Artificial
  CRISPR gRNA sequence
atttgtcaactgatggcaat

SEQ ID NO: 385951 - DNA, 20 bp, Artificial
  CRISPR gRNA sequence
gtcaactgatggcaatggca

SEQ ID NO: 385952 - DNA, 20 bp, Artificial
  CRISPR gRNA sequence
tcaactgatggcaatggcag

SEQ ID NO: 385953 - DNA, 20 bp, Artificial
  CRISPR gRNA sequence
atggcaatggcagcagccct

SEQ ID NO: 385954 - DNA, 20 bp, Artificial
  CRISPR gRNA sequence
attacatcacagaattgtga

SEQ ID NO: 385955 - DNA, 20 bp, Artificial
  CRISPR gRNA sequence
catcacagaattgtgatgag

SEQ ID NO: 385956 - DNA, 20 bp, Artificial
  CRISPR gRNA sequence
tgatgagactctcatgagtc

SEQ ID NO: 385957 - DNA, 20 bp, Artificial
  CRISPR gRNA sequence
tcatgagtcaatattcacaa

SEQ ID NO: 385958 - DNA, 20 bp, Artificial
  CRISPR gRNA sequence
atgagtcaatattcacaaga

SEQ ID NO: 385959 - DNA, 20 bp, Artificial
  CRISPR gRNA sequence
acaagaacaatcaactgcga

SEQ ID NO: 385960 - DNA, 20 bp, Artificial
  CRISPR gRNA sequence
cgattagagaaatgtcccct

SEQ ID NO: 385961 - DNA, 20 bp, Artificial
  CRISPR gRNA sequence
gagaaatgtcccctctggag

SEQ ID NO: 385962 - DNA, 20 bp, Artificial
  CRISPR gRNA sequence
tggagtgtgagcccagtgag

SEQ ID NO: 385963 - DNA, 20 bp, Artificial
  CRISPR gRNA sequence
gagtgtgagcccagtgaggt

SEQ ID NO: 385964 - DNA, 20 bp, Artificial
  CRISPR gRNA sequence
tatctttttgttacatcctc

SEQ ID NO: 385965 - DNA, 20 bp, Artificial
  CRISPR gRNA sequence
atctttttgttacatcctcc

SEQ ID NO: 385966 - DNA, 20 bp, Artificial
  CRISPR gRNA sequence
tctttttgttacatcctcct

SEQ ID NO: 385967 - DNA, 20 bp, Artificial
  CRISPR gRNA sequence
tttgttacatcctcctgccc

SEQ ID NO: 385968 - DNA, 20 bp, Artificial
  CRISPR gRNA sequence
ttgttacatcctcctgccca

SEQ ID NO: 385969 - DNA, 20 bp, Artificial
  CRISPR gRNA sequence
tgttacatcctcctgcccac

SEQ ID NO: 385970 - DNA, 20 bp, Artificial
  CRISPR gRNA sequence
gttacatcctcctgcccaca

SEQ ID NO: 385971 - DNA, 20 bp, Artificial
  CRISPR gRNA sequence
ttacatcctcctgcccacaa

SEQ ID NO: 385972 - DNA, 20 bp, Artificial
  CRISPR gRNA sequence
catcctcctgcccacaacac

SEQ ID NO: 385973 - DNA, 20 bp, Artificial
  CRISPR gRNA sequence
ctgcccacaacacacctctc

SEQ ID NO: 385974 - DNA, 20 bp, Artificial
  CRISPR gRNA sequence
cccacaacacacctctcacc

SEQ ID NO: 385975 - DNA, 20 bp, Artificial
  CRISPR gRNA sequence
tcacccttcaacccacagag

SEQ ID NO: 385976 - DNA, 20 bp, Artificial
  CRISPR gRNA sequence
acccttcaacccacagagca

SEQ ID NO: 385977 - DNA, 20 bp, Artificial
  CRISPR gRNA sequence
caacccacagagcatgttgt

SEQ ID NO: 385978 - DNA, 20 bp, Artificial
  CRISPR gRNA sequence
aacccacagagcatgttgtg

SEQ ID NO: 385979 - DNA, 20 bp, Artificial
  CRISPR gRNA sequence
tgagtgcctcccacagggaa

SEQ ID NO: 385980 - DNA, 20 bp, Artificial
  CRISPR gRNA sequence
ccacagggaagaatcccatc

SEQ ID NO: 385981 - DNA, 20 bp, Artificial
  CRISPR gRNA sequence
ctgctgggaataggactgaa

SEQ ID NO: 385982 - DNA, 20 bp, Artificial
  CRISPR gRNA sequence
ctgggaataggactgaaatg

SEQ ID NO: 385983 - DNA, 20 bp, Artificial
  CRISPR gRNA sequence
ggaataggactgaaatgaaa

SEQ ID NO: 385984 - DNA, 20 bp, Artificial
  CRISPR gRNA sequence
aaatgaaacccaatggtctt

SEQ ID NO: 385985 - DNA, 20 bp, Artificial
  CRISPR gRNA sequence
cattgctgtctctcttcggg

SEQ ID NO: 385986 - DNA, 20 bp, Artificial
  CRISPR gRNA sequence
attgctgtctctcttcggga

SEQ ID NO: 385987 - DNA, 20 bp, Artificial
  CRISPR gRNA sequence
ctgtctctcttcgggaaagc

SEQ ID NO: 385988 - DNA, 20 bp, Artificial
  CRISPR gRNA sequence
tctctcttcgggaaagcgaa

SEQ ID NO: 385989 - DNA, 20 bp, Artificial
  CRISPR gRNA sequence
tcttcgggaaagcgaacctg

SEQ ID NO: 385990 - DNA, 20 bp, Artificial
  CRISPR gRNA sequence
ttcgggaaagcgaacctgtc

SEQ ID NO: 385991 - DNA, 20 bp, Artificial
  CRISPR gRNA sequence
cgggaaagcgaacctgtcaa

SEQ ID NO: 385992 - DNA, 20 bp, Artificial
  CRISPR gRNA sequence
gggaaagcgaacctgtcaat

SEQ ID NO: 385993 - DNA, 20 bp, Artificial
  CRISPR gRNA sequence
tcaatcaccccaccattagg

SEQ ID NO: 385994 - DNA, 20 bp, Artificial
  CRISPR gRNA sequence
ggatgatgccaggctctgag

SEQ ID NO: 385995 - DNA, 20 bp, Artificial
  CRISPR gRNA sequence
tgagagggcagcacaatttc

SEQ ID NO: 385996 - DNA, 20 bp, Artificial
  CRISPR gRNA sequence
agagggcagcacaatttccc

SEQ ID NO: 385997 - DNA, 20 bp, Artificial
  CRISPR gRNA sequence
cccttcctcctgaaatcaaa

SEQ ID NO: 385998 - DNA, 20 bp, Artificial
  CRISPR gRNA sequence
ccttcctcctgaaatcaaag

SEQ ID NO: 385999 - DNA, 20 bp, Artificial
  CRISPR gRNA sequence
cctcctgaaatcaaagcttg

SEQ ID NO: 386000 - DNA, 20 bp, Artificial
  CRISPR gRNA sequence
ctcctgaaatcaaagcttga

SEQ ID NO: 386001 - DNA, 20 bp, Artificial
  CRISPR gRNA sequence
ctgaaatcaaagcttgaatg

SEQ ID NO: 386002 - DNA, 20 bp, Artificial
  CRISPR gRNA sequence
aaatcaaagcttgaatgttt

SEQ ID NO: 386003 - DNA, 20 bp, Artificial
  CRISPR gRNA sequence
gaatgtttgtactgtgacac

SEQ ID NO: 386004 - DNA, 20 bp, Artificial
  CRISPR gRNA sequence
aatgtttgtactgtgacacc

SEQ ID NO: 386005 - DNA, 20 bp, Artificial
  CRISPR gRNA sequence
gtactgtgacaccccggctg

SEQ ID NO: 386006 - DNA, 20 bp, Artificial
  CRISPR gRNA sequence
tactgtgacaccccggctgt

SEQ ID NO: 386007 - DNA, 20 bp, Artificial
  CRISPR gRNA sequence
tgacaccccggctgtctgga

SEQ ID NO: 386008 - DNA, 20 bp, Artificial
  CRISPR gRNA sequence
tctggaatcctattgcagcc

SEQ ID NO: 386009 - DNA, 20 bp, Artificial
  CRISPR gRNA sequence
gaatcctattgcagcctgaa

SEQ ID NO: 386010 - DNA, 20 bp, Artificial
  CRISPR gRNA sequence
ttgcagcctgaaaaccatga

SEQ ID NO: 386011 - DNA, 20 bp, Artificial
  CRISPR gRNA sequence
cagcctgaaaaccatgactt

SEQ ID NO: 386012 - DNA, 20 bp, Artificial
  CRISPR gRNA sequence
aaaaccatgactttcaacca

SEQ ID NO: 386013 - DNA, 20 bp, Artificial
  CRISPR gRNA sequence
tcaaccaattcttccccatc

SEQ ID NO: 386014 - DNA, 20 bp, Artificial
  CRISPR gRNA sequence
caaccaattcttccccatct

SEQ ID NO: 386015 - DNA, 20 bp, Artificial
  CRISPR gRNA sequence
aaccaattcttccccatctt

SEQ ID NO: 386016 - DNA, 20 bp, Artificial
  CRISPR gRNA sequence
ttccccatcttttcctcaga

SEQ ID NO: 386017 - DNA, 20 bp, Artificial
  CRISPR gRNA sequence
ccccatcttttcctcagaaa

SEQ ID NO: 386018 - DNA, 20 bp, Artificial
  CRISPR gRNA sequence
cccatcttttcctcagaaaa

SEQ ID NO: 386019 - DNA, 20 bp, Artificial
  CRISPR gRNA sequence
ttcctcagaaaatttcttct

SEQ ID NO: 386020 - DNA, 20 bp, Artificial
  CRISPR gRNA sequence
tcctcagaaaatttcttctc

SEQ ID NO: 386021 - DNA, 20 bp, Artificial
  CRISPR gRNA sequence
cctcagaaaatttcttctca

SEQ ID NO: 386022 - DNA, 20 bp, Artificial
  CRISPR gRNA sequence
ctcagaaaatttcttctcac

SEQ ID NO: 386023 - DNA, 20 bp, Artificial
  CRISPR gRNA sequence
agaaaatttcttctcacttt

SEQ ID NO: 386024 - DNA, 20 bp, Artificial
  CRISPR gRNA sequence
cttctcactttatccactat

SEQ ID NO: 386025 - DNA, 20 bp, Artificial
  CRISPR gRNA sequence
ttctcactttatccactatg

SEQ ID NO: 386026 - DNA, 20 bp, Artificial
  CRISPR gRNA sequence
ctcactttatccactatgta

SEQ ID NO: 386027 - DNA, 20 bp, Artificial
  CRISPR gRNA sequence
tcactttatccactatgtag

SEQ ID NO: 386028 - DNA, 20 bp, Artificial
  CRISPR gRNA sequence
actttatccactatgtagct

SEQ ID NO: 386029 - DNA, 20 bp, Artificial
  CRISPR gRNA sequence
tatccactatgtagctgcat

SEQ ID NO: 386030 - DNA, 20 bp, Artificial
  CRISPR gRNA sequence
atccactatgtagctgcatt

SEQ ID NO: 386031 - DNA, 20 bp, Artificial
  CRISPR gRNA sequence
tccactatgtagctgcattt

SEQ ID NO: 386032 - DNA, 20 bp, Artificial
  CRISPR gRNA sequence
tgtagctgcatttttttcat

SEQ ID NO: 386033 - DNA, 20 bp, Artificial
  CRISPR gRNA sequence
catttttttcataagaactc

SEQ ID NO: 386034 - DNA, 20 bp, Artificial
  CRISPR gRNA sequence
ttttcataagaactcaaagt

SEQ ID NO: 386035 - DNA, 20 bp, Artificial
  CRISPR gRNA sequence
tttcataagaactcaaagta

SEQ ID NO: 386036 - DNA, 20 bp, Artificial
  CRISPR gRNA sequence
ttcataagaactcaaagtat

SEQ ID NO: 386037 - DNA, 20 bp, Artificial
  CRISPR gRNA sequence
tcataagaactcaaagtata

SEQ ID NO: 386038 - DNA, 20 bp, Artificial
  CRISPR gRNA sequence
cataagaactcaaagtatag

SEQ ID NO: 386039 - DNA, 20 bp, Artificial
  CRISPR gRNA sequence
ataagaactcaaagtataga

SEQ ID NO: 386040 - DNA, 20 bp, Artificial
  CRISPR gRNA sequence
aaagtatagacccacttatt

SEQ ID NO: 386041 - DNA, 20 bp, Artificial
  CRISPR gRNA sequence
attctttcacaaactttact

SEQ ID NO: 386042 - DNA, 20 bp, Artificial
  CRISPR gRNA sequence
ttctttcacaaactttactg

SEQ ID NO: 386043 - DNA, 20 bp, Artificial
  CRISPR gRNA sequence
tttcacaaactttactgcaa

SEQ ID NO: 386044 - DNA, 20 bp, Artificial
  CRISPR gRNA sequence
tcacaaactttactgcaaag

SEQ ID NO: 386045 - DNA, 20 bp, Artificial
  CRISPR gRNA sequence
cacaaactttactgcaaaga

SEQ ID NO: 386046 - DNA, 20 bp, Artificial
  CRISPR gRNA sequence
acaaactttactgcaaagag

SEQ ID NO: 386047 - DNA, 20 bp, Artificial
  CRISPR gRNA sequence
tactgcaaagagaaactaag

SEQ ID NO: 386048 - DNA, 20 bp, Artificial
  CRISPR gRNA sequence
actgcaaagagaaactaaga

SEQ ID NO: 386049 - DNA, 20 bp, Artificial
  CRISPR gRNA sequence
ctgcaaagagaaactaagac

SEQ ID NO: 386050 - DNA, 20 bp, Artificial
  CRISPR gRNA sequence
caaagagaaactaagacaaa

SEQ ID NO: 386051 - DNA, 20 bp, Artificial
  CRISPR gRNA sequence
agacaaataagcaaacattt

SEQ ID NO: 386052 - DNA, 20 bp, Artificial
  CRISPR gRNA sequence
tatttttaaacgttttagac

SEQ ID NO: 386053 - DNA, 20 bp, Artificial
  CRISPR gRNA sequence
atttttaaacgttttagacc

SEQ ID NO: 386054 - DNA, 20 bp, Artificial
  CRISPR gRNA sequence
tttttaaacgttttagacct

SEQ ID NO: 386055 - DNA, 20 bp, Artificial
  CRISPR gRNA sequence
ttaaacgttttagacctaga

SEQ ID NO: 386056 - DNA, 20 bp, Artificial
  CRISPR gRNA sequence
taaacgttttagacctagat

SEQ ID NO: 386057 - DNA, 20 bp, Artificial
  CRISPR gRNA sequence
aaacgttttagacctagatt

SEQ ID NO: 386058 - DNA, 20 bp, Artificial
  CRISPR gRNA sequence
aacgttttagacctagattc

SEQ ID NO: 386059 - DNA, 20 bp, Artificial
  CRISPR gRNA sequence
tagacctagattccacaaat

SEQ ID NO: 386060 - DNA, 20 bp, Artificial
  CRISPR gRNA sequence
agacctagattccacaaata

SEQ ID NO: 386061 - DNA, 20 bp, Artificial
  CRISPR gRNA sequence
gacctagattccacaaataa

SEQ ID NO: 386062 - DNA, 20 bp, Artificial
  CRISPR gRNA sequence
gattccacaaataagtgaag

SEQ ID NO: 386063 - DNA, 20 bp, Artificial
  CRISPR gRNA sequence
cacaaataagtgaagtcata

SEQ ID NO: 386064 - DNA, 20 bp, Artificial
  CRISPR gRNA sequence
tttctttttgtgtctggctt

SEQ ID NO: 386065 - DNA, 20 bp, Artificial
  CRISPR gRNA sequence
ttctttttgtgtctggctta

SEQ ID NO: 386066 - DNA, 20 bp, Artificial
  CRISPR gRNA sequence
tctttttgtgtctggcttat

SEQ ID NO: 386067 - DNA, 20 bp, Artificial
  CRISPR gRNA sequence
ctttttgtgtctggcttatt

SEQ ID NO: 386068 - DNA, 20 bp, Artificial
  CRISPR gRNA sequence
tttttgtgtctggcttattt

SEQ ID NO: 386069 - DNA, 20 bp, Artificial
  CRISPR gRNA sequence
tttgtgtctggcttatttca

SEQ ID NO: 386070 - DNA, 20 bp, Artificial
  CRISPR gRNA sequence
ttgtgtctggcttatttcac

SEQ ID NO: 386071 - DNA, 20 bp, Artificial
  CRISPR gRNA sequence
tgtgtctggcttatttcact

SEQ ID NO: 386072 - DNA, 20 bp, Artificial
  CRISPR gRNA sequence
gtgtctggcttatttcactt

SEQ ID NO: 386073 - DNA, 20 bp, Artificial
  CRISPR gRNA sequence
tgtctggcttatttcacttt

SEQ ID NO: 386074 - DNA, 20 bp, Artificial
  CRISPR gRNA sequence
gcttatttcacttttcataa

SEQ ID NO: 386075 - DNA, 20 bp, Artificial
  CRISPR gRNA sequence
atttcacttttcataatgtc

SEQ ID NO: 386076 - DNA, 20 bp, Artificial
  CRISPR gRNA sequence
tttcacttttcataatgtcc

SEQ ID NO: 386077 - DNA, 20 bp, Artificial
  CRISPR gRNA sequence
cacttttcataatgtcctca

SEQ ID NO: 386078 - DNA, 20 bp, Artificial
  CRISPR gRNA sequence
acttttcataatgtcctcaa

SEQ ID NO: 386079 - DNA, 20 bp, Artificial
  CRISPR gRNA sequence
ttcataatgtcctcaaggtt

SEQ ID NO: 386080 - DNA, 20 bp, Artificial
  CRISPR gRNA sequence
tcataatgtcctcaaggttt

SEQ ID NO: 386081 - DNA, 20 bp, Artificial
  CRISPR gRNA sequence
cataatgtcctcaaggttta

SEQ ID NO: 386082 - DNA, 20 bp, Artificial
  CRISPR gRNA sequence
ataatgtcctcaaggtttat

SEQ ID NO: 386083 - DNA, 20 bp, Artificial
  CRISPR gRNA sequence
aaggtttatccaccctgtca

SEQ ID NO: 386084 - DNA, 20 bp, Artificial
  CRISPR gRNA sequence
atccaccctgtcacacatga

SEQ ID NO: 386085 - DNA, 20 bp, Artificial
  CRISPR gRNA sequence
tccaccctgtcacacatgat

SEQ ID NO: 386086 - DNA, 20 bp, Artificial
  CRISPR gRNA sequence
tcacacatgatatgatttcc

SEQ ID NO: 386087 - DNA, 20 bp, Artificial
  CRISPR gRNA sequence
ccttcttttttaaagggtta

SEQ ID NO: 386088 - DNA, 20 bp, Artificial
  CRISPR gRNA sequence
cttcttttttaaagggttaa

SEQ ID NO: 386089 - DNA, 20 bp, Artificial
  CRISPR gRNA sequence
cttttttaaagggttaatag

SEQ ID NO: 386090 - DNA, 20 bp, Artificial
  CRISPR gRNA sequence
ttttttaaagggttaatagt

SEQ ID NO: 386091 - DNA, 20 bp, Artificial
  CRISPR gRNA sequence
ttttaaagggttaatagtac

SEQ ID NO: 386092 - DNA, 20 bp, Artificial
  CRISPR gRNA sequence
tttaaagggttaatagtact

SEQ ID NO: 386093 - DNA, 20 bp, Artificial
  CRISPR gRNA sequence
ttaaagggttaatagtacta

SEQ ID NO: 386094 - DNA, 20 bp, Artificial
  CRISPR gRNA sequence
taaagggttaatagtactac

SEQ ID NO: 386095 - DNA, 20 bp, Artificial
  CRISPR gRNA sequence
aaagggttaatagtactaca

SEQ ID NO: 386096 - DNA, 20 bp, Artificial
  CRISPR gRNA sequence
aagggttaatagtactacat

SEQ ID NO: 386097 - DNA, 20 bp, Artificial
  CRISPR gRNA sequence
atagtactacattgtgtcta

SEQ ID NO: 386098 - DNA, 20 bp, Artificial
  CRISPR gRNA sequence
cattgtgtctatgtaccaca

SEQ ID NO: 386099 - DNA, 20 bp, Artificial
  CRISPR gRNA sequence
tgtctatgtaccacattttc

SEQ ID NO: 386100 - DNA, 20 bp, Artificial
  CRISPR gRNA sequence
tgtaccacattttctttatc

SEQ ID NO: 386101 - DNA, 20 bp, Artificial
  CRISPR gRNA sequence
tctttatctattcatctgtt

SEQ ID NO: 386102 - DNA, 20 bp, Artificial
  CRISPR gRNA sequence
ctttatctattcatctgttg

SEQ ID NO: 386103 - DNA, 20 bp, Artificial
  CRISPR gRNA sequence
tttatctattcatctgttga

SEQ ID NO: 386104 - DNA, 20 bp, Artificial
  CRISPR gRNA sequence
tatctattcatctgttgatg

SEQ ID NO: 386105 - DNA, 20 bp, Artificial
  CRISPR gRNA sequence
atctattcatctgttgatgg

SEQ ID NO: 386106 - DNA, 20 bp, Artificial
  CRISPR gRNA sequence
tctattcatctgttgatgga

SEQ ID NO: 386107 - DNA, 20 bp, Artificial
  CRISPR gRNA sequence
ttcatctgttgatggacacc

SEQ ID NO: 386108 - DNA, 20 bp, Artificial
  CRISPR gRNA sequence
atctgttgatggacacctag

SEQ ID NO: 386109 - DNA, 20 bp, Artificial
  CRISPR gRNA sequence
ttgatggacacctaggttgc

SEQ ID NO: 386110 - DNA, 20 bp, Artificial
  CRISPR gRNA sequence
atggacacctaggttgcatc

SEQ ID NO: 386111 - DNA, 20 bp, Artificial
  CRISPR gRNA sequence
ggttgcatccacatcttgac

SEQ ID NO: 386112 - DNA, 20 bp, Artificial
  CRISPR gRNA sequence
catccacatcttgactactg

SEQ ID NO: 386113 - DNA, 20 bp, Artificial
  CRISPR gRNA sequence
gactactgtagacaatgatg

SEQ ID NO: 386114 - DNA, 20 bp, Artificial
  CRISPR gRNA sequence
actactgtagacaatgatgc

SEQ ID NO: 386115 - DNA, 20 bp, Artificial
  CRISPR gRNA sequence
ctgtagacaatgatgcaata

SEQ ID NO: 386116 - DNA, 20 bp, Artificial
  CRISPR gRNA sequence
tagacaatgatgcaatacat

SEQ ID NO: 386117 - DNA, 20 bp, Artificial
  CRISPR gRNA sequence
cttcaagatactgacctcat

SEQ ID NO: 386118 - DNA, 20 bp, Artificial
  CRISPR gRNA sequence
ttcaagatactgacctcatt

SEQ ID NO: 386119 - DNA, 20 bp, Artificial
  CRISPR gRNA sequence
caagatactgacctcatttc

SEQ ID NO: 386120 - DNA, 20 bp, Artificial
  CRISPR gRNA sequence
aagatactgacctcatttcc

SEQ ID NO: 386121 - DNA, 20 bp, Artificial
  CRISPR gRNA sequence
acctcatttcctttgtatat

SEQ ID NO: 386122 - DNA, 20 bp, Artificial
  CRISPR gRNA sequence
atttcctttgtatataatac

SEQ ID NO: 386123 - DNA, 20 bp, Artificial
  CRISPR gRNA sequence
cctttgtatataatacccat

SEQ ID NO: 386124 - DNA, 20 bp, Artificial
  CRISPR gRNA sequence
ctttgtatataatacccatc

SEQ ID NO: 386125 - DNA, 20 bp, Artificial
  CRISPR gRNA sequence
tgtatataatacccatcaga

SEQ ID NO: 386126 - DNA, 20 bp, Artificial
  CRISPR gRNA sequence
gtatataatacccatcagat

SEQ ID NO: 386127 - DNA, 20 bp, Artificial
  CRISPR gRNA sequence
tatataatacccatcagatt

SEQ ID NO: 386128 - DNA, 20 bp, Artificial
  CRISPR gRNA sequence
ctggttcatatgatagcttt

SEQ ID NO: 386129 - DNA, 20 bp, Artificial
  CRISPR gRNA sequence
gttcatatgatagctttatt

SEQ ID NO: 386130 - DNA, 20 bp, Artificial
  CRISPR gRNA sequence
atatgatagctttatttatt

SEQ ID NO: 386131 - DNA, 20 bp, Artificial
  CRISPR gRNA sequence
tatttattttattttaattt

SEQ ID NO: 386132 - DNA, 20 bp, Artificial
  CRISPR gRNA sequence
atttattttattttaatttt

SEQ ID NO: 386133 - DNA, 20 bp, Artificial
  CRISPR gRNA sequence
tttattttattttaatttta

SEQ ID NO: 386134 - DNA, 20 bp, Artificial
  CRISPR gRNA sequence
attttattttaattttattt

SEQ ID NO: 386135 - DNA, 20 bp, Artificial
  CRISPR gRNA sequence
ttttattttaattttatttt

SEQ ID NO: 386136 - DNA, 20 bp, Artificial
  CRISPR gRNA sequence
tattttaattttattttatt

SEQ ID NO: 386137 - DNA, 20 bp, Artificial
  CRISPR gRNA sequence
attttaattttattttattt

SEQ ID NO: 386138 - DNA, 20 bp, Artificial
  CRISPR gRNA sequence
ttttaattttattttatttt

SEQ ID NO: 386139 - DNA, 20 bp, Artificial
  CRISPR gRNA sequence
taattttattttatttttgg

SEQ ID NO: 386140 - DNA, 20 bp, Artificial
  CRISPR gRNA sequence
aattttattttatttttggg

SEQ ID NO: 386141 - DNA, 20 bp, Artificial
  CRISPR gRNA sequence
attttattttatttttggga

SEQ ID NO: 386142 - DNA, 20 bp, Artificial
  CRISPR gRNA sequence
tattttatttttgggacaga

SEQ ID NO: 386143 - DNA, 20 bp, Artificial
  CRISPR gRNA sequence
attttatttttgggacagag

SEQ ID NO: 386144 - DNA, 20 bp, Artificial
  CRISPR gRNA sequence
ttttatttttgggacagagt

SEQ ID NO: 386145 - DNA, 20 bp, Artificial
  CRISPR gRNA sequence
tatttttgggacagagtttc

SEQ ID NO: 386146 - DNA, 20 bp, Artificial
  CRISPR gRNA sequence
atttttgggacagagtttca

SEQ ID NO: 386147 - DNA, 20 bp, Artificial
  CRISPR gRNA sequence
tttttgggacagagtttcac

SEQ ID NO: 386148 - DNA, 20 bp, Artificial
  CRISPR gRNA sequence
ttgggacagagtttcactct

SEQ ID NO: 386149 - DNA, 20 bp, Artificial
  CRISPR gRNA sequence
tgggacagagtttcactctt

SEQ ID NO: 386150 - DNA, 20 bp, Artificial
  CRISPR gRNA sequence
gggacagagtttcactcttg

SEQ ID NO: 386151 - DNA, 20 bp, Artificial
  CRISPR gRNA sequence
ggacagagtttcactcttgt

SEQ ID NO: 386152 - DNA, 20 bp, Artificial
  CRISPR gRNA sequence
cactcttgtcacccaggctg

SEQ ID NO: 386153 - DNA, 20 bp, Artificial
  CRISPR gRNA sequence
actcttgtcacccaggctgg

SEQ ID NO: 386154 - DNA, 20 bp, Artificial
  CRISPR gRNA sequence
ttgtcacccaggctggagtg

SEQ ID NO: 386155 - DNA, 20 bp, Artificial
  CRISPR gRNA sequence
gtcacccaggctggagtgca

SEQ ID NO: 386156 - DNA, 20 bp, Artificial
  CRISPR gRNA sequence
tcacccaggctggagtgcag

SEQ ID NO: 386157 - DNA, 20 bp, Artificial
  CRISPR gRNA sequence
gagtgcagtggcacaatctc

SEQ ID NO: 386158 - DNA, 20 bp, Artificial
  CRISPR gRNA sequence
agctcgctgcaagctccact

SEQ ID NO: 386159 - DNA, 20 bp, Artificial
  CRISPR gRNA sequence
gctgcaagctccacttccca

SEQ ID NO: 386160 - DNA, 20 bp, Artificial
  CRISPR gRNA sequence
caagctccacttcccaggtt

SEQ ID NO: 386161 - DNA, 20 bp, Artificial
  CRISPR gRNA sequence
cacttcccaggttcaagcaa

SEQ ID NO: 386162 - DNA, 20 bp, Artificial
  CRISPR gRNA sequence
cccaggttcaagcaattctc

SEQ ID NO: 386163 - DNA, 20 bp, Artificial
  CRISPR gRNA sequence
ccaggttcaagcaattctcc

SEQ ID NO: 386164 - DNA, 20 bp, Artificial
  CRISPR gRNA sequence
aagcaattctcctgcctcag

SEQ ID NO: 386165 - DNA, 20 bp, Artificial
  CRISPR gRNA sequence
tcctgcctcagcctccaagt

SEQ ID NO: 386166 - DNA, 20 bp, Artificial
  CRISPR gRNA sequence
ctgcctcagcctccaagtag

SEQ ID NO: 386167 - DNA, 20 bp, Artificial
  CRISPR gRNA sequence
cctcagcctccaagtagctg

SEQ ID NO: 386168 - DNA, 20 bp, Artificial
  CRISPR gRNA sequence
agcctccaagtagctgggat

SEQ ID NO: 386169 - DNA, 20 bp, Artificial
  CRISPR gRNA sequence
caagtagctgggattacagg

SEQ ID NO: 386170 - DNA, 20 bp, Artificial
  CRISPR gRNA sequence
ggattacaggcacctgccac

SEQ ID NO: 386171 - DNA, 20 bp, Artificial
  CRISPR gRNA sequence
caggcacctgccaccacacc

SEQ ID NO: 386172 - DNA, 20 bp, Artificial
  CRISPR gRNA sequence
ccaccacacccagctaattt

SEQ ID NO: 386173 - DNA, 20 bp, Artificial
  CRISPR gRNA sequence
atttttgtatttttagtaga

SEQ ID NO: 386174 - DNA, 20 bp, Artificial
  CRISPR gRNA sequence
ttgtatttttagtagagatg

SEQ ID NO: 386175 - DNA, 20 bp, Artificial
  CRISPR gRNA sequence
tgtatttttagtagagatgg

SEQ ID NO: 386176 - DNA, 20 bp, Artificial
  CRISPR gRNA sequence
gtatttttagtagagatggg

SEQ ID NO: 386177 - DNA, 20 bp, Artificial
  CRISPR gRNA sequence
tatttttagtagagatgggg

SEQ ID NO: 386178 - DNA, 20 bp, Artificial
  CRISPR gRNA sequence
ttagtagagatggggtttca

SEQ ID NO: 386179 - DNA, 20 bp, Artificial
  CRISPR gRNA sequence
tagtagagatggggtttcac

SEQ ID NO: 386180 - DNA, 20 bp, Artificial
  CRISPR gRNA sequence
agtagagatggggtttcacc

SEQ ID NO: 386181 - DNA, 20 bp, Artificial
  CRISPR gRNA sequence
gtagagatggggtttcaccc

SEQ ID NO: 386182 - DNA, 20 bp, Artificial
  CRISPR gRNA sequence
caccctgttggccaggctgg

SEQ ID NO: 386183 - DNA, 20 bp, Artificial
  CRISPR gRNA sequence
accctgttggccaggctggt

SEQ ID NO: 386184 - DNA, 20 bp, Artificial
  CRISPR gRNA sequence
ttggccaggctggtctcgaa

SEQ ID NO: 386185 - DNA, 20 bp, Artificial
  CRISPR gRNA sequence
gccaggctggtctcgaactc

SEQ ID NO: 386186 - DNA, 20 bp, Artificial
  CRISPR gRNA sequence
gtctcgaactcctgacctca

SEQ ID NO: 386187 - DNA, 20 bp, Artificial
  CRISPR gRNA sequence
gaactcctgacctcaggtga

SEQ ID NO: 386188 - DNA, 20 bp, Artificial
  CRISPR gRNA sequence
ctgacctcaggtgatccatc

SEQ ID NO: 386189 - DNA, 20 bp, Artificial
  CRISPR gRNA sequence
acctcaggtgatccatctgc

SEQ ID NO: 386190 - DNA, 20 bp, Artificial
  CRISPR gRNA sequence
aggtgatccatctgccttgg

SEQ ID NO: 386191 - DNA, 20 bp, Artificial
  CRISPR gRNA sequence
ccttggcctcccaaagtgct

SEQ ID NO: 386192 - DNA, 20 bp, Artificial
  CRISPR gRNA sequence
ggcctcccaaagtgctggga

SEQ ID NO: 386193 - DNA, 20 bp, Artificial
  CRISPR gRNA sequence
gcctcccaaagtgctgggat

SEQ ID NO: 386194 - DNA, 20 bp, Artificial
  CRISPR gRNA sequence
ccaaagtgctgggattacag

SEQ ID NO: 386195 - DNA, 20 bp, Artificial
  CRISPR gRNA sequence
ggattacaggcatgagccac

SEQ ID NO: 386196 - DNA, 20 bp, Artificial
  CRISPR gRNA sequence
caggcatgagccaccgcacc

SEQ ID NO: 386197 - DNA, 20 bp, Artificial
  CRISPR gRNA sequence
gcctatttttaatttcttga

SEQ ID NO: 386198 - DNA, 20 bp, Artificial
  CRISPR gRNA sequence
tttttaatttcttgaggaac

SEQ ID NO: 386199 - DNA, 20 bp, Artificial
  CRISPR gRNA sequence
ttaatttcttgaggaaccta

SEQ ID NO: 386200 - DNA, 20 bp, Artificial
  CRISPR gRNA sequence
taatttcttgaggaacctac

SEQ ID NO: 386201 - DNA, 20 bp, Artificial
  CRISPR gRNA sequence
aatttcttgaggaacctact

SEQ ID NO: 386202 - DNA, 20 bp, Artificial
  CRISPR gRNA sequence
atttcttgaggaacctacta

SEQ ID NO: 386203 - DNA, 20 bp, Artificial
  CRISPR gRNA sequence
cttgaggaacctactacctg

SEQ ID NO: 386204 - DNA, 20 bp, Artificial
  CRISPR gRNA sequence
ttgaggaacctactacctgt

SEQ ID NO: 386205 - DNA, 20 bp, Artificial
  CRISPR gRNA sequence
gaggaacctactacctgtac

SEQ ID NO: 386206 - DNA, 20 bp, Artificial
  CRISPR gRNA sequence
aggaacctactacctgtacc

SEQ ID NO: 386207 - DNA, 20 bp, Artificial
  CRISPR gRNA sequence
ctacctgtaccaataacgag

SEQ ID NO: 386208 - DNA, 20 bp, Artificial
  CRISPR gRNA sequence
cctgtaccaataacgagtgt

SEQ ID NO: 386209 - DNA, 20 bp, Artificial
  CRISPR gRNA sequence
taccaataacgagtgtaccc

SEQ ID NO: 386210 - DNA, 20 bp, Artificial
  CRISPR gRNA sequence
acattcccgccaacagtgta

SEQ ID NO: 386211 - DNA, 20 bp, Artificial
  CRISPR gRNA sequence
cattcccgccaacagtgtac

SEQ ID NO: 386212 - DNA, 20 bp, Artificial
  CRISPR gRNA sequence
ccgccaacagtgtacaaggg

SEQ ID NO: 386213 - DNA, 20 bp, Artificial
  CRISPR gRNA sequence
ccttttctccacatcctcac

SEQ ID NO: 386214 - DNA, 20 bp, Artificial
  CRISPR gRNA sequence
ttctccacatcctcaccaac

SEQ ID NO: 386215 - DNA, 20 bp, Artificial
  CRISPR gRNA sequence
tctccacatcctcaccaaca

SEQ ID NO: 386216 - DNA, 20 bp, Artificial
  CRISPR gRNA sequence
ctccacatcctcaccaacac

SEQ ID NO: 386217 - DNA, 20 bp, Artificial
  CRISPR gRNA sequence
tccacatcctcaccaacact

SEQ ID NO: 386218 - DNA, 20 bp, Artificial
  CRISPR gRNA sequence
cacatcctcaccaacacttg

SEQ ID NO: 386219 - DNA, 20 bp, Artificial
  CRISPR gRNA sequence
accaacacttgctatctctt

SEQ ID NO: 386220 - DNA, 20 bp, Artificial
  CRISPR gRNA sequence
gctatctcttgcctttttga

SEQ ID NO: 386221 - DNA, 20 bp, Artificial
  CRISPR gRNA sequence
ctatctcttgcctttttgat

SEQ ID NO: 386222 - DNA, 20 bp, Artificial
  CRISPR gRNA sequence
tctcttgcctttttgataac

SEQ ID NO: 386223 - DNA, 20 bp, Artificial
  CRISPR gRNA sequence
ttgcctttttgataacagcc

SEQ ID NO: 386224 - DNA, 20 bp, Artificial
  CRISPR gRNA sequence
gcctttttgataacagccat

SEQ ID NO: 386225 - DNA, 20 bp, Artificial
  CRISPR gRNA sequence
cctttttgataacagccatt

SEQ ID NO: 386226 - DNA, 20 bp, Artificial
  CRISPR gRNA sequence
tttgataacagccattctaa

SEQ ID NO: 386227 - DNA, 20 bp, Artificial
  CRISPR gRNA sequence
ttgataacagccattctaat

SEQ ID NO: 386228 - DNA, 20 bp, Artificial
  CRISPR gRNA sequence
tgataacagccattctaata

SEQ ID NO: 386229 - DNA, 20 bp, Artificial
  CRISPR gRNA sequence
gataacagccattctaatag

SEQ ID NO: 386230 - DNA, 20 bp, Artificial
  CRISPR gRNA sequence
ataacagccattctaatagg

SEQ ID NO: 386231 - DNA, 20 bp, Artificial
  CRISPR gRNA sequence
taataggtgtgaggtgagag

SEQ ID NO: 386232 - DNA, 20 bp, Artificial
  CRISPR gRNA sequence
ataggtgtgaggtgagagct

SEQ ID NO: 386233 - DNA, 20 bp, Artificial
  CRISPR gRNA sequence
actggggttttgatttgcat

SEQ ID NO: 386234 - DNA, 20 bp, Artificial
  CRISPR gRNA sequence
gggttttgatttgcatttcc

SEQ ID NO: 386235 - DNA, 20 bp, Artificial
  CRISPR gRNA sequence
tgatttgcatttccctgatg

SEQ ID NO: 386236 - DNA, 20 bp, Artificial
  CRISPR gRNA sequence
gatttgcatttccctgatga

SEQ ID NO: 386237 - DNA, 20 bp, Artificial
  CRISPR gRNA sequence
atttgcatttccctgatgac

SEQ ID NO: 386238 - DNA, 20 bp, Artificial
  CRISPR gRNA sequence
gcatttccctgatgaccagt

SEQ ID NO: 386239 - DNA, 20 bp, Artificial
  CRISPR gRNA sequence
catttccctgatgaccagta

SEQ ID NO: 386240 - DNA, 20 bp, Artificial
  CRISPR gRNA sequence
ccctgatgaccagtaatgtt

SEQ ID NO: 386241 - DNA, 20 bp, Artificial
  CRISPR gRNA sequence
cctgatgaccagtaatgttg

SEQ ID NO: 386242 - DNA, 20 bp, Artificial
  CRISPR gRNA sequence
atgaccagtaatgttgagca

SEQ ID NO: 386243 - DNA, 20 bp, Artificial
  CRISPR gRNA sequence
agcagctttccatataccta

SEQ ID NO: 386244 - DNA, 20 bp, Artificial
  CRISPR gRNA sequence
tccatatacctattggccag

SEQ ID NO: 386245 - DNA, 20 bp, Artificial
  CRISPR gRNA sequence
ccatatacctattggccagt

SEQ ID NO: 386246 - DNA, 20 bp, Artificial
  CRISPR gRNA sequence
catatacctattggccagtg

SEQ ID NO: 386247 - DNA, 20 bp, Artificial
  CRISPR gRNA sequence
ttggccagtgttatgtcttc

SEQ ID NO: 386248 - DNA, 20 bp, Artificial
  CRISPR gRNA sequence
gccagtgttatgtcttcttt

SEQ ID NO: 386249 - DNA, 20 bp, Artificial
  CRISPR gRNA sequence
tgtcttctttggaaagatgt

SEQ ID NO: 386250 - DNA, 20 bp, Artificial
  CRISPR gRNA sequence
ctttggaaagatgtctgttt

SEQ ID NO: 386251 - DNA, 20 bp, Artificial
  CRISPR gRNA sequence
tttggaaagatgtctgtttt

SEQ ID NO: 386252 - DNA, 20 bp, Artificial
  CRISPR gRNA sequence
tggaaagatgtctgtttttg

SEQ ID NO: 386253 - DNA, 20 bp, Artificial
  CRISPR gRNA sequence
ggaaagatgtctgtttttgc

SEQ ID NO: 386254 - DNA, 20 bp, Artificial
  CRISPR gRNA sequence
gaaagatgtctgtttttgcc

SEQ ID NO: 386255 - DNA, 20 bp, Artificial
  CRISPR gRNA sequence
tttttgcccactttttaatt

SEQ ID NO: 386256 - DNA, 20 bp, Artificial
  CRISPR gRNA sequence
ttgcccactttttaattggg

SEQ ID NO: 386257 - DNA, 20 bp, Artificial
  CRISPR gRNA sequence
tgcccactttttaattgggt

SEQ ID NO: 386258 - DNA, 20 bp, Artificial
  CRISPR gRNA sequence
gcccactttttaattgggtt

SEQ ID NO: 386259 - DNA, 20 bp, Artificial
  CRISPR gRNA sequence
cccactttttaattgggttg

SEQ ID NO: 386260 - DNA, 20 bp, Artificial
  CRISPR gRNA sequence
tttaattgggttgctctttt

SEQ ID NO: 386261 - DNA, 20 bp, Artificial
  CRISPR gRNA sequence
ttaattgggttgctcttttg

SEQ ID NO: 386262 - DNA, 20 bp, Artificial
  CRISPR gRNA sequence
taattgggttgctcttttgc

SEQ ID NO: 386263 - DNA, 20 bp, Artificial
  CRISPR gRNA sequence
aattgggttgctcttttgct

SEQ ID NO: 386264 - DNA, 20 bp, Artificial
  CRISPR gRNA sequence
attgggttgctcttttgctg

SEQ ID NO: 386265 - DNA, 20 bp, Artificial
  CRISPR gRNA sequence
ggttgctcttttgctgtgaa

SEQ ID NO: 386266 - DNA, 20 bp, Artificial
  CRISPR gRNA sequence
ctcttttgctgtgaaatcct

SEQ ID NO: 386267 - DNA, 20 bp, Artificial
  CRISPR gRNA sequence
ttttgctgtgaaatcctgcc

SEQ ID NO: 386268 - DNA, 20 bp, Artificial
  CRISPR gRNA sequence
ttgctgtgaaatcctgccat

SEQ ID NO: 386269 - DNA, 20 bp, Artificial
  CRISPR gRNA sequence
tgctgtgaaatcctgccatt

SEQ ID NO: 386270 - DNA, 20 bp, Artificial
  CRISPR gRNA sequence
gctgtgaaatcctgccattt

SEQ ID NO: 386271 - DNA, 20 bp, Artificial
  CRISPR gRNA sequence
ctgtgaaatcctgccatttg

SEQ ID NO: 386272 - DNA, 20 bp, Artificial
  CRISPR gRNA sequence
tgaaatcctgccatttgcga

SEQ ID NO: 386273 - DNA, 20 bp, Artificial
  CRISPR gRNA sequence
ccatttgcgacagcatggat

SEQ ID NO: 386274 - DNA, 20 bp, Artificial
  CRISPR gRNA sequence
gcgacagcatggatgaattt

SEQ ID NO: 386275 - DNA, 20 bp, Artificial
  CRISPR gRNA sequence
cgacagcatggatgaatttg

SEQ ID NO: 386276 - DNA, 20 bp, Artificial
  CRISPR gRNA sequence
ggaggacattatgtaagtga

SEQ ID NO: 386277 - DNA, 20 bp, Artificial
  CRISPR gRNA sequence
gaggacattatgtaagtgaa

SEQ ID NO: 386278 - DNA, 20 bp, Artificial
  CRISPR gRNA sequence
tgtaagtgaaataagccaga

SEQ ID NO: 386279 - DNA, 20 bp, Artificial
  CRISPR gRNA sequence
tataatctcacctgtatgtg

SEQ ID NO: 386280 - DNA, 20 bp, Artificial
  CRISPR gRNA sequence
acctgtatgtggaatctaaa

SEQ ID NO: 386281 - DNA, 20 bp, Artificial
  CRISPR gRNA sequence
tatgtggaatctaaaaaagt

SEQ ID NO: 386282 - DNA, 20 bp, Artificial
  CRISPR gRNA sequence
aaaaagtcaaacttatagaa

SEQ ID NO: 386283 - DNA, 20 bp, Artificial
  CRISPR gRNA sequence
atagaagcagggaatagaac

SEQ ID NO: 386284 - DNA, 20 bp, Artificial
  CRISPR gRNA sequence
tagaagcagggaatagaaca

SEQ ID NO: 386285 - DNA, 20 bp, Artificial
  CRISPR gRNA sequence
ccaggaggtgggagggcaga

SEQ ID NO: 386286 - DNA, 20 bp, Artificial
  CRISPR gRNA sequence
gctaaagggtaccaactttt

SEQ ID NO: 386287 - DNA, 20 bp, Artificial
  CRISPR gRNA sequence
aagggtaccaacttttggtt

SEQ ID NO: 386288 - DNA, 20 bp, Artificial
  CRISPR gRNA sequence
ttggttataatggggaccta

SEQ ID NO: 386289 - DNA, 20 bp, Artificial
  CRISPR gRNA sequence
tggttataatggggacctac

SEQ ID NO: 386290 - DNA, 20 bp, Artificial
  CRISPR gRNA sequence
ggttataatggggacctact

SEQ ID NO: 386291 - DNA, 20 bp, Artificial
  CRISPR gRNA sequence
gttataatggggacctacta

SEQ ID NO: 386292 - DNA, 20 bp, Artificial
  CRISPR gRNA sequence
taatggggacctactataca

SEQ ID NO: 386293 - DNA, 20 bp, Artificial
  CRISPR gRNA sequence
ctatacagtatggatggtga

SEQ ID NO: 386294 - DNA, 20 bp, Artificial
  CRISPR gRNA sequence
tacagtatggatggtgatac

SEQ ID NO: 386295 - DNA, 20 bp, Artificial
  CRISPR gRNA sequence
attaattgtggtgattacta

SEQ ID NO: 386296 - DNA, 20 bp, Artificial
  CRISPR gRNA sequence
attgtggtgattactacacc

SEQ ID NO: 386297 - DNA, 20 bp, Artificial
  CRISPR gRNA sequence
tggtgattactacaccatgt

SEQ ID NO: 386298 - DNA, 20 bp, Artificial
  CRISPR gRNA sequence
ctacaccatgtttatataca

SEQ ID NO: 386299 - DNA, 20 bp, Artificial
  CRISPR gRNA sequence
caccatgtttatatacatca

SEQ ID NO: 386300 - DNA, 20 bp, Artificial
  CRISPR gRNA sequence
atatacatcaaataatcaca

SEQ ID NO: 386301 - DNA, 20 bp, Artificial
  CRISPR gRNA sequence
tatacatcaaataatcacac

SEQ ID NO: 386302 - DNA, 20 bp, Artificial
  CRISPR gRNA sequence
tatgccctgaatatattcaa

SEQ ID NO: 386303 - DNA, 20 bp, Artificial
  CRISPR gRNA sequence
aatatattcaatctttattt

SEQ ID NO: 386304 - DNA, 20 bp, Artificial
  CRISPR gRNA sequence
aatctttatttgacagttaa

SEQ ID NO: 386305 - DNA, 20 bp, Artificial
  CRISPR gRNA sequence
tatttgacagttaattattt

SEQ ID NO: 386306 - DNA, 20 bp, Artificial
  CRISPR gRNA sequence
atttgacagttaattattta

SEQ ID NO: 386307 - DNA, 20 bp, Artificial
  CRISPR gRNA sequence
tttgacagttaattatttaa

SEQ ID NO: 386308 - DNA, 20 bp, Artificial
  CRISPR gRNA sequence
gacagttaattatttaaaaa

SEQ ID NO: 386309 - DNA, 20 bp, Artificial
  CRISPR gRNA sequence
acagttaattatttaaaaaa

SEQ ID NO: 386310 - DNA, 20 bp, Artificial
  CRISPR gRNA sequence
attatttaaaaaaaaattta

SEQ ID NO: 386311 - DNA, 20 bp, Artificial
  CRISPR gRNA sequence
tttaaaaaaaaatttaaagc

SEQ ID NO: 386312 - DNA, 20 bp, Artificial
  CRISPR gRNA sequence
aaaaaaaaatttaaagcaat

SEQ ID NO: 386313 - DNA, 20 bp, Artificial
  CRISPR gRNA sequence
aaaaaaaatttaaagcaatt

SEQ ID NO: 386314 - DNA, 20 bp, Artificial
  CRISPR gRNA sequence
aaagcaattgttttctttgg

SEQ ID NO: 386315 - DNA, 20 bp, Artificial
  CRISPR gRNA sequence
aagcaattgttttctttggg

SEQ ID NO: 386316 - DNA, 20 bp, Artificial
  CRISPR gRNA sequence
ttttctttgggcttttttat

SEQ ID NO: 386317 - DNA, 20 bp, Artificial
  CRISPR gRNA sequence
tctttgggcttttttatatt

SEQ ID NO: 386318 - DNA, 20 bp, Artificial
  CRISPR gRNA sequence
ctttgggcttttttatattt

SEQ ID NO: 386319 - DNA, 20 bp, Artificial
  CRISPR gRNA sequence
tttgggcttttttatatttt

SEQ ID NO: 386320 - DNA, 20 bp, Artificial
  CRISPR gRNA sequence
tgggcttttttatattttcc

SEQ ID NO: 386321 - DNA, 20 bp, Artificial
  CRISPR gRNA sequence
gggcttttttatattttcca

SEQ ID NO: 386322 - DNA, 20 bp, Artificial
  CRISPR gRNA sequence
ggcttttttatattttccaa

SEQ ID NO: 386323 - DNA, 20 bp, Artificial
  CRISPR gRNA sequence
ttttatattttccaaatttt

SEQ ID NO: 386324 - DNA, 20 bp, Artificial
  CRISPR gRNA sequence
tttatattttccaaattttc

SEQ ID NO: 386325 - DNA, 20 bp, Artificial
  CRISPR gRNA sequence
ttatattttccaaattttct

SEQ ID NO: 386326 - DNA, 20 bp, Artificial
  CRISPR gRNA sequence
tatattttccaaattttcta

SEQ ID NO: 386327 - DNA, 20 bp, Artificial
  CRISPR gRNA sequence
atattttccaaattttctag

SEQ ID NO: 386328 - DNA, 20 bp, Artificial
  CRISPR gRNA sequence
tattttccaaattttctaga

SEQ ID NO: 386329 - DNA, 20 bp, Artificial
  CRISPR gRNA sequence
tccaaattttctagacgatg

SEQ ID NO: 386330 - DNA, 20 bp, Artificial
  CRISPR gRNA sequence
ccaaattttctagacgatgt

SEQ ID NO: 386331 - DNA, 20 bp, Artificial
  CRISPR gRNA sequence
caaattttctagacgatgtg

SEQ ID NO: 386332 - DNA, 20 bp, Artificial
  CRISPR gRNA sequence
tctagacgatgtgttcattt

SEQ ID NO: 386333 - DNA, 20 bp, Artificial
  CRISPR gRNA sequence
ctagacgatgtgttcatttt

SEQ ID NO: 386334 - DNA, 20 bp, Artificial
  CRISPR gRNA sequence
tagacgatgtgttcattttg

SEQ ID NO: 386335 - DNA, 20 bp, Artificial
  CRISPR gRNA sequence
gacgatgtgttcattttgtg

SEQ ID NO: 386336 - DNA, 20 bp, Artificial
  CRISPR gRNA sequence
attttgtgatcaggcaaata

SEQ ID NO: 386337 - DNA, 20 bp, Artificial
  CRISPR gRNA sequence
tgtgatcaggcaaatacagt

SEQ ID NO: 386338 - DNA, 20 bp, Artificial
  CRISPR gRNA sequence
gtgatcaggcaaatacagta

SEQ ID NO: 386339 - DNA, 20 bp, Artificial
  CRISPR gRNA sequence
tgatcaggcaaatacagtac

SEQ ID NO: 386340 - DNA, 20 bp, Artificial
  CRISPR gRNA sequence
caggcttaaaaaagaatatt

SEQ ID NO: 386341 - DNA, 20 bp, Artificial
  CRISPR gRNA sequence
aaaaaagaatattttatcaa

SEQ ID NO: 386342 - DNA, 20 bp, Artificial
  CRISPR gRNA sequence
aaaaagaatattttatcaaa

SEQ ID NO: 386343 - DNA, 20 bp, Artificial
  CRISPR gRNA sequence
tatcaaatcttagtggttaa

SEQ ID NO: 386344 - DNA, 20 bp, Artificial
  CRISPR gRNA sequence
atcaaatcttagtggttaaa

SEQ ID NO: 386345 - DNA, 20 bp, Artificial
  CRISPR gRNA sequence
tcaaatcttagtggttaaag

SEQ ID NO: 386346 - DNA, 20 bp, Artificial
  CRISPR gRNA sequence
agtggttaaagtacaggatg

SEQ ID NO: 386347 - DNA, 20 bp, Artificial
  CRISPR gRNA sequence
gtggttaaagtacaggatgt

SEQ ID NO: 386348 - DNA, 20 bp, Artificial
  CRISPR gRNA sequence
aagtacaggatgtagaaatc

SEQ ID NO: 386349 - DNA, 20 bp, Artificial
  CRISPR gRNA sequence
ttctttagaaatagaatact

SEQ ID NO: 386350 - DNA, 20 bp, Artificial
  CRISPR gRNA sequence
tctttagaaatagaatactt

SEQ ID NO: 386351 - DNA, 20 bp, Artificial
  CRISPR gRNA sequence
ctttagaaatagaatactta

SEQ ID NO: 386352 - DNA, 20 bp, Artificial
  CRISPR gRNA sequence
tttagaaatagaatacttaa

SEQ ID NO: 386353 - DNA, 20 bp, Artificial
  CRISPR gRNA sequence
tagaaatagaatacttaaca

SEQ ID NO: 386354 - DNA, 20 bp, Artificial
  CRISPR gRNA sequence
agaaatagaatacttaacaa

SEQ ID NO: 386355 - DNA, 20 bp, Artificial
  CRISPR gRNA sequence
gaaatagaatacttaacaat

SEQ ID NO: 386356 - DNA, 20 bp, Artificial
  CRISPR gRNA sequence
aacaattaagatggctttct

SEQ ID NO: 386357 - DNA, 20 bp, Artificial
  CRISPR gRNA sequence
acaattaagatggctttctt

SEQ ID NO: 386358 - DNA, 20 bp, Artificial
  CRISPR gRNA sequence
agatggctttctttatgaag

SEQ ID NO: 386359 - DNA, 20 bp, Artificial
  CRISPR gRNA sequence
tctttatgaaggtctaattt

SEQ ID NO: 386360 - DNA, 20 bp, Artificial
  CRISPR gRNA sequence
ctttatgaaggtctaattta

SEQ ID NO: 386361 - DNA, 20 bp, Artificial
  CRISPR gRNA sequence
tttatgaaggtctaatttat

SEQ ID NO: 386362 - DNA, 20 bp, Artificial
  CRISPR gRNA sequence
tatgaaggtctaatttatat

SEQ ID NO: 386363 - DNA, 20 bp, Artificial
  CRISPR gRNA sequence
atgaaggtctaatttatatg

SEQ ID NO: 386364 - DNA, 20 bp, Artificial
  CRISPR gRNA sequence
tgaaggtctaatttatatga

SEQ ID NO: 386365 - DNA, 20 bp, Artificial
  CRISPR gRNA sequence
atttatatgaatttaacagt

SEQ ID NO: 386366 - DNA, 20 bp, Artificial
  CRISPR gRNA sequence
atatgaatttaacagtataa

SEQ ID NO: 386367 - DNA, 20 bp, Artificial
  CRISPR gRNA sequence
tatgaatttaacagtataac

SEQ ID NO: 386368 - DNA, 20 bp, Artificial
  CRISPR gRNA sequence
aacagtataacctgcttgaa

SEQ ID NO: 386369 - DNA, 20 bp, Artificial
  CRISPR gRNA sequence
acagtataacctgcttgaaa

SEQ ID NO: 386370 - DNA, 20 bp, Artificial
  CRISPR gRNA sequence
cttgaaagtacgaccacttg

SEQ ID NO: 386371 - DNA, 20 bp, Artificial
  CRISPR gRNA sequence
gaaagtacgaccacttgtga

SEQ ID NO: 386372 - DNA, 20 bp, Artificial
  CRISPR gRNA sequence
aaagtacgaccacttgtgac

SEQ ID NO: 386373 - DNA, 20 bp, Artificial
  CRISPR gRNA sequence
gtgacacactgttcaattat

SEQ ID NO: 386374 - DNA, 20 bp, Artificial
  CRISPR gRNA sequence
tgacacactgttcaattata

SEQ ID NO: 386375 - DNA, 20 bp, Artificial
  CRISPR gRNA sequence
ttcaattataaatccaaatt

SEQ ID NO: 386376 - DNA, 20 bp, Artificial
  CRISPR gRNA sequence
aattataaatccaaatttca

SEQ ID NO: 386377 - DNA, 20 bp, Artificial
  CRISPR gRNA sequence
taaatccaaatttcagatgc

SEQ ID NO: 386378 - DNA, 20 bp, Artificial
  CRISPR gRNA sequence
cagatgcattgtttcatagg

SEQ ID NO: 386379 - DNA, 20 bp, Artificial
  CRISPR gRNA sequence
agatgcattgtttcatagga

SEQ ID NO: 386380 - DNA, 20 bp, Artificial
  CRISPR gRNA sequence
tttcataggaaatatgttac

SEQ ID NO: 386381 - DNA, 20 bp, Artificial
  CRISPR gRNA sequence
cataggaaatatgttaccta

SEQ ID NO: 386382 - DNA, 20 bp, Artificial
  CRISPR gRNA sequence
ataggaaatatgttacctat

SEQ ID NO: 386383 - DNA, 20 bp, Artificial
  CRISPR gRNA sequence
cctatttgtaacccgttttt

SEQ ID NO: 386384 - DNA, 20 bp, Artificial
  CRISPR gRNA sequence
tttgtaacccgtttttagta

SEQ ID NO: 386385 - DNA, 20 bp, Artificial
  CRISPR gRNA sequence
gtaacccgtttttagtaatg

SEQ ID NO: 386386 - DNA, 20 bp, Artificial
  CRISPR gRNA sequence
taacccgtttttagtaatgt

SEQ ID NO: 386387 - DNA, 20 bp, Artificial
  CRISPR gRNA sequence
ttagtaatgtttggcctctt

SEQ ID NO: 386388 - DNA, 20 bp, Artificial
  CRISPR gRNA sequence
tagtaatgtttggcctcttg

SEQ ID NO: 386389 - DNA, 20 bp, Artificial
  CRISPR gRNA sequence
agtaatgtttggcctcttgg

SEQ ID NO: 386390 - DNA, 20 bp, Artificial
  CRISPR gRNA sequence
gtaatgtttggcctcttgga

SEQ ID NO: 386391 - DNA, 20 bp, Artificial
  CRISPR gRNA sequence
ggcctcttggatcagatcca

SEQ ID NO: 386392 - DNA, 20 bp, Artificial
  CRISPR gRNA sequence
gcctcttggatcagatccat

SEQ ID NO: 386393 - DNA, 20 bp, Artificial
  CRISPR gRNA sequence
ttggatcagatccatttatt

SEQ ID NO: 386394 - DNA, 20 bp, Artificial
  CRISPR gRNA sequence
ggatcagatccatttattca

SEQ ID NO: 386395 - DNA, 20 bp, Artificial
  CRISPR gRNA sequence
gatcagatccatttattcac

SEQ ID NO: 386396 - DNA, 20 bp, Artificial
  CRISPR gRNA sequence
attcactcagtctttaaaca

SEQ ID NO: 386397 - DNA, 20 bp, Artificial
  CRISPR gRNA sequence
ttcactcagtctttaaacac

SEQ ID NO: 386398 - DNA, 20 bp, Artificial
  CRISPR gRNA sequence
actcagtctttaaacacaaa

SEQ ID NO: 386399 - DNA, 20 bp, Artificial
  CRISPR gRNA sequence
agtctttaaacacaaagtat

SEQ ID NO: 386400 - DNA, 20 bp, Artificial
  CRISPR gRNA sequence
taaacacaaagtatttcaag

SEQ ID NO: 386401 - DNA, 20 bp, Artificial
  CRISPR gRNA sequence
aaacacaaagtatttcaagg

SEQ ID NO: 386402 - DNA, 20 bp, Artificial
  CRISPR gRNA sequence
aacacaaagtatttcaaggt

SEQ ID NO: 386403 - DNA, 20 bp, Artificial
  CRISPR gRNA sequence
caaggtgtactgtatgcctg

SEQ ID NO: 386404 - DNA, 20 bp, Artificial
  CRISPR gRNA sequence
aaggtgtactgtatgcctgg

SEQ ID NO: 386405 - DNA, 20 bp, Artificial
  CRISPR gRNA sequence
tatgcctggtactacagaca

SEQ ID NO: 386406 - DNA, 20 bp, Artificial
  CRISPR gRNA sequence
gtactacagacaaagtggta

SEQ ID NO: 386407 - DNA, 20 bp, Artificial
  CRISPR gRNA sequence
cagacaaagtggtaggtaaa

SEQ ID NO: 386408 - DNA, 20 bp, Artificial
  CRISPR gRNA sequence
gacacctgtgtagaaaaaaa

SEQ ID NO: 386409 - DNA, 20 bp, Artificial
  CRISPR gRNA sequence
acacctgtgtagaaaaaaaa

SEQ ID NO: 386410 - DNA, 20 bp, Artificial
  CRISPR gRNA sequence
tgtagaaaaaaaactctcca

SEQ ID NO: 386411 - DNA, 20 bp, Artificial
  CRISPR gRNA sequence
tccaattgtgttttttctct

SEQ ID NO: 386412 - DNA, 20 bp, Artificial
  CRISPR gRNA sequence
caattgtgttttttctctgc

SEQ ID NO: 386413 - DNA, 20 bp, Artificial
  CRISPR gRNA sequence
tgttttttctctgctctcac

SEQ ID NO: 386414 - DNA, 20 bp, Artificial
  CRISPR gRNA sequence
tttctctgctctcacactac

SEQ ID NO: 386415 - DNA, 20 bp, Artificial
  CRISPR gRNA sequence
ttctctgctctcacactacc

SEQ ID NO: 386416 - DNA, 20 bp, Artificial
  CRISPR gRNA sequence
tctctgctctcacactacca

SEQ ID NO: 386417 - DNA, 20 bp, Artificial
  CRISPR gRNA sequence
ctctgctctcacactaccac

SEQ ID NO: 386418 - DNA, 20 bp, Artificial
  CRISPR gRNA sequence
tctgctctcacactaccaca

SEQ ID NO: 386419 - DNA, 20 bp, Artificial
  CRISPR gRNA sequence
tgctctcacactaccacagc

SEQ ID NO: 386420 - DNA, 20 bp, Artificial
  CRISPR gRNA sequence
ctctcacactaccacagcaa

SEQ ID NO: 386421 - DNA, 20 bp, Artificial
  CRISPR gRNA sequence
tcacactaccacagcaatcg

SEQ ID NO: 386422 - DNA, 20 bp, Artificial
  CRISPR gRNA sequence
acactaccacagcaatcgtc

SEQ ID NO: 386423 - DNA, 20 bp, Artificial
  CRISPR gRNA sequence
ccacagcaatcgtcaacaga

SEQ ID NO: 386424 - DNA, 20 bp, Artificial
  CRISPR gRNA sequence
ctgtgaccaaaggtgtgggt

SEQ ID NO: 386425 - DNA, 20 bp, Artificial
  CRISPR gRNA sequence
tgtgaccaaaggtgtgggtg

SEQ ID NO: 386426 - DNA, 20 bp, Artificial
  CRISPR gRNA sequence
tgaccaaaggtgtgggtggt

SEQ ID NO: 386427 - DNA, 20 bp, Artificial
  CRISPR gRNA sequence
tcccccacagtaacaggcac

SEQ ID NO: 386428 - DNA, 20 bp, Artificial
  CRISPR gRNA sequence
cccccacagtaacaggcacc

SEQ ID NO: 386429 - DNA, 20 bp, Artificial
  CRISPR gRNA sequence
ccccacagtaacaggcacca

SEQ ID NO: 386430 - DNA, 20 bp, Artificial
  CRISPR gRNA sequence
agtgtccgccaattcaattc

SEQ ID NO: 386431 - DNA, 20 bp, Artificial
  CRISPR gRNA sequence
aattctgacatgatctaccc

SEQ ID NO: 386432 - DNA, 20 bp, Artificial
  CRISPR gRNA sequence
tgacatgatctacccaagga

SEQ ID NO: 386433 - DNA, 20 bp, Artificial
  CRISPR gRNA sequence
acatgatctacccaaggaca

SEQ ID NO: 386434 - DNA, 20 bp, Artificial
  CRISPR gRNA sequence
cccaaggacagtatcagatc

SEQ ID NO: 386435 - DNA, 20 bp, Artificial
  CRISPR gRNA sequence
ggggctcagtcccaaagaca

SEQ ID NO: 386436 - DNA, 20 bp, Artificial
  CRISPR gRNA sequence
agtcccaaagacatctcacc

SEQ ID NO: 386437 - DNA, 20 bp, Artificial
  CRISPR gRNA sequence
accccctcctccattgctaa

SEQ ID NO: 386438 - DNA, 20 bp, Artificial
  CRISPR gRNA sequence
ctccattgctaaccctgccc

SEQ ID NO: 386439 - DNA, 20 bp, Artificial
  CRISPR gRNA sequence
cattgctaaccctgcccttc

SEQ ID NO: 386440 - DNA, 20 bp, Artificial
  CRISPR gRNA sequence
ctaaccctgcccttcagaca

SEQ ID NO: 386441 - DNA, 20 bp, Artificial
  CRISPR gRNA sequence
accctgcccttcagacacca

SEQ ID NO: 386442 - DNA, 20 bp, Artificial
  CRISPR gRNA sequence
cccttcagacaccaattgca

SEQ ID NO: 386443 - DNA, 20 bp, Artificial
  CRISPR gRNA sequence
cagacaccaattgcaagtcc

SEQ ID NO: 386444 - DNA, 20 bp, Artificial
  CRISPR gRNA sequence
agacaccaattgcaagtcca

SEQ ID NO: 386445 - DNA, 20 bp, Artificial
  CRISPR gRNA sequence
caagtccaggcctctagaac

SEQ ID NO: 386446 - DNA, 20 bp, Artificial
  CRISPR gRNA sequence
tagaactttttttttttttt

SEQ ID NO: 386447 - DNA, 20 bp, Artificial
  CRISPR gRNA sequence
gaactttttttttttttttt

SEQ ID NO: 386448 - DNA, 20 bp, Artificial
  CRISPR gRNA sequence
tttttttttttttttttttt

SEQ ID NO: 386449 - DNA, 20 bp, Artificial
  CRISPR gRNA sequence
tttttttttttttttttttt

SEQ ID NO: 386450 - DNA, 20 bp, Artificial
  CRISPR gRNA sequence
tttttttttttttttttttt

SEQ ID NO: 386451 - DNA, 20 bp, Artificial
  CRISPR gRNA sequence
tttttttttttttttttttt

SEQ ID NO: 386452 - DNA, 20 bp, Artificial
  CRISPR gRNA sequence
tttttttttttttttttttt

SEQ ID NO: 386453 - DNA, 20 bp, Artificial
  CRISPR gRNA sequence
tttttttttttttttttttg

SEQ ID NO: 386454 - DNA, 20 bp, Artificial
  CRISPR gRNA sequence
ttttttttttttttttttga

SEQ ID NO: 386455 - DNA, 20 bp, Artificial
  CRISPR gRNA sequence
tttttttttttttttttgag

SEQ ID NO: 386456 - DNA, 20 bp, Artificial
  CRISPR gRNA sequence
ttttttttttttttttgaga

SEQ ID NO: 386457 - DNA, 20 bp, Artificial
  CRISPR gRNA sequence
tttttttttttttttgagac

SEQ ID NO: 386458 - DNA, 20 bp, Artificial
  CRISPR gRNA sequence
ttttttttttttttgagacg

SEQ ID NO: 386459 - DNA, 20 bp, Artificial
  CRISPR gRNA sequence
tttttttttttttgagacgg

SEQ ID NO: 386460 - DNA, 20 bp, Artificial
  CRISPR gRNA sequence
ttttttttttttgagacgga

SEQ ID NO: 386461 - DNA, 20 bp, Artificial
  CRISPR gRNA sequence
tttttttttttgagacggag

SEQ ID NO: 386462 - DNA, 20 bp, Artificial
  CRISPR gRNA sequence
ttttttttttgagacggagt

SEQ ID NO: 386463 - DNA, 20 bp, Artificial
  CRISPR gRNA sequence
tttttttttgagacggagtc

SEQ ID NO: 386464 - DNA, 20 bp, Artificial
  CRISPR gRNA sequence
ttttttttgagacggagtct

SEQ ID NO: 386465 - DNA, 20 bp, Artificial
  CRISPR gRNA sequence
tttttttgagacggagtctc

SEQ ID NO: 386466 - DNA, 20 bp, Artificial
  CRISPR gRNA sequence
ttttttgagacggagtctcg

SEQ ID NO: 386467 - DNA, 20 bp, Artificial
  CRISPR gRNA sequence
tttttgagacggagtctcgc

SEQ ID NO: 386468 - DNA, 20 bp, Artificial
  CRISPR gRNA sequence
ttttgagacggagtctcgct

SEQ ID NO: 386469 - DNA, 20 bp, Artificial
  CRISPR gRNA sequence
tttgagacggagtctcgctc

SEQ ID NO: 386470 - DNA, 20 bp, Artificial
  CRISPR gRNA sequence
ttgagacggagtctcgctct

SEQ ID NO: 386471 - DNA, 20 bp, Artificial
  CRISPR gRNA sequence
tgagacggagtctcgctctg

SEQ ID NO: 386472 - DNA, 20 bp, Artificial
  CRISPR gRNA sequence
gagacggagtctcgctctgt

SEQ ID NO: 386473 - DNA, 20 bp, Artificial
  CRISPR gRNA sequence
agacggagtctcgctctgtc

SEQ ID NO: 386474 - DNA, 20 bp, Artificial
  CRISPR gRNA sequence
gctctgtcacccaggctgga

SEQ ID NO: 386475 - DNA, 20 bp, Artificial
  CRISPR gRNA sequence
tgtcacccaggctggagtac

SEQ ID NO: 386476 - DNA, 20 bp, Artificial
  CRISPR gRNA sequence
tcacccaggctggagtacaa

SEQ ID NO: 386477 - DNA, 20 bp, Artificial
  CRISPR gRNA sequence
gagtacaatggcaggatctc

SEQ ID NO: 386478 - DNA, 20 bp, Artificial
  CRISPR gRNA sequence
ggctcgctgcaatctccgcc

SEQ ID NO: 386479 - DNA, 20 bp, Artificial
  CRISPR gRNA sequence
gctgcaatctccgcctccca

SEQ ID NO: 386480 - DNA, 20 bp, Artificial
  CRISPR gRNA sequence
caatctccgcctcccaggtt

SEQ ID NO: 386481 - DNA, 20 bp, Artificial
  CRISPR gRNA sequence
cgcctcccaggttcaagtga

SEQ ID NO: 386482 - DNA, 20 bp, Artificial
  CRISPR gRNA sequence
ccaggttcaagtgattctcc

SEQ ID NO: 386483 - DNA, 20 bp, Artificial
  CRISPR gRNA sequence
aagtgattctcctgcctcag

SEQ ID NO: 386484 - DNA, 20 bp, Artificial
  CRISPR gRNA sequence
tcctgcctcagcctcctgag

SEQ ID NO: 386485 - DNA, 20 bp, Artificial
  CRISPR gRNA sequence
ctgcctcagcctcctgagta

SEQ ID NO: 386486 - DNA, 20 bp, Artificial
  CRISPR gRNA sequence
cctcagcctcctgagtagct

SEQ ID NO: 386487 - DNA, 20 bp, Artificial
  CRISPR gRNA sequence
agcctcctgagtagctggga

SEQ ID NO: 386488 - DNA, 20 bp, Artificial
  CRISPR gRNA sequence
ctgagtagctgggattacag

SEQ ID NO: 386489 - DNA, 20 bp, Artificial
  CRISPR gRNA sequence
agtagctgggattacaggca

SEQ ID NO: 386490 - DNA, 20 bp, Artificial
  CRISPR gRNA sequence
ggattacaggcacccgccac

SEQ ID NO: 386491 - DNA, 20 bp, Artificial
  CRISPR gRNA sequence
caggcacccgccactacgtc

SEQ ID NO: 386492 - DNA, 20 bp, Artificial
  CRISPR gRNA sequence
cgtccagctaatttttgtat

SEQ ID NO: 386493 - DNA, 20 bp, Artificial
  CRISPR gRNA sequence
atttttgtatttttagtaga

SEQ ID NO: 386494 - DNA, 20 bp, Artificial
  CRISPR gRNA sequence
ttgtatttttagtagagacg

SEQ ID NO: 386495 - DNA, 20 bp, Artificial
  CRISPR gRNA sequence
tgtatttttagtagagacgg

SEQ ID NO: 386496 - DNA, 20 bp, Artificial
  CRISPR gRNA sequence
gtatttttagtagagacggg

SEQ ID NO: 386497 - DNA, 20 bp, Artificial
  CRISPR gRNA sequence
tatttttagtagagacgggg

SEQ ID NO: 386498 - DNA, 20 bp, Artificial
  CRISPR gRNA sequence
ttagtagagacggggtttca

SEQ ID NO: 386499 - DNA, 20 bp, Artificial
  CRISPR gRNA sequence
tagtagagacggggtttcac

SEQ ID NO: 386500 - DNA, 20 bp, Artificial
  CRISPR gRNA sequence
agtagagacggggtttcacc

SEQ ID NO: 386501 - DNA, 20 bp, Artificial
  CRISPR gRNA sequence
gtagagacggggtttcacca

SEQ ID NO: 386502 - DNA, 20 bp, Artificial
  CRISPR gRNA sequence
caccatgttagtcaggctgg

SEQ ID NO: 386503 - DNA, 20 bp, Artificial
  CRISPR gRNA sequence
accatgttagtcaggctggt

SEQ ID NO: 386504 - DNA, 20 bp, Artificial
  CRISPR gRNA sequence
gtcaggctggtctcgaactc

SEQ ID NO: 386505 - DNA, 20 bp, Artificial
  CRISPR gRNA sequence
gtctcgaactcctcacctaa

SEQ ID NO: 386506 - DNA, 20 bp, Artificial
  CRISPR gRNA sequence
gaactcctcacctaaggtga

SEQ ID NO: 386507 - DNA, 20 bp, Artificial
  CRISPR gRNA sequence
ctcacctaaggtgatccgcc

SEQ ID NO: 386508 - DNA, 20 bp, Artificial
  CRISPR gRNA sequence
acctaaggtgatccgccctc

SEQ ID NO: 386509 - DNA, 20 bp, Artificial
  CRISPR gRNA sequence
aggtgatccgccctcctcgg

SEQ ID NO: 386510 - DNA, 20 bp, Artificial
  CRISPR gRNA sequence
ctcggcctcccaaagtgctg

SEQ ID NO: 386511 - DNA, 20 bp, Artificial
  CRISPR gRNA sequence
ggcctcccaaagtgctggga

SEQ ID NO: 386512 - DNA, 20 bp, Artificial
  CRISPR gRNA sequence
ccaaagtgctgggattgcag

SEQ ID NO: 386513 - DNA, 20 bp, Artificial
  CRISPR gRNA sequence
ggattgcaggcgtgagccac

SEQ ID NO: 386514 - DNA, 20 bp, Artificial
  CRISPR gRNA sequence
caggcgtgagccaccgtgcc

SEQ ID NO: 386515 - DNA, 20 bp, Artificial
  CRISPR gRNA sequence
tagaacttcggaccaatggg

SEQ ID NO: 386516 - DNA, 20 bp, Artificial
  CRISPR gRNA sequence
gaacttcggaccaatgggcc

SEQ ID NO: 386517 - DNA, 20 bp, Artificial
  CRISPR gRNA sequence
cggaccaatgggcctcaagc

SEQ ID NO: 386518 - DNA, 20 bp, Artificial
  CRISPR gRNA sequence
ggaccaatgggcctcaagct

SEQ ID NO: 386519 - DNA, 20 bp, Artificial
  CRISPR gRNA sequence
aagctggggttcccaagacc

SEQ ID NO: 386520 - DNA, 20 bp, Artificial
  CRISPR gRNA sequence
gggttcccaagacccctttt

SEQ ID NO: 386521 - DNA, 20 bp, Artificial
  CRISPR gRNA sequence
ccaagacccctttttcaggt

SEQ ID NO: 386522 - DNA, 20 bp, Artificial
  CRISPR gRNA sequence
tttcaggtttggttaatctg

SEQ ID NO: 386523 - DNA, 20 bp, Artificial
  CRISPR gRNA sequence
ttcaggtttggttaatctgg

SEQ ID NO: 386524 - DNA, 20 bp, Artificial
  CRISPR gRNA sequence
tcaggtttggttaatctggt

SEQ ID NO: 386525 - DNA, 20 bp, Artificial
  CRISPR gRNA sequence
caggtttggttaatctggtg

SEQ ID NO: 386526 - DNA, 20 bp, Artificial
  CRISPR gRNA sequence
aggtttggttaatctggtgg

SEQ ID NO: 386527 - DNA, 20 bp, Artificial
  CRISPR gRNA sequence
ggttaatctggtggagccag

SEQ ID NO: 386528 - DNA, 20 bp, Artificial
  CRISPR gRNA sequence
gttaatctggtggagccagt

SEQ ID NO: 386529 - DNA, 20 bp, Artificial
  CRISPR gRNA sequence
atctggtggagccagttata

SEQ ID NO: 386530 - DNA, 20 bp, Artificial
  CRISPR gRNA sequence
gtggagccagttatagagct

SEQ ID NO: 386531 - DNA, 20 bp, Artificial
  CRISPR gRNA sequence
tagagctcaagaaaacacat

SEQ ID NO: 386532 - DNA, 20 bp, Artificial
  CRISPR gRNA sequence
aagaaaacacatttgtcagt

SEQ ID NO: 386533 - DNA, 20 bp, Artificial
  CRISPR gRNA sequence
gtcagtttaatatcaaggat

SEQ ID NO: 386534 - DNA, 20 bp, Artificial
  CRISPR gRNA sequence
tcagtttaatatcaaggata

SEQ ID NO: 386535 - DNA, 20 bp, Artificial
  CRISPR gRNA sequence
aatatcaaggatattgcaag

SEQ ID NO: 386536 - DNA, 20 bp, Artificial
  CRISPR gRNA sequence
atatcaaggatattgcaagg

SEQ ID NO: 386537 - DNA, 20 bp, Artificial
  CRISPR gRNA sequence
caagggatacagatgaagag

SEQ ID NO: 386538 - DNA, 20 bp, Artificial
  CRISPR gRNA sequence
gtagggtgaggcatgtgtaa

SEQ ID NO: 386539 - DNA, 20 bp, Artificial
  CRISPR gRNA sequence
ccatgccctccctgtccaca

SEQ ID NO: 386540 - DNA, 20 bp, Artificial
  CRISPR gRNA sequence
cctgtccacatcaccctcca

SEQ ID NO: 386541 - DNA, 20 bp, Artificial
  CRISPR gRNA sequence
tccacatcaccctccaggag

SEQ ID NO: 386542 - DNA, 20 bp, Artificial
  CRISPR gRNA sequence
caggaggctccacatgttca

SEQ ID NO: 386543 - DNA, 20 bp, Artificial
  CRISPR gRNA sequence
cacatgttcagctgtccaga

SEQ ID NO: 386544 - DNA, 20 bp, Artificial
  CRISPR gRNA sequence
agctgtccagaaactctcca

SEQ ID NO: 386545 - DNA, 20 bp, Artificial
  CRISPR gRNA sequence
tccagaaactctccaaaccc

SEQ ID NO: 386546 - DNA, 20 bp, Artificial
  CRISPR gRNA sequence
tccaaaccccatcctcttgg

SEQ ID NO: 386547 - DNA, 20 bp, Artificial
  CRISPR gRNA sequence
caaaccccatcctcttggat

SEQ ID NO: 386548 - DNA, 20 bp, Artificial
  CRISPR gRNA sequence
ttggatttttatggaggctt

SEQ ID NO: 386549 - DNA, 20 bp, Artificial
  CRISPR gRNA sequence
ggatttttatggaggcttca

SEQ ID NO: 386550 - DNA, 20 bp, Artificial
  CRISPR gRNA sequence
gatttttatggaggcttcat

SEQ ID NO: 386551 - DNA, 20 bp, Artificial
  CRISPR gRNA sequence
ttatggaggcttcattacgt

SEQ ID NO: 386552 - DNA, 20 bp, Artificial
  CRISPR gRNA sequence
tatggaggcttcattacgta

SEQ ID NO: 386553 - DNA, 20 bp, Artificial
  CRISPR gRNA sequence
atggaggcttcattacgtag

SEQ ID NO: 386554 - DNA, 20 bp, Artificial
  CRISPR gRNA sequence
tggaggcttcattacgtagg

SEQ ID NO: 386555 - DNA, 20 bp, Artificial
  CRISPR gRNA sequence
cattacgtaggtatgactga

SEQ ID NO: 386556 - DNA, 20 bp, Artificial
  CRISPR gRNA sequence
attacgtaggtatgactgac

SEQ ID NO: 386557 - DNA, 20 bp, Artificial
  CRISPR gRNA sequence
cgtaggtatgactgacaacc

SEQ ID NO: 386558 - DNA, 20 bp, Artificial
  CRISPR gRNA sequence
acaaccttgtagaaatggga

SEQ ID NO: 386559 - DNA, 20 bp, Artificial
  CRISPR gRNA sequence
gtagaaatgggactgggcaa

SEQ ID NO: 386560 - DNA, 20 bp, Artificial
  CRISPR gRNA sequence
tagaaatgggactgggcaaa

SEQ ID NO: 386561 - DNA, 20 bp, Artificial
  CRISPR gRNA sequence
ggcaaaaagcatatcatcta

SEQ ID NO: 386562 - DNA, 20 bp, Artificial
  CRISPR gRNA sequence
aacccagcaagtcctgtcca

SEQ ID NO: 386563 - DNA, 20 bp, Artificial
  CRISPR gRNA sequence
tccagactttagatatgggg

SEQ ID NO: 386564 - DNA, 20 bp, Artificial
  CRISPR gRNA sequence
tagatatggggtgggatcct

SEQ ID NO: 386565 - DNA, 20 bp, Artificial
  CRISPR gRNA sequence
agatatggggtgggatcctc

SEQ ID NO: 386566 - DNA, 20 bp, Artificial
  CRISPR gRNA sequence
gatatggggtgggatcctct

SEQ ID NO: 386567 - DNA, 20 bp, Artificial
  CRISPR gRNA sequence
tctggaatgagggtcttttg

SEQ ID NO: 386568 - DNA, 20 bp, Artificial
  CRISPR gRNA sequence
tggaatgagggtcttttgac

SEQ ID NO: 386569 - DNA, 20 bp, Artificial
  CRISPR gRNA sequence
gaatgagggtcttttgaccc

SEQ ID NO: 386570 - DNA, 20 bp, Artificial
  CRISPR gRNA sequence
ttgacccacattcagattag

SEQ ID NO: 386571 - DNA, 20 bp, Artificial
  CRISPR gRNA sequence
tgacccacattcagattaga

SEQ ID NO: 386572 - DNA, 20 bp, Artificial
  CRISPR gRNA sequence
gacccacattcagattagag

SEQ ID NO: 386573 - DNA, 20 bp, Artificial
  CRISPR gRNA sequence
acccacattcagattagagt

SEQ ID NO: 386574 - DNA, 20 bp, Artificial
  CRISPR gRNA sequence
agattagagtcttaccttgg

SEQ ID NO: 386575 - DNA, 20 bp, Artificial
  CRISPR gRNA sequence
gagtcttaccttggtcagga

SEQ ID NO: 386576 - DNA, 20 bp, Artificial
  CRISPR gRNA sequence
accttggtcaggagaaagga

SEQ ID NO: 386577 - DNA, 20 bp, Artificial
  CRISPR gRNA sequence
ccttggtcaggagaaaggac

SEQ ID NO: 386578 - DNA, 20 bp, Artificial
  CRISPR gRNA sequence
ggtcaggagaaaggacagga

SEQ ID NO: 386579 - DNA, 20 bp, Artificial
  CRISPR gRNA sequence
gtcaggagaaaggacaggag

SEQ ID NO: 386580 - DNA, 20 bp, Artificial
  CRISPR gRNA sequence
ctgtttcctgaggcctgaag

SEQ ID NO: 386581 - DNA, 20 bp, Artificial
  CRISPR gRNA sequence
tgtttcctgaggcctgaagt

SEQ ID NO: 386582 - DNA, 20 bp, Artificial
  CRISPR gRNA sequence
tttcctgaggcctgaagtgc

SEQ ID NO: 386583 - DNA, 20 bp, Artificial
  CRISPR gRNA sequence
cctgaggcctgaagtgcccc

SEQ ID NO: 386584 - DNA, 20 bp, Artificial
  CRISPR gRNA sequence
ctgaggcctgaagtgcccca

SEQ ID NO: 386585 - DNA, 20 bp, Artificial
  CRISPR gRNA sequence
aggcctgaagtgccccaaca

SEQ ID NO: 386586 - DNA, 20 bp, Artificial
  CRISPR gRNA sequence
aagtgccccaacattataac

SEQ ID NO: 386587 - DNA, 20 bp, Artificial
  CRISPR gRNA sequence
taacaaggaccatgtgaatt

SEQ ID NO: 386588 - DNA, 20 bp, Artificial
  CRISPR gRNA sequence
tgagccaggacccgtggatg

SEQ ID NO: 386589 - DNA, 20 bp, Artificial
  CRISPR gRNA sequence
gagccaggacccgtggatga

SEQ ID NO: 386590 - DNA, 20 bp, Artificial
  CRISPR gRNA sequence
agccaggacccgtggatgaa

SEQ ID NO: 386591 - DNA, 20 bp, Artificial
  CRISPR gRNA sequence
tagatctgcatatcctaata

SEQ ID NO: 386592 - DNA, 20 bp, Artificial
  CRISPR gRNA sequence
catatcctaataccacaata

SEQ ID NO: 386593 - DNA, 20 bp, Artificial
  CRISPR gRNA sequence
ataccacaatacctgattta

SEQ ID NO: 386594 - DNA, 20 bp, Artificial
  CRISPR gRNA sequence
atttagtggaacatatattg

SEQ ID NO: 386595 - DNA, 20 bp, Artificial
  CRISPR gRNA sequence
agtggaacatatattgtttt

SEQ ID NO: 386596 - DNA, 20 bp, Artificial
  CRISPR gRNA sequence
gtggaacatatattgttttg

SEQ ID NO: 386597 - DNA, 20 bp, Artificial
  CRISPR gRNA sequence
ttttgaaaagtcctagacaa

SEQ ID NO: 386598 - DNA, 20 bp, Artificial
  CRISPR gRNA sequence
tgaaaagtcctagacaattt

SEQ ID NO: 386599 - DNA, 20 bp, Artificial
  CRISPR gRNA sequence
gaaaagtcctagacaattta

SEQ ID NO: 386600 - DNA, 20 bp, Artificial
  CRISPR gRNA sequence
aaaagtcctagacaatttaa

SEQ ID NO: 386601 - DNA, 20 bp, Artificial
  CRISPR gRNA sequence
gacaatttaaaaatagttag

SEQ ID NO: 386602 - DNA, 20 bp, Artificial
  CRISPR gRNA sequence
aaaaatagttagggaaaaag

SEQ ID NO: 386603 - DNA, 20 bp, Artificial
  CRISPR gRNA sequence
aaaatagttagggaaaaagg

SEQ ID NO: 386604 - DNA, 20 bp, Artificial
  CRISPR gRNA sequence
gggaaaaaggattttttctt

SEQ ID NO: 386605 - DNA, 20 bp, Artificial
  CRISPR gRNA sequence
tttcttaagaaataaaggtg

SEQ ID NO: 386606 - DNA, 20 bp, Artificial
  CRISPR gRNA sequence
ttcttaagaaataaaggtga

SEQ ID NO: 386607 - DNA, 20 bp, Artificial
  CRISPR gRNA sequence
tcttaagaaataaaggtgaa

SEQ ID NO: 386608 - DNA, 20 bp, Artificial
  CRISPR gRNA sequence
cttaagaaataaaggtgaaa

SEQ ID NO: 386609 - DNA, 20 bp, Artificial
  CRISPR gRNA sequence
ttaagaaataaaggtgaaat

SEQ ID NO: 386610 - DNA, 20 bp, Artificial
  CRISPR gRNA sequence
aagaaataaaggtgaaataa

SEQ ID NO: 386611 - DNA, 20 bp, Artificial
  CRISPR gRNA sequence
agaaataaaggtgaaataaa

SEQ ID NO: 386612 - DNA, 20 bp, Artificial
  CRISPR gRNA sequence
aatccagagacatttcaatc

SEQ ID NO: 386613 - DNA, 20 bp, Artificial
  CRISPR gRNA sequence
caatctagagtggcccagcc

SEQ ID NO: 386614 - DNA, 20 bp, Artificial
  CRISPR gRNA sequence
aatctagagtggcccagcct

SEQ ID NO: 386615 - DNA, 20 bp, Artificial
  CRISPR gRNA sequence
gagtggcccagcctgtagct

SEQ ID NO: 386616 - DNA, 20 bp, Artificial
  CRISPR gRNA sequence
tagctgacatggcttctcag

SEQ ID NO: 386617 - DNA, 20 bp, Artificial
  CRISPR gRNA sequence
acatggcttctcagtccatt

SEQ ID NO: 386618 - DNA, 20 bp, Artificial
  CRISPR gRNA sequence
ctcagtccattccctgcctt

SEQ ID NO: 386619 - DNA, 20 bp, Artificial
  CRISPR gRNA sequence
tcagtccattccctgccttg

SEQ ID NO: 386620 - DNA, 20 bp, Artificial
  CRISPR gRNA sequence
agtccattccctgccttgcc

SEQ ID NO: 386621 - DNA, 20 bp, Artificial
  CRISPR gRNA sequence
cctgccttgcctgcagcttc

SEQ ID NO: 386622 - DNA, 20 bp, Artificial
  CRISPR gRNA sequence
ccttgcctgcagcttccaca

SEQ ID NO: 386623 - DNA, 20 bp, Artificial
  CRISPR gRNA sequence
gcctgcagcttccacatgaa

SEQ ID NO: 386624 - DNA, 20 bp, Artificial
  CRISPR gRNA sequence
cctgcagcttccacatgaat

SEQ ID NO: 386625 - DNA, 20 bp, Artificial
  CRISPR gRNA sequence
cagcttccacatgaatgacc

SEQ ID NO: 386626 - DNA, 20 bp, Artificial
  CRISPR gRNA sequence
ccacatgaatgaccactggc

SEQ ID NO: 386627 - DNA, 20 bp, Artificial
  CRISPR gRNA sequence
cacatgaatgaccactggcc

SEQ ID NO: 386628 - DNA, 20 bp, Artificial
  CRISPR gRNA sequence
gcctatacagggcttgcacc

SEQ ID NO: 386629 - DNA, 20 bp, Artificial
  CRISPR gRNA sequence
tacagggcttgcaccttgct

SEQ ID NO: 386630 - DNA, 20 bp, Artificial
  CRISPR gRNA sequence
gcaccttgctgggccctgta

SEQ ID NO: 386631 - DNA, 20 bp, Artificial
  CRISPR gRNA sequence
caccttgctgggccctgtat

SEQ ID NO: 386632 - DNA, 20 bp, Artificial
  CRISPR gRNA sequence
gctgggccctgtatggctgg

SEQ ID NO: 386633 - DNA, 20 bp, Artificial
  CRISPR gRNA sequence
ctgggccctgtatggctggg

SEQ ID NO: 386634 - DNA, 20 bp, Artificial
  CRISPR gRNA sequence
ggccctgtatggctggggaa

SEQ ID NO: 386635 - DNA, 20 bp, Artificial
  CRISPR gRNA sequence
tatggctggggaaaataaaa

SEQ ID NO: 386636 - DNA, 20 bp, Artificial
  CRISPR gRNA sequence
gggaaaataaaaaggaaaag

SEQ ID NO: 386637 - DNA, 20 bp, Artificial
  CRISPR gRNA sequence
tgggagttaatcaacagttc

SEQ ID NO: 386638 - DNA, 20 bp, Artificial
  CRISPR gRNA sequence
gggagttaatcaacagttca

SEQ ID NO: 386639 - DNA, 20 bp, Artificial
  CRISPR gRNA sequence
ggagttaatcaacagttcat

SEQ ID NO: 386640 - DNA, 20 bp, Artificial
  CRISPR gRNA sequence
atcaacagttcataacattt

SEQ ID NO: 386641 - DNA, 20 bp, Artificial
  CRISPR gRNA sequence
ataacatttagttttttaag

SEQ ID NO: 386642 - DNA, 20 bp, Artificial
  CRISPR gRNA sequence
agttttttaagttttgctaa

SEQ ID NO: 386643 - DNA, 20 bp, Artificial
  CRISPR gRNA sequence
gttttttaagttttgctaat

SEQ ID NO: 386644 - DNA, 20 bp, Artificial
  CRISPR gRNA sequence
tttaagttttgctaatagat

SEQ ID NO: 386645 - DNA, 20 bp, Artificial
  CRISPR gRNA sequence
ttaagttttgctaatagatg

SEQ ID NO: 386646 - DNA, 20 bp, Artificial
  CRISPR gRNA sequence
taagttttgctaatagatgt

SEQ ID NO: 386647 - DNA, 20 bp, Artificial
  CRISPR gRNA sequence
aagttttgctaatagatgtc

SEQ ID NO: 386648 - DNA, 20 bp, Artificial
  CRISPR gRNA sequence
agttttgctaatagatgtca

SEQ ID NO: 386649 - DNA, 20 bp, Artificial
  CRISPR gRNA sequence
tgctaatagatgtcagattg

SEQ ID NO: 386650 - DNA, 20 bp, Artificial
  CRISPR gRNA sequence
gctaatagatgtcagattga

SEQ ID NO: 386651 - DNA, 20 bp, Artificial
  CRISPR gRNA sequence
ctaatagatgtcagattgag

SEQ ID NO: 386652 - DNA, 20 bp, Artificial
  CRISPR gRNA sequence
atagatgtcagattgagtaa

SEQ ID NO: 386653 - DNA, 20 bp, Artificial
  CRISPR gRNA sequence
agtaatgtcagccctgaagc

SEQ ID NO: 386654 - DNA, 20 bp, Artificial
  CRISPR gRNA sequence
aagcccttttctttaaaaag

SEQ ID NO: 386655 - DNA, 20 bp, Artificial
  CRISPR gRNA sequence
ttctttaaaaaggaagccct

SEQ ID NO: 386656 - DNA, 20 bp, Artificial
  CRISPR gRNA sequence
tctttaaaaaggaagccctt

SEQ ID NO: 386657 - DNA, 20 bp, Artificial
  CRISPR gRNA sequence
ctttaaaaaggaagcccttt

SEQ ID NO: 386658 - DNA, 20 bp, Artificial
  CRISPR gRNA sequence
tttaaaaaggaagccctttt

SEQ ID NO: 386659 - DNA, 20 bp, Artificial
  CRISPR gRNA sequence
taaaaaggaagcccttttct

SEQ ID NO: 386660 - DNA, 20 bp, Artificial
  CRISPR gRNA sequence
aaaaaggaagcccttttctt

SEQ ID NO: 386661 - DNA, 20 bp, Artificial
  CRISPR gRNA sequence
aaaaggaagcccttttcttt

SEQ ID NO: 386662 - DNA, 20 bp, Artificial
  CRISPR gRNA sequence
ttctttaaaaaagaagaatt

SEQ ID NO: 386663 - DNA, 20 bp, Artificial
  CRISPR gRNA sequence
tctttaaaaaagaagaattg

SEQ ID NO: 386664 - DNA, 20 bp, Artificial
  CRISPR gRNA sequence
ctttaaaaaagaagaattgt

SEQ ID NO: 386665 - DNA, 20 bp, Artificial
  CRISPR gRNA sequence
tttaaaaaagaagaattgtt

SEQ ID NO: 386666 - DNA, 20 bp, Artificial
  CRISPR gRNA sequence
taaaaaagaagaattgtttc

SEQ ID NO: 386667 - DNA, 20 bp, Artificial
  CRISPR gRNA sequence
aaaaaagaagaattgtttcc

SEQ ID NO: 386668 - DNA, 20 bp, Artificial
  CRISPR gRNA sequence
aaaaagaagaattgtttcca

SEQ ID NO: 386669 - DNA, 20 bp, Artificial
  CRISPR gRNA sequence
tttccagaagccattttttt

SEQ ID NO: 386670 - DNA, 20 bp, Artificial
  CRISPR gRNA sequence
ccagaagccatttttttgct

SEQ ID NO: 386671 - DNA, 20 bp, Artificial
  CRISPR gRNA sequence
cagaagccatttttttgcta

SEQ ID NO: 386672 - DNA, 20 bp, Artificial
  CRISPR gRNA sequence
ttttgctaacttttttcact

SEQ ID NO: 386673 - DNA, 20 bp, Artificial
  CRISPR gRNA sequence
tttgctaacttttttcactt

SEQ ID NO: 386674 - DNA, 20 bp, Artificial
  CRISPR gRNA sequence
ttgctaacttttttcactta

SEQ ID NO: 386675 - DNA, 20 bp, Artificial
  CRISPR gRNA sequence
tgctaacttttttcacttat

SEQ ID NO: 386676 - DNA, 20 bp, Artificial
  CRISPR gRNA sequence
gctaacttttttcacttata

SEQ ID NO: 386677 - DNA, 20 bp, Artificial
  CRISPR gRNA sequence
ctaacttttttcacttatat

SEQ ID NO: 386678 - DNA, 20 bp, Artificial
  CRISPR gRNA sequence
acttttttcacttatatccc

SEQ ID NO: 386679 - DNA, 20 bp, Artificial
  CRISPR gRNA sequence
ttttcacttatatcccaatg

SEQ ID NO: 386680 - DNA, 20 bp, Artificial
  CRISPR gRNA sequence
tttcacttatatcccaatgc

SEQ ID NO: 386681 - DNA, 20 bp, Artificial
  CRISPR gRNA sequence
ttcacttatatcccaatgct

SEQ ID NO: 386682 - DNA, 20 bp, Artificial
  CRISPR gRNA sequence
tcacttatatcccaatgctg

SEQ ID NO: 386683 - DNA, 20 bp, Artificial
  CRISPR gRNA sequence
cacttatatcccaatgctgt

SEQ ID NO: 386684 - DNA, 20 bp, Artificial
  CRISPR gRNA sequence
acttatatcccaatgctgtg

SEQ ID NO: 386685 - DNA, 20 bp, Artificial
  CRISPR gRNA sequence
atatcccaatgctgtgttga

SEQ ID NO: 386686 - DNA, 20 bp, Artificial
  CRISPR gRNA sequence
tatcccaatgctgtgttgat

SEQ ID NO: 386687 - DNA, 20 bp, Artificial
  CRISPR gRNA sequence
tgttgattcataggaggaga

SEQ ID NO: 386688 - DNA, 20 bp, Artificial
  CRISPR gRNA sequence
attcataggaggagaagtgt

SEQ ID NO: 386689 - DNA, 20 bp, Artificial
  CRISPR gRNA sequence
ataggaggagaagtgtcttg

SEQ ID NO: 386690 - DNA, 20 bp, Artificial
  CRISPR gRNA sequence
gaactgtaaaaccattacct

SEQ ID NO: 386691 - DNA, 20 bp, Artificial
  CRISPR gRNA sequence
aactgtaaaaccattacctt

SEQ ID NO: 386692 - DNA, 20 bp, Artificial
  CRISPR gRNA sequence
taaaaccattaccttacatc

SEQ ID NO: 386693 - DNA, 20 bp, Artificial
  CRISPR gRNA sequence
ccttacatcacagaagataa

SEQ ID NO: 386694 - DNA, 20 bp, Artificial
  CRISPR gRNA sequence
acatcacagaagataaatac

SEQ ID NO: 386695 - DNA, 20 bp, Artificial
  CRISPR gRNA sequence
catcacagaagataaataca

SEQ ID NO: 386696 - DNA, 20 bp, Artificial
  CRISPR gRNA sequence
aaacaatttaaagcaagtca

SEQ ID NO: 386697 - DNA, 20 bp, Artificial
  CRISPR gRNA sequence
aaagcaagtcagtgaaatat

SEQ ID NO: 386698 - DNA, 20 bp, Artificial
  CRISPR gRNA sequence
aagcaagtcagtgaaatata

SEQ ID NO: 386699 - DNA, 20 bp, Artificial
  CRISPR gRNA sequence
actccaggattgtgaccctc

SEQ ID NO: 386700 - DNA, 20 bp, Artificial
  CRISPR gRNA sequence
ctccaggattgtgaccctct

SEQ ID NO: 386701 - DNA, 20 bp, Artificial
  CRISPR gRNA sequence
caggattgtgaccctctagg

SEQ ID NO: 386702 - DNA, 20 bp, Artificial
  CRISPR gRNA sequence
tgaccctctaggctaagttt

SEQ ID NO: 386703 - DNA, 20 bp, Artificial
  CRISPR gRNA sequence
taggctaagtttctggcaat

SEQ ID NO: 386704 - DNA, 20 bp, Artificial
  CRISPR gRNA sequence
ggctaagtttctggcaatga

SEQ ID NO: 386705 - DNA, 20 bp, Artificial
  CRISPR gRNA sequence
agtttctggcaatgacaagt

SEQ ID NO: 386706 - DNA, 20 bp, Artificial
  CRISPR gRNA sequence
ctggcaatgacaagtattta

SEQ ID NO: 386707 - DNA, 20 bp, Artificial
  CRISPR gRNA sequence
tggcaatgacaagtatttat

SEQ ID NO: 386708 - DNA, 20 bp, Artificial
  CRISPR gRNA sequence
gcaatgacaagtatttatgg

SEQ ID NO: 386709 - DNA, 20 bp, Artificial
  CRISPR gRNA sequence
atggctgagttatacactct

SEQ ID NO: 386710 - DNA, 20 bp, Artificial
  CRISPR gRNA sequence
tggctgagttatacactctt

SEQ ID NO: 386711 - DNA, 20 bp, Artificial
  CRISPR gRNA sequence
agttatacactcttagaaaa

SEQ ID NO: 386712 - DNA, 20 bp, Artificial
  CRISPR gRNA sequence
tacactcttagaaaaggctc

SEQ ID NO: 386713 - DNA, 20 bp, Artificial
  CRISPR gRNA sequence
ttagaaaaggctcatgatag

SEQ ID NO: 386714 - DNA, 20 bp, Artificial
  CRISPR gRNA sequence
agaaaaggctcatgatagaa

SEQ ID NO: 386715 - DNA, 20 bp, Artificial
  CRISPR gRNA sequence
gaaaaggctcatgatagaaa

SEQ ID NO: 386716 - DNA, 20 bp, Artificial
  CRISPR gRNA sequence
atgatagaaatattgccagt

SEQ ID NO: 386717 - DNA, 20 bp, Artificial
  CRISPR gRNA sequence
ccagtcccttcttccctcag

SEQ ID NO: 386718 - DNA, 20 bp, Artificial
  CRISPR gRNA sequence
cttccctcagagttcggcag

SEQ ID NO: 386719 - DNA, 20 bp, Artificial
  CRISPR gRNA sequence
ttccctcagagttcggcagg

SEQ ID NO: 386720 - DNA, 20 bp, Artificial
  CRISPR gRNA sequence
ccctcagagttcggcaggca

SEQ ID NO: 386721 - DNA, 20 bp, Artificial
  CRISPR gRNA sequence
cctcagagttcggcaggcaa

SEQ ID NO: 386722 - DNA, 20 bp, Artificial
  CRISPR gRNA sequence
agagttcggcaggcaagagt

SEQ ID NO: 386723 - DNA, 20 bp, Artificial
  CRISPR gRNA sequence
ggcaggcaagagtggccatt

SEQ ID NO: 386724 - DNA, 20 bp, Artificial
  CRISPR gRNA sequence
atgtctatagtttatcctct

SEQ ID NO: 386725 - DNA, 20 bp, Artificial
  CRISPR gRNA sequence
tagtttatcctctattaggg

SEQ ID NO: 386726 - DNA, 20 bp, Artificial
  CRISPR gRNA sequence
atcctctattagggtggggg

SEQ ID NO: 386727 - DNA, 20 bp, Artificial
  CRISPR gRNA sequence
tcctctattagggtgggggt

SEQ ID NO: 386728 - DNA, 20 bp, Artificial
  CRISPR gRNA sequence
tattagggtgggggtggagt

SEQ ID NO: 386729 - DNA, 20 bp, Artificial
  CRISPR gRNA sequence
ttagggtgggggtggagtta

SEQ ID NO: 386730 - DNA, 20 bp, Artificial
  CRISPR gRNA sequence
gggtgggggtggagttaggg

SEQ ID NO: 386731 - DNA, 20 bp, Artificial
  CRISPR gRNA sequence
gggagtgaagaaagcaagtc

SEQ ID NO: 386732 - DNA, 20 bp, Artificial
  CRISPR gRNA sequence
agaacctaaataactgggcc

SEQ ID NO: 386733 - DNA, 20 bp, Artificial
  CRISPR gRNA sequence
gaacctaaataactgggcca

SEQ ID NO: 386734 - DNA, 20 bp, Artificial
  CRISPR gRNA sequence
aataactgggccaaagaata

SEQ ID NO: 386735 - DNA, 20 bp, Artificial
  CRISPR gRNA sequence
ggccaaagaatatgccaggg

SEQ ID NO: 386736 - DNA, 20 bp, Artificial
  CRISPR gRNA sequence
actctctaacatcaagcgtt

SEQ ID NO: 386737 - DNA, 20 bp, Artificial
  CRISPR gRNA sequence
tctaacatcaagcgttaggc

SEQ ID NO: 386738 - DNA, 20 bp, Artificial
  CRISPR gRNA sequence
taacatcaagcgttaggctg

SEQ ID NO: 386739 - DNA, 20 bp, Artificial
  CRISPR gRNA sequence
acatcaagcgttaggctgga

SEQ ID NO: 386740 - DNA, 20 bp, Artificial
  CRISPR gRNA sequence
ggctggaaactgcaaattaa

SEQ ID NO: 386741 - DNA, 20 bp, Artificial
  CRISPR gRNA sequence
gaaactgcaaattaaaacca

SEQ ID NO: 386742 - DNA, 20 bp, Artificial
  CRISPR gRNA sequence
caaattaaaaccacaatgag

SEQ ID NO: 386743 - DNA, 20 bp, Artificial
  CRISPR gRNA sequence
aaaccacaatgagagaccac

SEQ ID NO: 386744 - DNA, 20 bp, Artificial
  CRISPR gRNA sequence
acacctttttgaatggcttt

SEQ ID NO: 386745 - DNA, 20 bp, Artificial
  CRISPR gRNA sequence
tttgaatggcttttctcaaa

SEQ ID NO: 386746 - DNA, 20 bp, Artificial
  CRISPR gRNA sequence
ttgaatggcttttctcaaaa

SEQ ID NO: 386747 - DNA, 20 bp, Artificial
  CRISPR gRNA sequence
tgaatggcttttctcaaaaa

SEQ ID NO: 386748 - DNA, 20 bp, Artificial
  CRISPR gRNA sequence
gaatggcttttctcaaaaag

SEQ ID NO: 386749 - DNA, 20 bp, Artificial
  CRISPR gRNA sequence
aatggcttttctcaaaaaga

SEQ ID NO: 386750 - DNA, 20 bp, Artificial
  CRISPR gRNA sequence
ttctcaaaaagatgaaagaa

SEQ ID NO: 386751 - DNA, 20 bp, Artificial
  CRISPR gRNA sequence
tctcaaaaagatgaaagaaa

SEQ ID NO: 386752 - DNA, 20 bp, Artificial
  CRISPR gRNA sequence
ctcaaaaagatgaaagaaaa

SEQ ID NO: 386753 - DNA, 20 bp, Artificial
  CRISPR gRNA sequence
tcaaaaagatgaaagaaaac

SEQ ID NO: 386754 - DNA, 20 bp, Artificial
  CRISPR gRNA sequence
aaaaagatgaaagaaaacat

SEQ ID NO: 386755 - DNA, 20 bp, Artificial
  CRISPR gRNA sequence
tcgccgccatcatggtgtgt

SEQ ID NO: 386756 - DNA, 20 bp, Artificial
  CRISPR gRNA sequence
cgccgccatcatggtgtgtg

SEQ ID NO: 386757 - DNA, 20 bp, Artificial
  CRISPR gRNA sequence
gccgccatcatggtgtgtgt

SEQ ID NO: 386758 - DNA, 20 bp, Artificial
  CRISPR gRNA sequence
actccattcctcaccatgtc

SEQ ID NO: 386759 - DNA, 20 bp, Artificial
  CRISPR gRNA sequence
cattcctcaccatgtcttct

SEQ ID NO: 386760 - DNA, 20 bp, Artificial
  CRISPR gRNA sequence
ctcaccatgtcttctcccaa

SEQ ID NO: 386761 - DNA, 20 bp, Artificial
  CRISPR gRNA sequence
accatgtcttctcccaagac

SEQ ID NO: 386762 - DNA, 20 bp, Artificial
  CRISPR gRNA sequence
ctcccaagactttcagggtc

SEQ ID NO: 386763 - DNA, 20 bp, Artificial
  CRISPR gRNA sequence
tcccaagactttcagggtca

SEQ ID NO: 386764 - DNA, 20 bp, Artificial
  CRISPR gRNA sequence
ccaagactttcagggtcaag

SEQ ID NO: 386765 - DNA, 20 bp, Artificial
  CRISPR gRNA sequence
tcagggtcaagcaattcctg

SEQ ID NO: 386766 - DNA, 20 bp, Artificial
  CRISPR gRNA sequence
cagggtcaagcaattcctgg

SEQ ID NO: 386767 - DNA, 20 bp, Artificial
  CRISPR gRNA sequence
agggtcaagcaattcctggt

SEQ ID NO: 386768 - DNA, 20 bp, Artificial
  CRISPR gRNA sequence
ctggtcaagaaacaaaagca

SEQ ID NO: 386769 - DNA, 20 bp, Artificial
  CRISPR gRNA sequence
gtcaagaaacaaaagcaaaa

SEQ ID NO: 386770 - DNA, 20 bp, Artificial
  CRISPR gRNA sequence
tatcgggggaacctgcccct

SEQ ID NO: 386771 - DNA, 20 bp, Artificial
  CRISPR gRNA sequence
atcgggggaacctgcccctg

SEQ ID NO: 386772 - DNA, 20 bp, Artificial
  CRISPR gRNA sequence
tcgggggaacctgcccctga

SEQ ID NO: 386773 - DNA, 20 bp, Artificial
  CRISPR gRNA sequence
cccctgataattcaatgtag

SEQ ID NO: 386774 - DNA, 20 bp, Artificial
  CRISPR gRNA sequence
ataattcaatgtaggttctt

SEQ ID NO: 386775 - DNA, 20 bp, Artificial
  CRISPR gRNA sequence
aatgtaggttcttttctatt

SEQ ID NO: 386776 - DNA, 20 bp, Artificial
  CRISPR gRNA sequence
ttttctattttccctaagtg

SEQ ID NO: 386777 - DNA, 20 bp, Artificial
  CRISPR gRNA sequence
ttctattttccctaagtgtt

SEQ ID NO: 386778 - DNA, 20 bp, Artificial
  CRISPR gRNA sequence
tctattttccctaagtgttg

SEQ ID NO: 386779 - DNA, 20 bp, Artificial
  CRISPR gRNA sequence
ctattttccctaagtgttgg

SEQ ID NO: 386780 - DNA, 20 bp, Artificial
  CRISPR gRNA sequence
tattttccctaagtgttggc

SEQ ID NO: 386781 - DNA, 20 bp, Artificial
  CRISPR gRNA sequence
ttttccctaagtgttggcca

SEQ ID NO: 386782 - DNA, 20 bp, Artificial
  CRISPR gRNA sequence
tccctaagtgttggccagtc

SEQ ID NO: 386783 - DNA, 20 bp, Artificial
  CRISPR gRNA sequence
ccctaagtgttggccagtct

SEQ ID NO: 386784 - DNA, 20 bp, Artificial
  CRISPR gRNA sequence
cctaagtgttggccagtctg

SEQ ID NO: 386785 - DNA, 20 bp, Artificial
  CRISPR gRNA sequence
agtgttggccagtctgagaa

SEQ ID NO: 386786 - DNA, 20 bp, Artificial
  CRISPR gRNA sequence
gccagtctgagaaataaagg

SEQ ID NO: 386787 - DNA, 20 bp, Artificial
  CRISPR gRNA sequence
agaaataaagggaaagagta

SEQ ID NO: 386788 - DNA, 20 bp, Artificial
  CRISPR gRNA sequence
taaagctgggtgtctagggg

SEQ ID NO: 386789 - DNA, 20 bp, Artificial
  CRISPR gRNA sequence
aaagctgggtgtctagggga

SEQ ID NO: 386790 - DNA, 20 bp, Artificial
  CRISPR gRNA sequence
aagctgggtgtctaggggag

SEQ ID NO: 386791 - DNA, 20 bp, Artificial
  CRISPR gRNA sequence
ggtgtctaggggagacatca

SEQ ID NO: 386792 - DNA, 20 bp, Artificial
  CRISPR gRNA sequence
ggggagacatcacatgttgg

SEQ ID NO: 386793 - DNA, 20 bp, Artificial
  CRISPR gRNA sequence
gcaggttccgtgatgcctcc

SEQ ID NO: 386794 - DNA, 20 bp, Artificial
  CRISPR gRNA sequence
cgtgatgcctcctgagccgt

SEQ ID NO: 386795 - DNA, 20 bp, Artificial
  CRISPR gRNA sequence
ctgagccgtaaaaccagcaa

SEQ ID NO: 386796 - DNA, 20 bp, Artificial
  CRISPR gRNA sequence
agccgtaaaaccagcaagtt

SEQ ID NO: 386797 - DNA, 20 bp, Artificial
  CRISPR gRNA sequence
ttattagcaattttcaaagg

SEQ ID NO: 386798 - DNA, 20 bp, Artificial
  CRISPR gRNA sequence
tattagcaattttcaaaggg

SEQ ID NO: 386799 - DNA, 20 bp, Artificial
  CRISPR gRNA sequence
attagcaattttcaaagggg

SEQ ID NO: 386800 - DNA, 20 bp, Artificial
  CRISPR gRNA sequence
ttagcaattttcaaagggga

SEQ ID NO: 386801 - DNA, 20 bp, Artificial
  CRISPR gRNA sequence
gcaattttcaaaggggaggg

SEQ ID NO: 386802 - DNA, 20 bp, Artificial
  CRISPR gRNA sequence
tcaaaggggagggagtgtat

SEQ ID NO: 386803 - DNA, 20 bp, Artificial
  CRISPR gRNA sequence
caaaggggagggagtgtatg

SEQ ID NO: 386804 - DNA, 20 bp, Artificial
  CRISPR gRNA sequence
aaaggggagggagtgtatga

SEQ ID NO: 386805 - DNA, 20 bp, Artificial
  CRISPR gRNA sequence
caagggcaacaaaagatcac

SEQ ID NO: 386806 - DNA, 20 bp, Artificial
  CRISPR gRNA sequence
aagggcaacaaaagatcaca

SEQ ID NO: 386807 - DNA, 20 bp, Artificial
  CRISPR gRNA sequence
aaattgctaatgaagtttca

SEQ ID NO: 386808 - DNA, 20 bp, Artificial
  CRISPR gRNA sequence
ctaatgaagtttcaggaaca

SEQ ID NO: 386809 - DNA, 20 bp, Artificial
  CRISPR gRNA sequence
atgaagtttcaggaacacac

SEQ ID NO: 386810 - DNA, 20 bp, Artificial
  CRISPR gRNA sequence
caggaacacactgtcactga

SEQ ID NO: 386811 - DNA, 20 bp, Artificial
  CRISPR gRNA sequence
aggaacacactgtcactgat

SEQ ID NO: 386812 - DNA, 20 bp, Artificial
  CRISPR gRNA sequence
tcactgataaacatcttaac

SEQ ID NO: 386813 - DNA, 20 bp, Artificial
  CRISPR gRNA sequence
ataaacatcttaacagggtt

SEQ ID NO: 386814 - DNA, 20 bp, Artificial
  CRISPR gRNA sequence
aacagggttcaagagcagag

SEQ ID NO: 386815 - DNA, 20 bp, Artificial
  CRISPR gRNA sequence
acagggttcaagagcagaga

SEQ ID NO: 386816 - DNA, 20 bp, Artificial
  CRISPR gRNA sequence
aagagcagagaaccagtctg

SEQ ID NO: 386817 - DNA, 20 bp, Artificial
  CRISPR gRNA sequence
actagaattcgccaggctgg

SEQ ID NO: 386818 - DNA, 20 bp, Artificial
  CRISPR gRNA sequence
gaattcgccaggctggaatt

SEQ ID NO: 386819 - DNA, 20 bp, Artificial
  CRISPR gRNA sequence
gccaggctggaatttcctaa

SEQ ID NO: 386820 - DNA, 20 bp, Artificial
  CRISPR gRNA sequence
gaatttcctaatcctagcaa

SEQ ID NO: 386821 - DNA, 20 bp, Artificial
  CRISPR gRNA sequence
cctaatcctagcaagcctgg

SEQ ID NO: 386822 - DNA, 20 bp, Artificial
  CRISPR gRNA sequence
ctaatcctagcaagcctggg

SEQ ID NO: 386823 - DNA, 20 bp, Artificial
  CRISPR gRNA sequence
atcctagcaagcctgggggt

SEQ ID NO: 386824 - DNA, 20 bp, Artificial
  CRISPR gRNA sequence
gcaagcctgggggtgctgca

SEQ ID NO: 386825 - DNA, 20 bp, Artificial
  CRISPR gRNA sequence
ggggtgctgcaggaggccag

SEQ ID NO: 386826 - DNA, 20 bp, Artificial
  CRISPR gRNA sequence
caggaggccagggcatgttt

SEQ ID NO: 386827 - DNA, 20 bp, Artificial
  CRISPR gRNA sequence
catcccttatctgcaactgc

SEQ ID NO: 386828 - DNA, 20 bp, Artificial
  CRISPR gRNA sequence
atcccttatctgcaactgca

SEQ ID NO: 386829 - DNA, 20 bp, Artificial
  CRISPR gRNA sequence
atctgcaactgcataaggca

SEQ ID NO: 386830 - DNA, 20 bp, Artificial
  CRISPR gRNA sequence
tctgcaactgcataaggcag

SEQ ID NO: 386831 - DNA, 20 bp, Artificial
  CRISPR gRNA sequence
caactgcataaggcagacac

SEQ ID NO: 386832 - DNA, 20 bp, Artificial
  CRISPR gRNA sequence
cataaggcagacaccccccg

SEQ ID NO: 386833 - DNA, 20 bp, Artificial
  CRISPR gRNA sequence
agaggccattatagagggct

SEQ ID NO: 386834 - DNA, 20 bp, Artificial
  CRISPR gRNA sequence
tagagggctctcctcccccc

SEQ ID NO: 386835 - DNA, 20 bp, Artificial
  CRISPR gRNA sequence
tcctccccccaggaaagcat

SEQ ID NO: 386836 - DNA, 20 bp, Artificial
  CRISPR gRNA sequence
ctccccccaggaaagcattc

SEQ ID NO: 386837 - DNA, 20 bp, Artificial
  CRISPR gRNA sequence
cccccaggaaagcattcttt

SEQ ID NO: 386838 - DNA, 20 bp, Artificial
  CRISPR gRNA sequence
ttttcccagggctgtgaatt

SEQ ID NO: 386839 - DNA, 20 bp, Artificial
  CRISPR gRNA sequence
ttcccagggctgtgaattat

SEQ ID NO: 386840 - DNA, 20 bp, Artificial
  CRISPR gRNA sequence
tcccagggctgtgaattatt

SEQ ID NO: 386841 - DNA, 20 bp, Artificial
  CRISPR gRNA sequence
cccagggctgtgaattatta

SEQ ID NO: 386842 - DNA, 20 bp, Artificial
  CRISPR gRNA sequence
ccagggctgtgaattattaa

SEQ ID NO: 386843 - DNA, 20 bp, Artificial
  CRISPR gRNA sequence
tgaattattaatattcctta

SEQ ID NO: 386844 - DNA, 20 bp, Artificial
  CRISPR gRNA sequence
ttaatattccttactgggga

SEQ ID NO: 386845 - DNA, 20 bp, Artificial
  CRISPR gRNA sequence
atattccttactggggaagg

SEQ ID NO: 386846 - DNA, 20 bp, Artificial
  CRISPR gRNA sequence
cttactggggaaggaattca

SEQ ID NO: 386847 - DNA, 20 bp, Artificial
  CRISPR gRNA sequence
actggggaaggaattcagcg

SEQ ID NO: 386848 - DNA, 20 bp, Artificial
  CRISPR gRNA sequence
ctggggaaggaattcagcga

SEQ ID NO: 386849 - DNA, 20 bp, Artificial
  CRISPR gRNA sequence
gggaaggaattcagcgatat

SEQ ID NO: 386850 - DNA, 20 bp, Artificial
  CRISPR gRNA sequence
agcgatatttctcttaccca

SEQ ID NO: 386851 - DNA, 20 bp, Artificial
  CRISPR gRNA sequence
ctcttacccattttcgataa

SEQ ID NO: 386852 - DNA, 20 bp, Artificial
  CRISPR gRNA sequence
tcttacccattttcgataat

SEQ ID NO: 386853 - DNA, 20 bp, Artificial
  CRISPR gRNA sequence
ttacccattttcgataataa

SEQ ID NO: 386854 - DNA, 20 bp, Artificial
  CRISPR gRNA sequence
acccattttcgataataaga

SEQ ID NO: 386855 - DNA, 20 bp, Artificial
  CRISPR gRNA sequence
cccattttcgataataagag

SEQ ID NO: 386856 - DNA, 20 bp, Artificial
  CRISPR gRNA sequence
tcgataataagagaaatatg

SEQ ID NO: 386857 - DNA, 20 bp, Artificial
  CRISPR gRNA sequence
cgataataagagaaatatgg

SEQ ID NO: 386858 - DNA, 20 bp, Artificial
  CRISPR gRNA sequence
gataataagagaaatatggc

SEQ ID NO: 386859 - DNA, 20 bp, Artificial
  CRISPR gRNA sequence
tgtcctgactggcctacagg

SEQ ID NO: 386860 - DNA, 20 bp, Artificial
  CRISPR gRNA sequence
tcctgactggcctacaggca

SEQ ID NO: 386861 - DNA, 20 bp, Artificial
  CRISPR gRNA sequence
actggcctacaggcagccag

SEQ ID NO: 386862 - DNA, 20 bp, Artificial
  CRISPR gRNA sequence
gcctacaggcagccagactt

SEQ ID NO: 386863 - DNA, 20 bp, Artificial
  CRISPR gRNA sequence
caggcagccagactttaagg

SEQ ID NO: 386864 - DNA, 20 bp, Artificial
  CRISPR gRNA sequence
taaggttatctcccttgttc

SEQ ID NO: 386865 - DNA, 20 bp, Artificial
  CRISPR gRNA sequence
aaggttatctcccttgttct

SEQ ID NO: 386866 - DNA, 20 bp, Artificial
  CRISPR gRNA sequence
aggttatctcccttgttctc

SEQ ID NO: 386867 - DNA, 20 bp, Artificial
  CRISPR gRNA sequence
tctcccttgttctctgaaaa

SEQ ID NO: 386868 - DNA, 20 bp, Artificial
  CRISPR gRNA sequence
ccttgttctctgaaaatcac

SEQ ID NO: 386869 - DNA, 20 bp, Artificial
  CRISPR gRNA sequence
gttctctgaaaatcacagtt

SEQ ID NO: 386870 - DNA, 20 bp, Artificial
  CRISPR gRNA sequence
ttctctgaaaatcacagtta

SEQ ID NO: 386871 - DNA, 20 bp, Artificial
  CRISPR gRNA sequence
tctgaaaatcacagttatcc

SEQ ID NO: 386872 - DNA, 20 bp, Artificial
  CRISPR gRNA sequence
tgaaaatcacagttatcctg

SEQ ID NO: 386873 - DNA, 20 bp, Artificial
  CRISPR gRNA sequence
aaaatcacagttatcctgtt

SEQ ID NO: 386874 - DNA, 20 bp, Artificial
  CRISPR gRNA sequence
tcctgttcttaaggtgccca

SEQ ID NO: 386875 - DNA, 20 bp, Artificial
  CRISPR gRNA sequence
ttcttaaggtgcccagattt

SEQ ID NO: 386876 - DNA, 20 bp, Artificial
  CRISPR gRNA sequence
ttaaggtgcccagatttcat

SEQ ID NO: 386877 - DNA, 20 bp, Artificial
  CRISPR gRNA sequence
aaggtgcccagatttcatat

SEQ ID NO: 386878 - DNA, 20 bp, Artificial
  CRISPR gRNA sequence
aggtgcccagatttcatatt

SEQ ID NO: 386879 - DNA, 20 bp, Artificial
  CRISPR gRNA sequence
catattgttcaaacatacat

SEQ ID NO: 386880 - DNA, 20 bp, Artificial
  CRISPR gRNA sequence
atattgttcaaacatacatg

SEQ ID NO: 386881 - DNA, 20 bp, Artificial
  CRISPR gRNA sequence
ttcaaacatacatgctttac

SEQ ID NO: 386882 - DNA, 20 bp, Artificial
  CRISPR gRNA sequence
aaacatacatgctttacaaa

SEQ ID NO: 386883 - DNA, 20 bp, Artificial
  CRISPR gRNA sequence
tacaaacaatttgtgcagtt

SEQ ID NO: 386884 - DNA, 20 bp, Artificial
  CRISPR gRNA sequence
acaaacaatttgtgcagtta

SEQ ID NO: 386885 - DNA, 20 bp, Artificial
  CRISPR gRNA sequence
caaacaatttgtgcagttaa

SEQ ID NO: 386886 - DNA, 20 bp, Artificial
  CRISPR gRNA sequence
gtgcagttaacacaaccatc

SEQ ID NO: 386887 - DNA, 20 bp, Artificial
  CRISPR gRNA sequence
tgcagttaacacaaccatca

SEQ ID NO: 386888 - DNA, 20 bp, Artificial
  CRISPR gRNA sequence
acacaaccatcacagggtcc

SEQ ID NO: 386889 - DNA, 20 bp, Artificial
  CRISPR gRNA sequence
aggtgacatacatcctcagc

SEQ ID NO: 386890 - DNA, 20 bp, Artificial
  CRISPR gRNA sequence
agcttacgaagatgacggga

SEQ ID NO: 386891 - DNA, 20 bp, Artificial
  CRISPR gRNA sequence
acgaagatgacgggattaag

SEQ ID NO: 386892 - DNA, 20 bp, Artificial
  CRISPR gRNA sequence
cgaagatgacgggattaaga

SEQ ID NO: 386893 - DNA, 20 bp, Artificial
  CRISPR gRNA sequence
agagattaaagtaaagacaa

SEQ ID NO: 386894 - DNA, 20 bp, Artificial
  CRISPR gRNA sequence
aagtaaagacaagcatagga

SEQ ID NO: 386895 - DNA, 20 bp, Artificial
  CRISPR gRNA sequence
actggggaagtgataaatgt

SEQ ID NO: 386896 - DNA, 20 bp, Artificial
  CRISPR gRNA sequence
gggaagtgataaatgtccat

SEQ ID NO: 386897 - DNA, 20 bp, Artificial
  CRISPR gRNA sequence
cacaatttaaattcttctgc

SEQ ID NO: 386898 - DNA, 20 bp, Artificial
  CRISPR gRNA sequence
acaatttaaattcttctgcc

SEQ ID NO: 386899 - DNA, 20 bp, Artificial
  CRISPR gRNA sequence
aaattcttctgccatggctt

SEQ ID NO: 386900 - DNA, 20 bp, Artificial
  CRISPR gRNA sequence
aattcttctgccatggcttc

SEQ ID NO: 386901 - DNA, 20 bp, Artificial
  CRISPR gRNA sequence
ttctgccatggcttcagcca

SEQ ID NO: 386902 - DNA, 20 bp, Artificial
  CRISPR gRNA sequence
ctgccatggcttcagccagt

SEQ ID NO: 386903 - DNA, 20 bp, Artificial
  CRISPR gRNA sequence
tgccatggcttcagccagtc

SEQ ID NO: 386904 - DNA, 20 bp, Artificial
  CRISPR gRNA sequence
ccatggcttcagccagtccc

SEQ ID NO: 386905 - DNA, 20 bp, Artificial
  CRISPR gRNA sequence
cagccagtccctccgttcag

SEQ ID NO: 386906 - DNA, 20 bp, Artificial
  CRISPR gRNA sequence
agccagtccctccgttcagg

SEQ ID NO: 386907 - DNA, 20 bp, Artificial
  CRISPR gRNA sequence
cgttcaggttccctgacttc

SEQ ID NO: 386908 - DNA, 20 bp, Artificial
  CRISPR gRNA sequence
aggttccctgacttcccaca

SEQ ID NO: 386909 - DNA, 20 bp, Artificial
  CRISPR gRNA sequence
cctgacttcccacagcacca

SEQ ID NO: 386910 - DNA, 20 bp, Artificial
  CRISPR gRNA sequence
acttcccacagcaccatttc

SEQ ID NO: 386911 - DNA, 20 bp, Artificial
  CRISPR gRNA sequence
cccacagcaccatttcccag

SEQ ID NO: 386912 - DNA, 20 bp, Artificial
  CRISPR gRNA sequence
ccacagcaccatttcccagt

SEQ ID NO: 386913 - DNA, 20 bp, Artificial
  CRISPR gRNA sequence
cccagtggattcagatgaca

SEQ ID NO: 386914 - DNA, 20 bp, Artificial
  CRISPR gRNA sequence
ccagtggattcagatgacag

SEQ ID NO: 386915 - DNA, 20 bp, Artificial
  CRISPR gRNA sequence
agatgacagctggtaataca

SEQ ID NO: 386916 - DNA, 20 bp, Artificial
  CRISPR gRNA sequence
gtaatacaaccagttacagc

SEQ ID NO: 386917 - DNA, 20 bp, Artificial
  CRISPR gRNA sequence
cagctccaaaacggagccac

SEQ ID NO: 386918 - DNA, 20 bp, Artificial
  CRISPR gRNA sequence
caaaacggagccactgaaga

SEQ ID NO: 386919 - DNA, 20 bp, Artificial
  CRISPR gRNA sequence
aagaagaaccaagctgggtt

SEQ ID NO: 386920 - DNA, 20 bp, Artificial
  CRISPR gRNA sequence
ggtttatacggaattgtacg

SEQ ID NO: 386921 - DNA, 20 bp, Artificial
  CRISPR gRNA sequence
atacggaattgtacgtgaga

SEQ ID NO: 386922 - DNA, 20 bp, Artificial
  CRISPR gRNA sequence
tacggaattgtacgtgagat

SEQ ID NO: 386923 - DNA, 20 bp, Artificial
  CRISPR gRNA sequence
tacgtgagatggcacacagg

SEQ ID NO: 386924 - DNA, 20 bp, Artificial
  CRISPR gRNA sequence
acgctgtgtcaaagtcatga

SEQ ID NO: 386925 - DNA, 20 bp, Artificial
  CRISPR gRNA sequence
cgctgtgtcaaagtcatgat

SEQ ID NO: 386926 - DNA, 20 bp, Artificial
  CRISPR gRNA sequence
tgtcaaagtcatgatcatgt

SEQ ID NO: 386927 - DNA, 20 bp, Artificial
  CRISPR gRNA sequence
tgaatgtcaccactatctgg

SEQ ID NO: 386928 - DNA, 20 bp, Artificial
  CRISPR gRNA sequence
tctggacagtcgaacatgtt

SEQ ID NO: 386929 - DNA, 20 bp, Artificial
  CRISPR gRNA sequence
gacagtcgaacatgttttat

SEQ ID NO: 386930 - DNA, 20 bp, Artificial
  CRISPR gRNA sequence
tattgggaatatgttttttc

SEQ ID NO: 386931 - DNA, 20 bp, Artificial
  CRISPR gRNA sequence
attgggaatatgttttttct

SEQ ID NO: 386932 - DNA, 20 bp, Artificial
  CRISPR gRNA sequence
ttgggaatatgttttttctc

SEQ ID NO: 386933 - DNA, 20 bp, Artificial
  CRISPR gRNA sequence
ggaatatgttttttctcttt

SEQ ID NO: 386934 - DNA, 20 bp, Artificial
  CRISPR gRNA sequence
tttctctttgtttatatgct

SEQ ID NO: 386935 - DNA, 20 bp, Artificial
  CRISPR gRNA sequence
ttctctttgtttatatgctc

SEQ ID NO: 386936 - DNA, 20 bp, Artificial
  CRISPR gRNA sequence
tctctttgtttatatgctct

SEQ ID NO: 386937 - DNA, 20 bp, Artificial
  CRISPR gRNA sequence
ctctttgtttatatgctctg

SEQ ID NO: 386938 - DNA, 20 bp, Artificial
  CRISPR gRNA sequence
tctttgtttatatgctctgc

SEQ ID NO: 386939 - DNA, 20 bp, Artificial
  CRISPR gRNA sequence
tttgtttatatgctctgcac

SEQ ID NO: 386940 - DNA, 20 bp, Artificial
  CRISPR gRNA sequence
tgtttatatgctctgcacta

SEQ ID NO: 386941 - DNA, 20 bp, Artificial
  CRISPR gRNA sequence
gtttatatgctctgcactag

SEQ ID NO: 386942 - DNA, 20 bp, Artificial
  CRISPR gRNA sequence
tttatatgctctgcactagt

SEQ ID NO: 386943 - DNA, 20 bp, Artificial
  CRISPR gRNA sequence
atatgctctgcactagtagg

SEQ ID NO: 386944 - DNA, 20 bp, Artificial
  CRISPR gRNA sequence
tatgctctgcactagtaggt

SEQ ID NO: 386945 - DNA, 20 bp, Artificial
  CRISPR gRNA sequence
tgcactagtaggtaggttca

SEQ ID NO: 386946 - DNA, 20 bp, Artificial
  CRISPR gRNA sequence
cactagtaggtaggttcagt

SEQ ID NO: 386947 - DNA, 20 bp, Artificial
  CRISPR gRNA sequence
gtaggtaggttcagtaataa

SEQ ID NO: 386948 - DNA, 20 bp, Artificial
  CRISPR gRNA sequence
agtaataaatatgtgagaac

SEQ ID NO: 386949 - DNA, 20 bp, Artificial
  CRISPR gRNA sequence
ttgtttcagtaaaagaagaa

SEQ ID NO: 386950 - DNA, 20 bp, Artificial
  CRISPR gRNA sequence
tgtttcagtaaaagaagaaa

SEQ ID NO: 386951 - DNA, 20 bp, Artificial
  CRISPR gRNA sequence
gtttcagtaaaagaagaaag

SEQ ID NO: 386952 - DNA, 20 bp, Artificial
  CRISPR gRNA sequence
tttcagtaaaagaagaaaga

SEQ ID NO: 386953 - DNA, 20 bp, Artificial
  CRISPR gRNA sequence
cagtaaaagaagaaagaaag

SEQ ID NO: 386954 - DNA, 20 bp, Artificial
  CRISPR gRNA sequence
agtaaaagaagaaagaaaga

SEQ ID NO: 386955 - DNA, 20 bp, Artificial
  CRISPR gRNA sequence
gcaagggtatggagaagaga

SEQ ID NO: 386956 - DNA, 20 bp, Artificial
  CRISPR gRNA sequence
gcacactgttgaaagacaaa

SEQ ID NO: 386957 - DNA, 20 bp, Artificial
  CRISPR gRNA sequence
ttgaaagacaaataccacat

SEQ ID NO: 386958 - DNA, 20 bp, Artificial
  CRISPR gRNA sequence
aaagacaaataccacataat

SEQ ID NO: 386959 - DNA, 20 bp, Artificial
  CRISPR gRNA sequence
acttaaatatggaacctaaa

SEQ ID NO: 386960 - DNA, 20 bp, Artificial
  CRISPR gRNA sequence
aaatatggaacctaaaaaaa

SEQ ID NO: 386961 - DNA, 20 bp, Artificial
  CRISPR gRNA sequence
aatatggaacctaaaaaaat

SEQ ID NO: 386962 - DNA, 20 bp, Artificial
  CRISPR gRNA sequence
aaaaaattaatgtcttagaa

SEQ ID NO: 386963 - DNA, 20 bp, Artificial
  CRISPR gRNA sequence
atgtcttagaagtagaaagt

SEQ ID NO: 386964 - DNA, 20 bp, Artificial
  CRISPR gRNA sequence
agaagtagaaagtagaatga

SEQ ID NO: 386965 - DNA, 20 bp, Artificial
  CRISPR gRNA sequence
gaagtagaaagtagaatgat

SEQ ID NO: 386966 - DNA, 20 bp, Artificial
  CRISPR gRNA sequence
ccagaggctgtgcaagagaa

SEQ ID NO: 386967 - DNA, 20 bp, Artificial
  CRISPR gRNA sequence
tgcaagagaatggggaggga

SEQ ID NO: 386968 - DNA, 20 bp, Artificial
  CRISPR gRNA sequence
ttggtcaaagagtacaaaat

SEQ ID NO: 386969 - DNA, 20 bp, Artificial
  CRISPR gRNA sequence
gtcaaagagtacaaaatttc

SEQ ID NO: 386970 - DNA, 20 bp, Artificial
  CRISPR gRNA sequence
cagatacacgaggggaataa

SEQ ID NO: 386971 - DNA, 20 bp, Artificial
  CRISPR gRNA sequence
agatacacgaggggaataag

SEQ ID NO: 386972 - DNA, 20 bp, Artificial
  CRISPR gRNA sequence
aagatttctttttttttttt

SEQ ID NO: 386973 - DNA, 20 bp, Artificial
  CRISPR gRNA sequence
agatttcttttttttttttt

SEQ ID NO: 386974 - DNA, 20 bp, Artificial
  CRISPR gRNA sequence
cttttttttttttttttgag

SEQ ID NO: 386975 - DNA, 20 bp, Artificial
  CRISPR gRNA sequence
ttttttttttttttttgaga

SEQ ID NO: 386976 - DNA, 20 bp, Artificial
  CRISPR gRNA sequence
ttttttttttttttgagaca

SEQ ID NO: 386977 - DNA, 20 bp, Artificial
  CRISPR gRNA sequence
tttttttttttttgagacag

SEQ ID NO: 386978 - DNA, 20 bp, Artificial
  CRISPR gRNA sequence
ttttttttttttgagacaga

SEQ ID NO: 386979 - DNA, 20 bp, Artificial
  CRISPR gRNA sequence
tttttttttttgagacagag

SEQ ID NO: 386980 - DNA, 20 bp, Artificial
  CRISPR gRNA sequence
ttttttttttgagacagagt

SEQ ID NO: 386981 - DNA, 20 bp, Artificial
  CRISPR gRNA sequence
tttttttttgagacagagtc

SEQ ID NO: 386982 - DNA, 20 bp, Artificial
  CRISPR gRNA sequence
ttttttttgagacagagtct

SEQ ID NO: 386983 - DNA, 20 bp, Artificial
  CRISPR gRNA sequence
tttttttgagacagagtctc

SEQ ID NO: 386984 - DNA, 20 bp, Artificial
  CRISPR gRNA sequence
ttttttgagacagagtctcg

SEQ ID NO: 386985 - DNA, 20 bp, Artificial
  CRISPR gRNA sequence
tttttgagacagagtctcgt

SEQ ID NO: 386986 - DNA, 20 bp, Artificial
  CRISPR gRNA sequence
ttttgagacagagtctcgtt

SEQ ID NO: 386987 - DNA, 20 bp, Artificial
  CRISPR gRNA sequence
tttgagacagagtctcgttt

SEQ ID NO: 386988 - DNA, 20 bp, Artificial
  CRISPR gRNA sequence
ttgagacagagtctcgtttt

SEQ ID NO: 386989 - DNA, 20 bp, Artificial
  CRISPR gRNA sequence
tgagacagagtctcgttttg

SEQ ID NO: 386990 - DNA, 20 bp, Artificial
  CRISPR gRNA sequence
gagacagagtctcgttttgt

SEQ ID NO: 386991 - DNA, 20 bp, Artificial
  CRISPR gRNA sequence
agacagagtctcgttttgtc

SEQ ID NO: 386992 - DNA, 20 bp, Artificial
  CRISPR gRNA sequence
gttttgtcacccaggctgga

SEQ ID NO: 386993 - DNA, 20 bp, Artificial
  CRISPR gRNA sequence
tgtcacccaggctggagtgc

SEQ ID NO: 386994 - DNA, 20 bp, Artificial
  CRISPR gRNA sequence
gtcacccaggctggagtgca

SEQ ID NO: 386995 - DNA, 20 bp, Artificial
  CRISPR gRNA sequence
tcacccaggctggagtgcag

SEQ ID NO: 386996 - DNA, 20 bp, Artificial
  CRISPR gRNA sequence
gagtgcagtggcacgatctc

SEQ ID NO: 386997 - DNA, 20 bp, Artificial
  CRISPR gRNA sequence
ggctcactgcaacctccgcc

SEQ ID NO: 386998 - DNA, 20 bp, Artificial
  CRISPR gRNA sequence
actgcaacctccgcctcctg

SEQ ID NO: 386999 - DNA, 20 bp, Artificial
  CRISPR gRNA sequence
caacctccgcctcctgggtt

SEQ ID NO: 387000 - DNA, 20 bp, Artificial
  CRISPR gRNA sequence
cgcctcctgggttcaagcga

SEQ ID NO: 387001 - DNA, 20 bp, Artificial
  CRISPR gRNA sequence
ctgggttcaagcgattctcc

SEQ ID NO: 387002 - DNA, 20 bp, Artificial
  CRISPR gRNA sequence
ggttcaagcgattctcctgc

SEQ ID NO: 387003 - DNA, 20 bp, Artificial
  CRISPR gRNA sequence
aagcgattctcctgcctcag

SEQ ID NO: 387004 - DNA, 20 bp, Artificial
  CRISPR gRNA sequence
tcctgcctcagccccctgag

SEQ ID NO: 387005 - DNA, 20 bp, Artificial
  CRISPR gRNA sequence
ctgcctcagccccctgagta

SEQ ID NO: 387006 - DNA, 20 bp, Artificial
  CRISPR gRNA sequence
cctcagccccctgagtagct

SEQ ID NO: 387007 - DNA, 20 bp, Artificial
  CRISPR gRNA sequence
agccccctgagtagctggga

SEQ ID NO: 387008 - DNA, 20 bp, Artificial
  CRISPR gRNA sequence
agtagctgggactacaggcg

SEQ ID NO: 387009 - DNA, 20 bp, Artificial
  CRISPR gRNA sequence
ggactacaggcgcccgccac

SEQ ID NO: 387010 - DNA, 20 bp, Artificial
  CRISPR gRNA sequence
caggcgcccgccacaatgcc

SEQ ID NO: 387011 - DNA, 20 bp, Artificial
  CRISPR gRNA sequence
atttttatattttagtagag

SEQ ID NO: 387012 - DNA, 20 bp, Artificial
  CRISPR gRNA sequence
ttatattttagtagagatgg

SEQ ID NO: 387013 - DNA, 20 bp, Artificial
  CRISPR gRNA sequence
tatattttagtagagatggg

SEQ ID NO: 387014 - DNA, 20 bp, Artificial
  CRISPR gRNA sequence
atattttagtagagatgggg

SEQ ID NO: 387015 - DNA, 20 bp, Artificial
  CRISPR gRNA sequence
tattttagtagagatggggt

SEQ ID NO: 387016 - DNA, 20 bp, Artificial
  CRISPR gRNA sequence
tagtagagatggggtttcac

SEQ ID NO: 387017 - DNA, 20 bp, Artificial
  CRISPR gRNA sequence
agtagagatggggtttcacc

SEQ ID NO: 387018 - DNA, 20 bp, Artificial
  CRISPR gRNA sequence
gtagagatggggtttcacca

SEQ ID NO: 387019 - DNA, 20 bp, Artificial
  CRISPR gRNA sequence
caccatgttggccatgctgg

SEQ ID NO: 387020 - DNA, 20 bp, Artificial
  CRISPR gRNA sequence
accatgttggccatgctggt

SEQ ID NO: 387021 - DNA, 20 bp, Artificial
  CRISPR gRNA sequence
gccatgctggtctcgaactc

SEQ ID NO: 387022 - DNA, 20 bp, Artificial
  CRISPR gRNA sequence
gtctcgaactcctgacctcg

SEQ ID NO: 387023 - DNA, 20 bp, Artificial
  CRISPR gRNA sequence
gaactcctgacctcgaggga

SEQ ID NO: 387024 - DNA, 20 bp, Artificial
  CRISPR gRNA sequence
ctgacctcgagggatccacc

SEQ ID NO: 387025 - DNA, 20 bp, Artificial
  CRISPR gRNA sequence
acctcgagggatccacctgc

SEQ ID NO: 387026 - DNA, 20 bp, Artificial
  CRISPR gRNA sequence
gagggatccacctgcctcgg

SEQ ID NO: 387027 - DNA, 20 bp, Artificial
  CRISPR gRNA sequence
cctcggtctcctaaagtgct

SEQ ID NO: 387028 - DNA, 20 bp, Artificial
  CRISPR gRNA sequence
ggtctcctaaagtgctggaa

SEQ ID NO: 387029 - DNA, 20 bp, Artificial
  CRISPR gRNA sequence
ctaaagtgctggaattacag

SEQ ID NO: 387030 - DNA, 20 bp, Artificial
  CRISPR gRNA sequence
aagtgctggaattacaggcg

SEQ ID NO: 387031 - DNA, 20 bp, Artificial
  CRISPR gRNA sequence
gaattacaggcgtgagccac

SEQ ID NO: 387032 - DNA, 20 bp, Artificial
  CRISPR gRNA sequence
caggcgtgagccacagcacc

SEQ ID NO: 387033 - DNA, 20 bp, Artificial
  CRISPR gRNA sequence
taagatttatcatacagcag

SEQ ID NO: 387034 - DNA, 20 bp, Artificial
  CRISPR gRNA sequence
aagatttatcatacagcaga

SEQ ID NO: 387035 - DNA, 20 bp, Artificial
  CRISPR gRNA sequence
agatttatcatacagcagag

SEQ ID NO: 387036 - DNA, 20 bp, Artificial
  CRISPR gRNA sequence
atcatacagcagagtctcta

SEQ ID NO: 387037 - DNA, 20 bp, Artificial
  CRISPR gRNA sequence
tcatacagcagagtctctat

SEQ ID NO: 387038 - DNA, 20 bp, Artificial
  CRISPR gRNA sequence
tatagtcaataataatgtat

SEQ ID NO: 387039 - DNA, 20 bp, Artificial
  CRISPR gRNA sequence
tagtcaataataatgtatac

SEQ ID NO: 387040 - DNA, 20 bp, Artificial
  CRISPR gRNA sequence
caaagtgactgagtaaattt

SEQ ID NO: 387041 - DNA, 20 bp, Artificial
  CRISPR gRNA sequence
aaagtgactgagtaaatttc

SEQ ID NO: 387042 - DNA, 20 bp, Artificial
  CRISPR gRNA sequence
agtaaatttcaaatatctca

SEQ ID NO: 387043 - DNA, 20 bp, Artificial
  CRISPR gRNA sequence
caaatatctcacagtagaaa

SEQ ID NO: 387044 - DNA, 20 bp, Artificial
  CRISPR gRNA sequence
aaatatctcacagtagaaat

SEQ ID NO: 387045 - DNA, 20 bp, Artificial
  CRISPR gRNA sequence
acagtagaaatcataggtaa

SEQ ID NO: 387046 - DNA, 20 bp, Artificial
  CRISPR gRNA sequence
attggcttgatttaatcact

SEQ ID NO: 387047 - DNA, 20 bp, Artificial
  CRISPR gRNA sequence
gcttgatttaatcactctac

SEQ ID NO: 387048 - DNA, 20 bp, Artificial
  CRISPR gRNA sequence
gatttaatcactctacattg

SEQ ID NO: 387049 - DNA, 20 bp, Artificial
  CRISPR gRNA sequence
atttaatcactctacattgt

SEQ ID NO: 387050 - DNA, 20 bp, Artificial
  CRISPR gRNA sequence
aatcactctacattgtatac

SEQ ID NO: 387051 - DNA, 20 bp, Artificial
  CRISPR gRNA sequence
atcactctacattgtataca

SEQ ID NO: 387052 - DNA, 20 bp, Artificial
  CRISPR gRNA sequence
tacattgtatacatatgtca

SEQ ID NO: 387053 - DNA, 20 bp, Artificial
  CRISPR gRNA sequence
cattgtatacatatgtcaaa

SEQ ID NO: 387054 - DNA, 20 bp, Artificial
  CRISPR gRNA sequence
tatacatatgtcaaaatatc

SEQ ID NO: 387055 - DNA, 20 bp, Artificial
  CRISPR gRNA sequence
tttgtcaactaaaataaaat

SEQ ID NO: 387056 - DNA, 20 bp, Artificial
  CRISPR gRNA sequence
gtcaactaaaataaaattaa

SEQ ID NO: 387057 - DNA, 20 bp, Artificial
  CRISPR gRNA sequence
tcaactaaaataaaattaac

SEQ ID NO: 387058 - DNA, 20 bp, Artificial
  CRISPR gRNA sequence
aaataaaattaacttttttt

SEQ ID NO: 387059 - DNA, 20 bp, Artificial
  CRISPR gRNA sequence
actttttttagattttaaga

SEQ ID NO: 387060 - DNA, 20 bp, Artificial
  CRISPR gRNA sequence
tttttagattttaagaaaat

SEQ ID NO: 387061 - DNA, 20 bp, Artificial
  CRISPR gRNA sequence
ttttagattttaagaaaata

SEQ ID NO: 387062 - DNA, 20 bp, Artificial
  CRISPR gRNA sequence
tttagattttaagaaaataa

SEQ ID NO: 387063 - DNA, 20 bp, Artificial
  CRISPR gRNA sequence
ttagattttaagaaaataaa

SEQ ID NO: 387064 - DNA, 20 bp, Artificial
  CRISPR gRNA sequence
tagattttaagaaaataaac

SEQ ID NO: 387065 - DNA, 20 bp, Artificial
  CRISPR gRNA sequence
agattttaagaaaataaact

SEQ ID NO: 387066 - DNA, 20 bp, Artificial
  CRISPR gRNA sequence
gattttaagaaaataaactg

SEQ ID NO: 387067 - DNA, 20 bp, Artificial
  CRISPR gRNA sequence
taagaaaataaactgaaata

SEQ ID NO: 387068 - DNA, 20 bp, Artificial
  CRISPR gRNA sequence
aagaaaataaactgaaatat

SEQ ID NO: 387069 - DNA, 20 bp, Artificial
  CRISPR gRNA sequence
agaaaataaactgaaatatt

SEQ ID NO: 387070 - DNA, 20 bp, Artificial
  CRISPR gRNA sequence
aaatattagaccttgttttg

SEQ ID NO: 387071 - DNA, 20 bp, Artificial
  CRISPR gRNA sequence
gaccttgttttgtgtacaga

SEQ ID NO: 387072 - DNA, 20 bp, Artificial
  CRISPR gRNA sequence
gttttgtgtacagatggacc

SEQ ID NO: 387073 - DNA, 20 bp, Artificial
  CRISPR gRNA sequence
ttttgtgtacagatggacca

SEQ ID NO: 387074 - DNA, 20 bp, Artificial
  CRISPR gRNA sequence
tgtgtacagatggaccataa

SEQ ID NO: 387075 - DNA, 20 bp, Artificial
  CRISPR gRNA sequence
gtgtacagatggaccataat

SEQ ID NO: 387076 - DNA, 20 bp, Artificial
  CRISPR gRNA sequence
tgtacagatggaccataatg

SEQ ID NO: 387077 - DNA, 20 bp, Artificial
  CRISPR gRNA sequence
acacagagcagatgtgggtg

SEQ ID NO: 387078 - DNA, 20 bp, Artificial
  CRISPR gRNA sequence
acagattctgcattatcagg

SEQ ID NO: 387079 - DNA, 20 bp, Artificial
  CRISPR gRNA sequence
tgcattatcaggtcatacaa

SEQ ID NO: 387080 - DNA, 20 bp, Artificial
  CRISPR gRNA sequence
cattatcaggtcatacaaag

SEQ ID NO: 387081 - DNA, 20 bp, Artificial
  CRISPR gRNA sequence
tcaggtcatacaaagttttg

SEQ ID NO: 387082 - DNA, 20 bp, Artificial
  CRISPR gRNA sequence
tgaccttctatataatgtaa

SEQ ID NO: 387083 - DNA, 20 bp, Artificial
  CRISPR gRNA sequence
gaccttctatataatgtaaa

SEQ ID NO: 387084 - DNA, 20 bp, Artificial
  CRISPR gRNA sequence
accttctatataatgtaaac

SEQ ID NO: 387085 - DNA, 20 bp, Artificial
  CRISPR gRNA sequence
ctatataatgtaaacaaata

SEQ ID NO: 387086 - DNA, 20 bp, Artificial
  CRISPR gRNA sequence
tatataatgtaaacaaatat

SEQ ID NO: 387087 - DNA, 20 bp, Artificial
  CRISPR gRNA sequence
tataatgtaaacaaatattc

SEQ ID NO: 387088 - DNA, 20 bp, Artificial
  CRISPR gRNA sequence
aacctttgtcccactttaga

SEQ ID NO: 387089 - DNA, 20 bp, Artificial
  CRISPR gRNA sequence
tgtcccactttagacattgg

SEQ ID NO: 387090 - DNA, 20 bp, Artificial
  CRISPR gRNA sequence
gtcccactttagacattggt

SEQ ID NO: 387091 - DNA, 20 bp, Artificial
  CRISPR gRNA sequence
tcccactttagacattggtt

SEQ ID NO: 387092 - DNA, 20 bp, Artificial
  CRISPR gRNA sequence
tagacattggtttattgaaa

SEQ ID NO: 387093 - DNA, 20 bp, Artificial
  CRISPR gRNA sequence
agacattggtttattgaaaa

SEQ ID NO: 387094 - DNA, 20 bp, Artificial
  CRISPR gRNA sequence
gacattggtttattgaaaac

SEQ ID NO: 387095 - DNA, 20 bp, Artificial
  CRISPR gRNA sequence
gtttattgaaaacagagact

SEQ ID NO: 387096 - DNA, 20 bp, Artificial
  CRISPR gRNA sequence
attgaaaacagagactgagg

SEQ ID NO: 387097 - DNA, 20 bp, Artificial
  CRISPR gRNA sequence
ttgaaaacagagactgagga

SEQ ID NO: 387098 - DNA, 20 bp, Artificial
  CRISPR gRNA sequence
aaaacagagactgaggagaa

SEQ ID NO: 387099 - DNA, 20 bp, Artificial
  CRISPR gRNA sequence
aggagaaaagccttggggcc

SEQ ID NO: 387100 - DNA, 20 bp, Artificial
  CRISPR gRNA sequence
ggggcctagtcctgtcttct

SEQ ID NO: 387101 - DNA, 20 bp, Artificial
  CRISPR gRNA sequence
gggcctagtcctgtcttcta

SEQ ID NO: 387102 - DNA, 20 bp, Artificial
  CRISPR gRNA sequence
gtcctgtcttctaattcttt

SEQ ID NO: 387103 - DNA, 20 bp, Artificial
  CRISPR gRNA sequence
tcttctaattctttcccctg

SEQ ID NO: 387104 - DNA, 20 bp, Artificial
  CRISPR gRNA sequence
ctaattctttcccctggaag

SEQ ID NO: 387105 - DNA, 20 bp, Artificial
  CRISPR gRNA sequence
taattctttcccctggaaga

SEQ ID NO: 387106 - DNA, 20 bp, Artificial
  CRISPR gRNA sequence
attctttcccctggaagact

SEQ ID NO: 387107 - DNA, 20 bp, Artificial
  CRISPR gRNA sequence
tttcccctggaagacttcac

SEQ ID NO: 387108 - DNA, 20 bp, Artificial
  CRISPR gRNA sequence
tcccctggaagacttcacat

SEQ ID NO: 387109 - DNA, 20 bp, Artificial
  CRISPR gRNA sequence
cccctggaagacttcacata

SEQ ID NO: 387110 - DNA, 20 bp, Artificial
  CRISPR gRNA sequence
ccctggaagacttcacatag

SEQ ID NO: 387111 - DNA, 20 bp, Artificial
  CRISPR gRNA sequence
gaagacttcacataggacac

SEQ ID NO: 387112 - DNA, 20 bp, Artificial
  CRISPR gRNA sequence
cacataggacacttaatgtt

SEQ ID NO: 387113 - DNA, 20 bp, Artificial
  CRISPR gRNA sequence
acataggacacttaatgttt

SEQ ID NO: 387114 - DNA, 20 bp, Artificial
  CRISPR gRNA sequence
aatgttttaaacagtttttt

SEQ ID NO: 387115 - DNA, 20 bp, Artificial
  CRISPR gRNA sequence
atgttttaaacagttttttt

SEQ ID NO: 387116 - DNA, 20 bp, Artificial
  CRISPR gRNA sequence
taaacagttttttttggcaa

SEQ ID NO: 387117 - DNA, 20 bp, Artificial
  CRISPR gRNA sequence
aaacagttttttttggcaac

SEQ ID NO: 387118 - DNA, 20 bp, Artificial
  CRISPR gRNA sequence
aacagttttttttggcaact

SEQ ID NO: 387119 - DNA, 20 bp, Artificial
  CRISPR gRNA sequence
tttttggcaactgcataatg

SEQ ID NO: 387120 - DNA, 20 bp, Artificial
  CRISPR gRNA sequence
ttttggcaactgcataatga

SEQ ID NO: 387121 - DNA, 20 bp, Artificial
  CRISPR gRNA sequence
tttggcaactgcataatgat

SEQ ID NO: 387122 - DNA, 20 bp, Artificial
  CRISPR gRNA sequence
ttggcaactgcataatgatg

SEQ ID NO: 387123 - DNA, 20 bp, Artificial
  CRISPR gRNA sequence
tggcaactgcataatgatga

SEQ ID NO: 387124 - DNA, 20 bp, Artificial
  CRISPR gRNA sequence
ggcaactgcataatgatgat

SEQ ID NO: 387125 - DNA, 20 bp, Artificial
  CRISPR gRNA sequence
gcaactgcataatgatgata

SEQ ID NO: 387126 - DNA, 20 bp, Artificial
  CRISPR gRNA sequence
cataatgatgataaaattaa

SEQ ID NO: 387127 - DNA, 20 bp, Artificial
  CRISPR gRNA sequence
accacaagggtagctatgag

SEQ ID NO: 387128 - DNA, 20 bp, Artificial
  CRISPR gRNA sequence
tgagatttaaatcaagcatg

SEQ ID NO: 387129 - DNA, 20 bp, Artificial
  CRISPR gRNA sequence
aaatcaagcatgcagaggtg

SEQ ID NO: 387130 - DNA, 20 bp, Artificial
  CRISPR gRNA sequence
aatcaagcatgcagaggtgg

SEQ ID NO: 387131 - DNA, 20 bp, Artificial
  CRISPR gRNA sequence
caacattttaagcgccaaac

SEQ ID NO: 387132 - DNA, 20 bp, Artificial
  CRISPR gRNA sequence
aacattttaagcgccaaacg

SEQ ID NO: 387133 - DNA, 20 bp, Artificial
  CRISPR gRNA sequence
taagcgccaaacgatttagg

SEQ ID NO: 387134 - DNA, 20 bp, Artificial
  CRISPR gRNA sequence
aagcgccaaacgatttaggt

SEQ ID NO: 387135 - DNA, 20 bp, Artificial
  CRISPR gRNA sequence
agcgccaaacgatttaggtt

SEQ ID NO: 387136 - DNA, 20 bp, Artificial
  CRISPR gRNA sequence
aggttattaatcatgcatat

SEQ ID NO: 387137 - DNA, 20 bp, Artificial
  CRISPR gRNA sequence
ggttattaatcatgcatatt

SEQ ID NO: 387138 - DNA, 20 bp, Artificial
  CRISPR gRNA sequence
ttaatcatgcatatttaata

SEQ ID NO: 387139 - DNA, 20 bp, Artificial
  CRISPR gRNA sequence
atcatgcatatttaatatgc

SEQ ID NO: 387140 - DNA, 20 bp, Artificial
  CRISPR gRNA sequence
aatatgcatttatattttac

SEQ ID NO: 387141 - DNA, 20 bp, Artificial
  CRISPR gRNA sequence
atatgcatttatattttacg

SEQ ID NO: 387142 - DNA, 20 bp, Artificial
  CRISPR gRNA sequence
atattttacgtagacacatt

SEQ ID NO: 387143 - DNA, 20 bp, Artificial
  CRISPR gRNA sequence
tattttacgtagacacattc

SEQ ID NO: 387144 - DNA, 20 bp, Artificial
  CRISPR gRNA sequence
tacgtagacacattccaaat

SEQ ID NO: 387145 - DNA, 20 bp, Artificial
  CRISPR gRNA sequence
acgtagacacattccaaatg

SEQ ID NO: 387146 - DNA, 20 bp, Artificial
  CRISPR gRNA sequence
cgtagacacattccaaatga

SEQ ID NO: 387147 - DNA, 20 bp, Artificial
  CRISPR gRNA sequence
caaatgagggttaatcagat

SEQ ID NO: 387148 - DNA, 20 bp, Artificial
  CRISPR gRNA sequence
atcagataacttgtttctat

SEQ ID NO: 387149 - DNA, 20 bp, Artificial
  CRISPR gRNA sequence
gtttctatttttttcatgtt

SEQ ID NO: 387150 - DNA, 20 bp, Artificial
  CRISPR gRNA sequence
tttctatttttttcatgttg

SEQ ID NO: 387151 - DNA, 20 bp, Artificial
  CRISPR gRNA sequence
ctatttttttcatgttgaga

SEQ ID NO: 387152 - DNA, 20 bp, Artificial
  CRISPR gRNA sequence
tatttttttcatgttgagat

SEQ ID NO: 387153 - DNA, 20 bp, Artificial
  CRISPR gRNA sequence
tttttttcatgttgagatgt

SEQ ID NO: 387154 - DNA, 20 bp, Artificial
  CRISPR gRNA sequence
ttttcatgttgagatgtcac

SEQ ID NO: 387155 - DNA, 20 bp, Artificial
  CRISPR gRNA sequence
tttcatgttgagatgtcaca

SEQ ID NO: 387156 - DNA, 20 bp, Artificial
  CRISPR gRNA sequence
ttcatgttgagatgtcacat

SEQ ID NO: 387157 - DNA, 20 bp, Artificial
  CRISPR gRNA sequence
tcatgttgagatgtcacatt

SEQ ID NO: 387158 - DNA, 20 bp, Artificial
  CRISPR gRNA sequence
catgttgagatgtcacattg

SEQ ID NO: 387159 - DNA, 20 bp, Artificial
  CRISPR gRNA sequence
atgttgagatgtcacattga

SEQ ID NO: 387160 - DNA, 20 bp, Artificial
  CRISPR gRNA sequence
agatgtcacattgaagtagt

SEQ ID NO: 387161 - DNA, 20 bp, Artificial
  CRISPR gRNA sequence
aagtagtcgtgtacagcaga

SEQ ID NO: 387162 - DNA, 20 bp, Artificial
  CRISPR gRNA sequence
gctcctgcagctagactcgc

SEQ ID NO: 387163 - DNA, 20 bp, Artificial
  CRISPR gRNA sequence
ctcctgcagctagactcgcc

SEQ ID NO: 387164 - DNA, 20 bp, Artificial
  CRISPR gRNA sequence
ctgcagctagactcgccttc

SEQ ID NO: 387165 - DNA, 20 bp, Artificial
  CRISPR gRNA sequence
cagctagactcgccttcctg

SEQ ID NO: 387166 - DNA, 20 bp, Artificial
  CRISPR gRNA sequence
gactcgccttcctggggaaa

SEQ ID NO: 387167 - DNA, 20 bp, Artificial
  CRISPR gRNA sequence
gccttcctggggaaaggcac

SEQ ID NO: 387168 - DNA, 20 bp, Artificial
  CRISPR gRNA sequence
cctggggaaaggcacaggta

SEQ ID NO: 387169 - DNA, 20 bp, Artificial
  CRISPR gRNA sequence
ctggggaaaggcacaggtac

SEQ ID NO: 387170 - DNA, 20 bp, Artificial
  CRISPR gRNA sequence
gggaaaggcacaggtactgt

SEQ ID NO: 387171 - DNA, 20 bp, Artificial
  CRISPR gRNA sequence
ttggtaaacatctatacaat

SEQ ID NO: 387172 - DNA, 20 bp, Artificial
  CRISPR gRNA sequence
gtaaacatctatacaataac

SEQ ID NO: 387173 - DNA, 20 bp, Artificial
  CRISPR gRNA sequence
tacaataactgttgccttgg

SEQ ID NO: 387174 - DNA, 20 bp, Artificial
  CRISPR gRNA sequence
ttgccttggcagaccaccgg

SEQ ID NO: 387175 - DNA, 20 bp, Artificial
  CRISPR gRNA sequence
ccttggcagaccaccggaaa

SEQ ID NO: 387176 - DNA, 20 bp, Artificial
  CRISPR gRNA sequence
ggcagaccaccggaaataat

SEQ ID NO: 387177 - DNA, 20 bp, Artificial
  CRISPR gRNA sequence
gcagaccaccggaaataata

SEQ ID NO: 387178 - DNA, 20 bp, Artificial
  CRISPR gRNA sequence
aactttcctgtatgcctgaa

SEQ ID NO: 387179 - DNA, 20 bp, Artificial
  CRISPR gRNA sequence
tcctgtatgcctgaaatacg

SEQ ID NO: 387180 - DNA, 20 bp, Artificial
  CRISPR gRNA sequence
cctgtatgcctgaaatacgc

SEQ ID NO: 387181 - DNA, 20 bp, Artificial
  CRISPR gRNA sequence
ctgtatgcctgaaatacgca

SEQ ID NO: 387182 - DNA, 20 bp, Artificial
  CRISPR gRNA sequence
tatgcctgaaatacgcatca

SEQ ID NO: 387183 - DNA, 20 bp, Artificial
  CRISPR gRNA sequence
aaatacgcatcacgtggata

SEQ ID NO: 387184 - DNA, 20 bp, Artificial
  CRISPR gRNA sequence
gtatggtaatattattccaa

SEQ ID NO: 387185 - DNA, 20 bp, Artificial
  CRISPR gRNA sequence
ttccaagttttcaaaggtca

SEQ ID NO: 387186 - DNA, 20 bp, Artificial
  CRISPR gRNA sequence
caagttttcaaaggtcaact

SEQ ID NO: 387187 - DNA, 20 bp, Artificial
  CRISPR gRNA sequence
tcaaaggtcaactttctttg

SEQ ID NO: 387188 - DNA, 20 bp, Artificial
  CRISPR gRNA sequence
caaaggtcaactttctttgt

SEQ ID NO: 387189 - DNA, 20 bp, Artificial
  CRISPR gRNA sequence
aaaggtcaactttctttgtc

SEQ ID NO: 387190 - DNA, 20 bp, Artificial
  CRISPR gRNA sequence
tctttgtccagataaatcag

SEQ ID NO: 387191 - DNA, 20 bp, Artificial
  CRISPR gRNA sequence
ctttgtccagataaatcagt

SEQ ID NO: 387192 - DNA, 20 bp, Artificial
  CRISPR gRNA sequence
tttgtccagataaatcagtt

SEQ ID NO: 387193 - DNA, 20 bp, Artificial
  CRISPR gRNA sequence
tgtccagataaatcagtttt

SEQ ID NO: 387194 - DNA, 20 bp, Artificial
  CRISPR gRNA sequence
gtccagataaatcagtttta

SEQ ID NO: 387195 - DNA, 20 bp, Artificial
  CRISPR gRNA sequence
tccagataaatcagttttat

SEQ ID NO: 387196 - DNA, 20 bp, Artificial
  CRISPR gRNA sequence
tatactctgtatttcagaaa

SEQ ID NO: 387197 - DNA, 20 bp, Artificial
  CRISPR gRNA sequence
atactctgtatttcagaaac

SEQ ID NO: 387198 - DNA, 20 bp, Artificial
  CRISPR gRNA sequence
tactctgtatttcagaaacc

SEQ ID NO: 387199 - DNA, 20 bp, Artificial
  CRISPR gRNA sequence
tgtatttcagaaacctttct

SEQ ID NO: 387200 - DNA, 20 bp, Artificial
  CRISPR gRNA sequence
tatttcagaaacctttctgt

SEQ ID NO: 387201 - DNA, 20 bp, Artificial
  CRISPR gRNA sequence
cagaaacctttctgtgtttt

SEQ ID NO: 387202 - DNA, 20 bp, Artificial
  CRISPR gRNA sequence
agaaacctttctgtgtttta

SEQ ID NO: 387203 - DNA, 20 bp, Artificial
  CRISPR gRNA sequence
tctgtgttttatagctagaa

SEQ ID NO: 387204 - DNA, 20 bp, Artificial
  CRISPR gRNA sequence
ctgtgttttatagctagaag

SEQ ID NO: 387205 - DNA, 20 bp, Artificial
  CRISPR gRNA sequence
tgtgttttatagctagaagg

SEQ ID NO: 387206 - DNA, 20 bp, Artificial
  CRISPR gRNA sequence
tgttttatagctagaaggtc

SEQ ID NO: 387207 - DNA, 20 bp, Artificial
  CRISPR gRNA sequence
tatagctagaaggtcctaga

SEQ ID NO: 387208 - DNA, 20 bp, Artificial
  CRISPR gRNA sequence
atagctagaaggtcctagag

SEQ ID NO: 387209 - DNA, 20 bp, Artificial
  CRISPR gRNA sequence
tagctagaaggtcctagagt

SEQ ID NO: 387210 - DNA, 20 bp, Artificial
  CRISPR gRNA sequence
gaaggtcctagagtgtaaat

SEQ ID NO: 387211 - DNA, 20 bp, Artificial
  CRISPR gRNA sequence
gagtgtaaattattttcaga

SEQ ID NO: 387212 - DNA, 20 bp, Artificial
  CRISPR gRNA sequence
ttttcagagaattaaagggc

SEQ ID NO: 387213 - DNA, 20 bp, Artificial
  CRISPR gRNA sequence
tcagagaattaaagggccat

SEQ ID NO: 387214 - DNA, 20 bp, Artificial
  CRISPR gRNA sequence
cagagaattaaagggccatg

SEQ ID NO: 387215 - DNA, 20 bp, Artificial
  CRISPR gRNA sequence
agagaattaaagggccatgg

SEQ ID NO: 387216 - DNA, 20 bp, Artificial
  CRISPR gRNA sequence
aagggccatggcttcaacct

SEQ ID NO: 387217 - DNA, 20 bp, Artificial
  CRISPR gRNA sequence
caacctctaatccttcttct

SEQ ID NO: 387218 - DNA, 20 bp, Artificial
  CRISPR gRNA sequence
aacctctaatccttcttctg

SEQ ID NO: 387219 - DNA, 20 bp, Artificial
  CRISPR gRNA sequence
taatccttcttctgagtaaa

SEQ ID NO: 387220 - DNA, 20 bp, Artificial
  CRISPR gRNA sequence
atccttcttctgagtaaata

SEQ ID NO: 387221 - DNA, 20 bp, Artificial
  CRISPR gRNA sequence
cttctgagtaaatagcaact

SEQ ID NO: 387222 - DNA, 20 bp, Artificial
  CRISPR gRNA sequence
ttctgagtaaatagcaacta

SEQ ID NO: 387223 - DNA, 20 bp, Artificial
  CRISPR gRNA sequence
ctgagtaaatagcaactact

SEQ ID NO: 387224 - DNA, 20 bp, Artificial
  CRISPR gRNA sequence
tgagtaaatagcaactactt

SEQ ID NO: 387225 - DNA, 20 bp, Artificial
  CRISPR gRNA sequence
agtaaatagcaactactttt

SEQ ID NO: 387226 - DNA, 20 bp, Artificial
  CRISPR gRNA sequence
cttttcctcaaaataaaagt

SEQ ID NO: 387227 - DNA, 20 bp, Artificial
  CRISPR gRNA sequence
ttcctcaaaataaaagtatt

SEQ ID NO: 387228 - DNA, 20 bp, Artificial
  CRISPR gRNA sequence
tcctcaaaataaaagtatta

SEQ ID NO: 387229 - DNA, 20 bp, Artificial
  CRISPR gRNA sequence
cctcaaaataaaagtattat

SEQ ID NO: 387230 - DNA, 20 bp, Artificial
  CRISPR gRNA sequence
ctcaaaataaaagtattatc

SEQ ID NO: 387231 - DNA, 20 bp, Artificial
  CRISPR gRNA sequence
aaaataaaagtattatcagg

SEQ ID NO: 387232 - DNA, 20 bp, Artificial
  CRISPR gRNA sequence
tcaggttttaactaagaaac

SEQ ID NO: 387233 - DNA, 20 bp, Artificial
  CRISPR gRNA sequence
taactaagaaacataaggcc

SEQ ID NO: 387234 - DNA, 20 bp, Artificial
  CRISPR gRNA sequence
aactaagaaacataaggccc

SEQ ID NO: 387235 - DNA, 20 bp, Artificial
  CRISPR gRNA sequence
actaagaaacataaggccca

SEQ ID NO: 387236 - DNA, 20 bp, Artificial
  CRISPR gRNA sequence
agaaacataaggcccagaga

SEQ ID NO: 387237 - DNA, 20 bp, Artificial
  CRISPR gRNA sequence
aataatttttctgtcattat

SEQ ID NO: 387238 - DNA, 20 bp, Artificial
  CRISPR gRNA sequence
ttctgtcattatagagcaaa

SEQ ID NO: 387239 - DNA, 20 bp, Artificial
  CRISPR gRNA sequence
tctgtcattatagagcaaac

SEQ ID NO: 387240 - DNA, 20 bp, Artificial
  CRISPR gRNA sequence
ctgtcattatagagcaaacc

SEQ ID NO: 387241 - DNA, 20 bp, Artificial
  CRISPR gRNA sequence
tgtcattatagagcaaacca

SEQ ID NO: 387242 - DNA, 20 bp, Artificial
  CRISPR gRNA sequence
tcattatagagcaaaccagt

SEQ ID NO: 387243 - DNA, 20 bp, Artificial
  CRISPR gRNA sequence
tagagcaaaccagtgaggga

SEQ ID NO: 387244 - DNA, 20 bp, Artificial
  CRISPR gRNA sequence
cctagctgatgtagaaattt

SEQ ID NO: 387245 - DNA, 20 bp, Artificial
  CRISPR gRNA sequence
ctagctgatgtagaaatttt

SEQ ID NO: 387246 - DNA, 20 bp, Artificial
  CRISPR gRNA sequence
gctgatgtagaaattttgct

SEQ ID NO: 387247 - DNA, 20 bp, Artificial
  CRISPR gRNA sequence
atgtagaaattttgctacaa

SEQ ID NO: 387248 - DNA, 20 bp, Artificial
  CRISPR gRNA sequence
tgctacaatttgcctctctt

SEQ ID NO: 387249 - DNA, 20 bp, Artificial
  CRISPR gRNA sequence
gctacaatttgcctctcttg

SEQ ID NO: 387250 - DNA, 20 bp, Artificial
  CRISPR gRNA sequence
ctacaatttgcctctcttga

SEQ ID NO: 387251 - DNA, 20 bp, Artificial
  CRISPR gRNA sequence
caatttgcctctcttgatgg

SEQ ID NO: 387252 - DNA, 20 bp, Artificial
  CRISPR gRNA sequence
gcctctcttgatggcaaatt

SEQ ID NO: 387253 - DNA, 20 bp, Artificial
  CRISPR gRNA sequence
cctctcttgatggcaaatta

SEQ ID NO: 387254 - DNA, 20 bp, Artificial
  CRISPR gRNA sequence
tcttgatggcaaattatagc

SEQ ID NO: 387255 - DNA, 20 bp, Artificial
  CRISPR gRNA sequence
ttgatggcaaattatagcaa

SEQ ID NO: 387256 - DNA, 20 bp, Artificial
  CRISPR gRNA sequence
gatggcaaattatagcaaaa

SEQ ID NO: 387257 - DNA, 20 bp, Artificial
  CRISPR gRNA sequence
atggcaaattatagcaaaat

SEQ ID NO: 387258 - DNA, 20 bp, Artificial
  CRISPR gRNA sequence
tagcaaaattagtatatcag

SEQ ID NO: 387259 - DNA, 20 bp, Artificial
  CRISPR gRNA sequence
gtatatcaggtgggaaactt

SEQ ID NO: 387260 - DNA, 20 bp, Artificial
  CRISPR gRNA sequence
tctttatgttgaaaatactt

SEQ ID NO: 387261 - DNA, 20 bp, Artificial
  CRISPR gRNA sequence
ctttatgttgaaaatacttg

SEQ ID NO: 387262 - DNA, 20 bp, Artificial
  CRISPR gRNA sequence
tttatgttgaaaatacttgt

SEQ ID NO: 387263 - DNA, 20 bp, Artificial
  CRISPR gRNA sequence
tatgttgaaaatacttgtcc

SEQ ID NO: 387264 - DNA, 20 bp, Artificial
  CRISPR gRNA sequence
atgttgaaaatacttgtccc

SEQ ID NO: 387265 - DNA, 20 bp, Artificial
  CRISPR gRNA sequence
tgttgaaaatacttgtccca

SEQ ID NO: 387266 - DNA, 20 bp, Artificial
  CRISPR gRNA sequence
aaaatacttgtcccaaatag

SEQ ID NO: 387267 - DNA, 20 bp, Artificial
  CRISPR gRNA sequence
gtcccaaatagtttaaacac

SEQ ID NO: 387268 - DNA, 20 bp, Artificial
  CRISPR gRNA sequence
tcccaaatagtttaaacact

SEQ ID NO: 387269 - DNA, 20 bp, Artificial
  CRISPR gRNA sequence
aaacactttaaaggtttatg

SEQ ID NO: 387270 - DNA, 20 bp, Artificial
  CRISPR gRNA sequence
aacactttaaaggtttatgt

SEQ ID NO: 387271 - DNA, 20 bp, Artificial
  CRISPR gRNA sequence
taaaggtttatgtcagttga

SEQ ID NO: 387272 - DNA, 20 bp, Artificial
  CRISPR gRNA sequence
aaaggtttatgtcagttgag

SEQ ID NO: 387273 - DNA, 20 bp, Artificial
  CRISPR gRNA sequence
aaggtttatgtcagttgaga

SEQ ID NO: 387274 - DNA, 20 bp, Artificial
  CRISPR gRNA sequence
atgtcagttgagaaacatat

SEQ ID NO: 387275 - DNA, 20 bp, Artificial
  CRISPR gRNA sequence
tgtcagttgagaaacatata

SEQ ID NO: 387276 - DNA, 20 bp, Artificial
  CRISPR gRNA sequence
agaaacatataccctaagat

SEQ ID NO: 387277 - DNA, 20 bp, Artificial
  CRISPR gRNA sequence
agatagcttgtgtgtacgtt

SEQ ID NO: 387278 - DNA, 20 bp, Artificial
  CRISPR gRNA sequence
gtgtgtacgttttacctaca

SEQ ID NO: 387279 - DNA, 20 bp, Artificial
  CRISPR gRNA sequence
tgtgtacgttttacctacac

SEQ ID NO: 387280 - DNA, 20 bp, Artificial
  CRISPR gRNA sequence
tacctacacaatatagaatg

SEQ ID NO: 387281 - DNA, 20 bp, Artificial
  CRISPR gRNA sequence
acctacacaatatagaatga

SEQ ID NO: 387282 - DNA, 20 bp, Artificial
  CRISPR gRNA sequence
cctacacaatatagaatgac

SEQ ID NO: 387283 - DNA, 20 bp, Artificial
  CRISPR gRNA sequence
cacaatatagaatgactgta

SEQ ID NO: 387284 - DNA, 20 bp, Artificial
  CRISPR gRNA sequence
tattagctacttcttctggt

SEQ ID NO: 387285 - DNA, 20 bp, Artificial
  CRISPR gRNA sequence
gctacttcttctggtgcgat

SEQ ID NO: 387286 - DNA, 20 bp, Artificial
  CRISPR gRNA sequence
cttcttctggtgcgataatg

SEQ ID NO: 387287 - DNA, 20 bp, Artificial
  CRISPR gRNA sequence
cttctggtgcgataatgtag

SEQ ID NO: 387288 - DNA, 20 bp, Artificial
  CRISPR gRNA sequence
ttctggtgcgataatgtagc

SEQ ID NO: 387289 - DNA, 20 bp, Artificial
  CRISPR gRNA sequence
ctggtgcgataatgtagcat

SEQ ID NO: 387290 - DNA, 20 bp, Artificial
  CRISPR gRNA sequence
tggtgcgataatgtagcatc

SEQ ID NO: 387291 - DNA, 20 bp, Artificial
  CRISPR gRNA sequence
gtgcgataatgtagcatcat

SEQ ID NO: 387292 - DNA, 20 bp, Artificial
  CRISPR gRNA sequence
agtactgtgggccataagtt

SEQ ID NO: 387293 - DNA, 20 bp, Artificial
  CRISPR gRNA sequence
tgggccataagttctccaca

SEQ ID NO: 387294 - DNA, 20 bp, Artificial
  CRISPR gRNA sequence
tccacagtgattggtgtatg

SEQ ID NO: 387295 - DNA, 20 bp, Artificial
  CRISPR gRNA sequence
cacagtgattggtgtatggc

SEQ ID NO: 387296 - DNA, 20 bp, Artificial
  CRISPR gRNA sequence
gtgtatggcaaggatattta

SEQ ID NO: 387297 - DNA, 20 bp, Artificial
  CRISPR gRNA sequence
aagtgagcacatgaggacaa

SEQ ID NO: 387298 - DNA, 20 bp, Artificial
  CRISPR gRNA sequence
agtgagcacatgaggacaaa

SEQ ID NO: 387299 - DNA, 20 bp, Artificial
  CRISPR gRNA sequence
caaattgacacatttattga

SEQ ID NO: 387300 - DNA, 20 bp, Artificial
  CRISPR gRNA sequence
aaattgacacatttattgag

SEQ ID NO: 387301 - DNA, 20 bp, Artificial
  CRISPR gRNA sequence
acacatttattgagaaaaat

SEQ ID NO: 387302 - DNA, 20 bp, Artificial
  CRISPR gRNA sequence
attgagaaaaatgttacggc

SEQ ID NO: 387303 - DNA, 20 bp, Artificial
  CRISPR gRNA sequence
ttgagaaaaatgttacggct

SEQ ID NO: 387304 - DNA, 20 bp, Artificial
  CRISPR gRNA sequence
agaaaaatgttacggctgac

SEQ ID NO: 387305 - DNA, 20 bp, Artificial
  CRISPR gRNA sequence
cggctgactcctttgtatta

SEQ ID NO: 387306 - DNA, 20 bp, Artificial
  CRISPR gRNA sequence
actcctttgtattagatatc

SEQ ID NO: 387307 - DNA, 20 bp, Artificial
  CRISPR gRNA sequence
ctttgtattagatatctcat

SEQ ID NO: 387308 - DNA, 20 bp, Artificial
  CRISPR gRNA sequence
tgtattagatatctcatatt

SEQ ID NO: 387309 - DNA, 20 bp, Artificial
  CRISPR gRNA sequence
gtattagatatctcatattt

SEQ ID NO: 387310 - DNA, 20 bp, Artificial
  CRISPR gRNA sequence
tattagatatctcatatttt

SEQ ID NO: 387311 - DNA, 20 bp, Artificial
  CRISPR gRNA sequence
gatatctcatatttttaccc

SEQ ID NO: 387312 - DNA, 20 bp, Artificial
  CRISPR gRNA sequence
atatttttacccaaatattt

SEQ ID NO: 387313 - DNA, 20 bp, Artificial
  CRISPR gRNA sequence
ttacccaaatatttctgagt

SEQ ID NO: 387314 - DNA, 20 bp, Artificial
  CRISPR gRNA sequence
tacccaaatatttctgagtc

SEQ ID NO: 387315 - DNA, 20 bp, Artificial
  CRISPR gRNA sequence
acccaaatatttctgagtct

SEQ ID NO: 387316 - DNA, 20 bp, Artificial
  CRISPR gRNA sequence
cccaaatatttctgagtctt

SEQ ID NO: 387317 - DNA, 20 bp, Artificial
  CRISPR gRNA sequence
ctgagtcttatacttcttgc

SEQ ID NO: 387318 - DNA, 20 bp, Artificial
  CRISPR gRNA sequence
tgagtcttatacttcttgca

SEQ ID NO: 387319 - DNA, 20 bp, Artificial
  CRISPR gRNA sequence
agtcttatacttcttgcaca

SEQ ID NO: 387320 - DNA, 20 bp, Artificial
  CRISPR gRNA sequence
atacttcttgcacatttacc

SEQ ID NO: 387321 - DNA, 20 bp, Artificial
  CRISPR gRNA sequence
tacttcttgcacatttacct

SEQ ID NO: 387322 - DNA, 20 bp, Artificial
  CRISPR gRNA sequence
cttgcacatttacctcaatt

SEQ ID NO: 387323 - DNA, 20 bp, Artificial
  CRISPR gRNA sequence
ttgcacatttacctcaattt

SEQ ID NO: 387324 - DNA, 20 bp, Artificial
  CRISPR gRNA sequence
gcacatttacctcaattttt

SEQ ID NO: 387325 - DNA, 20 bp, Artificial
  CRISPR gRNA sequence
cacatttacctcaattttta

SEQ ID NO: 387326 - DNA, 20 bp, Artificial
  CRISPR gRNA sequence
acctcaatttttatgaacat

SEQ ID NO: 387327 - DNA, 20 bp, Artificial
  CRISPR gRNA sequence
cctcaatttttatgaacata

SEQ ID NO: 387328 - DNA, 20 bp, Artificial
  CRISPR gRNA sequence
aatttttatgaacatattat

SEQ ID NO: 387329 - DNA, 20 bp, Artificial
  CRISPR gRNA sequence
ttatgaacatattatttaaa

SEQ ID NO: 387330 - DNA, 20 bp, Artificial
  CRISPR gRNA sequence
tatgaacatattatttaaag

SEQ ID NO: 387331 - DNA, 20 bp, Artificial
  CRISPR gRNA sequence
atgaacatattatttaaaga

SEQ ID NO: 387332 - DNA, 20 bp, Artificial
  CRISPR gRNA sequence
tgaacatattatttaaagag

SEQ ID NO: 387333 - DNA, 20 bp, Artificial
  CRISPR gRNA sequence
tttaaagagactatatagat

SEQ ID NO: 387334 - DNA, 20 bp, Artificial
  CRISPR gRNA sequence
aaagagactatatagatgct

SEQ ID NO: 387335 - DNA, 20 bp, Artificial
  CRISPR gRNA sequence
aagagactatatagatgctt

SEQ ID NO: 387336 - DNA, 20 bp, Artificial
  CRISPR gRNA sequence
tatagatgcttcaaaagtca

SEQ ID NO: 387337 - DNA, 20 bp, Artificial
  CRISPR gRNA sequence
caaaagtcagaatgtcaaga

SEQ ID NO: 387338 - DNA, 20 bp, Artificial
  CRISPR gRNA sequence
aaaagtcagaatgtcaagag

SEQ ID NO: 387339 - DNA, 20 bp, Artificial
  CRISPR gRNA sequence
cacatacctttctcactgtc

SEQ ID NO: 387340 - DNA, 20 bp, Artificial
  CRISPR gRNA sequence
tctcactgtcttagtgaatt

SEQ ID NO: 387341 - DNA, 20 bp, Artificial
  CRISPR gRNA sequence
ctcactgtcttagtgaatta

SEQ ID NO: 387342 - DNA, 20 bp, Artificial
  CRISPR gRNA sequence
tcactgtcttagtgaattag

SEQ ID NO: 387343 - DNA, 20 bp, Artificial
  CRISPR gRNA sequence
actgtcttagtgaattagtg

SEQ ID NO: 387344 - DNA, 20 bp, Artificial
  CRISPR gRNA sequence
tcttagtgaattagtgtgca

SEQ ID NO: 387345 - DNA, 20 bp, Artificial
  CRISPR gRNA sequence
agtgaattagtgtgcagaaa

SEQ ID NO: 387346 - DNA, 20 bp, Artificial
  CRISPR gRNA sequence
gtgaattagtgtgcagaaaa

SEQ ID NO: 387347 - DNA, 20 bp, Artificial
  CRISPR gRNA sequence
gtgtgcagaaaagagttcat

SEQ ID NO: 387348 - DNA, 20 bp, Artificial
  CRISPR gRNA sequence
atgtagcaggcttggattct

SEQ ID NO: 387349 - DNA, 20 bp, Artificial
  CRISPR gRNA sequence
ggattctgggtgatcctcct

SEQ ID NO: 387350 - DNA, 20 bp, Artificial
  CRISPR gRNA sequence
gattctgggtgatcctcctg

SEQ ID NO: 387351 - DNA, 20 bp, Artificial
  CRISPR gRNA sequence
tgggtgatcctcctgcctca

SEQ ID NO: 387352 - DNA, 20 bp, Artificial
  CRISPR gRNA sequence
ggtgatcctcctgcctcagc

SEQ ID NO: 387353 - DNA, 20 bp, Artificial
  CRISPR gRNA sequence
ctgcctcagcctcccaagta

SEQ ID NO: 387354 - DNA, 20 bp, Artificial
  CRISPR gRNA sequence
cctcagcctcccaagtagct

SEQ ID NO: 387355 - DNA, 20 bp, Artificial
  CRISPR gRNA sequence
agcctcccaagtagctggga

SEQ ID NO: 387356 - DNA, 20 bp, Artificial
  CRISPR gRNA sequence
ccaagtagctgggaccacag

SEQ ID NO: 387357 - DNA, 20 bp, Artificial
  CRISPR gRNA sequence
ggaccacaggcacatgccac

SEQ ID NO: 387358 - DNA, 20 bp, Artificial
  CRISPR gRNA sequence
acatttttttaaattgtttg

SEQ ID NO: 387359 - DNA, 20 bp, Artificial
  CRISPR gRNA sequence
ttttaaattgtttgtagaga

SEQ ID NO: 387360 - DNA, 20 bp, Artificial
  CRISPR gRNA sequence
tttaaattgtttgtagagac

SEQ ID NO: 387361 - DNA, 20 bp, Artificial
  CRISPR gRNA sequence
ttaaattgtttgtagagaca

SEQ ID NO: 387362 - DNA, 20 bp, Artificial
  CRISPR gRNA sequence
taaattgtttgtagagacaa

SEQ ID NO: 387363 - DNA, 20 bp, Artificial
  CRISPR gRNA sequence
aaattgtttgtagagacaag

SEQ ID NO: 387364 - DNA, 20 bp, Artificial
  CRISPR gRNA sequence
aattgtttgtagagacaaga

SEQ ID NO: 387365 - DNA, 20 bp, Artificial
  CRISPR gRNA sequence
tttgtagagacaagatctcg

SEQ ID NO: 387366 - DNA, 20 bp, Artificial
  CRISPR gRNA sequence
gtagagacaagatctcgcta

SEQ ID NO: 387367 - DNA, 20 bp, Artificial
  CRISPR gRNA sequence
tagagacaagatctcgctat

SEQ ID NO: 387368 - DNA, 20 bp, Artificial
  CRISPR gRNA sequence
gctatgttgctcaggctggg

SEQ ID NO: 387369 - DNA, 20 bp, Artificial
  CRISPR gRNA sequence
tgttgctcaggctggggttg

SEQ ID NO: 387370 - DNA, 20 bp, Artificial
  CRISPR gRNA sequence
ctcaggctggggttgaactc

SEQ ID NO: 387371 - DNA, 20 bp, Artificial
  CRISPR gRNA sequence
aggctggggttgaactctag

SEQ ID NO: 387372 - DNA, 20 bp, Artificial
  CRISPR gRNA sequence
gggttgaactctagacctca

SEQ ID NO: 387373 - DNA, 20 bp, Artificial
  CRISPR gRNA sequence
aactctagacctcaagcagt

SEQ ID NO: 387374 - DNA, 20 bp, Artificial
  CRISPR gRNA sequence
tagacctcaagcagtcctac

SEQ ID NO: 387375 - DNA, 20 bp, Artificial
  CRISPR gRNA sequence
gacctcaagcagtcctactg

SEQ ID NO: 387376 - DNA, 20 bp, Artificial
  CRISPR gRNA sequence
aagcagtcctactgaaatgg

SEQ ID NO: 387377 - DNA, 20 bp, Artificial
  CRISPR gRNA sequence
ctgaaatggcctcccaaagc

SEQ ID NO: 387378 - DNA, 20 bp, Artificial
  CRISPR gRNA sequence
aaatggcctcccaaagcatt

SEQ ID NO: 387379 - DNA, 20 bp, Artificial
  CRISPR gRNA sequence
ccaaagcattgggattacag

SEQ ID NO: 387380 - DNA, 20 bp, Artificial
  CRISPR gRNA sequence
ggattacaggcaggagccac

SEQ ID NO: 387381 - DNA, 20 bp, Artificial
  CRISPR gRNA sequence
caggcaggagccaccacgcc

SEQ ID NO: 387382 - DNA, 20 bp, Artificial
  CRISPR gRNA sequence
gctccaagggattattatgg

SEQ ID NO: 387383 - DNA, 20 bp, Artificial
  CRISPR gRNA sequence
caagggattattatggacac

SEQ ID NO: 387384 - DNA, 20 bp, Artificial
  CRISPR gRNA sequence
ttatggacacttgactctga

SEQ ID NO: 387385 - DNA, 20 bp, Artificial
  CRISPR gRNA sequence
tggacacttgactctgagtc

SEQ ID NO: 387386 - DNA, 20 bp, Artificial
  CRISPR gRNA sequence
gactctgagtcaaagcctag

SEQ ID NO: 387387 - DNA, 20 bp, Artificial
  CRISPR gRNA sequence
actctgagtcaaagcctagc

SEQ ID NO: 387388 - DNA, 20 bp, Artificial
  CRISPR gRNA sequence
tgagtcaaagcctagccaag

SEQ ID NO: 387389 - DNA, 20 bp, Artificial
  CRISPR gRNA sequence
agtcaaagcctagccaagac

SEQ ID NO: 387390 - DNA, 20 bp, Artificial
  CRISPR gRNA sequence
gccaagactgtttctgttta

SEQ ID NO: 387391 - DNA, 20 bp, Artificial
  CRISPR gRNA sequence
tttctgtttagctttatttc

SEQ ID NO: 387392 - DNA, 20 bp, Artificial
  CRISPR gRNA sequence
ctgtttagctttatttctag

SEQ ID NO: 387393 - DNA, 20 bp, Artificial
  CRISPR gRNA sequence
tgtttagctttatttctagt

SEQ ID NO: 387394 - DNA, 20 bp, Artificial
  CRISPR gRNA sequence
tttagctttatttctagtgc

SEQ ID NO: 387395 - DNA, 20 bp, Artificial
  CRISPR gRNA sequence
agctttatttctagtgcttt

SEQ ID NO: 387396 - DNA, 20 bp, Artificial
  CRISPR gRNA sequence
gctttatttctagtgctttt

SEQ ID NO: 387397 - DNA, 20 bp, Artificial
  CRISPR gRNA sequence
tatttctagtgcttttgtgt

SEQ ID NO: 387398 - DNA, 20 bp, Artificial
  CRISPR gRNA sequence
atttctagtgcttttgtgtt

SEQ ID NO: 387399 - DNA, 20 bp, Artificial
  CRISPR gRNA sequence
tttctagtgcttttgtgttc

SEQ ID NO: 387400 - DNA, 20 bp, Artificial
  CRISPR gRNA sequence
ctagtgcttttgtgttcatg

SEQ ID NO: 387401 - DNA, 20 bp, Artificial
  CRISPR gRNA sequence
tagtgcttttgtgttcatgt

SEQ ID NO: 387402 - DNA, 20 bp, Artificial
  CRISPR gRNA sequence
gtgcttttgtgttcatgtct

SEQ ID NO: 387403 - DNA, 20 bp, Artificial
  CRISPR gRNA sequence
ttgtgttcatgtctgtagac

SEQ ID NO: 387404 - DNA, 20 bp, Artificial
  CRISPR gRNA sequence
tgtgttcatgtctgtagaca

SEQ ID NO: 387405 - DNA, 20 bp, Artificial
  CRISPR gRNA sequence
gtgttcatgtctgtagacat

SEQ ID NO: 387406 - DNA, 20 bp, Artificial
  CRISPR gRNA sequence
tgttcatgtctgtagacatg

SEQ ID NO: 387407 - DNA, 20 bp, Artificial
  CRISPR gRNA sequence
atgtctgtagacatgtcttg

SEQ ID NO: 387408 - DNA, 20 bp, Artificial
  CRISPR gRNA sequence
tagacatgtcttgattgaaa

SEQ ID NO: 387409 - DNA, 20 bp, Artificial
  CRISPR gRNA sequence
gattgaaatcaggaattaga

SEQ ID NO: 387410 - DNA, 20 bp, Artificial
  CRISPR gRNA sequence
attgaaatcaggaattagaa

SEQ ID NO: 387411 - DNA, 20 bp, Artificial
  CRISPR gRNA sequence
aaatcaggaattagaaatta

SEQ ID NO: 387412 - DNA, 20 bp, Artificial
  CRISPR gRNA sequence
gaaattaaatgccaagtcca

SEQ ID NO: 387413 - DNA, 20 bp, Artificial
  CRISPR gRNA sequence
aatgccaagtccataaaaaa

SEQ ID NO: 387414 - DNA, 20 bp, Artificial
  CRISPR gRNA sequence
tctgcttggataagcatagc

SEQ ID NO: 387415 - DNA, 20 bp, Artificial
  CRISPR gRNA sequence
tgcttggataagcatagcag

SEQ ID NO: 387416 - DNA, 20 bp, Artificial
  CRISPR gRNA sequence
cttggataagcatagcagtg

SEQ ID NO: 387417 - DNA, 20 bp, Artificial
  CRISPR gRNA sequence
ggataagcatagcagtgaga

SEQ ID NO: 387418 - DNA, 20 bp, Artificial
  CRISPR gRNA sequence
gataagcatagcagtgagac

SEQ ID NO: 387419 - DNA, 20 bp, Artificial
  CRISPR gRNA sequence
tcatagatactgtcaccttt

SEQ ID NO: 387420 - DNA, 20 bp, Artificial
  CRISPR gRNA sequence
tcacctttgactcataaagt

SEQ ID NO: 387421 - DNA, 20 bp, Artificial
  CRISPR gRNA sequence
tgactcataaagtgtctctt

SEQ ID NO: 387422 - DNA, 20 bp, Artificial
  CRISPR gRNA sequence
gactcataaagtgtctcttg

SEQ ID NO: 387423 - DNA, 20 bp, Artificial
  CRISPR gRNA sequence
actcataaagtgtctcttgg

SEQ ID NO: 387424 - DNA, 20 bp, Artificial
  CRISPR gRNA sequence
ataaagtgtctcttgggaat

SEQ ID NO: 387425 - DNA, 20 bp, Artificial
  CRISPR gRNA sequence
ttgggaatctggcttcctgt

SEQ ID NO: 387426 - DNA, 20 bp, Artificial
  CRISPR gRNA sequence
gggaatctggcttcctgtca

SEQ ID NO: 387427 - DNA, 20 bp, Artificial
  CRISPR gRNA sequence
ggaatctggcttcctgtcat

SEQ ID NO: 387428 - DNA, 20 bp, Artificial
  CRISPR gRNA sequence
gcttcctgtcataacagaag

SEQ ID NO: 387429 - DNA, 20 bp, Artificial
  CRISPR gRNA sequence
cctgtcataacagaagttat

SEQ ID NO: 387430 - DNA, 20 bp, Artificial
  CRISPR gRNA sequence
ctgtcataacagaagttatt

SEQ ID NO: 387431 - DNA, 20 bp, Artificial
  CRISPR gRNA sequence
tcataacagaagttattttt

SEQ ID NO: 387432 - DNA, 20 bp, Artificial
  CRISPR gRNA sequence
ttttttaactttaactttaa

SEQ ID NO: 387433 - DNA, 20 bp, Artificial
  CRISPR gRNA sequence
tttaactttaactttaaaac

SEQ ID NO: 387434 - DNA, 20 bp, Artificial
  CRISPR gRNA sequence
ttaactttaactttaaaacc

SEQ ID NO: 387435 - DNA, 20 bp, Artificial
  CRISPR gRNA sequence
taactttaactttaaaaccg

SEQ ID NO: 387436 - DNA, 20 bp, Artificial
  CRISPR gRNA sequence
aactttaactttaaaaccgt

SEQ ID NO: 387437 - DNA, 20 bp, Artificial
  CRISPR gRNA sequence
actttaactttaaaaccgtt

SEQ ID NO: 387438 - DNA, 20 bp, Artificial
  CRISPR gRNA sequence
taactttaaaaccgttgttt

SEQ ID NO: 387439 - DNA, 20 bp, Artificial
  CRISPR gRNA sequence
aactttaaaaccgttgtttt

SEQ ID NO: 387440 - DNA, 20 bp, Artificial
  CRISPR gRNA sequence
actttaaaaccgttgttttt

SEQ ID NO: 387441 - DNA, 20 bp, Artificial
  CRISPR gRNA sequence
taaaaccgttgttttttata

SEQ ID NO: 387442 - DNA, 20 bp, Artificial
  CRISPR gRNA sequence
aaaaccgttgttttttataa

SEQ ID NO: 387443 - DNA, 20 bp, Artificial
  CRISPR gRNA sequence
aaaccgttgttttttataac

SEQ ID NO: 387444 - DNA, 20 bp, Artificial
  CRISPR gRNA sequence
ttttttataacaataaaaaa

SEQ ID NO: 387445 - DNA, 20 bp, Artificial
  CRISPR gRNA sequence
tttataacaataaaaaaaac

SEQ ID NO: 387446 - DNA, 20 bp, Artificial
  CRISPR gRNA sequence
ttataacaataaaaaaaacc

SEQ ID NO: 387447 - DNA, 20 bp, Artificial
  CRISPR gRNA sequence
tataacaataaaaaaaacct

SEQ ID NO: 387448 - DNA, 20 bp, Artificial
  CRISPR gRNA sequence
ataacaataaaaaaaaccta

SEQ ID NO: 387449 - DNA, 20 bp, Artificial
  CRISPR gRNA sequence
taacaataaaaaaaacctag

SEQ ID NO: 387450 - DNA, 20 bp, Artificial
  CRISPR gRNA sequence
gaaaaatggcaaaaaataga

SEQ ID NO: 387451 - DNA, 20 bp, Artificial
  CRISPR gRNA sequence
tggaatattgaggaaaacaa

SEQ ID NO: 387452 - DNA, 20 bp, Artificial
  CRISPR gRNA sequence
aggaaaacaaacgaggtagg

SEQ ID NO: 387453 - DNA, 20 bp, Artificial
  CRISPR gRNA sequence
tgtagtgagcgaggggacca

SEQ ID NO: 387454 - DNA, 20 bp, Artificial
  CRISPR gRNA sequence
gtagtgagcgaggggaccaa

SEQ ID NO: 387455 - DNA, 20 bp, Artificial
  CRISPR gRNA sequence
tagtgagcgaggggaccaaa

SEQ ID NO: 387456 - DNA, 20 bp, Artificial
  CRISPR gRNA sequence
aaacaaacaaacatacaaga

SEQ ID NO: 387457 - DNA, 20 bp, Artificial
  CRISPR gRNA sequence
aaagcggggattaaccatct

SEQ ID NO: 387458 - DNA, 20 bp, Artificial
  CRISPR gRNA sequence
aagcggggattaaccatctt

SEQ ID NO: 387459 - DNA, 20 bp, Artificial
  CRISPR gRNA sequence
accatcttgcttctcattat

SEQ ID NO: 387460 - DNA, 20 bp, Artificial
  CRISPR gRNA sequence
gcttctcattatatcccacc

SEQ ID NO: 387461 - DNA, 20 bp, Artificial
  CRISPR gRNA sequence
cttctcattatatcccacca

SEQ ID NO: 387462 - DNA, 20 bp, Artificial
  CRISPR gRNA sequence
ctcattatatcccaccacat

SEQ ID NO: 387463 - DNA, 20 bp, Artificial
  CRISPR gRNA sequence
tcattatatcccaccacata

SEQ ID NO: 387464 - DNA, 20 bp, Artificial
  CRISPR gRNA sequence
attatatcccaccacataga

SEQ ID NO: 387465 - DNA, 20 bp, Artificial
  CRISPR gRNA sequence
tatcccaccacatagagcaa

SEQ ID NO: 387466 - DNA, 20 bp, Artificial
  CRISPR gRNA sequence
ggtgctcagaggacaccagg

SEQ ID NO: 387467 - DNA, 20 bp, Artificial
  CRISPR gRNA sequence
gtgctcagaggacaccagga

SEQ ID NO: 387468 - DNA, 20 bp, Artificial
  CRISPR gRNA sequence
agaggacaccaggacagcca

SEQ ID NO: 387469 - DNA, 20 bp, Artificial
  CRISPR gRNA sequence
tatctattgtcctctgttta

SEQ ID NO: 387470 - DNA, 20 bp, Artificial
  CRISPR gRNA sequence
ttgtcctctgtttagtaagg

SEQ ID NO: 387471 - DNA, 20 bp, Artificial
  CRISPR gRNA sequence
tcctctgtttagtaaggcaa

SEQ ID NO: 387472 - DNA, 20 bp, Artificial
  CRISPR gRNA sequence
tgtttagtaaggcaaagaaa

SEQ ID NO: 387473 - DNA, 20 bp, Artificial
  CRISPR gRNA sequence
tttagtaaggcaaagaaaca

SEQ ID NO: 387474 - DNA, 20 bp, Artificial
  CRISPR gRNA sequence
agtaaggcaaagaaacatgc

SEQ ID NO: 387475 - DNA, 20 bp, Artificial
  CRISPR gRNA sequence
gtaaggcaaagaaacatgct

SEQ ID NO: 387476 - DNA, 20 bp, Artificial
  CRISPR gRNA sequence
tccagcttcgaattctttcc

SEQ ID NO: 387477 - DNA, 20 bp, Artificial
  CRISPR gRNA sequence
cgaattctttccatctaaaa

SEQ ID NO: 387478 - DNA, 20 bp, Artificial
  CRISPR gRNA sequence
gaattctttccatctaaaaa

SEQ ID NO: 387479 - DNA, 20 bp, Artificial
  CRISPR gRNA sequence
tttccatctaaaaatgataa

SEQ ID NO: 387480 - DNA, 20 bp, Artificial
  CRISPR gRNA sequence
tccatctaaaaatgataatt

SEQ ID NO: 387481 - DNA, 20 bp, Artificial
  CRISPR gRNA sequence
ccatctaaaaatgataattt

SEQ ID NO: 387482 - DNA, 20 bp, Artificial
  CRISPR gRNA sequence
catctaaaaatgataattta

SEQ ID NO: 387483 - DNA, 20 bp, Artificial
  CRISPR gRNA sequence
aaaatgataatttaaaaact

SEQ ID NO: 387484 - DNA, 20 bp, Artificial
  CRISPR gRNA sequence
aaaaacttggtacataaaag

SEQ ID NO: 387485 - DNA, 20 bp, Artificial
  CRISPR gRNA sequence
aaaacttggtacataaaagg

SEQ ID NO: 387486 - DNA, 20 bp, Artificial
  CRISPR gRNA sequence
ggtacataaaaggaataagc

SEQ ID NO: 387487 - DNA, 20 bp, Artificial
  CRISPR gRNA sequence
gtacataaaaggaataagct

SEQ ID NO: 387488 - DNA, 20 bp, Artificial
  CRISPR gRNA sequence
tactaaacttagaagatgta

SEQ ID NO: 387489 - DNA, 20 bp, Artificial
  CRISPR gRNA sequence
actaaacttagaagatgtat

SEQ ID NO: 387490 - DNA, 20 bp, Artificial
  CRISPR gRNA sequence
ctaaacttagaagatgtatg

SEQ ID NO: 387491 - DNA, 20 bp, Artificial
  CRISPR gRNA sequence
aacttagaagatgtatgtat

SEQ ID NO: 387492 - DNA, 20 bp, Artificial
  CRISPR gRNA sequence
agaagatgtatgtatataag

SEQ ID NO: 387493 - DNA, 20 bp, Artificial
  CRISPR gRNA sequence
gaagatgtatgtatataaga

SEQ ID NO: 387494 - DNA, 20 bp, Artificial
  CRISPR gRNA sequence
cttattgcctacagaaataa

SEQ ID NO: 387495 - DNA, 20 bp, Artificial
  CRISPR gRNA sequence
attgcctacagaaataaggc

SEQ ID NO: 387496 - DNA, 20 bp, Artificial
  CRISPR gRNA sequence
ttgcctacagaaataaggcc

SEQ ID NO: 387497 - DNA, 20 bp, Artificial
  CRISPR gRNA sequence
cctacagaaataaggcctat

SEQ ID NO: 387498 - DNA, 20 bp, Artificial
  CRISPR gRNA sequence
cagaaataaggcctattgta

SEQ ID NO: 387499 - DNA, 20 bp, Artificial
  CRISPR gRNA sequence
ttgtatatgcaaactgtgtt

SEQ ID NO: 387500 - DNA, 20 bp, Artificial
  CRISPR gRNA sequence
tatatgcaaactgtgtttca

SEQ ID NO: 387501 - DNA, 20 bp, Artificial
  CRISPR gRNA sequence
tgtttcaaataaaactagta

SEQ ID NO: 387502 - DNA, 20 bp, Artificial
  CRISPR gRNA sequence
caaataaaactagtatgaga

SEQ ID NO: 387503 - DNA, 20 bp, Artificial
  CRISPR gRNA sequence
aaataaaactagtatgagaa

SEQ ID NO: 387504 - DNA, 20 bp, Artificial
  CRISPR gRNA sequence
gtatgagaatgtatatgttc

SEQ ID NO: 387505 - DNA, 20 bp, Artificial
  CRISPR gRNA sequence
ttataacaatagaaatatca

SEQ ID NO: 387506 - DNA, 20 bp, Artificial
  CRISPR gRNA sequence
ataacaatagaaatatcatc

SEQ ID NO: 387507 - DNA, 20 bp, Artificial
  CRISPR gRNA sequence
taacaatagaaatatcatct

SEQ ID NO: 387508 - DNA, 20 bp, Artificial
  CRISPR gRNA sequence
aaaatgagccatcagtatta

SEQ ID NO: 387509 - DNA, 20 bp, Artificial
  CRISPR gRNA sequence
aaatgagccatcagtattaa

SEQ ID NO: 387510 - DNA, 20 bp, Artificial
  CRISPR gRNA sequence
aaaggcaaccaacacactat

SEQ ID NO: 387511 - DNA, 20 bp, Artificial
  CRISPR gRNA sequence
tttcacggttgtgttcaggg

SEQ ID NO: 387512 - DNA, 20 bp, Artificial
  CRISPR gRNA sequence
cacggttgtgttcagggtgc

SEQ ID NO: 387513 - DNA, 20 bp, Artificial
  CRISPR gRNA sequence
acggttgtgttcagggtgcc

SEQ ID NO: 387514 - DNA, 20 bp, Artificial
  CRISPR gRNA sequence
tgttcagggtgccccctccc

SEQ ID NO: 387515 - DNA, 20 bp, Artificial
  CRISPR gRNA sequence
agggtgccccctccccagga

SEQ ID NO: 387516 - DNA, 20 bp, Artificial
  CRISPR gRNA sequence
cccaggatctgggatttgct

SEQ ID NO: 387517 - DNA, 20 bp, Artificial
  CRISPR gRNA sequence
ggatttgctggaaggacaca

SEQ ID NO: 387518 - DNA, 20 bp, Artificial
  CRISPR gRNA sequence
gctggaaggacacacagctt

SEQ ID NO: 387519 - DNA, 20 bp, Artificial
  CRISPR gRNA sequence
ctggaaggacacacagcttt

SEQ ID NO: 387520 - DNA, 20 bp, Artificial
  CRISPR gRNA sequence
gaaggacacacagctttcag

SEQ ID NO: 387521 - DNA, 20 bp, Artificial
  CRISPR gRNA sequence
tcagcctgtacccacgtcac

SEQ ID NO: 387522 - DNA, 20 bp, Artificial
  CRISPR gRNA sequence
cagcctgtacccacgtcaca

SEQ ID NO: 387523 - DNA, 20 bp, Artificial
  CRISPR gRNA sequence
agcctgtacccacgtcacag

SEQ ID NO: 387524 - DNA, 20 bp, Artificial
  CRISPR gRNA sequence
tacccacgtcacagctcagg

SEQ ID NO: 387525 - DNA, 20 bp, Artificial
  CRISPR gRNA sequence
aggtttatgacagcagaagg

SEQ ID NO: 387526 - DNA, 20 bp, Artificial
  CRISPR gRNA sequence
atgacagcagaaggatccaa

SEQ ID NO: 387527 - DNA, 20 bp, Artificial
  CRISPR gRNA sequence
tgacagcagaaggatccaaa

SEQ ID NO: 387528 - DNA, 20 bp, Artificial
  CRISPR gRNA sequence
cctgggcaaagtcagaagga

SEQ ID NO: 387529 - DNA, 20 bp, Artificial
  CRISPR gRNA sequence
ggcaaagtcagaaggactgg

SEQ ID NO: 387530 - DNA, 20 bp, Artificial
  CRISPR gRNA sequence
gctgatgtccctgaagaaaa

SEQ ID NO: 387531 - DNA, 20 bp, Artificial
  CRISPR gRNA sequence
atgtccctgaagaaaagcag

SEQ ID NO: 387532 - DNA, 20 bp, Artificial
  CRISPR gRNA sequence
aagaaaagcaggtgtttagc

SEQ ID NO: 387533 - DNA, 20 bp, Artificial
  CRISPR gRNA sequence
agcataaaccacatgggttg

SEQ ID NO: 387534 - DNA, 20 bp, Artificial
  CRISPR gRNA sequence
gcataaaccacatgggttgt

SEQ ID NO: 387535 - DNA, 20 bp, Artificial
  CRISPR gRNA sequence
tataaacatttagacagaat

SEQ ID NO: 387536 - DNA, 20 bp, Artificial
  CRISPR gRNA sequence
agacagaataagccacccca

SEQ ID NO: 387537 - DNA, 20 bp, Artificial
  CRISPR gRNA sequence
gacagaataagccaccccag

SEQ ID NO: 387538 - DNA, 20 bp, Artificial
  CRISPR gRNA sequence
ttgaaagcctccaaaaatcc

SEQ ID NO: 387539 - DNA, 20 bp, Artificial
  CRISPR gRNA sequence
aaagcctccaaaaatccaag

SEQ ID NO: 387540 - DNA, 20 bp, Artificial
  CRISPR gRNA sequence
caaaaatccaagttctcaca

SEQ ID NO: 387541 - DNA, 20 bp, Artificial
  CRISPR gRNA sequence
tcacatgcccacagagagcc

SEQ ID NO: 387542 - DNA, 20 bp, Artificial
  CRISPR gRNA sequence
acatgcccacagagagccaa

SEQ ID NO: 387543 - DNA, 20 bp, Artificial
  CRISPR gRNA sequence
gcaggcaggccgtcctaagg

SEQ ID NO: 387544 - DNA, 20 bp, Artificial
  CRISPR gRNA sequence
caggcaggccgtcctaagga

SEQ ID NO: 387545 - DNA, 20 bp, Artificial
  CRISPR gRNA sequence
aggactgtagtcccaggcct

SEQ ID NO: 387546 - DNA, 20 bp, Artificial
  CRISPR gRNA sequence
tagtcccaggcctggatgac

SEQ ID NO: 387547 - DNA, 20 bp, Artificial
  CRISPR gRNA sequence
gatgacagagcaagaccctg

SEQ ID NO: 387548 - DNA, 20 bp, Artificial
  CRISPR gRNA sequence
tctctaaaacaaaacaatac

SEQ ID NO: 387549 - DNA, 20 bp, Artificial
  CRISPR gRNA sequence
taaaacaaaacaatacaaat

SEQ ID NO: 387550 - DNA, 20 bp, Artificial
  CRISPR gRNA sequence
aaacaaaacaatacaaatga

SEQ ID NO: 387551 - DNA, 20 bp, Artificial
  CRISPR gRNA sequence
gtggaatatcaccctgattc

SEQ ID NO: 387552 - DNA, 20 bp, Artificial
  CRISPR gRNA sequence
tggaatatcaccctgattcc

SEQ ID NO: 387553 - DNA, 20 bp, Artificial
  CRISPR gRNA sequence
attcctaggcctgggaacaa

SEQ ID NO: 387554 - DNA, 20 bp, Artificial
  CRISPR gRNA sequence
ctaggcctgggaacaagtcc

SEQ ID NO: 387555 - DNA, 20 bp, Artificial
  CRISPR gRNA sequence
ggcctgggaacaagtcccag

SEQ ID NO: 387556 - DNA, 20 bp, Artificial
  CRISPR gRNA sequence
ggaacaagtcccaggaatcc

SEQ ID NO: 387557 - DNA, 20 bp, Artificial
  CRISPR gRNA sequence
tcagcaagcataccagatga

SEQ ID NO: 387558 - DNA, 20 bp, Artificial
  CRISPR gRNA sequence
cagcaagcataccagatgat

SEQ ID NO: 387559 - DNA, 20 bp, Artificial
  CRISPR gRNA sequence
agcaagcataccagatgatc

SEQ ID NO: 387560 - DNA, 20 bp, Artificial
  CRISPR gRNA sequence
atgttggtgttccacagaat

SEQ ID NO: 387561 - DNA, 20 bp, Artificial
  CRISPR gRNA sequence
gtgttccacagaatggcatt

SEQ ID NO: 387562 - DNA, 20 bp, Artificial
  CRISPR gRNA sequence
cacagaatggcattgagaaa

SEQ ID NO: 387563 - DNA, 20 bp, Artificial
  CRISPR gRNA sequence
agaaacactgctctactcta

SEQ ID NO: 387564 - DNA, 20 bp, Artificial
  CRISPR gRNA sequence
ctctactctagaaagcacct

SEQ ID NO: 387565 - DNA, 20 bp, Artificial
  CRISPR gRNA sequence
tactctagaaagcaccttcc

SEQ ID NO: 387566 - DNA, 20 bp, Artificial
  CRISPR gRNA sequence
ctctagaaagcaccttccag

SEQ ID NO: 387567 - DNA, 20 bp, Artificial
  CRISPR gRNA sequence
tagaaagcaccttccagggg

SEQ ID NO: 387568 - DNA, 20 bp, Artificial
  CRISPR gRNA sequence
gaaagcaccttccaggggag

SEQ ID NO: 387569 - DNA, 20 bp, Artificial
  CRISPR gRNA sequence
ccaggggagctccagctgct

SEQ ID NO: 387570 - DNA, 20 bp, Artificial
  CRISPR gRNA sequence
caggggagctccagctgctg

SEQ ID NO: 387571 - DNA, 20 bp, Artificial
  CRISPR gRNA sequence
cagctgctgagccccagtct

SEQ ID NO: 387572 - DNA, 20 bp, Artificial
  CRISPR gRNA sequence
ctgagccccagtctgccagt

SEQ ID NO: 387573 - DNA, 20 bp, Artificial
  CRISPR gRNA sequence
agccccagtctgccagtgga

SEQ ID NO: 387574 - DNA, 20 bp, Artificial
  CRISPR gRNA sequence
ccagtggatttctcctccct

SEQ ID NO: 387575 - DNA, 20 bp, Artificial
  CRISPR gRNA sequence
ctcctccctcctttcttagg

SEQ ID NO: 387576 - DNA, 20 bp, Artificial
  CRISPR gRNA sequence
tcctccctcctttcttaggg

SEQ ID NO: 387577 - DNA, 20 bp, Artificial
  CRISPR gRNA sequence
ctccctcctttcttagggta

SEQ ID NO: 387578 - DNA, 20 bp, Artificial
  CRISPR gRNA sequence
cctcctttcttagggtattg

SEQ ID NO: 387579 - DNA, 20 bp, Artificial
  CRISPR gRNA sequence
ctttcttagggtattgactt

SEQ ID NO: 387580 - DNA, 20 bp, Artificial
  CRISPR gRNA sequence
tcttagggtattgactttag

SEQ ID NO: 387581 - DNA, 20 bp, Artificial
  CRISPR gRNA sequence
cttagggtattgactttaga

SEQ ID NO: 387582 - DNA, 20 bp, Artificial
  CRISPR gRNA sequence
ttagggtattgactttagaa

SEQ ID NO: 387583 - DNA, 20 bp, Artificial
  CRISPR gRNA sequence
agggtattgactttagaaaa

SEQ ID NO: 387584 - DNA, 20 bp, Artificial
  CRISPR gRNA sequence
gggtattgactttagaaaac

SEQ ID NO: 387585 - DNA, 20 bp, Artificial
  CRISPR gRNA sequence
actttagaaaacttgtaatt

SEQ ID NO: 387586 - DNA, 20 bp, Artificial
  CRISPR gRNA sequence
tagaaaacttgtaattggca

SEQ ID NO: 387587 - DNA, 20 bp, Artificial
  CRISPR gRNA sequence
agaaaacttgtaattggcag

SEQ ID NO: 387588 - DNA, 20 bp, Artificial
  CRISPR gRNA sequence
gaaaacttgtaattggcagt

SEQ ID NO: 387589 - DNA, 20 bp, Artificial
  CRISPR gRNA sequence
gtaattggcagttctgtctc

SEQ ID NO: 387590 - DNA, 20 bp, Artificial
  CRISPR gRNA sequence
taattggcagttctgtctct

SEQ ID NO: 387591 - DNA, 20 bp, Artificial
  CRISPR gRNA sequence
gcagttctgtctctgtctct

SEQ ID NO: 387592 - DNA, 20 bp, Artificial
  CRISPR gRNA sequence
tgtctctgtctctttgaaag

SEQ ID NO: 387593 - DNA, 20 bp, Artificial
  CRISPR gRNA sequence
tctctgtctctttgaaagac

SEQ ID NO: 387594 - DNA, 20 bp, Artificial
  CRISPR gRNA sequence
tgtctctttgaaagacatgc

SEQ ID NO: 387595 - DNA, 20 bp, Artificial
  CRISPR gRNA sequence
tctctttgaaagacatgcac

SEQ ID NO: 387596 - DNA, 20 bp, Artificial
  CRISPR gRNA sequence
tttgaaagacatgcacatct

SEQ ID NO: 387597 - DNA, 20 bp, Artificial
  CRISPR gRNA sequence
tgaaagacatgcacatcttt

SEQ ID NO: 387598 - DNA, 20 bp, Artificial
  CRISPR gRNA sequence
gaaagacatgcacatctttt

SEQ ID NO: 387599 - DNA, 20 bp, Artificial
  CRISPR gRNA sequence
aaagacatgcacatcttttt

SEQ ID NO: 387600 - DNA, 20 bp, Artificial
  CRISPR gRNA sequence
tttaacggccagataagtct

SEQ ID NO: 387601 - DNA, 20 bp, Artificial
  CRISPR gRNA sequence
ttaacggccagataagtctt

SEQ ID NO: 387602 - DNA, 20 bp, Artificial
  CRISPR gRNA sequence
taacggccagataagtcttt

SEQ ID NO: 387603 - DNA, 20 bp, Artificial
  CRISPR gRNA sequence
aacggccagataagtctttt

SEQ ID NO: 387604 - DNA, 20 bp, Artificial
  CRISPR gRNA sequence
acggccagataagtcttttg

SEQ ID NO: 387605 - DNA, 20 bp, Artificial
  CRISPR gRNA sequence
ttgtcagcttttgatggaga

SEQ ID NO: 387606 - DNA, 20 bp, Artificial
  CRISPR gRNA sequence
tgtcagcttttgatggagaa

SEQ ID NO: 387607 - DNA, 20 bp, Artificial
  CRISPR gRNA sequence
gtcagcttttgatggagaaa

SEQ ID NO: 387608 - DNA, 20 bp, Artificial
  CRISPR gRNA sequence
tcagcttttgatggagaaat

SEQ ID NO: 387609 - DNA, 20 bp, Artificial
  CRISPR gRNA sequence
ttgatggagaaatgtctttc

SEQ ID NO: 387610 - DNA, 20 bp, Artificial
  CRISPR gRNA sequence
tgatggagaaatgtctttct

SEQ ID NO: 387611 - DNA, 20 bp, Artificial
  CRISPR gRNA sequence
gatggagaaatgtctttctc

SEQ ID NO: 387612 - DNA, 20 bp, Artificial
  CRISPR gRNA sequence
atggagaaatgtctttctcg

SEQ ID NO: 387613 - DNA, 20 bp, Artificial
  CRISPR gRNA sequence
tctcgaggacctgggagcca

SEQ ID NO: 387614 - DNA, 20 bp, Artificial
  CRISPR gRNA sequence
ctcgaggacctgggagccat

SEQ ID NO: 387615 - DNA, 20 bp, Artificial
  CRISPR gRNA sequence
tcgaggacctgggagccatc

SEQ ID NO: 387616 - DNA, 20 bp, Artificial
  CRISPR gRNA sequence
gaggacctgggagccatccc

SEQ ID NO: 387617 - DNA, 20 bp, Artificial
  CRISPR gRNA sequence
ggagccatccctttgaaatg

SEQ ID NO: 387618 - DNA, 20 bp, Artificial
  CRISPR gRNA sequence
tgaaatgtaaccatcaagga

SEQ ID NO: 387619 - DNA, 20 bp, Artificial
  CRISPR gRNA sequence
gaaatgtaaccatcaaggaa

SEQ ID NO: 387620 - DNA, 20 bp, Artificial
  CRISPR gRNA sequence
aaatgtaaccatcaaggaag

SEQ ID NO: 387621 - DNA, 20 bp, Artificial
  CRISPR gRNA sequence
acctcccaatttctgagagg

SEQ ID NO: 387622 - DNA, 20 bp, Artificial
  CRISPR gRNA sequence
cctcccaatttctgagaggg

SEQ ID NO: 387623 - DNA, 20 bp, Artificial
  CRISPR gRNA sequence
ccaatttctgagagggtaga

SEQ ID NO: 387624 - DNA, 20 bp, Artificial
  CRISPR gRNA sequence
ctgagagggtagaaaactac

SEQ ID NO: 387625 - DNA, 20 bp, Artificial
  CRISPR gRNA sequence
tgagagggtagaaaactacc

SEQ ID NO: 387626 - DNA, 20 bp, Artificial
  CRISPR gRNA sequence
agagggtagaaaactaccac

SEQ ID NO: 387627 - DNA, 20 bp, Artificial
  CRISPR gRNA sequence
ccacaagcacctcactcaag

SEQ ID NO: 387628 - DNA, 20 bp, Artificial
  CRISPR gRNA sequence
actcaaggtgcaaaagtacc

SEQ ID NO: 387629 - DNA, 20 bp, Artificial
  CRISPR gRNA sequence
aaggtgcaaaagtacctcct

SEQ ID NO: 387630 - DNA, 20 bp, Artificial
  CRISPR gRNA sequence
ctgtcataaagatgtgagaa

SEQ ID NO: 387631 - DNA, 20 bp, Artificial
  CRISPR gRNA sequence
tcataaagatgtgagaagtt

SEQ ID NO: 387632 - DNA, 20 bp, Artificial
  CRISPR gRNA sequence
gtttttcctttggataaagc

SEQ ID NO: 387633 - DNA, 20 bp, Artificial
  CRISPR gRNA sequence
tttttcctttggataaagcc

SEQ ID NO: 387634 - DNA, 20 bp, Artificial
  CRISPR gRNA sequence
ttcctttggataaagccaat

SEQ ID NO: 387635 - DNA, 20 bp, Artificial
  CRISPR gRNA sequence
tcctttggataaagccaatt

SEQ ID NO: 387636 - DNA, 20 bp, Artificial
  CRISPR gRNA sequence
cctttggataaagccaatta

SEQ ID NO: 387637 - DNA, 20 bp, Artificial
  CRISPR gRNA sequence
ctttggataaagccaattat

SEQ ID NO: 387638 - DNA, 20 bp, Artificial
  CRISPR gRNA sequence
tggataaagccaattattag

SEQ ID NO: 387639 - DNA, 20 bp, Artificial
  CRISPR gRNA sequence
ggataaagccaattattagc

SEQ ID NO: 387640 - DNA, 20 bp, Artificial
  CRISPR gRNA sequence
gataaagccaattattagct

SEQ ID NO: 387641 - DNA, 20 bp, Artificial
  CRISPR gRNA sequence
ttagctaacacacacagtca

SEQ ID NO: 387642 - DNA, 20 bp, Artificial
  CRISPR gRNA sequence
gctaacacacacagtcatcc

SEQ ID NO: 387643 - DNA, 20 bp, Artificial
  CRISPR gRNA sequence
acacacacagtcatccccaa

SEQ ID NO: 387644 - DNA, 20 bp, Artificial
  CRISPR gRNA sequence
ccagttgaatctaggatgaa

SEQ ID NO: 387645 - DNA, 20 bp, Artificial
  CRISPR gRNA sequence
aatctaggatgaagcatgtg

SEQ ID NO: 387646 - DNA, 20 bp, Artificial
  CRISPR gRNA sequence
ggatgaagcatgtgtgacaa

SEQ ID NO: 387647 - DNA, 20 bp, Artificial
  CRISPR gRNA sequence
acaagccctcttacttgaag

SEQ ID NO: 387648 - DNA, 20 bp, Artificial
  CRISPR gRNA sequence
ttacttgaagactagttatc

SEQ ID NO: 387649 - DNA, 20 bp, Artificial
  CRISPR gRNA sequence
acttgaagactagttatcat

SEQ ID NO: 387650 - DNA, 20 bp, Artificial
  CRISPR gRNA sequence
cttgaagactagttatcatt

SEQ ID NO: 387651 - DNA, 20 bp, Artificial
  CRISPR gRNA sequence
gaagactagttatcattcat

SEQ ID NO: 387652 - DNA, 20 bp, Artificial
  CRISPR gRNA sequence
aagactagttatcattcatc

SEQ ID NO: 387653 - DNA, 20 bp, Artificial
  CRISPR gRNA sequence
gttatcattcatctttagag

SEQ ID NO: 387654 - DNA, 20 bp, Artificial
  CRISPR gRNA sequence
tcattcatctttagagcatg

SEQ ID NO: 387655 - DNA, 20 bp, Artificial
  CRISPR gRNA sequence
atctttagagcatgtatgta

SEQ ID NO: 387656 - DNA, 20 bp, Artificial
  CRISPR gRNA sequence
tagagcatgtatgtaatggg

SEQ ID NO: 387657 - DNA, 20 bp, Artificial
  CRISPR gRNA sequence
agagcatgtatgtaatgggt

SEQ ID NO: 387658 - DNA, 20 bp, Artificial
  CRISPR gRNA sequence
gagcatgtatgtaatgggtt

SEQ ID NO: 387659 - DNA, 20 bp, Artificial
  CRISPR gRNA sequence
tatctacttggctgtatgag

SEQ ID NO: 387660 - DNA, 20 bp, Artificial
  CRISPR gRNA sequence
cttggctgtatgagagagtg

SEQ ID NO: 387661 - DNA, 20 bp, Artificial
  CRISPR gRNA sequence
ggctgtatgagagagtgaga

SEQ ID NO: 387662 - DNA, 20 bp, Artificial
  CRISPR gRNA sequence
gctgtatgagagagtgagat

SEQ ID NO: 387663 - DNA, 20 bp, Artificial
  CRISPR gRNA sequence
tatgagagagtgagatttct

SEQ ID NO: 387664 - DNA, 20 bp, Artificial
  CRISPR gRNA sequence
ctttgtctttgcagtctctt

SEQ ID NO: 387665 - DNA, 20 bp, Artificial
  CRISPR gRNA sequence
tttgtctttgcagtctctta

SEQ ID NO: 387666 - DNA, 20 bp, Artificial
  CRISPR gRNA sequence
tgtctttgcagtctcttagg

SEQ ID NO: 387667 - DNA, 20 bp, Artificial
  CRISPR gRNA sequence
gtctttgcagtctcttagga

SEQ ID NO: 387668 - DNA, 20 bp, Artificial
  CRISPR gRNA sequence
tctttgcagtctcttaggag

SEQ ID NO: 387669 - DNA, 20 bp, Artificial
  CRISPR gRNA sequence
tgcagtctcttaggaggttg

SEQ ID NO: 387670 - DNA, 20 bp, Artificial
  CRISPR gRNA sequence
gcagtctcttaggaggttgc

SEQ ID NO: 387671 - DNA, 20 bp, Artificial
  CRISPR gRNA sequence
cagtctcttaggaggttgcc

SEQ ID NO: 387672 - DNA, 20 bp, Artificial
  CRISPR gRNA sequence
ttaggaggttgcctgtgaca

SEQ ID NO: 387673 - DNA, 20 bp, Artificial
  CRISPR gRNA sequence
aggaggttgcctgtgacatg

SEQ ID NO: 387674 - DNA, 20 bp, Artificial
  CRISPR gRNA sequence
ggaggttgcctgtgacatgc

SEQ ID NO: 387675 - DNA, 20 bp, Artificial
  CRISPR gRNA sequence
cctgtgacatgcattacatt

SEQ ID NO: 387676 - DNA, 20 bp, Artificial
  CRISPR gRNA sequence
tgacatgcattacattctga

SEQ ID NO: 387677 - DNA, 20 bp, Artificial
  CRISPR gRNA sequence
cattctgatttagtgcttat

SEQ ID NO: 387678 - DNA, 20 bp, Artificial
  CRISPR gRNA sequence
tgatttagtgcttattcaat

SEQ ID NO: 387679 - DNA, 20 bp, Artificial
  CRISPR gRNA sequence
atttagtgcttattcaataa

SEQ ID NO: 387680 - DNA, 20 bp, Artificial
  CRISPR gRNA sequence
agtgcttattcaataacaaa

SEQ ID NO: 387681 - DNA, 20 bp, Artificial
  CRISPR gRNA sequence
gtgcttattcaataacaaaa

SEQ ID NO: 387682 - DNA, 20 bp, Artificial
  CRISPR gRNA sequence
attcaataacaaaattattt

SEQ ID NO: 387683 - DNA, 20 bp, Artificial
  CRISPR gRNA sequence
ttcaataacaaaattatttt

SEQ ID NO: 387684 - DNA, 20 bp, Artificial
  CRISPR gRNA sequence
aataacaaaattattttgtt

SEQ ID NO: 387685 - DNA, 20 bp, Artificial
  CRISPR gRNA sequence
ttttgttttctacctttgtg

SEQ ID NO: 387686 - DNA, 20 bp, Artificial
  CRISPR gRNA sequence
tgttttctacctttgtggag

SEQ ID NO: 387687 - DNA, 20 bp, Artificial
  CRISPR gRNA sequence
gttttctacctttgtggagc

SEQ ID NO: 387688 - DNA, 20 bp, Artificial
  CRISPR gRNA sequence
ttttctacctttgtggagca

SEQ ID NO: 387689 - DNA, 20 bp, Artificial
  CRISPR gRNA sequence
tctacctttgtggagcagtt

SEQ ID NO: 387690 - DNA, 20 bp, Artificial
  CRISPR gRNA sequence
ctacctttgtggagcagttt

SEQ ID NO: 387691 - DNA, 20 bp, Artificial
  CRISPR gRNA sequence
tacctttgtggagcagtttt

SEQ ID NO: 387692 - DNA, 20 bp, Artificial
  CRISPR gRNA sequence
cctttgtggagcagttttct

SEQ ID NO: 387693 - DNA, 20 bp, Artificial
  CRISPR gRNA sequence
tgtggagcagttttctgggt

SEQ ID NO: 387694 - DNA, 20 bp, Artificial
  CRISPR gRNA sequence
gtggagcagttttctgggta

SEQ ID NO: 387695 - DNA, 20 bp, Artificial
  CRISPR gRNA sequence
tggagcagttttctgggtag

SEQ ID NO: 387696 - DNA, 20 bp, Artificial
  CRISPR gRNA sequence
tctgggtagggaggagattt

SEQ ID NO: 387697 - DNA, 20 bp, Artificial
  CRISPR gRNA sequence
ctgggtagggaggagatttt

SEQ ID NO: 387698 - DNA, 20 bp, Artificial
  CRISPR gRNA sequence
tgggtagggaggagattttg

SEQ ID NO: 387699 - DNA, 20 bp, Artificial
  CRISPR gRNA sequence
ggtagggaggagattttgtt

SEQ ID NO: 387700 - DNA, 20 bp, Artificial
  CRISPR gRNA sequence
tgtttctaattatatttctc

SEQ ID NO: 387701 - DNA, 20 bp, Artificial
  CRISPR gRNA sequence
gtttctaattatatttctcc

SEQ ID NO: 387702 - DNA, 20 bp, Artificial
  CRISPR gRNA sequence
tttctaattatatttctccg

SEQ ID NO: 387703 - DNA, 20 bp, Artificial
  CRISPR gRNA sequence
ctaattatatttctccggca

SEQ ID NO: 387704 - DNA, 20 bp, Artificial
  CRISPR gRNA sequence
taattatatttctccggcac

SEQ ID NO: 387705 - DNA, 20 bp, Artificial
  CRISPR gRNA sequence
attatatttctccggcacac

SEQ ID NO: 387706 - DNA, 20 bp, Artificial
  CRISPR gRNA sequence
tatttctccggcacactttt

SEQ ID NO: 387707 - DNA, 20 bp, Artificial
  CRISPR gRNA sequence
ctccggcacacttttattat

SEQ ID NO: 387708 - DNA, 20 bp, Artificial
  CRISPR gRNA sequence
tccggcacacttttattatt

SEQ ID NO: 387709 - DNA, 20 bp, Artificial
  CRISPR gRNA sequence
cggcacacttttattattac

SEQ ID NO: 387710 - DNA, 20 bp, Artificial
  CRISPR gRNA sequence
ttattattactgttgtttaa

SEQ ID NO: 387711 - DNA, 20 bp, Artificial
  CRISPR gRNA sequence
tattattactgttgtttaat

SEQ ID NO: 387712 - DNA, 20 bp, Artificial
  CRISPR gRNA sequence
attattactgttgtttaatc

SEQ ID NO: 387713 - DNA, 20 bp, Artificial
  CRISPR gRNA sequence
ttattactgttgtttaatca

SEQ ID NO: 387714 - DNA, 20 bp, Artificial
  CRISPR gRNA sequence
ttactgttgtttaatcaggt

SEQ ID NO: 387715 - DNA, 20 bp, Artificial
  CRISPR gRNA sequence
ctgttgtttaatcaggtata

SEQ ID NO: 387716 - DNA, 20 bp, Artificial
  CRISPR gRNA sequence
ttgtttaatcaggtataact

SEQ ID NO: 387717 - DNA, 20 bp, Artificial
  CRISPR gRNA sequence
tttaatcaggtataactcta

SEQ ID NO: 387718 - DNA, 20 bp, Artificial
  CRISPR gRNA sequence
aatcaggtataactctacat

SEQ ID NO: 387719 - DNA, 20 bp, Artificial
  CRISPR gRNA sequence
atcaggtataactctacatt

SEQ ID NO: 387720 - DNA, 20 bp, Artificial
  CRISPR gRNA sequence
tacattacagtgctaccatt

SEQ ID NO: 387721 - DNA, 20 bp, Artificial
  CRISPR gRNA sequence
cattacagtgctaccattat

SEQ ID NO: 387722 - DNA, 20 bp, Artificial
  CRISPR gRNA sequence
cagtgctaccattatgctta

SEQ ID NO: 387723 - DNA, 20 bp, Artificial
  CRISPR gRNA sequence
ccattatgcttatcctcagg

SEQ ID NO: 387724 - DNA, 20 bp, Artificial
  CRISPR gRNA sequence
tgcttatcctcaggaaatag

SEQ ID NO: 387725 - DNA, 20 bp, Artificial
  CRISPR gRNA sequence
atcctcaggaaataggaaat

SEQ ID NO: 387726 - DNA, 20 bp, Artificial
  CRISPR gRNA sequence
tcctcaggaaataggaaatt

SEQ ID NO: 387727 - DNA, 20 bp, Artificial
  CRISPR gRNA sequence
aggaaataggaaatttttca

SEQ ID NO: 387728 - DNA, 20 bp, Artificial
  CRISPR gRNA sequence
ttcaaatgttgtagtgaaat

SEQ ID NO: 387729 - DNA, 20 bp, Artificial
  CRISPR gRNA sequence
tcaaatgttgtagtgaaatc

SEQ ID NO: 387730 - DNA, 20 bp, Artificial
  CRISPR gRNA sequence
caaatgttgtagtgaaatca

SEQ ID NO: 387731 - DNA, 20 bp, Artificial
  CRISPR gRNA sequence
aaatgttgtagtgaaatcaa

SEQ ID NO: 387732 - DNA, 20 bp, Artificial
  CRISPR gRNA sequence
tagtgaaatcaagataaaca

SEQ ID NO: 387733 - DNA, 20 bp, Artificial
  CRISPR gRNA sequence
gtgtctgcaggttgcaacag

SEQ ID NO: 387734 - DNA, 20 bp, Artificial
  CRISPR gRNA sequence
caggttgcaacaggacacac

SEQ ID NO: 387735 - DNA, 20 bp, Artificial
  CRISPR gRNA sequence
caacaggacacacaataggc

SEQ ID NO: 387736 - DNA, 20 bp, Artificial
  CRISPR gRNA sequence
aaatatattatgtatttagc

SEQ ID NO: 387737 - DNA, 20 bp, Artificial
  CRISPR gRNA sequence
aatatattatgtatttagct

SEQ ID NO: 387738 - DNA, 20 bp, Artificial
  CRISPR gRNA sequence
tgtatttagctgtacaatat

SEQ ID NO: 387739 - DNA, 20 bp, Artificial
  CRISPR gRNA sequence
agctgtacaatataaactac

SEQ ID NO: 387740 - DNA, 20 bp, Artificial
  CRISPR gRNA sequence
gctgtacaatataaactaca

SEQ ID NO: 387741 - DNA, 20 bp, Artificial
  CRISPR gRNA sequence
tacaatataaactacataaa

SEQ ID NO: 387742 - DNA, 20 bp, Artificial
  CRISPR gRNA sequence
cataaacatgagagaacata

SEQ ID NO: 387743 - DNA, 20 bp, Artificial
  CRISPR gRNA sequence
agaatgttttaatatggaaa

SEQ ID NO: 387744 - DNA, 20 bp, Artificial
  CRISPR gRNA sequence
taatatggaaaataaacttt

SEQ ID NO: 387745 - DNA, 20 bp, Artificial
  CRISPR gRNA sequence
aatatggaaaataaactttt

SEQ ID NO: 387746 - DNA, 20 bp, Artificial
  CRISPR gRNA sequence
atatggaaaataaacttttg

SEQ ID NO: 387747 - DNA, 20 bp, Artificial
  CRISPR gRNA sequence
ttgtttttggaagggagatt

SEQ ID NO: 387748 - DNA, 20 bp, Artificial
  CRISPR gRNA sequence
tgtttttggaagggagattt

SEQ ID NO: 387749 - DNA, 20 bp, Artificial
  CRISPR gRNA sequence
gtttttggaagggagatttt

SEQ ID NO: 387750 - DNA, 20 bp, Artificial
  CRISPR gRNA sequence
tttttggaagggagatttta

SEQ ID NO: 387751 - DNA, 20 bp, Artificial
  CRISPR gRNA sequence
ttggaagggagattttagag

SEQ ID NO: 387752 - DNA, 20 bp, Artificial
  CRISPR gRNA sequence
tggaagggagattttagagg

SEQ ID NO: 387753 - DNA, 20 bp, Artificial
  CRISPR gRNA sequence
ggaagggagattttagaggt

SEQ ID NO: 387754 - DNA, 20 bp, Artificial
  CRISPR gRNA sequence
gaagggagattttagaggtg

SEQ ID NO: 387755 - DNA, 20 bp, Artificial
  CRISPR gRNA sequence
tagaggtgaagccctcactg

SEQ ID NO: 387756 - DNA, 20 bp, Artificial
  CRISPR gRNA sequence
agaggtgaagccctcactgt

SEQ ID NO: 387757 - DNA, 20 bp, Artificial
  CRISPR gRNA sequence
gaggtgaagccctcactgtc

SEQ ID NO: 387758 - DNA, 20 bp, Artificial
  CRISPR gRNA sequence
actgtccctaaggaaggagg

SEQ ID NO: 387759 - DNA, 20 bp, Artificial
  CRISPR gRNA sequence
tccctaaggaaggagggact

SEQ ID NO: 387760 - DNA, 20 bp, Artificial
  CRISPR gRNA sequence
aggaaggagggactagtatt

SEQ ID NO: 387761 - DNA, 20 bp, Artificial
  CRISPR gRNA sequence
gtattctgattactccagct

SEQ ID NO: 387762 - DNA, 20 bp, Artificial
  CRISPR gRNA sequence
tgattactccagctctggtt

SEQ ID NO: 387763 - DNA, 20 bp, Artificial
  CRISPR gRNA sequence
attactccagctctggtttc

SEQ ID NO: 387764 - DNA, 20 bp, Artificial
  CRISPR gRNA sequence
ctccagctctggtttcaaga

SEQ ID NO: 387765 - DNA, 20 bp, Artificial
  CRISPR gRNA sequence
cagctctggtttcaagaagc

SEQ ID NO: 387766 - DNA, 20 bp, Artificial
  CRISPR gRNA sequence
tggtttcaagaagccattac

SEQ ID NO: 387767 - DNA, 20 bp, Artificial
  CRISPR gRNA sequence
gtttcaagaagccattacgg

SEQ ID NO: 387768 - DNA, 20 bp, Artificial
  CRISPR gRNA sequence
caagaagccattacggtctg

SEQ ID NO: 387769 - DNA, 20 bp, Artificial
  CRISPR gRNA sequence
aagaagccattacggtctgg

SEQ ID NO: 387770 - DNA, 20 bp, Artificial
  CRISPR gRNA sequence
cggtctgggcacaagagcaa

SEQ ID NO: 387771 - DNA, 20 bp, Artificial
  CRISPR gRNA sequence
ggcacaagagcaagagagca

SEQ ID NO: 387772 - DNA, 20 bp, Artificial
  CRISPR gRNA sequence
gacaggaagagaagaaggga

SEQ ID NO: 387773 - DNA, 20 bp, Artificial
  CRISPR gRNA sequence
acaggaagagaagaagggag

SEQ ID NO: 387774 - DNA, 20 bp, Artificial
  CRISPR gRNA sequence
agaaggaggaaggaagggcg

SEQ ID NO: 387775 - DNA, 20 bp, Artificial
  CRISPR gRNA sequence
gggaacttttagcagattcc

SEQ ID NO: 387776 - DNA, 20 bp, Artificial
  CRISPR gRNA sequence
ggaacttttagcagattcct

SEQ ID NO: 387777 - DNA, 20 bp, Artificial
  CRISPR gRNA sequence
ttagcagattcctggaaagc

SEQ ID NO: 387778 - DNA, 20 bp, Artificial
  CRISPR gRNA sequence
tagcagattcctggaaagct

SEQ ID NO: 387779 - DNA, 20 bp, Artificial
  CRISPR gRNA sequence
agcagattcctggaaagctg

SEQ ID NO: 387780 - DNA, 20 bp, Artificial
  CRISPR gRNA sequence
gcagattcctggaaagctgt

SEQ ID NO: 387781 - DNA, 20 bp, Artificial
  CRISPR gRNA sequence
ctggaaagctgttcaaggga

SEQ ID NO: 387782 - DNA, 20 bp, Artificial
  CRISPR gRNA sequence
gaaagctgttcaagggagtg

SEQ ID NO: 387783 - DNA, 20 bp, Artificial
  CRISPR gRNA sequence
ttcaagggagtggactttcc

SEQ ID NO: 387784 - DNA, 20 bp, Artificial
  CRISPR gRNA sequence
aagggagtggactttcccac

SEQ ID NO: 387785 - DNA, 20 bp, Artificial
  CRISPR gRNA sequence
tcccacacaggaagcgtcca

SEQ ID NO: 387786 - DNA, 20 bp, Artificial
  CRISPR gRNA sequence
cccacacaggaagcgtccag

SEQ ID NO: 387787 - DNA, 20 bp, Artificial
  CRISPR gRNA sequence
ccacacaggaagcgtccagt

SEQ ID NO: 387788 - DNA, 20 bp, Artificial
  CRISPR gRNA sequence
gtgaggccatgagaacaggt

SEQ ID NO: 387789 - DNA, 20 bp, Artificial
  CRISPR gRNA sequence
tgtagtggccagaagctgtg

SEQ ID NO: 387790 - DNA, 20 bp, Artificial
  CRISPR gRNA sequence
gtagtggccagaagctgtgc

SEQ ID NO: 387791 - DNA, 20 bp, Artificial
  CRISPR gRNA sequence
tagtggccagaagctgtgcc

SEQ ID NO: 387792 - DNA, 20 bp, Artificial
  CRISPR gRNA sequence
tgcctatgagacctgagcca

SEQ ID NO: 387793 - DNA, 20 bp, Artificial
  CRISPR gRNA sequence
tgagacctgagccatcacca

SEQ ID NO: 387794 - DNA, 20 bp, Artificial
  CRISPR gRNA sequence
agccatcaccaggtctcctt

SEQ ID NO: 387795 - DNA, 20 bp, Artificial
  CRISPR gRNA sequence
ctttgcgcagaggctactcc

SEQ ID NO: 387796 - DNA, 20 bp, Artificial
  CRISPR gRNA sequence
tgcgcagaggctactcctaa

SEQ ID NO: 387797 - DNA, 20 bp, Artificial
  CRISPR gRNA sequence
gcgcagaggctactcctaaa

SEQ ID NO: 387798 - DNA, 20 bp, Artificial
  CRISPR gRNA sequence
cgcagaggctactcctaaag

SEQ ID NO: 387799 - DNA, 20 bp, Artificial
  CRISPR gRNA sequence
ctcctaaagttcccctaatc

SEQ ID NO: 387800 - DNA, 20 bp, Artificial
  CRISPR gRNA sequence
ctaaagttcccctaatctgt

SEQ ID NO: 387801 - DNA, 20 bp, Artificial
  CRISPR gRNA sequence
aagttcccctaatctgttcc

SEQ ID NO: 387802 - DNA, 20 bp, Artificial
  CRISPR gRNA sequence
ccctaatctgttcctggtgt

SEQ ID NO: 387803 - DNA, 20 bp, Artificial
  CRISPR gRNA sequence
atctgttcctggtgtggatt

SEQ ID NO: 387804 - DNA, 20 bp, Artificial
  CRISPR gRNA sequence
ttcctggtgtggatttgact

SEQ ID NO: 387805 - DNA, 20 bp, Artificial
  CRISPR gRNA sequence
ctggtgtggatttgacttca

SEQ ID NO: 387806 - DNA, 20 bp, Artificial
  CRISPR gRNA sequence
gtgtggatttgacttcacca

SEQ ID NO: 387807 - DNA, 20 bp, Artificial
  CRISPR gRNA sequence
gacttcaccagcaaccagca

SEQ ID NO: 387808 - DNA, 20 bp, Artificial
  CRISPR gRNA sequence
acttcaccagcaaccagcac

SEQ ID NO: 387809 - DNA, 20 bp, Artificial
  CRISPR gRNA sequence
caccagcaaccagcacctcc

SEQ ID NO: 387810 - DNA, 20 bp, Artificial
  CRISPR gRNA sequence
accagcaaccagcacctccc

SEQ ID NO: 387811 - DNA, 20 bp, Artificial
  CRISPR gRNA sequence
ccctccaggccttcacacct

SEQ ID NO: 387812 - DNA, 20 bp, Artificial
  CRISPR gRNA sequence
caggccttcacacctgctac

SEQ ID NO: 387813 - DNA, 20 bp, Artificial
  CRISPR gRNA sequence
cacacctgctacctgattgt

SEQ ID NO: 387814 - DNA, 20 bp, Artificial
  CRISPR gRNA sequence
acacctgctacctgattgtg

SEQ ID NO: 387815 - DNA, 20 bp, Artificial
  CRISPR gRNA sequence
ctacctgattgtgcctgtcc

SEQ ID NO: 387816 - DNA, 20 bp, Artificial
  CRISPR gRNA sequence
cctgattgtgcctgtccctc

SEQ ID NO: 387817 - DNA, 20 bp, Artificial
  CRISPR gRNA sequence
attgtgcctgtccctcatgg

SEQ ID NO: 387818 - DNA, 20 bp, Artificial
  CRISPR gRNA sequence
tgcctgtccctcatggcact

SEQ ID NO: 387819 - DNA, 20 bp, Artificial
  CRISPR gRNA sequence
tccctcatggcactgtgtgg

SEQ ID NO: 387820 - DNA, 20 bp, Artificial
  CRISPR gRNA sequence
atggcactgtgtggacagcc

SEQ ID NO: 387821 - DNA, 20 bp, Artificial
  CRISPR gRNA sequence
tgtggacagcctgcctcacg

SEQ ID NO: 387822 - DNA, 20 bp, Artificial
  CRISPR gRNA sequence
cctcacgtgactccatgatg

SEQ ID NO: 387823 - DNA, 20 bp, Artificial
  CRISPR gRNA sequence
acgtgactccatgatgtgca

SEQ ID NO: 387824 - DNA, 20 bp, Artificial
  CRISPR gRNA sequence
catgatgtgcacaagcccct

SEQ ID NO: 387825 - DNA, 20 bp, Artificial
  CRISPR gRNA sequence
gaaggaagacaggaaggaag

SEQ ID NO: 387826 - DNA, 20 bp, Artificial
  CRISPR gRNA sequence
atagcattggcgtcagcgaa

SEQ ID NO: 387827 - DNA, 20 bp, Artificial
  CRISPR gRNA sequence
gcgtcagcgaaggatcccga

SEQ ID NO: 387828 - DNA, 20 bp, Artificial
  CRISPR gRNA sequence
aaataaagtagcgggagacc

SEQ ID NO: 387829 - DNA, 20 bp, Artificial
  CRISPR gRNA sequence
cccgactcctttgcctaaac

SEQ ID NO: 387830 - DNA, 20 bp, Artificial
  CRISPR gRNA sequence
ctttgcctaaacttgctcta

SEQ ID NO: 387831 - DNA, 20 bp, Artificial
  CRISPR gRNA sequence
tgcctaaacttgctctagac

SEQ ID NO: 387832 - DNA, 20 bp, Artificial
  CRISPR gRNA sequence
gcctaaacttgctctagaca

SEQ ID NO: 387833 - DNA, 20 bp, Artificial
  CRISPR gRNA sequence
cctaaacttgctctagacat

SEQ ID NO: 387834 - DNA, 20 bp, Artificial
  CRISPR gRNA sequence
aacttgctctagacattggt

SEQ ID NO: 387835 - DNA, 20 bp, Artificial
  CRISPR gRNA sequence
gctctagacattggttcagc

SEQ ID NO: 387836 - DNA, 20 bp, Artificial
  CRISPR gRNA sequence
ctctagacattggttcagcc

SEQ ID NO: 387837 - DNA, 20 bp, Artificial
  CRISPR gRNA sequence
tagacattggttcagcctga

SEQ ID NO: 387838 - DNA, 20 bp, Artificial
  CRISPR gRNA sequence
gacattggttcagcctgaaa

SEQ ID NO: 387839 - DNA, 20 bp, Artificial
  CRISPR gRNA sequence
gttcagcctgaaacctatca

SEQ ID NO: 387840 - DNA, 20 bp, Artificial
  CRISPR gRNA sequence
agcctgaaacctatcacttg

SEQ ID NO: 387841 - DNA, 20 bp, Artificial
  CRISPR gRNA sequence
aaacctatcacttgtataaa

SEQ ID NO: 387842 - DNA, 20 bp, Artificial
  CRISPR gRNA sequence
tcacttgtataaacctcttg

SEQ ID NO: 387843 - DNA, 20 bp, Artificial
  CRISPR gRNA sequence
gtataaacctcttgaagaag

SEQ ID NO: 387844 - DNA, 20 bp, Artificial
  CRISPR gRNA sequence
tataaacctcttgaagaagg

SEQ ID NO: 387845 - DNA, 20 bp, Artificial
  CRISPR gRNA sequence
ttgaagaaggacgctctgta

SEQ ID NO: 387846 - DNA, 20 bp, Artificial
  CRISPR gRNA sequence
gaagaaggacgctctgtagc

SEQ ID NO: 387847 - DNA, 20 bp, Artificial
  CRISPR gRNA sequence
aagaaggacgctctgtagct

SEQ ID NO: 387848 - DNA, 20 bp, Artificial
  CRISPR gRNA sequence
tgtagctccaccgtcaccag

SEQ ID NO: 387849 - DNA, 20 bp, Artificial
  CRISPR gRNA sequence
tagctccaccgtcaccagct

SEQ ID NO: 387850 - DNA, 20 bp, Artificial
  CRISPR gRNA sequence
caccgtcaccagcttctgtt

SEQ ID NO: 387851 - DNA, 20 bp, Artificial
  CRISPR gRNA sequence
ctgttgtgatgagtctcctg

SEQ ID NO: 387852 - DNA, 20 bp, Artificial
  CRISPR gRNA sequence
tgttgtgatgagtctcctga

SEQ ID NO: 387853 - DNA, 20 bp, Artificial
  CRISPR gRNA sequence
ttgtgatgagtctcctgatg

SEQ ID NO: 387854 - DNA, 20 bp, Artificial
  CRISPR gRNA sequence
tgatgagtctcctgatgaga

SEQ ID NO: 387855 - DNA, 20 bp, Artificial
  CRISPR gRNA sequence
ctgatgagagtagtttttct

SEQ ID NO: 387856 - DNA, 20 bp, Artificial
  CRISPR gRNA sequence
atgagagtagtttttctctt

SEQ ID NO: 387857 - DNA, 20 bp, Artificial
  CRISPR gRNA sequence
ttctcttccactttgagcag

SEQ ID NO: 387858 - DNA, 20 bp, Artificial
  CRISPR gRNA sequence
tctcttccactttgagcaga

SEQ ID NO: 387859 - DNA, 20 bp, Artificial
  CRISPR gRNA sequence
ctcttccactttgagcagaa

SEQ ID NO: 387860 - DNA, 20 bp, Artificial
  CRISPR gRNA sequence
tcttccactttgagcagaaa

SEQ ID NO: 387861 - DNA, 20 bp, Artificial
  CRISPR gRNA sequence
ttccactttgagcagaaaag

SEQ ID NO: 387862 - DNA, 20 bp, Artificial
  CRISPR gRNA sequence
ccactttgagcagaaaagta

SEQ ID NO: 387863 - DNA, 20 bp, Artificial
  CRISPR gRNA sequence
cactttgagcagaaaagtag

SEQ ID NO: 387864 - DNA, 20 bp, Artificial
  CRISPR gRNA sequence
tgagcagaaaagtagtgctg

SEQ ID NO: 387865 - DNA, 20 bp, Artificial
  CRISPR gRNA sequence
gagcagaaaagtagtgctgg

SEQ ID NO: 387866 - DNA, 20 bp, Artificial
  CRISPR gRNA sequence
agcagaaaagtagtgctggg

SEQ ID NO: 387867 - DNA, 20 bp, Artificial
  CRISPR gRNA sequence
gggccaagaataggaactct

SEQ ID NO: 387868 - DNA, 20 bp, Artificial
  CRISPR gRNA sequence
tgaagccagtcagcccgcat

SEQ ID NO: 387869 - DNA, 20 bp, Artificial
  CRISPR gRNA sequence
aagccagtcagcccgcatct

SEQ ID NO: 387870 - DNA, 20 bp, Artificial
  CRISPR gRNA sequence
aatccctgcccctctattta

SEQ ID NO: 387871 - DNA, 20 bp, Artificial
  CRISPR gRNA sequence
cccctctatttattagttac

SEQ ID NO: 387872 - DNA, 20 bp, Artificial
  CRISPR gRNA sequence
tatttattagttaccaagcc

SEQ ID NO: 387873 - DNA, 20 bp, Artificial
  CRISPR gRNA sequence
tttattagttaccaagcctg

SEQ ID NO: 387874 - DNA, 20 bp, Artificial
  CRISPR gRNA sequence
attagttaccaagcctgaga

SEQ ID NO: 387875 - DNA, 20 bp, Artificial
  CRISPR gRNA sequence
ttagttaccaagcctgagat

SEQ ID NO: 387876 - DNA, 20 bp, Artificial
  CRISPR gRNA sequence
gttaccaagcctgagataag

SEQ ID NO: 387877 - DNA, 20 bp, Artificial
  CRISPR gRNA sequence
ccaagcctgagataagtccc

SEQ ID NO: 387878 - DNA, 20 bp, Artificial
  CRISPR gRNA sequence
agataagtcccgtcaactct

SEQ ID NO: 387879 - DNA, 20 bp, Artificial
  CRISPR gRNA sequence
tccatacctcactttccaca

SEQ ID NO: 387880 - DNA, 20 bp, Artificial
  CRISPR gRNA sequence
catacctcactttccacaga

SEQ ID NO: 387881 - DNA, 20 bp, Artificial
  CRISPR gRNA sequence
actttccacagacgtcaaac

SEQ ID NO: 387882 - DNA, 20 bp, Artificial
  CRISPR gRNA sequence
tccacagacgtcaaacgtgg

SEQ ID NO: 387883 - DNA, 20 bp, Artificial
  CRISPR gRNA sequence
ccacagacgtcaaacgtggg

SEQ ID NO: 387884 - DNA, 20 bp, Artificial
  CRISPR gRNA sequence
cacagacgtcaaacgtgggc

SEQ ID NO: 387885 - DNA, 20 bp, Artificial
  CRISPR gRNA sequence
ctgtgacaagtaaatcagta

SEQ ID NO: 387886 - DNA, 20 bp, Artificial
  CRISPR gRNA sequence
tgacaagtaaatcagtaact

SEQ ID NO: 387887 - DNA, 20 bp, Artificial
  CRISPR gRNA sequence
cgagtaaattctcagaacag

SEQ ID NO: 387888 - DNA, 20 bp, Artificial
  CRISPR gRNA sequence
tcagaacagccactggcaca

SEQ ID NO: 387889 - DNA, 20 bp, Artificial
  CRISPR gRNA sequence
agaacagccactggcacaca

SEQ ID NO: 387890 - DNA, 20 bp, Artificial
  CRISPR gRNA sequence
gcacacatagaaacatggta

SEQ ID NO: 387891 - DNA, 20 bp, Artificial
  CRISPR gRNA sequence
atcatatagcgaccaagaca

SEQ ID NO: 387892 - DNA, 20 bp, Artificial
  CRISPR gRNA sequence
tcatatagcgaccaagacaa

SEQ ID NO: 387893 - DNA, 20 bp, Artificial
  CRISPR gRNA sequence
tgacacgtaattcttagaac

SEQ ID NO: 387894 - DNA, 20 bp, Artificial
  CRISPR gRNA sequence
ttagaacagctacttataac

SEQ ID NO: 387895 - DNA, 20 bp, Artificial
  CRISPR gRNA sequence
agaacagctacttataactc

SEQ ID NO: 387896 - DNA, 20 bp, Artificial
  CRISPR gRNA sequence
gaacagctacttataactct

SEQ ID NO: 387897 - DNA, 20 bp, Artificial
  CRISPR gRNA sequence
cttataactctttccttggg

SEQ ID NO: 387898 - DNA, 20 bp, Artificial
  CRISPR gRNA sequence
ataactctttccttgggtcc

SEQ ID NO: 387899 - DNA, 20 bp, Artificial
  CRISPR gRNA sequence
taactctttccttgggtcct

SEQ ID NO: 387900 - DNA, 20 bp, Artificial
  CRISPR gRNA sequence
tttccttgggtccttagaaa

SEQ ID NO: 387901 - DNA, 20 bp, Artificial
  CRISPR gRNA sequence
tccttgggtccttagaaaac

SEQ ID NO: 387902 - DNA, 20 bp, Artificial
  CRISPR gRNA sequence
ccttgggtccttagaaaact

SEQ ID NO: 387903 - DNA, 20 bp, Artificial
  CRISPR gRNA sequence
cttgggtccttagaaaactt

SEQ ID NO: 387904 - DNA, 20 bp, Artificial
  CRISPR gRNA sequence
gggtccttagaaaacttcaa

SEQ ID NO: 387905 - DNA, 20 bp, Artificial
  CRISPR gRNA sequence
ggtccttagaaaacttcaaa

SEQ ID NO: 387906 - DNA, 20 bp, Artificial
  CRISPR gRNA sequence
agaaaacttcaaaatgtgac

SEQ ID NO: 387907 - DNA, 20 bp, Artificial
  CRISPR gRNA sequence
gaaaacttcaaaatgtgacc

SEQ ID NO: 387908 - DNA, 20 bp, Artificial
  CRISPR gRNA sequence
caaaatgtgaccaggtgcag

SEQ ID NO: 387909 - DNA, 20 bp, Artificial
  CRISPR gRNA sequence
aaaatgtgaccaggtgcagt

SEQ ID NO: 387910 - DNA, 20 bp, Artificial
  CRISPR gRNA sequence
acgtctgcaatcccggcact

SEQ ID NO: 387911 - DNA, 20 bp, Artificial
  CRISPR gRNA sequence
caatcccggcactttggaag

SEQ ID NO: 387912 - DNA, 20 bp, Artificial
  CRISPR gRNA sequence
tggaaggccgaggtgggtgg

SEQ ID NO: 387913 - DNA, 20 bp, Artificial
  CRISPR gRNA sequence
ggaaggccgaggtgggtgga

SEQ ID NO: 387914 - DNA, 20 bp, Artificial
  CRISPR gRNA sequence
gaaggccgaggtgggtggat

SEQ ID NO: 387915 - DNA, 20 bp, Artificial
  CRISPR gRNA sequence
aggtcaggacttcgagacca

SEQ ID NO: 387916 - DNA, 20 bp, Artificial
  CRISPR gRNA sequence
cgagaccagcttgaccaatg

SEQ ID NO: 387917 - DNA, 20 bp, Artificial
  CRISPR gRNA sequence
gagaccagcttgaccaatgt

SEQ ID NO: 387918 - DNA, 20 bp, Artificial
  CRISPR gRNA sequence
gaccaatgtggtgaaacccc

SEQ ID NO: 387919 - DNA, 20 bp, Artificial
  CRISPR gRNA sequence
accaatgtggtgaaaccccg

SEQ ID NO: 387920 - DNA, 20 bp, Artificial
  CRISPR gRNA sequence
ttctaaaaatacaaaaatta

SEQ ID NO: 387921 - DNA, 20 bp, Artificial
  CRISPR gRNA sequence
ctaaaaatacaaaaattagc

SEQ ID NO: 387922 - DNA, 20 bp, Artificial
  CRISPR gRNA sequence
taaaaatacaaaaattagct

SEQ ID NO: 387923 - DNA, 20 bp, Artificial
  CRISPR gRNA sequence
aaaatacaaaaattagctgg

SEQ ID NO: 387924 - DNA, 20 bp, Artificial
  CRISPR gRNA sequence
gctgggcatggtggcaggtg

SEQ ID NO: 387925 - DNA, 20 bp, Artificial
  CRISPR gRNA sequence
ggcatggtggcaggtgcctg

SEQ ID NO: 387926 - DNA, 20 bp, Artificial
  CRISPR gRNA sequence
taatcccagctgcttgggag

SEQ ID NO: 387927 - DNA, 20 bp, Artificial
  CRISPR gRNA sequence
cttgggaggctgaggcagaa

SEQ ID NO: 387928 - DNA, 20 bp, Artificial
  CRISPR gRNA sequence
gggaggctgaggcagaagaa

SEQ ID NO: 387929 - DNA, 20 bp, Artificial
  CRISPR gRNA sequence
ggaggctgaggcagaagaat

SEQ ID NO: 387930 - DNA, 20 bp, Artificial
  CRISPR gRNA sequence
aggcagaagaatcgcttgaa

SEQ ID NO: 387931 - DNA, 20 bp, Artificial
  CRISPR gRNA sequence
gaacccaggaggaggaggtt

SEQ ID NO: 387932 - DNA, 20 bp, Artificial
  CRISPR gRNA sequence
aacccaggaggaggaggttg

SEQ ID NO: 387933 - DNA, 20 bp, Artificial
  CRISPR gRNA sequence
cagtgagccgagatcgtgcc

SEQ ID NO: 387934 - DNA, 20 bp, Artificial
  CRISPR gRNA sequence
cactccagcctgggcaacag

SEQ ID NO: 387935 - DNA, 20 bp, Artificial
  CRISPR gRNA sequence
cagcctgggcaacagagtga

SEQ ID NO: 387936 - DNA, 20 bp, Artificial
  CRISPR gRNA sequence
ggcaacagagtgagaacctg

SEQ ID NO: 387937 - DNA, 20 bp, Artificial
  CRISPR gRNA sequence
tctcaaaaaaaaaataaaaa

SEQ ID NO: 387938 - DNA, 20 bp, Artificial
  CRISPR gRNA sequence
aaaaaaaaaataaaaataaa

SEQ ID NO: 387939 - DNA, 20 bp, Artificial
  CRISPR gRNA sequence
tttaaaaaaaggaaacttga

SEQ ID NO: 387940 - DNA, 20 bp, Artificial
  CRISPR gRNA sequence
ttaaaaaaaggaaacttgaa

SEQ ID NO: 387941 - DNA, 20 bp, Artificial
  CRISPR gRNA sequence
taaaaaaaggaaacttgaaa

SEQ ID NO: 387942 - DNA, 20 bp, Artificial
  CRISPR gRNA sequence
aaaaaaaggaaacttgaaaa

SEQ ID NO: 387943 - DNA, 20 bp, Artificial
  CRISPR gRNA sequence
aaaaaaggaaacttgaaaat

SEQ ID NO: 387944 - DNA, 20 bp, Artificial
  CRISPR gRNA sequence
gaaaatgcaaaccatatagc

SEQ ID NO: 387945 - DNA, 20 bp, Artificial
  CRISPR gRNA sequence
aaaatgcaaaccatatagca

SEQ ID NO: 387946 - DNA, 20 bp, Artificial
  CRISPR gRNA sequence
acaaagacttatatctaaag

SEQ ID NO: 387947 - DNA, 20 bp, Artificial
  CRISPR gRNA sequence
caaagacttatatctaaagg

SEQ ID NO: 387948 - DNA, 20 bp, Artificial
  CRISPR gRNA sequence
atatctaaaggtgttataaa

SEQ ID NO: 387949 - DNA, 20 bp, Artificial
  CRISPR gRNA sequence
tatctaaaggtgttataaat

SEQ ID NO: 387950 - DNA, 20 bp, Artificial
  CRISPR gRNA sequence
aaggtgttataaatgttgta

SEQ ID NO: 387951 - DNA, 20 bp, Artificial
  CRISPR gRNA sequence
taaatgttgtacagatcttt

SEQ ID NO: 387952 - DNA, 20 bp, Artificial
  CRISPR gRNA sequence
tacagatcttttcagaatat

SEQ ID NO: 387953 - DNA, 20 bp, Artificial
  CRISPR gRNA sequence
ttcagaatatgaaattcagc

SEQ ID NO: 387954 - DNA, 20 bp, Artificial
  CRISPR gRNA sequence
tcagaatatgaaattcagca

SEQ ID NO: 387955 - DNA, 20 bp, Artificial
  CRISPR gRNA sequence
cagaatatgaaattcagcaa

SEQ ID NO: 387956 - DNA, 20 bp, Artificial
  CRISPR gRNA sequence
agaatatgaaattcagcaag

SEQ ID NO: 387957 - DNA, 20 bp, Artificial
  CRISPR gRNA sequence
agcaagccttaggctgaata

SEQ ID NO: 387958 - DNA, 20 bp, Artificial
  CRISPR gRNA sequence
aggctgaatacctccaaata

SEQ ID NO: 387959 - DNA, 20 bp, Artificial
  CRISPR gRNA sequence
ggctgaatacctccaaatag

SEQ ID NO: 387960 - DNA, 20 bp, Artificial
  CRISPR gRNA sequence
aatacctccaaatagactat

SEQ ID NO: 387961 - DNA, 20 bp, Artificial
  CRISPR gRNA sequence
caaatagactatccaatttt

SEQ ID NO: 387962 - DNA, 20 bp, Artificial
  CRISPR gRNA sequence
tccaattttaaaccatttta

SEQ ID NO: 387963 - DNA, 20 bp, Artificial
  CRISPR gRNA sequence
taaaccattttatgaaaaaa

SEQ ID NO: 387964 - DNA, 20 bp, Artificial
  CRISPR gRNA sequence
aaaccattttatgaaaaaaa

SEQ ID NO: 387965 - DNA, 20 bp, Artificial
  CRISPR gRNA sequence
aaccattttatgaaaaaaat

SEQ ID NO: 387966 - DNA, 20 bp, Artificial
  CRISPR gRNA sequence
tatgaaaaaaattccctaag

SEQ ID NO: 387967 - DNA, 20 bp, Artificial
  CRISPR gRNA sequence
atgaaaaaaattccctaagt

SEQ ID NO: 387968 - DNA, 20 bp, Artificial
  CRISPR gRNA sequence
tgaaaaaaattccctaagtg

SEQ ID NO: 387969 - DNA, 20 bp, Artificial
  CRISPR gRNA sequence
cctaagtgctctacaaaaca

SEQ ID NO: 387970 - DNA, 20 bp, Artificial
  CRISPR gRNA sequence
agtgctctacaaaacatgaa

SEQ ID NO: 387971 - DNA, 20 bp, Artificial
  CRISPR gRNA sequence
tacaaaacatgaaagcctat

SEQ ID NO: 387972 - DNA, 20 bp, Artificial
  CRISPR gRNA sequence
caaaacatgaaagcctatgc

SEQ ID NO: 387973 - DNA, 20 bp, Artificial
  CRISPR gRNA sequence
tgcctggctataagaaataa

SEQ ID NO: 387974 - DNA, 20 bp, Artificial
  CRISPR gRNA sequence
gctataagaaataataacta

SEQ ID NO: 387975 - DNA, 20 bp, Artificial
  CRISPR gRNA sequence
taagaaataataactaggaa

SEQ ID NO: 387976 - DNA, 20 bp, Artificial
  CRISPR gRNA sequence
ggaataatttcaaaatctgc

SEQ ID NO: 387977 - DNA, 20 bp, Artificial
  CRISPR gRNA sequence
caaaatctgctgctttatgc

SEQ ID NO: 387978 - DNA, 20 bp, Artificial
  CRISPR gRNA sequence
aaaatctgctgctttatgct

SEQ ID NO: 387979 - DNA, 20 bp, Artificial
  CRISPR gRNA sequence
ctgctttatgctctagagtt

SEQ ID NO: 387980 - DNA, 20 bp, Artificial
  CRISPR gRNA sequence
ctttatgctctagagtttaa

SEQ ID NO: 387981 - DNA, 20 bp, Artificial
  CRISPR gRNA sequence
tatgctctagagtttaataa

SEQ ID NO: 387982 - DNA, 20 bp, Artificial
  CRISPR gRNA sequence
atgctctagagtttaataac

SEQ ID NO: 387983 - DNA, 20 bp, Artificial
  CRISPR gRNA sequence
tgctctagagtttaataacc

SEQ ID NO: 387984 - DNA, 20 bp, Artificial
  CRISPR gRNA sequence
tagagtttaataacccatct

SEQ ID NO: 387985 - DNA, 20 bp, Artificial
  CRISPR gRNA sequence
gagtttaataacccatctca

SEQ ID NO: 387986 - DNA, 20 bp, Artificial
  CRISPR gRNA sequence
aataacccatctcatctctc

SEQ ID NO: 387987 - DNA, 20 bp, Artificial
  CRISPR gRNA sequence
ataacccatctcatctctct

SEQ ID NO: 387988 - DNA, 20 bp, Artificial
  CRISPR gRNA sequence
atctctcttttttaaaaaga

SEQ ID NO: 387989 - DNA, 20 bp, Artificial
  CRISPR gRNA sequence
tcttttttaaaaagagccaa

SEQ ID NO: 387990 - DNA, 20 bp, Artificial
  CRISPR gRNA sequence
ttttttaaaaagagccaata

SEQ ID NO: 387991 - DNA, 20 bp, Artificial
  CRISPR gRNA sequence
ttttaaaaagagccaataat

SEQ ID NO: 387992 - DNA, 20 bp, Artificial
  CRISPR gRNA sequence
tttaaaaagagccaataatt

SEQ ID NO: 387993 - DNA, 20 bp, Artificial
  CRISPR gRNA sequence
ttaaaaagagccaataattt

SEQ ID NO: 387994 - DNA, 20 bp, Artificial
  CRISPR gRNA sequence
taaaaagagccaataattta

SEQ ID NO: 387995 - DNA, 20 bp, Artificial
  CRISPR gRNA sequence
aaaaagagccaataatttaa

SEQ ID NO: 387996 - DNA, 20 bp, Artificial
  CRISPR gRNA sequence
aaaagagccaataatttaaa

SEQ ID NO: 387997 - DNA, 20 bp, Artificial
  CRISPR gRNA sequence
aaaaatgaattatatgatta

SEQ ID NO: 387998 - DNA, 20 bp, Artificial
  CRISPR gRNA sequence
aaaatgaattatatgattag

SEQ ID NO: 387999 - DNA, 20 bp, Artificial
  CRISPR gRNA sequence
tatgattagatttcaaaact

SEQ ID NO: 388000 - DNA, 20 bp, Artificial
  CRISPR gRNA sequence
gatttcaaaactgatacctt

SEQ ID NO: 388001 - DNA, 20 bp, Artificial
  CRISPR gRNA sequence
caaaactgatacctttatct

SEQ ID NO: 388002 - DNA, 20 bp, Artificial
  CRISPR gRNA sequence
aaaactgatacctttatctg

SEQ ID NO: 388003 - DNA, 20 bp, Artificial
  CRISPR gRNA sequence
atacctttatctgctggatc

SEQ ID NO: 388004 - DNA, 20 bp, Artificial
  CRISPR gRNA sequence
tatctgctggatcaggaaga

SEQ ID NO: 388005 - DNA, 20 bp, Artificial
  CRISPR gRNA sequence
atctgctggatcaggaagag

SEQ ID NO: 388006 - DNA, 20 bp, Artificial
  CRISPR gRNA sequence
tctgctggatcaggaagaga

SEQ ID NO: 388007 - DNA, 20 bp, Artificial
  CRISPR gRNA sequence
ctggatcaggaagagaaaat

SEQ ID NO: 388008 - DNA, 20 bp, Artificial
  CRISPR gRNA sequence
gatcaggaagagaaaatagt

SEQ ID NO: 388009 - DNA, 20 bp, Artificial
  CRISPR gRNA sequence
gtttggattaaaatatttgg

SEQ ID NO: 388010 - DNA, 20 bp, Artificial
  CRISPR gRNA sequence
tttggattaaaatatttggg

SEQ ID NO: 388011 - DNA, 20 bp, Artificial
  CRISPR gRNA sequence
ggattaaaatatttgggatt

SEQ ID NO: 388012 - DNA, 20 bp, Artificial
  CRISPR gRNA sequence
gattaaaatatttgggattt

SEQ ID NO: 388013 - DNA, 20 bp, Artificial
  CRISPR gRNA sequence
aaatatttgggatttggcat

SEQ ID NO: 388014 - DNA, 20 bp, Artificial
  CRISPR gRNA sequence
gggatttggcatgtgtgcat

SEQ ID NO: 388015 - DNA, 20 bp, Artificial
  CRISPR gRNA sequence
ggatttggcatgtgtgcata

SEQ ID NO: 388016 - DNA, 20 bp, Artificial
  CRISPR gRNA sequence
ggcatgtgtgcatatggtaa

SEQ ID NO: 388017 - DNA, 20 bp, Artificial
  CRISPR gRNA sequence
gcatgtgtgcatatggtaag

SEQ ID NO: 388018 - DNA, 20 bp, Artificial
  CRISPR gRNA sequence
taaagttgcccacacaatcg

SEQ ID NO: 388019 - DNA, 20 bp, Artificial
  CRISPR gRNA sequence
cccacacaatcgtgtgtatt

SEQ ID NO: 388020 - DNA, 20 bp, Artificial
  CRISPR gRNA sequence
gttgagtgtttaccatacgg

SEQ ID NO: 388021 - DNA, 20 bp, Artificial
  CRISPR gRNA sequence
ttgagtgtttaccatacggc

SEQ ID NO: 388022 - DNA, 20 bp, Artificial
  CRISPR gRNA sequence
agtgtttaccatacggcagg

SEQ ID NO: 388023 - DNA, 20 bp, Artificial
  CRISPR gRNA sequence
accatacggcaggttgaaaa

SEQ ID NO: 388024 - DNA, 20 bp, Artificial
  CRISPR gRNA sequence
ccatacggcaggttgaaaaa

SEQ ID NO: 388025 - DNA, 20 bp, Artificial
  CRISPR gRNA sequence
aaaaataaacttgttactcc

SEQ ID NO: 388026 - DNA, 20 bp, Artificial
  CRISPR gRNA sequence
gttactcctcctaacaaata

SEQ ID NO: 388027 - DNA, 20 bp, Artificial
  CRISPR gRNA sequence
ttactcctcctaacaaatat

SEQ ID NO: 388028 - DNA, 20 bp, Artificial
  CRISPR gRNA sequence
ctcctcctaacaaatattca

SEQ ID NO: 388029 - DNA, 20 bp, Artificial
  CRISPR gRNA sequence
ctcctaacaaatattcatag

SEQ ID NO: 388030 - DNA, 20 bp, Artificial
  CRISPR gRNA sequence
ctaacaaatattcatagata

SEQ ID NO: 388031 - DNA, 20 bp, Artificial
  CRISPR gRNA sequence
acaaatattcatagatatct

SEQ ID NO: 388032 - DNA, 20 bp, Artificial
  CRISPR gRNA sequence
atagatatctcagttcatac

SEQ ID NO: 388033 - DNA, 20 bp, Artificial
  CRISPR gRNA sequence
agttcatacacctacacata

SEQ ID NO: 388034 - DNA, 20 bp, Artificial
  CRISPR gRNA sequence
atacacctacacatacacac

SEQ ID NO: 388035 - DNA, 20 bp, Artificial
  CRISPR gRNA sequence
cacatacacacacacacaca

SEQ ID NO: 388036 - DNA, 20 bp, Artificial
  CRISPR gRNA sequence
aaagagtgaataatcaatcc

SEQ ID NO: 388037 - DNA, 20 bp, Artificial
  CRISPR gRNA sequence
atgctccacataagatgtga

SEQ ID NO: 388038 - DNA, 20 bp, Artificial
  CRISPR gRNA sequence
cacataagatgtgaaaaact

SEQ ID NO: 388039 - DNA, 20 bp, Artificial
  CRISPR gRNA sequence
aagacacagtgacatcagga

SEQ ID NO: 388040 - DNA, 20 bp, Artificial
  CRISPR gRNA sequence
tacttggtgagcctgtattt

SEQ ID NO: 388041 - DNA, 20 bp, Artificial
  CRISPR gRNA sequence
ggtgagcctgtatttttctg

SEQ ID NO: 388042 - DNA, 20 bp, Artificial
  CRISPR gRNA sequence
gtgagcctgtatttttctgt

SEQ ID NO: 388043 - DNA, 20 bp, Artificial
  CRISPR gRNA sequence
tatttttctgtataaacttc

SEQ ID NO: 388044 - DNA, 20 bp, Artificial
  CRISPR gRNA sequence
ttctgtataaacttccctcc

SEQ ID NO: 388045 - DNA, 20 bp, Artificial
  CRISPR gRNA sequence
tctgtataaacttccctccc

SEQ ID NO: 388046 - DNA, 20 bp, Artificial
  CRISPR gRNA sequence
ctgtataaacttccctccca

SEQ ID NO: 388047 - DNA, 20 bp, Artificial
  CRISPR gRNA sequence
tgtataaacttccctcccat

SEQ ID NO: 388048 - DNA, 20 bp, Artificial
  CRISPR gRNA sequence
tataaacttccctcccatgg

SEQ ID NO: 388049 - DNA, 20 bp, Artificial
  CRISPR gRNA sequence
ccctcccatgggttcattta

SEQ ID NO: 388050 - DNA, 20 bp, Artificial
  CRISPR gRNA sequence
cctcccatgggttcatttac

SEQ ID NO: 388051 - DNA, 20 bp, Artificial
  CRISPR gRNA sequence
ccatgggttcatttacacat

SEQ ID NO: 388052 - DNA, 20 bp, Artificial
  CRISPR gRNA sequence
atttacacattgcgtcccac

SEQ ID NO: 388053 - DNA, 20 bp, Artificial
  CRISPR gRNA sequence
acacattgcgtcccacagaa

SEQ ID NO: 388054 - DNA, 20 bp, Artificial
  CRISPR gRNA sequence
cacattgcgtcccacagaaa

SEQ ID NO: 388055 - DNA, 20 bp, Artificial
  CRISPR gRNA sequence
cgtcccacagaaaatacccc

SEQ ID NO: 388056 - DNA, 20 bp, Artificial
  CRISPR gRNA sequence
tgttaatgaaatcttctcaa

SEQ ID NO: 388057 - DNA, 20 bp, Artificial
  CRISPR gRNA sequence
gttaatgaaatcttctcaac

SEQ ID NO: 388058 - DNA, 20 bp, Artificial
  CRISPR gRNA sequence
ttaatgaaatcttctcaact

SEQ ID NO: 388059 - DNA, 20 bp, Artificial
  CRISPR gRNA sequence
atgaaatcttctcaactcag

SEQ ID NO: 388060 - DNA, 20 bp, Artificial
  CRISPR gRNA sequence
ctcaactcagcatctacttt

SEQ ID NO: 388061 - DNA, 20 bp, Artificial
  CRISPR gRNA sequence
tcaactcagcatctactttt

SEQ ID NO: 388062 - DNA, 20 bp, Artificial
  CRISPR gRNA sequence
aactcagcatctacttttta

SEQ ID NO: 388063 - DNA, 20 bp, Artificial
  CRISPR gRNA sequence
agcatctactttttatttta

SEQ ID NO: 388064 - DNA, 20 bp, Artificial
  CRISPR gRNA sequence
ctttttattttacccgtgtc

SEQ ID NO: 388065 - DNA, 20 bp, Artificial
  CRISPR gRNA sequence
tttattttacccgtgtccat

SEQ ID NO: 388066 - DNA, 20 bp, Artificial
  CRISPR gRNA sequence
ttattttacccgtgtccatc

SEQ ID NO: 388067 - DNA, 20 bp, Artificial
  CRISPR gRNA sequence
tattttacccgtgtccatca

SEQ ID NO: 388068 - DNA, 20 bp, Artificial
  CRISPR gRNA sequence
attttacccgtgtccatcat

SEQ ID NO: 388069 - DNA, 20 bp, Artificial
  CRISPR gRNA sequence
ttttacccgtgtccatcatc

SEQ ID NO: 388070 - DNA, 20 bp, Artificial
  CRISPR gRNA sequence
tacccgtgtccatcatcatc

SEQ ID NO: 388071 - DNA, 20 bp, Artificial
  CRISPR gRNA sequence
acccgtgtccatcatcatca

SEQ ID NO: 388072 - DNA, 20 bp, Artificial
  CRISPR gRNA sequence
cccgtgtccatcatcatcac

SEQ ID NO: 388073 - DNA, 20 bp, Artificial
  CRISPR gRNA sequence
tttttattgtttcactcact

SEQ ID NO: 388074 - DNA, 20 bp, Artificial
  CRISPR gRNA sequence
ttttattgtttcactcactg

SEQ ID NO: 388075 - DNA, 20 bp, Artificial
  CRISPR gRNA sequence
tttattgtttcactcactgt

SEQ ID NO: 388076 - DNA, 20 bp, Artificial
  CRISPR gRNA sequence
ttattgtttcactcactgtc

SEQ ID NO: 388077 - DNA, 20 bp, Artificial
  CRISPR gRNA sequence
tattgtttcactcactgtcc

SEQ ID NO: 388078 - DNA, 20 bp, Artificial
  CRISPR gRNA sequence
attgtttcactcactgtcca

SEQ ID NO: 388079 - DNA, 20 bp, Artificial
  CRISPR gRNA sequence
ttgtttcactcactgtccaa

SEQ ID NO: 388080 - DNA, 20 bp, Artificial
  CRISPR gRNA sequence
tttcactcactgtccaacat

SEQ ID NO: 388081 - DNA, 20 bp, Artificial
  CRISPR gRNA sequence
cactcactgtccaacatagc

SEQ ID NO: 388082 - DNA, 20 bp, Artificial
  CRISPR gRNA sequence
actcactgtccaacatagct

SEQ ID NO: 388083 - DNA, 20 bp, Artificial
  CRISPR gRNA sequence
actgtccaacatagctaaag

SEQ ID NO: 388084 - DNA, 20 bp, Artificial
  CRISPR gRNA sequence
tccaacatagctaaagccat

SEQ ID NO: 388085 - DNA, 20 bp, Artificial
  CRISPR gRNA sequence
aagccattttcactttccac

SEQ ID NO: 388086 - DNA, 20 bp, Artificial
  CRISPR gRNA sequence
tcactttccaccaatccaac

SEQ ID NO: 388087 - DNA, 20 bp, Artificial
  CRISPR gRNA sequence
cactttccaccaatccaact

SEQ ID NO: 388088 - DNA, 20 bp, Artificial
  CRISPR gRNA sequence
actttccaccaatccaactg

SEQ ID NO: 388089 - DNA, 20 bp, Artificial
  CRISPR gRNA sequence
tccaccaatccaactgagag

SEQ ID NO: 388090 - DNA, 20 bp, Artificial
  CRISPR gRNA sequence
ccaccaatccaactgagagt

SEQ ID NO: 388091 - DNA, 20 bp, Artificial
  CRISPR gRNA sequence
caccaatccaactgagagta

SEQ ID NO: 388092 - DNA, 20 bp, Artificial
  CRISPR gRNA sequence
agagtattaacatttcaact

SEQ ID NO: 388093 - DNA, 20 bp, Artificial
  CRISPR gRNA sequence
acatttcaacttgatacttg

SEQ ID NO: 388094 - DNA, 20 bp, Artificial
  CRISPR gRNA sequence
caacttgatacttgtgaaag

SEQ ID NO: 388095 - DNA, 20 bp, Artificial
  CRISPR gRNA sequence
aacttgatacttgtgaaaga

SEQ ID NO: 388096 - DNA, 20 bp, Artificial
  CRISPR gRNA sequence
gatacttgtgaaagactctc

SEQ ID NO: 388097 - DNA, 20 bp, Artificial
  CRISPR gRNA sequence
atacttgtgaaagactctct

SEQ ID NO: 388098 - DNA, 20 bp, Artificial
  CRISPR gRNA sequence
gtgaaagactctctccctgt

SEQ ID NO: 388099 - DNA, 20 bp, Artificial
  CRISPR gRNA sequence
tgaaagactctctccctgtg

SEQ ID NO: 388100 - DNA, 20 bp, Artificial
  CRISPR gRNA sequence
tctccctgtgagttaattaa

SEQ ID NO: 388101 - DNA, 20 bp, Artificial
  CRISPR gRNA sequence
tccctgtgagttaattaatt

SEQ ID NO: 388102 - DNA, 20 bp, Artificial
  CRISPR gRNA sequence
cctgtgagttaattaattaa

SEQ ID NO: 388103 - DNA, 20 bp, Artificial
  CRISPR gRNA sequence
tgagttaattaattaaaatg

SEQ ID NO: 388104 - DNA, 20 bp, Artificial
  CRISPR gRNA sequence
attaattaaaatgccactca

SEQ ID NO: 388105 - DNA, 20 bp, Artificial
  CRISPR gRNA sequence
attaaaatgccactcatatc

SEQ ID NO: 388106 - DNA, 20 bp, Artificial
  CRISPR gRNA sequence
aaatgccactcatatctaaa

SEQ ID NO: 388107 - DNA, 20 bp, Artificial
  CRISPR gRNA sequence
atatctaaaggattgtgaac

SEQ ID NO: 388108 - DNA, 20 bp, Artificial
  CRISPR gRNA sequence
aaggattgtgaacaccatgg

SEQ ID NO: 388109 - DNA, 20 bp, Artificial
  CRISPR gRNA sequence
tgaacaccatggcctacctt

SEQ ID NO: 388110 - DNA, 20 bp, Artificial
  CRISPR gRNA sequence
cctttgagttctaccaaagt

SEQ ID NO: 388111 - DNA, 20 bp, Artificial
  CRISPR gRNA sequence
tgagttctaccaaagttaaa

SEQ ID NO: 388112 - DNA, 20 bp, Artificial
  CRISPR gRNA sequence
gagttctaccaaagttaaaa

SEQ ID NO: 388113 - DNA, 20 bp, Artificial
  CRISPR gRNA sequence
agttctaccaaagttaaaaa

SEQ ID NO: 388114 - DNA, 20 bp, Artificial
  CRISPR gRNA sequence
taccaaagttaaaaacattg

SEQ ID NO: 388115 - DNA, 20 bp, Artificial
  CRISPR gRNA sequence
ccaaagttaaaaacattgaa

SEQ ID NO: 388116 - DNA, 20 bp, Artificial
  CRISPR gRNA sequence
aaaacattgaattaatcctg

SEQ ID NO: 388117 - DNA, 20 bp, Artificial
  CRISPR gRNA sequence
aattaatcctggaaatgaat

SEQ ID NO: 388118 - DNA, 20 bp, Artificial
  CRISPR gRNA sequence
atcctggaaatgaattttag

SEQ ID NO: 388119 - DNA, 20 bp, Artificial
  CRISPR gRNA sequence
gaaatgaattttagagtgct

SEQ ID NO: 388120 - DNA, 20 bp, Artificial
  CRISPR gRNA sequence
tagagtgctcaatgaagatt

SEQ ID NO: 388121 - DNA, 20 bp, Artificial
  CRISPR gRNA sequence
agagtgctcaatgaagattg

SEQ ID NO: 388122 - DNA, 20 bp, Artificial
  CRISPR gRNA sequence
gagtgctcaatgaagattgc

SEQ ID NO: 388123 - DNA, 20 bp, Artificial
  CRISPR gRNA sequence
aatgaagattgcaaaatatt

SEQ ID NO: 388124 - DNA, 20 bp, Artificial
  CRISPR gRNA sequence
caaaatatttattttataaa

SEQ ID NO: 388125 - DNA, 20 bp, Artificial
  CRISPR gRNA sequence
attttataaaagttgcacca

SEQ ID NO: 388126 - DNA, 20 bp, Artificial
  CRISPR gRNA sequence
ttttataaaagttgcaccaa

SEQ ID NO: 388127 - DNA, 20 bp, Artificial
  CRISPR gRNA sequence
tataaaagttgcaccaaaaa

SEQ ID NO: 388128 - DNA, 20 bp, Artificial
  CRISPR gRNA sequence
ataaaagttgcaccaaaaaa

SEQ ID NO: 388129 - DNA, 20 bp, Artificial
  CRISPR gRNA sequence
taaaagttgcaccaaaaaaa

SEQ ID NO: 388130 - DNA, 20 bp, Artificial
  CRISPR gRNA sequence
caccaaaaaaacttatattc

SEQ ID NO: 388131 - DNA, 20 bp, Artificial
  CRISPR gRNA sequence
atattcctgttgaataaatg

SEQ ID NO: 388132 - DNA, 20 bp, Artificial
  CRISPR gRNA sequence
tattcctgttgaataaatgt

SEQ ID NO: 388133 - DNA, 20 bp, Artificial
  CRISPR gRNA sequence
ctgttgaataaatgtatttt

SEQ ID NO: 388134 - DNA, 20 bp, Artificial
  CRISPR gRNA sequence
ttgaataaatgtatttttaa

SEQ ID NO: 388135 - DNA, 20 bp, Artificial
  CRISPR gRNA sequence
aataaatgtatttttaaaat

SEQ ID NO: 388136 - DNA, 20 bp, Artificial
  CRISPR gRNA sequence
ttaaaatccctgaatcattt

SEQ ID NO: 388137 - DNA, 20 bp, Artificial
  CRISPR gRNA sequence
taaaatccctgaatcatttt

SEQ ID NO: 388138 - DNA, 20 bp, Artificial
  CRISPR gRNA sequence
aaaatccctgaatcatttta

SEQ ID NO: 388139 - DNA, 20 bp, Artificial
  CRISPR gRNA sequence
aaatccctgaatcattttag

SEQ ID NO: 388140 - DNA, 20 bp, Artificial
  CRISPR gRNA sequence
aatcattttagtataaataa

SEQ ID NO: 388141 - DNA, 20 bp, Artificial
  CRISPR gRNA sequence
tagtataaataatagcttaa

SEQ ID NO: 388142 - DNA, 20 bp, Artificial
  CRISPR gRNA sequence
agtataaataatagcttaaa

SEQ ID NO: 388143 - DNA, 20 bp, Artificial
  CRISPR gRNA sequence
gtataaataatagcttaaag

SEQ ID NO: 388144 - DNA, 20 bp, Artificial
  CRISPR gRNA sequence
aaagatagaaattggggttc

SEQ ID NO: 388145 - DNA, 20 bp, Artificial
  CRISPR gRNA sequence
aagatagaaattggggttca

SEQ ID NO: 388146 - DNA, 20 bp, Artificial
  CRISPR gRNA sequence
gggttcaaagatatacttct

SEQ ID NO: 388147 - DNA, 20 bp, Artificial
  CRISPR gRNA sequence
aaagatatacttctacttat

SEQ ID NO: 388148 - DNA, 20 bp, Artificial
  CRISPR gRNA sequence
ctacttatgacagatctgtt

SEQ ID NO: 388149 - DNA, 20 bp, Artificial
  CRISPR gRNA sequence
tacttatgacagatctgttt

SEQ ID NO: 388150 - DNA, 20 bp, Artificial
  CRISPR gRNA sequence
cttatgacagatctgtttat

SEQ ID NO: 388151 - DNA, 20 bp, Artificial
  CRISPR gRNA sequence
atgacagatctgtttattct

SEQ ID NO: 388152 - DNA, 20 bp, Artificial
  CRISPR gRNA sequence
tgacagatctgtttattctt

SEQ ID NO: 388153 - DNA, 20 bp, Artificial
  CRISPR gRNA sequence
tttattcttcattttccgtc

SEQ ID NO: 388154 - DNA, 20 bp, Artificial
  CRISPR gRNA sequence
attcttcattttccgtcctc

SEQ ID NO: 388155 - DNA, 20 bp, Artificial
  CRISPR gRNA sequence
ttcttcattttccgtcctct

SEQ ID NO: 388156 - DNA, 20 bp, Artificial
  CRISPR gRNA sequence
ttcattttccgtcctcttaa

SEQ ID NO: 388157 - DNA, 20 bp, Artificial
  CRISPR gRNA sequence
cattttccgtcctcttaaac

SEQ ID NO: 388158 - DNA, 20 bp, Artificial
  CRISPR gRNA sequence
attttccgtcctcttaaaca

SEQ ID NO: 388159 - DNA, 20 bp, Artificial
  CRISPR gRNA sequence
tccgtcctcttaaacaacat

SEQ ID NO: 388160 - DNA, 20 bp, Artificial
  CRISPR gRNA sequence
ccgtcctcttaaacaacata

SEQ ID NO: 388161 - DNA, 20 bp, Artificial
  CRISPR gRNA sequence
cgtcctcttaaacaacatag

SEQ ID NO: 388162 - DNA, 20 bp, Artificial
  CRISPR gRNA sequence
ttaaacaacatagtcctcca

SEQ ID NO: 388163 - DNA, 20 bp, Artificial
  CRISPR gRNA sequence
aaacaacatagtcctccaga

SEQ ID NO: 388164 - DNA, 20 bp, Artificial
  CRISPR gRNA sequence
aacaacatagtcctccagaa

SEQ ID NO: 388165 - DNA, 20 bp, Artificial
  CRISPR gRNA sequence
cagaaacctagtacatcgcc

SEQ ID NO: 388166 - DNA, 20 bp, Artificial
  CRISPR gRNA sequence
gtacatcgcctttgaatatt

SEQ ID NO: 388167 - DNA, 20 bp, Artificial
  CRISPR gRNA sequence
tgaatatttatcaggatcca

SEQ ID NO: 388168 - DNA, 20 bp, Artificial
  CRISPR gRNA sequence
gaatatttatcaggatccat

SEQ ID NO: 388169 - DNA, 20 bp, Artificial
  CRISPR gRNA sequence
aatatttatcaggatccatg

SEQ ID NO: 388170 - DNA, 20 bp, Artificial
  CRISPR gRNA sequence
atcaggatccatgtcaataa

SEQ ID NO: 388171 - DNA, 20 bp, Artificial
  CRISPR gRNA sequence
tcaggatccatgtcaataat

SEQ ID NO: 388172 - DNA, 20 bp, Artificial
  CRISPR gRNA sequence
gaaatacttcagatgaagtt

SEQ ID NO: 388173 - DNA, 20 bp, Artificial
  CRISPR gRNA sequence
aaatacttcagatgaagttc

SEQ ID NO: 388174 - DNA, 20 bp, Artificial
  CRISPR gRNA sequence
cagatgaagttcaaagtaat

SEQ ID NO: 388175 - DNA, 20 bp, Artificial
  CRISPR gRNA sequence
agatgaagttcaaagtaatc

SEQ ID NO: 388176 - DNA, 20 bp, Artificial
  CRISPR gRNA sequence
aaagtaatcgactgattgag

SEQ ID NO: 388177 - DNA, 20 bp, Artificial
  CRISPR gRNA sequence
attgagttgtaatacttaaa

SEQ ID NO: 388178 - DNA, 20 bp, Artificial
  CRISPR gRNA sequence
agttgtaatacttaaattag

SEQ ID NO: 388179 - DNA, 20 bp, Artificial
  CRISPR gRNA sequence
taatacttaaattagaattt

SEQ ID NO: 388180 - DNA, 20 bp, Artificial
  CRISPR gRNA sequence
aaattagaatttctattaag

SEQ ID NO: 388181 - DNA, 20 bp, Artificial
  CRISPR gRNA sequence
aattagaatttctattaaga

SEQ ID NO: 388182 - DNA, 20 bp, Artificial
  CRISPR gRNA sequence
gaatttctattaagaatgaa

SEQ ID NO: 388183 - DNA, 20 bp, Artificial
  CRISPR gRNA sequence
ctattaagaatgaaatgcta

SEQ ID NO: 388184 - DNA, 20 bp, Artificial
  CRISPR gRNA sequence
tattaagaatgaaatgctat

SEQ ID NO: 388185 - DNA, 20 bp, Artificial
  CRISPR gRNA sequence
ttaagaatgaaatgctatta

SEQ ID NO: 388186 - DNA, 20 bp, Artificial
  CRISPR gRNA sequence
agaatgaaatgctattaatc

SEQ ID NO: 388187 - DNA, 20 bp, Artificial
  CRISPR gRNA sequence
ttaatcttataagaataact

SEQ ID NO: 388188 - DNA, 20 bp, Artificial
  CRISPR gRNA sequence
atcttataagaataacttat

SEQ ID NO: 388189 - DNA, 20 bp, Artificial
  CRISPR gRNA sequence
ataagaataacttattttac

SEQ ID NO: 388190 - DNA, 20 bp, Artificial
  CRISPR gRNA sequence
taagaataacttattttaca

SEQ ID NO: 388191 - DNA, 20 bp, Artificial
  CRISPR gRNA sequence
attttacattttaagtaatt

SEQ ID NO: 388192 - DNA, 20 bp, Artificial
  CRISPR gRNA sequence
ttttacattttaagtaattt

SEQ ID NO: 388193 - DNA, 20 bp, Artificial
  CRISPR gRNA sequence
tacattttaagtaattttct

SEQ ID NO: 388194 - DNA, 20 bp, Artificial
  CRISPR gRNA sequence
acattttaagtaattttcta

SEQ ID NO: 388195 - DNA, 20 bp, Artificial
  CRISPR gRNA sequence
cattttaagtaattttctac

SEQ ID NO: 388196 - DNA, 20 bp, Artificial
  CRISPR gRNA sequence
taagtaattttctacttgct

SEQ ID NO: 388197 - DNA, 20 bp, Artificial
  CRISPR gRNA sequence
aagtaattttctacttgctt

SEQ ID NO: 388198 - DNA, 20 bp, Artificial
  CRISPR gRNA sequence
agtaattttctacttgcttt

SEQ ID NO: 388199 - DNA, 20 bp, Artificial
  CRISPR gRNA sequence
tctacttgcttttggagaaa

SEQ ID NO: 388200 - DNA, 20 bp, Artificial
  CRISPR gRNA sequence
ctacttgcttttggagaaat

SEQ ID NO: 388201 - DNA, 20 bp, Artificial
  CRISPR gRNA sequence
tacttgcttttggagaaatc

SEQ ID NO: 388202 - DNA, 20 bp, Artificial
  CRISPR gRNA sequence
cttgcttttggagaaatctt

SEQ ID NO: 388203 - DNA, 20 bp, Artificial
  CRISPR gRNA sequence
gcttttggagaaatctttga

SEQ ID NO: 388204 - DNA, 20 bp, Artificial
  CRISPR gRNA sequence
cttttggagaaatctttgat

SEQ ID NO: 388205 - DNA, 20 bp, Artificial
  CRISPR gRNA sequence
ttggagaaatctttgatcaa

SEQ ID NO: 388206 - DNA, 20 bp, Artificial
  CRISPR gRNA sequence
tggagaaatctttgatcaat

SEQ ID NO: 388207 - DNA, 20 bp, Artificial
  CRISPR gRNA sequence
ggagaaatctttgatcaatc

SEQ ID NO: 388208 - DNA, 20 bp, Artificial
  CRISPR gRNA sequence
gagaaatctttgatcaatca

SEQ ID NO: 388209 - DNA, 20 bp, Artificial
  CRISPR gRNA sequence
tgatcaatcatttatgttca

SEQ ID NO: 388210 - DNA, 20 bp, Artificial
  CRISPR gRNA sequence
gatcaatcatttatgttcag

SEQ ID NO: 388211 - DNA, 20 bp, Artificial
  CRISPR gRNA sequence
atcaatcatttatgttcagt

SEQ ID NO: 388212 - DNA, 20 bp, Artificial
  CRISPR gRNA sequence
atgttcagtttttaataagg

SEQ ID NO: 388213 - DNA, 20 bp, Artificial
  CRISPR gRNA sequence
tgttcagtttttaataaggc

SEQ ID NO: 388214 - DNA, 20 bp, Artificial
  CRISPR gRNA sequence
agtttttaataaggctctaa

SEQ ID NO: 388215 - DNA, 20 bp, Artificial
  CRISPR gRNA sequence
ttaataaggctctaagagac

SEQ ID NO: 388216 - DNA, 20 bp, Artificial
  CRISPR gRNA sequence
taataaggctctaagagaca

SEQ ID NO: 388217 - DNA, 20 bp, Artificial
  CRISPR gRNA sequence
aataaggctctaagagacaa

SEQ ID NO: 388218 - DNA, 20 bp, Artificial
  CRISPR gRNA sequence
ataaggctctaagagacaac

SEQ ID NO: 388219 - DNA, 20 bp, Artificial
  CRISPR gRNA sequence
taagagacaacctcaagctg

SEQ ID NO: 388220 - DNA, 20 bp, Artificial
  CRISPR gRNA sequence
agagacaacctcaagctgtt

SEQ ID NO: 388221 - DNA, 20 bp, Artificial
  CRISPR gRNA sequence
aagctgttaacaattcccag

SEQ ID NO: 388222 - DNA, 20 bp, Artificial
  CRISPR gRNA sequence
ttaacaattcccaggtgctt

SEQ ID NO: 388223 - DNA, 20 bp, Artificial
  CRISPR gRNA sequence
acaattcccaggtgctttta

SEQ ID NO: 388224 - DNA, 20 bp, Artificial
  CRISPR gRNA sequence
ccaggtgcttttagaatgta

SEQ ID NO: 388225 - DNA, 20 bp, Artificial
  CRISPR gRNA sequence
ttagaatgtaaattccatat

SEQ ID NO: 388226 - DNA, 20 bp, Artificial
  CRISPR gRNA sequence
tagaatgtaaattccatata

SEQ ID NO: 388227 - DNA, 20 bp, Artificial
  CRISPR gRNA sequence
agaatgtaaattccatatac

SEQ ID NO: 388228 - DNA, 20 bp, Artificial
  CRISPR gRNA sequence
gaatgtaaattccatatacg

SEQ ID NO: 388229 - DNA, 20 bp, Artificial
  CRISPR gRNA sequence
catatacgacaataaagtat

SEQ ID NO: 388230 - DNA, 20 bp, Artificial
  CRISPR gRNA sequence
tttcacagtcagagtcattt

SEQ ID NO: 388231 - DNA, 20 bp, Artificial
  CRISPR gRNA sequence
cacagtcagagtcatttgaa

SEQ ID NO: 388232 - DNA, 20 bp, Artificial
  CRISPR gRNA sequence
acagtcagagtcatttgaaa

SEQ ID NO: 388233 - DNA, 20 bp, Artificial
  CRISPR gRNA sequence
gaaaggtctcaaataaatgt

SEQ ID NO: 388234 - DNA, 20 bp, Artificial
  CRISPR gRNA sequence
aaaggtctcaaataaatgta

SEQ ID NO: 388235 - DNA, 20 bp, Artificial
  CRISPR gRNA sequence
aaataaatgtagccatgcac

SEQ ID NO: 388236 - DNA, 20 bp, Artificial
  CRISPR gRNA sequence
actatttttttcctttctct

SEQ ID NO: 388237 - DNA, 20 bp, Artificial
  CRISPR gRNA sequence
tttttttcctttctcttttt

SEQ ID NO: 388238 - DNA, 20 bp, Artificial
  CRISPR gRNA sequence
ttttcctttctctttttttt

SEQ ID NO: 388239 - DNA, 20 bp, Artificial
  CRISPR gRNA sequence
tttcctttctcttttttttt

SEQ ID NO: 388240 - DNA, 20 bp, Artificial
  CRISPR gRNA sequence
ttcctttctctttttttttt

SEQ ID NO: 388241 - DNA, 20 bp, Artificial
  CRISPR gRNA sequence
tcctttctcttttttttttt

SEQ ID NO: 388242 - DNA, 20 bp, Artificial
  CRISPR gRNA sequence
cctttctctttttttttttt

SEQ ID NO: 388243 - DNA, 20 bp, Artificial
  CRISPR gRNA sequence
ctttctcttttttttttttt

SEQ ID NO: 388244 - DNA, 20 bp, Artificial
  CRISPR gRNA sequence
tctctttttttttttttttt

SEQ ID NO: 388245 - DNA, 20 bp, Artificial
  CRISPR gRNA sequence
ctcttttttttttttttttt

SEQ ID NO: 388246 - DNA, 20 bp, Artificial
  CRISPR gRNA sequence
tctttttttttttttttttt

SEQ ID NO: 388247 - DNA, 20 bp, Artificial
  CRISPR gRNA sequence
tttttttttttttttttttg

SEQ ID NO: 388248 - DNA, 20 bp, Artificial
  CRISPR gRNA sequence
tttttttttttttttttgga

SEQ ID NO: 388249 - DNA, 20 bp, Artificial
  CRISPR gRNA sequence
ttttttttttttttttggag

SEQ ID NO: 388250 - DNA, 20 bp, Artificial
  CRISPR gRNA sequence
tttttttttttttttggaga

SEQ ID NO: 388251 - DNA, 20 bp, Artificial
  CRISPR gRNA sequence
ttttttttttttttggagac

SEQ ID NO: 388252 - DNA, 20 bp, Artificial
  CRISPR gRNA sequence
tttttttttttttggagaca

SEQ ID NO: 388253 - DNA, 20 bp, Artificial
  CRISPR gRNA sequence
ttttttttttttggagacag

SEQ ID NO: 388254 - DNA, 20 bp, Artificial
  CRISPR gRNA sequence
tttttttttttggagacagg

SEQ ID NO: 388255 - DNA, 20 bp, Artificial
  CRISPR gRNA sequence
ttttttttttggagacaggt

SEQ ID NO: 388256 - DNA, 20 bp, Artificial
  CRISPR gRNA sequence
tttttttttggagacaggtt

SEQ ID NO: 388257 - DNA, 20 bp, Artificial
  CRISPR gRNA sequence
ttttttttggagacaggttc

SEQ ID NO: 388258 - DNA, 20 bp, Artificial
  CRISPR gRNA sequence
tttttttggagacaggttct

SEQ ID NO: 388259 - DNA, 20 bp, Artificial
  CRISPR gRNA sequence
ttttttggagacaggttctg

SEQ ID NO: 388260 - DNA, 20 bp, Artificial
  CRISPR gRNA sequence
tttttggagacaggttctgg

SEQ ID NO: 388261 - DNA, 20 bp, Artificial
  CRISPR gRNA sequence
ttttggagacaggttctggc

SEQ ID NO: 388262 - DNA, 20 bp, Artificial
  CRISPR gRNA sequence
tttggagacaggttctggct

SEQ ID NO: 388263 - DNA, 20 bp, Artificial
  CRISPR gRNA sequence
ttggagacaggttctggctc

SEQ ID NO: 388264 - DNA, 20 bp, Artificial
  CRISPR gRNA sequence
tggagacaggttctggctct

SEQ ID NO: 388265 - DNA, 20 bp, Artificial
  CRISPR gRNA sequence
ggagacaggttctggctctg

SEQ ID NO: 388266 - DNA, 20 bp, Artificial
  CRISPR gRNA sequence
gagacaggttctggctctgt

SEQ ID NO: 388267 - DNA, 20 bp, Artificial
  CRISPR gRNA sequence
tggctctgttgcccaggctg

SEQ ID NO: 388268 - DNA, 20 bp, Artificial
  CRISPR gRNA sequence
gctctgttgcccaggctgca

SEQ ID NO: 388269 - DNA, 20 bp, Artificial
  CRISPR gRNA sequence
tgttgcccaggctgcagtgc

SEQ ID NO: 388270 - DNA, 20 bp, Artificial
  CRISPR gRNA sequence
ttgcccaggctgcagtgcaa

SEQ ID NO: 388271 - DNA, 20 bp, Artificial
  CRISPR gRNA sequence
cccaggctgcagtgcaatgg

SEQ ID NO: 388272 - DNA, 20 bp, Artificial
  CRISPR gRNA sequence
cagtgcaatggtgcagtcat

SEQ ID NO: 388273 - DNA, 20 bp, Artificial
  CRISPR gRNA sequence
actgcagccactaattcttg

SEQ ID NO: 388274 - DNA, 20 bp, Artificial
  CRISPR gRNA sequence
cagccactaattcttgggct

SEQ ID NO: 388275 - DNA, 20 bp, Artificial
  CRISPR gRNA sequence
attcttgggctcaaggactc

SEQ ID NO: 388276 - DNA, 20 bp, Artificial
  CRISPR gRNA sequence
ttgggctcaaggactcctac

SEQ ID NO: 388277 - DNA, 20 bp, Artificial
  CRISPR gRNA sequence
gggctcaaggactcctaccg

SEQ ID NO: 388278 - DNA, 20 bp, Artificial
  CRISPR gRNA sequence
ggctcaaggactcctaccgc

SEQ ID NO: 388279 - DNA, 20 bp, Artificial
  CRISPR gRNA sequence
aaggactcctaccgcctcag

SEQ ID NO: 388280 - DNA, 20 bp, Artificial
  CRISPR gRNA sequence
ctaccgcctcagcctcccaa

SEQ ID NO: 388281 - DNA, 20 bp, Artificial
  CRISPR gRNA sequence
ccgcctcagcctcccaaagc

SEQ ID NO: 388282 - DNA, 20 bp, Artificial
  CRISPR gRNA sequence
agcctcccaaagcaccatgt

SEQ ID NO: 388283 - DNA, 20 bp, Artificial
  CRISPR gRNA sequence
ccaaagcaccatgtgtgaat

SEQ ID NO: 388284 - DNA, 20 bp, Artificial
  CRISPR gRNA sequence
taagtaggaagaaaatcagt

SEQ ID NO: 388285 - DNA, 20 bp, Artificial
  CRISPR gRNA sequence
aagtaggaagaaaatcagta

SEQ ID NO: 388286 - DNA, 20 bp, Artificial
  CRISPR gRNA sequence
agtaggaagaaaatcagtac

SEQ ID NO: 388287 - DNA, 20 bp, Artificial
  CRISPR gRNA sequence
gtctgaatgtgaatcctgac

SEQ ID NO: 388288 - DNA, 20 bp, Artificial
  CRISPR gRNA sequence
tctgaatgtgaatcctgact

SEQ ID NO: 388289 - DNA, 20 bp, Artificial
  CRISPR gRNA sequence
aatgtgaatcctgacttgta

SEQ ID NO: 388290 - DNA, 20 bp, Artificial
  CRISPR gRNA sequence
acttgtagtctaagttccca

SEQ ID NO: 388291 - DNA, 20 bp, Artificial
  CRISPR gRNA sequence
gtagtctaagttcccaggga

SEQ ID NO: 388292 - DNA, 20 bp, Artificial
  CRISPR gRNA sequence
tagtctaagttcccagggag

SEQ ID NO: 388293 - DNA, 20 bp, Artificial
  CRISPR gRNA sequence
agttcccagggagagaaaaa

SEQ ID NO: 388294 - DNA, 20 bp, Artificial
  CRISPR gRNA sequence
ccagggagagaaaaacttta

SEQ ID NO: 388295 - DNA, 20 bp, Artificial
  CRISPR gRNA sequence
tatgaaaagagttgaaaatt

SEQ ID NO: 388296 - DNA, 20 bp, Artificial
  CRISPR gRNA sequence
atgaaaagagttgaaaattc

SEQ ID NO: 388297 - DNA, 20 bp, Artificial
  CRISPR gRNA sequence
tgaaaagagttgaaaattca

SEQ ID NO: 388298 - DNA, 20 bp, Artificial
  CRISPR gRNA sequence
aaaattcaatcagaagataa

SEQ ID NO: 388299 - DNA, 20 bp, Artificial
  CRISPR gRNA sequence
aatcagaagataaaggtcca

SEQ ID NO: 388300 - DNA, 20 bp, Artificial
  CRISPR gRNA sequence
tagaacagcagttcctagga

SEQ ID NO: 388301 - DNA, 20 bp, Artificial
  CRISPR gRNA sequence
ctaggatcaactgctttcta

SEQ ID NO: 388302 - DNA, 20 bp, Artificial
  CRISPR gRNA sequence
ggatcaactgctttctaatt

SEQ ID NO: 388303 - DNA, 20 bp, Artificial
  CRISPR gRNA sequence
ctttctaattctacaaactt

SEQ ID NO: 388304 - DNA, 20 bp, Artificial
  CRISPR gRNA sequence
tctaattctacaaacttgca

SEQ ID NO: 388305 - DNA, 20 bp, Artificial
  CRISPR gRNA sequence
ctaattctacaaacttgcat

SEQ ID NO: 388306 - DNA, 20 bp, Artificial
  CRISPR gRNA sequence
taattctacaaacttgcatt

SEQ ID NO: 388307 - DNA, 20 bp, Artificial
  CRISPR gRNA sequence
attctacaaacttgcattgt

SEQ ID NO: 388308 - DNA, 20 bp, Artificial
  CRISPR gRNA sequence
tacaaacttgcattgtttat

SEQ ID NO: 388309 - DNA, 20 bp, Artificial
  CRISPR gRNA sequence
caaacttgcattgtttatag

SEQ ID NO: 388310 - DNA, 20 bp, Artificial
  CRISPR gRNA sequence
gcattgtttatagtggtgtt

SEQ ID NO: 388311 - DNA, 20 bp, Artificial
  CRISPR gRNA sequence
cattgtttatagtggtgttc

SEQ ID NO: 388312 - DNA, 20 bp, Artificial
  CRISPR gRNA sequence
tttatagtggtgttctgtta

SEQ ID NO: 388313 - DNA, 20 bp, Artificial
  CRISPR gRNA sequence
atagtggtgttctgttagaa

SEQ ID NO: 388314 - DNA, 20 bp, Artificial
  CRISPR gRNA sequence
tagtggtgttctgttagaac

SEQ ID NO: 388315 - DNA, 20 bp, Artificial
  CRISPR gRNA sequence
tgttagaacttgctttatgt

SEQ ID NO: 388316 - DNA, 20 bp, Artificial
  CRISPR gRNA sequence
ttagaacttgctttatgtac

SEQ ID NO: 388317 - DNA, 20 bp, Artificial
  CRISPR gRNA sequence
gaacttgctttatgtacatg

SEQ ID NO: 388318 - DNA, 20 bp, Artificial
  CRISPR gRNA sequence
gctttatgtacatgaggtag

SEQ ID NO: 388319 - DNA, 20 bp, Artificial
  CRISPR gRNA sequence
ctttatgtacatgaggtagc

SEQ ID NO: 388320 - DNA, 20 bp, Artificial
  CRISPR gRNA sequence
tatgtacatgaggtagcaat

SEQ ID NO: 388321 - DNA, 20 bp, Artificial
  CRISPR gRNA sequence
atgtacatgaggtagcaatg

SEQ ID NO: 388322 - DNA, 20 bp, Artificial
  CRISPR gRNA sequence
tgtacatgaggtagcaatgt

SEQ ID NO: 388323 - DNA, 20 bp, Artificial
  CRISPR gRNA sequence
ttcaatataatagtgtcatc

SEQ ID NO: 388324 - DNA, 20 bp, Artificial
  CRISPR gRNA sequence
caatataatagtgtcatcag

SEQ ID NO: 388325 - DNA, 20 bp, Artificial
  CRISPR gRNA sequence
aatataatagtgtcatcaga

SEQ ID NO: 388326 - DNA, 20 bp, Artificial
  CRISPR gRNA sequence
agcatgtaaccttttagagt

SEQ ID NO: 388327 - DNA, 20 bp, Artificial
  CRISPR gRNA sequence
ttagagtttcattccctctg

SEQ ID NO: 388328 - DNA, 20 bp, Artificial
  CRISPR gRNA sequence
tagagtttcattccctctga

SEQ ID NO: 388329 - DNA, 20 bp, Artificial
  CRISPR gRNA sequence
agagtttcattccctctgac

SEQ ID NO: 388330 - DNA, 20 bp, Artificial
  CRISPR gRNA sequence
gagtttcattccctctgaca

SEQ ID NO: 388331 - DNA, 20 bp, Artificial
  CRISPR gRNA sequence
cattccctctgacaataact

SEQ ID NO: 388332 - DNA, 20 bp, Artificial
  CRISPR gRNA sequence
attccctctgacaataactt

SEQ ID NO: 388333 - DNA, 20 bp, Artificial
  CRISPR gRNA sequence
cctctgacaataacttatca

SEQ ID NO: 388334 - DNA, 20 bp, Artificial
  CRISPR gRNA sequence
tgacaataacttatcactat

SEQ ID NO: 388335 - DNA, 20 bp, Artificial
  CRISPR gRNA sequence
acaataacttatcactatta

SEQ ID NO: 388336 - DNA, 20 bp, Artificial
  CRISPR gRNA sequence
atcactattattcaatatct

SEQ ID NO: 388337 - DNA, 20 bp, Artificial
  CRISPR gRNA sequence
tcactattattcaatatctt

SEQ ID NO: 388338 - DNA, 20 bp, Artificial
  CRISPR gRNA sequence
ttattcaatatcttacttat

SEQ ID NO: 388339 - DNA, 20 bp, Artificial
  CRISPR gRNA sequence
ttcaatatcttacttatcta

SEQ ID NO: 388340 - DNA, 20 bp, Artificial
  CRISPR gRNA sequence
aatatcttacttatctatac

SEQ ID NO: 388341 - DNA, 20 bp, Artificial
  CRISPR gRNA sequence
acttatctatacaataatag

SEQ ID NO: 388342 - DNA, 20 bp, Artificial
  CRISPR gRNA sequence
cttatctatacaataatagt

SEQ ID NO: 388343 - DNA, 20 bp, Artificial
  CRISPR gRNA sequence
atctatacaataatagtatg

SEQ ID NO: 388344 - DNA, 20 bp, Artificial
  CRISPR gRNA sequence
tctatacaataatagtatgt

SEQ ID NO: 388345 - DNA, 20 bp, Artificial
  CRISPR gRNA sequence
tacaataatagtatgtataa

SEQ ID NO: 388346 - DNA, 20 bp, Artificial
  CRISPR gRNA sequence
caggcaaacattctaggttt

SEQ ID NO: 388347 - DNA, 20 bp, Artificial
  CRISPR gRNA sequence
taggtttttgtgtgttcaaa

SEQ ID NO: 388348 - DNA, 20 bp, Artificial
  CRISPR gRNA sequence
ggtttttgtgtgttcaaaaa

SEQ ID NO: 388349 - DNA, 20 bp, Artificial
  CRISPR gRNA sequence
ttgtgtgttcaaaaaatgaa

SEQ ID NO: 388350 - DNA, 20 bp, Artificial
  CRISPR gRNA sequence
tgtgtgttcaaaaaatgaat

SEQ ID NO: 388351 - DNA, 20 bp, Artificial
  CRISPR gRNA sequence
gtgtgttcaaaaaatgaata

SEQ ID NO: 388352 - DNA, 20 bp, Artificial
  CRISPR gRNA sequence
tgtgttcaaaaaatgaatag

SEQ ID NO: 388353 - DNA, 20 bp, Artificial
  CRISPR gRNA sequence
aaaaaatgaatagatcaata

SEQ ID NO: 388354 - DNA, 20 bp, Artificial
  CRISPR gRNA sequence
gggcttacaaaacaaattaa

SEQ ID NO: 388355 - DNA, 20 bp, Artificial
  CRISPR gRNA sequence
acaaaacaaattaactgacc

SEQ ID NO: 388356 - DNA, 20 bp, Artificial
  CRISPR gRNA sequence
caaaacaaattaactgaccg

SEQ ID NO: 388357 - DNA, 20 bp, Artificial
  CRISPR gRNA sequence
actgaccggttgcatttttt

SEQ ID NO: 388358 - DNA, 20 bp, Artificial
  CRISPR gRNA sequence
accggttgcatttttttgaa

SEQ ID NO: 388359 - DNA, 20 bp, Artificial
  CRISPR gRNA sequence
catttttttgaatgcaatag

SEQ ID NO: 388360 - DNA, 20 bp, Artificial
  CRISPR gRNA sequence
ttttgaatgcaatagatcat

SEQ ID NO: 388361 - DNA, 20 bp, Artificial
  CRISPR gRNA sequence
tttgaatgcaatagatcatt

SEQ ID NO: 388362 - DNA, 20 bp, Artificial
  CRISPR gRNA sequence
ttgaatgcaatagatcatta

SEQ ID NO: 388363 - DNA, 20 bp, Artificial
  CRISPR gRNA sequence
tgaatgcaatagatcattaa

SEQ ID NO: 388364 - DNA, 20 bp, Artificial
  CRISPR gRNA sequence
gaatgcaatagatcattaaa

SEQ ID NO: 388365 - DNA, 20 bp, Artificial
  CRISPR gRNA sequence
aatgcaatagatcattaaaa

SEQ ID NO: 388366 - DNA, 20 bp, Artificial
  CRISPR gRNA sequence
aaaaaaatgatctgggcaga

SEQ ID NO: 388367 - DNA, 20 bp, Artificial
  CRISPR gRNA sequence
ggcagaggcaacagtaaagt

SEQ ID NO: 388368 - DNA, 20 bp, Artificial
  CRISPR gRNA sequence
aaccacataatagccatgat

SEQ ID NO: 388369 - DNA, 20 bp, Artificial
  CRISPR gRNA sequence
agtaatcaactcacttgtga

SEQ ID NO: 388370 - DNA, 20 bp, Artificial
  CRISPR gRNA sequence
acttgtgatgctggaaacta

SEQ ID NO: 388371 - DNA, 20 bp, Artificial
  CRISPR gRNA sequence
gtgatgctggaaactatgtt

SEQ ID NO: 388372 - DNA, 20 bp, Artificial
  CRISPR gRNA sequence
tgatgctggaaactatgttt

SEQ ID NO: 388373 - DNA, 20 bp, Artificial
  CRISPR gRNA sequence
gaaactatgtttcatctgga

SEQ ID NO: 388374 - DNA, 20 bp, Artificial
  CRISPR gRNA sequence
tgtttcatctggatacccag

SEQ ID NO: 388375 - DNA, 20 bp, Artificial
  CRISPR gRNA sequence
catctggatacccagtttca

SEQ ID NO: 388376 - DNA, 20 bp, Artificial
  CRISPR gRNA sequence
atctggatacccagtttcac

SEQ ID NO: 388377 - DNA, 20 bp, Artificial
  CRISPR gRNA sequence
gatacccagtttcaccgaga

SEQ ID NO: 388378 - DNA, 20 bp, Artificial
  CRISPR gRNA sequence
caccgagaaaactaaattgg

SEQ ID NO: 388379 - DNA, 20 bp, Artificial
  CRISPR gRNA sequence
accgagaaaactaaattggg

SEQ ID NO: 388380 - DNA, 20 bp, Artificial
  CRISPR gRNA sequence
aattgggctgaaaattgtgg

SEQ ID NO: 388381 - DNA, 20 bp, Artificial
  CRISPR gRNA sequence
ggctgaaaattgtggttgat

SEQ ID NO: 388382 - DNA, 20 bp, Artificial
  CRISPR gRNA sequence
aaaattgtggttgatctgtt

SEQ ID NO: 388383 - DNA, 20 bp, Artificial
  CRISPR gRNA sequence
tggttgatctgtttgagtag

SEQ ID NO: 388384 - DNA, 20 bp, Artificial
  CRISPR gRNA sequence
atctgtttgagtagaggtta

SEQ ID NO: 388385 - DNA, 20 bp, Artificial
  CRISPR gRNA sequence
tttgagtagaggttatttta

SEQ ID NO: 388386 - DNA, 20 bp, Artificial
  CRISPR gRNA sequence
gagtagaggttattttagct

SEQ ID NO: 388387 - DNA, 20 bp, Artificial
  CRISPR gRNA sequence
agtagaggttattttagctt

SEQ ID NO: 388388 - DNA, 20 bp, Artificial
  CRISPR gRNA sequence
ttttagcttgtgagcagtga

SEQ ID NO: 388389 - DNA, 20 bp, Artificial
  CRISPR gRNA sequence
tagcttgtgagcagtgacac

SEQ ID NO: 388390 - DNA, 20 bp, Artificial
  CRISPR gRNA sequence
agcttgtgagcagtgacacg

SEQ ID NO: 388391 - DNA, 20 bp, Artificial
  CRISPR gRNA sequence
gcttgtgagcagtgacacgg

SEQ ID NO: 388392 - DNA, 20 bp, Artificial
  CRISPR gRNA sequence
gtgagcagtgacacggtgct

SEQ ID NO: 388393 - DNA, 20 bp, Artificial
  CRISPR gRNA sequence
tgagcagtgacacggtgctc

SEQ ID NO: 388394 - DNA, 20 bp, Artificial
  CRISPR gRNA sequence
tgggattctggtcgtgttgc

SEQ ID NO: 388395 - DNA, 20 bp, Artificial
  CRISPR gRNA sequence
ggattctggtcgtgttgctc

SEQ ID NO: 388396 - DNA, 20 bp, Artificial
  CRISPR gRNA sequence
tggtcgtgttgctccatcat

SEQ ID NO: 388397 - DNA, 20 bp, Artificial
  CRISPR gRNA sequence
gtcgtgttgctccatcatat

SEQ ID NO: 388398 - DNA, 20 bp, Artificial
  CRISPR gRNA sequence
ctccatcatataaattaact

SEQ ID NO: 388399 - DNA, 20 bp, Artificial
  CRISPR gRNA sequence
catcatataaattaactgtc

SEQ ID NO: 388400 - DNA, 20 bp, Artificial
  CRISPR gRNA sequence
actgtcatggacattttact

SEQ ID NO: 388401 - DNA, 20 bp, Artificial
  CRISPR gRNA sequence
tcatggacattttactttcc

SEQ ID NO: 388402 - DNA, 20 bp, Artificial
  CRISPR gRNA sequence
tactttccatgtaggtaaag

SEQ ID NO: 388403 - DNA, 20 bp, Artificial
  CRISPR gRNA sequence
actttccatgtaggtaaaga

SEQ ID NO: 388404 - DNA, 20 bp, Artificial
  CRISPR gRNA sequence
ctttccatgtaggtaaagat

SEQ ID NO: 388405 - DNA, 20 bp, Artificial
  CRISPR gRNA sequence
tccatgtaggtaaagataat

SEQ ID NO: 388406 - DNA, 20 bp, Artificial
  CRISPR gRNA sequence
ccatgtaggtaaagataata

SEQ ID NO: 388407 - DNA, 20 bp, Artificial
  CRISPR gRNA sequence
catgtaggtaaagataataa

SEQ ID NO: 388408 - DNA, 20 bp, Artificial
  CRISPR gRNA sequence
aggttcaccacacaatgtca

SEQ ID NO: 388409 - DNA, 20 bp, Artificial
  CRISPR gRNA sequence
accacacaatgtcatggaaa

SEQ ID NO: 388410 - DNA, 20 bp, Artificial
  CRISPR gRNA sequence
tcagcccagtgcacaccagt

SEQ ID NO: 388411 - DNA, 20 bp, Artificial
  CRISPR gRNA sequence
agacaatcctcatgtccaca

SEQ ID NO: 388412 - DNA, 20 bp, Artificial
  CRISPR gRNA sequence
atgtccacaagctttatatc

SEQ ID NO: 388413 - DNA, 20 bp, Artificial
  CRISPR gRNA sequence
tatatctattctaaattcat

SEQ ID NO: 388414 - DNA, 20 bp, Artificial
  CRISPR gRNA sequence
atatctattctaaattcata

SEQ ID NO: 388415 - DNA, 20 bp, Artificial
  CRISPR gRNA sequence
tatctattctaaattcatag

SEQ ID NO: 388416 - DNA, 20 bp, Artificial
  CRISPR gRNA sequence
ttctaaattcataggagtgg

SEQ ID NO: 388417 - DNA, 20 bp, Artificial
  CRISPR gRNA sequence
taaattcataggagtgggac

SEQ ID NO: 388418 - DNA, 20 bp, Artificial
  CRISPR gRNA sequence
aattcataggagtgggacag

SEQ ID NO: 388419 - DNA, 20 bp, Artificial
  CRISPR gRNA sequence
ataggagtgggacagaaggt

SEQ ID NO: 388420 - DNA, 20 bp, Artificial
  CRISPR gRNA sequence
tggattaatggaatccttaa

SEQ ID NO: 388421 - DNA, 20 bp, Artificial
  CRISPR gRNA sequence
gattaatggaatccttaaaa

SEQ ID NO: 388422 - DNA, 20 bp, Artificial
  CRISPR gRNA sequence
atggaatccttaaaaaaaaa

SEQ ID NO: 388423 - DNA, 20 bp, Artificial
  CRISPR gRNA sequence
aaaaaaaaaaaaaaactgtc

SEQ ID NO: 388424 - DNA, 20 bp, Artificial
  CRISPR gRNA sequence
aaaaaaaaaaaaaactgtct

SEQ ID NO: 388425 - DNA, 20 bp, Artificial
  CRISPR gRNA sequence
tcttgtctacaacctgaaac

SEQ ID NO: 388426 - DNA, 20 bp, Artificial
  CRISPR gRNA sequence
gtctacaacctgaaactctt

SEQ ID NO: 388427 - DNA, 20 bp, Artificial
  CRISPR gRNA sequence
tctacaacctgaaactcttc

SEQ ID NO: 388428 - DNA, 20 bp, Artificial
  CRISPR gRNA sequence
caacctgaaactcttctgga

SEQ ID NO: 388429 - DNA, 20 bp, Artificial
  CRISPR gRNA sequence
aaactcttctggaatccaaa

SEQ ID NO: 388430 - DNA, 20 bp, Artificial
  CRISPR gRNA sequence
ttctggaatccaaatggact

SEQ ID NO: 388431 - DNA, 20 bp, Artificial
  CRISPR gRNA sequence
ctggaatccaaatggactgg

SEQ ID NO: 388432 - DNA, 20 bp, Artificial
  CRISPR gRNA sequence
tggaatccaaatggactggg

SEQ ID NO: 388433 - DNA, 20 bp, Artificial
  CRISPR gRNA sequence
gaatccaaatggactgggag

SEQ ID NO: 388434 - DNA, 20 bp, Artificial
  CRISPR gRNA sequence
ggagcaaactggttggtttt

SEQ ID NO: 388435 - DNA, 20 bp, Artificial
  CRISPR gRNA sequence
gttggtttttgacagaaata

SEQ ID NO: 388436 - DNA, 20 bp, Artificial
  CRISPR gRNA sequence
gtttttgacagaaataaaag

SEQ ID NO: 388437 - DNA, 20 bp, Artificial
  CRISPR gRNA sequence
ttgacagaaataaaaggcca

SEQ ID NO: 388438 - DNA, 20 bp, Artificial
  CRISPR gRNA sequence
tgacagaaataaaaggccaa

SEQ ID NO: 388439 - DNA, 20 bp, Artificial
  CRISPR gRNA sequence
gacagaaataaaaggccaag

SEQ ID NO: 388440 - DNA, 20 bp, Artificial
  CRISPR gRNA sequence
acagaaataaaaggccaagg

SEQ ID NO: 388441 - DNA, 20 bp, Artificial
  CRISPR gRNA sequence
atttcctttcttcaataatt

SEQ ID NO: 388442 - DNA, 20 bp, Artificial
  CRISPR gRNA sequence
tttcctttcttcaataattt

SEQ ID NO: 388443 - DNA, 20 bp, Artificial
  CRISPR gRNA sequence
cctttcttcaataattttat

SEQ ID NO: 388444 - DNA, 20 bp, Artificial
  CRISPR gRNA sequence
ctttcttcaataattttata

SEQ ID NO: 388445 - DNA, 20 bp, Artificial
  CRISPR gRNA sequence
tcttcaataattttataatc

SEQ ID NO: 388446 - DNA, 20 bp, Artificial
  CRISPR gRNA sequence
cttcaataattttataatcc

SEQ ID NO: 388447 - DNA, 20 bp, Artificial
  CRISPR gRNA sequence
ttcaataattttataatcca

SEQ ID NO: 388448 - DNA, 20 bp, Artificial
  CRISPR gRNA sequence
caataattttataatccaac

SEQ ID NO: 388449 - DNA, 20 bp, Artificial
  CRISPR gRNA sequence
aataattttataatccaact

SEQ ID NO: 388450 - DNA, 20 bp, Artificial
  CRISPR gRNA sequence
tataatccaactcaggagca

SEQ ID NO: 388451 - DNA, 20 bp, Artificial
  CRISPR gRNA sequence
ataatccaactcaggagcac

SEQ ID NO: 388452 - DNA, 20 bp, Artificial
  CRISPR gRNA sequence
taatccaactcaggagcaca

SEQ ID NO: 388453 - DNA, 20 bp, Artificial
  CRISPR gRNA sequence
aggagcacagagtctcaaag

SEQ ID NO: 388454 - DNA, 20 bp, Artificial
  CRISPR gRNA sequence
aaagtcagtaacctcccaca

SEQ ID NO: 388455 - DNA, 20 bp, Artificial
  CRISPR gRNA sequence
ccacaagccatctacaggca

SEQ ID NO: 388456 - DNA, 20 bp, Artificial
  CRISPR gRNA sequence
caggcaagatttataatctg

SEQ ID NO: 388457 - DNA, 20 bp, Artificial
  CRISPR gRNA sequence
ataatctgtataaataagat

SEQ ID NO: 388458 - DNA, 20 bp, Artificial
  CRISPR gRNA sequence
taatctgtataaataagatg

SEQ ID NO: 388459 - DNA, 20 bp, Artificial
  CRISPR gRNA sequence
tataaataagatgtatcatc

SEQ ID NO: 388460 - DNA, 20 bp, Artificial
  CRISPR gRNA sequence
tatacggatgtatttataac

SEQ ID NO: 388461 - DNA, 20 bp, Artificial
  CRISPR gRNA sequence
ataacttacagcactctatt

SEQ ID NO: 388462 - DNA, 20 bp, Artificial
  CRISPR gRNA sequence
taacttacagcactctattc

SEQ ID NO: 388463 - DNA, 20 bp, Artificial
  CRISPR gRNA sequence
acagcactctattcccctgt

SEQ ID NO: 388464 - DNA, 20 bp, Artificial
  CRISPR gRNA sequence
cagcactctattcccctgtc

SEQ ID NO: 388465 - DNA, 20 bp, Artificial
  CRISPR gRNA sequence
tattcccctgtccttcctcc

SEQ ID NO: 388466 - DNA, 20 bp, Artificial
  CRISPR gRNA sequence
ttcccctgtccttcctcctt

SEQ ID NO: 388467 - DNA, 20 bp, Artificial
  CRISPR gRNA sequence
ccctgtccttcctccttgtc

SEQ ID NO: 388468 - DNA, 20 bp, Artificial
  CRISPR gRNA sequence
tccttcctccttgtcaatcc

SEQ ID NO: 388469 - DNA, 20 bp, Artificial
  CRISPR gRNA sequence
cctccttgtcaatcctatac

SEQ ID NO: 388470 - DNA, 20 bp, Artificial
  CRISPR gRNA sequence
ctccttgtcaatcctatacc

SEQ ID NO: 388471 - DNA, 20 bp, Artificial
  CRISPR gRNA sequence
cttgtcaatcctatacctca

SEQ ID NO: 388472 - DNA, 20 bp, Artificial
  CRISPR gRNA sequence
gtcaatcctatacctcacat

SEQ ID NO: 388473 - DNA, 20 bp, Artificial
  CRISPR gRNA sequence
tcaatcctatacctcacatc

SEQ ID NO: 388474 - DNA, 20 bp, Artificial
  CRISPR gRNA sequence
tacctcacatcgtcccagag

SEQ ID NO: 388475 - DNA, 20 bp, Artificial
  CRISPR gRNA sequence
acatcgtcccagaggaaata

SEQ ID NO: 388476 - DNA, 20 bp, Artificial
  CRISPR gRNA sequence
ggaagattctcttagctgtg

SEQ ID NO: 388477 - DNA, 20 bp, Artificial
  CRISPR gRNA sequence
tcttagctgtggcactatga

SEQ ID NO: 388478 - DNA, 20 bp, Artificial
  CRISPR gRNA sequence
ttagctgtggcactatgatt

SEQ ID NO: 388479 - DNA, 20 bp, Artificial
  CRISPR gRNA sequence
agctgtggcactatgatttc

SEQ ID NO: 388480 - DNA, 20 bp, Artificial
  CRISPR gRNA sequence
gctgtggcactatgatttcc

SEQ ID NO: 388481 - DNA, 20 bp, Artificial
  CRISPR gRNA sequence
tggcactatgatttcctagt

SEQ ID NO: 388482 - DNA, 20 bp, Artificial
  CRISPR gRNA sequence
tgatttcctagtgaatagtt

SEQ ID NO: 388483 - DNA, 20 bp, Artificial
  CRISPR gRNA sequence
cctagtgaatagttttgtaa

SEQ ID NO: 388484 - DNA, 20 bp, Artificial
  CRISPR gRNA sequence
ctagtgaatagttttgtaat

SEQ ID NO: 388485 - DNA, 20 bp, Artificial
  CRISPR gRNA sequence
gtgaatagttttgtaatctt

SEQ ID NO: 388486 - DNA, 20 bp, Artificial
  CRISPR gRNA sequence
tgtaatcttaatttactaat

SEQ ID NO: 388487 - DNA, 20 bp, Artificial
  CRISPR gRNA sequence
gtaatcttaatttactaatc

SEQ ID NO: 388488 - DNA, 20 bp, Artificial
  CRISPR gRNA sequence
taatcttaatttactaatcc

SEQ ID NO: 388489 - DNA, 20 bp, Artificial
  CRISPR gRNA sequence
aatttactaatcccatcctt

SEQ ID NO: 388490 - DNA, 20 bp, Artificial
  CRISPR gRNA sequence
atttactaatcccatccttc

SEQ ID NO: 388491 - DNA, 20 bp, Artificial
  CRISPR gRNA sequence
actaatcccatccttctatt

SEQ ID NO: 388492 - DNA, 20 bp, Artificial
  CRISPR gRNA sequence
ctaatcccatccttctattc

SEQ ID NO: 388493 - DNA, 20 bp, Artificial
  CRISPR gRNA sequence
atcccatccttctattcaga

SEQ ID NO: 388494 - DNA, 20 bp, Artificial
  CRISPR gRNA sequence
ctattcagatgaccagcaat

SEQ ID NO: 388495 - DNA, 20 bp, Artificial
  CRISPR gRNA sequence
tattcagatgaccagcaatt

SEQ ID NO: 388496 - DNA, 20 bp, Artificial
  CRISPR gRNA sequence
ttcagatgaccagcaattat

SEQ ID NO: 388497 - DNA, 20 bp, Artificial
  CRISPR gRNA sequence
agatgaccagcaattatgtg

SEQ ID NO: 388498 - DNA, 20 bp, Artificial
  CRISPR gRNA sequence
tgtgccacttatattaaaaa

SEQ ID NO: 388499 - DNA, 20 bp, Artificial
  CRISPR gRNA sequence
atattaaaaattcaaaataa

SEQ ID NO: 388500 - DNA, 20 bp, Artificial
  CRISPR gRNA sequence
tattaaaaattcaaaataag

SEQ ID NO: 388501 - DNA, 20 bp, Artificial
  CRISPR gRNA sequence
aaaattcaaaataagaaaat

SEQ ID NO: 388502 - DNA, 20 bp, Artificial
  CRISPR gRNA sequence
aaaataagaaaatgaaagtt

SEQ ID NO: 388503 - DNA, 20 bp, Artificial
  CRISPR gRNA sequence
aaaaagtaaatagccctatc

SEQ ID NO: 388504 - DNA, 20 bp, Artificial
  CRISPR gRNA sequence
tctgaaagttatatatgtaa

SEQ ID NO: 388505 - DNA, 20 bp, Artificial
  CRISPR gRNA sequence
aaagttatatatgtaaacaa

SEQ ID NO: 388506 - DNA, 20 bp, Artificial
  CRISPR gRNA sequence
tatatgtaaacaagagttca

SEQ ID NO: 388507 - DNA, 20 bp, Artificial
  CRISPR gRNA sequence
atgaaagttttttctccaat

SEQ ID NO: 388508 - DNA, 20 bp, Artificial
  CRISPR gRNA sequence
tttctccaatcactgtagtt

SEQ ID NO: 388509 - DNA, 20 bp, Artificial
  CRISPR gRNA sequence
ttctccaatcactgtagttg

SEQ ID NO: 388510 - DNA, 20 bp, Artificial
  CRISPR gRNA sequence
tctccaatcactgtagttga

SEQ ID NO: 388511 - DNA, 20 bp, Artificial
  CRISPR gRNA sequence
ctccaatcactgtagttgat

SEQ ID NO: 388512 - DNA, 20 bp, Artificial
  CRISPR gRNA sequence
tccaatcactgtagttgatc

SEQ ID NO: 388513 - DNA, 20 bp, Artificial
  CRISPR gRNA sequence
caatcactgtagttgatctt

SEQ ID NO: 388514 - DNA, 20 bp, Artificial
  CRISPR gRNA sequence
tagttgatcttttgaaagtt

SEQ ID NO: 388515 - DNA, 20 bp, Artificial
  CRISPR gRNA sequence
atcttttgaaagttcagttt

SEQ ID NO: 388516 - DNA, 20 bp, Artificial
  CRISPR gRNA sequence
ttgaaagttcagtttctttg

SEQ ID NO: 388517 - DNA, 20 bp, Artificial
  CRISPR gRNA sequence
tgaaagttcagtttctttga

SEQ ID NO: 388518 - DNA, 20 bp, Artificial
  CRISPR gRNA sequence
gaaagttcagtttctttgat

SEQ ID NO: 388519 - DNA, 20 bp, Artificial
  CRISPR gRNA sequence
aaagttcagtttctttgatc

SEQ ID NO: 388520 - DNA, 20 bp, Artificial
  CRISPR gRNA sequence
agtttctttgatcaacaatc

SEQ ID NO: 388521 - DNA, 20 bp, Artificial
  CRISPR gRNA sequence
ctttgatcaacaatcagtaa

SEQ ID NO: 388522 - DNA, 20 bp, Artificial
  CRISPR gRNA sequence
tttgatcaacaatcagtaaa

SEQ ID NO: 388523 - DNA, 20 bp, Artificial
  CRISPR gRNA sequence
tgatcaacaatcagtaaacc

SEQ ID NO: 388524 - DNA, 20 bp, Artificial
  CRISPR gRNA sequence
gatcaacaatcagtaaacct

SEQ ID NO: 388525 - DNA, 20 bp, Artificial
  CRISPR gRNA sequence
atcaacaatcagtaaacctc

SEQ ID NO: 388526 - DNA, 20 bp, Artificial
  CRISPR gRNA sequence
aaaggttaaacgttgaagaa

SEQ ID NO: 388527 - DNA, 20 bp, Artificial
  CRISPR gRNA sequence
aacgttgaagaaaaaaaatc

SEQ ID NO: 388528 - DNA, 20 bp, Artificial
  CRISPR gRNA sequence
aagaaaaaaaatctggaaag

SEQ ID NO: 388529 - DNA, 20 bp, Artificial
  CRISPR gRNA sequence
gaaagaaaagaggtagaaaa

SEQ ID NO: 388530 - DNA, 20 bp, Artificial
  CRISPR gRNA sequence
aaaattaaaatggacacagc

SEQ ID NO: 388531 - DNA, 20 bp, Artificial
  CRISPR gRNA sequence
aaattaaaatggacacagcc

SEQ ID NO: 388532 - DNA, 20 bp, Artificial
  CRISPR gRNA sequence
aaatggacacagcccctact

SEQ ID NO: 388533 - DNA, 20 bp, Artificial
  CRISPR gRNA sequence
ctagaatgaatagaaacatt

SEQ ID NO: 388534 - DNA, 20 bp, Artificial
  CRISPR gRNA sequence
gaatgaatagaaacattaac

SEQ ID NO: 388535 - DNA, 20 bp, Artificial
  CRISPR gRNA sequence
acataatcggtcaagaacac

SEQ ID NO: 388536 - DNA, 20 bp, Artificial
  CRISPR gRNA sequence
actgggcatattctgaaaag

SEQ ID NO: 388537 - DNA, 20 bp, Artificial
  CRISPR gRNA sequence
ctgggcatattctgaaaaga

SEQ ID NO: 388538 - DNA, 20 bp, Artificial
  CRISPR gRNA sequence
ggcatattctgaaaagatgc

SEQ ID NO: 388539 - DNA, 20 bp, Artificial
  CRISPR gRNA sequence
tgaaaagatgctttgacaac

SEQ ID NO: 388540 - DNA, 20 bp, Artificial
  CRISPR gRNA sequence
aaaagatgctttgacaactt

SEQ ID NO: 388541 - DNA, 20 bp, Artificial
  CRISPR gRNA sequence
tgacaactttaagcagatgc

SEQ ID NO: 388542 - DNA, 20 bp, Artificial
  CRISPR gRNA sequence
gacaactttaagcagatgcc

SEQ ID NO: 388543 - DNA, 20 bp, Artificial
  CRISPR gRNA sequence
acaactttaagcagatgcca

SEQ ID NO: 388544 - DNA, 20 bp, Artificial
  CRISPR gRNA sequence
taagcagatgccataatcct

SEQ ID NO: 388545 - DNA, 20 bp, Artificial
  CRISPR gRNA sequence
aagcagatgccataatcctt

SEQ ID NO: 388546 - DNA, 20 bp, Artificial
  CRISPR gRNA sequence
agcagatgccataatcctta

SEQ ID NO: 388547 - DNA, 20 bp, Artificial
  CRISPR gRNA sequence
aatctcaattaatttctgat

SEQ ID NO: 388548 - DNA, 20 bp, Artificial
  CRISPR gRNA sequence
atctcaattaatttctgata

SEQ ID NO: 388549 - DNA, 20 bp, Artificial
  CRISPR gRNA sequence
aattaatttctgataaccag

SEQ ID NO: 388550 - DNA, 20 bp, Artificial
  CRISPR gRNA sequence
atttctgataaccagagttt

SEQ ID NO: 388551 - DNA, 20 bp, Artificial
  CRISPR gRNA sequence
ctgataaccagagtttggaa

SEQ ID NO: 388552 - DNA, 20 bp, Artificial
  CRISPR gRNA sequence
tgataaccagagtttggaac

SEQ ID NO: 388553 - DNA, 20 bp, Artificial
  CRISPR gRNA sequence
ataaccagagtttggaacat

SEQ ID NO: 388554 - DNA, 20 bp, Artificial
  CRISPR gRNA sequence
ggaacattacaaatagatgc

SEQ ID NO: 388555 - DNA, 20 bp, Artificial
  CRISPR gRNA sequence
gaacattacaaatagatgca

SEQ ID NO: 388556 - DNA, 20 bp, Artificial
  CRISPR gRNA sequence
caaatagatgcaggccaggt

SEQ ID NO: 388557 - DNA, 20 bp, Artificial
  CRISPR gRNA sequence
acactaccaatcccagcact

SEQ ID NO: 388558 - DNA, 20 bp, Artificial
  CRISPR gRNA sequence
ccaatcccagcactttagga

SEQ ID NO: 388559 - DNA, 20 bp, Artificial
  CRISPR gRNA sequence
taggaggctgaggcagggga

SEQ ID NO: 388560 - DNA, 20 bp, Artificial
  CRISPR gRNA sequence
aggaggctgaggcaggggat

SEQ ID NO: 388561 - DNA, 20 bp, Artificial
  CRISPR gRNA sequence
ggaggctgaggcaggggatt

SEQ ID NO: 388562 - DNA, 20 bp, Artificial
  CRISPR gRNA sequence
aggcaggggattgcttgagc

SEQ ID NO: 388563 - DNA, 20 bp, Artificial
  CRISPR gRNA sequence
cttgagcccaggaccatcct

SEQ ID NO: 388564 - DNA, 20 bp, Artificial
  CRISPR gRNA sequence
gagcccaggaccatccttga

SEQ ID NO: 388565 - DNA, 20 bp, Artificial
  CRISPR gRNA sequence
agcccaggaccatccttgaa

SEQ ID NO: 388566 - DNA, 20 bp, Artificial
  CRISPR gRNA sequence
gaaaccccatctctaccaaa

SEQ ID NO: 388567 - DNA, 20 bp, Artificial
  CRISPR gRNA sequence
aaaccccatctctaccaaaa

SEQ ID NO: 388568 - DNA, 20 bp, Artificial
  CRISPR gRNA sequence
taccaaaaatacaaaaatta

SEQ ID NO: 388569 - DNA, 20 bp, Artificial
  CRISPR gRNA sequence
ccaaaaatacaaaaattagc

SEQ ID NO: 388570 - DNA, 20 bp, Artificial
  CRISPR gRNA sequence
gccagtctcataacccggtc

SEQ ID NO: 388571 - DNA, 20 bp, Artificial
  CRISPR gRNA sequence
ataacccggtctcaaaaaat

SEQ ID NO: 388572 - DNA, 20 bp, Artificial
  CRISPR gRNA sequence
aaaaaataaataaataaata

SEQ ID NO: 388573 - DNA, 20 bp, Artificial
  CRISPR gRNA sequence
ataagtcactcgagggtagc

SEQ ID NO: 388574 - DNA, 20 bp, Artificial
  CRISPR gRNA sequence
gagggtagcaattttcagac

SEQ ID NO: 388575 - DNA, 20 bp, Artificial
  CRISPR gRNA sequence
tcagactataaaagtttgag

SEQ ID NO: 388576 - DNA, 20 bp, Artificial
  CRISPR gRNA sequence
cagactataaaagtttgaga

SEQ ID NO: 388577 - DNA, 20 bp, Artificial
  CRISPR gRNA sequence
agactataaaagtttgagaa

SEQ ID NO: 388578 - DNA, 20 bp, Artificial
  CRISPR gRNA sequence
taaaagtttgagaaatccaa

SEQ ID NO: 388579 - DNA, 20 bp, Artificial
  CRISPR gRNA sequence
gagaaatccaagatgcttaa

SEQ ID NO: 388580 - DNA, 20 bp, Artificial
  CRISPR gRNA sequence
agaaatccaagatgcttaat

SEQ ID NO: 388581 - DNA, 20 bp, Artificial
  CRISPR gRNA sequence
aatatttcaatgatggggaa

SEQ ID NO: 388582 - DNA, 20 bp, Artificial
  CRISPR gRNA sequence
atatttcaatgatggggaag

SEQ ID NO: 388583 - DNA, 20 bp, Artificial
  CRISPR gRNA sequence
caatgatggggaagcagttt

SEQ ID NO: 388584 - DNA, 20 bp, Artificial
  CRISPR gRNA sequence
aatgatggggaagcagtttg

SEQ ID NO: 388585 - DNA, 20 bp, Artificial
  CRISPR gRNA sequence
ggtctgatgtggaaaaaaac

SEQ ID NO: 388586 - DNA, 20 bp, Artificial
  CRISPR gRNA sequence
gtctgatgtggaaaaaaaca

SEQ ID NO: 388587 - DNA, 20 bp, Artificial
  CRISPR gRNA sequence
atgtggaaaaaaacatagac

SEQ ID NO: 388588 - DNA, 20 bp, Artificial
  CRISPR gRNA sequence
agacggctgaaactctatag

SEQ ID NO: 388589 - DNA, 20 bp, Artificial
  CRISPR gRNA sequence
aaactctataggaaagaaag

SEQ ID NO: 388590 - DNA, 20 bp, Artificial
  CRISPR gRNA sequence
tataggaaagaaagcaaatg

SEQ ID NO: 388591 - DNA, 20 bp, Artificial
  CRISPR gRNA sequence
taggaaagaaagcaaatgtg

SEQ ID NO: 388592 - DNA, 20 bp, Artificial
  CRISPR gRNA sequence
agtcagttagaaaaaggaga

SEQ ID NO: 388593 - DNA, 20 bp, Artificial
  CRISPR gRNA sequence
gtcagttagaaaaaggagaa

SEQ ID NO: 388594 - DNA, 20 bp, Artificial
  CRISPR gRNA sequence
gaaaaaggagaaagtaggaa

SEQ ID NO: 388595 - DNA, 20 bp, Artificial
  CRISPR gRNA sequence
tgaggcagtggaaagcacaa

SEQ ID NO: 388596 - DNA, 20 bp, Artificial
  CRISPR gRNA sequence
gaggcagtggaaagcacaaa

SEQ ID NO: 388597 - DNA, 20 bp, Artificial
  CRISPR gRNA sequence
aggcagtggaaagcacaaac

SEQ ID NO: 388598 - DNA, 20 bp, Artificial
  CRISPR gRNA sequence
agattcaaatcatgctgaca

SEQ ID NO: 388599 - DNA, 20 bp, Artificial
  CRISPR gRNA sequence
aaatcatgctgacagtatct

SEQ ID NO: 388600 - DNA, 20 bp, Artificial
  CRISPR gRNA sequence
acagtatctctctaccctgt

SEQ ID NO: 388601 - DNA, 20 bp, Artificial
  CRISPR gRNA sequence
tctaccctgtgtaggacacc

SEQ ID NO: 388602 - DNA, 20 bp, Artificial
  CRISPR gRNA sequence
taccctgtgtaggacacctt

SEQ ID NO: 388603 - DNA, 20 bp, Artificial
  CRISPR gRNA sequence
ccctgtgtaggacacctttg

SEQ ID NO: 388604 - DNA, 20 bp, Artificial
  CRISPR gRNA sequence
tgtaggacacctttgtgcct

SEQ ID NO: 388605 - DNA, 20 bp, Artificial
  CRISPR gRNA sequence
tgtgcctacaaaggtaggtg

SEQ ID NO: 388606 - DNA, 20 bp, Artificial
  CRISPR gRNA sequence
gtgcctacaaaggtaggtgg

SEQ ID NO: 388607 - DNA, 20 bp, Artificial
  CRISPR gRNA sequence
tgcctacaaaggtaggtgga

SEQ ID NO: 388608 - DNA, 20 bp, Artificial
  CRISPR gRNA sequence
caaaggtaggtggatcagtg

SEQ ID NO: 388609 - DNA, 20 bp, Artificial
  CRISPR gRNA sequence
tgacccatcactgatcccag

SEQ ID NO: 388610 - DNA, 20 bp, Artificial
  CRISPR gRNA sequence
atcccaggaccaggtggctt

SEQ ID NO: 388611 - DNA, 20 bp, Artificial
  CRISPR gRNA sequence
cacagatgaattctatcaaa

SEQ ID NO: 388612 - DNA, 20 bp, Artificial
  CRISPR gRNA sequence
acagatgaattctatcaaac

SEQ ID NO: 388613 - DNA, 20 bp, Artificial
  CRISPR gRNA sequence
tatcaaacattctaggaatt

SEQ ID NO: 388614 - DNA, 20 bp, Artificial
  CRISPR gRNA sequence
tcaaacattctaggaattaa

SEQ ID NO: 388615 - DNA, 20 bp, Artificial
  CRISPR gRNA sequence
taggaattaatgccaatcct

SEQ ID NO: 388616 - DNA, 20 bp, Artificial
  CRISPR gRNA sequence
ggaattaatgccaatcctga

SEQ ID NO: 388617 - DNA, 20 bp, Artificial
  CRISPR gRNA sequence
atgccaatcctgagtttaga

SEQ ID NO: 388618 - DNA, 20 bp, Artificial
  CRISPR gRNA sequence
agtttagaaacagttctaca

SEQ ID NO: 388619 - DNA, 20 bp, Artificial
  CRISPR gRNA sequence
agaaacagttctacattatc

SEQ ID NO: 388620 - DNA, 20 bp, Artificial
  CRISPR gRNA sequence
gaaacagttctacattatca

SEQ ID NO: 388621 - DNA, 20 bp, Artificial
  CRISPR gRNA sequence
tacattatcatgtgtaatca

SEQ ID NO: 388622 - DNA, 20 bp, Artificial
  CRISPR gRNA sequence
cattatcatgtgtaatcaat

SEQ ID NO: 388623 - DNA, 20 bp, Artificial
  CRISPR gRNA sequence
tcatgtgtaatcaataaatg

SEQ ID NO: 388624 - DNA, 20 bp, Artificial
  CRISPR gRNA sequence
aattcttttttaaaaaaaga

SEQ ID NO: 388625 - DNA, 20 bp, Artificial
  CRISPR gRNA sequence
attcttttttaaaaaaagaa

SEQ ID NO: 388626 - DNA, 20 bp, Artificial
  CRISPR gRNA sequence
ttttttaaaaaaagaagcag

SEQ ID NO: 388627 - DNA, 20 bp, Artificial
  CRISPR gRNA sequence
ttttaaaaaaagaagcagtt

SEQ ID NO: 388628 - DNA, 20 bp, Artificial
  CRISPR gRNA sequence
tttaaaaaaagaagcagttc

SEQ ID NO: 388629 - DNA, 20 bp, Artificial
  CRISPR gRNA sequence
ttaaaaaaagaagcagttct

SEQ ID NO: 388630 - DNA, 20 bp, Artificial
  CRISPR gRNA sequence
taaaaaaagaagcagttcta

SEQ ID NO: 388631 - DNA, 20 bp, Artificial
  CRISPR gRNA sequence
aaaaaaagaagcagttctaa

SEQ ID NO: 388632 - DNA, 20 bp, Artificial
  CRISPR gRNA sequence
aaaaaagaagcagttctaaa

SEQ ID NO: 388633 - DNA, 20 bp, Artificial
  CRISPR gRNA sequence
taaactcagtttatgagacc

SEQ ID NO: 388634 - DNA, 20 bp, Artificial
  CRISPR gRNA sequence
aactcagtttatgagaccag

SEQ ID NO: 388635 - DNA, 20 bp, Artificial
  CRISPR gRNA sequence
agtttatgagaccagcatca

SEQ ID NO: 388636 - DNA, 20 bp, Artificial
  CRISPR gRNA sequence
atgagaccagcatcaccctg

SEQ ID NO: 388637 - DNA, 20 bp, Artificial
  CRISPR gRNA sequence
tgagaccagcatcaccctga

SEQ ID NO: 388638 - DNA, 20 bp, Artificial
  CRISPR gRNA sequence
ataccaaaaccagacaaaga

SEQ ID NO: 388639 - DNA, 20 bp, Artificial
  CRISPR gRNA sequence
caggctgacatccctaatga

SEQ ID NO: 388640 - DNA, 20 bp, Artificial
  CRISPR gRNA sequence
acatccctaatgaacacaga

SEQ ID NO: 388641 - DNA, 20 bp, Artificial
  CRISPR gRNA sequence
atgaacacagatgaaaaaat

SEQ ID NO: 388642 - DNA, 20 bp, Artificial
  CRISPR gRNA sequence
aacaaaatactagcaaacta

SEQ ID NO: 388643 - DNA, 20 bp, Artificial
  CRISPR gRNA sequence
gcaaactaaattcaccatca

SEQ ID NO: 388644 - DNA, 20 bp, Artificial
  CRISPR gRNA sequence
aattcaccatcacattaaat

SEQ ID NO: 388645 - DNA, 20 bp, Artificial
  CRISPR gRNA sequence
accatcacattaaatggatt

SEQ ID NO: 388646 - DNA, 20 bp, Artificial
  CRISPR gRNA sequence
aatggattgtatattctaat

SEQ ID NO: 388647 - DNA, 20 bp, Artificial
  CRISPR gRNA sequence
tatattctaatcaattctga

SEQ ID NO: 388648 - DNA, 20 bp, Artificial
  CRISPR gRNA sequence
taatcaattctgatttatcc

SEQ ID NO: 388649 - DNA, 20 bp, Artificial
  CRISPR gRNA sequence
atcaattctgatttatccct

SEQ ID NO: 388650 - DNA, 20 bp, Artificial
  CRISPR gRNA sequence
tgatttatccctggcatgca

SEQ ID NO: 388651 - DNA, 20 bp, Artificial
  CRISPR gRNA sequence
atttatccctggcatgcaaa

SEQ ID NO: 388652 - DNA, 20 bp, Artificial
  CRISPR gRNA sequence
atccctggcatgcaaagatg

SEQ ID NO: 388653 - DNA, 20 bp, Artificial
  CRISPR gRNA sequence
tccctggcatgcaaagatgg

SEQ ID NO: 388654 - DNA, 20 bp, Artificial
  CRISPR gRNA sequence
gcatgcaaagatggttcaac

SEQ ID NO: 388655 - DNA, 20 bp, Artificial
  CRISPR gRNA sequence
aacatatgtaaatcaatcaa

SEQ ID NO: 388656 - DNA, 20 bp, Artificial
  CRISPR gRNA sequence
acaaagtgatataaaaaggc

SEQ ID NO: 388657 - DNA, 20 bp, Artificial
  CRISPR gRNA sequence
gacaaattcaacatccttgt

SEQ ID NO: 388658 - DNA, 20 bp, Artificial
  CRISPR gRNA sequence
acaaattcaacatccttgtg

SEQ ID NO: 388659 - DNA, 20 bp, Artificial
  CRISPR gRNA sequence
aacatccttgtgtgattaaa

SEQ ID NO: 388660 - DNA, 20 bp, Artificial
  CRISPR gRNA sequence
gtgtgattaaaaaaaaaaaa

SEQ ID NO: 388661 - DNA, 20 bp, Artificial
  CRISPR gRNA sequence
tgtgattaaaaaaaaaaaac

SEQ ID NO: 388662 - DNA, 20 bp, Artificial
  CRISPR gRNA sequence
aaaaaaaaaaactctcaaca

SEQ ID NO: 388663 - DNA, 20 bp, Artificial
  CRISPR gRNA sequence
tcaacaaattaggtacagaa

SEQ ID NO: 388664 - DNA, 20 bp, Artificial
  CRISPR gRNA sequence
aacaaattaggtacagaaag

SEQ ID NO: 388665 - DNA, 20 bp, Artificial
  CRISPR gRNA sequence
ggtacagaaagaatttaccc

SEQ ID NO: 388666 - DNA, 20 bp, Artificial
  CRISPR gRNA sequence
accccaacacaataaaggcc

SEQ ID NO: 388667 - DNA, 20 bp, Artificial
  CRISPR gRNA sequence
ccccaacacaataaaggcca

SEQ ID NO: 388668 - DNA, 20 bp, Artificial
  CRISPR gRNA sequence
tgaaaagcccacagctaaca

SEQ ID NO: 388669 - DNA, 20 bp, Artificial
  CRISPR gRNA sequence
acatcataccaagtcatgta

SEQ ID NO: 388670 - DNA, 20 bp, Artificial
  CRISPR gRNA sequence
agaacttttgctctaagatc

SEQ ID NO: 388671 - DNA, 20 bp, Artificial
  CRISPR gRNA sequence
ttgctctaagatcaggaaaa

SEQ ID NO: 388672 - DNA, 20 bp, Artificial
  CRISPR gRNA sequence
tgctctaagatcaggaaaaa

SEQ ID NO: 388673 - DNA, 20 bp, Artificial
  CRISPR gRNA sequence
gctctaagatcaggaaaaag

SEQ ID NO: 388674 - DNA, 20 bp, Artificial
  CRISPR gRNA sequence
ctctaagatcaggaaaaaga

SEQ ID NO: 388675 - DNA, 20 bp, Artificial
  CRISPR gRNA sequence
taagatcaggaaaaagacaa

SEQ ID NO: 388676 - DNA, 20 bp, Artificial
  CRISPR gRNA sequence
agatcaggaaaaagacaaag

SEQ ID NO: 388677 - DNA, 20 bp, Artificial
  CRISPR gRNA sequence
tcaacacctctgcttaacat

SEQ ID NO: 388678 - DNA, 20 bp, Artificial
  CRISPR gRNA sequence
caacacctctgcttaacata

SEQ ID NO: 388679 - DNA, 20 bp, Artificial
  CRISPR gRNA sequence
aacacctctgcttaacatag

SEQ ID NO: 388680 - DNA, 20 bp, Artificial
  CRISPR gRNA sequence
tgcttaacatagtacaagaa

SEQ ID NO: 388681 - DNA, 20 bp, Artificial
  CRISPR gRNA sequence
cttaacatagtacaagaagt

SEQ ID NO: 388682 - DNA, 20 bp, Artificial
  CRISPR gRNA sequence
aacatagtacaagaagtctt

SEQ ID NO: 388683 - DNA, 20 bp, Artificial
  CRISPR gRNA sequence
acatagtacaagaagtctta

SEQ ID NO: 388684 - DNA, 20 bp, Artificial
  CRISPR gRNA sequence
aatcagagccattaaacaag

SEQ ID NO: 388685 - DNA, 20 bp, Artificial
  CRISPR gRNA sequence
atcagagccattaaacaaga

SEQ ID NO: 388686 - DNA, 20 bp, Artificial
  CRISPR gRNA sequence
aacaagaaaaagaaaacaaa

SEQ ID NO: 388687 - DNA, 20 bp, Artificial
  CRISPR gRNA sequence
aaatcagaaaggaagaagta

SEQ ID NO: 388688 - DNA, 20 bp, Artificial
  CRISPR gRNA sequence
tctctgtttgccgatgacat

SEQ ID NO: 388689 - DNA, 20 bp, Artificial
  CRISPR gRNA sequence
tgtttgccgatgacataatc

SEQ ID NO: 388690 - DNA, 20 bp, Artificial
  CRISPR gRNA sequence
tttgccgatgacataatcat

SEQ ID NO: 388691 - DNA, 20 bp, Artificial
  CRISPR gRNA sequence
gccgatgacataatcatata

SEQ ID NO: 388692 - DNA, 20 bp, Artificial
  CRISPR gRNA sequence
ccgatgacataatcatatat

SEQ ID NO: 388693 - DNA, 20 bp, Artificial
  CRISPR gRNA sequence
aaagtgccacaaaaaaacct

SEQ ID NO: 388694 - DNA, 20 bp, Artificial
  CRISPR gRNA sequence
ttcaaactaataaatgaatt

SEQ ID NO: 388695 - DNA, 20 bp, Artificial
  CRISPR gRNA sequence
aaactaataaatgaattcag

SEQ ID NO: 388696 - DNA, 20 bp, Artificial
  CRISPR gRNA sequence
ataaatgaattcagttaaga

SEQ ID NO: 388697 - DNA, 20 bp, Artificial
  CRISPR gRNA sequence
agttaagaggcaggatacaa

SEQ ID NO: 388698 - DNA, 20 bp, Artificial
  CRISPR gRNA sequence
agaggcaggatacaaaaatc

SEQ ID NO: 388699 - DNA, 20 bp, Artificial
  CRISPR gRNA sequence
ctgtacacaaacagcaaact

SEQ ID NO: 388700 - DNA, 20 bp, Artificial
  CRISPR gRNA sequence
tgtacacaaacagcaaacta

SEQ ID NO: 388701 - DNA, 20 bp, Artificial
  CRISPR gRNA sequence
tacacaaacagcaaactatc

SEQ ID NO: 388702 - DNA, 20 bp, Artificial
  CRISPR gRNA sequence
tccaaaaaaggaattaaaac

SEQ ID NO: 388703 - DNA, 20 bp, Artificial
  CRISPR gRNA sequence
aaacaaaatcccatccccaa

SEQ ID NO: 388704 - DNA, 20 bp, Artificial
  CRISPR gRNA sequence
aagaataaacttaaccaaaa

SEQ ID NO: 388705 - DNA, 20 bp, Artificial
  CRISPR gRNA sequence
agaataaacttaaccaaaaa

SEQ ID NO: 388706 - DNA, 20 bp, Artificial
  CRISPR gRNA sequence
aaccaaaaatgttaaagact

SEQ ID NO: 388707 - DNA, 20 bp, Artificial
  CRISPR gRNA sequence
accaaaaatgttaaagactt

SEQ ID NO: 388708 - DNA, 20 bp, Artificial
  CRISPR gRNA sequence
aagacttgcacactgaaaat

SEQ ID NO: 388709 - DNA, 20 bp, Artificial
  CRISPR gRNA sequence
gcacactgaaaatcatatag

SEQ ID NO: 388710 - DNA, 20 bp, Artificial
  CRISPR gRNA sequence
cacactgaaaatcatatagc

SEQ ID NO: 388711 - DNA, 20 bp, Artificial
  CRISPR gRNA sequence
aaaatcatatagcaacttat

SEQ ID NO: 388712 - DNA, 20 bp, Artificial
  CRISPR gRNA sequence
attctttcatgattattgtt

SEQ ID NO: 388713 - DNA, 20 bp, Artificial
  CRISPR gRNA sequence
ttctttcatgattattgttt

SEQ ID NO: 388714 - DNA, 20 bp, Artificial
  CRISPR gRNA sequence
tttcatgattattgttttgc

SEQ ID NO: 388715 - DNA, 20 bp, Artificial
  CRISPR gRNA sequence
tcatgattattgttttgcca

SEQ ID NO: 388716 - DNA, 20 bp, Artificial
  CRISPR gRNA sequence
catgattattgttttgccat

SEQ ID NO: 388717 - DNA, 20 bp, Artificial
  CRISPR gRNA sequence
atgattattgttttgccatc

SEQ ID NO: 388718 - DNA, 20 bp, Artificial
  CRISPR gRNA sequence
ttgttttgccatctttgctc

SEQ ID NO: 388719 - DNA, 20 bp, Artificial
  CRISPR gRNA sequence
ttttgccatctttgctcaag

SEQ ID NO: 388720 - DNA, 20 bp, Artificial
  CRISPR gRNA sequence
tgccatctttgctcaagaac

SEQ ID NO: 388721 - DNA, 20 bp, Artificial
  CRISPR gRNA sequence
gccatctttgctcaagaact

SEQ ID NO: 388722 - DNA, 20 bp, Artificial
  CRISPR gRNA sequence
ccatctttgctcaagaacta

SEQ ID NO: 388723 - DNA, 20 bp, Artificial
  CRISPR gRNA sequence
tgctcaagaactaatggtag

SEQ ID NO: 388724 - DNA, 20 bp, Artificial
  CRISPR gRNA sequence
gctcaagaactaatggtagc

SEQ ID NO: 388725 - DNA, 20 bp, Artificial
  CRISPR gRNA sequence
ctcaagaactaatggtagct

SEQ ID NO: 388726 - DNA, 20 bp, Artificial
  CRISPR gRNA sequence
aagaactaatggtagctttg

SEQ ID NO: 388727 - DNA, 20 bp, Artificial
  CRISPR gRNA sequence
atggtagctttgcttgacaa

SEQ ID NO: 388728 - DNA, 20 bp, Artificial
  CRISPR gRNA sequence
tgcttgacaattatatgaga

SEQ ID NO: 388729 - DNA, 20 bp, Artificial
  CRISPR gRNA sequence
gcttgacaattatatgagat

SEQ ID NO: 388730 - DNA, 20 bp, Artificial
  CRISPR gRNA sequence
cttgacaattatatgagatg

SEQ ID NO: 388731 - DNA, 20 bp, Artificial
  CRISPR gRNA sequence
gacaattatatgagatgcag

SEQ ID NO: 388732 - DNA, 20 bp, Artificial
  CRISPR gRNA sequence
acaattatatgagatgcagg

SEQ ID NO: 388733 - DNA, 20 bp, Artificial
  CRISPR gRNA sequence
tatgagatgcaggttttcac

SEQ ID NO: 388734 - DNA, 20 bp, Artificial
  CRISPR gRNA sequence
tcactgtcatcacttaattt

SEQ ID NO: 388735 - DNA, 20 bp, Artificial
  CRISPR gRNA sequence
cactgtcatcacttaattta

SEQ ID NO: 388736 - DNA, 20 bp, Artificial
  CRISPR gRNA sequence
actgtcatcacttaatttaa

SEQ ID NO: 388737 - DNA, 20 bp, Artificial
  CRISPR gRNA sequence
tcatcacttaatttaaccta

SEQ ID NO: 388738 - DNA, 20 bp, Artificial
  CRISPR gRNA sequence
aatttaacctacctcgtccc

SEQ ID NO: 388739 - DNA, 20 bp, Artificial
  CRISPR gRNA sequence
atttaacctacctcgtccca

SEQ ID NO: 388740 - DNA, 20 bp, Artificial
  CRISPR gRNA sequence
aacctacctcgtcccatatt

SEQ ID NO: 388741 - DNA, 20 bp, Artificial
  CRISPR gRNA sequence
acctacctcgtcccatatta

SEQ ID NO: 388742 - DNA, 20 bp, Artificial
  CRISPR gRNA sequence
cctcgtcccatattaataca

SEQ ID NO: 388743 - DNA, 20 bp, Artificial
  CRISPR gRNA sequence
gtcccatattaatacataac

SEQ ID NO: 388744 - DNA, 20 bp, Artificial
  CRISPR gRNA sequence
atacataacttagactctcc

SEQ ID NO: 388745 - DNA, 20 bp, Artificial
  CRISPR gRNA sequence
agactctccataccaaccta

SEQ ID NO: 388746 - DNA, 20 bp, Artificial
  CRISPR gRNA sequence
gactctccataccaacctag

SEQ ID NO: 388747 - DNA, 20 bp, Artificial
  CRISPR gRNA sequence
tccataccaacctagtcatt

SEQ ID NO: 388748 - DNA, 20 bp, Artificial
  CRISPR gRNA sequence
cataccaacctagtcatttg

SEQ ID NO: 388749 - DNA, 20 bp, Artificial
  CRISPR gRNA sequence
gtcatttgactacagtctcc

SEQ ID NO: 388750 - DNA, 20 bp, Artificial
  CRISPR gRNA sequence
gactacagtctcccatgcac

SEQ ID NO: 388751 - DNA, 20 bp, Artificial
  CRISPR gRNA sequence
actacagtctcccatgcacc

SEQ ID NO: 388752 - DNA, 20 bp, Artificial
  CRISPR gRNA sequence
cagtctcccatgcaccatct

SEQ ID NO: 388753 - DNA, 20 bp, Artificial
  CRISPR gRNA sequence
ccatgcaccatctccccatt

SEQ ID NO: 388754 - DNA, 20 bp, Artificial
  CRISPR gRNA sequence
cccattcctcctgcatattt

SEQ ID NO: 388755 - DNA, 20 bp, Artificial
  CRISPR gRNA sequence
ctcctgcatatttggggtta

SEQ ID NO: 388756 - DNA, 20 bp, Artificial
  CRISPR gRNA sequence
ctgcatatttggggttactc

SEQ ID NO: 388757 - DNA, 20 bp, Artificial
  CRISPR gRNA sequence
catatttggggttactcttc

SEQ ID NO: 388758 - DNA, 20 bp, Artificial
  CRISPR gRNA sequence
ggggttactcttcataacct

SEQ ID NO: 388759 - DNA, 20 bp, Artificial
  CRISPR gRNA sequence
gggttactcttcataacctg

SEQ ID NO: 388760 - DNA, 20 bp, Artificial
  CRISPR gRNA sequence
ctcttcataacctgtttcat

SEQ ID NO: 388761 - DNA, 20 bp, Artificial
  CRISPR gRNA sequence
ttcataacctgtttcatgtc

SEQ ID NO: 388762 - DNA, 20 bp, Artificial
  CRISPR gRNA sequence
cataacctgtttcatgtcat

SEQ ID NO: 388763 - DNA, 20 bp, Artificial
  CRISPR gRNA sequence
ataacctgtttcatgtcatt

SEQ ID NO: 388764 - DNA, 20 bp, Artificial
  CRISPR gRNA sequence
tttcatgtcattcctcagct

SEQ ID NO: 388765 - DNA, 20 bp, Artificial
  CRISPR gRNA sequence
catgtcattcctcagctcta

SEQ ID NO: 388766 - DNA, 20 bp, Artificial
  CRISPR gRNA sequence
atgtcattcctcagctctaa

SEQ ID NO: 388767 - DNA, 20 bp, Artificial
  CRISPR gRNA sequence
ctcagctctaatcatcaatg

SEQ ID NO: 388768 - DNA, 20 bp, Artificial
  CRISPR gRNA sequence
agctctaatcatcaatgcct

SEQ ID NO: 388769 - DNA, 20 bp, Artificial
  CRISPR gRNA sequence
taatcatcaatgcctcattt

SEQ ID NO: 388770 - DNA, 20 bp, Artificial
  CRISPR gRNA sequence
atcatcaatgcctcatttga

SEQ ID NO: 388771 - DNA, 20 bp, Artificial
  CRISPR gRNA sequence
atttgaaccttgatggtccc

SEQ ID NO: 388772 - DNA, 20 bp, Artificial
  CRISPR gRNA sequence
gaaccttgatggtcccgcct

SEQ ID NO: 388773 - DNA, 20 bp, Artificial
  CRISPR gRNA sequence
aaccttgatggtcccgcctg

SEQ ID NO: 388774 - DNA, 20 bp, Artificial
  CRISPR gRNA sequence
gatggtcccgcctgagtggt

SEQ ID NO: 388775 - DNA, 20 bp, Artificial
  CRISPR gRNA sequence
atggtcccgcctgagtggtc

SEQ ID NO: 388776 - DNA, 20 bp, Artificial
  CRISPR gRNA sequence
agtggtctcactggtggaag

SEQ ID NO: 388777 - DNA, 20 bp, Artificial
  CRISPR gRNA sequence
actggtggaagacgattata

SEQ ID NO: 388778 - DNA, 20 bp, Artificial
  CRISPR gRNA sequence
gtggaagacgattatacaag

SEQ ID NO: 388779 - DNA, 20 bp, Artificial
  CRISPR gRNA sequence
tacaaggacatgagtaatta

SEQ ID NO: 388780 - DNA, 20 bp, Artificial
  CRISPR gRNA sequence
tacttatcaatagcaaacag

SEQ ID NO: 388781 - DNA, 20 bp, Artificial
  CRISPR gRNA sequence
atcaatagcaaacagaagtt

SEQ ID NO: 388782 - DNA, 20 bp, Artificial
  CRISPR gRNA sequence
tcaatagcaaacagaagttt

SEQ ID NO: 388783 - DNA, 20 bp, Artificial
  CRISPR gRNA sequence
tttcaatattagcctcctcc

SEQ ID NO: 388784 - DNA, 20 bp, Artificial
  CRISPR gRNA sequence
ttcaatattagcctcctcca

SEQ ID NO: 388785 - DNA, 20 bp, Artificial
  CRISPR gRNA sequence
tcaatattagcctcctccag

SEQ ID NO: 388786 - DNA, 20 bp, Artificial
  CRISPR gRNA sequence
caatattagcctcctccaga

SEQ ID NO: 388787 - DNA, 20 bp, Artificial
  CRISPR gRNA sequence
aatattagcctcctccagaa

SEQ ID NO: 388788 - DNA, 20 bp, Artificial
  CRISPR gRNA sequence
gcctcctccagaaactttct

SEQ ID NO: 388789 - DNA, 20 bp, Artificial
  CRISPR gRNA sequence
ctccagaaactttctgcaag

SEQ ID NO: 388790 - DNA, 20 bp, Artificial
  CRISPR gRNA sequence
cagaaactttctgcaagagc

SEQ ID NO: 388791 - DNA, 20 bp, Artificial
  CRISPR gRNA sequence
tctgcaagagctgattttat

SEQ ID NO: 388792 - DNA, 20 bp, Artificial
  CRISPR gRNA sequence
ctgcaagagctgattttatt

SEQ ID NO: 388793 - DNA, 20 bp, Artificial
  CRISPR gRNA sequence
tgcaagagctgattttattt

SEQ ID NO: 388794 - DNA, 20 bp, Artificial
  CRISPR gRNA sequence
caagagctgattttatttct

SEQ ID NO: 388795 - DNA, 20 bp, Artificial
  CRISPR gRNA sequence
attttatttcttttgccttc

SEQ ID NO: 388796 - DNA, 20 bp, Artificial
  CRISPR gRNA sequence
tatttcttttgccttcattc

SEQ ID NO: 388797 - DNA, 20 bp, Artificial
  CRISPR gRNA sequence
atttcttttgccttcattct

SEQ ID NO: 388798 - DNA, 20 bp, Artificial
  CRISPR gRNA sequence
tttcttttgccttcattctt

SEQ ID NO: 388799 - DNA, 20 bp, Artificial
  CRISPR gRNA sequence
cttttgccttcattcttttt

SEQ ID NO: 388800 - DNA, 20 bp, Artificial
  CRISPR gRNA sequence
ttttgccttcattcttttta

SEQ ID NO: 388801 - DNA, 20 bp, Artificial
  CRISPR gRNA sequence
ttgccttcattctttttata

SEQ ID NO: 388802 - DNA, 20 bp, Artificial
  CRISPR gRNA sequence
tgccttcattctttttatag

SEQ ID NO: 388803 - DNA, 20 bp, Artificial
  CRISPR gRNA sequence
gccttcattctttttatagc

SEQ ID NO: 388804 - DNA, 20 bp, Artificial
  CRISPR gRNA sequence
ccttcattctttttatagcc

SEQ ID NO: 388805 - DNA, 20 bp, Artificial
  CRISPR gRNA sequence
cattctttttatagccaata

SEQ ID NO: 388806 - DNA, 20 bp, Artificial
  CRISPR gRNA sequence
attctttttatagccaataa

SEQ ID NO: 388807 - DNA, 20 bp, Artificial
  CRISPR gRNA sequence
tttttatagccaataaggtc

SEQ ID NO: 388808 - DNA, 20 bp, Artificial
  CRISPR gRNA sequence
tttatagccaataaggtcag

SEQ ID NO: 388809 - DNA, 20 bp, Artificial
  CRISPR gRNA sequence
ttatagccaataaggtcagt

SEQ ID NO: 388810 - DNA, 20 bp, Artificial
  CRISPR gRNA sequence
tatagccaataaggtcagtt

SEQ ID NO: 388811 - DNA, 20 bp, Artificial
  CRISPR gRNA sequence
atagccaataaggtcagttt

SEQ ID NO: 388812 - DNA, 20 bp, Artificial
  CRISPR gRNA sequence
tagccaataaggtcagttta

SEQ ID NO: 388813 - DNA, 20 bp, Artificial
  CRISPR gRNA sequence
aaacaatagtagtctgcaaa

SEQ ID NO: 388814 - DNA, 20 bp, Artificial
  CRISPR gRNA sequence
aacaatagtagtctgcaaat

SEQ ID NO: 388815 - DNA, 20 bp, Artificial
  CRISPR gRNA sequence
caaatcatttagctaatatt

SEQ ID NO: 388816 - DNA, 20 bp, Artificial
  CRISPR gRNA sequence
agctaatattaaaatatttg

SEQ ID NO: 388817 - DNA, 20 bp, Artificial
  CRISPR gRNA sequence
gctaatattaaaatatttga

SEQ ID NO: 388818 - DNA, 20 bp, Artificial
  CRISPR gRNA sequence
atattaaaatatttgacaaa

SEQ ID NO: 388819 - DNA, 20 bp, Artificial
  CRISPR gRNA sequence
aaatatttgacaaattattt

SEQ ID NO: 388820 - DNA, 20 bp, Artificial
  CRISPR gRNA sequence
gacaaattattttagtggca

SEQ ID NO: 388821 - DNA, 20 bp, Artificial
  CRISPR gRNA sequence
acaaattattttagtggcac

SEQ ID NO: 388822 - DNA, 20 bp, Artificial
  CRISPR gRNA sequence
ttttagtggcacctaaaata

SEQ ID NO: 388823 - DNA, 20 bp, Artificial
  CRISPR gRNA sequence
tagtggcacctaaaatactt

SEQ ID NO: 388824 - DNA, 20 bp, Artificial
  CRISPR gRNA sequence
agtggcacctaaaatacttc

SEQ ID NO: 388825 - DNA, 20 bp, Artificial
  CRISPR gRNA sequence
gtggcacctaaaatacttct

SEQ ID NO: 388826 - DNA, 20 bp, Artificial
  CRISPR gRNA sequence
aaatacttctcttatgacaa

SEQ ID NO: 388827 - DNA, 20 bp, Artificial
  CRISPR gRNA sequence
ctcttatgacaaatgaaaat

SEQ ID NO: 388828 - DNA, 20 bp, Artificial
  CRISPR gRNA sequence
tcttatgacaaatgaaaatc

SEQ ID NO: 388829 - DNA, 20 bp, Artificial
  CRISPR gRNA sequence
ttatgacaaatgaaaatcca

SEQ ID NO: 388830 - DNA, 20 bp, Artificial
  CRISPR gRNA sequence
atgacaaatgaaaatccaga

SEQ ID NO: 388831 - DNA, 20 bp, Artificial
  CRISPR gRNA sequence
tgacaaatgaaaatccagag

SEQ ID NO: 388832 - DNA, 20 bp, Artificial
  CRISPR gRNA sequence
agggccaaaaataactgtag

SEQ ID NO: 388833 - DNA, 20 bp, Artificial
  CRISPR gRNA sequence
tagtcactgtcaataaacag

SEQ ID NO: 388834 - DNA, 20 bp, Artificial
  CRISPR gRNA sequence
tcaataaacagacattcccc

SEQ ID NO: 388835 - DNA, 20 bp, Artificial
  CRISPR gRNA sequence
ccctgtgctccccccgtccc

SEQ ID NO: 388836 - DNA, 20 bp, Artificial
  CRISPR gRNA sequence
tgctccccccgtccccactt

SEQ ID NO: 388837 - DNA, 20 bp, Artificial
  CRISPR gRNA sequence
cccccgtccccactttcctt

SEQ ID NO: 388838 - DNA, 20 bp, Artificial
  CRISPR gRNA sequence
tccttgcccttcggtccagg

SEQ ID NO: 388839 - DNA, 20 bp, Artificial
  CRISPR gRNA sequence
ccttgcccttcggtccaggc

SEQ ID NO: 388840 - DNA, 20 bp, Artificial
  CRISPR gRNA sequence
cttgcccttcggtccaggca

SEQ ID NO: 388841 - DNA, 20 bp, Artificial
  CRISPR gRNA sequence
gcccttcggtccaggcaagt

SEQ ID NO: 388842 - DNA, 20 bp, Artificial
  CRISPR gRNA sequence
cccttcggtccaggcaagtt

SEQ ID NO: 388843 - DNA, 20 bp, Artificial
  CRISPR gRNA sequence
cggtccaggcaagtttcaaa

SEQ ID NO: 388844 - DNA, 20 bp, Artificial
  CRISPR gRNA sequence
ggtccaggcaagtttcaaat

SEQ ID NO: 388845 - DNA, 20 bp, Artificial
  CRISPR gRNA sequence
caaattcagaaaagtcagtc

SEQ ID NO: 388846 - DNA, 20 bp, Artificial
  CRISPR gRNA sequence
aaattcagaaaagtcagtct

SEQ ID NO: 388847 - DNA, 20 bp, Artificial
  CRISPR gRNA sequence
agaaaagtcagtctggaatt

SEQ ID NO: 388848 - DNA, 20 bp, Artificial
  CRISPR gRNA sequence
gaattatttcattctacatt

SEQ ID NO: 388849 - DNA, 20 bp, Artificial
  CRISPR gRNA sequence
tttcattctacatttcagga

SEQ ID NO: 388850 - DNA, 20 bp, Artificial
  CRISPR gRNA sequence
cattctacatttcaggacat

SEQ ID NO: 388851 - DNA, 20 bp, Artificial
  CRISPR gRNA sequence
attctacatttcaggacata

SEQ ID NO: 388852 - DNA, 20 bp, Artificial
  CRISPR gRNA sequence
tacatttcaggacataagtg

SEQ ID NO: 388853 - DNA, 20 bp, Artificial
  CRISPR gRNA sequence
catttcaggacataagtgca

SEQ ID NO: 388854 - DNA, 20 bp, Artificial
  CRISPR gRNA sequence
caggacataagtgcaaagga

SEQ ID NO: 388855 - DNA, 20 bp, Artificial
  CRISPR gRNA sequence
aggacataagtgcaaaggac

SEQ ID NO: 388856 - DNA, 20 bp, Artificial
  CRISPR gRNA sequence
cttttcactcagcaaagaaa

SEQ ID NO: 388857 - DNA, 20 bp, Artificial
  CRISPR gRNA sequence
ttttcactcagcaaagaaag

SEQ ID NO: 388858 - DNA, 20 bp, Artificial
  CRISPR gRNA sequence
ttcactcagcaaagaaagtc

SEQ ID NO: 388859 - DNA, 20 bp, Artificial
  CRISPR gRNA sequence
tcactcagcaaagaaagtca

SEQ ID NO: 388860 - DNA, 20 bp, Artificial
  CRISPR gRNA sequence
cactcagcaaagaaagtcag

SEQ ID NO: 388861 - DNA, 20 bp, Artificial
  CRISPR gRNA sequence
actcagcaaagaaagtcagt

SEQ ID NO: 388862 - DNA, 20 bp, Artificial
  CRISPR gRNA sequence
agcaaagaaagtcagtggta

SEQ ID NO: 388863 - DNA, 20 bp, Artificial
  CRISPR gRNA sequence
agttcttgcttctgccattt

SEQ ID NO: 388864 - DNA, 20 bp, Artificial
  CRISPR gRNA sequence
ttgcttctgccattttctcc

SEQ ID NO: 388865 - DNA, 20 bp, Artificial
  CRISPR gRNA sequence
gcttctgccattttctcctc

SEQ ID NO: 388866 - DNA, 20 bp, Artificial
  CRISPR gRNA sequence
cttctgccattttctcctct

SEQ ID NO: 388867 - DNA, 20 bp, Artificial
  CRISPR gRNA sequence
ctgccattttctcctctgtt

SEQ ID NO: 388868 - DNA, 20 bp, Artificial
  CRISPR gRNA sequence
tgccattttctcctctgttc

SEQ ID NO: 388869 - DNA, 20 bp, Artificial
  CRISPR gRNA sequence
ccattttctcctctgttcaa

SEQ ID NO: 388870 - DNA, 20 bp, Artificial
  CRISPR gRNA sequence
tctcctctgttcaaaaccaa

SEQ ID NO: 388871 - DNA, 20 bp, Artificial
  CRISPR gRNA sequence
ctcctctgttcaaaaccaat

SEQ ID NO: 388872 - DNA, 20 bp, Artificial
  CRISPR gRNA sequence
tcctctgttcaaaaccaatc

SEQ ID NO: 388873 - DNA, 20 bp, Artificial
  CRISPR gRNA sequence
ctctgttcaaaaccaatcaa

SEQ ID NO: 388874 - DNA, 20 bp, Artificial
  CRISPR gRNA sequence
tgttcaaaaccaatcaaggc

SEQ ID NO: 388875 - DNA, 20 bp, Artificial
  CRISPR gRNA sequence
ttcaaaaccaatcaaggcct

SEQ ID NO: 388876 - DNA, 20 bp, Artificial
  CRISPR gRNA sequence
aaaaccaatcaaggcctgga

SEQ ID NO: 388877 - DNA, 20 bp, Artificial
  CRISPR gRNA sequence
gatacttgacctgctggttg

SEQ ID NO: 388878 - DNA, 20 bp, Artificial
  CRISPR gRNA sequence
gacctgctggttggcagggg

SEQ ID NO: 388879 - DNA, 20 bp, Artificial
  CRISPR gRNA sequence
acctgctggttggcaggggt

SEQ ID NO: 388880 - DNA, 20 bp, Artificial
  CRISPR gRNA sequence
ctggttggcaggggtcctct

SEQ ID NO: 388881 - DNA, 20 bp, Artificial
  CRISPR gRNA sequence
gttggcaggggtcctctgtt

SEQ ID NO: 388882 - DNA, 20 bp, Artificial
  CRISPR gRNA sequence
gcaggggtcctctgttgagt

SEQ ID NO: 388883 - DNA, 20 bp, Artificial
  CRISPR gRNA sequence
tgttgagtgacctggtactt

SEQ ID NO: 388884 - DNA, 20 bp, Artificial
  CRISPR gRNA sequence
ttgagtgacctggtacttgt

SEQ ID NO: 388885 - DNA, 20 bp, Artificial
  CRISPR gRNA sequence
agtgacctggtacttgtctg

SEQ ID NO: 388886 - DNA, 20 bp, Artificial
  CRISPR gRNA sequence
gtacttgtctgaagatgaat

SEQ ID NO: 388887 - DNA, 20 bp, Artificial
  CRISPR gRNA sequence
gtctgaagatgaatgcaggc

SEQ ID NO: 388888 - DNA, 20 bp, Artificial
  CRISPR gRNA sequence
tctgaagatgaatgcaggca

SEQ ID NO: 388889 - DNA, 20 bp, Artificial
  CRISPR gRNA sequence
aagatgaatgcaggcaggta

SEQ ID NO: 388890 - DNA, 20 bp, Artificial
  CRISPR gRNA sequence
tctgtgtgtgtgtccgtgtc

SEQ ID NO: 388891 - DNA, 20 bp, Artificial
  CRISPR gRNA sequence
tgtgtgtgtgtccgtgtctg

SEQ ID NO: 388892 - DNA, 20 bp, Artificial
  CRISPR gRNA sequence
tgtgtgtgtccgtgtctgtg

SEQ ID NO: 388893 - DNA, 20 bp, Artificial
  CRISPR gRNA sequence
tgtgtgcatgtgtgtgtgtg

SEQ ID NO: 388894 - DNA, 20 bp, Artificial
  CRISPR gRNA sequence
aaaatctctcttttagatcc

SEQ ID NO: 388895 - DNA, 20 bp, Artificial
  CRISPR gRNA sequence
tcttttagatccaatactat

SEQ ID NO: 388896 - DNA, 20 bp, Artificial
  CRISPR gRNA sequence
ttttagatccaatactatgt

SEQ ID NO: 388897 - DNA, 20 bp, Artificial
  CRISPR gRNA sequence
ttagatccaatactatgtgc

SEQ ID NO: 388898 - DNA, 20 bp, Artificial
  CRISPR gRNA sequence
tagatccaatactatgtgct

SEQ ID NO: 388899 - DNA, 20 bp, Artificial
  CRISPR gRNA sequence
agatccaatactatgtgcta

SEQ ID NO: 388900 - DNA, 20 bp, Artificial
  CRISPR gRNA sequence
gatccaatactatgtgctat

SEQ ID NO: 388901 - DNA, 20 bp, Artificial
  CRISPR gRNA sequence
tgtgctataaaagaagtcat

SEQ ID NO: 388902 - DNA, 20 bp, Artificial
  CRISPR gRNA sequence
taaaagaagtcattgagaac

SEQ ID NO: 388903 - DNA, 20 bp, Artificial
  CRISPR gRNA sequence
agaactaacaaaagtatgta

SEQ ID NO: 388904 - DNA, 20 bp, Artificial
  CRISPR gRNA sequence
acaaaagtatgtacagcaat

SEQ ID NO: 388905 - DNA, 20 bp, Artificial
  CRISPR gRNA sequence
ataaaatctgccacaatcac

SEQ ID NO: 388906 - DNA, 20 bp, Artificial
  CRISPR gRNA sequence
taaaatctgccacaatcacc

SEQ ID NO: 388907 - DNA, 20 bp, Artificial
  CRISPR gRNA sequence
ccacaatcacctttcccttg

SEQ ID NO: 388908 - DNA, 20 bp, Artificial
  CRISPR gRNA sequence
tcccttggcagttgaaataa

SEQ ID NO: 388909 - DNA, 20 bp, Artificial
  CRISPR gRNA sequence
cccttggcagttgaaataaa

SEQ ID NO: 388910 - DNA, 20 bp, Artificial
  CRISPR gRNA sequence
ccttggcagttgaaataaat

SEQ ID NO: 388911 - DNA, 20 bp, Artificial
  CRISPR gRNA sequence
ggcagttgaaataaattaaa

SEQ ID NO: 388912 - DNA, 20 bp, Artificial
  CRISPR gRNA sequence
gcagttgaaataaattaaat

SEQ ID NO: 388913 - DNA, 20 bp, Artificial
  CRISPR gRNA sequence
aaataaattaaatctgtccc

SEQ ID NO: 388914 - DNA, 20 bp, Artificial
  CRISPR gRNA sequence
aatctgtcccacatcttata

SEQ ID NO: 388915 - DNA, 20 bp, Artificial
  CRISPR gRNA sequence
tcccacatcttatatctgtc

SEQ ID NO: 388916 - DNA, 20 bp, Artificial
  CRISPR gRNA sequence
atatctgtctctctgcttta

SEQ ID NO: 388917 - DNA, 20 bp, Artificial
  CRISPR gRNA sequence
tatctgtctctctgctttaa

SEQ ID NO: 388918 - DNA, 20 bp, Artificial
  CRISPR gRNA sequence
tctctctgctttaatctcca

SEQ ID NO: 388919 - DNA, 20 bp, Artificial
  CRISPR gRNA sequence
tctgctttaatctccacatt

SEQ ID NO: 388920 - DNA, 20 bp, Artificial
  CRISPR gRNA sequence
tgctttaatctccacattga

SEQ ID NO: 388921 - DNA, 20 bp, Artificial
  CRISPR gRNA sequence
ctttaatctccacattgatt

SEQ ID NO: 388922 - DNA, 20 bp, Artificial
  CRISPR gRNA sequence
taatctccacattgattttt

SEQ ID NO: 388923 - DNA, 20 bp, Artificial
  CRISPR gRNA sequence
aatctccacattgatttttg

SEQ ID NO: 388924 - DNA, 20 bp, Artificial
  CRISPR gRNA sequence
atctccacattgatttttga

SEQ ID NO: 388925 - DNA, 20 bp, Artificial
  CRISPR gRNA sequence
cacattgatttttgaccaaa

SEQ ID NO: 388926 - DNA, 20 bp, Artificial
  CRISPR gRNA sequence
atttttgaccaaagagcctc

SEQ ID NO: 388927 - DNA, 20 bp, Artificial
  CRISPR gRNA sequence
ttgaccaaagagcctcaaga

SEQ ID NO: 388928 - DNA, 20 bp, Artificial
  CRISPR gRNA sequence
tgaccaaagagcctcaagac

SEQ ID NO: 388929 - DNA, 20 bp, Artificial
  CRISPR gRNA sequence
gaccaaagagcctcaagacg

SEQ ID NO: 388930 - DNA, 20 bp, Artificial
  CRISPR gRNA sequence
accaaagagcctcaagacgt

SEQ ID NO: 388931 - DNA, 20 bp, Artificial
  CRISPR gRNA sequence
aagacgtgaaataatcaaat

SEQ ID NO: 388932 - DNA, 20 bp, Artificial
  CRISPR gRNA sequence
caccagagaaaacacaaatg

SEQ ID NO: 388933 - DNA, 20 bp, Artificial
  CRISPR gRNA sequence
ttttgctttgcatctaagtt

SEQ ID NO: 388934 - DNA, 20 bp, Artificial
  CRISPR gRNA sequence
tgctttgcatctaagtttta

SEQ ID NO: 388935 - DNA, 20 bp, Artificial
  CRISPR gRNA sequence
gctttgcatctaagttttat

SEQ ID NO: 388936 - DNA, 20 bp, Artificial
  CRISPR gRNA sequence
ctttgcatctaagttttata

SEQ ID NO: 388937 - DNA, 20 bp, Artificial
  CRISPR gRNA sequence
tgcatctaagttttatattc

SEQ ID NO: 388938 - DNA, 20 bp, Artificial
  CRISPR gRNA sequence
gcatctaagttttatattca

SEQ ID NO: 388939 - DNA, 20 bp, Artificial
  CRISPR gRNA sequence
catctaagttttatattcaa

SEQ ID NO: 388940 - DNA, 20 bp, Artificial
  CRISPR gRNA sequence
agttttatattcaatctttc

SEQ ID NO: 388941 - DNA, 20 bp, Artificial
  CRISPR gRNA sequence
tatattcaatctttcactta

SEQ ID NO: 388942 - DNA, 20 bp, Artificial
  CRISPR gRNA sequence
atattcaatctttcacttat

SEQ ID NO: 388943 - DNA, 20 bp, Artificial
  CRISPR gRNA sequence
tattcaatctttcacttata

SEQ ID NO: 388944 - DNA, 20 bp, Artificial
  CRISPR gRNA sequence
aatctttcacttataaaaat

SEQ ID NO: 388945 - DNA, 20 bp, Artificial
  CRISPR gRNA sequence
tcacttataaaaattgaaaa

SEQ ID NO: 388946 - DNA, 20 bp, Artificial
  CRISPR gRNA sequence
cacttataaaaattgaaaaa

SEQ ID NO: 388947 - DNA, 20 bp, Artificial
  CRISPR gRNA sequence
acttataaaaattgaaaaaa

SEQ ID NO: 388948 - DNA, 20 bp, Artificial
  CRISPR gRNA sequence
ataaaaattgaaaaaaggaa

SEQ ID NO: 388949 - DNA, 20 bp, Artificial
  CRISPR gRNA sequence
taaaaattgaaaaaaggaat

SEQ ID NO: 388950 - DNA, 20 bp, Artificial
  CRISPR gRNA sequence
aaaaaaggaattaaactgaa

SEQ ID NO: 388951 - DNA, 20 bp, Artificial
  CRISPR gRNA sequence
aactgaaacatacagtcaat

SEQ ID NO: 388952 - DNA, 20 bp, Artificial
  CRISPR gRNA sequence
aaacatacagtcaatggctg

SEQ ID NO: 388953 - DNA, 20 bp, Artificial
  CRISPR gRNA sequence
tcatcttctgtcaatgataa

SEQ ID NO: 388954 - DNA, 20 bp, Artificial
  CRISPR gRNA sequence
ctgtcaatgataacttttta

SEQ ID NO: 388955 - DNA, 20 bp, Artificial
  CRISPR gRNA sequence
tgtcaatgataactttttac

SEQ ID NO: 388956 - DNA, 20 bp, Artificial
  CRISPR gRNA sequence
tcaatgataactttttacta

SEQ ID NO: 388957 - DNA, 20 bp, Artificial
  CRISPR gRNA sequence
tttactaatggatacaaggt

SEQ ID NO: 388958 - DNA, 20 bp, Artificial
  CRISPR gRNA sequence
ttactaatggatacaaggtc

SEQ ID NO: 388959 - DNA, 20 bp, Artificial
  CRISPR gRNA sequence
tactaatggatacaaggtcc

SEQ ID NO: 388960 - DNA, 20 bp, Artificial
  CRISPR gRNA sequence
actaatggatacaaggtcca

SEQ ID NO: 388961 - DNA, 20 bp, Artificial
  CRISPR gRNA sequence
ctaatggatacaaggtccag

SEQ ID NO: 388962 - DNA, 20 bp, Artificial
  CRISPR gRNA sequence
atggatacaaggtccagttg

SEQ ID NO: 388963 - DNA, 20 bp, Artificial
  CRISPR gRNA sequence
acattctttcaatctgtcaa

SEQ ID NO: 388964 - DNA, 20 bp, Artificial
  CRISPR gRNA sequence
tttcaatctgtcaactgaat

SEQ ID NO: 388965 - DNA, 20 bp, Artificial
  CRISPR gRNA sequence
tcaatctgtcaactgaatgt

SEQ ID NO: 388966 - DNA, 20 bp, Artificial
  CRISPR gRNA sequence
caatctgtcaactgaatgtc

SEQ ID NO: 388967 - DNA, 20 bp, Artificial
  CRISPR gRNA sequence
aatctgtcaactgaatgtca

SEQ ID NO: 388968 - DNA, 20 bp, Artificial
  CRISPR gRNA sequence
tcaactgaatgtcaaaaagc

SEQ ID NO: 388969 - DNA, 20 bp, Artificial
  CRISPR gRNA sequence
aatgtcaaaaagccatttgc

SEQ ID NO: 388970 - DNA, 20 bp, Artificial
  CRISPR gRNA sequence
gcaactgttcaaaacacatg

SEQ ID NO: 388971 - DNA, 20 bp, Artificial
  CRISPR gRNA sequence
caactgttcaaaacacatgg

SEQ ID NO: 388972 - DNA, 20 bp, Artificial
  CRISPR gRNA sequence
ttcaaaacacatggacacta

SEQ ID NO: 388973 - DNA, 20 bp, Artificial
  CRISPR gRNA sequence
aaaacacatggacactaaca

SEQ ID NO: 388974 - DNA, 20 bp, Artificial
  CRISPR gRNA sequence
acactactgaccattacatt

SEQ ID NO: 388975 - DNA, 20 bp, Artificial
  CRISPR gRNA sequence
ctgaccattacatttagtca

SEQ ID NO: 388976 - DNA, 20 bp, Artificial
  CRISPR gRNA sequence
accattacatttagtcatct

SEQ ID NO: 388977 - DNA, 20 bp, Artificial
  CRISPR gRNA sequence
catttagtcatcttcatttc

SEQ ID NO: 388978 - DNA, 20 bp, Artificial
  CRISPR gRNA sequence
agtcatcttcatttcattgg

SEQ ID NO: 388979 - DNA, 20 bp, Artificial
  CRISPR gRNA sequence
gtcatcttcatttcattggc

SEQ ID NO: 388980 - DNA, 20 bp, Artificial
  CRISPR gRNA sequence
catttcattggcagagtttg

SEQ ID NO: 388981 - DNA, 20 bp, Artificial
  CRISPR gRNA sequence
atttcattggcagagtttga

SEQ ID NO: 388982 - DNA, 20 bp, Artificial
  CRISPR gRNA sequence
cattggcagagtttgacgct

SEQ ID NO: 388983 - DNA, 20 bp, Artificial
  CRISPR gRNA sequence
attggcagagtttgacgctg

SEQ ID NO: 388984 - DNA, 20 bp, Artificial
  CRISPR gRNA sequence
gcagagtttgacgctgttta

SEQ ID NO: 388985 - DNA, 20 bp, Artificial
  CRISPR gRNA sequence
gacgctgtttataatttaca

SEQ ID NO: 388986 - DNA, 20 bp, Artificial
  CRISPR gRNA sequence
acgctgtttataatttacat

SEQ ID NO: 388987 - DNA, 20 bp, Artificial
  CRISPR gRNA sequence
tttataatttacatacaaag

SEQ ID NO: 388988 - DNA, 20 bp, Artificial
  CRISPR gRNA sequence
ataatttacatacaaagaaa

SEQ ID NO: 388989 - DNA, 20 bp, Artificial
  CRISPR gRNA sequence
taatttacatacaaagaaat

SEQ ID NO: 388990 - DNA, 20 bp, Artificial
  CRISPR gRNA sequence
acatacaaagaaatagtttt

SEQ ID NO: 388991 - DNA, 20 bp, Artificial
  CRISPR gRNA sequence
catacaaagaaatagttttg

SEQ ID NO: 388992 - DNA, 20 bp, Artificial
  CRISPR gRNA sequence
tgtgcaagaaacttagtcat

SEQ ID NO: 388993 - DNA, 20 bp, Artificial
  CRISPR gRNA sequence
gtgcaagaaacttagtcatc

SEQ ID NO: 388994 - DNA, 20 bp, Artificial
  CRISPR gRNA sequence
tgcaagaaacttagtcatct

SEQ ID NO: 388995 - DNA, 20 bp, Artificial
  CRISPR gRNA sequence
agtcatctttggacagatga

SEQ ID NO: 388996 - DNA, 20 bp, Artificial
  CRISPR gRNA sequence
gtcatctttggacagatgaa

SEQ ID NO: 388997 - DNA, 20 bp, Artificial
  CRISPR gRNA sequence
tggacagatgaatgacattt

SEQ ID NO: 388998 - DNA, 20 bp, Artificial
  CRISPR gRNA sequence
ggacagatgaatgacatttt

SEQ ID NO: 388999 - DNA, 20 bp, Artificial
  CRISPR gRNA sequence
gacagatgaatgacattttt

SEQ ID NO: 389000 - DNA, 20 bp, Artificial
  CRISPR gRNA sequence
ttattaattaataagagtta

SEQ ID NO: 389001 - DNA, 20 bp, Artificial
  CRISPR gRNA sequence
tattaattaataagagttaa

SEQ ID NO: 389002 - DNA, 20 bp, Artificial
  CRISPR gRNA sequence
attaattaataagagttaaa

SEQ ID NO: 389003 - DNA, 20 bp, Artificial
  CRISPR gRNA sequence
ttaattaataagagttaaat

SEQ ID NO: 389004 - DNA, 20 bp, Artificial
  CRISPR gRNA sequence
attaataagagttaaataac

SEQ ID NO: 389005 - DNA, 20 bp, Artificial
  CRISPR gRNA sequence
ataagagttaaataaccata

SEQ ID NO: 389006 - DNA, 20 bp, Artificial
  CRISPR gRNA sequence
aataaccatatctcctaaaa

SEQ ID NO: 389007 - DNA, 20 bp, Artificial
  CRISPR gRNA sequence
ctaaaaatctgttaccttca

SEQ ID NO: 389008 - DNA, 20 bp, Artificial
  CRISPR gRNA sequence
aaaatctgttaccttcattt

SEQ ID NO: 389009 - DNA, 20 bp, Artificial
  CRISPR gRNA sequence
ttaccttcattttctctata

SEQ ID NO: 389010 - DNA, 20 bp, Artificial
  CRISPR gRNA sequence
ccttcattttctctataatt

SEQ ID NO: 389011 - DNA, 20 bp, Artificial
  CRISPR gRNA sequence
cattttctctataatttaag

SEQ ID NO: 389012 - DNA, 20 bp, Artificial
  CRISPR gRNA sequence
attttctctataatttaaga

SEQ ID NO: 389013 - DNA, 20 bp, Artificial
  CRISPR gRNA sequence
tctctataatttaagatgtt

SEQ ID NO: 389014 - DNA, 20 bp, Artificial
  CRISPR gRNA sequence
ctctataatttaagatgttt

SEQ ID NO: 389015 - DNA, 20 bp, Artificial
  CRISPR gRNA sequence
tctataatttaagatgttta

SEQ ID NO: 389016 - DNA, 20 bp, Artificial
  CRISPR gRNA sequence
tataatttaagatgtttaca

SEQ ID NO: 389017 - DNA, 20 bp, Artificial
  CRISPR gRNA sequence
taatttaagatgtttacaat

SEQ ID NO: 389018 - DNA, 20 bp, Artificial
  CRISPR gRNA sequence
aagatgtttacaattacttt

SEQ ID NO: 389019 - DNA, 20 bp, Artificial
  CRISPR gRNA sequence
agatgtttacaattactttt

SEQ ID NO: 389020 - DNA, 20 bp, Artificial
  CRISPR gRNA sequence
acaattactttttcagcata

SEQ ID NO: 389021 - DNA, 20 bp, Artificial
  CRISPR gRNA sequence
caattactttttcagcatat

SEQ ID NO: 389022 - DNA, 20 bp, Artificial
  CRISPR gRNA sequence
ctttttcagcatataatggg

SEQ ID NO: 389023 - DNA, 20 bp, Artificial
  CRISPR gRNA sequence
tttcagcatataatgggcaa

SEQ ID NO: 389024 - DNA, 20 bp, Artificial
  CRISPR gRNA sequence
ttcagcatataatgggcaaa

SEQ ID NO: 389025 - DNA, 20 bp, Artificial
  CRISPR gRNA sequence
tcagcatataatgggcaaaa

SEQ ID NO: 389026 - DNA, 20 bp, Artificial
  CRISPR gRNA sequence
cagcatataatgggcaaaat

SEQ ID NO: 389027 - DNA, 20 bp, Artificial
  CRISPR gRNA sequence
agcatataatgggcaaaatc

SEQ ID NO: 389028 - DNA, 20 bp, Artificial
  CRISPR gRNA sequence
atacgtgtttgaaaatgatt

SEQ ID NO: 389029 - DNA, 20 bp, Artificial
  CRISPR gRNA sequence
tacgtgtttgaaaatgattc

SEQ ID NO: 389030 - DNA, 20 bp, Artificial
  CRISPR gRNA sequence
gaaaatgattctttatgaca

SEQ ID NO: 389031 - DNA, 20 bp, Artificial
  CRISPR gRNA sequence
aaaatgattctttatgacac

SEQ ID NO: 389032 - DNA, 20 bp, Artificial
  CRISPR gRNA sequence
tttatgacacttttctgaat

SEQ ID NO: 389033 - DNA, 20 bp, Artificial
  CRISPR gRNA sequence
tatgacacttttctgaatag

SEQ ID NO: 389034 - DNA, 20 bp, Artificial
  CRISPR gRNA sequence
atgacacttttctgaataga

SEQ ID NO: 389035 - DNA, 20 bp, Artificial
  CRISPR gRNA sequence
tgacacttttctgaatagaa

SEQ ID NO: 389036 - DNA, 20 bp, Artificial
  CRISPR gRNA sequence
ttctgaatagaacatttttt

SEQ ID NO: 389037 - DNA, 20 bp, Artificial
  CRISPR gRNA sequence
tctgaatagaacattttttt

SEQ ID NO: 389038 - DNA, 20 bp, Artificial
  CRISPR gRNA sequence
ctgaatagaacatttttttc

SEQ ID NO: 389039 - DNA, 20 bp, Artificial
  CRISPR gRNA sequence
tgaatagaacatttttttct

SEQ ID NO: 389040 - DNA, 20 bp, Artificial
  CRISPR gRNA sequence
aatagaacatttttttcttg

SEQ ID NO: 389041 - DNA, 20 bp, Artificial
  CRISPR gRNA sequence
ttttcttgccttggtctcta

SEQ ID NO: 389042 - DNA, 20 bp, Artificial
  CRISPR gRNA sequence
tttcttgccttggtctctaa

SEQ ID NO: 389043 - DNA, 20 bp, Artificial
  CRISPR gRNA sequence
ttcttgccttggtctctaat

SEQ ID NO: 389044 - DNA, 20 bp, Artificial
  CRISPR gRNA sequence
tcttgccttggtctctaatc

SEQ ID NO: 389045 - DNA, 20 bp, Artificial
  CRISPR gRNA sequence
cttgccttggtctctaatct

SEQ ID NO: 389046 - DNA, 20 bp, Artificial
  CRISPR gRNA sequence
ttgccttggtctctaatctg

SEQ ID NO: 389047 - DNA, 20 bp, Artificial
  CRISPR gRNA sequence
gccttggtctctaatctgtt

SEQ ID NO: 389048 - DNA, 20 bp, Artificial
  CRISPR gRNA sequence
ccttggtctctaatctgttt

SEQ ID NO: 389049 - DNA, 20 bp, Artificial
  CRISPR gRNA sequence
ggtctctaatctgttttcac

SEQ ID NO: 389050 - DNA, 20 bp, Artificial
  CRISPR gRNA sequence
gtctctaatctgttttcact

SEQ ID NO: 389051 - DNA, 20 bp, Artificial
  CRISPR gRNA sequence
taatctgttttcactgtttc

SEQ ID NO: 389052 - DNA, 20 bp, Artificial
  CRISPR gRNA sequence
atctgttttcactgtttctt

SEQ ID NO: 389053 - DNA, 20 bp, Artificial
  CRISPR gRNA sequence
ttttcactgtttctttttcc

SEQ ID NO: 389054 - DNA, 20 bp, Artificial
  CRISPR gRNA sequence
tcactgtttctttttcctga

SEQ ID NO: 389055 - DNA, 20 bp, Artificial
  CRISPR gRNA sequence
cactgtttctttttcctgac

SEQ ID NO: 389056 - DNA, 20 bp, Artificial
  CRISPR gRNA sequence
actgtttctttttcctgacc

SEQ ID NO: 389057 - DNA, 20 bp, Artificial
  CRISPR gRNA sequence
tttctttttcctgaccagtt

SEQ ID NO: 389058 - DNA, 20 bp, Artificial
  CRISPR gRNA sequence
ctttttcctgaccagtttca

SEQ ID NO: 389059 - DNA, 20 bp, Artificial
  CRISPR gRNA sequence
tttttcctgaccagtttcaa

SEQ ID NO: 389060 - DNA, 20 bp, Artificial
  CRISPR gRNA sequence
tttcctgaccagtttcaaaa

SEQ ID NO: 389061 - DNA, 20 bp, Artificial
  CRISPR gRNA sequence
ttcctgaccagtttcaaaaa

SEQ ID NO: 389062 - DNA, 20 bp, Artificial
  CRISPR gRNA sequence
tcctgaccagtttcaaaaaa

SEQ ID NO: 389063 - DNA, 20 bp, Artificial
  CRISPR gRNA sequence
cctgaccagtttcaaaaaat

SEQ ID NO: 389064 - DNA, 20 bp, Artificial
  CRISPR gRNA sequence
ctgaccagtttcaaaaaata

SEQ ID NO: 389065 - DNA, 20 bp, Artificial
  CRISPR gRNA sequence
accagtttcaaaaaatactt

SEQ ID NO: 389066 - DNA, 20 bp, Artificial
  CRISPR gRNA sequence
caaaaaatacttccataatg

SEQ ID NO: 389067 - DNA, 20 bp, Artificial
  CRISPR gRNA sequence
aaaaaatacttccataatgc

SEQ ID NO: 389068 - DNA, 20 bp, Artificial
  CRISPR gRNA sequence
ccataatgcaagggattttt

SEQ ID NO: 389069 - DNA, 20 bp, Artificial
  CRISPR gRNA sequence
cataatgcaagggattttta

SEQ ID NO: 389070 - DNA, 20 bp, Artificial
  CRISPR gRNA sequence
ttaggtaagaagttcttttt

SEQ ID NO: 389071 - DNA, 20 bp, Artificial
  CRISPR gRNA sequence
taggtaagaagttctttttg

SEQ ID NO: 389072 - DNA, 20 bp, Artificial
  CRISPR gRNA sequence
aggtaagaagttctttttgt

SEQ ID NO: 389073 - DNA, 20 bp, Artificial
  CRISPR gRNA sequence
ggtaagaagttctttttgtc

SEQ ID NO: 389074 - DNA, 20 bp, Artificial
  CRISPR gRNA sequence
tttttgtctgtgtctgaagg

SEQ ID NO: 389075 - DNA, 20 bp, Artificial
  CRISPR gRNA sequence
tttgtctgtgtctgaaggaa

SEQ ID NO: 389076 - DNA, 20 bp, Artificial
  CRISPR gRNA sequence
ttgtctgtgtctgaaggaac

SEQ ID NO: 389077 - DNA, 20 bp, Artificial
  CRISPR gRNA sequence
tgtctgtgtctgaaggaaca

SEQ ID NO: 389078 - DNA, 20 bp, Artificial
  CRISPR gRNA sequence
gtctgtgtctgaaggaacag

SEQ ID NO: 389079 - DNA, 20 bp, Artificial
  CRISPR gRNA sequence
tctgtgtctgaaggaacaga

SEQ ID NO: 389080 - DNA, 20 bp, Artificial
  CRISPR gRNA sequence
tgtctgaaggaacagagtca

SEQ ID NO: 389081 - DNA, 20 bp, Artificial
  CRISPR gRNA sequence
aaggaacagagtcaacattt

SEQ ID NO: 389082 - DNA, 20 bp, Artificial
  CRISPR gRNA sequence
aaaatgaggagtctctgcta

SEQ ID NO: 389083 - DNA, 20 bp, Artificial
  CRISPR gRNA sequence
aaatgaggagtctctgctaa

SEQ ID NO: 389084 - DNA, 20 bp, Artificial
  CRISPR gRNA sequence
tgctaatttttcctccccca

SEQ ID NO: 389085 - DNA, 20 bp, Artificial
  CRISPR gRNA sequence
ctaatttttcctcccccaaa

SEQ ID NO: 389086 - DNA, 20 bp, Artificial
  CRISPR gRNA sequence
atttttcctcccccaaatat

SEQ ID NO: 389087 - DNA, 20 bp, Artificial
  CRISPR gRNA sequence
ttcctcccccaaatatttca

SEQ ID NO: 389088 - DNA, 20 bp, Artificial
  CRISPR gRNA sequence
tcctcccccaaatatttcac

SEQ ID NO: 389089 - DNA, 20 bp, Artificial
  CRISPR gRNA sequence
cctcccccaaatatttcacc

SEQ ID NO: 389090 - DNA, 20 bp, Artificial
  CRISPR gRNA sequence
ctcccccaaatatttcacca

SEQ ID NO: 389091 - DNA, 20 bp, Artificial
  CRISPR gRNA sequence
ccccaaatatttcaccaacc

SEQ ID NO: 389092 - DNA, 20 bp, Artificial
  CRISPR gRNA sequence
caccaaccactcatcatttt

SEQ ID NO: 389093 - DNA, 20 bp, Artificial
  CRISPR gRNA sequence
accaaccactcatcattttc

SEQ ID NO: 389094 - DNA, 20 bp, Artificial
  CRISPR gRNA sequence
atcattttcattaaattcta

SEQ ID NO: 389095 - DNA, 20 bp, Artificial
  CRISPR gRNA sequence
tcattaaattctaagtccaa

SEQ ID NO: 389096 - DNA, 20 bp, Artificial
  CRISPR gRNA sequence
cattaaattctaagtccaat

SEQ ID NO: 389097 - DNA, 20 bp, Artificial
  CRISPR gRNA sequence
attaaattctaagtccaatg

SEQ ID NO: 389098 - DNA, 20 bp, Artificial
  CRISPR gRNA sequence
aattctaagtccaatgtatg

SEQ ID NO: 389099 - DNA, 20 bp, Artificial
  CRISPR gRNA sequence
taagtccaatgtatgtctca

SEQ ID NO: 389100 - DNA, 20 bp, Artificial
  CRISPR gRNA sequence
agtccaatgtatgtctcacc

SEQ ID NO: 389101 - DNA, 20 bp, Artificial
  CRISPR gRNA sequence
accacagttcctagaggaac

SEQ ID NO: 389102 - DNA, 20 bp, Artificial
  CRISPR gRNA sequence
ctagaggaacaagggaggct

SEQ ID NO: 389103 - DNA, 20 bp, Artificial
  CRISPR gRNA sequence
gaggaacaagggaggcttga

SEQ ID NO: 389104 - DNA, 20 bp, Artificial
  CRISPR gRNA sequence
gatgtggtccaaggtgattg

SEQ ID NO: 389105 - DNA, 20 bp, Artificial
  CRISPR gRNA sequence
atgtggtccaaggtgattgt

SEQ ID NO: 389106 - DNA, 20 bp, Artificial
  CRISPR gRNA sequence
tgtatgaaaagatgttattc

SEQ ID NO: 389107 - DNA, 20 bp, Artificial
  CRISPR gRNA sequence
ttccctgaaaatgctctcct

SEQ ID NO: 389108 - DNA, 20 bp, Artificial
  CRISPR gRNA sequence
cctgaaaatgctctccttat

SEQ ID NO: 389109 - DNA, 20 bp, Artificial
  CRISPR gRNA sequence
aaaatgctctccttattata

SEQ ID NO: 389110 - DNA, 20 bp, Artificial
  CRISPR gRNA sequence
tccttattatacacagagct

SEQ ID NO: 389111 - DNA, 20 bp, Artificial
  CRISPR gRNA sequence
cttattatacacagagctat

SEQ ID NO: 389112 - DNA, 20 bp, Artificial
  CRISPR gRNA sequence
attatacacagagctatagt

SEQ ID NO: 389113 - DNA, 20 bp, Artificial
  CRISPR gRNA sequence
ttatacacagagctatagtg

SEQ ID NO: 389114 - DNA, 20 bp, Artificial
  CRISPR gRNA sequence
tacacagagctatagtggaa

SEQ ID NO: 389115 - DNA, 20 bp, Artificial
  CRISPR gRNA sequence
tagtggaagcttctgtttat

SEQ ID NO: 389116 - DNA, 20 bp, Artificial
  CRISPR gRNA sequence
ctgtttatacaagacctttt

SEQ ID NO: 389117 - DNA, 20 bp, Artificial
  CRISPR gRNA sequence
tgtttatacaagaccttttc

SEQ ID NO: 389118 - DNA, 20 bp, Artificial
  CRISPR gRNA sequence
tttatacaagaccttttctt

SEQ ID NO: 389119 - DNA, 20 bp, Artificial
  CRISPR gRNA sequence
atacaagaccttttcttctt

SEQ ID NO: 389120 - DNA, 20 bp, Artificial
  CRISPR gRNA sequence
tacaagaccttttcttcttc

SEQ ID NO: 389121 - DNA, 20 bp, Artificial
  CRISPR gRNA sequence
ttcttcttcattttcaacac

SEQ ID NO: 389122 - DNA, 20 bp, Artificial
  CRISPR gRNA sequence
tcttcttcattttcaacaca

SEQ ID NO: 389123 - DNA, 20 bp, Artificial
  CRISPR gRNA sequence
cttcttcattttcaacacag

SEQ ID NO: 389124 - DNA, 20 bp, Artificial
  CRISPR gRNA sequence
ttcttcattttcaacacagg

SEQ ID NO: 389125 - DNA, 20 bp, Artificial
  CRISPR gRNA sequence
cttcattttcaacacaggaa

SEQ ID NO: 389126 - DNA, 20 bp, Artificial
  CRISPR gRNA sequence
ttcattttcaacacaggaag

SEQ ID NO: 389127 - DNA, 20 bp, Artificial
  CRISPR gRNA sequence
cattttcaacacaggaagaa

SEQ ID NO: 389128 - DNA, 20 bp, Artificial
  CRISPR gRNA sequence
attttcaacacaggaagaaa

SEQ ID NO: 389129 - DNA, 20 bp, Artificial
  CRISPR gRNA sequence
tcaacacaggaagaaatatc

SEQ ID NO: 389130 - DNA, 20 bp, Artificial
  CRISPR gRNA sequence
caacacaggaagaaatatca

SEQ ID NO: 389131 - DNA, 20 bp, Artificial
  CRISPR gRNA sequence
aacacaggaagaaatatcag

SEQ ID NO: 389132 - DNA, 20 bp, Artificial
  CRISPR gRNA sequence
gcaatatgagcaaagtctat

SEQ ID NO: 389133 - DNA, 20 bp, Artificial
  CRISPR gRNA sequence
caatatgagcaaagtctata

SEQ ID NO: 389134 - DNA, 20 bp, Artificial
  CRISPR gRNA sequence
taaagggacagccaaagcct

SEQ ID NO: 389135 - DNA, 20 bp, Artificial
  CRISPR gRNA sequence
gcaagcgttggctctacaag

SEQ ID NO: 389136 - DNA, 20 bp, Artificial
  CRISPR gRNA sequence
gctctacaagtctaacataa

SEQ ID NO: 389137 - DNA, 20 bp, Artificial
  CRISPR gRNA sequence
tacaagtctaacataagtca

SEQ ID NO: 389138 - DNA, 20 bp, Artificial
  CRISPR gRNA sequence
caagtctaacataagtcaaa

SEQ ID NO: 389139 - DNA, 20 bp, Artificial
  CRISPR gRNA sequence
acataagtcaaaggtaaatt

SEQ ID NO: 389140 - DNA, 20 bp, Artificial
  CRISPR gRNA sequence
gctggctgaaagcatgtgga

SEQ ID NO: 389141 - DNA, 20 bp, Artificial
  CRISPR gRNA sequence
gctgaaagcatgtggaaggg

SEQ ID NO: 389142 - DNA, 20 bp, Artificial
  CRISPR gRNA sequence
aaagcatgtggaagggagaa

SEQ ID NO: 389143 - DNA, 20 bp, Artificial
  CRISPR gRNA sequence
taatacaggcctctacacag

SEQ ID NO: 389144 - DNA, 20 bp, Artificial
  CRISPR gRNA sequence
tacacagaactctatatgga

SEQ ID NO: 389145 - DNA, 20 bp, Artificial
  CRISPR gRNA sequence
cacagaactctatatggacc

SEQ ID NO: 389146 - DNA, 20 bp, Artificial
  CRISPR gRNA sequence
tatatggacctctatatttg

SEQ ID NO: 389147 - DNA, 20 bp, Artificial
  CRISPR gRNA sequence
tatggacctctatatttgta

SEQ ID NO: 389148 - DNA, 20 bp, Artificial
  CRISPR gRNA sequence
tatatttgtacttctgtaaa

SEQ ID NO: 389149 - DNA, 20 bp, Artificial
  CRISPR gRNA sequence
tatttgtacttctgtaaata

SEQ ID NO: 389150 - DNA, 20 bp, Artificial
  CRISPR gRNA sequence
gtacttctgtaaataaaaaa

SEQ ID NO: 389151 - DNA, 20 bp, Artificial
  CRISPR gRNA sequence
tacttctgtaaataaaaaaa

SEQ ID NO: 389152 - DNA, 20 bp, Artificial
  CRISPR gRNA sequence
ctgtaaataaaaaaaaaatc

SEQ ID NO: 389153 - DNA, 20 bp, Artificial
  CRISPR gRNA sequence
tgtaaataaaaaaaaaatca

SEQ ID NO: 389154 - DNA, 20 bp, Artificial
  CRISPR gRNA sequence
taaataaaaaaaaaatcact

SEQ ID NO: 389155 - DNA, 20 bp, Artificial
  CRISPR gRNA sequence
tttctcacaatcatacaaag

SEQ ID NO: 389156 - DNA, 20 bp, Artificial
  CRISPR gRNA sequence
ttctcacaatcatacaaagt

SEQ ID NO: 389157 - DNA, 20 bp, Artificial
  CRISPR gRNA sequence
tctcacaatcatacaaagtg

SEQ ID NO: 389158 - DNA, 20 bp, Artificial
  CRISPR gRNA sequence
ctcacaatcatacaaagtgg

SEQ ID NO: 389159 - DNA, 20 bp, Artificial
  CRISPR gRNA sequence
tcacaatcatacaaagtgga

SEQ ID NO: 389160 - DNA, 20 bp, Artificial
  CRISPR gRNA sequence
acaatcatacaaagtggatc

SEQ ID NO: 389161 - DNA, 20 bp, Artificial
  CRISPR gRNA sequence
ggttttgtgggggctggaat

SEQ ID NO: 389162 - DNA, 20 bp, Artificial
  CRISPR gRNA sequence
tgtgggggctggaatcttac

SEQ ID NO: 389163 - DNA, 20 bp, Artificial
  CRISPR gRNA sequence
gtgggggctggaatcttaca

SEQ ID NO: 389164 - DNA, 20 bp, Artificial
  CRISPR gRNA sequence
tgggggctggaatcttacac

SEQ ID NO: 389165 - DNA, 20 bp, Artificial
  CRISPR gRNA sequence
gaatcttacacaatttaagg

SEQ ID NO: 389166 - DNA, 20 bp, Artificial
  CRISPR gRNA sequence
acacaatttaaggattcatt

SEQ ID NO: 389167 - DNA, 20 bp, Artificial
  CRISPR gRNA sequence
cacaatttaaggattcattg

SEQ ID NO: 389168 - DNA, 20 bp, Artificial
  CRISPR gRNA sequence
aaggattcattgtgacaaaa

SEQ ID NO: 389169 - DNA, 20 bp, Artificial
  CRISPR gRNA sequence
aggattcattgtgacaaaag

SEQ ID NO: 389170 - DNA, 20 bp, Artificial
  CRISPR gRNA sequence
attgtgacaaaagagacaaa

SEQ ID NO: 389171 - DNA, 20 bp, Artificial
  CRISPR gRNA sequence
tgacaaaagagacaaatgcc

SEQ ID NO: 389172 - DNA, 20 bp, Artificial
  CRISPR gRNA sequence
atacacaaatagtgcagtgc

SEQ ID NO: 389173 - DNA, 20 bp, Artificial
  CRISPR gRNA sequence
tggaaggggcctgctcaagt

SEQ ID NO: 389174 - DNA, 20 bp, Artificial
  CRISPR gRNA sequence
ggaaggggcctgctcaagtg

SEQ ID NO: 389175 - DNA, 20 bp, Artificial
  CRISPR gRNA sequence
gaaggggcctgctcaagtgg

SEQ ID NO: 389176 - DNA, 20 bp, Artificial
  CRISPR gRNA sequence
ctcaagtgggaggaaggaag

SEQ ID NO: 389177 - DNA, 20 bp, Artificial
  CRISPR gRNA sequence
aagtgggaggaaggaaggaa

SEQ ID NO: 389178 - DNA, 20 bp, Artificial
  CRISPR gRNA sequence
ttttctcttccgtgtcccga

SEQ ID NO: 389179 - DNA, 20 bp, Artificial
  CRISPR gRNA sequence
tctcttccgtgtcccgacag

SEQ ID NO: 389180 - DNA, 20 bp, Artificial
  CRISPR gRNA sequence
ctcttccgtgtcccgacagt

SEQ ID NO: 389181 - DNA, 20 bp, Artificial
  CRISPR gRNA sequence
tcttccgtgtcccgacagtg

SEQ ID NO: 389182 - DNA, 20 bp, Artificial
  CRISPR gRNA sequence
ttccgtgtcccgacagtgag

SEQ ID NO: 389183 - DNA, 20 bp, Artificial
  CRISPR gRNA sequence
ccgtgtcccgacagtgagga

SEQ ID NO: 389184 - DNA, 20 bp, Artificial
  CRISPR gRNA sequence
cgtgtcccgacagtgaggaa

SEQ ID NO: 389185 - DNA, 20 bp, Artificial
  CRISPR gRNA sequence
gcccagaggcagagctggga

SEQ ID NO: 389186 - DNA, 20 bp, Artificial
  CRISPR gRNA sequence
ggagagcctgggatggcctt

SEQ ID NO: 389187 - DNA, 20 bp, Artificial
  CRISPR gRNA sequence
ggatggccttcctctctctc

SEQ ID NO: 389188 - DNA, 20 bp, Artificial
  CRISPR gRNA sequence
cctctctctcaactgtaatg

SEQ ID NO: 389189 - DNA, 20 bp, Artificial
  CRISPR gRNA sequence
ctctctctcaactgtaatgc

SEQ ID NO: 389190 - DNA, 20 bp, Artificial
  CRISPR gRNA sequence
tctctcaactgtaatgcagg

SEQ ID NO: 389191 - DNA, 20 bp, Artificial
  CRISPR gRNA sequence
tctcaactgtaatgcaggcc

SEQ ID NO: 389192 - DNA, 20 bp, Artificial
  CRISPR gRNA sequence
tcaactgtaatgcaggcctc

SEQ ID NO: 389193 - DNA, 20 bp, Artificial
  CRISPR gRNA sequence
aactgtaatgcaggcctcta

SEQ ID NO: 389194 - DNA, 20 bp, Artificial
  CRISPR gRNA sequence
taatgcaggcctctacacag

SEQ ID NO: 389195 - DNA, 20 bp, Artificial
  CRISPR gRNA sequence
tacacagacctctatatggg

SEQ ID NO: 389196 - DNA, 20 bp, Artificial
  CRISPR gRNA sequence
cacagacctctatatgggcc

SEQ ID NO: 389197 - DNA, 20 bp, Artificial
  CRISPR gRNA sequence
tatatgggcctctctatatt

SEQ ID NO: 389198 - DNA, 20 bp, Artificial
  CRISPR gRNA sequence
tatgggcctctctatattag

SEQ ID NO: 389199 - DNA, 20 bp, Artificial
  CRISPR gRNA sequence
tctatattagcacttctgta

SEQ ID NO: 389200 - DNA, 20 bp, Artificial
  CRISPR gRNA sequence
tatattagcacttctgtaag

SEQ ID NO: 389201 - DNA, 20 bp, Artificial
  CRISPR gRNA sequence
tattagcacttctgtaagtg

SEQ ID NO: 389202 - DNA, 20 bp, Artificial
  CRISPR gRNA sequence
gcacttctgtaagtgaaaga

SEQ ID NO: 389203 - DNA, 20 bp, Artificial
  CRISPR gRNA sequence
ctgtaagtgaaagaaattac

SEQ ID NO: 389204 - DNA, 20 bp, Artificial
  CRISPR gRNA sequence
tgtaagtgaaagaaattact

SEQ ID NO: 389205 - DNA, 20 bp, Artificial
  CRISPR gRNA sequence
taagtgaaagaaattacttt

SEQ ID NO: 389206 - DNA, 20 bp, Artificial
  CRISPR gRNA sequence
ctttttctcatactcatgca

SEQ ID NO: 389207 - DNA, 20 bp, Artificial
  CRISPR gRNA sequence
tttctcatactcatgcaaag

SEQ ID NO: 389208 - DNA, 20 bp, Artificial
  CRISPR gRNA sequence
ttctcatactcatgcaaagt

SEQ ID NO: 389209 - DNA, 20 bp, Artificial
  CRISPR gRNA sequence
tctcatactcatgcaaagtg

SEQ ID NO: 389210 - DNA, 20 bp, Artificial
  CRISPR gRNA sequence
ctcatactcatgcaaagtgg

SEQ ID NO: 389211 - DNA, 20 bp, Artificial
  CRISPR gRNA sequence
tcatactcatgcaaagtgga

SEQ ID NO: 389212 - DNA, 20 bp, Artificial
  CRISPR gRNA sequence
atactcatgcaaagtggatc

SEQ ID NO: 389213 - DNA, 20 bp, Artificial
  CRISPR gRNA sequence
atgcaaagtggatctaggtt

SEQ ID NO: 389214 - DNA, 20 bp, Artificial
  CRISPR gRNA sequence
ggttttgcaggtcctgaaac

SEQ ID NO: 389215 - DNA, 20 bp, Artificial
  CRISPR gRNA sequence
tgcaggtcctgaaacacaat

SEQ ID NO: 389216 - DNA, 20 bp, Artificial
  CRISPR gRNA sequence
gcaggtcctgaaacacaatg

SEQ ID NO: 389217 - DNA, 20 bp, Artificial
  CRISPR gRNA sequence
caggtcctgaaacacaatga

SEQ ID NO: 389218 - DNA, 20 bp, Artificial
  CRISPR gRNA sequence
aaacacaatgaaaggcttca

SEQ ID NO: 389219 - DNA, 20 bp, Artificial
  CRISPR gRNA sequence
cattgtgacaaaaaaaagac

SEQ ID NO: 389220 - DNA, 20 bp, Artificial
  CRISPR gRNA sequence
attgtgacaaaaaaaagaca

SEQ ID NO: 389221 - DNA, 20 bp, Artificial
  CRISPR gRNA sequence
tgacaaaaaaaagacaaatg

SEQ ID NO: 389222 - DNA, 20 bp, Artificial
  CRISPR gRNA sequence
atatacaaatagtgtggtgc

SEQ ID NO: 389223 - DNA, 20 bp, Artificial
  CRISPR gRNA sequence
ggaggaggccttggaggagg

SEQ ID NO: 389224 - DNA, 20 bp, Artificial
  CRISPR gRNA sequence
gaggaggccttggaggaggt

SEQ ID NO: 389225 - DNA, 20 bp, Artificial
  CRISPR gRNA sequence
ggaggaggtggaagccccaa

SEQ ID NO: 389226 - DNA, 20 bp, Artificial
  CRISPR gRNA sequence
gaggaggtggaagccccaaa

SEQ ID NO: 389227 - DNA, 20 bp, Artificial
  CRISPR gRNA sequence
caccagcacaaagattatac

SEQ ID NO: 389228 - DNA, 20 bp, Artificial
  CRISPR gRNA sequence
accagcacaaagattatact

SEQ ID NO: 389229 - DNA, 20 bp, Artificial
  CRISPR gRNA sequence
tactcagtaatggtcaccaa

SEQ ID NO: 389230 - DNA, 20 bp, Artificial
  CRISPR gRNA sequence
agtaatggtcaccaaagatc

SEQ ID NO: 389231 - DNA, 20 bp, Artificial
  CRISPR gRNA sequence
agtcagtggttcttatagta

SEQ ID NO: 389232 - DNA, 20 bp, Artificial
  CRISPR gRNA sequence
ttatagtatgtttgggggtc

SEQ ID NO: 389233 - DNA, 20 bp, Artificial
  CRISPR gRNA sequence
atagtatgtttgggggtccc

SEQ ID NO: 389234 - DNA, 20 bp, Artificial
  CRISPR gRNA sequence
tagtatgtttgggggtccct

SEQ ID NO: 389235 - DNA, 20 bp, Artificial
  CRISPR gRNA sequence
gggggtccctgaggatccct

SEQ ID NO: 389236 - DNA, 20 bp, Artificial
  CRISPR gRNA sequence
ggggtccctgaggatccctg

SEQ ID NO: 389237 - DNA, 20 bp, Artificial
  CRISPR gRNA sequence
aggatccctgtgtccctttt

SEQ ID NO: 389238 - DNA, 20 bp, Artificial
  CRISPR gRNA sequence
tgtcccttttggggatctgc

SEQ ID NO: 389239 - DNA, 20 bp, Artificial
  CRISPR gRNA sequence
ttggggatctgcaaggtcaa

SEQ ID NO: 389240 - DNA, 20 bp, Artificial
  CRISPR gRNA sequence
tggggatctgcaaggtcaaa

SEQ ID NO: 389241 - DNA, 20 bp, Artificial
  CRISPR gRNA sequence
ggggatctgcaaggtcaaac

SEQ ID NO: 389242 - DNA, 20 bp, Artificial
  CRISPR gRNA sequence
gggatctgcaaggtcaaacc

SEQ ID NO: 389243 - DNA, 20 bp, Artificial
  CRISPR gRNA sequence
caaggtcaaacctattttcc

SEQ ID NO: 389244 - DNA, 20 bp, Artificial
  CRISPR gRNA sequence
ttttcctagtaatattaaga

SEQ ID NO: 389245 - DNA, 20 bp, Artificial
  CRISPR gRNA sequence
tcctagtaatattaagatgc

SEQ ID NO: 389246 - DNA, 20 bp, Artificial
  CRISPR gRNA sequence
cctagtaatattaagatgca

SEQ ID NO: 389247 - DNA, 20 bp, Artificial
  CRISPR gRNA sequence
ctagtaatattaagatgcaa

SEQ ID NO: 389248 - DNA, 20 bp, Artificial
  CRISPR gRNA sequence
gtaatattaagatgcaacat

SEQ ID NO: 389249 - DNA, 20 bp, Artificial
  CRISPR gRNA sequence
agatgcaacatcagtctgtt

SEQ ID NO: 389250 - DNA, 20 bp, Artificial
  CRISPR gRNA sequence
tttctgcatccacatctgaa

SEQ ID NO: 389251 - DNA, 20 bp, Artificial
  CRISPR gRNA sequence
ctgcatccacatctgaaaaa

SEQ ID NO: 389252 - DNA, 20 bp, Artificial
  CRISPR gRNA sequence
tgcatccacatctgaaaaag

SEQ ID NO: 389253 - DNA, 20 bp, Artificial
  CRISPR gRNA sequence
catccacatctgaaaaagac

SEQ ID NO: 389254 - DNA, 20 bp, Artificial
  CRISPR gRNA sequence
aaaaagactgagagaaaaaa

SEQ ID NO: 389255 - DNA, 20 bp, Artificial
  CRISPR gRNA sequence
agagaaaaaaaggctcctgt

SEQ ID NO: 389256 - DNA, 20 bp, Artificial
  CRISPR gRNA sequence
ctgtctggcaaactggcaac

SEQ ID NO: 389257 - DNA, 20 bp, Artificial
  CRISPR gRNA sequence
tctggcaaactggcaaccgc

SEQ ID NO: 389258 - DNA, 20 bp, Artificial
  CRISPR gRNA sequence
gcaaactggcaaccgcattc

SEQ ID NO: 389259 - DNA, 20 bp, Artificial
  CRISPR gRNA sequence
gcaaccgcattctcaaacac

SEQ ID NO: 389260 - DNA, 20 bp, Artificial
  CRISPR gRNA sequence
tcaaacacctgctgaaatgc

SEQ ID NO: 389261 - DNA, 20 bp, Artificial
  CRISPR gRNA sequence
aaacacctgctgaaatgcac

SEQ ID NO: 389262 - DNA, 20 bp, Artificial
  CRISPR gRNA sequence
ctgaaatgcactcaacgcag

SEQ ID NO: 389263 - DNA, 20 bp, Artificial
  CRISPR gRNA sequence
aaatgcactcaacgcagccc

SEQ ID NO: 389264 - DNA, 20 bp, Artificial
  CRISPR gRNA sequence
aacgcagccctgcttcagcc

SEQ ID NO: 389265 - DNA, 20 bp, Artificial
  CRISPR gRNA sequence
cttcagccatatcaacctag

SEQ ID NO: 389266 - DNA, 20 bp, Artificial
  CRISPR gRNA sequence
cagccatatcaacctagcac

SEQ ID NO: 389267 - DNA, 20 bp, Artificial
  CRISPR gRNA sequence
agccatatcaacctagcact

SEQ ID NO: 389268 - DNA, 20 bp, Artificial
  CRISPR gRNA sequence
gcactgtcttgtattgctgg

SEQ ID NO: 389269 - DNA, 20 bp, Artificial
  CRISPR gRNA sequence
tcttgtattgctggggtatg

SEQ ID NO: 389270 - DNA, 20 bp, Artificial
  CRISPR gRNA sequence
gtattgctggggtatgtggg

SEQ ID NO: 389271 - DNA, 20 bp, Artificial
  CRISPR gRNA sequence
tattgctggggtatgtgggg

SEQ ID NO: 389272 - DNA, 20 bp, Artificial
  CRISPR gRNA sequence
ctggggtatgtggggattct

SEQ ID NO: 389273 - DNA, 20 bp, Artificial
  CRISPR gRNA sequence
gggtatgtggggattctaac

SEQ ID NO: 389274 - DNA, 20 bp, Artificial
  CRISPR gRNA sequence
taacaccttatcaccaccat

SEQ ID NO: 389275 - DNA, 20 bp, Artificial
  CRISPR gRNA sequence
acaccttatcaccaccatca

SEQ ID NO: 389276 - DNA, 20 bp, Artificial
  CRISPR gRNA sequence
atcaccaccatcaaaaatat

SEQ ID NO: 389277 - DNA, 20 bp, Artificial
  CRISPR gRNA sequence
tcaccaccatcaaaaatatt

SEQ ID NO: 389278 - DNA, 20 bp, Artificial
  CRISPR gRNA sequence
atgtaattgggaagatagga

SEQ ID NO: 389279 - DNA, 20 bp, Artificial
  CRISPR gRNA sequence
ggaagataggagttctacag

SEQ ID NO: 389280 - DNA, 20 bp, Artificial
  CRISPR gRNA sequence
tacagctgaaacctgaaggc

SEQ ID NO: 389281 - DNA, 20 bp, Artificial
  CRISPR gRNA sequence
cagctgaaacctgaaggctg

SEQ ID NO: 389282 - DNA, 20 bp, Artificial
  CRISPR gRNA sequence
aaacctgaaggctggtaata

SEQ ID NO: 389283 - DNA, 20 bp, Artificial
  CRISPR gRNA sequence
aaggctggtaataccatatg

SEQ ID NO: 389284 - DNA, 20 bp, Artificial
  CRISPR gRNA sequence
gtaataccatatgtttttca

SEQ ID NO: 389285 - DNA, 20 bp, Artificial
  CRISPR gRNA sequence
ttcagccctttacgaatttc

SEQ ID NO: 389286 - DNA, 20 bp, Artificial
  CRISPR gRNA sequence
tcagccctttacgaatttct

SEQ ID NO: 389287 - DNA, 20 bp, Artificial
  CRISPR gRNA sequence
cagccctttacgaatttctt

SEQ ID NO: 389288 - DNA, 20 bp, Artificial
  CRISPR gRNA sequence
agccctttacgaatttcttt

SEQ ID NO: 389289 - DNA, 20 bp, Artificial
  CRISPR gRNA sequence
tacgaatttcttttttaagc

SEQ ID NO: 389290 - DNA, 20 bp, Artificial
  CRISPR gRNA sequence
acgaatttcttttttaagct

SEQ ID NO: 389291 - DNA, 20 bp, Artificial
  CRISPR gRNA sequence
cgaatttcttttttaagctt

SEQ ID NO: 389292 - DNA, 20 bp, Artificial
  CRISPR gRNA sequence
cttttttaagcttcaggatg

SEQ ID NO: 389293 - DNA, 20 bp, Artificial
  CRISPR gRNA sequence
ttttttaagcttcaggatgg

SEQ ID NO: 389294 - DNA, 20 bp, Artificial
  CRISPR gRNA sequence
ttttaagcttcaggatggtg

SEQ ID NO: 389295 - DNA, 20 bp, Artificial
  CRISPR gRNA sequence
tttaagcttcaggatggtgg

SEQ ID NO: 389296 - DNA, 20 bp, Artificial
  CRISPR gRNA sequence
ttaagcttcaggatggtggc

SEQ ID NO: 389297 - DNA, 20 bp, Artificial
  CRISPR gRNA sequence
taagcttcaggatggtggca

SEQ ID NO: 389298 - DNA, 20 bp, Artificial
  CRISPR gRNA sequence
aagcttcaggatggtggcag

SEQ ID NO: 389299 - DNA, 20 bp, Artificial
  CRISPR gRNA sequence
agcttcaggatggtggcaga

SEQ ID NO: 389300 - DNA, 20 bp, Artificial
  CRISPR gRNA sequence
caggatggtggcagataaga

SEQ ID NO: 389301 - DNA, 20 bp, Artificial
  CRISPR gRNA sequence
aggatggtggcagataagaa

SEQ ID NO: 389302 - DNA, 20 bp, Artificial
  CRISPR gRNA sequence
gaaagatttttattgctgta

SEQ ID NO: 389303 - DNA, 20 bp, Artificial
  CRISPR gRNA sequence
ttattgctgtatctgattga

SEQ ID NO: 389304 - DNA, 20 bp, Artificial
  CRISPR gRNA sequence
tattgctgtatctgattgat

SEQ ID NO: 389305 - DNA, 20 bp, Artificial
  CRISPR gRNA sequence
attgctgtatctgattgatg

SEQ ID NO: 389306 - DNA, 20 bp, Artificial
  CRISPR gRNA sequence
ttgctgtatctgattgatgg

SEQ ID NO: 389307 - DNA, 20 bp, Artificial
  CRISPR gRNA sequence
ctgtatctgattgatggatt

SEQ ID NO: 389308 - DNA, 20 bp, Artificial
  CRISPR gRNA sequence
tatctgattgatggattcac

SEQ ID NO: 389309 - DNA, 20 bp, Artificial
  CRISPR gRNA sequence
attgatggattcacaagata

SEQ ID NO: 389310 - DNA, 20 bp, Artificial
  CRISPR gRNA sequence
atggattcacaagataaaga

SEQ ID NO: 389311 - DNA, 20 bp, Artificial
  CRISPR gRNA sequence
acaagataaagaaaccctca

SEQ ID NO: 389312 - DNA, 20 bp, Artificial
  CRISPR gRNA sequence
aatactagaataatggccaa

SEQ ID NO: 389313 - DNA, 20 bp, Artificial
  CRISPR gRNA sequence
gaataatggccaactcacct

SEQ ID NO: 389314 - DNA, 20 bp, Artificial
  CRISPR gRNA sequence
acctaaattcagccatttaa

SEQ ID NO: 389315 - DNA, 20 bp, Artificial
  CRISPR gRNA sequence
aattcagccatttaaaaaaa

SEQ ID NO: 389316 - DNA, 20 bp, Artificial
  CRISPR gRNA sequence
agccatttaaaaaaatgctg

SEQ ID NO: 389317 - DNA, 20 bp, Artificial
  CRISPR gRNA sequence
aaaaaaatgctgaatatgcg

SEQ ID NO: 389318 - DNA, 20 bp, Artificial
  CRISPR gRNA sequence
aaaaaatgctgaatatgcgc

SEQ ID NO: 389319 - DNA, 20 bp, Artificial
  CRISPR gRNA sequence
aatatgcgcattaaatgaac

SEQ ID NO: 389320 - DNA, 20 bp, Artificial
  CRISPR gRNA sequence
aatgaacatgtttaccataa

SEQ ID NO: 389321 - DNA, 20 bp, Artificial
  CRISPR gRNA sequence
accataaataaaaacagaga

SEQ ID NO: 389322 - DNA, 20 bp, Artificial
  CRISPR gRNA sequence
ccataaataaaaacagagac

SEQ ID NO: 389323 - DNA, 20 bp, Artificial
  CRISPR gRNA sequence
gctttttccatgtttgatac

SEQ ID NO: 389324 - DNA, 20 bp, Artificial
  CRISPR gRNA sequence
tttccatgtttgataccaga

SEQ ID NO: 389325 - DNA, 20 bp, Artificial
  CRISPR gRNA sequence
ttccatgtttgataccagaa

SEQ ID NO: 389326 - DNA, 20 bp, Artificial
  CRISPR gRNA sequence
tccatgtttgataccagaag

SEQ ID NO: 389327 - DNA, 20 bp, Artificial
  CRISPR gRNA sequence
ccatgtttgataccagaaga

SEQ ID NO: 389328 - DNA, 20 bp, Artificial
  CRISPR gRNA sequence
catgtttgataccagaagat

SEQ ID NO: 389329 - DNA, 20 bp, Artificial
  CRISPR gRNA sequence
gataccagaagatgtctggt

SEQ ID NO: 389330 - DNA, 20 bp, Artificial
  CRISPR gRNA sequence
ataccagaagatgtctggtg

SEQ ID NO: 389331 - DNA, 20 bp, Artificial
  CRISPR gRNA sequence
gtgctcactcaccctcggct

SEQ ID NO: 389332 - DNA, 20 bp, Artificial
  CRISPR gRNA sequence
actcaccctcggctacagtc

SEQ ID NO: 389333 - DNA, 20 bp, Artificial
  CRISPR gRNA sequence
accctcggctacagtcaatc

SEQ ID NO: 389334 - DNA, 20 bp, Artificial
  CRISPR gRNA sequence
ggctacagtcaatctcatca

SEQ ID NO: 389335 - DNA, 20 bp, Artificial
  CRISPR gRNA sequence
cagtcaatctcatcacgaag

SEQ ID NO: 389336 - DNA, 20 bp, Artificial
  CRISPR gRNA sequence
atcacgaaggtttcgttttc

SEQ ID NO: 389337 - DNA, 20 bp, Artificial
  CRISPR gRNA sequence
cgttttctcctgcgctggcc

SEQ ID NO: 389338 - DNA, 20 bp, Artificial
  CRISPR gRNA sequence
gttttctcctgcgctggcct

SEQ ID NO: 389339 - DNA, 20 bp, Artificial
  CRISPR gRNA sequence
tctcctgcgctggcctgcaa

SEQ ID NO: 389340 - DNA, 20 bp, Artificial
  CRISPR gRNA sequence
ctcctgcgctggcctgcaag

SEQ ID NO: 389341 - DNA, 20 bp, Artificial
  CRISPR gRNA sequence
tcctgcgctggcctgcaagt

SEQ ID NO: 389342 - DNA, 20 bp, Artificial
  CRISPR gRNA sequence
ctgcgctggcctgcaagtag

SEQ ID NO: 389343 - DNA, 20 bp, Artificial
  CRISPR gRNA sequence
cgctggcctgcaagtagcag

SEQ ID NO: 389344 - DNA, 20 bp, Artificial
  CRISPR gRNA sequence
gcctgcaagtagcagcggta

SEQ ID NO: 389345 - DNA, 20 bp, Artificial
  CRISPR gRNA sequence
caagtagcagcggtaaagcc

SEQ ID NO: 389346 - DNA, 20 bp, Artificial
  CRISPR gRNA sequence
agactgtgacatcggggatg

SEQ ID NO: 389347 - DNA, 20 bp, Artificial
  CRISPR gRNA sequence
tgacatcggggatgacgatg

SEQ ID NO: 389348 - DNA, 20 bp, Artificial
  CRISPR gRNA sequence
caccttccgtggctgcagtt

SEQ ID NO: 389349 - DNA, 20 bp, Artificial
  CRISPR gRNA sequence
ccgtggctgcagttgctcac

SEQ ID NO: 389350 - DNA, 20 bp, Artificial
  CRISPR gRNA sequence
cgtggctgcagttgctcact

SEQ ID NO: 389351 - DNA, 20 bp, Artificial
  CRISPR gRNA sequence
cagttgctcactatttgtct

SEQ ID NO: 389352 - DNA, 20 bp, Artificial
  CRISPR gRNA sequence
ctcactatttgtcttgggaa

SEQ ID NO: 389353 - DNA, 20 bp, Artificial
  CRISPR gRNA sequence
actatttgtcttgggaactt

SEQ ID NO: 389354 - DNA, 20 bp, Artificial
  CRISPR gRNA sequence
tttgtcttgggaacttggag

SEQ ID NO: 389355 - DNA, 20 bp, Artificial
  CRISPR gRNA sequence
gtcttgggaacttggaggtg

SEQ ID NO: 389356 - DNA, 20 bp, Artificial
  CRISPR gRNA sequence
tcttgggaacttggaggtga

SEQ ID NO: 389357 - DNA, 20 bp, Artificial
  CRISPR gRNA sequence
gggaacttggaggtgaaatt

SEQ ID NO: 389358 - DNA, 20 bp, Artificial
  CRISPR gRNA sequence
ggaacttggaggtgaaattt

SEQ ID NO: 389359 - DNA, 20 bp, Artificial
  CRISPR gRNA sequence
ggaggtgaaatttctgccat

SEQ ID NO: 389360 - DNA, 20 bp, Artificial
  CRISPR gRNA sequence
gaggtgaaatttctgccatg

SEQ ID NO: 389361 - DNA, 20 bp, Artificial
  CRISPR gRNA sequence
ctgccatggaccaagttgca

SEQ ID NO: 389362 - DNA, 20 bp, Artificial
  CRISPR gRNA sequence
tgccatggaccaagttgcag

SEQ ID NO: 389363 - DNA, 20 bp, Artificial
  CRISPR gRNA sequence
ccatggaccaagttgcagta

SEQ ID NO: 389364 - DNA, 20 bp, Artificial
  CRISPR gRNA sequence
cagtaagttaagaggtcgat

SEQ ID NO: 389365 - DNA, 20 bp, Artificial
  CRISPR gRNA sequence
agaggtcgatctgacggggc

SEQ ID NO: 389366 - DNA, 20 bp, Artificial
  CRISPR gRNA sequence
acggggctggatcttttccc

SEQ ID NO: 389367 - DNA, 20 bp, Artificial
  CRISPR gRNA sequence
gatcttttcccacctcactg

SEQ ID NO: 389368 - DNA, 20 bp, Artificial
  CRISPR gRNA sequence
ttcccacctcactgcctgca

SEQ ID NO: 389369 - DNA, 20 bp, Artificial
  CRISPR gRNA sequence
tcccacctcactgcctgcac

SEQ ID NO: 389370 - DNA, 20 bp, Artificial
  CRISPR gRNA sequence
cccacctcactgcctgcaca

SEQ ID NO: 389371 - DNA, 20 bp, Artificial
  CRISPR gRNA sequence
ccacctcactgcctgcacag

SEQ ID NO: 389372 - DNA, 20 bp, Artificial
  CRISPR gRNA sequence
actgcctgcacaggccacgt

SEQ ID NO: 389373 - DNA, 20 bp, Artificial
  CRISPR gRNA sequence
cctgcacaggccacgtcatc

SEQ ID NO: 389374 - DNA, 20 bp, Artificial
  CRISPR gRNA sequence
cacaggccacgtcatctgag

SEQ ID NO: 389375 - DNA, 20 bp, Artificial
  CRISPR gRNA sequence
aggctgacaagtgagtgtga

SEQ ID NO: 389376 - DNA, 20 bp, Artificial
  CRISPR gRNA sequence
acaagtgagtgtgacattct

SEQ ID NO: 389377 - DNA, 20 bp, Artificial
  CRISPR gRNA sequence
tttccaggttccgaaacaat

SEQ ID NO: 389378 - DNA, 20 bp, Artificial
  CRISPR gRNA sequence
tccaggttccgaaacaatgt

SEQ ID NO: 389379 - DNA, 20 bp, Artificial
  CRISPR gRNA sequence
ccaggttccgaaacaatgtg

SEQ ID NO: 389380 - DNA, 20 bp, Artificial
  CRISPR gRNA sequence
caggttccgaaacaatgtgg

SEQ ID NO: 389381 - DNA, 20 bp, Artificial
  CRISPR gRNA sequence
cgaaacaatgtggctatttg

SEQ ID NO: 389382 - DNA, 20 bp, Artificial
  CRISPR gRNA sequence
tttgatggcacagctgcctc

SEQ ID NO: 389383 - DNA, 20 bp, Artificial
  CRISPR gRNA sequence
gatggcacagctgcctcaaa

SEQ ID NO: 389384 - DNA, 20 bp, Artificial
  CRISPR gRNA sequence
atggcacagctgcctcaaaa

SEQ ID NO: 389385 - DNA, 20 bp, Artificial
  CRISPR gRNA sequence
cctcaaaactatctgaaaag

SEQ ID NO: 389386 - DNA, 20 bp, Artificial
  CRISPR gRNA sequence
aaaactatctgaaaagaaga

SEQ ID NO: 389387 - DNA, 20 bp, Artificial
  CRISPR gRNA sequence
tctgaaaagaagaagcaaat

SEQ ID NO: 389388 - DNA, 20 bp, Artificial
  CRISPR gRNA sequence
aaaagaagaagcaaatgatt

SEQ ID NO: 389389 - DNA, 20 bp, Artificial
  CRISPR gRNA sequence
gatacaggttgtcaaatttt

SEQ ID NO: 389390 - DNA, 20 bp, Artificial
  CRISPR gRNA sequence
tcaaattttgggacacccaa

SEQ ID NO: 389391 - DNA, 20 bp, Artificial
  CRISPR gRNA sequence
tgggacacccaactggaaga

SEQ ID NO: 389392 - DNA, 20 bp, Artificial
  CRISPR gRNA sequence
gggacacccaactggaagat

SEQ ID NO: 389393 - DNA, 20 bp, Artificial
  CRISPR gRNA sequence
ggacacccaactggaagata

SEQ ID NO: 389394 - DNA, 20 bp, Artificial
  CRISPR gRNA sequence
gaagatacttaatcataaaa

SEQ ID NO: 389395 - DNA, 20 bp, Artificial
  CRISPR gRNA sequence
aatcataaaaataattggtg

SEQ ID NO: 389396 - DNA, 20 bp, Artificial
  CRISPR gRNA sequence
atcataaaaataattggtga

SEQ ID NO: 389397 - DNA, 20 bp, Artificial
  CRISPR gRNA sequence
gtgatgttacctaacacagt

SEQ ID NO: 389398 - DNA, 20 bp, Artificial
  CRISPR gRNA sequence
cctaacacagttcttccgtt

SEQ ID NO: 389399 - DNA, 20 bp, Artificial
  CRISPR gRNA sequence
acacagttcttccgttgtga

SEQ ID NO: 389400 - DNA, 20 bp, Artificial
  CRISPR gRNA sequence
ttccgttgtgaatgacctct

SEQ ID NO: 389401 - DNA, 20 bp, Artificial
  CRISPR gRNA sequence
ccgttgtgaatgacctcttt

SEQ ID NO: 389402 - DNA, 20 bp, Artificial
  CRISPR gRNA sequence
cgttgtgaatgacctcttta

SEQ ID NO: 389403 - DNA, 20 bp, Artificial
  CRISPR gRNA sequence
tgaatgacctctttatacta

SEQ ID NO: 389404 - DNA, 20 bp, Artificial
  CRISPR gRNA sequence
tttatactactttttttttt

SEQ ID NO: 389405 - DNA, 20 bp, Artificial
  CRISPR gRNA sequence
tatactactttttttttttt

SEQ ID NO: 389406 - DNA, 20 bp, Artificial
  CRISPR gRNA sequence
atactacttttttttttttt

SEQ ID NO: 389407 - DNA, 20 bp, Artificial
  CRISPR gRNA sequence
tactactttttttttttttt

SEQ ID NO: 389408 - DNA, 20 bp, Artificial
  CRISPR gRNA sequence
ctttttttttttttttcctg

SEQ ID NO: 389409 - DNA, 20 bp, Artificial
  CRISPR gRNA sequence
tttttttttttttcctgaga

SEQ ID NO: 389410 - DNA, 20 bp, Artificial
  CRISPR gRNA sequence
ttttttttttttcctgagac

SEQ ID NO: 389411 - DNA, 20 bp, Artificial
  CRISPR gRNA sequence
tttttttttttcctgagacg

SEQ ID NO: 389412 - DNA, 20 bp, Artificial
  CRISPR gRNA sequence
ttttttttttcctgagacgg

SEQ ID NO: 389413 - DNA, 20 bp, Artificial
  CRISPR gRNA sequence
tttttttttcctgagacgga

SEQ ID NO: 389414 - DNA, 20 bp, Artificial
  CRISPR gRNA sequence
ttttttttcctgagacggag

SEQ ID NO: 389415 - DNA, 20 bp, Artificial
  CRISPR gRNA sequence
tttttttcctgagacggagt

SEQ ID NO: 389416 - DNA, 20 bp, Artificial
  CRISPR gRNA sequence
ttttttcctgagacggagtc

SEQ ID NO: 389417 - DNA, 20 bp, Artificial
  CRISPR gRNA sequence
tttttcctgagacggagtct

SEQ ID NO: 389418 - DNA, 20 bp, Artificial
  CRISPR gRNA sequence
ttttcctgagacggagtctt

SEQ ID NO: 389419 - DNA, 20 bp, Artificial
  CRISPR gRNA sequence
tttcctgagacggagtcttg

SEQ ID NO: 389420 - DNA, 20 bp, Artificial
  CRISPR gRNA sequence
ttcctgagacggagtcttgc

SEQ ID NO: 389421 - DNA, 20 bp, Artificial
  CRISPR gRNA sequence
tcctgagacggagtcttgct

SEQ ID NO: 389422 - DNA, 20 bp, Artificial
  CRISPR gRNA sequence
cctgagacggagtcttgctc

SEQ ID NO: 389423 - DNA, 20 bp, Artificial
  CRISPR gRNA sequence
ctgagacggagtcttgctct

SEQ ID NO: 389424 - DNA, 20 bp, Artificial
  CRISPR gRNA sequence
agacggagtcttgctctgtc

SEQ ID NO: 389425 - DNA, 20 bp, Artificial
  CRISPR gRNA sequence
gctctgtcacccagactaga

SEQ ID NO: 389426 - DNA, 20 bp, Artificial
  CRISPR gRNA sequence
ctctgtcacccagactagag

SEQ ID NO: 389427 - DNA, 20 bp, Artificial
  CRISPR gRNA sequence
tgtcacccagactagagtgc

SEQ ID NO: 389428 - DNA, 20 bp, Artificial
  CRISPR gRNA sequence
tcacccagactagagtgcag

SEQ ID NO: 389429 - DNA, 20 bp, Artificial
  CRISPR gRNA sequence
gagtgcagtggtgtgatctc

SEQ ID NO: 389430 - DNA, 20 bp, Artificial
  CRISPR gRNA sequence
ggctcaatgcaacctccacc

SEQ ID NO: 389431 - DNA, 20 bp, Artificial
  CRISPR gRNA sequence
aatgcaacctccacctccca

SEQ ID NO: 389432 - DNA, 20 bp, Artificial
  CRISPR gRNA sequence
cacctcccaggttcacgcca

SEQ ID NO: 389433 - DNA, 20 bp, Artificial
  CRISPR gRNA sequence
ccaggttcacgccattctcc

SEQ ID NO: 389434 - DNA, 20 bp, Artificial
  CRISPR gRNA sequence
acgccattctcctgcctcag

SEQ ID NO: 389435 - DNA, 20 bp, Artificial
  CRISPR gRNA sequence
tcctgcctcagcctcctgag

SEQ ID NO: 389436 - DNA, 20 bp, Artificial
  CRISPR gRNA sequence
ctgcctcagcctcctgagta

SEQ ID NO: 389437 - DNA, 20 bp, Artificial
  CRISPR gRNA sequence
cctcagcctcctgagtagct

SEQ ID NO: 389438 - DNA, 20 bp, Artificial
  CRISPR gRNA sequence
agcctcctgagtagctggga

SEQ ID NO: 389439 - DNA, 20 bp, Artificial
  CRISPR gRNA sequence
ctgagtagctgggactatag

SEQ ID NO: 389440 - DNA, 20 bp, Artificial
  CRISPR gRNA sequence
agtagctgggactataggcg

SEQ ID NO: 389441 - DNA, 20 bp, Artificial
  CRISPR gRNA sequence
ggactataggcgcccgccac

SEQ ID NO: 389442 - DNA, 20 bp, Artificial
  CRISPR gRNA sequence
taggcgcccgccaccgcgcc

SEQ ID NO: 389443 - DNA, 20 bp, Artificial
  CRISPR gRNA sequence
attttttgtatttttagtag

SEQ ID NO: 389444 - DNA, 20 bp, Artificial
  CRISPR gRNA sequence
tttgtatttttagtagagac

SEQ ID NO: 389445 - DNA, 20 bp, Artificial
  CRISPR gRNA sequence
ttgtatttttagtagagacg

SEQ ID NO: 389446 - DNA, 20 bp, Artificial
  CRISPR gRNA sequence
tgtatttttagtagagacgg

SEQ ID NO: 389447 - DNA, 20 bp, Artificial
  CRISPR gRNA sequence
gtatttttagtagagacggg

SEQ ID NO: 389448 - DNA, 20 bp, Artificial
  CRISPR gRNA sequence
tatttttagtagagacgggc

SEQ ID NO: 389449 - DNA, 20 bp, Artificial
  CRISPR gRNA sequence
ttagtagagacgggctttca

SEQ ID NO: 389450 - DNA, 20 bp, Artificial
  CRISPR gRNA sequence
tagtagagacgggctttcac

SEQ ID NO: 389451 - DNA, 20 bp, Artificial
  CRISPR gRNA sequence
agtagagacgggctttcacc

SEQ ID NO: 389452 - DNA, 20 bp, Artificial
  CRISPR gRNA sequence
gtagagacgggctttcaccg

SEQ ID NO: 389453 - DNA, 20 bp, Artificial
  CRISPR gRNA sequence
tcaccgtgttagccaggatg

SEQ ID NO: 389454 - DNA, 20 bp, Artificial
  CRISPR gRNA sequence
caccgtgttagccaggatgg

SEQ ID NO: 389455 - DNA, 20 bp, Artificial
  CRISPR gRNA sequence
accgtgttagccaggatggt

SEQ ID NO: 389456 - DNA, 20 bp, Artificial
  CRISPR gRNA sequence
gccaggatggtctcaatctc

SEQ ID NO: 389457 - DNA, 20 bp, Artificial
  CRISPR gRNA sequence
aatctcctgaccttgtgatc

SEQ ID NO: 389458 - DNA, 20 bp, Artificial
  CRISPR gRNA sequence
ctgaccttgtgatccgccca

SEQ ID NO: 389459 - DNA, 20 bp, Artificial
  CRISPR gRNA sequence
accttgtgatccgcccacct

SEQ ID NO: 389460 - DNA, 20 bp, Artificial
  CRISPR gRNA sequence
gtgatccgcccacctcggcc

SEQ ID NO: 389461 - DNA, 20 bp, Artificial
  CRISPR gRNA sequence
tgatccgcccacctcggcct

SEQ ID NO: 389462 - DNA, 20 bp, Artificial
  CRISPR gRNA sequence
ggcctcccaaagtgctggga

SEQ ID NO: 389463 - DNA, 20 bp, Artificial
  CRISPR gRNA sequence
ccaaagtgctgggattacag

SEQ ID NO: 389464 - DNA, 20 bp, Artificial
  CRISPR gRNA sequence
ggattacaggcatgagccac

SEQ ID NO: 389465 - DNA, 20 bp, Artificial
  CRISPR gRNA sequence
caggcatgagccaccgcacc

SEQ ID NO: 389466 - DNA, 20 bp, Artificial
  CRISPR gRNA sequence
tgaatgacacattcttgtaa

SEQ ID NO: 389467 - DNA, 20 bp, Artificial
  CRISPR gRNA sequence
ttgtaagagaaagggttttt

SEQ ID NO: 389468 - DNA, 20 bp, Artificial
  CRISPR gRNA sequence
gtaagagaaagggttttttt

SEQ ID NO: 389469 - DNA, 20 bp, Artificial
  CRISPR gRNA sequence
taagagaaagggtttttttt

SEQ ID NO: 389470 - DNA, 20 bp, Artificial
  CRISPR gRNA sequence
tttttgttttttgttttttg

SEQ ID NO: 389471 - DNA, 20 bp, Artificial
  CRISPR gRNA sequence
ttttgttttttgttttttgt

SEQ ID NO: 389472 - DNA, 20 bp, Artificial
  CRISPR gRNA sequence
tttgttttttgttttttgtt

SEQ ID NO: 389473 - DNA, 20 bp, Artificial
  CRISPR gRNA sequence
ttgttttttgttttttgttt

SEQ ID NO: 389474 - DNA, 20 bp, Artificial
  CRISPR gRNA sequence
tgttttttgttttttgtttt

SEQ ID NO: 389475 - DNA, 20 bp, Artificial
  CRISPR gRNA sequence
gttttttgttttttgttttt

SEQ ID NO: 389476 - DNA, 20 bp, Artificial
  CRISPR gRNA sequence
ttttttgttttttgttttta

SEQ ID NO: 389477 - DNA, 20 bp, Artificial
  CRISPR gRNA sequence
tttgttttttgtttttaagt

SEQ ID NO: 389478 - DNA, 20 bp, Artificial
  CRISPR gRNA sequence
ttgttttttgtttttaagtc

SEQ ID NO: 389479 - DNA, 20 bp, Artificial
  CRISPR gRNA sequence
tgttttttgtttttaagtcc

SEQ ID NO: 389480 - DNA, 20 bp, Artificial
  CRISPR gRNA sequence
gttttttgtttttaagtccg

SEQ ID NO: 389481 - DNA, 20 bp, Artificial
  CRISPR gRNA sequence
ttttttgtttttaagtccgg

SEQ ID NO: 389482 - DNA, 20 bp, Artificial
  CRISPR gRNA sequence
tttgtttttaagtccgggag

SEQ ID NO: 389483 - DNA, 20 bp, Artificial
  CRISPR gRNA sequence
ttgtttttaagtccgggaga

SEQ ID NO: 389484 - DNA, 20 bp, Artificial
  CRISPR gRNA sequence
tgtttttaagtccgggagat

SEQ ID NO: 389485 - DNA, 20 bp, Artificial
  CRISPR gRNA sequence
gtttttaagtccgggagata

SEQ ID NO: 389486 - DNA, 20 bp, Artificial
  CRISPR gRNA sequence
tttttaagtccgggagataa

SEQ ID NO: 389487 - DNA, 20 bp, Artificial
  CRISPR gRNA sequence
ttaagtccgggagataaata

SEQ ID NO: 389488 - DNA, 20 bp, Artificial
  CRISPR gRNA sequence
taagtccgggagataaatag

SEQ ID NO: 389489 - DNA, 20 bp, Artificial
  CRISPR gRNA sequence
aagtccgggagataaataga

SEQ ID NO: 389490 - DNA, 20 bp, Artificial
  CRISPR gRNA sequence
agtccgggagataaatagaa

SEQ ID NO: 389491 - DNA, 20 bp, Artificial
  CRISPR gRNA sequence
ttcacacatagttccataag

SEQ ID NO: 389492 - DNA, 20 bp, Artificial
  CRISPR gRNA sequence
acacatagttccataagtgt

SEQ ID NO: 389493 - DNA, 20 bp, Artificial
  CRISPR gRNA sequence
cataagtgttacttggttaa

SEQ ID NO: 389494 - DNA, 20 bp, Artificial
  CRISPR gRNA sequence
cttggttaaccatgtagtga

SEQ ID NO: 389495 - DNA, 20 bp, Artificial
  CRISPR gRNA sequence
ggttaaccatgtagtgagaa

SEQ ID NO: 389496 - DNA, 20 bp, Artificial
  CRISPR gRNA sequence
gttaaccatgtagtgagaaa

SEQ ID NO: 389497 - DNA, 20 bp, Artificial
  CRISPR gRNA sequence
accatgtagtgagaaacaca

SEQ ID NO: 389498 - DNA, 20 bp, Artificial
  CRISPR gRNA sequence
gtgcttttcttggtatcata

SEQ ID NO: 389499 - DNA, 20 bp, Artificial
  CRISPR gRNA sequence
ttcttggtatcatatcaaga

SEQ ID NO: 389500 - DNA, 20 bp, Artificial
  CRISPR gRNA sequence
tcttggtatcatatcaagag

SEQ ID NO: 389501 - DNA, 20 bp, Artificial
  CRISPR gRNA sequence
cttggtatcatatcaagagg

SEQ ID NO: 389502 - DNA, 20 bp, Artificial
  CRISPR gRNA sequence
ttggtatcatatcaagaggc

SEQ ID NO: 389503 - DNA, 20 bp, Artificial
  CRISPR gRNA sequence
ggtatcatatcaagaggctg

SEQ ID NO: 389504 - DNA, 20 bp, Artificial
  CRISPR gRNA sequence
gtatcatatcaagaggctga

SEQ ID NO: 389505 - DNA, 20 bp, Artificial
  CRISPR gRNA sequence
aattttacaaagagactgtt

SEQ ID NO: 389506 - DNA, 20 bp, Artificial
  CRISPR gRNA sequence
tacaaagagactgttaggca

SEQ ID NO: 389507 - DNA, 20 bp, Artificial
  CRISPR gRNA sequence
acaaagagactgttaggcaa

SEQ ID NO: 389508 - DNA, 20 bp, Artificial
  CRISPR gRNA sequence
caaagagactgttaggcaat

SEQ ID NO: 389509 - DNA, 20 bp, Artificial
  CRISPR gRNA sequence
ttaggcaataatgctgggct

SEQ ID NO: 389510 - DNA, 20 bp, Artificial
  CRISPR gRNA sequence
ggcaataatgctgggctggt

SEQ ID NO: 389511 - DNA, 20 bp, Artificial
  CRISPR gRNA sequence
ggctggtgtctctgacactg

SEQ ID NO: 389512 - DNA, 20 bp, Artificial
  CRISPR gRNA sequence
gtgtctctgacactgaccta

SEQ ID NO: 389513 - DNA, 20 bp, Artificial
  CRISPR gRNA sequence
tgacactgacctacagtatc

SEQ ID NO: 389514 - DNA, 20 bp, Artificial
  CRISPR gRNA sequence
acactgacctacagtatcaa

SEQ ID NO: 389515 - DNA, 20 bp, Artificial
  CRISPR gRNA sequence
acctacagtatcaaatgttc

SEQ ID NO: 389516 - DNA, 20 bp, Artificial
  CRISPR gRNA sequence
cagtatcaaatgttcaggtt

SEQ ID NO: 389517 - DNA, 20 bp, Artificial
  CRISPR gRNA sequence
aggttataatcattctggct

SEQ ID NO: 389518 - DNA, 20 bp, Artificial
  CRISPR gRNA sequence
taatcattctggctaagatt

SEQ ID NO: 389519 - DNA, 20 bp, Artificial
  CRISPR gRNA sequence
tggctaagattctgacagtt

SEQ ID NO: 389520 - DNA, 20 bp, Artificial
  CRISPR gRNA sequence
gctaagattctgacagttat

SEQ ID NO: 389521 - DNA, 20 bp, Artificial
  CRISPR gRNA sequence
agattctgacagttatgaaa

SEQ ID NO: 389522 - DNA, 20 bp, Artificial
  CRISPR gRNA sequence
tgacagttatgaaaaagata

SEQ ID NO: 389523 - DNA, 20 bp, Artificial
  CRISPR gRNA sequence
acagttatgaaaaagatacc

SEQ ID NO: 389524 - DNA, 20 bp, Artificial
  CRISPR gRNA sequence
tgaaaaagataccaaatcat

SEQ ID NO: 389525 - DNA, 20 bp, Artificial
  CRISPR gRNA sequence
tcactgaatatacacatgat

SEQ ID NO: 389526 - DNA, 20 bp, Artificial
  CRISPR gRNA sequence
actgaatatacacatgatct

SEQ ID NO: 389527 - DNA, 20 bp, Artificial
  CRISPR gRNA sequence
aatatacacatgatctcatt

SEQ ID NO: 389528 - DNA, 20 bp, Artificial
  CRISPR gRNA sequence
attcttcagatatacagggt

SEQ ID NO: 389529 - DNA, 20 bp, Artificial
  CRISPR gRNA sequence
ttcagatatacagggttgtc

SEQ ID NO: 389530 - DNA, 20 bp, Artificial
  CRISPR gRNA sequence
cagatatacagggttgtctt

SEQ ID NO: 389531 - DNA, 20 bp, Artificial
  CRISPR gRNA sequence
agatatacagggttgtctta

SEQ ID NO: 389532 - DNA, 20 bp, Artificial
  CRISPR gRNA sequence
tcttacacatgggtagagta

SEQ ID NO: 389533 - DNA, 20 bp, Artificial
  CRISPR gRNA sequence
acacatgggtagagtagggc

SEQ ID NO: 389534 - DNA, 20 bp, Artificial
  CRISPR gRNA sequence
cacatgggtagagtagggcc

SEQ ID NO: 389535 - DNA, 20 bp, Artificial
  CRISPR gRNA sequence
ttgataccatgaaagtccag

SEQ ID NO: 389536 - DNA, 20 bp, Artificial
  CRISPR gRNA sequence
gataccatgaaagtccagta

SEQ ID NO: 389537 - DNA, 20 bp, Artificial
  CRISPR gRNA sequence
ataccatgaaagtccagtat

SEQ ID NO: 389538 - DNA, 20 bp, Artificial
  CRISPR gRNA sequence
tcccaccttcctcacaccat

SEQ ID NO: 389539 - DNA, 20 bp, Artificial
  CRISPR gRNA sequence
ccaccttcctcacaccattt

SEQ ID NO: 389540 - DNA, 20 bp, Artificial
  CRISPR gRNA sequence
cctcacaccatttctggaat

SEQ ID NO: 389541 - DNA, 20 bp, Artificial
  CRISPR gRNA sequence
ctcacaccatttctggaatt

SEQ ID NO: 389542 - DNA, 20 bp, Artificial
  CRISPR gRNA sequence
acaccatttctggaattcct

SEQ ID NO: 389543 - DNA, 20 bp, Artificial
  CRISPR gRNA sequence
ctggaattcctaccataaag

SEQ ID NO: 389544 - DNA, 20 bp, Artificial
  CRISPR gRNA sequence
tggaattcctaccataaagt

SEQ ID NO: 389545 - DNA, 20 bp, Artificial
  CRISPR gRNA sequence
gaattcctaccataaagtac

SEQ ID NO: 389546 - DNA, 20 bp, Artificial
  CRISPR gRNA sequence
ctaccataaagtactcagta

SEQ ID NO: 389547 - DNA, 20 bp, Artificial
  CRISPR gRNA sequence
ccataaagtactcagtaatt

SEQ ID NO: 389548 - DNA, 20 bp, Artificial
  CRISPR gRNA sequence
agtaattgtcactaaatatc

SEQ ID NO: 389549 - DNA, 20 bp, Artificial
  CRISPR gRNA sequence
tcactaaatatctaagtcca

SEQ ID NO: 389550 - DNA, 20 bp, Artificial
  CRISPR gRNA sequence
aatatctaagtccatggtcc

SEQ ID NO: 389551 - DNA, 20 bp, Artificial
  CRISPR gRNA sequence
agtccatggtccttagagtg

SEQ ID NO: 389552 - DNA, 20 bp, Artificial
  CRISPR gRNA sequence
agagtgtgtttgggggccct

SEQ ID NO: 389553 - DNA, 20 bp, Artificial
  CRISPR gRNA sequence
gagtgtgtttgggggccctg

SEQ ID NO: 389554 - DNA, 20 bp, Artificial
  CRISPR gRNA sequence
gggggccctgggcatctctg

SEQ ID NO: 389555 - DNA, 20 bp, Artificial
  CRISPR gRNA sequence
ggggccctgggcatctctgt

SEQ ID NO: 389556 - DNA, 20 bp, Artificial
  CRISPR gRNA sequence
ggcatctctgtgtcccttta

SEQ ID NO: 389557 - DNA, 20 bp, Artificial
  CRISPR gRNA sequence
tgtgtccctttaggggatat

SEQ ID NO: 389558 - DNA, 20 bp, Artificial
  CRISPR gRNA sequence
tgtccctttaggggatatgc

SEQ ID NO: 389559 - DNA, 20 bp, Artificial
  CRISPR gRNA sequence
taggggatatgccagttcaa

SEQ ID NO: 389560 - DNA, 20 bp, Artificial
  CRISPR gRNA sequence
aggggatatgccagttcaaa

SEQ ID NO: 389561 - DNA, 20 bp, Artificial
  CRISPR gRNA sequence
ggggatatgccagttcaaat

SEQ ID NO: 389562 - DNA, 20 bp, Artificial
  CRISPR gRNA sequence
aaatctattttcctagtgat

SEQ ID NO: 389563 - DNA, 20 bp, Artificial
  CRISPR gRNA sequence
ttttcctagtgatattgaga

SEQ ID NO: 389564 - DNA, 20 bp, Artificial
  CRISPR gRNA sequence
tcctagtgatattgagagga

SEQ ID NO: 389565 - DNA, 20 bp, Artificial
  CRISPR gRNA sequence
cctagtgatattgagaggaa

SEQ ID NO: 389566 - DNA, 20 bp, Artificial
  CRISPR gRNA sequence
ctagtgatattgagaggaaa

SEQ ID NO: 389567 - DNA, 20 bp, Artificial
  CRISPR gRNA sequence
gtgatattgagaggaaattc

SEQ ID NO: 389568 - DNA, 20 bp, Artificial
  CRISPR gRNA sequence
agaggaaattccccctcttc

SEQ ID NO: 389569 - DNA, 20 bp, Artificial
  CRISPR gRNA sequence
cccctcttcactccagttct

SEQ ID NO: 389570 - DNA, 20 bp, Artificial
  CRISPR gRNA sequence
ttcactccagttctctcaca

SEQ ID NO: 389571 - DNA, 20 bp, Artificial
  CRISPR gRNA sequence
cactccagttctctcacagg

SEQ ID NO: 389572 - DNA, 20 bp, Artificial
  CRISPR gRNA sequence
actccagttctctcacaggt

SEQ ID NO: 389573 - DNA, 20 bp, Artificial
  CRISPR gRNA sequence
cagttctctcacaggtatac

SEQ ID NO: 389574 - DNA, 20 bp, Artificial
  CRISPR gRNA sequence
tctcacaggtatacagtaga

SEQ ID NO: 389575 - DNA, 20 bp, Artificial
  CRISPR gRNA sequence
tcacaggtatacagtagata

SEQ ID NO: 389576 - DNA, 20 bp, Artificial
  CRISPR gRNA sequence
acaggtatacagtagatatt

SEQ ID NO: 389577 - DNA, 20 bp, Artificial
  CRISPR gRNA sequence
ccagaggctctgccagctag

SEQ ID NO: 389578 - DNA, 20 bp, Artificial
  CRISPR gRNA sequence
cagaggctctgccagctagt

SEQ ID NO: 389579 - DNA, 20 bp, Artificial
  CRISPR gRNA sequence
tgccagctagtggtatgcat

SEQ ID NO: 389580 - DNA, 20 bp, Artificial
  CRISPR gRNA sequence
ccagctagtggtatgcatgc

SEQ ID NO: 389581 - DNA, 20 bp, Artificial
  CRISPR gRNA sequence
gtggtatgcatgcttgaaaa

SEQ ID NO: 389582 - DNA, 20 bp, Artificial
  CRISPR gRNA sequence
gaaaattcttgtgttttaaa

SEQ ID NO: 389583 - DNA, 20 bp, Artificial
  CRISPR gRNA sequence
aaaattcttgtgttttaaat

SEQ ID NO: 389584 - DNA, 20 bp, Artificial
  CRISPR gRNA sequence
ttgtgttttaaattttgctc

SEQ ID NO: 389585 - DNA, 20 bp, Artificial
  CRISPR gRNA sequence
gtgttttaaattttgctcaa

SEQ ID NO: 389586 - DNA, 20 bp, Artificial
  CRISPR gRNA sequence
tgttttaaattttgctcaat

SEQ ID NO: 389587 - DNA, 20 bp, Artificial
  CRISPR gRNA sequence
taaattttgctcaatattga

SEQ ID NO: 389588 - DNA, 20 bp, Artificial
  CRISPR gRNA sequence
aaattttgctcaatattgat

SEQ ID NO: 389589 - DNA, 20 bp, Artificial
  CRISPR gRNA sequence
aattttgctcaatattgatt

SEQ ID NO: 389590 - DNA, 20 bp, Artificial
  CRISPR gRNA sequence
tgctcaatattgatttctaa

SEQ ID NO: 389591 - DNA, 20 bp, Artificial
  CRISPR gRNA sequence
gctcaatattgatttctaat

SEQ ID NO: 389592 - DNA, 20 bp, Artificial
  CRISPR gRNA sequence
ctcaatattgatttctaata

SEQ ID NO: 389593 - DNA, 20 bp, Artificial
  CRISPR gRNA sequence
aatattgatttctaatacag

SEQ ID NO: 389594 - DNA, 20 bp, Artificial
  CRISPR gRNA sequence
atttctaatacagtaaacat

SEQ ID NO: 389595 - DNA, 20 bp, Artificial
  CRISPR gRNA sequence
ctaatacagtaaacatgaca

SEQ ID NO: 389596 - DNA, 20 bp, Artificial
  CRISPR gRNA sequence
taatacagtaaacatgacag

SEQ ID NO: 389597 - DNA, 20 bp, Artificial
  CRISPR gRNA sequence
atacagtaaacatgacagat

SEQ ID NO: 389598 - DNA, 20 bp, Artificial
  CRISPR gRNA sequence
cctgagggccttcagtaatt

SEQ ID NO: 389599 - DNA, 20 bp, Artificial
  CRISPR gRNA sequence
agggccttcagtaattttta

SEQ ID NO: 389600 - DNA, 20 bp, Artificial
  CRISPR gRNA sequence
cagtaatttttaaaatagca

SEQ ID NO: 389601 - DNA, 20 bp, Artificial
  CRISPR gRNA sequence
agtaatttttaaaatagcat

SEQ ID NO: 389602 - DNA, 20 bp, Artificial
  CRISPR gRNA sequence
ttaaaatagcataaaggggt

SEQ ID NO: 389603 - DNA, 20 bp, Artificial
  CRISPR gRNA sequence
taaaatagcataaaggggtc

SEQ ID NO: 389604 - DNA, 20 bp, Artificial
  CRISPR gRNA sequence
aaaatagcataaaggggtct

SEQ ID NO: 389605 - DNA, 20 bp, Artificial
  CRISPR gRNA sequence
aaatagcataaaggggtctt

SEQ ID NO: 389606 - DNA, 20 bp, Artificial
  CRISPR gRNA sequence
gagaccaaaaagtttgggaa

SEQ ID NO: 389607 - DNA, 20 bp, Artificial
  CRISPR gRNA sequence
agaccaaaaagtttgggaac

SEQ ID NO: 389608 - DNA, 20 bp, Artificial
  CRISPR gRNA sequence
gggaacccgatctaaagaat

SEQ ID NO: 389609 - DNA, 20 bp, Artificial
  CRISPR gRNA sequence
ggaacccgatctaaagaata

SEQ ID NO: 389610 - DNA, 20 bp, Artificial
  CRISPR gRNA sequence
aagaataaactgtggtaact

SEQ ID NO: 389611 - DNA, 20 bp, Artificial
  CRISPR gRNA sequence
tggtaactctttcttaaaat

SEQ ID NO: 389612 - DNA, 20 bp, Artificial
  CRISPR gRNA sequence
tttcttaaaattaagataac

SEQ ID NO: 389613 - DNA, 20 bp, Artificial
  CRISPR gRNA sequence
tcttaaaattaagataaccc

SEQ ID NO: 389614 - DNA, 20 bp, Artificial
  CRISPR gRNA sequence
cttaaaattaagataaccca

SEQ ID NO: 389615 - DNA, 20 bp, Artificial
  CRISPR gRNA sequence
ttaaaattaagataacccag

SEQ ID NO: 389616 - DNA, 20 bp, Artificial
  CRISPR gRNA sequence
aaaattaagataacccagca

SEQ ID NO: 389617 - DNA, 20 bp, Artificial
  CRISPR gRNA sequence
aaattaagataacccagcaa

SEQ ID NO: 389618 - DNA, 20 bp, Artificial
  CRISPR gRNA sequence
agataacccagcaaggtaac

SEQ ID NO: 389619 - DNA, 20 bp, Artificial
  CRISPR gRNA sequence
tttattagtgatgaacacct

SEQ ID NO: 389620 - DNA, 20 bp, Artificial
  CRISPR gRNA sequence
attagtgatgaacaccttct

SEQ ID NO: 389621 - DNA, 20 bp, Artificial
  CRISPR gRNA sequence
ttagtgatgaacaccttctt

SEQ ID NO: 389622 - DNA, 20 bp, Artificial
  CRISPR gRNA sequence
gtgatgaacaccttctttct

SEQ ID NO: 389623 - DNA, 20 bp, Artificial
  CRISPR gRNA sequence
ctttcttctgatggcatcac

SEQ ID NO: 389624 - DNA, 20 bp, Artificial
  CRISPR gRNA sequence
tttcttctgatggcatcact

SEQ ID NO: 389625 - DNA, 20 bp, Artificial
  CRISPR gRNA sequence
tcttctgatggcatcactaa

SEQ ID NO: 389626 - DNA, 20 bp, Artificial
  CRISPR gRNA sequence
cttctgatggcatcactaat

SEQ ID NO: 389627 - DNA, 20 bp, Artificial
  CRISPR gRNA sequence
ttctgatggcatcactaatg

SEQ ID NO: 389628 - DNA, 20 bp, Artificial
  CRISPR gRNA sequence
ctgatggcatcactaatgcc

SEQ ID NO: 389629 - DNA, 20 bp, Artificial
  CRISPR gRNA sequence
tgatggcatcactaatgcca

SEQ ID NO: 389630 - DNA, 20 bp, Artificial
  CRISPR gRNA sequence
atggcatcactaatgccaac

SEQ ID NO: 389631 - DNA, 20 bp, Artificial
  CRISPR gRNA sequence
atgccaacaaatcctgacct

SEQ ID NO: 389632 - DNA, 20 bp, Artificial
  CRISPR gRNA sequence
acctgctatttcagtagagt

SEQ ID NO: 389633 - DNA, 20 bp, Artificial
  CRISPR gRNA sequence
ctatttcagtagagtgaggc

SEQ ID NO: 389634 - DNA, 20 bp, Artificial
  CRISPR gRNA sequence
tttcagtagagtgaggcctg

SEQ ID NO: 389635 - DNA, 20 bp, Artificial
  CRISPR gRNA sequence
cagtagagtgaggcctgggc

SEQ ID NO: 389636 - DNA, 20 bp, Artificial
  CRISPR gRNA sequence
agtagagtgaggcctgggca

SEQ ID NO: 389637 - DNA, 20 bp, Artificial
  CRISPR gRNA sequence
ggcagtaatgatgtcacaaa

SEQ ID NO: 389638 - DNA, 20 bp, Artificial
  CRISPR gRNA sequence
tctggcactaagggagaaat

SEQ ID NO: 389639 - DNA, 20 bp, Artificial
  CRISPR gRNA sequence
tggcactaagggagaaatgc

SEQ ID NO: 389640 - DNA, 20 bp, Artificial
  CRISPR gRNA sequence
gcactaagggagaaatgcaa

SEQ ID NO: 389641 - DNA, 20 bp, Artificial
  CRISPR gRNA sequence
agggagaaatgcaaaaagtg

SEQ ID NO: 389642 - DNA, 20 bp, Artificial
  CRISPR gRNA sequence
tcacttcaactatgtgacag

SEQ ID NO: 389643 - DNA, 20 bp, Artificial
  CRISPR gRNA sequence
caactatgtgacagtttcac

SEQ ID NO: 389644 - DNA, 20 bp, Artificial
  CRISPR gRNA sequence
aactatgtgacagtttcact

SEQ ID NO: 389645 - DNA, 20 bp, Artificial
  CRISPR gRNA sequence
tgtgacagtttcactcagga

SEQ ID NO: 389646 - DNA, 20 bp, Artificial
  CRISPR gRNA sequence
cactcaggactggcccagga

SEQ ID NO: 389647 - DNA, 20 bp, Artificial
  CRISPR gRNA sequence
actcaggactggcccaggag

SEQ ID NO: 389648 - DNA, 20 bp, Artificial
  CRISPR gRNA sequence
aggactggcccaggagccat

SEQ ID NO: 389649 - DNA, 20 bp, Artificial
  CRISPR gRNA sequence
gcccaggagccattgtcttg

SEQ ID NO: 389650 - DNA, 20 bp, Artificial
  CRISPR gRNA sequence
tcttggcatacaaacaaaag

SEQ ID NO: 389651 - DNA, 20 bp, Artificial
  CRISPR gRNA sequence
ggcatacaaacaaaagaaaa

SEQ ID NO: 389652 - DNA, 20 bp, Artificial
  CRISPR gRNA sequence
gcatacaaacaaaagaaaaa

SEQ ID NO: 389653 - DNA, 20 bp, Artificial
  CRISPR gRNA sequence
cgaaagagagaatgaaagca

SEQ ID NO: 389654 - DNA, 20 bp, Artificial
  CRISPR gRNA sequence
gaaagagagaatgaaagcaa

SEQ ID NO: 389655 - DNA, 20 bp, Artificial
  CRISPR gRNA sequence
aagtgcagtaagatttgcca

SEQ ID NO: 389656 - DNA, 20 bp, Artificial
  CRISPR gRNA sequence
gccatctattgaactagaat

SEQ ID NO: 389657 - DNA, 20 bp, Artificial
  CRISPR gRNA sequence
ccatctattgaactagaata

SEQ ID NO: 389658 - DNA, 20 bp, Artificial
  CRISPR gRNA sequence
ttgaactagaatatcatggc

SEQ ID NO: 389659 - DNA, 20 bp, Artificial
  CRISPR gRNA sequence
aactagaatatcatggctac

SEQ ID NO: 389660 - DNA, 20 bp, Artificial
  CRISPR gRNA sequence
gaatatcatggctacgatag

SEQ ID NO: 389661 - DNA, 20 bp, Artificial
  CRISPR gRNA sequence
cgatagtttcagccgcacca

SEQ ID NO: 389662 - DNA, 20 bp, Artificial
  CRISPR gRNA sequence
cagccgcaccaaaaactagc

SEQ ID NO: 389663 - DNA, 20 bp, Artificial
  CRISPR gRNA sequence
agccgcaccaaaaactagct

SEQ ID NO: 389664 - DNA, 20 bp, Artificial
  CRISPR gRNA sequence
gcttctcatcttcagcatgc

SEQ ID NO: 389665 - DNA, 20 bp, Artificial
  CRISPR gRNA sequence
ctcatcttcagcatgcggtt

SEQ ID NO: 389666 - DNA, 20 bp, Artificial
  CRISPR gRNA sequence
tcatcttcagcatgcggttc

SEQ ID NO: 389667 - DNA, 20 bp, Artificial
  CRISPR gRNA sequence
atcttcagcatgcggttcca

SEQ ID NO: 389668 - DNA, 20 bp, Artificial
  CRISPR gRNA sequence
cagcatgcggttccatgtgt

SEQ ID NO: 389669 - DNA, 20 bp, Artificial
  CRISPR gRNA sequence
agcatgcggttccatgtgtc

SEQ ID NO: 389670 - DNA, 20 bp, Artificial
  CRISPR gRNA sequence
catgtgtcaaaatgttgtaa

SEQ ID NO: 389671 - DNA, 20 bp, Artificial
  CRISPR gRNA sequence
taaaaagaaaaccacagcac

SEQ ID NO: 389672 - DNA, 20 bp, Artificial
  CRISPR gRNA sequence
cagctttctcctctgtacaa

SEQ ID NO: 389673 - DNA, 20 bp, Artificial
  CRISPR gRNA sequence
tctcctctgtacaaccgttt

SEQ ID NO: 389674 - DNA, 20 bp, Artificial
  CRISPR gRNA sequence
ctcctctgtacaaccgttta

SEQ ID NO: 389675 - DNA, 20 bp, Artificial
  CRISPR gRNA sequence
tcctctgtacaaccgtttac

SEQ ID NO: 389676 - DNA, 20 bp, Artificial
  CRISPR gRNA sequence
ctctgtacaaccgtttacca

SEQ ID NO: 389677 - DNA, 20 bp, Artificial
  CRISPR gRNA sequence
tgtacaaccgtttaccaaag

SEQ ID NO: 389678 - DNA, 20 bp, Artificial
  CRISPR gRNA sequence
tacaaccgtttaccaaaggt

SEQ ID NO: 389679 - DNA, 20 bp, Artificial
  CRISPR gRNA sequence
accaaaggtagcactttacc

SEQ ID NO: 389680 - DNA, 20 bp, Artificial
  CRISPR gRNA sequence
ccaaaggtagcactttaccc

SEQ ID NO: 389681 - DNA, 20 bp, Artificial
  CRISPR gRNA sequence
tacccacataacacacaccc

SEQ ID NO: 389682 - DNA, 20 bp, Artificial
  CRISPR gRNA sequence
acccacataacacacacccg

SEQ ID NO: 389683 - DNA, 20 bp, Artificial
  CRISPR gRNA sequence
cccacataacacacacccgg

SEQ ID NO: 389684 - DNA, 20 bp, Artificial
  CRISPR gRNA sequence
cgtctctaagtaataaagca

SEQ ID NO: 389685 - DNA, 20 bp, Artificial
  CRISPR gRNA sequence
gtctctaagtaataaagcaa

SEQ ID NO: 389686 - DNA, 20 bp, Artificial
  CRISPR gRNA sequence
taagtaataaagcaacacaa

SEQ ID NO: 389687 - DNA, 20 bp, Artificial
  CRISPR gRNA sequence
agtaataaagcaacacaaga

SEQ ID NO: 389688 - DNA, 20 bp, Artificial
  CRISPR gRNA sequence
attaaaaaagggaaaaaagg

SEQ ID NO: 389689 - DNA, 20 bp, Artificial
  CRISPR gRNA sequence
aaaaagggaaaaaaggaaat

SEQ ID NO: 389690 - DNA, 20 bp, Artificial
  CRISPR gRNA sequence
aaaagaaacaaaaggaaaat

SEQ ID NO: 389691 - DNA, 20 bp, Artificial
  CRISPR gRNA sequence
aaagaaacaaaaggaaaatt

SEQ ID NO: 389692 - DNA, 20 bp, Artificial
  CRISPR gRNA sequence
aaataaaaattaaaacaggg

SEQ ID NO: 389693 - DNA, 20 bp, Artificial
  CRISPR gRNA sequence
aaacagggaaaggaagacgt

SEQ ID NO: 389694 - DNA, 20 bp, Artificial
  CRISPR gRNA sequence
gcacaccatgtggagaaatg

SEQ ID NO: 389695 - DNA, 20 bp, Artificial
  CRISPR gRNA sequence
tcatgtgagcccttctggtc

SEQ ID NO: 389696 - DNA, 20 bp, Artificial
  CRISPR gRNA sequence
catgtgagcccttctggtcc

SEQ ID NO: 389697 - DNA, 20 bp, Artificial
  CRISPR gRNA sequence
atgtgagcccttctggtccc

SEQ ID NO: 389698 - DNA, 20 bp, Artificial
  CRISPR gRNA sequence
ctggtccctgggaagtaaga

SEQ ID NO: 389699 - DNA, 20 bp, Artificial
  CRISPR gRNA sequence
tggtccctgggaagtaagag

SEQ ID NO: 389700 - DNA, 20 bp, Artificial
  CRISPR gRNA sequence
gtccctgggaagtaagaggc

SEQ ID NO: 389701 - DNA, 20 bp, Artificial
  CRISPR gRNA sequence
ggaagtaagaggcagcgtga

SEQ ID NO: 389702 - DNA, 20 bp, Artificial
  CRISPR gRNA sequence
agtgctcacacgcacaactg

SEQ ID NO: 389703 - DNA, 20 bp, Artificial
  CRISPR gRNA sequence
acacgcacaactgttttgtg

SEQ ID NO: 389704 - DNA, 20 bp, Artificial
  CRISPR gRNA sequence
ttttgtgtttttcttcttct

SEQ ID NO: 389705 - DNA, 20 bp, Artificial
  CRISPR gRNA sequence
tgtgtttttcttcttcttct

SEQ ID NO: 389706 - DNA, 20 bp, Artificial
  CRISPR gRNA sequence
gtgtttttcttcttcttctc

SEQ ID NO: 389707 - DNA, 20 bp, Artificial
  CRISPR gRNA sequence
tgtttttcttcttcttctct

SEQ ID NO: 389708 - DNA, 20 bp, Artificial
  CRISPR gRNA sequence
ttcttcttcttctctctgga

SEQ ID NO: 389709 - DNA, 20 bp, Artificial
  CRISPR gRNA sequence
tcttcttcttctctctggat

SEQ ID NO: 389710 - DNA, 20 bp, Artificial
  CRISPR gRNA sequence
cttcttcttctctctggatg

SEQ ID NO: 389711 - DNA, 20 bp, Artificial
  CRISPR gRNA sequence
ttcttcttctctctggatgc

SEQ ID NO: 389712 - DNA, 20 bp, Artificial
  CRISPR gRNA sequence
cttcttctctctggatgccg

SEQ ID NO: 389713 - DNA, 20 bp, Artificial
  CRISPR gRNA sequence
ttcttctctctggatgccgc

SEQ ID NO: 389714 - DNA, 20 bp, Artificial
  CRISPR gRNA sequence
cttctctctggatgccgccc

SEQ ID NO: 389715 - DNA, 20 bp, Artificial
  CRISPR gRNA sequence
ttctctctggatgccgcccc

SEQ ID NO: 389716 - DNA, 20 bp, Artificial
  CRISPR gRNA sequence
ctctctggatgccgccccgt

SEQ ID NO: 389717 - DNA, 20 bp, Artificial
  CRISPR gRNA sequence
tctctggatgccgccccgtc

SEQ ID NO: 389718 - DNA, 20 bp, Artificial
  CRISPR gRNA sequence
tctggatgccgccccgtcca

SEQ ID NO: 389719 - DNA, 20 bp, Artificial
  CRISPR gRNA sequence
tggatgccgccccgtccaat

SEQ ID NO: 389720 - DNA, 20 bp, Artificial
  CRISPR gRNA sequence
gatgccgccccgtccaatct

SEQ ID NO: 389721 - DNA, 20 bp, Artificial
  CRISPR gRNA sequence
aggagtttcctttgtctgcc

SEQ ID NO: 389722 - DNA, 20 bp, Artificial
  CRISPR gRNA sequence
cctttgtctgcctatctaac

SEQ ID NO: 389723 - DNA, 20 bp, Artificial
  CRISPR gRNA sequence
ctttgtctgcctatctaacc

SEQ ID NO: 389724 - DNA, 20 bp, Artificial
  CRISPR gRNA sequence
tgtctgcctatctaaccaaa

SEQ ID NO: 389725 - DNA, 20 bp, Artificial
  CRISPR gRNA sequence
gtctgcctatctaaccaaaa

SEQ ID NO: 389726 - DNA, 20 bp, Artificial
  CRISPR gRNA sequence
tctgcctatctaaccaaaac

SEQ ID NO: 389727 - DNA, 20 bp, Artificial
  CRISPR gRNA sequence
cctatctaaccaaaaccatg

SEQ ID NO: 389728 - DNA, 20 bp, Artificial
  CRISPR gRNA sequence
tctaaccaaaaccatgctgt

SEQ ID NO: 389729 - DNA, 20 bp, Artificial
  CRISPR gRNA sequence
accaaaaccatgctgtcagg

SEQ ID NO: 389730 - DNA, 20 bp, Artificial
  CRISPR gRNA sequence
tcaggcccccgtgaacctgc

SEQ ID NO: 389731 - DNA, 20 bp, Artificial
  CRISPR gRNA sequence
ccgactcaggtagaaacagg

SEQ ID NO: 389732 - DNA, 20 bp, Artificial
  CRISPR gRNA sequence
aggtagaaacaggggtctac

SEQ ID NO: 389733 - DNA, 20 bp, Artificial
  CRISPR gRNA sequence
ctcatagccgtgtctgcatt

SEQ ID NO: 389734 - DNA, 20 bp, Artificial
  CRISPR gRNA sequence
atagccgtgtctgcattttc

SEQ ID NO: 389735 - DNA, 20 bp, Artificial
  CRISPR gRNA sequence
cattttcacaaaggacaatg

SEQ ID NO: 389736 - DNA, 20 bp, Artificial
  CRISPR gRNA sequence
tcacaaaggacaatgcagga

SEQ ID NO: 389737 - DNA, 20 bp, Artificial
  CRISPR gRNA sequence
cacaaaggacaatgcaggaa

SEQ ID NO: 389738 - DNA, 20 bp, Artificial
  CRISPR gRNA sequence
acaaaggacaatgcaggaag

SEQ ID NO: 389739 - DNA, 20 bp, Artificial
  CRISPR gRNA sequence
gaggggatgcagctgtcttt

SEQ ID NO: 389740 - DNA, 20 bp, Artificial
  CRISPR gRNA sequence
tctttggggagcaaagtgca

SEQ ID NO: 389741 - DNA, 20 bp, Artificial
  CRISPR gRNA sequence
tggggagcaaagtgcaggga

SEQ ID NO: 389742 - DNA, 20 bp, Artificial
  CRISPR gRNA sequence
ggggagcaaagtgcagggag

SEQ ID NO: 389743 - DNA, 20 bp, Artificial
  CRISPR gRNA sequence
gggagcaaagtgcagggagg

SEQ ID NO: 389744 - DNA, 20 bp, Artificial
  CRISPR gRNA sequence
cagcagaggctccatgtgag

SEQ ID NO: 389745 - DNA, 20 bp, Artificial
  CRISPR gRNA sequence
catgtgaggacctagacccg

SEQ ID NO: 389746 - DNA, 20 bp, Artificial
  CRISPR gRNA sequence
gacccgcctctcaatagact

SEQ ID NO: 389747 - DNA, 20 bp, Artificial
  CRISPR gRNA sequence
tcaatagactcagcctggag

SEQ ID NO: 389748 - DNA, 20 bp, Artificial
  CRISPR gRNA sequence
aatagactcagcctggaggt

SEQ ID NO: 389749 - DNA, 20 bp, Artificial
  CRISPR gRNA sequence
agcctggaggtgaaagaagt

SEQ ID NO: 389750 - DNA, 20 bp, Artificial
  CRISPR gRNA sequence
gaggtgaaagaagtggttcc

SEQ ID NO: 389751 - DNA, 20 bp, Artificial
  CRISPR gRNA sequence
ccaaccctagagccaggtgg

SEQ ID NO: 389752 - DNA, 20 bp, Artificial
  CRISPR gRNA sequence
gagccaggtggttcagaagc

SEQ ID NO: 389753 - DNA, 20 bp, Artificial
  CRISPR gRNA sequence
agaagctcagagtagcccct

SEQ ID NO: 389754 - DNA, 20 bp, Artificial
  CRISPR gRNA sequence
agagtagcccctgattaacc

SEQ ID NO: 389755 - DNA, 20 bp, Artificial
  CRISPR gRNA sequence
attaacctttcctgacaaac

SEQ ID NO: 389756 - DNA, 20 bp, Artificial
  CRISPR gRNA sequence
acctttcctgacaaacagag

SEQ ID NO: 389757 - DNA, 20 bp, Artificial
  CRISPR gRNA sequence
tcctgacaaacagagtaact

SEQ ID NO: 389758 - DNA, 20 bp, Artificial
  CRISPR gRNA sequence
cctgacaaacagagtaactg

SEQ ID NO: 389759 - DNA, 20 bp, Artificial
  CRISPR gRNA sequence
ctgacaaacagagtaactga

SEQ ID NO: 389760 - DNA, 20 bp, Artificial
  CRISPR gRNA sequence
acaaacagagtaactgattg

SEQ ID NO: 389761 - DNA, 20 bp, Artificial
  CRISPR gRNA sequence
attggtgttagatgaaaatc

SEQ ID NO: 389762 - DNA, 20 bp, Artificial
  CRISPR gRNA sequence
gtgttagatgaaaatcaaga

SEQ ID NO: 389763 - DNA, 20 bp, Artificial
  CRISPR gRNA sequence
gatgaaaatcaagacctatt

SEQ ID NO: 389764 - DNA, 20 bp, Artificial
  CRISPR gRNA sequence
ttacgaggtcggccaaacct

SEQ ID NO: 389765 - DNA, 20 bp, Artificial
  CRISPR gRNA sequence
cgaggtcggccaaacctgcc

SEQ ID NO: 389766 - DNA, 20 bp, Artificial
  CRISPR gRNA sequence
ccttgcctcagatattgctt

SEQ ID NO: 389767 - DNA, 20 bp, Artificial
  CRISPR gRNA sequence
gcctcagatattgcttgtgg

SEQ ID NO: 389768 - DNA, 20 bp, Artificial
  CRISPR gRNA sequence
cctcagatattgcttgtggc

SEQ ID NO: 389769 - DNA, 20 bp, Artificial
  CRISPR gRNA sequence
agatattgcttgtggcttct

SEQ ID NO: 389770 - DNA, 20 bp, Artificial
  CRISPR gRNA sequence
cttgtggcttctcagaccac

SEQ ID NO: 389771 - DNA, 20 bp, Artificial
  CRISPR gRNA sequence
gtggcttctcagaccacagg

SEQ ID NO: 389772 - DNA, 20 bp, Artificial
  CRISPR gRNA sequence
tggcttctcagaccacaggc

SEQ ID NO: 389773 - DNA, 20 bp, Artificial
  CRISPR gRNA sequence
ctcagaccacaggctcttcc

SEQ ID NO: 389774 - DNA, 20 bp, Artificial
  CRISPR gRNA sequence
tcagaccacaggctcttcct

SEQ ID NO: 389775 - DNA, 20 bp, Artificial
  CRISPR gRNA sequence
agaccacaggctcttcctgc

SEQ ID NO: 389776 - DNA, 20 bp, Artificial
  CRISPR gRNA sequence
ttcctgcaaagctcagtgga

SEQ ID NO: 389777 - DNA, 20 bp, Artificial
  CRISPR gRNA sequence
cctgcaaagctcagtggaag

SEQ ID NO: 389778 - DNA, 20 bp, Artificial
  CRISPR gRNA sequence
ctgcaaagctcagtggaagg

SEQ ID NO: 389779 - DNA, 20 bp, Artificial
  CRISPR gRNA sequence
caaagctcagtggaaggcag

SEQ ID NO: 389780 - DNA, 20 bp, Artificial
  CRISPR gRNA sequence
agtggaaggcagctcaaaat

SEQ ID NO: 389781 - DNA, 20 bp, Artificial
  CRISPR gRNA sequence
aaaatgaccttgaaaagaac

SEQ ID NO: 389782 - DNA, 20 bp, Artificial
  CRISPR gRNA sequence
gaaaagaactgccagaaaga

SEQ ID NO: 389783 - DNA, 20 bp, Artificial
  CRISPR gRNA sequence
aaaagaactgccagaaagag

SEQ ID NO: 389784 - DNA, 20 bp, Artificial
  CRISPR gRNA sequence
ccagaaagagcccacacaaa

SEQ ID NO: 389785 - DNA, 20 bp, Artificial
  CRISPR gRNA sequence
atgaacttggaattggaaag

SEQ ID NO: 389786 - DNA, 20 bp, Artificial
  CRISPR gRNA sequence
ggaattggaaagtggattca

SEQ ID NO: 389787 - DNA, 20 bp, Artificial
  CRISPR gRNA sequence
gaattggaaagtggattcac

SEQ ID NO: 389788 - DNA, 20 bp, Artificial
  CRISPR gRNA sequence
gaaagtggattcacgtgaaa

SEQ ID NO: 389789 - DNA, 20 bp, Artificial
  CRISPR gRNA sequence
acgtgaaacagaccaaaatg

SEQ ID NO: 389790 - DNA, 20 bp, Artificial
  CRISPR gRNA sequence
attgggaagaaaaaaatttg

SEQ ID NO: 389791 - DNA, 20 bp, Artificial
  CRISPR gRNA sequence
ggaagaaaaaaatttgattt

SEQ ID NO: 389792 - DNA, 20 bp, Artificial
  CRISPR gRNA sequence
gatttcaataaaacaaatac

SEQ ID NO: 389793 - DNA, 20 bp, Artificial
  CRISPR gRNA sequence
atttcaataaaacaaataca

SEQ ID NO: 389794 - DNA, 20 bp, Artificial
  CRISPR gRNA sequence
caataaaacaaatacaaata

SEQ ID NO: 389795 - DNA, 20 bp, Artificial
  CRISPR gRNA sequence
aataaaacaaatacaaataa

SEQ ID NO: 389796 - DNA, 20 bp, Artificial
  CRISPR gRNA sequence
atacttatatgtagctacgt

SEQ ID NO: 389797 - DNA, 20 bp, Artificial
  CRISPR gRNA sequence
tacttatatgtagctacgta

SEQ ID NO: 389798 - DNA, 20 bp, Artificial
  CRISPR gRNA sequence
atatgtagctacgtattaat

SEQ ID NO: 389799 - DNA, 20 bp, Artificial
  CRISPR gRNA sequence
tatgtagctacgtattaata

SEQ ID NO: 389800 - DNA, 20 bp, Artificial
  CRISPR gRNA sequence
cgtattaatacttagaataa

SEQ ID NO: 389801 - DNA, 20 bp, Artificial
  CRISPR gRNA sequence
atacttagaataaacattga

SEQ ID NO: 389802 - DNA, 20 bp, Artificial
  CRISPR gRNA sequence
agaataaacattgaatagac

SEQ ID NO: 389803 - DNA, 20 bp, Artificial
  CRISPR gRNA sequence
gaataaacattgaatagact

SEQ ID NO: 389804 - DNA, 20 bp, Artificial
  CRISPR gRNA sequence
aatagactgtgttgttttcc

SEQ ID NO: 389805 - DNA, 20 bp, Artificial
  CRISPR gRNA sequence
tgttgttttcccatgatttt

SEQ ID NO: 389806 - DNA, 20 bp, Artificial
  CRISPR gRNA sequence
ttttcccatgatttttattg

SEQ ID NO: 389807 - DNA, 20 bp, Artificial
  CRISPR gRNA sequence
tcccatgatttttattgcag

SEQ ID NO: 389808 - DNA, 20 bp, Artificial
  CRISPR gRNA sequence
cccatgatttttattgcagg

SEQ ID NO: 389809 - DNA, 20 bp, Artificial
  CRISPR gRNA sequence
ccatgatttttattgcagga

SEQ ID NO: 389810 - DNA, 20 bp, Artificial
  CRISPR gRNA sequence
ttattgcaggatatcatgat

SEQ ID NO: 389811 - DNA, 20 bp, Artificial
  CRISPR gRNA sequence
tattgcaggatatcatgatt

SEQ ID NO: 389812 - DNA, 20 bp, Artificial
  CRISPR gRNA sequence
attgcaggatatcatgatta

SEQ ID NO: 389813 - DNA, 20 bp, Artificial
  CRISPR gRNA sequence
ttgcaggatatcatgattaa

SEQ ID NO: 389814 - DNA, 20 bp, Artificial
  CRISPR gRNA sequence
caggatatcatgattaaata

SEQ ID NO: 389815 - DNA, 20 bp, Artificial
  CRISPR gRNA sequence
aatattctctattttgtatg

SEQ ID NO: 389816 - DNA, 20 bp, Artificial
  CRISPR gRNA sequence
tctattttgtatgtggcttc

SEQ ID NO: 389817 - DNA, 20 bp, Artificial
  CRISPR gRNA sequence
tattttgtatgtggcttctc

SEQ ID NO: 389818 - DNA, 20 bp, Artificial
  CRISPR gRNA sequence
ttttgtatgtggcttctctg

SEQ ID NO: 389819 - DNA, 20 bp, Artificial
  CRISPR gRNA sequence
tgtatgtggcttctctggct

SEQ ID NO: 389820 - DNA, 20 bp, Artificial
  CRISPR gRNA sequence
gtatgtggcttctctggctt

SEQ ID NO: 389821 - DNA, 20 bp, Artificial
  CRISPR gRNA sequence
tatgtggcttctctggcttg

SEQ ID NO: 389822 - DNA, 20 bp, Artificial
  CRISPR gRNA sequence
ctctggcttgaccacaaatc

SEQ ID NO: 389823 - DNA, 20 bp, Artificial
  CRISPR gRNA sequence
tctggcttgaccacaaatca

SEQ ID NO: 389824 - DNA, 20 bp, Artificial
  CRISPR gRNA sequence
tggcttgaccacaaatcatc

SEQ ID NO: 389825 - DNA, 20 bp, Artificial
  CRISPR gRNA sequence
gcttgaccacaaatcatcct

SEQ ID NO: 389826 - DNA, 20 bp, Artificial
  CRISPR gRNA sequence
gaccacaaatcatccttgga

SEQ ID NO: 389827 - DNA, 20 bp, Artificial
  CRISPR gRNA sequence
accacaaatcatccttggaa

SEQ ID NO: 389828 - DNA, 20 bp, Artificial
  CRISPR gRNA sequence
ggaaattatttcagtgcttc

SEQ ID NO: 389829 - DNA, 20 bp, Artificial
  CRISPR gRNA sequence
gaaattatttcagtgcttca

SEQ ID NO: 389830 - DNA, 20 bp, Artificial
  CRISPR gRNA sequence
tttcagtgcttcatcacttt

SEQ ID NO: 389831 - DNA, 20 bp, Artificial
  CRISPR gRNA sequence
cagtgcttcatcacttttcc

SEQ ID NO: 389832 - DNA, 20 bp, Artificial
  CRISPR gRNA sequence
agtgcttcatcacttttcca

SEQ ID NO: 389833 - DNA, 20 bp, Artificial
  CRISPR gRNA sequence
catcacttttccaaccactg

SEQ ID NO: 389834 - DNA, 20 bp, Artificial
  CRISPR gRNA sequence
atcacttttccaaccactgc

SEQ ID NO: 389835 - DNA, 20 bp, Artificial
  CRISPR gRNA sequence
ttccaaccactgctcatgtc

SEQ ID NO: 389836 - DNA, 20 bp, Artificial
  CRISPR gRNA sequence
tccaaccactgctcatgtcc

SEQ ID NO: 389837 - DNA, 20 bp, Artificial
  CRISPR gRNA sequence
ccaaccactgctcatgtcct

SEQ ID NO: 389838 - DNA, 20 bp, Artificial
  CRISPR gRNA sequence
caaccactgctcatgtcctg

SEQ ID NO: 389839 - DNA, 20 bp, Artificial
  CRISPR gRNA sequence
ctcatgtcctgggtacccca

SEQ ID NO: 389840 - DNA, 20 bp, Artificial
  CRISPR gRNA sequence
atgtcctgggtaccccaaac

SEQ ID NO: 389841 - DNA, 20 bp, Artificial
  CRISPR gRNA sequence
ggtaccccaaacattgctgg

SEQ ID NO: 389842 - DNA, 20 bp, Artificial
  CRISPR gRNA sequence
ctgggtacatcttcacatca

SEQ ID NO: 389843 - DNA, 20 bp, Artificial
  CRISPR gRNA sequence
ggtacatcttcacatcatgc

SEQ ID NO: 389844 - DNA, 20 bp, Artificial
  CRISPR gRNA sequence
cacatcatgccactgcccct

SEQ ID NO: 389845 - DNA, 20 bp, Artificial
  CRISPR gRNA sequence
acatcatgccactgcccctg

SEQ ID NO: 389846 - DNA, 20 bp, Artificial
  CRISPR gRNA sequence
cccctgcccactagcgcctc

SEQ ID NO: 389847 - DNA, 20 bp, Artificial
  CRISPR gRNA sequence
cccactagcgcctccctggc

SEQ ID NO: 389848 - DNA, 20 bp, Artificial
  CRISPR gRNA sequence
gcgcctccctggctactgac

SEQ ID NO: 389849 - DNA, 20 bp, Artificial
  CRISPR gRNA sequence
cctggctactgacctgtcct

SEQ ID NO: 389850 - DNA, 20 bp, Artificial
  CRISPR gRNA sequence
gctactgacctgtcctcctc

SEQ ID NO: 389851 - DNA, 20 bp, Artificial
  CRISPR gRNA sequence
ctgacctgtcctcctcacca

SEQ ID NO: 389852 - DNA, 20 bp, Artificial
  CRISPR gRNA sequence
acctgtcctcctcaccatcc

SEQ ID NO: 389853 - DNA, 20 bp, Artificial
  CRISPR gRNA sequence
tcctcctcaccatcctcact

SEQ ID NO: 389854 - DNA, 20 bp, Artificial
  CRISPR gRNA sequence
ctcaccatcctcactggtca

SEQ ID NO: 389855 - DNA, 20 bp, Artificial
  CRISPR gRNA sequence
accatcctcactggtcaaca

SEQ ID NO: 389856 - DNA, 20 bp, Artificial
  CRISPR gRNA sequence
actggtcaacagttctgcat

SEQ ID NO: 389857 - DNA, 20 bp, Artificial
  CRISPR gRNA sequence
gtcaacagttctgcatatgc

SEQ ID NO: 389858 - DNA, 20 bp, Artificial
  CRISPR gRNA sequence
tgcatatgcagtttgagcag

SEQ ID NO: 389859 - DNA, 20 bp, Artificial
  CRISPR gRNA sequence
catatgcagtttgagcagct

SEQ ID NO: 389860 - DNA, 20 bp, Artificial
  CRISPR gRNA sequence
gagcagctctgcaaaatcct

SEQ ID NO: 389861 - DNA, 20 bp, Artificial
  CRISPR gRNA sequence
agcagctctgcaaaatcctt

SEQ ID NO: 389862 - DNA, 20 bp, Artificial
  CRISPR gRNA sequence
tgcaaaatccttcacccact

SEQ ID NO: 389863 - DNA, 20 bp, Artificial
  CRISPR gRNA sequence
caaaatccttcacccacttc

SEQ ID NO: 389864 - DNA, 20 bp, Artificial
  CRISPR gRNA sequence
cacccacttcacaaaaccct

SEQ ID NO: 389865 - DNA, 20 bp, Artificial
  CRISPR gRNA sequence
acccacttcacaaaaccctg

SEQ ID NO: 389866 - DNA, 20 bp, Artificial
  CRISPR gRNA sequence
cacaaaaccctgagtcattt

SEQ ID NO: 389867 - DNA, 20 bp, Artificial
  CRISPR gRNA sequence
acaaaaccctgagtcatttt

SEQ ID NO: 389868 - DNA, 20 bp, Artificial
  CRISPR gRNA sequence
agtcattttactgtcagctt

SEQ ID NO: 389869 - DNA, 20 bp, Artificial
  CRISPR gRNA sequence
tactgtcagcttcgtaaacc

SEQ ID NO: 389870 - DNA, 20 bp, Artificial
  CRISPR gRNA sequence
actgtcagcttcgtaaaccc

SEQ ID NO: 389871 - DNA, 20 bp, Artificial
  CRISPR gRNA sequence
ctgtcagcttcgtaaaccca

SEQ ID NO: 389872 - DNA, 20 bp, Artificial
  CRISPR gRNA sequence
tcagcttcgtaaacccaagc

SEQ ID NO: 389873 - DNA, 20 bp, Artificial
  CRISPR gRNA sequence
cgtaaacccaagcctctgta

SEQ ID NO: 389874 - DNA, 20 bp, Artificial
  CRISPR gRNA sequence
gtaaacccaagcctctgtat

SEQ ID NO: 389875 - DNA, 20 bp, Artificial
  CRISPR gRNA sequence
tgtatagctagaccatttta

SEQ ID NO: 389876 - DNA, 20 bp, Artificial
  CRISPR gRNA sequence
tatagctagaccattttaca

SEQ ID NO: 389877 - DNA, 20 bp, Artificial
  CRISPR gRNA sequence
gaccattttacactgctctg

SEQ ID NO: 389878 - DNA, 20 bp, Artificial
  CRISPR gRNA sequence
tacactgctctgtacttagc

SEQ ID NO: 389879 - DNA, 20 bp, Artificial
  CRISPR gRNA sequence
acactgctctgtacttagca

SEQ ID NO: 389880 - DNA, 20 bp, Artificial
  CRISPR gRNA sequence
cactgctctgtacttagcac

SEQ ID NO: 389881 - DNA, 20 bp, Artificial
  CRISPR gRNA sequence
ctctgtacttagcacctaga

SEQ ID NO: 389882 - DNA, 20 bp, Artificial
  CRISPR gRNA sequence
tgtacttagcacctagaacc

SEQ ID NO: 389883 - DNA, 20 bp, Artificial
  CRISPR gRNA sequence
tacttagcacctagaaccat

SEQ ID NO: 389884 - DNA, 20 bp, Artificial
  CRISPR gRNA sequence
agcacctagaaccatgcttg

SEQ ID NO: 389885 - DNA, 20 bp, Artificial
  CRISPR gRNA sequence
gcacctagaaccatgcttgg

SEQ ID NO: 389886 - DNA, 20 bp, Artificial
  CRISPR gRNA sequence
gaaccatgcttggcataaag

SEQ ID NO: 389887 - DNA, 20 bp, Artificial
  CRISPR gRNA sequence
ggcataaagtagagaagtca

SEQ ID NO: 389888 - DNA, 20 bp, Artificial
  CRISPR gRNA sequence
gcataaagtagagaagtcaa

SEQ ID NO: 389889 - DNA, 20 bp, Artificial
  CRISPR gRNA sequence
tttggataaaaaatttgcca

SEQ ID NO: 389890 - DNA, 20 bp, Artificial
  CRISPR gRNA sequence
ttggataaaaaatttgccaa

SEQ ID NO: 389891 - DNA, 20 bp, Artificial
  CRISPR gRNA sequence
tggataaaaaatttgccaac

SEQ ID NO: 389892 - DNA, 20 bp, Artificial
  CRISPR gRNA sequence
ggataaaaaatttgccaacc

SEQ ID NO: 389893 - DNA, 20 bp, Artificial
  CRISPR gRNA sequence
gataaaaaatttgccaacct

SEQ ID NO: 389894 - DNA, 20 bp, Artificial
  CRISPR gRNA sequence
gccaacctaaagaatgggag

SEQ ID NO: 389895 - DNA, 20 bp, Artificial
  CRISPR gRNA sequence
ccaacctaaagaatgggagg

SEQ ID NO: 389896 - DNA, 20 bp, Artificial
  CRISPR gRNA sequence
aagaatgggaggaaatattt

SEQ ID NO: 389897 - DNA, 20 bp, Artificial
  CRISPR gRNA sequence
gcaaactatgcatctgacaa

SEQ ID NO: 389898 - DNA, 20 bp, Artificial
  CRISPR gRNA sequence
caaactatgcatctgacaaa

SEQ ID NO: 389899 - DNA, 20 bp, Artificial
  CRISPR gRNA sequence
tgcatctgacaaaggtctaa

SEQ ID NO: 389900 - DNA, 20 bp, Artificial
  CRISPR gRNA sequence
acaaaggtctaatatccagc

SEQ ID NO: 389901 - DNA, 20 bp, Artificial
  CRISPR gRNA sequence
atatccagcatctataagga

SEQ ID NO: 389902 - DNA, 20 bp, Artificial
  CRISPR gRNA sequence
taaggaagttaagcaaattt

SEQ ID NO: 389903 - DNA, 20 bp, Artificial
  CRISPR gRNA sequence
agcaaatttacaagaggaaa

SEQ ID NO: 389904 - DNA, 20 bp, Artificial
  CRISPR gRNA sequence
acaagaggaaaacgacccca

SEQ ID NO: 389905 - DNA, 20 bp, Artificial
  CRISPR gRNA sequence
caagaggaaaacgaccccat

SEQ ID NO: 389906 - DNA, 20 bp, Artificial
  CRISPR gRNA sequence
aaaagtgggtaaaggacaca

SEQ ID NO: 389907 - DNA, 20 bp, Artificial
  CRISPR gRNA sequence
ctcaaaagaagacatatacg

SEQ ID NO: 389908 - DNA, 20 bp, Artificial
  CRISPR gRNA sequence
tcaaaagaagacatatacgt

SEQ ID NO: 389909 - DNA, 20 bp, Artificial
  CRISPR gRNA sequence
aaaagaagacatatacgtgg

SEQ ID NO: 389910 - DNA, 20 bp, Artificial
  CRISPR gRNA sequence
aatatcactcatcattacag

SEQ ID NO: 389911 - DNA, 20 bp, Artificial
  CRISPR gRNA sequence
atcattacagaaaggcaaac

SEQ ID NO: 389912 - DNA, 20 bp, Artificial
  CRISPR gRNA sequence
cagaaaggcaaaccaaaatg

SEQ ID NO: 389913 - DNA, 20 bp, Artificial
  CRISPR gRNA sequence
ataccagtcagaatggctat

SEQ ID NO: 389914 - DNA, 20 bp, Artificial
  CRISPR gRNA sequence
ttactaaaaaggcaaaacat

SEQ ID NO: 389915 - DNA, 20 bp, Artificial
  CRISPR gRNA sequence
ctaaaaaggcaaaacattac

SEQ ID NO: 389916 - DNA, 20 bp, Artificial
  CRISPR gRNA sequence
aaaaggcaaaacattacaga

SEQ ID NO: 389917 - DNA, 20 bp, Artificial
  CRISPR gRNA sequence
cagatgctggtgaggttgca

SEQ ID NO: 389918 - DNA, 20 bp, Artificial
  CRISPR gRNA sequence
gtgaggttgcagagaaaagg

SEQ ID NO: 389919 - DNA, 20 bp, Artificial
  CRISPR gRNA sequence
cagagaaaagggaacactta

SEQ ID NO: 389920 - DNA, 20 bp, Artificial
  CRISPR gRNA sequence
atacactgttggtgggagtg

SEQ ID NO: 389921 - DNA, 20 bp, Artificial
  CRISPR gRNA sequence
tacactgttggtgggagtgt

SEQ ID NO: 389922 - DNA, 20 bp, Artificial
  CRISPR gRNA sequence
ttggtgggagtgtaaattaa

SEQ ID NO: 389923 - DNA, 20 bp, Artificial
  CRISPR gRNA sequence
gtgggagtgtaaattaattc

SEQ ID NO: 389924 - DNA, 20 bp, Artificial
  CRISPR gRNA sequence
attcaaccattgtggaaagc

SEQ ID NO: 389925 - DNA, 20 bp, Artificial
  CRISPR gRNA sequence
aaccattgtggaaagcagta

SEQ ID NO: 389926 - DNA, 20 bp, Artificial
  CRISPR gRNA sequence
tggaaagcagtatggcaatt

SEQ ID NO: 389927 - DNA, 20 bp, Artificial
  CRISPR gRNA sequence
ctcaaagagataaaagcaga

SEQ ID NO: 389928 - DNA, 20 bp, Artificial
  CRISPR gRNA sequence
aaagagataaaagcagaact

SEQ ID NO: 389929 - DNA, 20 bp, Artificial
  CRISPR gRNA sequence
ccatttgacccagcaatccc

SEQ ID NO: 389930 - DNA, 20 bp, Artificial
  CRISPR gRNA sequence
gacccagcaatcccattcct

SEQ ID NO: 389931 - DNA, 20 bp, Artificial
  CRISPR gRNA sequence
acccagcaatcccattcctg

SEQ ID NO: 389932 - DNA, 20 bp, Artificial
  CRISPR gRNA sequence
ctgggcatatacccagagga

SEQ ID NO: 389933 - DNA, 20 bp, Artificial
  CRISPR gRNA sequence
ggcatatacccagaggaata

SEQ ID NO: 389934 - DNA, 20 bp, Artificial
  CRISPR gRNA sequence
taaagacacatatgtacatg

SEQ ID NO: 389935 - DNA, 20 bp, Artificial
  CRISPR gRNA sequence
actgcagcactaatcacaat

SEQ ID NO: 389936 - DNA, 20 bp, Artificial
  CRISPR gRNA sequence
cagcactaatcacaatagca

SEQ ID NO: 389937 - DNA, 20 bp, Artificial
  CRISPR gRNA sequence
atcacaatagcaaagacatg

SEQ ID NO: 389938 - DNA, 20 bp, Artificial
  CRISPR gRNA sequence
aacgtccatcagtgacagat

SEQ ID NO: 389939 - DNA, 20 bp, Artificial
  CRISPR gRNA sequence
catattcatcatggaatact

SEQ ID NO: 389940 - DNA, 20 bp, Artificial
  CRISPR gRNA sequence
atcatggaatactatgcagc

SEQ ID NO: 389941 - DNA, 20 bp, Artificial
  CRISPR gRNA sequence
tgcagccataaaaaagaatg

SEQ ID NO: 389942 - DNA, 20 bp, Artificial
  CRISPR gRNA sequence
tgtgggaacatggatgcagc

SEQ ID NO: 389943 - DNA, 20 bp, Artificial
  CRISPR gRNA sequence
gtgggaacatggatgcagct

SEQ ID NO: 389944 - DNA, 20 bp, Artificial
  CRISPR gRNA sequence
tgggaacatggatgcagctg

SEQ ID NO: 389945 - DNA, 20 bp, Artificial
  CRISPR gRNA sequence
gaggctattatcctcagtaa

SEQ ID NO: 389946 - DNA, 20 bp, Artificial
  CRISPR gRNA sequence
ttatcctcagtaaactaatg

SEQ ID NO: 389947 - DNA, 20 bp, Artificial
  CRISPR gRNA sequence
tcctcagtaaactaatgcag

SEQ ID NO: 389948 - DNA, 20 bp, Artificial
  CRISPR gRNA sequence
agtaaactaatgcaggaatt

SEQ ID NO: 389949 - DNA, 20 bp, Artificial
  CRISPR gRNA sequence
atgcaggaattgaaaaccaa

SEQ ID NO: 389950 - DNA, 20 bp, Artificial
  CRISPR gRNA sequence
aaaaccaaataccacatgtt

SEQ ID NO: 389951 - DNA, 20 bp, Artificial
  CRISPR gRNA sequence
tcactttcaaatgggagcta

SEQ ID NO: 389952 - DNA, 20 bp, Artificial
  CRISPR gRNA sequence
actttcaaatgggagctaaa

SEQ ID NO: 389953 - DNA, 20 bp, Artificial
  CRISPR gRNA sequence
tcaaatgggagctaaaggat

SEQ ID NO: 389954 - DNA, 20 bp, Artificial
  CRISPR gRNA sequence
caaatgggagctaaaggata

SEQ ID NO: 389955 - DNA, 20 bp, Artificial
  CRISPR gRNA sequence
aaatgggagctaaaggataa

SEQ ID NO: 389956 - DNA, 20 bp, Artificial
  CRISPR gRNA sequence
aaggataagaagttaggaac

SEQ ID NO: 389957 - DNA, 20 bp, Artificial
  CRISPR gRNA sequence
ggaacataaagaaggaaaca

SEQ ID NO: 389958 - DNA, 20 bp, Artificial
  CRISPR gRNA sequence
ggtctagttgagagcggagg

SEQ ID NO: 389959 - DNA, 20 bp, Artificial
  CRISPR gRNA sequence
gttgagagcggagggtggga

SEQ ID NO: 389960 - DNA, 20 bp, Artificial
  CRISPR gRNA sequence
agagcggagggtgggaggag

SEQ ID NO: 389961 - DNA, 20 bp, Artificial
  CRISPR gRNA sequence
ttagttactgagcttaataa

SEQ ID NO: 389962 - DNA, 20 bp, Artificial
  CRISPR gRNA sequence
agttactgagcttaataact

SEQ ID NO: 389963 - DNA, 20 bp, Artificial
  CRISPR gRNA sequence
gttactgagcttaataactg

SEQ ID NO: 389964 - DNA, 20 bp, Artificial
  CRISPR gRNA sequence
ctgagcttaataactggtga

SEQ ID NO: 389965 - DNA, 20 bp, Artificial
  CRISPR gRNA sequence
agcttaataactggtgatga

SEQ ID NO: 389966 - DNA, 20 bp, Artificial
  CRISPR gRNA sequence
aataactggtgatgaaataa

SEQ ID NO: 389967 - DNA, 20 bp, Artificial
  CRISPR gRNA sequence
ataactggtgatgaaataat

SEQ ID NO: 389968 - DNA, 20 bp, Artificial
  CRISPR gRNA sequence
gtgatgaaataatatgtaca

SEQ ID NO: 389969 - DNA, 20 bp, Artificial
  CRISPR gRNA sequence
tgacacatatttacctatgc

SEQ ID NO: 389970 - DNA, 20 bp, Artificial
  CRISPR gRNA sequence
acctatgcaacaaaccttca

SEQ ID NO: 389971 - DNA, 20 bp, Artificial
  CRISPR gRNA sequence
cctatgcaacaaaccttcac

SEQ ID NO: 389972 - DNA, 20 bp, Artificial
  CRISPR gRNA sequence
tgcaacaaaccttcacatgt

SEQ ID NO: 389973 - DNA, 20 bp, Artificial
  CRISPR gRNA sequence
cacatgtacccacaaaccta

SEQ ID NO: 389974 - DNA, 20 bp, Artificial
  CRISPR gRNA sequence
acatgtacccacaaacctaa

SEQ ID NO: 389975 - DNA, 20 bp, Artificial
  CRISPR gRNA sequence
aaagtttttttaaaaatttt

SEQ ID NO: 389976 - DNA, 20 bp, Artificial
  CRISPR gRNA sequence
ttttaaaaatttttctggcc

SEQ ID NO: 389977 - DNA, 20 bp, Artificial
  CRISPR gRNA sequence
tttaaaaatttttctggccg

SEQ ID NO: 389978 - DNA, 20 bp, Artificial
  CRISPR gRNA sequence
ttaaaaatttttctggccgg

SEQ ID NO: 389979 - DNA, 20 bp, Artificial
  CRISPR gRNA sequence
taaaaatttttctggccggg

SEQ ID NO: 389980 - DNA, 20 bp, Artificial
  CRISPR gRNA sequence
aaaaatttttctggccgggc

SEQ ID NO: 389981 - DNA, 20 bp, Artificial
  CRISPR gRNA sequence
aaaatttttctggccgggcg

SEQ ID NO: 389982 - DNA, 20 bp, Artificial
  CRISPR gRNA sequence
ttctggccgggcgcggtggc

SEQ ID NO: 389983 - DNA, 20 bp, Artificial
  CRISPR gRNA sequence
tctggccgggcgcggtggct

SEQ ID NO: 389984 - DNA, 20 bp, Artificial
  CRISPR gRNA sequence
ctggccgggcgcggtggctc

SEQ ID NO: 389985 - DNA, 20 bp, Artificial
  CRISPR gRNA sequence
tggccgggcgcggtggctca

SEQ ID NO: 389986 - DNA, 20 bp, Artificial
  CRISPR gRNA sequence
gccgggcgcggtggctcacg

SEQ ID NO: 389987 - DNA, 20 bp, Artificial
  CRISPR gRNA sequence
acgcctgtaatcccagcact

SEQ ID NO: 389988 - DNA, 20 bp, Artificial
  CRISPR gRNA sequence
taatcccagcactttgcgag

SEQ ID NO: 389989 - DNA, 20 bp, Artificial
  CRISPR gRNA sequence
tgcgaggccgaggcgggcgg

SEQ ID NO: 389990 - DNA, 20 bp, Artificial
  CRISPR gRNA sequence
gcgaggccgaggcgggcgga

SEQ ID NO: 389991 - DNA, 20 bp, Artificial
  CRISPR gRNA sequence
cgaggccgaggcgggcggat

SEQ ID NO: 389992 - DNA, 20 bp, Artificial
  CRISPR gRNA sequence
gctaacaaggtgaaaccccg

SEQ ID NO: 389993 - DNA, 20 bp, Artificial
  CRISPR gRNA sequence
acaaggtgaaaccccgtctc

SEQ ID NO: 389994 - DNA, 20 bp, Artificial
  CRISPR gRNA sequence
tactaaaaatacaaaaaatt

SEQ ID NO: 389995 - DNA, 20 bp, Artificial
  CRISPR gRNA sequence
ctaaaaatacaaaaaattag

SEQ ID NO: 389996 - DNA, 20 bp, Artificial
  CRISPR gRNA sequence
aaaatacaaaaaattagccg

SEQ ID NO: 389997 - DNA, 20 bp, Artificial
  CRISPR gRNA sequence
gccgggcgcggtggcgggcg

SEQ ID NO: 389998 - DNA, 20 bp, Artificial
  CRISPR gRNA sequence
tagtcccagctactcgggag

SEQ ID NO: 389999 - DNA, 20 bp, Artificial
  CRISPR gRNA sequence
ctcgggaggctgaggcagga

SEQ ID NO: 390000 - DNA, 20 bp, Artificial
  CRISPR gRNA sequence
gggaggctgaggcaggagaa

SEQ ID NO: 390001 - DNA, 20 bp, Artificial
  CRISPR gRNA sequence
aggcaggagaatggcgtgaa

SEQ ID NO: 390002 - DNA, 20 bp, Artificial
  CRISPR gRNA sequence
gcagtgagccgagattgcgc

SEQ ID NO: 390003 - DNA, 20 bp, Artificial
  CRISPR gRNA sequence
cagtgagccgagattgcgcc

SEQ ID NO: 390004 - DNA, 20 bp, Artificial
  CRISPR gRNA sequence
cgccactgcagtccgcagtc

SEQ ID NO: 390005 - DNA, 20 bp, Artificial
  CRISPR gRNA sequence
cagtccgcagtccggcctgg

SEQ ID NO: 390006 - DNA, 20 bp, Artificial
  CRISPR gRNA sequence
ggcgacagagcgagactccg

SEQ ID NO: 390007 - DNA, 20 bp, Artificial
  CRISPR gRNA sequence
cgtctcaaaaaaaaaaaaaa

SEQ ID NO: 390008 - DNA, 20 bp, Artificial
  CRISPR gRNA sequence
aaaaaaaaaaaaaaaaaatt

SEQ ID NO: 390009 - DNA, 20 bp, Artificial
  CRISPR gRNA sequence
ctaataaaataaaactgtat

SEQ ID NO: 390010 - DNA, 20 bp, Artificial
  CRISPR gRNA sequence
taataaaataaaactgtatt

SEQ ID NO: 390011 - DNA, 20 bp, Artificial
  CRISPR gRNA sequence
ataaaataaaactgtatttc

SEQ ID NO: 390012 - DNA, 20 bp, Artificial
  CRISPR gRNA sequence
tatttctgactttaaacact

SEQ ID NO: 390013 - DNA, 20 bp, Artificial
  CRISPR gRNA sequence
ctgactttaaacacttgaaa

SEQ ID NO: 390014 - DNA, 20 bp, Artificial
  CRISPR gRNA sequence
tgactttaaacacttgaaaa

SEQ ID NO: 390015 - DNA, 20 bp, Artificial
  CRISPR gRNA sequence
actttaaacacttgaaaaaa

SEQ ID NO: 390016 - DNA, 20 bp, Artificial
  CRISPR gRNA sequence
taaacacttgaaaaaattaa

SEQ ID NO: 390017 - DNA, 20 bp, Artificial
  CRISPR gRNA sequence
aaacacttgaaaaaattaat

SEQ ID NO: 390018 - DNA, 20 bp, Artificial
  CRISPR gRNA sequence
aacacttgaaaaaattaatt

SEQ ID NO: 390019 - DNA, 20 bp, Artificial
  CRISPR gRNA sequence
gaaaaaattaatttgcaatt

SEQ ID NO: 390020 - DNA, 20 bp, Artificial
  CRISPR gRNA sequence
aaaaaattaatttgcaattc

SEQ ID NO: 390021 - DNA, 20 bp, Artificial
  CRISPR gRNA sequence
atttgcaattcatttgcact

SEQ ID NO: 390022 - DNA, 20 bp, Artificial
  CRISPR gRNA sequence
gcaattcatttgcactcaat

SEQ ID NO: 390023 - DNA, 20 bp, Artificial
  CRISPR gRNA sequence
caattcatttgcactcaatg

SEQ ID NO: 390024 - DNA, 20 bp, Artificial
  CRISPR gRNA sequence
atttgcactcaatgtgcatg

SEQ ID NO: 390025 - DNA, 20 bp, Artificial
  CRISPR gRNA sequence
gcactcaatgtgcatgtatt

SEQ ID NO: 390026 - DNA, 20 bp, Artificial
  CRISPR gRNA sequence
cactcaatgtgcatgtattt

SEQ ID NO: 390027 - DNA, 20 bp, Artificial
  CRISPR gRNA sequence
aatgtgcatgtatttttatt

SEQ ID NO: 390028 - DNA, 20 bp, Artificial
  CRISPR gRNA sequence
ttattgattttgggggagat

SEQ ID NO: 390029 - DNA, 20 bp, Artificial
  CRISPR gRNA sequence
tattgattttgggggagatt

SEQ ID NO: 390030 - DNA, 20 bp, Artificial
  CRISPR gRNA sequence
attgattttgggggagattt

SEQ ID NO: 390031 - DNA, 20 bp, Artificial
  CRISPR gRNA sequence
ttgattttgggggagattta

SEQ ID NO: 390032 - DNA, 20 bp, Artificial
  CRISPR gRNA sequence
attttgggggagatttacat

SEQ ID NO: 390033 - DNA, 20 bp, Artificial
  CRISPR gRNA sequence
tgggggagatttacatctat

SEQ ID NO: 390034 - DNA, 20 bp, Artificial
  CRISPR gRNA sequence
gggggagatttacatctata

SEQ ID NO: 390035 - DNA, 20 bp, Artificial
  CRISPR gRNA sequence
ggggagatttacatctataa

SEQ ID NO: 390036 - DNA, 20 bp, Artificial
  CRISPR gRNA sequence
acatctataataaccctaat

SEQ ID NO: 390037 - DNA, 20 bp, Artificial
  CRISPR gRNA sequence
catctataataaccctaata

SEQ ID NO: 390038 - DNA, 20 bp, Artificial
  CRISPR gRNA sequence
taataaccctaatattaaga

SEQ ID NO: 390039 - DNA, 20 bp, Artificial
  CRISPR gRNA sequence
atattaagaaatatatttaa

SEQ ID NO: 390040 - DNA, 20 bp, Artificial
  CRISPR gRNA sequence
agaaatatatttaaaatagt

SEQ ID NO: 390041 - DNA, 20 bp, Artificial
  CRISPR gRNA sequence
aaaatagtattagtcatgcc

SEQ ID NO: 390042 - DNA, 20 bp, Artificial
  CRISPR gRNA sequence
aaatagtattagtcatgcct

SEQ ID NO: 390043 - DNA, 20 bp, Artificial
  CRISPR gRNA sequence
gtcatgcctaaacgaattga

SEQ ID NO: 390044 - DNA, 20 bp, Artificial
  CRISPR gRNA sequence
aacgaattgagagttctagg

SEQ ID NO: 390045 - DNA, 20 bp, Artificial
  CRISPR gRNA sequence
agagttctaggcaacaatcc

SEQ ID NO: 390046 - DNA, 20 bp, Artificial
  CRISPR gRNA sequence
taggcaacaatcctcagtgt

SEQ ID NO: 390047 - DNA, 20 bp, Artificial
  CRISPR gRNA sequence
ggcaacaatcctcagtgtct

SEQ ID NO: 390048 - DNA, 20 bp, Artificial
  CRISPR gRNA sequence
agtgtctgcaaattcacaaa

SEQ ID NO: 390049 - DNA, 20 bp, Artificial
  CRISPR gRNA sequence
caaattcacaaatgccattt

SEQ ID NO: 390050 - DNA, 20 bp, Artificial
  CRISPR gRNA sequence
acaaatgccatttatgtttc

SEQ ID NO: 390051 - DNA, 20 bp, Artificial
  CRISPR gRNA sequence
atgtttccacagtaccacct

SEQ ID NO: 390052 - DNA, 20 bp, Artificial
  CRISPR gRNA sequence
tgtttccacagtaccacctt

SEQ ID NO: 390053 - DNA, 20 bp, Artificial
  CRISPR gRNA sequence
ccacagtaccaccttggaag

SEQ ID NO: 390054 - DNA, 20 bp, Artificial
  CRISPR gRNA sequence
cacagtaccaccttggaagt

SEQ ID NO: 390055 - DNA, 20 bp, Artificial
  CRISPR gRNA sequence
ggaagtcatagccttgtcaa

SEQ ID NO: 390056 - DNA, 20 bp, Artificial
  CRISPR gRNA sequence
gaagtcatagccttgtcaaa

SEQ ID NO: 390057 - DNA, 20 bp, Artificial
  CRISPR gRNA sequence
gtcaaaataatcaaacctga

SEQ ID NO: 390058 - DNA, 20 bp, Artificial
  CRISPR gRNA sequence
tcaaaataatcaaacctgat

SEQ ID NO: 390059 - DNA, 20 bp, Artificial
  CRISPR gRNA sequence
atgctaatcaagcctccaaa

SEQ ID NO: 390060 - DNA, 20 bp, Artificial
  CRISPR gRNA sequence
atcaagcctccaaatctaac

SEQ ID NO: 390061 - DNA, 20 bp, Artificial
  CRISPR gRNA sequence
caaatctaaccaccaactta

SEQ ID NO: 390062 - DNA, 20 bp, Artificial
  CRISPR gRNA sequence
accaccaacttacagaactg

SEQ ID NO: 390063 - DNA, 20 bp, Artificial
  CRISPR gRNA sequence
acagaactgcaaagagcaga

SEQ ID NO: 390064 - DNA, 20 bp, Artificial
  CRISPR gRNA sequence
cagaactgcaaagagcagag

SEQ ID NO: 390065 - DNA, 20 bp, Artificial
  CRISPR gRNA sequence
caaagagcagagaaacgtat

SEQ ID NO: 390066 - DNA, 20 bp, Artificial
  CRISPR gRNA sequence
aaggtgacaacaacaacaaa

SEQ ID NO: 390067 - DNA, 20 bp, Artificial
  CRISPR gRNA sequence
caggttaaagggaggtatta

SEQ ID NO: 390068 - DNA, 20 bp, Artificial
  CRISPR gRNA sequence
aagggaggtattacacagta

SEQ ID NO: 390069 - DNA, 20 bp, Artificial
  CRISPR gRNA sequence
cacagtaacaatgtgtggaa

SEQ ID NO: 390070 - DNA, 20 bp, Artificial
  CRISPR gRNA sequence
aaaaaggaaaaattcataga

SEQ ID NO: 390071 - DNA, 20 bp, Artificial
  CRISPR gRNA sequence
aaaaggaaaaattcatagaa

SEQ ID NO: 390072 - DNA, 20 bp, Artificial
  CRISPR gRNA sequence
atagaactggagaaatgcaa

SEQ ID NO: 390073 - DNA, 20 bp, Artificial
  CRISPR gRNA sequence
gagaaatgcaaagtagacac

SEQ ID NO: 390074 - DNA, 20 bp, Artificial
  CRISPR gRNA sequence
aataattttaagaaattatt

SEQ ID NO: 390075 - DNA, 20 bp, Artificial
  CRISPR gRNA sequence
ataattttaagaaattattg

SEQ ID NO: 390076 - DNA, 20 bp, Artificial
  CRISPR gRNA sequence
taagaaattattgctgtttt

SEQ ID NO: 390077 - DNA, 20 bp, Artificial
  CRISPR gRNA sequence
aagaaattattgctgttttg

SEQ ID NO: 390078 - DNA, 20 bp, Artificial
  CRISPR gRNA sequence
agaaattattgctgttttgt

SEQ ID NO: 390079 - DNA, 20 bp, Artificial
  CRISPR gRNA sequence
ttgctgttttgtgaggggtg

SEQ ID NO: 390080 - DNA, 20 bp, Artificial
  CRISPR gRNA sequence
ctgttttgtgaggggtgaag

SEQ ID NO: 390081 - DNA, 20 bp, Artificial
  CRISPR gRNA sequence
ttttgtgaggggtgaaggta

SEQ ID NO: 390082 - DNA, 20 bp, Artificial
  CRISPR gRNA sequence
tgtgaggggtgaaggtaatg

SEQ ID NO: 390083 - DNA, 20 bp, Artificial
  CRISPR gRNA sequence
gtgaggggtgaaggtaatga

SEQ ID NO: 390084 - DNA, 20 bp, Artificial
  CRISPR gRNA sequence
tgaggggtgaaggtaatgat

SEQ ID NO: 390085 - DNA, 20 bp, Artificial
  CRISPR gRNA sequence
atgttaaaaagaaaactcat

SEQ ID NO: 390086 - DNA, 20 bp, Artificial
  CRISPR gRNA sequence
tgttaaaaagaaaactcatc

SEQ ID NO: 390087 - DNA, 20 bp, Artificial
  CRISPR gRNA sequence
aaaagaaaactcatcttttg

SEQ ID NO: 390088 - DNA, 20 bp, Artificial
  CRISPR gRNA sequence
atcttttgagattcaggcta

SEQ ID NO: 390089 - DNA, 20 bp, Artificial
  CRISPR gRNA sequence
ttgagattcaggctaaaata

SEQ ID NO: 390090 - DNA, 20 bp, Artificial
  CRISPR gRNA sequence
tgagattcaggctaaaatat

SEQ ID NO: 390091 - DNA, 20 bp, Artificial
  CRISPR gRNA sequence
gagattcaggctaaaatatt

SEQ ID NO: 390092 - DNA, 20 bp, Artificial
  CRISPR gRNA sequence
agattcaggctaaaatattt

SEQ ID NO: 390093 - DNA, 20 bp, Artificial
  CRISPR gRNA sequence
aggctaaaatatttattgat

SEQ ID NO: 390094 - DNA, 20 bp, Artificial
  CRISPR gRNA sequence
aaatatttattgatgagatg

SEQ ID NO: 390095 - DNA, 20 bp, Artificial
  CRISPR gRNA sequence
attgatgagatgacttaatg

SEQ ID NO: 390096 - DNA, 20 bp, Artificial
  CRISPR gRNA sequence
ttgatgagatgacttaatgg

SEQ ID NO: 390097 - DNA, 20 bp, Artificial
  CRISPR gRNA sequence
atgagatgacttaatggctg

SEQ ID NO: 390098 - DNA, 20 bp, Artificial
  CRISPR gRNA sequence
aatggctggaatttgcttca

SEQ ID NO: 390099 - DNA, 20 bp, Artificial
  CRISPR gRNA sequence
atggctggaatttgcttcaa

SEQ ID NO: 390100 - DNA, 20 bp, Artificial
  CRISPR gRNA sequence
gaatttgcttcaaattaatc

SEQ ID NO: 390101 - DNA, 20 bp, Artificial
  CRISPR gRNA sequence
gcttcaaattaatcaaggga

SEQ ID NO: 390102 - DNA, 20 bp, Artificial
  CRISPR gRNA sequence
cttcaaattaatcaagggaa

SEQ ID NO: 390103 - DNA, 20 bp, Artificial
  CRISPR gRNA sequence
caaattaatcaagggaaaga

SEQ ID NO: 390104 - DNA, 20 bp, Artificial
  CRISPR gRNA sequence
aaattaatcaagggaaagag

SEQ ID NO: 390105 - DNA, 20 bp, Artificial
  CRISPR gRNA sequence
atcaagggaaagagagagtg

SEQ ID NO: 390106 - DNA, 20 bp, Artificial
  CRISPR gRNA sequence
acccaaacttgatagtcggc

SEQ ID NO: 390107 - DNA, 20 bp, Artificial
  CRISPR gRNA sequence
gatagtcggcgaagctatat

SEQ ID NO: 390108 - DNA, 20 bp, Artificial
  CRISPR gRNA sequence
atagtcggcgaagctatata

SEQ ID NO: 390109 - DNA, 20 bp, Artificial
  CRISPR gRNA sequence
tatactggtcacaggggaac

SEQ ID NO: 390110 - DNA, 20 bp, Artificial
  CRISPR gRNA sequence
gtcacaggggaactgattat

SEQ ID NO: 390111 - DNA, 20 bp, Artificial
  CRISPR gRNA sequence
attatgctattctttctatt

SEQ ID NO: 390112 - DNA, 20 bp, Artificial
  CRISPR gRNA sequence
tgctattctttctatttttg

SEQ ID NO: 390113 - DNA, 20 bp, Artificial
  CRISPR gRNA sequence
ttctttctatttttgtatat

SEQ ID NO: 390114 - DNA, 20 bp, Artificial
  CRISPR gRNA sequence
tttctatttttgtatatgtt

SEQ ID NO: 390115 - DNA, 20 bp, Artificial
  CRISPR gRNA sequence
tctatttttgtatatgtttg

SEQ ID NO: 390116 - DNA, 20 bp, Artificial
  CRISPR gRNA sequence
ctatttttgtatatgtttga

SEQ ID NO: 390117 - DNA, 20 bp, Artificial
  CRISPR gRNA sequence
tatttttgtatatgtttgaa

SEQ ID NO: 390118 - DNA, 20 bp, Artificial
  CRISPR gRNA sequence
tttttgtatatgtttgaaac

SEQ ID NO: 390119 - DNA, 20 bp, Artificial
  CRISPR gRNA sequence
ttgtatatgtttgaaacttc

SEQ ID NO: 390120 - DNA, 20 bp, Artificial
  CRISPR gRNA sequence
tgtatatgtttgaaacttcc

SEQ ID NO: 390121 - DNA, 20 bp, Artificial
  CRISPR gRNA sequence
gtatatgtttgaaacttcca

SEQ ID NO: 390122 - DNA, 20 bp, Artificial
  CRISPR gRNA sequence
tatatgtttgaaacttccat

SEQ ID NO: 390123 - DNA, 20 bp, Artificial
  CRISPR gRNA sequence
gaaacttccattaaaaaagc

SEQ ID NO: 390124 - DNA, 20 bp, Artificial
  CRISPR gRNA sequence
aaacttccattaaaaaagct

SEQ ID NO: 390125 - DNA, 20 bp, Artificial
  CRISPR gRNA sequence
ccattaaaaaagctttaaaa

SEQ ID NO: 390126 - DNA, 20 bp, Artificial
  CRISPR gRNA sequence
cattaaaaaagctttaaaag

SEQ ID NO: 390127 - DNA, 20 bp, Artificial
  CRISPR gRNA sequence
aaaaagctttaaaagtattt

SEQ ID NO: 390128 - DNA, 20 bp, Artificial
  CRISPR gRNA sequence
taaaagtatttatttgtgcc

SEQ ID NO: 390129 - DNA, 20 bp, Artificial
  CRISPR gRNA sequence
aaaagtatttatttgtgccc

SEQ ID NO: 390130 - DNA, 20 bp, Artificial
  CRISPR gRNA sequence
aaagtatttatttgtgcccg

SEQ ID NO: 390131 - DNA, 20 bp, Artificial
  CRISPR gRNA sequence
atttgtgcccgggcacagtg

SEQ ID NO: 390132 - DNA, 20 bp, Artificial
  CRISPR gRNA sequence
tttgtgcccgggcacagtgg

SEQ ID NO: 390133 - DNA, 20 bp, Artificial
  CRISPR gRNA sequence
gtgcccgggcacagtggctc

SEQ ID NO: 390134 - DNA, 20 bp, Artificial
  CRISPR gRNA sequence
tgcccgggcacagtggctca

SEQ ID NO: 390135 - DNA, 20 bp, Artificial
  CRISPR gRNA sequence
acacctgtaatccagcactt

SEQ ID NO: 390136 - DNA, 20 bp, Artificial
  CRISPR gRNA sequence
taatccagcactttgggagg

SEQ ID NO: 390137 - DNA, 20 bp, Artificial
  CRISPR gRNA sequence
tgggaggccgaggcaggcag

SEQ ID NO: 390138 - DNA, 20 bp, Artificial
  CRISPR gRNA sequence
gggaggccgaggcaggcaga

SEQ ID NO: 390139 - DNA, 20 bp, Artificial
  CRISPR gRNA sequence
ggaggccgaggcaggcagat

SEQ ID NO: 390140 - DNA, 20 bp, Artificial
  CRISPR gRNA sequence
gctaacatggtgaaaccccg

SEQ ID NO: 390141 - DNA, 20 bp, Artificial
  CRISPR gRNA sequence
acatggtgaaaccccgtctc

SEQ ID NO: 390142 - DNA, 20 bp, Artificial
  CRISPR gRNA sequence
tactaaaaatacaaaaaatt

SEQ ID NO: 390143 - DNA, 20 bp, Artificial
  CRISPR gRNA sequence
ctaaaaatacaaaaaattag

SEQ ID NO: 390144 - DNA, 20 bp, Artificial
  CRISPR gRNA sequence
aaaatacaaaaaattagccg

SEQ ID NO: 390145 - DNA, 20 bp, Artificial
  CRISPR gRNA sequence
gccgggcgtggtggcaggtg

SEQ ID NO: 390146 - DNA, 20 bp, Artificial
  CRISPR gRNA sequence
tagtcccagctactcaggag

SEQ ID NO: 390147 - DNA, 20 bp, Artificial
  CRISPR gRNA sequence
ctcaggaggctgaggcagaa

SEQ ID NO: 390148 - DNA, 20 bp, Artificial
  CRISPR gRNA sequence
aggaggctgaggcagaagaa

SEQ ID NO: 390149 - DNA, 20 bp, Artificial
  CRISPR gRNA sequence
aggcagaagaatggcgtgaa

SEQ ID NO: 390150 - DNA, 20 bp, Artificial
  CRISPR gRNA sequence
gcagtgagccgagatcgcac

SEQ ID NO: 390151 - DNA, 20 bp, Artificial
  CRISPR gRNA sequence
cagtgagccgagatcgcacc

SEQ ID NO: 390152 - DNA, 20 bp, Artificial
  CRISPR gRNA sequence
cactccagcctgggcgacag

SEQ ID NO: 390153 - DNA, 20 bp, Artificial
  CRISPR gRNA sequence
cagcctgggcgacagagcaa

SEQ ID NO: 390154 - DNA, 20 bp, Artificial
  CRISPR gRNA sequence
ggcgacagagcaagactctg

SEQ ID NO: 390155 - DNA, 20 bp, Artificial
  CRISPR gRNA sequence
tgactcaaaaaaaaaaaaaa

SEQ ID NO: 390156 - DNA, 20 bp, Artificial
  CRISPR gRNA sequence
actcaaaaaaaaaaaaaaaa

SEQ ID NO: 390157 - DNA, 20 bp, Artificial
  CRISPR gRNA sequence
aaaaaaaaaaaaaaaagtat

SEQ ID NO: 390158 - DNA, 20 bp, Artificial
  CRISPR gRNA sequence
gttagtacaagatttgagaa

SEQ ID NO: 390159 - DNA, 20 bp, Artificial
  CRISPR gRNA sequence
ttagtacaagatttgagaag

SEQ ID NO: 390160 - DNA, 20 bp, Artificial
  CRISPR gRNA sequence
gtacaagatttgagaagcaa

SEQ ID NO: 390161 - DNA, 20 bp, Artificial
  CRISPR gRNA sequence
gagaagcaagagaaggaacc

SEQ ID NO: 390162 - DNA, 20 bp, Artificial
  CRISPR gRNA sequence
agaagcaagagaaggaacct

SEQ ID NO: 390163 - DNA, 20 bp, Artificial
  CRISPR gRNA sequence
aattggagtccctgcttgtg

SEQ ID NO: 390164 - DNA, 20 bp, Artificial
  CRISPR gRNA sequence
gagtccctgcttgtgaaagg

SEQ ID NO: 390165 - DNA, 20 bp, Artificial
  CRISPR gRNA sequence
cttgtgaaaggtacttcaca

SEQ ID NO: 390166 - DNA, 20 bp, Artificial
  CRISPR gRNA sequence
gtgaaaggtacttcacacac

SEQ ID NO: 390167 - DNA, 20 bp, Artificial
  CRISPR gRNA sequence
tgaaaggtacttcacacacc

SEQ ID NO: 390168 - DNA, 20 bp, Artificial
  CRISPR gRNA sequence
cacacacccaatctctaatc

SEQ ID NO: 390169 - DNA, 20 bp, Artificial
  CRISPR gRNA sequence
acacacccaatctctaatcc

SEQ ID NO: 390170 - DNA, 20 bp, Artificial
  CRISPR gRNA sequence
taatcctaacaataacatcc

SEQ ID NO: 390171 - DNA, 20 bp, Artificial
  CRISPR gRNA sequence
atcctaacaataacatccaa

SEQ ID NO: 390172 - DNA, 20 bp, Artificial
  CRISPR gRNA sequence
acaataacatccaatcagta

SEQ ID NO: 390173 - DNA, 20 bp, Artificial
  CRISPR gRNA sequence
atgtgcctgtttcacagttg

SEQ ID NO: 390174 - DNA, 20 bp, Artificial
  CRISPR gRNA sequence
tttcacagttgaaaaaataa

SEQ ID NO: 390175 - DNA, 20 bp, Artificial
  CRISPR gRNA sequence
cacagttgaaaaaataaata

SEQ ID NO: 390176 - DNA, 20 bp, Artificial
  CRISPR gRNA sequence
acagttgaaaaaataaatat

SEQ ID NO: 390177 - DNA, 20 bp, Artificial
  CRISPR gRNA sequence
aaaaaataaatatactgaag

SEQ ID NO: 390178 - DNA, 20 bp, Artificial
  CRISPR gRNA sequence
aagtagctttcccaaagagc

SEQ ID NO: 390179 - DNA, 20 bp, Artificial
  CRISPR gRNA sequence
tcccaaagagctgagctggc

SEQ ID NO: 390180 - DNA, 20 bp, Artificial
  CRISPR gRNA sequence
cccaaagagctgagctggca

SEQ ID NO: 390181 - DNA, 20 bp, Artificial
  CRISPR gRNA sequence
ccaaagagctgagctggcaa

SEQ ID NO: 390182 - DNA, 20 bp, Artificial
  CRISPR gRNA sequence
agctggcaaagaacagaatc

SEQ ID NO: 390183 - DNA, 20 bp, Artificial
  CRISPR gRNA sequence
gcaaagaacagaatcagaaa

SEQ ID NO: 390184 - DNA, 20 bp, Artificial
  CRISPR gRNA sequence
atttggttttaaagctcata

SEQ ID NO: 390185 - DNA, 20 bp, Artificial
  CRISPR gRNA sequence
ggttttaaagctcatacatt

SEQ ID NO: 390186 - DNA, 20 bp, Artificial
  CRISPR gRNA sequence
gttttaaagctcatacattt

SEQ ID NO: 390187 - DNA, 20 bp, Artificial
  CRISPR gRNA sequence
taaagctcatacatttttca

SEQ ID NO: 390188 - DNA, 20 bp, Artificial
  CRISPR gRNA sequence
aaagctcatacatttttcat

SEQ ID NO: 390189 - DNA, 20 bp, Artificial
  CRISPR gRNA sequence
aagctcatacatttttcatg

SEQ ID NO: 390190 - DNA, 20 bp, Artificial
  CRISPR gRNA sequence
atacatttttcatgccagaa

SEQ ID NO: 390191 - DNA, 20 bp, Artificial
  CRISPR gRNA sequence
ttcatgccagaacaccacaa

SEQ ID NO: 390192 - DNA, 20 bp, Artificial
  CRISPR gRNA sequence
tcatgccagaacaccacaaa

SEQ ID NO: 390193 - DNA, 20 bp, Artificial
  CRISPR gRNA sequence
catgccagaacaccacaaat

SEQ ID NO: 390194 - DNA, 20 bp, Artificial
  CRISPR gRNA sequence
atgccagaacaccacaaatg

SEQ ID NO: 390195 - DNA, 20 bp, Artificial
  CRISPR gRNA sequence
aactctctcctgtatcttta

SEQ ID NO: 390196 - DNA, 20 bp, Artificial
  CRISPR gRNA sequence
tctcctgtatctttaacctc

SEQ ID NO: 390197 - DNA, 20 bp, Artificial
  CRISPR gRNA sequence
tcctgtatctttaacctcca

SEQ ID NO: 390198 - DNA, 20 bp, Artificial
  CRISPR gRNA sequence
ctgtatctttaacctccaat

SEQ ID NO: 390199 - DNA, 20 bp, Artificial
  CRISPR gRNA sequence
tatctttaacctccaattct

SEQ ID NO: 390200 - DNA, 20 bp, Artificial
  CRISPR gRNA sequence
taacctccaattctaagtgg

SEQ ID NO: 390201 - DNA, 20 bp, Artificial
  CRISPR gRNA sequence
aacctccaattctaagtgga

SEQ ID NO: 390202 - DNA, 20 bp, Artificial
  CRISPR gRNA sequence
acctccaattctaagtggac

SEQ ID NO: 390203 - DNA, 20 bp, Artificial
  CRISPR gRNA sequence
caattctaagtggactgttc

SEQ ID NO: 390204 - DNA, 20 bp, Artificial
  CRISPR gRNA sequence
taagtggactgttctctctc

SEQ ID NO: 390205 - DNA, 20 bp, Artificial
  CRISPR gRNA sequence
agtggactgttctctctctc

SEQ ID NO: 390206 - DNA, 20 bp, Artificial
  CRISPR gRNA sequence
ttctctctctcacctctaaa

SEQ ID NO: 390207 - DNA, 20 bp, Artificial
  CRISPR gRNA sequence
tctctctcacctctaaacgg

SEQ ID NO: 390208 - DNA, 20 bp, Artificial
  CRISPR gRNA sequence
tctctcacctctaaacggga

SEQ ID NO: 390209 - DNA, 20 bp, Artificial
  CRISPR gRNA sequence
tctcacctctaaacgggatc

SEQ ID NO: 390210 - DNA, 20 bp, Artificial
  CRISPR gRNA sequence
tcacctctaaacgggatctt

SEQ ID NO: 390211 - DNA, 20 bp, Artificial
  CRISPR gRNA sequence
acctctaaacgggatctttc

SEQ ID NO: 390212 - DNA, 20 bp, Artificial
  CRISPR gRNA sequence
taaacgggatctttctccca

SEQ ID NO: 390213 - DNA, 20 bp, Artificial
  CRISPR gRNA sequence
aacgggatctttctcccatt

SEQ ID NO: 390214 - DNA, 20 bp, Artificial
  CRISPR gRNA sequence
tctcccattcctgaaaacca

SEQ ID NO: 390215 - DNA, 20 bp, Artificial
  CRISPR gRNA sequence
ctcccattcctgaaaaccaa

SEQ ID NO: 390216 - DNA, 20 bp, Artificial
  CRISPR gRNA sequence
tcccattcctgaaaaccaac

SEQ ID NO: 390217 - DNA, 20 bp, Artificial
  CRISPR gRNA sequence
ccattcctgaaaaccaactt

SEQ ID NO: 390218 - DNA, 20 bp, Artificial
  CRISPR gRNA sequence
ctgaaaaccaactttggacc

SEQ ID NO: 390219 - DNA, 20 bp, Artificial
  CRISPR gRNA sequence
aaaaccaactttggaccttt

SEQ ID NO: 390220 - DNA, 20 bp, Artificial
  CRISPR gRNA sequence
tggaccttttggcgccatcc

SEQ ID NO: 390221 - DNA, 20 bp, Artificial
  CRISPR gRNA sequence
ggaccttttggcgccatcca

SEQ ID NO: 390222 - DNA, 20 bp, Artificial
  CRISPR gRNA sequence
gaccttttggcgccatccag

SEQ ID NO: 390223 - DNA, 20 bp, Artificial
  CRISPR gRNA sequence
ttggcgccatccagtccttg

SEQ ID NO: 390224 - DNA, 20 bp, Artificial
  CRISPR gRNA sequence
tggcgccatccagtccttgt

SEQ ID NO: 390225 - DNA, 20 bp, Artificial
  CRISPR gRNA sequence
ggcgccatccagtccttgtt

SEQ ID NO: 390226 - DNA, 20 bp, Artificial
  CRISPR gRNA sequence
gcgccatccagtccttgttt

SEQ ID NO: 390227 - DNA, 20 bp, Artificial
  CRISPR gRNA sequence
gtttcttcttccctattcat

SEQ ID NO: 390228 - DNA, 20 bp, Artificial
  CRISPR gRNA sequence
tttcttcttccctattcatt

SEQ ID NO: 390229 - DNA, 20 bp, Artificial
  CRISPR gRNA sequence
cttcttccctattcattcaa

SEQ ID NO: 390230 - DNA, 20 bp, Artificial
  CRISPR gRNA sequence
ttcttccctattcattcaaa

SEQ ID NO: 390231 - DNA, 20 bp, Artificial
  CRISPR gRNA sequence
cttccctattcattcaaaat

SEQ ID NO: 390232 - DNA, 20 bp, Artificial
  CRISPR gRNA sequence
ttccctattcattcaaaatt

SEQ ID NO: 390233 - DNA, 20 bp, Artificial
  CRISPR gRNA sequence
ccctattcattcaaaattcc

SEQ ID NO: 390234 - DNA, 20 bp, Artificial
  CRISPR gRNA sequence
cctattcattcaaaattcca

SEQ ID NO: 390235 - DNA, 20 bp, Artificial
  CRISPR gRNA sequence
ttcattcaaaattccaggag

SEQ ID NO: 390236 - DNA, 20 bp, Artificial
  CRISPR gRNA sequence
attcaaaattccaggagtgg

SEQ ID NO: 390237 - DNA, 20 bp, Artificial
  CRISPR gRNA sequence
aaaattccaggagtgggttc

SEQ ID NO: 390238 - DNA, 20 bp, Artificial
  CRISPR gRNA sequence
caggagtgggttcccatcct

SEQ ID NO: 390239 - DNA, 20 bp, Artificial
  CRISPR gRNA sequence
ccatcctgctcggcctcacc

SEQ ID NO: 390240 - DNA, 20 bp, Artificial
  CRISPR gRNA sequence
ctcggcctcaccctttccca

SEQ ID NO: 390241 - DNA, 20 bp, Artificial
  CRISPR gRNA sequence
ggcctcaccctttcccatgt

SEQ ID NO: 390242 - DNA, 20 bp, Artificial
  CRISPR gRNA sequence
accctttcccatgtgtgctt

SEQ ID NO: 390243 - DNA, 20 bp, Artificial
  CRISPR gRNA sequence
tcccatgtgtgcttcgacac

SEQ ID NO: 390244 - DNA, 20 bp, Artificial
  CRISPR gRNA sequence
cccatgtgtgcttcgacaca

SEQ ID NO: 390245 - DNA, 20 bp, Artificial
  CRISPR gRNA sequence
ccatgtgtgcttcgacacaa

SEQ ID NO: 390246 - DNA, 20 bp, Artificial
  CRISPR gRNA sequence
cgacacaatcgagcatccat

SEQ ID NO: 390247 - DNA, 20 bp, Artificial
  CRISPR gRNA sequence
gacacaatcgagcatccatt

SEQ ID NO: 390248 - DNA, 20 bp, Artificial
  CRISPR gRNA sequence
ccacccttctaccaagactg

SEQ ID NO: 390249 - DNA, 20 bp, Artificial
  CRISPR gRNA sequence
cacccttctaccaagactgc

SEQ ID NO: 390250 - DNA, 20 bp, Artificial
  CRISPR gRNA sequence
ctaccaagactgcaaatgtc

SEQ ID NO: 390251 - DNA, 20 bp, Artificial
  CRISPR gRNA sequence
taccaagactgcaaatgtca

SEQ ID NO: 390252 - DNA, 20 bp, Artificial
  CRISPR gRNA sequence
ccaagactgcaaatgtcatc

SEQ ID NO: 390253 - DNA, 20 bp, Artificial
  CRISPR gRNA sequence
caaatgtcatcagtgttctt

SEQ ID NO: 390254 - DNA, 20 bp, Artificial
  CRISPR gRNA sequence
ttgacctgaatgctggatgt

SEQ ID NO: 390255 - DNA, 20 bp, Artificial
  CRISPR gRNA sequence
gacctgaatgctggatgtcc

SEQ ID NO: 390256 - DNA, 20 bp, Artificial
  CRISPR gRNA sequence
acctgaatgctggatgtcca

SEQ ID NO: 390257 - DNA, 20 bp, Artificial
  CRISPR gRNA sequence
aatgctggatgtccagccct

SEQ ID NO: 390258 - DNA, 20 bp, Artificial
  CRISPR gRNA sequence
gatgtccagccctcctggaa

SEQ ID NO: 390259 - DNA, 20 bp, Artificial
  CRISPR gRNA sequence
ctggaaatactctacccctt

SEQ ID NO: 390260 - DNA, 20 bp, Artificial
  CRISPR gRNA sequence
gaaatactctaccccttggc

SEQ ID NO: 390261 - DNA, 20 bp, Artificial
  CRISPR gRNA sequence
taccccttggcttccgtgac

SEQ ID NO: 390262 - DNA, 20 bp, Artificial
  CRISPR gRNA sequence
ccccttggcttccgtgacat

SEQ ID NO: 390263 - DNA, 20 bp, Artificial
  CRISPR gRNA sequence
ggcttccgtgacattgcact

SEQ ID NO: 390264 - DNA, 20 bp, Artificial
  CRISPR gRNA sequence
gcttccgtgacattgcactt

SEQ ID NO: 390265 - DNA, 20 bp, Artificial
  CRISPR gRNA sequence
ccgtgacattgcacttgcct

SEQ ID NO: 390266 - DNA, 20 bp, Artificial
  CRISPR gRNA sequence
cgtgacattgcacttgcctg

SEQ ID NO: 390267 - DNA, 20 bp, Artificial
  CRISPR gRNA sequence
cacttgcctgcctctcctct

SEQ ID NO: 390268 - DNA, 20 bp, Artificial
  CRISPR gRNA sequence
gcctgcctctcctctctcct

SEQ ID NO: 390269 - DNA, 20 bp, Artificial
  CRISPR gRNA sequence
cctgcctctcctctctcctt

SEQ ID NO: 390270 - DNA, 20 bp, Artificial
  CRISPR gRNA sequence
cctctcctctctcctttctg

SEQ ID NO: 390271 - DNA, 20 bp, Artificial
  CRISPR gRNA sequence
tcctctctcctttctgacct

SEQ ID NO: 390272 - DNA, 20 bp, Artificial
  CRISPR gRNA sequence
ctctctcctttctgacctcc

SEQ ID NO: 390273 - DNA, 20 bp, Artificial
  CRISPR gRNA sequence
tctcctttctgacctccctc

SEQ ID NO: 390274 - DNA, 20 bp, Artificial
  CRISPR gRNA sequence
tcctttctgacctccctctg

SEQ ID NO: 390275 - DNA, 20 bp, Artificial
  CRISPR gRNA sequence
ctttctgacctccctctgct

SEQ ID NO: 390276 - DNA, 20 bp, Artificial
  CRISPR gRNA sequence
tctgacctccctctgctatc

SEQ ID NO: 390277 - DNA, 20 bp, Artificial
  CRISPR gRNA sequence
ctgacctccctctgctatct

SEQ ID NO: 390278 - DNA, 20 bp, Artificial
  CRISPR gRNA sequence
tgacctccctctgctatctc

SEQ ID NO: 390279 - DNA, 20 bp, Artificial
  CRISPR gRNA sequence
acctccctctgctatctcct

SEQ ID NO: 390280 - DNA, 20 bp, Artificial
  CRISPR gRNA sequence
cctctgctatctccttcatg

SEQ ID NO: 390281 - DNA, 20 bp, Artificial
  CRISPR gRNA sequence
tgctatctccttcatgcttt

SEQ ID NO: 390282 - DNA, 20 bp, Artificial
  CRISPR gRNA sequence
ctatctccttcatgctttct

SEQ ID NO: 390283 - DNA, 20 bp, Artificial
  CRISPR gRNA sequence
tctccttcatgctttctctt

SEQ ID NO: 390284 - DNA, 20 bp, Artificial
  CRISPR gRNA sequence
cttcatgctttctcttcttc

SEQ ID NO: 390285 - DNA, 20 bp, Artificial
  CRISPR gRNA sequence
catgctttctcttcttctgc

SEQ ID NO: 390286 - DNA, 20 bp, Artificial
  CRISPR gRNA sequence
atgctttctcttcttctgct

SEQ ID NO: 390287 - DNA, 20 bp, Artificial
  CRISPR gRNA sequence
tctcttcttctgcttgtccc

SEQ ID NO: 390288 - DNA, 20 bp, Artificial
  CRISPR gRNA sequence
ctcttcttctgcttgtccct

SEQ ID NO: 390289 - DNA, 20 bp, Artificial
  CRISPR gRNA sequence
tcttcttctgcttgtcccta

SEQ ID NO: 390290 - DNA, 20 bp, Artificial
  CRISPR gRNA sequence
ttcttctgcttgtccctaaa

SEQ ID NO: 390291 - DNA, 20 bp, Artificial
  CRISPR gRNA sequence
cttctgcttgtccctaaaaa

SEQ ID NO: 390292 - DNA, 20 bp, Artificial
  CRISPR gRNA sequence
ttctgcttgtccctaaaaaa

SEQ ID NO: 390293 - DNA, 20 bp, Artificial
  CRISPR gRNA sequence
ctgcttgtccctaaaaaaaa

SEQ ID NO: 390294 - DNA, 20 bp, Artificial
  CRISPR gRNA sequence
tgcttgtccctaaaaaaaaa

SEQ ID NO: 390295 - DNA, 20 bp, Artificial
  CRISPR gRNA sequence
cttgtccctaaaaaaaaatg

SEQ ID NO: 390296 - DNA, 20 bp, Artificial
  CRISPR gRNA sequence
gtccctaaaaaaaaatgtgt

SEQ ID NO: 390297 - DNA, 20 bp, Artificial
  CRISPR gRNA sequence
tccctaaaaaaaaatgtgtg

SEQ ID NO: 390298 - DNA, 20 bp, Artificial
  CRISPR gRNA sequence
aaaaaaaatgtgtgttgtgc

SEQ ID NO: 390299 - DNA, 20 bp, Artificial
  CRISPR gRNA sequence
tgcccccaggagtccactgc

SEQ ID NO: 390300 - DNA, 20 bp, Artificial
  CRISPR gRNA sequence
cccttccctgtctactcacc

SEQ ID NO: 390301 - DNA, 20 bp, Artificial
  CRISPR gRNA sequence
ccctgtctactcaccatcgc

SEQ ID NO: 390302 - DNA, 20 bp, Artificial
  CRISPR gRNA sequence
cctgtctactcaccatcgct

SEQ ID NO: 390303 - DNA, 20 bp, Artificial
  CRISPR gRNA sequence
tctactcaccatcgctgagt

SEQ ID NO: 390304 - DNA, 20 bp, Artificial
  CRISPR gRNA sequence
ctcaccatcgctgagtgagc

SEQ ID NO: 390305 - DNA, 20 bp, Artificial
  CRISPR gRNA sequence
accatcgctgagtgagccta

SEQ ID NO: 390306 - DNA, 20 bp, Artificial
  CRISPR gRNA sequence
agtgagcctatctactctcc

SEQ ID NO: 390307 - DNA, 20 bp, Artificial
  CRISPR gRNA sequence
tctactctccttgttcaacc

SEQ ID NO: 390308 - DNA, 20 bp, Artificial
  CRISPR gRNA sequence
ctctccttgttcaaccatct

SEQ ID NO: 390309 - DNA, 20 bp, Artificial
  CRISPR gRNA sequence
tccttgttcaaccatctctt

SEQ ID NO: 390310 - DNA, 20 bp, Artificial
  CRISPR gRNA sequence
cttgttcaaccatctcttag

SEQ ID NO: 390311 - DNA, 20 bp, Artificial
  CRISPR gRNA sequence
gttcaaccatctcttaggtg

SEQ ID NO: 390312 - DNA, 20 bp, Artificial
  CRISPR gRNA sequence
ttcaaccatctcttaggtgc

SEQ ID NO: 390313 - DNA, 20 bp, Artificial
  CRISPR gRNA sequence
aaccatctcttaggtgcaga

SEQ ID NO: 390314 - DNA, 20 bp, Artificial
  CRISPR gRNA sequence
ttaggtgcagatcaagtgca

SEQ ID NO: 390315 - DNA, 20 bp, Artificial
  CRISPR gRNA sequence
aggtgcagatcaagtgcaaa

SEQ ID NO: 390316 - DNA, 20 bp, Artificial
  CRISPR gRNA sequence
ggtgcagatcaagtgcaaat

SEQ ID NO: 390317 - DNA, 20 bp, Artificial
  CRISPR gRNA sequence
ctcagtcagacctctcccca

SEQ ID NO: 390318 - DNA, 20 bp, Artificial
  CRISPR gRNA sequence
agtcagacctctccccaggg

SEQ ID NO: 390319 - DNA, 20 bp, Artificial
  CRISPR gRNA sequence
tccccagggtttctaaagca

SEQ ID NO: 390320 - DNA, 20 bp, Artificial
  CRISPR gRNA sequence
cccagggtttctaaagcacg

SEQ ID NO: 390321 - DNA, 20 bp, Artificial
  CRISPR gRNA sequence
ctaaagcacgagacgataac

SEQ ID NO: 390322 - DNA, 20 bp, Artificial
  CRISPR gRNA sequence
taaagcacgagacgataact

SEQ ID NO: 390323 - DNA, 20 bp, Artificial
  CRISPR gRNA sequence
aagcacgagacgataacttg

SEQ ID NO: 390324 - DNA, 20 bp, Artificial
  CRISPR gRNA sequence
gttcttacgatgcttcaaat

SEQ ID NO: 390325 - DNA, 20 bp, Artificial
  CRISPR gRNA sequence
ttcttacgatgcttcaaata

SEQ ID NO: 390326 - DNA, 20 bp, Artificial
  CRISPR gRNA sequence
ttacgatgcttcaaatagac

SEQ ID NO: 390327 - DNA, 20 bp, Artificial
  CRISPR gRNA sequence
acgatgcttcaaatagacta

SEQ ID NO: 390328 - DNA, 20 bp, Artificial
  CRISPR gRNA sequence
cgatgcttcaaatagactaa

SEQ ID NO: 390329 - DNA, 20 bp, Artificial
  CRISPR gRNA sequence
caaatagactaaaaattaaa

SEQ ID NO: 390330 - DNA, 20 bp, Artificial
  CRISPR gRNA sequence
aaatagactaaaaattaaac

SEQ ID NO: 390331 - DNA, 20 bp, Artificial
  CRISPR gRNA sequence
aaaattaaacagcccagcat

SEQ ID NO: 390332 - DNA, 20 bp, Artificial
  CRISPR gRNA sequence
aacagcccagcattgcccta

SEQ ID NO: 390333 - DNA, 20 bp, Artificial
  CRISPR gRNA sequence
ccctaagccatctgcaggag

SEQ ID NO: 390334 - DNA, 20 bp, Artificial
  CRISPR gRNA sequence
agccatctgcaggagcacta

SEQ ID NO: 390335 - DNA, 20 bp, Artificial
  CRISPR gRNA sequence
caggagcactattattacac

SEQ ID NO: 390336 - DNA, 20 bp, Artificial
  CRISPR gRNA sequence
ttattacactagctaattag

SEQ ID NO: 390337 - DNA, 20 bp, Artificial
  CRISPR gRNA sequence
ttacactagctaattagaaa

SEQ ID NO: 390338 - DNA, 20 bp, Artificial
  CRISPR gRNA sequence
cactagctaattagaaatga

SEQ ID NO: 390339 - DNA, 20 bp, Artificial
  CRISPR gRNA sequence
gctaattagaaatgatgata

SEQ ID NO: 390340 - DNA, 20 bp, Artificial
  CRISPR gRNA sequence
attagaaatgatgatagtag

SEQ ID NO: 390341 - DNA, 20 bp, Artificial
  CRISPR gRNA sequence
gaaatgatgatagtagtagc

SEQ ID NO: 390342 - DNA, 20 bp, Artificial
  CRISPR gRNA sequence
cagtagcttcacgtattccc

SEQ ID NO: 390343 - DNA, 20 bp, Artificial
  CRISPR gRNA sequence
cacgtattcccaactgtgcc

SEQ ID NO: 390344 - DNA, 20 bp, Artificial
  CRISPR gRNA sequence
acgtattcccaactgtgcct

SEQ ID NO: 390345 - DNA, 20 bp, Artificial
  CRISPR gRNA sequence
ccaactgtgcctagactatg

SEQ ID NO: 390346 - DNA, 20 bp, Artificial
  CRISPR gRNA sequence
tgcctagactatgaatatgc

SEQ ID NO: 390347 - DNA, 20 bp, Artificial
  CRISPR gRNA sequence
gactatgaatatgctcaatt

SEQ ID NO: 390348 - DNA, 20 bp, Artificial
  CRISPR gRNA sequence
tgaatatgctcaattaagaa

SEQ ID NO: 390349 - DNA, 20 bp, Artificial
  CRISPR gRNA sequence
aattaagaacttttctacaa

SEQ ID NO: 390350 - DNA, 20 bp, Artificial
  CRISPR gRNA sequence
agaacttttctacaaactct

SEQ ID NO: 390351 - DNA, 20 bp, Artificial
  CRISPR gRNA sequence
ttctacaaactcttactagt

SEQ ID NO: 390352 - DNA, 20 bp, Artificial
  CRISPR gRNA sequence
tctacaaactcttactagtc

SEQ ID NO: 390353 - DNA, 20 bp, Artificial
  CRISPR gRNA sequence
ctacaaactcttactagtca

SEQ ID NO: 390354 - DNA, 20 bp, Artificial
  CRISPR gRNA sequence
tacaaactcttactagtcac

SEQ ID NO: 390355 - DNA, 20 bp, Artificial
  CRISPR gRNA sequence
caaactcttactagtcaccc

SEQ ID NO: 390356 - DNA, 20 bp, Artificial
  CRISPR gRNA sequence
ttactagtcacccaaataaa

SEQ ID NO: 390357 - DNA, 20 bp, Artificial
  CRISPR gRNA sequence
actagtcacccaaataaatg

SEQ ID NO: 390358 - DNA, 20 bp, Artificial
  CRISPR gRNA sequence
ctagtcacccaaataaatgc

SEQ ID NO: 390359 - DNA, 20 bp, Artificial
  CRISPR gRNA sequence
gtcacccaaataaatgcaaa

SEQ ID NO: 390360 - DNA, 20 bp, Artificial
  CRISPR gRNA sequence
actgcatgatgactaaggag

SEQ ID NO: 390361 - DNA, 20 bp, Artificial
  CRISPR gRNA sequence
catgatgactaaggaggtct

SEQ ID NO: 390362 - DNA, 20 bp, Artificial
  CRISPR gRNA sequence
aggaggtctcctaaagtgcc

SEQ ID NO: 390363 - DNA, 20 bp, Artificial
  CRISPR gRNA sequence
ctaaagtgcctgagataaag

SEQ ID NO: 390364 - DNA, 20 bp, Artificial
  CRISPR gRNA sequence
aagtgcctgagataaagttc

SEQ ID NO: 390365 - DNA, 20 bp, Artificial
  CRISPR gRNA sequence
agataaagttctcaaaaata

SEQ ID NO: 390366 - DNA, 20 bp, Artificial
  CRISPR gRNA sequence
tcaaaaataagcaagcaaaa

SEQ ID NO: 390367 - DNA, 20 bp, Artificial
  CRISPR gRNA sequence
aaaaataagcaagcaaaaga

SEQ ID NO: 390368 - DNA, 20 bp, Artificial
  CRISPR gRNA sequence
ccagttacaagcaagcaaca

SEQ ID NO: 390369 - DNA, 20 bp, Artificial
  CRISPR gRNA sequence
caagcaagcaacaaagtcca

SEQ ID NO: 390370 - DNA, 20 bp, Artificial
  CRISPR gRNA sequence
ttgaagctcatagggcatgc

SEQ ID NO: 390371 - DNA, 20 bp, Artificial
  CRISPR gRNA sequence
tgaagctcatagggcatgca

SEQ ID NO: 390372 - DNA, 20 bp, Artificial
  CRISPR gRNA sequence
gaagctcatagggcatgcag

SEQ ID NO: 390373 - DNA, 20 bp, Artificial
  CRISPR gRNA sequence
aagctcatagggcatgcagt

SEQ ID NO: 390374 - DNA, 20 bp, Artificial
  CRISPR gRNA sequence
atagggcatgcagtgtggga

SEQ ID NO: 390375 - DNA, 20 bp, Artificial
  CRISPR gRNA sequence
aggacagaaggagaaacaca

SEQ ID NO: 390376 - DNA, 20 bp, Artificial
  CRISPR gRNA sequence
tccaaggatgcctttgcctg

SEQ ID NO: 390377 - DNA, 20 bp, Artificial
  CRISPR gRNA sequence
ccaaggatgcctttgcctgc

SEQ ID NO: 390378 - DNA, 20 bp, Artificial
  CRISPR gRNA sequence
caaggatgcctttgcctgcc

SEQ ID NO: 390379 - DNA, 20 bp, Artificial
  CRISPR gRNA sequence
tgcctgcctcatagttctgg

SEQ ID NO: 390380 - DNA, 20 bp, Artificial
  CRISPR gRNA sequence
gcctgcctcatagttctggc

SEQ ID NO: 390381 - DNA, 20 bp, Artificial
  CRISPR gRNA sequence
cctgcctcatagttctggct

SEQ ID NO: 390382 - DNA, 20 bp, Artificial
  CRISPR gRNA sequence
cctcatagttctggctgtga

SEQ ID NO: 390383 - DNA, 20 bp, Artificial
  CRISPR gRNA sequence
atagttctggctgtgacagc

SEQ ID NO: 390384 - DNA, 20 bp, Artificial
  CRISPR gRNA sequence
tggctgtgacagccaaaaag

SEQ ID NO: 390385 - DNA, 20 bp, Artificial
  CRISPR gRNA sequence
gctgtgacagccaaaaagtg

SEQ ID NO: 390386 - DNA, 20 bp, Artificial
  CRISPR gRNA sequence
tgacagccaaaaagtgaaaa

SEQ ID NO: 390387 - DNA, 20 bp, Artificial
  CRISPR gRNA sequence
aactgagctgtcaggcagct

SEQ ID NO: 390388 - DNA, 20 bp, Artificial
  CRISPR gRNA sequence
agctgtcaggcagcttcaag

SEQ ID NO: 390389 - DNA, 20 bp, Artificial
  CRISPR gRNA sequence
tcaggcagcttcaagcagaa

SEQ ID NO: 390390 - DNA, 20 bp, Artificial
  CRISPR gRNA sequence
caagcagaatagaaacagaa

SEQ ID NO: 390391 - DNA, 20 bp, Artificial
  CRISPR gRNA sequence
aagcagaatagaaacagaag

SEQ ID NO: 390392 - DNA, 20 bp, Artificial
  CRISPR gRNA sequence
ttccctagaacgcatcagca

SEQ ID NO: 390393 - DNA, 20 bp, Artificial
  CRISPR gRNA sequence
ccctagaacgcatcagcatt

SEQ ID NO: 390394 - DNA, 20 bp, Artificial
  CRISPR gRNA sequence
cctagaacgcatcagcattc

SEQ ID NO: 390395 - DNA, 20 bp, Artificial
  CRISPR gRNA sequence
gaacgcatcagcattcccag

SEQ ID NO: 390396 - DNA, 20 bp, Artificial
  CRISPR gRNA sequence
ccagaaagagaatgcaagct

SEQ ID NO: 390397 - DNA, 20 bp, Artificial
  CRISPR gRNA sequence
ctgcctacactgtagactcc

SEQ ID NO: 390398 - DNA, 20 bp, Artificial
  CRISPR gRNA sequence
cctacactgtagactccctg

SEQ ID NO: 390399 - DNA, 20 bp, Artificial
  CRISPR gRNA sequence
cactgtagactccctgtgtg

SEQ ID NO: 390400 - DNA, 20 bp, Artificial
  CRISPR gRNA sequence
tagactccctgtgtgcattc

SEQ ID NO: 390401 - DNA, 20 bp, Artificial
  CRISPR gRNA sequence
cctgtgtgcattcatttcaa

SEQ ID NO: 390402 - DNA, 20 bp, Artificial
  CRISPR gRNA sequence
tgtgcattcatttcaaacat

SEQ ID NO: 390403 - DNA, 20 bp, Artificial
  CRISPR gRNA sequence
atttcaaacatagacagcaa

SEQ ID NO: 390404 - DNA, 20 bp, Artificial
  CRISPR gRNA sequence
caaacatagacagcaatgac

SEQ ID NO: 390405 - DNA, 20 bp, Artificial
  CRISPR gRNA sequence
aaacatagacagcaatgaca

SEQ ID NO: 390406 - DNA, 20 bp, Artificial
  CRISPR gRNA sequence
gatggcatttctctaaaaag

SEQ ID NO: 390407 - DNA, 20 bp, Artificial
  CRISPR gRNA sequence
ctctaaaaagctgcaatgtt

SEQ ID NO: 390408 - DNA, 20 bp, Artificial
  CRISPR gRNA sequence
tctaaaaagctgcaatgttc

SEQ ID NO: 390409 - DNA, 20 bp, Artificial
  CRISPR gRNA sequence
taaaaagctgcaatgttccc

SEQ ID NO: 390410 - DNA, 20 bp, Artificial
  CRISPR gRNA sequence
aaaagctgcaatgttcccag

SEQ ID NO: 390411 - DNA, 20 bp, Artificial
  CRISPR gRNA sequence
caatgttcccagatggccaa

SEQ ID NO: 390412 - DNA, 20 bp, Artificial
  CRISPR gRNA sequence
ccagatggccaagtttgggg

SEQ ID NO: 390413 - DNA, 20 bp, Artificial
  CRISPR gRNA sequence
ggggatgttacaggtggaat

SEQ ID NO: 390414 - DNA, 20 bp, Artificial
  CRISPR gRNA sequence
gggatgttacaggtggaatt

SEQ ID NO: 390415 - DNA, 20 bp, Artificial
  CRISPR gRNA sequence
caggtggaattgtgtccccc

SEQ ID NO: 390416 - DNA, 20 bp, Artificial
  CRISPR gRNA sequence
tgtcccccaacattcctatg

SEQ ID NO: 390417 - DNA, 20 bp, Artificial
  CRISPR gRNA sequence
ctatggtgaagtcctagcct

SEQ ID NO: 390418 - DNA, 20 bp, Artificial
  CRISPR gRNA sequence
tggtgaagtcctagcctcca

SEQ ID NO: 390419 - DNA, 20 bp, Artificial
  CRISPR gRNA sequence
gcctccagtacttcacaacc

SEQ ID NO: 390420 - DNA, 20 bp, Artificial
  CRISPR gRNA sequence
cagtacttcacaacctgatc

SEQ ID NO: 390421 - DNA, 20 bp, Artificial
  CRISPR gRNA sequence
cacaacctgatctgatttgg

SEQ ID NO: 390422 - DNA, 20 bp, Artificial
  CRISPR gRNA sequence
acaacctgatctgatttgga

SEQ ID NO: 390423 - DNA, 20 bp, Artificial
  CRISPR gRNA sequence
atctgatttggaaatagggc

SEQ ID NO: 390424 - DNA, 20 bp, Artificial
  CRISPR gRNA sequence
atttggaaatagggctgttg

SEQ ID NO: 390425 - DNA, 20 bp, Artificial
  CRISPR gRNA sequence
ggaaatagggctgttgcaga

SEQ ID NO: 390426 - DNA, 20 bp, Artificial
  CRISPR gRNA sequence
gaaatagggctgttgcagat

SEQ ID NO: 390427 - DNA, 20 bp, Artificial
  CRISPR gRNA sequence
ttgcagatacaattagttaa

SEQ ID NO: 390428 - DNA, 20 bp, Artificial
  CRISPR gRNA sequence
cagatacaattagttaacat

SEQ ID NO: 390429 - DNA, 20 bp, Artificial
  CRISPR gRNA sequence
gttaacatgaagtcatcctg

SEQ ID NO: 390430 - DNA, 20 bp, Artificial
  CRISPR gRNA sequence
acatgaagtcatcctggaat

SEQ ID NO: 390431 - DNA, 20 bp, Artificial
  CRISPR gRNA sequence
gaatagggtggcccctaatc

SEQ ID NO: 390432 - DNA, 20 bp, Artificial
  CRISPR gRNA sequence
atccaatatgaccgtgtcct

SEQ ID NO: 390433 - DNA, 20 bp, Artificial
  CRISPR gRNA sequence
ataaaaaggggaaattctga

SEQ ID NO: 390434 - DNA, 20 bp, Artificial
  CRISPR gRNA sequence
taaaaaggggaaattctgac

SEQ ID NO: 390435 - DNA, 20 bp, Artificial
  CRISPR gRNA sequence
tgacacaggcatgaatacaa

SEQ ID NO: 390436 - DNA, 20 bp, Artificial
  CRISPR gRNA sequence
acacaggcatgaatacaagc

SEQ ID NO: 390437 - DNA, 20 bp, Artificial
  CRISPR gRNA sequence
ggttgatgcttccacgagcc

SEQ ID NO: 390438 - DNA, 20 bp, Artificial
  CRISPR gRNA sequence
atgcttccacgagccaagga

SEQ ID NO: 390439 - DNA, 20 bp, Artificial
  CRISPR gRNA sequence
ccacgagccaaggaaggcca

SEQ ID NO: 390440 - DNA, 20 bp, Artificial
  CRISPR gRNA sequence
cacgagccaaggaaggccaa

SEQ ID NO: 390441 - DNA, 20 bp, Artificial
  CRISPR gRNA sequence
ccagaaattgccagaagcta

SEQ ID NO: 390442 - DNA, 20 bp, Artificial
  CRISPR gRNA sequence
ccagaagctaggtgagacct

SEQ ID NO: 390443 - DNA, 20 bp, Artificial
  CRISPR gRNA sequence
ggtgagacctctccttgcaa

SEQ ID NO: 390444 - DNA, 20 bp, Artificial
  CRISPR gRNA sequence
tccttgcaacccccagaggg

SEQ ID NO: 390445 - DNA, 20 bp, Artificial
  CRISPR gRNA sequence
cttgcaacccccagagggaa

SEQ ID NO: 390446 - DNA, 20 bp, Artificial
  CRISPR gRNA sequence
gcaacccccagagggaacca

SEQ ID NO: 390447 - DNA, 20 bp, Artificial
  CRISPR gRNA sequence
caacccccagagggaaccaa

SEQ ID NO: 390448 - DNA, 20 bp, Artificial
  CRISPR gRNA sequence
ctgataccttcactttggac

SEQ ID NO: 390449 - DNA, 20 bp, Artificial
  CRISPR gRNA sequence
ataccttcactttggacttc

SEQ ID NO: 390450 - DNA, 20 bp, Artificial
  CRISPR gRNA sequence
cactttggacttcaaactgc

SEQ ID NO: 390451 - DNA, 20 bp, Artificial
  CRISPR gRNA sequence
actttggacttcaaactgca

SEQ ID NO: 390452 - DNA, 20 bp, Artificial
  CRISPR gRNA sequence
tggacttcaaactgcaagac

SEQ ID NO: 390453 - DNA, 20 bp, Artificial
  CRISPR gRNA sequence
ggacttcaaactgcaagaca

SEQ ID NO: 390454 - DNA, 20 bp, Artificial
  CRISPR gRNA sequence
gacttcaaactgcaagacaa

SEQ ID NO: 390455 - DNA, 20 bp, Artificial
  CRISPR gRNA sequence
caaactgcaagacaacacat

SEQ ID NO: 390456 - DNA, 20 bp, Artificial
  CRISPR gRNA sequence
aaactgcaagacaacacatt

SEQ ID NO: 390457 - DNA, 20 bp, Artificial
  CRISPR gRNA sequence
caagacaacacatttctgtt

SEQ ID NO: 390458 - DNA, 20 bp, Artificial
  CRISPR gRNA sequence
ctgttaagttacccagcttt

SEQ ID NO: 390459 - DNA, 20 bp, Artificial
  CRISPR gRNA sequence
tgttaagttacccagctttt

SEQ ID NO: 390460 - DNA, 20 bp, Artificial
  CRISPR gRNA sequence
ttaagttacccagcttttgg

SEQ ID NO: 390461 - DNA, 20 bp, Artificial
  CRISPR gRNA sequence
agttacccagcttttggtat

SEQ ID NO: 390462 - DNA, 20 bp, Artificial
  CRISPR gRNA sequence
cccagcttttggtatcatgt

SEQ ID NO: 390463 - DNA, 20 bp, Artificial
  CRISPR gRNA sequence
ttggtatcatgtgccagcag

SEQ ID NO: 390464 - DNA, 20 bp, Artificial
  CRISPR gRNA sequence
tggtatcatgtgccagcagc

SEQ ID NO: 390465 - DNA, 20 bp, Artificial
  CRISPR gRNA sequence
ggtatcatgtgccagcagct

SEQ ID NO: 390466 - DNA, 20 bp, Artificial
  CRISPR gRNA sequence
gtatcatgtgccagcagctc

SEQ ID NO: 390467 - DNA, 20 bp, Artificial
  CRISPR gRNA sequence
taggacactaatagggagta

SEQ ID NO: 390468 - DNA, 20 bp, Artificial
  CRISPR gRNA sequence
ggacactaatagggagtaag

SEQ ID NO: 390469 - DNA, 20 bp, Artificial
  CRISPR gRNA sequence
atagggagtaaggaccatca

SEQ ID NO: 390470 - DNA, 20 bp, Artificial
  CRISPR gRNA sequence
gggtacagtctgggcctcgc

SEQ ID NO: 390471 - DNA, 20 bp, Artificial
  CRISPR gRNA sequence
ggtacagtctgggcctcgcc

SEQ ID NO: 390472 - DNA, 20 bp, Artificial
  CRISPR gRNA sequence
ggcctcgccagcacccatca

SEQ ID NO: 390473 - DNA, 20 bp, Artificial
  CRISPR gRNA sequence
gccagcacccatcagaagca

SEQ ID NO: 390474 - DNA, 20 bp, Artificial
  CRISPR gRNA sequence
ctgagaaaatcggccgtctt

SEQ ID NO: 390475 - DNA, 20 bp, Artificial
  CRISPR gRNA sequence
agaaaatcggccgtcttcac

SEQ ID NO: 390476 - DNA, 20 bp, Artificial
  CRISPR gRNA sequence
cacaacactgcttcccacac

SEQ ID NO: 390477 - DNA, 20 bp, Artificial
  CRISPR gRNA sequence
acaacactgcttcccacacg

SEQ ID NO: 390478 - DNA, 20 bp, Artificial
  CRISPR gRNA sequence
cttcccacacgttgccattt

SEQ ID NO: 390479 - DNA, 20 bp, Artificial
  CRISPR gRNA sequence
cccacacgttgccattttct

SEQ ID NO: 390480 - DNA, 20 bp, Artificial
  CRISPR gRNA sequence
ccacacgttgccattttctg

SEQ ID NO: 390481 - DNA, 20 bp, Artificial
  CRISPR gRNA sequence
ccattttctgtctttcatct

SEQ ID NO: 390482 - DNA, 20 bp, Artificial
  CRISPR gRNA sequence
tctgtctttcatctaaagtg

SEQ ID NO: 390483 - DNA, 20 bp, Artificial
  CRISPR gRNA sequence
ctgtctttcatctaaagtgc

SEQ ID NO: 390484 - DNA, 20 bp, Artificial
  CRISPR gRNA sequence
tgtctttcatctaaagtgca

SEQ ID NO: 390485 - DNA, 20 bp, Artificial
  CRISPR gRNA sequence
tctttcatctaaagtgcaga

SEQ ID NO: 390486 - DNA, 20 bp, Artificial
  CRISPR gRNA sequence
tcatctaaagtgcagataaa

SEQ ID NO: 390487 - DNA, 20 bp, Artificial
  CRISPR gRNA sequence
catctaaagtgcagataaaa

SEQ ID NO: 390488 - DNA, 20 bp, Artificial
  CRISPR gRNA sequence
atctaaagtgcagataaaag

SEQ ID NO: 390489 - DNA, 20 bp, Artificial
  CRISPR gRNA sequence
aagtgcagataaaaggtaaa

SEQ ID NO: 390490 - DNA, 20 bp, Artificial
  CRISPR gRNA sequence
aaagaccgcttaactgaaag

SEQ ID NO: 390491 - DNA, 20 bp, Artificial
  CRISPR gRNA sequence
aactgaaaggcacagataaa

SEQ ID NO: 390492 - DNA, 20 bp, Artificial
  CRISPR gRNA sequence
actgaaaggcacagataaag

SEQ ID NO: 390493 - DNA, 20 bp, Artificial
  CRISPR gRNA sequence
aaaggcacagataaagtggg

SEQ ID NO: 390494 - DNA, 20 bp, Artificial
  CRISPR gRNA sequence
caataaagagataaaaacac

SEQ ID NO: 390495 - DNA, 20 bp, Artificial
  CRISPR gRNA sequence
gtggaaataaaaaaatgaag

SEQ ID NO: 390496 - DNA, 20 bp, Artificial
  CRISPR gRNA sequence
tggaaataaaaaaatgaagg

SEQ ID NO: 390497 - DNA, 20 bp, Artificial
  CRISPR gRNA sequence
gattcaggctgcgtgtcctg

SEQ ID NO: 390498 - DNA, 20 bp, Artificial
  CRISPR gRNA sequence
aggctgcgtgtcctgcatgg

SEQ ID NO: 390499 - DNA, 20 bp, Artificial
  CRISPR gRNA sequence
cgtgtcctgcatggcaaatc

SEQ ID NO: 390500 - DNA, 20 bp, Artificial
  CRISPR gRNA sequence
catggcaaatcaggattcag

SEQ ID NO: 390501 - DNA, 20 bp, Artificial
  CRISPR gRNA sequence
agcccagaaaatccatatta

SEQ ID NO: 390502 - DNA, 20 bp, Artificial
  CRISPR gRNA sequence
agagatgatttgcagtatgt

SEQ ID NO: 390503 - DNA, 20 bp, Artificial
  CRISPR gRNA sequence
gcagtatgtccaaagagcga

SEQ ID NO: 390504 - DNA, 20 bp, Artificial
  CRISPR gRNA sequence
cagtatgtccaaagagcgat

SEQ ID NO: 390505 - DNA, 20 bp, Artificial
  CRISPR gRNA sequence
ccctgtctaagcactgaaca

SEQ ID NO: 390506 - DNA, 20 bp, Artificial
  CRISPR gRNA sequence
tctaagcactgaacagcaaa

SEQ ID NO: 390507 - DNA, 20 bp, Artificial
  CRISPR gRNA sequence
agcactgaacagcaaaggac

SEQ ID NO: 390508 - DNA, 20 bp, Artificial
  CRISPR gRNA sequence
aacagcaaaggacttgcaat

SEQ ID NO: 390509 - DNA, 20 bp, Artificial
  CRISPR gRNA sequence
gcaatgcaggccccggcagc

SEQ ID NO: 390510 - DNA, 20 bp, Artificial
  CRISPR gRNA sequence
caatgcaggccccggcagct

SEQ ID NO: 390511 - DNA, 20 bp, Artificial
  CRISPR gRNA sequence
tgtgattcagattacccagg

SEQ ID NO: 390512 - DNA, 20 bp, Artificial
  CRISPR gRNA sequence
gtgattcagattacccagga

SEQ ID NO: 390513 - DNA, 20 bp, Artificial
  CRISPR gRNA sequence
tgattcagattacccaggag

SEQ ID NO: 390514 - DNA, 20 bp, Artificial
  CRISPR gRNA sequence
agattacccaggagtcaaag

SEQ ID NO: 390515 - DNA, 20 bp, Artificial
  CRISPR gRNA sequence
cccaggagtcaaagcaactg

SEQ ID NO: 390516 - DNA, 20 bp, Artificial
  CRISPR gRNA sequence
ctgagaccaccggcctcccc

SEQ ID NO: 390517 - DNA, 20 bp, Artificial
  CRISPR gRNA sequence
agaccaccggcctccccagc

SEQ ID NO: 390518 - DNA, 20 bp, Artificial
  CRISPR gRNA sequence
cccagcttcagagcccaggc

SEQ ID NO: 390519 - DNA, 20 bp, Artificial
  CRISPR gRNA sequence
cagagcccaggctgcctcca

SEQ ID NO: 390520 - DNA, 20 bp, Artificial
  CRISPR gRNA sequence
agagcccaggctgcctccag

SEQ ID NO: 390521 - DNA, 20 bp, Artificial
  CRISPR gRNA sequence
cctccaggggcagctccgtg

SEQ ID NO: 390522 - DNA, 20 bp, Artificial
  CRISPR gRNA sequence
caggggcagctccgtggagc

SEQ ID NO: 390523 - DNA, 20 bp, Artificial
  CRISPR gRNA sequence
cgtggagctccagaatcttg

SEQ ID NO: 390524 - DNA, 20 bp, Artificial
  CRISPR gRNA sequence
cagaatcttgagattggctc

SEQ ID NO: 390525 - DNA, 20 bp, Artificial
  CRISPR gRNA sequence
gagattggctcctgaaaggt

SEQ ID NO: 390526 - DNA, 20 bp, Artificial
  CRISPR gRNA sequence
agattggctcctgaaaggta

SEQ ID NO: 390527 - DNA, 20 bp, Artificial
  CRISPR gRNA sequence
gctcctgaaaggtaaccgtg

SEQ ID NO: 390528 - DNA, 20 bp, Artificial
  CRISPR gRNA sequence
ctgaaaggtaaccgtgggtc

SEQ ID NO: 390529 - DNA, 20 bp, Artificial
  CRISPR gRNA sequence
aaaggtaaccgtgggtcccc

SEQ ID NO: 390530 - DNA, 20 bp, Artificial
  CRISPR gRNA sequence
ggtgtaatgtttgttcaggt

SEQ ID NO: 390531 - DNA, 20 bp, Artificial
  CRISPR gRNA sequence
gtgtaatgtttgttcaggtt

SEQ ID NO: 390532 - DNA, 20 bp, Artificial
  CRISPR gRNA sequence
gttcaggttctaattgttaa

SEQ ID NO: 390533 - DNA, 20 bp, Artificial
  CRISPR gRNA sequence
ttcaggttctaattgttaaa

SEQ ID NO: 390534 - DNA, 20 bp, Artificial
  CRISPR gRNA sequence
aggttctaattgttaaaaaa

SEQ ID NO: 390535 - DNA, 20 bp, Artificial
  CRISPR gRNA sequence
taattgttaaaaaaaataac

SEQ ID NO: 390536 - DNA, 20 bp, Artificial
  CRISPR gRNA sequence
attgttaaaaaaaataactt

SEQ ID NO: 390537 - DNA, 20 bp, Artificial
  CRISPR gRNA sequence
ttaaaaaaaataactttcaa

SEQ ID NO: 390538 - DNA, 20 bp, Artificial
  CRISPR gRNA sequence
aaaaaaataactttcaatct

SEQ ID NO: 390539 - DNA, 20 bp, Artificial
  CRISPR gRNA sequence
tcaatctctccaccatggta

SEQ ID NO: 390540 - DNA, 20 bp, Artificial
  CRISPR gRNA sequence
caatctctccaccatggtac

SEQ ID NO: 390541 - DNA, 20 bp, Artificial
  CRISPR gRNA sequence
aatctctccaccatggtaca

SEQ ID NO: 390542 - DNA, 20 bp, Artificial
  CRISPR gRNA sequence
tccaccatggtacaatgaga

SEQ ID NO: 390543 - DNA, 20 bp, Artificial
  CRISPR gRNA sequence
caccatggtacaatgagaat

SEQ ID NO: 390544 - DNA, 20 bp, Artificial
  CRISPR gRNA sequence
ttattatagtcagtatcata

SEQ ID NO: 390545 - DNA, 20 bp, Artificial
  CRISPR gRNA sequence
tattatagtcagtatcataa

SEQ ID NO: 390546 - DNA, 20 bp, Artificial
  CRISPR gRNA sequence
attatagtcagtatcataag

SEQ ID NO: 390547 - DNA, 20 bp, Artificial
  CRISPR gRNA sequence
ttatagtcagtatcataaga

SEQ ID NO: 390548 - DNA, 20 bp, Artificial
  CRISPR gRNA sequence
tagtcagtatcataagattt

SEQ ID NO: 390549 - DNA, 20 bp, Artificial
  CRISPR gRNA sequence
gctgaatcacatggaaaagt

SEQ ID NO: 390550 - DNA, 20 bp, Artificial
  CRISPR gRNA sequence
ctgaatcacatggaaaagtc

SEQ ID NO: 390551 - DNA, 20 bp, Artificial
  CRISPR gRNA sequence
aatcacatggaaaagtcaaa

SEQ ID NO: 390552 - DNA, 20 bp, Artificial
  CRISPR gRNA sequence
ttgagccattctgcagtttc

SEQ ID NO: 390553 - DNA, 20 bp, Artificial
  CRISPR gRNA sequence
tgagccattctgcagtttct

SEQ ID NO: 390554 - DNA, 20 bp, Artificial
  CRISPR gRNA sequence
gagccattctgcagtttctc

SEQ ID NO: 390555 - DNA, 20 bp, Artificial
  CRISPR gRNA sequence
agccattctgcagtttctct

SEQ ID NO: 390556 - DNA, 20 bp, Artificial
  CRISPR gRNA sequence
tgcagtttctctcaaccaga

SEQ ID NO: 390557 - DNA, 20 bp, Artificial
  CRISPR gRNA sequence
cagtttctctcaaccagaaa

SEQ ID NO: 390558 - DNA, 20 bp, Artificial
  CRISPR gRNA sequence
ctctcaaccagaaaaattac

SEQ ID NO: 390559 - DNA, 20 bp, Artificial
  CRISPR gRNA sequence
tctcaaccagaaaaattact

SEQ ID NO: 390560 - DNA, 20 bp, Artificial
  CRISPR gRNA sequence
tcaaccagaaaaattactga

SEQ ID NO: 390561 - DNA, 20 bp, Artificial
  CRISPR gRNA sequence
aaccagaaaaattactgact

SEQ ID NO: 390562 - DNA, 20 bp, Artificial
  CRISPR gRNA sequence
ctgactaatgggatataaga

SEQ ID NO: 390563 - DNA, 20 bp, Artificial
  CRISPR gRNA sequence
actaatgggatataagaatt

SEQ ID NO: 390564 - DNA, 20 bp, Artificial
  CRISPR gRNA sequence
atgggatataagaattttaa

SEQ ID NO: 390565 - DNA, 20 bp, Artificial
  CRISPR gRNA sequence
taaatataggtagtacatct

SEQ ID NO: 390566 - DNA, 20 bp, Artificial
  CRISPR gRNA sequence
aaatataggtagtacatctc

SEQ ID NO: 390567 - DNA, 20 bp, Artificial
  CRISPR gRNA sequence
aatataggtagtacatctct

SEQ ID NO: 390568 - DNA, 20 bp, Artificial
  CRISPR gRNA sequence
tgaggtctcataaaaccaaa

SEQ ID NO: 390569 - DNA, 20 bp, Artificial
  CRISPR gRNA sequence
aggtctcataaaaccaaaaa

SEQ ID NO: 390570 - DNA, 20 bp, Artificial
  CRISPR gRNA sequence
ataaaaccaaaaaataaaat

SEQ ID NO: 390571 - DNA, 20 bp, Artificial
  CRISPR gRNA sequence
gtctgtttcttctactaaaa

SEQ ID NO: 390572 - DNA, 20 bp, Artificial
  CRISPR gRNA sequence
tttcttctactaaaatgtta

SEQ ID NO: 390573 - DNA, 20 bp, Artificial
  CRISPR gRNA sequence
cttctactaaaatgttacca

SEQ ID NO: 390574 - DNA, 20 bp, Artificial
  CRISPR gRNA sequence
ttctactaaaatgttaccaa

SEQ ID NO: 390575 - DNA, 20 bp, Artificial
  CRISPR gRNA sequence
ctactaaaatgttaccaatt

SEQ ID NO: 390576 - DNA, 20 bp, Artificial
  CRISPR gRNA sequence
tactaaaatgttaccaattg

SEQ ID NO: 390577 - DNA, 20 bp, Artificial
  CRISPR gRNA sequence
ctaaaatgttaccaattggc

SEQ ID NO: 390578 - DNA, 20 bp, Artificial
  CRISPR gRNA sequence
aaatgttaccaattggcccc

SEQ ID NO: 390579 - DNA, 20 bp, Artificial
  CRISPR gRNA sequence
ccaattggccccccaggtta

SEQ ID NO: 390580 - DNA, 20 bp, Artificial
  CRISPR gRNA sequence
gccccccaggttagacaatt

SEQ ID NO: 390581 - DNA, 20 bp, Artificial
  CRISPR gRNA sequence
gacaatttaatgtagacttt

SEQ ID NO: 390582 - DNA, 20 bp, Artificial
  CRISPR gRNA sequence
aatgtagactttctgcatgg

SEQ ID NO: 390583 - DNA, 20 bp, Artificial
  CRISPR gRNA sequence
atgtagactttctgcatggc

SEQ ID NO: 390584 - DNA, 20 bp, Artificial
  CRISPR gRNA sequence
tctgcatggcaggtttttaa

SEQ ID NO: 390585 - DNA, 20 bp, Artificial
  CRISPR gRNA sequence
ctgcatggcaggtttttaac

SEQ ID NO: 390586 - DNA, 20 bp, Artificial
  CRISPR gRNA sequence
tgcatggcaggtttttaaca

SEQ ID NO: 390587 - DNA, 20 bp, Artificial
  CRISPR gRNA sequence
catggcaggtttttaacaga

SEQ ID NO: 390588 - DNA, 20 bp, Artificial
  CRISPR gRNA sequence
ttaacagaaaaagacatcaa

SEQ ID NO: 390589 - DNA, 20 bp, Artificial
  CRISPR gRNA sequence
taacagaaaaagacatcaag

SEQ ID NO: 390590 - DNA, 20 bp, Artificial
  CRISPR gRNA sequence
aacagaaaaagacatcaaga

SEQ ID NO: 390591 - DNA, 20 bp, Artificial
  CRISPR gRNA sequence
acagaaaaagacatcaagag

SEQ ID NO: 390592 - DNA, 20 bp, Artificial
  CRISPR gRNA sequence
acaccatctctaatgattct

SEQ ID NO: 390593 - DNA, 20 bp, Artificial
  CRISPR gRNA sequence
taatgattctgtactagaga

SEQ ID NO: 390594 - DNA, 20 bp, Artificial
  CRISPR gRNA sequence
atgattctgtactagagaat

SEQ ID NO: 390595 - DNA, 20 bp, Artificial
  CRISPR gRNA sequence
tgtactagagaatagattgt

SEQ ID NO: 390596 - DNA, 20 bp, Artificial
  CRISPR gRNA sequence
tactagagaatagattgtta

SEQ ID NO: 390597 - DNA, 20 bp, Artificial
  CRISPR gRNA sequence
gagaatagattgttagtgat

SEQ ID NO: 390598 - DNA, 20 bp, Artificial
  CRISPR gRNA sequence
ttagtgatggtccctggaga

SEQ ID NO: 390599 - DNA, 20 bp, Artificial
  CRISPR gRNA sequence
gtgatggtccctggagacta

SEQ ID NO: 390600 - DNA, 20 bp, Artificial
  CRISPR gRNA sequence
gagactacattaagcatttt

SEQ ID NO: 390601 - DNA, 20 bp, Artificial
  CRISPR gRNA sequence
cattaagcattttgtcccat

SEQ ID NO: 390602 - DNA, 20 bp, Artificial
  CRISPR gRNA sequence
agcattttgtcccatatact

SEQ ID NO: 390603 - DNA, 20 bp, Artificial
  CRISPR gRNA sequence
tgtcccatatacttaaaaat

SEQ ID NO: 390604 - DNA, 20 bp, Artificial
  CRISPR gRNA sequence
gtcccatatacttaaaaata

SEQ ID NO: 390605 - DNA, 20 bp, Artificial
  CRISPR gRNA sequence
tcccatatacttaaaaatat

SEQ ID NO: 390606 - DNA, 20 bp, Artificial
  CRISPR gRNA sequence
aaaaatattttcagtatatt

SEQ ID NO: 390607 - DNA, 20 bp, Artificial
  CRISPR gRNA sequence
aaaatattttcagtatattt

SEQ ID NO: 390608 - DNA, 20 bp, Artificial
  CRISPR gRNA sequence
tcagtatatttttaaagtaa

SEQ ID NO: 390609 - DNA, 20 bp, Artificial
  CRISPR gRNA sequence
cagtatatttttaaagtaaa

SEQ ID NO: 390610 - DNA, 20 bp, Artificial
  CRISPR gRNA sequence
agtatatttttaaagtaaaa

SEQ ID NO: 390611 - DNA, 20 bp, Artificial
  CRISPR gRNA sequence
ttaaagtaaaataataagcc

SEQ ID NO: 390612 - DNA, 20 bp, Artificial
  CRISPR gRNA sequence
taaagtaaaataataagcct

SEQ ID NO: 390613 - DNA, 20 bp, Artificial
  CRISPR gRNA sequence
aaagtaaaataataagcctt

SEQ ID NO: 390614 - DNA, 20 bp, Artificial
  CRISPR gRNA sequence
aagtaaaataataagccttg

SEQ ID NO: 390615 - DNA, 20 bp, Artificial
  CRISPR gRNA sequence
gaacgagtccttactaagtg

SEQ ID NO: 390616 - DNA, 20 bp, Artificial
  CRISPR gRNA sequence
aacgagtccttactaagtgc

SEQ ID NO: 390617 - DNA, 20 bp, Artificial
  CRISPR gRNA sequence
actaagtgccagcattaaat

SEQ ID NO: 390618 - DNA, 20 bp, Artificial
  CRISPR gRNA sequence
ctaagtgccagcattaaatg

SEQ ID NO: 390619 - DNA, 20 bp, Artificial
  CRISPR gRNA sequence
agtgccagcattaaatgcat

SEQ ID NO: 390620 - DNA, 20 bp, Artificial
  CRISPR gRNA sequence
aatgcattacctaagctagt

SEQ ID NO: 390621 - DNA, 20 bp, Artificial
  CRISPR gRNA sequence
cctaagctagtgcatttagt

SEQ ID NO: 390622 - DNA, 20 bp, Artificial
  CRISPR gRNA sequence
agctagtgcatttagtcccc

SEQ ID NO: 390623 - DNA, 20 bp, Artificial
  CRISPR gRNA sequence
gtgcatttagtccccacaaa

SEQ ID NO: 390624 - DNA, 20 bp, Artificial
  CRISPR gRNA sequence
agtccccacaaataagtcac

SEQ ID NO: 390625 - DNA, 20 bp, Artificial
  CRISPR gRNA sequence
gtccccacaaataagtcacc

SEQ ID NO: 390626 - DNA, 20 bp, Artificial
  CRISPR gRNA sequence
tgaatggcaggacattctta

SEQ ID NO: 390627 - DNA, 20 bp, Artificial
  CRISPR gRNA sequence
ttacctaggcagggcgtcta

SEQ ID NO: 390628 - DNA, 20 bp, Artificial
  CRISPR gRNA sequence
acctaggcagggcgtctagg

SEQ ID NO: 390629 - DNA, 20 bp, Artificial
  CRISPR gRNA sequence
cctaggcagggcgtctaggg

SEQ ID NO: 390630 - DNA, 20 bp, Artificial
  CRISPR gRNA sequence
ggcagggcgtctagggagcc

SEQ ID NO: 390631 - DNA, 20 bp, Artificial
  CRISPR gRNA sequence
gggagccagtctcaaaccag

SEQ ID NO: 390632 - DNA, 20 bp, Artificial
  CRISPR gRNA sequence
aaaccagccctgagaaggga

SEQ ID NO: 390633 - DNA, 20 bp, Artificial
  CRISPR gRNA sequence
agaagggactccggtgacag

SEQ ID NO: 390634 - DNA, 20 bp, Artificial
  CRISPR gRNA sequence
cggtgacagccagagttttc

SEQ ID NO: 390635 - DNA, 20 bp, Artificial
  CRISPR gRNA sequence
tcttttccaccctgcagcag

SEQ ID NO: 390636 - DNA, 20 bp, Artificial
  CRISPR gRNA sequence
cttttccaccctgcagcagg

SEQ ID NO: 390637 - DNA, 20 bp, Artificial
  CRISPR gRNA sequence
ttttccaccctgcagcaggg

SEQ ID NO: 390638 - DNA, 20 bp, Artificial
  CRISPR gRNA sequence
ttccaccctgcagcagggca

SEQ ID NO: 390639 - DNA, 20 bp, Artificial
  CRISPR gRNA sequence
tccaccctgcagcagggcag

SEQ ID NO: 390640 - DNA, 20 bp, Artificial
  CRISPR gRNA sequence
ccaccctgcagcagggcagg

SEQ ID NO: 390641 - DNA, 20 bp, Artificial
  CRISPR gRNA sequence
caccctgcagcagggcagga

SEQ ID NO: 390642 - DNA, 20 bp, Artificial
  CRISPR gRNA sequence
cagcagggcaggatctcaga

SEQ ID NO: 390643 - DNA, 20 bp, Artificial
  CRISPR gRNA sequence
agaggcaacatcagctccaa

SEQ ID NO: 390644 - DNA, 20 bp, Artificial
  CRISPR gRNA sequence
caaggatgcctctgctccta

SEQ ID NO: 390645 - DNA, 20 bp, Artificial
  CRISPR gRNA sequence
tgctcctagatagcttattt

SEQ ID NO: 390646 - DNA, 20 bp, Artificial
  CRISPR gRNA sequence
ctcctagatagcttattttc

SEQ ID NO: 390647 - DNA, 20 bp, Artificial
  CRISPR gRNA sequence
ctagatagcttattttctga

SEQ ID NO: 390648 - DNA, 20 bp, Artificial
  CRISPR gRNA sequence
gatagcttattttctgatgc

SEQ ID NO: 390649 - DNA, 20 bp, Artificial
  CRISPR gRNA sequence
attttctgatgccttaactc

SEQ ID NO: 390650 - DNA, 20 bp, Artificial
  CRISPR gRNA sequence
ttttctgatgccttaactct

SEQ ID NO: 390651 - DNA, 20 bp, Artificial
  CRISPR gRNA sequence
tctgatgccttaactcttat

SEQ ID NO: 390652 - DNA, 20 bp, Artificial
  CRISPR gRNA sequence
ctgatgccttaactcttata

SEQ ID NO: 390653 - DNA, 20 bp, Artificial
  CRISPR gRNA sequence
tgatgccttaactcttataa

SEQ ID NO: 390654 - DNA, 20 bp, Artificial
  CRISPR gRNA sequence
atgccttaactcttataatt

SEQ ID NO: 390655 - DNA, 20 bp, Artificial
  CRISPR gRNA sequence
aactcttataattagaaatc

SEQ ID NO: 390656 - DNA, 20 bp, Artificial
  CRISPR gRNA sequence
actcttataattagaaatca

SEQ ID NO: 390657 - DNA, 20 bp, Artificial
  CRISPR gRNA sequence
ttataattagaaatcaattt

SEQ ID NO: 390658 - DNA, 20 bp, Artificial
  CRISPR gRNA sequence
ataattagaaatcaatttct

SEQ ID NO: 390659 - DNA, 20 bp, Artificial
  CRISPR gRNA sequence
taattagaaatcaatttctg

SEQ ID NO: 390660 - DNA, 20 bp, Artificial
  CRISPR gRNA sequence
gaaatcaatttctgcacttg

SEQ ID NO: 390661 - DNA, 20 bp, Artificial
  CRISPR gRNA sequence
ctgcacttgtccttgttaaa

SEQ ID NO: 390662 - DNA, 20 bp, Artificial
  CRISPR gRNA sequence
tgcacttgtccttgttaaaa

SEQ ID NO: 390663 - DNA, 20 bp, Artificial
  CRISPR gRNA sequence
cacttgtccttgttaaaatg

SEQ ID NO: 390664 - DNA, 20 bp, Artificial
  CRISPR gRNA sequence
gtccttgttaaaatgcatat

SEQ ID NO: 390665 - DNA, 20 bp, Artificial
  CRISPR gRNA sequence
tccttgttaaaatgcatata

SEQ ID NO: 390666 - DNA, 20 bp, Artificial
  CRISPR gRNA sequence
gttaaaatgcatataaaatt

SEQ ID NO: 390667 - DNA, 20 bp, Artificial
  CRISPR gRNA sequence
ttaaaatgcatataaaattt

SEQ ID NO: 390668 - DNA, 20 bp, Artificial
  CRISPR gRNA sequence
aaatgcatataaaattttca

SEQ ID NO: 390669 - DNA, 20 bp, Artificial
  CRISPR gRNA sequence
tcaattcccggcaggcacca

SEQ ID NO: 390670 - DNA, 20 bp, Artificial
  CRISPR gRNA sequence
caattcccggcaggcaccaa

SEQ ID NO: 390671 - DNA, 20 bp, Artificial
  CRISPR gRNA sequence
aattcccggcaggcaccaac

SEQ ID NO: 390672 - DNA, 20 bp, Artificial
  CRISPR gRNA sequence
ccggcaggcaccaacacatt

SEQ ID NO: 390673 - DNA, 20 bp, Artificial
  CRISPR gRNA sequence
gtgtgaaattgtccattaga

SEQ ID NO: 390674 - DNA, 20 bp, Artificial
  CRISPR gRNA sequence
tccattagattgttttccaa

SEQ ID NO: 390675 - DNA, 20 bp, Artificial
  CRISPR gRNA sequence
gattgttttccaagtagaaa

SEQ ID NO: 390676 - DNA, 20 bp, Artificial
  CRISPR gRNA sequence
ttttccaagtagaaagcaag

SEQ ID NO: 390677 - DNA, 20 bp, Artificial
  CRISPR gRNA sequence
tccaagtagaaagcaaggaa

SEQ ID NO: 390678 - DNA, 20 bp, Artificial
  CRISPR gRNA sequence
ccaagtagaaagcaaggaag

SEQ ID NO: 390679 - DNA, 20 bp, Artificial
  CRISPR gRNA sequence
caagtagaaagcaaggaaga

SEQ ID NO: 390680 - DNA, 20 bp, Artificial
  CRISPR gRNA sequence
cccacaggagagtggccagc

SEQ ID NO: 390681 - DNA, 20 bp, Artificial
  CRISPR gRNA sequence
ccacaggagagtggccagca

SEQ ID NO: 390682 - DNA, 20 bp, Artificial
  CRISPR gRNA sequence
gctgtggcaaaggagagaga

SEQ ID NO: 390683 - DNA, 20 bp, Artificial
  CRISPR gRNA sequence
ctgtggcaaaggagagagag

SEQ ID NO: 390684 - DNA, 20 bp, Artificial
  CRISPR gRNA sequence
tggcaaaggagagagaggag

SEQ ID NO: 390685 - DNA, 20 bp, Artificial
  CRISPR gRNA sequence
gccttgtccctgccaaggtg

SEQ ID NO: 390686 - DNA, 20 bp, Artificial
  CRISPR gRNA sequence
gtccctgccaaggtgagtgc

SEQ ID NO: 390687 - DNA, 20 bp, Artificial
  CRISPR gRNA sequence
tccctgccaaggtgagtgca

SEQ ID NO: 390688 - DNA, 20 bp, Artificial
  CRISPR gRNA sequence
ccaaggtgagtgcaccgcgg

SEQ ID NO: 390689 - DNA, 20 bp, Artificial
  CRISPR gRNA sequence
gtgggagactcatgcagaaa

SEQ ID NO: 390690 - DNA, 20 bp, Artificial
  CRISPR gRNA sequence
atgcagaaagatggactgca

SEQ ID NO: 390691 - DNA, 20 bp, Artificial
  CRISPR gRNA sequence
caaaccagaggcggtgaaat

SEQ ID NO: 390692 - DNA, 20 bp, Artificial
  CRISPR gRNA sequence
tacctcctttatttttcctt

SEQ ID NO: 390693 - DNA, 20 bp, Artificial
  CRISPR gRNA sequence
acctcctttatttttccttc

SEQ ID NO: 390694 - DNA, 20 bp, Artificial
  CRISPR gRNA sequence
cctcctttatttttccttcc

SEQ ID NO: 390695 - DNA, 20 bp, Artificial
  CRISPR gRNA sequence
ctttatttttccttccttta

SEQ ID NO: 390696 - DNA, 20 bp, Artificial
  CRISPR gRNA sequence
tatttttccttcctttattc

SEQ ID NO: 390697 - DNA, 20 bp, Artificial
  CRISPR gRNA sequence
atttttccttcctttattca

SEQ ID NO: 390698 - DNA, 20 bp, Artificial
  CRISPR gRNA sequence
tttttccttcctttattcat

SEQ ID NO: 390699 - DNA, 20 bp, Artificial
  CRISPR gRNA sequence
ttccttcctttattcattca

SEQ ID NO: 390700 - DNA, 20 bp, Artificial
  CRISPR gRNA sequence
tccttcctttattcattcaa

SEQ ID NO: 390701 - DNA, 20 bp, Artificial
  CRISPR gRNA sequence
ccttcctttattcattcaac

SEQ ID NO: 390702 - DNA, 20 bp, Artificial
  CRISPR gRNA sequence
cttcctttattcattcaaca

SEQ ID NO: 390703 - DNA, 20 bp, Artificial
  CRISPR gRNA sequence
cctttattcattcaacattc

SEQ ID NO: 390704 - DNA, 20 bp, Artificial
  CRISPR gRNA sequence
ctttattcattcaacattca

SEQ ID NO: 390705 - DNA, 20 bp, Artificial
  CRISPR gRNA sequence
tattcattcaacattcattc

SEQ ID NO: 390706 - DNA, 20 bp, Artificial
  CRISPR gRNA sequence
attcattcaacattcattcc

SEQ ID NO: 390707 - DNA, 20 bp, Artificial
  CRISPR gRNA sequence
ttcattcaacattcattcct

SEQ ID NO: 390708 - DNA, 20 bp, Artificial
  CRISPR gRNA sequence
attcaacattcattccttca

SEQ ID NO: 390709 - DNA, 20 bp, Artificial
  CRISPR gRNA sequence
aacattcattccttcatcca

SEQ ID NO: 390710 - DNA, 20 bp, Artificial
  CRISPR gRNA sequence
attccttcatccacaaagat

SEQ ID NO: 390711 - DNA, 20 bp, Artificial
  CRISPR gRNA sequence
cttcatccacaaagattact

SEQ ID NO: 390712 - DNA, 20 bp, Artificial
  CRISPR gRNA sequence
catccacaaagattactggg

SEQ ID NO: 390713 - DNA, 20 bp, Artificial
  CRISPR gRNA sequence
atccacaaagattactgggt

SEQ ID NO: 390714 - DNA, 20 bp, Artificial
  CRISPR gRNA sequence
ctgggtgtaaataaaacaca

SEQ ID NO: 390715 - DNA, 20 bp, Artificial
  CRISPR gRNA sequence
ggtgtaaataaaacacagac

SEQ ID NO: 390716 - DNA, 20 bp, Artificial
  CRISPR gRNA sequence
ggttaggggagagacacaca

SEQ ID NO: 390717 - DNA, 20 bp, Artificial
  CRISPR gRNA sequence
ggggagagacacacaagcag

SEQ ID NO: 390718 - DNA, 20 bp, Artificial
  CRISPR gRNA sequence
ctgtaaaaagacgataagtc

SEQ ID NO: 390719 - DNA, 20 bp, Artificial
  CRISPR gRNA sequence
taaaaagacgataagtcctc

SEQ ID NO: 390720 - DNA, 20 bp, Artificial
  CRISPR gRNA sequence
caaagaacaaagtgatgaaa

SEQ ID NO: 390721 - DNA, 20 bp, Artificial
  CRISPR gRNA sequence
tagaaattccccactgaggc

SEQ ID NO: 390722 - DNA, 20 bp, Artificial
  CRISPR gRNA sequence
cccactgaggccctgatggc

SEQ ID NO: 390723 - DNA, 20 bp, Artificial
  CRISPR gRNA sequence
aggccctgatggcatctgca

SEQ ID NO: 390724 - DNA, 20 bp, Artificial
  CRISPR gRNA sequence
atggcatctgcagagaccca

SEQ ID NO: 390725 - DNA, 20 bp, Artificial
  CRISPR gRNA sequence
cagagacccaaagagacaga

SEQ ID NO: 390726 - DNA, 20 bp, Artificial
  CRISPR gRNA sequence
tgagtttcagaagcagctat

SEQ ID NO: 390727 - DNA, 20 bp, Artificial
  CRISPR gRNA sequence
cagaagcagctattgcccga

SEQ ID NO: 390728 - DNA, 20 bp, Artificial
  CRISPR gRNA sequence
agaagcagctattgcccgac

SEQ ID NO: 390729 - DNA, 20 bp, Artificial
  CRISPR gRNA sequence
ttgcccgacggtgctcacca

SEQ ID NO: 390730 - DNA, 20 bp, Artificial
  CRISPR gRNA sequence
cccgacggtgctcaccaagg

SEQ ID NO: 390731 - DNA, 20 bp, Artificial
  CRISPR gRNA sequence
accaaggtctgtcaaagatt

SEQ ID NO: 390732 - DNA, 20 bp, Artificial
  CRISPR gRNA sequence
tcaaagattctctcaccaaa

SEQ ID NO: 390733 - DNA, 20 bp, Artificial
  CRISPR gRNA sequence
tctcaccaaacacaagggta

SEQ ID NO: 390734 - DNA, 20 bp, Artificial
  CRISPR gRNA sequence
tcaccaaacacaagggtatt

SEQ ID NO: 390735 - DNA, 20 bp, Artificial
  CRISPR gRNA sequence
accaaacacaagggtatttg

SEQ ID NO: 390736 - DNA, 20 bp, Artificial
  CRISPR gRNA sequence
gccagaagaaaatctattta

SEQ ID NO: 390737 - DNA, 20 bp, Artificial
  CRISPR gRNA sequence
ccagaagaaaatctatttag

SEQ ID NO: 390738 - DNA, 20 bp, Artificial
  CRISPR gRNA sequence
tttaggactccaaacttaag

SEQ ID NO: 390739 - DNA, 20 bp, Artificial
  CRISPR gRNA sequence
aggactccaaacttaagctg

SEQ ID NO: 390740 - DNA, 20 bp, Artificial
  CRISPR gRNA sequence
ggactccaaacttaagctgt

SEQ ID NO: 390741 - DNA, 20 bp, Artificial
  CRISPR gRNA sequence
caaacttaagctgttcgatt

SEQ ID NO: 390742 - DNA, 20 bp, Artificial
  CRISPR gRNA sequence
aagctgttcgattgcataag

SEQ ID NO: 390743 - DNA, 20 bp, Artificial
  CRISPR gRNA sequence
agctgttcgattgcataagt

SEQ ID NO: 390744 - DNA, 20 bp, Artificial
  CRISPR gRNA sequence
ttcgattgcataagtttgat

SEQ ID NO: 390745 - DNA, 20 bp, Artificial
  CRISPR gRNA sequence
gattgcataagtttgatgcc

SEQ ID NO: 390746 - DNA, 20 bp, Artificial
  CRISPR gRNA sequence
cataagtttgatgcctttag

SEQ ID NO: 390747 - DNA, 20 bp, Artificial
  CRISPR gRNA sequence
gatgcctttagagcatctac

SEQ ID NO: 390748 - DNA, 20 bp, Artificial
  CRISPR gRNA sequence
atgcctttagagcatctact

SEQ ID NO: 390749 - DNA, 20 bp, Artificial
  CRISPR gRNA sequence
tagagcatctactccaggtt

SEQ ID NO: 390750 - DNA, 20 bp, Artificial
  CRISPR gRNA sequence
agagcatctactccaggttc

SEQ ID NO: 390751 - DNA, 20 bp, Artificial
  CRISPR gRNA sequence
gagcatctactccaggttca

SEQ ID NO: 390752 - DNA, 20 bp, Artificial
  CRISPR gRNA sequence
ctccaggttcaatttccttc

SEQ ID NO: 390753 - DNA, 20 bp, Artificial
  CRISPR gRNA sequence
caggttcaatttccttcctc

SEQ ID NO: 390754 - DNA, 20 bp, Artificial
  CRISPR gRNA sequence
aatttccttcctcttctcat

SEQ ID NO: 390755 - DNA, 20 bp, Artificial
  CRISPR gRNA sequence
ccttcctcttctcatatttt

SEQ ID NO: 390756 - DNA, 20 bp, Artificial
  CRISPR gRNA sequence
cttcctcttctcatattttc

SEQ ID NO: 390757 - DNA, 20 bp, Artificial
  CRISPR gRNA sequence
cctcttctcatattttctga

SEQ ID NO: 390758 - DNA, 20 bp, Artificial
  CRISPR gRNA sequence
ctcttctcatattttctgac

SEQ ID NO: 390759 - DNA, 20 bp, Artificial
  CRISPR gRNA sequence
ttctcatattttctgaccat

SEQ ID NO: 390760 - DNA, 20 bp, Artificial
  CRISPR gRNA sequence
ctcatattttctgaccatgt

SEQ ID NO: 390761 - DNA, 20 bp, Artificial
  CRISPR gRNA sequence
tcatattttctgaccatgtc

SEQ ID NO: 390762 - DNA, 20 bp, Artificial
  CRISPR gRNA sequence
atattttctgaccatgtcac

SEQ ID NO: 390763 - DNA, 20 bp, Artificial
  CRISPR gRNA sequence
tctgaccatgtcactatttt

SEQ ID NO: 390764 - DNA, 20 bp, Artificial
  CRISPR gRNA sequence
ctgaccatgtcactatttta

SEQ ID NO: 390765 - DNA, 20 bp, Artificial
  CRISPR gRNA sequence
tgaccatgtcactattttag

SEQ ID NO: 390766 - DNA, 20 bp, Artificial
  CRISPR gRNA sequence
accatgtcactattttagta

SEQ ID NO: 390767 - DNA, 20 bp, Artificial
  CRISPR gRNA sequence
ttttagtatctacttcatta

SEQ ID NO: 390768 - DNA, 20 bp, Artificial
  CRISPR gRNA sequence
tagtatctacttcattacat

SEQ ID NO: 390769 - DNA, 20 bp, Artificial
  CRISPR gRNA sequence
agtatctacttcattacatt

SEQ ID NO: 390770 - DNA, 20 bp, Artificial
  CRISPR gRNA sequence
gtatctacttcattacattt

SEQ ID NO: 390771 - DNA, 20 bp, Artificial
  CRISPR gRNA sequence
cttcattacatttctttggt

SEQ ID NO: 390772 - DNA, 20 bp, Artificial
  CRISPR gRNA sequence
cattacatttctttggtatt

SEQ ID NO: 390773 - DNA, 20 bp, Artificial
  CRISPR gRNA sequence
attacatttctttggtattt

SEQ ID NO: 390774 - DNA, 20 bp, Artificial
  CRISPR gRNA sequence
catttctttggtatttccag

SEQ ID NO: 390775 - DNA, 20 bp, Artificial
  CRISPR gRNA sequence
ctttggtatttccagatggc

SEQ ID NO: 390776 - DNA, 20 bp, Artificial
  CRISPR gRNA sequence
tttggtatttccagatggct

SEQ ID NO: 390777 - DNA, 20 bp, Artificial
  CRISPR gRNA sequence
tggtatttccagatggcttt

SEQ ID NO: 390778 - DNA, 20 bp, Artificial
  CRISPR gRNA sequence
ggtatttccagatggctttg

SEQ ID NO: 390779 - DNA, 20 bp, Artificial
  CRISPR gRNA sequence
gtatttccagatggctttgt

SEQ ID NO: 390780 - DNA, 20 bp, Artificial
  CRISPR gRNA sequence
ccagatggctttgtggagaa

SEQ ID NO: 390781 - DNA, 20 bp, Artificial
  CRISPR gRNA sequence
cagatggctttgtggagaac

SEQ ID NO: 390782 - DNA, 20 bp, Artificial
  CRISPR gRNA sequence
tgtggagaacaaataagtac

SEQ ID NO: 390783 - DNA, 20 bp, Artificial
  CRISPR gRNA sequence
gtggagaacaaataagtacc

SEQ ID NO: 390784 - DNA, 20 bp, Artificial
  CRISPR gRNA sequence
tggagaacaaataagtacca

SEQ ID NO: 390785 - DNA, 20 bp, Artificial
  CRISPR gRNA sequence
gtgatgcatgacatatgaaa

SEQ ID NO: 390786 - DNA, 20 bp, Artificial
  CRISPR gRNA sequence
tgatgcatgacatatgaaaa

SEQ ID NO: 390787 - DNA, 20 bp, Artificial
  CRISPR gRNA sequence
agaaccaactgatataatgt

SEQ ID NO: 390788 - DNA, 20 bp, Artificial
  CRISPR gRNA sequence
atataatgttagaaatggga

SEQ ID NO: 390789 - DNA, 20 bp, Artificial
  CRISPR gRNA sequence
gaaatgggaaaccaagaaac

SEQ ID NO: 390790 - DNA, 20 bp, Artificial
  CRISPR gRNA sequence
cacaccctcacaatgtactc

SEQ ID NO: 390791 - DNA, 20 bp, Artificial
  CRISPR gRNA sequence
acaatgtactctacacatac

SEQ ID NO: 390792 - DNA, 20 bp, Artificial
  CRISPR gRNA sequence
tacacatactatatacgcct

SEQ ID NO: 390793 - DNA, 20 bp, Artificial
  CRISPR gRNA sequence
cacatactatatacgcctag

SEQ ID NO: 390794 - DNA, 20 bp, Artificial
  CRISPR gRNA sequence
tatacgcctagatgtgaact

SEQ ID NO: 390795 - DNA, 20 bp, Artificial
  CRISPR gRNA sequence
gatgtgaacttacatatttt

SEQ ID NO: 390796 - DNA, 20 bp, Artificial
  CRISPR gRNA sequence
acatattttgacttccattg

SEQ ID NO: 390797 - DNA, 20 bp, Artificial
  CRISPR gRNA sequence
catattttgacttccattga

SEQ ID NO: 390798 - DNA, 20 bp, Artificial
  CRISPR gRNA sequence
tgacttccattgaaaaaaaa

SEQ ID NO: 390799 - DNA, 20 bp, Artificial
  CRISPR gRNA sequence
gacttccattgaaaaaaaag

SEQ ID NO: 390800 - DNA, 20 bp, Artificial
  CRISPR gRNA sequence
acttccattgaaaaaaaaga

SEQ ID NO: 390801 - DNA, 20 bp, Artificial
  CRISPR gRNA sequence
ccattgaaaaaaaagatgta

SEQ ID NO: 390802 - DNA, 20 bp, Artificial
  CRISPR gRNA sequence
cattgaaaaaaaagatgtaa

SEQ ID NO: 390803 - DNA, 20 bp, Artificial
  CRISPR gRNA sequence
aaaaaaaagatgtaataaaa

SEQ ID NO: 390804 - DNA, 20 bp, Artificial
  CRISPR gRNA sequence
agttaattctaaaactaagt

SEQ ID NO: 390805 - DNA, 20 bp, Artificial
  CRISPR gRNA sequence
attctaaaactaagttttaa

SEQ ID NO: 390806 - DNA, 20 bp, Artificial
  CRISPR gRNA sequence
taaaactaagttttaaaaca

SEQ ID NO: 390807 - DNA, 20 bp, Artificial
  CRISPR gRNA sequence
aaactaagttttaaaacaca

SEQ ID NO: 390808 - DNA, 20 bp, Artificial
  CRISPR gRNA sequence
agttttaaaacacactgctc

SEQ ID NO: 390809 - DNA, 20 bp, Artificial
  CRISPR gRNA sequence
taaaacacactgctcaggaa

SEQ ID NO: 390810 - DNA, 20 bp, Artificial
  CRISPR gRNA sequence
aaaacacactgctcaggaaa

SEQ ID NO: 390811 - DNA, 20 bp, Artificial
  CRISPR gRNA sequence
aaacacactgctcaggaaat

SEQ ID NO: 390812 - DNA, 20 bp, Artificial
  CRISPR gRNA sequence
ctcaggaaatcagaggttca

SEQ ID NO: 390813 - DNA, 20 bp, Artificial
  CRISPR gRNA sequence
aggaaatcagaggttcacca

SEQ ID NO: 390814 - DNA, 20 bp, Artificial
  CRISPR gRNA sequence
accattgctaacagtgtgat

SEQ ID NO: 390815 - DNA, 20 bp, Artificial
  CRISPR gRNA sequence
ctaacagtgtgattcctatc

SEQ ID NO: 390816 - DNA, 20 bp, Artificial
  CRISPR gRNA sequence
acagtgtgattcctatccaa

SEQ ID NO: 390817 - DNA, 20 bp, Artificial
  CRISPR gRNA sequence
ctatccaattaaaattgctc

SEQ ID NO: 390818 - DNA, 20 bp, Artificial
  CRISPR gRNA sequence
tccaattaaaattgctctga

SEQ ID NO: 390819 - DNA, 20 bp, Artificial
  CRISPR gRNA sequence
aaattgctctgaaaattgga

SEQ ID NO: 390820 - DNA, 20 bp, Artificial
  CRISPR gRNA sequence
ctctgaaaattggaagataa

SEQ ID NO: 390821 - DNA, 20 bp, Artificial
  CRISPR gRNA sequence
tgaaaattggaagataattt

SEQ ID NO: 390822 - DNA, 20 bp, Artificial
  CRISPR gRNA sequence
aaaattggaagataatttct

SEQ ID NO: 390823 - DNA, 20 bp, Artificial
  CRISPR gRNA sequence
gaagataatttctgcaaatt

SEQ ID NO: 390824 - DNA, 20 bp, Artificial
  CRISPR gRNA sequence
ctgcaaatttctgcaggcaa

SEQ ID NO: 390825 - DNA, 20 bp, Artificial
  CRISPR gRNA sequence
tgcaaatttctgcaggcaaa

SEQ ID NO: 390826 - DNA, 20 bp, Artificial
  CRISPR gRNA sequence
caaatttctgcaggcaaaag

SEQ ID NO: 390827 - DNA, 20 bp, Artificial
  CRISPR gRNA sequence
ctgcaggcaaaagacatgac

SEQ ID NO: 390828 - DNA, 20 bp, Artificial
  CRISPR gRNA sequence
tgcaggcaaaagacatgacc

SEQ ID NO: 390829 - DNA, 20 bp, Artificial
  CRISPR gRNA sequence
caggcaaaagacatgaccta

SEQ ID NO: 390830 - DNA, 20 bp, Artificial
  CRISPR gRNA sequence
tgaaatagaagccattttct

SEQ ID NO: 390831 - DNA, 20 bp, Artificial
  CRISPR gRNA sequence
tctgtagggaaaggagaaca

SEQ ID NO: 390832 - DNA, 20 bp, Artificial
  CRISPR gRNA sequence
ctgtagggaaaggagaacac

SEQ ID NO: 390833 - DNA, 20 bp, Artificial
  CRISPR gRNA sequence
tgtagggaaaggagaacaca

SEQ ID NO: 390834 - DNA, 20 bp, Artificial
  CRISPR gRNA sequence
tagggaaaggagaacacaag

SEQ ID NO: 390835 - DNA, 20 bp, Artificial
  CRISPR gRNA sequence
tggtcttgctcagcgctgca

SEQ ID NO: 390836 - DNA, 20 bp, Artificial
  CRISPR gRNA sequence
gtcttgctcagcgctgcaaa

SEQ ID NO: 390837 - DNA, 20 bp, Artificial
  CRISPR gRNA sequence
gctcagcgctgcaaaaatct

SEQ ID NO: 390838 - DNA, 20 bp, Artificial
  CRISPR gRNA sequence
ctcagcgctgcaaaaatctc

SEQ ID NO: 390839 - DNA, 20 bp, Artificial
  CRISPR gRNA sequence
agcgctgcaaaaatctcgtc

SEQ ID NO: 390840 - DNA, 20 bp, Artificial
  CRISPR gRNA sequence
caaaaatctcgtcaggaata

SEQ ID NO: 390841 - DNA, 20 bp, Artificial
  CRISPR gRNA sequence
gtcaggaatagcaacaggac

SEQ ID NO: 390842 - DNA, 20 bp, Artificial
  CRISPR gRNA sequence
aaagaaaagcaaactaaaaa

SEQ ID NO: 390843 - DNA, 20 bp, Artificial
  CRISPR gRNA sequence
aaaattcacccttatggctc

SEQ ID NO: 390844 - DNA, 20 bp, Artificial
  CRISPR gRNA sequence
acccttatggctctctcctg

SEQ ID NO: 390845 - DNA, 20 bp, Artificial
  CRISPR gRNA sequence
atggctctctcctgaaaatg

SEQ ID NO: 390846 - DNA, 20 bp, Artificial
  CRISPR gRNA sequence
tggctctctcctgaaaatgt

SEQ ID NO: 390847 - DNA, 20 bp, Artificial
  CRISPR gRNA sequence
tctcctgaaaatgtgaatat

SEQ ID NO: 390848 - DNA, 20 bp, Artificial
  CRISPR gRNA sequence
tcctgaaaatgtgaatatga

SEQ ID NO: 390849 - DNA, 20 bp, Artificial
  CRISPR gRNA sequence
ctgaaaatgtgaatatgagc

SEQ ID NO: 390850 - DNA, 20 bp, Artificial
  CRISPR gRNA sequence
aaaatgtgaatatgagccct

SEQ ID NO: 390851 - DNA, 20 bp, Artificial
  CRISPR gRNA sequence
ttttgcctagcaaaatattt

SEQ ID NO: 390852 - DNA, 20 bp, Artificial
  CRISPR gRNA sequence
tgcctagcaaaatatttcac

SEQ ID NO: 390853 - DNA, 20 bp, Artificial
  CRISPR gRNA sequence
gcctagcaaaatatttcacg

SEQ ID NO: 390854 - DNA, 20 bp, Artificial
  CRISPR gRNA sequence
cctagcaaaatatttcacgc

SEQ ID NO: 390855 - DNA, 20 bp, Artificial
  CRISPR gRNA sequence
gcaaaatatttcacgcttta

SEQ ID NO: 390856 - DNA, 20 bp, Artificial
  CRISPR gRNA sequence
cacgctttaactggccgcag

SEQ ID NO: 390857 - DNA, 20 bp, Artificial
  CRISPR gRNA sequence
acgctttaactggccgcagg

SEQ ID NO: 390858 - DNA, 20 bp, Artificial
  CRISPR gRNA sequence
taactggccgcaggcaagaa

SEQ ID NO: 390859 - DNA, 20 bp, Artificial
  CRISPR gRNA sequence
aactggccgcaggcaagaaa

SEQ ID NO: 390860 - DNA, 20 bp, Artificial
  CRISPR gRNA sequence
actggccgcaggcaagaaag

SEQ ID NO: 390861 - DNA, 20 bp, Artificial
  CRISPR gRNA sequence
gccgcaggcaagaaaggtga

SEQ ID NO: 390862 - DNA, 20 bp, Artificial
  CRISPR gRNA sequence
cttggaggacttcgagtttc

SEQ ID NO: 390863 - DNA, 20 bp, Artificial
  CRISPR gRNA sequence
ttggaggacttcgagtttca

SEQ ID NO: 390864 - DNA, 20 bp, Artificial
  CRISPR gRNA sequence
ggaggacttcgagtttcaga

SEQ ID NO: 390865 - DNA, 20 bp, Artificial
  CRISPR gRNA sequence
gaggacttcgagtttcagac

SEQ ID NO: 390866 - DNA, 20 bp, Artificial
  CRISPR gRNA sequence
cgagtttcagacaatattca

SEQ ID NO: 390867 - DNA, 20 bp, Artificial
  CRISPR gRNA sequence
gagtttcagacaatattcac

SEQ ID NO: 390868 - DNA, 20 bp, Artificial
  CRISPR gRNA sequence
cagacaatattcacgttcgt

SEQ ID NO: 390869 - DNA, 20 bp, Artificial
  CRISPR gRNA sequence
agacaatattcacgttcgtt

SEQ ID NO: 390870 - DNA, 20 bp, Artificial
  CRISPR gRNA sequence
acgttcgttgtaagggaaaa

SEQ ID NO: 390871 - DNA, 20 bp, Artificial
  CRISPR gRNA sequence
gttgtaagggaaaatggcaa

SEQ ID NO: 390872 - DNA, 20 bp, Artificial
  CRISPR gRNA sequence
taagggaaaatggcaaatga

SEQ ID NO: 390873 - DNA, 20 bp, Artificial
  CRISPR gRNA sequence
aaagatgaaatctttgcttg

SEQ ID NO: 390874 - DNA, 20 bp, Artificial
  CRISPR gRNA sequence
tgcttgggtttcgctaagca

SEQ ID NO: 390875 - DNA, 20 bp, Artificial
  CRISPR gRNA sequence
gcttgggtttcgctaagcaa

SEQ ID NO: 390876 - DNA, 20 bp, Artificial
  CRISPR gRNA sequence
cttgggtttcgctaagcaat

SEQ ID NO: 390877 - DNA, 20 bp, Artificial
  CRISPR gRNA sequence
gggtttcgctaagcaataag

SEQ ID NO: 390878 - DNA, 20 bp, Artificial
  CRISPR gRNA sequence
ggtttcgctaagcaataagt

SEQ ID NO: 390879 - DNA, 20 bp, Artificial
  CRISPR gRNA sequence
cgctaagcaataagttccaa

SEQ ID NO: 390880 - DNA, 20 bp, Artificial
  CRISPR gRNA sequence
gctaagcaataagttccaaa

SEQ ID NO: 390881 - DNA, 20 bp, Artificial
  CRISPR gRNA sequence
agcaataagttccaaacacc

SEQ ID NO: 390882 - DNA, 20 bp, Artificial
  CRISPR gRNA sequence
caaacaccctgcaatgcagg

SEQ ID NO: 390883 - DNA, 20 bp, Artificial
  CRISPR gRNA sequence
caatgcagggaactccataa

SEQ ID NO: 390884 - DNA, 20 bp, Artificial
  CRISPR gRNA sequence
cataaaaatggagcaggagc

SEQ ID NO: 390885 - DNA, 20 bp, Artificial
  CRISPR gRNA sequence
gactcggacagtgagcagat

SEQ ID NO: 390886 - DNA, 20 bp, Artificial
  CRISPR gRNA sequence
actcggacagtgagcagatg

SEQ ID NO: 390887 - DNA, 20 bp, Artificial
  CRISPR gRNA sequence
ggacagtgagcagatgctgt

SEQ ID NO: 390888 - DNA, 20 bp, Artificial
  CRISPR gRNA sequence
tcaggctctacggacacctc

SEQ ID NO: 390889 - DNA, 20 bp, Artificial
  CRISPR gRNA sequence
tacggacacctcctgggacc

SEQ ID NO: 390890 - DNA, 20 bp, Artificial
  CRISPR gRNA sequence
cggacacctcctgggacctt

SEQ ID NO: 390891 - DNA, 20 bp, Artificial
  CRISPR gRNA sequence
ctgggacctttctgccttct

SEQ ID NO: 390892 - DNA, 20 bp, Artificial
  CRISPR gRNA sequence
ggacctttctgccttcttga

SEQ ID NO: 390893 - DNA, 20 bp, Artificial
  CRISPR gRNA sequence
tctgccttcttgaagcaccc

SEQ ID NO: 390894 - DNA, 20 bp, Artificial
  CRISPR gRNA sequence
ctgccttcttgaagcacccc

SEQ ID NO: 390895 - DNA, 20 bp, Artificial
  CRISPR gRNA sequence
tgccttcttgaagcacccca

SEQ ID NO: 390896 - DNA, 20 bp, Artificial
  CRISPR gRNA sequence
ccttcttgaagcaccccagc

SEQ ID NO: 390897 - DNA, 20 bp, Artificial
  CRISPR gRNA sequence
cttgaagcaccccagcttct

SEQ ID NO: 390898 - DNA, 20 bp, Artificial
  CRISPR gRNA sequence
ttgaagcaccccagcttctg

SEQ ID NO: 390899 - DNA, 20 bp, Artificial
  CRISPR gRNA sequence
gaagcaccccagcttctgtg

SEQ ID NO: 390900 - DNA, 20 bp, Artificial
  CRISPR gRNA sequence
aagcaccccagcttctgtgc

SEQ ID NO: 390901 - DNA, 20 bp, Artificial
  CRISPR gRNA sequence
ctgtgctctcttctccccta

SEQ ID NO: 390902 - DNA, 20 bp, Artificial
  CRISPR gRNA sequence
tgtgctctcttctcccctaa

SEQ ID NO: 390903 - DNA, 20 bp, Artificial
  CRISPR gRNA sequence
tgctctcttctcccctaaca

SEQ ID NO: 390904 - DNA, 20 bp, Artificial
  CRISPR gRNA sequence
tcttctcccctaacagccag

SEQ ID NO: 390905 - DNA, 20 bp, Artificial
  CRISPR gRNA sequence
ttctcccctaacagccagca

SEQ ID NO: 390906 - DNA, 20 bp, Artificial
  CRISPR gRNA sequence
ctcccctaacagccagcacc

SEQ ID NO: 390907 - DNA, 20 bp, Artificial
  CRISPR gRNA sequence
tcccctaacagccagcacct

SEQ ID NO: 390908 - DNA, 20 bp, Artificial
  CRISPR gRNA sequence
ccctaacagccagcacctgc

SEQ ID NO: 390909 - DNA, 20 bp, Artificial
  CRISPR gRNA sequence
acagccagcacctgccccgc

SEQ ID NO: 390910 - DNA, 20 bp, Artificial
  CRISPR gRNA sequence
ccccgctaggttggagcact

SEQ ID NO: 390911 - DNA, 20 bp, Artificial
  CRISPR gRNA sequence
ggttggagcactgcccaggg

SEQ ID NO: 390912 - DNA, 20 bp, Artificial
  CRISPR gRNA sequence
gagcactgcccagggtggct

SEQ ID NO: 390913 - DNA, 20 bp, Artificial
  CRISPR gRNA sequence
cccagggtggctggagcctg

SEQ ID NO: 390914 - DNA, 20 bp, Artificial
  CRISPR gRNA sequence
gagcctgcctgagaatgcac

SEQ ID NO: 390915 - DNA, 20 bp, Artificial
  CRISPR gRNA sequence
cctgagaatgcacacactga

SEQ ID NO: 390916 - DNA, 20 bp, Artificial
  CRISPR gRNA sequence
agaatgcacacactgatcaa

SEQ ID NO: 390917 - DNA, 20 bp, Artificial
  CRISPR gRNA sequence
atcaagggaccctgatccag

SEQ ID NO: 390918 - DNA, 20 bp, Artificial
  CRISPR gRNA sequence
atccagtgactgaccctggt

SEQ ID NO: 390919 - DNA, 20 bp, Artificial
  CRISPR gRNA sequence
accctggtagagtttgcttt

SEQ ID NO: 390920 - DNA, 20 bp, Artificial
  CRISPR gRNA sequence
gtagagtttgcttttcctga

SEQ ID NO: 390921 - DNA, 20 bp, Artificial
  CRISPR gRNA sequence
gcttttcctgaccaggcagc

SEQ ID NO: 390922 - DNA, 20 bp, Artificial
  CRISPR gRNA sequence
cttttcctgaccaggcagct

SEQ ID NO: 390923 - DNA, 20 bp, Artificial
  CRISPR gRNA sequence
ttcctgaccaggcagcttcc

SEQ ID NO: 390924 - DNA, 20 bp, Artificial
  CRISPR gRNA sequence
tcctgaccaggcagcttccc

SEQ ID NO: 390925 - DNA, 20 bp, Artificial
  CRISPR gRNA sequence
cctgaccaggcagcttccct

SEQ ID NO: 390926 - DNA, 20 bp, Artificial
  CRISPR gRNA sequence
ctgaccaggcagcttcccta

SEQ ID NO: 390927 - DNA, 20 bp, Artificial
  CRISPR gRNA sequence
accaggcagcttccctagac

SEQ ID NO: 390928 - DNA, 20 bp, Artificial
  CRISPR gRNA sequence
ccctagacttcgctggatcc

SEQ ID NO: 390929 - DNA, 20 bp, Artificial
  CRISPR gRNA sequence
cctagacttcgctggatcct

SEQ ID NO: 390930 - DNA, 20 bp, Artificial
  CRISPR gRNA sequence
gacttcgctggatcctgtgc

SEQ ID NO: 390931 - DNA, 20 bp, Artificial
  CRISPR gRNA sequence
cgctggatcctgtgcccttg

SEQ ID NO: 390932 - DNA, 20 bp, Artificial
  CRISPR gRNA sequence
gctggatcctgtgcccttgc

SEQ ID NO: 390933 - DNA, 20 bp, Artificial
  CRISPR gRNA sequence
gatcctgtgcccttgctgga

SEQ ID NO: 390934 - DNA, 20 bp, Artificial
  CRISPR gRNA sequence
tgcccttgctggatctctcc

SEQ ID NO: 390935 - DNA, 20 bp, Artificial
  CRISPR gRNA sequence
gctggatctctccttccctt

SEQ ID NO: 390936 - DNA, 20 bp, Artificial
  CRISPR gRNA sequence
ctggatctctccttcccttt

SEQ ID NO: 390937 - DNA, 20 bp, Artificial
  CRISPR gRNA sequence
gatctctccttccctttcca

SEQ ID NO: 390938 - DNA, 20 bp, Artificial
  CRISPR gRNA sequence
tccttccctttccaatccag

SEQ ID NO: 390939 - DNA, 20 bp, Artificial
  CRISPR gRNA sequence
cttccctttccaatccagat

SEQ ID NO: 390940 - DNA, 20 bp, Artificial
  CRISPR gRNA sequence
ccctttccaatccagatccc

SEQ ID NO: 390941 - DNA, 20 bp, Artificial
  CRISPR gRNA sequence
cctttccaatccagatcccc

SEQ ID NO: 390942 - DNA, 20 bp, Artificial
  CRISPR gRNA sequence
tccaatccagatcccctgat

SEQ ID NO: 390943 - DNA, 20 bp, Artificial
  CRISPR gRNA sequence
ccaatccagatcccctgatg

SEQ ID NO: 390944 - DNA, 20 bp, Artificial
  CRISPR gRNA sequence
caatccagatcccctgatgg

SEQ ID NO: 390945 - DNA, 20 bp, Artificial
  CRISPR gRNA sequence
atgggtttccctgcgaacac

SEQ ID NO: 390946 - DNA, 20 bp, Artificial
  CRISPR gRNA sequence
ccctgcgaacacttcctaat

SEQ ID NO: 390947 - DNA, 20 bp, Artificial
  CRISPR gRNA sequence
cctgcgaacacttcctaatg

SEQ ID NO: 390948 - DNA, 20 bp, Artificial
  CRISPR gRNA sequence
cgaacacttcctaatgggtc

SEQ ID NO: 390949 - DNA, 20 bp, Artificial
  CRISPR gRNA sequence
cctaatgggtccttttcaca

SEQ ID NO: 390950 - DNA, 20 bp, Artificial
  CRISPR gRNA sequence
ctaatgggtccttttcacat

SEQ ID NO: 390951 - DNA, 20 bp, Artificial
  CRISPR gRNA sequence
atgggtccttttcacattta

SEQ ID NO: 390952 - DNA, 20 bp, Artificial
  CRISPR gRNA sequence
ttcacatttatcctcttctc

SEQ ID NO: 390953 - DNA, 20 bp, Artificial
  CRISPR gRNA sequence
tcacatttatcctcttctca

SEQ ID NO: 390954 - DNA, 20 bp, Artificial
  CRISPR gRNA sequence
cacatttatcctcttctcag

SEQ ID NO: 390955 - DNA, 20 bp, Artificial
  CRISPR gRNA sequence
acatttatcctcttctcagg

SEQ ID NO: 390956 - DNA, 20 bp, Artificial
  CRISPR gRNA sequence
atcctcttctcagggactgc

SEQ ID NO: 390957 - DNA, 20 bp, Artificial
  CRISPR gRNA sequence
tcctcttctcagggactgct

SEQ ID NO: 390958 - DNA, 20 bp, Artificial
  CRISPR gRNA sequence
ttctcagggactgcttctgg

SEQ ID NO: 390959 - DNA, 20 bp, Artificial
  CRISPR gRNA sequence
ctcagggactgcttctggtg

SEQ ID NO: 390960 - DNA, 20 bp, Artificial
  CRISPR gRNA sequence
tcagggactgcttctggtga

SEQ ID NO: 390961 - DNA, 20 bp, Artificial
  CRISPR gRNA sequence
agggactgcttctggtgaat

SEQ ID NO: 390962 - DNA, 20 bp, Artificial
  CRISPR gRNA sequence
cttctggtgaatgcaatcta

SEQ ID NO: 390963 - DNA, 20 bp, Artificial
  CRISPR gRNA sequence
ctggtgaatgcaatctaaag

SEQ ID NO: 390964 - DNA, 20 bp, Artificial
  CRISPR gRNA sequence
tggtgaatgcaatctaaagc

SEQ ID NO: 390965 - DNA, 20 bp, Artificial
  CRISPR gRNA sequence
gtgaatgcaatctaaagcaa

SEQ ID NO: 390966 - DNA, 20 bp, Artificial
  CRISPR gRNA sequence
aagcaagcacaattgtagaa

SEQ ID NO: 390967 - DNA, 20 bp, Artificial
  CRISPR gRNA sequence
tagaactttactaaattgta

SEQ ID NO: 390968 - DNA, 20 bp, Artificial
  CRISPR gRNA sequence
tactaaattgtacttggagc

SEQ ID NO: 390969 - DNA, 20 bp, Artificial
  CRISPR gRNA sequence
actaaattgtacttggagcc

SEQ ID NO: 390970 - DNA, 20 bp, Artificial
  CRISPR gRNA sequence
ctaaattgtacttggagcct

SEQ ID NO: 390971 - DNA, 20 bp, Artificial
  CRISPR gRNA sequence
aattgtacttggagcctaga

SEQ ID NO: 390972 - DNA, 20 bp, Artificial
  CRISPR gRNA sequence
tacttggagcctagaatcta

SEQ ID NO: 390973 - DNA, 20 bp, Artificial
  CRISPR gRNA sequence
ggagcctagaatctaaattt

SEQ ID NO: 390974 - DNA, 20 bp, Artificial
  CRISPR gRNA sequence
gagcctagaatctaaatttc

SEQ ID NO: 390975 - DNA, 20 bp, Artificial
  CRISPR gRNA sequence
gaatctaaatttccatcagt

SEQ ID NO: 390976 - DNA, 20 bp, Artificial
  CRISPR gRNA sequence
aatttccatcagtgtgcctg

SEQ ID NO: 390977 - DNA, 20 bp, Artificial
  CRISPR gRNA sequence
ccatcagtgtgcctggaacc

SEQ ID NO: 390978 - DNA, 20 bp, Artificial
  CRISPR gRNA sequence
catcagtgtgcctggaacca

SEQ ID NO: 390979 - DNA, 20 bp, Artificial
  CRISPR gRNA sequence
gaaccagattcctaaatgtc

SEQ ID NO: 390980 - DNA, 20 bp, Artificial
  CRISPR gRNA sequence
ctaaatgtcttttttgtttg

SEQ ID NO: 390981 - DNA, 20 bp, Artificial
  CRISPR gRNA sequence
aatgtcttttttgtttgttt

SEQ ID NO: 390982 - DNA, 20 bp, Artificial
  CRISPR gRNA sequence
ttttgtttgtttttcagatg

SEQ ID NO: 390983 - DNA, 20 bp, Artificial
  CRISPR gRNA sequence
tttgtttgtttttcagatgg

SEQ ID NO: 390984 - DNA, 20 bp, Artificial
  CRISPR gRNA sequence
ttgtttgtttttcagatgga

SEQ ID NO: 390985 - DNA, 20 bp, Artificial
  CRISPR gRNA sequence
tgtttgtttttcagatggag

SEQ ID NO: 390986 - DNA, 20 bp, Artificial
  CRISPR gRNA sequence
gtttgtttttcagatggagt

SEQ ID NO: 390987 - DNA, 20 bp, Artificial
  CRISPR gRNA sequence
tttgtttttcagatggagtc

SEQ ID NO: 390988 - DNA, 20 bp, Artificial
  CRISPR gRNA sequence
gtttttcagatggagtccca

SEQ ID NO: 390989 - DNA, 20 bp, Artificial
  CRISPR gRNA sequence
tttttcagatggagtcccac

SEQ ID NO: 390990 - DNA, 20 bp, Artificial
  CRISPR gRNA sequence
ttcagatggagtcccactct

SEQ ID NO: 390991 - DNA, 20 bp, Artificial
  CRISPR gRNA sequence
tcagatggagtcccactctg

SEQ ID NO: 390992 - DNA, 20 bp, Artificial
  CRISPR gRNA sequence
cagatggagtcccactctgt

SEQ ID NO: 390993 - DNA, 20 bp, Artificial
  CRISPR gRNA sequence
agatggagtcccactctgtt

SEQ ID NO: 390994 - DNA, 20 bp, Artificial
  CRISPR gRNA sequence
tgttgcccaggctggagtgc

SEQ ID NO: 390995 - DNA, 20 bp, Artificial
  CRISPR gRNA sequence
ttgcccaggctggagtgcag

SEQ ID NO: 390996 - DNA, 20 bp, Artificial
  CRISPR gRNA sequence
cccaggctggagtgcagtga

SEQ ID NO: 390997 - DNA, 20 bp, Artificial
  CRISPR gRNA sequence
gagtgcagtgatggtatctt

SEQ ID NO: 390998 - DNA, 20 bp, Artificial
  CRISPR gRNA sequence
gactcagcacctcctgggtt

SEQ ID NO: 390999 - DNA, 20 bp, Artificial
  CRISPR gRNA sequence
actcagcacctcctgggttc

SEQ ID NO: 391000 - DNA, 20 bp, Artificial
  CRISPR gRNA sequence
agcacctcctgggttcaagc

SEQ ID NO: 391001 - DNA, 20 bp, Artificial
  CRISPR gRNA sequence
ctgggttcaagcaattctgc

SEQ ID NO: 391002 - DNA, 20 bp, Artificial
  CRISPR gRNA sequence
ggttcaagcaattctgctgc

SEQ ID NO: 391003 - DNA, 20 bp, Artificial
  CRISPR gRNA sequence
aagcaattctgctgcctcag

SEQ ID NO: 391004 - DNA, 20 bp, Artificial
  CRISPR gRNA sequence
tgctgcctcagcctcccgag

SEQ ID NO: 391005 - DNA, 20 bp, Artificial
  CRISPR gRNA sequence
ctgcctcagcctcccgagta

SEQ ID NO: 391006 - DNA, 20 bp, Artificial
  CRISPR gRNA sequence
cctcagcctcccgagtaact

SEQ ID NO: 391007 - DNA, 20 bp, Artificial
  CRISPR gRNA sequence
agcctcccgagtaactggga

SEQ ID NO: 391008 - DNA, 20 bp, Artificial
  CRISPR gRNA sequence
ccgagtaactgggattacag

SEQ ID NO: 391009 - DNA, 20 bp, Artificial
  CRISPR gRNA sequence
ggattacaggcacacaccac

SEQ ID NO: 391010 - DNA, 20 bp, Artificial
  CRISPR gRNA sequence
caggcacacaccaccatgcc

SEQ ID NO: 391011 - DNA, 20 bp, Artificial
  CRISPR gRNA sequence
aattttttgtatttttagta

SEQ ID NO: 391012 - DNA, 20 bp, Artificial
  CRISPR gRNA sequence
tttgtatttttagtagagat

SEQ ID NO: 391013 - DNA, 20 bp, Artificial
  CRISPR gRNA sequence
ttgtatttttagtagagatg

SEQ ID NO: 391014 - DNA, 20 bp, Artificial
  CRISPR gRNA sequence
tgtatttttagtagagatgg

SEQ ID NO: 391015 - DNA, 20 bp, Artificial
  CRISPR gRNA sequence
gtatttttagtagagatggg

SEQ ID NO: 391016 - DNA, 20 bp, Artificial
  CRISPR gRNA sequence
tatttttagtagagatgggg

SEQ ID NO: 391017 - DNA, 20 bp, Artificial
  CRISPR gRNA sequence
ttagtagagatggggttttg

SEQ ID NO: 391018 - DNA, 20 bp, Artificial
  CRISPR gRNA sequence
tagtagagatggggttttgc

SEQ ID NO: 391019 - DNA, 20 bp, Artificial
  CRISPR gRNA sequence
agtagagatggggttttgcc

SEQ ID NO: 391020 - DNA, 20 bp, Artificial
  CRISPR gRNA sequence
gtagagatggggttttgcca

SEQ ID NO: 391021 - DNA, 20 bp, Artificial
  CRISPR gRNA sequence
tgccatgttggccaggctgg

SEQ ID NO: 391022 - DNA, 20 bp, Artificial
  CRISPR gRNA sequence
gccatgttggccaggctggt

SEQ ID NO: 391023 - DNA, 20 bp, Artificial
  CRISPR gRNA sequence
ccatgttggccaggctggtc

SEQ ID NO: 391024 - DNA, 20 bp, Artificial
  CRISPR gRNA sequence
gccaggctggtctcgaactc

SEQ ID NO: 391025 - DNA, 20 bp, Artificial
  CRISPR gRNA sequence
gtctcgaactcctgatctca

SEQ ID NO: 391026 - DNA, 20 bp, Artificial
  CRISPR gRNA sequence
gaactcctgatctcaagtgg

SEQ ID NO: 391027 - DNA, 20 bp, Artificial
  CRISPR gRNA sequence
ctgatctcaagtggtccgcc

SEQ ID NO: 391028 - DNA, 20 bp, Artificial
  CRISPR gRNA sequence
atctcaagtggtccgcccac

SEQ ID NO: 391029 - DNA, 20 bp, Artificial
  CRISPR gRNA sequence
aagtggtccgcccacctcgg

SEQ ID NO: 391030 - DNA, 20 bp, Artificial
  CRISPR gRNA sequence
ggcctcccaaagtgctggga

SEQ ID NO: 391031 - DNA, 20 bp, Artificial
  CRISPR gRNA sequence
ccaaagtgctgggattacag

SEQ ID NO: 391032 - DNA, 20 bp, Artificial
  CRISPR gRNA sequence
ggattacaggtgtgtgccac

SEQ ID NO: 391033 - DNA, 20 bp, Artificial
  CRISPR gRNA sequence
caggtgtgtgccaccacacc

SEQ ID NO: 391034 - DNA, 20 bp, Artificial
  CRISPR gRNA sequence
gcccttgaatgtcttcttga

SEQ ID NO: 391035 - DNA, 20 bp, Artificial
  CRISPR gRNA sequence
gaatgtcttcttgataacat

SEQ ID NO: 391036 - DNA, 20 bp, Artificial
  CRISPR gRNA sequence
aatgtcttcttgataacatg

SEQ ID NO: 391037 - DNA, 20 bp, Artificial
  CRISPR gRNA sequence
cttgataacatgacctgagt

SEQ ID NO: 391038 - DNA, 20 bp, Artificial
  CRISPR gRNA sequence
ttgataacatgacctgagtc

SEQ ID NO: 391039 - DNA, 20 bp, Artificial
  CRISPR gRNA sequence
gataacatgacctgagtcaa

SEQ ID NO: 391040 - DNA, 20 bp, Artificial
  CRISPR gRNA sequence
ataacatgacctgagtcaat

SEQ ID NO: 391041 - DNA, 20 bp, Artificial
  CRISPR gRNA sequence
agtcaatgaaatctctctca

SEQ ID NO: 391042 - DNA, 20 bp, Artificial
  CRISPR gRNA sequence
tctcatagaagcagagggta

SEQ ID NO: 391043 - DNA, 20 bp, Artificial
  CRISPR gRNA sequence
tcatagaagcagagggtagg

SEQ ID NO: 391044 - DNA, 20 bp, Artificial
  CRISPR gRNA sequence
atagaagcagagggtaggat

SEQ ID NO: 391045 - DNA, 20 bp, Artificial
  CRISPR gRNA sequence
acagtggctggggattggga

SEQ ID NO: 391046 - DNA, 20 bp, Artificial
  CRISPR gRNA sequence
cagtggctggggattgggag

SEQ ID NO: 391047 - DNA, 20 bp, Artificial
  CRISPR gRNA sequence
gggattgggagaatgagggg

SEQ ID NO: 391048 - DNA, 20 bp, Artificial
  CRISPR gRNA sequence
ggagaatgaggggataacgg

SEQ ID NO: 391049 - DNA, 20 bp, Artificial
  CRISPR gRNA sequence
agagggtacaaaacctcagt

SEQ ID NO: 391050 - DNA, 20 bp, Artificial
  CRISPR gRNA sequence
agtcagacagaagacatagg

SEQ ID NO: 391051 - DNA, 20 bp, Artificial
  CRISPR gRNA sequence
ttccttttttgagctccgtc

SEQ ID NO: 391052 - DNA, 20 bp, Artificial
  CRISPR gRNA sequence
ccttttttgagctccgtcac

SEQ ID NO: 391053 - DNA, 20 bp, Artificial
  CRISPR gRNA sequence
cttttttgagctccgtcaca

SEQ ID NO: 391054 - DNA, 20 bp, Artificial
  CRISPR gRNA sequence
ttttgagctccgtcacacag

SEQ ID NO: 391055 - DNA, 20 bp, Artificial
  CRISPR gRNA sequence
tttgagctccgtcacacagc

SEQ ID NO: 391056 - DNA, 20 bp, Artificial
  CRISPR gRNA sequence
ttgagctccgtcacacagct

SEQ ID NO: 391057 - DNA, 20 bp, Artificial
  CRISPR gRNA sequence
tgagctccgtcacacagctt

SEQ ID NO: 391058 - DNA, 20 bp, Artificial
  CRISPR gRNA sequence
gagctccgtcacacagcttg

SEQ ID NO: 391059 - DNA, 20 bp, Artificial
  CRISPR gRNA sequence
agctccgtcacacagcttga

SEQ ID NO: 391060 - DNA, 20 bp, Artificial
  CRISPR gRNA sequence
cgtcacacagcttgatgcat

SEQ ID NO: 391061 - DNA, 20 bp, Artificial
  CRISPR gRNA sequence
gatgcatataaataagagag

SEQ ID NO: 391062 - DNA, 20 bp, Artificial
  CRISPR gRNA sequence
atgcatataaataagagagt

SEQ ID NO: 391063 - DNA, 20 bp, Artificial
  CRISPR gRNA sequence
cccatttcaaaatttctaga

SEQ ID NO: 391064 - DNA, 20 bp, Artificial
  CRISPR gRNA sequence
caaaatttctagagagtgaa

SEQ ID NO: 391065 - DNA, 20 bp, Artificial
  CRISPR gRNA sequence
aaaatttctagagagtgaat

SEQ ID NO: 391066 - DNA, 20 bp, Artificial
  CRISPR gRNA sequence
ctagagagtgaatttcaaat

SEQ ID NO: 391067 - DNA, 20 bp, Artificial
  CRISPR gRNA sequence
tagagagtgaatttcaaata

SEQ ID NO: 391068 - DNA, 20 bp, Artificial
  CRISPR gRNA sequence
gagagtgaatttcaaatatt

SEQ ID NO: 391069 - DNA, 20 bp, Artificial
  CRISPR gRNA sequence
caaatattctcaccacaaaa

SEQ ID NO: 391070 - DNA, 20 bp, Artificial
  CRISPR gRNA sequence
aaatattctcaccacaaaaa

SEQ ID NO: 391071 - DNA, 20 bp, Artificial
  CRISPR gRNA sequence
tcaccacaaaaaaagttaag

SEQ ID NO: 391072 - DNA, 20 bp, Artificial
  CRISPR gRNA sequence
accacaaaaaaagttaagta

SEQ ID NO: 391073 - DNA, 20 bp, Artificial
  CRISPR gRNA sequence
agtatttgagaggatggata

SEQ ID NO: 391074 - DNA, 20 bp, Artificial
  CRISPR gRNA sequence
gagaggatggatacatgaac

SEQ ID NO: 391075 - DNA, 20 bp, Artificial
  CRISPR gRNA sequence
agaggatggatacatgaact

SEQ ID NO: 391076 - DNA, 20 bp, Artificial
  CRISPR gRNA sequence
gcttgatttaattattacac

SEQ ID NO: 391077 - DNA, 20 bp, Artificial
  CRISPR gRNA sequence
gatttaattattacacatta

SEQ ID NO: 391078 - DNA, 20 bp, Artificial
  CRISPR gRNA sequence
atttaattattacacattat

SEQ ID NO: 391079 - DNA, 20 bp, Artificial
  CRISPR gRNA sequence
aattattacacattatattt

SEQ ID NO: 391080 - DNA, 20 bp, Artificial
  CRISPR gRNA sequence
attattacacattatattta

SEQ ID NO: 391081 - DNA, 20 bp, Artificial
  CRISPR gRNA sequence
ttacacattatatttataag

SEQ ID NO: 391082 - DNA, 20 bp, Artificial
  CRISPR gRNA sequence
cacattatatttataagtta

SEQ ID NO: 391083 - DNA, 20 bp, Artificial
  CRISPR gRNA sequence
tatttataagttataacctc

SEQ ID NO: 391084 - DNA, 20 bp, Artificial
  CRISPR gRNA sequence
ataagttataacctctgttt

SEQ ID NO: 391085 - DNA, 20 bp, Artificial
  CRISPR gRNA sequence
taagttataacctctgtttg

SEQ ID NO: 391086 - DNA, 20 bp, Artificial
  CRISPR gRNA sequence
taacctctgtttgtacccta

SEQ ID NO: 391087 - DNA, 20 bp, Artificial
  CRISPR gRNA sequence
tgtttgtaccctataaattt

SEQ ID NO: 391088 - DNA, 20 bp, Artificial
  CRISPR gRNA sequence
tttgtaccctataaatttat

SEQ ID NO: 391089 - DNA, 20 bp, Artificial
  CRISPR gRNA sequence
gtaccctataaatttataga

SEQ ID NO: 391090 - DNA, 20 bp, Artificial
  CRISPR gRNA sequence
taccctataaatttatagaa

SEQ ID NO: 391091 - DNA, 20 bp, Artificial
  CRISPR gRNA sequence
taaatttatagaattataaa

SEQ ID NO: 391092 - DNA, 20 bp, Artificial
  CRISPR gRNA sequence
atagaattataaattgtcaa

SEQ ID NO: 391093 - DNA, 20 bp, Artificial
  CRISPR gRNA sequence
tagaattataaattgtcaaa

SEQ ID NO: 391094 - DNA, 20 bp, Artificial
  CRISPR gRNA sequence
taaattgtcaaattacaatt

SEQ ID NO: 391095 - DNA, 20 bp, Artificial
  CRISPR gRNA sequence
tcaaattacaatttaaaaat

SEQ ID NO: 391096 - DNA, 20 bp, Artificial
  CRISPR gRNA sequence
caatttaaaaattaataaca

SEQ ID NO: 391097 - DNA, 20 bp, Artificial
  CRISPR gRNA sequence
aaaaattaataacaaaacaa

SEQ ID NO: 391098 - DNA, 20 bp, Artificial
  CRISPR gRNA sequence
aaaattaataacaaaacaaa

SEQ ID NO: 391099 - DNA, 20 bp, Artificial
  CRISPR gRNA sequence
ataacaaaacaaaaccgact

SEQ ID NO: 391100 - DNA, 20 bp, Artificial
  CRISPR gRNA sequence
tgtctttgactctctgtttg

SEQ ID NO: 391101 - DNA, 20 bp, Artificial
  CRISPR gRNA sequence
tctttgactctctgtttggc

SEQ ID NO: 391102 - DNA, 20 bp, Artificial
  CRISPR gRNA sequence
tgactctctgtttggctcta

SEQ ID NO: 391103 - DNA, 20 bp, Artificial
  CRISPR gRNA sequence
gactctctgtttggctctat

SEQ ID NO: 391104 - DNA, 20 bp, Artificial
  CRISPR gRNA sequence
actctctgtttggctctatc

SEQ ID NO: 391105 - DNA, 20 bp, Artificial
  CRISPR gRNA sequence
tctgtttggctctatcactc

SEQ ID NO: 391106 - DNA, 20 bp, Artificial
  CRISPR gRNA sequence
tgtttggctctatcactctc

SEQ ID NO: 391107 - DNA, 20 bp, Artificial
  CRISPR gRNA sequence
tttggctctatcactctctc

SEQ ID NO: 391108 - DNA, 20 bp, Artificial
  CRISPR gRNA sequence
ggctctatcactctctcaag

SEQ ID NO: 391109 - DNA, 20 bp, Artificial
  CRISPR gRNA sequence
gctctatcactctctcaagt

SEQ ID NO: 391110 - DNA, 20 bp, Artificial
  CRISPR gRNA sequence
tatcactctctcaagtccca

SEQ ID NO: 391111 - DNA, 20 bp, Artificial
  CRISPR gRNA sequence
tcactctctcaagtcccagc

SEQ ID NO: 391112 - DNA, 20 bp, Artificial
  CRISPR gRNA sequence
tctcaagtcccagcttgacc

SEQ ID NO: 391113 - DNA, 20 bp, Artificial
  CRISPR gRNA sequence
tcaagtcccagcttgaccta

SEQ ID NO: 391114 - DNA, 20 bp, Artificial
  CRISPR gRNA sequence
aagtcccagcttgacctatc

SEQ ID NO: 391115 - DNA, 20 bp, Artificial
  CRISPR gRNA sequence
gacctatctctctcccagga

SEQ ID NO: 391116 - DNA, 20 bp, Artificial
  CRISPR gRNA sequence
acctatctctctcccaggac

SEQ ID NO: 391117 - DNA, 20 bp, Artificial
  CRISPR gRNA sequence
tctctctcccaggacttacc

SEQ ID NO: 391118 - DNA, 20 bp, Artificial
  CRISPR gRNA sequence
tctcccaggacttacccaca

SEQ ID NO: 391119 - DNA, 20 bp, Artificial
  CRISPR gRNA sequence
tcccaggacttacccacagt

SEQ ID NO: 391120 - DNA, 20 bp, Artificial
  CRISPR gRNA sequence
ccaggacttacccacagtaa

SEQ ID NO: 391121 - DNA, 20 bp, Artificial
  CRISPR gRNA sequence
acccacagtaatctctcagc

SEQ ID NO: 391122 - DNA, 20 bp, Artificial
  CRISPR gRNA sequence
cccacagtaatctctcagcc

SEQ ID NO: 391123 - DNA, 20 bp, Artificial
  CRISPR gRNA sequence
tcagccactgaatcctacgg

SEQ ID NO: 391124 - DNA, 20 bp, Artificial
  CRISPR gRNA sequence
agccactgaatcctacggct

SEQ ID NO: 391125 - DNA, 20 bp, Artificial
  CRISPR gRNA sequence
aatcctacggctctctcttt

SEQ ID NO: 391126 - DNA, 20 bp, Artificial
  CRISPR gRNA sequence
cggctctctctttccacatt

SEQ ID NO: 391127 - DNA, 20 bp, Artificial
  CRISPR gRNA sequence
tctctttccacatttttgtg

SEQ ID NO: 391128 - DNA, 20 bp, Artificial
  CRISPR gRNA sequence
tctttccacatttttgtgta

SEQ ID NO: 391129 - DNA, 20 bp, Artificial
  CRISPR gRNA sequence
tttccacatttttgtgtaat

SEQ ID NO: 391130 - DNA, 20 bp, Artificial
  CRISPR gRNA sequence
tccacatttttgtgtaattg

SEQ ID NO: 391131 - DNA, 20 bp, Artificial
  CRISPR gRNA sequence
ccacatttttgtgtaattgg

SEQ ID NO: 391132 - DNA, 20 bp, Artificial
  CRISPR gRNA sequence
cacatttttgtgtaattgga

SEQ ID NO: 391133 - DNA, 20 bp, Artificial
  CRISPR gRNA sequence
ttgtgtaattggatataaca

SEQ ID NO: 391134 - DNA, 20 bp, Artificial
  CRISPR gRNA sequence
tgtgtaattggatataacaa

SEQ ID NO: 391135 - DNA, 20 bp, Artificial
  CRISPR gRNA sequence
gtgtaattggatataacaaa

SEQ ID NO: 391136 - DNA, 20 bp, Artificial
  CRISPR gRNA sequence
tgtaattggatataacaaag

SEQ ID NO: 391137 - DNA, 20 bp, Artificial
  CRISPR gRNA sequence
gatataacaaagtactgcac

SEQ ID NO: 391138 - DNA, 20 bp, Artificial
  CRISPR gRNA sequence
cacttgcaaaatataaactg

SEQ ID NO: 391139 - DNA, 20 bp, Artificial
  CRISPR gRNA sequence
gcaaaatataaactgtcgtg

SEQ ID NO: 391140 - DNA, 20 bp, Artificial
  CRISPR gRNA sequence
caaaatataaactgtcgtgt

SEQ ID NO: 391141 - DNA, 20 bp, Artificial
  CRISPR gRNA sequence
tcgtgttttctatttctgtg

SEQ ID NO: 391142 - DNA, 20 bp, Artificial
  CRISPR gRNA sequence
tctatttctgtggctatgtc

SEQ ID NO: 391143 - DNA, 20 bp, Artificial
  CRISPR gRNA sequence
ctatttctgtggctatgtct

SEQ ID NO: 391144 - DNA, 20 bp, Artificial
  CRISPR gRNA sequence
tatttctgtggctatgtctt

SEQ ID NO: 391145 - DNA, 20 bp, Artificial
  CRISPR gRNA sequence
tttctgtggctatgtcttgc

SEQ ID NO: 391146 - DNA, 20 bp, Artificial
  CRISPR gRNA sequence
ctgtggctatgtcttgcttt

SEQ ID NO: 391147 - DNA, 20 bp, Artificial
  CRISPR gRNA sequence
tgtggctatgtcttgctttt

SEQ ID NO: 391148 - DNA, 20 bp, Artificial
  CRISPR gRNA sequence
tggctatgtcttgcttttct

SEQ ID NO: 391149 - DNA, 20 bp, Artificial
  CRISPR gRNA sequence
tgtcttgcttttctcagtta

SEQ ID NO: 391150 - DNA, 20 bp, Artificial
  CRISPR gRNA sequence
gcttttctcagttatgccaa

SEQ ID NO: 391151 - DNA, 20 bp, Artificial
  CRISPR gRNA sequence
cttttctcagttatgccaag

SEQ ID NO: 391152 - DNA, 20 bp, Artificial
  CRISPR gRNA sequence
ttctcagttatgccaagctc

SEQ ID NO: 391153 - DNA, 20 bp, Artificial
  CRISPR gRNA sequence
tctcagttatgccaagctcc

SEQ ID NO: 391154 - DNA, 20 bp, Artificial
  CRISPR gRNA sequence
ctcagttatgccaagctcct

SEQ ID NO: 391155 - DNA, 20 bp, Artificial
  CRISPR gRNA sequence
tcagttatgccaagctcctt

SEQ ID NO: 391156 - DNA, 20 bp, Artificial
  CRISPR gRNA sequence
agttatgccaagctccttgg

SEQ ID NO: 391157 - DNA, 20 bp, Artificial
  CRISPR gRNA sequence
tgccaagctccttggaggca

SEQ ID NO: 391158 - DNA, 20 bp, Artificial
  CRISPR gRNA sequence
cttggaggcaaaaataattt

SEQ ID NO: 391159 - DNA, 20 bp, Artificial
  CRISPR gRNA sequence
ggaggcaaaaataatttcta

SEQ ID NO: 391160 - DNA, 20 bp, Artificial
  CRISPR gRNA sequence
gaggcaaaaataatttctaa

SEQ ID NO: 391161 - DNA, 20 bp, Artificial
  CRISPR gRNA sequence
ctaaaatatttgtttgtttc

SEQ ID NO: 391162 - DNA, 20 bp, Artificial
  CRISPR gRNA sequence
taaaatatttgtttgtttct

SEQ ID NO: 391163 - DNA, 20 bp, Artificial
  CRISPR gRNA sequence
aaatatttgtttgtttcttg

SEQ ID NO: 391164 - DNA, 20 bp, Artificial
  CRISPR gRNA sequence
gtttgtttcttgttactcca

SEQ ID NO: 391165 - DNA, 20 bp, Artificial
  CRISPR gRNA sequence
tttgtttcttgttactccac

SEQ ID NO: 391166 - DNA, 20 bp, Artificial
  CRISPR gRNA sequence
gtttcttgttactccaccat

SEQ ID NO: 391167 - DNA, 20 bp, Artificial
  CRISPR gRNA sequence
tttcttgttactccaccatg

SEQ ID NO: 391168 - DNA, 20 bp, Artificial
  CRISPR gRNA sequence
cttgttactccaccatgttt

SEQ ID NO: 391169 - DNA, 20 bp, Artificial
  CRISPR gRNA sequence
ttgttactccaccatgtttc

SEQ ID NO: 391170 - DNA, 20 bp, Artificial
  CRISPR gRNA sequence
gttactccaccatgtttcaa

SEQ ID NO: 391171 - DNA, 20 bp, Artificial
  CRISPR gRNA sequence
ttactccaccatgtttcaaa

SEQ ID NO: 391172 - DNA, 20 bp, Artificial
  CRISPR gRNA sequence
ctccaccatgtttcaaaagc

SEQ ID NO: 391173 - DNA, 20 bp, Artificial
  CRISPR gRNA sequence
caccatgtttcaaaagcttg

SEQ ID NO: 391174 - DNA, 20 bp, Artificial
  CRISPR gRNA sequence
caaaagcttgccagttaatt

SEQ ID NO: 391175 - DNA, 20 bp, Artificial
  CRISPR gRNA sequence
aaaagcttgccagttaattg

SEQ ID NO: 391176 - DNA, 20 bp, Artificial
  CRISPR gRNA sequence
gccagttaattgtagggtga

SEQ ID NO: 391177 - DNA, 20 bp, Artificial
  CRISPR gRNA sequence
ccagttaattgtagggtgaa

SEQ ID NO: 391178 - DNA, 20 bp, Artificial
  CRISPR gRNA sequence
attgtagggtgaattgtact

SEQ ID NO: 391179 - DNA, 20 bp, Artificial
  CRISPR gRNA sequence
tagggtgaattgtactcctt

SEQ ID NO: 391180 - DNA, 20 bp, Artificial
  CRISPR gRNA sequence
tactccttctaatctcagga

SEQ ID NO: 391181 - DNA, 20 bp, Artificial
  CRISPR gRNA sequence
cttctaatctcaggaaaaac

SEQ ID NO: 391182 - DNA, 20 bp, Artificial
  CRISPR gRNA sequence
ctaatctcaggaaaaacctt

SEQ ID NO: 391183 - DNA, 20 bp, Artificial
  CRISPR gRNA sequence
taatctcaggaaaaacctta

SEQ ID NO: 391184 - DNA, 20 bp, Artificial
  CRISPR gRNA sequence
atctcaggaaaaaccttata

SEQ ID NO: 391185 - DNA, 20 bp, Artificial
  CRISPR gRNA sequence
aggaaaaaccttatataata

SEQ ID NO: 391186 - DNA, 20 bp, Artificial
  CRISPR gRNA sequence
atataatagcttgtacatat

SEQ ID NO: 391187 - DNA, 20 bp, Artificial
  CRISPR gRNA sequence
tataatagcttgtacatatt

SEQ ID NO: 391188 - DNA, 20 bp, Artificial
  CRISPR gRNA sequence
gtacatattggatgattaat

SEQ ID NO: 391189 - DNA, 20 bp, Artificial
  CRISPR gRNA sequence
tacatattggatgattaata

SEQ ID NO: 391190 - DNA, 20 bp, Artificial
  CRISPR gRNA sequence
gatgattaataaatacttga

SEQ ID NO: 391191 - DNA, 20 bp, Artificial
  CRISPR gRNA sequence
ataaatacttgagaattcat

SEQ ID NO: 391192 - DNA, 20 bp, Artificial
  CRISPR gRNA sequence
gagaattcatttactacatc

SEQ ID NO: 391193 - DNA, 20 bp, Artificial
  CRISPR gRNA sequence
agaattcatttactacatct

SEQ ID NO: 391194 - DNA, 20 bp, Artificial
  CRISPR gRNA sequence
atttactacatctgtaggag

SEQ ID NO: 391195 - DNA, 20 bp, Artificial
  CRISPR gRNA sequence
actacatctgtaggagttaa

SEQ ID NO: 391196 - DNA, 20 bp, Artificial
  CRISPR gRNA sequence
ctacatctgtaggagttaag

SEQ ID NO: 391197 - DNA, 20 bp, Artificial
  CRISPR gRNA sequence
catctgtaggagttaagcac

SEQ ID NO: 391198 - DNA, 20 bp, Artificial
  CRISPR gRNA sequence
taggagttaagcacaatctc

SEQ ID NO: 391199 - DNA, 20 bp, Artificial
  CRISPR gRNA sequence
agcacaatctcaaagaaatc

SEQ ID NO: 391200 - DNA, 20 bp, Artificial
  CRISPR gRNA sequence
aaagaaatctgcacaacagc

SEQ ID NO: 391201 - DNA, 20 bp, Artificial
  CRISPR gRNA sequence
cacaacagcaagaatgacta

SEQ ID NO: 391202 - DNA, 20 bp, Artificial
  CRISPR gRNA sequence
acacaaagatgatgaacagt

SEQ ID NO: 391203 - DNA, 20 bp, Artificial
  CRISPR gRNA sequence
ttaaccaaacagaatgaaaa

SEQ ID NO: 391204 - DNA, 20 bp, Artificial
  CRISPR gRNA sequence
aaccaaacagaatgaaaatt

SEQ ID NO: 391205 - DNA, 20 bp, Artificial
  CRISPR gRNA sequence
accaaacagaatgaaaattt

SEQ ID NO: 391206 - DNA, 20 bp, Artificial
  CRISPR gRNA sequence
gagatatggttattagaggc

SEQ ID NO: 391207 - DNA, 20 bp, Artificial
  CRISPR gRNA sequence
agatatggttattagaggct

SEQ ID NO: 391208 - DNA, 20 bp, Artificial
  CRISPR gRNA sequence
ttagaggcttccctacattt

SEQ ID NO: 391209 - DNA, 20 bp, Artificial
  CRISPR gRNA sequence
gaggcttccctacatttttt

SEQ ID NO: 391210 - DNA, 20 bp, Artificial
  CRISPR gRNA sequence
ccctacattttttcaactgg

SEQ ID NO: 391211 - DNA, 20 bp, Artificial
  CRISPR gRNA sequence
cctacattttttcaactgga

SEQ ID NO: 391212 - DNA, 20 bp, Artificial
  CRISPR gRNA sequence
cattttttcaactggactat

SEQ ID NO: 391213 - DNA, 20 bp, Artificial
  CRISPR gRNA sequence
tttcaactggactattaaaa

SEQ ID NO: 391214 - DNA, 20 bp, Artificial
  CRISPR gRNA sequence
ttcaactggactattaaaat

SEQ ID NO: 391215 - DNA, 20 bp, Artificial
  CRISPR gRNA sequence
tcaactggactattaaaata

SEQ ID NO: 391216 - DNA, 20 bp, Artificial
  CRISPR gRNA sequence
caactggactattaaaatag

SEQ ID NO: 391217 - DNA, 20 bp, Artificial
  CRISPR gRNA sequence
aactggactattaaaatagt

SEQ ID NO: 391218 - DNA, 20 bp, Artificial
  CRISPR gRNA sequence
gactattaaaatagttgtca

SEQ ID NO: 391219 - DNA, 20 bp, Artificial
  CRISPR gRNA sequence
ttaaaatagttgtcaaaatg

SEQ ID NO: 391220 - DNA, 20 bp, Artificial
  CRISPR gRNA sequence
aaatagttgtcaaaatgaac

SEQ ID NO: 391221 - DNA, 20 bp, Artificial
  CRISPR gRNA sequence
tcaaaatgaactctaattgt

SEQ ID NO: 391222 - DNA, 20 bp, Artificial
  CRISPR gRNA sequence
taattgtagccccttttccc

SEQ ID NO: 391223 - DNA, 20 bp, Artificial
  CRISPR gRNA sequence
attgtagccccttttccctc

SEQ ID NO: 391224 - DNA, 20 bp, Artificial
  CRISPR gRNA sequence
tagccccttttccctccaat

SEQ ID NO: 391225 - DNA, 20 bp, Artificial
  CRISPR gRNA sequence
ttccctccaattcatattgc

SEQ ID NO: 391226 - DNA, 20 bp, Artificial
  CRISPR gRNA sequence
tccctccaattcatattgca

SEQ ID NO: 391227 - DNA, 20 bp, Artificial
  CRISPR gRNA sequence
ccctccaattcatattgcat

SEQ ID NO: 391228 - DNA, 20 bp, Artificial
  CRISPR gRNA sequence
cctccaattcatattgcatc

SEQ ID NO: 391229 - DNA, 20 bp, Artificial
  CRISPR gRNA sequence
caattcatattgcatcaaag

SEQ ID NO: 391230 - DNA, 20 bp, Artificial
  CRISPR gRNA sequence
atattgcatcaaagactata

SEQ ID NO: 391231 - DNA, 20 bp, Artificial
  CRISPR gRNA sequence
catcaaagactatataacta

SEQ ID NO: 391232 - DNA, 20 bp, Artificial
  CRISPR gRNA sequence
tataactaacatataaatct

SEQ ID NO: 391233 - DNA, 20 bp, Artificial
  CRISPR gRNA sequence
acatataaatcttatcaggc

SEQ ID NO: 391234 - DNA, 20 bp, Artificial
  CRISPR gRNA sequence
atcaggctacagctgtactt

SEQ ID NO: 391235 - DNA, 20 bp, Artificial
  CRISPR gRNA sequence
tcaggctacagctgtacttt

SEQ ID NO: 391236 - DNA, 20 bp, Artificial
  CRISPR gRNA sequence
cagctgtactttgaaaggtt

SEQ ID NO: 391237 - DNA, 20 bp, Artificial
  CRISPR gRNA sequence
tactttgaaaggttcagacg

SEQ ID NO: 391238 - DNA, 20 bp, Artificial
  CRISPR gRNA sequence
tgaaaggttcagacgtttcc

SEQ ID NO: 391239 - DNA, 20 bp, Artificial
  CRISPR gRNA sequence
gaaaggttcagacgtttcct

SEQ ID NO: 391240 - DNA, 20 bp, Artificial
  CRISPR gRNA sequence
aaaggttcagacgtttccta

SEQ ID NO: 391241 - DNA, 20 bp, Artificial
  CRISPR gRNA sequence
agacgtttcctattcctact

SEQ ID NO: 391242 - DNA, 20 bp, Artificial
  CRISPR gRNA sequence
cctattcctactacaggaca

SEQ ID NO: 391243 - DNA, 20 bp, Artificial
  CRISPR gRNA sequence
ctattcctactacaggacaa

SEQ ID NO: 391244 - DNA, 20 bp, Artificial
  CRISPR gRNA sequence
ttcctactacaggacaaagc

SEQ ID NO: 391245 - DNA, 20 bp, Artificial
  CRISPR gRNA sequence
ctactacaggacaaagcaca

SEQ ID NO: 391246 - DNA, 20 bp, Artificial
  CRISPR gRNA sequence
ctacaggacaaagcacatgt

SEQ ID NO: 391247 - DNA, 20 bp, Artificial
  CRISPR gRNA sequence
caggacaaagcacatgttct

SEQ ID NO: 391248 - DNA, 20 bp, Artificial
  CRISPR gRNA sequence
tttagcaaaatcctatatga

SEQ ID NO: 391249 - DNA, 20 bp, Artificial
  CRISPR gRNA sequence
tagcaaaatcctatatgatt

SEQ ID NO: 391250 - DNA, 20 bp, Artificial
  CRISPR gRNA sequence
agcaaaatcctatatgattt

SEQ ID NO: 391251 - DNA, 20 bp, Artificial
  CRISPR gRNA sequence
gcaaaatcctatatgatttt

SEQ ID NO: 391252 - DNA, 20 bp, Artificial
  CRISPR gRNA sequence
tatgattttattcttgcctt

SEQ ID NO: 391253 - DNA, 20 bp, Artificial
  CRISPR gRNA sequence
tattcttgcctttgtctcca

SEQ ID NO: 391254 - DNA, 20 bp, Artificial
  CRISPR gRNA sequence
attcttgcctttgtctccat

SEQ ID NO: 391255 - DNA, 20 bp, Artificial
  CRISPR gRNA sequence
ttcttgcctttgtctccatt

SEQ ID NO: 391256 - DNA, 20 bp, Artificial
  CRISPR gRNA sequence
ttgcctttgtctccattctc

SEQ ID NO: 391257 - DNA, 20 bp, Artificial
  CRISPR gRNA sequence
gcctttgtctccattctcat

SEQ ID NO: 391258 - DNA, 20 bp, Artificial
  CRISPR gRNA sequence
cctttgtctccattctcatc

SEQ ID NO: 391259 - DNA, 20 bp, Artificial
  CRISPR gRNA sequence
tgtctccattctcatctcct

SEQ ID NO: 391260 - DNA, 20 bp, Artificial
  CRISPR gRNA sequence
gtctccattctcatctccta

SEQ ID NO: 391261 - DNA, 20 bp, Artificial
  CRISPR gRNA sequence
tctccattctcatctcctac

SEQ ID NO: 391262 - DNA, 20 bp, Artificial
  CRISPR gRNA sequence
cattctcatctcctactaga

SEQ ID NO: 391263 - DNA, 20 bp, Artificial
  CRISPR gRNA sequence
tcatctcctactagaatctg

SEQ ID NO: 391264 - DNA, 20 bp, Artificial
  CRISPR gRNA sequence
atctcctactagaatctgcc

SEQ ID NO: 391265 - DNA, 20 bp, Artificial
  CRISPR gRNA sequence
ctactagaatctgccatata

SEQ ID NO: 391266 - DNA, 20 bp, Artificial
  CRISPR gRNA sequence
ctagaatctgccatatactc

SEQ ID NO: 391267 - DNA, 20 bp, Artificial
  CRISPR gRNA sequence
gaatctgccatatactccag

SEQ ID NO: 391268 - DNA, 20 bp, Artificial
  CRISPR gRNA sequence
ccatatactccagtttcccc

SEQ ID NO: 391269 - DNA, 20 bp, Artificial
  CRISPR gRNA sequence
cagtttccccaagaacatta

SEQ ID NO: 391270 - DNA, 20 bp, Artificial
  CRISPR gRNA sequence
ccccaagaacattattcacc

SEQ ID NO: 391271 - DNA, 20 bp, Artificial
  CRISPR gRNA sequence
cccaagaacattattcacct

SEQ ID NO: 391272 - DNA, 20 bp, Artificial
  CRISPR gRNA sequence
ttcacctttatgatcttgca

SEQ ID NO: 391273 - DNA, 20 bp, Artificial
  CRISPR gRNA sequence
acctttatgatcttgcatca

SEQ ID NO: 391274 - DNA, 20 bp, Artificial
  CRISPR gRNA sequence
tatgatcttgcatcagctat

SEQ ID NO: 391275 - DNA, 20 bp, Artificial
  CRISPR gRNA sequence
atgatcttgcatcagctatc

SEQ ID NO: 391276 - DNA, 20 bp, Artificial
  CRISPR gRNA sequence
tgatcttgcatcagctatct

SEQ ID NO: 391277 - DNA, 20 bp, Artificial
  CRISPR gRNA sequence
gcatcagctatctcttcttc

SEQ ID NO: 391278 - DNA, 20 bp, Artificial
  CRISPR gRNA sequence
catcagctatctcttcttct

SEQ ID NO: 391279 - DNA, 20 bp, Artificial
  CRISPR gRNA sequence
tctcttcttctggaatgcct

SEQ ID NO: 391280 - DNA, 20 bp, Artificial
  CRISPR gRNA sequence
ttcttctggaatgccttcat

SEQ ID NO: 391281 - DNA, 20 bp, Artificial
  CRISPR gRNA sequence
cttctggaatgccttcatat

SEQ ID NO: 391282 - DNA, 20 bp, Artificial
  CRISPR gRNA sequence
ttctggaatgccttcatata

SEQ ID NO: 391283 - DNA, 20 bp, Artificial
  CRISPR gRNA sequence
ctggaatgccttcatataat

SEQ ID NO: 391284 - DNA, 20 bp, Artificial
  CRISPR gRNA sequence
tggaatgccttcatataatc

SEQ ID NO: 391285 - DNA, 20 bp, Artificial
  CRISPR gRNA sequence
gaatgccttcatataatcct

SEQ ID NO: 391286 - DNA, 20 bp, Artificial
  CRISPR gRNA sequence
catataatccttccacttca

SEQ ID NO: 391287 - DNA, 20 bp, Artificial
  CRISPR gRNA sequence
atataatccttccacttcat

SEQ ID NO: 391288 - DNA, 20 bp, Artificial
  CRISPR gRNA sequence
ccacttcattccaagaacac

SEQ ID NO: 391289 - DNA, 20 bp, Artificial
  CRISPR gRNA sequence
cacttcattccaagaacact

SEQ ID NO: 391290 - DNA, 20 bp, Artificial
  CRISPR gRNA sequence
cattccaagaacactgctat

SEQ ID NO: 391291 - DNA, 20 bp, Artificial
  CRISPR gRNA sequence
attccaagaacactgctatt

SEQ ID NO: 391292 - DNA, 20 bp, Artificial
  CRISPR gRNA sequence
caagaacactgctatttatc

SEQ ID NO: 391293 - DNA, 20 bp, Artificial
  CRISPR gRNA sequence
ctatttatccttcaaaattt

SEQ ID NO: 391294 - DNA, 20 bp, Artificial
  CRISPR gRNA sequence
tttatccttcaaaatttatc

SEQ ID NO: 391295 - DNA, 20 bp, Artificial
  CRISPR gRNA sequence
atccttcaaaatttatcctg

SEQ ID NO: 391296 - DNA, 20 bp, Artificial
  CRISPR gRNA sequence
tccttcaaaatttatcctgt

SEQ ID NO: 391297 - DNA, 20 bp, Artificial
  CRISPR gRNA sequence
caaaatttatcctgtgatgc

SEQ ID NO: 391298 - DNA, 20 bp, Artificial
  CRISPR gRNA sequence
aaaatttatcctgtgatgcc

SEQ ID NO: 391299 - DNA, 20 bp, Artificial
  CRISPR gRNA sequence
atcctgtgatgccaccttat

SEQ ID NO: 391300 - DNA, 20 bp, Artificial
  CRISPR gRNA sequence
tcctgtgatgccaccttatc

SEQ ID NO: 391301 - DNA, 20 bp, Artificial
  CRISPR gRNA sequence
tgatgccaccttatcctgtg

SEQ ID NO: 391302 - DNA, 20 bp, Artificial
  CRISPR gRNA sequence
atcctgtgatgccacttatc

SEQ ID NO: 391303 - DNA, 20 bp, Artificial
  CRISPR gRNA sequence
tcctgtgatgccacttatcc

SEQ ID NO: 391304 - DNA, 20 bp, Artificial
  CRISPR gRNA sequence
tgatgccacttatcctgtga

SEQ ID NO: 391305 - DNA, 20 bp, Artificial
  CRISPR gRNA sequence
atcctgtgatatcacttatt

SEQ ID NO: 391306 - DNA, 20 bp, Artificial
  CRISPR gRNA sequence
tcctgtgatatcacttattc

SEQ ID NO: 391307 - DNA, 20 bp, Artificial
  CRISPR gRNA sequence
tgatatcacttattctgtga

SEQ ID NO: 391308 - DNA, 20 bp, Artificial
  CRISPR gRNA sequence
attctgtgacatcacctatt

SEQ ID NO: 391309 - DNA, 20 bp, Artificial
  CRISPR gRNA sequence
ttctgtgacatcacctattt

SEQ ID NO: 391310 - DNA, 20 bp, Artificial
  CRISPR gRNA sequence
tgtgacatcacctatttcaa

SEQ ID NO: 391311 - DNA, 20 bp, Artificial
  CRISPR gRNA sequence
tgacatcacctatttcaagg

SEQ ID NO: 391312 - DNA, 20 bp, Artificial
  CRISPR gRNA sequence
tttcaaggaagtattttctt

SEQ ID NO: 391313 - DNA, 20 bp, Artificial
  CRISPR gRNA sequence
caaggaagtattttcttact

SEQ ID NO: 391314 - DNA, 20 bp, Artificial
  CRISPR gRNA sequence
aaggaagtattttcttactc

SEQ ID NO: 391315 - DNA, 20 bp, Artificial
  CRISPR gRNA sequence
tcttactcatttcaaaatag

SEQ ID NO: 391316 - DNA, 20 bp, Artificial
  CRISPR gRNA sequence
cttactcatttcaaaatagg

SEQ ID NO: 391317 - DNA, 20 bp, Artificial
  CRISPR gRNA sequence
ttactcatttcaaaataggc

SEQ ID NO: 391318 - DNA, 20 bp, Artificial
  CRISPR gRNA sequence
actcatttcaaaataggcta

SEQ ID NO: 391319 - DNA, 20 bp, Artificial
  CRISPR gRNA sequence
ctcatttcaaaataggctaa

SEQ ID NO: 391320 - DNA, 20 bp, Artificial
  CRISPR gRNA sequence
atttcaaaataggctaacca

SEQ ID NO: 391321 - DNA, 20 bp, Artificial
  CRISPR gRNA sequence
caaaataggctaaccactcc

SEQ ID NO: 391322 - DNA, 20 bp, Artificial
  CRISPR gRNA sequence
aaaataggctaaccactccc

SEQ ID NO: 391323 - DNA, 20 bp, Artificial
  CRISPR gRNA sequence
accactccctcctctgtttt

SEQ ID NO: 391324 - DNA, 20 bp, Artificial
  CRISPR gRNA sequence
cctcctctgttttacctcta

SEQ ID NO: 391325 - DNA, 20 bp, Artificial
  CRISPR gRNA sequence
ctctgttttacctctacctt

SEQ ID NO: 391326 - DNA, 20 bp, Artificial
  CRISPR gRNA sequence
tgttttacctctaccttcta

SEQ ID NO: 391327 - DNA, 20 bp, Artificial
  CRISPR gRNA sequence
ttttacctctaccttctatt

SEQ ID NO: 391328 - DNA, 20 bp, Artificial
  CRISPR gRNA sequence
tacctctaccttctattgtg

SEQ ID NO: 391329 - DNA, 20 bp, Artificial
  CRISPR gRNA sequence
acctctaccttctattgtgt

SEQ ID NO: 391330 - DNA, 20 bp, Artificial
  CRISPR gRNA sequence
cctctaccttctattgtgtt

SEQ ID NO: 391331 - DNA, 20 bp, Artificial
  CRISPR gRNA sequence
taccttctattgtgttgttt

SEQ ID NO: 391332 - DNA, 20 bp, Artificial
  CRISPR gRNA sequence
ccttctattgtgttgttttt

SEQ ID NO: 391333 - DNA, 20 bp, Artificial
  CRISPR gRNA sequence
ctattgtgttgttttttatt

SEQ ID NO: 391334 - DNA, 20 bp, Artificial
  CRISPR gRNA sequence
tattgtgttgttttttattt

SEQ ID NO: 391335 - DNA, 20 bp, Artificial
  CRISPR gRNA sequence
ttgtgttgttttttatttgt

SEQ ID NO: 391336 - DNA, 20 bp, Artificial
  CRISPR gRNA sequence
tgttgttttttatttgttgt

SEQ ID NO: 391337 - DNA, 20 bp, Artificial
  CRISPR gRNA sequence
ttttttatttgttgtcattt

SEQ ID NO: 391338 - DNA, 20 bp, Artificial
  CRISPR gRNA sequence
tttatttgttgtcatttact

SEQ ID NO: 391339 - DNA, 20 bp, Artificial
  CRISPR gRNA sequence
ttatttgttgtcatttactt

SEQ ID NO: 391340 - DNA, 20 bp, Artificial
  CRISPR gRNA sequence
tatttgttgtcatttacttc

SEQ ID NO: 391341 - DNA, 20 bp, Artificial
  CRISPR gRNA sequence
atttgttgtcatttacttcc

SEQ ID NO: 391342 - DNA, 20 bp, Artificial
  CRISPR gRNA sequence
tttgttgtcatttacttcct

SEQ ID NO: 391343 - DNA, 20 bp, Artificial
  CRISPR gRNA sequence
gttgtcatttacttcctgcc

SEQ ID NO: 391344 - DNA, 20 bp, Artificial
  CRISPR gRNA sequence
ttgtcatttacttcctgccc

SEQ ID NO: 391345 - DNA, 20 bp, Artificial
  CRISPR gRNA sequence
tcatttacttcctgccctaa

SEQ ID NO: 391346 - DNA, 20 bp, Artificial
  CRISPR gRNA sequence
acttcctgccctaagaaact

SEQ ID NO: 391347 - DNA, 20 bp, Artificial
  CRISPR gRNA sequence
cttcctgccctaagaaacta

SEQ ID NO: 391348 - DNA, 20 bp, Artificial
  CRISPR gRNA sequence
cctgccctaagaaactatcc

SEQ ID NO: 391349 - DNA, 20 bp, Artificial
  CRISPR gRNA sequence
ctgccctaagaaactatcca

SEQ ID NO: 391350 - DNA, 20 bp, Artificial
  CRISPR gRNA sequence
ccctaagaaactatccactc

SEQ ID NO: 391351 - DNA, 20 bp, Artificial
  CRISPR gRNA sequence
agaaactatccactccttaa

SEQ ID NO: 391352 - DNA, 20 bp, Artificial
  CRISPR gRNA sequence
tccactccttaaagacattg

SEQ ID NO: 391353 - DNA, 20 bp, Artificial
  CRISPR gRNA sequence
cttaaagacattgtaccttc

SEQ ID NO: 391354 - DNA, 20 bp, Artificial
  CRISPR gRNA sequence
aaagacattgtaccttcagt

SEQ ID NO: 391355 - DNA, 20 bp, Artificial
  CRISPR gRNA sequence
aagacattgtaccttcagta

SEQ ID NO: 391356 - DNA, 20 bp, Artificial
  CRISPR gRNA sequence
taccttcagtatgtctaatc

SEQ ID NO: 391357 - DNA, 20 bp, Artificial
  CRISPR gRNA sequence
cagtatgtctaatcttagca

SEQ ID NO: 391358 - DNA, 20 bp, Artificial
  CRISPR gRNA sequence
agtatgtctaatcttagcaa

SEQ ID NO: 391359 - DNA, 20 bp, Artificial
  CRISPR gRNA sequence
atcttagcaaaatgccaggc

SEQ ID NO: 391360 - DNA, 20 bp, Artificial
  CRISPR gRNA sequence
agcaaaatgccaggcacatt

SEQ ID NO: 391361 - DNA, 20 bp, Artificial
  CRISPR gRNA sequence
gcaaaatgccaggcacatta

SEQ ID NO: 391362 - DNA, 20 bp, Artificial
  CRISPR gRNA sequence
agtttcccaataattttggg

SEQ ID NO: 391363 - DNA, 20 bp, Artificial
  CRISPR gRNA sequence
cccaataattttggggggac

SEQ ID NO: 391364 - DNA, 20 bp, Artificial
  CRISPR gRNA sequence
ccaataattttggggggact

SEQ ID NO: 391365 - DNA, 20 bp, Artificial
  CRISPR gRNA sequence
tggggggactacatggatga

SEQ ID NO: 391366 - DNA, 20 bp, Artificial
  CRISPR gRNA sequence
ggggggactacatggatgag

SEQ ID NO: 391367 - DNA, 20 bp, Artificial
  CRISPR gRNA sequence
gggggactacatggatgaga

SEQ ID NO: 391368 - DNA, 20 bp, Artificial
  CRISPR gRNA sequence
catggatgagaaaacatctc

SEQ ID NO: 391369 - DNA, 20 bp, Artificial
  CRISPR gRNA sequence
caaagatgatgtgttgtaaa

SEQ ID NO: 391370 - DNA, 20 bp, Artificial
  CRISPR gRNA sequence
taaatttagtgaatgatacc

SEQ ID NO: 391371 - DNA, 20 bp, Artificial
  CRISPR gRNA sequence
agtgaatgataccaggaact

SEQ ID NO: 391372 - DNA, 20 bp, Artificial
  CRISPR gRNA sequence
gtgaatgataccaggaactc

SEQ ID NO: 391373 - DNA, 20 bp, Artificial
  CRISPR gRNA sequence
agagcaatattttccagtcc

SEQ ID NO: 391374 - DNA, 20 bp, Artificial
  CRISPR gRNA sequence
tccagtccaggccctacatg

SEQ ID NO: 391375 - DNA, 20 bp, Artificial
  CRISPR gRNA sequence
ccagtccaggccctacatga

SEQ ID NO: 391376 - DNA, 20 bp, Artificial
  CRISPR gRNA sequence
cagtccaggccctacatgag

SEQ ID NO: 391377 - DNA, 20 bp, Artificial
  CRISPR gRNA sequence
catgagtttgggtctccatt

SEQ ID NO: 391378 - DNA, 20 bp, Artificial
  CRISPR gRNA sequence
gggtctccattcccacttct

SEQ ID NO: 391379 - DNA, 20 bp, Artificial
  CRISPR gRNA sequence
ggtctccattcccacttctg

SEQ ID NO: 391380 - DNA, 20 bp, Artificial
  CRISPR gRNA sequence
cattcccacttctgccaaat

SEQ ID NO: 391381 - DNA, 20 bp, Artificial
  CRISPR gRNA sequence
ccacttctgccaaatggaaa

SEQ ID NO: 391382 - DNA, 20 bp, Artificial
  CRISPR gRNA sequence
ctgccaaatggaaacccaca

SEQ ID NO: 391383 - DNA, 20 bp, Artificial
  CRISPR gRNA sequence
tgccaaatggaaacccacac

SEQ ID NO: 391384 - DNA, 20 bp, Artificial
  CRISPR gRNA sequence
ccaaatggaaacccacacag

SEQ ID NO: 391385 - DNA, 20 bp, Artificial
  CRISPR gRNA sequence
tccctcctggcaccactcac

SEQ ID NO: 391386 - DNA, 20 bp, Artificial
  CRISPR gRNA sequence
ccctcctggcaccactcacc

SEQ ID NO: 391387 - DNA, 20 bp, Artificial
  CRISPR gRNA sequence
cctcctggcaccactcaccc

SEQ ID NO: 391388 - DNA, 20 bp, Artificial
  CRISPR gRNA sequence
ctggcaccactcacccctga

SEQ ID NO: 391389 - DNA, 20 bp, Artificial
  CRISPR gRNA sequence
gcaccactcacccctgagca

SEQ ID NO: 391390 - DNA, 20 bp, Artificial
  CRISPR gRNA sequence
acccctgagcatcagccagc

SEQ ID NO: 391391 - DNA, 20 bp, Artificial
  CRISPR gRNA sequence
agcatcagccagcactgcaa

SEQ ID NO: 391392 - DNA, 20 bp, Artificial
  CRISPR gRNA sequence
caaatttatggttttaatac

SEQ ID NO: 391393 - DNA, 20 bp, Artificial
  CRISPR gRNA sequence
atggttttaataccaactct

SEQ ID NO: 391394 - DNA, 20 bp, Artificial
  CRISPR gRNA sequence
tggttttaataccaactctc

SEQ ID NO: 391395 - DNA, 20 bp, Artificial
  CRISPR gRNA sequence
taataccaactctccaaaga

SEQ ID NO: 391396 - DNA, 20 bp, Artificial
  CRISPR gRNA sequence
aataccaactctccaaagag

SEQ ID NO: 391397 - DNA, 20 bp, Artificial
  CRISPR gRNA sequence
ataccaactctccaaagagc

SEQ ID NO: 391398 - DNA, 20 bp, Artificial
  CRISPR gRNA sequence
tccaaagagctccaggtgct

SEQ ID NO: 391399 - DNA, 20 bp, Artificial
  CRISPR gRNA sequence
caaagagctccaggtgcttt

SEQ ID NO: 391400 - DNA, 20 bp, Artificial
  CRISPR gRNA sequence
caggtgcttttcaaaccaca

SEQ ID NO: 391401 - DNA, 20 bp, Artificial
  CRISPR gRNA sequence
ttcaaaccacagaaagatca

SEQ ID NO: 391402 - DNA, 20 bp, Artificial
  CRISPR gRNA sequence
tcaaaccacagaaagatcaa

SEQ ID NO: 391403 - DNA, 20 bp, Artificial
  CRISPR gRNA sequence
caaaccacagaaagatcaac

SEQ ID NO: 391404 - DNA, 20 bp, Artificial
  CRISPR gRNA sequence
aaaccacagaaagatcaaca

SEQ ID NO: 391405 - DNA, 20 bp, Artificial
  CRISPR gRNA sequence
ctcacaactccctgaggtag

SEQ ID NO: 391406 - DNA, 20 bp, Artificial
  CRISPR gRNA sequence
tcacaactccctgaggtaga

SEQ ID NO: 391407 - DNA, 20 bp, Artificial
  CRISPR gRNA sequence
acaactccctgaggtagaag

SEQ ID NO: 391408 - DNA, 20 bp, Artificial
  CRISPR gRNA sequence
cctgaggtagaagaggctga

SEQ ID NO: 391409 - DNA, 20 bp, Artificial
  CRISPR gRNA sequence
aggtagaagaggctgaaatt

SEQ ID NO: 391410 - DNA, 20 bp, Artificial
  CRISPR gRNA sequence
aaattatttagttcaaacca

SEQ ID NO: 391411 - DNA, 20 bp, Artificial
  CRISPR gRNA sequence
tttagttcaaaccataatga

SEQ ID NO: 391412 - DNA, 20 bp, Artificial
  CRISPR gRNA sequence
agttcaaaccataatgaagt

SEQ ID NO: 391413 - DNA, 20 bp, Artificial
  CRISPR gRNA sequence
gttcaaaccataatgaagtt

SEQ ID NO: 391414 - DNA, 20 bp, Artificial
  CRISPR gRNA sequence
aaaccataatgaagttaaaa

SEQ ID NO: 391415 - DNA, 20 bp, Artificial
  CRISPR gRNA sequence
aaatgaaaaatataacaata

SEQ ID NO: 391416 - DNA, 20 bp, Artificial
  CRISPR gRNA sequence
aaaaaccagtgtgagtacag

SEQ ID NO: 391417 - DNA, 20 bp, Artificial
  CRISPR gRNA sequence
ttagcagggatagttgtaat

SEQ ID NO: 391418 - DNA, 20 bp, Artificial
  CRISPR gRNA sequence
gcagggatagttgtaatcat

SEQ ID NO: 391419 - DNA, 20 bp, Artificial
  CRISPR gRNA sequence
taatcatcacatcgattcag

SEQ ID NO: 391420 - DNA, 20 bp, Artificial
  CRISPR gRNA sequence
agaaaagcaagtagcccaga

SEQ ID NO: 391421 - DNA, 20 bp, Artificial
  CRISPR gRNA sequence
acagcaagagggaaacaaga

SEQ ID NO: 391422 - DNA, 20 bp, Artificial
  CRISPR gRNA sequence
attttggatttgcaatgaaa

SEQ ID NO: 391423 - DNA, 20 bp, Artificial
  CRISPR gRNA sequence
ttttggatttgcaatgaaat

SEQ ID NO: 391424 - DNA, 20 bp, Artificial
  CRISPR gRNA sequence
tggatttgcaatgaaatttg

SEQ ID NO: 391425 - DNA, 20 bp, Artificial
  CRISPR gRNA sequence
ggatttgcaatgaaatttgg

SEQ ID NO: 391426 - DNA, 20 bp, Artificial
  CRISPR gRNA sequence
gatttgcaatgaaatttggg

SEQ ID NO: 391427 - DNA, 20 bp, Artificial
  CRISPR gRNA sequence
gcaatgaaatttgggaatta

SEQ ID NO: 391428 - DNA, 20 bp, Artificial
  CRISPR gRNA sequence
caatgaaatttgggaattaa

SEQ ID NO: 391429 - DNA, 20 bp, Artificial
  CRISPR gRNA sequence
gggaattaaaggagataata

SEQ ID NO: 391430 - DNA, 20 bp, Artificial
  CRISPR gRNA sequence
ggaattaaaggagataataa

SEQ ID NO: 391431 - DNA, 20 bp, Artificial
  CRISPR gRNA sequence
aaggagataataatacatgt

SEQ ID NO: 391432 - DNA, 20 bp, Artificial
  CRISPR gRNA sequence
agcatttaatttgtgttctt

SEQ ID NO: 391433 - DNA, 20 bp, Artificial
  CRISPR gRNA sequence
aatttgtgttctttatacgt

SEQ ID NO: 391434 - DNA, 20 bp, Artificial
  CRISPR gRNA sequence
atttgtgttctttatacgtc

SEQ ID NO: 391435 - DNA, 20 bp, Artificial
  CRISPR gRNA sequence
gtgttctttatacgtcagag

SEQ ID NO: 391436 - DNA, 20 bp, Artificial
  CRISPR gRNA sequence
tgttctttatacgtcagagg

SEQ ID NO: 391437 - DNA, 20 bp, Artificial
  CRISPR gRNA sequence
tttatacgtcagaggaaatg

SEQ ID NO: 391438 - DNA, 20 bp, Artificial
  CRISPR gRNA sequence
tatacgtcagaggaaatgtc

SEQ ID NO: 391439 - DNA, 20 bp, Artificial
  CRISPR gRNA sequence
atacgtcagaggaaatgtct

SEQ ID NO: 391440 - DNA, 20 bp, Artificial
  CRISPR gRNA sequence
tacgtcagaggaaatgtctg

SEQ ID NO: 391441 - DNA, 20 bp, Artificial
  CRISPR gRNA sequence
caaattaatcctacgcaaca

SEQ ID NO: 391442 - DNA, 20 bp, Artificial
  CRISPR gRNA sequence
atcctacgcaacaataattc

SEQ ID NO: 391443 - DNA, 20 bp, Artificial
  CRISPR gRNA sequence
cgcaacaataattctgtaaa

SEQ ID NO: 391444 - DNA, 20 bp, Artificial
  CRISPR gRNA sequence
tgtaaagcattacatatgtg

SEQ ID NO: 391445 - DNA, 20 bp, Artificial
  CRISPR gRNA sequence
taaagcattacatatgtgaa

SEQ ID NO: 391446 - DNA, 20 bp, Artificial
  CRISPR gRNA sequence
catatgtgaagatgactaca

SEQ ID NO: 391447 - DNA, 20 bp, Artificial
  CRISPR gRNA sequence
caccaagcattagttgaaat

SEQ ID NO: 391448 - DNA, 20 bp, Artificial
  CRISPR gRNA sequence
gttgaaatagagaatattgg

SEQ ID NO: 391449 - DNA, 20 bp, Artificial
  CRISPR gRNA sequence
aaatagagaatattggaaag

SEQ ID NO: 391450 - DNA, 20 bp, Artificial
  CRISPR gRNA sequence
gaaagaatctaaatgtccag

SEQ ID NO: 391451 - DNA, 20 bp, Artificial
  CRISPR gRNA sequence
aatgtccagaaacttaacaa

SEQ ID NO: 391452 - DNA, 20 bp, Artificial
  CRISPR gRNA sequence
aacaaggtgaagcaaatcat

SEQ ID NO: 391453 - DNA, 20 bp, Artificial
  CRISPR gRNA sequence
acaaggtgaagcaaatcatg

SEQ ID NO: 391454 - DNA, 20 bp, Artificial
  CRISPR gRNA sequence
tcagtattggaaatgcttat

SEQ ID NO: 391455 - DNA, 20 bp, Artificial
  CRISPR gRNA sequence
gaaatgcttatgacataatg

SEQ ID NO: 391456 - DNA, 20 bp, Artificial
  CRISPR gRNA sequence
atgacataatgtacagaaaa

SEQ ID NO: 391457 - DNA, 20 bp, Artificial
  CRISPR gRNA sequence
tgacataatgtacagaaaaa

SEQ ID NO: 391458 - DNA, 20 bp, Artificial
  CRISPR gRNA sequence
tcaatgacatgtatgtacac

SEQ ID NO: 391459 - DNA, 20 bp, Artificial
  CRISPR gRNA sequence
tgctaacagttagaacatgt

SEQ ID NO: 391460 - DNA, 20 bp, Artificial
  CRISPR gRNA sequence
gctaacagttagaacatgtg

SEQ ID NO: 391461 - DNA, 20 bp, Artificial
  CRISPR gRNA sequence
ctaacagttagaacatgtgt

SEQ ID NO: 391462 - DNA, 20 bp, Artificial
  CRISPR gRNA sequence
acagttagaacatgtgtgtg

SEQ ID NO: 391463 - DNA, 20 bp, Artificial
  CRISPR gRNA sequence
gaacatgtgtgtgctctgaa

SEQ ID NO: 391464 - DNA, 20 bp, Artificial
  CRISPR gRNA sequence
tgaatgagagttgaacagga

SEQ ID NO: 391465 - DNA, 20 bp, Artificial
  CRISPR gRNA sequence
aatgagagttgaacaggaaa

SEQ ID NO: 391466 - DNA, 20 bp, Artificial
  CRISPR gRNA sequence
aacaggaaacgggaagagga

SEQ ID NO: 391467 - DNA, 20 bp, Artificial
  CRISPR gRNA sequence
aacttttttcatttatttct

SEQ ID NO: 391468 - DNA, 20 bp, Artificial
  CRISPR gRNA sequence
ttttcatttatttctcttat

SEQ ID NO: 391469 - DNA, 20 bp, Artificial
  CRISPR gRNA sequence
tttcatttatttctcttatg

SEQ ID NO: 391470 - DNA, 20 bp, Artificial
  CRISPR gRNA sequence
ttcatttatttctcttatgc

SEQ ID NO: 391471 - DNA, 20 bp, Artificial
  CRISPR gRNA sequence
tcatttatttctcttatgca

SEQ ID NO: 391472 - DNA, 20 bp, Artificial
  CRISPR gRNA sequence
catttatttctcttatgcat

SEQ ID NO: 391473 - DNA, 20 bp, Artificial
  CRISPR gRNA sequence
atttatttctcttatgcatt

SEQ ID NO: 391474 - DNA, 20 bp, Artificial
  CRISPR gRNA sequence
atttctcttatgcattttaa

SEQ ID NO: 391475 - DNA, 20 bp, Artificial
  CRISPR gRNA sequence
tttctcttatgcattttaaa

SEQ ID NO: 391476 - DNA, 20 bp, Artificial
  CRISPR gRNA sequence
ctcttatgcattttaaaatt

SEQ ID NO: 391477 - DNA, 20 bp, Artificial
  CRISPR gRNA sequence
tcttatgcattttaaaattt

SEQ ID NO: 391478 - DNA, 20 bp, Artificial
  CRISPR gRNA sequence
ttatgcattttaaaatttct

SEQ ID NO: 391479 - DNA, 20 bp, Artificial
  CRISPR gRNA sequence
atgcattttaaaatttctgt

SEQ ID NO: 391480 - DNA, 20 bp, Artificial
  CRISPR gRNA sequence
tgcattttaaaatttctgta

SEQ ID NO: 391481 - DNA, 20 bp, Artificial
  CRISPR gRNA sequence
taaaatttctgtaaatgttg

SEQ ID NO: 391482 - DNA, 20 bp, Artificial
  CRISPR gRNA sequence
aaaatttctgtaaatgttgt

SEQ ID NO: 391483 - DNA, 20 bp, Artificial
  CRISPR gRNA sequence
aaatttctgtaaatgttgtt

SEQ ID NO: 391484 - DNA, 20 bp, Artificial
  CRISPR gRNA sequence
ctgtaaatgttgttttgata

SEQ ID NO: 391485 - DNA, 20 bp, Artificial
  CRISPR gRNA sequence
tgtaaatgttgttttgatac

SEQ ID NO: 391486 - DNA, 20 bp, Artificial
  CRISPR gRNA sequence
taaatgttgttttgatactc

SEQ ID NO: 391487 - DNA, 20 bp, Artificial
  CRISPR gRNA sequence
ttttgatactcttggtgcac

SEQ ID NO: 391488 - DNA, 20 bp, Artificial
  CRISPR gRNA sequence
tgatactcttggtgcactgt

SEQ ID NO: 391489 - DNA, 20 bp, Artificial
  CRISPR gRNA sequence
gatactcttggtgcactgtg

SEQ ID NO: 391490 - DNA, 20 bp, Artificial
  CRISPR gRNA sequence
atactcttggtgcactgtgt

SEQ ID NO: 391491 - DNA, 20 bp, Artificial
  CRISPR gRNA sequence
ttggtgcactgtgttagtag

SEQ ID NO: 391492 - DNA, 20 bp, Artificial
  CRISPR gRNA sequence
ggtgcactgtgttagtagtt

SEQ ID NO: 391493 - DNA, 20 bp, Artificial
  CRISPR gRNA sequence
gtgcactgtgttagtagttt

SEQ ID NO: 391494 - DNA, 20 bp, Artificial
  CRISPR gRNA sequence
tgttagtagttttctaaaga

SEQ ID NO: 391495 - DNA, 20 bp, Artificial
  CRISPR gRNA sequence
gtagttttctaaagaaggag

SEQ ID NO: 391496 - DNA, 20 bp, Artificial
  CRISPR gRNA sequence
tctaaagaaggaggcagccc

SEQ ID NO: 391497 - DNA, 20 bp, Artificial
  CRISPR gRNA sequence
ctaaagaaggaggcagccct

SEQ ID NO: 391498 - DNA, 20 bp, Artificial
  CRISPR gRNA sequence
taaagaaggaggcagccctg

SEQ ID NO: 391499 - DNA, 20 bp, Artificial
  CRISPR gRNA sequence
aagaaggaggcagccctgtg

SEQ ID NO: 391500 - DNA, 20 bp, Artificial
  CRISPR gRNA sequence
tgaggatgggcacaccttgg

SEQ ID NO: 391501 - DNA, 20 bp, Artificial
  CRISPR gRNA sequence
ggagacttgcgtccaaagac

SEQ ID NO: 391502 - DNA, 20 bp, Artificial
  CRISPR gRNA sequence
gagacttgcgtccaaagact

SEQ ID NO: 391503 - DNA, 20 bp, Artificial
  CRISPR gRNA sequence
gcgtccaaagactagaacac

SEQ ID NO: 391504 - DNA, 20 bp, Artificial
  CRISPR gRNA sequence
cgtccaaagactagaacaca

SEQ ID NO: 391505 - DNA, 20 bp, Artificial
  CRISPR gRNA sequence
gaacacagaaaggagaaata

SEQ ID NO: 391506 - DNA, 20 bp, Artificial
  CRISPR gRNA sequence
gacttcacagtgggaaaacg

SEQ ID NO: 391507 - DNA, 20 bp, Artificial
  CRISPR gRNA sequence
acttcacagtgggaaaacgt

SEQ ID NO: 391508 - DNA, 20 bp, Artificial
  CRISPR gRNA sequence
cacagtgggaaaacgtggca

SEQ ID NO: 391509 - DNA, 20 bp, Artificial
  CRISPR gRNA sequence
acagtgggaaaacgtggcaa

SEQ ID NO: 391510 - DNA, 20 bp, Artificial
  CRISPR gRNA sequence
aaccacatgatggagaccaa

SEQ ID NO: 391511 - DNA, 20 bp, Artificial
  CRISPR gRNA sequence
accacatgatggagaccaac

SEQ ID NO: 391512 - DNA, 20 bp, Artificial
  CRISPR gRNA sequence
agtgacgctgcgtggatatg

SEQ ID NO: 391513 - DNA, 20 bp, Artificial
  CRISPR gRNA sequence
cgtggatatgaggtacccct

SEQ ID NO: 391514 - DNA, 20 bp, Artificial
  CRISPR gRNA sequence
gatatgatgtgatgagaagg

SEQ ID NO: 391515 - DNA, 20 bp, Artificial
  CRISPR gRNA sequence
atatgatgtgatgagaaggg

SEQ ID NO: 391516 - DNA, 20 bp, Artificial
  CRISPR gRNA sequence
atgactctggtattctttcc

SEQ ID NO: 391517 - DNA, 20 bp, Artificial
  CRISPR gRNA sequence
tggtattctttccaaaattc

SEQ ID NO: 391518 - DNA, 20 bp, Artificial
  CRISPR gRNA sequence
gtattctttccaaaattcca

SEQ ID NO: 391519 - DNA, 20 bp, Artificial
  CRISPR gRNA sequence
tttccaaaattccatattcc

SEQ ID NO: 391520 - DNA, 20 bp, Artificial
  CRISPR gRNA sequence
tccaaaattccatattccca

SEQ ID NO: 391521 - DNA, 20 bp, Artificial
  CRISPR gRNA sequence
ccaaaattccatattcccag

SEQ ID NO: 391522 - DNA, 20 bp, Artificial
  CRISPR gRNA sequence
caaaattccatattcccagt

SEQ ID NO: 391523 - DNA, 20 bp, Artificial
  CRISPR gRNA sequence
catattcccagtctaatcat

SEQ ID NO: 391524 - DNA, 20 bp, Artificial
  CRISPR gRNA sequence
ccagtctaatcatgagtgaa

SEQ ID NO: 391525 - DNA, 20 bp, Artificial
  CRISPR gRNA sequence
atcatgagtgaaacatcaga

SEQ ID NO: 391526 - DNA, 20 bp, Artificial
  CRISPR gRNA sequence
attgggagatgctctgcagg

SEQ ID NO: 391527 - DNA, 20 bp, Artificial
  CRISPR gRNA sequence
ggagatgctctgcaggacac

SEQ ID NO: 391528 - DNA, 20 bp, Artificial
  CRISPR gRNA sequence
tgcaggacactgggctagta

SEQ ID NO: 391529 - DNA, 20 bp, Artificial
  CRISPR gRNA sequence
caggacactgggctagtatt

SEQ ID NO: 391530 - DNA, 20 bp, Artificial
  CRISPR gRNA sequence
ggctagtattcctcaggcct

SEQ ID NO: 391531 - DNA, 20 bp, Artificial
  CRISPR gRNA sequence
gtattcctcaggcctcacag

SEQ ID NO: 391532 - DNA, 20 bp, Artificial
  CRISPR gRNA sequence
ctcaggcctcacagggttgt

SEQ ID NO: 391533 - DNA, 20 bp, Artificial
  CRISPR gRNA sequence
aggcctcacagggttgtgaa

SEQ ID NO: 391534 - DNA, 20 bp, Artificial
  CRISPR gRNA sequence
acagggttgtgaaaagcaag

SEQ ID NO: 391535 - DNA, 20 bp, Artificial
  CRISPR gRNA sequence
tgaaaagcaaggagagatag

SEQ ID NO: 391536 - DNA, 20 bp, Artificial
  CRISPR gRNA sequence
tcacagatcagaggaaactg

SEQ ID NO: 391537 - DNA, 20 bp, Artificial
  CRISPR gRNA sequence
gggagaagtggcaactcaat

SEQ ID NO: 391538 - DNA, 20 bp, Artificial
  CRISPR gRNA sequence
aatgcaatgtggtggcctgg

SEQ ID NO: 391539 - DNA, 20 bp, Artificial
  CRISPR gRNA sequence
gtggaggagaccctggaaag

SEQ ID NO: 391540 - DNA, 20 bp, Artificial
  CRISPR gRNA sequence
gaaaggaaagaggacaaaac

SEQ ID NO: 391541 - DNA, 20 bp, Artificial
  CRISPR gRNA sequence
tggatccaaataaagtctag

SEQ ID NO: 391542 - DNA, 20 bp, Artificial
  CRISPR gRNA sequence
ggatccaaataaagtctaga

SEQ ID NO: 391543 - DNA, 20 bp, Artificial
  CRISPR gRNA sequence
gatccaaataaagtctagag

SEQ ID NO: 391544 - DNA, 20 bp, Artificial
  CRISPR gRNA sequence
gagctgagttaacggtagta

SEQ ID NO: 391545 - DNA, 20 bp, Artificial
  CRISPR gRNA sequence
agttaacggtagtatactag

SEQ ID NO: 391546 - DNA, 20 bp, Artificial
  CRISPR gRNA sequence
acggtagtatactagtttca

SEQ ID NO: 391547 - DNA, 20 bp, Artificial
  CRISPR gRNA sequence
gtttcagtttctttggttta

SEQ ID NO: 391548 - DNA, 20 bp, Artificial
  CRISPR gRNA sequence
cagtttctttggtttaacaa

SEQ ID NO: 391549 - DNA, 20 bp, Artificial
  CRISPR gRNA sequence
agtttctttggtttaacaaa

SEQ ID NO: 391550 - DNA, 20 bp, Artificial
  CRISPR gRNA sequence
ctttggtttaacaaacatac

SEQ ID NO: 391551 - DNA, 20 bp, Artificial
  CRISPR gRNA sequence
tttggtttaacaaacatacc

SEQ ID NO: 391552 - DNA, 20 bp, Artificial
  CRISPR gRNA sequence
tggtttaacaaacataccac

SEQ ID NO: 391553 - DNA, 20 bp, Artificial
  CRISPR gRNA sequence
ggtttaacaaacataccaca

SEQ ID NO: 391554 - DNA, 20 bp, Artificial
  CRISPR gRNA sequence
gtttaacaaacataccacaa

SEQ ID NO: 391555 - DNA, 20 bp, Artificial
  CRISPR gRNA sequence
aacaaacataccacaataat

SEQ ID NO: 391556 - DNA, 20 bp, Artificial
  CRISPR gRNA sequence
acaaacataccacaataatg

SEQ ID NO: 391557 - DNA, 20 bp, Artificial
  CRISPR gRNA sequence
acaatgggggagactggata

SEQ ID NO: 391558 - DNA, 20 bp, Artificial
  CRISPR gRNA sequence
gataaggggtatatggaaac

SEQ ID NO: 391559 - DNA, 20 bp, Artificial
  CRISPR gRNA sequence
tctgtactagtttttccact

SEQ ID NO: 391560 - DNA, 20 bp, Artificial
  CRISPR gRNA sequence
tactagtttttccacttttc

SEQ ID NO: 391561 - DNA, 20 bp, Artificial
  CRISPR gRNA sequence
gtttttccacttttctgtaa

SEQ ID NO: 391562 - DNA, 20 bp, Artificial
  CRISPR gRNA sequence
ttccacttttctgtaaatct

SEQ ID NO: 391563 - DNA, 20 bp, Artificial
  CRISPR gRNA sequence
tccacttttctgtaaatcta

SEQ ID NO: 391564 - DNA, 20 bp, Artificial
  CRISPR gRNA sequence
ccacttttctgtaaatctaa

SEQ ID NO: 391565 - DNA, 20 bp, Artificial
  CRISPR gRNA sequence
cacttttctgtaaatctaaa

SEQ ID NO: 391566 - DNA, 20 bp, Artificial
  CRISPR gRNA sequence
ttctgtaaatctaaaaatat

SEQ ID NO: 391567 - DNA, 20 bp, Artificial
  CRISPR gRNA sequence
tctgtaaatctaaaaatatt

SEQ ID NO: 391568 - DNA, 20 bp, Artificial
  CRISPR gRNA sequence
ctgtaaatctaaaaatattc

SEQ ID NO: 391569 - DNA, 20 bp, Artificial
  CRISPR gRNA sequence
tgtaaatctaaaaatattct

SEQ ID NO: 391570 - DNA, 20 bp, Artificial
  CRISPR gRNA sequence
taaatctaaaaatattctaa

SEQ ID NO: 391571 - DNA, 20 bp, Artificial
  CRISPR gRNA sequence
aaaatattctaaaatttaaa

SEQ ID NO: 391572 - DNA, 20 bp, Artificial
  CRISPR gRNA sequence
taaaatttaaagattattag

SEQ ID NO: 391573 - DNA, 20 bp, Artificial
  CRISPR gRNA sequence
aaatttaaagattattagaa

SEQ ID NO: 391574 - DNA, 20 bp, Artificial
  CRISPR gRNA sequence
aaagattattagaagggtaa

SEQ ID NO: 391575 - DNA, 20 bp, Artificial
  CRISPR gRNA sequence
aagattattagaagggtaag

SEQ ID NO: 391576 - DNA, 20 bp, Artificial
  CRISPR gRNA sequence
ttagaagggtaagagggcca

SEQ ID NO: 391577 - DNA, 20 bp, Artificial
  CRISPR gRNA sequence
gaagggtaagagggccagat

SEQ ID NO: 391578 - DNA, 20 bp, Artificial
  CRISPR gRNA sequence
gggagtctataaaagaaaag

SEQ ID NO: 391579 - DNA, 20 bp, Artificial
  CRISPR gRNA sequence
ggagtctataaaagaaaaga

SEQ ID NO: 391580 - DNA, 20 bp, Artificial
  CRISPR gRNA sequence
taaaagaaaagaaacacaag

SEQ ID NO: 391581 - DNA, 20 bp, Artificial
  CRISPR gRNA sequence
ttgcaacaccatcttgagtg

SEQ ID NO: 391582 - DNA, 20 bp, Artificial
  CRISPR gRNA sequence
tgcaacaccatcttgagtgg

SEQ ID NO: 391583 - DNA, 20 bp, Artificial
  CRISPR gRNA sequence
gcaacaccatcttgagtggt

SEQ ID NO: 391584 - DNA, 20 bp, Artificial
  CRISPR gRNA sequence
caacaccatcttgagtggta

SEQ ID NO: 391585 - DNA, 20 bp, Artificial
  CRISPR gRNA sequence
gagtggtacaaggcaatgga

SEQ ID NO: 391586 - DNA, 20 bp, Artificial
  CRISPR gRNA sequence
agtggtacaaggcaatggag

SEQ ID NO: 391587 - DNA, 20 bp, Artificial
  CRISPR gRNA sequence
ggactacactgcagtcggtt

SEQ ID NO: 391588 - DNA, 20 bp, Artificial
  CRISPR gRNA sequence
cactgcagtcggttaggaaa

SEQ ID NO: 391589 - DNA, 20 bp, Artificial
  CRISPR gRNA sequence
cagtcggttaggaaagagga

SEQ ID NO: 391590 - DNA, 20 bp, Artificial
  CRISPR gRNA sequence
ggaaagaggaataataatga

SEQ ID NO: 391591 - DNA, 20 bp, Artificial
  CRISPR gRNA sequence
tcatgggtggaaccgaggcc

SEQ ID NO: 391592 - DNA, 20 bp, Artificial
  CRISPR gRNA sequence
atgggtggaaccgaggccat

SEQ ID NO: 391593 - DNA, 20 bp, Artificial
  CRISPR gRNA sequence
ggtgttggcgaagtgagtta

SEQ ID NO: 391594 - DNA, 20 bp, Artificial
  CRISPR gRNA sequence
gcgaagtgagttagctcaac

SEQ ID NO: 391595 - DNA, 20 bp, Artificial
  CRISPR gRNA sequence
gctcaacatactggtgcaca

SEQ ID NO: 391596 - DNA, 20 bp, Artificial
  CRISPR gRNA sequence
aacatactggtgcacaagaa

SEQ ID NO: 391597 - DNA, 20 bp, Artificial
  CRISPR gRNA sequence
gtgcacaagaaacaatgtta

SEQ ID NO: 391598 - DNA, 20 bp, Artificial
  CRISPR gRNA sequence
attgaaatggtccaacattt

SEQ ID NO: 391599 - DNA, 20 bp, Artificial
  CRISPR gRNA sequence
aaatggtccaacattttgct

SEQ ID NO: 391600 - DNA, 20 bp, Artificial
  CRISPR gRNA sequence
tgctagctaaaaagtataaa

SEQ ID NO: 391601 - DNA, 20 bp, Artificial
  CRISPR gRNA sequence
gctagctaaaaagtataaat

SEQ ID NO: 391602 - DNA, 20 bp, Artificial
  CRISPR gRNA sequence
ctagctaaaaagtataaatt

SEQ ID NO: 391603 - DNA, 20 bp, Artificial
  CRISPR gRNA sequence
gctaaaaagtataaatttct

SEQ ID NO: 391604 - DNA, 20 bp, Artificial
  CRISPR gRNA sequence
aaaagtataaatttctctgt

SEQ ID NO: 391605 - DNA, 20 bp, Artificial
  CRISPR gRNA sequence
ctctgtcttccttgagatag

SEQ ID NO: 391606 - DNA, 20 bp, Artificial
  CRISPR gRNA sequence
tctgtcttccttgagatagg

SEQ ID NO: 391607 - DNA, 20 bp, Artificial
  CRISPR gRNA sequence
tgtcttccttgagataggtc

SEQ ID NO: 391608 - DNA, 20 bp, Artificial
  CRISPR gRNA sequence
tcttccttgagataggtcca

SEQ ID NO: 391609 - DNA, 20 bp, Artificial
  CRISPR gRNA sequence
ccttgagataggtccatgtt

SEQ ID NO: 391610 - DNA, 20 bp, Artificial
  CRISPR gRNA sequence
cttgagataggtccatgttg

SEQ ID NO: 391611 - DNA, 20 bp, Artificial
  CRISPR gRNA sequence
gagataggtccatgttggca

SEQ ID NO: 391612 - DNA, 20 bp, Artificial
  CRISPR gRNA sequence
agataggtccatgttggcac

SEQ ID NO: 391613 - DNA, 20 bp, Artificial
  CRISPR gRNA sequence
gcacatgtgagttaatctta

SEQ ID NO: 391614 - DNA, 20 bp, Artificial
  CRISPR gRNA sequence
atcttattttttgaagtgag

SEQ ID NO: 391615 - DNA, 20 bp, Artificial
  CRISPR gRNA sequence
attttttgaagtgagtactg

SEQ ID NO: 391616 - DNA, 20 bp, Artificial
  CRISPR gRNA sequence
ttttttgaagtgagtactgt

SEQ ID NO: 391617 - DNA, 20 bp, Artificial
  CRISPR gRNA sequence
tttgaagtgagtactgtcaa

SEQ ID NO: 391618 - DNA, 20 bp, Artificial
  CRISPR gRNA sequence
ttgaagtgagtactgtcaaa

SEQ ID NO: 391619 - DNA, 20 bp, Artificial
  CRISPR gRNA sequence
tgaagtgagtactgtcaaaa

SEQ ID NO: 391620 - DNA, 20 bp, Artificial
  CRISPR gRNA sequence
gaagtgagtactgtcaaaaa

SEQ ID NO: 391621 - DNA, 20 bp, Artificial
  CRISPR gRNA sequence
aagtgagtactgtcaaaaaa

SEQ ID NO: 391622 - DNA, 20 bp, Artificial
  CRISPR gRNA sequence
tcaaaaaactcagagaaggc

SEQ ID NO: 391623 - DNA, 20 bp, Artificial
  CRISPR gRNA sequence
agagaaggcttcagtggaac

SEQ ID NO: 391624 - DNA, 20 bp, Artificial
  CRISPR gRNA sequence
cagtggaacaggtttggggt

SEQ ID NO: 391625 - DNA, 20 bp, Artificial
  CRISPR gRNA sequence
agtggaacaggtttggggtg

SEQ ID NO: 391626 - DNA, 20 bp, Artificial
  CRISPR gRNA sequence
ggggtgctggagattgccac

SEQ ID NO: 391627 - DNA, 20 bp, Artificial
  CRISPR gRNA sequence
gggtgctggagattgccaca

SEQ ID NO: 391628 - DNA, 20 bp, Artificial
  CRISPR gRNA sequence
gagattgccacagagcccca

SEQ ID NO: 391629 - DNA, 20 bp, Artificial
  CRISPR gRNA sequence
ccacagagccccatctttcc

SEQ ID NO: 391630 - DNA, 20 bp, Artificial
  CRISPR gRNA sequence
tcccttgaggaagggtaata

SEQ ID NO: 391631 - DNA, 20 bp, Artificial
  CRISPR gRNA sequence
cccttgaggaagggtaatag

SEQ ID NO: 391632 - DNA, 20 bp, Artificial
  CRISPR gRNA sequence
ccttgaggaagggtaataga

SEQ ID NO: 391633 - DNA, 20 bp, Artificial
  CRISPR gRNA sequence
gaggaagggtaatagagtgg

SEQ ID NO: 391634 - DNA, 20 bp, Artificial
  CRISPR gRNA sequence
aggaagggtaatagagtgga

SEQ ID NO: 391635 - DNA, 20 bp, Artificial
  CRISPR gRNA sequence
gcaaagagcaactgaacacc

SEQ ID NO: 391636 - DNA, 20 bp, Artificial
  CRISPR gRNA sequence
aacaccggcatcctttctcc

SEQ ID NO: 391637 - DNA, 20 bp, Artificial
  CRISPR gRNA sequence
tctccaaatgctgacattta

SEQ ID NO: 391638 - DNA, 20 bp, Artificial
  CRISPR gRNA sequence
ctccaaatgctgacatttat

SEQ ID NO: 391639 - DNA, 20 bp, Artificial
  CRISPR gRNA sequence
tccaaatgctgacatttatc

SEQ ID NO: 391640 - DNA, 20 bp, Artificial
  CRISPR gRNA sequence
caaatgctgacatttatcca

SEQ ID NO: 391641 - DNA, 20 bp, Artificial
  CRISPR gRNA sequence
acatttatccaactagaata

SEQ ID NO: 391642 - DNA, 20 bp, Artificial
  CRISPR gRNA sequence
atccaactagaatattgagc

SEQ ID NO: 391643 - DNA, 20 bp, Artificial
  CRISPR gRNA sequence
tccaactagaatattgagct

SEQ ID NO: 391644 - DNA, 20 bp, Artificial
  CRISPR gRNA sequence
gaatattgagctattaaaag

SEQ ID NO: 391645 - DNA, 20 bp, Artificial
  CRISPR gRNA sequence
agctattaaaagtctattag

SEQ ID NO: 391646 - DNA, 20 bp, Artificial
  CRISPR gRNA sequence
ttaaaagtctattagcctag

SEQ ID NO: 391647 - DNA, 20 bp, Artificial
  CRISPR gRNA sequence
aaagtctattagcctagcaa

SEQ ID NO: 391648 - DNA, 20 bp, Artificial
  CRISPR gRNA sequence
ttagcctagcaagccctggg

SEQ ID NO: 391649 - DNA, 20 bp, Artificial
  CRISPR gRNA sequence
gcctagcaagccctgggaac

SEQ ID NO: 391650 - DNA, 20 bp, Artificial
  CRISPR gRNA sequence
gcaagccctgggaactgcct

SEQ ID NO: 391651 - DNA, 20 bp, Artificial
  CRISPR gRNA sequence
ggaactgccttcttcatttt

SEQ ID NO: 391652 - DNA, 20 bp, Artificial
  CRISPR gRNA sequence
ccttcttcatttttggaagt

SEQ ID NO: 391653 - DNA, 20 bp, Artificial
  CRISPR gRNA sequence
cttcatttttggaagttggg

SEQ ID NO: 391654 - DNA, 20 bp, Artificial
  CRISPR gRNA sequence
ttcatttttggaagttggga

SEQ ID NO: 391655 - DNA, 20 bp, Artificial
  CRISPR gRNA sequence
catttttggaagttgggacc

SEQ ID NO: 391656 - DNA, 20 bp, Artificial
  CRISPR gRNA sequence
atttttggaagttgggacca

SEQ ID NO: 391657 - DNA, 20 bp, Artificial
  CRISPR gRNA sequence
ttggaagttgggaccaaaac

SEQ ID NO: 391658 - DNA, 20 bp, Artificial
  CRISPR gRNA sequence
tggaagttgggaccaaaaca

SEQ ID NO: 391659 - DNA, 20 bp, Artificial
  CRISPR gRNA sequence
ggaagttgggaccaaaacaa

SEQ ID NO: 391660 - DNA, 20 bp, Artificial
  CRISPR gRNA sequence
gaagttgggaccaaaacaaa

SEQ ID NO: 391661 - DNA, 20 bp, Artificial
  CRISPR gRNA sequence
ggaccaaaacaaattgaaaa

SEQ ID NO: 391662 - DNA, 20 bp, Artificial
  CRISPR gRNA sequence
aaaataaaccctaaacagat

SEQ ID NO: 391663 - DNA, 20 bp, Artificial
  CRISPR gRNA sequence
aacagatattgctacaaacc

SEQ ID NO: 391664 - DNA, 20 bp, Artificial
  CRISPR gRNA sequence
ctacaaaccacatatgaaga

SEQ ID NO: 391665 - DNA, 20 bp, Artificial
  CRISPR gRNA sequence
caaaccacatatgaagagcg

SEQ ID NO: 391666 - DNA, 20 bp, Artificial
  CRISPR gRNA sequence
aaagtccatgttcacagagt

SEQ ID NO: 391667 - DNA, 20 bp, Artificial
  CRISPR gRNA sequence
aagtccatgttcacagagtg

SEQ ID NO: 391668 - DNA, 20 bp, Artificial
  CRISPR gRNA sequence
acagagtgggcacaactgat

SEQ ID NO: 391669 - DNA, 20 bp, Artificial
  CRISPR gRNA sequence
atgcggccaggcactccact

SEQ ID NO: 391670 - DNA, 20 bp, Artificial
  CRISPR gRNA sequence
cacttcacccatccccgcag

SEQ ID NO: 391671 - DNA, 20 bp, Artificial
  CRISPR gRNA sequence
cacccatccccgcaggtcgg

SEQ ID NO: 391672 - DNA, 20 bp, Artificial
  CRISPR gRNA sequence
acccatccccgcaggtcggc

SEQ ID NO: 391673 - DNA, 20 bp, Artificial
  CRISPR gRNA sequence
acacacacgggaatgctaac

SEQ ID NO: 391674 - DNA, 20 bp, Artificial
  CRISPR gRNA sequence
acactcatataagtttggaa

SEQ ID NO: 391675 - DNA, 20 bp, Artificial
  CRISPR gRNA sequence
atataagtttggaataatac

SEQ ID NO: 391676 - DNA, 20 bp, Artificial
  CRISPR gRNA sequence
ggaataatacccaattcact

SEQ ID NO: 391677 - DNA, 20 bp, Artificial
  CRISPR gRNA sequence
gaataatacccaattcactc

SEQ ID NO: 391678 - DNA, 20 bp, Artificial
  CRISPR gRNA sequence
actcaaaatgaggccagaat

SEQ ID NO: 391679 - DNA, 20 bp, Artificial
  CRISPR gRNA sequence
aaaatgaggccagaattctc

SEQ ID NO: 391680 - DNA, 20 bp, Artificial
  CRISPR gRNA sequence
tcaactctaatccaaagcaa

SEQ ID NO: 391681 - DNA, 20 bp, Artificial
  CRISPR gRNA sequence
aactctaatccaaagcaact

SEQ ID NO: 391682 - DNA, 20 bp, Artificial
  CRISPR gRNA sequence
taatccaaagcaactctctt

SEQ ID NO: 391683 - DNA, 20 bp, Artificial
  CRISPR gRNA sequence
atccaaagcaactctctttt

SEQ ID NO: 391684 - DNA, 20 bp, Artificial
  CRISPR gRNA sequence
tcttttcaccacacttatct

SEQ ID NO: 391685 - DNA, 20 bp, Artificial
  CRISPR gRNA sequence
ttttcaccacacttatctgc

SEQ ID NO: 391686 - DNA, 20 bp, Artificial
  CRISPR gRNA sequence
ttcaccacacttatctgccc

SEQ ID NO: 391687 - DNA, 20 bp, Artificial
  CRISPR gRNA sequence
tcaccacacttatctgcccc

SEQ ID NO: 391688 - DNA, 20 bp, Artificial
  CRISPR gRNA sequence
caccacacttatctgcccca

SEQ ID NO: 391689 - DNA, 20 bp, Artificial
  CRISPR gRNA sequence
accacacttatctgccccat

SEQ ID NO: 391690 - DNA, 20 bp, Artificial
  CRISPR gRNA sequence
atctgccccatgtattactt

SEQ ID NO: 391691 - DNA, 20 bp, Artificial
  CRISPR gRNA sequence
tctgccccatgtattacttt

SEQ ID NO: 391692 - DNA, 20 bp, Artificial
  CRISPR gRNA sequence
ccccatgtattactttttca

SEQ ID NO: 391693 - DNA, 20 bp, Artificial
  CRISPR gRNA sequence
ctttttcatgtattttctaa

SEQ ID NO: 391694 - DNA, 20 bp, Artificial
  CRISPR gRNA sequence
tttcatgtattttctaatca

SEQ ID NO: 391695 - DNA, 20 bp, Artificial
  CRISPR gRNA sequence
ttcatgtattttctaatcac

SEQ ID NO: 391696 - DNA, 20 bp, Artificial
  CRISPR gRNA sequence
tcatgtattttctaatcact

SEQ ID NO: 391697 - DNA, 20 bp, Artificial
  CRISPR gRNA sequence
catgtattttctaatcactt

SEQ ID NO: 391698 - DNA, 20 bp, Artificial
  CRISPR gRNA sequence
atgtattttctaatcacttg

SEQ ID NO: 391699 - DNA, 20 bp, Artificial
  CRISPR gRNA sequence
tctaatcacttgattaaaat

SEQ ID NO: 391700 - DNA, 20 bp, Artificial
  CRISPR gRNA sequence
ctaatcacttgattaaaata

SEQ ID NO: 391701 - DNA, 20 bp, Artificial
  CRISPR gRNA sequence
taatcacttgattaaaataa

SEQ ID NO: 391702 - DNA, 20 bp, Artificial
  CRISPR gRNA sequence
atcacttgattaaaataaag

SEQ ID NO: 391703 - DNA, 20 bp, Artificial
  CRISPR gRNA sequence
gattaaaataaagaggtaaa

SEQ ID NO: 391704 - DNA, 20 bp, Artificial
  CRISPR gRNA sequence
attaaaataaagaggtaaat

SEQ ID NO: 391705 - DNA, 20 bp, Artificial
  CRISPR gRNA sequence
aaataaagaggtaaatactt

SEQ ID NO: 391706 - DNA, 20 bp, Artificial
  CRISPR gRNA sequence
tggtatacatttttaactgt

SEQ ID NO: 391707 - DNA, 20 bp, Artificial
  CRISPR gRNA sequence
ggtatacatttttaactgtg

SEQ ID NO: 391708 - DNA, 20 bp, Artificial
  CRISPR gRNA sequence
gtatacatttttaactgtga

SEQ ID NO: 391709 - DNA, 20 bp, Artificial
  CRISPR gRNA sequence
ttaactgtgatttttattct

SEQ ID NO: 391710 - DNA, 20 bp, Artificial
  CRISPR gRNA sequence
taactgtgatttttattctt

SEQ ID NO: 391711 - DNA, 20 bp, Artificial
  CRISPR gRNA sequence
aactgtgatttttattcttt

SEQ ID NO: 391712 - DNA, 20 bp, Artificial
  CRISPR gRNA sequence
actgtgatttttattctttt

SEQ ID NO: 391713 - DNA, 20 bp, Artificial
  CRISPR gRNA sequence
tgatttttattcttttctca

SEQ ID NO: 391714 - DNA, 20 bp, Artificial
  CRISPR gRNA sequence
ttattcttttctcaaaataa

SEQ ID NO: 391715 - DNA, 20 bp, Artificial
  CRISPR gRNA sequence
tattcttttctcaaaataaa

SEQ ID NO: 391716 - DNA, 20 bp, Artificial
  CRISPR gRNA sequence
attcttttctcaaaataaaa

SEQ ID NO: 391717 - DNA, 20 bp, Artificial
  CRISPR gRNA sequence
ttcttttctcaaaataaaat

SEQ ID NO: 391718 - DNA, 20 bp, Artificial
  CRISPR gRNA sequence
ttttctcaaaataaaataga

SEQ ID NO: 391719 - DNA, 20 bp, Artificial
  CRISPR gRNA sequence
ttctcaaaataaaatagaat

SEQ ID NO: 391720 - DNA, 20 bp, Artificial
  CRISPR gRNA sequence
tctcaaaataaaatagaata

SEQ ID NO: 391721 - DNA, 20 bp, Artificial
  CRISPR gRNA sequence
ctcaaaataaaatagaatat

SEQ ID NO: 391722 - DNA, 20 bp, Artificial
  CRISPR gRNA sequence
tcaaaataaaatagaatatg

SEQ ID NO: 391723 - DNA, 20 bp, Artificial
  CRISPR gRNA sequence
aaaataaaatagaatatgct

SEQ ID NO: 391724 - DNA, 20 bp, Artificial
  CRISPR gRNA sequence
attttacatgtgtgtatgtg

SEQ ID NO: 391725 - DNA, 20 bp, Artificial
  CRISPR gRNA sequence
tacatgtgtgtatgtgtgtg

SEQ ID NO: 391726 - DNA, 20 bp, Artificial
  CRISPR gRNA sequence
acatgtgtgtatgtgtgtgt

SEQ ID NO: 391727 - DNA, 20 bp, Artificial
  CRISPR gRNA sequence
catgtgtgtatgtgtgtgtg

SEQ ID NO: 391728 - DNA, 20 bp, Artificial
  CRISPR gRNA sequence
ctaataagcatactgaacta

SEQ ID NO: 391729 - DNA, 20 bp, Artificial
  CRISPR gRNA sequence
ataagcatactgaactaaga

SEQ ID NO: 391730 - DNA, 20 bp, Artificial
  CRISPR gRNA sequence
aactaagagtctttgcccac

SEQ ID NO: 391731 - DNA, 20 bp, Artificial
  CRISPR gRNA sequence
agagtctttgcccacaaaaa

SEQ ID NO: 391732 - DNA, 20 bp, Artificial
  CRISPR gRNA sequence
tgcccacaaaaatatatctc

SEQ ID NO: 391733 - DNA, 20 bp, Artificial
  CRISPR gRNA sequence
gcccacaaaaatatatctct

SEQ ID NO: 391734 - DNA, 20 bp, Artificial
  CRISPR gRNA sequence
cccacaaaaatatatctctt

SEQ ID NO: 391735 - DNA, 20 bp, Artificial
  CRISPR gRNA sequence
ttaatcatatttcttggctg

SEQ ID NO: 391736 - DNA, 20 bp, Artificial
  CRISPR gRNA sequence
aatcatatttcttggctgtg

SEQ ID NO: 391737 - DNA, 20 bp, Artificial
  CRISPR gRNA sequence
atcatatttcttggctgtgg

SEQ ID NO: 391738 - DNA, 20 bp, Artificial
  CRISPR gRNA sequence
cttggctgtggacttaactt

SEQ ID NO: 391739 - DNA, 20 bp, Artificial
  CRISPR gRNA sequence
ttggctgtggacttaacttt

SEQ ID NO: 391740 - DNA, 20 bp, Artificial
  CRISPR gRNA sequence
ggctgtggacttaacttttt

SEQ ID NO: 391741 - DNA, 20 bp, Artificial
  CRISPR gRNA sequence
gctgtggacttaactttttg

SEQ ID NO: 391742 - DNA, 20 bp, Artificial
  CRISPR gRNA sequence
tggacttaactttttgttca

SEQ ID NO: 391743 - DNA, 20 bp, Artificial
  CRISPR gRNA sequence
aactttttgttcagctgaat

SEQ ID NO: 391744 - DNA, 20 bp, Artificial
  CRISPR gRNA sequence
actttttgttcagctgaata

SEQ ID NO: 391745 - DNA, 20 bp, Artificial
  CRISPR gRNA sequence
tttgttcagctgaatacagt

SEQ ID NO: 391746 - DNA, 20 bp, Artificial
  CRISPR gRNA sequence
ttgttcagctgaatacagta

SEQ ID NO: 391747 - DNA, 20 bp, Artificial
  CRISPR gRNA sequence
tgttcagctgaatacagtaa

SEQ ID NO: 391748 - DNA, 20 bp, Artificial
  CRISPR gRNA sequence
gttcagctgaatacagtaaa

SEQ ID NO: 391749 - DNA, 20 bp, Artificial
  CRISPR gRNA sequence
ttcagctgaatacagtaaat

SEQ ID NO: 391750 - DNA, 20 bp, Artificial
  CRISPR gRNA sequence
agctgaatacagtaaatctt

SEQ ID NO: 391751 - DNA, 20 bp, Artificial
  CRISPR gRNA sequence
aatacagtaaatcttcattt

SEQ ID NO: 391752 - DNA, 20 bp, Artificial
  CRISPR gRNA sequence
cattttcttatatctattca

SEQ ID NO: 391753 - DNA, 20 bp, Artificial
  CRISPR gRNA sequence
attttcttatatctattcaa

SEQ ID NO: 391754 - DNA, 20 bp, Artificial
  CRISPR gRNA sequence
tcttatatctattcaaaatg

SEQ ID NO: 391755 - DNA, 20 bp, Artificial
  CRISPR gRNA sequence
cttatatctattcaaaatgt

SEQ ID NO: 391756 - DNA, 20 bp, Artificial
  CRISPR gRNA sequence
ttatatctattcaaaatgtt

SEQ ID NO: 391757 - DNA, 20 bp, Artificial
  CRISPR gRNA sequence
atatctattcaaaatgtttc

SEQ ID NO: 391758 - DNA, 20 bp, Artificial
  CRISPR gRNA sequence
tatctattcaaaatgtttct

SEQ ID NO: 391759 - DNA, 20 bp, Artificial
  CRISPR gRNA sequence
ttcaaaatgtttctttcttt

SEQ ID NO: 391760 - DNA, 20 bp, Artificial
  CRISPR gRNA sequence
aaaatgtttctttctttttt

SEQ ID NO: 391761 - DNA, 20 bp, Artificial
  CRISPR gRNA sequence
ctttctttttttattatact

SEQ ID NO: 391762 - DNA, 20 bp, Artificial
  CRISPR gRNA sequence
tttctttttttattatactt

SEQ ID NO: 391763 - DNA, 20 bp, Artificial
  CRISPR gRNA sequence
tctttttttattatacttta

SEQ ID NO: 391764 - DNA, 20 bp, Artificial
  CRISPR gRNA sequence
ctttttttattatactttaa

SEQ ID NO: 391765 - DNA, 20 bp, Artificial
  CRISPR gRNA sequence
tttttttattatactttaag

SEQ ID NO: 391766 - DNA, 20 bp, Artificial
  CRISPR gRNA sequence
tttttattatactttaagtt

SEQ ID NO: 391767 - DNA, 20 bp, Artificial
  CRISPR gRNA sequence
ttttattatactttaagttc

SEQ ID NO: 391768 - DNA, 20 bp, Artificial
  CRISPR gRNA sequence
tttattatactttaagttct

SEQ ID NO: 391769 - DNA, 20 bp, Artificial
  CRISPR gRNA sequence
ttattatactttaagttcta

SEQ ID NO: 391770 - DNA, 20 bp, Artificial
  CRISPR gRNA sequence
tattatactttaagttctag

SEQ ID NO: 391771 - DNA, 20 bp, Artificial
  CRISPR gRNA sequence
attatactttaagttctagg

SEQ ID NO: 391772 - DNA, 20 bp, Artificial
  CRISPR gRNA sequence
ttatactttaagttctaggg

SEQ ID NO: 391773 - DNA, 20 bp, Artificial
  CRISPR gRNA sequence
tactttaagttctagggtac

SEQ ID NO: 391774 - DNA, 20 bp, Artificial
  CRISPR gRNA sequence
taagttctagggtacatgtg

SEQ ID NO: 391775 - DNA, 20 bp, Artificial
  CRISPR gRNA sequence
aagttctagggtacatgtgc

SEQ ID NO: 391776 - DNA, 20 bp, Artificial
  CRISPR gRNA sequence
agttctagggtacatgtgca

SEQ ID NO: 391777 - DNA, 20 bp, Artificial
  CRISPR gRNA sequence
tagggtacatgtgcacacgt

SEQ ID NO: 391778 - DNA, 20 bp, Artificial
  CRISPR gRNA sequence
gggtacatgtgcacacgtgc

SEQ ID NO: 391779 - DNA, 20 bp, Artificial
  CRISPR gRNA sequence
gttacatatgtatggtgctg

SEQ ID NO: 391780 - DNA, 20 bp, Artificial
  CRISPR gRNA sequence
ttacatatgtatggtgctgg

SEQ ID NO: 391781 - DNA, 20 bp, Artificial
  CRISPR gRNA sequence
catatgtatggtgctgggaa

SEQ ID NO: 391782 - DNA, 20 bp, Artificial
  CRISPR gRNA sequence
ggaaaactggctagccatat

SEQ ID NO: 391783 - DNA, 20 bp, Artificial
  CRISPR gRNA sequence
gctagccatatgtagaaagc

SEQ ID NO: 391784 - DNA, 20 bp, Artificial
  CRISPR gRNA sequence
gccatatgtagaaagctgaa

SEQ ID NO: 391785 - DNA, 20 bp, Artificial
  CRISPR gRNA sequence
aaactggatcccttccttac

SEQ ID NO: 391786 - DNA, 20 bp, Artificial
  CRISPR gRNA sequence
gatcccttccttacacctta

SEQ ID NO: 391787 - DNA, 20 bp, Artificial
  CRISPR gRNA sequence
ccttacaccttatacaaaaa

SEQ ID NO: 391788 - DNA, 20 bp, Artificial
  CRISPR gRNA sequence
cttacaccttatacaaaaat

SEQ ID NO: 391789 - DNA, 20 bp, Artificial
  CRISPR gRNA sequence
acaccttatacaaaaattaa

SEQ ID NO: 391790 - DNA, 20 bp, Artificial
  CRISPR gRNA sequence
caccttatacaaaaattaat

SEQ ID NO: 391791 - DNA, 20 bp, Artificial
  CRISPR gRNA sequence
atacaaaaattaattcaaga

SEQ ID NO: 391792 - DNA, 20 bp, Artificial
  CRISPR gRNA sequence
tacaaaaattaattcaagat

SEQ ID NO: 391793 - DNA, 20 bp, Artificial
  CRISPR gRNA sequence
attcaagatggattaaagac

SEQ ID NO: 391794 - DNA, 20 bp, Artificial
  CRISPR gRNA sequence
aagatggattaaagacttaa

SEQ ID NO: 391795 - DNA, 20 bp, Artificial
  CRISPR gRNA sequence
aagacttaaatgttagacct

SEQ ID NO: 391796 - DNA, 20 bp, Artificial
  CRISPR gRNA sequence
aaatgttagacctaaaacca

SEQ ID NO: 391797 - DNA, 20 bp, Artificial
  CRISPR gRNA sequence
aatgttagacctaaaaccat

SEQ ID NO: 391798 - DNA, 20 bp, Artificial
  CRISPR gRNA sequence
gacctaaaaccataaaaacc

SEQ ID NO: 391799 - DNA, 20 bp, Artificial
  CRISPR gRNA sequence
aaaccataaaaaccctagaa

SEQ ID NO: 391800 - DNA, 20 bp, Artificial
  CRISPR gRNA sequence
gaagaaaacctaggcattac

SEQ ID NO: 391801 - DNA, 20 bp, Artificial
  CRISPR gRNA sequence
ggcattaccattcaggacat

SEQ ID NO: 391802 - DNA, 20 bp, Artificial
  CRISPR gRNA sequence
ccattcaggacataggcatg

SEQ ID NO: 391803 - DNA, 20 bp, Artificial
  CRISPR gRNA sequence
aggacataggcatgggcaag

SEQ ID NO: 391804 - DNA, 20 bp, Artificial
  CRISPR gRNA sequence
catgcctaaaacaccaaaag

SEQ ID NO: 391805 - DNA, 20 bp, Artificial
  CRISPR gRNA sequence
atgcctaaaacaccaaaagc

SEQ ID NO: 391806 - DNA, 20 bp, Artificial
  CRISPR gRNA sequence
aaacaccaaaagcaatggca

SEQ ID NO: 391807 - DNA, 20 bp, Artificial
  CRISPR gRNA sequence
ctttcatttcttcatttaaa

SEQ ID NO: 391808 - DNA, 20 bp, Artificial
  CRISPR gRNA sequence
tttcatttcttcatttaaac

SEQ ID NO: 391809 - DNA, 20 bp, Artificial
  CRISPR gRNA sequence
tcatttcttcatttaaacat

SEQ ID NO: 391810 - DNA, 20 bp, Artificial
  CRISPR gRNA sequence
catttcttcatttaaacata

SEQ ID NO: 391811 - DNA, 20 bp, Artificial
  CRISPR gRNA sequence
atttcttcatttaaacataa

SEQ ID NO: 391812 - DNA, 20 bp, Artificial
  CRISPR gRNA sequence
cttcatttaaacataaaatg

SEQ ID NO: 391813 - DNA, 20 bp, Artificial
  CRISPR gRNA sequence
ttcatttaaacataaaatgg

SEQ ID NO: 391814 - DNA, 20 bp, Artificial
  CRISPR gRNA sequence
catttaaacataaaatggtt

SEQ ID NO: 391815 - DNA, 20 bp, Artificial
  CRISPR gRNA sequence
atttaaacataaaatggttg

SEQ ID NO: 391816 - DNA, 20 bp, Artificial
  CRISPR gRNA sequence
aaacataaaatggttgagcc

SEQ ID NO: 391817 - DNA, 20 bp, Artificial
  CRISPR gRNA sequence
aacataaaatggttgagcct

SEQ ID NO: 391818 - DNA, 20 bp, Artificial
  CRISPR gRNA sequence
agccttcttacaggaagaaa

SEQ ID NO: 391819 - DNA, 20 bp, Artificial
  CRISPR gRNA sequence
cttacaggaagaaattagtg

SEQ ID NO: 391820 - DNA, 20 bp, Artificial
  CRISPR gRNA sequence
ttacaggaagaaattagtga

SEQ ID NO: 391821 - DNA, 20 bp, Artificial
  CRISPR gRNA sequence
acaggaagaaattagtgaaa

SEQ ID NO: 391822 - DNA, 20 bp, Artificial
  CRISPR gRNA sequence
caggaagaaattagtgaaaa

SEQ ID NO: 391823 - DNA, 20 bp, Artificial
  CRISPR gRNA sequence
gtgaaaacccaggagacatc

SEQ ID NO: 391824 - DNA, 20 bp, Artificial
  CRISPR gRNA sequence
caatgttgtcataaagtgag

SEQ ID NO: 391825 - DNA, 20 bp, Artificial
  CRISPR gRNA sequence
tcataaagtgagtggctatt

SEQ ID NO: 391826 - DNA, 20 bp, Artificial
  CRISPR gRNA sequence
tttttaaaatgatgcccctt

SEQ ID NO: 391827 - DNA, 20 bp, Artificial
  CRISPR gRNA sequence
ttaaaatgatgccccttcta

SEQ ID NO: 391828 - DNA, 20 bp, Artificial
  CRISPR gRNA sequence
taaaatgatgccccttctat

SEQ ID NO: 391829 - DNA, 20 bp, Artificial
  CRISPR gRNA sequence
aaaatgatgccccttctatg

SEQ ID NO: 391830 - DNA, 20 bp, Artificial
  CRISPR gRNA sequence
aaatgatgccccttctatgt

SEQ ID NO: 391831 - DNA, 20 bp, Artificial
  CRISPR gRNA sequence
ctatgtttttgtttgtttga

SEQ ID NO: 391832 - DNA, 20 bp, Artificial
  CRISPR gRNA sequence
tatgtttttgtttgtttgat

SEQ ID NO: 391833 - DNA, 20 bp, Artificial
  CRISPR gRNA sequence
tgtttttgtttgtttgatta

SEQ ID NO: 391834 - DNA, 20 bp, Artificial
  CRISPR gRNA sequence
ttgtttgtttgattatatcc

SEQ ID NO: 391835 - DNA, 20 bp, Artificial
  CRISPR gRNA sequence
tgtttgtttgattatatcca

SEQ ID NO: 391836 - DNA, 20 bp, Artificial
  CRISPR gRNA sequence
gtttgtttgattatatccac

SEQ ID NO: 391837 - DNA, 20 bp, Artificial
  CRISPR gRNA sequence
tttgtttgattatatccaca

SEQ ID NO: 391838 - DNA, 20 bp, Artificial
  CRISPR gRNA sequence
gtttgattatatccacatat

SEQ ID NO: 391839 - DNA, 20 bp, Artificial
  CRISPR gRNA sequence
tttgattatatccacatatc

SEQ ID NO: 391840 - DNA, 20 bp, Artificial
  CRISPR gRNA sequence
gattatatccacatatcttt

SEQ ID NO: 391841 - DNA, 20 bp, Artificial
  CRISPR gRNA sequence
attatatccacatatctttt

SEQ ID NO: 391842 - DNA, 20 bp, Artificial
  CRISPR gRNA sequence
tatccacatatcttttcctt

SEQ ID NO: 391843 - DNA, 20 bp, Artificial
  CRISPR gRNA sequence
ttccttcctgagttctgaga

SEQ ID NO: 391844 - DNA, 20 bp, Artificial
  CRISPR gRNA sequence
tccttcctgagttctgagaa

SEQ ID NO: 391845 - DNA, 20 bp, Artificial
  CRISPR gRNA sequence
ccttcctgagttctgagaaa

SEQ ID NO: 391846 - DNA, 20 bp, Artificial
  CRISPR gRNA sequence
cttcctgagttctgagaaag

SEQ ID NO: 391847 - DNA, 20 bp, Artificial
  CRISPR gRNA sequence
cctgagttctgagaaagggt

SEQ ID NO: 391848 - DNA, 20 bp, Artificial
  CRISPR gRNA sequence
ctgagttctgagaaagggta

SEQ ID NO: 391849 - DNA, 20 bp, Artificial
  CRISPR gRNA sequence
agttctgagaaagggtatac

SEQ ID NO: 391850 - DNA, 20 bp, Artificial
  CRISPR gRNA sequence
tgagaaagggtatacaaagc

SEQ ID NO: 391851 - DNA, 20 bp, Artificial
  CRISPR gRNA sequence
agaaagggtatacaaagctc

SEQ ID NO: 391852 - DNA, 20 bp, Artificial
  CRISPR gRNA sequence
tgtacattttgagattgaga

SEQ ID NO: 391853 - DNA, 20 bp, Artificial
  CRISPR gRNA sequence
tacattttgagattgagatg

SEQ ID NO: 391854 - DNA, 20 bp, Artificial
  CRISPR gRNA sequence
tgagattgagatgtctaggc

SEQ ID NO: 391855 - DNA, 20 bp, Artificial
  CRISPR gRNA sequence
gagattgagatgtctaggct

SEQ ID NO: 391856 - DNA, 20 bp, Artificial
  CRISPR gRNA sequence
agattgagatgtctaggcta

SEQ ID NO: 391857 - DNA, 20 bp, Artificial
  CRISPR gRNA sequence
agatgtctaggctacaaaat

SEQ ID NO: 391858 - DNA, 20 bp, Artificial
  CRISPR gRNA sequence
ggctacaaaattctttaaat

SEQ ID NO: 391859 - DNA, 20 bp, Artificial
  CRISPR gRNA sequence
caaaattctttaaatttttg

SEQ ID NO: 391860 - DNA, 20 bp, Artificial
  CRISPR gRNA sequence
tttaaatttttggacataaa

SEQ ID NO: 391861 - DNA, 20 bp, Artificial
  CRISPR gRNA sequence
taaatttttggacataaaat

SEQ ID NO: 391862 - DNA, 20 bp, Artificial
  CRISPR gRNA sequence
aaatttttggacataaaatt

SEQ ID NO: 391863 - DNA, 20 bp, Artificial
  CRISPR gRNA sequence
aatttttggacataaaattc

SEQ ID NO: 391864 - DNA, 20 bp, Artificial
  CRISPR gRNA sequence
ttggacataaaattcctctc

SEQ ID NO: 391865 - DNA, 20 bp, Artificial
  CRISPR gRNA sequence
tggacataaaattcctctct

SEQ ID NO: 391866 - DNA, 20 bp, Artificial
  CRISPR gRNA sequence
ggacataaaattcctctcta

SEQ ID NO: 391867 - DNA, 20 bp, Artificial
  CRISPR gRNA sequence
gacataaaattcctctctac

SEQ ID NO: 391868 - DNA, 20 bp, Artificial
  CRISPR gRNA sequence
ctctctactgagggctagaa

SEQ ID NO: 391869 - DNA, 20 bp, Artificial
  CRISPR gRNA sequence
tctactgagggctagaacaa

SEQ ID NO: 391870 - DNA, 20 bp, Artificial
  CRISPR gRNA sequence
tactgagggctagaacaaat

SEQ ID NO: 391871 - DNA, 20 bp, Artificial
  CRISPR gRNA sequence
ctgagggctagaacaaatgt

SEQ ID NO: 391872 - DNA, 20 bp, Artificial
  CRISPR gRNA sequence
agggctagaacaaatgtcac

SEQ ID NO: 391873 - DNA, 20 bp, Artificial
  CRISPR gRNA sequence
gaacaaatgtcacctctgat

SEQ ID NO: 391874 - DNA, 20 bp, Artificial
  CRISPR gRNA sequence
tgatttgctcagggatttgg

SEQ ID NO: 391875 - DNA, 20 bp, Artificial
  CRISPR gRNA sequence
atttgctcagggatttggct

SEQ ID NO: 391876 - DNA, 20 bp, Artificial
  CRISPR gRNA sequence
gctcagggatttggctatat

SEQ ID NO: 391877 - DNA, 20 bp, Artificial
  CRISPR gRNA sequence
ctcagggatttggctatatt

SEQ ID NO: 391878 - DNA, 20 bp, Artificial
  CRISPR gRNA sequence
agggatttggctatatttca

SEQ ID NO: 391879 - DNA, 20 bp, Artificial
  CRISPR gRNA sequence
ggctatatttcatgatcttt

SEQ ID NO: 391880 - DNA, 20 bp, Artificial
  CRISPR gRNA sequence
gctatatttcatgatcttta

SEQ ID NO: 391881 - DNA, 20 bp, Artificial
  CRISPR gRNA sequence
tatttcatgatctttattaa

SEQ ID NO: 391882 - DNA, 20 bp, Artificial
  CRISPR gRNA sequence
catgatctttattaagaaag

SEQ ID NO: 391883 - DNA, 20 bp, Artificial
  CRISPR gRNA sequence
atgatctttattaagaaaga

SEQ ID NO: 391884 - DNA, 20 bp, Artificial
  CRISPR gRNA sequence
tattaagaaagatgataata

SEQ ID NO: 391885 - DNA, 20 bp, Artificial
  CRISPR gRNA sequence
attaagaaagatgataataa

SEQ ID NO: 391886 - DNA, 20 bp, Artificial
  CRISPR gRNA sequence
ttaagaaagatgataataat

SEQ ID NO: 391887 - DNA, 20 bp, Artificial
  CRISPR gRNA sequence
agaaagatgataataatcta

SEQ ID NO: 391888 - DNA, 20 bp, Artificial
  CRISPR gRNA sequence
gtctttaggtctgattaata

SEQ ID NO: 391889 - DNA, 20 bp, Artificial
  CRISPR gRNA sequence
taggtctgattaataataat

SEQ ID NO: 391890 - DNA, 20 bp, Artificial
  CRISPR gRNA sequence
aggtctgattaataataata

SEQ ID NO: 391891 - DNA, 20 bp, Artificial
  CRISPR gRNA sequence
ggtctgattaataataataa

SEQ ID NO: 391892 - DNA, 20 bp, Artificial
  CRISPR gRNA sequence
attaataataataacagcta

SEQ ID NO: 391893 - DNA, 20 bp, Artificial
  CRISPR gRNA sequence
ataataataacagctatagt

SEQ ID NO: 391894 - DNA, 20 bp, Artificial
  CRISPR gRNA sequence
tagtttgaggacttattatc

SEQ ID NO: 391895 - DNA, 20 bp, Artificial
  CRISPR gRNA sequence
gaggacttattatctgcttg

SEQ ID NO: 391896 - DNA, 20 bp, Artificial
  CRISPR gRNA sequence
aggacttattatctgcttgt

SEQ ID NO: 391897 - DNA, 20 bp, Artificial
  CRISPR gRNA sequence
attatctgcttgtgactata

SEQ ID NO: 391898 - DNA, 20 bp, Artificial
  CRISPR gRNA sequence
ttatctgcttgtgactatat

SEQ ID NO: 391899 - DNA, 20 bp, Artificial
  CRISPR gRNA sequence
tctgcttgtgactatattca

SEQ ID NO: 391900 - DNA, 20 bp, Artificial
  CRISPR gRNA sequence
cttgtgactatattcaatgc

SEQ ID NO: 391901 - DNA, 20 bp, Artificial
  CRISPR gRNA sequence
gtgactatattcaatgcttt

SEQ ID NO: 391902 - DNA, 20 bp, Artificial
  CRISPR gRNA sequence
tgactatattcaatgctttg

SEQ ID NO: 391903 - DNA, 20 bp, Artificial
  CRISPR gRNA sequence
tattcaatgctttgcatatg

SEQ ID NO: 391904 - DNA, 20 bp, Artificial
  CRISPR gRNA sequence
aatgctttgcatatgcagta

SEQ ID NO: 391905 - DNA, 20 bp, Artificial
  CRISPR gRNA sequence
tgcatatgcagtactatttc

SEQ ID NO: 391906 - DNA, 20 bp, Artificial
  CRISPR gRNA sequence
gcatatgcagtactatttca

SEQ ID NO: 391907 - DNA, 20 bp, Artificial
  CRISPR gRNA sequence
catatgcagtactatttcat

SEQ ID NO: 391908 - DNA, 20 bp, Artificial
  CRISPR gRNA sequence
tttcattttcacatttacaa

SEQ ID NO: 391909 - DNA, 20 bp, Artificial
  CRISPR gRNA sequence
cattttcacatttacaattc

SEQ ID NO: 391910 - DNA, 20 bp, Artificial
  CRISPR gRNA sequence
attttcacatttacaattca

SEQ ID NO: 391911 - DNA, 20 bp, Artificial
  CRISPR gRNA sequence
tcacatttacaattcagtga

SEQ ID NO: 391912 - DNA, 20 bp, Artificial
  CRISPR gRNA sequence
cacatttacaattcagtgaa

SEQ ID NO: 391913 - DNA, 20 bp, Artificial
  CRISPR gRNA sequence
acatttacaattcagtgaag

SEQ ID NO: 391914 - DNA, 20 bp, Artificial
  CRISPR gRNA sequence
acaattcagtgaagtatgga

SEQ ID NO: 391915 - DNA, 20 bp, Artificial
  CRISPR gRNA sequence
caattcagtgaagtatggat

SEQ ID NO: 391916 - DNA, 20 bp, Artificial
  CRISPR gRNA sequence
agtgaagtatggattattgt

SEQ ID NO: 391917 - DNA, 20 bp, Artificial
  CRISPR gRNA sequence
ttgtatcattttatagagga

SEQ ID NO: 391918 - DNA, 20 bp, Artificial
  CRISPR gRNA sequence
tatcattttatagaggatga

SEQ ID NO: 391919 - DNA, 20 bp, Artificial
  CRISPR gRNA sequence
tatagaggatgaaattcagg

SEQ ID NO: 391920 - DNA, 20 bp, Artificial
  CRISPR gRNA sequence
atagaggatgaaattcaggg

SEQ ID NO: 391921 - DNA, 20 bp, Artificial
  CRISPR gRNA sequence
tagaggatgaaattcagggt

SEQ ID NO: 391922 - DNA, 20 bp, Artificial
  CRISPR gRNA sequence
agggtagagaagtaaagaga

SEQ ID NO: 391923 - DNA, 20 bp, Artificial
  CRISPR gRNA sequence
tggatctaatcacttgtaac

SEQ ID NO: 391924 - DNA, 20 bp, Artificial
  CRISPR gRNA sequence
ggatctaatcacttgtaaca

SEQ ID NO: 391925 - DNA, 20 bp, Artificial
  CRISPR gRNA sequence
gatctaatcacttgtaacaa

SEQ ID NO: 391926 - DNA, 20 bp, Artificial
  CRISPR gRNA sequence
atcacttgtaacaaatggga

SEQ ID NO: 391927 - DNA, 20 bp, Artificial
  CRISPR gRNA sequence
gtaacaaatgggatctgttt

SEQ ID NO: 391928 - DNA, 20 bp, Artificial
  CRISPR gRNA sequence
taacaaatgggatctgtttc

SEQ ID NO: 391929 - DNA, 20 bp, Artificial
  CRISPR gRNA sequence
tttctctctctctcctcagc

SEQ ID NO: 391930 - DNA, 20 bp, Artificial
  CRISPR gRNA sequence
ctctctctctcctcagcttt

SEQ ID NO: 391931 - DNA, 20 bp, Artificial
  CRISPR gRNA sequence
tctctctctcctcagcttta

SEQ ID NO: 391932 - DNA, 20 bp, Artificial
  CRISPR gRNA sequence
tctctctcctcagctttagg

SEQ ID NO: 391933 - DNA, 20 bp, Artificial
  CRISPR gRNA sequence
tctctcctcagctttaggaa

SEQ ID NO: 391934 - DNA, 20 bp, Artificial
  CRISPR gRNA sequence
tctcctcagctttaggaaag

SEQ ID NO: 391935 - DNA, 20 bp, Artificial
  CRISPR gRNA sequence
tcctcagctttaggaaagga

SEQ ID NO: 391936 - DNA, 20 bp, Artificial
  CRISPR gRNA sequence
ctcagctttaggaaaggaac

SEQ ID NO: 391937 - DNA, 20 bp, Artificial
  CRISPR gRNA sequence
agctttaggaaaggaaccac

SEQ ID NO: 391938 - DNA, 20 bp, Artificial
  CRISPR gRNA sequence
taggaaaggaaccacacagc

SEQ ID NO: 391939 - DNA, 20 bp, Artificial
  CRISPR gRNA sequence
aggaaaggaaccacacagca

SEQ ID NO: 391940 - DNA, 20 bp, Artificial
  CRISPR gRNA sequence
ggaaaggaaccacacagcac

SEQ ID NO: 391941 - DNA, 20 bp, Artificial
  CRISPR gRNA sequence
gcagataaagagcatttagg

SEQ ID NO: 391942 - DNA, 20 bp, Artificial
  CRISPR gRNA sequence
agggaactcagtgcaacaaa

SEQ ID NO: 391943 - DNA, 20 bp, Artificial
  CRISPR gRNA sequence
gggaactcagtgcaacaaac

SEQ ID NO: 391944 - DNA, 20 bp, Artificial
  CRISPR gRNA sequence
agtgcaacaaacagtttgtc

SEQ ID NO: 391945 - DNA, 20 bp, Artificial
  CRISPR gRNA sequence
gtctcactggtttcttataa

SEQ ID NO: 391946 - DNA, 20 bp, Artificial
  CRISPR gRNA sequence
tctcactggtttcttataac

SEQ ID NO: 391947 - DNA, 20 bp, Artificial
  CRISPR gRNA sequence
actggtttcttataactaga

SEQ ID NO: 391948 - DNA, 20 bp, Artificial
  CRISPR gRNA sequence
gtttcttataactagaataa

SEQ ID NO: 391949 - DNA, 20 bp, Artificial
  CRISPR gRNA sequence
cttataactagaataaggta

SEQ ID NO: 391950 - DNA, 20 bp, Artificial
  CRISPR gRNA sequence
ttataactagaataaggtac

SEQ ID NO: 391951 - DNA, 20 bp, Artificial
  CRISPR gRNA sequence
ataactagaataaggtactc

SEQ ID NO: 391952 - DNA, 20 bp, Artificial
  CRISPR gRNA sequence
taactagaataaggtactcc

SEQ ID NO: 391953 - DNA, 20 bp, Artificial
  CRISPR gRNA sequence
gaataaggtactcccagatc

SEQ ID NO: 391954 - DNA, 20 bp, Artificial
  CRISPR gRNA sequence
ccagatctaaatgacactct

SEQ ID NO: 391955 - DNA, 20 bp, Artificial
  CRISPR gRNA sequence
aatgacactctgcttattat

SEQ ID NO: 391956 - DNA, 20 bp, Artificial
  CRISPR gRNA sequence
tgcttattatgaatagggac

SEQ ID NO: 391957 - DNA, 20 bp, Artificial
  CRISPR gRNA sequence
cttattatgaatagggacaa

SEQ ID NO: 391958 - DNA, 20 bp, Artificial
  CRISPR gRNA sequence
attatgaatagggacaatag

SEQ ID NO: 391959 - DNA, 20 bp, Artificial
  CRISPR gRNA sequence
ttatgaatagggacaataga

SEQ ID NO: 391960 - DNA, 20 bp, Artificial
  CRISPR gRNA sequence
tgaatagggacaatagaaaa

SEQ ID NO: 391961 - DNA, 20 bp, Artificial
  CRISPR gRNA sequence
ctgatgggcagattcctcta

SEQ ID NO: 391962 - DNA, 20 bp, Artificial
  CRISPR gRNA sequence
tgatgggcagattcctctag

SEQ ID NO: 391963 - DNA, 20 bp, Artificial
  CRISPR gRNA sequence
atgggcagattcctctagca

SEQ ID NO: 391964 - DNA, 20 bp, Artificial
  CRISPR gRNA sequence
ctctagcaccagcaccagat

SEQ ID NO: 391965 - DNA, 20 bp, Artificial
  CRISPR gRNA sequence
tagcaccagcaccagatggt

SEQ ID NO: 391966 - DNA, 20 bp, Artificial
  CRISPR gRNA sequence
gcaccagcaccagatggtgg

SEQ ID NO: 391967 - DNA, 20 bp, Artificial
  CRISPR gRNA sequence
tgggatgcgccgtcatacct

SEQ ID NO: 391968 - DNA, 20 bp, Artificial
  CRISPR gRNA sequence
ggatgcgccgtcatacctgc

SEQ ID NO: 391969 - DNA, 20 bp, Artificial
  CRISPR gRNA sequence
ccagcccagcaaccacagcc

SEQ ID NO: 391970 - DNA, 20 bp, Artificial
  CRISPR gRNA sequence
ccccgtctccacaccctcac

SEQ ID NO: 391971 - DNA, 20 bp, Artificial
  CRISPR gRNA sequence
cccgtctccacaccctcacc

SEQ ID NO: 391972 - DNA, 20 bp, Artificial
  CRISPR gRNA sequence
cacaccctcacctttcccaa

SEQ ID NO: 391973 - DNA, 20 bp, Artificial
  CRISPR gRNA sequence
acctttcccaatagcagtgg

SEQ ID NO: 391974 - DNA, 20 bp, Artificial
  CRISPR gRNA sequence
tcccaatagcagtggagaag

SEQ ID NO: 391975 - DNA, 20 bp, Artificial
  CRISPR gRNA sequence
cccaatagcagtggagaaga

SEQ ID NO: 391976 - DNA, 20 bp, Artificial
  CRISPR gRNA sequence
ccaatagcagtggagaagag

SEQ ID NO: 391977 - DNA, 20 bp, Artificial
  CRISPR gRNA sequence
tagaaaatagatcgccagag

SEQ ID NO: 391978 - DNA, 20 bp, Artificial
  CRISPR gRNA sequence
agaaaatagatcgccagagc

SEQ ID NO: 391979 - DNA, 20 bp, Artificial
  CRISPR gRNA sequence
gaaaatagatcgccagagct

SEQ ID NO: 391980 - DNA, 20 bp, Artificial
  CRISPR gRNA sequence
tgaaaaccaaaaaagtcctt

SEQ ID NO: 391981 - DNA, 20 bp, Artificial
  CRISPR gRNA sequence
aaaaccaaaaaagtccttat

SEQ ID NO: 391982 - DNA, 20 bp, Artificial
  CRISPR gRNA sequence
attgaagagataagtgtgcc

SEQ ID NO: 391983 - DNA, 20 bp, Artificial
  CRISPR gRNA sequence
ttgaagagataagtgtgcct

SEQ ID NO: 391984 - DNA, 20 bp, Artificial
  CRISPR gRNA sequence
aagagataagtgtgcctaaa

SEQ ID NO: 391985 - DNA, 20 bp, Artificial
  CRISPR gRNA sequence
aaggatttgttattgtcaca

SEQ ID NO: 391986 - DNA, 20 bp, Artificial
  CRISPR gRNA sequence
gttattgtcacagagcacag

SEQ ID NO: 391987 - DNA, 20 bp, Artificial
  CRISPR gRNA sequence
ttattgtcacagagcacaga

SEQ ID NO: 391988 - DNA, 20 bp, Artificial
  CRISPR gRNA sequence
ttgtcacagagcacagatca

SEQ ID NO: 391989 - DNA, 20 bp, Artificial
  CRISPR gRNA sequence
tcacagagcacagatcaaag

SEQ ID NO: 391990 - DNA, 20 bp, Artificial
  CRISPR gRNA sequence
tttaagctttttatttctca

SEQ ID NO: 391991 - DNA, 20 bp, Artificial
  CRISPR gRNA sequence
aagctttttatttctcagag

SEQ ID NO: 391992 - DNA, 20 bp, Artificial
  CRISPR gRNA sequence
agctttttatttctcagagt

SEQ ID NO: 391993 - DNA, 20 bp, Artificial
  CRISPR gRNA sequence
tttatttctcagagtgagaa

SEQ ID NO: 391994 - DNA, 20 bp, Artificial
  CRISPR gRNA sequence
ttatttctcagagtgagaaa

SEQ ID NO: 391995 - DNA, 20 bp, Artificial
  CRISPR gRNA sequence
tatttctcagagtgagaaaa

SEQ ID NO: 391996 - DNA, 20 bp, Artificial
  CRISPR gRNA sequence
atttctcagagtgagaaaag

SEQ ID NO: 391997 - DNA, 20 bp, Artificial
  CRISPR gRNA sequence
tttctcagagtgagaaaagg

SEQ ID NO: 391998 - DNA, 20 bp, Artificial
  CRISPR gRNA sequence
ctcagagtgagaaaaggaca

SEQ ID NO: 391999 - DNA, 20 bp, Artificial
  CRISPR gRNA sequence
tcagagtgagaaaaggacag

SEQ ID NO: 392000 - DNA, 20 bp, Artificial
  CRISPR gRNA sequence
agagtgagaaaaggacaggt

SEQ ID NO: 392001 - DNA, 20 bp, Artificial
  CRISPR gRNA sequence
ttcataattagaaaacaaaa

SEQ ID NO: 392002 - DNA, 20 bp, Artificial
  CRISPR gRNA sequence
ataattagaaaacaaaataa

SEQ ID NO: 392003 - DNA, 20 bp, Artificial
  CRISPR gRNA sequence
gaaaacaaaataaacttttt

SEQ ID NO: 392004 - DNA, 20 bp, Artificial
  CRISPR gRNA sequence
tttattttctaaacatgtgc

SEQ ID NO: 392005 - DNA, 20 bp, Artificial
  CRISPR gRNA sequence
ttattttctaaacatgtgct

SEQ ID NO: 392006 - DNA, 20 bp, Artificial
  CRISPR gRNA sequence
tattttctaaacatgtgctt

SEQ ID NO: 392007 - DNA, 20 bp, Artificial
  CRISPR gRNA sequence
attttctaaacatgtgcttt

SEQ ID NO: 392008 - DNA, 20 bp, Artificial
  CRISPR gRNA sequence
ttttctaaacatgtgctttt

SEQ ID NO: 392009 - DNA, 20 bp, Artificial
  CRISPR gRNA sequence
tctaaacatgtgcttttttc

SEQ ID NO: 392010 - DNA, 20 bp, Artificial
  CRISPR gRNA sequence
ctaaacatgtgcttttttct

SEQ ID NO: 392011 - DNA, 20 bp, Artificial
  CRISPR gRNA sequence
taaacatgtgcttttttcta

SEQ ID NO: 392012 - DNA, 20 bp, Artificial
  CRISPR gRNA sequence
aacatgtgcttttttctaaa

SEQ ID NO: 392013 - DNA, 20 bp, Artificial
  CRISPR gRNA sequence
ttttctaaatgaaaaactgc

SEQ ID NO: 392014 - DNA, 20 bp, Artificial
  CRISPR gRNA sequence
tttctaaatgaaaaactgcc

SEQ ID NO: 392015 - DNA, 20 bp, Artificial
  CRISPR gRNA sequence
ttctaaatgaaaaactgcct

SEQ ID NO: 392016 - DNA, 20 bp, Artificial
  CRISPR gRNA sequence
tctaaatgaaaaactgccta

SEQ ID NO: 392017 - DNA, 20 bp, Artificial
  CRISPR gRNA sequence
ctaaatgaaaaactgcctaa

SEQ ID NO: 392018 - DNA, 20 bp, Artificial
  CRISPR gRNA sequence
taaatgaaaaactgcctaaa

SEQ ID NO: 392019 - DNA, 20 bp, Artificial
  CRISPR gRNA sequence
aatgaaaaactgcctaaagc

SEQ ID NO: 392020 - DNA, 20 bp, Artificial
  CRISPR gRNA sequence
cctaaagcaactctagaatt

SEQ ID NO: 392021 - DNA, 20 bp, Artificial
  CRISPR gRNA sequence
aagcaactctagaattttat

SEQ ID NO: 392022 - DNA, 20 bp, Artificial
  CRISPR gRNA sequence
tagaattttattaatctatg

SEQ ID NO: 392023 - DNA, 20 bp, Artificial
  CRISPR gRNA sequence
gaattttattaatctatgtt

SEQ ID NO: 392024 - DNA, 20 bp, Artificial
  CRISPR gRNA sequence
tattaatctatgtttatgca

SEQ ID NO: 392025 - DNA, 20 bp, Artificial
  CRISPR gRNA sequence
attaatctatgtttatgcat

SEQ ID NO: 392026 - DNA, 20 bp, Artificial
  CRISPR gRNA sequence
ttaatctatgtttatgcatt

SEQ ID NO: 392027 - DNA, 20 bp, Artificial
  CRISPR gRNA sequence
atctatgtttatgcattaca

SEQ ID NO: 392028 - DNA, 20 bp, Artificial
  CRISPR gRNA sequence
tgtttatgcattacatgtga

SEQ ID NO: 392029 - DNA, 20 bp, Artificial
  CRISPR gRNA sequence
atgcattacatgtgaacatt

SEQ ID NO: 392030 - DNA, 20 bp, Artificial
  CRISPR gRNA sequence
tgcattacatgtgaacatta

SEQ ID NO: 392031 - DNA, 20 bp, Artificial
  CRISPR gRNA sequence
catgtgaacattatttaaaa

SEQ ID NO: 392032 - DNA, 20 bp, Artificial
  CRISPR gRNA sequence
tttaaaaaaaatagatcatc

SEQ ID NO: 392033 - DNA, 20 bp, Artificial
  CRISPR gRNA sequence
aaaaaaaatagatcatctta

SEQ ID NO: 392034 - DNA, 20 bp, Artificial
  CRISPR gRNA sequence
aaaaaaatagatcatcttag

SEQ ID NO: 392035 - DNA, 20 bp, Artificial
  CRISPR gRNA sequence
agagcaaactcagtaaacgt

SEQ ID NO: 392036 - DNA, 20 bp, Artificial
  CRISPR gRNA sequence
gagcaaactcagtaaacgta

SEQ ID NO: 392037 - DNA, 20 bp, Artificial
  CRISPR gRNA sequence
agtaaacgtatgccatactc

SEQ ID NO: 392038 - DNA, 20 bp, Artificial
  CRISPR gRNA sequence
ttagagtaacaacctttgta

SEQ ID NO: 392039 - DNA, 20 bp, Artificial
  CRISPR gRNA sequence
agagtaacaacctttgtaaa

SEQ ID NO: 392040 - DNA, 20 bp, Artificial
  CRISPR gRNA sequence
gagtaacaacctttgtaaat

SEQ ID NO: 392041 - DNA, 20 bp, Artificial
  CRISPR gRNA sequence
tgtaaattactgtttaaatt

SEQ ID NO: 392042 - DNA, 20 bp, Artificial
  CRISPR gRNA sequence
gtaaattactgtttaaatta

SEQ ID NO: 392043 - DNA, 20 bp, Artificial
  CRISPR gRNA sequence
taaattactgtttaaattac

SEQ ID NO: 392044 - DNA, 20 bp, Artificial
  CRISPR gRNA sequence
ctgtttaaattacaagcgtg

SEQ ID NO: 392045 - DNA, 20 bp, Artificial
  CRISPR gRNA sequence
tttaaattacaagcgtgggg

SEQ ID NO: 392046 - DNA, 20 bp, Artificial
  CRISPR gRNA sequence
aaattacaagcgtggggtaa

SEQ ID NO: 392047 - DNA, 20 bp, Artificial
  CRISPR gRNA sequence
aattacaagcgtggggtaag

SEQ ID NO: 392048 - DNA, 20 bp, Artificial
  CRISPR gRNA sequence
caagcgtggggtaagttggt

SEQ ID NO: 392049 - DNA, 20 bp, Artificial
  CRISPR gRNA sequence
gtgcttagagtagttgggaa

SEQ ID NO: 392050 - DNA, 20 bp, Artificial
  CRISPR gRNA sequence
agagtagttgggaaggaggc

SEQ ID NO: 392051 - DNA, 20 bp, Artificial
  CRISPR gRNA sequence
gagtagttgggaaggaggca

SEQ ID NO: 392052 - DNA, 20 bp, Artificial
  CRISPR gRNA sequence
ggaaggaggcaggagaagtc

SEQ ID NO: 392053 - DNA, 20 bp, Artificial
  CRISPR gRNA sequence
tgcaggatggacctcacgag

SEQ ID NO: 392054 - DNA, 20 bp, Artificial
  CRISPR gRNA sequence
caggatggacctcacgagca

SEQ ID NO: 392055 - DNA, 20 bp, Artificial
  CRISPR gRNA sequence
acgagcaggcaggagttcag

SEQ ID NO: 392056 - DNA, 20 bp, Artificial
  CRISPR gRNA sequence
agtgtgggcagagaactctt

SEQ ID NO: 392057 - DNA, 20 bp, Artificial
  CRISPR gRNA sequence
tttttgcagggctcaagtgt

SEQ ID NO: 392058 - DNA, 20 bp, Artificial
  CRISPR gRNA sequence
tttgcagggctcaagtgtcc

SEQ ID NO: 392059 - DNA, 20 bp, Artificial
  CRISPR gRNA sequence
ttgcagggctcaagtgtcct

SEQ ID NO: 392060 - DNA, 20 bp, Artificial
  CRISPR gRNA sequence
tgcagggctcaagtgtccta

SEQ ID NO: 392061 - DNA, 20 bp, Artificial
  CRISPR gRNA sequence
gcagggctcaagtgtcctag

SEQ ID NO: 392062 - DNA, 20 bp, Artificial
  CRISPR gRNA sequence
cagggctcaagtgtcctagt

SEQ ID NO: 392063 - DNA, 20 bp, Artificial
  CRISPR gRNA sequence
aagtgtcctagtgaaatgct

SEQ ID NO: 392064 - DNA, 20 bp, Artificial
  CRISPR gRNA sequence
gtgaaatgctaagcctgcat

SEQ ID NO: 392065 - DNA, 20 bp, Artificial
  CRISPR gRNA sequence
agcctgcatattatggagca

SEQ ID NO: 392066 - DNA, 20 bp, Artificial
  CRISPR gRNA sequence
catattatggagcaagggac

SEQ ID NO: 392067 - DNA, 20 bp, Artificial
  CRISPR gRNA sequence
tggagcaagggaccagccct

SEQ ID NO: 392068 - DNA, 20 bp, Artificial
  CRISPR gRNA sequence
tgaaagatgggcttcagatg

SEQ ID NO: 392069 - DNA, 20 bp, Artificial
  CRISPR gRNA sequence
aaagatgggcttcagatgtg

SEQ ID NO: 392070 - DNA, 20 bp, Artificial
  CRISPR gRNA sequence
cagatgtgctaaaagaattg

SEQ ID NO: 392071 - DNA, 20 bp, Artificial
  CRISPR gRNA sequence
agatgtgctaaaagaattgg

SEQ ID NO: 392072 - DNA, 20 bp, Artificial
  CRISPR gRNA sequence
aaagaattggagaattatag

SEQ ID NO: 392073 - DNA, 20 bp, Artificial
  CRISPR gRNA sequence
gagaattatagacaacctca

SEQ ID NO: 392074 - DNA, 20 bp, Artificial
  CRISPR gRNA sequence
tagacaacctcaccggaaag

SEQ ID NO: 392075 - DNA, 20 bp, Artificial
  CRISPR gRNA sequence
accggaaagggagaaaaagg

SEQ ID NO: 392076 - DNA, 20 bp, Artificial
  CRISPR gRNA sequence
cttactaaagtgtgaagggg

SEQ ID NO: 392077 - DNA, 20 bp, Artificial
  CRISPR gRNA sequence
ttactaaagtgtgaagggga

SEQ ID NO: 392078 - DNA, 20 bp, Artificial
  CRISPR gRNA sequence
actaaagtgtgaaggggaaa

SEQ ID NO: 392079 - DNA, 20 bp, Artificial
  CRISPR gRNA sequence
ctaaagtgtgaaggggaaaa

SEQ ID NO: 392080 - DNA, 20 bp, Artificial
  CRISPR gRNA sequence
aagtgtgaaggggaaaaaat

SEQ ID NO: 392081 - DNA, 20 bp, Artificial
  CRISPR gRNA sequence
ctctatcattctattgatct

SEQ ID NO: 392082 - DNA, 20 bp, Artificial
  CRISPR gRNA sequence
tctatcattctattgatctt

SEQ ID NO: 392083 - DNA, 20 bp, Artificial
  CRISPR gRNA sequence
tatcattctattgatcttaa

SEQ ID NO: 392084 - DNA, 20 bp, Artificial
  CRISPR gRNA sequence
tcattctattgatcttaatg

SEQ ID NO: 392085 - DNA, 20 bp, Artificial
  CRISPR gRNA sequence
tattgatcttaatgaggttt

SEQ ID NO: 392086 - DNA, 20 bp, Artificial
  CRISPR gRNA sequence
ttgatcttaatgaggtttct

SEQ ID NO: 392087 - DNA, 20 bp, Artificial
  CRISPR gRNA sequence
atcttaatgaggtttctgga

SEQ ID NO: 392088 - DNA, 20 bp, Artificial
  CRISPR gRNA sequence
aatgaggtttctggaaacaa

SEQ ID NO: 392089 - DNA, 20 bp, Artificial
  CRISPR gRNA sequence
atgaggtttctggaaacaaa

SEQ ID NO: 392090 - DNA, 20 bp, Artificial
  CRISPR gRNA sequence
ctggaaacaaaatgagttgg

SEQ ID NO: 392091 - DNA, 20 bp, Artificial
  CRISPR gRNA sequence
tggaaacaaaatgagttggg

SEQ ID NO: 392092 - DNA, 20 bp, Artificial
  CRISPR gRNA sequence
gaaacaaaatgagttggggg

SEQ ID NO: 392093 - DNA, 20 bp, Artificial
  CRISPR gRNA sequence
ggggaaatgcactacttcta

SEQ ID NO: 392094 - DNA, 20 bp, Artificial
  CRISPR gRNA sequence
cttctattagagagatttcc

SEQ ID NO: 392095 - DNA, 20 bp, Artificial
  CRISPR gRNA sequence
ctattagagagatttccaaa

SEQ ID NO: 392096 - DNA, 20 bp, Artificial
  CRISPR gRNA sequence
tattagagagatttccaaaa

SEQ ID NO: 392097 - DNA, 20 bp, Artificial
  CRISPR gRNA sequence
ttagagagatttccaaaatt

SEQ ID NO: 392098 - DNA, 20 bp, Artificial
  CRISPR gRNA sequence
gagagatttccaaaatttgg

SEQ ID NO: 392099 - DNA, 20 bp, Artificial
  CRISPR gRNA sequence
ccaaaatttggaaagctgtc

SEQ ID NO: 392100 - DNA, 20 bp, Artificial
  CRISPR gRNA sequence
caaaatttggaaagctgtct

SEQ ID NO: 392101 - DNA, 20 bp, Artificial
  CRISPR gRNA sequence
ggaaagctgtctcactgtga

SEQ ID NO: 392102 - DNA, 20 bp, Artificial
  CRISPR gRNA sequence
gaaagctgtctcactgtgat

SEQ ID NO: 392103 - DNA, 20 bp, Artificial
  CRISPR gRNA sequence
tctcactgtgatcatatttt

SEQ ID NO: 392104 - DNA, 20 bp, Artificial
  CRISPR gRNA sequence
actgtgatcatattttcata

SEQ ID NO: 392105 - DNA, 20 bp, Artificial
  CRISPR gRNA sequence
tgatcatattttcatagcat

SEQ ID NO: 392106 - DNA, 20 bp, Artificial
  CRISPR gRNA sequence
tcatagcatgattttggaac

SEQ ID NO: 392107 - DNA, 20 bp, Artificial
  CRISPR gRNA sequence
catagcatgattttggaaca

SEQ ID NO: 392108 - DNA, 20 bp, Artificial
  CRISPR gRNA sequence
atagcatgattttggaacaa

SEQ ID NO: 392109 - DNA, 20 bp, Artificial
  CRISPR gRNA sequence
tggaacaataatctaaaatg

SEQ ID NO: 392110 - DNA, 20 bp, Artificial
  CRISPR gRNA sequence
ggaacaataatctaaaatgt

SEQ ID NO: 392111 - DNA, 20 bp, Artificial
  CRISPR gRNA sequence
gaacaataatctaaaatgtc

SEQ ID NO: 392112 - DNA, 20 bp, Artificial
  CRISPR gRNA sequence
aaatgtccagtatttatact

SEQ ID NO: 392113 - DNA, 20 bp, Artificial
  CRISPR gRNA sequence
atactaccatctatgaattt

SEQ ID NO: 392114 - DNA, 20 bp, Artificial
  CRISPR gRNA sequence
tactaccatctatgaatttg

SEQ ID NO: 392115 - DNA, 20 bp, Artificial
  CRISPR gRNA sequence
ccatctatgaatttggcttg

SEQ ID NO: 392116 - DNA, 20 bp, Artificial
  CRISPR gRNA sequence
tgaatttggcttgtatgtat

SEQ ID NO: 392117 - DNA, 20 bp, Artificial
  CRISPR gRNA sequence
ggcttgtatgtattatgtca

SEQ ID NO: 392118 - DNA, 20 bp, Artificial
  CRISPR gRNA sequence
gcttgtatgtattatgtcag

SEQ ID NO: 392119 - DNA, 20 bp, Artificial
  CRISPR gRNA sequence
gtatgtattatgtcagaatg

SEQ ID NO: 392120 - DNA, 20 bp, Artificial
  CRISPR gRNA sequence
tatgtattatgtcagaatgt

SEQ ID NO: 392121 - DNA, 20 bp, Artificial
  CRISPR gRNA sequence
tgtcagaatgtgaaaaatct

SEQ ID NO: 392122 - DNA, 20 bp, Artificial
  CRISPR gRNA sequence
tggctctgaaattctacctt

SEQ ID NO: 392123 - DNA, 20 bp, Artificial
  CRISPR gRNA sequence
gctctgaaattctacctttc

SEQ ID NO: 392124 - DNA, 20 bp, Artificial
  CRISPR gRNA sequence
tgaaattctacctttctata

SEQ ID NO: 392125 - DNA, 20 bp, Artificial
  CRISPR gRNA sequence
aaattctacctttctatata

SEQ ID NO: 392126 - DNA, 20 bp, Artificial
  CRISPR gRNA sequence
tacctttctatataatattt

SEQ ID NO: 392127 - DNA, 20 bp, Artificial
  CRISPR gRNA sequence
cctttctatataatatttca

SEQ ID NO: 392128 - DNA, 20 bp, Artificial
  CRISPR gRNA sequence
tctatataatatttcagatc

SEQ ID NO: 392129 - DNA, 20 bp, Artificial
  CRISPR gRNA sequence
ctatataatatttcagatca

SEQ ID NO: 392130 - DNA, 20 bp, Artificial
  CRISPR gRNA sequence
tatataatatttcagatcac

SEQ ID NO: 392131 - DNA, 20 bp, Artificial
  CRISPR gRNA sequence
tataatatttcagatcacac

SEQ ID NO: 392132 - DNA, 20 bp, Artificial
  CRISPR gRNA sequence
cagatcacacctgcaaaact

SEQ ID NO: 392133 - DNA, 20 bp, Artificial
  CRISPR gRNA sequence
agatcacacctgcaaaacta

SEQ ID NO: 392134 - DNA, 20 bp, Artificial
  CRISPR gRNA sequence
caaaactactctacgacctt

SEQ ID NO: 392135 - DNA, 20 bp, Artificial
  CRISPR gRNA sequence
ctctacgaccttgacatttt

SEQ ID NO: 392136 - DNA, 20 bp, Artificial
  CRISPR gRNA sequence
tacgaccttgacatttttga

SEQ ID NO: 392137 - DNA, 20 bp, Artificial
  CRISPR gRNA sequence
cgaccttgacatttttgatg

SEQ ID NO: 392138 - DNA, 20 bp, Artificial
  CRISPR gRNA sequence
gacatttttgatgagtttga

SEQ ID NO: 392139 - DNA, 20 bp, Artificial
  CRISPR gRNA sequence
acatttttgatgagtttgat

SEQ ID NO: 392140 - DNA, 20 bp, Artificial
  CRISPR gRNA sequence
ttgatgagtttgatgagatc

SEQ ID NO: 392141 - DNA, 20 bp, Artificial
  CRISPR gRNA sequence
tgatgagtttgatgagatct

SEQ ID NO: 392142 - DNA, 20 bp, Artificial
  CRISPR gRNA sequence
gatgagtttgatgagatctt

SEQ ID NO: 392143 - DNA, 20 bp, Artificial
  CRISPR gRNA sequence
atgagtttgatgagatcttc

SEQ ID NO: 392144 - DNA, 20 bp, Artificial
  CRISPR gRNA sequence
gatgagatcttcgactgctt

SEQ ID NO: 392145 - DNA, 20 bp, Artificial
  CRISPR gRNA sequence
atgagatcttcgactgcttc

SEQ ID NO: 392146 - DNA, 20 bp, Artificial
  CRISPR gRNA sequence
cgactgcttcaagtcaatca

SEQ ID NO: 392147 - DNA, 20 bp, Artificial
  CRISPR gRNA sequence
gactgcttcaagtcaatcac

SEQ ID NO: 392148 - DNA, 20 bp, Artificial
  CRISPR gRNA sequence
cttcaagtcaatcacctcat

SEQ ID NO: 392149 - DNA, 20 bp, Artificial
  CRISPR gRNA sequence
caagtcaatcacctcatatc

SEQ ID NO: 392150 - DNA, 20 bp, Artificial
  CRISPR gRNA sequence
aagtcaatcacctcatatca

SEQ ID NO: 392151 - DNA, 20 bp, Artificial
  CRISPR gRNA sequence
atatcagtgccattggcaat

SEQ ID NO: 392152 - DNA, 20 bp, Artificial
  CRISPR gRNA sequence
gcaatttgaggaagacaaag

SEQ ID NO: 392153 - DNA, 20 bp, Artificial
  CRISPR gRNA sequence
gaggaagacaaagaggagct

SEQ ID NO: 392154 - DNA, 20 bp, Artificial
  CRISPR gRNA sequence
aggaagacaaagaggagctt

SEQ ID NO: 392155 - DNA, 20 bp, Artificial
  CRISPR gRNA sequence
ggttcaagttgattagcact

SEQ ID NO: 392156 - DNA, 20 bp, Artificial
  CRISPR gRNA sequence
gttcaagttgattagcacta

SEQ ID NO: 392157 - DNA, 20 bp, Artificial
  CRISPR gRNA sequence
aagttgattagcactaccag

SEQ ID NO: 392158 - DNA, 20 bp, Artificial
  CRISPR gRNA sequence
attagcactaccagaaaaga

SEQ ID NO: 392159 - DNA, 20 bp, Artificial
  CRISPR gRNA sequence
gcactaccagaaaagaaact

SEQ ID NO: 392160 - DNA, 20 bp, Artificial
  CRISPR gRNA sequence
ccagaaaagaaactcacagt

SEQ ID NO: 392161 - DNA, 20 bp, Artificial
  CRISPR gRNA sequence
acagtgaacaccatatatca

SEQ ID NO: 392162 - DNA, 20 bp, Artificial
  CRISPR gRNA sequence
ttccattgagttcatggacc

SEQ ID NO: 392163 - DNA, 20 bp, Artificial
  CRISPR gRNA sequence
cattgagttcatggaccaag

SEQ ID NO: 392164 - DNA, 20 bp, Artificial
  CRISPR gRNA sequence
agttcatggaccaagaggag

SEQ ID NO: 392165 - DNA, 20 bp, Artificial
  CRISPR gRNA sequence
atggaccaagaggagaatat

SEQ ID NO: 392166 - DNA, 20 bp, Artificial
  CRISPR gRNA sequence
attttcaagttttgtggtta

SEQ ID NO: 392167 - DNA, 20 bp, Artificial
  CRISPR gRNA sequence
ttttcaagttttgtggttag

SEQ ID NO: 392168 - DNA, 20 bp, Artificial
  CRISPR gRNA sequence
tcaagttttgtggttagcaa

SEQ ID NO: 392169 - DNA, 20 bp, Artificial
  CRISPR gRNA sequence
caagttttgtggttagcaat

SEQ ID NO: 392170 - DNA, 20 bp, Artificial
  CRISPR gRNA sequence
aagttttgtggttagcaatt

SEQ ID NO: 392171 - DNA, 20 bp, Artificial
  CRISPR gRNA sequence
tgtggttagcaattccttgt

SEQ ID NO: 392172 - DNA, 20 bp, Artificial
  CRISPR gRNA sequence
gtggttagcaattccttgtg

SEQ ID NO: 392173 - DNA, 20 bp, Artificial
  CRISPR gRNA sequence
tggttagcaattccttgtga

SEQ ID NO: 392174 - DNA, 20 bp, Artificial
  CRISPR gRNA sequence
gcaattccttgtgatagttc

SEQ ID NO: 392175 - DNA, 20 bp, Artificial
  CRISPR gRNA sequence
cttgtgatagttctgccagt

SEQ ID NO: 392176 - DNA, 20 bp, Artificial
  CRISPR gRNA sequence
gtgatagttctgccagtttc

SEQ ID NO: 392177 - DNA, 20 bp, Artificial
  CRISPR gRNA sequence
tgatagttctgccagtttcc

SEQ ID NO: 392178 - DNA, 20 bp, Artificial
  CRISPR gRNA sequence
tgccagtttccaattttctc

SEQ ID NO: 392179 - DNA, 20 bp, Artificial
  CRISPR gRNA sequence
ccagtttccaattttctcac

SEQ ID NO: 392180 - DNA, 20 bp, Artificial
  CRISPR gRNA sequence
ccaattttctcactgaaggg

SEQ ID NO: 392181 - DNA, 20 bp, Artificial
  CRISPR gRNA sequence
caattttctcactgaagggc

SEQ ID NO: 392182 - DNA, 20 bp, Artificial
  CRISPR gRNA sequence
tctcactgaagggctacaga

SEQ ID NO: 392183 - DNA, 20 bp, Artificial
  CRISPR gRNA sequence
ctcactgaagggctacagag

SEQ ID NO: 392184 - DNA, 20 bp, Artificial
  CRISPR gRNA sequence
tcactgaagggctacagagt

SEQ ID NO: 392185 - DNA, 20 bp, Artificial
  CRISPR gRNA sequence
actgaagggctacagagttc

SEQ ID NO: 392186 - DNA, 20 bp, Artificial
  CRISPR gRNA sequence
aagggctacagagttccgta

SEQ ID NO: 392187 - DNA, 20 bp, Artificial
  CRISPR gRNA sequence
cagagttccgtatttgtgcc

SEQ ID NO: 392188 - DNA, 20 bp, Artificial
  CRISPR gRNA sequence
cgtatttgtgccaagtccta

SEQ ID NO: 392189 - DNA, 20 bp, Artificial
  CRISPR gRNA sequence
gtgccaagtcctatatattg

SEQ ID NO: 392190 - DNA, 20 bp, Artificial
  CRISPR gRNA sequence
tgccaagtcctatatattgc

SEQ ID NO: 392191 - DNA, 20 bp, Artificial
  CRISPR gRNA sequence
tatattgctcctttacaaaa

SEQ ID NO: 392192 - DNA, 20 bp, Artificial
  CRISPR gRNA sequence
ctcctttacaaaagcatttc

SEQ ID NO: 392193 - DNA, 20 bp, Artificial
  CRISPR gRNA sequence
ctttacaaaagcatttctac

SEQ ID NO: 392194 - DNA, 20 bp, Artificial
  CRISPR gRNA sequence
tacaaaagcatttctactga

SEQ ID NO: 392195 - DNA, 20 bp, Artificial
  CRISPR gRNA sequence
acaaaagcatttctactgaa

SEQ ID NO: 392196 - DNA, 20 bp, Artificial
  CRISPR gRNA sequence
caaaagcatttctactgaag

SEQ ID NO: 392197 - DNA, 20 bp, Artificial
  CRISPR gRNA sequence
ctactgaagtaaattggaaa

SEQ ID NO: 392198 - DNA, 20 bp, Artificial
  CRISPR gRNA sequence
tactgaagtaaattggaaaa

SEQ ID NO: 392199 - DNA, 20 bp, Artificial
  CRISPR gRNA sequence
ctgaagtaaattggaaaaag

SEQ ID NO: 392200 - DNA, 20 bp, Artificial
  CRISPR gRNA sequence
aagtaaattggaaaaagaag

SEQ ID NO: 392201 - DNA, 20 bp, Artificial
  CRISPR gRNA sequence
gaaaaagaagaaaaggcaag

SEQ ID NO: 392202 - DNA, 20 bp, Artificial
  CRISPR gRNA sequence
gacttttggccctccttcta

SEQ ID NO: 392203 - DNA, 20 bp, Artificial
  CRISPR gRNA sequence
ttggccctccttctaattga

SEQ ID NO: 392204 - DNA, 20 bp, Artificial
  CRISPR gRNA sequence
tggccctccttctaattgag

SEQ ID NO: 392205 - DNA, 20 bp, Artificial
  CRISPR gRNA sequence
ggccctccttctaattgaga

SEQ ID NO: 392206 - DNA, 20 bp, Artificial
  CRISPR gRNA sequence
gccctccttctaattgagaa

SEQ ID NO: 392207 - DNA, 20 bp, Artificial
  CRISPR gRNA sequence
cttctaattgagaatgacaa

SEQ ID NO: 392208 - DNA, 20 bp, Artificial
  CRISPR gRNA sequence
ctaattgagaatgacaacca

SEQ ID NO: 392209 - DNA, 20 bp, Artificial
  CRISPR gRNA sequence
taattgagaatgacaaccac

SEQ ID NO: 392210 - DNA, 20 bp, Artificial
  CRISPR gRNA sequence
attgagaatgacaaccacaa

SEQ ID NO: 392211 - DNA, 20 bp, Artificial
  CRISPR gRNA sequence
agaatgacaaccacaaccat

SEQ ID NO: 392212 - DNA, 20 bp, Artificial
  CRISPR gRNA sequence
cagttgcattcagctgtcat

SEQ ID NO: 392213 - DNA, 20 bp, Artificial
  CRISPR gRNA sequence
agttgcattcagctgtcatt

SEQ ID NO: 392214 - DNA, 20 bp, Artificial
  CRISPR gRNA sequence
cattcagctgtcattctgtt

SEQ ID NO: 392215 - DNA, 20 bp, Artificial
  CRISPR gRNA sequence
agctgtcattctgttactcc

SEQ ID NO: 392216 - DNA, 20 bp, Artificial
  CRISPR gRNA sequence
tcattctgttactcccaata

SEQ ID NO: 392217 - DNA, 20 bp, Artificial
  CRISPR gRNA sequence
tgttactcccaataaaacag

SEQ ID NO: 392218 - DNA, 20 bp, Artificial
  CRISPR gRNA sequence
ttactcccaataaaacagaa

SEQ ID NO: 392219 - DNA, 20 bp, Artificial
  CRISPR gRNA sequence
ctcccaataaaacagaaatg

SEQ ID NO: 392220 - DNA, 20 bp, Artificial
  CRISPR gRNA sequence
ccaataaaacagaaatgttc

SEQ ID NO: 392221 - DNA, 20 bp, Artificial
  CRISPR gRNA sequence
atgctctaaagtaactaaca

SEQ ID NO: 392222 - DNA, 20 bp, Artificial
  CRISPR gRNA sequence
taaagtaactaacacaaata

SEQ ID NO: 392223 - DNA, 20 bp, Artificial
  CRISPR gRNA sequence
aagtaactaacacaaataac

SEQ ID NO: 392224 - DNA, 20 bp, Artificial
  CRISPR gRNA sequence
acacaaataaccatcaattg

SEQ ID NO: 392225 - DNA, 20 bp, Artificial
  CRISPR gRNA sequence
aggacctactatatttaaga

SEQ ID NO: 392226 - DNA, 20 bp, Artificial
  CRISPR gRNA sequence
ctatatttaagacaatgtcc

SEQ ID NO: 392227 - DNA, 20 bp, Artificial
  CRISPR gRNA sequence
tatttaagacaatgtcccaa

SEQ ID NO: 392228 - DNA, 20 bp, Artificial
  CRISPR gRNA sequence
aagacaatgtcccaaattct

SEQ ID NO: 392229 - DNA, 20 bp, Artificial
  CRISPR gRNA sequence
agacaatgtcccaaattctg

SEQ ID NO: 392230 - DNA, 20 bp, Artificial
  CRISPR gRNA sequence
tgagccaaatctcaaggaaa

SEQ ID NO: 392231 - DNA, 20 bp, Artificial
  CRISPR gRNA sequence
agccaaatctcaaggaaatt

SEQ ID NO: 392232 - DNA, 20 bp, Artificial
  CRISPR gRNA sequence
aaggaaattgcaaaggaaag

SEQ ID NO: 392233 - DNA, 20 bp, Artificial
  CRISPR gRNA sequence
caaaggaaagtcaaaggaat

SEQ ID NO: 392234 - DNA, 20 bp, Artificial
  CRISPR gRNA sequence
aaatcaataatgcaataggt

SEQ ID NO: 392235 - DNA, 20 bp, Artificial
  CRISPR gRNA sequence
actcgcctgaaagtaaattg

SEQ ID NO: 392236 - DNA, 20 bp, Artificial
  CRISPR gRNA sequence
gcctgaaagtaaattggcac

SEQ ID NO: 392237 - DNA, 20 bp, Artificial
  CRISPR gRNA sequence
aaagtaaattggcacaagaa

SEQ ID NO: 392238 - DNA, 20 bp, Artificial
  CRISPR gRNA sequence
gcacaagaaaacatccaaaa

SEQ ID NO: 392239 - DNA, 20 bp, Artificial
  CRISPR gRNA sequence
ttttactatcttagcatact

SEQ ID NO: 392240 - DNA, 20 bp, Artificial
  CRISPR gRNA sequence
tttactatcttagcatactc

SEQ ID NO: 392241 - DNA, 20 bp, Artificial
  CRISPR gRNA sequence
ttactatcttagcatactct

SEQ ID NO: 392242 - DNA, 20 bp, Artificial
  CRISPR gRNA sequence
tactatcttagcatactctg

SEQ ID NO: 392243 - DNA, 20 bp, Artificial
  CRISPR gRNA sequence
actatcttagcatactctga

SEQ ID NO: 392244 - DNA, 20 bp, Artificial
  CRISPR gRNA sequence
ctatcttagcatactctgat

SEQ ID NO: 392245 - DNA, 20 bp, Artificial
  CRISPR gRNA sequence
tcttagcatactctgatttt

SEQ ID NO: 392246 - DNA, 20 bp, Artificial
  CRISPR gRNA sequence
agcatactctgattttctag

SEQ ID NO: 392247 - DNA, 20 bp, Artificial
  CRISPR gRNA sequence
gcatactctgattttctaga

SEQ ID NO: 392248 - DNA, 20 bp, Artificial
  CRISPR gRNA sequence
tgattttctagaaattctac

SEQ ID NO: 392249 - DNA, 20 bp, Artificial
  CRISPR gRNA sequence
attttctagaaattctactc

SEQ ID NO: 392250 - DNA, 20 bp, Artificial
  CRISPR gRNA sequence
tctagaaattctactcttgt

SEQ ID NO: 392251 - DNA, 20 bp, Artificial
  CRISPR gRNA sequence
ctagaaattctactcttgtt

SEQ ID NO: 392252 - DNA, 20 bp, Artificial
  CRISPR gRNA sequence
tagaaattctactcttgttc

SEQ ID NO: 392253 - DNA, 20 bp, Artificial
  CRISPR gRNA sequence
gaaattctactcttgttcag

SEQ ID NO: 392254 - DNA, 20 bp, Artificial
  CRISPR gRNA sequence
tactcttgttcagtttaaag

SEQ ID NO: 392255 - DNA, 20 bp, Artificial
  CRISPR gRNA sequence
ctcttgttcagtttaaagtg

SEQ ID NO: 392256 - DNA, 20 bp, Artificial
  CRISPR gRNA sequence
ttgttcagtttaaagtgagg

SEQ ID NO: 392257 - DNA, 20 bp, Artificial
  CRISPR gRNA sequence
gttcagtttaaagtgaggga

SEQ ID NO: 392258 - DNA, 20 bp, Artificial
  CRISPR gRNA sequence
ttcagtttaaagtgagggaa

SEQ ID NO: 392259 - DNA, 20 bp, Artificial
  CRISPR gRNA sequence
agtttaaagtgagggaagat

SEQ ID NO: 392260 - DNA, 20 bp, Artificial
  CRISPR gRNA sequence
aaagtgagggaagattttac

SEQ ID NO: 392261 - DNA, 20 bp, Artificial
  CRISPR gRNA sequence
aagtgagggaagattttact

SEQ ID NO: 392262 - DNA, 20 bp, Artificial
  CRISPR gRNA sequence
tactttgaagtattagagct

SEQ ID NO: 392263 - DNA, 20 bp, Artificial
  CRISPR gRNA sequence
actttgaagtattagagctt

SEQ ID NO: 392264 - DNA, 20 bp, Artificial
  CRISPR gRNA sequence
ctttgaagtattagagcttt

SEQ ID NO: 392265 - DNA, 20 bp, Artificial
  CRISPR gRNA sequence
tgaagtattagagctttacc

SEQ ID NO: 392266 - DNA, 20 bp, Artificial
  CRISPR gRNA sequence
gaagtattagagctttacca

SEQ ID NO: 392267 - DNA, 20 bp, Artificial
  CRISPR gRNA sequence
aagtattagagctttaccag

SEQ ID NO: 392268 - DNA, 20 bp, Artificial
  CRISPR gRNA sequence
gagctttaccagagttgttc

SEQ ID NO: 392269 - DNA, 20 bp, Artificial
  CRISPR gRNA sequence
taccagagttgttcattttg

SEQ ID NO: 392270 - DNA, 20 bp, Artificial
  CRISPR gRNA sequence
accagagttgttcattttgg

SEQ ID NO: 392271 - DNA, 20 bp, Artificial
  CRISPR gRNA sequence
ccagagttgttcattttgga

SEQ ID NO: 392272 - DNA, 20 bp, Artificial
  CRISPR gRNA sequence
ttcattttggaaacagtatc

SEQ ID NO: 392273 - DNA, 20 bp, Artificial
  CRISPR gRNA sequence
attttggaaacagtatcgtt

SEQ ID NO: 392274 - DNA, 20 bp, Artificial
  CRISPR gRNA sequence
tggaaacagtatcgttaatg

SEQ ID NO: 392275 - DNA, 20 bp, Artificial
  CRISPR gRNA sequence
ggaaacagtatcgttaatga

SEQ ID NO: 392276 - DNA, 20 bp, Artificial
  CRISPR gRNA sequence
gaaacagtatcgttaatgat

SEQ ID NO: 392277 - DNA, 20 bp, Artificial
  CRISPR gRNA sequence
atgattgacaatgccattca

SEQ ID NO: 392278 - DNA, 20 bp, Artificial
  CRISPR gRNA sequence
acaatgccattcagggtaat

SEQ ID NO: 392279 - DNA, 20 bp, Artificial
  CRISPR gRNA sequence
agggtaatcacatcttctag

SEQ ID NO: 392280 - DNA, 20 bp, Artificial
  CRISPR gRNA sequence
ctagtcatagttcacggtga

SEQ ID NO: 392281 - DNA, 20 bp, Artificial
  CRISPR gRNA sequence
tagtcatagttcacggtgat

SEQ ID NO: 392282 - DNA, 20 bp, Artificial
  CRISPR gRNA sequence
gtcatagttcacggtgattc

SEQ ID NO: 392283 - DNA, 20 bp, Artificial
  CRISPR gRNA sequence
acggtgattctaaatggagg

SEQ ID NO: 392284 - DNA, 20 bp, Artificial
  CRISPR gRNA sequence
taaatggaggtgaacacatt

SEQ ID NO: 392285 - DNA, 20 bp, Artificial
  CRISPR gRNA sequence
aatggaggtgaacacatttc

SEQ ID NO: 392286 - DNA, 20 bp, Artificial
  CRISPR gRNA sequence
caccatttcattttatccct

SEQ ID NO: 392287 - DNA, 20 bp, Artificial
  CRISPR gRNA sequence
accatttcattttatccctc

SEQ ID NO: 392288 - DNA, 20 bp, Artificial
  CRISPR gRNA sequence
cattttatccctctcacaca

SEQ ID NO: 392289 - DNA, 20 bp, Artificial
  CRISPR gRNA sequence
attttatccctctcacacaa

SEQ ID NO: 392290 - DNA, 20 bp, Artificial
  CRISPR gRNA sequence
tatccctctcacacaatagc

SEQ ID NO: 392291 - DNA, 20 bp, Artificial
  CRISPR gRNA sequence
atccctctcacacaatagca

SEQ ID NO: 392292 - DNA, 20 bp, Artificial
  CRISPR gRNA sequence
tccctctcacacaatagcac

SEQ ID NO: 392293 - DNA, 20 bp, Artificial
  CRISPR gRNA sequence
tcacacaatagcacctggac

SEQ ID NO: 392294 - DNA, 20 bp, Artificial
  CRISPR gRNA sequence
acacaatagcacctggacac

SEQ ID NO: 392295 - DNA, 20 bp, Artificial
  CRISPR gRNA sequence
gacacgatttcaaaatggtt

SEQ ID NO: 392296 - DNA, 20 bp, Artificial
  CRISPR gRNA sequence
caaaatggttaaggagactt

SEQ ID NO: 392297 - DNA, 20 bp, Artificial
  CRISPR gRNA sequence
aaaatggttaaggagactta

SEQ ID NO: 392298 - DNA, 20 bp, Artificial
  CRISPR gRNA sequence
aggagacttataaagtattt

SEQ ID NO: 392299 - DNA, 20 bp, Artificial
  CRISPR gRNA sequence
ataaagtatttattacagaa

SEQ ID NO: 392300 - DNA, 20 bp, Artificial
  CRISPR gRNA sequence
taaagtatttattacagaag

SEQ ID NO: 392301 - DNA, 20 bp, Artificial
  CRISPR gRNA sequence
attacagaagagaacattgg

SEQ ID NO: 392302 - DNA, 20 bp, Artificial
  CRISPR gRNA sequence
ttacagaagagaacattgga

SEQ ID NO: 392303 - DNA, 20 bp, Artificial
  CRISPR gRNA sequence
cagaagagaacattggatct

SEQ ID NO: 392304 - DNA, 20 bp, Artificial
  CRISPR gRNA sequence
gatctgatagggttgacaat

SEQ ID NO: 392305 - DNA, 20 bp, Artificial
  CRISPR gRNA sequence
atagggttgacaatcattgc

SEQ ID NO: 392306 - DNA, 20 bp, Artificial
  CRISPR gRNA sequence
acaatcattgctatttgctt

SEQ ID NO: 392307 - DNA, 20 bp, Artificial
  CRISPR gRNA sequence
ctatttgctttattagtagc

SEQ ID NO: 392308 - DNA, 20 bp, Artificial
  CRISPR gRNA sequence
tttgctttattagtagcaga

SEQ ID NO: 392309 - DNA, 20 bp, Artificial
  CRISPR gRNA sequence
gctttattagtagcagaatg

SEQ ID NO: 392310 - DNA, 20 bp, Artificial
  CRISPR gRNA sequence
ctttattagtagcagaatga

SEQ ID NO: 392311 - DNA, 20 bp, Artificial
  CRISPR gRNA sequence
tattagtagcagaatgagta

SEQ ID NO: 392312 - DNA, 20 bp, Artificial
  CRISPR gRNA sequence
attagtagcagaatgagtaa

SEQ ID NO: 392313 - DNA, 20 bp, Artificial
  CRISPR gRNA sequence
ttagtagcagaatgagtaaa

SEQ ID NO: 392314 - DNA, 20 bp, Artificial
  CRISPR gRNA sequence
gtagcagaatgagtaaaaat

SEQ ID NO: 392315 - DNA, 20 bp, Artificial
  CRISPR gRNA sequence
tagcaaatgatcaaagagtc

SEQ ID NO: 392316 - DNA, 20 bp, Artificial
  CRISPR gRNA sequence
agcaaatgatcaaagagtcc

SEQ ID NO: 392317 - DNA, 20 bp, Artificial
  CRISPR gRNA sequence
gcaaatgatcaaagagtcca

SEQ ID NO: 392318 - DNA, 20 bp, Artificial
  CRISPR gRNA sequence
ttaatctaataaatgaattc

SEQ ID NO: 392319 - DNA, 20 bp, Artificial
  CRISPR gRNA sequence
taatctaataaatgaattca

SEQ ID NO: 392320 - DNA, 20 bp, Artificial
  CRISPR gRNA sequence
aatctaataaatgaattcaa

SEQ ID NO: 392321 - DNA, 20 bp, Artificial
  CRISPR gRNA sequence
atctaataaatgaattcaat

SEQ ID NO: 392322 - DNA, 20 bp, Artificial
  CRISPR gRNA sequence
ataaatgaattcaatgttaa

SEQ ID NO: 392323 - DNA, 20 bp, Artificial
  CRISPR gRNA sequence
aatgttaatataactaacca

SEQ ID NO: 392324 - DNA, 20 bp, Artificial
  CRISPR gRNA sequence
atataactaaccaaaggtcc

SEQ ID NO: 392325 - DNA, 20 bp, Artificial
  CRISPR gRNA sequence
accaaaggtcctcagctact

SEQ ID NO: 392326 - DNA, 20 bp, Artificial
  CRISPR gRNA sequence
agctactttttatcatgcca

SEQ ID NO: 392327 - DNA, 20 bp, Artificial
  CRISPR gRNA sequence
ctttttatcatgccatggtt

SEQ ID NO: 392328 - DNA, 20 bp, Artificial
  CRISPR gRNA sequence
tttatcatgccatggttctc

SEQ ID NO: 392329 - DNA, 20 bp, Artificial
  CRISPR gRNA sequence
ttatcatgccatggttctcc

SEQ ID NO: 392330 - DNA, 20 bp, Artificial
  CRISPR gRNA sequence
tatcatgccatggttctcca

SEQ ID NO: 392331 - DNA, 20 bp, Artificial
  CRISPR gRNA sequence
atcatgccatggttctccat

SEQ ID NO: 392332 - DNA, 20 bp, Artificial
  CRISPR gRNA sequence
tcatgccatggttctccatt

SEQ ID NO: 392333 - DNA, 20 bp, Artificial
  CRISPR gRNA sequence
tccatttgccagaattcatc

SEQ ID NO: 392334 - DNA, 20 bp, Artificial
  CRISPR gRNA sequence
catttgccagaattcatcta

SEQ ID NO: 392335 - DNA, 20 bp, Artificial
  CRISPR gRNA sequence
gccagaattcatctaacagc

SEQ ID NO: 392336 - DNA, 20 bp, Artificial
  CRISPR gRNA sequence
ccagaattcatctaacagcc

SEQ ID NO: 392337 - DNA, 20 bp, Artificial
  CRISPR gRNA sequence
atctaacagccccattaaaa

SEQ ID NO: 392338 - DNA, 20 bp, Artificial
  CRISPR gRNA sequence
acagccccattaaaattgta

SEQ ID NO: 392339 - DNA, 20 bp, Artificial
  CRISPR gRNA sequence
aaattgtaaacactggaagc

SEQ ID NO: 392340 - DNA, 20 bp, Artificial
  CRISPR gRNA sequence
taaacactggaagcaaagat

SEQ ID NO: 392341 - DNA, 20 bp, Artificial
  CRISPR gRNA sequence
gaagcaaagatgaaatggag

SEQ ID NO: 392342 - DNA, 20 bp, Artificial
  CRISPR gRNA sequence
ttttccagattacagttagt

SEQ ID NO: 392343 - DNA, 20 bp, Artificial
  CRISPR gRNA sequence
ttccagattacagttagttc

SEQ ID NO: 392344 - DNA, 20 bp, Artificial
  CRISPR gRNA sequence
tccagattacagttagttct

SEQ ID NO: 392345 - DNA, 20 bp, Artificial
  CRISPR gRNA sequence
ccagattacagttagttctc

SEQ ID NO: 392346 - DNA, 20 bp, Artificial
  CRISPR gRNA sequence
cagattacagttagttctca

SEQ ID NO: 392347 - DNA, 20 bp, Artificial
  CRISPR gRNA sequence
cagttagttctcaaatatac

SEQ ID NO: 392348 - DNA, 20 bp, Artificial
  CRISPR gRNA sequence
gttctcaaatatacctttgg

SEQ ID NO: 392349 - DNA, 20 bp, Artificial
  CRISPR gRNA sequence
tcaaatatacctttggaagc

SEQ ID NO: 392350 - DNA, 20 bp, Artificial
  CRISPR gRNA sequence
aaatatacctttggaagcta

SEQ ID NO: 392351 - DNA, 20 bp, Artificial
  CRISPR gRNA sequence
tggaagctaggtcagaaaga

SEQ ID NO: 392352 - DNA, 20 bp, Artificial
  CRISPR gRNA sequence
ggaagctaggtcagaaagaa

SEQ ID NO: 392353 - DNA, 20 bp, Artificial
  CRISPR gRNA sequence
gaagctaggtcagaaagaac

SEQ ID NO: 392354 - DNA, 20 bp, Artificial
  CRISPR gRNA sequence
ggtcagaaagaacttagata

SEQ ID NO: 392355 - DNA, 20 bp, Artificial
  CRISPR gRNA sequence
agataaatatgcttcctatg

SEQ ID NO: 392356 - DNA, 20 bp, Artificial
  CRISPR gRNA sequence
gataaatatgcttcctatga

SEQ ID NO: 392357 - DNA, 20 bp, Artificial
  CRISPR gRNA sequence
cctatgaattggtatatgtc

SEQ ID NO: 392358 - DNA, 20 bp, Artificial
  CRISPR gRNA sequence
ctatgaattggtatatgtcc

SEQ ID NO: 392359 - DNA, 20 bp, Artificial
  CRISPR gRNA sequence
tgaattggtatatgtcctat

SEQ ID NO: 392360 - DNA, 20 bp, Artificial
  CRISPR gRNA sequence
gtatatgtcctattgctacg

SEQ ID NO: 392361 - DNA, 20 bp, Artificial
  CRISPR gRNA sequence
ttgctacgcgccatttttta

SEQ ID NO: 392362 - DNA, 20 bp, Artificial
  CRISPR gRNA sequence
ctacgcgccattttttaaat

SEQ ID NO: 392363 - DNA, 20 bp, Artificial
  CRISPR gRNA sequence
cgcgccattttttaaatgcg

SEQ ID NO: 392364 - DNA, 20 bp, Artificial
  CRISPR gRNA sequence
tttaaatgcggaaactaatt

SEQ ID NO: 392365 - DNA, 20 bp, Artificial
  CRISPR gRNA sequence
ttaaatgcggaaactaattg

SEQ ID NO: 392366 - DNA, 20 bp, Artificial
  CRISPR gRNA sequence
taaatgcggaaactaattga

SEQ ID NO: 392367 - DNA, 20 bp, Artificial
  CRISPR gRNA sequence
aaatgcggaaactaattgaa

SEQ ID NO: 392368 - DNA, 20 bp, Artificial
  CRISPR gRNA sequence
aatgcggaaactaattgaaa

SEQ ID NO: 392369 - DNA, 20 bp, Artificial
  CRISPR gRNA sequence
attgaaatagttgctttgaa

SEQ ID NO: 392370 - DNA, 20 bp, Artificial
  CRISPR gRNA sequence
aaatagttgctttgaaatat

SEQ ID NO: 392371 - DNA, 20 bp, Artificial
  CRISPR gRNA sequence
ctttgaaatatttaagctca

SEQ ID NO: 392372 - DNA, 20 bp, Artificial
  CRISPR gRNA sequence
tgaaatatttaagctcagtg

SEQ ID NO: 392373 - DNA, 20 bp, Artificial
  CRISPR gRNA sequence
gaaatatttaagctcagtgt

SEQ ID NO: 392374 - DNA, 20 bp, Artificial
  CRISPR gRNA sequence
aaatatttaagctcagtgtt

SEQ ID NO: 392375 - DNA, 20 bp, Artificial
  CRISPR gRNA sequence
aagctcagtgtttgccattc

SEQ ID NO: 392376 - DNA, 20 bp, Artificial
  CRISPR gRNA sequence
agctcagtgtttgccattct

SEQ ID NO: 392377 - DNA, 20 bp, Artificial
  CRISPR gRNA sequence
agtgtttgccattctccttg

SEQ ID NO: 392378 - DNA, 20 bp, Artificial
  CRISPR gRNA sequence
gccattctccttggctcttt

SEQ ID NO: 392379 - DNA, 20 bp, Artificial
  CRISPR gRNA sequence
ccattctccttggctctttt

SEQ ID NO: 392380 - DNA, 20 bp, Artificial
  CRISPR gRNA sequence
tccttggctcttttatctca

SEQ ID NO: 392381 - DNA, 20 bp, Artificial
  CRISPR gRNA sequence
cttggctcttttatctcact

SEQ ID NO: 392382 - DNA, 20 bp, Artificial
  CRISPR gRNA sequence
ggctcttttatctcactaca

SEQ ID NO: 392383 - DNA, 20 bp, Artificial
  CRISPR gRNA sequence
gctcttttatctcactacac

SEQ ID NO: 392384 - DNA, 20 bp, Artificial
  CRISPR gRNA sequence
ttttatctcactacacactc

SEQ ID NO: 392385 - DNA, 20 bp, Artificial
  CRISPR gRNA sequence
ttatctcactacacactctt

SEQ ID NO: 392386 - DNA, 20 bp, Artificial
  CRISPR gRNA sequence
tatctcactacacactcttt

SEQ ID NO: 392387 - DNA, 20 bp, Artificial
  CRISPR gRNA sequence
atctcactacacactctttt

SEQ ID NO: 392388 - DNA, 20 bp, Artificial
  CRISPR gRNA sequence
tctcactacacactcttttt

SEQ ID NO: 392389 - DNA, 20 bp, Artificial
  CRISPR gRNA sequence
actacacactctttttctaa

SEQ ID NO: 392390 - DNA, 20 bp, Artificial
  CRISPR gRNA sequence
cacactctttttctaagtta

SEQ ID NO: 392391 - DNA, 20 bp, Artificial
  CRISPR gRNA sequence
tttttctaagttagggatga

SEQ ID NO: 392392 - DNA, 20 bp, Artificial
  CRISPR gRNA sequence
tttctaagttagggatgact

SEQ ID NO: 392393 - DNA, 20 bp, Artificial
  CRISPR gRNA sequence
ttctaagttagggatgactt

SEQ ID NO: 392394 - DNA, 20 bp, Artificial
  CRISPR gRNA sequence
tctaagttagggatgacttc

SEQ ID NO: 392395 - DNA, 20 bp, Artificial
  CRISPR gRNA sequence
ctaagttagggatgacttcc

SEQ ID NO: 392396 - DNA, 20 bp, Artificial
  CRISPR gRNA sequence
taagttagggatgacttcca

SEQ ID NO: 392397 - DNA, 20 bp, Artificial
  CRISPR gRNA sequence
agttagggatgacttccatt

SEQ ID NO: 392398 - DNA, 20 bp, Artificial
  CRISPR gRNA sequence
gggatgacttccatttcccc

SEQ ID NO: 392399 - DNA, 20 bp, Artificial
  CRISPR gRNA sequence
ccatttcccctgcatagtac

SEQ ID NO: 392400 - DNA, 20 bp, Artificial
  CRISPR gRNA sequence
catttcccctgcatagtacg

SEQ ID NO: 392401 - DNA, 20 bp, Artificial
  CRISPR gRNA sequence
cccctgcatagtacgcactt

SEQ ID NO: 392402 - DNA, 20 bp, Artificial
  CRISPR gRNA sequence
ccctgcatagtacgcacttc

SEQ ID NO: 392403 - DNA, 20 bp, Artificial
  CRISPR gRNA sequence
catagtacgcacttccccga

SEQ ID NO: 392404 - DNA, 20 bp, Artificial
  CRISPR gRNA sequence
ccccgaagtctgcaatttaa

SEQ ID NO: 392405 - DNA, 20 bp, Artificial
  CRISPR gRNA sequence
cccgaagtctgcaatttaat

SEQ ID NO: 392406 - DNA, 20 bp, Artificial
  CRISPR gRNA sequence
caatttaatttccacctcca

SEQ ID NO: 392407 - DNA, 20 bp, Artificial
  CRISPR gRNA sequence
aatttccacctccataattt

SEQ ID NO: 392408 - DNA, 20 bp, Artificial
  CRISPR gRNA sequence
atttccacctccataatttt

SEQ ID NO: 392409 - DNA, 20 bp, Artificial
  CRISPR gRNA sequence
ccacctccataattttaaat

SEQ ID NO: 392410 - DNA, 20 bp, Artificial
  CRISPR gRNA sequence
cacctccataattttaaata

SEQ ID NO: 392411 - DNA, 20 bp, Artificial
  CRISPR gRNA sequence
cataattttaaatattttaa

SEQ ID NO: 392412 - DNA, 20 bp, Artificial
  CRISPR gRNA sequence
taaatattttaaagttatca

SEQ ID NO: 392413 - DNA, 20 bp, Artificial
  CRISPR gRNA sequence
aaatattttaaagttatcat

SEQ ID NO: 392414 - DNA, 20 bp, Artificial
  CRISPR gRNA sequence
aatattttaaagttatcatt

SEQ ID NO: 392415 - DNA, 20 bp, Artificial
  CRISPR gRNA sequence
taaagttatcattttacact

SEQ ID NO: 392416 - DNA, 20 bp, Artificial
  CRISPR gRNA sequence
aaagttatcattttacactc

SEQ ID NO: 392417 - DNA, 20 bp, Artificial
  CRISPR gRNA sequence
aagttatcattttacactct

SEQ ID NO: 392418 - DNA, 20 bp, Artificial
  CRISPR gRNA sequence
tcattttacactctcaattt

SEQ ID NO: 392419 - DNA, 20 bp, Artificial
  CRISPR gRNA sequence
tacactctcaattttcctct

SEQ ID NO: 392420 - DNA, 20 bp, Artificial
  CRISPR gRNA sequence
acactctcaattttcctcta

SEQ ID NO: 392421 - DNA, 20 bp, Artificial
  CRISPR gRNA sequence
cactctcaattttcctctac

SEQ ID NO: 392422 - DNA, 20 bp, Artificial
  CRISPR gRNA sequence
tcaattttcctctacaattg

SEQ ID NO: 392423 - DNA, 20 bp, Artificial
  CRISPR gRNA sequence
aattttcctctacaattgcc

SEQ ID NO: 392424 - DNA, 20 bp, Artificial
  CRISPR gRNA sequence
tcctctacaattgccttcat

SEQ ID NO: 392425 - DNA, 20 bp, Artificial
  CRISPR gRNA sequence
cctctacaattgccttcata

SEQ ID NO: 392426 - DNA, 20 bp, Artificial
  CRISPR gRNA sequence
ctctacaattgccttcataa

SEQ ID NO: 392427 - DNA, 20 bp, Artificial
  CRISPR gRNA sequence
tacaattgccttcataatgg

SEQ ID NO: 392428 - DNA, 20 bp, Artificial
  CRISPR gRNA sequence
caattgccttcataatggct

SEQ ID NO: 392429 - DNA, 20 bp, Artificial
  CRISPR gRNA sequence
ccttcataatggcttcctaa

SEQ ID NO: 392430 - DNA, 20 bp, Artificial
  CRISPR gRNA sequence
cataatggcttcctaactct

SEQ ID NO: 392431 - DNA, 20 bp, Artificial
  CRISPR gRNA sequence
ataatggcttcctaactcta

SEQ ID NO: 392432 - DNA, 20 bp, Artificial
  CRISPR gRNA sequence
cctaactctactgtcttgga

SEQ ID NO: 392433 - DNA, 20 bp, Artificial
  CRISPR gRNA sequence
ctaactctactgtcttggaa

SEQ ID NO: 392434 - DNA, 20 bp, Artificial
  CRISPR gRNA sequence
actctactgtcttggaatta

SEQ ID NO: 392435 - DNA, 20 bp, Artificial
  CRISPR gRNA sequence
tactgtcttggaattacatt

SEQ ID NO: 392436 - DNA, 20 bp, Artificial
  CRISPR gRNA sequence
ctgtcttggaattacatttt

SEQ ID NO: 392437 - DNA, 20 bp, Artificial
  CRISPR gRNA sequence
tcttggaattacatttttca

SEQ ID NO: 392438 - DNA, 20 bp, Artificial
  CRISPR gRNA sequence
ggaattacatttttcacatt

SEQ ID NO: 392439 - DNA, 20 bp, Artificial
  CRISPR gRNA sequence
gaattacatttttcacattt

SEQ ID NO: 392440 - DNA, 20 bp, Artificial
  CRISPR gRNA sequence
catttttcacatttataggt

SEQ ID NO: 392441 - DNA, 20 bp, Artificial
  CRISPR gRNA sequence
ttcacatttataggtttgtc

SEQ ID NO: 392442 - DNA, 20 bp, Artificial
  CRISPR gRNA sequence
tcacatttataggtttgtct

SEQ ID NO: 392443 - DNA, 20 bp, Artificial
  CRISPR gRNA sequence
cacatttataggtttgtctt

SEQ ID NO: 392444 - DNA, 20 bp, Artificial
  CRISPR gRNA sequence
acatttataggtttgtcttt

SEQ ID NO: 392445 - DNA, 20 bp, Artificial
  CRISPR gRNA sequence
ataggtttgtcttttaaaag

SEQ ID NO: 392446 - DNA, 20 bp, Artificial
  CRISPR gRNA sequence
taggtttgtcttttaaaagc

SEQ ID NO: 392447 - DNA, 20 bp, Artificial
  CRISPR gRNA sequence
gtcttttaaaagcaaaacaa

SEQ ID NO: 392448 - DNA, 20 bp, Artificial
  CRISPR gRNA sequence
tcttttaaaagcaaaacaaa

SEQ ID NO: 392449 - DNA, 20 bp, Artificial
  CRISPR gRNA sequence
ttaaaagcaaaacaaaacaa

SEQ ID NO: 392450 - DNA, 20 bp, Artificial
  CRISPR gRNA sequence
taaaagcaaaacaaaacaaa

SEQ ID NO: 392451 - DNA, 20 bp, Artificial
  CRISPR gRNA sequence
aaaagcaaaacaaaacaaaa

SEQ ID NO: 392452 - DNA, 20 bp, Artificial
  CRISPR gRNA sequence
aaagcaaaacaaaacaaaaa

SEQ ID NO: 392453 - DNA, 20 bp, Artificial
  CRISPR gRNA sequence
ggggatcagaatcaaatcac

SEQ ID NO: 392454 - DNA, 20 bp, Artificial
  CRISPR gRNA sequence
gggatcagaatcaaatcaca

SEQ ID NO: 392455 - DNA, 20 bp, Artificial
  CRISPR gRNA sequence
cagatataccctaatgtgag

SEQ ID NO: 392456 - DNA, 20 bp, Artificial
  CRISPR gRNA sequence
atgtgaggtttattgcagtt

SEQ ID NO: 392457 - DNA, 20 bp, Artificial
  CRISPR gRNA sequence
attgcagttgtgctatttca

SEQ ID NO: 392458 - DNA, 20 bp, Artificial
  CRISPR gRNA sequence
ttgcagttgtgctatttcat

SEQ ID NO: 392459 - DNA, 20 bp, Artificial
  CRISPR gRNA sequence
cagttgtgctatttcatttc

SEQ ID NO: 392460 - DNA, 20 bp, Artificial
  CRISPR gRNA sequence
tgctatttcatttcagaggt

SEQ ID NO: 392461 - DNA, 20 bp, Artificial
  CRISPR gRNA sequence
tttcatttcagaggtatatt

SEQ ID NO: 392462 - DNA, 20 bp, Artificial
  CRISPR gRNA sequence
catttcagaggtatattact

SEQ ID NO: 392463 - DNA, 20 bp, Artificial
  CRISPR gRNA sequence
atttcagaggtatattactg

SEQ ID NO: 392464 - DNA, 20 bp, Artificial
  CRISPR gRNA sequence
cagaggtatattactgtaga

SEQ ID NO: 392465 - DNA, 20 bp, Artificial
  CRISPR gRNA sequence
agaggtatattactgtagaa

SEQ ID NO: 392466 - DNA, 20 bp, Artificial
  CRISPR gRNA sequence
ctgtagaataacagttaaga

SEQ ID NO: 392467 - DNA, 20 bp, Artificial
  CRISPR gRNA sequence
tagaataacagttaagagaa

SEQ ID NO: 392468 - DNA, 20 bp, Artificial
  CRISPR gRNA sequence
agagaacaaagcatattttt

SEQ ID NO: 392469 - DNA, 20 bp, Artificial
  CRISPR gRNA sequence
tttgcctgtcaatagattca

SEQ ID NO: 392470 - DNA, 20 bp, Artificial
  CRISPR gRNA sequence
ttgcctgtcaatagattcaa

SEQ ID NO: 392471 - DNA, 20 bp, Artificial
  CRISPR gRNA sequence
tgcctgtcaatagattcaat

SEQ ID NO: 392472 - DNA, 20 bp, Artificial
  CRISPR gRNA sequence
gcctgtcaatagattcaatt

SEQ ID NO: 392473 - DNA, 20 bp, Artificial
  CRISPR gRNA sequence
cctgtcaatagattcaattg

SEQ ID NO: 392474 - DNA, 20 bp, Artificial
  CRISPR gRNA sequence
tcaatagattcaattgcatt

SEQ ID NO: 392475 - DNA, 20 bp, Artificial
  CRISPR gRNA sequence
aattgcattttacagcaaaa

SEQ ID NO: 392476 - DNA, 20 bp, Artificial
  CRISPR gRNA sequence
cattttacagcaaaaataat

SEQ ID NO: 392477 - DNA, 20 bp, Artificial
  CRISPR gRNA sequence
tacagcaaaaataatttact

SEQ ID NO: 392478 - DNA, 20 bp, Artificial
  CRISPR gRNA sequence
acagcaaaaataatttactc

SEQ ID NO: 392479 - DNA, 20 bp, Artificial
  CRISPR gRNA sequence
cagcaaaaataatttactcg

SEQ ID NO: 392480 - DNA, 20 bp, Artificial
  CRISPR gRNA sequence
actcgcaggtttaaattaga

SEQ ID NO: 392481 - DNA, 20 bp, Artificial
  CRISPR gRNA sequence
ctcgcaggtttaaattagac

SEQ ID NO: 392482 - DNA, 20 bp, Artificial
  CRISPR gRNA sequence
gcaggtttaaattagacatc

SEQ ID NO: 392483 - DNA, 20 bp, Artificial
  CRISPR gRNA sequence
aaattagacatctaagtgat

SEQ ID NO: 392484 - DNA, 20 bp, Artificial
  CRISPR gRNA sequence
aattagacatctaagtgatg

SEQ ID NO: 392485 - DNA, 20 bp, Artificial
  CRISPR gRNA sequence
gacatctaagtgatgcaaat

SEQ ID NO: 392486 - DNA, 20 bp, Artificial
  CRISPR gRNA sequence
agtgatgcaaataaataaat

SEQ ID NO: 392487 - DNA, 20 bp, Artificial
  CRISPR gRNA sequence
atgatttcagcaaccagaga

SEQ ID NO: 392488 - DNA, 20 bp, Artificial
  CRISPR gRNA sequence
cagcaaccagagataaccac

SEQ ID NO: 392489 - DNA, 20 bp, Artificial
  CRISPR gRNA sequence
agcaaccagagataaccaca

SEQ ID NO: 392490 - DNA, 20 bp, Artificial
  CRISPR gRNA sequence
atttgtgatttatttgtaat

SEQ ID NO: 392491 - DNA, 20 bp, Artificial
  CRISPR gRNA sequence
gtgatttatttgtaatatac

SEQ ID NO: 392492 - DNA, 20 bp, Artificial
  CRISPR gRNA sequence
tgatttatttgtaatatacc

SEQ ID NO: 392493 - DNA, 20 bp, Artificial
  CRISPR gRNA sequence
atttgtaatataccacaaac

SEQ ID NO: 392494 - DNA, 20 bp, Artificial
  CRISPR gRNA sequence
tttgtaatataccacaaaca

SEQ ID NO: 392495 - DNA, 20 bp, Artificial
  CRISPR gRNA sequence
gtaatataccacaaacaaaa

SEQ ID NO: 392496 - DNA, 20 bp, Artificial
  CRISPR gRNA sequence
taatataccacaaacaaaac

SEQ ID NO: 392497 - DNA, 20 bp, Artificial
  CRISPR gRNA sequence
aaaacttcaatgtatatttc

SEQ ID NO: 392498 - DNA, 20 bp, Artificial
  CRISPR gRNA sequence
caatgtatatttcaggaaaa

SEQ ID NO: 392499 - DNA, 20 bp, Artificial
  CRISPR gRNA sequence
aatgtatatttcaggaaaag

SEQ ID NO: 392500 - DNA, 20 bp, Artificial
  CRISPR gRNA sequence
caggaaaagattaatttggt

SEQ ID NO: 392501 - DNA, 20 bp, Artificial
  CRISPR gRNA sequence
aggaaaagattaatttggtg

SEQ ID NO: 392502 - DNA, 20 bp, Artificial
  CRISPR gRNA sequence
atttggtgtgtggttactta

SEQ ID NO: 392503 - DNA, 20 bp, Artificial
  CRISPR gRNA sequence
ggtgtgtggttacttataaa

SEQ ID NO: 392504 - DNA, 20 bp, Artificial
  CRISPR gRNA sequence
gtgtgtggttacttataaaa

SEQ ID NO: 392505 - DNA, 20 bp, Artificial
  CRISPR gRNA sequence
cttataaaatcatgtaagag

SEQ ID NO: 392506 - DNA, 20 bp, Artificial
  CRISPR gRNA sequence
ataaaatcatgtaagagtaa

SEQ ID NO: 392507 - DNA, 20 bp, Artificial
  CRISPR gRNA sequence
taaaatcatgtaagagtaac

SEQ ID NO: 392508 - DNA, 20 bp, Artificial
  CRISPR gRNA sequence
taaataatagaatttaagaa

SEQ ID NO: 392509 - DNA, 20 bp, Artificial
  CRISPR gRNA sequence
aaataatagaatttaagaat

SEQ ID NO: 392510 - DNA, 20 bp, Artificial
  CRISPR gRNA sequence
aataatagaatttaagaatg

SEQ ID NO: 392511 - DNA, 20 bp, Artificial
  CRISPR gRNA sequence
aagaatgctctagtcctaaa

SEQ ID NO: 392512 - DNA, 20 bp, Artificial
  CRISPR gRNA sequence
agaatgctctagtcctaaag

SEQ ID NO: 392513 - DNA, 20 bp, Artificial
  CRISPR gRNA sequence
tagtcctaaagaataattta

SEQ ID NO: 392514 - DNA, 20 bp, Artificial
  CRISPR gRNA sequence
gtcctaaagaataatttagt

SEQ ID NO: 392515 - DNA, 20 bp, Artificial
  CRISPR gRNA sequence
aagaataatttagtatgaca

SEQ ID NO: 392516 - DNA, 20 bp, Artificial
  CRISPR gRNA sequence
agtatgacattgaccatcta

SEQ ID NO: 392517 - DNA, 20 bp, Artificial
  CRISPR gRNA sequence
gtatgacattgaccatctaa

SEQ ID NO: 392518 - DNA, 20 bp, Artificial
  CRISPR gRNA sequence
accatctaaccatccctcta

SEQ ID NO: 392519 - DNA, 20 bp, Artificial
  CRISPR gRNA sequence
accatccctctatttcctct

SEQ ID NO: 392520 - DNA, 20 bp, Artificial
  CRISPR gRNA sequence
tatttcctctcccaaaatat

SEQ ID NO: 392521 - DNA, 20 bp, Artificial
  CRISPR gRNA sequence
tttcctctcccaaaatatag

SEQ ID NO: 392522 - DNA, 20 bp, Artificial
  CRISPR gRNA sequence
cctctcccaaaatatagttc

SEQ ID NO: 392523 - DNA, 20 bp, Artificial
  CRISPR gRNA sequence
ctctcccaaaatatagttcg

SEQ ID NO: 392524 - DNA, 20 bp, Artificial
  CRISPR gRNA sequence
tcccaaaatatagttcggat

SEQ ID NO: 392525 - DNA, 20 bp, Artificial
  CRISPR gRNA sequence
ccaaaatatagttcggatgc

SEQ ID NO: 392526 - DNA, 20 bp, Artificial
  CRISPR gRNA sequence
ggatgctgaaagtgaaatac

SEQ ID NO: 392527 - DNA, 20 bp, Artificial
  CRISPR gRNA sequence
aaagtgaaatacaccttaaa

SEQ ID NO: 392528 - DNA, 20 bp, Artificial
  CRISPR gRNA sequence
aaaaaataaaaggtaaaata

SEQ ID NO: 392529 - DNA, 20 bp, Artificial
  CRISPR gRNA sequence
aaaaataaaaggtaaaatat

SEQ ID NO: 392530 - DNA, 20 bp, Artificial
  CRISPR gRNA sequence
tcagactaatctgtactgaa

SEQ ID NO: 392531 - DNA, 20 bp, Artificial
  CRISPR gRNA sequence
atctgtactgaataaaatac

SEQ ID NO: 392532 - DNA, 20 bp, Artificial
  CRISPR gRNA sequence
tactgaataaaataccctcc

SEQ ID NO: 392533 - DNA, 20 bp, Artificial
  CRISPR gRNA sequence
aataaaataccctccggaaa

SEQ ID NO: 392534 - DNA, 20 bp, Artificial
  CRISPR gRNA sequence
cggaaagccatgactcaaaa

SEQ ID NO: 392535 - DNA, 20 bp, Artificial
  CRISPR gRNA sequence
aaaacatttatcatctcaac

SEQ ID NO: 392536 - DNA, 20 bp, Artificial
  CRISPR gRNA sequence
atcatctcaacaagaaacaa

SEQ ID NO: 392537 - DNA, 20 bp, Artificial
  CRISPR gRNA sequence
tcatctcaacaagaaacaat

SEQ ID NO: 392538 - DNA, 20 bp, Artificial
  CRISPR gRNA sequence
aacaagaaacaatgatgtgt

SEQ ID NO: 392539 - DNA, 20 bp, Artificial
  CRISPR gRNA sequence
gattcataaagtaatacaaa

SEQ ID NO: 392540 - DNA, 20 bp, Artificial
  CRISPR gRNA sequence
attcataaagtaatacaaaa

SEQ ID NO: 392541 - DNA, 20 bp, Artificial
  CRISPR gRNA sequence
ataaagtaatacaaaaagta

SEQ ID NO: 392542 - DNA, 20 bp, Artificial
  CRISPR gRNA sequence
gttttcctgatgtttagaca

SEQ ID NO: 392543 - DNA, 20 bp, Artificial
  CRISPR gRNA sequence
ttttcctgatgtttagacaa

SEQ ID NO: 392544 - DNA, 20 bp, Artificial
  CRISPR gRNA sequence
tcctgatgtttagacaagca

SEQ ID NO: 392545 - DNA, 20 bp, Artificial
  CRISPR gRNA sequence
cctgatgtttagacaagcat

SEQ ID NO: 392546 - DNA, 20 bp, Artificial
  CRISPR gRNA sequence
ctgatgtttagacaagcatc

SEQ ID NO: 392547 - DNA, 20 bp, Artificial
  CRISPR gRNA sequence
atgtttagacaagcatcaaa

SEQ ID NO: 392548 - DNA, 20 bp, Artificial
  CRISPR gRNA sequence
agacaagcatcaaaccacac

SEQ ID NO: 392549 - DNA, 20 bp, Artificial
  CRISPR gRNA sequence
gacaagcatcaaaccacaca

SEQ ID NO: 392550 - DNA, 20 bp, Artificial
  CRISPR gRNA sequence
tttaatgagtcattggacta

SEQ ID NO: 392551 - DNA, 20 bp, Artificial
  CRISPR gRNA sequence
ttaatgagtcattggactag

SEQ ID NO: 392552 - DNA, 20 bp, Artificial
  CRISPR gRNA sequence
taatgagtcattggactaga

SEQ ID NO: 392553 - DNA, 20 bp, Artificial
  CRISPR gRNA sequence
aatgagtcattggactagaa

SEQ ID NO: 392554 - DNA, 20 bp, Artificial
  CRISPR gRNA sequence
atgagtcattggactagaaa

SEQ ID NO: 392555 - DNA, 20 bp, Artificial
  CRISPR gRNA sequence
gactagaaatctgagcttta

SEQ ID NO: 392556 - DNA, 20 bp, Artificial
  CRISPR gRNA sequence
gaaatctgagctttatcttt

SEQ ID NO: 392557 - DNA, 20 bp, Artificial
  CRISPR gRNA sequence
agctttatctttcatactaa

SEQ ID NO: 392558 - DNA, 20 bp, Artificial
  CRISPR gRNA sequence
tatctttcatactaaataca

SEQ ID NO: 392559 - DNA, 20 bp, Artificial
  CRISPR gRNA sequence
atctttcatactaaatacac

SEQ ID NO: 392560 - DNA, 20 bp, Artificial
  CRISPR gRNA sequence
tctttcatactaaatacacg

SEQ ID NO: 392561 - DNA, 20 bp, Artificial
  CRISPR gRNA sequence
tcatactaaatacacggttc

SEQ ID NO: 392562 - DNA, 20 bp, Artificial
  CRISPR gRNA sequence
catactaaatacacggttca

SEQ ID NO: 392563 - DNA, 20 bp, Artificial
  CRISPR gRNA sequence
atactaaatacacggttcat

SEQ ID NO: 392564 - DNA, 20 bp, Artificial
  CRISPR gRNA sequence
aatacacggttcatccacta

SEQ ID NO: 392565 - DNA, 20 bp, Artificial
  CRISPR gRNA sequence
atccactagggtatcaacct

SEQ ID NO: 392566 - DNA, 20 bp, Artificial
  CRISPR gRNA sequence
gggtatcaacctactagggg

SEQ ID NO: 392567 - DNA, 20 bp, Artificial
  CRISPR gRNA sequence
ctaggggcatgaactgtcct

SEQ ID NO: 392568 - DNA, 20 bp, Artificial
  CRISPR gRNA sequence
ggggcatgaactgtcctttt

SEQ ID NO: 392569 - DNA, 20 bp, Artificial
  CRISPR gRNA sequence
tcctttttatacattttgta

SEQ ID NO: 392570 - DNA, 20 bp, Artificial
  CRISPR gRNA sequence
tttatacattttgtacataa

SEQ ID NO: 392571 - DNA, 20 bp, Artificial
  CRISPR gRNA sequence
ttatacattttgtacataag

SEQ ID NO: 392572 - DNA, 20 bp, Artificial
  CRISPR gRNA sequence
tatacattttgtacataagg

SEQ ID NO: 392573 - DNA, 20 bp, Artificial
  CRISPR gRNA sequence
atacattttgtacataaggg

SEQ ID NO: 392574 - DNA, 20 bp, Artificial
  CRISPR gRNA sequence
tacattttgtacataaggga

SEQ ID NO: 392575 - DNA, 20 bp, Artificial
  CRISPR gRNA sequence
tgtacataagggaacagacg

SEQ ID NO: 392576 - DNA, 20 bp, Artificial
  CRISPR gRNA sequence
gtacataagggaacagacga

SEQ ID NO: 392577 - DNA, 20 bp, Artificial
  CRISPR gRNA sequence
tacataagggaacagacgag

SEQ ID NO: 392578 - DNA, 20 bp, Artificial
  CRISPR gRNA sequence
ttatactcaatatgagcacc

SEQ ID NO: 392579 - DNA, 20 bp, Artificial
  CRISPR gRNA sequence
atactcaatatgagcaccca

SEQ ID NO: 392580 - DNA, 20 bp, Artificial
  CRISPR gRNA sequence
tactcaatatgagcacccaa

SEQ ID NO: 392581 - DNA, 20 bp, Artificial
  CRISPR gRNA sequence
aatatgagcacccaatgggc

SEQ ID NO: 392582 - DNA, 20 bp, Artificial
  CRISPR gRNA sequence
attatatgctcatcaagttt

SEQ ID NO: 392583 - DNA, 20 bp, Artificial
  CRISPR gRNA sequence
tatgctcatcaagtttgctt

SEQ ID NO: 392584 - DNA, 20 bp, Artificial
  CRISPR gRNA sequence
atcaagtttgctttaaggga

SEQ ID NO: 392585 - DNA, 20 bp, Artificial
  CRISPR gRNA sequence
gctttaagggatgttgagag

SEQ ID NO: 392586 - DNA, 20 bp, Artificial
  CRISPR gRNA sequence
ctttaagggatgttgagaga

SEQ ID NO: 392587 - DNA, 20 bp, Artificial
  CRISPR gRNA sequence
taagggatgttgagagagca

SEQ ID NO: 392588 - DNA, 20 bp, Artificial
  CRISPR gRNA sequence
aagggatgttgagagagcag

SEQ ID NO: 392589 - DNA, 20 bp, Artificial
  CRISPR gRNA sequence
agggatgttgagagagcagt

SEQ ID NO: 392590 - DNA, 20 bp, Artificial
  CRISPR gRNA sequence
agagagcagtataactttct

SEQ ID NO: 392591 - DNA, 20 bp, Artificial
  CRISPR gRNA sequence
tctgcatacgaattctgaac

SEQ ID NO: 392592 - DNA, 20 bp, Artificial
  CRISPR gRNA sequence
ctgcatacgaattctgaacc

SEQ ID NO: 392593 - DNA, 20 bp, Artificial
  CRISPR gRNA sequence
tgcatacgaattctgaacct

SEQ ID NO: 392594 - DNA, 20 bp, Artificial
  CRISPR gRNA sequence
catacgaattctgaaccttt

SEQ ID NO: 392595 - DNA, 20 bp, Artificial
  CRISPR gRNA sequence
tgaacctttgtgacatggta

SEQ ID NO: 392596 - DNA, 20 bp, Artificial
  CRISPR gRNA sequence
aacctttgtgacatggtatc

SEQ ID NO: 392597 - DNA, 20 bp, Artificial
  CRISPR gRNA sequence
tgtgacatggtatccttctg

SEQ ID NO: 392598 - DNA, 20 bp, Artificial
  CRISPR gRNA sequence
gtgacatggtatccttctga

SEQ ID NO: 392599 - DNA, 20 bp, Artificial
  CRISPR gRNA sequence
tgacatggtatccttctgac

SEQ ID NO: 392600 - DNA, 20 bp, Artificial
  CRISPR gRNA sequence
ctgacaatctctatcttggt

SEQ ID NO: 392601 - DNA, 20 bp, Artificial
  CRISPR gRNA sequence
tgacaatctctatcttggtt

SEQ ID NO: 392602 - DNA, 20 bp, Artificial
  CRISPR gRNA sequence
acaatctctatcttggttaa

SEQ ID NO: 392603 - DNA, 20 bp, Artificial
  CRISPR gRNA sequence
tatcttggttaataccatct

SEQ ID NO: 392604 - DNA, 20 bp, Artificial
  CRISPR gRNA sequence
tcttggttaataccatctcc

SEQ ID NO: 392605 - DNA, 20 bp, Artificial
  CRISPR gRNA sequence
ggttaataccatctccccac

SEQ ID NO: 392606 - DNA, 20 bp, Artificial
  CRISPR gRNA sequence
gttaataccatctccccaca

SEQ ID NO: 392607 - DNA, 20 bp, Artificial
  CRISPR gRNA sequence
ataccatctccccacatgac

SEQ ID NO: 392608 - DNA, 20 bp, Artificial
  CRISPR gRNA sequence
cccacatgacctgctatcaa

SEQ ID NO: 392609 - DNA, 20 bp, Artificial
  CRISPR gRNA sequence
ctatcaagatttgaagccaa

SEQ ID NO: 392610 - DNA, 20 bp, Artificial
  CRISPR gRNA sequence
tcaagatttgaagccaagct

SEQ ID NO: 392611 - DNA, 20 bp, Artificial
  CRISPR gRNA sequence
gaagccaagcttcactcctt

SEQ ID NO: 392612 - DNA, 20 bp, Artificial
  CRISPR gRNA sequence
aagccaagcttcactccttc

SEQ ID NO: 392613 - DNA, 20 bp, Artificial
  CRISPR gRNA sequence
cactccttcctttgtgcatc

SEQ ID NO: 392614 - DNA, 20 bp, Artificial
  CRISPR gRNA sequence
actccttcctttgtgcatcc

SEQ ID NO: 392615 - DNA, 20 bp, Artificial
  CRISPR gRNA sequence
cttcctttgtgcatccctcc

SEQ ID NO: 392616 - DNA, 20 bp, Artificial
  CRISPR gRNA sequence
cctttgtgcatccctcccat

SEQ ID NO: 392617 - DNA, 20 bp, Artificial
  CRISPR gRNA sequence
ctttgtgcatccctcccatt

SEQ ID NO: 392618 - DNA, 20 bp, Artificial
  CRISPR gRNA sequence
tgtgcatccctcccatttca

SEQ ID NO: 392619 - DNA, 20 bp, Artificial
  CRISPR gRNA sequence
gtgcatccctcccatttcac

SEQ ID NO: 392620 - DNA, 20 bp, Artificial
  CRISPR gRNA sequence
tgcatccctcccatttcact

SEQ ID NO: 392621 - DNA, 20 bp, Artificial
  CRISPR gRNA sequence
ccatttcactcacacccaaa

SEQ ID NO: 392622 - DNA, 20 bp, Artificial
  CRISPR gRNA sequence
cactcacacccaaatcctgt

SEQ ID NO: 392623 - DNA, 20 bp, Artificial
  CRISPR gRNA sequence
actcacacccaaatcctgtc

SEQ ID NO: 392624 - DNA, 20 bp, Artificial
  CRISPR gRNA sequence
acacccaaatcctgtcactt

SEQ ID NO: 392625 - DNA, 20 bp, Artificial
  CRISPR gRNA sequence
tcacttcctcctccttaata

SEQ ID NO: 392626 - DNA, 20 bp, Artificial
  CRISPR gRNA sequence
cctcctccttaatagcctta

SEQ ID NO: 392627 - DNA, 20 bp, Artificial
  CRISPR gRNA sequence
ctcctccttaatagccttac

SEQ ID NO: 392628 - DNA, 20 bp, Artificial
  CRISPR gRNA sequence
ctccttaatagccttacatc

SEQ ID NO: 392629 - DNA, 20 bp, Artificial
  CRISPR gRNA sequence
cttaatagccttacatctgc

SEQ ID NO: 392630 - DNA, 20 bp, Artificial
  CRISPR gRNA sequence
aatagccttacatctgccta

SEQ ID NO: 392631 - DNA, 20 bp, Artificial
  CRISPR gRNA sequence
atagccttacatctgcctac

SEQ ID NO: 392632 - DNA, 20 bp, Artificial
  CRISPR gRNA sequence
acatctgcctacttctctgc

SEQ ID NO: 392633 - DNA, 20 bp, Artificial
  CRISPR gRNA sequence
catctgcctacttctctgct

SEQ ID NO: 392634 - DNA, 20 bp, Artificial
  CRISPR gRNA sequence
cctacttctctgctttccca

SEQ ID NO: 392635 - DNA, 20 bp, Artificial
  CRISPR gRNA sequence
cttctctgctttcccacttg

SEQ ID NO: 392636 - DNA, 20 bp, Artificial
  CRISPR gRNA sequence
ctctgctttcccacttgaac

SEQ ID NO: 392637 - DNA, 20 bp, Artificial
  CRISPR gRNA sequence
tctgctttcccacttgaaca

SEQ ID NO: 392638 - DNA, 20 bp, Artificial
  CRISPR gRNA sequence
tgctttcccacttgaacagg

SEQ ID NO: 392639 - DNA, 20 bp, Artificial
  CRISPR gRNA sequence
ctttcccacttgaacaggtt

SEQ ID NO: 392640 - DNA, 20 bp, Artificial
  CRISPR gRNA sequence
tcccacttgaacaggttctt

SEQ ID NO: 392641 - DNA, 20 bp, Artificial
  CRISPR gRNA sequence
cccacttgaacaggttctta

SEQ ID NO: 392642 - DNA, 20 bp, Artificial
  CRISPR gRNA sequence
ccacttgaacaggttcttat

SEQ ID NO: 392643 - DNA, 20 bp, Artificial
  CRISPR gRNA sequence
gaacaggttcttatcatcac

SEQ ID NO: 392644 - DNA, 20 bp, Artificial
  CRISPR gRNA sequence
aacaggttcttatcatcacc

SEQ ID NO: 392645 - DNA, 20 bp, Artificial
  CRISPR gRNA sequence
ttatcatcacctctccccag

SEQ ID NO: 392646 - DNA, 20 bp, Artificial
  CRISPR gRNA sequence
atcatcacctctccccaggt

SEQ ID NO: 392647 - DNA, 20 bp, Artificial
  CRISPR gRNA sequence
tcatcacctctccccaggtg

SEQ ID NO: 392648 - DNA, 20 bp, Artificial
  CRISPR gRNA sequence
tccccaggtggtaatgacaa

SEQ ID NO: 392649 - DNA, 20 bp, Artificial
  CRISPR gRNA sequence
cccaggtggtaatgacaagg

SEQ ID NO: 392650 - DNA, 20 bp, Artificial
  CRISPR gRNA sequence
gtcataattctctatataca

SEQ ID NO: 392651 - DNA, 20 bp, Artificial
  CRISPR gRNA sequence
tcataattctctatatacat

SEQ ID NO: 392652 - DNA, 20 bp, Artificial
  CRISPR gRNA sequence
tctatatacattacatagta

SEQ ID NO: 392653 - DNA, 20 bp, Artificial
  CRISPR gRNA sequence
tatatacattacatagtaca

SEQ ID NO: 392654 - DNA, 20 bp, Artificial
  CRISPR gRNA sequence
tatacattacatagtacagc

SEQ ID NO: 392655 - DNA, 20 bp, Artificial
  CRISPR gRNA sequence
catagtacagccagagtaat

SEQ ID NO: 392656 - DNA, 20 bp, Artificial
  CRISPR gRNA sequence
tgtaaaacagatctggccct

SEQ ID NO: 392657 - DNA, 20 bp, Artificial
  CRISPR gRNA sequence
gtaaaacagatctggcccta

SEQ ID NO: 392658 - DNA, 20 bp, Artificial
  CRISPR gRNA sequence
taaaacagatctggccctat

SEQ ID NO: 392659 - DNA, 20 bp, Artificial
  CRISPR gRNA sequence
gccctattagtccctagctt

SEQ ID NO: 392660 - DNA, 20 bp, Artificial
  CRISPR gRNA sequence
ttagtccctagcttaaaatt

SEQ ID NO: 392661 - DNA, 20 bp, Artificial
  CRISPR gRNA sequence
gtccctagcttaaaattcta

SEQ ID NO: 392662 - DNA, 20 bp, Artificial
  CRISPR gRNA sequence
gcttaaaattctatgtatcc

SEQ ID NO: 392663 - DNA, 20 bp, Artificial
  CRISPR gRNA sequence
aaaattctatgtatccccaa

SEQ ID NO: 392664 - DNA, 20 bp, Artificial
  CRISPR gRNA sequence
aaattctatgtatccccaaa

SEQ ID NO: 392665 - DNA, 20 bp, Artificial
  CRISPR gRNA sequence
tatgtatccccaaagcctcc

SEQ ID NO: 392666 - DNA, 20 bp, Artificial
  CRISPR gRNA sequence
tgtatccccaaagcctccag

SEQ ID NO: 392667 - DNA, 20 bp, Artificial
  CRISPR gRNA sequence
caggataaaattcaaacttc

SEQ ID NO: 392668 - DNA, 20 bp, Artificial
  CRISPR gRNA sequence
aaacttctcagcacatattc

SEQ ID NO: 392669 - DNA, 20 bp, Artificial
  CRISPR gRNA sequence
ctcagcacatattctaaggc

SEQ ID NO: 392670 - DNA, 20 bp, Artificial
  CRISPR gRNA sequence
tcagcacatattctaaggcc

SEQ ID NO: 392671 - DNA, 20 bp, Artificial
  CRISPR gRNA sequence
agcacatattctaaggccta

SEQ ID NO: 392672 - DNA, 20 bp, Artificial
  CRISPR gRNA sequence
taaggcctaatagaagtagt

SEQ ID NO: 392673 - DNA, 20 bp, Artificial
  CRISPR gRNA sequence
aggcctaatagaagtagtca

SEQ ID NO: 392674 - DNA, 20 bp, Artificial
  CRISPR gRNA sequence
atagaagtagtcatggtttc

SEQ ID NO: 392675 - DNA, 20 bp, Artificial
  CRISPR gRNA sequence
ctccaagtgtcagctctggt

SEQ ID NO: 392676 - DNA, 20 bp, Artificial
  CRISPR gRNA sequence
tccaagtgtcagctctggtc

SEQ ID NO: 392677 - DNA, 20 bp, Artificial
  CRISPR gRNA sequence
caagtgtcagctctggtcca

SEQ ID NO: 392678 - DNA, 20 bp, Artificial
  CRISPR gRNA sequence
tggtccaccactcaccttgc

SEQ ID NO: 392679 - DNA, 20 bp, Artificial
  CRISPR gRNA sequence
gtccaccactcaccttgccc

SEQ ID NO: 392680 - DNA, 20 bp, Artificial
  CRISPR gRNA sequence
accttgcccctgggctcatt

SEQ ID NO: 392681 - DNA, 20 bp, Artificial
  CRISPR gRNA sequence
gcccctgggctcattctcag

SEQ ID NO: 392682 - DNA, 20 bp, Artificial
  CRISPR gRNA sequence
cccctgggctcattctcaga

SEQ ID NO: 392683 - DNA, 20 bp, Artificial
  CRISPR gRNA sequence
ggctcattctcagatcctcc

SEQ ID NO: 392684 - DNA, 20 bp, Artificial
  CRISPR gRNA sequence
attctcagatcctccaactc

SEQ ID NO: 392685 - DNA, 20 bp, Artificial
  CRISPR gRNA sequence
tcagatcctccaactcacca

SEQ ID NO: 392686 - DNA, 20 bp, Artificial
  CRISPR gRNA sequence
agatcctccaactcaccaca

SEQ ID NO: 392687 - DNA, 20 bp, Artificial
  CRISPR gRNA sequence
caactcaccacatacactcc

SEQ ID NO: 392688 - DNA, 20 bp, Artificial
  CRISPR gRNA sequence
accacatacactccatctca

SEQ ID NO: 392689 - DNA, 20 bp, Artificial
  CRISPR gRNA sequence
catctcacgtctgaactctg

SEQ ID NO: 392690 - DNA, 20 bp, Artificial
  CRISPR gRNA sequence
acgtctgaactctggaccag

SEQ ID NO: 392691 - DNA, 20 bp, Artificial
  CRISPR gRNA sequence
aactctggaccaggacactc

SEQ ID NO: 392692 - DNA, 20 bp, Artificial
  CRISPR gRNA sequence
tggaccaggacactccctcc

SEQ ID NO: 392693 - DNA, 20 bp, Artificial
  CRISPR gRNA sequence
gaccaggacactccctcccc

SEQ ID NO: 392694 - DNA, 20 bp, Artificial
  CRISPR gRNA sequence
cctcccccagcaccatcttt

SEQ ID NO: 392695 - DNA, 20 bp, Artificial
  CRISPR gRNA sequence
ccccagcaccatctttcctt

SEQ ID NO: 392696 - DNA, 20 bp, Artificial
  CRISPR gRNA sequence
tccttccctccttctgctgc

SEQ ID NO: 392697 - DNA, 20 bp, Artificial
  CRISPR gRNA sequence
ccttccctccttctgctgct

SEQ ID NO: 392698 - DNA, 20 bp, Artificial
  CRISPR gRNA sequence
cttccctccttctgctgctt

SEQ ID NO: 392699 - DNA, 20 bp, Artificial
  CRISPR gRNA sequence
ccctccttctgctgctttct

SEQ ID NO: 392700 - DNA, 20 bp, Artificial
  CRISPR gRNA sequence
cctccttctgctgctttctg

SEQ ID NO: 392701 - DNA, 20 bp, Artificial
  CRISPR gRNA sequence
cttctgctgctttctgcctc

SEQ ID NO: 392702 - DNA, 20 bp, Artificial
  CRISPR gRNA sequence
ctgctgctttctgcctcttc

SEQ ID NO: 392703 - DNA, 20 bp, Artificial
  CRISPR gRNA sequence
tgctgctttctgcctcttcc

SEQ ID NO: 392704 - DNA, 20 bp, Artificial
  CRISPR gRNA sequence
ctgctttctgcctcttccat

SEQ ID NO: 392705 - DNA, 20 bp, Artificial
  CRISPR gRNA sequence
ctttctgcctcttccattga

SEQ ID NO: 392706 - DNA, 20 bp, Artificial
  CRISPR gRNA sequence
tctgcctcttccattgagct

SEQ ID NO: 392707 - DNA, 20 bp, Artificial
  CRISPR gRNA sequence
ctgcctcttccattgagctt

SEQ ID NO: 392708 - DNA, 20 bp, Artificial
  CRISPR gRNA sequence
tgcctcttccattgagcttt

SEQ ID NO: 392709 - DNA, 20 bp, Artificial
  CRISPR gRNA sequence
cctcttccattgagctttcc

SEQ ID NO: 392710 - DNA, 20 bp, Artificial
  CRISPR gRNA sequence
ttccattgagctttcctggg

SEQ ID NO: 392711 - DNA, 20 bp, Artificial
  CRISPR gRNA sequence
ccattgagctttcctgggtt

SEQ ID NO: 392712 - DNA, 20 bp, Artificial
  CRISPR gRNA sequence
cattgagctttcctgggttg

SEQ ID NO: 392713 - DNA, 20 bp, Artificial
  CRISPR gRNA sequence
agctttcctgggttgctcct

SEQ ID NO: 392714 - DNA, 20 bp, Artificial
  CRISPR gRNA sequence
tcctgggttgctcctcctcc

SEQ ID NO: 392715 - DNA, 20 bp, Artificial
  CRISPR gRNA sequence
cctgggttgctcctcctcct

SEQ ID NO: 392716 - DNA, 20 bp, Artificial
  CRISPR gRNA sequence
ctgggttgctcctcctcctc

SEQ ID NO: 392717 - DNA, 20 bp, Artificial
  CRISPR gRNA sequence
ggttgctcctcctcctcaag

SEQ ID NO: 392718 - DNA, 20 bp, Artificial
  CRISPR gRNA sequence
ctcctcctcctcaagctagg

SEQ ID NO: 392719 - DNA, 20 bp, Artificial
  CRISPR gRNA sequence
ctcctcctcaagctaggtta

SEQ ID NO: 392720 - DNA, 20 bp, Artificial
  CRISPR gRNA sequence
ctcctcaagctaggttacac

SEQ ID NO: 392721 - DNA, 20 bp, Artificial
  CRISPR gRNA sequence
ctcaagctaggttacacacc

SEQ ID NO: 392722 - DNA, 20 bp, Artificial
  CRISPR gRNA sequence
aagctaggttacacaccccc

SEQ ID NO: 392723 - DNA, 20 bp, Artificial
  CRISPR gRNA sequence
ggttacacacccccccaaca

SEQ ID NO: 392724 - DNA, 20 bp, Artificial
  CRISPR gRNA sequence
cacacccccccaacacatgc

SEQ ID NO: 392725 - DNA, 20 bp, Artificial
  CRISPR gRNA sequence
tatgctcatattttagccta

SEQ ID NO: 392726 - DNA, 20 bp, Artificial
  CRISPR gRNA sequence
atgctcatattttagcctat

SEQ ID NO: 392727 - DNA, 20 bp, Artificial
  CRISPR gRNA sequence
tgctcatattttagcctata

SEQ ID NO: 392728 - DNA, 20 bp, Artificial
  CRISPR gRNA sequence
atattttagcctatatgcac

SEQ ID NO: 392729 - DNA, 20 bp, Artificial
  CRISPR gRNA sequence
tagcctatatgcacctcttc

SEQ ID NO: 392730 - DNA, 20 bp, Artificial
  CRISPR gRNA sequence
agcctatatgcacctcttca

SEQ ID NO: 392731 - DNA, 20 bp, Artificial
  CRISPR gRNA sequence
gcctatatgcacctcttcat

SEQ ID NO: 392732 - DNA, 20 bp, Artificial
  CRISPR gRNA sequence
tatgcacctcttcatttaca

SEQ ID NO: 392733 - DNA, 20 bp, Artificial
  CRISPR gRNA sequence
ttcatttacagtgctgctcc

SEQ ID NO: 392734 - DNA, 20 bp, Artificial
  CRISPR gRNA sequence
catttacagtgctgctccta

SEQ ID NO: 392735 - DNA, 20 bp, Artificial
  CRISPR gRNA sequence
atttacagtgctgctcctaa

SEQ ID NO: 392736 - DNA, 20 bp, Artificial
  CRISPR gRNA sequence
acagtgctgctcctaagata

SEQ ID NO: 392737 - DNA, 20 bp, Artificial
  CRISPR gRNA sequence
cagtgctgctcctaagatat

SEQ ID NO: 392738 - DNA, 20 bp, Artificial
  CRISPR gRNA sequence
ctcctaagatatgcctcttg

SEQ ID NO: 392739 - DNA, 20 bp, Artificial
  CRISPR gRNA sequence
ctaagatatgcctcttgtgc

SEQ ID NO: 392740 - DNA, 20 bp, Artificial
  CRISPR gRNA sequence
agatatgcctcttgtgcagc

SEQ ID NO: 392741 - DNA, 20 bp, Artificial
  CRISPR gRNA sequence
ttgtgcagctgttgactttt

SEQ ID NO: 392742 - DNA, 20 bp, Artificial
  CRISPR gRNA sequence
gtgcagctgttgactttttt

SEQ ID NO: 392743 - DNA, 20 bp, Artificial
  CRISPR gRNA sequence
tgcagctgttgactttttta

SEQ ID NO: 392744 - DNA, 20 bp, Artificial
  CRISPR gRNA sequence
ttgacttttttaaaaataaa

SEQ ID NO: 392745 - DNA, 20 bp, Artificial
  CRISPR gRNA sequence
acttttttaaaaataaagca

SEQ ID NO: 392746 - DNA, 20 bp, Artificial
  CRISPR gRNA sequence
ttttaaaaataaagcacagg

SEQ ID NO: 392747 - DNA, 20 bp, Artificial
  CRISPR gRNA sequence
tttaaaaataaagcacagga

SEQ ID NO: 392748 - DNA, 20 bp, Artificial
  CRISPR gRNA sequence
ttaaaaataaagcacaggaa

SEQ ID NO: 392749 - DNA, 20 bp, Artificial
  CRISPR gRNA sequence
taaaaataaagcacaggaat

SEQ ID NO: 392750 - DNA, 20 bp, Artificial
  CRISPR gRNA sequence
aaaaataaagcacaggaatt

SEQ ID NO: 392751 - DNA, 20 bp, Artificial
  CRISPR gRNA sequence
aaaataaagcacaggaattt

SEQ ID NO: 392752 - DNA, 20 bp, Artificial
  CRISPR gRNA sequence
atatgttctcctacctgatt

SEQ ID NO: 392753 - DNA, 20 bp, Artificial
  CRISPR gRNA sequence
tatgttctcctacctgattt

SEQ ID NO: 392754 - DNA, 20 bp, Artificial
  CRISPR gRNA sequence
tcctacctgattttagtgag

SEQ ID NO: 392755 - DNA, 20 bp, Artificial
  CRISPR gRNA sequence
ctacctgattttagtgagtt

SEQ ID NO: 392756 - DNA, 20 bp, Artificial
  CRISPR gRNA sequence
cctgattttagtgagttagc

SEQ ID NO: 392757 - DNA, 20 bp, Artificial
  CRISPR gRNA sequence
attttagtgagttagcgctg

SEQ ID NO: 392758 - DNA, 20 bp, Artificial
  CRISPR gRNA sequence
tagtgagttagcgctgtcag

SEQ ID NO: 392759 - DNA, 20 bp, Artificial
  CRISPR gRNA sequence
agtgagttagcgctgtcagt

SEQ ID NO: 392760 - DNA, 20 bp, Artificial
  CRISPR gRNA sequence
gtgagttagcgctgtcagtt

SEQ ID NO: 392761 - DNA, 20 bp, Artificial
  CRISPR gRNA sequence
gcgctgtcagtttagttaag

SEQ ID NO: 392762 - DNA, 20 bp, Artificial
  CRISPR gRNA sequence
tcagtttagttaagttgata

SEQ ID NO: 392763 - DNA, 20 bp, Artificial
  CRISPR gRNA sequence
agttaagttgatagtttgag

SEQ ID NO: 392764 - DNA, 20 bp, Artificial
  CRISPR gRNA sequence
gttaagttgatagtttgagt

SEQ ID NO: 392765 - DNA, 20 bp, Artificial
  CRISPR gRNA sequence
agttgatagtttgagtttac

SEQ ID NO: 392766 - DNA, 20 bp, Artificial
  CRISPR gRNA sequence
atagtttgagtttacttttc

SEQ ID NO: 392767 - DNA, 20 bp, Artificial
  CRISPR gRNA sequence
gagtttacttttccaaatgg

SEQ ID NO: 392768 - DNA, 20 bp, Artificial
  CRISPR gRNA sequence
agtttacttttccaaatggg

SEQ ID NO: 392769 - DNA, 20 bp, Artificial
  CRISPR gRNA sequence
acttttccaaatgggtgctt

SEQ ID NO: 392770 - DNA, 20 bp, Artificial
  CRISPR gRNA sequence
cttttccaaatgggtgcttt

SEQ ID NO: 392771 - DNA, 20 bp, Artificial
  CRISPR gRNA sequence
ttccaaatgggtgctttcgt

SEQ ID NO: 392772 - DNA, 20 bp, Artificial
  CRISPR gRNA sequence
tccaaatgggtgctttcgtc

SEQ ID NO: 392773 - DNA, 20 bp, Artificial
  CRISPR gRNA sequence
ccaaatgggtgctttcgtct

SEQ ID NO: 392774 - DNA, 20 bp, Artificial
  CRISPR gRNA sequence
caaatgggtgctttcgtcta

SEQ ID NO: 392775 - DNA, 20 bp, Artificial
  CRISPR gRNA sequence
tcgtctatcattgtgaactt

SEQ ID NO: 392776 - DNA, 20 bp, Artificial
  CRISPR gRNA sequence
cgtctatcattgtgaacttc

SEQ ID NO: 392777 - DNA, 20 bp, Artificial
  CRISPR gRNA sequence
gtctatcattgtgaacttca

SEQ ID NO: 392778 - DNA, 20 bp, Artificial
  CRISPR gRNA sequence
tcattgtgaacttcaggtat

SEQ ID NO: 392779 - DNA, 20 bp, Artificial
  CRISPR gRNA sequence
tgaacttcaggtatgacctg

SEQ ID NO: 392780 - DNA, 20 bp, Artificial
  CRISPR gRNA sequence
caggtatgacctgcgttatg

SEQ ID NO: 392781 - DNA, 20 bp, Artificial
  CRISPR gRNA sequence
aggtatgacctgcgttatgt

SEQ ID NO: 392782 - DNA, 20 bp, Artificial
  CRISPR gRNA sequence
cgttatgtgtataaatatat

SEQ ID NO: 392783 - DNA, 20 bp, Artificial
  CRISPR gRNA sequence
tgtgtataaatatatcttta

SEQ ID NO: 392784 - DNA, 20 bp, Artificial
  CRISPR gRNA sequence
taagtcttcatacagcttct

SEQ ID NO: 392785 - DNA, 20 bp, Artificial
  CRISPR gRNA sequence
aagtcttcatacagcttctt

SEQ ID NO: 392786 - DNA, 20 bp, Artificial
  CRISPR gRNA sequence
agtcttcatacagcttcttg

SEQ ID NO: 392787 - DNA, 20 bp, Artificial
  CRISPR gRNA sequence
catacagcttcttggacaag

SEQ ID NO: 392788 - DNA, 20 bp, Artificial
  CRISPR gRNA sequence
atacagcttcttggacaagg

SEQ ID NO: 392789 - DNA, 20 bp, Artificial
  CRISPR gRNA sequence
cttggacaaggggggagtca

SEQ ID NO: 392790 - DNA, 20 bp, Artificial
  CRISPR gRNA sequence
ttggacaaggggggagtcat

SEQ ID NO: 392791 - DNA, 20 bp, Artificial
  CRISPR gRNA sequence
ggacaaggggggagtcattg

SEQ ID NO: 392792 - DNA, 20 bp, Artificial
  CRISPR gRNA sequence
gacaaggggggagtcattga

SEQ ID NO: 392793 - DNA, 20 bp, Artificial
  CRISPR gRNA sequence
aaaaggatcaaagattgagt

SEQ ID NO: 392794 - DNA, 20 bp, Artificial
  CRISPR gRNA sequence
agtctcctgtctaatactta

SEQ ID NO: 392795 - DNA, 20 bp, Artificial
  CRISPR gRNA sequence
ctgtctaatacttaatccat

SEQ ID NO: 392796 - DNA, 20 bp, Artificial
  CRISPR gRNA sequence
tctaatacttaatccattgt

SEQ ID NO: 392797 - DNA, 20 bp, Artificial
  CRISPR gRNA sequence
atacttaatccattgttgat

SEQ ID NO: 392798 - DNA, 20 bp, Artificial
  CRISPR gRNA sequence
aatccattgttgattatgct

SEQ ID NO: 392799 - DNA, 20 bp, Artificial
  CRISPR gRNA sequence
atccattgttgattatgctt

SEQ ID NO: 392800 - DNA, 20 bp, Artificial
  CRISPR gRNA sequence
ttgattatgctttgagatca

SEQ ID NO: 392801 - DNA, 20 bp, Artificial
  CRISPR gRNA sequence
attatgctttgagatcacag

SEQ ID NO: 392802 - DNA, 20 bp, Artificial
  CRISPR gRNA sequence
tgctttgagatcacagaggg

SEQ ID NO: 392803 - DNA, 20 bp, Artificial
  CRISPR gRNA sequence
tgagatcacagagggaagtt

SEQ ID NO: 392804 - DNA, 20 bp, Artificial
  CRISPR gRNA sequence
gagatcacagagggaagtta

SEQ ID NO: 392805 - DNA, 20 bp, Artificial
  CRISPR gRNA sequence
agatcacagagggaagttat

SEQ ID NO: 392806 - DNA, 20 bp, Artificial
  CRISPR gRNA sequence
tagtgaaggaaaatgagtgg

SEQ ID NO: 392807 - DNA, 20 bp, Artificial
  CRISPR gRNA sequence
gaattcactccaaagaggag

SEQ ID NO: 392808 - DNA, 20 bp, Artificial
  CRISPR gRNA sequence
aattcactccaaagaggagc

SEQ ID NO: 392809 - DNA, 20 bp, Artificial
  CRISPR gRNA sequence
actccaaagaggagcaaaag

SEQ ID NO: 392810 - DNA, 20 bp, Artificial
  CRISPR gRNA sequence
caaagaggagcaaaagagct

SEQ ID NO: 392811 - DNA, 20 bp, Artificial
  CRISPR gRNA sequence
tataatgaccaagagcccct

SEQ ID NO: 392812 - DNA, 20 bp, Artificial
  CRISPR gRNA sequence
ataatgaccaagagcccctg

SEQ ID NO: 392813 - DNA, 20 bp, Artificial
  CRISPR gRNA sequence
taatgaccaagagcccctgg

SEQ ID NO: 392814 - DNA, 20 bp, Artificial
  CRISPR gRNA sequence
gctctaaaaccttgaaaaca

SEQ ID NO: 392815 - DNA, 20 bp, Artificial
  CRISPR gRNA sequence
taaaaccttgaaaacaagtc

SEQ ID NO: 392816 - DNA, 20 bp, Artificial
  CRISPR gRNA sequence
aaaccttgaaaacaagtcag

SEQ ID NO: 392817 - DNA, 20 bp, Artificial
  CRISPR gRNA sequence
gaaaacaagtcagctgccca

SEQ ID NO: 392818 - DNA, 20 bp, Artificial
  CRISPR gRNA sequence
aaaacaagtcagctgcccac

SEQ ID NO: 392819 - DNA, 20 bp, Artificial
  CRISPR gRNA sequence
cccactgaacccacctaccc

SEQ ID NO: 392820 - DNA, 20 bp, Artificial
  CRISPR gRNA sequence
aacccacctacccaaggcca

SEQ ID NO: 392821 - DNA, 20 bp, Artificial
  CRISPR gRNA sequence
cccaaggccatatgagatta

SEQ ID NO: 392822 - DNA, 20 bp, Artificial
  CRISPR gRNA sequence
aatttgtgcctcaccagcca

SEQ ID NO: 392823 - DNA, 20 bp, Artificial
  CRISPR gRNA sequence
gtgcctcaccagccacacca

SEQ ID NO: 392824 - DNA, 20 bp, Artificial
  CRISPR gRNA sequence
tgcctcaccagccacaccaa

SEQ ID NO: 392825 - DNA, 20 bp, Artificial
  CRISPR gRNA sequence
accagccacaccaagcaagg

SEQ ID NO: 392826 - DNA, 20 bp, Artificial
  CRISPR gRNA sequence
agtcttcaacatggaggtga

SEQ ID NO: 392827 - DNA, 20 bp, Artificial
  CRISPR gRNA sequence
gtcttcaacatggaggtgag

SEQ ID NO: 392828 - DNA, 20 bp, Artificial
  CRISPR gRNA sequence
caacatggaggtgagttcat

SEQ ID NO: 392829 - DNA, 20 bp, Artificial
  CRISPR gRNA sequence
aacatggaggtgagttcatc

SEQ ID NO: 392830 - DNA, 20 bp, Artificial
  CRISPR gRNA sequence
atctcaattaaacaaatcta

SEQ ID NO: 392831 - DNA, 20 bp, Artificial
  CRISPR gRNA sequence
aattaaacaaatctactttt

SEQ ID NO: 392832 - DNA, 20 bp, Artificial
  CRISPR gRNA sequence
aacaaatctacttttaaggg

SEQ ID NO: 392833 - DNA, 20 bp, Artificial
  CRISPR gRNA sequence
cttttaagggtctattgtaa

SEQ ID NO: 392834 - DNA, 20 bp, Artificial
  CRISPR gRNA sequence
ttaagggtctattgtaaaat

SEQ ID NO: 392835 - DNA, 20 bp, Artificial
  CRISPR gRNA sequence
taagggtctattgtaaaata

SEQ ID NO: 392836 - DNA, 20 bp, Artificial
  CRISPR gRNA sequence
aagggtctattgtaaaatat

SEQ ID NO: 392837 - DNA, 20 bp, Artificial
  CRISPR gRNA sequence
agggtctattgtaaaatatg

SEQ ID NO: 392838 - DNA, 20 bp, Artificial
  CRISPR gRNA sequence
ttgtaaaatatgtgtgaggc

SEQ ID NO: 392839 - DNA, 20 bp, Artificial
  CRISPR gRNA sequence
taaaatatgtgtgaggcaat

SEQ ID NO: 392840 - DNA, 20 bp, Artificial
  CRISPR gRNA sequence
atgggacaagacccatcacg

SEQ ID NO: 392841 - DNA, 20 bp, Artificial
  CRISPR gRNA sequence
aaagagcttacaaaaagagt

SEQ ID NO: 392842 - DNA, 20 bp, Artificial
  CRISPR gRNA sequence
acaaaaagagtcacctactt

SEQ ID NO: 392843 - DNA, 20 bp, Artificial
  CRISPR gRNA sequence
caaaaagagtcacctacttc

SEQ ID NO: 392844 - DNA, 20 bp, Artificial
  CRISPR gRNA sequence
cttcaattacaaattcagtt

SEQ ID NO: 392845 - DNA, 20 bp, Artificial
  CRISPR gRNA sequence
caattacaaattcagttcaa

SEQ ID NO: 392846 - DNA, 20 bp, Artificial
  CRISPR gRNA sequence
aattacaaattcagttcaaa

SEQ ID NO: 392847 - DNA, 20 bp, Artificial
  CRISPR gRNA sequence
caaattcagttcaaaaatat

SEQ ID NO: 392848 - DNA, 20 bp, Artificial
  CRISPR gRNA sequence
agttcaaaaatatttggtaa

SEQ ID NO: 392849 - DNA, 20 bp, Artificial
  CRISPR gRNA sequence
aaaaatatttggtaagggcc

SEQ ID NO: 392850 - DNA, 20 bp, Artificial
  CRISPR gRNA sequence
ggtaagggcctagtacatga

SEQ ID NO: 392851 - DNA, 20 bp, Artificial
  CRISPR gRNA sequence
gtaagggcctagtacatgag

SEQ ID NO: 392852 - DNA, 20 bp, Artificial
  CRISPR gRNA sequence
gtacatgagaagtactaaag

SEQ ID NO: 392853 - DNA, 20 bp, Artificial
  CRISPR gRNA sequence
aagaagctattagggccagg

SEQ ID NO: 392854 - DNA, 20 bp, Artificial
  CRISPR gRNA sequence
ttagggccaggcacggtggc

SEQ ID NO: 392855 - DNA, 20 bp, Artificial
  CRISPR gRNA sequence
gggccaggcacggtggctca

SEQ ID NO: 392856 - DNA, 20 bp, Artificial
  CRISPR gRNA sequence
acgcctgtaatcccagcact

SEQ ID NO: 392857 - DNA, 20 bp, Artificial
  CRISPR gRNA sequence
taatcccagcactttgggag

SEQ ID NO: 392858 - DNA, 20 bp, Artificial
  CRISPR gRNA sequence
tgggaggccgaggcaggtgg

SEQ ID NO: 392859 - DNA, 20 bp, Artificial
  CRISPR gRNA sequence
gggaggccgaggcaggtgga

SEQ ID NO: 392860 - DNA, 20 bp, Artificial
  CRISPR gRNA sequence
ggaggccgaggcaggtggat

SEQ ID NO: 392861 - DNA, 20 bp, Artificial
  CRISPR gRNA sequence
aggtcaggagtttgagacca

SEQ ID NO: 392862 - DNA, 20 bp, Artificial
  CRISPR gRNA sequence
gagaccagcctggccaacat

SEQ ID NO: 392863 - DNA, 20 bp, Artificial
  CRISPR gRNA sequence
agaccagcctggccaacatc

SEQ ID NO: 392864 - DNA, 20 bp, Artificial
  CRISPR gRNA sequence
gccaacatcatgaaacccca

SEQ ID NO: 392865 - DNA, 20 bp, Artificial
  CRISPR gRNA sequence
ctaaaaatacaaaaataaaa

SEQ ID NO: 392866 - DNA, 20 bp, Artificial
  CRISPR gRNA sequence
aaaatacaaaaataaaatta

SEQ ID NO: 392867 - DNA, 20 bp, Artificial
  CRISPR gRNA sequence
gccaggtgtggtggcaggca

SEQ ID NO: 392868 - DNA, 20 bp, Artificial
  CRISPR gRNA sequence
taatcccagctacttgggag

SEQ ID NO: 392869 - DNA, 20 bp, Artificial
  CRISPR gRNA sequence
cttgggaggctgaggcagaa

SEQ ID NO: 392870 - DNA, 20 bp, Artificial
  CRISPR gRNA sequence
gggaggctgaggcagaagaa

SEQ ID NO: 392871 - DNA, 20 bp, Artificial
  CRISPR gRNA sequence
ggaggctgaggcagaagaat

SEQ ID NO: 392872 - DNA, 20 bp, Artificial
  CRISPR gRNA sequence
aggcagaagaatcacttgaa

SEQ ID NO: 392873 - DNA, 20 bp, Artificial
  CRISPR gRNA sequence
gaacttggcaggtggaggtt

SEQ ID NO: 392874 - DNA, 20 bp, Artificial
  CRISPR gRNA sequence
aacttggcaggtggaggttg

SEQ ID NO: 392875 - DNA, 20 bp, Artificial
  CRISPR gRNA sequence
ggcaggtggaggttgcggtg

SEQ ID NO: 392876 - DNA, 20 bp, Artificial
  CRISPR gRNA sequence
gcaggtggaggttgcggtga

SEQ ID NO: 392877 - DNA, 20 bp, Artificial
  CRISPR gRNA sequence
cggtgagccgagattgtgcc

SEQ ID NO: 392878 - DNA, 20 bp, Artificial
  CRISPR gRNA sequence
tgccattgcactccagcttt

SEQ ID NO: 392879 - DNA, 20 bp, Artificial
  CRISPR gRNA sequence
cactccagctttggtgacag

SEQ ID NO: 392880 - DNA, 20 bp, Artificial
  CRISPR gRNA sequence
cagctttggtgacagagtgg

SEQ ID NO: 392881 - DNA, 20 bp, Artificial
  CRISPR gRNA sequence
tggtgacagagtgggactct

SEQ ID NO: 392882 - DNA, 20 bp, Artificial
  CRISPR gRNA sequence
ggtgacagagtgggactctg

SEQ ID NO: 392883 - DNA, 20 bp, Artificial
  CRISPR gRNA sequence
gtgacagagtgggactctgt

SEQ ID NO: 392884 - DNA, 20 bp, Artificial
  CRISPR gRNA sequence
tgtctcaaaaaataaattaa

SEQ ID NO: 392885 - DNA, 20 bp, Artificial
  CRISPR gRNA sequence
tctcaaaaaataaattaatt

SEQ ID NO: 392886 - DNA, 20 bp, Artificial
  CRISPR gRNA sequence
aaaaaataaattaattaaaa

SEQ ID NO: 392887 - DNA, 20 bp, Artificial
  CRISPR gRNA sequence
attaaaaagcagctattaag

SEQ ID NO: 392888 - DNA, 20 bp, Artificial
  CRISPR gRNA sequence
aaaagcagctattaaggata

SEQ ID NO: 392889 - DNA, 20 bp, Artificial
  CRISPR gRNA sequence
ttaaggatagagtggataat

SEQ ID NO: 392890 - DNA, 20 bp, Artificial
  CRISPR gRNA sequence
aggatagagtggataatacc

SEQ ID NO: 392891 - DNA, 20 bp, Artificial
  CRISPR gRNA sequence
aggcatggtctcggtcctca

SEQ ID NO: 392892 - DNA, 20 bp, Artificial
  CRISPR gRNA sequence
ggtcctcacagggcttagga

SEQ ID NO: 392893 - DNA, 20 bp, Artificial
  CRISPR gRNA sequence
acagggcttaggaactaata

SEQ ID NO: 392894 - DNA, 20 bp, Artificial
  CRISPR gRNA sequence
aggaactaataaggaagcca

SEQ ID NO: 392895 - DNA, 20 bp, Artificial
  CRISPR gRNA sequence
ggaactaataaggaagccat

SEQ ID NO: 392896 - DNA, 20 bp, Artificial
  CRISPR gRNA sequence
ataaggaagccataaaacta

SEQ ID NO: 392897 - DNA, 20 bp, Artificial
  CRISPR gRNA sequence
aacagatgtttacaatgtaa

SEQ ID NO: 392898 - DNA, 20 bp, Artificial
  CRISPR gRNA sequence
acaatgtaaaatgcactgtg

SEQ ID NO: 392899 - DNA, 20 bp, Artificial
  CRISPR gRNA sequence
caatgtaaaatgcactgtga

SEQ ID NO: 392900 - DNA, 20 bp, Artificial
  CRISPR gRNA sequence
tgagctctgtgcagggacac

SEQ ID NO: 392901 - DNA, 20 bp, Artificial
  CRISPR gRNA sequence
tgtgcagggacacagtagga

SEQ ID NO: 392902 - DNA, 20 bp, Artificial
  CRISPR gRNA sequence
tgcagggacacagtaggaaa

SEQ ID NO: 392903 - DNA, 20 bp, Artificial
  CRISPR gRNA sequence
gacttggagcagagccacag

SEQ ID NO: 392904 - DNA, 20 bp, Artificial
  CRISPR gRNA sequence
acttggagcagagccacagc

SEQ ID NO: 392905 - DNA, 20 bp, Artificial
  CRISPR gRNA sequence
ggagcagagccacagccatc

SEQ ID NO: 392906 - DNA, 20 bp, Artificial
  CRISPR gRNA sequence
gagcagagccacagccatca

SEQ ID NO: 392907 - DNA, 20 bp, Artificial
  CRISPR gRNA sequence
atagacacccctgtgcaaat

SEQ ID NO: 392908 - DNA, 20 bp, Artificial
  CRISPR gRNA sequence
tagacacccctgtgcaaata

SEQ ID NO: 392909 - DNA, 20 bp, Artificial
  CRISPR gRNA sequence
tgcaaataggggagtcatgg

SEQ ID NO: 392910 - DNA, 20 bp, Artificial
  CRISPR gRNA sequence
gactgttgcccaatacgcat

SEQ ID NO: 392911 - DNA, 20 bp, Artificial
  CRISPR gRNA sequence
ttgcccaatacgcatctgta

SEQ ID NO: 392912 - DNA, 20 bp, Artificial
  CRISPR gRNA sequence
cccaatacgcatctgtataa

SEQ ID NO: 392913 - DNA, 20 bp, Artificial
  CRISPR gRNA sequence
tataatttcgtggactgaat

SEQ ID NO: 392914 - DNA, 20 bp, Artificial
  CRISPR gRNA sequence
cgtggactgaatgtgtgggg

SEQ ID NO: 392915 - DNA, 20 bp, Artificial
  CRISPR gRNA sequence
gtggactgaatgtgtggggc

SEQ ID NO: 392916 - DNA, 20 bp, Artificial
  CRISPR gRNA sequence
aatgtgtggggcaggctagt

SEQ ID NO: 392917 - DNA, 20 bp, Artificial
  CRISPR gRNA sequence
gtgatacttcaggaagggct

SEQ ID NO: 392918 - DNA, 20 bp, Artificial
  CRISPR gRNA sequence
caggaagggctgagattgtt

SEQ ID NO: 392919 - DNA, 20 bp, Artificial
  CRISPR gRNA sequence
aggaagggctgagattgttg

SEQ ID NO: 392920 - DNA, 20 bp, Artificial
  CRISPR gRNA sequence
agattgttgctgcactgata

SEQ ID NO: 392921 - DNA, 20 bp, Artificial
  CRISPR gRNA sequence
ttgctgcactgatacagaca

SEQ ID NO: 392922 - DNA, 20 bp, Artificial
  CRISPR gRNA sequence
ctgcactgatacagacatgg

SEQ ID NO: 392923 - DNA, 20 bp, Artificial
  CRISPR gRNA sequence
cactgatacagacatgggat

SEQ ID NO: 392924 - DNA, 20 bp, Artificial
  CRISPR gRNA sequence
atacagacatgggatgcaat

SEQ ID NO: 392925 - DNA, 20 bp, Artificial
  CRISPR gRNA sequence
ccaaggcctagaaatggaaa

SEQ ID NO: 392926 - DNA, 20 bp, Artificial
  CRISPR gRNA sequence
gaaatggaaagatgaagaag

SEQ ID NO: 392927 - DNA, 20 bp, Artificial
  CRISPR gRNA sequence
aggaaataatgtcactgcca

SEQ ID NO: 392928 - DNA, 20 bp, Artificial
  CRISPR gRNA sequence
ggaaataatgtcactgccag

SEQ ID NO: 392929 - DNA, 20 bp, Artificial
  CRISPR gRNA sequence
ccagaggacctggcagccaa

SEQ ID NO: 392930 - DNA, 20 bp, Artificial
  CRISPR gRNA sequence
gcagccaaatgaagaaaaaa

SEQ ID NO: 392931 - DNA, 20 bp, Artificial
  CRISPR gRNA sequence
agaaaaaggttaacacttta

SEQ ID NO: 392932 - DNA, 20 bp, Artificial
  CRISPR gRNA sequence
acactttaaacagaaaatgt

SEQ ID NO: 392933 - DNA, 20 bp, Artificial
  CRISPR gRNA sequence
taaacagaaaatgttcggac

SEQ ID NO: 392934 - DNA, 20 bp, Artificial
  CRISPR gRNA sequence
aaacagaaaatgttcggaca

SEQ ID NO: 392935 - DNA, 20 bp, Artificial
  CRISPR gRNA sequence
aacagaaaatgttcggacag

SEQ ID NO: 392936 - DNA, 20 bp, Artificial
  CRISPR gRNA sequence
ggacagttgaggcttcaagc

SEQ ID NO: 392937 - DNA, 20 bp, Artificial
  CRISPR gRNA sequence
aggcttcaagcactgcgtcc

SEQ ID NO: 392938 - DNA, 20 bp, Artificial
  CRISPR gRNA sequence
caagcactgcgtccaatgag

SEQ ID NO: 392939 - DNA, 20 bp, Artificial
  CRISPR gRNA sequence
aagcactgcgtccaatgagt

SEQ ID NO: 392940 - DNA, 20 bp, Artificial
  CRISPR gRNA sequence
cgtccaatgagtactggata

SEQ ID NO: 392941 - DNA, 20 bp, Artificial
  CRISPR gRNA sequence
gatattatctcagctaattt

SEQ ID NO: 392942 - DNA, 20 bp, Artificial
  CRISPR gRNA sequence
tctcagctaatttgccactt

SEQ ID NO: 392943 - DNA, 20 bp, Artificial
  CRISPR gRNA sequence
agctaatttgccacttcgtt

SEQ ID NO: 392944 - DNA, 20 bp, Artificial
  CRISPR gRNA sequence
atttgccacttcgtttctca

SEQ ID NO: 392945 - DNA, 20 bp, Artificial
  CRISPR gRNA sequence
gccacttcgtttctcaagga

SEQ ID NO: 392946 - DNA, 20 bp, Artificial
  CRISPR gRNA sequence
ccacttcgtttctcaaggat

SEQ ID NO: 392947 - DNA, 20 bp, Artificial
  CRISPR gRNA sequence
cgtttctcaaggataaccaa

SEQ ID NO: 392948 - DNA, 20 bp, Artificial
  CRISPR gRNA sequence
gtttctcaaggataaccaag

SEQ ID NO: 392949 - DNA, 20 bp, Artificial
  CRISPR gRNA sequence
ctcaaggataaccaagaact

SEQ ID NO: 392950 - DNA, 20 bp, Artificial
  CRISPR gRNA sequence
tcaaggataaccaagaactg

SEQ ID NO: 392951 - DNA, 20 bp, Artificial
  CRISPR gRNA sequence
aaggataaccaagaactggt

SEQ ID NO: 392952 - DNA, 20 bp, Artificial
  CRISPR gRNA sequence
gttgtggcctctctgtttcc

SEQ ID NO: 392953 - DNA, 20 bp, Artificial
  CRISPR gRNA sequence
tggcctctctgtttccataa

SEQ ID NO: 392954 - DNA, 20 bp, Artificial
  CRISPR gRNA sequence
tctgtttccataatgctcaa

SEQ ID NO: 392955 - DNA, 20 bp, Artificial
  CRISPR gRNA sequence
tgtttccataatgctcaaac

SEQ ID NO: 392956 - DNA, 20 bp, Artificial
  CRISPR gRNA sequence
tttccataatgctcaaactg

SEQ ID NO: 392957 - DNA, 20 bp, Artificial
  CRISPR gRNA sequence
ccataatgctcaaactgaag

SEQ ID NO: 392958 - DNA, 20 bp, Artificial
  CRISPR gRNA sequence
cataatgctcaaactgaaga

SEQ ID NO: 392959 - DNA, 20 bp, Artificial
  CRISPR gRNA sequence
aaactgaagaaaaataacgg

SEQ ID NO: 392960 - DNA, 20 bp, Artificial
  CRISPR gRNA sequence
aagaaaaataacggagcaac

SEQ ID NO: 392961 - DNA, 20 bp, Artificial
  CRISPR gRNA sequence
aaacattccagaaacgctgt

SEQ ID NO: 392962 - DNA, 20 bp, Artificial
  CRISPR gRNA sequence
aacattccagaaacgctgtc

SEQ ID NO: 392963 - DNA, 20 bp, Artificial
  CRISPR gRNA sequence
cagaaacgctgtcagggagc

SEQ ID NO: 392964 - DNA, 20 bp, Artificial
  CRISPR gRNA sequence
tcagggagcttttttcaaac

SEQ ID NO: 392965 - DNA, 20 bp, Artificial
  CRISPR gRNA sequence
ttttcaaacataggaaggaa

SEQ ID NO: 392966 - DNA, 20 bp, Artificial
  CRISPR gRNA sequence
tttcaaacataggaaggaaa

SEQ ID NO: 392967 - DNA, 20 bp, Artificial
  CRISPR gRNA sequence
ttcaaacataggaaggaaaa

SEQ ID NO: 392968 - DNA, 20 bp, Artificial
  CRISPR gRNA sequence
tcaaacataggaaggaaaaa

SEQ ID NO: 392969 - DNA, 20 bp, Artificial
  CRISPR gRNA sequence
caaacataggaaggaaaaaa

SEQ ID NO: 392970 - DNA, 20 bp, Artificial
  CRISPR gRNA sequence
aaacataggaaggaaaaaac

SEQ ID NO: 392971 - DNA, 20 bp, Artificial
  CRISPR gRNA sequence
accgtttacatagctacaaa

SEQ ID NO: 392972 - DNA, 20 bp, Artificial
  CRISPR gRNA sequence
acatagctacaaaaaaatat

SEQ ID NO: 392973 - DNA, 20 bp, Artificial
  CRISPR gRNA sequence
catagctacaaaaaaatatc

SEQ ID NO: 392974 - DNA, 20 bp, Artificial
  CRISPR gRNA sequence
caaaaaaatatctaaaatat

SEQ ID NO: 392975 - DNA, 20 bp, Artificial
  CRISPR gRNA sequence
aaatattgtcaaaagaagtc

SEQ ID NO: 392976 - DNA, 20 bp, Artificial
  CRISPR gRNA sequence
tcaaaagaagtcttgaacca

SEQ ID NO: 392977 - DNA, 20 bp, Artificial
  CRISPR gRNA sequence
gaaccaaggaaatttatcac

SEQ ID NO: 392978 - DNA, 20 bp, Artificial
  CRISPR gRNA sequence
aaccaaggaaatttatcaca

SEQ ID NO: 392979 - DNA, 20 bp, Artificial
  CRISPR gRNA sequence
atcacataagacaaaccatt

SEQ ID NO: 392980 - DNA, 20 bp, Artificial
  CRISPR gRNA sequence
tcacataagacaaaccattt

SEQ ID NO: 392981 - DNA, 20 bp, Artificial
  CRISPR gRNA sequence
cattttcaccataatattta

SEQ ID NO: 392982 - DNA, 20 bp, Artificial
  CRISPR gRNA sequence
attttcaccataatatttaa

SEQ ID NO: 392983 - DNA, 20 bp, Artificial
  CRISPR gRNA sequence
tcaccataatatttaaagga

SEQ ID NO: 392984 - DNA, 20 bp, Artificial
  CRISPR gRNA sequence
caccataatatttaaaggat

SEQ ID NO: 392985 - DNA, 20 bp, Artificial
  CRISPR gRNA sequence
accataatatttaaaggatc

SEQ ID NO: 392986 - DNA, 20 bp, Artificial
  CRISPR gRNA sequence
aaaggatcatccaggaagta

SEQ ID NO: 392987 - DNA, 20 bp, Artificial
  CRISPR gRNA sequence
aaggatcatccaggaagtag

SEQ ID NO: 392988 - DNA, 20 bp, Artificial
  CRISPR gRNA sequence
ttcaaacaatgtctagtatc

SEQ ID NO: 392989 - DNA, 20 bp, Artificial
  CRISPR gRNA sequence
caaacaatgtctagtatcaa

SEQ ID NO: 392990 - DNA, 20 bp, Artificial
  CRISPR gRNA sequence
aaacaatgtctagtatcaaa

SEQ ID NO: 392991 - DNA, 20 bp, Artificial
  CRISPR gRNA sequence
gtatcaaaagaaagtgaata

SEQ ID NO: 392992 - DNA, 20 bp, Artificial
  CRISPR gRNA sequence
tactttctgaaagaactgaa

SEQ ID NO: 392993 - DNA, 20 bp, Artificial
  CRISPR gRNA sequence
ctttctgaaagaactgaagg

SEQ ID NO: 392994 - DNA, 20 bp, Artificial
  CRISPR gRNA sequence
tctgaaagaactgaaggcaa

SEQ ID NO: 392995 - DNA, 20 bp, Artificial
  CRISPR gRNA sequence
ctgaaagaactgaaggcaag

SEQ ID NO: 392996 - DNA, 20 bp, Artificial
  CRISPR gRNA sequence
tgaaagaactgaaggcaagg

SEQ ID NO: 392997 - DNA, 20 bp, Artificial
  CRISPR gRNA sequence
aaagaactgaaggcaaggag

SEQ ID NO: 392998 - DNA, 20 bp, Artificial
  CRISPR gRNA sequence
aaggcaaggagattacctaa

SEQ ID NO: 392999 - DNA, 20 bp, Artificial
  CRISPR gRNA sequence
cctaaattttaagagtaaat

SEQ ID NO: 393000 - DNA, 20 bp, Artificial
  CRISPR gRNA sequence
aattttaagagtaaataaat

SEQ ID NO: 393001 - DNA, 20 bp, Artificial
  CRISPR gRNA sequence
taagagtaaataaatgctga

SEQ ID NO: 393002 - DNA, 20 bp, Artificial
  CRISPR gRNA sequence
aagagtaaataaatgctgaa

SEQ ID NO: 393003 - DNA, 20 bp, Artificial
  CRISPR gRNA sequence
agagtaaataaatgctgaag

SEQ ID NO: 393004 - DNA, 20 bp, Artificial
  CRISPR gRNA sequence
aagagacaaaacataatatc

SEQ ID NO: 393005 - DNA, 20 bp, Artificial
  CRISPR gRNA sequence
tctgtgaagtaaatggcacc

SEQ ID NO: 393006 - DNA, 20 bp, Artificial
  CRISPR gRNA sequence
tgaagtaaatggcaccaggc

SEQ ID NO: 393007 - DNA, 20 bp, Artificial
  CRISPR gRNA sequence
tcatcttatttcgctgaaca

SEQ ID NO: 393008 - DNA, 20 bp, Artificial
  CRISPR gRNA sequence
catcttatttcgctgaacaa

SEQ ID NO: 393009 - DNA, 20 bp, Artificial
  CRISPR gRNA sequence
atcttatttcgctgaacaat

SEQ ID NO: 393010 - DNA, 20 bp, Artificial
  CRISPR gRNA sequence
atttcgctgaacaatgcagg

SEQ ID NO: 393011 - DNA, 20 bp, Artificial
  CRISPR gRNA sequence
tttcgctgaacaatgcaggc

SEQ ID NO: 393012 - DNA, 20 bp, Artificial
  CRISPR gRNA sequence
cgctgaacaatgcaggccag

SEQ ID NO: 393013 - DNA, 20 bp, Artificial
  CRISPR gRNA sequence
gctgaacaatgcaggccagg

SEQ ID NO: 393014 - DNA, 20 bp, Artificial
  CRISPR gRNA sequence
aacaatgcaggccagggtta

SEQ ID NO: 393015 - DNA, 20 bp, Artificial
  CRISPR gRNA sequence
ttaagtctgacaaggcaaat

SEQ ID NO: 393016 - DNA, 20 bp, Artificial
  CRISPR gRNA sequence
agtctgacaaggcaaattgt

SEQ ID NO: 393017 - DNA, 20 bp, Artificial
  CRISPR gRNA sequence
acaaggcaaattgtttatca

SEQ ID NO: 393018 - DNA, 20 bp, Artificial
  CRISPR gRNA sequence
tttatcatgactgagtcata

SEQ ID NO: 393019 - DNA, 20 bp, Artificial
  CRISPR gRNA sequence
atcatgactgagtcataaat

SEQ ID NO: 393020 - DNA, 20 bp, Artificial
  CRISPR gRNA sequence
tcatgactgagtcataaata

SEQ ID NO: 393021 - DNA, 20 bp, Artificial
  CRISPR gRNA sequence
agtcataaatactagtacca

SEQ ID NO: 393022 - DNA, 20 bp, Artificial
  CRISPR gRNA sequence
gtaccaagagatgtgattta

SEQ ID NO: 393023 - DNA, 20 bp, Artificial
  CRISPR gRNA sequence
actgaacagtaccaaacacc

SEQ ID NO: 393024 - DNA, 20 bp, Artificial
  CRISPR gRNA sequence
ctgaacagtaccaaacaccg

SEQ ID NO: 393025 - DNA, 20 bp, Artificial
  CRISPR gRNA sequence
aacagtaccaaacaccgaat

SEQ ID NO: 393026 - DNA, 20 bp, Artificial
  CRISPR gRNA sequence
tttaaatgaagttatttcaa

SEQ ID NO: 393027 - DNA, 20 bp, Artificial
  CRISPR gRNA sequence
ttaaatgaagttatttcaaa

SEQ ID NO: 393028 - DNA, 20 bp, Artificial
  CRISPR gRNA sequence
taaatgaagttatttcaaaa

SEQ ID NO: 393029 - DNA, 20 bp, Artificial
  CRISPR gRNA sequence
aaatgaagttatttcaaaaa

SEQ ID NO: 393030 - DNA, 20 bp, Artificial
  CRISPR gRNA sequence
aatgaagttatttcaaaaaa

SEQ ID NO: 393031 - DNA, 20 bp, Artificial
  CRISPR gRNA sequence
tttcaaaaaagagtcggtta

SEQ ID NO: 393032 - DNA, 20 bp, Artificial
  CRISPR gRNA sequence
caaaaaagagtcggttacta

SEQ ID NO: 393033 - DNA, 20 bp, Artificial
  CRISPR gRNA sequence
aaaaaagagtcggttactat

SEQ ID NO: 393034 - DNA, 20 bp, Artificial
  CRISPR gRNA sequence
ctataagaagcatgagttat

SEQ ID NO: 393035 - DNA, 20 bp, Artificial
  CRISPR gRNA sequence
taagaagcatgagttatcct

SEQ ID NO: 393036 - DNA, 20 bp, Artificial
  CRISPR gRNA sequence
tcctcttactttcatctact

SEQ ID NO: 393037 - DNA, 20 bp, Artificial
  CRISPR gRNA sequence
ttactttcatctacttttgt

SEQ ID NO: 393038 - DNA, 20 bp, Artificial
  CRISPR gRNA sequence
actttcatctacttttgttg

SEQ ID NO: 393039 - DNA, 20 bp, Artificial
  CRISPR gRNA sequence
ctttcatctacttttgttgt

SEQ ID NO: 393040 - DNA, 20 bp, Artificial
  CRISPR gRNA sequence
tcatctacttttgttgtcac

SEQ ID NO: 393041 - DNA, 20 bp, Artificial
  CRISPR gRNA sequence
catctacttttgttgtcact

SEQ ID NO: 393042 - DNA, 20 bp, Artificial
  CRISPR gRNA sequence
atctacttttgttgtcactc

SEQ ID NO: 393043 - DNA, 20 bp, Artificial
  CRISPR gRNA sequence
cttttgttgtcactcttttt

SEQ ID NO: 393044 - DNA, 20 bp, Artificial
  CRISPR gRNA sequence
ttgttgtcactctttttttt

SEQ ID NO: 393045 - DNA, 20 bp, Artificial
  CRISPR gRNA sequence
tgttgtcactcttttttttt

SEQ ID NO: 393046 - DNA, 20 bp, Artificial
  CRISPR gRNA sequence
gttgtcactctttttttttt

SEQ ID NO: 393047 - DNA, 20 bp, Artificial
  CRISPR gRNA sequence
ttgtcactcttttttttttt

SEQ ID NO: 393048 - DNA, 20 bp, Artificial
  CRISPR gRNA sequence
tcactctttttttttttttt

SEQ ID NO: 393049 - DNA, 20 bp, Artificial
  CRISPR gRNA sequence
ttttttttttttttttccaa

SEQ ID NO: 393050 - DNA, 20 bp, Artificial
  CRISPR gRNA sequence
ttttttttttttttccaaag

SEQ ID NO: 393051 - DNA, 20 bp, Artificial
  CRISPR gRNA sequence
tttttttttttttccaaaga

SEQ ID NO: 393052 - DNA, 20 bp, Artificial
  CRISPR gRNA sequence
ttttttttttttccaaagac

SEQ ID NO: 393053 - DNA, 20 bp, Artificial
  CRISPR gRNA sequence
tttttttttttccaaagaca

SEQ ID NO: 393054 - DNA, 20 bp, Artificial
  CRISPR gRNA sequence
ttttttttttccaaagacaa

SEQ ID NO: 393055 - DNA, 20 bp, Artificial
  CRISPR gRNA sequence
tttttttttccaaagacaag

SEQ ID NO: 393056 - DNA, 20 bp, Artificial
  CRISPR gRNA sequence
ttttttttccaaagacaagg

SEQ ID NO: 393057 - DNA, 20 bp, Artificial
  CRISPR gRNA sequence
tttttttccaaagacaaggt

SEQ ID NO: 393058 - DNA, 20 bp, Artificial
  CRISPR gRNA sequence
ttttttccaaagacaaggtc

SEQ ID NO: 393059 - DNA, 20 bp, Artificial
  CRISPR gRNA sequence
tttttccaaagacaaggtct

SEQ ID NO: 393060 - DNA, 20 bp, Artificial
  CRISPR gRNA sequence
ttttccaaagacaaggtctc

SEQ ID NO: 393061 - DNA, 20 bp, Artificial
  CRISPR gRNA sequence
tttccaaagacaaggtctcg

SEQ ID NO: 393062 - DNA, 20 bp, Artificial
  CRISPR gRNA sequence
ttccaaagacaaggtctcgc

SEQ ID NO: 393063 - DNA, 20 bp, Artificial
  CRISPR gRNA sequence
tccaaagacaaggtctcgct

SEQ ID NO: 393064 - DNA, 20 bp, Artificial
  CRISPR gRNA sequence
ccaaagacaaggtctcgctc

SEQ ID NO: 393065 - DNA, 20 bp, Artificial
  CRISPR gRNA sequence
caaagacaaggtctcgctct

SEQ ID NO: 393066 - DNA, 20 bp, Artificial
  CRISPR gRNA sequence
gctctattgcccatgagcaa

SEQ ID NO: 393067 - DNA, 20 bp, Artificial
  CRISPR gRNA sequence
tattgcccatgagcaatcac

SEQ ID NO: 393068 - DNA, 20 bp, Artificial
  CRISPR gRNA sequence
ttgcccatgagcaatcacag

SEQ ID NO: 393069 - DNA, 20 bp, Artificial
  CRISPR gRNA sequence
cccatgagcaatcacaggtc

SEQ ID NO: 393070 - DNA, 20 bp, Artificial
  CRISPR gRNA sequence
aagccccgacctttcaggat

SEQ ID NO: 393071 - DNA, 20 bp, Artificial
  CRISPR gRNA sequence
tcaggatcaaaccatcatcc

SEQ ID NO: 393072 - DNA, 20 bp, Artificial
  CRISPR gRNA sequence
caggatcaaaccatcatccc

SEQ ID NO: 393073 - DNA, 20 bp, Artificial
  CRISPR gRNA sequence
aggatcaaaccatcatccca

SEQ ID NO: 393074 - DNA, 20 bp, Artificial
  CRISPR gRNA sequence
agcctcctaagtagctggga

SEQ ID NO: 393075 - DNA, 20 bp, Artificial
  CRISPR gRNA sequence
ctaagtagctgggacaacag

SEQ ID NO: 393076 - DNA, 20 bp, Artificial
  CRISPR gRNA sequence
agtagctgggacaacagaca

SEQ ID NO: 393077 - DNA, 20 bp, Artificial
  CRISPR gRNA sequence
ggacaacagacatgtgccac

SEQ ID NO: 393078 - DNA, 20 bp, Artificial
  CRISPR gRNA sequence
agctaatttttatatttttt

SEQ ID NO: 393079 - DNA, 20 bp, Artificial
  CRISPR gRNA sequence
atttttatatttttttgtag

SEQ ID NO: 393080 - DNA, 20 bp, Artificial
  CRISPR gRNA sequence
ttatatttttttgtagcaac

SEQ ID NO: 393081 - DNA, 20 bp, Artificial
  CRISPR gRNA sequence
tatatttttttgtagcaaca

SEQ ID NO: 393082 - DNA, 20 bp, Artificial
  CRISPR gRNA sequence
atatttttttgtagcaacag

SEQ ID NO: 393083 - DNA, 20 bp, Artificial
  CRISPR gRNA sequence
tatttttttgtagcaacagg

SEQ ID NO: 393084 - DNA, 20 bp, Artificial
  CRISPR gRNA sequence
ttttgtagcaacagggtttt

SEQ ID NO: 393085 - DNA, 20 bp, Artificial
  CRISPR gRNA sequence
tttgtagcaacagggttttg

SEQ ID NO: 393086 - DNA, 20 bp, Artificial
  CRISPR gRNA sequence
ttgtagcaacagggttttgc

SEQ ID NO: 393087 - DNA, 20 bp, Artificial
  CRISPR gRNA sequence
tgtagcaacagggttttgcc

SEQ ID NO: 393088 - DNA, 20 bp, Artificial
  CRISPR gRNA sequence
gtagcaacagggttttgcca

SEQ ID NO: 393089 - DNA, 20 bp, Artificial
  CRISPR gRNA sequence
tagcaacagggttttgccaa

SEQ ID NO: 393090 - DNA, 20 bp, Artificial
  CRISPR gRNA sequence
tgccaagttgcccaggctgg

SEQ ID NO: 393091 - DNA, 20 bp, Artificial
  CRISPR gRNA sequence
gccaagttgcccaggctggt

SEQ ID NO: 393092 - DNA, 20 bp, Artificial
  CRISPR gRNA sequence
ccaagttgcccaggctggtc

SEQ ID NO: 393093 - DNA, 20 bp, Artificial
  CRISPR gRNA sequence
cccaggctggtctcgaactc

SEQ ID NO: 393094 - DNA, 20 bp, Artificial
  CRISPR gRNA sequence
gtctcgaactctaggatcaa

SEQ ID NO: 393095 - DNA, 20 bp, Artificial
  CRISPR gRNA sequence
gaactctaggatcaagggat

SEQ ID NO: 393096 - DNA, 20 bp, Artificial
  CRISPR gRNA sequence
taggatcaagggatctgcct

SEQ ID NO: 393097 - DNA, 20 bp, Artificial
  CRISPR gRNA sequence
ggatcaagggatctgcctgc

SEQ ID NO: 393098 - DNA, 20 bp, Artificial
  CRISPR gRNA sequence
cctgcctcagcctcccaaag

SEQ ID NO: 393099 - DNA, 20 bp, Artificial
  CRISPR gRNA sequence
cctcagcctcccaaagtgct

SEQ ID NO: 393100 - DNA, 20 bp, Artificial
  CRISPR gRNA sequence
agcctcccaaagtgctggga

SEQ ID NO: 393101 - DNA, 20 bp, Artificial
  CRISPR gRNA sequence
ccaaagtgctgggattacag

SEQ ID NO: 393102 - DNA, 20 bp, Artificial
  CRISPR gRNA sequence
ggattacaggtgtgagccac

SEQ ID NO: 393103 - DNA, 20 bp, Artificial
  CRISPR gRNA sequence
caggtgtgagccaccatgcc

SEQ ID NO: 393104 - DNA, 20 bp, Artificial
  CRISPR gRNA sequence
gccttgttgtcactctctac

SEQ ID NO: 393105 - DNA, 20 bp, Artificial
  CRISPR gRNA sequence
gttgtcactctctacacagg

SEQ ID NO: 393106 - DNA, 20 bp, Artificial
  CRISPR gRNA sequence
ttgtcactctctacacaggc

SEQ ID NO: 393107 - DNA, 20 bp, Artificial
  CRISPR gRNA sequence
tcactctctacacaggctca

SEQ ID NO: 393108 - DNA, 20 bp, Artificial
  CRISPR gRNA sequence
tctacacaggctcaaaccca

SEQ ID NO: 393109 - DNA, 20 bp, Artificial
  CRISPR gRNA sequence
tacacaggctcaaacccaaa

SEQ ID NO: 393110 - DNA, 20 bp, Artificial
  CRISPR gRNA sequence
cacaggctcaaacccaaaaa

SEQ ID NO: 393111 - DNA, 20 bp, Artificial
  CRISPR gRNA sequence
aaacccaaaaatagaaacag

SEQ ID NO: 393112 - DNA, 20 bp, Artificial
  CRISPR gRNA sequence
aagatattttttaaactgct

SEQ ID NO: 393113 - DNA, 20 bp, Artificial
  CRISPR gRNA sequence
tttaaactgctttgctttcc

SEQ ID NO: 393114 - DNA, 20 bp, Artificial
  CRISPR gRNA sequence
ttaaactgctttgctttcct

SEQ ID NO: 393115 - DNA, 20 bp, Artificial
  CRISPR gRNA sequence
taaactgctttgctttcctg

SEQ ID NO: 393116 - DNA, 20 bp, Artificial
  CRISPR gRNA sequence
aaactgctttgctttcctgg

SEQ ID NO: 393117 - DNA, 20 bp, Artificial
  CRISPR gRNA sequence
aactgctttgctttcctggg

SEQ ID NO: 393118 - DNA, 20 bp, Artificial
  CRISPR gRNA sequence
ctttgctttcctggggaaga

SEQ ID NO: 393119 - DNA, 20 bp, Artificial
  CRISPR gRNA sequence
tgctttcctggggaagatat

SEQ ID NO: 393120 - DNA, 20 bp, Artificial
  CRISPR gRNA sequence
gctttcctggggaagatatt

SEQ ID NO: 393121 - DNA, 20 bp, Artificial
  CRISPR gRNA sequence
ctttcctggggaagatatta

SEQ ID NO: 393122 - DNA, 20 bp, Artificial
  CRISPR gRNA sequence
tcctggggaagatattacaa

SEQ ID NO: 393123 - DNA, 20 bp, Artificial
  CRISPR gRNA sequence
cctggggaagatattacaaa

SEQ ID NO: 393124 - DNA, 20 bp, Artificial
  CRISPR gRNA sequence
ctggggaagatattacaaat

SEQ ID NO: 393125 - DNA, 20 bp, Artificial
  CRISPR gRNA sequence
gggaagatattacaaatgaa

SEQ ID NO: 393126 - DNA, 20 bp, Artificial
  CRISPR gRNA sequence
caaatgaacttacttctcta

SEQ ID NO: 393127 - DNA, 20 bp, Artificial
  CRISPR gRNA sequence
acttctctacttccatttgc

SEQ ID NO: 393128 - DNA, 20 bp, Artificial
  CRISPR gRNA sequence
cttctctacttccatttgct

SEQ ID NO: 393129 - DNA, 20 bp, Artificial
  CRISPR gRNA sequence
ctctacttccatttgctttg

SEQ ID NO: 393130 - DNA, 20 bp, Artificial
  CRISPR gRNA sequence
tctacttccatttgctttga

SEQ ID NO: 393131 - DNA, 20 bp, Artificial
  CRISPR gRNA sequence
tacttccatttgctttgata

SEQ ID NO: 393132 - DNA, 20 bp, Artificial
  CRISPR gRNA sequence
cttccatttgctttgataaa

SEQ ID NO: 393133 - DNA, 20 bp, Artificial
  CRISPR gRNA sequence
ccatttgctttgataaaaag

SEQ ID NO: 393134 - DNA, 20 bp, Artificial
  CRISPR gRNA sequence
catttgctttgataaaaaga

SEQ ID NO: 393135 - DNA, 20 bp, Artificial
  CRISPR gRNA sequence
gctttgataaaaagactaga

SEQ ID NO: 393136 - DNA, 20 bp, Artificial
  CRISPR gRNA sequence
ctttgataaaaagactagag

SEQ ID NO: 393137 - DNA, 20 bp, Artificial
  CRISPR gRNA sequence
tgataaaaagactagaggtc

SEQ ID NO: 393138 - DNA, 20 bp, Artificial
  CRISPR gRNA sequence
gataaaaagactagaggtct

SEQ ID NO: 393139 - DNA, 20 bp, Artificial
  CRISPR gRNA sequence
ataaaaagactagaggtctc

SEQ ID NO: 393140 - DNA, 20 bp, Artificial
  CRISPR gRNA sequence
gaggtctctttgttcttcac

SEQ ID NO: 393141 - DNA, 20 bp, Artificial
  CRISPR gRNA sequence
tttgttcttcacattatgaa

SEQ ID NO: 393142 - DNA, 20 bp, Artificial
  CRISPR gRNA sequence
tgttcttcacattatgaaac

SEQ ID NO: 393143 - DNA, 20 bp, Artificial
  CRISPR gRNA sequence
gttcttcacattatgaaaca

SEQ ID NO: 393144 - DNA, 20 bp, Artificial
  CRISPR gRNA sequence
ttcttcacattatgaaacag

SEQ ID NO: 393145 - DNA, 20 bp, Artificial
  CRISPR gRNA sequence
ttcacattatgaaacaggaa

SEQ ID NO: 393146 - DNA, 20 bp, Artificial
  CRISPR gRNA sequence
cacattatgaaacaggaatt

SEQ ID NO: 393147 - DNA, 20 bp, Artificial
  CRISPR gRNA sequence
acattatgaaacaggaattt

SEQ ID NO: 393148 - DNA, 20 bp, Artificial
  CRISPR gRNA sequence
tgaaacaggaattttccata

SEQ ID NO: 393149 - DNA, 20 bp, Artificial
  CRISPR gRNA sequence
tccatagaaaatccatcccc

SEQ ID NO: 393150 - DNA, 20 bp, Artificial
  CRISPR gRNA sequence
ccatagaaaatccatcccct

SEQ ID NO: 393151 - DNA, 20 bp, Artificial
  CRISPR gRNA sequence
catagaaaatccatccccta

SEQ ID NO: 393152 - DNA, 20 bp, Artificial
  CRISPR gRNA sequence
ctgccttgaaatgtccattt

SEQ ID NO: 393153 - DNA, 20 bp, Artificial
  CRISPR gRNA sequence
ccttgaaatgtccatttata

SEQ ID NO: 393154 - DNA, 20 bp, Artificial
  CRISPR gRNA sequence
gaaatgtccatttatataca

SEQ ID NO: 393155 - DNA, 20 bp, Artificial
  CRISPR gRNA sequence
aaatgtccatttatatacaa

SEQ ID NO: 393156 - DNA, 20 bp, Artificial
  CRISPR gRNA sequence
atatacaagataaaaacaat

SEQ ID NO: 393157 - DNA, 20 bp, Artificial
  CRISPR gRNA sequence
tatacaagataaaaacaatg

SEQ ID NO: 393158 - DNA, 20 bp, Artificial
  CRISPR gRNA sequence
catggagtttataatataga

SEQ ID NO: 393159 - DNA, 20 bp, Artificial
  CRISPR gRNA sequence
atggagtttataatatagaa

SEQ ID NO: 393160 - DNA, 20 bp, Artificial
  CRISPR gRNA sequence
ataatatagaatcacttatt

SEQ ID NO: 393161 - DNA, 20 bp, Artificial
  CRISPR gRNA sequence
taatatagaatcacttattg

SEQ ID NO: 393162 - DNA, 20 bp, Artificial
  CRISPR gRNA sequence
attgcctcaccaatgcattc

SEQ ID NO: 393163 - DNA, 20 bp, Artificial
  CRISPR gRNA sequence
ttgcctcaccaatgcattca

SEQ ID NO: 393164 - DNA, 20 bp, Artificial
  CRISPR gRNA sequence
cctcaccaatgcattcattt

SEQ ID NO: 393165 - DNA, 20 bp, Artificial
  CRISPR gRNA sequence
accaatgcattcatttcttc

SEQ ID NO: 393166 - DNA, 20 bp, Artificial
  CRISPR gRNA sequence
atttcttcatttttatataa

SEQ ID NO: 393167 - DNA, 20 bp, Artificial
  CRISPR gRNA sequence
cttcatttttatataagaaa

SEQ ID NO: 393168 - DNA, 20 bp, Artificial
  CRISPR gRNA sequence
ttcatttttatataagaaaa

SEQ ID NO: 393169 - DNA, 20 bp, Artificial
  CRISPR gRNA sequence
catttttatataagaaaact

SEQ ID NO: 393170 - DNA, 20 bp, Artificial
  CRISPR gRNA sequence
atttttatataagaaaactt

SEQ ID NO: 393171 - DNA, 20 bp, Artificial
  CRISPR gRNA sequence
ttatataagaaaacttgaca

SEQ ID NO: 393172 - DNA, 20 bp, Artificial
  CRISPR gRNA sequence
tatataagaaaacttgacac

SEQ ID NO: 393173 - DNA, 20 bp, Artificial
  CRISPR gRNA sequence
atataagaaaacttgacact

SEQ ID NO: 393174 - DNA, 20 bp, Artificial
  CRISPR gRNA sequence
tataagaaaacttgacactt

SEQ ID NO: 393175 - DNA, 20 bp, Artificial
  CRISPR gRNA sequence
gacacttctcctttttactt

SEQ ID NO: 393176 - DNA, 20 bp, Artificial
  CRISPR gRNA sequence
acacttctcctttttactta

SEQ ID NO: 393177 - DNA, 20 bp, Artificial
  CRISPR gRNA sequence
ctcctttttacttacatgaa

SEQ ID NO: 393178 - DNA, 20 bp, Artificial
  CRISPR gRNA sequence
tcctttttacttacatgaaa

SEQ ID NO: 393179 - DNA, 20 bp, Artificial
  CRISPR gRNA sequence
ctttttacttacatgaaaat

SEQ ID NO: 393180 - DNA, 20 bp, Artificial
  CRISPR gRNA sequence
tttacttacatgaaaattca

SEQ ID NO: 393181 - DNA, 20 bp, Artificial
  CRISPR gRNA sequence
ttacttacatgaaaattcat

SEQ ID NO: 393182 - DNA, 20 bp, Artificial
  CRISPR gRNA sequence
tacttacatgaaaattcatt

SEQ ID NO: 393183 - DNA, 20 bp, Artificial
  CRISPR gRNA sequence
acttacatgaaaattcattc

SEQ ID NO: 393184 - DNA, 20 bp, Artificial
  CRISPR gRNA sequence
cttacatgaaaattcattcc

SEQ ID NO: 393185 - DNA, 20 bp, Artificial
  CRISPR gRNA sequence
acatgaaaattcattcctct

SEQ ID NO: 393186 - DNA, 20 bp, Artificial
  CRISPR gRNA sequence
catgaaaattcattcctctg

SEQ ID NO: 393187 - DNA, 20 bp, Artificial
  CRISPR gRNA sequence
attcctctgtatttttcttt

SEQ ID NO: 393188 - DNA, 20 bp, Artificial
  CRISPR gRNA sequence
ctctgtatttttctttatac

SEQ ID NO: 393189 - DNA, 20 bp, Artificial
  CRISPR gRNA sequence
tgtatttttctttataccca

SEQ ID NO: 393190 - DNA, 20 bp, Artificial
  CRISPR gRNA sequence
tatttttctttatacccagt

SEQ ID NO: 393191 - DNA, 20 bp, Artificial
  CRISPR gRNA sequence
ttctttatacccagtagtac

SEQ ID NO: 393192 - DNA, 20 bp, Artificial
  CRISPR gRNA sequence
tctttatacccagtagtact

SEQ ID NO: 393193 - DNA, 20 bp, Artificial
  CRISPR gRNA sequence
ctttatacccagtagtactt

SEQ ID NO: 393194 - DNA, 20 bp, Artificial
  CRISPR gRNA sequence
tttatacccagtagtactta

SEQ ID NO: 393195 - DNA, 20 bp, Artificial
  CRISPR gRNA sequence
tatacccagtagtacttaca

SEQ ID NO: 393196 - DNA, 20 bp, Artificial
  CRISPR gRNA sequence
atacccagtagtacttacaa

SEQ ID NO: 393197 - DNA, 20 bp, Artificial
  CRISPR gRNA sequence
tacccagtagtacttacaat

SEQ ID NO: 393198 - DNA, 20 bp, Artificial
  CRISPR gRNA sequence
acaattactcctcaaaagaa

SEQ ID NO: 393199 - DNA, 20 bp, Artificial
  CRISPR gRNA sequence
caattactcctcaaaagaaa

SEQ ID NO: 393200 - DNA, 20 bp, Artificial
  CRISPR gRNA sequence
ctcctcaaaagaaaaataac

SEQ ID NO: 393201 - DNA, 20 bp, Artificial
  CRISPR gRNA sequence
ctcaaaagaaaaataacttt

SEQ ID NO: 393202 - DNA, 20 bp, Artificial
  CRISPR gRNA sequence
aaaagaaaaataactttgct

SEQ ID NO: 393203 - DNA, 20 bp, Artificial
  CRISPR gRNA sequence
tgcttcattcttctatatgt

SEQ ID NO: 393204 - DNA, 20 bp, Artificial
  CRISPR gRNA sequence
gcttcattcttctatatgtt

SEQ ID NO: 393205 - DNA, 20 bp, Artificial
  CRISPR gRNA sequence
cttcattcttctatatgttg

SEQ ID NO: 393206 - DNA, 20 bp, Artificial
  CRISPR gRNA sequence
cattcttctatatgttgtta

SEQ ID NO: 393207 - DNA, 20 bp, Artificial
  CRISPR gRNA sequence
attcttctatatgttgttat

SEQ ID NO: 393208 - DNA, 20 bp, Artificial
  CRISPR gRNA sequence
ttctatatgttgttatttgg

SEQ ID NO: 393209 - DNA, 20 bp, Artificial
  CRISPR gRNA sequence
ctatatgttgttatttgggc

SEQ ID NO: 393210 - DNA, 20 bp, Artificial
  CRISPR gRNA sequence
tatatgttgttatttgggcc

SEQ ID NO: 393211 - DNA, 20 bp, Artificial
  CRISPR gRNA sequence
tatgttgttatttgggccaa

SEQ ID NO: 393212 - DNA, 20 bp, Artificial
  CRISPR gRNA sequence
ttatttgggccaattaatca

SEQ ID NO: 393213 - DNA, 20 bp, Artificial
  CRISPR gRNA sequence
tttgggccaattaatcataa

SEQ ID NO: 393214 - DNA, 20 bp, Artificial
  CRISPR gRNA sequence
gggccaattaatcataataa

SEQ ID NO: 393215 - DNA, 20 bp, Artificial
  CRISPR gRNA sequence
ggccaattaatcataataaa

SEQ ID NO: 393216 - DNA, 20 bp, Artificial
  CRISPR gRNA sequence
atcataataaaaaatttaat

SEQ ID NO: 393217 - DNA, 20 bp, Artificial
  CRISPR gRNA sequence
aatatatactaagtatttat

SEQ ID NO: 393218 - DNA, 20 bp, Artificial
  CRISPR gRNA sequence
atatatactaagtatttata

SEQ ID NO: 393219 - DNA, 20 bp, Artificial
  CRISPR gRNA sequence
agtatttataatgaggcacg

SEQ ID NO: 393220 - DNA, 20 bp, Artificial
  CRISPR gRNA sequence
ataatgaggcacgatgtgtg

SEQ ID NO: 393221 - DNA, 20 bp, Artificial
  CRISPR gRNA sequence
taatgaggcacgatgtgtga

SEQ ID NO: 393222 - DNA, 20 bp, Artificial
  CRISPR gRNA sequence
tgcagcggatgtttattgaa

SEQ ID NO: 393223 - DNA, 20 bp, Artificial
  CRISPR gRNA sequence
gcagcggatgtttattgaat

SEQ ID NO: 393224 - DNA, 20 bp, Artificial
  CRISPR gRNA sequence
cagcggatgtttattgaatc

SEQ ID NO: 393225 - DNA, 20 bp, Artificial
  CRISPR gRNA sequence
attgaatctcacctttcatt

SEQ ID NO: 393226 - DNA, 20 bp, Artificial
  CRISPR gRNA sequence
ttgaatctcacctttcattt

SEQ ID NO: 393227 - DNA, 20 bp, Artificial
  CRISPR gRNA sequence
aatctcacctttcatttgag

SEQ ID NO: 393228 - DNA, 20 bp, Artificial
  CRISPR gRNA sequence
acctttcatttgaggcactg

SEQ ID NO: 393229 - DNA, 20 bp, Artificial
  CRISPR gRNA sequence
tcatttgaggcactgttatt

SEQ ID NO: 393230 - DNA, 20 bp, Artificial
  CRISPR gRNA sequence
catttgaggcactgttatta

SEQ ID NO: 393231 - DNA, 20 bp, Artificial
  CRISPR gRNA sequence
atttgaggcactgttattat

SEQ ID NO: 393232 - DNA, 20 bp, Artificial
  CRISPR gRNA sequence
gaggcactgttattatgact

SEQ ID NO: 393233 - DNA, 20 bp, Artificial
  CRISPR gRNA sequence
aggcactgttattatgactc

SEQ ID NO: 393234 - DNA, 20 bp, Artificial
  CRISPR gRNA sequence
ttattatgactctcatttta

SEQ ID NO: 393235 - DNA, 20 bp, Artificial
  CRISPR gRNA sequence
ttatgactctcattttaaag

SEQ ID NO: 393236 - DNA, 20 bp, Artificial
  CRISPR gRNA sequence
tgactctcattttaaagata

SEQ ID NO: 393237 - DNA, 20 bp, Artificial
  CRISPR gRNA sequence
tcattttaaagatattgtaa

SEQ ID NO: 393238 - DNA, 20 bp, Artificial
  CRISPR gRNA sequence
attttaaagatattgtaaca

SEQ ID NO: 393239 - DNA, 20 bp, Artificial
  CRISPR gRNA sequence
taaagatattgtaacaaggg

SEQ ID NO: 393240 - DNA, 20 bp, Artificial
  CRISPR gRNA sequence
aaagatattgtaacaagggt

SEQ ID NO: 393241 - DNA, 20 bp, Artificial
  CRISPR gRNA sequence
aagatattgtaacaagggtt

SEQ ID NO: 393242 - DNA, 20 bp, Artificial
  CRISPR gRNA sequence
taacaagggttatgactagc

SEQ ID NO: 393243 - DNA, 20 bp, Artificial
  CRISPR gRNA sequence
tgactagcgaagacagagtc

SEQ ID NO: 393244 - DNA, 20 bp, Artificial
  CRISPR gRNA sequence
gcgaagacagagtcagtatt

SEQ ID NO: 393245 - DNA, 20 bp, Artificial
  CRISPR gRNA sequence
gaacacagaaatttgactga

SEQ ID NO: 393246 - DNA, 20 bp, Artificial
  CRISPR gRNA sequence
aacacagaaatttgactgag

SEQ ID NO: 393247 - DNA, 20 bp, Artificial
  CRISPR gRNA sequence
gactgagttccttaaaagaa

SEQ ID NO: 393248 - DNA, 20 bp, Artificial
  CRISPR gRNA sequence
actgagttccttaaaagaac

SEQ ID NO: 393249 - DNA, 20 bp, Artificial
  CRISPR gRNA sequence
agttccttaaaagaacaaaa

SEQ ID NO: 393250 - DNA, 20 bp, Artificial
  CRISPR gRNA sequence
cttaaaagaacaaaaataaa

SEQ ID NO: 393251 - DNA, 20 bp, Artificial
  CRISPR gRNA sequence
aaaagaacaaaaataaaaac

SEQ ID NO: 393252 - DNA, 20 bp, Artificial
  CRISPR gRNA sequence
aaagaacaaaaataaaaact

SEQ ID NO: 393253 - DNA, 20 bp, Artificial
  CRISPR gRNA sequence
acgtacccaaatagtagatg

SEQ ID NO: 393254 - DNA, 20 bp, Artificial
  CRISPR gRNA sequence
cgtacccaaatagtagatga

SEQ ID NO: 393255 - DNA, 20 bp, Artificial
  CRISPR gRNA sequence
gcacaacatgttccctaaaa

SEQ ID NO: 393256 - DNA, 20 bp, Artificial
  CRISPR gRNA sequence
cctaaaatgataactacaaa

SEQ ID NO: 393257 - DNA, 20 bp, Artificial
  CRISPR gRNA sequence
aaatgataactacaaattat

SEQ ID NO: 393258 - DNA, 20 bp, Artificial
  CRISPR gRNA sequence
caaattattaattctggaat

SEQ ID NO: 393259 - DNA, 20 bp, Artificial
  CRISPR gRNA sequence
ttaattctggaatcctttat

SEQ ID NO: 393260 - DNA, 20 bp, Artificial
  CRISPR gRNA sequence
attctggaatcctttataca

SEQ ID NO: 393261 - DNA, 20 bp, Artificial
  CRISPR gRNA sequence
tggaatcctttatacaaaaa

SEQ ID NO: 393262 - DNA, 20 bp, Artificial
  CRISPR gRNA sequence
gaatcctttatacaaaaaag

SEQ ID NO: 393263 - DNA, 20 bp, Artificial
  CRISPR gRNA sequence
tatacaaaaaagtcatctcg

SEQ ID NO: 393264 - DNA, 20 bp, Artificial
  CRISPR gRNA sequence
atacaaaaaagtcatctcgc

SEQ ID NO: 393265 - DNA, 20 bp, Artificial
  CRISPR gRNA sequence
tacaaaaaagtcatctcgct

SEQ ID NO: 393266 - DNA, 20 bp, Artificial
  CRISPR gRNA sequence
gcttatgcagcacaactcag

SEQ ID NO: 393267 - DNA, 20 bp, Artificial
  CRISPR gRNA sequence
atgcagcacaactcagccct

SEQ ID NO: 393268 - DNA, 20 bp, Artificial
  CRISPR gRNA sequence
tgcagcacaactcagccctg

SEQ ID NO: 393269 - DNA, 20 bp, Artificial
  CRISPR gRNA sequence
agccctgtgtatttgtcttt

SEQ ID NO: 393270 - DNA, 20 bp, Artificial
  CRISPR gRNA sequence
tgtatttgtctttttcccat

SEQ ID NO: 393271 - DNA, 20 bp, Artificial
  CRISPR gRNA sequence
gtctttttcccatctgcagg

SEQ ID NO: 393272 - DNA, 20 bp, Artificial
  CRISPR gRNA sequence
tctttttcccatctgcaggt

SEQ ID NO: 393273 - DNA, 20 bp, Artificial
  CRISPR gRNA sequence
tttcccatctgcaggtcact

SEQ ID NO: 393274 - DNA, 20 bp, Artificial
  CRISPR gRNA sequence
ttcccatctgcaggtcactg

SEQ ID NO: 393275 - DNA, 20 bp, Artificial
  CRISPR gRNA sequence
tcccatctgcaggtcactgc

SEQ ID NO: 393276 - DNA, 20 bp, Artificial
  CRISPR gRNA sequence
cccatctgcaggtcactgcc

SEQ ID NO: 393277 - DNA, 20 bp, Artificial
  CRISPR gRNA sequence
ccatctgcaggtcactgccg

SEQ ID NO: 393278 - DNA, 20 bp, Artificial
  CRISPR gRNA sequence
caggtcactgccgtcacagg

SEQ ID NO: 393279 - DNA, 20 bp, Artificial
  CRISPR gRNA sequence
ccgtcacaggacgcaattgc

SEQ ID NO: 393280 - DNA, 20 bp, Artificial
  CRISPR gRNA sequence
ctcagttcttcatgccgagg

SEQ ID NO: 393281 - DNA, 20 bp, Artificial
  CRISPR gRNA sequence
agttcttcatgccgaggcaa

SEQ ID NO: 393282 - DNA, 20 bp, Artificial
  CRISPR gRNA sequence
ttcatgccgaggcaatgaaa

SEQ ID NO: 393283 - DNA, 20 bp, Artificial
  CRISPR gRNA sequence
catgccgaggcaatgaaaac

SEQ ID NO: 393284 - DNA, 20 bp, Artificial
  CRISPR gRNA sequence
atgccgaggcaatgaaaact

SEQ ID NO: 393285 - DNA, 20 bp, Artificial
  CRISPR gRNA sequence
atacccaatgtttcctctgg

SEQ ID NO: 393286 - DNA, 20 bp, Artificial
  CRISPR gRNA sequence
tacccaatgtttcctctggg

SEQ ID NO: 393287 - DNA, 20 bp, Artificial
  CRISPR gRNA sequence
cctctgggagggcaattctt

SEQ ID NO: 393288 - DNA, 20 bp, Artificial
  CRISPR gRNA sequence
ctctgggagggcaattcttc

SEQ ID NO: 393289 - DNA, 20 bp, Artificial
  CRISPR gRNA sequence
tgggagggcaattcttccca

SEQ ID NO: 393290 - DNA, 20 bp, Artificial
  CRISPR gRNA sequence
ggagggcaattcttcccaaa

SEQ ID NO: 393291 - DNA, 20 bp, Artificial
  CRISPR gRNA sequence
ttcccaaatgtaaatctgat

SEQ ID NO: 393292 - DNA, 20 bp, Artificial
  CRISPR gRNA sequence
cccaaatgtaaatctgatca

SEQ ID NO: 393293 - DNA, 20 bp, Artificial
  CRISPR gRNA sequence
ccaaatgtaaatctgatcat

SEQ ID NO: 393294 - DNA, 20 bp, Artificial
  CRISPR gRNA sequence
atcatggacctctctgcttg

SEQ ID NO: 393295 - DNA, 20 bp, Artificial
  CRISPR gRNA sequence
tctgcttgcaaaccagtttc

SEQ ID NO: 393296 - DNA, 20 bp, Artificial
  CRISPR gRNA sequence
tgcttgcaaaccagtttcaa

SEQ ID NO: 393297 - DNA, 20 bp, Artificial
  CRISPR gRNA sequence
cttgcaaaccagtttcaata

SEQ ID NO: 393298 - DNA, 20 bp, Artificial
  CRISPR gRNA sequence
gcaaaccagtttcaatactt

SEQ ID NO: 393299 - DNA, 20 bp, Artificial
  CRISPR gRNA sequence
caaaccagtttcaatacttg

SEQ ID NO: 393300 - DNA, 20 bp, Artificial
  CRISPR gRNA sequence
caatacttggagcttcttac

SEQ ID NO: 393301 - DNA, 20 bp, Artificial
  CRISPR gRNA sequence
aatacttggagcttcttaca

SEQ ID NO: 393302 - DNA, 20 bp, Artificial
  CRISPR gRNA sequence
ggagcttcttacactcatgc

SEQ ID NO: 393303 - DNA, 20 bp, Artificial
  CRISPR gRNA sequence
gagcttcttacactcatgca

SEQ ID NO: 393304 - DNA, 20 bp, Artificial
  CRISPR gRNA sequence
cttacactcatgcaagtata

SEQ ID NO: 393305 - DNA, 20 bp, Artificial
  CRISPR gRNA sequence
ttacactcatgcaagtataa

SEQ ID NO: 393306 - DNA, 20 bp, Artificial
  CRISPR gRNA sequence
acactcatgcaagtataatc

SEQ ID NO: 393307 - DNA, 20 bp, Artificial
  CRISPR gRNA sequence
cactcatgcaagtataatct

SEQ ID NO: 393308 - DNA, 20 bp, Artificial
  CRISPR gRNA sequence
atgcaagtataatctctctc

SEQ ID NO: 393309 - DNA, 20 bp, Artificial
  CRISPR gRNA sequence
tctctaagcctccttctctc

SEQ ID NO: 393310 - DNA, 20 bp, Artificial
  CRISPR gRNA sequence
tctaagcctccttctctctg

SEQ ID NO: 393311 - DNA, 20 bp, Artificial
  CRISPR gRNA sequence
taagcctccttctctctgcc

SEQ ID NO: 393312 - DNA, 20 bp, Artificial
  CRISPR gRNA sequence
agcctccttctctctgccct

SEQ ID NO: 393313 - DNA, 20 bp, Artificial
  CRISPR gRNA sequence
cttctctctgccctcacctc

SEQ ID NO: 393314 - DNA, 20 bp, Artificial
  CRISPR gRNA sequence
ctctctgccctcacctctca

SEQ ID NO: 393315 - DNA, 20 bp, Artificial
  CRISPR gRNA sequence
tctctgccctcacctctcac

SEQ ID NO: 393316 - DNA, 20 bp, Artificial
  CRISPR gRNA sequence
tctgccctcacctctcacta

SEQ ID NO: 393317 - DNA, 20 bp, Artificial
  CRISPR gRNA sequence
tgccctcacctctcactaca

SEQ ID NO: 393318 - DNA, 20 bp, Artificial
  CRISPR gRNA sequence
ccctcacctctcactacatc

SEQ ID NO: 393319 - DNA, 20 bp, Artificial
  CRISPR gRNA sequence
acctctcactacatctgtcc

SEQ ID NO: 393320 - DNA, 20 bp, Artificial
  CRISPR gRNA sequence
tcactacatctgtccatgcc

SEQ ID NO: 393321 - DNA, 20 bp, Artificial
  CRISPR gRNA sequence
actacatctgtccatgcccc

SEQ ID NO: 393322 - DNA, 20 bp, Artificial
  CRISPR gRNA sequence
catctgtccatgccccacaa

SEQ ID NO: 393323 - DNA, 20 bp, Artificial
  CRISPR gRNA sequence
tccatgccccacaatcacca

SEQ ID NO: 393324 - DNA, 20 bp, Artificial
  CRISPR gRNA sequence
atcaccaccactccaggccc

SEQ ID NO: 393325 - DNA, 20 bp, Artificial
  CRISPR gRNA sequence
caggccctcatgtgttcacc

SEQ ID NO: 393326 - DNA, 20 bp, Artificial
  CRISPR gRNA sequence
atgtgttcacctctcttgtc

SEQ ID NO: 393327 - DNA, 20 bp, Artificial
  CRISPR gRNA sequence
acctctcttgtccacgcctc

SEQ ID NO: 393328 - DNA, 20 bp, Artificial
  CRISPR gRNA sequence
tcttgtccacgcctccatgc

SEQ ID NO: 393329 - DNA, 20 bp, Artificial
  CRISPR gRNA sequence
ttgtccacgcctccatgccc

SEQ ID NO: 393330 - DNA, 20 bp, Artificial
  CRISPR gRNA sequence
gtccacgcctccatgccccg

SEQ ID NO: 393331 - DNA, 20 bp, Artificial
  CRISPR gRNA sequence
tccacgcctccatgccccgt

SEQ ID NO: 393332 - DNA, 20 bp, Artificial
  CRISPR gRNA sequence
catgccccgtgcaggttgtt

SEQ ID NO: 393333 - DNA, 20 bp, Artificial
  CRISPR gRNA sequence
ttctgtctgctgagatcctc

SEQ ID NO: 393334 - DNA, 20 bp, Artificial
  CRISPR gRNA sequence
tgtctgctgagatcctcaaa

SEQ ID NO: 393335 - DNA, 20 bp, Artificial
  CRISPR gRNA sequence
tctgctgagatcctcaaacc

SEQ ID NO: 393336 - DNA, 20 bp, Artificial
  CRISPR gRNA sequence
ctgagatcctcaaaccctga

SEQ ID NO: 393337 - DNA, 20 bp, Artificial
  CRISPR gRNA sequence
agatcctcaaaccctgaagg

SEQ ID NO: 393338 - DNA, 20 bp, Artificial
  CRISPR gRNA sequence
aaaccctgaaggcctcctcg

SEQ ID NO: 393339 - DNA, 20 bp, Artificial
  CRISPR gRNA sequence
aaggcctcctcgcatgggat

SEQ ID NO: 393340 - DNA, 20 bp, Artificial
  CRISPR gRNA sequence
ctcgcatgggatcatctggg

SEQ ID NO: 393341 - DNA, 20 bp, Artificial
  CRISPR gRNA sequence
gcatgggatcatctgggaag

SEQ ID NO: 393342 - DNA, 20 bp, Artificial
  CRISPR gRNA sequence
ggaagcttcgccagctttgg

SEQ ID NO: 393343 - DNA, 20 bp, Artificial
  CRISPR gRNA sequence
cgccagctttgggggcgcag

SEQ ID NO: 393344 - DNA, 20 bp, Artificial
  CRISPR gRNA sequence
gccagctttgggggcgcagt

SEQ ID NO: 393345 - DNA, 20 bp, Artificial
  CRISPR gRNA sequence
tgggggcgcagtttgcatcc

SEQ ID NO: 393346 - DNA, 20 bp, Artificial
  CRISPR gRNA sequence
gggggcgcagtttgcatcct

SEQ ID NO: 393347 - DNA, 20 bp, Artificial
  CRISPR gRNA sequence
ggggcgcagtttgcatccta

SEQ ID NO: 393348 - DNA, 20 bp, Artificial
  CRISPR gRNA sequence
gcatcctatcctatctgcac

SEQ ID NO: 393349 - DNA, 20 bp, Artificial
  CRISPR gRNA sequence
catcctatcctatctgcact

SEQ ID NO: 393350 - DNA, 20 bp, Artificial
  CRISPR gRNA sequence
tcctatctgcactctggcca

SEQ ID NO: 393351 - DNA, 20 bp, Artificial
  CRISPR gRNA sequence
tctgcactctggccatctct

SEQ ID NO: 393352 - DNA, 20 bp, Artificial
  CRISPR gRNA sequence
cactctggccatctctgtga

SEQ ID NO: 393353 - DNA, 20 bp, Artificial
  CRISPR gRNA sequence
tggccatctctgtgagaagc

SEQ ID NO: 393354 - DNA, 20 bp, Artificial
  CRISPR gRNA sequence
gccatctctgtgagaagcta

SEQ ID NO: 393355 - DNA, 20 bp, Artificial
  CRISPR gRNA sequence
tgtgagaagctaacacatct

SEQ ID NO: 393356 - DNA, 20 bp, Artificial
  CRISPR gRNA sequence
tgagaagctaacacatctta

SEQ ID NO: 393357 - DNA, 20 bp, Artificial
  CRISPR gRNA sequence
acacatcttattgggccatt

SEQ ID NO: 393358 - DNA, 20 bp, Artificial
  CRISPR gRNA sequence
attgggccattggattgtaa

SEQ ID NO: 393359 - DNA, 20 bp, Artificial
  CRISPR gRNA sequence
ttgggccattggattgtaag

SEQ ID NO: 393360 - DNA, 20 bp, Artificial
  CRISPR gRNA sequence
ggccattggattgtaagcat

SEQ ID NO: 393361 - DNA, 20 bp, Artificial
  CRISPR gRNA sequence
gattgtaagcatctccacag

SEQ ID NO: 393362 - DNA, 20 bp, Artificial
  CRISPR gRNA sequence
taagcatctccacagaagga

SEQ ID NO: 393363 - DNA, 20 bp, Artificial
  CRISPR gRNA sequence
cacagaaggaatgacttctt

SEQ ID NO: 393364 - DNA, 20 bp, Artificial
  CRISPR gRNA sequence
cttagtcatataagagggca

SEQ ID NO: 393365 - DNA, 20 bp, Artificial
  CRISPR gRNA sequence
ttagtcatataagagggcac

SEQ ID NO: 393366 - DNA, 20 bp, Artificial
  CRISPR gRNA sequence
agtcatataagagggcacca

SEQ ID NO: 393367 - DNA, 20 bp, Artificial
  CRISPR gRNA sequence
gtcatataagagggcaccac

SEQ ID NO: 393368 - DNA, 20 bp, Artificial
  CRISPR gRNA sequence
ttaaccttcctacccaatct

SEQ ID NO: 393369 - DNA, 20 bp, Artificial
  CRISPR gRNA sequence
taaccttcctacccaatctc

SEQ ID NO: 393370 - DNA, 20 bp, Artificial
  CRISPR gRNA sequence
aaccttcctacccaatctct

SEQ ID NO: 393371 - DNA, 20 bp, Artificial
  CRISPR gRNA sequence
accttcctacccaatctctt

SEQ ID NO: 393372 - DNA, 20 bp, Artificial
  CRISPR gRNA sequence
cctacccaatctctttaata

SEQ ID NO: 393373 - DNA, 20 bp, Artificial
  CRISPR gRNA sequence
ctacccaatctctttaataa

SEQ ID NO: 393374 - DNA, 20 bp, Artificial
  CRISPR gRNA sequence
cccaatctctttaataaggt

SEQ ID NO: 393375 - DNA, 20 bp, Artificial
  CRISPR gRNA sequence
tttaataaggtggctgtcct

SEQ ID NO: 393376 - DNA, 20 bp, Artificial
  CRISPR gRNA sequence
taataaggtggctgtcctcc

SEQ ID NO: 393377 - DNA, 20 bp, Artificial
  CRISPR gRNA sequence
aataaggtggctgtcctcct

SEQ ID NO: 393378 - DNA, 20 bp, Artificial
  CRISPR gRNA sequence
ataaggtggctgtcctcctt

SEQ ID NO: 393379 - DNA, 20 bp, Artificial
  CRISPR gRNA sequence
tcctccttcccccaggccga

SEQ ID NO: 393380 - DNA, 20 bp, Artificial
  CRISPR gRNA sequence
cttcccccaggccgagccac

SEQ ID NO: 393381 - DNA, 20 bp, Artificial
  CRISPR gRNA sequence
cccccaggccgagccacaag

SEQ ID NO: 393382 - DNA, 20 bp, Artificial
  CRISPR gRNA sequence
ccccaggccgagccacaagg

SEQ ID NO: 393383 - DNA, 20 bp, Artificial
  CRISPR gRNA sequence
ccctgtgggaagacccatga

SEQ ID NO: 393384 - DNA, 20 bp, Artificial
  CRISPR gRNA sequence
tgggaagacccatgaggccc

SEQ ID NO: 393385 - DNA, 20 bp, Artificial
  CRISPR gRNA sequence
cgtggattggccttatcttt

SEQ ID NO: 393386 - DNA, 20 bp, Artificial
  CRISPR gRNA sequence
gtggattggccttatctttt

SEQ ID NO: 393387 - DNA, 20 bp, Artificial
  CRISPR gRNA sequence
gccttatcttttgaatatta

SEQ ID NO: 393388 - DNA, 20 bp, Artificial
  CRISPR gRNA sequence
atcttttgaatattatctta

SEQ ID NO: 393389 - DNA, 20 bp, Artificial
  CRISPR gRNA sequence
tcttttgaatattatcttaa

SEQ ID NO: 393390 - DNA, 20 bp, Artificial
  CRISPR gRNA sequence
ttgaatattatcttaaatca

SEQ ID NO: 393391 - DNA, 20 bp, Artificial
  CRISPR gRNA sequence
tgaatattatcttaaatcac

SEQ ID NO: 393392 - DNA, 20 bp, Artificial
  CRISPR gRNA sequence
gaatattatcttaaatcact

SEQ ID NO: 393393 - DNA, 20 bp, Artificial
  CRISPR gRNA sequence
aatattatcttaaatcactt

SEQ ID NO: 393394 - DNA, 20 bp, Artificial
  CRISPR gRNA sequence
tcttaaatcacttgtctcct

SEQ ID NO: 393395 - DNA, 20 bp, Artificial
  CRISPR gRNA sequence
aaatcacttgtctccttgtt

SEQ ID NO: 393396 - DNA, 20 bp, Artificial
  CRISPR gRNA sequence
aatcacttgtctccttgtta

SEQ ID NO: 393397 - DNA, 20 bp, Artificial
  CRISPR gRNA sequence
gtctccttgttagtcagttt

SEQ ID NO: 393398 - DNA, 20 bp, Artificial
  CRISPR gRNA sequence
tctccttgttagtcagttta

SEQ ID NO: 393399 - DNA, 20 bp, Artificial
  CRISPR gRNA sequence
cttgttagtcagtttaagta

SEQ ID NO: 393400 - DNA, 20 bp, Artificial
  CRISPR gRNA sequence
gttagtcagtttaagtaact

SEQ ID NO: 393401 - DNA, 20 bp, Artificial
  CRISPR gRNA sequence
ttagtcagtttaagtaactg

SEQ ID NO: 393402 - DNA, 20 bp, Artificial
  CRISPR gRNA sequence
gtcagtttaagtaactgtaa

SEQ ID NO: 393403 - DNA, 20 bp, Artificial
  CRISPR gRNA sequence
aagtaactgtaagtcaaagg

SEQ ID NO: 393404 - DNA, 20 bp, Artificial
  CRISPR gRNA sequence
agtaactgtaagtcaaaggg

SEQ ID NO: 393405 - DNA, 20 bp, Artificial
  CRISPR gRNA sequence
taagtcaaagggaagaatgc

SEQ ID NO: 393406 - DNA, 20 bp, Artificial
  CRISPR gRNA sequence
cacactccaagttttatcca

SEQ ID NO: 393407 - DNA, 20 bp, Artificial
  CRISPR gRNA sequence
caagttttatccaatgctct

SEQ ID NO: 393408 - DNA, 20 bp, Artificial
  CRISPR gRNA sequence
tatccaatgctctttggcat

SEQ ID NO: 393409 - DNA, 20 bp, Artificial
  CRISPR gRNA sequence
atccaatgctctttggcata

SEQ ID NO: 393410 - DNA, 20 bp, Artificial
  CRISPR gRNA sequence
tccaatgctctttggcataa

SEQ ID NO: 393411 - DNA, 20 bp, Artificial
  CRISPR gRNA sequence
tttggcataatttgcctcca

SEQ ID NO: 393412 - DNA, 20 bp, Artificial
  CRISPR gRNA sequence
tggcataatttgcctccatg

SEQ ID NO: 393413 - DNA, 20 bp, Artificial
  CRISPR gRNA sequence
ggcataatttgcctccatga

SEQ ID NO: 393414 - DNA, 20 bp, Artificial
  CRISPR gRNA sequence
gcataatttgcctccatgat

SEQ ID NO: 393415 - DNA, 20 bp, Artificial
  CRISPR gRNA sequence
gcctccatgatattctttat

SEQ ID NO: 393416 - DNA, 20 bp, Artificial
  CRISPR gRNA sequence
cctccatgatattctttatt

SEQ ID NO: 393417 - DNA, 20 bp, Artificial
  CRISPR gRNA sequence
catgatattctttattctta

SEQ ID NO: 393418 - DNA, 20 bp, Artificial
  CRISPR gRNA sequence
tttattcttagtcttactgc

SEQ ID NO: 393419 - DNA, 20 bp, Artificial
  CRISPR gRNA sequence
tattcttagtcttactgctc

SEQ ID NO: 393420 - DNA, 20 bp, Artificial
  CRISPR gRNA sequence
attcttagtcttactgctct

SEQ ID NO: 393421 - DNA, 20 bp, Artificial
  CRISPR gRNA sequence
ttcttagtcttactgctcta

SEQ ID NO: 393422 - DNA, 20 bp, Artificial
  CRISPR gRNA sequence
ttagtcttactgctctactg

SEQ ID NO: 393423 - DNA, 20 bp, Artificial
  CRISPR gRNA sequence
agtcttactgctctactgac

SEQ ID NO: 393424 - DNA, 20 bp, Artificial
  CRISPR gRNA sequence
gtcttactgctctactgact

SEQ ID NO: 393425 - DNA, 20 bp, Artificial
  CRISPR gRNA sequence
actgctctactgacttcttt

SEQ ID NO: 393426 - DNA, 20 bp, Artificial
  CRISPR gRNA sequence
ctgctctactgacttctttc

SEQ ID NO: 393427 - DNA, 20 bp, Artificial
  CRISPR gRNA sequence
ctctactgacttctttcctc

SEQ ID NO: 393428 - DNA, 20 bp, Artificial
  CRISPR gRNA sequence
tactgacttctttcctccgg

SEQ ID NO: 393429 - DNA, 20 bp, Artificial
  CRISPR gRNA sequence
ctgacttctttcctccgggt

SEQ ID NO: 393430 - DNA, 20 bp, Artificial
  CRISPR gRNA sequence
acttctttcctccgggtttt

SEQ ID NO: 393431 - DNA, 20 bp, Artificial
  CRISPR gRNA sequence
ctttcctccgggttttttgt

SEQ ID NO: 393432 - DNA, 20 bp, Artificial
  CRISPR gRNA sequence
tttcctccgggttttttgtt

SEQ ID NO: 393433 - DNA, 20 bp, Artificial
  CRISPR gRNA sequence
tcctccgggttttttgtttt

SEQ ID NO: 393434 - DNA, 20 bp, Artificial
  CRISPR gRNA sequence
cctccgggttttttgttttg

SEQ ID NO: 393435 - DNA, 20 bp, Artificial
  CRISPR gRNA sequence
ctccgggttttttgttttga

SEQ ID NO: 393436 - DNA, 20 bp, Artificial
  CRISPR gRNA sequence
cgggttttttgttttgattt

SEQ ID NO: 393437 - DNA, 20 bp, Artificial
  CRISPR gRNA sequence
tttgttttgatttagtttgg

SEQ ID NO: 393438 - DNA, 20 bp, Artificial
  CRISPR gRNA sequence
ttgttttgatttagtttggg

SEQ ID NO: 393439 - DNA, 20 bp, Artificial
  CRISPR gRNA sequence
tgttttgatttagtttgggc

SEQ ID NO: 393440 - DNA, 20 bp, Artificial
  CRISPR gRNA sequence
gttttgatttagtttgggct

SEQ ID NO: 393441 - DNA, 20 bp, Artificial
  CRISPR gRNA sequence
ttttgatttagtttgggctt

SEQ ID NO: 393442 - DNA, 20 bp, Artificial
  CRISPR gRNA sequence
tgatttagtttgggctttgg

SEQ ID NO: 393443 - DNA, 20 bp, Artificial
  CRISPR gRNA sequence
gatttagtttgggctttggg

SEQ ID NO: 393444 - DNA, 20 bp, Artificial
  CRISPR gRNA sequence
atttagtttgggctttgggg

SEQ ID NO: 393445 - DNA, 20 bp, Artificial
  CRISPR gRNA sequence
agtttgggctttggggattt

SEQ ID NO: 393446 - DNA, 20 bp, Artificial
  CRISPR gRNA sequence
gtttgggctttggggatttt

SEQ ID NO: 393447 - DNA, 20 bp, Artificial
  CRISPR gRNA sequence
gggctttggggattttatgg

SEQ ID NO: 393448 - DNA, 20 bp, Artificial
  CRISPR gRNA sequence
ggctttggggattttatggg

SEQ ID NO: 393449 - DNA, 20 bp, Artificial
  CRISPR gRNA sequence
tggggattttatgggttttt

SEQ ID NO: 393450 - DNA, 20 bp, Artificial
  CRISPR gRNA sequence
ggggattttatgggtttttt

SEQ ID NO: 393451 - DNA, 20 bp, Artificial
  CRISPR gRNA sequence
gggattttatgggttttttt

SEQ ID NO: 393452 - DNA, 20 bp, Artificial
  CRISPR gRNA sequence
tatgggtttttttaatttga

SEQ ID NO: 393453 - DNA, 20 bp, Artificial
  CRISPR gRNA sequence
atgggtttttttaatttgaa

SEQ ID NO: 393454 - DNA, 20 bp, Artificial
  CRISPR gRNA sequence
tgggtttttttaatttgaat

SEQ ID NO: 393455 - DNA, 20 bp, Artificial
  CRISPR gRNA sequence
ttttaatttgaatttttgtt

SEQ ID NO: 393456 - DNA, 20 bp, Artificial
  CRISPR gRNA sequence
tttaatttgaatttttgttt

SEQ ID NO: 393457 - DNA, 20 bp, Artificial
  CRISPR gRNA sequence
ttaatttgaatttttgtttc

SEQ ID NO: 393458 - DNA, 20 bp, Artificial
  CRISPR gRNA sequence
taatttgaatttttgtttct

SEQ ID NO: 393459 - DNA, 20 bp, Artificial
  CRISPR gRNA sequence
aatttgaatttttgtttctt

SEQ ID NO: 393460 - DNA, 20 bp, Artificial
  CRISPR gRNA sequence
atttgaatttttgtttcttt

SEQ ID NO: 393461 - DNA, 20 bp, Artificial
  CRISPR gRNA sequence
gaatttttgtttctttgttt

SEQ ID NO: 393462 - DNA, 20 bp, Artificial
  CRISPR gRNA sequence
aatttttgtttctttgtttc

SEQ ID NO: 393463 - DNA, 20 bp, Artificial
  CRISPR gRNA sequence
ttgtttctttgtttcttttg

SEQ ID NO: 393464 - DNA, 20 bp, Artificial
  CRISPR gRNA sequence
tgtttctttgtttcttttgg

SEQ ID NO: 393465 - DNA, 20 bp, Artificial
  CRISPR gRNA sequence
gtttctttgtttcttttggt

SEQ ID NO: 393466 - DNA, 20 bp, Artificial
  CRISPR gRNA sequence
tttctttgtttcttttggta

SEQ ID NO: 393467 - DNA, 20 bp, Artificial
  CRISPR gRNA sequence
ctttgtttcttttggtagaa

SEQ ID NO: 393468 - DNA, 20 bp, Artificial
  CRISPR gRNA sequence
tttgtttcttttggtagaaa

SEQ ID NO: 393469 - DNA, 20 bp, Artificial
  CRISPR gRNA sequence
tgtttcttttggtagaaatt

SEQ ID NO: 393470 - DNA, 20 bp, Artificial
  CRISPR gRNA sequence
gtttcttttggtagaaatta

SEQ ID NO: 393471 - DNA, 20 bp, Artificial
  CRISPR gRNA sequence
tttcttttggtagaaattaa

SEQ ID NO: 393472 - DNA, 20 bp, Artificial
  CRISPR gRNA sequence
cttttggtagaaattaaaaa

SEQ ID NO: 393473 - DNA, 20 bp, Artificial
  CRISPR gRNA sequence
ttttggtagaaattaaaaac

SEQ ID NO: 393474 - DNA, 20 bp, Artificial
  CRISPR gRNA sequence
ttggtagaaattaaaaacaa

SEQ ID NO: 393475 - DNA, 20 bp, Artificial
  CRISPR gRNA sequence
tggtagaaattaaaaacaag

SEQ ID NO: 393476 - DNA, 20 bp, Artificial
  CRISPR gRNA sequence
ggtagaaattaaaaacaagc

SEQ ID NO: 393477 - DNA, 20 bp, Artificial
  CRISPR gRNA sequence
gtagaaattaaaaacaagct

SEQ ID NO: 393478 - DNA, 20 bp, Artificial
  CRISPR gRNA sequence
aaaacaagctcccatttttg

SEQ ID NO: 393479 - DNA, 20 bp, Artificial
  CRISPR gRNA sequence
ccatttttgtctttggaaaa

SEQ ID NO: 393480 - DNA, 20 bp, Artificial
  CRISPR gRNA sequence
ttgtctttggaaaactccac

SEQ ID NO: 393481 - DNA, 20 bp, Artificial
  CRISPR gRNA sequence
tgtctttggaaaactccact

SEQ ID NO: 393482 - DNA, 20 bp, Artificial
  CRISPR gRNA sequence
gtctttggaaaactccactt

SEQ ID NO: 393483 - DNA, 20 bp, Artificial
  CRISPR gRNA sequence
tctttggaaaactccacttg

SEQ ID NO: 393484 - DNA, 20 bp, Artificial
  CRISPR gRNA sequence
tggaaaactccacttgagga

SEQ ID NO: 393485 - DNA, 20 bp, Artificial
  CRISPR gRNA sequence
ggaaaactccacttgaggaa

SEQ ID NO: 393486 - DNA, 20 bp, Artificial
  CRISPR gRNA sequence
gaaaactccacttgaggaag

SEQ ID NO: 393487 - DNA, 20 bp, Artificial
  CRISPR gRNA sequence
cacttgaggaagtaccaaga

SEQ ID NO: 393488 - DNA, 20 bp, Artificial
  CRISPR gRNA sequence
gaggaagtaccaagaatctt

SEQ ID NO: 393489 - DNA, 20 bp, Artificial
  CRISPR gRNA sequence
aggaagtaccaagaatcttc

SEQ ID NO: 393490 - DNA, 20 bp, Artificial
  CRISPR gRNA sequence
cactgttttagggacctcgt

SEQ ID NO: 393491 - DNA, 20 bp, Artificial
  CRISPR gRNA sequence
actgttttagggacctcgtt

SEQ ID NO: 393492 - DNA, 20 bp, Artificial
  CRISPR gRNA sequence
ttttagggacctcgttatta

SEQ ID NO: 393493 - DNA, 20 bp, Artificial
  CRISPR gRNA sequence
tagggacctcgttattacca

SEQ ID NO: 393494 - DNA, 20 bp, Artificial
  CRISPR gRNA sequence
agggacctcgttattaccag

SEQ ID NO: 393495 - DNA, 20 bp, Artificial
  CRISPR gRNA sequence
gggacctcgttattaccagt

SEQ ID NO: 393496 - DNA, 20 bp, Artificial
  CRISPR gRNA sequence
gttattaccagtcacatcaa

SEQ ID NO: 393497 - DNA, 20 bp, Artificial
  CRISPR gRNA sequence
ttaccagtcacatcaagcat

SEQ ID NO: 393498 - DNA, 20 bp, Artificial
  CRISPR gRNA sequence
ccagtcacatcaagcataag

SEQ ID NO: 393499 - DNA, 20 bp, Artificial
  CRISPR gRNA sequence
gttacacttactaaacggag

SEQ ID NO: 393500 - DNA, 20 bp, Artificial
  CRISPR gRNA sequence
cacttactaaacggagcact

SEQ ID NO: 393501 - DNA, 20 bp, Artificial
  CRISPR gRNA sequence
actaaacggagcactaaggt

SEQ ID NO: 393502 - DNA, 20 bp, Artificial
  CRISPR gRNA sequence
ctaaacggagcactaaggtg

SEQ ID NO: 393503 - DNA, 20 bp, Artificial
  CRISPR gRNA sequence
aacggagcactaaggtgtac

SEQ ID NO: 393504 - DNA, 20 bp, Artificial
  CRISPR gRNA sequence
aggtgtacaaaagtctggaa

SEQ ID NO: 393505 - DNA, 20 bp, Artificial
  CRISPR gRNA sequence
gaaaaataaacatgcaggag

SEQ ID NO: 393506 - DNA, 20 bp, Artificial
  CRISPR gRNA sequence
ttctaacagcatcagaaatg

SEQ ID NO: 393507 - DNA, 20 bp, Artificial
  CRISPR gRNA sequence
tctaacagcatcagaaatgt

SEQ ID NO: 393508 - DNA, 20 bp, Artificial
  CRISPR gRNA sequence
ctaacagcatcagaaatgtg

SEQ ID NO: 393509 - DNA, 20 bp, Artificial
  CRISPR gRNA sequence
taacagcatcagaaatgtgg

SEQ ID NO: 393510 - DNA, 20 bp, Artificial
  CRISPR gRNA sequence
acagcatcagaaatgtggca

SEQ ID NO: 393511 - DNA, 20 bp, Artificial
  CRISPR gRNA sequence
caaatgtttttattttttct

SEQ ID NO: 393512 - DNA, 20 bp, Artificial
  CRISPR gRNA sequence
ttattttttctatctaaaaa

SEQ ID NO: 393513 - DNA, 20 bp, Artificial
  CRISPR gRNA sequence
tattttttctatctaaaaag

SEQ ID NO: 393514 - DNA, 20 bp, Artificial
  CRISPR gRNA sequence
attttttctatctaaaaagc

SEQ ID NO: 393515 - DNA, 20 bp, Artificial
  CRISPR gRNA sequence
ttttttctatctaaaaagca

SEQ ID NO: 393516 - DNA, 20 bp, Artificial
  CRISPR gRNA sequence
tttctatctaaaaagcataa

SEQ ID NO: 393517 - DNA, 20 bp, Artificial
  CRISPR gRNA sequence
ttctatctaaaaagcataaa

SEQ ID NO: 393518 - DNA, 20 bp, Artificial
  CRISPR gRNA sequence
tctatctaaaaagcataaat

SEQ ID NO: 393519 - DNA, 20 bp, Artificial
  CRISPR gRNA sequence
ctatctaaaaagcataaata

SEQ ID NO: 393520 - DNA, 20 bp, Artificial
  CRISPR gRNA sequence
tatctaaaaagcataaatat

SEQ ID NO: 393521 - DNA, 20 bp, Artificial
  CRISPR gRNA sequence
tctaaaaagcataaatattt

SEQ ID NO: 393522 - DNA, 20 bp, Artificial
  CRISPR gRNA sequence
aaaagcataaatatttaaaa

SEQ ID NO: 393523 - DNA, 20 bp, Artificial
  CRISPR gRNA sequence
aaaaaatattaatataggcc

SEQ ID NO: 393524 - DNA, 20 bp, Artificial
  CRISPR gRNA sequence
aaaaatattaatataggcct

SEQ ID NO: 393525 - DNA, 20 bp, Artificial
  CRISPR gRNA sequence
atataggcctaattcaagga

SEQ ID NO: 393526 - DNA, 20 bp, Artificial
  CRISPR gRNA sequence
attcaaggaatggcaaatga

SEQ ID NO: 393527 - DNA, 20 bp, Artificial
  CRISPR gRNA sequence
aaggaatggcaaatgatttc

SEQ ID NO: 393528 - DNA, 20 bp, Artificial
  CRISPR gRNA sequence
cattgtcaagaagtaaggcc

SEQ ID NO: 393529 - DNA, 20 bp, Artificial
  CRISPR gRNA sequence
attgtcaagaagtaaggcct

SEQ ID NO: 393530 - DNA, 20 bp, Artificial
  CRISPR gRNA sequence
tcaagaagtaaggccttgag

SEQ ID NO: 393531 - DNA, 20 bp, Artificial
  CRISPR gRNA sequence
gagtatttgttgaatgtcta

SEQ ID NO: 393532 - DNA, 20 bp, Artificial
  CRISPR gRNA sequence
agtatttgttgaatgtctat

SEQ ID NO: 393533 - DNA, 20 bp, Artificial
  CRISPR gRNA sequence
gttgaatgtctataattttc

SEQ ID NO: 393534 - DNA, 20 bp, Artificial
  CRISPR gRNA sequence
ttgaatgtctataattttcg

SEQ ID NO: 393535 - DNA, 20 bp, Artificial
  CRISPR gRNA sequence
aatgtctataattttcgttt

SEQ ID NO: 393536 - DNA, 20 bp, Artificial
  CRISPR gRNA sequence
taattttcgtttgtttattt

SEQ ID NO: 393537 - DNA, 20 bp, Artificial
  CRISPR gRNA sequence
tcgtttgtttattttttgag

SEQ ID NO: 393538 - DNA, 20 bp, Artificial
  CRISPR gRNA sequence
cgtttgtttattttttgaga

SEQ ID NO: 393539 - DNA, 20 bp, Artificial
  CRISPR gRNA sequence
gtttgtttattttttgagat

SEQ ID NO: 393540 - DNA, 20 bp, Artificial
  CRISPR gRNA sequence
gtttattttttgagataggg

SEQ ID NO: 393541 - DNA, 20 bp, Artificial
  CRISPR gRNA sequence
tttattttttgagatagggt

SEQ ID NO: 393542 - DNA, 20 bp, Artificial
  CRISPR gRNA sequence
attttttgagatagggtctc

SEQ ID NO: 393543 - DNA, 20 bp, Artificial
  CRISPR gRNA sequence
ttttttgagatagggtctca

SEQ ID NO: 393544 - DNA, 20 bp, Artificial
  CRISPR gRNA sequence
tttgagatagggtctcactc

SEQ ID NO: 393545 - DNA, 20 bp, Artificial
  CRISPR gRNA sequence
ttgagatagggtctcactct

SEQ ID NO: 393546 - DNA, 20 bp, Artificial
  CRISPR gRNA sequence
tgagatagggtctcactctg

SEQ ID NO: 393547 - DNA, 20 bp, Artificial
  CRISPR gRNA sequence
gagatagggtctcactctgg

SEQ ID NO: 393548 - DNA, 20 bp, Artificial
  CRISPR gRNA sequence
agatagggtctcactctggc

SEQ ID NO: 393549 - DNA, 20 bp, Artificial
  CRISPR gRNA sequence
actctggcacccagcctgga

SEQ ID NO: 393550 - DNA, 20 bp, Artificial
  CRISPR gRNA sequence
tggcacccagcctggagtcc

SEQ ID NO: 393551 - DNA, 20 bp, Artificial
  CRISPR gRNA sequence
gcacccagcctggagtccag

SEQ ID NO: 393552 - DNA, 20 bp, Artificial
  CRISPR gRNA sequence
gagtccagtggtgcgatcat

SEQ ID NO: 393553 - DNA, 20 bp, Artificial
  CRISPR gRNA sequence
actgcagcttcaagcacctg

SEQ ID NO: 393554 - DNA, 20 bp, Artificial
  CRISPR gRNA sequence
cagcttcaagcacctgggca

SEQ ID NO: 393555 - DNA, 20 bp, Artificial
  CRISPR gRNA sequence
caagcacctgggcacaggca

SEQ ID NO: 393556 - DNA, 20 bp, Artificial
  CRISPR gRNA sequence
aagcacctgggcacaggcag

SEQ ID NO: 393557 - DNA, 20 bp, Artificial
  CRISPR gRNA sequence
ggcacaggcagtcctcctgc

SEQ ID NO: 393558 - DNA, 20 bp, Artificial
  CRISPR gRNA sequence
ctgcctcagcctcccaagta

SEQ ID NO: 393559 - DNA, 20 bp, Artificial
  CRISPR gRNA sequence
cctcagcctcccaagtagct

SEQ ID NO: 393560 - DNA, 20 bp, Artificial
  CRISPR gRNA sequence
agcctcccaagtagctggga

SEQ ID NO: 393561 - DNA, 20 bp, Artificial
  CRISPR gRNA sequence
ccaagtagctgggaccacag

SEQ ID NO: 393562 - DNA, 20 bp, Artificial
  CRISPR gRNA sequence
ggaccacagatgcataccac

SEQ ID NO: 393563 - DNA, 20 bp, Artificial
  CRISPR gRNA sequence
gataattttttattttcaat

SEQ ID NO: 393564 - DNA, 20 bp, Artificial
  CRISPR gRNA sequence
tttattttcaatcgagccac

SEQ ID NO: 393565 - DNA, 20 bp, Artificial
  CRISPR gRNA sequence
ttattttcaatcgagccaca

SEQ ID NO: 393566 - DNA, 20 bp, Artificial
  CRISPR gRNA sequence
tattttcaatcgagccacag

SEQ ID NO: 393567 - DNA, 20 bp, Artificial
  CRISPR gRNA sequence
attttcaatcgagccacagt

SEQ ID NO: 393568 - DNA, 20 bp, Artificial
  CRISPR gRNA sequence
ttttcaatcgagccacagtc

SEQ ID NO: 393569 - DNA, 20 bp, Artificial
  CRISPR gRNA sequence
tcaatcgagccacagtctca

SEQ ID NO: 393570 - DNA, 20 bp, Artificial
  CRISPR gRNA sequence
caatcgagccacagtctcac

SEQ ID NO: 393571 - DNA, 20 bp, Artificial
  CRISPR gRNA sequence
aatcgagccacagtctcact

SEQ ID NO: 393572 - DNA, 20 bp, Artificial
  CRISPR gRNA sequence
actatgttacccaggctggt

SEQ ID NO: 393573 - DNA, 20 bp, Artificial
  CRISPR gRNA sequence
tgttacccaggctggtttca

SEQ ID NO: 393574 - DNA, 20 bp, Artificial
  CRISPR gRNA sequence
cccaggctggtttcaaactc

SEQ ID NO: 393575 - DNA, 20 bp, Artificial
  CRISPR gRNA sequence
gtttcaaactcctaggctca

SEQ ID NO: 393576 - DNA, 20 bp, Artificial
  CRISPR gRNA sequence
caaactcctaggctcaagca

SEQ ID NO: 393577 - DNA, 20 bp, Artificial
  CRISPR gRNA sequence
aaactcctaggctcaagcaa

SEQ ID NO: 393578 - DNA, 20 bp, Artificial
  CRISPR gRNA sequence
ctaggctcaagcaatcctcc

SEQ ID NO: 393579 - DNA, 20 bp, Artificial
  CRISPR gRNA sequence
ggctcaagcaatcctcctgc

SEQ ID NO: 393580 - DNA, 20 bp, Artificial
  CRISPR gRNA sequence
aagcaatcctcctgcctcgg

SEQ ID NO: 393581 - DNA, 20 bp, Artificial
  CRISPR gRNA sequence
ctgcctcggtttcccaaaat

SEQ ID NO: 393582 - DNA, 20 bp, Artificial
  CRISPR gRNA sequence
cctcggtttcccaaaattct

SEQ ID NO: 393583 - DNA, 20 bp, Artificial
  CRISPR gRNA sequence
ggtttcccaaaattctgtga

SEQ ID NO: 393584 - DNA, 20 bp, Artificial
  CRISPR gRNA sequence
cccaaaattctgtgattaca

SEQ ID NO: 393585 - DNA, 20 bp, Artificial
  CRISPR gRNA sequence
ccaaaattctgtgattacag

SEQ ID NO: 393586 - DNA, 20 bp, Artificial
  CRISPR gRNA sequence
tgtgattacaggtgtgagcc

SEQ ID NO: 393587 - DNA, 20 bp, Artificial
  CRISPR gRNA sequence
tgattacaggtgtgagccac

SEQ ID NO: 393588 - DNA, 20 bp, Artificial
  CRISPR gRNA sequence
caggtgtgagccactgtgcc

SEQ ID NO: 393589 - DNA, 20 bp, Artificial
  CRISPR gRNA sequence
tgcccggctttgtataatgt

SEQ ID NO: 393590 - DNA, 20 bp, Artificial
  CRISPR gRNA sequence
tgtataatgttttacactaa

SEQ ID NO: 393591 - DNA, 20 bp, Artificial
  CRISPR gRNA sequence
gtataatgttttacactaaa

SEQ ID NO: 393592 - DNA, 20 bp, Artificial
  CRISPR gRNA sequence
tataatgttttacactaaaa

SEQ ID NO: 393593 - DNA, 20 bp, Artificial
  CRISPR gRNA sequence
tacactaaaaacagacttct

SEQ ID NO: 393594 - DNA, 20 bp, Artificial
  CRISPR gRNA sequence
acactaaaaacagacttctg

SEQ ID NO: 393595 - DNA, 20 bp, Artificial
  CRISPR gRNA sequence
cactaaaaacagacttctgt

SEQ ID NO: 393596 - DNA, 20 bp, Artificial
  CRISPR gRNA sequence
aaaacagacttctgtaaatg

SEQ ID NO: 393597 - DNA, 20 bp, Artificial
  CRISPR gRNA sequence
ctgtaaatggaacaattatg

SEQ ID NO: 393598 - DNA, 20 bp, Artificial
  CRISPR gRNA sequence
tgtaaatggaacaattatgg

SEQ ID NO: 393599 - DNA, 20 bp, Artificial
  CRISPR gRNA sequence
taaatggaacaattatggaa

SEQ ID NO: 393600 - DNA, 20 bp, Artificial
  CRISPR gRNA sequence
tggaaatgctggacttgaga

SEQ ID NO: 393601 - DNA, 20 bp, Artificial
  CRISPR gRNA sequence
gacttgagaaatgaggactc

SEQ ID NO: 393602 - DNA, 20 bp, Artificial
  CRISPR gRNA sequence
gagaaatgaggactcatctc

SEQ ID NO: 393603 - DNA, 20 bp, Artificial
  CRISPR gRNA sequence
agaaatgaggactcatctct

SEQ ID NO: 393604 - DNA, 20 bp, Artificial
  CRISPR gRNA sequence
atctctccacaaatcttatc

SEQ ID NO: 393605 - DNA, 20 bp, Artificial
  CRISPR gRNA sequence
tccacaaatcttatctagtc

SEQ ID NO: 393606 - DNA, 20 bp, Artificial
  CRISPR gRNA sequence
cacaaatcttatctagtcaa

SEQ ID NO: 393607 - DNA, 20 bp, Artificial
  CRISPR gRNA sequence
atctagtcaagaaacagacc

SEQ ID NO: 393608 - DNA, 20 bp, Artificial
  CRISPR gRNA sequence
tctagtcaagaaacagacca

SEQ ID NO: 393609 - DNA, 20 bp, Artificial
  CRISPR gRNA sequence
gtcaagaaacagaccaggcc

SEQ ID NO: 393610 - DNA, 20 bp, Artificial
  CRISPR gRNA sequence
tgaggatgcacagtgctgaa

SEQ ID NO: 393611 - DNA, 20 bp, Artificial
  CRISPR gRNA sequence
aaaacgaacccctgggaatg

SEQ ID NO: 393612 - DNA, 20 bp, Artificial
  CRISPR gRNA sequence
ggaatggggcccttcgcagt

SEQ ID NO: 393613 - DNA, 20 bp, Artificial
  CRISPR gRNA sequence
cgcagtctacccaattccac

SEQ ID NO: 393614 - DNA, 20 bp, Artificial
  CRISPR gRNA sequence
gcagtctacccaattccacc

SEQ ID NO: 393615 - DNA, 20 bp, Artificial
  CRISPR gRNA sequence
cccaattccaccctcataca

SEQ ID NO: 393616 - DNA, 20 bp, Artificial
  CRISPR gRNA sequence
caccctcatacagctttcaa

SEQ ID NO: 393617 - DNA, 20 bp, Artificial
  CRISPR gRNA sequence
atacagctttcaagtagtga

SEQ ID NO: 393618 - DNA, 20 bp, Artificial
  CRISPR gRNA sequence
tcaagtagtgagagctgata

SEQ ID NO: 393619 - DNA, 20 bp, Artificial
  CRISPR gRNA sequence
caagtagtgagagctgataa

SEQ ID NO: 393620 - DNA, 20 bp, Artificial
  CRISPR gRNA sequence
aagtagtgagagctgataaa

SEQ ID NO: 393621 - DNA, 20 bp, Artificial
  CRISPR gRNA sequence
ataaacactggcatgagagc

SEQ ID NO: 393622 - DNA, 20 bp, Artificial
  CRISPR gRNA sequence
gcatgagagcagttttgaaa

SEQ ID NO: 393623 - DNA, 20 bp, Artificial
  CRISPR gRNA sequence
tgaaaagaaaatctcataac

SEQ ID NO: 393624 - DNA, 20 bp, Artificial
  CRISPR gRNA sequence
gaaaagaaaatctcataact

SEQ ID NO: 393625 - DNA, 20 bp, Artificial
  CRISPR gRNA sequence
aaaagaaaatctcataactg

SEQ ID NO: 393626 - DNA, 20 bp, Artificial
  CRISPR gRNA sequence
ataactggccaggcttggtg

SEQ ID NO: 393627 - DNA, 20 bp, Artificial
  CRISPR gRNA sequence
gccaggcttggtggctcatg

SEQ ID NO: 393628 - DNA, 20 bp, Artificial
  CRISPR gRNA sequence
ggtggctcatgccttgtact

SEQ ID NO: 393629 - DNA, 20 bp, Artificial
  CRISPR gRNA sequence
gtggctcatgccttgtactc

SEQ ID NO: 393630 - DNA, 20 bp, Artificial
  CRISPR gRNA sequence
atgccttgtactcccagcac

SEQ ID NO: 393631 - DNA, 20 bp, Artificial
  CRISPR gRNA sequence
gtactcccagcactttggga

SEQ ID NO: 393632 - DNA, 20 bp, Artificial
  CRISPR gRNA sequence
tactcccagcactttgggag

SEQ ID NO: 393633 - DNA, 20 bp, Artificial
  CRISPR gRNA sequence
ccagcactttgggaggccaa

SEQ ID NO: 393634 - DNA, 20 bp, Artificial
  CRISPR gRNA sequence
tgggaggccaaggcaggcag

SEQ ID NO: 393635 - DNA, 20 bp, Artificial
  CRISPR gRNA sequence
gggaggccaaggcaggcaga

SEQ ID NO: 393636 - DNA, 20 bp, Artificial
  CRISPR gRNA sequence
ggaggccaaggcaggcagat

SEQ ID NO: 393637 - DNA, 20 bp, Artificial
  CRISPR gRNA sequence
aggtcaggagttcgagacca

SEQ ID NO: 393638 - DNA, 20 bp, Artificial
  CRISPR gRNA sequence
gagaccagcctggccaacat

SEQ ID NO: 393639 - DNA, 20 bp, Artificial
  CRISPR gRNA sequence
gccaacatggtgaaaccccc

SEQ ID NO: 393640 - DNA, 20 bp, Artificial
  CRISPR gRNA sequence
tactaaaattacaaaaatta

SEQ ID NO: 393641 - DNA, 20 bp, Artificial
  CRISPR gRNA sequence
ctaaaattacaaaaattagc

SEQ ID NO: 393642 - DNA, 20 bp, Artificial
  CRISPR gRNA sequence
aaattacaaaaattagccaa

SEQ ID NO: 393643 - DNA, 20 bp, Artificial
  CRISPR gRNA sequence
caaaaattagccaagcatgg

SEQ ID NO: 393644 - DNA, 20 bp, Artificial
  CRISPR gRNA sequence
gccaagcatggtggcgggca

SEQ ID NO: 393645 - DNA, 20 bp, Artificial
  CRISPR gRNA sequence
taatcccagctactcaggag

SEQ ID NO: 393646 - DNA, 20 bp, Artificial
  CRISPR gRNA sequence
ctcaggaggctgaggcagga

SEQ ID NO: 393647 - DNA, 20 bp, Artificial
  CRISPR gRNA sequence
aggaggctgaggcaggagaa

SEQ ID NO: 393648 - DNA, 20 bp, Artificial
  CRISPR gRNA sequence
aggcaggagaatggcttgaa

SEQ ID NO: 393649 - DNA, 20 bp, Artificial
  CRISPR gRNA sequence
gaacccaagaggcagaggtt

SEQ ID NO: 393650 - DNA, 20 bp, Artificial
  CRISPR gRNA sequence
aacccaagaggcagaggttg

SEQ ID NO: 393651 - DNA, 20 bp, Artificial
  CRISPR gRNA sequence
cagtgatccgagattgcgcc

SEQ ID NO: 393652 - DNA, 20 bp, Artificial
  CRISPR gRNA sequence
cgccactacactccagcctg

SEQ ID NO: 393653 - DNA, 20 bp, Artificial
  CRISPR gRNA sequence
cactccagcctgggcaacag

SEQ ID NO: 393654 - DNA, 20 bp, Artificial
  CRISPR gRNA sequence
cagcctgggcaacagtgaga

SEQ ID NO: 393655 - DNA, 20 bp, Artificial
  CRISPR gRNA sequence
ggcaacagtgagactctgtc

SEQ ID NO: 393656 - DNA, 20 bp, Artificial
  CRISPR gRNA sequence
tgtctcaaaaaagtcaaaga

SEQ ID NO: 393657 - DNA, 20 bp, Artificial
  CRISPR gRNA sequence
tctcaaaaaagtcaaagaag

SEQ ID NO: 393658 - DNA, 20 bp, Artificial
  CRISPR gRNA sequence
aaaaaagtcaaagaagaaag

SEQ ID NO: 393659 - DNA, 20 bp, Artificial
  CRISPR gRNA sequence
ataacaaaatagcaaaacat

SEQ ID NO: 393660 - DNA, 20 bp, Artificial
  CRISPR gRNA sequence
gaaggcaagtgtcgtgttgc

SEQ ID NO: 393661 - DNA, 20 bp, Artificial
  CRISPR gRNA sequence
caggaagacaagaattgggg

SEQ ID NO: 393662 - DNA, 20 bp, Artificial
  CRISPR gRNA sequence
ggggccaggagtgggatcaa

SEQ ID NO: 393663 - DNA, 20 bp, Artificial
  CRISPR gRNA sequence
aagttctcactggttagaat

SEQ ID NO: 393664 - DNA, 20 bp, Artificial
  CRISPR gRNA sequence
tcactggttagaatcctgcc

SEQ ID NO: 393665 - DNA, 20 bp, Artificial
  CRISPR gRNA sequence
actggttagaatcctgcccc

SEQ ID NO: 393666 - DNA, 20 bp, Artificial
  CRISPR gRNA sequence
gttagaatcctgccccctcc

SEQ ID NO: 393667 - DNA, 20 bp, Artificial
  CRISPR gRNA sequence
gaatcctgccccctcctcaa

SEQ ID NO: 393668 - DNA, 20 bp, Artificial
  CRISPR gRNA sequence
ccccctcctcaaaaccaact

SEQ ID NO: 393669 - DNA, 20 bp, Artificial
  CRISPR gRNA sequence
ctcaaaaccaactgcgaaaa

SEQ ID NO: 393670 - DNA, 20 bp, Artificial
  CRISPR gRNA sequence
aaaaccaactgcgaaaacgt

SEQ ID NO: 393671 - DNA, 20 bp, Artificial
  CRISPR gRNA sequence
cgaaaacgtcctctttttat

SEQ ID NO: 393672 - DNA, 20 bp, Artificial
  CRISPR gRNA sequence
tttttatccctgccttaccc

SEQ ID NO: 393673 - DNA, 20 bp, Artificial
  CRISPR gRNA sequence
tttatccctgccttacccca

SEQ ID NO: 393674 - DNA, 20 bp, Artificial
  CRISPR gRNA sequence
ttatccctgccttaccccat

SEQ ID NO: 393675 - DNA, 20 bp, Artificial
  CRISPR gRNA sequence
tatccctgccttaccccatc

SEQ ID NO: 393676 - DNA, 20 bp, Artificial
  CRISPR gRNA sequence
atccctgccttaccccatca

SEQ ID NO: 393677 - DNA, 20 bp, Artificial
  CRISPR gRNA sequence
tccctgccttaccccatcag

SEQ ID NO: 393678 - DNA, 20 bp, Artificial
  CRISPR gRNA sequence
ccttaccccatcagctctgg

SEQ ID NO: 393679 - DNA, 20 bp, Artificial
  CRISPR gRNA sequence
accccatcagctctggcctt

SEQ ID NO: 393680 - DNA, 20 bp, Artificial
  CRISPR gRNA sequence
ccccatcagctctggccttt

SEQ ID NO: 393681 - DNA, 20 bp, Artificial
  CRISPR gRNA sequence
tggcctttttaaaaacattt

SEQ ID NO: 393682 - DNA, 20 bp, Artificial
  CRISPR gRNA sequence
gcctttttaaaaacatttgt

SEQ ID NO: 393683 - DNA, 20 bp, Artificial
  CRISPR gRNA sequence
tttaaaaacatttgttgttc

SEQ ID NO: 393684 - DNA, 20 bp, Artificial
  CRISPR gRNA sequence
ttaaaaacatttgttgttct

SEQ ID NO: 393685 - DNA, 20 bp, Artificial
  CRISPR gRNA sequence
taaaaacatttgttgttctc

SEQ ID NO: 393686 - DNA, 20 bp, Artificial
  CRISPR gRNA sequence
aaaaacatttgttgttctct

SEQ ID NO: 393687 - DNA, 20 bp, Artificial
  CRISPR gRNA sequence
aaaacatttgttgttctcta

SEQ ID NO: 393688 - DNA, 20 bp, Artificial
  CRISPR gRNA sequence
gttgttctctagtgaagcct

SEQ ID NO: 393689 - DNA, 20 bp, Artificial
  CRISPR gRNA sequence
ttgttctctagtgaagcctc

SEQ ID NO: 393690 - DNA, 20 bp, Artificial
  CRISPR gRNA sequence
ttctctagtgaagcctctat

SEQ ID NO: 393691 - DNA, 20 bp, Artificial
  CRISPR gRNA sequence
tctagtgaagcctctatcac

SEQ ID NO: 393692 - DNA, 20 bp, Artificial
  CRISPR gRNA sequence
tagtgaagcctctatcacct

SEQ ID NO: 393693 - DNA, 20 bp, Artificial
  CRISPR gRNA sequence
gtgaagcctctatcaccttc

SEQ ID NO: 393694 - DNA, 20 bp, Artificial
  CRISPR gRNA sequence
tatcaccttctctatctgag

SEQ ID NO: 393695 - DNA, 20 bp, Artificial
  CRISPR gRNA sequence
tcaccttctctatctgagaa

SEQ ID NO: 393696 - DNA, 20 bp, Artificial
  CRISPR gRNA sequence
ctctatctgagaactgacca

SEQ ID NO: 393697 - DNA, 20 bp, Artificial
  CRISPR gRNA sequence
tctatctgagaactgaccaa

SEQ ID NO: 393698 - DNA, 20 bp, Artificial
  CRISPR gRNA sequence
tatctgagaactgaccaatg

SEQ ID NO: 393699 - DNA, 20 bp, Artificial
  CRISPR gRNA sequence
tctgagaactgaccaatgga

SEQ ID NO: 393700 - DNA, 20 bp, Artificial
  CRISPR gRNA sequence
agaactgaccaatggaaatt

SEQ ID NO: 393701 - DNA, 20 bp, Artificial
  CRISPR gRNA sequence
accaatggaaattcataact

SEQ ID NO: 393702 - DNA, 20 bp, Artificial
  CRISPR gRNA sequence
ataactttatctccagaaat

SEQ ID NO: 393703 - DNA, 20 bp, Artificial
  CRISPR gRNA sequence
tatctccagaaatcccagag

SEQ ID NO: 393704 - DNA, 20 bp, Artificial
  CRISPR gRNA sequence
atctccagaaatcccagagg

SEQ ID NO: 393705 - DNA, 20 bp, Artificial
  CRISPR gRNA sequence
tctccagaaatcccagaggc

SEQ ID NO: 393706 - DNA, 20 bp, Artificial
  CRISPR gRNA sequence
cagaaatcccagaggcctaa

SEQ ID NO: 393707 - DNA, 20 bp, Artificial
  CRISPR gRNA sequence
aaaaaattaagaggattaat

SEQ ID NO: 393708 - DNA, 20 bp, Artificial
  CRISPR gRNA sequence
agaggattaatgggaaactt

SEQ ID NO: 393709 - DNA, 20 bp, Artificial
  CRISPR gRNA sequence
atgggaaacttgcaagaaag

SEQ ID NO: 393710 - DNA, 20 bp, Artificial
  CRISPR gRNA sequence
gcaagaaagtgacaacctcg

SEQ ID NO: 393711 - DNA, 20 bp, Artificial
  CRISPR gRNA sequence
caagaaagtgacaacctcga

SEQ ID NO: 393712 - DNA, 20 bp, Artificial
  CRISPR gRNA sequence
gatagaagtgacacatctga

SEQ ID NO: 393713 - DNA, 20 bp, Artificial
  CRISPR gRNA sequence
atttaggatggaaaaaggtt

SEQ ID NO: 393714 - DNA, 20 bp, Artificial
  CRISPR gRNA sequence
aggatggaaaaaggttagtc

SEQ ID NO: 393715 - DNA, 20 bp, Artificial
  CRISPR gRNA sequence
ggatggaaaaaggttagtca

SEQ ID NO: 393716 - DNA, 20 bp, Artificial
  CRISPR gRNA sequence
gtcaataaaaatcaggccgg

SEQ ID NO: 393717 - DNA, 20 bp, Artificial
  CRISPR gRNA sequence
acgcctgtaatcccagcact

SEQ ID NO: 393718 - DNA, 20 bp, Artificial
  CRISPR gRNA sequence
taatcccagcactttgggag

SEQ ID NO: 393719 - DNA, 20 bp, Artificial
  CRISPR gRNA sequence
tgggaggccgaggcgggcgg

SEQ ID NO: 393720 - DNA, 20 bp, Artificial
  CRISPR gRNA sequence
gggaggccgaggcgggcgga

SEQ ID NO: 393721 - DNA, 20 bp, Artificial
  CRISPR gRNA sequence
ggaggccgaggcgggcggat

SEQ ID NO: 393722 - DNA, 20 bp, Artificial
  CRISPR gRNA sequence
aaaacggtgaaaccccgtct

SEQ ID NO: 393723 - DNA, 20 bp, Artificial
  CRISPR gRNA sequence
tactaaaaatacaaaaaatt

SEQ ID NO: 393724 - DNA, 20 bp, Artificial
  CRISPR gRNA sequence
ctaaaaatacaaaaaattag

SEQ ID NO: 393725 - DNA, 20 bp, Artificial
  CRISPR gRNA sequence
aaaatacaaaaaattagccg

SEQ ID NO: 393726 - DNA, 20 bp, Artificial
  CRISPR gRNA sequence
gccgggcgtagtggcgggcg

SEQ ID NO: 393727 - DNA, 20 bp, Artificial
  CRISPR gRNA sequence
tagtcccagctacttgggag

SEQ ID NO: 393728 - DNA, 20 bp, Artificial
  CRISPR gRNA sequence
cttgggaggctgaggcagga

SEQ ID NO: 393729 - DNA, 20 bp, Artificial
  CRISPR gRNA sequence
gggaggctgaggcaggagaa

SEQ ID NO: 393730 - DNA, 20 bp, Artificial
  CRISPR gRNA sequence
ggaggctgaggcaggagaat

SEQ ID NO: 393731 - DNA, 20 bp, Artificial
  CRISPR gRNA sequence
aggcaggagaatggcatgaa

SEQ ID NO: 393732 - DNA, 20 bp, Artificial
  CRISPR gRNA sequence
gcagtgagccgagatcgcgc

SEQ ID NO: 393733 - DNA, 20 bp, Artificial
  CRISPR gRNA sequence
cagtgagccgagatcgcgcc

SEQ ID NO: 393734 - DNA, 20 bp, Artificial
  CRISPR gRNA sequence
cactccagcctgggcgacag

SEQ ID NO: 393735 - DNA, 20 bp, Artificial
  CRISPR gRNA sequence
cagcctgggcgacagagcga

SEQ ID NO: 393736 - DNA, 20 bp, Artificial
  CRISPR gRNA sequence
ggcgacagagcgagactccg

SEQ ID NO: 393737 - DNA, 20 bp, Artificial
  CRISPR gRNA sequence
cgtctcaaaaaaaaaaaaaa

SEQ ID NO: 393738 - DNA, 20 bp, Artificial
  CRISPR gRNA sequence
aaaaaaaaaaaaaaaaatca

SEQ ID NO: 393739 - DNA, 20 bp, Artificial
  CRISPR gRNA sequence
tgtcctcagacttcaaaata

SEQ ID NO: 393740 - DNA, 20 bp, Artificial
  CRISPR gRNA sequence
agacttcaaaataaaaacag

SEQ ID NO: 393741 - DNA, 20 bp, Artificial
  CRISPR gRNA sequence
caaaataaaaacagatgcag

SEQ ID NO: 393742 - DNA, 20 bp, Artificial
  CRISPR gRNA sequence
aaaataaaaacagatgcagc

SEQ ID NO: 393743 - DNA, 20 bp, Artificial
  CRISPR gRNA sequence
atcgaggatggcttccacaa

SEQ ID NO: 393744 - DNA, 20 bp, Artificial
  CRISPR gRNA sequence
tcgaggatggcttccacaaa

SEQ ID NO: 393745 - DNA, 20 bp, Artificial
  CRISPR gRNA sequence
ccacaaaactcatatctaaa

SEQ ID NO: 393746 - DNA, 20 bp, Artificial
  CRISPR gRNA sequence
cacaaaactcatatctaaat

SEQ ID NO: 393747 - DNA, 20 bp, Artificial
  CRISPR gRNA sequence
atatctaaatagcaactgcc

SEQ ID NO: 393748 - DNA, 20 bp, Artificial
  CRISPR gRNA sequence
aatagcaactgccaacagaa

SEQ ID NO: 393749 - DNA, 20 bp, Artificial
  CRISPR gRNA sequence
ccaacagaaacctcaacact

SEQ ID NO: 393750 - DNA, 20 bp, Artificial
  CRISPR gRNA sequence
aacactttacaagggagaaa

SEQ ID NO: 393751 - DNA, 20 bp, Artificial
  CRISPR gRNA sequence
tacaagggagaaacgagctt

SEQ ID NO: 393752 - DNA, 20 bp, Artificial
  CRISPR gRNA sequence
acaagggagaaacgagcttc

SEQ ID NO: 393753 - DNA, 20 bp, Artificial
  CRISPR gRNA sequence
caagggagaaacgagcttct

SEQ ID NO: 393754 - DNA, 20 bp, Artificial
  CRISPR gRNA sequence
cttgaattataccatagacc

SEQ ID NO: 393755 - DNA, 20 bp, Artificial
  CRISPR gRNA sequence
ttgaattataccatagacca

SEQ ID NO: 393756 - DNA, 20 bp, Artificial
  CRISPR gRNA sequence
gaattataccatagaccacc

SEQ ID NO: 393757 - DNA, 20 bp, Artificial
  CRISPR gRNA sequence
aattataccatagaccaccg

SEQ ID NO: 393758 - DNA, 20 bp, Artificial
  CRISPR gRNA sequence
taccatagaccaccgagcca

SEQ ID NO: 393759 - DNA, 20 bp, Artificial
  CRISPR gRNA sequence
tgcaaaatgagacagatgga

SEQ ID NO: 393760 - DNA, 20 bp, Artificial
  CRISPR gRNA sequence
aattaggaaggactaacgga

SEQ ID NO: 393761 - DNA, 20 bp, Artificial
  CRISPR gRNA sequence
ggaaggactaacggactact

SEQ ID NO: 393762 - DNA, 20 bp, Artificial
  CRISPR gRNA sequence
acggactacttccattatct

SEQ ID NO: 393763 - DNA, 20 bp, Artificial
  CRISPR gRNA sequence
cttccattatctgcatcgta

SEQ ID NO: 393764 - DNA, 20 bp, Artificial
  CRISPR gRNA sequence
ccattatctgcatcgtatct

SEQ ID NO: 393765 - DNA, 20 bp, Artificial
  CRISPR gRNA sequence
cattatctgcatcgtatctt

SEQ ID NO: 393766 - DNA, 20 bp, Artificial
  CRISPR gRNA sequence
tctgcatcgtatcttgaatt

SEQ ID NO: 393767 - DNA, 20 bp, Artificial
  CRISPR gRNA sequence
catcgtatcttgaattctac

SEQ ID NO: 393768 - DNA, 20 bp, Artificial
  CRISPR gRNA sequence
gaattctacctctgaaaaag

SEQ ID NO: 393769 - DNA, 20 bp, Artificial
  CRISPR gRNA sequence
aattctacctctgaaaaagc

SEQ ID NO: 393770 - DNA, 20 bp, Artificial
  CRISPR gRNA sequence
tacctctgaaaaagctacag

SEQ ID NO: 393771 - DNA, 20 bp, Artificial
  CRISPR gRNA sequence
cctctgaaaaagctacagac

SEQ ID NO: 393772 - DNA, 20 bp, Artificial
  CRISPR gRNA sequence
tgaaaaagctacagacacac

SEQ ID NO: 393773 - DNA, 20 bp, Artificial
  CRISPR gRNA sequence
aaaaagctacagacacacta

SEQ ID NO: 393774 - DNA, 20 bp, Artificial
  CRISPR gRNA sequence
cagacacactacatttgtac

SEQ ID NO: 393775 - DNA, 20 bp, Artificial
  CRISPR gRNA sequence
catttgtactacacataact

SEQ ID NO: 393776 - DNA, 20 bp, Artificial
  CRISPR gRNA sequence
gtactacacataactggctc

SEQ ID NO: 393777 - DNA, 20 bp, Artificial
  CRISPR gRNA sequence
tactacacataactggctcc

SEQ ID NO: 393778 - DNA, 20 bp, Artificial
  CRISPR gRNA sequence
cacataactggctcctgaat

SEQ ID NO: 393779 - DNA, 20 bp, Artificial
  CRISPR gRNA sequence
gctcctgaatttataggaat

SEQ ID NO: 393780 - DNA, 20 bp, Artificial
  CRISPR gRNA sequence
ctgaatttataggaataaaa

SEQ ID NO: 393781 - DNA, 20 bp, Artificial
  CRISPR gRNA sequence
aatttataggaataaaaata

SEQ ID NO: 393782 - DNA, 20 bp, Artificial
  CRISPR gRNA sequence
ataggaataaaaatatatgg

SEQ ID NO: 393783 - DNA, 20 bp, Artificial
  CRISPR gRNA sequence
taggaataaaaatatatgga

SEQ ID NO: 393784 - DNA, 20 bp, Artificial
  CRISPR gRNA sequence
atattgcattgcggaatgaa

SEQ ID NO: 393785 - DNA, 20 bp, Artificial
  CRISPR gRNA sequence
tattgcattgcggaatgaaa

SEQ ID NO: 393786 - DNA, 20 bp, Artificial
  CRISPR gRNA sequence
cattgcggaatgaaatagat

SEQ ID NO: 393787 - DNA, 20 bp, Artificial
  CRISPR gRNA sequence
cggaatgaaatagatatata

SEQ ID NO: 393788 - DNA, 20 bp, Artificial
  CRISPR gRNA sequence
tgaatcatctgtcatgatca

SEQ ID NO: 393789 - DNA, 20 bp, Artificial
  CRISPR gRNA sequence
gaatcatctgtcatgatcaa

SEQ ID NO: 393790 - DNA, 20 bp, Artificial
  CRISPR gRNA sequence
aatcatctgtcatgatcaaa

SEQ ID NO: 393791 - DNA, 20 bp, Artificial
  CRISPR gRNA sequence
tcatgatcaaatgacaaaag

SEQ ID NO: 393792 - DNA, 20 bp, Artificial
  CRISPR gRNA sequence
tgactagaaaggcaaagtca

SEQ ID NO: 393793 - DNA, 20 bp, Artificial
  CRISPR gRNA sequence
actagaaaggcaaagtcaaa

SEQ ID NO: 393794 - DNA, 20 bp, Artificial
  CRISPR gRNA sequence
gaaaggcaaagtcaaaagtt

SEQ ID NO: 393795 - DNA, 20 bp, Artificial
  CRISPR gRNA sequence
attggaaatttttgcataat

SEQ ID NO: 393796 - DNA, 20 bp, Artificial
  CRISPR gRNA sequence
gaaatttttgcataattaca

SEQ ID NO: 393797 - DNA, 20 bp, Artificial
  CRISPR gRNA sequence
ttgcataattacaaatgaaa

SEQ ID NO: 393798 - DNA, 20 bp, Artificial
  CRISPR gRNA sequence
tgcataattacaaatgaaaa

SEQ ID NO: 393799 - DNA, 20 bp, Artificial
  CRISPR gRNA sequence
gcataattacaaatgaaaac

SEQ ID NO: 393800 - DNA, 20 bp, Artificial
  CRISPR gRNA sequence
cataattacaaatgaaaact

SEQ ID NO: 393801 - DNA, 20 bp, Artificial
  CRISPR gRNA sequence
caaatgaaaactacaataaa

SEQ ID NO: 393802 - DNA, 20 bp, Artificial
  CRISPR gRNA sequence
caataaaatgcaaatattct

SEQ ID NO: 393803 - DNA, 20 bp, Artificial
  CRISPR gRNA sequence
tggttaaaaaagtaaaagta

SEQ ID NO: 393804 - DNA, 20 bp, Artificial
  CRISPR gRNA sequence
gttaaaaaagtaaaagtata

SEQ ID NO: 393805 - DNA, 20 bp, Artificial
  CRISPR gRNA sequence
aaaaagtaaaagtatagttg

SEQ ID NO: 393806 - DNA, 20 bp, Artificial
  CRISPR gRNA sequence
aaaaggtaaaaatcccaaag

SEQ ID NO: 393807 - DNA, 20 bp, Artificial
  CRISPR gRNA sequence
gacttacaaaaaaaaaaaaa

SEQ ID NO: 393808 - DNA, 20 bp, Artificial
  CRISPR gRNA sequence
acaaaaaaaaaaaaaccaaa

SEQ ID NO: 393809 - DNA, 20 bp, Artificial
  CRISPR gRNA sequence
caaaaaaaaaaaaaccaaaa

SEQ ID NO: 393810 - DNA, 20 bp, Artificial
  CRISPR gRNA sequence
ttgaaagtccagggaaaata

SEQ ID NO: 393811 - DNA, 20 bp, Artificial
  CRISPR gRNA sequence
tgaaagtccagggaaaatat

SEQ ID NO: 393812 - DNA, 20 bp, Artificial
  CRISPR gRNA sequence
gaaagtccagggaaaatata

SEQ ID NO: 393813 - DNA, 20 bp, Artificial
  CRISPR gRNA sequence
aaagtccagggaaaatatat

SEQ ID NO: 393814 - DNA, 20 bp, Artificial
  CRISPR gRNA sequence
aagggccaagtgcttcaaat

SEQ ID NO: 393815 - DNA, 20 bp, Artificial
  CRISPR gRNA sequence
caaataaaaccccttatggc

SEQ ID NO: 393816 - DNA, 20 bp, Artificial
  CRISPR gRNA sequence
aaataaaaccccttatggct

SEQ ID NO: 393817 - DNA, 20 bp, Artificial
  CRISPR gRNA sequence
atggctgaactgacaaagtc

SEQ ID NO: 393818 - DNA, 20 bp, Artificial
  CRISPR gRNA sequence
tggctgaactgacaaagtca

SEQ ID NO: 393819 - DNA, 20 bp, Artificial
  CRISPR gRNA sequence
aactgacaaagtcaaagggc

SEQ ID NO: 393820 - DNA, 20 bp, Artificial
  CRISPR gRNA sequence
acaaagtcaaagggcaacag

SEQ ID NO: 393821 - DNA, 20 bp, Artificial
  CRISPR gRNA sequence
ccaaaaaaaaaaaaaaaaaa

SEQ ID NO: 393822 - DNA, 20 bp, Artificial
  CRISPR gRNA sequence
aaactggggagaactgcaaa

SEQ ID NO: 393823 - DNA, 20 bp, Artificial
  CRISPR gRNA sequence
gggagaactgcaaagcccag

SEQ ID NO: 393824 - DNA, 20 bp, Artificial
  CRISPR gRNA sequence
caaagcccagaggtacaaat

SEQ ID NO: 393825 - DNA, 20 bp, Artificial
  CRISPR gRNA sequence
gaaaactatctcacatagca

SEQ ID NO: 393826 - DNA, 20 bp, Artificial
  CRISPR gRNA sequence
aaaactatctcacatagcac

SEQ ID NO: 393827 - DNA, 20 bp, Artificial
  CRISPR gRNA sequence
tctcacatagcactccaaag

SEQ ID NO: 393828 - DNA, 20 bp, Artificial
  CRISPR gRNA sequence
acatagcactccaaagtaaa

SEQ ID NO: 393829 - DNA, 20 bp, Artificial
  CRISPR gRNA sequence
caaagtaaatgctgagaagt

SEQ ID NO: 393830 - DNA, 20 bp, Artificial
  CRISPR gRNA sequence
agaagtttttcagcacatca

SEQ ID NO: 393831 - DNA, 20 bp, Artificial
  CRISPR gRNA sequence
ttcagcacatcaaaaagaga

SEQ ID NO: 393832 - DNA, 20 bp, Artificial
  CRISPR gRNA sequence
tcagcacatcaaaaagagaa

SEQ ID NO: 393833 - DNA, 20 bp, Artificial
  CRISPR gRNA sequence
cagcacatcaaaaagagaaa

SEQ ID NO: 393834 - DNA, 20 bp, Artificial
  CRISPR gRNA sequence
agcacatcaaaaagagaaag

SEQ ID NO: 393835 - DNA, 20 bp, Artificial
  CRISPR gRNA sequence
catggcatttgaaaacaaca

SEQ ID NO: 393836 - DNA, 20 bp, Artificial
  CRISPR gRNA sequence
gaaaacaacatacacaacaa

SEQ ID NO: 393837 - DNA, 20 bp, Artificial
  CRISPR gRNA sequence
aaaacaacatacacaacaaa

SEQ ID NO: 393838 - DNA, 20 bp, Artificial
  CRISPR gRNA sequence
ttcagtgaataaaaacagag

SEQ ID NO: 393839 - DNA, 20 bp, Artificial
  CRISPR gRNA sequence
tcagtgaataaaaacagagt

SEQ ID NO: 393840 - DNA, 20 bp, Artificial
  CRISPR gRNA sequence
cagtgaataaaaacagagta

SEQ ID NO: 393841 - DNA, 20 bp, Artificial
  CRISPR gRNA sequence
agtgaataaaaacagagtaa

SEQ ID NO: 393842 - DNA, 20 bp, Artificial
  CRISPR gRNA sequence
aagggattcgtttcatcttt

SEQ ID NO: 393843 - DNA, 20 bp, Artificial
  CRISPR gRNA sequence
gtttcatctttttggaaaaa

SEQ ID NO: 393844 - DNA, 20 bp, Artificial
  CRISPR gRNA sequence
catctttttggaaaaagtga

SEQ ID NO: 393845 - DNA, 20 bp, Artificial
  CRISPR gRNA sequence
atctttttggaaaaagtgat

SEQ ID NO: 393846 - DNA, 20 bp, Artificial
  CRISPR gRNA sequence
tttggaaaaagtgattagag

SEQ ID NO: 393847 - DNA, 20 bp, Artificial
  CRISPR gRNA sequence
ttggaaaaagtgattagaga

SEQ ID NO: 393848 - DNA, 20 bp, Artificial
  CRISPR gRNA sequence
tggaaaaagtgattagagaa

SEQ ID NO: 393849 - DNA, 20 bp, Artificial
  CRISPR gRNA sequence
ggaaaaagtgattagagaat

SEQ ID NO: 393850 - DNA, 20 bp, Artificial
  CRISPR gRNA sequence
gaaaaagtgattagagaatt

SEQ ID NO: 393851 - DNA, 20 bp, Artificial
  CRISPR gRNA sequence
gagaattcctgaattttcca

SEQ ID NO: 393852 - DNA, 20 bp, Artificial
  CRISPR gRNA sequence
ctgaattttccattagaaca

SEQ ID NO: 393853 - DNA, 20 bp, Artificial
  CRISPR gRNA sequence
aattttccattagaacagat

SEQ ID NO: 393854 - DNA, 20 bp, Artificial
  CRISPR gRNA sequence
tccattagaacagataagca

SEQ ID NO: 393855 - DNA, 20 bp, Artificial
  CRISPR gRNA sequence
ccattagaacagataagcaa

SEQ ID NO: 393856 - DNA, 20 bp, Artificial
  CRISPR gRNA sequence
cattagaacagataagcaac

SEQ ID NO: 393857 - DNA, 20 bp, Artificial
  CRISPR gRNA sequence
gaacagataagcaacatata

SEQ ID NO: 393858 - DNA, 20 bp, Artificial
  CRISPR gRNA sequence
ctttaaataaataagccttt

SEQ ID NO: 393859 - DNA, 20 bp, Artificial
  CRISPR gRNA sequence
taaataaataagcctttgac

SEQ ID NO: 393860 - DNA, 20 bp, Artificial
  CRISPR gRNA sequence
aaataaataagcctttgacc

SEQ ID NO: 393861 - DNA, 20 bp, Artificial
  CRISPR gRNA sequence
aataaataagcctttgacct

SEQ ID NO: 393862 - DNA, 20 bp, Artificial
  CRISPR gRNA sequence
tgacctaactcatgaactga

SEQ ID NO: 393863 - DNA, 20 bp, Artificial
  CRISPR gRNA sequence
gacctaactcatgaactgaa

SEQ ID NO: 393864 - DNA, 20 bp, Artificial
  CRISPR gRNA sequence
acctaactcatgaactgaac

SEQ ID NO: 393865 - DNA, 20 bp, Artificial
  CRISPR gRNA sequence
actcatgaactgaacaaaac

SEQ ID NO: 393866 - DNA, 20 bp, Artificial
  CRISPR gRNA sequence
atgaactgaacaaaacgttc

SEQ ID NO: 393867 - DNA, 20 bp, Artificial
  CRISPR gRNA sequence
aacaaaacgttctcaccggg

SEQ ID NO: 393868 - DNA, 20 bp, Artificial
  CRISPR gRNA sequence
tcaccgggaacaaaaatcct

SEQ ID NO: 393869 - DNA, 20 bp, Artificial
  CRISPR gRNA sequence
accgggaacaaaaatcctcc

SEQ ID NO: 393870 - DNA, 20 bp, Artificial
  CRISPR gRNA sequence
cactcagcttgctttgcagg

SEQ ID NO: 393871 - DNA, 20 bp, Artificial
  CRISPR gRNA sequence
agcttgctttgcaggtgcta

SEQ ID NO: 393872 - DNA, 20 bp, Artificial
  CRISPR gRNA sequence
gctttgcaggtgctacaaga

SEQ ID NO: 393873 - DNA, 20 bp, Artificial
  CRISPR gRNA sequence
ctttgcaggtgctacaagac

SEQ ID NO: 393874 - DNA, 20 bp, Artificial
  CRISPR gRNA sequence
tgcaggtgctacaagacaac

SEQ ID NO: 393875 - DNA, 20 bp, Artificial
  CRISPR gRNA sequence
gcaggtgctacaagacaacc

SEQ ID NO: 393876 - DNA, 20 bp, Artificial
  CRISPR gRNA sequence
caggtgctacaagacaacct

SEQ ID NO: 393877 - DNA, 20 bp, Artificial
  CRISPR gRNA sequence
caagacaacctgttggacaa

SEQ ID NO: 393878 - DNA, 20 bp, Artificial
  CRISPR gRNA sequence
ttggacaaaatgcacttccg

SEQ ID NO: 393879 - DNA, 20 bp, Artificial
  CRISPR gRNA sequence
gacaaaatgcacttccgata

SEQ ID NO: 393880 - DNA, 20 bp, Artificial
  CRISPR gRNA sequence
ccgatatttgcaaatggcca

SEQ ID NO: 393881 - DNA, 20 bp, Artificial
  CRISPR gRNA sequence
cgatatttgcaaatggccac

SEQ ID NO: 393882 - DNA, 20 bp, Artificial
  CRISPR gRNA sequence
gcaaatggccaccatgcttc

SEQ ID NO: 393883 - DNA, 20 bp, Artificial
  CRISPR gRNA sequence
caaatggccaccatgcttca

SEQ ID NO: 393884 - DNA, 20 bp, Artificial
  CRISPR gRNA sequence
cagaatgagtgtgttttcaa

SEQ ID NO: 393885 - DNA, 20 bp, Artificial
  CRISPR gRNA sequence
agaatgagtgtgttttcaat

SEQ ID NO: 393886 - DNA, 20 bp, Artificial
  CRISPR gRNA sequence
tcaatgggtgccatccaaaa

SEQ ID NO: 393887 - DNA, 20 bp, Artificial
  CRISPR gRNA sequence
caatgggtgccatccaaaag

SEQ ID NO: 393888 - DNA, 20 bp, Artificial
  CRISPR gRNA sequence
aatgggtgccatccaaaagg

SEQ ID NO: 393889 - DNA, 20 bp, Artificial
  CRISPR gRNA sequence
taggtaggtcatgaaattaa

SEQ ID NO: 393890 - DNA, 20 bp, Artificial
  CRISPR gRNA sequence
ggtaggtcatgaaattaaag

SEQ ID NO: 393891 - DNA, 20 bp, Artificial
  CRISPR gRNA sequence
aagccagagagtctcactgc

SEQ ID NO: 393892 - DNA, 20 bp, Artificial
  CRISPR gRNA sequence
actgctatgtctaaaaaact

SEQ ID NO: 393893 - DNA, 20 bp, Artificial
  CRISPR gRNA sequence
ctatgtctaaaaaactgaga

SEQ ID NO: 393894 - DNA, 20 bp, Artificial
  CRISPR gRNA sequence
tgtctaaaaaactgagagaa

SEQ ID NO: 393895 - DNA, 20 bp, Artificial
  CRISPR gRNA sequence
aaaaactgagagaatgtgct

SEQ ID NO: 393896 - DNA, 20 bp, Artificial
  CRISPR gRNA sequence
agagaatgtgctgggacaag

SEQ ID NO: 393897 - DNA, 20 bp, Artificial
  CRISPR gRNA sequence
ggacaagtacttcgtgcata

SEQ ID NO: 393898 - DNA, 20 bp, Artificial
  CRISPR gRNA sequence
cgtgcataaccaaatacaaa

SEQ ID NO: 393899 - DNA, 20 bp, Artificial
  CRISPR gRNA sequence
gtgcataaccaaatacaaac

SEQ ID NO: 393900 - DNA, 20 bp, Artificial
  CRISPR gRNA sequence
ggatcagaaatgcagaatga

SEQ ID NO: 393901 - DNA, 20 bp, Artificial
  CRISPR gRNA sequence
tgcaaagaaaaagaatgcaa

SEQ ID NO: 393902 - DNA, 20 bp, Artificial
  CRISPR gRNA sequence
caaagaaaaagaatgcaaat

SEQ ID NO: 393903 - DNA, 20 bp, Artificial
  CRISPR gRNA sequence
acctgctagaatttcctggg

SEQ ID NO: 393904 - DNA, 20 bp, Artificial
  CRISPR gRNA sequence
ctagaatttcctgggtagat

SEQ ID NO: 393905 - DNA, 20 bp, Artificial
  CRISPR gRNA sequence
gaatttcctgggtagataaa

SEQ ID NO: 393906 - DNA, 20 bp, Artificial
  CRISPR gRNA sequence
cctgggtagataaatcacat

SEQ ID NO: 393907 - DNA, 20 bp, Artificial
  CRISPR gRNA sequence
ctgggtagataaatcacatg

SEQ ID NO: 393908 - DNA, 20 bp, Artificial
  CRISPR gRNA sequence
ggtagataaatcacatgtca

SEQ ID NO: 393909 - DNA, 20 bp, Artificial
  CRISPR gRNA sequence
gtttagattttcaagctctt

SEQ ID NO: 393910 - DNA, 20 bp, Artificial
  CRISPR gRNA sequence
agattttcaagctctttttt

SEQ ID NO: 393911 - DNA, 20 bp, Artificial
  CRISPR gRNA sequence
gattttcaagctcttttttt

SEQ ID NO: 393912 - DNA, 20 bp, Artificial
  CRISPR gRNA sequence
tcaagctcttttttttttcc

SEQ ID NO: 393913 - DNA, 20 bp, Artificial
  CRISPR gRNA sequence
caagctcttttttttttcca

SEQ ID NO: 393914 - DNA, 20 bp, Artificial
  CRISPR gRNA sequence
aagctcttttttttttccac

SEQ ID NO: 393915 - DNA, 20 bp, Artificial
  CRISPR gRNA sequence
ttttttttttccactttcta

SEQ ID NO: 393916 - DNA, 20 bp, Artificial
  CRISPR gRNA sequence
ttttttttccactttctatt

SEQ ID NO: 393917 - DNA, 20 bp, Artificial
  CRISPR gRNA sequence
tttttttccactttctattc

SEQ ID NO: 393918 - DNA, 20 bp, Artificial
  CRISPR gRNA sequence
ttttttccactttctattca

SEQ ID NO: 393919 - DNA, 20 bp, Artificial
  CRISPR gRNA sequence
tttttccactttctattcac

SEQ ID NO: 393920 - DNA, 20 bp, Artificial
  CRISPR gRNA sequence
ttttccactttctattcaca

SEQ ID NO: 393921 - DNA, 20 bp, Artificial
  CRISPR gRNA sequence
tttccactttctattcacag

SEQ ID NO: 393922 - DNA, 20 bp, Artificial
  CRISPR gRNA sequence
ttccactttctattcacaga

SEQ ID NO: 393923 - DNA, 20 bp, Artificial
  CRISPR gRNA sequence
tccactttctattcacagat

SEQ ID NO: 393924 - DNA, 20 bp, Artificial
  CRISPR gRNA sequence
ccactttctattcacagata

SEQ ID NO: 393925 - DNA, 20 bp, Artificial
  CRISPR gRNA sequence
cactttctattcacagatat

SEQ ID NO: 393926 - DNA, 20 bp, Artificial
  CRISPR gRNA sequence
tctattcacagatattccaa

SEQ ID NO: 393927 - DNA, 20 bp, Artificial
  CRISPR gRNA sequence
ctattcacagatattccaaa

SEQ ID NO: 393928 - DNA, 20 bp, Artificial
  CRISPR gRNA sequence
tattcacagatattccaaaa

SEQ ID NO: 393929 - DNA, 20 bp, Artificial
  CRISPR gRNA sequence
ttcacagatattccaaaacc

SEQ ID NO: 393930 - DNA, 20 bp, Artificial
  CRISPR gRNA sequence
acagatattccaaaaccata

SEQ ID NO: 393931 - DNA, 20 bp, Artificial
  CRISPR gRNA sequence
caaaaccatattcccctctc

SEQ ID NO: 393932 - DNA, 20 bp, Artificial
  CRISPR gRNA sequence
ccctctccaaactggctcct

SEQ ID NO: 393933 - DNA, 20 bp, Artificial
  CRISPR gRNA sequence
tccaaactggctccttttta

SEQ ID NO: 393934 - DNA, 20 bp, Artificial
  CRISPR gRNA sequence
caaactggctcctttttact

SEQ ID NO: 393935 - DNA, 20 bp, Artificial
  CRISPR gRNA sequence
gctcctttttactctcccca

SEQ ID NO: 393936 - DNA, 20 bp, Artificial
  CRISPR gRNA sequence
ctttttactctccccactgt

SEQ ID NO: 393937 - DNA, 20 bp, Artificial
  CRISPR gRNA sequence
tttactctccccactgttca

SEQ ID NO: 393938 - DNA, 20 bp, Artificial
  CRISPR gRNA sequence
ttactctccccactgttcag

SEQ ID NO: 393939 - DNA, 20 bp, Artificial
  CRISPR gRNA sequence
tactctccccactgttcaga

SEQ ID NO: 393940 - DNA, 20 bp, Artificial
  CRISPR gRNA sequence
actctccccactgttcagaa

SEQ ID NO: 393941 - DNA, 20 bp, Artificial
  CRISPR gRNA sequence
ctctccccactgttcagaaa

SEQ ID NO: 393942 - DNA, 20 bp, Artificial
  CRISPR gRNA sequence
tccccactgttcagaaactg

SEQ ID NO: 393943 - DNA, 20 bp, Artificial
  CRISPR gRNA sequence
cccactgttcagaaactggg

SEQ ID NO: 393944 - DNA, 20 bp, Artificial
  CRISPR gRNA sequence
ttcagaaactgggtatcctt

SEQ ID NO: 393945 - DNA, 20 bp, Artificial
  CRISPR gRNA sequence
agaaactgggtatccttctt

SEQ ID NO: 393946 - DNA, 20 bp, Artificial
  CRISPR gRNA sequence
ggtatccttcttaacacctc

SEQ ID NO: 393947 - DNA, 20 bp, Artificial
  CRISPR gRNA sequence
cttaacacctcttccctttc

SEQ ID NO: 393948 - DNA, 20 bp, Artificial
  CRISPR gRNA sequence
ttaacacctcttccctttct

SEQ ID NO: 393949 - DNA, 20 bp, Artificial
  CRISPR gRNA sequence
aacacctcttccctttctca

SEQ ID NO: 393950 - DNA, 20 bp, Artificial
  CRISPR gRNA sequence
acacctcttccctttctcac

SEQ ID NO: 393951 - DNA, 20 bp, Artificial
  CRISPR gRNA sequence
ttccctttctcactcatcca

SEQ ID NO: 393952 - DNA, 20 bp, Artificial
  CRISPR gRNA sequence
ccctttctcactcatccaat

SEQ ID NO: 393953 - DNA, 20 bp, Artificial
  CRISPR gRNA sequence
cctttctcactcatccaatc

SEQ ID NO: 393954 - DNA, 20 bp, Artificial
  CRISPR gRNA sequence
tctcactcatccaatcagtt

SEQ ID NO: 393955 - DNA, 20 bp, Artificial
  CRISPR gRNA sequence
ctcactcatccaatcagttg

SEQ ID NO: 393956 - DNA, 20 bp, Artificial
  CRISPR gRNA sequence
tcactcatccaatcagttgc

SEQ ID NO: 393957 - DNA, 20 bp, Artificial
  CRISPR gRNA sequence
actcatccaatcagttgctg

SEQ ID NO: 393958 - DNA, 20 bp, Artificial
  CRISPR gRNA sequence
atccaatcagttgctggatc

SEQ ID NO: 393959 - DNA, 20 bp, Artificial
  CRISPR gRNA sequence
ctggatcccgtcaactctac

SEQ ID NO: 393960 - DNA, 20 bp, Artificial
  CRISPR gRNA sequence
gatcccgtcaactctacctt

SEQ ID NO: 393961 - DNA, 20 bp, Artificial
  CRISPR gRNA sequence
taccttttaaacatctctca

SEQ ID NO: 393962 - DNA, 20 bp, Artificial
  CRISPR gRNA sequence
ccttttaaacatctctcaaa

SEQ ID NO: 393963 - DNA, 20 bp, Artificial
  CRISPR gRNA sequence
ttaaacatctctcaaacatg

SEQ ID NO: 393964 - DNA, 20 bp, Artificial
  CRISPR gRNA sequence
taaacatctctcaaacatgg

SEQ ID NO: 393965 - DNA, 20 bp, Artificial
  CRISPR gRNA sequence
aaacatctctcaaacatgga

SEQ ID NO: 393966 - DNA, 20 bp, Artificial
  CRISPR gRNA sequence
aacatctctcaaacatggac

SEQ ID NO: 393967 - DNA, 20 bp, Artificial
  CRISPR gRNA sequence
tcaaacatggaccctacact

SEQ ID NO: 393968 - DNA, 20 bp, Artificial
  CRISPR gRNA sequence
aaacatggaccctacactct

SEQ ID NO: 393969 - DNA, 20 bp, Artificial
  CRISPR gRNA sequence
cactctctatacaaattgcc

SEQ ID NO: 393970 - DNA, 20 bp, Artificial
  CRISPR gRNA sequence
tctatacaaattgccctatt

SEQ ID NO: 393971 - DNA, 20 bp, Artificial
  CRISPR gRNA sequence
tatacaaattgccctattct

SEQ ID NO: 393972 - DNA, 20 bp, Artificial
  CRISPR gRNA sequence
tacaaattgccctattctgc

SEQ ID NO: 393973 - DNA, 20 bp, Artificial
  CRISPR gRNA sequence
ccctattctgctccatccct

SEQ ID NO: 393974 - DNA, 20 bp, Artificial
  CRISPR gRNA sequence
ttctgctccatccctactat

SEQ ID NO: 393975 - DNA, 20 bp, Artificial
  CRISPR gRNA sequence
tgctccatccctactatatt

SEQ ID NO: 393976 - DNA, 20 bp, Artificial
  CRISPR gRNA sequence
ctccatccctactatattac

SEQ ID NO: 393977 - DNA, 20 bp, Artificial
  CRISPR gRNA sequence
catccctactatattactaa

SEQ ID NO: 393978 - DNA, 20 bp, Artificial
  CRISPR gRNA sequence
ctatattactaaaatagact

SEQ ID NO: 393979 - DNA, 20 bp, Artificial
  CRISPR gRNA sequence
tattactaaaatagacttct

SEQ ID NO: 393980 - DNA, 20 bp, Artificial
  CRISPR gRNA sequence
ctaaaatagacttctgccca

SEQ ID NO: 393981 - DNA, 20 bp, Artificial
  CRISPR gRNA sequence
aaatagacttctgcccagcc

SEQ ID NO: 393982 - DNA, 20 bp, Artificial
  CRISPR gRNA sequence
ctgcccagcctccttcactc

SEQ ID NO: 393983 - DNA, 20 bp, Artificial
  CRISPR gRNA sequence
tgcccagcctccttcactcc

SEQ ID NO: 393984 - DNA, 20 bp, Artificial
  CRISPR gRNA sequence
cccagcctccttcactccag

SEQ ID NO: 393985 - DNA, 20 bp, Artificial
  CRISPR gRNA sequence
cttcactccagtctcgctcc

SEQ ID NO: 393986 - DNA, 20 bp, Artificial
  CRISPR gRNA sequence
cactccagtctcgctcccat

SEQ ID NO: 393987 - DNA, 20 bp, Artificial
  CRISPR gRNA sequence
actccagtctcgctcccata

SEQ ID NO: 393988 - DNA, 20 bp, Artificial
  CRISPR gRNA sequence
cagtctcgctcccatatgaa

SEQ ID NO: 393989 - DNA, 20 bp, Artificial
  CRISPR gRNA sequence
gctcccatatgaacgacagt

SEQ ID NO: 393990 - DNA, 20 bp, Artificial
  CRISPR gRNA sequence
ccatatgaacgacagtccac

SEQ ID NO: 393991 - DNA, 20 bp, Artificial
  CRISPR gRNA sequence
atctctctctcaagacatta

SEQ ID NO: 393992 - DNA, 20 bp, Artificial
  CRISPR gRNA sequence
tctctcaagacattaaaacc

SEQ ID NO: 393993 - DNA, 20 bp, Artificial
  CRISPR gRNA sequence
tctcaagacattaaaaccct

SEQ ID NO: 393994 - DNA, 20 bp, Artificial
  CRISPR gRNA sequence
tcaagacattaaaacccttc

SEQ ID NO: 393995 - DNA, 20 bp, Artificial
  CRISPR gRNA sequence
aagacattaaaacccttcaa

SEQ ID NO: 393996 - DNA, 20 bp, Artificial
  CRISPR gRNA sequence
aaacccttcaataaactctc

SEQ ID NO: 393997 - DNA, 20 bp, Artificial
  CRISPR gRNA sequence
caataaactctcagtcccct

SEQ ID NO: 393998 - DNA, 20 bp, Artificial
  CRISPR gRNA sequence
aataaactctcagtcccctt

SEQ ID NO: 393999 - DNA, 20 bp, Artificial
  CRISPR gRNA sequence
tcagtccccttatggtgagt

SEQ ID NO: 394000 - DNA, 20 bp, Artificial
  CRISPR gRNA sequence
agtccccttatggtgagtat

SEQ ID NO: 394001 - DNA, 20 bp, Artificial
  CRISPR gRNA sequence
atggtgagtatgcacttctc

SEQ ID NO: 394002 - DNA, 20 bp, Artificial
  CRISPR gRNA sequence
tggtgagtatgcacttctca

SEQ ID NO: 394003 - DNA, 20 bp, Artificial
  CRISPR gRNA sequence
ctcaccacagcacatagaat

SEQ ID NO: 394004 - DNA, 20 bp, Artificial
  CRISPR gRNA sequence
tcaccacagcacatagaatc

SEQ ID NO: 394005 - DNA, 20 bp, Artificial
  CRISPR gRNA sequence
accacagcacatagaatcac

SEQ ID NO: 394006 - DNA, 20 bp, Artificial
  CRISPR gRNA sequence
agcaggctggaaacagtgga

SEQ ID NO: 394007 - DNA, 20 bp, Artificial
  CRISPR gRNA sequence
gcaggctggaaacagtggat

SEQ ID NO: 394008 - DNA, 20 bp, Artificial
  CRISPR gRNA sequence
gaaacagtggatcctgcctg

SEQ ID NO: 394009 - DNA, 20 bp, Artificial
  CRISPR gRNA sequence
cctgtaatcccagcactttg

SEQ ID NO: 394010 - DNA, 20 bp, Artificial
  CRISPR gRNA sequence
taatcccagcactttgggag

SEQ ID NO: 394011 - DNA, 20 bp, Artificial
  CRISPR gRNA sequence
tgggaggccgaggcgggcag

SEQ ID NO: 394012 - DNA, 20 bp, Artificial
  CRISPR gRNA sequence
gggaggccgaggcgggcaga

SEQ ID NO: 394013 - DNA, 20 bp, Artificial
  CRISPR gRNA sequence
ggaggccgaggcgggcagac

SEQ ID NO: 394014 - DNA, 20 bp, Artificial
  CRISPR gRNA sequence
aggccaggagttcgagacca

SEQ ID NO: 394015 - DNA, 20 bp, Artificial
  CRISPR gRNA sequence
gagaccagcctggccaatat

SEQ ID NO: 394016 - DNA, 20 bp, Artificial
  CRISPR gRNA sequence
gccaatatggtgatacccca

SEQ ID NO: 394017 - DNA, 20 bp, Artificial
  CRISPR gRNA sequence
taccaaatatacaaaaagta

SEQ ID NO: 394018 - DNA, 20 bp, Artificial
  CRISPR gRNA sequence
ccaaatatacaaaaagtagt

SEQ ID NO: 394019 - DNA, 20 bp, Artificial
  CRISPR gRNA sequence
caatccaagctactcgggag

SEQ ID NO: 394020 - DNA, 20 bp, Artificial
  CRISPR gRNA sequence
ctcgggaggctgaggaagga

SEQ ID NO: 394021 - DNA, 20 bp, Artificial
  CRISPR gRNA sequence
gggaggctgaggaaggagaa

SEQ ID NO: 394022 - DNA, 20 bp, Artificial
  CRISPR gRNA sequence
aggaaggagaatcactggaa

SEQ ID NO: 394023 - DNA, 20 bp, Artificial
  CRISPR gRNA sequence
gaacccaggatgtggaggtc

SEQ ID NO: 394024 - DNA, 20 bp, Artificial
  CRISPR gRNA sequence
cgccactgcactccagactg

SEQ ID NO: 394025 - DNA, 20 bp, Artificial
  CRISPR gRNA sequence
cactccagactgggcgacag

SEQ ID NO: 394026 - DNA, 20 bp, Artificial
  CRISPR gRNA sequence
cagactgggcgacagagtga

SEQ ID NO: 394027 - DNA, 20 bp, Artificial
  CRISPR gRNA sequence
ggcgacagagtgagactcca

SEQ ID NO: 394028 - DNA, 20 bp, Artificial
  CRISPR gRNA sequence
catctcaaaacaacaataac

SEQ ID NO: 394029 - DNA, 20 bp, Artificial
  CRISPR gRNA sequence
aaaacaacaataacaacaaa

SEQ ID NO: 394030 - DNA, 20 bp, Artificial
  CRISPR gRNA sequence
agcatcaggtctttgcctac

SEQ ID NO: 394031 - DNA, 20 bp, Artificial
  CRISPR gRNA sequence
tgcctacctctctgcttgta

SEQ ID NO: 394032 - DNA, 20 bp, Artificial
  CRISPR gRNA sequence
gcctacctctctgcttgtat

SEQ ID NO: 394033 - DNA, 20 bp, Artificial
  CRISPR gRNA sequence
cctacctctctgcttgtatc

SEQ ID NO: 394034 - DNA, 20 bp, Artificial
  CRISPR gRNA sequence
cctctctgcttgtatctatc

SEQ ID NO: 394035 - DNA, 20 bp, Artificial
  CRISPR gRNA sequence
tctgcttgtatctatcccat

SEQ ID NO: 394036 - DNA, 20 bp, Artificial
  CRISPR gRNA sequence
tgcttgtatctatcccattc

SEQ ID NO: 394037 - DNA, 20 bp, Artificial
  CRISPR gRNA sequence
cttgtatctatcccattccc

SEQ ID NO: 394038 - DNA, 20 bp, Artificial
  CRISPR gRNA sequence
gtatctatcccattcccacc

SEQ ID NO: 394039 - DNA, 20 bp, Artificial
  CRISPR gRNA sequence
tatctatcccattcccacct

SEQ ID NO: 394040 - DNA, 20 bp, Artificial
  CRISPR gRNA sequence
tcccattcccacctcataca

SEQ ID NO: 394041 - DNA, 20 bp, Artificial
  CRISPR gRNA sequence
ccacctcatacattatgttt

SEQ ID NO: 394042 - DNA, 20 bp, Artificial
  CRISPR gRNA sequence
atacattatgtttcaggatg

SEQ ID NO: 394043 - DNA, 20 bp, Artificial
  CRISPR gRNA sequence
tgtttcaggatgatgggctg

SEQ ID NO: 394044 - DNA, 20 bp, Artificial
  CRISPR gRNA sequence
caggatgatgggctgctttt

SEQ ID NO: 394045 - DNA, 20 bp, Artificial
  CRISPR gRNA sequence
aggatgatgggctgcttttc

SEQ ID NO: 394046 - DNA, 20 bp, Artificial
  CRISPR gRNA sequence
cttttccatcctcttacatc

SEQ ID NO: 394047 - DNA, 20 bp, Artificial
  CRISPR gRNA sequence
ttccatcctcttacatctcc

SEQ ID NO: 394048 - DNA, 20 bp, Artificial
  CRISPR gRNA sequence
tccatcctcttacatctccc

SEQ ID NO: 394049 - DNA, 20 bp, Artificial
  CRISPR gRNA sequence
ccatcctcttacatctcccg

SEQ ID NO: 394050 - DNA, 20 bp, Artificial
  CRISPR gRNA sequence
catcctcttacatctcccgc

SEQ ID NO: 394051 - DNA, 20 bp, Artificial
  CRISPR gRNA sequence
ttacatctcccgctttgtat

SEQ ID NO: 394052 - DNA, 20 bp, Artificial
  CRISPR gRNA sequence
acatctcccgctttgtattt

SEQ ID NO: 394053 - DNA, 20 bp, Artificial
  CRISPR gRNA sequence
catctcccgctttgtatttc

SEQ ID NO: 394054 - DNA, 20 bp, Artificial
  CRISPR gRNA sequence
ccgctttgtatttcttctcg

SEQ ID NO: 394055 - DNA, 20 bp, Artificial
  CRISPR gRNA sequence
tgtatttcttctcgggacct

SEQ ID NO: 394056 - DNA, 20 bp, Artificial
  CRISPR gRNA sequence
gtatttcttctcgggacctt

SEQ ID NO: 394057 - DNA, 20 bp, Artificial
  CRISPR gRNA sequence
tatttcttctcgggaccttt

SEQ ID NO: 394058 - DNA, 20 bp, Artificial
  CRISPR gRNA sequence
cttctcgggacctttgcact

SEQ ID NO: 394059 - DNA, 20 bp, Artificial
  CRISPR gRNA sequence
ttctcgggacctttgcactt

SEQ ID NO: 394060 - DNA, 20 bp, Artificial
  CRISPR gRNA sequence
ctcgggacctttgcacttgc

SEQ ID NO: 394061 - DNA, 20 bp, Artificial
  CRISPR gRNA sequence
tcgggacctttgcacttgct

SEQ ID NO: 394062 - DNA, 20 bp, Artificial
  CRISPR gRNA sequence
gggacctttgcacttgctat

SEQ ID NO: 394063 - DNA, 20 bp, Artificial
  CRISPR gRNA sequence
tgcacttgctattcctactg

SEQ ID NO: 394064 - DNA, 20 bp, Artificial
  CRISPR gRNA sequence
gcacttgctattcctactgc

SEQ ID NO: 394065 - DNA, 20 bp, Artificial
  CRISPR gRNA sequence
cacttgctattcctactgca

SEQ ID NO: 394066 - DNA, 20 bp, Artificial
  CRISPR gRNA sequence
gctattcctactgcaaggac

SEQ ID NO: 394067 - DNA, 20 bp, Artificial
  CRISPR gRNA sequence
ctattcctactgcaaggaca

SEQ ID NO: 394068 - DNA, 20 bp, Artificial
  CRISPR gRNA sequence
ttcctactgcaaggacaccc

SEQ ID NO: 394069 - DNA, 20 bp, Artificial
  CRISPR gRNA sequence
ctactgcaaggacaccctgc

SEQ ID NO: 394070 - DNA, 20 bp, Artificial
  CRISPR gRNA sequence
ctgcaaggacaccctgccct

SEQ ID NO: 394071 - DNA, 20 bp, Artificial
  CRISPR gRNA sequence
caaggacaccctgccctttc

SEQ ID NO: 394072 - DNA, 20 bp, Artificial
  CRISPR gRNA sequence
ccctttctttggctaactcc

SEQ ID NO: 394073 - DNA, 20 bp, Artificial
  CRISPR gRNA sequence
tctttggctaactcctactt

SEQ ID NO: 394074 - DNA, 20 bp, Artificial
  CRISPR gRNA sequence
ctttggctaactcctacttc

SEQ ID NO: 394075 - DNA, 20 bp, Artificial
  CRISPR gRNA sequence
tttggctaactcctacttct

SEQ ID NO: 394076 - DNA, 20 bp, Artificial
  CRISPR gRNA sequence
tggctaactcctacttcttt

SEQ ID NO: 394077 - DNA, 20 bp, Artificial
  CRISPR gRNA sequence
ggctaactcctacttcttta

SEQ ID NO: 394078 - DNA, 20 bp, Artificial
  CRISPR gRNA sequence
gctaactcctacttctttag

SEQ ID NO: 394079 - DNA, 20 bp, Artificial
  CRISPR gRNA sequence
actcctacttctttagttgt

SEQ ID NO: 394080 - DNA, 20 bp, Artificial
  CRISPR gRNA sequence
ctacttctttagttgtcaga

SEQ ID NO: 394081 - DNA, 20 bp, Artificial
  CRISPR gRNA sequence
cttctttagttgtcagatgt

SEQ ID NO: 394082 - DNA, 20 bp, Artificial
  CRISPR gRNA sequence
ctttagttgtcagatgtgtt

SEQ ID NO: 394083 - DNA, 20 bp, Artificial
  CRISPR gRNA sequence
tttagttgtcagatgtgttt

SEQ ID NO: 394084 - DNA, 20 bp, Artificial
  CRISPR gRNA sequence
tagttgtcagatgtgttttc

SEQ ID NO: 394085 - DNA, 20 bp, Artificial
  CRISPR gRNA sequence
agttgtcagatgtgttttcc

SEQ ID NO: 394086 - DNA, 20 bp, Artificial
  CRISPR gRNA sequence
gttgtcagatgtgttttcca

SEQ ID NO: 394087 - DNA, 20 bp, Artificial
  CRISPR gRNA sequence
tcagatgtgttttccatcca

SEQ ID NO: 394088 - DNA, 20 bp, Artificial
  CRISPR gRNA sequence
tccatccaacttgaacaatg

SEQ ID NO: 394089 - DNA, 20 bp, Artificial
  CRISPR gRNA sequence
ccatccaacttgaacaatga

SEQ ID NO: 394090 - DNA, 20 bp, Artificial
  CRISPR gRNA sequence
catccaacttgaacaatgag

SEQ ID NO: 394091 - DNA, 20 bp, Artificial
  CRISPR gRNA sequence
gaacaatgaggaatgacaac

SEQ ID NO: 394092 - DNA, 20 bp, Artificial
  CRISPR gRNA sequence
aacaatgaggaatgacaaca

SEQ ID NO: 394093 - DNA, 20 bp, Artificial
  CRISPR gRNA sequence
aaggactctgagagtcccct

SEQ ID NO: 394094 - DNA, 20 bp, Artificial
  CRISPR gRNA sequence
aggactctgagagtcccctt

SEQ ID NO: 394095 - DNA, 20 bp, Artificial
  CRISPR gRNA sequence
tgagagtcccctttatggca

SEQ ID NO: 394096 - DNA, 20 bp, Artificial
  CRISPR gRNA sequence
agagtcccctttatggcatt

SEQ ID NO: 394097 - DNA, 20 bp, Artificial
  CRISPR gRNA sequence
tatggcattatccccatgag

SEQ ID NO: 394098 - DNA, 20 bp, Artificial
  CRISPR gRNA sequence
atggcattatccccatgaga

SEQ ID NO: 394099 - DNA, 20 bp, Artificial
  CRISPR gRNA sequence
tggcattatccccatgagag

SEQ ID NO: 394100 - DNA, 20 bp, Artificial
  CRISPR gRNA sequence
tccccatgagagcgttattt

SEQ ID NO: 394101 - DNA, 20 bp, Artificial
  CRISPR gRNA sequence
tttcataccatcatgtaatg

SEQ ID NO: 394102 - DNA, 20 bp, Artificial
  CRISPR gRNA sequence
cataccatcatgtaatgtct

SEQ ID NO: 394103 - DNA, 20 bp, Artificial
  CRISPR gRNA sequence
ataccatcatgtaatgtcta

SEQ ID NO: 394104 - DNA, 20 bp, Artificial
  CRISPR gRNA sequence
cttacatatgatagggagga

SEQ ID NO: 394105 - DNA, 20 bp, Artificial
  CRISPR gRNA sequence
acatatgatagggaggaggg

SEQ ID NO: 394106 - DNA, 20 bp, Artificial
  CRISPR gRNA sequence
catatgatagggaggagggc

SEQ ID NO: 394107 - DNA, 20 bp, Artificial
  CRISPR gRNA sequence
taatatctcattcatcctaa

SEQ ID NO: 394108 - DNA, 20 bp, Artificial
  CRISPR gRNA sequence
attcatcctaatatttccag

SEQ ID NO: 394109 - DNA, 20 bp, Artificial
  CRISPR gRNA sequence
atcctaatatttccagttcc

SEQ ID NO: 394110 - DNA, 20 bp, Artificial
  CRISPR gRNA sequence
atatttccagttcctgatgg

SEQ ID NO: 394111 - DNA, 20 bp, Artificial
  CRISPR gRNA sequence
ccagttcctgatggaatgcc

SEQ ID NO: 394112 - DNA, 20 bp, Artificial
  CRISPR gRNA sequence
cagttcctgatggaatgcct

SEQ ID NO: 394113 - DNA, 20 bp, Artificial
  CRISPR gRNA sequence
ctgatggaatgcctggcaag

SEQ ID NO: 394114 - DNA, 20 bp, Artificial
  CRISPR gRNA sequence
atggaatgcctggcaagtgg

SEQ ID NO: 394115 - DNA, 20 bp, Artificial
  CRISPR gRNA sequence
gcaagtggtaacagctaaat

SEQ ID NO: 394116 - DNA, 20 bp, Artificial
  CRISPR gRNA sequence
aatatgtgttagttgaaatg

SEQ ID NO: 394117 - DNA, 20 bp, Artificial
  CRISPR gRNA sequence
gttgaaatgagttgaagttt

SEQ ID NO: 394118 - DNA, 20 bp, Artificial
  CRISPR gRNA sequence
aaatgagttgaagtttcaga

SEQ ID NO: 394119 - DNA, 20 bp, Artificial
  CRISPR gRNA sequence
aagtttcagactcaacaaga

SEQ ID NO: 394120 - DNA, 20 bp, Artificial
  CRISPR gRNA sequence
cagactcaacaagatatcta

SEQ ID NO: 394121 - DNA, 20 bp, Artificial
  CRISPR gRNA sequence
agactcaacaagatatctaa

SEQ ID NO: 394122 - DNA, 20 bp, Artificial
  CRISPR gRNA sequence
aacaagatatctaattcttc

SEQ ID NO: 394123 - DNA, 20 bp, Artificial
  CRISPR gRNA sequence
attcttcagggaacatggaa

SEQ ID NO: 394124 - DNA, 20 bp, Artificial
  CRISPR gRNA sequence
ttcagggaacatggaaaggg

SEQ ID NO: 394125 - DNA, 20 bp, Artificial
  CRISPR gRNA sequence
cagggaacatggaaagggaa

SEQ ID NO: 394126 - DNA, 20 bp, Artificial
  CRISPR gRNA sequence
agggaacatggaaagggaat

SEQ ID NO: 394127 - DNA, 20 bp, Artificial
  CRISPR gRNA sequence
aatggaaccatcatgtgctg

SEQ ID NO: 394128 - DNA, 20 bp, Artificial
  CRISPR gRNA sequence
ggcaacttccatgtgccaag

SEQ ID NO: 394129 - DNA, 20 bp, Artificial
  CRISPR gRNA sequence
ccatgtgccaagtattatat

SEQ ID NO: 394130 - DNA, 20 bp, Artificial
  CRISPR gRNA sequence
catgtgccaagtattatata

SEQ ID NO: 394131 - DNA, 20 bp, Artificial
  CRISPR gRNA sequence
tataggatctttgtatatta

SEQ ID NO: 394132 - DNA, 20 bp, Artificial
  CRISPR gRNA sequence
tgtatattatctcattagtt

SEQ ID NO: 394133 - DNA, 20 bp, Artificial
  CRISPR gRNA sequence
gtatattatctcattagttc

SEQ ID NO: 394134 - DNA, 20 bp, Artificial
  CRISPR gRNA sequence
tatattatctcattagttct

SEQ ID NO: 394135 - DNA, 20 bp, Artificial
  CRISPR gRNA sequence
tctcattagttctcatgcct

SEQ ID NO: 394136 - DNA, 20 bp, Artificial
  CRISPR gRNA sequence
attagttctcatgcctcccc

SEQ ID NO: 394137 - DNA, 20 bp, Artificial
  CRISPR gRNA sequence
gttctcatgcctcccctaag

SEQ ID NO: 394138 - DNA, 20 bp, Artificial
  CRISPR gRNA sequence
tcatgcctcccctaaggtac

SEQ ID NO: 394139 - DNA, 20 bp, Artificial
  CRISPR gRNA sequence
atgcctcccctaaggtacat

SEQ ID NO: 394140 - DNA, 20 bp, Artificial
  CRISPR gRNA sequence
ccctaaggtacatattatac

SEQ ID NO: 394141 - DNA, 20 bp, Artificial
  CRISPR gRNA sequence
aggtacatattatacatgag

SEQ ID NO: 394142 - DNA, 20 bp, Artificial
  CRISPR gRNA sequence
tacatgagtactttctatac

SEQ ID NO: 394143 - DNA, 20 bp, Artificial
  CRISPR gRNA sequence
tctatacatgagtaaactga

SEQ ID NO: 394144 - DNA, 20 bp, Artificial
  CRISPR gRNA sequence
ctatacatgagtaaactgaa

SEQ ID NO: 394145 - DNA, 20 bp, Artificial
  CRISPR gRNA sequence
tatacatgagtaaactgaag

SEQ ID NO: 394146 - DNA, 20 bp, Artificial
  CRISPR gRNA sequence
tacatgagtaaactgaagct

SEQ ID NO: 394147 - DNA, 20 bp, Artificial
  CRISPR gRNA sequence
aagctcagaaaaatgaagaa

SEQ ID NO: 394148 - DNA, 20 bp, Artificial
  CRISPR gRNA sequence
agaaaaatgaagaaactttt

SEQ ID NO: 394149 - DNA, 20 bp, Artificial
  CRISPR gRNA sequence
ttcagacatcaccagatgag

SEQ ID NO: 394150 - DNA, 20 bp, Artificial
  CRISPR gRNA sequence
tcagacatcaccagatgagt

SEQ ID NO: 394151 - DNA, 20 bp, Artificial
  CRISPR gRNA sequence
cagacatcaccagatgagtt

SEQ ID NO: 394152 - DNA, 20 bp, Artificial
  CRISPR gRNA sequence
agacatcaccagatgagtta

SEQ ID NO: 394153 - DNA, 20 bp, Artificial
  CRISPR gRNA sequence
ggagcaggacagaactcaaa

SEQ ID NO: 394154 - DNA, 20 bp, Artificial
  CRISPR gRNA sequence
aaagctctgtgtcaacaaat

SEQ ID NO: 394155 - DNA, 20 bp, Artificial
  CRISPR gRNA sequence
tgtgtcaacaaatccttttt

SEQ ID NO: 394156 - DNA, 20 bp, Artificial
  CRISPR gRNA sequence
tgtcaacaaatccttttttg

SEQ ID NO: 394157 - DNA, 20 bp, Artificial
  CRISPR gRNA sequence
ttttgttttcgtgtaataaa

SEQ ID NO: 394158 - DNA, 20 bp, Artificial
  CRISPR gRNA sequence
tttgttttcgtgtaataaag

SEQ ID NO: 394159 - DNA, 20 bp, Artificial
  CRISPR gRNA sequence
ttgttttcgtgtaataaaga

SEQ ID NO: 394160 - DNA, 20 bp, Artificial
  CRISPR gRNA sequence
tgttttcgtgtaataaagac

SEQ ID NO: 394161 - DNA, 20 bp, Artificial
  CRISPR gRNA sequence
gttttcgtgtaataaagaca

SEQ ID NO: 394162 - DNA, 20 bp, Artificial
  CRISPR gRNA sequence
ttttcgtgtaataaagacaa

SEQ ID NO: 394163 - DNA, 20 bp, Artificial
  CRISPR gRNA sequence
tcgtgtaataaagacaagaa

SEQ ID NO: 394164 - DNA, 20 bp, Artificial
  CRISPR gRNA sequence
cgtgtaataaagacaagaac

SEQ ID NO: 394165 - DNA, 20 bp, Artificial
  CRISPR gRNA sequence
gtgtaataaagacaagaacc

SEQ ID NO: 394166 - DNA, 20 bp, Artificial
  CRISPR gRNA sequence
ctctaaataaagaattgtta

SEQ ID NO: 394167 - DNA, 20 bp, Artificial
  CRISPR gRNA sequence
tctaaataaagaattgttaa

SEQ ID NO: 394168 - DNA, 20 bp, Artificial
  CRISPR gRNA sequence
taaataaagaattgttaaca

SEQ ID NO: 394169 - DNA, 20 bp, Artificial
  CRISPR gRNA sequence
aataaagaattgttaacaat

SEQ ID NO: 394170 - DNA, 20 bp, Artificial
  CRISPR gRNA sequence
ttaacaatgaaatttccctt

SEQ ID NO: 394171 - DNA, 20 bp, Artificial
  CRISPR gRNA sequence
acaatgaaatttcccttgaa

SEQ ID NO: 394172 - DNA, 20 bp, Artificial
  CRISPR gRNA sequence
cccttgaaataatcctggaa

SEQ ID NO: 394173 - DNA, 20 bp, Artificial
  CRISPR gRNA sequence
ccttgaaataatcctggaac

SEQ ID NO: 394174 - DNA, 20 bp, Artificial
  CRISPR gRNA sequence
gaaataatcctggaactaag

SEQ ID NO: 394175 - DNA, 20 bp, Artificial
  CRISPR gRNA sequence
aaataatcctggaactaagc

SEQ ID NO: 394176 - DNA, 20 bp, Artificial
  CRISPR gRNA sequence
gaactaagctcactgctatg

SEQ ID NO: 394177 - DNA, 20 bp, Artificial
  CRISPR gRNA sequence
agctcactgctatgatctga

SEQ ID NO: 394178 - DNA, 20 bp, Artificial
  CRISPR gRNA sequence
actgctatgatctgaatgtt

SEQ ID NO: 394179 - DNA, 20 bp, Artificial
  CRISPR gRNA sequence
ctatgatctgaatgtttctc

SEQ ID NO: 394180 - DNA, 20 bp, Artificial
  CRISPR gRNA sequence
tgatctgaatgtttctcaaa

SEQ ID NO: 394181 - DNA, 20 bp, Artificial
  CRISPR gRNA sequence
aatgtttctcaaattcatat

SEQ ID NO: 394182 - DNA, 20 bp, Artificial
  CRISPR gRNA sequence
ctcaaattcatattgaaacc

SEQ ID NO: 394183 - DNA, 20 bp, Artificial
  CRISPR gRNA sequence
tcaaattcatattgaaacct

SEQ ID NO: 394184 - DNA, 20 bp, Artificial
  CRISPR gRNA sequence
aaattcatattgaaacctaa

SEQ ID NO: 394185 - DNA, 20 bp, Artificial
  CRISPR gRNA sequence
atattgaaacctaatcccca

SEQ ID NO: 394186 - DNA, 20 bp, Artificial
  CRISPR gRNA sequence
aaacctaatccccattgtgg

SEQ ID NO: 394187 - DNA, 20 bp, Artificial
  CRISPR gRNA sequence
atccccattgtggtggtatt

SEQ ID NO: 394188 - DNA, 20 bp, Artificial
  CRISPR gRNA sequence
tggtggtattaagagatggt

SEQ ID NO: 394189 - DNA, 20 bp, Artificial
  CRISPR gRNA sequence
agagatggtgcttttgggga

SEQ ID NO: 394190 - DNA, 20 bp, Artificial
  CRISPR gRNA sequence
ttggggacatcattaagtct

SEQ ID NO: 394191 - DNA, 20 bp, Artificial
  CRISPR gRNA sequence
tggggacatcattaagtctt

SEQ ID NO: 394192 - DNA, 20 bp, Artificial
  CRISPR gRNA sequence
ggggacatcattaagtcttg

SEQ ID NO: 394193 - DNA, 20 bp, Artificial
  CRISPR gRNA sequence
gggacatcattaagtcttga

SEQ ID NO: 394194 - DNA, 20 bp, Artificial
  CRISPR gRNA sequence
agtcttgagaattctgcttt

SEQ ID NO: 394195 - DNA, 20 bp, Artificial
  CRISPR gRNA sequence
gagaattctgctttcatgaa

SEQ ID NO: 394196 - DNA, 20 bp, Artificial
  CRISPR gRNA sequence
agaattctgctttcatgaat

SEQ ID NO: 394197 - DNA, 20 bp, Artificial
  CRISPR gRNA sequence
tgctttcatgaatgtgatta

SEQ ID NO: 394198 - DNA, 20 bp, Artificial
  CRISPR gRNA sequence
ctttcatgaatgtgattagt

SEQ ID NO: 394199 - DNA, 20 bp, Artificial
  CRISPR gRNA sequence
tcatgaatgtgattagtgcc

SEQ ID NO: 394200 - DNA, 20 bp, Artificial
  CRISPR gRNA sequence
catgaatgtgattagtgccc

SEQ ID NO: 394201 - DNA, 20 bp, Artificial
  CRISPR gRNA sequence
atgaatgtgattagtgccct

SEQ ID NO: 394202 - DNA, 20 bp, Artificial
  CRISPR gRNA sequence
gtgcccttcagaaagatgtt

SEQ ID NO: 394203 - DNA, 20 bp, Artificial
  CRISPR gRNA sequence
cagaaagatgttgaagggag

SEQ ID NO: 394204 - DNA, 20 bp, Artificial
  CRISPR gRNA sequence
agaaagatgttgaagggagc

SEQ ID NO: 394205 - DNA, 20 bp, Artificial
  CRISPR gRNA sequence
aagggagctgctttgcccct

SEQ ID NO: 394206 - DNA, 20 bp, Artificial
  CRISPR gRNA sequence
ctttgccccttccaccatat

SEQ ID NO: 394207 - DNA, 20 bp, Artificial
  CRISPR gRNA sequence
tgccccttccaccatatgag

SEQ ID NO: 394208 - DNA, 20 bp, Artificial
  CRISPR gRNA sequence
gccccttccaccatatgagg

SEQ ID NO: 394209 - DNA, 20 bp, Artificial
  CRISPR gRNA sequence
ccccttccaccatatgagga

SEQ ID NO: 394210 - DNA, 20 bp, Artificial
  CRISPR gRNA sequence
ccaccatatgaggacgcagc

SEQ ID NO: 394211 - DNA, 20 bp, Artificial
  CRISPR gRNA sequence
caccatatgaggacgcagca

SEQ ID NO: 394212 - DNA, 20 bp, Artificial
  CRISPR gRNA sequence
ggaagcaaagagcaacccct

SEQ ID NO: 394213 - DNA, 20 bp, Artificial
  CRISPR gRNA sequence
gaagcaaagagcaacccctc

SEQ ID NO: 394214 - DNA, 20 bp, Artificial
  CRISPR gRNA sequence
actagacagtaaatttgctc

SEQ ID NO: 394215 - DNA, 20 bp, Artificial
  CRISPR gRNA sequence
gacagtaaatttgctcgtgc

SEQ ID NO: 394216 - DNA, 20 bp, Artificial
  CRISPR gRNA sequence
gctcgtgctttggtcttgga

SEQ ID NO: 394217 - DNA, 20 bp, Artificial
  CRISPR gRNA sequence
ctcgtgctttggtcttggac

SEQ ID NO: 394218 - DNA, 20 bp, Artificial
  CRISPR gRNA sequence
gtgctttggtcttggacttc

SEQ ID NO: 394219 - DNA, 20 bp, Artificial
  CRISPR gRNA sequence
tggtcttggacttcctagcc

SEQ ID NO: 394220 - DNA, 20 bp, Artificial
  CRISPR gRNA sequence
ggtcttggacttcctagcct

SEQ ID NO: 394221 - DNA, 20 bp, Artificial
  CRISPR gRNA sequence
gtcttggacttcctagcctc

SEQ ID NO: 394222 - DNA, 20 bp, Artificial
  CRISPR gRNA sequence
ggacttcctagcctctagaa

SEQ ID NO: 394223 - DNA, 20 bp, Artificial
  CRISPR gRNA sequence
gacttcctagcctctagaac

SEQ ID NO: 394224 - DNA, 20 bp, Artificial
  CRISPR gRNA sequence
cctagcctctagaacggtga

SEQ ID NO: 394225 - DNA, 20 bp, Artificial
  CRISPR gRNA sequence
ctagcctctagaacggtgag

SEQ ID NO: 394226 - DNA, 20 bp, Artificial
  CRISPR gRNA sequence
gcctctagaacggtgagata

SEQ ID NO: 394227 - DNA, 20 bp, Artificial
  CRISPR gRNA sequence
tagaacggtgagatatacaa

SEQ ID NO: 394228 - DNA, 20 bp, Artificial
  CRISPR gRNA sequence
gaacggtgagatatacaact

SEQ ID NO: 394229 - DNA, 20 bp, Artificial
  CRISPR gRNA sequence
atttatttataaattaccca

SEQ ID NO: 394230 - DNA, 20 bp, Artificial
  CRISPR gRNA sequence
atttataaattacccatcta

SEQ ID NO: 394231 - DNA, 20 bp, Artificial
  CRISPR gRNA sequence
tttataaattacccatctaa

SEQ ID NO: 394232 - DNA, 20 bp, Artificial
  CRISPR gRNA sequence
ataaattacccatctaaggt

SEQ ID NO: 394233 - DNA, 20 bp, Artificial
  CRISPR gRNA sequence
taaattacccatctaaggta

SEQ ID NO: 394234 - DNA, 20 bp, Artificial
  CRISPR gRNA sequence
cccatctaaggtactttgtt

SEQ ID NO: 394235 - DNA, 20 bp, Artificial
  CRISPR gRNA sequence
aggtactttgttatagcagc

SEQ ID NO: 394236 - DNA, 20 bp, Artificial
  CRISPR gRNA sequence
tgttatagcagcctgaacag

SEQ ID NO: 394237 - DNA, 20 bp, Artificial
  CRISPR gRNA sequence
gttatagcagcctgaacaga

SEQ ID NO: 394238 - DNA, 20 bp, Artificial
  CRISPR gRNA sequence
ttatagcagcctgaacagac

SEQ ID NO: 394239 - DNA, 20 bp, Artificial
  CRISPR gRNA sequence
tagcagcctgaacagactaa

SEQ ID NO: 394240 - DNA, 20 bp, Artificial
  CRISPR gRNA sequence
aacagactaagacactacac

SEQ ID NO: 394241 - DNA, 20 bp, Artificial
  CRISPR gRNA sequence
agacactacacacacacaca

SEQ ID NO: 394242 - DNA, 20 bp, Artificial
  CRISPR gRNA sequence
cacacacacacacacacaca

SEQ ID NO: 394243 - DNA, 20 bp, Artificial
  CRISPR gRNA sequence
agcccttttaaaatgtacag

SEQ ID NO: 394244 - DNA, 20 bp, Artificial
  CRISPR gRNA sequence
gcccttttaaaatgtacagt

SEQ ID NO: 394245 - DNA, 20 bp, Artificial
  CRISPR gRNA sequence
ttaaaatgtacagttcagta

SEQ ID NO: 394246 - DNA, 20 bp, Artificial
  CRISPR gRNA sequence
taaaatgtacagttcagtag

SEQ ID NO: 394247 - DNA, 20 bp, Artificial
  CRISPR gRNA sequence
aaaatgtacagttcagtagc

SEQ ID NO: 394248 - DNA, 20 bp, Artificial
  CRISPR gRNA sequence
aaatgtacagttcagtagca

SEQ ID NO: 394249 - DNA, 20 bp, Artificial
  CRISPR gRNA sequence
agtagcattaagtatattca

SEQ ID NO: 394250 - DNA, 20 bp, Artificial
  CRISPR gRNA sequence
agtatattcacattgttgta

SEQ ID NO: 394251 - DNA, 20 bp, Artificial
  CRISPR gRNA sequence
acattgttgtatacccaatt

SEQ ID NO: 394252 - DNA, 20 bp, Artificial
  CRISPR gRNA sequence
ttgtatacccaattttcaga

SEQ ID NO: 394253 - DNA, 20 bp, Artificial
  CRISPR gRNA sequence
tatacccaattttcagaact

SEQ ID NO: 394254 - DNA, 20 bp, Artificial
  CRISPR gRNA sequence
tcagaactctttttatctca

SEQ ID NO: 394255 - DNA, 20 bp, Artificial
  CRISPR gRNA sequence
cagaactctttttatctcac

SEQ ID NO: 394256 - DNA, 20 bp, Artificial
  CRISPR gRNA sequence
agaactctttttatctcaca

SEQ ID NO: 394257 - DNA, 20 bp, Artificial
  CRISPR gRNA sequence
tttttatctcacagaatcga

SEQ ID NO: 394258 - DNA, 20 bp, Artificial
  CRISPR gRNA sequence
tttatctcacagaatcgaaa

SEQ ID NO: 394259 - DNA, 20 bp, Artificial
  CRISPR gRNA sequence
ttatctcacagaatcgaaat

SEQ ID NO: 394260 - DNA, 20 bp, Artificial
  CRISPR gRNA sequence
tatctcacagaatcgaaatc

SEQ ID NO: 394261 - DNA, 20 bp, Artificial
  CRISPR gRNA sequence
atctcacagaatcgaaatcc

SEQ ID NO: 394262 - DNA, 20 bp, Artificial
  CRISPR gRNA sequence
tctcacagaatcgaaatcct

SEQ ID NO: 394263 - DNA, 20 bp, Artificial
  CRISPR gRNA sequence
acagaatcgaaatcctaccc

SEQ ID NO: 394264 - DNA, 20 bp, Artificial
  CRISPR gRNA sequence
cccattaaacaactccctgt

SEQ ID NO: 394265 - DNA, 20 bp, Artificial
  CRISPR gRNA sequence
aacaactccctgttctccca

SEQ ID NO: 394266 - DNA, 20 bp, Artificial
  CRISPR gRNA sequence
cctgttctcccatcccccac

SEQ ID NO: 394267 - DNA, 20 bp, Artificial
  CRISPR gRNA sequence
ttctcccatcccccaccccc

SEQ ID NO: 394268 - DNA, 20 bp, Artificial
  CRISPR gRNA sequence
tcccatcccccacccccgac

SEQ ID NO: 394269 - DNA, 20 bp, Artificial
  CRISPR gRNA sequence
ccatcccccacccccgacaa

SEQ ID NO: 394270 - DNA, 20 bp, Artificial
  CRISPR gRNA sequence
ccattccactttctgaatca

SEQ ID NO: 394271 - DNA, 20 bp, Artificial
  CRISPR gRNA sequence
cactttctgaatcaatgaat

SEQ ID NO: 394272 - DNA, 20 bp, Artificial
  CRISPR gRNA sequence
tctgaatcaatgaatttgac

SEQ ID NO: 394273 - DNA, 20 bp, Artificial
  CRISPR gRNA sequence
ctgaatcaatgaatttgact

SEQ ID NO: 394274 - DNA, 20 bp, Artificial
  CRISPR gRNA sequence
tgaatcaatgaatttgactc

SEQ ID NO: 394275 - DNA, 20 bp, Artificial
  CRISPR gRNA sequence
aatcaatgaatttgactcct

SEQ ID NO: 394276 - DNA, 20 bp, Artificial
  CRISPR gRNA sequence
gactcctctgtgtacctcat

SEQ ID NO: 394277 - DNA, 20 bp, Artificial
  CRISPR gRNA sequence
actcctctgtgtacctcata

SEQ ID NO: 394278 - DNA, 20 bp, Artificial
  CRISPR gRNA sequence
ctctgtgtacctcatataag

SEQ ID NO: 394279 - DNA, 20 bp, Artificial
  CRISPR gRNA sequence
tgtgtacctcatataagtgg

SEQ ID NO: 394280 - DNA, 20 bp, Artificial
  CRISPR gRNA sequence
tgtacctcatataagtggaa

SEQ ID NO: 394281 - DNA, 20 bp, Artificial
  CRISPR gRNA sequence
atataagtggaatcacaaag

SEQ ID NO: 394282 - DNA, 20 bp, Artificial
  CRISPR gRNA sequence
gttgtcttgtgactggcttt

SEQ ID NO: 394283 - DNA, 20 bp, Artificial
  CRISPR gRNA sequence
ttgtcttgtgactggctttg

SEQ ID NO: 394284 - DNA, 20 bp, Artificial
  CRISPR gRNA sequence
tcttgtgactggctttgttc

SEQ ID NO: 394285 - DNA, 20 bp, Artificial
  CRISPR gRNA sequence
gtgactggctttgttcattt

SEQ ID NO: 394286 - DNA, 20 bp, Artificial
  CRISPR gRNA sequence
tgactggctttgttcatttg

SEQ ID NO: 394287 - DNA, 20 bp, Artificial
  CRISPR gRNA sequence
gctttgttcatttggaataa

SEQ ID NO: 394288 - DNA, 20 bp, Artificial
  CRISPR gRNA sequence
tgttcatttggaataatgtc

SEQ ID NO: 394289 - DNA, 20 bp, Artificial
  CRISPR gRNA sequence
gttcatttggaataatgtcc

SEQ ID NO: 394290 - DNA, 20 bp, Artificial
  CRISPR gRNA sequence
ttcatttggaataatgtccc

SEQ ID NO: 394291 - DNA, 20 bp, Artificial
  CRISPR gRNA sequence
atttggaataatgtccccag

SEQ ID NO: 394292 - DNA, 20 bp, Artificial
  CRISPR gRNA sequence
ggaataatgtccccagggtt

SEQ ID NO: 394293 - DNA, 20 bp, Artificial
  CRISPR gRNA sequence
gaataatgtccccagggttc

SEQ ID NO: 394294 - DNA, 20 bp, Artificial
  CRISPR gRNA sequence
acccatgttgcagcatgtgt

SEQ ID NO: 394295 - DNA, 20 bp, Artificial
  CRISPR gRNA sequence
cagcatgtgttcaaatagtc

SEQ ID NO: 394296 - DNA, 20 bp, Artificial
  CRISPR gRNA sequence
aaatagtcctcatttttaag

SEQ ID NO: 394297 - DNA, 20 bp, Artificial
  CRISPR gRNA sequence
atttttaagaatgaagaata

SEQ ID NO: 394298 - DNA, 20 bp, Artificial
  CRISPR gRNA sequence
ttaagaatgaagaatattcc

SEQ ID NO: 394299 - DNA, 20 bp, Artificial
  CRISPR gRNA sequence
taagaatgaagaatattcca

SEQ ID NO: 394300 - DNA, 20 bp, Artificial
  CRISPR gRNA sequence
aagaatgaagaatattccat

SEQ ID NO: 394301 - DNA, 20 bp, Artificial
  CRISPR gRNA sequence
agaatgaagaatattccatt

SEQ ID NO: 394302 - DNA, 20 bp, Artificial
  CRISPR gRNA sequence
cattgtatatattctacatg

SEQ ID NO: 394303 - DNA, 20 bp, Artificial
  CRISPR gRNA sequence
tatatattctacatgttaca

SEQ ID NO: 394304 - DNA, 20 bp, Artificial
  CRISPR gRNA sequence
tacatgttacatacatttta

SEQ ID NO: 394305 - DNA, 20 bp, Artificial
  CRISPR gRNA sequence
catgttacatacattttata

SEQ ID NO: 394306 - DNA, 20 bp, Artificial
  CRISPR gRNA sequence
catacattttatatacatat

SEQ ID NO: 394307 - DNA, 20 bp, Artificial
  CRISPR gRNA sequence
tatatacatatacgcataat

SEQ ID NO: 394308 - DNA, 20 bp, Artificial
  CRISPR gRNA sequence
atatacatatacgcataata

SEQ ID NO: 394309 - DNA, 20 bp, Artificial
  CRISPR gRNA sequence
tatacatatacgcataatag

SEQ ID NO: 394310 - DNA, 20 bp, Artificial
  CRISPR gRNA sequence
tagatattctgcattttgtc

SEQ ID NO: 394311 - DNA, 20 bp, Artificial
  CRISPR gRNA sequence
tgcattttgtccatttattc

SEQ ID NO: 394312 - DNA, 20 bp, Artificial
  CRISPR gRNA sequence
cattttgtccatttattcct

SEQ ID NO: 394313 - DNA, 20 bp, Artificial
  CRISPR gRNA sequence
tgtccatttattcctccgta

SEQ ID NO: 394314 - DNA, 20 bp, Artificial
  CRISPR gRNA sequence
gtccatttattcctccgtag

SEQ ID NO: 394315 - DNA, 20 bp, Artificial
  CRISPR gRNA sequence
tccatttattcctccgtaga

SEQ ID NO: 394316 - DNA, 20 bp, Artificial
  CRISPR gRNA sequence
attcctccgtagacacttag

SEQ ID NO: 394317 - DNA, 20 bp, Artificial
  CRISPR gRNA sequence
ttcctccgtagacacttagg

SEQ ID NO: 394318 - DNA, 20 bp, Artificial
  CRISPR gRNA sequence
ctccgtagacacttaggttg

SEQ ID NO: 394319 - DNA, 20 bp, Artificial
  CRISPR gRNA sequence
cgtagacacttaggttgctt

SEQ ID NO: 394320 - DNA, 20 bp, Artificial
  CRISPR gRNA sequence
aggttgcttcttctttttag

SEQ ID NO: 394321 - DNA, 20 bp, Artificial
  CRISPR gRNA sequence
ggttgcttcttctttttagc

SEQ ID NO: 394322 - DNA, 20 bp, Artificial
  CRISPR gRNA sequence
cttcttctttttagctgttg

SEQ ID NO: 394323 - DNA, 20 bp, Artificial
  CRISPR gRNA sequence
cttctttttagctgttgtga

SEQ ID NO: 394324 - DNA, 20 bp, Artificial
  CRISPR gRNA sequence
ttctttttagctgttgtgaa

SEQ ID NO: 394325 - DNA, 20 bp, Artificial
  CRISPR gRNA sequence
ctttttagctgttgtgaata

SEQ ID NO: 394326 - DNA, 20 bp, Artificial
  CRISPR gRNA sequence
tttttagctgttgtgaataa

SEQ ID NO: 394327 - DNA, 20 bp, Artificial
  CRISPR gRNA sequence
tttagctgttgtgaataatg

SEQ ID NO: 394328 - DNA, 20 bp, Artificial
  CRISPR gRNA sequence
ttagctgttgtgaataatgc

SEQ ID NO: 394329 - DNA, 20 bp, Artificial
  CRISPR gRNA sequence
tagctgttgtgaataatgct

SEQ ID NO: 394330 - DNA, 20 bp, Artificial
  CRISPR gRNA sequence
agctgttgtgaataatgctg

SEQ ID NO: 394331 - DNA, 20 bp, Artificial
  CRISPR gRNA sequence
gctgttgtgaataatgctgt

SEQ ID NO: 394332 - DNA, 20 bp, Artificial
  CRISPR gRNA sequence
ttgtgaataatgctgttatg

SEQ ID NO: 394333 - DNA, 20 bp, Artificial
  CRISPR gRNA sequence
tgaataatgctgttatgaac

SEQ ID NO: 394334 - DNA, 20 bp, Artificial
  CRISPR gRNA sequence
ttatgaacatgagtgtacta

SEQ ID NO: 394335 - DNA, 20 bp, Artificial
  CRISPR gRNA sequence
tgaacatgagtgtactaagt

SEQ ID NO: 394336 - DNA, 20 bp, Artificial
  CRISPR gRNA sequence
agttcacataatatgtttac

SEQ ID NO: 394337 - DNA, 20 bp, Artificial
  CRISPR gRNA sequence
acataatatgtttacaaata

SEQ ID NO: 394338 - DNA, 20 bp, Artificial
  CRISPR gRNA sequence
acaaataatgtgctaataaa

SEQ ID NO: 394339 - DNA, 20 bp, Artificial
  CRISPR gRNA sequence
caaataatgtgctaataaat

SEQ ID NO: 394340 - DNA, 20 bp, Artificial
  CRISPR gRNA sequence
ataaatatccctatcaaaaa

SEQ ID NO: 394341 - DNA, 20 bp, Artificial
  CRISPR gRNA sequence
tcaaaaacttgcaaatgaca

SEQ ID NO: 394342 - DNA, 20 bp, Artificial
  CRISPR gRNA sequence
gcaaatgacactaaaccact

SEQ ID NO: 394343 - DNA, 20 bp, Artificial
  CRISPR gRNA sequence
caaatgacactaaaccactc

SEQ ID NO: 394344 - DNA, 20 bp, Artificial
  CRISPR gRNA sequence
aaccactctgagtggtaaaa

SEQ ID NO: 394345 - DNA, 20 bp, Artificial
  CRISPR gRNA sequence
tgagtggtaaaataacaaac

SEQ ID NO: 394346 - DNA, 20 bp, Artificial
  CRISPR gRNA sequence
agtggtaaaataacaaacta

SEQ ID NO: 394347 - DNA, 20 bp, Artificial
  CRISPR gRNA sequence
gtgggtgaaatactgaagaa

SEQ ID NO: 394348 - DNA, 20 bp, Artificial
  CRISPR gRNA sequence
aagaatctcattaagctatg

SEQ ID NO: 394349 - DNA, 20 bp, Artificial
  CRISPR gRNA sequence
attaagctatgaaatatgca

SEQ ID NO: 394350 - DNA, 20 bp, Artificial
  CRISPR gRNA sequence
agctatgaaatatgcagaaa

SEQ ID NO: 394351 - DNA, 20 bp, Artificial
  CRISPR gRNA sequence
tgaaatatgcagaaaagcgg

SEQ ID NO: 394352 - DNA, 20 bp, Artificial
  CRISPR gRNA sequence
caaaccatttagaaagacaa

SEQ ID NO: 394353 - DNA, 20 bp, Artificial
  CRISPR gRNA sequence
aaaccatttagaaagacaaa

SEQ ID NO: 394354 - DNA, 20 bp, Artificial
  CRISPR gRNA sequence
agaaagacaaattcatatcc

SEQ ID NO: 394355 - DNA, 20 bp, Artificial
  CRISPR gRNA sequence
gaaagacaaattcatatcca

SEQ ID NO: 394356 - DNA, 20 bp, Artificial
  CRISPR gRNA sequence
atatccaaatacacttcaaa

SEQ ID NO: 394357 - DNA, 20 bp, Artificial
  CRISPR gRNA sequence
caaaccatgtttcacatatg

SEQ ID NO: 394358 - DNA, 20 bp, Artificial
  CRISPR gRNA sequence
aaaccatgtttcacatatga

SEQ ID NO: 394359 - DNA, 20 bp, Artificial
  CRISPR gRNA sequence
cacatatgatgagctataaa

SEQ ID NO: 394360 - DNA, 20 bp, Artificial
  CRISPR gRNA sequence
acatatgatgagctataaac

SEQ ID NO: 394361 - DNA, 20 bp, Artificial
  CRISPR gRNA sequence
taaacctttgttcccaccca

SEQ ID NO: 394362 - DNA, 20 bp, Artificial
  CRISPR gRNA sequence
tgttcccacccaggggaata

SEQ ID NO: 394363 - DNA, 20 bp, Artificial
  CRISPR gRNA sequence
gttcccacccaggggaatac

SEQ ID NO: 394364 - DNA, 20 bp, Artificial
  CRISPR gRNA sequence
ttcccacccaggggaatact

SEQ ID NO: 394365 - DNA, 20 bp, Artificial
  CRISPR gRNA sequence
ccacccaggggaatactttt

SEQ ID NO: 394366 - DNA, 20 bp, Artificial
  CRISPR gRNA sequence
ttcacttactcgaaagtact

SEQ ID NO: 394367 - DNA, 20 bp, Artificial
  CRISPR gRNA sequence
tcacttactcgaaagtactc

SEQ ID NO: 394368 - DNA, 20 bp, Artificial
  CRISPR gRNA sequence
cacttactcgaaagtactca

SEQ ID NO: 394369 - DNA, 20 bp, Artificial
  CRISPR gRNA sequence
acttactcgaaagtactcat

SEQ ID NO: 394370 - DNA, 20 bp, Artificial
  CRISPR gRNA sequence
actcgaaagtactcataggc

SEQ ID NO: 394371 - DNA, 20 bp, Artificial
  CRISPR gRNA sequence
ctcgaaagtactcataggca

SEQ ID NO: 394372 - DNA, 20 bp, Artificial
  CRISPR gRNA sequence
gaaagtactcataggcagct

SEQ ID NO: 394373 - DNA, 20 bp, Artificial
  CRISPR gRNA sequence
ataggcagctgttctattct

SEQ ID NO: 394374 - DNA, 20 bp, Artificial
  CRISPR gRNA sequence
ttctattctacttaattaca

SEQ ID NO: 394375 - DNA, 20 bp, Artificial
  CRISPR gRNA sequence
tattctacttaattacatat

SEQ ID NO: 394376 - DNA, 20 bp, Artificial
  CRISPR gRNA sequence
ttctacttaattacatatgg

SEQ ID NO: 394377 - DNA, 20 bp, Artificial
  CRISPR gRNA sequence
tacttaattacatatggaat

SEQ ID NO: 394378 - DNA, 20 bp, Artificial
  CRISPR gRNA sequence
cttaattacatatggaattc

SEQ ID NO: 394379 - DNA, 20 bp, Artificial
  CRISPR gRNA sequence
aattacatatggaattcata

SEQ ID NO: 394380 - DNA, 20 bp, Artificial
  CRISPR gRNA sequence
attacatatggaattcatac

SEQ ID NO: 394381 - DNA, 20 bp, Artificial
  CRISPR gRNA sequence
catatggaattcatacgttt

SEQ ID NO: 394382 - DNA, 20 bp, Artificial
  CRISPR gRNA sequence
atacgtttcctatgtacaga

SEQ ID NO: 394383 - DNA, 20 bp, Artificial
  CRISPR gRNA sequence
cctatgtacagatcagcaat

SEQ ID NO: 394384 - DNA, 20 bp, Artificial
  CRISPR gRNA sequence
ctatgtacagatcagcaatt

SEQ ID NO: 394385 - DNA, 20 bp, Artificial
  CRISPR gRNA sequence
tgtacagatcagcaattggt

SEQ ID NO: 394386 - DNA, 20 bp, Artificial
  CRISPR gRNA sequence
gtgctgatcattttctatca

SEQ ID NO: 394387 - DNA, 20 bp, Artificial
  CRISPR gRNA sequence
atcattttctatcactcccc

SEQ ID NO: 394388 - DNA, 20 bp, Artificial
  CRISPR gRNA sequence
tctatcactccccctacttc

SEQ ID NO: 394389 - DNA, 20 bp, Artificial
  CRISPR gRNA sequence
ctatcactccccctacttca

SEQ ID NO: 394390 - DNA, 20 bp, Artificial
  CRISPR gRNA sequence
tatcactccccctacttcac

SEQ ID NO: 394391 - DNA, 20 bp, Artificial
  CRISPR gRNA sequence
tcactccccctacttcaccc

SEQ ID NO: 394392 - DNA, 20 bp, Artificial
  CRISPR gRNA sequence
cccctacttcaccccaactc

SEQ ID NO: 394393 - DNA, 20 bp, Artificial
  CRISPR gRNA sequence
cttcaccccaactcttttgc

SEQ ID NO: 394394 - DNA, 20 bp, Artificial
  CRISPR gRNA sequence
caccccaactcttttgctgt

SEQ ID NO: 394395 - DNA, 20 bp, Artificial
  CRISPR gRNA sequence
accccaactcttttgctgtt

SEQ ID NO: 394396 - DNA, 20 bp, Artificial
  CRISPR gRNA sequence
ttttgctgttttattgagca

SEQ ID NO: 394397 - DNA, 20 bp, Artificial
  CRISPR gRNA sequence
ttgctgttttattgagcatg

SEQ ID NO: 394398 - DNA, 20 bp, Artificial
  CRISPR gRNA sequence
tgctgttttattgagcatgt

SEQ ID NO: 394399 - DNA, 20 bp, Artificial
  CRISPR gRNA sequence
gctgttttattgagcatgtc

SEQ ID NO: 394400 - DNA, 20 bp, Artificial
  CRISPR gRNA sequence
ctgttttattgagcatgtct

SEQ ID NO: 394401 - DNA, 20 bp, Artificial
  CRISPR gRNA sequence
ttttattgagcatgtctcct

SEQ ID NO: 394402 - DNA, 20 bp, Artificial
  CRISPR gRNA sequence
tattgagcatgtctcctaag

SEQ ID NO: 394403 - DNA, 20 bp, Artificial
  CRISPR gRNA sequence
attgagcatgtctcctaagg

SEQ ID NO: 394404 - DNA, 20 bp, Artificial
  CRISPR gRNA sequence
ttgagcatgtctcctaaggg

SEQ ID NO: 394405 - DNA, 20 bp, Artificial
  CRISPR gRNA sequence
agcatgtctcctaagggcaa

SEQ ID NO: 394406 - DNA, 20 bp, Artificial
  CRISPR gRNA sequence
ctaagggcaaagctctgttc

SEQ ID NO: 394407 - DNA, 20 bp, Artificial
  CRISPR gRNA sequence
agggcaaagctctgttccca

SEQ ID NO: 394408 - DNA, 20 bp, Artificial
  CRISPR gRNA sequence
tgttcccaacattattggga

SEQ ID NO: 394409 - DNA, 20 bp, Artificial
  CRISPR gRNA sequence
ttcccaacattattgggatc

SEQ ID NO: 394410 - DNA, 20 bp, Artificial
  CRISPR gRNA sequence
ccaacattattgggatcatg

SEQ ID NO: 394411 - DNA, 20 bp, Artificial
  CRISPR gRNA sequence
ttgggatcatgaagagggaa

SEQ ID NO: 394412 - DNA, 20 bp, Artificial
  CRISPR gRNA sequence
ggatcatgaagagggaaatg

SEQ ID NO: 394413 - DNA, 20 bp, Artificial
  CRISPR gRNA sequence
ccctcattcaggacaggagg

SEQ ID NO: 394414 - DNA, 20 bp, Artificial
  CRISPR gRNA sequence
attcaggacaggaggcggtg

SEQ ID NO: 394415 - DNA, 20 bp, Artificial
  CRISPR gRNA sequence
aggacaggaggcggtgaggg

SEQ ID NO: 394416 - DNA, 20 bp, Artificial
  CRISPR gRNA sequence
gatggaatgcaaggaaaata

SEQ ID NO: 394417 - DNA, 20 bp, Artificial
  CRISPR gRNA sequence
aatgaaaaggtggccacaaa

SEQ ID NO: 394418 - DNA, 20 bp, Artificial
  CRISPR gRNA sequence
ctgttttaggggtgggacaa

SEQ ID NO: 394419 - DNA, 20 bp, Artificial
  CRISPR gRNA sequence
ttttaggggtgggacaatgt

SEQ ID NO: 394420 - DNA, 20 bp, Artificial
  CRISPR gRNA sequence
taggggtgggacaatgtttc

SEQ ID NO: 394421 - DNA, 20 bp, Artificial
  CRISPR gRNA sequence
aggggtgggacaatgtttcc

SEQ ID NO: 394422 - DNA, 20 bp, Artificial
  CRISPR gRNA sequence
ggggtgggacaatgtttcct

SEQ ID NO: 394423 - DNA, 20 bp, Artificial
  CRISPR gRNA sequence
ccttagctgaagaatgagta

SEQ ID NO: 394424 - DNA, 20 bp, Artificial
  CRISPR gRNA sequence
cttagctgaagaatgagtac

SEQ ID NO: 394425 - DNA, 20 bp, Artificial
  CRISPR gRNA sequence
agctgaagaatgagtacagg

SEQ ID NO: 394426 - DNA, 20 bp, Artificial
  CRISPR gRNA sequence
gctgaagaatgagtacaggt

SEQ ID NO: 394427 - DNA, 20 bp, Artificial
  CRISPR gRNA sequence
aagaatgagtacaggttgag

SEQ ID NO: 394428 - DNA, 20 bp, Artificial
  CRISPR gRNA sequence
agtatcccttatccaaaata

SEQ ID NO: 394429 - DNA, 20 bp, Artificial
  CRISPR gRNA sequence
atccaaaatacttgggaaca

SEQ ID NO: 394430 - DNA, 20 bp, Artificial
  CRISPR gRNA sequence
tccaaaatacttgggaacat

SEQ ID NO: 394431 - DNA, 20 bp, Artificial
  CRISPR gRNA sequence
gggaacataagtgtttcaga

SEQ ID NO: 394432 - DNA, 20 bp, Artificial
  CRISPR gRNA sequence
ggaacataagtgtttcagat

SEQ ID NO: 394433 - DNA, 20 bp, Artificial
  CRISPR gRNA sequence
cagatttgggattcttttgg

SEQ ID NO: 394434 - DNA, 20 bp, Artificial
  CRISPR gRNA sequence
agatttgggattcttttgga

SEQ ID NO: 394435 - DNA, 20 bp, Artificial
  CRISPR gRNA sequence
gggattcttttggattttgg

SEQ ID NO: 394436 - DNA, 20 bp, Artificial
  CRISPR gRNA sequence
ggattcttttggattttgga

SEQ ID NO: 394437 - DNA, 20 bp, Artificial
  CRISPR gRNA sequence
ttttggattttggaatattt

SEQ ID NO: 394438 - DNA, 20 bp, Artificial
  CRISPR gRNA sequence
ttggattttggaatatttac

SEQ ID NO: 394439 - DNA, 20 bp, Artificial
  CRISPR gRNA sequence
tggattttggaatatttaca

SEQ ID NO: 394440 - DNA, 20 bp, Artificial
  CRISPR gRNA sequence
ggattttggaatatttacat

SEQ ID NO: 394441 - DNA, 20 bp, Artificial
  CRISPR gRNA sequence
gattttggaatatttacatc

SEQ ID NO: 394442 - DNA, 20 bp, Artificial
  CRISPR gRNA sequence
tggaatatttacatcatacc

SEQ ID NO: 394443 - DNA, 20 bp, Artificial
  CRISPR gRNA sequence
ggaatatttacatcatacca

SEQ ID NO: 394444 - DNA, 20 bp, Artificial
  CRISPR gRNA sequence
gaatatttacatcataccag

SEQ ID NO: 394445 - DNA, 20 bp, Artificial
  CRISPR gRNA sequence
acatcataccagctgaacat

SEQ ID NO: 394446 - DNA, 20 bp, Artificial
  CRISPR gRNA sequence
catcataccagctgaacatc

SEQ ID NO: 394447 - DNA, 20 bp, Artificial
  CRISPR gRNA sequence
aacatcccaaatccaaaaat

SEQ ID NO: 394448 - DNA, 20 bp, Artificial
  CRISPR gRNA sequence
aaatctaaaatgctccaatg

SEQ ID NO: 394449 - DNA, 20 bp, Artificial
  CRISPR gRNA sequence
aaatgctccaatgagcattt

SEQ ID NO: 394450 - DNA, 20 bp, Artificial
  CRISPR gRNA sequence
caatgagcatttcctttgag

SEQ ID NO: 394451 - DNA, 20 bp, Artificial
  CRISPR gRNA sequence
cctttgagcatcatgttggc

SEQ ID NO: 394452 - DNA, 20 bp, Artificial
  CRISPR gRNA sequence
ctttgagcatcatgttggca

SEQ ID NO: 394453 - DNA, 20 bp, Artificial
  CRISPR gRNA sequence
tgagcatcatgttggcattc

SEQ ID NO: 394454 - DNA, 20 bp, Artificial
  CRISPR gRNA sequence
gagcatcatgttggcattca

SEQ ID NO: 394455 - DNA, 20 bp, Artificial
  CRISPR gRNA sequence
agcatcatgttggcattcaa

SEQ ID NO: 394456 - DNA, 20 bp, Artificial
  CRISPR gRNA sequence
gcattcaaagagttttggat

SEQ ID NO: 394457 - DNA, 20 bp, Artificial
  CRISPR gRNA sequence
aaagagttttggattttgga

SEQ ID NO: 394458 - DNA, 20 bp, Artificial
  CRISPR gRNA sequence
tggattttggagcatttcag

SEQ ID NO: 394459 - DNA, 20 bp, Artificial
  CRISPR gRNA sequence
ggattttggagcatttcaga

SEQ ID NO: 394460 - DNA, 20 bp, Artificial
  CRISPR gRNA sequence
gattttggagcatttcagat

SEQ ID NO: 394461 - DNA, 20 bp, Artificial
  CRISPR gRNA sequence
tggagcatttcagatttcag

SEQ ID NO: 394462 - DNA, 20 bp, Artificial
  CRISPR gRNA sequence
ggagcatttcagatttcaga

SEQ ID NO: 394463 - DNA, 20 bp, Artificial
  CRISPR gRNA sequence
gagcatttcagatttcagat

SEQ ID NO: 394464 - DNA, 20 bp, Artificial
  CRISPR gRNA sequence
cagatttcagattttttgat

SEQ ID NO: 394465 - DNA, 20 bp, Artificial
  CRISPR gRNA sequence
agatttcagattttttgatt

SEQ ID NO: 394466 - DNA, 20 bp, Artificial
  CRISPR gRNA sequence
cagattttttgatttgggat

SEQ ID NO: 394467 - DNA, 20 bp, Artificial
  CRISPR gRNA sequence
agattttttgatttgggata

SEQ ID NO: 394468 - DNA, 20 bp, Artificial
  CRISPR gRNA sequence
tttgatttgggatattcagt

SEQ ID NO: 394469 - DNA, 20 bp, Artificial
  CRISPR gRNA sequence
ttgatttgggatattcagtc

SEQ ID NO: 394470 - DNA, 20 bp, Artificial
  CRISPR gRNA sequence
tgatttgggatattcagtct

SEQ ID NO: 394471 - DNA, 20 bp, Artificial
  CRISPR gRNA sequence
gatttgggatattcagtctg

SEQ ID NO: 394472 - DNA, 20 bp, Artificial
  CRISPR gRNA sequence
atttgggatattcagtctgt

SEQ ID NO: 394473 - DNA, 20 bp, Artificial
  CRISPR gRNA sequence
gggatattcagtctgtagta

SEQ ID NO: 394474 - DNA, 20 bp, Artificial
  CRISPR gRNA sequence
ggatattcagtctgtagtac

SEQ ID NO: 394475 - DNA, 20 bp, Artificial
  CRISPR gRNA sequence
agtctgtagtacacagagtg

SEQ ID NO: 394476 - DNA, 20 bp, Artificial
  CRISPR gRNA sequence
tagtacacagagtgaaagag

SEQ ID NO: 394477 - DNA, 20 bp, Artificial
  CRISPR gRNA sequence
caattcagaaatgcagagga

SEQ ID NO: 394478 - DNA, 20 bp, Artificial
  CRISPR gRNA sequence
agaaatgcagaggatgccta

SEQ ID NO: 394479 - DNA, 20 bp, Artificial
  CRISPR gRNA sequence
gggaatttgcacttaaccat

SEQ ID NO: 394480 - DNA, 20 bp, Artificial
  CRISPR gRNA sequence
gcacttaaccatgtttggct

SEQ ID NO: 394481 - DNA, 20 bp, Artificial
  CRISPR gRNA sequence
cacttaaccatgtttggctg

SEQ ID NO: 394482 - DNA, 20 bp, Artificial
  CRISPR gRNA sequence
aaccatgtttggctgaaaaa

SEQ ID NO: 394483 - DNA, 20 bp, Artificial
  CRISPR gRNA sequence
accatgtttggctgaaaaaa

SEQ ID NO: 394484 - DNA, 20 bp, Artificial
  CRISPR gRNA sequence
ggctgaaaaaaaggaatgca

SEQ ID NO: 394485 - DNA, 20 bp, Artificial
  CRISPR gRNA sequence
gctgaaaaaaaggaatgcaa

SEQ ID NO: 394486 - DNA, 20 bp, Artificial
  CRISPR gRNA sequence
aaaaaaaggaatgcaaagtg

SEQ ID NO: 394487 - DNA, 20 bp, Artificial
  CRISPR gRNA sequence
tggaaggtatgcagggacca

SEQ ID NO: 394488 - DNA, 20 bp, Artificial
  CRISPR gRNA sequence
ggaaggtatgcagggaccaa

SEQ ID NO: 394489 - DNA, 20 bp, Artificial
  CRISPR gRNA sequence
gaaggtatgcagggaccaag

SEQ ID NO: 394490 - DNA, 20 bp, Artificial
  CRISPR gRNA sequence
agaagaccttgaacagcact

SEQ ID NO: 394491 - DNA, 20 bp, Artificial
  CRISPR gRNA sequence
gaagaccttgaacagcactt

SEQ ID NO: 394492 - DNA, 20 bp, Artificial
  CRISPR gRNA sequence
gaacagcacttgtaagaatc

SEQ ID NO: 394493 - DNA, 20 bp, Artificial
  CRISPR gRNA sequence
aacagcacttgtaagaatca

SEQ ID NO: 394494 - DNA, 20 bp, Artificial
  CRISPR gRNA sequence
gtaagaatcaagattaacca

SEQ ID NO: 394495 - DNA, 20 bp, Artificial
  CRISPR gRNA sequence
taagaatcaagattaaccac

SEQ ID NO: 394496 - DNA, 20 bp, Artificial
  CRISPR gRNA sequence
accacgtaggtgagggctcc

SEQ ID NO: 394497 - DNA, 20 bp, Artificial
  CRISPR gRNA sequence
caaagacaaattcccagagg

SEQ ID NO: 394498 - DNA, 20 bp, Artificial
  CRISPR gRNA sequence
ccagagggtccaggaagatc

SEQ ID NO: 394499 - DNA, 20 bp, Artificial
  CRISPR gRNA sequence
caatagggaagagtggggat

SEQ ID NO: 394500 - DNA, 20 bp, Artificial
  CRISPR gRNA sequence
tgggtgactcaggaatatat

SEQ ID NO: 394501 - DNA, 20 bp, Artificial
  CRISPR gRNA sequence
aggaatatattatttacaaa

SEQ ID NO: 394502 - DNA, 20 bp, Artificial
  CRISPR gRNA sequence
tttacaaaaaggttgctgct

SEQ ID NO: 394503 - DNA, 20 bp, Artificial
  CRISPR gRNA sequence
acaaaaaggttgctgctacc

SEQ ID NO: 394504 - DNA, 20 bp, Artificial
  CRISPR gRNA sequence
caaaaaggttgctgctaccc

SEQ ID NO: 394505 - DNA, 20 bp, Artificial
  CRISPR gRNA sequence
ctgctacccagcctagaaaa

SEQ ID NO: 394506 - DNA, 20 bp, Artificial
  CRISPR gRNA sequence
ctacccagcctagaaaatgc

SEQ ID NO: 394507 - DNA, 20 bp, Artificial
  CRISPR gRNA sequence
cccagcctagaaaatgctgc

SEQ ID NO: 394508 - DNA, 20 bp, Artificial
  CRISPR gRNA sequence
gaaaatgctgccaagcagaa

SEQ ID NO: 394509 - DNA, 20 bp, Artificial
  CRISPR gRNA sequence
ccaagcagaaaacttatggc

SEQ ID NO: 394510 - DNA, 20 bp, Artificial
  CRISPR gRNA sequence
atggcagtattaatagtcca

SEQ ID NO: 394511 - DNA, 20 bp, Artificial
  CRISPR gRNA sequence
tggcagtattaatagtccat

SEQ ID NO: 394512 - DNA, 20 bp, Artificial
  CRISPR gRNA sequence
atagtccatccagatgtgca

SEQ ID NO: 394513 - DNA, 20 bp, Artificial
  CRISPR gRNA sequence
ctgatcttccaaaaatgtgt

SEQ ID NO: 394514 - DNA, 20 bp, Artificial
  CRISPR gRNA sequence
tgatcttccaaaaatgtgtt

SEQ ID NO: 394515 - DNA, 20 bp, Artificial
  CRISPR gRNA sequence
atcttccaaaaatgtgttgg

SEQ ID NO: 394516 - DNA, 20 bp, Artificial
  CRISPR gRNA sequence
ccaaaaatgtgttggtcaaa

SEQ ID NO: 394517 - DNA, 20 bp, Artificial
  CRISPR gRNA sequence
caaaaatgtgttggtcaaat

SEQ ID NO: 394518 - DNA, 20 bp, Artificial
  CRISPR gRNA sequence
gtcaaatgaaatgggtgtta

SEQ ID NO: 394519 - DNA, 20 bp, Artificial
  CRISPR gRNA sequence
caggccacttgtttgcaaac

SEQ ID NO: 394520 - DNA, 20 bp, Artificial
  CRISPR gRNA sequence
gtttgcaaactgtggtgtgg

SEQ ID NO: 394521 - DNA, 20 bp, Artificial
  CRISPR gRNA sequence
tttgcaaactgtggtgtgga

SEQ ID NO: 394522 - DNA, 20 bp, Artificial
  CRISPR gRNA sequence
gcaaactgtggtgtggatcg

SEQ ID NO: 394523 - DNA, 20 bp, Artificial
  CRISPR gRNA sequence
caaactgtggtgtggatcgt

SEQ ID NO: 394524 - DNA, 20 bp, Artificial
  CRISPR gRNA sequence
tggtgtggatcgtgaggaca

SEQ ID NO: 394525 - DNA, 20 bp, Artificial
  CRISPR gRNA sequence
gatctagtaacatcccttcc

SEQ ID NO: 394526 - DNA, 20 bp, Artificial
  CRISPR gRNA sequence
gtaacatcccttccatcttg

SEQ ID NO: 394527 - DNA, 20 bp, Artificial
  CRISPR gRNA sequence
ccatcttgatttcttcatgt

SEQ ID NO: 394528 - DNA, 20 bp, Artificial
  CRISPR gRNA sequence
catcttgatttcttcatgta

SEQ ID NO: 394529 - DNA, 20 bp, Artificial
  CRISPR gRNA sequence
gatttcttcatgtacttgta

SEQ ID NO: 394530 - DNA, 20 bp, Artificial
  CRISPR gRNA sequence
atttcttcatgtacttgtaa

SEQ ID NO: 394531 - DNA, 20 bp, Artificial
  CRISPR gRNA sequence
cttcatgtacttgtaacatc

SEQ ID NO: 394532 - DNA, 20 bp, Artificial
  CRISPR gRNA sequence
ttcatgtacttgtaacatca

SEQ ID NO: 394533 - DNA, 20 bp, Artificial
  CRISPR gRNA sequence
catgtacttgtaacatcatt

SEQ ID NO: 394534 - DNA, 20 bp, Artificial
  CRISPR gRNA sequence
atgtacttgtaacatcattt

SEQ ID NO: 394535 - DNA, 20 bp, Artificial
  CRISPR gRNA sequence
gtaacatcattttatcaagt

SEQ ID NO: 394536 - DNA, 20 bp, Artificial
  CRISPR gRNA sequence
taacatcattttatcaagtc

SEQ ID NO: 394537 - DNA, 20 bp, Artificial
  CRISPR gRNA sequence
tatcaagtcactctcatgtg

SEQ ID NO: 394538 - DNA, 20 bp, Artificial
  CRISPR gRNA sequence
atcaagtcactctcatgtgc

SEQ ID NO: 394539 - DNA, 20 bp, Artificial
  CRISPR gRNA sequence
tcaagtcactctcatgtgct

SEQ ID NO: 394540 - DNA, 20 bp, Artificial
  CRISPR gRNA sequence
tcatgtgctaggtccttttt

SEQ ID NO: 394541 - DNA, 20 bp, Artificial
  CRISPR gRNA sequence
atgtgctaggtcctttttct

SEQ ID NO: 394542 - DNA, 20 bp, Artificial
  CRISPR gRNA sequence
ggtcctttttctccctatat

SEQ ID NO: 394543 - DNA, 20 bp, Artificial
  CRISPR gRNA sequence
tttctccctatatgctccat

SEQ ID NO: 394544 - DNA, 20 bp, Artificial
  CRISPR gRNA sequence
ttctccctatatgctccata

SEQ ID NO: 394545 - DNA, 20 bp, Artificial
  CRISPR gRNA sequence
tctccctatatgctccatag

SEQ ID NO: 394546 - DNA, 20 bp, Artificial
  CRISPR gRNA sequence
ctccctatatgctccatagt

SEQ ID NO: 394547 - DNA, 20 bp, Artificial
  CRISPR gRNA sequence
tccctatatgctccatagtc

SEQ ID NO: 394548 - DNA, 20 bp, Artificial
  CRISPR gRNA sequence
cctatatgctccatagtcta

SEQ ID NO: 394549 - DNA, 20 bp, Artificial
  CRISPR gRNA sequence
tatgctccatagtctatcct

SEQ ID NO: 394550 - DNA, 20 bp, Artificial
  CRISPR gRNA sequence
catagtctatcctcactttt

SEQ ID NO: 394551 - DNA, 20 bp, Artificial
  CRISPR gRNA sequence
tcctcactttttaaattttg

SEQ ID NO: 394552 - DNA, 20 bp, Artificial
  CRISPR gRNA sequence
actttttaaattttgctttt

SEQ ID NO: 394553 - DNA, 20 bp, Artificial
  CRISPR gRNA sequence
tttaaattttgctttttaaa

SEQ ID NO: 394554 - DNA, 20 bp, Artificial
  CRISPR gRNA sequence
ttaaattttgctttttaaat

SEQ ID NO: 394555 - DNA, 20 bp, Artificial
  CRISPR gRNA sequence
taaattttgctttttaaatt

SEQ ID NO: 394556 - DNA, 20 bp, Artificial
  CRISPR gRNA sequence
aaattttgctttttaaatta

SEQ ID NO: 394557 - DNA, 20 bp, Artificial
  CRISPR gRNA sequence
aattttgctttttaaattat

SEQ ID NO: 394558 - DNA, 20 bp, Artificial
  CRISPR gRNA sequence
tgctttttaaattatgtatt

SEQ ID NO: 394559 - DNA, 20 bp, Artificial
  CRISPR gRNA sequence
gctttttaaattatgtatta

SEQ ID NO: 394560 - DNA, 20 bp, Artificial
  CRISPR gRNA sequence
ctttttaaattatgtattaa

SEQ ID NO: 394561 - DNA, 20 bp, Artificial
  CRISPR gRNA sequence
tttaaattatgtattaataa

SEQ ID NO: 394562 - DNA, 20 bp, Artificial
  CRISPR gRNA sequence
ttaaattatgtattaataat

SEQ ID NO: 394563 - DNA, 20 bp, Artificial
  CRISPR gRNA sequence
taaattatgtattaataata

SEQ ID NO: 394564 - DNA, 20 bp, Artificial
  CRISPR gRNA sequence
aaattatgtattaataatac

SEQ ID NO: 394565 - DNA, 20 bp, Artificial
  CRISPR gRNA sequence
aattatgtattaataatact

SEQ ID NO: 394566 - DNA, 20 bp, Artificial
  CRISPR gRNA sequence
tgtattaataatactatctc

SEQ ID NO: 394567 - DNA, 20 bp, Artificial
  CRISPR gRNA sequence
ataatactatctccctcaca

SEQ ID NO: 394568 - DNA, 20 bp, Artificial
  CRISPR gRNA sequence
tctccctcacagggacaatg

SEQ ID NO: 394569 - DNA, 20 bp, Artificial
  CRISPR gRNA sequence
cctcacagggacaatgtgag

SEQ ID NO: 394570 - DNA, 20 bp, Artificial
  CRISPR gRNA sequence
acagggacaatgtgagggtt

SEQ ID NO: 394571 - DNA, 20 bp, Artificial
  CRISPR gRNA sequence
aatgaaataatcaatgtaaa

SEQ ID NO: 394572 - DNA, 20 bp, Artificial
  CRISPR gRNA sequence
tagagccctgcccagggctg

SEQ ID NO: 394573 - DNA, 20 bp, Artificial
  CRISPR gRNA sequence
agagccctgcccagggctgc

SEQ ID NO: 394574 - DNA, 20 bp, Artificial
  CRISPR gRNA sequence
gagccctgcccagggctgcc

SEQ ID NO: 394575 - DNA, 20 bp, Artificial
  CRISPR gRNA sequence
cccagggctgccacataata

SEQ ID NO: 394576 - DNA, 20 bp, Artificial
  CRISPR gRNA sequence
ccacataataaacattcaac

SEQ ID NO: 394577 - DNA, 20 bp, Artificial
  CRISPR gRNA sequence
aacggttatgaatgtgaagg

SEQ ID NO: 394578 - DNA, 20 bp, Artificial
  CRISPR gRNA sequence
tgaatgtgaaggaagactag

SEQ ID NO: 394579 - DNA, 20 bp, Artificial
  CRISPR gRNA sequence
gccaaagctctctgtgcata

SEQ ID NO: 394580 - DNA, 20 bp, Artificial
  CRISPR gRNA sequence
tctgtgcatactcgtacacc

SEQ ID NO: 394581 - DNA, 20 bp, Artificial
  CRISPR gRNA sequence
tgtgcatactcgtacaccca

SEQ ID NO: 394582 - DNA, 20 bp, Artificial
  CRISPR gRNA sequence
tgcatactcgtacacccatg

SEQ ID NO: 394583 - DNA, 20 bp, Artificial
  CRISPR gRNA sequence
gtacacccatgactttacca

SEQ ID NO: 394584 - DNA, 20 bp, Artificial
  CRISPR gRNA sequence
taccacatttgcatctccaa

SEQ ID NO: 394585 - DNA, 20 bp, Artificial
  CRISPR gRNA sequence
accacatttgcatctccaac

SEQ ID NO: 394586 - DNA, 20 bp, Artificial
  CRISPR gRNA sequence
ccacatttgcatctccaacc

SEQ ID NO: 394587 - DNA, 20 bp, Artificial
  CRISPR gRNA sequence
gcatctccaacccaagttct

SEQ ID NO: 394588 - DNA, 20 bp, Artificial
  CRISPR gRNA sequence
catctccaacccaagttctc

SEQ ID NO: 394589 - DNA, 20 bp, Artificial
  CRISPR gRNA sequence
caacccaagttctctcttgg

SEQ ID NO: 394590 - DNA, 20 bp, Artificial
  CRISPR gRNA sequence
tctcttgggttctgattaaa

SEQ ID NO: 394591 - DNA, 20 bp, Artificial
  CRISPR gRNA sequence
tcttgggttctgattaaaaa

SEQ ID NO: 394592 - DNA, 20 bp, Artificial
  CRISPR gRNA sequence
ttgggttctgattaaaaaat

SEQ ID NO: 394593 - DNA, 20 bp, Artificial
  CRISPR gRNA sequence
gggttctgattaaaaaatcc

SEQ ID NO: 394594 - DNA, 20 bp, Artificial
  CRISPR gRNA sequence
ggttctgattaaaaaatcct

SEQ ID NO: 394595 - DNA, 20 bp, Artificial
  CRISPR gRNA sequence
tgattaaaaaatcctcctgc

SEQ ID NO: 394596 - DNA, 20 bp, Artificial
  CRISPR gRNA sequence
attaaaaaatcctcctgcct

SEQ ID NO: 394597 - DNA, 20 bp, Artificial
  CRISPR gRNA sequence
aaaaatcctcctgcctgcta

SEQ ID NO: 394598 - DNA, 20 bp, Artificial
  CRISPR gRNA sequence
ctgcctgctagagagcttca

SEQ ID NO: 394599 - DNA, 20 bp, Artificial
  CRISPR gRNA sequence
cctgctagagagcttcactt

SEQ ID NO: 394600 - DNA, 20 bp, Artificial
  CRISPR gRNA sequence
ctagagagcttcacttggat

SEQ ID NO: 394601 - DNA, 20 bp, Artificial
  CRISPR gRNA sequence
gagagcttcacttggatgtc

SEQ ID NO: 394602 - DNA, 20 bp, Artificial
  CRISPR gRNA sequence
cacttggatgtctaaaccta

SEQ ID NO: 394603 - DNA, 20 bp, Artificial
  CRISPR gRNA sequence
acttggatgtctaaacctaa

SEQ ID NO: 394604 - DNA, 20 bp, Artificial
  CRISPR gRNA sequence
ggatgtctaaacctaaacga

SEQ ID NO: 394605 - DNA, 20 bp, Artificial
  CRISPR gRNA sequence
gatgtctaaacctaaacgat

SEQ ID NO: 394606 - DNA, 20 bp, Artificial
  CRISPR gRNA sequence
aacctaaacgattcaacccc

SEQ ID NO: 394607 - DNA, 20 bp, Artificial
  CRISPR gRNA sequence
aacgattcaaccccactccg

SEQ ID NO: 394608 - DNA, 20 bp, Artificial
  CRISPR gRNA sequence
aaccccactccggagcttct

SEQ ID NO: 394609 - DNA, 20 bp, Artificial
  CRISPR gRNA sequence
cggagcttctcatctcattc

SEQ ID NO: 394610 - DNA, 20 bp, Artificial
  CRISPR gRNA sequence
ctcatctcattctccctgat

SEQ ID NO: 394611 - DNA, 20 bp, Artificial
  CRISPR gRNA sequence
tcatctcattctccctgatg

SEQ ID NO: 394612 - DNA, 20 bp, Artificial
  CRISPR gRNA sequence
atctcattctccctgatgca

SEQ ID NO: 394613 - DNA, 20 bp, Artificial
  CRISPR gRNA sequence
attctccctgatgcagtcaa

SEQ ID NO: 394614 - DNA, 20 bp, Artificial
  CRISPR gRNA sequence
tccctgatgcagtcaatgac

SEQ ID NO: 394615 - DNA, 20 bp, Artificial
  CRISPR gRNA sequence
cctgatgcagtcaatgacag

SEQ ID NO: 394616 - DNA, 20 bp, Artificial
  CRISPR gRNA sequence
atgcagtcaatgacagcacc

SEQ ID NO: 394617 - DNA, 20 bp, Artificial
  CRISPR gRNA sequence
ctcaggatcccaagtaaaac

SEQ ID NO: 394618 - DNA, 20 bp, Artificial
  CRISPR gRNA sequence
aggatcccaagtaaaacctg

SEQ ID NO: 394619 - DNA, 20 bp, Artificial
  CRISPR gRNA sequence
gtgccactcttgaatccctt

SEQ ID NO: 394620 - DNA, 20 bp, Artificial
  CRISPR gRNA sequence
ttgaatcccttttctatttc

SEQ ID NO: 394621 - DNA, 20 bp, Artificial
  CRISPR gRNA sequence
gaatcccttttctatttcac

SEQ ID NO: 394622 - DNA, 20 bp, Artificial
  CRISPR gRNA sequence
aatcccttttctatttcaca

SEQ ID NO: 394623 - DNA, 20 bp, Artificial
  CRISPR gRNA sequence
ttctatttcacacgcaacat

SEQ ID NO: 394624 - DNA, 20 bp, Artificial
  CRISPR gRNA sequence
tctatttcacacgcaacatc

SEQ ID NO: 394625 - DNA, 20 bp, Artificial
  CRISPR gRNA sequence
ctatttcacacgcaacatcg

SEQ ID NO: 394626 - DNA, 20 bp, Artificial
  CRISPR gRNA sequence
tatttcacacgcaacatcga

SEQ ID NO: 394627 - DNA, 20 bp, Artificial
  CRISPR gRNA sequence
tttcacacgcaacatcgaat

SEQ ID NO: 394628 - DNA, 20 bp, Artificial
  CRISPR gRNA sequence
cacacgcaacatcgaatata

SEQ ID NO: 394629 - DNA, 20 bp, Artificial
  CRISPR gRNA sequence
acacgcaacatcgaatatat

SEQ ID NO: 394630 - DNA, 20 bp, Artificial
  CRISPR gRNA sequence
tgaaatctgtcatttctcaa

SEQ ID NO: 394631 - DNA, 20 bp, Artificial
  CRISPR gRNA sequence
tcatttctcaatttctctct

SEQ ID NO: 394632 - DNA, 20 bp, Artificial
  CRISPR gRNA sequence
ctcaatttctctctctgtct

SEQ ID NO: 394633 - DNA, 20 bp, Artificial
  CRISPR gRNA sequence
tcaatttctctctctgtctc

SEQ ID NO: 394634 - DNA, 20 bp, Artificial
  CRISPR gRNA sequence
aatttctctctctgtctctg

SEQ ID NO: 394635 - DNA, 20 bp, Artificial
  CRISPR gRNA sequence
ctctctctgtctctgtgtgt

SEQ ID NO: 394636 - DNA, 20 bp, Artificial
  CRISPR gRNA sequence
tctctctgtctctgtgtgtc

SEQ ID NO: 394637 - DNA, 20 bp, Artificial
  CRISPR gRNA sequence
tctctgtctctgtgtgtctc

SEQ ID NO: 394638 - DNA, 20 bp, Artificial
  CRISPR gRNA sequence
tctgtctctgtgtgtctctc

SEQ ID NO: 394639 - DNA, 20 bp, Artificial
  CRISPR gRNA sequence
tgtctctgtgtgtctctctc

SEQ ID NO: 394640 - DNA, 20 bp, Artificial
  CRISPR gRNA sequence
tctctgtgtgtctctctcta

SEQ ID NO: 394641 - DNA, 20 bp, Artificial
  CRISPR gRNA sequence
tgtgtgtctctctctagcct

SEQ ID NO: 394642 - DNA, 20 bp, Artificial
  CRISPR gRNA sequence
tgtgtctctctctagcctat

SEQ ID NO: 394643 - DNA, 20 bp, Artificial
  CRISPR gRNA sequence
tctctagcctattgtctgag

SEQ ID NO: 394644 - DNA, 20 bp, Artificial
  CRISPR gRNA sequence
tctagcctattgtctgagct

SEQ ID NO: 394645 - DNA, 20 bp, Artificial
  CRISPR gRNA sequence
tagcctattgtctgagctca

SEQ ID NO: 394646 - DNA, 20 bp, Artificial
  CRISPR gRNA sequence
gcctattgtctgagctcatt

SEQ ID NO: 394647 - DNA, 20 bp, Artificial
  CRISPR gRNA sequence
ttgtctgagctcattcccag

SEQ ID NO: 394648 - DNA, 20 bp, Artificial
  CRISPR gRNA sequence
tctgagctcattcccagaaa

SEQ ID NO: 394649 - DNA, 20 bp, Artificial
  CRISPR gRNA sequence
agctcattcccagaaatatg

SEQ ID NO: 394650 - DNA, 20 bp, Artificial
  CRISPR gRNA sequence
attcccagaaatatggaaat

SEQ ID NO: 394651 - DNA, 20 bp, Artificial
  CRISPR gRNA sequence
ccagaaatatggaaattcca

SEQ ID NO: 394652 - DNA, 20 bp, Artificial
  CRISPR gRNA sequence
cacaggctgcatgccatctc

SEQ ID NO: 394653 - DNA, 20 bp, Artificial
  CRISPR gRNA sequence
catgccatctctggaggtga

SEQ ID NO: 394654 - DNA, 20 bp, Artificial
  CRISPR gRNA sequence
tggaggtgatcaagaatgaa

SEQ ID NO: 394655 - DNA, 20 bp, Artificial
  CRISPR gRNA sequence
gaggtgatcaagaatgaagg

SEQ ID NO: 394656 - DNA, 20 bp, Artificial
  CRISPR gRNA sequence
gcatctctcctctgcaccat

SEQ ID NO: 394657 - DNA, 20 bp, Artificial
  CRISPR gRNA sequence
tcctctgcaccatgagcacg

SEQ ID NO: 394658 - DNA, 20 bp, Artificial
  CRISPR gRNA sequence
ctctgcaccatgagcacggg

SEQ ID NO: 394659 - DNA, 20 bp, Artificial
  CRISPR gRNA sequence
tgcaccatgagcacgggcaa

SEQ ID NO: 394660 - DNA, 20 bp, Artificial
  CRISPR gRNA sequence
caccatgagcacgggcaact

SEQ ID NO: 394661 - DNA, 20 bp, Artificial
  CRISPR gRNA sequence
caaacaaaatcctactggga

SEQ ID NO: 394662 - DNA, 20 bp, Artificial
  CRISPR gRNA sequence
ctgggactggagaagagtcc

SEQ ID NO: 394663 - DNA, 20 bp, Artificial
  CRISPR gRNA sequence
ggactggagaagagtccaaa

SEQ ID NO: 394664 - DNA, 20 bp, Artificial
  CRISPR gRNA sequence
gagaagagtccaaaaactgg

SEQ ID NO: 394665 - DNA, 20 bp, Artificial
  CRISPR gRNA sequence
gggtatttgatacatcattc

SEQ ID NO: 394666 - DNA, 20 bp, Artificial
  CRISPR gRNA sequence
gatacatcattcctgggaag

SEQ ID NO: 394667 - DNA, 20 bp, Artificial
  CRISPR gRNA sequence
atacatcattcctgggaaga

SEQ ID NO: 394668 - DNA, 20 bp, Artificial
  CRISPR gRNA sequence
ctgggaagatgatgggctac

SEQ ID NO: 394669 - DNA, 20 bp, Artificial
  CRISPR gRNA sequence
ggaagatgatgggctacatt

SEQ ID NO: 394670 - DNA, 20 bp, Artificial
  CRISPR gRNA sequence
cattattcagatcagacttt

SEQ ID NO: 394671 - DNA, 20 bp, Artificial
  CRISPR gRNA sequence
ttcagatcagactttcaggt

SEQ ID NO: 394672 - DNA, 20 bp, Artificial
  CRISPR gRNA sequence
agatcagactttcaggtaaa

SEQ ID NO: 394673 - DNA, 20 bp, Artificial
  CRISPR gRNA sequence
tcaggtaaaagcatctagat

SEQ ID NO: 394674 - DNA, 20 bp, Artificial
  CRISPR gRNA sequence
caggtaaaagcatctagatg

SEQ ID NO: 394675 - DNA, 20 bp, Artificial
  CRISPR gRNA sequence
aggtaaaagcatctagatga

SEQ ID NO: 394676 - DNA, 20 bp, Artificial
  CRISPR gRNA sequence
gatgacaaatattttttaaa

SEQ ID NO: 394677 - DNA, 20 bp, Artificial
  CRISPR gRNA sequence
tttaaaaaatacaaagaggt

SEQ ID NO: 394678 - DNA, 20 bp, Artificial
  CRISPR gRNA sequence
ttaaaaaatacaaagaggta

SEQ ID NO: 394679 - DNA, 20 bp, Artificial
  CRISPR gRNA sequence
taaaaaatacaaagaggtaa

SEQ ID NO: 394680 - DNA, 20 bp, Artificial
  CRISPR gRNA sequence
aaaaaatacaaagaggtaaa

SEQ ID NO: 394681 - DNA, 20 bp, Artificial
  CRISPR gRNA sequence
aaaaatacaaagaggtaaaa

SEQ ID NO: 394682 - DNA, 20 bp, Artificial
  CRISPR gRNA sequence
tgaatgaaggctgttgcaat

SEQ ID NO: 394683 - DNA, 20 bp, Artificial
  CRISPR gRNA sequence
gaatgaaggctgttgcaata

SEQ ID NO: 394684 - DNA, 20 bp, Artificial
  CRISPR gRNA sequence
aatgaaggctgttgcaatat

SEQ ID NO: 394685 - DNA, 20 bp, Artificial
  CRISPR gRNA sequence
ttgcaatatggtttgagata

SEQ ID NO: 394686 - DNA, 20 bp, Artificial
  CRISPR gRNA sequence
caatatggtttgagataaat

SEQ ID NO: 394687 - DNA, 20 bp, Artificial
  CRISPR gRNA sequence
gagataaatggatatgaggt

SEQ ID NO: 394688 - DNA, 20 bp, Artificial
  CRISPR gRNA sequence
agataaatggatatgaggtg

SEQ ID NO: 394689 - DNA, 20 bp, Artificial
  CRISPR gRNA sequence
ttttgcaagtctagacactt

SEQ ID NO: 394690 - DNA, 20 bp, Artificial
  CRISPR gRNA sequence
tgcaagtctagacacttaga

SEQ ID NO: 394691 - DNA, 20 bp, Artificial
  CRISPR gRNA sequence
gcaagtctagacacttagat

SEQ ID NO: 394692 - DNA, 20 bp, Artificial
  CRISPR gRNA sequence
caagtctagacacttagatg

SEQ ID NO: 394693 - DNA, 20 bp, Artificial
  CRISPR gRNA sequence
gacacttagatgtgaaaaat

SEQ ID NO: 394694 - DNA, 20 bp, Artificial
  CRISPR gRNA sequence
agatgtgaaaaatgaggcaa

SEQ ID NO: 394695 - DNA, 20 bp, Artificial
  CRISPR gRNA sequence
gatgtgaaaaatgaggcaaa

SEQ ID NO: 394696 - DNA, 20 bp, Artificial
  CRISPR gRNA sequence
ctatgtttttaagatgtggg

SEQ ID NO: 394697 - DNA, 20 bp, Artificial
  CRISPR gRNA sequence
tatgtttttaagatgtggga

SEQ ID NO: 394698 - DNA, 20 bp, Artificial
  CRISPR gRNA sequence
tgtttttaagatgtgggaat

SEQ ID NO: 394699 - DNA, 20 bp, Artificial
  CRISPR gRNA sequence
ttaagatgtgggaatattga

SEQ ID NO: 394700 - DNA, 20 bp, Artificial
  CRISPR gRNA sequence
taagatgtgggaatattgac

SEQ ID NO: 394701 - DNA, 20 bp, Artificial
  CRISPR gRNA sequence
aagatgtgggaatattgact

SEQ ID NO: 394702 - DNA, 20 bp, Artificial
  CRISPR gRNA sequence
agatgtgggaatattgactc

SEQ ID NO: 394703 - DNA, 20 bp, Artificial
  CRISPR gRNA sequence
actcaaatgagaaagactgg

SEQ ID NO: 394704 - DNA, 20 bp, Artificial
  CRISPR gRNA sequence
aaatgagaaagactgggagc

SEQ ID NO: 394705 - DNA, 20 bp, Artificial
  CRISPR gRNA sequence
ggagcaggacagatttgtga

SEQ ID NO: 394706 - DNA, 20 bp, Artificial
  CRISPR gRNA sequence
gtgaaaggagcaaatgtatt

SEQ ID NO: 394707 - DNA, 20 bp, Artificial
  CRISPR gRNA sequence
tgaaaggagcaaatgtattt

SEQ ID NO: 394708 - DNA, 20 bp, Artificial
  CRISPR gRNA sequence
gtgaaaggagcaaaagcatc

SEQ ID NO: 394709 - DNA, 20 bp, Artificial
  CRISPR gRNA sequence
tgaaaggagcaaaagcatca

SEQ ID NO: 394710 - DNA, 20 bp, Artificial
  CRISPR gRNA sequence
tgagaacacagggaccaccg

SEQ ID NO: 394711 - DNA, 20 bp, Artificial
  CRISPR gRNA sequence
agaacacagggaccaccgga

SEQ ID NO: 394712 - DNA, 20 bp, Artificial
  CRISPR gRNA sequence
gagacatagggacgtggaag

SEQ ID NO: 394713 - DNA, 20 bp, Artificial
  CRISPR gRNA sequence
ctgccctgagcacacctgcc

SEQ ID NO: 394714 - DNA, 20 bp, Artificial
  CRISPR gRNA sequence
tgccctgagcacacctgcca

SEQ ID NO: 394715 - DNA, 20 bp, Artificial
  CRISPR gRNA sequence
ccctgagcacacctgccagt

SEQ ID NO: 394716 - DNA, 20 bp, Artificial
  CRISPR gRNA sequence
agcacacctgccagtctaag

SEQ ID NO: 394717 - DNA, 20 bp, Artificial
  CRISPR gRNA sequence
ccagtctaagcaacgtgaac

SEQ ID NO: 394718 - DNA, 20 bp, Artificial
  CRISPR gRNA sequence
agcaacgtgaactctgattt

SEQ ID NO: 394719 - DNA, 20 bp, Artificial
  CRISPR gRNA sequence
tgatttttgaacctcataca

SEQ ID NO: 394720 - DNA, 20 bp, Artificial
  CRISPR gRNA sequence
atttttgaacctcatacaac

SEQ ID NO: 394721 - DNA, 20 bp, Artificial
  CRISPR gRNA sequence
ttgaacctcatacaacacga

SEQ ID NO: 394722 - DNA, 20 bp, Artificial
  CRISPR gRNA sequence
tgaacctcatacaacacgaa

SEQ ID NO: 394723 - DNA, 20 bp, Artificial
  CRISPR gRNA sequence
gaacctcatacaacacgaaa

SEQ ID NO: 394724 - DNA, 20 bp, Artificial
  CRISPR gRNA sequence
aacctcatacaacacgaaag

SEQ ID NO: 394725 - DNA, 20 bp, Artificial
  CRISPR gRNA sequence
atacaacacgaaagaaatag

SEQ ID NO: 394726 - DNA, 20 bp, Artificial
  CRISPR gRNA sequence
cctgaagtgagaattaaaaa

SEQ ID NO: 394727 - DNA, 20 bp, Artificial
  CRISPR gRNA sequence
aagtgagaattaaaaagaag

SEQ ID NO: 394728 - DNA, 20 bp, Artificial
  CRISPR gRNA sequence
aaaagaagaccttcctcttg

SEQ ID NO: 394729 - DNA, 20 bp, Artificial
  CRISPR gRNA sequence
cctcttgtcttgtcgagacc

SEQ ID NO: 394730 - DNA, 20 bp, Artificial
  CRISPR gRNA sequence
ctcttgtcttgtcgagacct

SEQ ID NO: 394731 - DNA, 20 bp, Artificial
  CRISPR gRNA sequence
ttgtcttgtcgagacctcta

SEQ ID NO: 394732 - DNA, 20 bp, Artificial
  CRISPR gRNA sequence
gtcttgtcgagacctctaag

SEQ ID NO: 394733 - DNA, 20 bp, Artificial
  CRISPR gRNA sequence
tcttgtcgagacctctaagt

SEQ ID NO: 394734 - DNA, 20 bp, Artificial
  CRISPR gRNA sequence
gtcgagacctctaagtgata

SEQ ID NO: 394735 - DNA, 20 bp, Artificial
  CRISPR gRNA sequence
tcgagacctctaagtgatac

SEQ ID NO: 394736 - DNA, 20 bp, Artificial
  CRISPR gRNA sequence
taagtgatactccttcatgg

SEQ ID NO: 394737 - DNA, 20 bp, Artificial
  CRISPR gRNA sequence
agtgatactccttcatggta

SEQ ID NO: 394738 - DNA, 20 bp, Artificial
  CRISPR gRNA sequence
cttcatggtaacaatgacct

SEQ ID NO: 394739 - DNA, 20 bp, Artificial
  CRISPR gRNA sequence
catggtaacaatgacctgga

SEQ ID NO: 394740 - DNA, 20 bp, Artificial
  CRISPR gRNA sequence
atggtaacaatgacctggaa

SEQ ID NO: 394741 - DNA, 20 bp, Artificial
  CRISPR gRNA sequence
gaaataagcatgtgctcacc

SEQ ID NO: 394742 - DNA, 20 bp, Artificial
  CRISPR gRNA sequence
acccgcatccccaggtgaat

SEQ ID NO: 394743 - DNA, 20 bp, Artificial
  CRISPR gRNA sequence
gagtagttctaagcacaaat

SEQ ID NO: 394744 - DNA, 20 bp, Artificial
  CRISPR gRNA sequence
agtagttctaagcacaaatc

SEQ ID NO: 394745 - DNA, 20 bp, Artificial
  CRISPR gRNA sequence
taagcacaaatcagtcctca

SEQ ID NO: 394746 - DNA, 20 bp, Artificial
  CRISPR gRNA sequence
agcacaaatcagtcctcatg

SEQ ID NO: 394747 - DNA, 20 bp, Artificial
  CRISPR gRNA sequence
atgtggatttatagcctaaa

SEQ ID NO: 394748 - DNA, 20 bp, Artificial
  CRISPR gRNA sequence
atagcctaaattcccatagt

SEQ ID NO: 394749 - DNA, 20 bp, Artificial
  CRISPR gRNA sequence
tagcctaaattcccatagta

SEQ ID NO: 394750 - DNA, 20 bp, Artificial
  CRISPR gRNA sequence
aattcccatagtacaggtgc

SEQ ID NO: 394751 - DNA, 20 bp, Artificial
  CRISPR gRNA sequence
ccatagtacaggtgctccat

SEQ ID NO: 394752 - DNA, 20 bp, Artificial
  CRISPR gRNA sequence
cataaagctcaggctgaaag

SEQ ID NO: 394753 - DNA, 20 bp, Artificial
  CRISPR gRNA sequence
aggctgaaagtaatccaggt

SEQ ID NO: 394754 - DNA, 20 bp, Artificial
  CRISPR gRNA sequence
aaagtaatccaggtttcgac

SEQ ID NO: 394755 - DNA, 20 bp, Artificial
  CRISPR gRNA sequence
cgactcctctgagaacaaag

SEQ ID NO: 394756 - DNA, 20 bp, Artificial
  CRISPR gRNA sequence
gactcctctgagaacaaagg

SEQ ID NO: 394757 - DNA, 20 bp, Artificial
  CRISPR gRNA sequence
ctctgagaacaaaggtccct

SEQ ID NO: 394758 - DNA, 20 bp, Artificial
  CRISPR gRNA sequence
tgagaacaaaggtcccttca

SEQ ID NO: 394759 - DNA, 20 bp, Artificial
  CRISPR gRNA sequence
agaacaaaggtcccttcatg

SEQ ID NO: 394760 - DNA, 20 bp, Artificial
  CRISPR gRNA sequence
catgttagacttcagagaat

SEQ ID NO: 394761 - DNA, 20 bp, Artificial
  CRISPR gRNA sequence
atgttagacttcagagaatc

SEQ ID NO: 394762 - DNA, 20 bp, Artificial
  CRISPR gRNA sequence
gacttcagagaatccccaga

SEQ ID NO: 394763 - DNA, 20 bp, Artificial
  CRISPR gRNA sequence
cagagaatccccagaaggct

SEQ ID NO: 394764 - DNA, 20 bp, Artificial
  CRISPR gRNA sequence
agagaatccccagaaggctt

SEQ ID NO: 394765 - DNA, 20 bp, Artificial
  CRISPR gRNA sequence
tatcaaggactatgagcagc

SEQ ID NO: 394766 - DNA, 20 bp, Artificial
  CRISPR gRNA sequence
atcaaggactatgagcagca

SEQ ID NO: 394767 - DNA, 20 bp, Artificial
  CRISPR gRNA sequence
tcaaggactatgagcagcac

SEQ ID NO: 394768 - DNA, 20 bp, Artificial
  CRISPR gRNA sequence
tgagcagcacacagtgaaaa

SEQ ID NO: 394769 - DNA, 20 bp, Artificial
  CRISPR gRNA sequence
cggcactattcacagtagca

SEQ ID NO: 394770 - DNA, 20 bp, Artificial
  CRISPR gRNA sequence
ttcacagtagcaaagacttg

SEQ ID NO: 394771 - DNA, 20 bp, Artificial
  CRISPR gRNA sequence
acagtagcaaagacttggaa

SEQ ID NO: 394772 - DNA, 20 bp, Artificial
  CRISPR gRNA sequence
ggaaccaacccaaatgtcca

SEQ ID NO: 394773 - DNA, 20 bp, Artificial
  CRISPR gRNA sequence
gaaccaacccaaatgtccaa

SEQ ID NO: 394774 - DNA, 20 bp, Artificial
  CRISPR gRNA sequence
gattaagaaaatgtggcaca

SEQ ID NO: 394775 - DNA, 20 bp, Artificial
  CRISPR gRNA sequence
agaaaatgtggcacatatac

SEQ ID NO: 394776 - DNA, 20 bp, Artificial
  CRISPR gRNA sequence
tgcagccataaaaaatgatg

SEQ ID NO: 394777 - DNA, 20 bp, Artificial
  CRISPR gRNA sequence
atgtcctttgtagggacatg

SEQ ID NO: 394778 - DNA, 20 bp, Artificial
  CRISPR gRNA sequence
tgtagggacatggatgaaac

SEQ ID NO: 394779 - DNA, 20 bp, Artificial
  CRISPR gRNA sequence
gtagggacatggatgaaact

SEQ ID NO: 394780 - DNA, 20 bp, Artificial
  CRISPR gRNA sequence
tagggacatggatgaaactg

SEQ ID NO: 394781 - DNA, 20 bp, Artificial
  CRISPR gRNA sequence
gaaaccatcattctcagcaa

SEQ ID NO: 394782 - DNA, 20 bp, Artificial
  CRISPR gRNA sequence
tcagcaaactatcacaaaga

SEQ ID NO: 394783 - DNA, 20 bp, Artificial
  CRISPR gRNA sequence
agcaaactatcacaaagaca

SEQ ID NO: 394784 - DNA, 20 bp, Artificial
  CRISPR gRNA sequence
tcacaaagacaaaaaccaaa

SEQ ID NO: 394785 - DNA, 20 bp, Artificial
  CRISPR gRNA sequence
tcactcataggtgggaattg

SEQ ID NO: 394786 - DNA, 20 bp, Artificial
  CRISPR gRNA sequence
actcataggtgggaattgaa

SEQ ID NO: 394787 - DNA, 20 bp, Artificial
  CRISPR gRNA sequence
ataggtgggaattgaacaat

SEQ ID NO: 394788 - DNA, 20 bp, Artificial
  CRISPR gRNA sequence
aacaatgagaacacatggac

SEQ ID NO: 394789 - DNA, 20 bp, Artificial
  CRISPR gRNA sequence
ttgtggggtggggagagggg

SEQ ID NO: 394790 - DNA, 20 bp, Artificial
  CRISPR gRNA sequence
tggggtggggagagggggga

SEQ ID NO: 394791 - DNA, 20 bp, Artificial
  CRISPR gRNA sequence
ggagatatacctaatgctaa

SEQ ID NO: 394792 - DNA, 20 bp, Artificial
  CRISPR gRNA sequence
atgctaaatgacaagttaat

SEQ ID NO: 394793 - DNA, 20 bp, Artificial
  CRISPR gRNA sequence
aatgacaagttaatgggtgc

SEQ ID NO: 394794 - DNA, 20 bp, Artificial
  CRISPR gRNA sequence
atgggtgcagcacaccaaca

SEQ ID NO: 394795 - DNA, 20 bp, Artificial
  CRISPR gRNA sequence
catgttgtgcacatgtaccc

SEQ ID NO: 394796 - DNA, 20 bp, Artificial
  CRISPR gRNA sequence
tgcacatgtaccctaaaact

SEQ ID NO: 394797 - DNA, 20 bp, Artificial
  CRISPR gRNA sequence
aaacttaaagtataataata

SEQ ID NO: 394798 - DNA, 20 bp, Artificial
  CRISPR gRNA sequence
aaagtataataataataaaa

SEQ ID NO: 394799 - DNA, 20 bp, Artificial
  CRISPR gRNA sequence
aagtataataataataaaat

SEQ ID NO: 394800 - DNA, 20 bp, Artificial
  CRISPR gRNA sequence
aaaaaaaagaaaagaaagta

SEQ ID NO: 394801 - DNA, 20 bp, Artificial
  CRISPR gRNA sequence
aaaaaaagaaaagaaagtaa

SEQ ID NO: 394802 - DNA, 20 bp, Artificial
  CRISPR gRNA sequence
agcaaagaagaaaaaaacag

SEQ ID NO: 394803 - DNA, 20 bp, Artificial
  CRISPR gRNA sequence
ctttaatattacagcatcag

SEQ ID NO: 394804 - DNA, 20 bp, Artificial
  CRISPR gRNA sequence
taatattacagcatcaggca

SEQ ID NO: 394805 - DNA, 20 bp, Artificial
  CRISPR gRNA sequence
aatattacagcatcaggcat

SEQ ID NO: 394806 - DNA, 20 bp, Artificial
  CRISPR gRNA sequence
atattacagcatcaggcata

SEQ ID NO: 394807 - DNA, 20 bp, Artificial
  CRISPR gRNA sequence
cagcatcaggcatagattac

SEQ ID NO: 394808 - DNA, 20 bp, Artificial
  CRISPR gRNA sequence
caaaataactaagtgtacta

SEQ ID NO: 394809 - DNA, 20 bp, Artificial
  CRISPR gRNA sequence
agtgtactaattctgggaaa

SEQ ID NO: 394810 - DNA, 20 bp, Artificial
  CRISPR gRNA sequence
attctgggaaagatggaggt

SEQ ID NO: 394811 - DNA, 20 bp, Artificial
  CRISPR gRNA sequence
tgggaaagatggaggtgtgt

SEQ ID NO: 394812 - DNA, 20 bp, Artificial
  CRISPR gRNA sequence
ggaaagatggaggtgtgtgc

SEQ ID NO: 394813 - DNA, 20 bp, Artificial
  CRISPR gRNA sequence
caaaacacaaattaaggtag

SEQ ID NO: 394814 - DNA, 20 bp, Artificial
  CRISPR gRNA sequence
aggtagagagaccgacagaa

SEQ ID NO: 394815 - DNA, 20 bp, Artificial
  CRISPR gRNA sequence
tgacaaagcaagtaggcagg

SEQ ID NO: 394816 - DNA, 20 bp, Artificial
  CRISPR gRNA sequence
gacaaagcaagtaggcaggg

SEQ ID NO: 394817 - DNA, 20 bp, Artificial
  CRISPR gRNA sequence
acaaagcaagtaggcaggga

SEQ ID NO: 394818 - DNA, 20 bp, Artificial
  CRISPR gRNA sequence
cagcaatttctgagccaaag

SEQ ID NO: 394819 - DNA, 20 bp, Artificial
  CRISPR gRNA sequence
ctgagccaaagctctggcag

SEQ ID NO: 394820 - DNA, 20 bp, Artificial
  CRISPR gRNA sequence
tgagccaaagctctggcagt

SEQ ID NO: 394821 - DNA, 20 bp, Artificial
  CRISPR gRNA sequence
agccaaagctctggcagttg

SEQ ID NO: 394822 - DNA, 20 bp, Artificial
  CRISPR gRNA sequence
tggcagttgtaatagttttt

SEQ ID NO: 394823 - DNA, 20 bp, Artificial
  CRISPR gRNA sequence
gcagttgtaatagtttttta

SEQ ID NO: 394824 - DNA, 20 bp, Artificial
  CRISPR gRNA sequence
taatagttttttaaaatgta

SEQ ID NO: 394825 - DNA, 20 bp, Artificial
  CRISPR gRNA sequence
tttaaaatgtaagacctgaa

SEQ ID NO: 394826 - DNA, 20 bp, Artificial
  CRISPR gRNA sequence
ttaaaatgtaagacctgaat

SEQ ID NO: 394827 - DNA, 20 bp, Artificial
  CRISPR gRNA sequence
taaaatgtaagacctgaatc

SEQ ID NO: 394828 - DNA, 20 bp, Artificial
  CRISPR gRNA sequence
aaaatgtaagacctgaatct

SEQ ID NO: 394829 - DNA, 20 bp, Artificial
  CRISPR gRNA sequence
aaatgtaagacctgaatctt

SEQ ID NO: 394830 - DNA, 20 bp, Artificial
  CRISPR gRNA sequence
aatcttcaagaggggaagaa

SEQ ID NO: 394831 - DNA, 20 bp, Artificial
  CRISPR gRNA sequence
caagaggggaagaattcaga

SEQ ID NO: 394832 - DNA, 20 bp, Artificial
  CRISPR gRNA sequence
aagaggggaagaattcagaa

SEQ ID NO: 394833 - DNA, 20 bp, Artificial
  CRISPR gRNA sequence
agaataatgaagaacacact

SEQ ID NO: 394834 - DNA, 20 bp, Artificial
  CRISPR gRNA sequence
ggaataaaattcatcttgaa

SEQ ID NO: 394835 - DNA, 20 bp, Artificial
  CRISPR gRNA sequence
atcttgaatatgccccatct

SEQ ID NO: 394836 - DNA, 20 bp, Artificial
  CRISPR gRNA sequence
gaatatgccccatctgcttt

SEQ ID NO: 394837 - DNA, 20 bp, Artificial
  CRISPR gRNA sequence
aatatgccccatctgcttta

SEQ ID NO: 394838 - DNA, 20 bp, Artificial
  CRISPR gRNA sequence
ctttatccccacttaagctg

SEQ ID NO: 394839 - DNA, 20 bp, Artificial
  CRISPR gRNA sequence
tatccccacttaagctgcct

SEQ ID NO: 394840 - DNA, 20 bp, Artificial
  CRISPR gRNA sequence
atccccacttaagctgcctt

SEQ ID NO: 394841 - DNA, 20 bp, Artificial
  CRISPR gRNA sequence
tccccacttaagctgcctta

SEQ ID NO: 394842 - DNA, 20 bp, Artificial
  CRISPR gRNA sequence
aagctgccttagtttaattc

SEQ ID NO: 394843 - DNA, 20 bp, Artificial
  CRISPR gRNA sequence
agctgccttagtttaattct

SEQ ID NO: 394844 - DNA, 20 bp, Artificial
  CRISPR gRNA sequence
ccttagtttaattctttttc

SEQ ID NO: 394845 - DNA, 20 bp, Artificial
  CRISPR gRNA sequence
agtttaattctttttcatcg

SEQ ID NO: 394846 - DNA, 20 bp, Artificial
  CRISPR gRNA sequence
gtttaattctttttcatcgc

SEQ ID NO: 394847 - DNA, 20 bp, Artificial
  CRISPR gRNA sequence
aattctttttcatcgcttgt

SEQ ID NO: 394848 - DNA, 20 bp, Artificial
  CRISPR gRNA sequence
attctttttcatcgcttgtc

SEQ ID NO: 394849 - DNA, 20 bp, Artificial
  CRISPR gRNA sequence
tttttcatcgcttgtctgac

SEQ ID NO: 394850 - DNA, 20 bp, Artificial
  CRISPR gRNA sequence
tttcatcgcttgtctgactt

SEQ ID NO: 394851 - DNA, 20 bp, Artificial
  CRISPR gRNA sequence
ttcatcgcttgtctgactta

SEQ ID NO: 394852 - DNA, 20 bp, Artificial
  CRISPR gRNA sequence
tcatcgcttgtctgacttat

SEQ ID NO: 394853 - DNA, 20 bp, Artificial
  CRISPR gRNA sequence
catcgcttgtctgacttatt

SEQ ID NO: 394854 - DNA, 20 bp, Artificial
  CRISPR gRNA sequence
atcgcttgtctgacttattc

SEQ ID NO: 394855 - DNA, 20 bp, Artificial
  CRISPR gRNA sequence
gtctgacttattcccatcac

SEQ ID NO: 394856 - DNA, 20 bp, Artificial
  CRISPR gRNA sequence
tctgacttattcccatcacc

SEQ ID NO: 394857 - DNA, 20 bp, Artificial
  CRISPR gRNA sequence
acttattcccatcacctctg

SEQ ID NO: 394858 - DNA, 20 bp, Artificial
  CRISPR gRNA sequence
attcccatcacctctgcatt

SEQ ID NO: 394859 - DNA, 20 bp, Artificial
  CRISPR gRNA sequence
ttcccatcacctctgcatta

SEQ ID NO: 394860 - DNA, 20 bp, Artificial
  CRISPR gRNA sequence
ccatcacctctgcattagtt

SEQ ID NO: 394861 - DNA, 20 bp, Artificial
  CRISPR gRNA sequence
tgcattagtttgctagggct

SEQ ID NO: 394862 - DNA, 20 bp, Artificial
  CRISPR gRNA sequence
cattagtttgctagggctgc

SEQ ID NO: 394863 - DNA, 20 bp, Artificial
  CRISPR gRNA sequence
gtttgctagggctgccataa

SEQ ID NO: 394864 - DNA, 20 bp, Artificial
  CRISPR gRNA sequence
gctagggctgccataataaa

SEQ ID NO: 394865 - DNA, 20 bp, Artificial
  CRISPR gRNA sequence
ctagggctgccataataaag

SEQ ID NO: 394866 - DNA, 20 bp, Artificial
  CRISPR gRNA sequence
gggctgccataataaagtac

SEQ ID NO: 394867 - DNA, 20 bp, Artificial
  CRISPR gRNA sequence
ccataataaagtaccacaga

SEQ ID NO: 394868 - DNA, 20 bp, Artificial
  CRISPR gRNA sequence
gatggcttaaacaacagaaa

SEQ ID NO: 394869 - DNA, 20 bp, Artificial
  CRISPR gRNA sequence
aaacaacagaaacttatttt

SEQ ID NO: 394870 - DNA, 20 bp, Artificial
  CRISPR gRNA sequence
aacaacagaaacttatttta

SEQ ID NO: 394871 - DNA, 20 bp, Artificial
  CRISPR gRNA sequence
attttatcgcaattctgcag

SEQ ID NO: 394872 - DNA, 20 bp, Artificial
  CRISPR gRNA sequence
ttttatcgcaattctgcagg

SEQ ID NO: 394873 - DNA, 20 bp, Artificial
  CRISPR gRNA sequence
tatcgcaattctgcaggcta

SEQ ID NO: 394874 - DNA, 20 bp, Artificial
  CRISPR gRNA sequence
atcgcaattctgcaggctag

SEQ ID NO: 394875 - DNA, 20 bp, Artificial
  CRISPR gRNA sequence
tcgcaattctgcaggctaga

SEQ ID NO: 394876 - DNA, 20 bp, Artificial
  CRISPR gRNA sequence
tgcaggctagaaacccaaaa

SEQ ID NO: 394877 - DNA, 20 bp, Artificial
  CRISPR gRNA sequence
caggctagaaacccaaaatt

SEQ ID NO: 394878 - DNA, 20 bp, Artificial
  CRISPR gRNA sequence
gaaacccaaaattcaggtgc

SEQ ID NO: 394879 - DNA, 20 bp, Artificial
  CRISPR gRNA sequence
aggtgccagcagggttgatt

SEQ ID NO: 394880 - DNA, 20 bp, Artificial
  CRISPR gRNA sequence
attccttttgaggcctctct

SEQ ID NO: 394881 - DNA, 20 bp, Artificial
  CRISPR gRNA sequence
cttttgaggcctctctcctt

SEQ ID NO: 394882 - DNA, 20 bp, Artificial
  CRISPR gRNA sequence
ttgaggcctctctccttggt

SEQ ID NO: 394883 - DNA, 20 bp, Artificial
  CRISPR gRNA sequence
tgaggcctctctccttggtt

SEQ ID NO: 394884 - DNA, 20 bp, Artificial
  CRISPR gRNA sequence
gaggcctctctccttggttt

SEQ ID NO: 394885 - DNA, 20 bp, Artificial
  CRISPR gRNA sequence
aggcctctctccttggtttc

SEQ ID NO: 394886 - DNA, 20 bp, Artificial
  CRISPR gRNA sequence
tctccttggtttccagatga

SEQ ID NO: 394887 - DNA, 20 bp, Artificial
  CRISPR gRNA sequence
tccttggtttccagatgacc

SEQ ID NO: 394888 - DNA, 20 bp, Artificial
  CRISPR gRNA sequence
cttggtttccagatgaccct

SEQ ID NO: 394889 - DNA, 20 bp, Artificial
  CRISPR gRNA sequence
ggtttccagatgaccctctg

SEQ ID NO: 394890 - DNA, 20 bp, Artificial
  CRISPR gRNA sequence
gtttccagatgaccctctgt

SEQ ID NO: 394891 - DNA, 20 bp, Artificial
  CRISPR gRNA sequence
ccagatgaccctctgtgtcc

SEQ ID NO: 394892 - DNA, 20 bp, Artificial
  CRISPR gRNA sequence
cagatgaccctctgtgtcct

SEQ ID NO: 394893 - DNA, 20 bp, Artificial
  CRISPR gRNA sequence
tgtgtcctaatctcctcttc

SEQ ID NO: 394894 - DNA, 20 bp, Artificial
  CRISPR gRNA sequence
tgtcctaatctcctcttctt

SEQ ID NO: 394895 - DNA, 20 bp, Artificial
  CRISPR gRNA sequence
atctcctcttcttatttgga

SEQ ID NO: 394896 - DNA, 20 bp, Artificial
  CRISPR gRNA sequence
ctcttcttatttggaaacca

SEQ ID NO: 394897 - DNA, 20 bp, Artificial
  CRISPR gRNA sequence
ttcttatttggaaaccagtc

SEQ ID NO: 394898 - DNA, 20 bp, Artificial
  CRISPR gRNA sequence
cttatttggaaaccagtcat

SEQ ID NO: 394899 - DNA, 20 bp, Artificial
  CRISPR gRNA sequence
ttatttggaaaccagtcata

SEQ ID NO: 394900 - DNA, 20 bp, Artificial
  CRISPR gRNA sequence
atttggaaaccagtcatatt

SEQ ID NO: 394901 - DNA, 20 bp, Artificial
  CRISPR gRNA sequence
tttggaaaccagtcatattg

SEQ ID NO: 394902 - DNA, 20 bp, Artificial
  CRISPR gRNA sequence
ggaaaccagtcatattggat

SEQ ID NO: 394903 - DNA, 20 bp, Artificial
  CRISPR gRNA sequence
gaaaccagtcatattggatt

SEQ ID NO: 394904 - DNA, 20 bp, Artificial
  CRISPR gRNA sequence
gattagatcccaccctaata

SEQ ID NO: 394905 - DNA, 20 bp, Artificial
  CRISPR gRNA sequence
gatcccaccctaataacctc

SEQ ID NO: 394906 - DNA, 20 bp, Artificial
  CRISPR gRNA sequence
ataacctcattttaacttaa

SEQ ID NO: 394907 - DNA, 20 bp, Artificial
  CRISPR gRNA sequence
attttaacttaattacctct

SEQ ID NO: 394908 - DNA, 20 bp, Artificial
  CRISPR gRNA sequence
taacttaattacctctttaa

SEQ ID NO: 394909 - DNA, 20 bp, Artificial
  CRISPR gRNA sequence
aacttaattacctctttaaa

SEQ ID NO: 394910 - DNA, 20 bp, Artificial
  CRISPR gRNA sequence
acttaattacctctttaaaa

SEQ ID NO: 394911 - DNA, 20 bp, Artificial
  CRISPR gRNA sequence
aattacctctttaaaagcct

SEQ ID NO: 394912 - DNA, 20 bp, Artificial
  CRISPR gRNA sequence
attacctctttaaaagcctc

SEQ ID NO: 394913 - DNA, 20 bp, Artificial
  CRISPR gRNA sequence
cctctttaaaagcctcattt

SEQ ID NO: 394914 - DNA, 20 bp, Artificial
  CRISPR gRNA sequence
tttaaaagcctcatttccaa

SEQ ID NO: 394915 - DNA, 20 bp, Artificial
  CRISPR gRNA sequence
taaaagcctcatttccaaat

SEQ ID NO: 394916 - DNA, 20 bp, Artificial
  CRISPR gRNA sequence
aaaagcctcatttccaaata

SEQ ID NO: 394917 - DNA, 20 bp, Artificial
  CRISPR gRNA sequence
aaagcctcatttccaaatag

SEQ ID NO: 394918 - DNA, 20 bp, Artificial
  CRISPR gRNA sequence
atttccaaatagtcaccttc

SEQ ID NO: 394919 - DNA, 20 bp, Artificial
  CRISPR gRNA sequence
ccaaatagtcaccttctgag

SEQ ID NO: 394920 - DNA, 20 bp, Artificial
  CRISPR gRNA sequence
caaatagtcaccttctgaga

SEQ ID NO: 394921 - DNA, 20 bp, Artificial
  CRISPR gRNA sequence
ctgagatatcaggagttgca

SEQ ID NO: 394922 - DNA, 20 bp, Artificial
  CRISPR gRNA sequence
tgagatatcaggagttgcaa

SEQ ID NO: 394923 - DNA, 20 bp, Artificial
  CRISPR gRNA sequence
agatatcaggagttgcaact

SEQ ID NO: 394924 - DNA, 20 bp, Artificial
  CRISPR gRNA sequence
caacttcaccaaataaactt

SEQ ID NO: 394925 - DNA, 20 bp, Artificial
  CRISPR gRNA sequence
caccaaataaacttggggac

SEQ ID NO: 394926 - DNA, 20 bp, Artificial
  CRISPR gRNA sequence
accaaataaacttggggaca

SEQ ID NO: 394927 - DNA, 20 bp, Artificial
  CRISPR gRNA sequence
ggggacacaattctcctgac

SEQ ID NO: 394928 - DNA, 20 bp, Artificial
  CRISPR gRNA sequence
gggacacaattctcctgact

SEQ ID NO: 394929 - DNA, 20 bp, Artificial
  CRISPR gRNA sequence
tcctgacttgtctttcctct

SEQ ID NO: 394930 - DNA, 20 bp, Artificial
  CRISPR gRNA sequence
ctgacttgtctttcctctat

SEQ ID NO: 394931 - DNA, 20 bp, Artificial
  CRISPR gRNA sequence
acttgtctttcctctattct

SEQ ID NO: 394932 - DNA, 20 bp, Artificial
  CRISPR gRNA sequence
gtctttcctctattctctct

SEQ ID NO: 394933 - DNA, 20 bp, Artificial
  CRISPR gRNA sequence
tctttcctctattctctctt

SEQ ID NO: 394934 - DNA, 20 bp, Artificial
  CRISPR gRNA sequence
tcctctattctctcttactt

SEQ ID NO: 394935 - DNA, 20 bp, Artificial
  CRISPR gRNA sequence
cctctattctctcttacttc

SEQ ID NO: 394936 - DNA, 20 bp, Artificial
  CRISPR gRNA sequence
ctctattctctcttacttcc

SEQ ID NO: 394937 - DNA, 20 bp, Artificial
  CRISPR gRNA sequence
tattctctcttacttccaat

SEQ ID NO: 394938 - DNA, 20 bp, Artificial
  CRISPR gRNA sequence
ttctctcttacttccaatct

SEQ ID NO: 394939 - DNA, 20 bp, Artificial
  CRISPR gRNA sequence
tctcttacttccaatctctc

SEQ ID NO: 394940 - DNA, 20 bp, Artificial
  CRISPR gRNA sequence
tcttacttccaatctctctt

SEQ ID NO: 394941 - DNA, 20 bp, Artificial
  CRISPR gRNA sequence
ttacttccaatctctcttct

SEQ ID NO: 394942 - DNA, 20 bp, Artificial
  CRISPR gRNA sequence
acttccaatctctcttctaa

SEQ ID NO: 394943 - DNA, 20 bp, Artificial
  CRISPR gRNA sequence
cttccaatctctcttctaaa

SEQ ID NO: 394944 - DNA, 20 bp, Artificial
  CRISPR gRNA sequence
ccaatctctcttctaaaccc

SEQ ID NO: 394945 - DNA, 20 bp, Artificial
  CRISPR gRNA sequence
caatctctcttctaaaccct

SEQ ID NO: 394946 - DNA, 20 bp, Artificial
  CRISPR gRNA sequence
tcttctaaaccctgtctgag

SEQ ID NO: 394947 - DNA, 20 bp, Artificial
  CRISPR gRNA sequence
ttctaaaccctgtctgagtg

SEQ ID NO: 394948 - DNA, 20 bp, Artificial
  CRISPR gRNA sequence
ctaaaccctgtctgagtgct

SEQ ID NO: 394949 - DNA, 20 bp, Artificial
  CRISPR gRNA sequence
taaaccctgtctgagtgctc

SEQ ID NO: 394950 - DNA, 20 bp, Artificial
  CRISPR gRNA sequence
aaccctgtctgagtgctctt

SEQ ID NO: 394951 - DNA, 20 bp, Artificial
  CRISPR gRNA sequence
tctgagtgctctttctaact

SEQ ID NO: 394952 - DNA, 20 bp, Artificial
  CRISPR gRNA sequence
agtgctctttctaactgcag

SEQ ID NO: 394953 - DNA, 20 bp, Artificial
  CRISPR gRNA sequence
tttctaactgcagactaatc

SEQ ID NO: 394954 - DNA, 20 bp, Artificial
  CRISPR gRNA sequence
tctaactgcagactaatcga

SEQ ID NO: 394955 - DNA, 20 bp, Artificial
  CRISPR gRNA sequence
ctaactgcagactaatcgaa

SEQ ID NO: 394956 - DNA, 20 bp, Artificial
  CRISPR gRNA sequence
taactgcagactaatcgaaa

SEQ ID NO: 394957 - DNA, 20 bp, Artificial
  CRISPR gRNA sequence
actgcagactaatcgaaatc

SEQ ID NO: 394958 - DNA, 20 bp, Artificial
  CRISPR gRNA sequence
cagactaatcgaaatccctt

SEQ ID NO: 394959 - DNA, 20 bp, Artificial
  CRISPR gRNA sequence
atcgaaatcccttgcctaaa

SEQ ID NO: 394960 - DNA, 20 bp, Artificial
  CRISPR gRNA sequence
gcctaaaatctaaagtcaaa

SEQ ID NO: 394961 - DNA, 20 bp, Artificial
  CRISPR gRNA sequence
cctaaaatctaaagtcaaaa

SEQ ID NO: 394962 - DNA, 20 bp, Artificial
  CRISPR gRNA sequence
aaatctaaagtcaaaatatc

SEQ ID NO: 394963 - DNA, 20 bp, Artificial
  CRISPR gRNA sequence
aagtcaaaatatcttagaat

SEQ ID NO: 394964 - DNA, 20 bp, Artificial
  CRISPR gRNA sequence
agaatagtgtacatttgtga

SEQ ID NO: 394965 - DNA, 20 bp, Artificial
  CRISPR gRNA sequence
gaatagtgtacatttgtgac

SEQ ID NO: 394966 - DNA, 20 bp, Artificial
  CRISPR gRNA sequence
gtgacatgacacgacaatgt

SEQ ID NO: 394967 - DNA, 20 bp, Artificial
  CRISPR gRNA sequence
tgacatgacacgacaatgta

SEQ ID NO: 394968 - DNA, 20 bp, Artificial
  CRISPR gRNA sequence
gagggaagtaaagctcctac

SEQ ID NO: 394969 - DNA, 20 bp, Artificial
  CRISPR gRNA sequence
ctactcccagcccactgcaa

SEQ ID NO: 394970 - DNA, 20 bp, Artificial
  CRISPR gRNA sequence
ctcccagcccactgcaaaga

SEQ ID NO: 394971 - DNA, 20 bp, Artificial
  CRISPR gRNA sequence
ccagcccactgcaaagaaaa

SEQ ID NO: 394972 - DNA, 20 bp, Artificial
  CRISPR gRNA sequence
caaagaaaatgcatctaagt

SEQ ID NO: 394973 - DNA, 20 bp, Artificial
  CRISPR gRNA sequence
agtaagcatgtgggtttgct

SEQ ID NO: 394974 - DNA, 20 bp, Artificial
  CRISPR gRNA sequence
gctgtgaacatgcagttcca

SEQ ID NO: 394975 - DNA, 20 bp, Artificial
  CRISPR gRNA sequence
ctgtgaacatgcagttccaa

SEQ ID NO: 394976 - DNA, 20 bp, Artificial
  CRISPR gRNA sequence
tgaacatgcagttccaaatc

SEQ ID NO: 394977 - DNA, 20 bp, Artificial
  CRISPR gRNA sequence
caaatcaagtgttctgaatg

SEQ ID NO: 394978 - DNA, 20 bp, Artificial
  CRISPR gRNA sequence
tgaatgccccctcttctaag

SEQ ID NO: 394979 - DNA, 20 bp, Artificial
  CRISPR gRNA sequence
aatgccccctcttctaagca

SEQ ID NO: 394980 - DNA, 20 bp, Artificial
  CRISPR gRNA sequence
ttctaagcaaaaatctggag

SEQ ID NO: 394981 - DNA, 20 bp, Artificial
  CRISPR gRNA sequence
ctaagcaaaaatctggagct

SEQ ID NO: 394982 - DNA, 20 bp, Artificial
  CRISPR gRNA sequence
taagcaaaaatctggagctc

SEQ ID NO: 394983 - DNA, 20 bp, Artificial
  CRISPR gRNA sequence
agcaaaaatctggagctcct

SEQ ID NO: 394984 - DNA, 20 bp, Artificial
  CRISPR gRNA sequence
gagctcctgctgatcacaca

SEQ ID NO: 394985 - DNA, 20 bp, Artificial
  CRISPR gRNA sequence
ctgctgatcacacatcaaat

SEQ ID NO: 394986 - DNA, 20 bp, Artificial
  CRISPR gRNA sequence
ctgatcacacatcaaatttc

SEQ ID NO: 394987 - DNA, 20 bp, Artificial
  CRISPR gRNA sequence
atcacacatcaaatttcttt

SEQ ID NO: 394988 - DNA, 20 bp, Artificial
  CRISPR gRNA sequence
ctttatcaccactatccacc

SEQ ID NO: 394989 - DNA, 20 bp, Artificial
  CRISPR gRNA sequence
tttatcaccactatccaccc

SEQ ID NO: 394990 - DNA, 20 bp, Artificial
  CRISPR gRNA sequence
tatcaccactatccacccct

SEQ ID NO: 394991 - DNA, 20 bp, Artificial
  CRISPR gRNA sequence
atcaccactatccacccctc

SEQ ID NO: 394992 - DNA, 20 bp, Artificial
  CRISPR gRNA sequence
tcaccactatccacccctcc

SEQ ID NO: 394993 - DNA, 20 bp, Artificial
  CRISPR gRNA sequence
tccacccctccaagttcacc

SEQ ID NO: 394994 - DNA, 20 bp, Artificial
  CRISPR gRNA sequence
caagttcaccacctggcacc

SEQ ID NO: 394995 - DNA, 20 bp, Artificial
  CRISPR gRNA sequence
accacctggcaccactaccc

SEQ ID NO: 394996 - DNA, 20 bp, Artificial
  CRISPR gRNA sequence
gcaccactacccacttaaat

SEQ ID NO: 394997 - DNA, 20 bp, Artificial
  CRISPR gRNA sequence
cccacttaaattagctttta

SEQ ID NO: 394998 - DNA, 20 bp, Artificial
  CRISPR gRNA sequence
aaattagcttttactcaggc

SEQ ID NO: 394999 - DNA, 20 bp, Artificial
  CRISPR gRNA sequence
aattagcttttactcaggct

SEQ ID NO: 395000 - DNA, 20 bp, Artificial
  CRISPR gRNA sequence
gcttttactcaggctttatg

SEQ ID NO: 395001 - DNA, 20 bp, Artificial
  CRISPR gRNA sequence
ttactcaggctttatgatcc

SEQ ID NO: 395002 - DNA, 20 bp, Artificial
  CRISPR gRNA sequence
tactcaggctttatgatcca

SEQ ID NO: 395003 - DNA, 20 bp, Artificial
  CRISPR gRNA sequence
actcaggctttatgatccat

SEQ ID NO: 395004 - DNA, 20 bp, Artificial
  CRISPR gRNA sequence
ctcaggctttatgatccatc

SEQ ID NO: 395005 - DNA, 20 bp, Artificial
  CRISPR gRNA sequence
aggctttatgatccatcctg

SEQ ID NO: 395006 - DNA, 20 bp, Artificial
  CRISPR gRNA sequence
tatgatccatcctgcaattc

SEQ ID NO: 395007 - DNA, 20 bp, Artificial
  CRISPR gRNA sequence
atgatccatcctgcaattcc

SEQ ID NO: 395008 - DNA, 20 bp, Artificial
  CRISPR gRNA sequence
tgatccatcctgcaattccc

SEQ ID NO: 395009 - DNA, 20 bp, Artificial
  CRISPR gRNA sequence
caattcccaagcacaccagc

SEQ ID NO: 395010 - DNA, 20 bp, Artificial
  CRISPR gRNA sequence
ccaagcacaccagcctcatt

SEQ ID NO: 395011 - DNA, 20 bp, Artificial
  CRISPR gRNA sequence
attttgcttttgcgccatta

SEQ ID NO: 395012 - DNA, 20 bp, Artificial
  CRISPR gRNA sequence
tgcttttgcgccattagcat

SEQ ID NO: 395013 - DNA, 20 bp, Artificial
  CRISPR gRNA sequence
gcttttgcgccattagcatg

SEQ ID NO: 395014 - DNA, 20 bp, Artificial
  CRISPR gRNA sequence
cttttgcgccattagcatga

SEQ ID NO: 395015 - DNA, 20 bp, Artificial
  CRISPR gRNA sequence
ttgcgccattagcatgattt

SEQ ID NO: 395016 - DNA, 20 bp, Artificial
  CRISPR gRNA sequence
tgcgccattagcatgatttc

SEQ ID NO: 395017 - DNA, 20 bp, Artificial
  CRISPR gRNA sequence
gcgccattagcatgatttcc

SEQ ID NO: 395018 - DNA, 20 bp, Artificial
  CRISPR gRNA sequence
cgccattagcatgatttccc

SEQ ID NO: 395019 - DNA, 20 bp, Artificial
  CRISPR gRNA sequence
gcatgatttccctccagcag

SEQ ID NO: 395020 - DNA, 20 bp, Artificial
  CRISPR gRNA sequence
ccctccagcaggaatgccat

SEQ ID NO: 395021 - DNA, 20 bp, Artificial
  CRISPR gRNA sequence
cctccagcaggaatgccatc

SEQ ID NO: 395022 - DNA, 20 bp, Artificial
  CRISPR gRNA sequence
cagcaggaatgccatccagc

SEQ ID NO: 395023 - DNA, 20 bp, Artificial
  CRISPR gRNA sequence
acagcatgaccacgcttcag

SEQ ID NO: 395024 - DNA, 20 bp, Artificial
  CRISPR gRNA sequence
cagtccgttctcatcttccc

SEQ ID NO: 395025 - DNA, 20 bp, Artificial
  CRISPR gRNA sequence
agtccgttctcatcttccct

SEQ ID NO: 395026 - DNA, 20 bp, Artificial
  CRISPR gRNA sequence
tcatcttccctcatgagtaa

SEQ ID NO: 395027 - DNA, 20 bp, Artificial
  CRISPR gRNA sequence
atcttccctcatgagtaagc

SEQ ID NO: 395028 - DNA, 20 bp, Artificial
  CRISPR gRNA sequence
ccctcatgagtaagctctcg

SEQ ID NO: 395029 - DNA, 20 bp, Artificial
  CRISPR gRNA sequence
cctcatgagtaagctctcgt

SEQ ID NO: 395030 - DNA, 20 bp, Artificial
  CRISPR gRNA sequence
atgagtaagctctcgtgtct

SEQ ID NO: 395031 - DNA, 20 bp, Artificial
  CRISPR gRNA sequence
tcgtgtcttctgatctctga

SEQ ID NO: 395032 - DNA, 20 bp, Artificial
  CRISPR gRNA sequence
gtgtcttctgatctctgaag

SEQ ID NO: 395033 - DNA, 20 bp, Artificial
  CRISPR gRNA sequence
ctgatctctgaagttccttg

SEQ ID NO: 395034 - DNA, 20 bp, Artificial
  CRISPR gRNA sequence
tgatctctgaagttccttga

SEQ ID NO: 395035 - DNA, 20 bp, Artificial
  CRISPR gRNA sequence
atctctgaagttccttgaat

SEQ ID NO: 395036 - DNA, 20 bp, Artificial
  CRISPR gRNA sequence
tgaagttccttgaatgaccc

SEQ ID NO: 395037 - DNA, 20 bp, Artificial
  CRISPR gRNA sequence
aagttccttgaatgacccct

SEQ ID NO: 395038 - DNA, 20 bp, Artificial
  CRISPR gRNA sequence
cttgaatgaccccttccctc

SEQ ID NO: 395039 - DNA, 20 bp, Artificial
  CRISPR gRNA sequence
gaatgaccccttccctcact

SEQ ID NO: 395040 - DNA, 20 bp, Artificial
  CRISPR gRNA sequence
aatgaccccttccctcactc

SEQ ID NO: 395041 - DNA, 20 bp, Artificial
  CRISPR gRNA sequence
ccctcactccacaaccctcc

SEQ ID NO: 395042 - DNA, 20 bp, Artificial
  CRISPR gRNA sequence
cctcactccacaaccctcct

SEQ ID NO: 395043 - DNA, 20 bp, Artificial
  CRISPR gRNA sequence
actccacaaccctccttccc

SEQ ID NO: 395044 - DNA, 20 bp, Artificial
  CRISPR gRNA sequence
cacaaccctccttcccacat

SEQ ID NO: 395045 - DNA, 20 bp, Artificial
  CRISPR gRNA sequence
cttcccacatgcacacacat

SEQ ID NO: 395046 - DNA, 20 bp, Artificial
  CRISPR gRNA sequence
cccacatgcacacacataca

SEQ ID NO: 395047 - DNA, 20 bp, Artificial
  CRISPR gRNA sequence
ccacatgcacacacatacac

SEQ ID NO: 395048 - DNA, 20 bp, Artificial
  CRISPR gRNA sequence
tcacgacccactcctagctc

SEQ ID NO: 395049 - DNA, 20 bp, Artificial
  CRISPR gRNA sequence
ctagctccaccaattcccgt

SEQ ID NO: 395050 - DNA, 20 bp, Artificial
  CRISPR gRNA sequence
gctccaccaattcccgtcct

SEQ ID NO: 395051 - DNA, 20 bp, Artificial
  CRISPR gRNA sequence
caccaattcccgtcctctgc

SEQ ID NO: 395052 - DNA, 20 bp, Artificial
  CRISPR gRNA sequence
ccgtcctctgcacacaaaca

SEQ ID NO: 395053 - DNA, 20 bp, Artificial
  CRISPR gRNA sequence
tgcacacaaacaatgtaagc

SEQ ID NO: 395054 - DNA, 20 bp, Artificial
  CRISPR gRNA sequence
cacacaaacaatgtaagcat

SEQ ID NO: 395055 - DNA, 20 bp, Artificial
  CRISPR gRNA sequence
gagcttgagatgagggactg

SEQ ID NO: 395056 - DNA, 20 bp, Artificial
  CRISPR gRNA sequence
agcttgagatgagggactgg

SEQ ID NO: 395057 - DNA, 20 bp, Artificial
  CRISPR gRNA sequence
gagatgagggactgggacat

SEQ ID NO: 395058 - DNA, 20 bp, Artificial
  CRISPR gRNA sequence
agatgagggactgggacatt

SEQ ID NO: 395059 - DNA, 20 bp, Artificial
  CRISPR gRNA sequence
ggacatttctcctgtatgcc

SEQ ID NO: 395060 - DNA, 20 bp, Artificial
  CRISPR gRNA sequence
ctcctgtatgcctccaacct

SEQ ID NO: 395061 - DNA, 20 bp, Artificial
  CRISPR gRNA sequence
tcctgtatgcctccaacctc

SEQ ID NO: 395062 - DNA, 20 bp, Artificial
  CRISPR gRNA sequence
ctgtatgcctccaacctcac

SEQ ID NO: 395063 - DNA, 20 bp, Artificial
  CRISPR gRNA sequence
tatgcctccaacctcacaca

SEQ ID NO: 395064 - DNA, 20 bp, Artificial
  CRISPR gRNA sequence
caacctcacacaggcccagc

SEQ ID NO: 395065 - DNA, 20 bp, Artificial
  CRISPR gRNA sequence
acacaggcccagcatatgac

SEQ ID NO: 395066 - DNA, 20 bp, Artificial
  CRISPR gRNA sequence
aataaacatttatagaatta

SEQ ID NO: 395067 - DNA, 20 bp, Artificial
  CRISPR gRNA sequence
atagaattaaagagcgggga

SEQ ID NO: 395068 - DNA, 20 bp, Artificial
  CRISPR gRNA sequence
tagaattaaagagcggggaa

SEQ ID NO: 395069 - DNA, 20 bp, Artificial
  CRISPR gRNA sequence
aagagcggggaaatgggaag

SEQ ID NO: 395070 - DNA, 20 bp, Artificial
  CRISPR gRNA sequence
gcagcaggggagctttcctg

SEQ ID NO: 395071 - DNA, 20 bp, Artificial
  CRISPR gRNA sequence
cagcaggggagctttcctgg

SEQ ID NO: 395072 - DNA, 20 bp, Artificial
  CRISPR gRNA sequence
tcctggtgtgtaatttggaa

SEQ ID NO: 395073 - DNA, 20 bp, Artificial
  CRISPR gRNA sequence
cctggtgtgtaatttggaaa

SEQ ID NO: 395074 - DNA, 20 bp, Artificial
  CRISPR gRNA sequence
ctggtgtgtaatttggaaag

SEQ ID NO: 395075 - DNA, 20 bp, Artificial
  CRISPR gRNA sequence
gtgtgtaatttggaaagact

SEQ ID NO: 395076 - DNA, 20 bp, Artificial
  CRISPR gRNA sequence
ggaaagactgctctggtggg

SEQ ID NO: 395077 - DNA, 20 bp, Artificial
  CRISPR gRNA sequence
gaaagactgctctggtgggc

SEQ ID NO: 395078 - DNA, 20 bp, Artificial
  CRISPR gRNA sequence
ctctggtgggctgcaccgtg

SEQ ID NO: 395079 - DNA, 20 bp, Artificial
  CRISPR gRNA sequence
tggtgggctgcaccgtgggg

SEQ ID NO: 395080 - DNA, 20 bp, Artificial
  CRISPR gRNA sequence
gtgggctgcaccgtgggggc

SEQ ID NO: 395081 - DNA, 20 bp, Artificial
  CRISPR gRNA sequence
caccgtgggggcagtgtcct

SEQ ID NO: 395082 - DNA, 20 bp, Artificial
  CRISPR gRNA sequence
cctcactgcagggccacagg

SEQ ID NO: 395083 - DNA, 20 bp, Artificial
  CRISPR gRNA sequence
actgcagggccacaggcctc

SEQ ID NO: 395084 - DNA, 20 bp, Artificial
  CRISPR gRNA sequence
cagggccacaggcctcccac

SEQ ID NO: 395085 - DNA, 20 bp, Artificial
  CRISPR gRNA sequence
ccactttcttgcctgttttc

SEQ ID NO: 395086 - DNA, 20 bp, Artificial
  CRISPR gRNA sequence
tcttgcctgttttcgtgtct

SEQ ID NO: 395087 - DNA, 20 bp, Artificial
  CRISPR gRNA sequence
cttgcctgttttcgtgtctc

SEQ ID NO: 395088 - DNA, 20 bp, Artificial
  CRISPR gRNA sequence
ttgcctgttttcgtgtctcc

SEQ ID NO: 395089 - DNA, 20 bp, Artificial
  CRISPR gRNA sequence
gcctgttttcgtgtctccta

SEQ ID NO: 395090 - DNA, 20 bp, Artificial
  CRISPR gRNA sequence
cctgttttcgtgtctcctat

SEQ ID NO: 395091 - DNA, 20 bp, Artificial
  CRISPR gRNA sequence
ttttcgtgtctcctatctgc

SEQ ID NO: 395092 - DNA, 20 bp, Artificial
  CRISPR gRNA sequence
tcgtgtctcctatctgcctg

SEQ ID NO: 395093 - DNA, 20 bp, Artificial
  CRISPR gRNA sequence
cgtgtctcctatctgcctgc

SEQ ID NO: 395094 - DNA, 20 bp, Artificial
  CRISPR gRNA sequence
gtgtctcctatctgcctgct

SEQ ID NO: 395095 - DNA, 20 bp, Artificial
  CRISPR gRNA sequence
ctatctgcctgcttttgtgc

SEQ ID NO: 395096 - DNA, 20 bp, Artificial
  CRISPR gRNA sequence
tctgcctgcttttgtgcctc

SEQ ID NO: 395097 - DNA, 20 bp, Artificial
  CRISPR gRNA sequence
cctgcttttgtgcctcctat

SEQ ID NO: 395098 - DNA, 20 bp, Artificial
  CRISPR gRNA sequence
cttttgtgcctcctatcttt

SEQ ID NO: 395099 - DNA, 20 bp, Artificial
  CRISPR gRNA sequence
ttgtgcctcctatctttctg

SEQ ID NO: 395100 - DNA, 20 bp, Artificial
  CRISPR gRNA sequence
tgtgcctcctatctttctgc

SEQ ID NO: 395101 - DNA, 20 bp, Artificial
  CRISPR gRNA sequence
gtgcctcctatctttctgcc

SEQ ID NO: 395102 - DNA, 20 bp, Artificial
  CRISPR gRNA sequence
tgcctcctatctttctgcct

SEQ ID NO: 395103 - DNA, 20 bp, Artificial
  CRISPR gRNA sequence
ctatctttctgccttcctac

SEQ ID NO: 395104 - DNA, 20 bp, Artificial
  CRISPR gRNA sequence
tctttctgccttcctacctc

SEQ ID NO: 395105 - DNA, 20 bp, Artificial
  CRISPR gRNA sequence
tctgccttcctacctctaca

SEQ ID NO: 395106 - DNA, 20 bp, Artificial
  CRISPR gRNA sequence
ctgccttcctacctctacat

SEQ ID NO: 395107 - DNA, 20 bp, Artificial
  CRISPR gRNA sequence
tgccttcctacctctacatc

SEQ ID NO: 395108 - DNA, 20 bp, Artificial
  CRISPR gRNA sequence
ccttcctacctctacatcat

SEQ ID NO: 395109 - DNA, 20 bp, Artificial
  CRISPR gRNA sequence
cctacctctacatcatcctc

SEQ ID NO: 395110 - DNA, 20 bp, Artificial
  CRISPR gRNA sequence
ctacctctacatcatcctcc

SEQ ID NO: 395111 - DNA, 20 bp, Artificial
  CRISPR gRNA sequence
cctctacatcatcctccgtg

SEQ ID NO: 395112 - DNA, 20 bp, Artificial
  CRISPR gRNA sequence
tacatcatcctccgtgctgt

SEQ ID NO: 395113 - DNA, 20 bp, Artificial
  CRISPR gRNA sequence
catcatcctccgtgctgttg

SEQ ID NO: 395114 - DNA, 20 bp, Artificial
  CRISPR gRNA sequence
cgtgctgttggtagggtcat

SEQ ID NO: 395115 - DNA, 20 bp, Artificial
  CRISPR gRNA sequence
ttggtagggtcatggctccc

SEQ ID NO: 395116 - DNA, 20 bp, Artificial
  CRISPR gRNA sequence
gtagggtcatggctcccaat

SEQ ID NO: 395117 - DNA, 20 bp, Artificial
  CRISPR gRNA sequence
ccaatcatggccaacatgag

SEQ ID NO: 395118 - DNA, 20 bp, Artificial
  CRISPR gRNA sequence
tcactatttgaaaactttac

SEQ ID NO: 395119 - DNA, 20 bp, Artificial
  CRISPR gRNA sequence
cactatttgaaaactttact

SEQ ID NO: 395120 - DNA, 20 bp, Artificial
  CRISPR gRNA sequence
actatttgaaaactttacta

SEQ ID NO: 395121 - DNA, 20 bp, Artificial
  CRISPR gRNA sequence
tttgaaaactttactaacaa

SEQ ID NO: 395122 - DNA, 20 bp, Artificial
  CRISPR gRNA sequence
gaaaactttactaacaacca

SEQ ID NO: 395123 - DNA, 20 bp, Artificial
  CRISPR gRNA sequence
aaaactttactaacaaccaa

SEQ ID NO: 395124 - DNA, 20 bp, Artificial
  CRISPR gRNA sequence
tactaacaaccaaatgaagt

SEQ ID NO: 395125 - DNA, 20 bp, Artificial
  CRISPR gRNA sequence
actaacaaccaaatgaagtc

SEQ ID NO: 395126 - DNA, 20 bp, Artificial
  CRISPR gRNA sequence
ctaacaaccaaatgaagtcc

SEQ ID NO: 395127 - DNA, 20 bp, Artificial
  CRISPR gRNA sequence
acaaccaaatgaagtccaaa

SEQ ID NO: 395128 - DNA, 20 bp, Artificial
  CRISPR gRNA sequence
gaccttccaccctccgacct

SEQ ID NO: 395129 - DNA, 20 bp, Artificial
  CRISPR gRNA sequence
ccaccctccgaccttcccct

SEQ ID NO: 395130 - DNA, 20 bp, Artificial
  CRISPR gRNA sequence
caccctccgaccttccccta

SEQ ID NO: 395131 - DNA, 20 bp, Artificial
  CRISPR gRNA sequence
cgaccttcccctaagcctct

SEQ ID NO: 395132 - DNA, 20 bp, Artificial
  CRISPR gRNA sequence
cccctaagcctctggccaaa

SEQ ID NO: 395133 - DNA, 20 bp, Artificial
  CRISPR gRNA sequence
ccctaagcctctggccaaat

SEQ ID NO: 395134 - DNA, 20 bp, Artificial
  CRISPR gRNA sequence
agcctctggccaaatttgtt

SEQ ID NO: 395135 - DNA, 20 bp, Artificial
  CRISPR gRNA sequence
tggccaaatttgtttttcat

SEQ ID NO: 395136 - DNA, 20 bp, Artificial
  CRISPR gRNA sequence
gccaaatttgtttttcatgt

SEQ ID NO: 395137 - DNA, 20 bp, Artificial
  CRISPR gRNA sequence
gtttttcatgtgcctcaaac

SEQ ID NO: 395138 - DNA, 20 bp, Artificial
  CRISPR gRNA sequence
tttttcatgtgcctcaaaca

SEQ ID NO: 395139 - DNA, 20 bp, Artificial
  CRISPR gRNA sequence
ttcatgtgcctcaaacacaa

SEQ ID NO: 395140 - DNA, 20 bp, Artificial
  CRISPR gRNA sequence
tcatgtgcctcaaacacaaa

SEQ ID NO: 395141 - DNA, 20 bp, Artificial
  CRISPR gRNA sequence
catgtgcctcaaacacaaag

SEQ ID NO: 395142 - DNA, 20 bp, Artificial
  CRISPR gRNA sequence
atgtgcctcaaacacaaaga

SEQ ID NO: 395143 - DNA, 20 bp, Artificial
  CRISPR gRNA sequence
aaacacaaagagcatctccc

SEQ ID NO: 395144 - DNA, 20 bp, Artificial
  CRISPR gRNA sequence
cctggtatgcgatgtttctt

SEQ ID NO: 395145 - DNA, 20 bp, Artificial
  CRISPR gRNA sequence
gtatgcgatgtttcttgtga

SEQ ID NO: 395146 - DNA, 20 bp, Artificial
  CRISPR gRNA sequence
cttgtgatgcactttcctgt

SEQ ID NO: 395147 - DNA, 20 bp, Artificial
  CRISPR gRNA sequence
ttgtgatgcactttcctgtt

SEQ ID NO: 395148 - DNA, 20 bp, Artificial
  CRISPR gRNA sequence
gtgatgcactttcctgtttg

SEQ ID NO: 395149 - DNA, 20 bp, Artificial
  CRISPR gRNA sequence
tgatgcactttcctgtttga

SEQ ID NO: 395150 - DNA, 20 bp, Artificial
  CRISPR gRNA sequence
tcctgtttgaacttcctccc

SEQ ID NO: 395151 - DNA, 20 bp, Artificial
  CRISPR gRNA sequence
cctgtttgaacttcctccct

SEQ ID NO: 395152 - DNA, 20 bp, Artificial
  CRISPR gRNA sequence
ctgtttgaacttcctccctc

SEQ ID NO: 395153 - DNA, 20 bp, Artificial
  CRISPR gRNA sequence
tttgaacttcctccctcttc

SEQ ID NO: 395154 - DNA, 20 bp, Artificial
  CRISPR gRNA sequence
gaacttcctccctcttcctg

SEQ ID NO: 395155 - DNA, 20 bp, Artificial
  CRISPR gRNA sequence
aacttcctccctcttcctgc

SEQ ID NO: 395156 - DNA, 20 bp, Artificial
  CRISPR gRNA sequence
cctccctcttcctgccagcc

SEQ ID NO: 395157 - DNA, 20 bp, Artificial
  CRISPR gRNA sequence
ctccctcttcctgccagccc

SEQ ID NO: 395158 - DNA, 20 bp, Artificial
  CRISPR gRNA sequence
cctcttcctgccagcccttg

SEQ ID NO: 395159 - DNA, 20 bp, Artificial
  CRISPR gRNA sequence
ttcctgccagcccttgtctc

SEQ ID NO: 395160 - DNA, 20 bp, Artificial
  CRISPR gRNA sequence
cctgccagcccttgtctcca

SEQ ID NO: 395161 - DNA, 20 bp, Artificial
  CRISPR gRNA sequence
ctgccagcccttgtctccat

SEQ ID NO: 395162 - DNA, 20 bp, Artificial
  CRISPR gRNA sequence
ccagcccttgtctccattca

SEQ ID NO: 395163 - DNA, 20 bp, Artificial
  CRISPR gRNA sequence
gtctccattcatccaaatta

SEQ ID NO: 395164 - DNA, 20 bp, Artificial
  CRISPR gRNA sequence
tctccattcatccaaattac

SEQ ID NO: 395165 - DNA, 20 bp, Artificial
  CRISPR gRNA sequence
cattcatccaaattacacct

SEQ ID NO: 395166 - DNA, 20 bp, Artificial
  CRISPR gRNA sequence
atccaaattacacctatatt

SEQ ID NO: 395167 - DNA, 20 bp, Artificial
  CRISPR gRNA sequence
cacctatatttccaggccat

SEQ ID NO: 395168 - DNA, 20 bp, Artificial
  CRISPR gRNA sequence
tatttccaggccatggtttc

SEQ ID NO: 395169 - DNA, 20 bp, Artificial
  CRISPR gRNA sequence
ccaggccatggtttccccaa

SEQ ID NO: 395170 - DNA, 20 bp, Artificial
  CRISPR gRNA sequence
caggccatggtttccccaaa

SEQ ID NO: 395171 - DNA, 20 bp, Artificial
  CRISPR gRNA sequence
ccccaaaccagaagtaacct

SEQ ID NO: 395172 - DNA, 20 bp, Artificial
  CRISPR gRNA sequence
cccaaaccagaagtaacctc

SEQ ID NO: 395173 - DNA, 20 bp, Artificial
  CRISPR gRNA sequence
tgtcacctccaactccccaa

SEQ ID NO: 395174 - DNA, 20 bp, Artificial
  CRISPR gRNA sequence
tcacctccaactccccaaac

SEQ ID NO: 395175 - DNA, 20 bp, Artificial
  CRISPR gRNA sequence
caactccccaaaccttgctt

SEQ ID NO: 395176 - DNA, 20 bp, Artificial
  CRISPR gRNA sequence
cccaaaccttgctttaagct

SEQ ID NO: 395177 - DNA, 20 bp, Artificial
  CRISPR gRNA sequence
gctttaagctactttccaaa

SEQ ID NO: 395178 - DNA, 20 bp, Artificial
  CRISPR gRNA sequence
ctttaagctactttccaaat

SEQ ID NO: 395179 - DNA, 20 bp, Artificial
  CRISPR gRNA sequence
taagctactttccaaattcc

SEQ ID NO: 395180 - DNA, 20 bp, Artificial
  CRISPR gRNA sequence
aagctactttccaaattcca

SEQ ID NO: 395181 - DNA, 20 bp, Artificial
  CRISPR gRNA sequence
agctactttccaaattccac

SEQ ID NO: 395182 - DNA, 20 bp, Artificial
  CRISPR gRNA sequence
ctttccaaattccaccttgc

SEQ ID NO: 395183 - DNA, 20 bp, Artificial
  CRISPR gRNA sequence
tccaaattccaccttgcatt

SEQ ID NO: 395184 - DNA, 20 bp, Artificial
  CRISPR gRNA sequence
ccaaattccaccttgcatta

SEQ ID NO: 395185 - DNA, 20 bp, Artificial
  CRISPR gRNA sequence
caaattccaccttgcattac

SEQ ID NO: 395186 - DNA, 20 bp, Artificial
  CRISPR gRNA sequence
caccttgcattacagtcact

SEQ ID NO: 395187 - DNA, 20 bp, Artificial
  CRISPR gRNA sequence
gcattacagtcacttggccc

SEQ ID NO: 395188 - DNA, 20 bp, Artificial
  CRISPR gRNA sequence
cattacagtcacttggccca

SEQ ID NO: 395189 - DNA, 20 bp, Artificial
  CRISPR gRNA sequence
cagtcacttggcccaaacgt

SEQ ID NO: 395190 - DNA, 20 bp, Artificial
  CRISPR gRNA sequence
ggcccaaacgttttacatgg

SEQ ID NO: 395191 - DNA, 20 bp, Artificial
  CRISPR gRNA sequence
gcccaaacgttttacatggc

SEQ ID NO: 395192 - DNA, 20 bp, Artificial
  CRISPR gRNA sequence
tacatggcgtataggcatac

SEQ ID NO: 395193 - DNA, 20 bp, Artificial
  CRISPR gRNA sequence
acatggcgtataggcataca

SEQ ID NO: 395194 - DNA, 20 bp, Artificial
  CRISPR gRNA sequence
catggcgtataggcatacat

SEQ ID NO: 395195 - DNA, 20 bp, Artificial
  CRISPR gRNA sequence
tttcttttcctcacagcaaa

SEQ ID NO: 395196 - DNA, 20 bp, Artificial
  CRISPR gRNA sequence
tcttttcctcacagcaaaca

SEQ ID NO: 395197 - DNA, 20 bp, Artificial
  CRISPR gRNA sequence
cttttcctcacagcaaacaa

SEQ ID NO: 395198 - DNA, 20 bp, Artificial
  CRISPR gRNA sequence
ttttcctcacagcaaacaat

SEQ ID NO: 395199 - DNA, 20 bp, Artificial
  CRISPR gRNA sequence
ttcctcacagcaaacaataa

SEQ ID NO: 395200 - DNA, 20 bp, Artificial
  CRISPR gRNA sequence
tcctcacagcaaacaataat

SEQ ID NO: 395201 - DNA, 20 bp, Artificial
  CRISPR gRNA sequence
cctcacagcaaacaataata

SEQ ID NO: 395202 - DNA, 20 bp, Artificial
  CRISPR gRNA sequence
ctcacagcaaacaataatat

SEQ ID NO: 395203 - DNA, 20 bp, Artificial
  CRISPR gRNA sequence
acagcaaacaataatatcta

SEQ ID NO: 395204 - DNA, 20 bp, Artificial
  CRISPR gRNA sequence
ttcaacagatttaggtaaga

SEQ ID NO: 395205 - DNA, 20 bp, Artificial
  CRISPR gRNA sequence
aacagatttaggtaagattt

SEQ ID NO: 395206 - DNA, 20 bp, Artificial
  CRISPR gRNA sequence
aggtaagatttacagggatt

SEQ ID NO: 395207 - DNA, 20 bp, Artificial
  CRISPR gRNA sequence
ggtaagatttacagggattt

SEQ ID NO: 395208 - DNA, 20 bp, Artificial
  CRISPR gRNA sequence
acagggattttttaattact

SEQ ID NO: 395209 - DNA, 20 bp, Artificial
  CRISPR gRNA sequence
cagggattttttaattactg

SEQ ID NO: 395210 - DNA, 20 bp, Artificial
  CRISPR gRNA sequence
tttaattactgttatcatcc

SEQ ID NO: 395211 - DNA, 20 bp, Artificial
  CRISPR gRNA sequence
ttaattactgttatcatcct

SEQ ID NO: 395212 - DNA, 20 bp, Artificial
  CRISPR gRNA sequence
taattactgttatcatcctt

SEQ ID NO: 395213 - DNA, 20 bp, Artificial
  CRISPR gRNA sequence
aattactgttatcatccttc

SEQ ID NO: 395214 - DNA, 20 bp, Artificial
  CRISPR gRNA sequence
attactgttatcatccttca

SEQ ID NO: 395215 - DNA, 20 bp, Artificial
  CRISPR gRNA sequence
ctgttatcatccttcatcca

SEQ ID NO: 395216 - DNA, 20 bp, Artificial
  CRISPR gRNA sequence
ttatcatccttcatccaata

SEQ ID NO: 395217 - DNA, 20 bp, Artificial
  CRISPR gRNA sequence
tcatccttcatccaataaag

SEQ ID NO: 395218 - DNA, 20 bp, Artificial
  CRISPR gRNA sequence
catccaataaagcagattca

SEQ ID NO: 395219 - DNA, 20 bp, Artificial
  CRISPR gRNA sequence
atccaataaagcagattcaa

SEQ ID NO: 395220 - DNA, 20 bp, Artificial
  CRISPR gRNA sequence
aattacctctgtgtcatttg

SEQ ID NO: 395221 - DNA, 20 bp, Artificial
  CRISPR gRNA sequence
cctctgtgtcatttgagcaa

SEQ ID NO: 395222 - DNA, 20 bp, Artificial
  CRISPR gRNA sequence
tgtgtcatttgagcaacaac

SEQ ID NO: 395223 - DNA, 20 bp, Artificial
  CRISPR gRNA sequence
tgtcatttgagcaacaacaa

SEQ ID NO: 395224 - DNA, 20 bp, Artificial
  CRISPR gRNA sequence
gagcaacaacaaggtttagc

SEQ ID NO: 395225 - DNA, 20 bp, Artificial
  CRISPR gRNA sequence
agcaacaacaaggtttagcc

SEQ ID NO: 395226 - DNA, 20 bp, Artificial
  CRISPR gRNA sequence
agccattttccctttagttc

SEQ ID NO: 395227 - DNA, 20 bp, Artificial
  CRISPR gRNA sequence
gccattttccctttagttca

SEQ ID NO: 395228 - DNA, 20 bp, Artificial
  CRISPR gRNA sequence
tccctttagttcaattctgc

SEQ ID NO: 395229 - DNA, 20 bp, Artificial
  CRISPR gRNA sequence
ccctttagttcaattctgct

SEQ ID NO: 395230 - DNA, 20 bp, Artificial
  CRISPR gRNA sequence
cctttagttcaattctgcta

SEQ ID NO: 395231 - DNA, 20 bp, Artificial
  CRISPR gRNA sequence
tagttcaattctgctatttt

SEQ ID NO: 395232 - DNA, 20 bp, Artificial
  CRISPR gRNA sequence
agttcaattctgctattttc

SEQ ID NO: 395233 - DNA, 20 bp, Artificial
  CRISPR gRNA sequence
gttcaattctgctattttca

SEQ ID NO: 395234 - DNA, 20 bp, Artificial
  CRISPR gRNA sequence
aattctgctattttcactga

SEQ ID NO: 395235 - DNA, 20 bp, Artificial
  CRISPR gRNA sequence
tgctattttcactgaaaaca

SEQ ID NO: 395236 - DNA, 20 bp, Artificial
  CRISPR gRNA sequence
ctattttcactgaaaacaga

SEQ ID NO: 395237 - DNA, 20 bp, Artificial
  CRISPR gRNA sequence
ttttcactgaaaacagaata

SEQ ID NO: 395238 - DNA, 20 bp, Artificial
  CRISPR gRNA sequence
tcactgaaaacagaataatc

SEQ ID NO: 395239 - DNA, 20 bp, Artificial
  CRISPR gRNA sequence
cactgaaaacagaataatca

SEQ ID NO: 395240 - DNA, 20 bp, Artificial
  CRISPR gRNA sequence
actgaaaacagaataatcag

SEQ ID NO: 395241 - DNA, 20 bp, Artificial
  CRISPR gRNA sequence
aaaacagaataatcagacca

SEQ ID NO: 395242 - DNA, 20 bp, Artificial
  CRISPR gRNA sequence
agaatgaaaattcaaacact

SEQ ID NO: 395243 - DNA, 20 bp, Artificial
  CRISPR gRNA sequence
aaacactgtgtcagcacaaa

SEQ ID NO: 395244 - DNA, 20 bp, Artificial
  CRISPR gRNA sequence
tgtcagcacaaagaaacaca

SEQ ID NO: 395245 - DNA, 20 bp, Artificial
  CRISPR gRNA sequence
aaaatattttcatcttatta

SEQ ID NO: 395246 - DNA, 20 bp, Artificial
  CRISPR gRNA sequence
tcatcttattaaatgtttgc

SEQ ID NO: 395247 - DNA, 20 bp, Artificial
  CRISPR gRNA sequence
catcttattaaatgtttgct

SEQ ID NO: 395248 - DNA, 20 bp, Artificial
  CRISPR gRNA sequence
atcttattaaatgtttgctc

SEQ ID NO: 395249 - DNA, 20 bp, Artificial
  CRISPR gRNA sequence
attaaatgtttgctctttcc

SEQ ID NO: 395250 - DNA, 20 bp, Artificial
  CRISPR gRNA sequence
ttaaatgtttgctctttcca

SEQ ID NO: 395251 - DNA, 20 bp, Artificial
  CRISPR gRNA sequence
aatgtttgctctttccagaa

SEQ ID NO: 395252 - DNA, 20 bp, Artificial
  CRISPR gRNA sequence
gctctttccagaaacattta

SEQ ID NO: 395253 - DNA, 20 bp, Artificial
  CRISPR gRNA sequence
ctctttccagaaacatttat

SEQ ID NO: 395254 - DNA, 20 bp, Artificial
  CRISPR gRNA sequence
tttccagaaacatttatagg

SEQ ID NO: 395255 - DNA, 20 bp, Artificial
  CRISPR gRNA sequence
tccagaaacatttataggat

SEQ ID NO: 395256 - DNA, 20 bp, Artificial
  CRISPR gRNA sequence
ccagaaacatttataggatt

SEQ ID NO: 395257 - DNA, 20 bp, Artificial
  CRISPR gRNA sequence
cagaaacatttataggattt

SEQ ID NO: 395258 - DNA, 20 bp, Artificial
  CRISPR gRNA sequence
ataggatttaaagagaataa

SEQ ID NO: 395259 - DNA, 20 bp, Artificial
  CRISPR gRNA sequence
taggatttaaagagaataaa

SEQ ID NO: 395260 - DNA, 20 bp, Artificial
  CRISPR gRNA sequence
aaagagaataaaaggaagaa

SEQ ID NO: 395261 - DNA, 20 bp, Artificial
  CRISPR gRNA sequence
aagagaataaaaggaagaag

SEQ ID NO: 395262 - DNA, 20 bp, Artificial
  CRISPR gRNA sequence
caagccctatgttaagtatt

SEQ ID NO: 395263 - DNA, 20 bp, Artificial
  CRISPR gRNA sequence
tgttaagtattctttatttc

SEQ ID NO: 395264 - DNA, 20 bp, Artificial
  CRISPR gRNA sequence
agtattctttatttcactta

SEQ ID NO: 395265 - DNA, 20 bp, Artificial
  CRISPR gRNA sequence
tttatttcacttaaatgagc

SEQ ID NO: 395266 - DNA, 20 bp, Artificial
  CRISPR gRNA sequence
tatttcacttaaatgagcaa

SEQ ID NO: 395267 - DNA, 20 bp, Artificial
  CRISPR gRNA sequence
atttcacttaaatgagcaac

SEQ ID NO: 395268 - DNA, 20 bp, Artificial
  CRISPR gRNA sequence
tttcacttaaatgagcaact

SEQ ID NO: 395269 - DNA, 20 bp, Artificial
  CRISPR gRNA sequence
cacttaaatgagcaactatg

SEQ ID NO: 395270 - DNA, 20 bp, Artificial
  CRISPR gRNA sequence
acttaaatgagcaactatgt

SEQ ID NO: 395271 - DNA, 20 bp, Artificial
  CRISPR gRNA sequence
aaatgagcaactatgtttct

SEQ ID NO: 395272 - DNA, 20 bp, Artificial
  CRISPR gRNA sequence
aatgagcaactatgtttctt

SEQ ID NO: 395273 - DNA, 20 bp, Artificial
  CRISPR gRNA sequence
tgtttcttaaaagataataa

SEQ ID NO: 395274 - DNA, 20 bp, Artificial
  CRISPR gRNA sequence
cttaaaagataataaagagg

SEQ ID NO: 395275 - DNA, 20 bp, Artificial
  CRISPR gRNA sequence
ttaaaagataataaagaggt

SEQ ID NO: 395276 - DNA, 20 bp, Artificial
  CRISPR gRNA sequence
aaaagataataaagaggtat

SEQ ID NO: 395277 - DNA, 20 bp, Artificial
  CRISPR gRNA sequence
aaagataataaagaggtatt

SEQ ID NO: 395278 - DNA, 20 bp, Artificial
  CRISPR gRNA sequence
tgagaaatctgatgtcagga

SEQ ID NO: 395279 - DNA, 20 bp, Artificial
  CRISPR gRNA sequence
gagaaatctgatgtcaggag

SEQ ID NO: 395280 - DNA, 20 bp, Artificial
  CRISPR gRNA sequence
agaaatctgatgtcaggagt

SEQ ID NO: 395281 - DNA, 20 bp, Artificial
  CRISPR gRNA sequence
atgtcaggagttaatgggac

SEQ ID NO: 395282 - DNA, 20 bp, Artificial
  CRISPR gRNA sequence
atgggactttacaaaggatc

SEQ ID NO: 395283 - DNA, 20 bp, Artificial
  CRISPR gRNA sequence
tacaaaggatctcttttgga

SEQ ID NO: 395284 - DNA, 20 bp, Artificial
  CRISPR gRNA sequence
acaaaggatctcttttggag

SEQ ID NO: 395285 - DNA, 20 bp, Artificial
  CRISPR gRNA sequence
caaaggatctcttttggaga

SEQ ID NO: 395286 - DNA, 20 bp, Artificial
  CRISPR gRNA sequence
ttttggagacatatactaac

SEQ ID NO: 395287 - DNA, 20 bp, Artificial
  CRISPR gRNA sequence
ttggagacatatactaacat

SEQ ID NO: 395288 - DNA, 20 bp, Artificial
  CRISPR gRNA sequence
tggagacatatactaacatt

SEQ ID NO: 395289 - DNA, 20 bp, Artificial
  CRISPR gRNA sequence
ggagacatatactaacatta

SEQ ID NO: 395290 - DNA, 20 bp, Artificial
  CRISPR gRNA sequence
gagacatatactaacattac

SEQ ID NO: 395291 - DNA, 20 bp, Artificial
  CRISPR gRNA sequence
acattaccaatacaacaact

SEQ ID NO: 395292 - DNA, 20 bp, Artificial
  CRISPR gRNA sequence
ccaatacaacaactgaattc

SEQ ID NO: 395293 - DNA, 20 bp, Artificial
  CRISPR gRNA sequence
aattctttggctgtttctca

SEQ ID NO: 395294 - DNA, 20 bp, Artificial
  CRISPR gRNA sequence
tttggctgtttctcacatga

SEQ ID NO: 395295 - DNA, 20 bp, Artificial
  CRISPR gRNA sequence
tggctgtttctcacatgaaa

SEQ ID NO: 395296 - DNA, 20 bp, Artificial
  CRISPR gRNA sequence
ggctgtttctcacatgaaaa

SEQ ID NO: 395297 - DNA, 20 bp, Artificial
  CRISPR gRNA sequence
gctgtttctcacatgaaaaa

SEQ ID NO: 395298 - DNA, 20 bp, Artificial
  CRISPR gRNA sequence
tttctcacatgaaaaaggta

SEQ ID NO: 395299 - DNA, 20 bp, Artificial
  CRISPR gRNA sequence
ctcacatgaaaaaggtatac

SEQ ID NO: 395300 - DNA, 20 bp, Artificial
  CRISPR gRNA sequence
tcacatgaaaaaggtataca

SEQ ID NO: 395301 - DNA, 20 bp, Artificial
  CRISPR gRNA sequence
acatgaaaaaggtatacatt

SEQ ID NO: 395302 - DNA, 20 bp, Artificial
  CRISPR gRNA sequence
aactagagcttccagtttgc

SEQ ID NO: 395303 - DNA, 20 bp, Artificial
  CRISPR gRNA sequence
gagcttccagtttgcaaaga

SEQ ID NO: 395304 - DNA, 20 bp, Artificial
  CRISPR gRNA sequence
ccagtttgcaaagagaaata

SEQ ID NO: 395305 - DNA, 20 bp, Artificial
  CRISPR gRNA sequence
cagtttgcaaagagaaataa

SEQ ID NO: 395306 - DNA, 20 bp, Artificial
  CRISPR gRNA sequence
gcaaagagaaataaatgtat

SEQ ID NO: 395307 - DNA, 20 bp, Artificial
  CRISPR gRNA sequence
caaagagaaataaatgtatc

SEQ ID NO: 395308 - DNA, 20 bp, Artificial
  CRISPR gRNA sequence
ttagtgaaatgaattaggta

SEQ ID NO: 395309 - DNA, 20 bp, Artificial
  CRISPR gRNA sequence
gtgaaatgaattaggtaaat

SEQ ID NO: 395310 - DNA, 20 bp, Artificial
  CRISPR gRNA sequence
ggtaaatgacttaaaatttg

SEQ ID NO: 395311 - DNA, 20 bp, Artificial
  CRISPR gRNA sequence
aaaatttgctatagtctcgg

SEQ ID NO: 395312 - DNA, 20 bp, Artificial
  CRISPR gRNA sequence
aaatttgctatagtctcggg

SEQ ID NO: 395313 - DNA, 20 bp, Artificial
  CRISPR gRNA sequence
gctatagtctcgggttcttt

SEQ ID NO: 395314 - DNA, 20 bp, Artificial
  CRISPR gRNA sequence
ctatagtctcgggttcttta

SEQ ID NO: 395315 - DNA, 20 bp, Artificial
  CRISPR gRNA sequence
tagtctcgggttctttatat

SEQ ID NO: 395316 - DNA, 20 bp, Artificial
  CRISPR gRNA sequence
gggttctttatatatcatga

SEQ ID NO: 395317 - DNA, 20 bp, Artificial
  CRISPR gRNA sequence
tttatatatcatgaaggaaa

SEQ ID NO: 395318 - DNA, 20 bp, Artificial
  CRISPR gRNA sequence
tatatatcatgaaggaaatg

SEQ ID NO: 395319 - DNA, 20 bp, Artificial
  CRISPR gRNA sequence
atatatcatgaaggaaatga

SEQ ID NO: 395320 - DNA, 20 bp, Artificial
  CRISPR gRNA sequence
tatatcatgaaggaaatgat

SEQ ID NO: 395321 - DNA, 20 bp, Artificial
  CRISPR gRNA sequence
tccacacagaggatacacac

SEQ ID NO: 395322 - DNA, 20 bp, Artificial
  CRISPR gRNA sequence
cactaagcaattctggaaat

SEQ ID NO: 395323 - DNA, 20 bp, Artificial
  CRISPR gRNA sequence
actaagcaattctggaaata

SEQ ID NO: 395324 - DNA, 20 bp, Artificial
  CRISPR gRNA sequence
agcaattctggaaatatcgg

SEQ ID NO: 395325 - DNA, 20 bp, Artificial
  CRISPR gRNA sequence
tggaaatatcggtgttggta

SEQ ID NO: 395326 - DNA, 20 bp, Artificial
  CRISPR gRNA sequence
gaaatatcggtgttggtagc

SEQ ID NO: 395327 - DNA, 20 bp, Artificial
  CRISPR gRNA sequence
gtagcatatagaattttatg

SEQ ID NO: 395328 - DNA, 20 bp, Artificial
  CRISPR gRNA sequence
tatgtagctggccaagaatt

SEQ ID NO: 395329 - DNA, 20 bp, Artificial
  CRISPR gRNA sequence
atgtagctggccaagaattg

SEQ ID NO: 395330 - DNA, 20 bp, Artificial
  CRISPR gRNA sequence
tgtagctggccaagaattgg

SEQ ID NO: 395331 - DNA, 20 bp, Artificial
  CRISPR gRNA sequence
gccaagaattggaacaagta

SEQ ID NO: 395332 - DNA, 20 bp, Artificial
  CRISPR gRNA sequence
gaacaagtatgttcttaaga

SEQ ID NO: 395333 - DNA, 20 bp, Artificial
  CRISPR gRNA sequence
ttaagagcctgtctgctaaa

SEQ ID NO: 395334 - DNA, 20 bp, Artificial
  CRISPR gRNA sequence
aagagcctgtctgctaaaat

SEQ ID NO: 395335 - DNA, 20 bp, Artificial
  CRISPR gRNA sequence
agagcctgtctgctaaaatg

SEQ ID NO: 395336 - DNA, 20 bp, Artificial
  CRISPR gRNA sequence
tctgctaaaatgagaatgtt

SEQ ID NO: 395337 - DNA, 20 bp, Artificial
  CRISPR gRNA sequence
ctaaaatgagaatgttaagt

SEQ ID NO: 395338 - DNA, 20 bp, Artificial
  CRISPR gRNA sequence
aaatgagaatgttaagtttc

SEQ ID NO: 395339 - DNA, 20 bp, Artificial
  CRISPR gRNA sequence
agtttcttaggattctgctc

SEQ ID NO: 395340 - DNA, 20 bp, Artificial
  CRISPR gRNA sequence
cttaggattctgctcattaa

SEQ ID NO: 395341 - DNA, 20 bp, Artificial
  CRISPR gRNA sequence
ttaggattctgctcattaaa

SEQ ID NO: 395342 - DNA, 20 bp, Artificial
  CRISPR gRNA sequence
aggattctgctcattaaatg

SEQ ID NO: 395343 - DNA, 20 bp, Artificial
  CRISPR gRNA sequence
ggattctgctcattaaatgg

SEQ ID NO: 395344 - DNA, 20 bp, Artificial
  CRISPR gRNA sequence
tgctcattaaatggtgcagc

SEQ ID NO: 395345 - DNA, 20 bp, Artificial
  CRISPR gRNA sequence
ctcattaaatggtgcagcta

SEQ ID NO: 395346 - DNA, 20 bp, Artificial
  CRISPR gRNA sequence
attaaatggtgcagctaaat

SEQ ID NO: 395347 - DNA, 20 bp, Artificial
  CRISPR gRNA sequence
aatggtgcagctaaatgctc

SEQ ID NO: 395348 - DNA, 20 bp, Artificial
  CRISPR gRNA sequence
aatgctcccagaattaatgc

SEQ ID NO: 395349 - DNA, 20 bp, Artificial
  CRISPR gRNA sequence
ccagaattaatgcccagatt

SEQ ID NO: 395350 - DNA, 20 bp, Artificial
  CRISPR gRNA sequence
atgcccagattttattctgt

SEQ ID NO: 395351 - DNA, 20 bp, Artificial
  CRISPR gRNA sequence
tattctgtttggccacggtc

SEQ ID NO: 395352 - DNA, 20 bp, Artificial
  CRISPR gRNA sequence
attctgtttggccacggtca

SEQ ID NO: 395353 - DNA, 20 bp, Artificial
  CRISPR gRNA sequence
ttctgtttggccacggtcac

SEQ ID NO: 395354 - DNA, 20 bp, Artificial
  CRISPR gRNA sequence
tgtttggccacggtcaccac

SEQ ID NO: 395355 - DNA, 20 bp, Artificial
  CRISPR gRNA sequence
tttggccacggtcaccactg

SEQ ID NO: 395356 - DNA, 20 bp, Artificial
  CRISPR gRNA sequence
ggccacggtcaccactgtgt

SEQ ID NO: 395357 - DNA, 20 bp, Artificial
  CRISPR gRNA sequence
gccacggtcaccactgtgtg

SEQ ID NO: 395358 - DNA, 20 bp, Artificial
  CRISPR gRNA sequence
tgtgcagatatgatgcacat

SEQ ID NO: 395359 - DNA, 20 bp, Artificial
  CRISPR gRNA sequence
tttacaacactagtaagtat

SEQ ID NO: 395360 - DNA, 20 bp, Artificial
  CRISPR gRNA sequence
acaacactagtaagtatgaa

SEQ ID NO: 395361 - DNA, 20 bp, Artificial
  CRISPR gRNA sequence
caacactagtaagtatgaat

SEQ ID NO: 395362 - DNA, 20 bp, Artificial
  CRISPR gRNA sequence
gtaagtatgaatattgtgtt

SEQ ID NO: 395363 - DNA, 20 bp, Artificial
  CRISPR gRNA sequence
tgttttacacctccatcctt

SEQ ID NO: 395364 - DNA, 20 bp, Artificial
  CRISPR gRNA sequence
tacacctccatccttggaag

SEQ ID NO: 395365 - DNA, 20 bp, Artificial
  CRISPR gRNA sequence
acacctccatccttggaagt

SEQ ID NO: 395366 - DNA, 20 bp, Artificial
  CRISPR gRNA sequence
cacctccatccttggaagtc

SEQ ID NO: 395367 - DNA, 20 bp, Artificial
  CRISPR gRNA sequence
catccttggaagtcttctta

SEQ ID NO: 395368 - DNA, 20 bp, Artificial
  CRISPR gRNA sequence
ggaagtcttcttatatcagt

SEQ ID NO: 395369 - DNA, 20 bp, Artificial
  CRISPR gRNA sequence
gaagtcttcttatatcagta

SEQ ID NO: 395370 - DNA, 20 bp, Artificial
  CRISPR gRNA sequence
cttatatcagtattctatga

SEQ ID NO: 395371 - DNA, 20 bp, Artificial
  CRISPR gRNA sequence
ttatatcagtattctatgaa

SEQ ID NO: 395372 - DNA, 20 bp, Artificial
  CRISPR gRNA sequence
atatcagtattctatgaaac

SEQ ID NO: 395373 - DNA, 20 bp, Artificial
  CRISPR gRNA sequence
tatcagtattctatgaaaca

SEQ ID NO: 395374 - DNA, 20 bp, Artificial
  CRISPR gRNA sequence
tatgaaacatggctctttct

SEQ ID NO: 395375 - DNA, 20 bp, Artificial
  CRISPR gRNA sequence
tgaaacatggctctttctct

SEQ ID NO: 395376 - DNA, 20 bp, Artificial
  CRISPR gRNA sequence
tttctctcgaggcagattac

SEQ ID NO: 395377 - DNA, 20 bp, Artificial
  CRISPR gRNA sequence
tctctcgaggcagattacaa

SEQ ID NO: 395378 - DNA, 20 bp, Artificial
  CRISPR gRNA sequence
ctctcgaggcagattacaaa

SEQ ID NO: 395379 - DNA, 20 bp, Artificial
  CRISPR gRNA sequence
tctcgaggcagattacaaag

SEQ ID NO: 395380 - DNA, 20 bp, Artificial
  CRISPR gRNA sequence
tcgaggcagattacaaagaa

SEQ ID NO: 395381 - DNA, 20 bp, Artificial
  CRISPR gRNA sequence
gaggcagattacaaagaaga

SEQ ID NO: 395382 - DNA, 20 bp, Artificial
  CRISPR gRNA sequence
caaagaagatttttttaaag

SEQ ID NO: 395383 - DNA, 20 bp, Artificial
  CRISPR gRNA sequence
ttttaaagtgtaagttggtt

SEQ ID NO: 395384 - DNA, 20 bp, Artificial
  CRISPR gRNA sequence
tttaaagtgtaagttggtta

SEQ ID NO: 395385 - DNA, 20 bp, Artificial
  CRISPR gRNA sequence
ttaaagtgtaagttggttaa

SEQ ID NO: 395386 - DNA, 20 bp, Artificial
  CRISPR gRNA sequence
taaagtgtaagttggttaaa

SEQ ID NO: 395387 - DNA, 20 bp, Artificial
  CRISPR gRNA sequence
aaagtgtaagttggttaaat

SEQ ID NO: 395388 - DNA, 20 bp, Artificial
  CRISPR gRNA sequence
aagtgtaagttggttaaata

SEQ ID NO: 395389 - DNA, 20 bp, Artificial
  CRISPR gRNA sequence
gttaaatagctgaagtcagg

SEQ ID NO: 395390 - DNA, 20 bp, Artificial
  CRISPR gRNA sequence
aatagctgaagtcaggaaaa

SEQ ID NO: 395391 - DNA, 20 bp, Artificial
  CRISPR gRNA sequence
aagtcaggaaaaattttctc

SEQ ID NO: 395392 - DNA, 20 bp, Artificial
  CRISPR gRNA sequence
tctcacattaagagttattg

SEQ ID NO: 395393 - DNA, 20 bp, Artificial
  CRISPR gRNA sequence
ctcacattaagagttattgg

SEQ ID NO: 395394 - DNA, 20 bp, Artificial
  CRISPR gRNA sequence
tcacattaagagttattgga

SEQ ID NO: 395395 - DNA, 20 bp, Artificial
  CRISPR gRNA sequence
acattaagagttattggatt

SEQ ID NO: 395396 - DNA, 20 bp, Artificial
  CRISPR gRNA sequence
agagttattggattgtgaat

SEQ ID NO: 395397 - DNA, 20 bp, Artificial
  CRISPR gRNA sequence
ttggattgtgaataatctct

SEQ ID NO: 395398 - DNA, 20 bp, Artificial
  CRISPR gRNA sequence
gattgtgaataatctctcaa

SEQ ID NO: 395399 - DNA, 20 bp, Artificial
  CRISPR gRNA sequence
tgaataatctctcaagggaa

SEQ ID NO: 395400 - DNA, 20 bp, Artificial
  CRISPR gRNA sequence
tcaagggaagtgccagaagc

SEQ ID NO: 395401 - DNA, 20 bp, Artificial
  CRISPR gRNA sequence
aagggaagtgccagaagccc

SEQ ID NO: 395402 - DNA, 20 bp, Artificial
  CRISPR gRNA sequence
agttatttaattaaaactgc

SEQ ID NO: 395403 - DNA, 20 bp, Artificial
  CRISPR gRNA sequence
tttaattaaaactgctcagg

SEQ ID NO: 395404 - DNA, 20 bp, Artificial
  CRISPR gRNA sequence
aattaaaactgctcaggagt

SEQ ID NO: 395405 - DNA, 20 bp, Artificial
  CRISPR gRNA sequence
attaaaactgctcaggagta

SEQ ID NO: 395406 - DNA, 20 bp, Artificial
  CRISPR gRNA sequence
aaactgctcaggagtaagta

SEQ ID NO: 395407 - DNA, 20 bp, Artificial
  CRISPR gRNA sequence
ctcaggagtaagtagaagag

SEQ ID NO: 395408 - DNA, 20 bp, Artificial
  CRISPR gRNA sequence
aggagtaagtagaagagatg

SEQ ID NO: 395409 - DNA, 20 bp, Artificial
  CRISPR gRNA sequence
cctgagggaataatttcaca

SEQ ID NO: 395410 - DNA, 20 bp, Artificial
  CRISPR gRNA sequence
agggaataatttcacactga

SEQ ID NO: 395411 - DNA, 20 bp, Artificial
  CRISPR gRNA sequence
cacactgatccctgaaggat

SEQ ID NO: 395412 - DNA, 20 bp, Artificial
  CRISPR gRNA sequence
acactgatccctgaaggatt

SEQ ID NO: 395413 - DNA, 20 bp, Artificial
  CRISPR gRNA sequence
atccctgaaggattgacttg

SEQ ID NO: 395414 - DNA, 20 bp, Artificial
  CRISPR gRNA sequence
aaggattgacttgatggtct

SEQ ID NO: 395415 - DNA, 20 bp, Artificial
  CRISPR gRNA sequence
acttgatggtcttgaaattc

SEQ ID NO: 395416 - DNA, 20 bp, Artificial
  CRISPR gRNA sequence
gatggtcttgaaattcttaa

SEQ ID NO: 395417 - DNA, 20 bp, Artificial
  CRISPR gRNA sequence
atggtcttgaaattcttaac

SEQ ID NO: 395418 - DNA, 20 bp, Artificial
  CRISPR gRNA sequence
gaaattcttaacagtttcaa

SEQ ID NO: 395419 - DNA, 20 bp, Artificial
  CRISPR gRNA sequence
aaattcttaacagtttcaaa

SEQ ID NO: 395420 - DNA, 20 bp, Artificial
  CRISPR gRNA sequence
ttaacagtttcaaaatctta

SEQ ID NO: 395421 - DNA, 20 bp, Artificial
  CRISPR gRNA sequence
aacagtttcaaaatcttaaa

SEQ ID NO: 395422 - DNA, 20 bp, Artificial
  CRISPR gRNA sequence
acagtttcaaaatcttaaat

SEQ ID NO: 395423 - DNA, 20 bp, Artificial
  CRISPR gRNA sequence
caaaatcttaaatgtcttca

SEQ ID NO: 395424 - DNA, 20 bp, Artificial
  CRISPR gRNA sequence
aaaatcttaaatgtcttcag

SEQ ID NO: 395425 - DNA, 20 bp, Artificial
  CRISPR gRNA sequence
aaatgtcttcagaaatagtc

SEQ ID NO: 395426 - DNA, 20 bp, Artificial
  CRISPR gRNA sequence
aatgtcttcagaaatagtct

SEQ ID NO: 395427 - DNA, 20 bp, Artificial
  CRISPR gRNA sequence
cagaaatagtctcctaccat

SEQ ID NO: 395428 - DNA, 20 bp, Artificial
  CRISPR gRNA sequence
agaaatagtctcctaccatt

SEQ ID NO: 395429 - DNA, 20 bp, Artificial
  CRISPR gRNA sequence
ctaccattttctccacggaa

SEQ ID NO: 395430 - DNA, 20 bp, Artificial
  CRISPR gRNA sequence
ccattttctccacggaaaga

SEQ ID NO: 395431 - DNA, 20 bp, Artificial
  CRISPR gRNA sequence
tctccacggaaagaaaaagc

SEQ ID NO: 395432 - DNA, 20 bp, Artificial
  CRISPR gRNA sequence
ctccacggaaagaaaaagcc

SEQ ID NO: 395433 - DNA, 20 bp, Artificial
  CRISPR gRNA sequence
tccacggaaagaaaaagcca

SEQ ID NO: 395434 - DNA, 20 bp, Artificial
  CRISPR gRNA sequence
cacggaaagaaaaagccatt

SEQ ID NO: 395435 - DNA, 20 bp, Artificial
  CRISPR gRNA sequence
tgcctgcaacctcctctccc

SEQ ID NO: 395436 - DNA, 20 bp, Artificial
  CRISPR gRNA sequence
cctgcaacctcctctcccta

SEQ ID NO: 395437 - DNA, 20 bp, Artificial
  CRISPR gRNA sequence
caacctcctctccctataaa

SEQ ID NO: 395438 - DNA, 20 bp, Artificial
  CRISPR gRNA sequence
ctctccctataaaaccaaac

SEQ ID NO: 395439 - DNA, 20 bp, Artificial
  CRISPR gRNA sequence
tccctataaaaccaaacaaa

SEQ ID NO: 395440 - DNA, 20 bp, Artificial
  CRISPR gRNA sequence
cctataaaaccaaacaaaaa

SEQ ID NO: 395441 - DNA, 20 bp, Artificial
  CRISPR gRNA sequence
taaaaccaaacaaaaacaaa

SEQ ID NO: 395442 - DNA, 20 bp, Artificial
  CRISPR gRNA sequence
agaaaccagatctttttatc

SEQ ID NO: 395443 - DNA, 20 bp, Artificial
  CRISPR gRNA sequence
gaaaccagatctttttatcg

SEQ ID NO: 395444 - DNA, 20 bp, Artificial
  CRISPR gRNA sequence
tttatcgacgctacctaaac

SEQ ID NO: 395445 - DNA, 20 bp, Artificial
  CRISPR gRNA sequence
ttatcgacgctacctaaacc

SEQ ID NO: 395446 - DNA, 20 bp, Artificial
  CRISPR gRNA sequence
tatcgacgctacctaaacca

SEQ ID NO: 395447 - DNA, 20 bp, Artificial
  CRISPR gRNA sequence
atcgacgctacctaaaccat

SEQ ID NO: 395448 - DNA, 20 bp, Artificial
  CRISPR gRNA sequence
tcgacgctacctaaaccatc

SEQ ID NO: 395449 - DNA, 20 bp, Artificial
  CRISPR gRNA sequence
cctaaaccatcacaggacag

SEQ ID NO: 395450 - DNA, 20 bp, Artificial
  CRISPR gRNA sequence
aaccatcacaggacagcatt

SEQ ID NO: 395451 - DNA, 20 bp, Artificial
  CRISPR gRNA sequence
actcaaagataaagccacag

SEQ ID NO: 395452 - DNA, 20 bp, Artificial
  CRISPR gRNA sequence
aaagataaagccacagagga

SEQ ID NO: 395453 - DNA, 20 bp, Artificial
  CRISPR gRNA sequence
caagcatcagtaaaaactga

SEQ ID NO: 395454 - DNA, 20 bp, Artificial
  CRISPR gRNA sequence
agagctttaccagctaagag

SEQ ID NO: 395455 - DNA, 20 bp, Artificial
  CRISPR gRNA sequence
taccagctaagagcttttgg

SEQ ID NO: 395456 - DNA, 20 bp, Artificial
  CRISPR gRNA sequence
accagctaagagcttttgga

SEQ ID NO: 395457 - DNA, 20 bp, Artificial
  CRISPR gRNA sequence
ccagctaagagcttttggac

SEQ ID NO: 395458 - DNA, 20 bp, Artificial
  CRISPR gRNA sequence
agagcttttggactttcttc

SEQ ID NO: 395459 - DNA, 20 bp, Artificial
  CRISPR gRNA sequence
ttggactttcttcagttact

SEQ ID NO: 395460 - DNA, 20 bp, Artificial
  CRISPR gRNA sequence
tggactttcttcagttactt

SEQ ID NO: 395461 - DNA, 20 bp, Artificial
  CRISPR gRNA sequence
ggactttcttcagttactta

SEQ ID NO: 395462 - DNA, 20 bp, Artificial
  CRISPR gRNA sequence
gactttcttcagttacttat

SEQ ID NO: 395463 - DNA, 20 bp, Artificial
  CRISPR gRNA sequence
tcttcagttacttattttct

SEQ ID NO: 395464 - DNA, 20 bp, Artificial
  CRISPR gRNA sequence
cttcagttacttattttctt

SEQ ID NO: 395465 - DNA, 20 bp, Artificial
  CRISPR gRNA sequence
ttcagttacttattttcttt

SEQ ID NO: 395466 - DNA, 20 bp, Artificial
  CRISPR gRNA sequence
cagttacttattttcttttt

SEQ ID NO: 395467 - DNA, 20 bp, Artificial
  CRISPR gRNA sequence
agttacttattttctttttg

SEQ ID NO: 395468 - DNA, 20 bp, Artificial
  CRISPR gRNA sequence
cttattttctttttgtttgc

SEQ ID NO: 395469 - DNA, 20 bp, Artificial
  CRISPR gRNA sequence
attttctttttgtttgcttt

SEQ ID NO: 395470 - DNA, 20 bp, Artificial
  CRISPR gRNA sequence
ttttctttttgtttgctttt

SEQ ID NO: 395471 - DNA, 20 bp, Artificial
  CRISPR gRNA sequence
tctttttgtttgcttttgaa

SEQ ID NO: 395472 - DNA, 20 bp, Artificial
  CRISPR gRNA sequence
ctttttgtttgcttttgaat

SEQ ID NO: 395473 - DNA, 20 bp, Artificial
  CRISPR gRNA sequence
tttttgtttgcttttgaata

SEQ ID NO: 395474 - DNA, 20 bp, Artificial
  CRISPR gRNA sequence
tttgtttgcttttgaatatc

SEQ ID NO: 395475 - DNA, 20 bp, Artificial
  CRISPR gRNA sequence
ttgtttgcttttgaatatct

SEQ ID NO: 395476 - DNA, 20 bp, Artificial
  CRISPR gRNA sequence
tgtttgcttttgaatatctc

SEQ ID NO: 395477 - DNA, 20 bp, Artificial
  CRISPR gRNA sequence
gtttgcttttgaatatctca

SEQ ID NO: 395478 - DNA, 20 bp, Artificial
  CRISPR gRNA sequence
tttgcttttgaatatctcaa

SEQ ID NO: 395479 - DNA, 20 bp, Artificial
  CRISPR gRNA sequence
gcttttgaatatctcaaatc

SEQ ID NO: 395480 - DNA, 20 bp, Artificial
  CRISPR gRNA sequence
cttttgaatatctcaaatct

SEQ ID NO: 395481 - DNA, 20 bp, Artificial
  CRISPR gRNA sequence
ttgaatatctcaaatctcac

SEQ ID NO: 395482 - DNA, 20 bp, Artificial
  CRISPR gRNA sequence
tgaatatctcaaatctcaca

SEQ ID NO: 395483 - DNA, 20 bp, Artificial
  CRISPR gRNA sequence
gaatatctcaaatctcacat

SEQ ID NO: 395484 - DNA, 20 bp, Artificial
  CRISPR gRNA sequence
aatatctcaaatctcacatt

SEQ ID NO: 395485 - DNA, 20 bp, Artificial
  CRISPR gRNA sequence
aaatctcacattttttattt

SEQ ID NO: 395486 - DNA, 20 bp, Artificial
  CRISPR gRNA sequence
acattttttattttacaaaa

SEQ ID NO: 395487 - DNA, 20 bp, Artificial
  CRISPR gRNA sequence
tttattttacaaaatgcaat

SEQ ID NO: 395488 - DNA, 20 bp, Artificial
  CRISPR gRNA sequence
ttattttacaaaatgcaatt

SEQ ID NO: 395489 - DNA, 20 bp, Artificial
  CRISPR gRNA sequence
tattttacaaaatgcaattt

SEQ ID NO: 395490 - DNA, 20 bp, Artificial
  CRISPR gRNA sequence
attttacaaaatgcaattta

SEQ ID NO: 395491 - DNA, 20 bp, Artificial
  CRISPR gRNA sequence
ttttacaaaatgcaatttat

SEQ ID NO: 395492 - DNA, 20 bp, Artificial
  CRISPR gRNA sequence
tacaaaatgcaatttataat

SEQ ID NO: 395493 - DNA, 20 bp, Artificial
  CRISPR gRNA sequence
acaaaatgcaatttataatg

SEQ ID NO: 395494 - DNA, 20 bp, Artificial
  CRISPR gRNA sequence
caaaatgcaatttataatgt

SEQ ID NO: 395495 - DNA, 20 bp, Artificial
  CRISPR gRNA sequence
ataatgttactttcagttaa

SEQ ID NO: 395496 - DNA, 20 bp, Artificial
  CRISPR gRNA sequence
taatgttactttcagttaat

SEQ ID NO: 395497 - DNA, 20 bp, Artificial
  CRISPR gRNA sequence
ctttcagttaataatgtgat

SEQ ID NO: 395498 - DNA, 20 bp, Artificial
  CRISPR gRNA sequence
tcagttaataatgtgatctg

SEQ ID NO: 395499 - DNA, 20 bp, Artificial
  CRISPR gRNA sequence
cagttaataatgtgatctgt

SEQ ID NO: 395500 - DNA, 20 bp, Artificial
  CRISPR gRNA sequence
agttaataatgtgatctgtt

SEQ ID NO: 395501 - DNA, 20 bp, Artificial
  CRISPR gRNA sequence
ataatgtgatctgttaagag

SEQ ID NO: 395502 - DNA, 20 bp, Artificial
  CRISPR gRNA sequence
ttaagaggtaaattcctata

SEQ ID NO: 395503 - DNA, 20 bp, Artificial
  CRISPR gRNA sequence
agaggtaaattcctataagg

SEQ ID NO: 395504 - DNA, 20 bp, Artificial
  CRISPR gRNA sequence
ctataaggcctttttgaagg

SEQ ID NO: 395505 - DNA, 20 bp, Artificial
  CRISPR gRNA sequence
taaggcctttttgaaggtca

SEQ ID NO: 395506 - DNA, 20 bp, Artificial
  CRISPR gRNA sequence
tttgaaggtcactcacacct

SEQ ID NO: 395507 - DNA, 20 bp, Artificial
  CRISPR gRNA sequence
ttgaaggtcactcacaccta

SEQ ID NO: 395508 - DNA, 20 bp, Artificial
  CRISPR gRNA sequence
tgaaggtcactcacacctac

SEQ ID NO: 395509 - DNA, 20 bp, Artificial
  CRISPR gRNA sequence
gaaggtcactcacacctact

SEQ ID NO: 395510 - DNA, 20 bp, Artificial
  CRISPR gRNA sequence
aaggtcactcacacctactc

SEQ ID NO: 395511 - DNA, 20 bp, Artificial
  CRISPR gRNA sequence
acacctactcactaatccta

SEQ ID NO: 395512 - DNA, 20 bp, Artificial
  CRISPR gRNA sequence
ctcactaatcctataaggaa

SEQ ID NO: 395513 - DNA, 20 bp, Artificial
  CRISPR gRNA sequence
actaatcctataaggaagtt

SEQ ID NO: 395514 - DNA, 20 bp, Artificial
  CRISPR gRNA sequence
atcctataaggaagtttccc

SEQ ID NO: 395515 - DNA, 20 bp, Artificial
  CRISPR gRNA sequence
taaggaagtttcccagagca

SEQ ID NO: 395516 - DNA, 20 bp, Artificial
  CRISPR gRNA sequence
cccagagcaagtgctggaga

SEQ ID NO: 395517 - DNA, 20 bp, Artificial
  CRISPR gRNA sequence
ccagagcaagtgctggagaa

SEQ ID NO: 395518 - DNA, 20 bp, Artificial
  CRISPR gRNA sequence
gagaacaatgcccactatct

SEQ ID NO: 395519 - DNA, 20 bp, Artificial
  CRISPR gRNA sequence
tctgcagctctcaacctttg

SEQ ID NO: 395520 - DNA, 20 bp, Artificial
  CRISPR gRNA sequence
cagctctcaacctttgaagt

SEQ ID NO: 395521 - DNA, 20 bp, Artificial
  CRISPR gRNA sequence
tcaacctttgaagtgaggaa

SEQ ID NO: 395522 - DNA, 20 bp, Artificial
  CRISPR gRNA sequence
aacctttgaagtgaggaatt

SEQ ID NO: 395523 - DNA, 20 bp, Artificial
  CRISPR gRNA sequence
tgaagtgaggaattttttaa

SEQ ID NO: 395524 - DNA, 20 bp, Artificial
  CRISPR gRNA sequence
gaagtgaggaattttttaaa

SEQ ID NO: 395525 - DNA, 20 bp, Artificial
  CRISPR gRNA sequence
aagtgaggaattttttaaaa

SEQ ID NO: 395526 - DNA, 20 bp, Artificial
  CRISPR gRNA sequence
tttaaaagatcacagaagcc

SEQ ID NO: 395527 - DNA, 20 bp, Artificial
  CRISPR gRNA sequence
ttaaaagatcacagaagccg

SEQ ID NO: 395528 - DNA, 20 bp, Artificial
  CRISPR gRNA sequence
taaaagatcacagaagccga

SEQ ID NO: 395529 - DNA, 20 bp, Artificial
  CRISPR gRNA sequence
aaaagatcacagaagccgag

SEQ ID NO: 395530 - DNA, 20 bp, Artificial
  CRISPR gRNA sequence
aaagatcacagaagccgaga

SEQ ID NO: 395531 - DNA, 20 bp, Artificial
  CRISPR gRNA sequence
aggaggagtctcaacgtgtg

SEQ ID NO: 395532 - DNA, 20 bp, Artificial
  CRISPR gRNA sequence
aacgtgtgtgggctgaacat

SEQ ID NO: 395533 - DNA, 20 bp, Artificial
  CRISPR gRNA sequence
aacatgttccacagttattt

SEQ ID NO: 395534 - DNA, 20 bp, Artificial
  CRISPR gRNA sequence
cacagttatttgacaggcat

SEQ ID NO: 395535 - DNA, 20 bp, Artificial
  CRISPR gRNA sequence
tttgacaggcattgaaggct

SEQ ID NO: 395536 - DNA, 20 bp, Artificial
  CRISPR gRNA sequence
gacaggcattgaaggctata

SEQ ID NO: 395537 - DNA, 20 bp, Artificial
  CRISPR gRNA sequence
acaggcattgaaggctatag

SEQ ID NO: 395538 - DNA, 20 bp, Artificial
  CRISPR gRNA sequence
aaggctataggacaccagct

SEQ ID NO: 395539 - DNA, 20 bp, Artificial
  CRISPR gRNA sequence
taggacaccagctcttactc

SEQ ID NO: 395540 - DNA, 20 bp, Artificial
  CRISPR gRNA sequence
ttactcatgtgtgaggccac

SEQ ID NO: 395541 - DNA, 20 bp, Artificial
  CRISPR gRNA sequence
actcatgtgtgaggccacag

SEQ ID NO: 395542 - DNA, 20 bp, Artificial
  CRISPR gRNA sequence
ctcatgtgtgaggccacagt

SEQ ID NO: 395543 - DNA, 20 bp, Artificial
  CRISPR gRNA sequence
atgtgtgaggccacagtccc

SEQ ID NO: 395544 - DNA, 20 bp, Artificial
  CRISPR gRNA sequence
cattggcacccacacaccac

SEQ ID NO: 395545 - DNA, 20 bp, Artificial
  CRISPR gRNA sequence
gcacccacacaccaccaaca

SEQ ID NO: 395546 - DNA, 20 bp, Artificial
  CRISPR gRNA sequence
tgaagaggaaatgtattcct

SEQ ID NO: 395547 - DNA, 20 bp, Artificial
  CRISPR gRNA sequence
aagaggaaatgtattcctca

SEQ ID NO: 395548 - DNA, 20 bp, Artificial
  CRISPR gRNA sequence
ctcatgttgtggttggcagc

SEQ ID NO: 395549 - DNA, 20 bp, Artificial
  CRISPR gRNA sequence
atgttgtggttggcagccgc

SEQ ID NO: 395550 - DNA, 20 bp, Artificial
  CRISPR gRNA sequence
tggttggcagccgccttcag

SEQ ID NO: 395551 - DNA, 20 bp, Artificial
  CRISPR gRNA sequence
gcagccgccttcagtgctgg

SEQ ID NO: 395552 - DNA, 20 bp, Artificial
  CRISPR gRNA sequence
cagtgctgggtaaacagctg

SEQ ID NO: 395553 - DNA, 20 bp, Artificial
  CRISPR gRNA sequence
agtgctgggtaaacagctgt

SEQ ID NO: 395554 - DNA, 20 bp, Artificial
  CRISPR gRNA sequence
ggtaaacagctgttgtggta

SEQ ID NO: 395555 - DNA, 20 bp, Artificial
  CRISPR gRNA sequence
ttgtggtaaaggtgtgagtt

SEQ ID NO: 395556 - DNA, 20 bp, Artificial
  CRISPR gRNA sequence
tggtaaaggtgtgagttgtc

SEQ ID NO: 395557 - DNA, 20 bp, Artificial
  CRISPR gRNA sequence
tcttgatcactgagagttga

SEQ ID NO: 395558 - DNA, 20 bp, Artificial
  CRISPR gRNA sequence
gatcactgagagttgaagga

SEQ ID NO: 395559 - DNA, 20 bp, Artificial
  CRISPR gRNA sequence
atcactgagagttgaaggag

SEQ ID NO: 395560 - DNA, 20 bp, Artificial
  CRISPR gRNA sequence
agagttgaaggaggaaaaac

SEQ ID NO: 395561 - DNA, 20 bp, Artificial
  CRISPR gRNA sequence
aaggaggaaaaaccaagaac

SEQ ID NO: 395562 - DNA, 20 bp, Artificial
  CRISPR gRNA sequence
tgtagtttccagctatactc

SEQ ID NO: 395563 - DNA, 20 bp, Artificial
  CRISPR gRNA sequence
ccagctatactcacagaatg

SEQ ID NO: 395564 - DNA, 20 bp, Artificial
  CRISPR gRNA sequence
cagctatactcacagaatgt

SEQ ID NO: 395565 - DNA, 20 bp, Artificial
  CRISPR gRNA sequence
tactcacagaatgttctgag

SEQ ID NO: 395566 - DNA, 20 bp, Artificial
  CRISPR gRNA sequence
acagaatgttctgaggtcac

SEQ ID NO: 395567 - DNA, 20 bp, Artificial
  CRISPR gRNA sequence
tgaggtcacaggagaatcag

SEQ ID NO: 395568 - DNA, 20 bp, Artificial
  CRISPR gRNA sequence
aggtcacaggagaatcagtg

SEQ ID NO: 395569 - DNA, 20 bp, Artificial
  CRISPR gRNA sequence
cagctgtagcccattctcta

SEQ ID NO: 395570 - DNA, 20 bp, Artificial
  CRISPR gRNA sequence
agctgtagcccattctctat

SEQ ID NO: 395571 - DNA, 20 bp, Artificial
  CRISPR gRNA sequence
tagcccattctctatcaatt

SEQ ID NO: 395572 - DNA, 20 bp, Artificial
  CRISPR gRNA sequence
tctatcaattcagccaagca

SEQ ID NO: 395573 - DNA, 20 bp, Artificial
  CRISPR gRNA sequence
tatcaattcagccaagcata

SEQ ID NO: 395574 - DNA, 20 bp, Artificial
  CRISPR gRNA sequence
tcaattcagccaagcatacc

SEQ ID NO: 395575 - DNA, 20 bp, Artificial
  CRISPR gRNA sequence
agccaagcatacccctactc

SEQ ID NO: 395576 - DNA, 20 bp, Artificial
  CRISPR gRNA sequence
ctctacaatcatcttgaaaa

SEQ ID NO: 395577 - DNA, 20 bp, Artificial
  CRISPR gRNA sequence
tacaatcatcttgaaaatat

SEQ ID NO: 395578 - DNA, 20 bp, Artificial
  CRISPR gRNA sequence
caatcatcttgaaaatataa

SEQ ID NO: 395579 - DNA, 20 bp, Artificial
  CRISPR gRNA sequence
gaaaatataaatacctacaa

SEQ ID NO: 395580 - DNA, 20 bp, Artificial
  CRISPR gRNA sequence
aaaatataaatacctacaat

SEQ ID NO: 395581 - DNA, 20 bp, Artificial
  CRISPR gRNA sequence
caataagaagggtacagttt

SEQ ID NO: 395582 - DNA, 20 bp, Artificial
  CRISPR gRNA sequence
caagtttacataggtagtat

SEQ ID NO: 395583 - DNA, 20 bp, Artificial
  CRISPR gRNA sequence
aagtttacataggtagtata

SEQ ID NO: 395584 - DNA, 20 bp, Artificial
  CRISPR gRNA sequence
acataggtagtataaataaa

SEQ ID NO: 395585 - DNA, 20 bp, Artificial
  CRISPR gRNA sequence
cataggtagtataaataaac

SEQ ID NO: 395586 - DNA, 20 bp, Artificial
  CRISPR gRNA sequence
cacacaaagatggcagccaa

SEQ ID NO: 395587 - DNA, 20 bp, Artificial
  CRISPR gRNA sequence
cactccctgctctggctcgc

SEQ ID NO: 395588 - DNA, 20 bp, Artificial
  CRISPR gRNA sequence
cctgctctggctcgcctgac

SEQ ID NO: 395589 - DNA, 20 bp, Artificial
  CRISPR gRNA sequence
ctctggctcgcctgactgca

SEQ ID NO: 395590 - DNA, 20 bp, Artificial
  CRISPR gRNA sequence
tggctcgcctgactgcattt

SEQ ID NO: 395591 - DNA, 20 bp, Artificial
  CRISPR gRNA sequence
gctcgcctgactgcatttga

SEQ ID NO: 395592 - DNA, 20 bp, Artificial
  CRISPR gRNA sequence
gcctgactgcatttgacaac

SEQ ID NO: 395593 - DNA, 20 bp, Artificial
  CRISPR gRNA sequence
actgcatttgacaacaagcc

SEQ ID NO: 395594 - DNA, 20 bp, Artificial
  CRISPR gRNA sequence
catttgacaacaagcccaaa

SEQ ID NO: 395595 - DNA, 20 bp, Artificial
  CRISPR gRNA sequence
gacaacaagcccaaagtaaa

SEQ ID NO: 395596 - DNA, 20 bp, Artificial
  CRISPR gRNA sequence
acaacaagcccaaagtaaaa

SEQ ID NO: 395597 - DNA, 20 bp, Artificial
  CRISPR gRNA sequence
cctctggattttgctacagc

SEQ ID NO: 395598 - DNA, 20 bp, Artificial
  CRISPR gRNA sequence
ctctggattttgctacagct

SEQ ID NO: 395599 - DNA, 20 bp, Artificial
  CRISPR gRNA sequence
tggattttgctacagctcag

SEQ ID NO: 395600 - DNA, 20 bp, Artificial
  CRISPR gRNA sequence
gattttgctacagctcagaa

SEQ ID NO: 395601 - DNA, 20 bp, Artificial
  CRISPR gRNA sequence
tgctacagctcagaagtgtc

SEQ ID NO: 395602 - DNA, 20 bp, Artificial
  CRISPR gRNA sequence
gctacagctcagaagtgtca

SEQ ID NO: 395603 - DNA, 20 bp, Artificial
  CRISPR gRNA sequence
ctacagctcagaagtgtcaa

SEQ ID NO: 395604 - DNA, 20 bp, Artificial
  CRISPR gRNA sequence
cagctcagaagtgtcaaaga

SEQ ID NO: 395605 - DNA, 20 bp, Artificial
  CRISPR gRNA sequence
agaagtgtcaaagactgggg

SEQ ID NO: 395606 - DNA, 20 bp, Artificial
  CRISPR gRNA sequence
gggtgtctcacggggcataa

SEQ ID NO: 395607 - DNA, 20 bp, Artificial
  CRISPR gRNA sequence
acggggcataaaggaggtga

SEQ ID NO: 395608 - DNA, 20 bp, Artificial
  CRISPR gRNA sequence
aatccccaaaaatccaagcc

SEQ ID NO: 395609 - DNA, 20 bp, Artificial
  CRISPR gRNA sequence
tacccgtgcctgtacgtgaa

SEQ ID NO: 395610 - DNA, 20 bp, Artificial
  CRISPR gRNA sequence
tacgtgaattccactgtatc

SEQ ID NO: 395611 - DNA, 20 bp, Artificial
  CRISPR gRNA sequence
cactgtatcagccattcgat

SEQ ID NO: 395612 - DNA, 20 bp, Artificial
  CRISPR gRNA sequence
tatcagccattcgattattg

SEQ ID NO: 395613 - DNA, 20 bp, Artificial
  CRISPR gRNA sequence
gattattgaattcaattgtg

SEQ ID NO: 395614 - DNA, 20 bp, Artificial
  CRISPR gRNA sequence
ttgaattcaattgtgtatat

SEQ ID NO: 395615 - DNA, 20 bp, Artificial
  CRISPR gRNA sequence
aattcaattgtgtatataaa

SEQ ID NO: 395616 - DNA, 20 bp, Artificial
  CRISPR gRNA sequence
aattgtgtatataaatttag

SEQ ID NO: 395617 - DNA, 20 bp, Artificial
  CRISPR gRNA sequence
tgtatataaatttagtatta

SEQ ID NO: 395618 - DNA, 20 bp, Artificial
  CRISPR gRNA sequence
agtattatctggctttagag

SEQ ID NO: 395619 - DNA, 20 bp, Artificial
  CRISPR gRNA sequence
gtattatctggctttagaga

SEQ ID NO: 395620 - DNA, 20 bp, Artificial
  CRISPR gRNA sequence
tctggctttagagagttttt

SEQ ID NO: 395621 - DNA, 20 bp, Artificial
  CRISPR gRNA sequence
gctttagagagtttttaaac

SEQ ID NO: 395622 - DNA, 20 bp, Artificial
  CRISPR gRNA sequence
tagagagtttttaaactttc

SEQ ID NO: 395623 - DNA, 20 bp, Artificial
  CRISPR gRNA sequence
agagagtttttaaactttct

SEQ ID NO: 395624 - DNA, 20 bp, Artificial
  CRISPR gRNA sequence
gagagtttttaaactttctc

SEQ ID NO: 395625 - DNA, 20 bp, Artificial
  CRISPR gRNA sequence
ttaaactttctctttttttt

SEQ ID NO: 395626 - DNA, 20 bp, Artificial
  CRISPR gRNA sequence
taaactttctcttttttttt

SEQ ID NO: 395627 - DNA, 20 bp, Artificial
  CRISPR gRNA sequence
aaactttctctttttttttg

SEQ ID NO: 395628 - DNA, 20 bp, Artificial
  CRISPR gRNA sequence
aactttctctttttttttga

SEQ ID NO: 395629 - DNA, 20 bp, Artificial
  CRISPR gRNA sequence
tctctttttttttgattttt

SEQ ID NO: 395630 - DNA, 20 bp, Artificial
  CRISPR gRNA sequence
ctctttttttttgatttttg

SEQ ID NO: 395631 - DNA, 20 bp, Artificial
  CRISPR gRNA sequence
tctttttttttgatttttga

SEQ ID NO: 395632 - DNA, 20 bp, Artificial
  CRISPR gRNA sequence
tttttttttgatttttgatt

SEQ ID NO: 395633 - DNA, 20 bp, Artificial
  CRISPR gRNA sequence
tttttttgatttttgattac

SEQ ID NO: 395634 - DNA, 20 bp, Artificial
  CRISPR gRNA sequence
ttttttgatttttgattaca

SEQ ID NO: 395635 - DNA, 20 bp, Artificial
  CRISPR gRNA sequence
tttttgatttttgattacag

SEQ ID NO: 395636 - DNA, 20 bp, Artificial
  CRISPR gRNA sequence
ttttgatttttgattacaga

SEQ ID NO: 395637 - DNA, 20 bp, Artificial
  CRISPR gRNA sequence
tttgatttttgattacagag

SEQ ID NO: 395638 - DNA, 20 bp, Artificial
  CRISPR gRNA sequence
ttgatttttgattacagagc

SEQ ID NO: 395639 - DNA, 20 bp, Artificial
  CRISPR gRNA sequence
tgatttttgattacagagct

SEQ ID NO: 395640 - DNA, 20 bp, Artificial
  CRISPR gRNA sequence
gatttttgattacagagctt

SEQ ID NO: 395641 - DNA, 20 bp, Artificial
  CRISPR gRNA sequence
atttttgattacagagcttt

SEQ ID NO: 395642 - DNA, 20 bp, Artificial
  CRISPR gRNA sequence
ttgattacagagctttgcct

SEQ ID NO: 395643 - DNA, 20 bp, Artificial
  CRISPR gRNA sequence
tgattacagagctttgcctg

SEQ ID NO: 395644 - DNA, 20 bp, Artificial
  CRISPR gRNA sequence
gattacagagctttgcctga

SEQ ID NO: 395645 - DNA, 20 bp, Artificial
  CRISPR gRNA sequence
attacagagctttgcctgaa

SEQ ID NO: 395646 - DNA, 20 bp, Artificial
  CRISPR gRNA sequence
cagagctttgcctgaaagcc

SEQ ID NO: 395647 - DNA, 20 bp, Artificial
  CRISPR gRNA sequence
tgcctgaaagcctgagggtt

SEQ ID NO: 395648 - DNA, 20 bp, Artificial
  CRISPR gRNA sequence
gcctgaaagcctgagggttg

SEQ ID NO: 395649 - DNA, 20 bp, Artificial
  CRISPR gRNA sequence
cctgaaagcctgagggttga

SEQ ID NO: 395650 - DNA, 20 bp, Artificial
  CRISPR gRNA sequence
aaagcctgagggttgattcc

SEQ ID NO: 395651 - DNA, 20 bp, Artificial
  CRISPR gRNA sequence
agggttgattcccacagtga

SEQ ID NO: 395652 - DNA, 20 bp, Artificial
  CRISPR gRNA sequence
attcccacagtgacatgtgt

SEQ ID NO: 395653 - DNA, 20 bp, Artificial
  CRISPR gRNA sequence
ccacagtgacatgtgttctt

SEQ ID NO: 395654 - DNA, 20 bp, Artificial
  CRISPR gRNA sequence
ttgtgcctgttccttcctgg

SEQ ID NO: 395655 - DNA, 20 bp, Artificial
  CRISPR gRNA sequence
gtgcctgttccttcctgggc

SEQ ID NO: 395656 - DNA, 20 bp, Artificial
  CRISPR gRNA sequence
tgcctgttccttcctgggct

SEQ ID NO: 395657 - DNA, 20 bp, Artificial
  CRISPR gRNA sequence
ttccttcctgggcttagcac

SEQ ID NO: 395658 - DNA, 20 bp, Artificial
  CRISPR gRNA sequence
cttcctgggcttagcacagg

SEQ ID NO: 395659 - DNA, 20 bp, Artificial
  CRISPR gRNA sequence
cctgggcttagcacagggaa

SEQ ID NO: 395660 - DNA, 20 bp, Artificial
  CRISPR gRNA sequence
ctgggcttagcacagggaaa

SEQ ID NO: 395661 - DNA, 20 bp, Artificial
  CRISPR gRNA sequence
ggcttagcacagggaaagca

SEQ ID NO: 395662 - DNA, 20 bp, Artificial
  CRISPR gRNA sequence
agcacagggaaagcacgtgg

SEQ ID NO: 395663 - DNA, 20 bp, Artificial
  CRISPR gRNA sequence
gcacagggaaagcacgtgga

SEQ ID NO: 395664 - DNA, 20 bp, Artificial
  CRISPR gRNA sequence
ggcacacgttctggtaacca

SEQ ID NO: 395665 - DNA, 20 bp, Artificial
  CRISPR gRNA sequence
gcacacgttctggtaaccat

SEQ ID NO: 395666 - DNA, 20 bp, Artificial
  CRISPR gRNA sequence
tggtaaccatccactttcag

SEQ ID NO: 395667 - DNA, 20 bp, Artificial
  CRISPR gRNA sequence
gtaaccatccactttcagtt

SEQ ID NO: 395668 - DNA, 20 bp, Artificial
  CRISPR gRNA sequence
tcagtttcccatttacttca

SEQ ID NO: 395669 - DNA, 20 bp, Artificial
  CRISPR gRNA sequence
cagtttcccatttacttcac

SEQ ID NO: 395670 - DNA, 20 bp, Artificial
  CRISPR gRNA sequence
agtttcccatttacttcacc

SEQ ID NO: 395671 - DNA, 20 bp, Artificial
  CRISPR gRNA sequence
cccatttacttcacccttga

SEQ ID NO: 395672 - DNA, 20 bp, Artificial
  CRISPR gRNA sequence
ccatttacttcacccttgag

SEQ ID NO: 395673 - DNA, 20 bp, Artificial
  CRISPR gRNA sequence
acttcacccttgagaagtgc

SEQ ID NO: 395674 - DNA, 20 bp, Artificial
  CRISPR gRNA sequence
cttcacccttgagaagtgca

SEQ ID NO: 395675 - DNA, 20 bp, Artificial
  CRISPR gRNA sequence
cacccttgagaagtgcagtg

SEQ ID NO: 395676 - DNA, 20 bp, Artificial
  CRISPR gRNA sequence
acccttgagaagtgcagtga

SEQ ID NO: 395677 - DNA, 20 bp, Artificial
  CRISPR gRNA sequence
gagaagtgcagtgaccataa

SEQ ID NO: 395678 - DNA, 20 bp, Artificial
  CRISPR gRNA sequence
agaagtgcagtgaccataac

SEQ ID NO: 395679 - DNA, 20 bp, Artificial
  CRISPR gRNA sequence
gctttctgtgagtcttaaaa

SEQ ID NO: 395680 - DNA, 20 bp, Artificial
  CRISPR gRNA sequence
ctttctgtgagtcttaaaat

SEQ ID NO: 395681 - DNA, 20 bp, Artificial
  CRISPR gRNA sequence
tctgtgagtcttaaaatgtt

SEQ ID NO: 395682 - DNA, 20 bp, Artificial
  CRISPR gRNA sequence
ctgtgagtcttaaaatgttt

SEQ ID NO: 395683 - DNA, 20 bp, Artificial
  CRISPR gRNA sequence
tgtgagtcttaaaatgtttt

SEQ ID NO: 395684 - DNA, 20 bp, Artificial
  CRISPR gRNA sequence
tgagtcttaaaatgtttttt

SEQ ID NO: 395685 - DNA, 20 bp, Artificial
  CRISPR gRNA sequence
aaaatgttttttatcgtctg

SEQ ID NO: 395686 - DNA, 20 bp, Artificial
  CRISPR gRNA sequence
aaatgttttttatcgtctgc

SEQ ID NO: 395687 - DNA, 20 bp, Artificial
  CRISPR gRNA sequence
tttatcgtctgccttcttta

SEQ ID NO: 395688 - DNA, 20 bp, Artificial
  CRISPR gRNA sequence
ttatcgtctgccttctttat

SEQ ID NO: 395689 - DNA, 20 bp, Artificial
  CRISPR gRNA sequence
tatcgtctgccttctttata

SEQ ID NO: 395690 - DNA, 20 bp, Artificial
  CRISPR gRNA sequence
atcgtctgccttctttatat

SEQ ID NO: 395691 - DNA, 20 bp, Artificial
  CRISPR gRNA sequence
tcgtctgccttctttatata

SEQ ID NO: 395692 - DNA, 20 bp, Artificial
  CRISPR gRNA sequence
ccttctttatatactatttt

SEQ ID NO: 395693 - DNA, 20 bp, Artificial
  CRISPR gRNA sequence
ctttatatactattttattt

SEQ ID NO: 395694 - DNA, 20 bp, Artificial
  CRISPR gRNA sequence
tttatatactattttatttc

SEQ ID NO: 395695 - DNA, 20 bp, Artificial
  CRISPR gRNA sequence
tatatactattttatttcat

SEQ ID NO: 395696 - DNA, 20 bp, Artificial
  CRISPR gRNA sequence
atatactattttatttcatt

SEQ ID NO: 395697 - DNA, 20 bp, Artificial
  CRISPR gRNA sequence
tatactattttatttcatta

SEQ ID NO: 395698 - DNA, 20 bp, Artificial
  CRISPR gRNA sequence
ttttatttcattacggagtg

SEQ ID NO: 395699 - DNA, 20 bp, Artificial
  CRISPR gRNA sequence
tatttcattacggagtgaga

SEQ ID NO: 395700 - DNA, 20 bp, Artificial
  CRISPR gRNA sequence
atttcattacggagtgagat

SEQ ID NO: 395701 - DNA, 20 bp, Artificial
  CRISPR gRNA sequence
tttcattacggagtgagatt

SEQ ID NO: 395702 - DNA, 20 bp, Artificial
  CRISPR gRNA sequence
cattacggagtgagattttt

SEQ ID NO: 395703 - DNA, 20 bp, Artificial
  CRISPR gRNA sequence
attacggagtgagattttta

SEQ ID NO: 395704 - DNA, 20 bp, Artificial
  CRISPR gRNA sequence
cggagtgagatttttaagcc

SEQ ID NO: 395705 - DNA, 20 bp, Artificial
  CRISPR gRNA sequence
ttaagcctttaaaatgtttc

SEQ ID NO: 395706 - DNA, 20 bp, Artificial
  CRISPR gRNA sequence
taagcctttaaaatgtttct

SEQ ID NO: 395707 - DNA, 20 bp, Artificial
  CRISPR gRNA sequence
aagcctttaaaatgtttctg

SEQ ID NO: 395708 - DNA, 20 bp, Artificial
  CRISPR gRNA sequence
agcctttaaaatgtttctgc

SEQ ID NO: 395709 - DNA, 20 bp, Artificial
  CRISPR gRNA sequence
taaaatgtttctgcttcatc

SEQ ID NO: 395710 - DNA, 20 bp, Artificial
  CRISPR gRNA sequence
aaaatgtttctgcttcatcc

SEQ ID NO: 395711 - DNA, 20 bp, Artificial
  CRISPR gRNA sequence
aaatgtttctgcttcatccc

SEQ ID NO: 395712 - DNA, 20 bp, Artificial
  CRISPR gRNA sequence
ctgcttcatcccttgtggat

SEQ ID NO: 395713 - DNA, 20 bp, Artificial
  CRISPR gRNA sequence
tgcttcatcccttgtggatt

SEQ ID NO: 395714 - DNA, 20 bp, Artificial
  CRISPR gRNA sequence
cttcatcccttgtggattcc

SEQ ID NO: 395715 - DNA, 20 bp, Artificial
  CRISPR gRNA sequence
catcccttgtggattcctta

SEQ ID NO: 395716 - DNA, 20 bp, Artificial
  CRISPR gRNA sequence
atcccttgtggattccttat

SEQ ID NO: 395717 - DNA, 20 bp, Artificial
  CRISPR gRNA sequence
gtggattccttataggtacc

SEQ ID NO: 395718 - DNA, 20 bp, Artificial
  CRISPR gRNA sequence
tggattccttataggtacca

SEQ ID NO: 395719 - DNA, 20 bp, Artificial
  CRISPR gRNA sequence
cttataggtaccatttagta

SEQ ID NO: 395720 - DNA, 20 bp, Artificial
  CRISPR gRNA sequence
ataggtaccatttagtattt

SEQ ID NO: 395721 - DNA, 20 bp, Artificial
  CRISPR gRNA sequence
taggtaccatttagtatttt

SEQ ID NO: 395722 - DNA, 20 bp, Artificial
  CRISPR gRNA sequence
agtatttttttctttaaatg

SEQ ID NO: 395723 - DNA, 20 bp, Artificial
  CRISPR gRNA sequence
gtatttttttctttaaatga

SEQ ID NO: 395724 - DNA, 20 bp, Artificial
  CRISPR gRNA sequence
ttttctttaaatgaaaaact

SEQ ID NO: 395725 - DNA, 20 bp, Artificial
  CRISPR gRNA sequence
tttctttaaatgaaaaactg

SEQ ID NO: 395726 - DNA, 20 bp, Artificial
  CRISPR gRNA sequence
ttctttaaatgaaaaactgc

SEQ ID NO: 395727 - DNA, 20 bp, Artificial
  CRISPR gRNA sequence
tctttaaatgaaaaactgct

SEQ ID NO: 395728 - DNA, 20 bp, Artificial
  CRISPR gRNA sequence
ctttaaatgaaaaactgcta

SEQ ID NO: 395729 - DNA, 20 bp, Artificial
  CRISPR gRNA sequence
tttaaatgaaaaactgctaa

SEQ ID NO: 395730 - DNA, 20 bp, Artificial
  CRISPR gRNA sequence
taaatgaaaaactgctaaaa

SEQ ID NO: 395731 - DNA, 20 bp, Artificial
  CRISPR gRNA sequence
aaatgaaaaactgctaaaat

SEQ ID NO: 395732 - DNA, 20 bp, Artificial
  CRISPR gRNA sequence
aatgaaaaactgctaaaatg

SEQ ID NO: 395733 - DNA, 20 bp, Artificial
  CRISPR gRNA sequence
ctaaaatgtaacatttttta

SEQ ID NO: 395734 - DNA, 20 bp, Artificial
  CRISPR gRNA sequence
aaatgtaacattttttagtc

SEQ ID NO: 395735 - DNA, 20 bp, Artificial
  CRISPR gRNA sequence
tttagtcttgtgtgtgtgca

SEQ ID NO: 395736 - DNA, 20 bp, Artificial
  CRISPR gRNA sequence
ttagtcttgtgtgtgtgcat

SEQ ID NO: 395737 - DNA, 20 bp, Artificial
  CRISPR gRNA sequence
tagtcttgtgtgtgtgcatg

SEQ ID NO: 395738 - DNA, 20 bp, Artificial
  CRISPR gRNA sequence
agtcttgtgtgtgtgcatgc

SEQ ID NO: 395739 - DNA, 20 bp, Artificial
  CRISPR gRNA sequence
gtcttgtgtgtgtgcatgca

SEQ ID NO: 395740 - DNA, 20 bp, Artificial
  CRISPR gRNA sequence
gtgtgtgtgcatgcatacac

SEQ ID NO: 395741 - DNA, 20 bp, Artificial
  CRISPR gRNA sequence
tgtgtgtgcatgcatacaca

SEQ ID NO: 395742 - DNA, 20 bp, Artificial
  CRISPR gRNA sequence
tatgacttatttctaatctc

SEQ ID NO: 395743 - DNA, 20 bp, Artificial
  CRISPR gRNA sequence
atgacttatttctaatctca

SEQ ID NO: 395744 - DNA, 20 bp, Artificial
  CRISPR gRNA sequence
tgacttatttctaatctcac

SEQ ID NO: 395745 - DNA, 20 bp, Artificial
  CRISPR gRNA sequence
atttctaatctcaccagaat

SEQ ID NO: 395746 - DNA, 20 bp, Artificial
  CRISPR gRNA sequence
tttctaatctcaccagaatg

SEQ ID NO: 395747 - DNA, 20 bp, Artificial
  CRISPR gRNA sequence
ctaatctcaccagaatgggc

SEQ ID NO: 395748 - DNA, 20 bp, Artificial
  CRISPR gRNA sequence
taatctcaccagaatgggcc

SEQ ID NO: 395749 - DNA, 20 bp, Artificial
  CRISPR gRNA sequence
atctcaccagaatgggcctg

SEQ ID NO: 395750 - DNA, 20 bp, Artificial
  CRISPR gRNA sequence
accagaatgggcctgaagag

SEQ ID NO: 395751 - DNA, 20 bp, Artificial
  CRISPR gRNA sequence
aagagagagcttatggcttc

SEQ ID NO: 395752 - DNA, 20 bp, Artificial
  CRISPR gRNA sequence
atggcttcattctctaatca

SEQ ID NO: 395753 - DNA, 20 bp, Artificial
  CRISPR gRNA sequence
tggcttcattctctaatcag

SEQ ID NO: 395754 - DNA, 20 bp, Artificial
  CRISPR gRNA sequence
cattctctaatcagttgact

SEQ ID NO: 395755 - DNA, 20 bp, Artificial
  CRISPR gRNA sequence
attctctaatcagttgactt

SEQ ID NO: 395756 - DNA, 20 bp, Artificial
  CRISPR gRNA sequence
tctaatcagttgacttggaa

SEQ ID NO: 395757 - DNA, 20 bp, Artificial
  CRISPR gRNA sequence
taatcagttgacttggaatg

SEQ ID NO: 395758 - DNA, 20 bp, Artificial
  CRISPR gRNA sequence
atcagttgacttggaatgac

SEQ ID NO: 395759 - DNA, 20 bp, Artificial
  CRISPR gRNA sequence
acttggaatgactttttttc

SEQ ID NO: 395760 - DNA, 20 bp, Artificial
  CRISPR gRNA sequence
ggaatgactttttttcttat

SEQ ID NO: 395761 - DNA, 20 bp, Artificial
  CRISPR gRNA sequence
gaatgactttttttcttatt

SEQ ID NO: 395762 - DNA, 20 bp, Artificial
  CRISPR gRNA sequence
tttttcttatttctccatct

SEQ ID NO: 395763 - DNA, 20 bp, Artificial
  CRISPR gRNA sequence
ttttcttatttctccatctg

SEQ ID NO: 395764 - DNA, 20 bp, Artificial
  CRISPR gRNA sequence
tttcttatttctccatctga

SEQ ID NO: 395765 - DNA, 20 bp, Artificial
  CRISPR gRNA sequence
ttcttatttctccatctgac

SEQ ID NO: 395766 - DNA, 20 bp, Artificial
  CRISPR gRNA sequence
tcttatttctccatctgact

SEQ ID NO: 395767 - DNA, 20 bp, Artificial
  CRISPR gRNA sequence
cttatttctccatctgactt

SEQ ID NO: 395768 - DNA, 20 bp, Artificial
  CRISPR gRNA sequence
ttatttctccatctgactta

SEQ ID NO: 395769 - DNA, 20 bp, Artificial
  CRISPR gRNA sequence
atttctccatctgacttaag

SEQ ID NO: 395770 - DNA, 20 bp, Artificial
  CRISPR gRNA sequence
tttctccatctgacttaaga

SEQ ID NO: 395771 - DNA, 20 bp, Artificial
  CRISPR gRNA sequence
ctccatctgacttaagaaaa

SEQ ID NO: 395772 - DNA, 20 bp, Artificial
  CRISPR gRNA sequence
tccatctgacttaagaaaat

SEQ ID NO: 395773 - DNA, 20 bp, Artificial
  CRISPR gRNA sequence
catctgacttaagaaaatta

SEQ ID NO: 395774 - DNA, 20 bp, Artificial
  CRISPR gRNA sequence
acttaagaaaattaaaagtg

SEQ ID NO: 395775 - DNA, 20 bp, Artificial
  CRISPR gRNA sequence
aagaaaattaaaagtgatag

SEQ ID NO: 395776 - DNA, 20 bp, Artificial
  CRISPR gRNA sequence
agaaaattaaaagtgataga

SEQ ID NO: 395777 - DNA, 20 bp, Artificial
  CRISPR gRNA sequence
aaagtgatagagatacatat

SEQ ID NO: 395778 - DNA, 20 bp, Artificial
  CRISPR gRNA sequence
aaaaaggtctacacaaggac

SEQ ID NO: 395779 - DNA, 20 bp, Artificial
  CRISPR gRNA sequence
cacaaggactaaggaagcta

SEQ ID NO: 395780 - DNA, 20 bp, Artificial
  CRISPR gRNA sequence
aggaagctagcaggaattgg

SEQ ID NO: 395781 - DNA, 20 bp, Artificial
  CRISPR gRNA sequence
gcaggaattggtgaccctta

SEQ ID NO: 395782 - DNA, 20 bp, Artificial
  CRISPR gRNA sequence
gtgacccttataacaggaga

SEQ ID NO: 395783 - DNA, 20 bp, Artificial
  CRISPR gRNA sequence
ataacaggagaataagaaag

SEQ ID NO: 395784 - DNA, 20 bp, Artificial
  CRISPR gRNA sequence
taacaggagaataagaaaga

SEQ ID NO: 395785 - DNA, 20 bp, Artificial
  CRISPR gRNA sequence
tttctctgtggccttcttaa

SEQ ID NO: 395786 - DNA, 20 bp, Artificial
  CRISPR gRNA sequence
tctctgtggccttcttaacc

SEQ ID NO: 395787 - DNA, 20 bp, Artificial
  CRISPR gRNA sequence
ctctgtggccttcttaacct

SEQ ID NO: 395788 - DNA, 20 bp, Artificial
  CRISPR gRNA sequence
tctgtggccttcttaacctt

SEQ ID NO: 395789 - DNA, 20 bp, Artificial
  CRISPR gRNA sequence
tgtggccttcttaaccttgt

SEQ ID NO: 395790 - DNA, 20 bp, Artificial
  CRISPR gRNA sequence
tggccttcttaaccttgttt

SEQ ID NO: 395791 - DNA, 20 bp, Artificial
  CRISPR gRNA sequence
cttaaccttgtttgaaattt

SEQ ID NO: 395792 - DNA, 20 bp, Artificial
  CRISPR gRNA sequence
ttaaccttgtttgaaatttc

SEQ ID NO: 395793 - DNA, 20 bp, Artificial
  CRISPR gRNA sequence
aaccttgtttgaaatttcct

SEQ ID NO: 395794 - DNA, 20 bp, Artificial
  CRISPR gRNA sequence
accttgtttgaaatttcctt

SEQ ID NO: 395795 - DNA, 20 bp, Artificial
  CRISPR gRNA sequence
gtttgaaatttcctttgaca

SEQ ID NO: 395796 - DNA, 20 bp, Artificial
  CRISPR gRNA sequence
tttgaaatttcctttgacag

SEQ ID NO: 395797 - DNA, 20 bp, Artificial
  CRISPR gRNA sequence
gaaatttcctttgacaggca

SEQ ID NO: 395798 - DNA, 20 bp, Artificial
  CRISPR gRNA sequence
aaatttcctttgacaggcaa

SEQ ID NO: 395799 - DNA, 20 bp, Artificial
  CRISPR gRNA sequence
cctttgacaggcaatagcct

SEQ ID NO: 395800 - DNA, 20 bp, Artificial
  CRISPR gRNA sequence
ctttgacaggcaatagcctt

SEQ ID NO: 395801 - DNA, 20 bp, Artificial
  CRISPR gRNA sequence
tgacaggcaatagcctttca

SEQ ID NO: 395802 - DNA, 20 bp, Artificial
  CRISPR gRNA sequence
gacaggcaatagcctttcag

SEQ ID NO: 395803 - DNA, 20 bp, Artificial
  CRISPR gRNA sequence
acaggcaatagcctttcaga

SEQ ID NO: 395804 - DNA, 20 bp, Artificial
  CRISPR gRNA sequence
tcagaccaaatctcctcctc

SEQ ID NO: 395805 - DNA, 20 bp, Artificial
  CRISPR gRNA sequence
cagaccaaatctcctcctcc

SEQ ID NO: 395806 - DNA, 20 bp, Artificial
  CRISPR gRNA sequence
agaccaaatctcctcctcca

SEQ ID NO: 395807 - DNA, 20 bp, Artificial
  CRISPR gRNA sequence
ctcctccatcactttcacct

SEQ ID NO: 395808 - DNA, 20 bp, Artificial
  CRISPR gRNA sequence
ctccatcactttcacctgtc

SEQ ID NO: 395809 - DNA, 20 bp, Artificial
  CRISPR gRNA sequence
catcactttcacctgtcatt

SEQ ID NO: 395810 - DNA, 20 bp, Artificial
  CRISPR gRNA sequence
tcacctgtcattaatagata

SEQ ID NO: 395811 - DNA, 20 bp, Artificial
  CRISPR gRNA sequence
cacctgtcattaatagatat

SEQ ID NO: 395812 - DNA, 20 bp, Artificial
  CRISPR gRNA sequence
acctgtcattaatagatatg

SEQ ID NO: 395813 - DNA, 20 bp, Artificial
  CRISPR gRNA sequence
tcattaatagatatgatagt

SEQ ID NO: 395814 - DNA, 20 bp, Artificial
  CRISPR gRNA sequence
atagatatgatagtgtcatt

SEQ ID NO: 395815 - DNA, 20 bp, Artificial
  CRISPR gRNA sequence
tcgtatgttttcttccttcc

SEQ ID NO: 395816 - DNA, 20 bp, Artificial
  CRISPR gRNA sequence
cgtatgttttcttccttcct

SEQ ID NO: 395817 - DNA, 20 bp, Artificial
  CRISPR gRNA sequence
gtatgttttcttccttcctt

SEQ ID NO: 395818 - DNA, 20 bp, Artificial
  CRISPR gRNA sequence
tcttccttccttctgaattt

SEQ ID NO: 395819 - DNA, 20 bp, Artificial
  CRISPR gRNA sequence
cttccttccttctgaatttg

SEQ ID NO: 395820 - DNA, 20 bp, Artificial
  CRISPR gRNA sequence
ttccttccttctgaatttgg

SEQ ID NO: 395821 - DNA, 20 bp, Artificial
  CRISPR gRNA sequence
ccttccttctgaatttggga

SEQ ID NO: 395822 - DNA, 20 bp, Artificial
  CRISPR gRNA sequence
cttccttctgaatttgggat

SEQ ID NO: 395823 - DNA, 20 bp, Artificial
  CRISPR gRNA sequence
ccttctgaatttgggatagg

SEQ ID NO: 395824 - DNA, 20 bp, Artificial
  CRISPR gRNA sequence
cttctgaatttgggataggc

SEQ ID NO: 395825 - DNA, 20 bp, Artificial
  CRISPR gRNA sequence
ctgaatttgggataggcaaa

SEQ ID NO: 395826 - DNA, 20 bp, Artificial
  CRISPR gRNA sequence
tgaatttgggataggcaaaa

SEQ ID NO: 395827 - DNA, 20 bp, Artificial
  CRISPR gRNA sequence
aatttgggataggcaaaaca

SEQ ID NO: 395828 - DNA, 20 bp, Artificial
  CRISPR gRNA sequence
gggataggcaaaacaaaagc

SEQ ID NO: 395829 - DNA, 20 bp, Artificial
  CRISPR gRNA sequence
ggataggcaaaacaaaagcc

SEQ ID NO: 395830 - DNA, 20 bp, Artificial
  CRISPR gRNA sequence
taaaatacaattgcatagtg

SEQ ID NO: 395831 - DNA, 20 bp, Artificial
  CRISPR gRNA sequence
catagtgcatctggcttccc

SEQ ID NO: 395832 - DNA, 20 bp, Artificial
  CRISPR gRNA sequence
gcttcccttgccttttgaag

SEQ ID NO: 395833 - DNA, 20 bp, Artificial
  CRISPR gRNA sequence
cccttgccttttgaagcagc

SEQ ID NO: 395834 - DNA, 20 bp, Artificial
  CRISPR gRNA sequence
ccttgccttttgaagcagca

SEQ ID NO: 395835 - DNA, 20 bp, Artificial
  CRISPR gRNA sequence
gccttttgaagcagcaattc

SEQ ID NO: 395836 - DNA, 20 bp, Artificial
  CRISPR gRNA sequence
ccttttgaagcagcaattca

SEQ ID NO: 395837 - DNA, 20 bp, Artificial
  CRISPR gRNA sequence
ttgaagcagcaattcaacat

SEQ ID NO: 395838 - DNA, 20 bp, Artificial
  CRISPR gRNA sequence
tgaagcagcaattcaacatg

SEQ ID NO: 395839 - DNA, 20 bp, Artificial
  CRISPR gRNA sequence
gaagcagcaattcaacatgt

SEQ ID NO: 395840 - DNA, 20 bp, Artificial
  CRISPR gRNA sequence
aagcagcaattcaacatgtc

SEQ ID NO: 395841 - DNA, 20 bp, Artificial
  CRISPR gRNA sequence
aacatgtcaaccaagccatg

SEQ ID NO: 395842 - DNA, 20 bp, Artificial
  CRISPR gRNA sequence
taaaccggaataaattgctt

SEQ ID NO: 395843 - DNA, 20 bp, Artificial
  CRISPR gRNA sequence
ctttaatttgttgatcaatt

SEQ ID NO: 395844 - DNA, 20 bp, Artificial
  CRISPR gRNA sequence
taatttgttgatcaattcta

SEQ ID NO: 395845 - DNA, 20 bp, Artificial
  CRISPR gRNA sequence
aatttgttgatcaattctat

SEQ ID NO: 395846 - DNA, 20 bp, Artificial
  CRISPR gRNA sequence
atttgttgatcaattctatg

SEQ ID NO: 395847 - DNA, 20 bp, Artificial
  CRISPR gRNA sequence
gttgatcaattctatgtgtt

SEQ ID NO: 395848 - DNA, 20 bp, Artificial
  CRISPR gRNA sequence
ttgatcaattctatgtgttg

SEQ ID NO: 395849 - DNA, 20 bp, Artificial
  CRISPR gRNA sequence
atcaattctatgtgttggtt

SEQ ID NO: 395850 - DNA, 20 bp, Artificial
  CRISPR gRNA sequence
tatgtgttggttcaatttta

SEQ ID NO: 395851 - DNA, 20 bp, Artificial
  CRISPR gRNA sequence
tgtgttggttcaattttaga

SEQ ID NO: 395852 - DNA, 20 bp, Artificial
  CRISPR gRNA sequence
gttcaattttagaggttttt

SEQ ID NO: 395853 - DNA, 20 bp, Artificial
  CRISPR gRNA sequence
aattttagaggtttttggtg

SEQ ID NO: 395854 - DNA, 20 bp, Artificial
  CRISPR gRNA sequence
tagaggtttttggtgttttg

SEQ ID NO: 395855 - DNA, 20 bp, Artificial
  CRISPR gRNA sequence
agaggtttttggtgttttgt

SEQ ID NO: 395856 - DNA, 20 bp, Artificial
  CRISPR gRNA sequence
gaggtttttggtgttttgtt

SEQ ID NO: 395857 - DNA, 20 bp, Artificial
  CRISPR gRNA sequence
ttggtgttttgttgttgggg

SEQ ID NO: 395858 - DNA, 20 bp, Artificial
  CRISPR gRNA sequence
tggtgttttgttgttggggt

SEQ ID NO: 395859 - DNA, 20 bp, Artificial
  CRISPR gRNA sequence
ggtgttttgttgttggggtc

SEQ ID NO: 395860 - DNA, 20 bp, Artificial
  CRISPR gRNA sequence
gtgttttgttgttggggtcc

SEQ ID NO: 395861 - DNA, 20 bp, Artificial
  CRISPR gRNA sequence
tgttgttggggtccttttga

SEQ ID NO: 395862 - DNA, 20 bp, Artificial
  CRISPR gRNA sequence
gttgttggggtccttttgaa

SEQ ID NO: 395863 - DNA, 20 bp, Artificial
  CRISPR gRNA sequence
ttgttggggtccttttgaac

SEQ ID NO: 395864 - DNA, 20 bp, Artificial
  CRISPR gRNA sequence
ttggggtccttttgaacaat

SEQ ID NO: 395865 - DNA, 20 bp, Artificial
  CRISPR gRNA sequence
gggtccttttgaacaatgaa

SEQ ID NO: 395866 - DNA, 20 bp, Artificial
  CRISPR gRNA sequence
ttgaacaatgaaaattatct

SEQ ID NO: 395867 - DNA, 20 bp, Artificial
  CRISPR gRNA sequence
tgaacaatgaaaattatctt

SEQ ID NO: 395868 - DNA, 20 bp, Artificial
  CRISPR gRNA sequence
gaacaatgaaaattatcttc

SEQ ID NO: 395869 - DNA, 20 bp, Artificial
  CRISPR gRNA sequence
aacaatgaaaattatcttcc

SEQ ID NO: 395870 - DNA, 20 bp, Artificial
  CRISPR gRNA sequence
tcttccaaagtaggttacac

SEQ ID NO: 395871 - DNA, 20 bp, Artificial
  CRISPR gRNA sequence
ccaaagtaggttacactgga

SEQ ID NO: 395872 - DNA, 20 bp, Artificial
  CRISPR gRNA sequence
caaagtaggttacactggag

SEQ ID NO: 395873 - DNA, 20 bp, Artificial
  CRISPR gRNA sequence
cactggagcctactatctag

SEQ ID NO: 395874 - DNA, 20 bp, Artificial
  CRISPR gRNA sequence
gagcctactatctagaaaat

SEQ ID NO: 395875 - DNA, 20 bp, Artificial
  CRISPR gRNA sequence
ctatctagaaaatagctgtc

SEQ ID NO: 395876 - DNA, 20 bp, Artificial
  CRISPR gRNA sequence
tctagaaaatagctgtctat

SEQ ID NO: 395877 - DNA, 20 bp, Artificial
  CRISPR gRNA sequence
gaaaatagctgtctattttc

SEQ ID NO: 395878 - DNA, 20 bp, Artificial
  CRISPR gRNA sequence
tctattttctagataatttt

SEQ ID NO: 395879 - DNA, 20 bp, Artificial
  CRISPR gRNA sequence
ttttctagataattttctaa

SEQ ID NO: 395880 - DNA, 20 bp, Artificial
  CRISPR gRNA sequence
tctagataattttctaaagc

SEQ ID NO: 395881 - DNA, 20 bp, Artificial
  CRISPR gRNA sequence
ctagataattttctaaagca

SEQ ID NO: 395882 - DNA, 20 bp, Artificial
  CRISPR gRNA sequence
tagataattttctaaagcaa

SEQ ID NO: 395883 - DNA, 20 bp, Artificial
  CRISPR gRNA sequence
gataattttctaaagcaatt

SEQ ID NO: 395884 - DNA, 20 bp, Artificial
  CRISPR gRNA sequence
tctaaagcaattctcctgga

SEQ ID NO: 395885 - DNA, 20 bp, Artificial
  CRISPR gRNA sequence
ctaaagcaattctcctggaa

SEQ ID NO: 395886 - DNA, 20 bp, Artificial
  CRISPR gRNA sequence
taaagcaattctcctggaat

SEQ ID NO: 395887 - DNA, 20 bp, Artificial
  CRISPR gRNA sequence
aagcaattctcctggaatag

SEQ ID NO: 395888 - DNA, 20 bp, Artificial
  CRISPR gRNA sequence
tcctggaatagtgcctatta

SEQ ID NO: 395889 - DNA, 20 bp, Artificial
  CRISPR gRNA sequence
ctggaatagtgcctattaat

SEQ ID NO: 395890 - DNA, 20 bp, Artificial
  CRISPR gRNA sequence
gaatagtgcctattaatctc

SEQ ID NO: 395891 - DNA, 20 bp, Artificial
  CRISPR gRNA sequence
ttaatctcaacatccaaatt

SEQ ID NO: 395892 - DNA, 20 bp, Artificial
  CRISPR gRNA sequence
atctcaacatccaaattttc

SEQ ID NO: 395893 - DNA, 20 bp, Artificial
  CRISPR gRNA sequence
aacatccaaattttctgggt

SEQ ID NO: 395894 - DNA, 20 bp, Artificial
  CRISPR gRNA sequence
tctgggttggcagttcaaat

SEQ ID NO: 395895 - DNA, 20 bp, Artificial
  CRISPR gRNA sequence
ctgggttggcagttcaaatt

SEQ ID NO: 395896 - DNA, 20 bp, Artificial
  CRISPR gRNA sequence
tgggttggcagttcaaattc

SEQ ID NO: 395897 - DNA, 20 bp, Artificial
  CRISPR gRNA sequence
ggttggcagttcaaattcca

SEQ ID NO: 395898 - DNA, 20 bp, Artificial
  CRISPR gRNA sequence
gcagttcaaattccactttt

SEQ ID NO: 395899 - DNA, 20 bp, Artificial
  CRISPR gRNA sequence
aaattccactttttcaggga

SEQ ID NO: 395900 - DNA, 20 bp, Artificial
  CRISPR gRNA sequence
cactttttcagggactctgc

SEQ ID NO: 395901 - DNA, 20 bp, Artificial
  CRISPR gRNA sequence
tttcagggactctgccctga

SEQ ID NO: 395902 - DNA, 20 bp, Artificial
  CRISPR gRNA sequence
ttcagggactctgccctgaa

SEQ ID NO: 395903 - DNA, 20 bp, Artificial
  CRISPR gRNA sequence
tcagggactctgccctgaat

SEQ ID NO: 395904 - DNA, 20 bp, Artificial
  CRISPR gRNA sequence
cagggactctgccctgaatt

SEQ ID NO: 395905 - DNA, 20 bp, Artificial
  CRISPR gRNA sequence
agggactctgccctgaattt

SEQ ID NO: 395906 - DNA, 20 bp, Artificial
  CRISPR gRNA sequence
tgccctgaatttcctaggta

SEQ ID NO: 395907 - DNA, 20 bp, Artificial
  CRISPR gRNA sequence
ccctgaatttcctaggtaaa

SEQ ID NO: 395908 - DNA, 20 bp, Artificial
  CRISPR gRNA sequence
aatttcctaggtaaaataaa

SEQ ID NO: 395909 - DNA, 20 bp, Artificial
  CRISPR gRNA sequence
cctaggtaaaataaaattat

SEQ ID NO: 395910 - DNA, 20 bp, Artificial
  CRISPR gRNA sequence
ctaggtaaaataaaattata

SEQ ID NO: 395911 - DNA, 20 bp, Artificial
  CRISPR gRNA sequence
ggtaaaataaaattatatcc

SEQ ID NO: 395912 - DNA, 20 bp, Artificial
  CRISPR gRNA sequence
tatcctctagactacaatgc

SEQ ID NO: 395913 - DNA, 20 bp, Artificial
  CRISPR gRNA sequence
tagactacaatgcgacttat

SEQ ID NO: 395914 - DNA, 20 bp, Artificial
  CRISPR gRNA sequence
gactacaatgcgacttattt

SEQ ID NO: 395915 - DNA, 20 bp, Artificial
  CRISPR gRNA sequence
caatgcgacttatttttttg

SEQ ID NO: 395916 - DNA, 20 bp, Artificial
  CRISPR gRNA sequence
atttttttgcctcaaataat

SEQ ID NO: 395917 - DNA, 20 bp, Artificial
  CRISPR gRNA sequence
tttttttgcctcaaataata

SEQ ID NO: 395918 - DNA, 20 bp, Artificial
  CRISPR gRNA sequence
ttttgcctcaaataataatt

SEQ ID NO: 395919 - DNA, 20 bp, Artificial
  CRISPR gRNA sequence
tttgcctcaaataataattt

SEQ ID NO: 395920 - DNA, 20 bp, Artificial
  CRISPR gRNA sequence
ttgcctcaaataataatttg

SEQ ID NO: 395921 - DNA, 20 bp, Artificial
  CRISPR gRNA sequence
tgcctcaaataataatttgt

SEQ ID NO: 395922 - DNA, 20 bp, Artificial
  CRISPR gRNA sequence
gcctcaaataataatttgtg

SEQ ID NO: 395923 - DNA, 20 bp, Artificial
  CRISPR gRNA sequence
cctcaaataataatttgtga

SEQ ID NO: 395924 - DNA, 20 bp, Artificial
  CRISPR gRNA sequence
aaataataatttgtgatata

SEQ ID NO: 395925 - DNA, 20 bp, Artificial
  CRISPR gRNA sequence
gtgatataaacttttctctc

SEQ ID NO: 395926 - DNA, 20 bp, Artificial
  CRISPR gRNA sequence
tgatataaacttttctctct

SEQ ID NO: 395927 - DNA, 20 bp, Artificial
  CRISPR gRNA sequence
ttctctctcccaatattcta

SEQ ID NO: 395928 - DNA, 20 bp, Artificial
  CRISPR gRNA sequence
tctctctcccaatattctac

SEQ ID NO: 395929 - DNA, 20 bp, Artificial
  CRISPR gRNA sequence
ctctctcccaatattctaca

SEQ ID NO: 395930 - DNA, 20 bp, Artificial
  CRISPR gRNA sequence
tctctcccaatattctacat

SEQ ID NO: 395931 - DNA, 20 bp, Artificial
  CRISPR gRNA sequence
tctcccaatattctacatcc

SEQ ID NO: 395932 - DNA, 20 bp, Artificial
  CRISPR gRNA sequence
tcccaatattctacatccta

SEQ ID NO: 395933 - DNA, 20 bp, Artificial
  CRISPR gRNA sequence
ccaatattctacatcctatt

SEQ ID NO: 395934 - DNA, 20 bp, Artificial
  CRISPR gRNA sequence
tacatcctatttagagctaa

SEQ ID NO: 395935 - DNA, 20 bp, Artificial
  CRISPR gRNA sequence
catcctatttagagctaaga

SEQ ID NO: 395936 - DNA, 20 bp, Artificial
  CRISPR gRNA sequence
tttagagctaagatctatgt

SEQ ID NO: 395937 - DNA, 20 bp, Artificial
  CRISPR gRNA sequence
agagctaagatctatgtctt

SEQ ID NO: 395938 - DNA, 20 bp, Artificial
  CRISPR gRNA sequence
gagctaagatctatgtcttt

SEQ ID NO: 395939 - DNA, 20 bp, Artificial
  CRISPR gRNA sequence
agatctatgtctttctatct

SEQ ID NO: 395940 - DNA, 20 bp, Artificial
  CRISPR gRNA sequence
tgtctttctatcttccaaac

SEQ ID NO: 395941 - DNA, 20 bp, Artificial
  CRISPR gRNA sequence
tctatcttccaaaccactga

SEQ ID NO: 395942 - DNA, 20 bp, Artificial
  CRISPR gRNA sequence
ctatcttccaaaccactgaa

SEQ ID NO: 395943 - DNA, 20 bp, Artificial
  CRISPR gRNA sequence
tatcttccaaaccactgaac

SEQ ID NO: 395944 - DNA, 20 bp, Artificial
  CRISPR gRNA sequence
tcttccaaaccactgaacat

SEQ ID NO: 395945 - DNA, 20 bp, Artificial
  CRISPR gRNA sequence
ccaaaccactgaacattaca

SEQ ID NO: 395946 - DNA, 20 bp, Artificial
  CRISPR gRNA sequence
caaaccactgaacattacat

SEQ ID NO: 395947 - DNA, 20 bp, Artificial
  CRISPR gRNA sequence
aacattacattgtacattgt

SEQ ID NO: 395948 - DNA, 20 bp, Artificial
  CRISPR gRNA sequence
cattgtacattgtagattct

SEQ ID NO: 395949 - DNA, 20 bp, Artificial
  CRISPR gRNA sequence
tacattgtagattctcagga

SEQ ID NO: 395950 - DNA, 20 bp, Artificial
  CRISPR gRNA sequence
tagattctcaggaaagactt

SEQ ID NO: 395951 - DNA, 20 bp, Artificial
  CRISPR gRNA sequence
tcaggaaagacttgatgagt

SEQ ID NO: 395952 - DNA, 20 bp, Artificial
  CRISPR gRNA sequence
aggaaagacttgatgagtga

SEQ ID NO: 395953 - DNA, 20 bp, Artificial
  CRISPR gRNA sequence
gatgagtgaattaatggata

SEQ ID NO: 395954 - DNA, 20 bp, Artificial
  CRISPR gRNA sequence
atgagtgaattaatggataa

SEQ ID NO: 395955 - DNA, 20 bp, Artificial
  CRISPR gRNA sequence
atggataagtgggttcagct

SEQ ID NO: 395956 - DNA, 20 bp, Artificial
  CRISPR gRNA sequence
agctcctgcaaatcagcaca

SEQ ID NO: 395957 - DNA, 20 bp, Artificial
  CRISPR gRNA sequence
ctgcaaatcagcacacccat

SEQ ID NO: 395958 - DNA, 20 bp, Artificial
  CRISPR gRNA sequence
caaatcagcacacccattta

SEQ ID NO: 395959 - DNA, 20 bp, Artificial
  CRISPR gRNA sequence
ataaaagccagatttgagac

SEQ ID NO: 395960 - DNA, 20 bp, Artificial
  CRISPR gRNA sequence
taaaagccagatttgagaca

SEQ ID NO: 395961 - DNA, 20 bp, Artificial
  CRISPR gRNA sequence
gagacacttccctctcccca

SEQ ID NO: 395962 - DNA, 20 bp, Artificial
  CRISPR gRNA sequence
agacacttccctctccccag

SEQ ID NO: 395963 - DNA, 20 bp, Artificial
  CRISPR gRNA sequence
ccctctccccagctttaaat

SEQ ID NO: 395964 - DNA, 20 bp, Artificial
  CRISPR gRNA sequence
cctctccccagctttaaatc

SEQ ID NO: 395965 - DNA, 20 bp, Artificial
  CRISPR gRNA sequence
tccccagctttaaatcaaat

SEQ ID NO: 395966 - DNA, 20 bp, Artificial
  CRISPR gRNA sequence
cccagctttaaatcaaattt

SEQ ID NO: 395967 - DNA, 20 bp, Artificial
  CRISPR gRNA sequence
taaatcaaatttaaaggctg

SEQ ID NO: 395968 - DNA, 20 bp, Artificial
  CRISPR gRNA sequence
aaatcaaatttaaaggctga

SEQ ID NO: 395969 - DNA, 20 bp, Artificial
  CRISPR gRNA sequence
aatcaaatttaaaggctgag

SEQ ID NO: 395970 - DNA, 20 bp, Artificial
  CRISPR gRNA sequence
aaaggctgagattatacccc

SEQ ID NO: 395971 - DNA, 20 bp, Artificial
  CRISPR gRNA sequence
aaggctgagattatacccca

SEQ ID NO: 395972 - DNA, 20 bp, Artificial
  CRISPR gRNA sequence
agattataccccagcattag

SEQ ID NO: 395973 - DNA, 20 bp, Artificial
  CRISPR gRNA sequence
taccccagcattagaaaaat

SEQ ID NO: 395974 - DNA, 20 bp, Artificial
  CRISPR gRNA sequence
gaaaaatgttggccatgctg

SEQ ID NO: 395975 - DNA, 20 bp, Artificial
  CRISPR gRNA sequence
gccatgctgccctcaactaa

SEQ ID NO: 395976 - DNA, 20 bp, Artificial
  CRISPR gRNA sequence
ccctcaactaatatataggc

SEQ ID NO: 395977 - DNA, 20 bp, Artificial
  CRISPR gRNA sequence
aactaatatataggccagca

SEQ ID NO: 395978 - DNA, 20 bp, Artificial
  CRISPR gRNA sequence
atatataggccagcatgatc

SEQ ID NO: 395979 - DNA, 20 bp, Artificial
  CRISPR gRNA sequence
tagaatccctttcatcatag

SEQ ID NO: 395980 - DNA, 20 bp, Artificial
  CRISPR gRNA sequence
agaatccctttcatcatagg

SEQ ID NO: 395981 - DNA, 20 bp, Artificial
  CRISPR gRNA sequence
gaatccctttcatcatagga

SEQ ID NO: 395982 - DNA, 20 bp, Artificial
  CRISPR gRNA sequence
tcatcataggattcctcaga

SEQ ID NO: 395983 - DNA, 20 bp, Artificial
  CRISPR gRNA sequence
catcataggattcctcagaa

SEQ ID NO: 395984 - DNA, 20 bp, Artificial
  CRISPR gRNA sequence
atcataggattcctcagaac

SEQ ID NO: 395985 - DNA, 20 bp, Artificial
  CRISPR gRNA sequence
ctcagaactgccatcaattc

SEQ ID NO: 395986 - DNA, 20 bp, Artificial
  CRISPR gRNA sequence
agaactgccatcaattctgg

SEQ ID NO: 395987 - DNA, 20 bp, Artificial
  CRISPR gRNA sequence
ccatcaattctggagccctt

SEQ ID NO: 395988 - DNA, 20 bp, Artificial
  CRISPR gRNA sequence
tggagcccttaatattaaag

SEQ ID NO: 395989 - DNA, 20 bp, Artificial
  CRISPR gRNA sequence
gagcccttaatattaaagga

SEQ ID NO: 395990 - DNA, 20 bp, Artificial
  CRISPR gRNA sequence
aatattaaaggaatctcttt

SEQ ID NO: 395991 - DNA, 20 bp, Artificial
  CRISPR gRNA sequence
atattaaaggaatctcttta

SEQ ID NO: 395992 - DNA, 20 bp, Artificial
  CRISPR gRNA sequence
aaggaatctctttagtgcca

SEQ ID NO: 395993 - DNA, 20 bp, Artificial
  CRISPR gRNA sequence
tttagtgccactaaccagca

SEQ ID NO: 395994 - DNA, 20 bp, Artificial
  CRISPR gRNA sequence
tagtgccactaaccagcaga

SEQ ID NO: 395995 - DNA, 20 bp, Artificial
  CRISPR gRNA sequence
agtgccactaaccagcagat

SEQ ID NO: 395996 - DNA, 20 bp, Artificial
  CRISPR gRNA sequence
gtgccactaaccagcagata

SEQ ID NO: 395997 - DNA, 20 bp, Artificial
  CRISPR gRNA sequence
accagcagatatatacaaga

SEQ ID NO: 395998 - DNA, 20 bp, Artificial
  CRISPR gRNA sequence
tggctgctatgtcagctgct

SEQ ID NO: 395999 - DNA, 20 bp, Artificial
  CRISPR gRNA sequence
ggctgctatgtcagctgctg

SEQ ID NO: 396000 - DNA, 20 bp, Artificial
  CRISPR gRNA sequence
gctgctatgtcagctgctgg

SEQ ID NO: 396001 - DNA, 20 bp, Artificial
  CRISPR gRNA sequence
ctatgtcagctgctgggaac

SEQ ID NO: 396002 - DNA, 20 bp, Artificial
  CRISPR gRNA sequence
tgtcagctgctgggaacctg

SEQ ID NO: 396003 - DNA, 20 bp, Artificial
  CRISPR gRNA sequence
ctgggaacctggacagagaa

SEQ ID NO: 396004 - DNA, 20 bp, Artificial
  CRISPR gRNA sequence
ggaacctggacagagaacac

SEQ ID NO: 396005 - DNA, 20 bp, Artificial
  CRISPR gRNA sequence
gacagagaacacttgtccct

SEQ ID NO: 396006 - DNA, 20 bp, Artificial
  CRISPR gRNA sequence
gtccctgaagggtgtagaga

SEQ ID NO: 396007 - DNA, 20 bp, Artificial
  CRISPR gRNA sequence
tccctgaagggtgtagagat

SEQ ID NO: 396008 - DNA, 20 bp, Artificial
  CRISPR gRNA sequence
aagggtgtagagataagagc

SEQ ID NO: 396009 - DNA, 20 bp, Artificial
  CRISPR gRNA sequence
ctaagaatgagcatggatgg

SEQ ID NO: 396010 - DNA, 20 bp, Artificial
  CRISPR gRNA sequence
taagaatgagcatggatggc

SEQ ID NO: 396011 - DNA, 20 bp, Artificial
  CRISPR gRNA sequence
agaatgagcatggatggcat

SEQ ID NO: 396012 - DNA, 20 bp, Artificial
  CRISPR gRNA sequence
atcccacctgggagagaatg

SEQ ID NO: 396013 - DNA, 20 bp, Artificial
  CRISPR gRNA sequence
ggagagaatgagactcttaa

SEQ ID NO: 396014 - DNA, 20 bp, Artificial
  CRISPR gRNA sequence
ttaaagggaaacagtgagga

SEQ ID NO: 396015 - DNA, 20 bp, Artificial
  CRISPR gRNA sequence
aaagggaaacagtgaggaac

SEQ ID NO: 396016 - DNA, 20 bp, Artificial
  CRISPR gRNA sequence
aagggaaacagtgaggaaca

SEQ ID NO: 396017 - DNA, 20 bp, Artificial
  CRISPR gRNA sequence
tgtgcccagtttgagataaa

SEQ ID NO: 396018 - DNA, 20 bp, Artificial
  CRISPR gRNA sequence
tgcccagtttgagataaatg

SEQ ID NO: 396019 - DNA, 20 bp, Artificial
  CRISPR gRNA sequence
gagataaatggactggaata

SEQ ID NO: 396020 - DNA, 20 bp, Artificial
  CRISPR gRNA sequence
agataaatggactggaatat

SEQ ID NO: 396021 - DNA, 20 bp, Artificial
  CRISPR gRNA sequence
gaatatgggagatcacagag

SEQ ID NO: 396022 - DNA, 20 bp, Artificial
  CRISPR gRNA sequence
catgtgtggagcaagaaaat

SEQ ID NO: 396023 - DNA, 20 bp, Artificial
  CRISPR gRNA sequence
accctctactataaatatga

SEQ ID NO: 396024 - DNA, 20 bp, Artificial
  CRISPR gRNA sequence
tactataaatatgagttcta

SEQ ID NO: 396025 - DNA, 20 bp, Artificial
  CRISPR gRNA sequence
ctataaatatgagttctatg

SEQ ID NO: 396026 - DNA, 20 bp, Artificial
  CRISPR gRNA sequence
taaatatgagttctatgtgt

SEQ ID NO: 396027 - DNA, 20 bp, Artificial
  CRISPR gRNA sequence
tatgtgtcttctgctctcac

SEQ ID NO: 396028 - DNA, 20 bp, Artificial
  CRISPR gRNA sequence
tgtgtcttctgctctcacat

SEQ ID NO: 396029 - DNA, 20 bp, Artificial
  CRISPR gRNA sequence
ctgctctcacatcaataatt

SEQ ID NO: 396030 - DNA, 20 bp, Artificial
  CRISPR gRNA sequence
tgctctcacatcaataattc

SEQ ID NO: 396031 - DNA, 20 bp, Artificial
  CRISPR gRNA sequence
ctctcacatcaataattcac

SEQ ID NO: 396032 - DNA, 20 bp, Artificial
  CRISPR gRNA sequence
tcacatcaataattcacctg

SEQ ID NO: 396033 - DNA, 20 bp, Artificial
  CRISPR gRNA sequence
acatcaataattcacctgtt

SEQ ID NO: 396034 - DNA, 20 bp, Artificial
  CRISPR gRNA sequence
acctgttcactttcctctcc

SEQ ID NO: 396035 - DNA, 20 bp, Artificial
  CRISPR gRNA sequence
ttcactttcctctccctccc

SEQ ID NO: 396036 - DNA, 20 bp, Artificial
  CRISPR gRNA sequence
actttcctctccctcccaac

SEQ ID NO: 396037 - DNA, 20 bp, Artificial
  CRISPR gRNA sequence
tcctctccctcccaactctc

SEQ ID NO: 396038 - DNA, 20 bp, Artificial
  CRISPR gRNA sequence
cctctccctcccaactctcc

SEQ ID NO: 396039 - DNA, 20 bp, Artificial
  CRISPR gRNA sequence
ctctccctcccaactctccc

SEQ ID NO: 396040 - DNA, 20 bp, Artificial
  CRISPR gRNA sequence
tccctcccaactctccccct

SEQ ID NO: 396041 - DNA, 20 bp, Artificial
  CRISPR gRNA sequence
cctcccaactctccccctct

SEQ ID NO: 396042 - DNA, 20 bp, Artificial
  CRISPR gRNA sequence
ccaactctccccctcttttc

SEQ ID NO: 396043 - DNA, 20 bp, Artificial
  CRISPR gRNA sequence
tccccctcttttctctatgc

SEQ ID NO: 396044 - DNA, 20 bp, Artificial
  CRISPR gRNA sequence
cccctcttttctctatgccc

SEQ ID NO: 396045 - DNA, 20 bp, Artificial
  CRISPR gRNA sequence
ttttctctatgccctctaca

SEQ ID NO: 396046 - DNA, 20 bp, Artificial
  CRISPR gRNA sequence
ttctctatgccctctacatt

SEQ ID NO: 396047 - DNA, 20 bp, Artificial
  CRISPR gRNA sequence
tctctatgccctctacattc

SEQ ID NO: 396048 - DNA, 20 bp, Artificial
  CRISPR gRNA sequence
ctctatgccctctacattct

SEQ ID NO: 396049 - DNA, 20 bp, Artificial
  CRISPR gRNA sequence
tctatgccctctacattctt

SEQ ID NO: 396050 - DNA, 20 bp, Artificial
  CRISPR gRNA sequence
tatgccctctacattcttta

SEQ ID NO: 396051 - DNA, 20 bp, Artificial
  CRISPR gRNA sequence
tgccctctacattctttaac

SEQ ID NO: 396052 - DNA, 20 bp, Artificial
  CRISPR gRNA sequence
tacattctttaacatgaaca

SEQ ID NO: 396053 - DNA, 20 bp, Artificial
  CRISPR gRNA sequence
cattctttaacatgaacacc

SEQ ID NO: 396054 - DNA, 20 bp, Artificial
  CRISPR gRNA sequence
tttaacatgaacaccttctt

SEQ ID NO: 396055 - DNA, 20 bp, Artificial
  CRISPR gRNA sequence
taacatgaacaccttcttta

SEQ ID NO: 396056 - DNA, 20 bp, Artificial
  CRISPR gRNA sequence
aacatgaacaccttctttaa

SEQ ID NO: 396057 - DNA, 20 bp, Artificial
  CRISPR gRNA sequence
acatgaacaccttctttaac

SEQ ID NO: 396058 - DNA, 20 bp, Artificial
  CRISPR gRNA sequence
ctttaacacactacaatgtg

SEQ ID NO: 396059 - DNA, 20 bp, Artificial
  CRISPR gRNA sequence
tttaacacactacaatgtga

SEQ ID NO: 396060 - DNA, 20 bp, Artificial
  CRISPR gRNA sequence
taacacactacaatgtgacc

SEQ ID NO: 396061 - DNA, 20 bp, Artificial
  CRISPR gRNA sequence
aacacactacaatgtgacca

SEQ ID NO: 396062 - DNA, 20 bp, Artificial
  CRISPR gRNA sequence
acacactacaatgtgaccat

SEQ ID NO: 396063 - DNA, 20 bp, Artificial
  CRISPR gRNA sequence
caatgtgaccatcctccaag

SEQ ID NO: 396064 - DNA, 20 bp, Artificial
  CRISPR gRNA sequence
caagccacaagctatgacct

SEQ ID NO: 396065 - DNA, 20 bp, Artificial
  CRISPR gRNA sequence
tgaccttagacttctgcccc

SEQ ID NO: 396066 - DNA, 20 bp, Artificial
  CRISPR gRNA sequence
agacttctgcccccatccat

SEQ ID NO: 396067 - DNA, 20 bp, Artificial
  CRISPR gRNA sequence
gacttctgcccccatccatt

SEQ ID NO: 396068 - DNA, 20 bp, Artificial
  CRISPR gRNA sequence
ctgcccccatccattggtac

SEQ ID NO: 396069 - DNA, 20 bp, Artificial
  CRISPR gRNA sequence
tgcccccatccattggtact

SEQ ID NO: 396070 - DNA, 20 bp, Artificial
  CRISPR gRNA sequence
cccccatccattggtacttt

SEQ ID NO: 396071 - DNA, 20 bp, Artificial
  CRISPR gRNA sequence
gtactttcttagttaacccc

SEQ ID NO: 396072 - DNA, 20 bp, Artificial
  CRISPR gRNA sequence
tcttagttaaccccatccat

SEQ ID NO: 396073 - DNA, 20 bp, Artificial
  CRISPR gRNA sequence
cttagttaaccccatccatc

SEQ ID NO: 396074 - DNA, 20 bp, Artificial
  CRISPR gRNA sequence
ttagttaaccccatccatcc

SEQ ID NO: 396075 - DNA, 20 bp, Artificial
  CRISPR gRNA sequence
agttaaccccatccatccac

SEQ ID NO: 396076 - DNA, 20 bp, Artificial
  CRISPR gRNA sequence
gttaaccccatccatccaca

SEQ ID NO: 396077 - DNA, 20 bp, Artificial
  CRISPR gRNA sequence
accccatccatccacatgtg

SEQ ID NO: 396078 - DNA, 20 bp, Artificial
  CRISPR gRNA sequence
gatgatcattcagatgactt

SEQ ID NO: 396079 - DNA, 20 bp, Artificial
  CRISPR gRNA sequence
agatgacttcaaattggata

SEQ ID NO: 396080 - DNA, 20 bp, Artificial
  CRISPR gRNA sequence
caaattggatattttcaatc

SEQ ID NO: 396081 - DNA, 20 bp, Artificial
  CRISPR gRNA sequence
aaattggatattttcaatcc

SEQ ID NO: 396082 - DNA, 20 bp, Artificial
  CRISPR gRNA sequence
gatattttcaatcctggttt

SEQ ID NO: 396083 - DNA, 20 bp, Artificial
  CRISPR gRNA sequence
tcaatcctggtttgttgttc

SEQ ID NO: 396084 - DNA, 20 bp, Artificial
  CRISPR gRNA sequence
caatcctggtttgttgttcc

SEQ ID NO: 396085 - DNA, 20 bp, Artificial
  CRISPR gRNA sequence
aatcctggtttgttgttcca

SEQ ID NO: 396086 - DNA, 20 bp, Artificial
  CRISPR gRNA sequence
gtttgttgttccataatttc

SEQ ID NO: 396087 - DNA, 20 bp, Artificial
  CRISPR gRNA sequence
gttgttccataatttcaatt

SEQ ID NO: 396088 - DNA, 20 bp, Artificial
  CRISPR gRNA sequence
ttgttccataatttcaattg

SEQ ID NO: 396089 - DNA, 20 bp, Artificial
  CRISPR gRNA sequence
ttccataatttcaattgtca

SEQ ID NO: 396090 - DNA, 20 bp, Artificial
  CRISPR gRNA sequence
cataatttcaattgtcagct

SEQ ID NO: 396091 - DNA, 20 bp, Artificial
  CRISPR gRNA sequence
caattgtcagctggtcaaag

SEQ ID NO: 396092 - DNA, 20 bp, Artificial
  CRISPR gRNA sequence
aattgtcagctggtcaaagg

SEQ ID NO: 396093 - DNA, 20 bp, Artificial
  CRISPR gRNA sequence
tcagctggtcaaaggctact

SEQ ID NO: 396094 - DNA, 20 bp, Artificial
  CRISPR gRNA sequence
gtcaaaggctactttacaat

SEQ ID NO: 396095 - DNA, 20 bp, Artificial
  CRISPR gRNA sequence
ctttacaatttaatacacct

SEQ ID NO: 396096 - DNA, 20 bp, Artificial
  CRISPR gRNA sequence
tacaatttaatacacctgaa

SEQ ID NO: 396097 - DNA, 20 bp, Artificial
  CRISPR gRNA sequence
acaatttaatacacctgaaa

SEQ ID NO: 396098 - DNA, 20 bp, Artificial
  CRISPR gRNA sequence
caatttaatacacctgaaac

SEQ ID NO: 396099 - DNA, 20 bp, Artificial
  CRISPR gRNA sequence
aatacacctgaaacagactt

SEQ ID NO: 396100 - DNA, 20 bp, Artificial
  CRISPR gRNA sequence
atacacctgaaacagactta

SEQ ID NO: 396101 - DNA, 20 bp, Artificial
  CRISPR gRNA sequence
aaacagacttaattccactc

SEQ ID NO: 396102 - DNA, 20 bp, Artificial
  CRISPR gRNA sequence
aattccactcttgctagcca

SEQ ID NO: 396103 - DNA, 20 bp, Artificial
  CRISPR gRNA sequence
attccactcttgctagccaa

SEQ ID NO: 396104 - DNA, 20 bp, Artificial
  CRISPR gRNA sequence
cactcttgctagccaagttg

SEQ ID NO: 396105 - DNA, 20 bp, Artificial
  CRISPR gRNA sequence
ttgctagccaagttggtctc

SEQ ID NO: 396106 - DNA, 20 bp, Artificial
  CRISPR gRNA sequence
gctagccaagttggtctctt

SEQ ID NO: 396107 - DNA, 20 bp, Artificial
  CRISPR gRNA sequence
ctagccaagttggtctctta

SEQ ID NO: 396108 - DNA, 20 bp, Artificial
  CRISPR gRNA sequence
gccaagttggtctcttaatt

SEQ ID NO: 396109 - DNA, 20 bp, Artificial
  CRISPR gRNA sequence
gtctcttaatttcacatctt

SEQ ID NO: 396110 - DNA, 20 bp, Artificial
  CRISPR gRNA sequence
ttaatttcacatctttttca

SEQ ID NO: 396111 - DNA, 20 bp, Artificial
  CRISPR gRNA sequence
aatttcacatctttttcact

SEQ ID NO: 396112 - DNA, 20 bp, Artificial
  CRISPR gRNA sequence
atttcacatctttttcacta

SEQ ID NO: 396113 - DNA, 20 bp, Artificial
  CRISPR gRNA sequence
cacatctttttcactaaaat

SEQ ID NO: 396114 - DNA, 20 bp, Artificial
  CRISPR gRNA sequence
acatctttttcactaaaatc

SEQ ID NO: 396115 - DNA, 20 bp, Artificial
  CRISPR gRNA sequence
tttcactaaaatcatcattt

SEQ ID NO: 396116 - DNA, 20 bp, Artificial
  CRISPR gRNA sequence
ttcactaaaatcatcatttt

SEQ ID NO: 396117 - DNA, 20 bp, Artificial
  CRISPR gRNA sequence
tcactaaaatcatcattttt

SEQ ID NO: 396118 - DNA, 20 bp, Artificial
  CRISPR gRNA sequence
cactaaaatcatcatttttt

SEQ ID NO: 396119 - DNA, 20 bp, Artificial
  CRISPR gRNA sequence
actaaaatcatcatttttta

SEQ ID NO: 396120 - DNA, 20 bp, Artificial
  CRISPR gRNA sequence
aaatcatcattttttagtcc

SEQ ID NO: 396121 - DNA, 20 bp, Artificial
  CRISPR gRNA sequence
tttagtccttggatcataaa

SEQ ID NO: 396122 - DNA, 20 bp, Artificial
  CRISPR gRNA sequence
ttagtccttggatcataaaa

SEQ ID NO: 396123 - DNA, 20 bp, Artificial
  CRISPR gRNA sequence
tagtccttggatcataaaaa

SEQ ID NO: 396124 - DNA, 20 bp, Artificial
  CRISPR gRNA sequence
agtccttggatcataaaaat

SEQ ID NO: 396125 - DNA, 20 bp, Artificial
  CRISPR gRNA sequence
gtccttggatcataaaaatt

SEQ ID NO: 396126 - DNA, 20 bp, Artificial
  CRISPR gRNA sequence
ggatcataaaaatttgaaac

SEQ ID NO: 396127 - DNA, 20 bp, Artificial
  CRISPR gRNA sequence
gatcataaaaatttgaaacc

SEQ ID NO: 396128 - DNA, 20 bp, Artificial
  CRISPR gRNA sequence
gaaaccattgctgaaactta

SEQ ID NO: 396129 - DNA, 20 bp, Artificial
  CRISPR gRNA sequence
aaaccattgctgaaacttac

SEQ ID NO: 396130 - DNA, 20 bp, Artificial
  CRISPR gRNA sequence
ctgaaacttacctctacctg

SEQ ID NO: 396131 - DNA, 20 bp, Artificial
  CRISPR gRNA sequence
aaacttacctctacctggcc

SEQ ID NO: 396132 - DNA, 20 bp, Artificial
  CRISPR gRNA sequence
acctctacctggcccccagg

SEQ ID NO: 396133 - DNA, 20 bp, Artificial
  CRISPR gRNA sequence
cctctacctggcccccaggc

SEQ ID NO: 396134 - DNA, 20 bp, Artificial
  CRISPR gRNA sequence
tacctggcccccaggccata

SEQ ID NO: 396135 - DNA, 20 bp, Artificial
  CRISPR gRNA sequence
cctggcccccaggccatatc

SEQ ID NO: 396136 - DNA, 20 bp, Artificial
  CRISPR gRNA sequence
gcccccaggccatatcagaa

SEQ ID NO: 396137 - DNA, 20 bp, Artificial
  CRISPR gRNA sequence
catccttaccttagagcttt

SEQ ID NO: 396138 - DNA, 20 bp, Artificial
  CRISPR gRNA sequence
atccttaccttagagctttc

SEQ ID NO: 396139 - DNA, 20 bp, Artificial
  CRISPR gRNA sequence
accttagagctttcaactgc

SEQ ID NO: 396140 - DNA, 20 bp, Artificial
  CRISPR gRNA sequence
ccttagagctttcaactgct

SEQ ID NO: 396141 - DNA, 20 bp, Artificial
  CRISPR gRNA sequence
agagctttcaactgctcaaa

SEQ ID NO: 396142 - DNA, 20 bp, Artificial
  CRISPR gRNA sequence
gagctttcaactgctcaaaa

SEQ ID NO: 396143 - DNA, 20 bp, Artificial
  CRISPR gRNA sequence
tcaactgctcaaaaattgca

SEQ ID NO: 396144 - DNA, 20 bp, Artificial
  CRISPR gRNA sequence
caactgctcaaaaattgcaa

SEQ ID NO: 396145 - DNA, 20 bp, Artificial
  CRISPR gRNA sequence
aactgctcaaaaattgcaat

SEQ ID NO: 396146 - DNA, 20 bp, Artificial
  CRISPR gRNA sequence
ctcaaaaattgcaatcacat

SEQ ID NO: 396147 - DNA, 20 bp, Artificial
  CRISPR gRNA sequence
aaaaattgcaatcacatctc

SEQ ID NO: 396148 - DNA, 20 bp, Artificial
  CRISPR gRNA sequence
caatcacatctcttttcacc

SEQ ID NO: 396149 - DNA, 20 bp, Artificial
  CRISPR gRNA sequence
ttttcaccattagaaatcag

SEQ ID NO: 396150 - DNA, 20 bp, Artificial
  CRISPR gRNA sequence
ttcaccattagaaatcagta

SEQ ID NO: 396151 - DNA, 20 bp, Artificial
  CRISPR gRNA sequence
tcaccattagaaatcagtag

SEQ ID NO: 396152 - DNA, 20 bp, Artificial
  CRISPR gRNA sequence
caccattagaaatcagtaga

SEQ ID NO: 396153 - DNA, 20 bp, Artificial
  CRISPR gRNA sequence
accattagaaatcagtagat

SEQ ID NO: 396154 - DNA, 20 bp, Artificial
  CRISPR gRNA sequence
gaaatcagtagatttggcca

SEQ ID NO: 396155 - DNA, 20 bp, Artificial
  CRISPR gRNA sequence
ggccaggcaaggtggcctat

SEQ ID NO: 396156 - DNA, 20 bp, Artificial
  CRISPR gRNA sequence
gccaggcaaggtggcctatg

SEQ ID NO: 396157 - DNA, 20 bp, Artificial
  CRISPR gRNA sequence
tgcctgtaattccagcactt

SEQ ID NO: 396158 - DNA, 20 bp, Artificial
  CRISPR gRNA sequence
taattccagcactttgggag

SEQ ID NO: 396159 - DNA, 20 bp, Artificial
  CRISPR gRNA sequence
cagcactttgggaggccaag

SEQ ID NO: 396160 - DNA, 20 bp, Artificial
  CRISPR gRNA sequence
tgggaggccaaggtggggtg

SEQ ID NO: 396161 - DNA, 20 bp, Artificial
  CRISPR gRNA sequence
gggaggccaaggtggggtgg

SEQ ID NO: 396162 - DNA, 20 bp, Artificial
  CRISPR gRNA sequence
ggaggccaaggtggggtgga

SEQ ID NO: 396163 - DNA, 20 bp, Artificial
  CRISPR gRNA sequence
aggtcaggagtttgagatca

SEQ ID NO: 396164 - DNA, 20 bp, Artificial
  CRISPR gRNA sequence
gagatcagcctggccaacat

SEQ ID NO: 396165 - DNA, 20 bp, Artificial
  CRISPR gRNA sequence
agatcagcctggccaacatg

SEQ ID NO: 396166 - DNA, 20 bp, Artificial
  CRISPR gRNA sequence
gccaacatggcaaaaccccc

SEQ ID NO: 396167 - DNA, 20 bp, Artificial
  CRISPR gRNA sequence
tacaaaaatacaaaaattag

SEQ ID NO: 396168 - DNA, 20 bp, Artificial
  CRISPR gRNA sequence
caaaaatacaaaaattagct

SEQ ID NO: 396169 - DNA, 20 bp, Artificial
  CRISPR gRNA sequence
gctgggtgtgatgatgcagg

SEQ ID NO: 396170 - DNA, 20 bp, Artificial
  CRISPR gRNA sequence
ggtgtgatgatgcaggcctg

SEQ ID NO: 396171 - DNA, 20 bp, Artificial
  CRISPR gRNA sequence
taatcccagctactcaggag

SEQ ID NO: 396172 - DNA, 20 bp, Artificial
  CRISPR gRNA sequence
ctcaggaggctgaggcagga

SEQ ID NO: 396173 - DNA, 20 bp, Artificial
  CRISPR gRNA sequence
aggaggctgaggcaggagaa

SEQ ID NO: 396174 - DNA, 20 bp, Artificial
  CRISPR gRNA sequence
aggcaggagaaccacttgaa

SEQ ID NO: 396175 - DNA, 20 bp, Artificial
  CRISPR gRNA sequence
gaacccaggaggcagaggtt

SEQ ID NO: 396176 - DNA, 20 bp, Artificial
  CRISPR gRNA sequence
aacccaggaggcagaggttg

SEQ ID NO: 396177 - DNA, 20 bp, Artificial
  CRISPR gRNA sequence
caatgagctgagatcatgcc

SEQ ID NO: 396178 - DNA, 20 bp, Artificial
  CRISPR gRNA sequence
agatcatgccactgcactcc

SEQ ID NO: 396179 - DNA, 20 bp, Artificial
  CRISPR gRNA sequence
cactccagcctgggcaacag

SEQ ID NO: 396180 - DNA, 20 bp, Artificial
  CRISPR gRNA sequence
cagcctgggcaacagagtga

SEQ ID NO: 396181 - DNA, 20 bp, Artificial
  CRISPR gRNA sequence
ggcaacagagtgagactctg

SEQ ID NO: 396182 - DNA, 20 bp, Artificial
  CRISPR gRNA sequence
tgtctcaaaaaaggaaaaga

SEQ ID NO: 396183 - DNA, 20 bp, Artificial
  CRISPR gRNA sequence
tctcaaaaaaggaaaagaaa

SEQ ID NO: 396184 - DNA, 20 bp, Artificial
  CRISPR gRNA sequence
aaaaaaggaaaagaaaaaga

SEQ ID NO: 396185 - DNA, 20 bp, Artificial
  CRISPR gRNA sequence
gaaagaaatcttctaaaaca

SEQ ID NO: 396186 - DNA, 20 bp, Artificial
  CRISPR gRNA sequence
aaagaaatcttctaaaacat

SEQ ID NO: 396187 - DNA, 20 bp, Artificial
  CRISPR gRNA sequence
ctaaaacattttgagacaaa

SEQ ID NO: 396188 - DNA, 20 bp, Artificial
  CRISPR gRNA sequence
taaaacattttgagacaaat

SEQ ID NO: 396189 - DNA, 20 bp, Artificial
  CRISPR gRNA sequence
aaacattttgagacaaatgc

SEQ ID NO: 396190 - DNA, 20 bp, Artificial
  CRISPR gRNA sequence
tgagacaaatgcaaaataaa

SEQ ID NO: 396191 - DNA, 20 bp, Artificial
  CRISPR gRNA sequence
gagacaaatgcaaaataaaa

SEQ ID NO: 396192 - DNA, 20 bp, Artificial
  CRISPR gRNA sequence
agacaaatgcaaaataaaac

SEQ ID NO: 396193 - DNA, 20 bp, Artificial
  CRISPR gRNA sequence
tataaggaaaacaccctgac

SEQ ID NO: 396194 - DNA, 20 bp, Artificial
  CRISPR gRNA sequence
actatgagccttaaagaccc

SEQ ID NO: 396195 - DNA, 20 bp, Artificial
  CRISPR gRNA sequence
tgagccttaaagaccctttc

SEQ ID NO: 396196 - DNA, 20 bp, Artificial
  CRISPR gRNA sequence
aaagaccctttcagcccttc

SEQ ID NO: 396197 - DNA, 20 bp, Artificial
  CRISPR gRNA sequence
aagaccctttcagcccttcc

SEQ ID NO: 396198 - DNA, 20 bp, Artificial
  CRISPR gRNA sequence
tcagcccttcctgattctat

SEQ ID NO: 396199 - DNA, 20 bp, Artificial
  CRISPR gRNA sequence
cagcccttcctgattctatt

SEQ ID NO: 396200 - DNA, 20 bp, Artificial
  CRISPR gRNA sequence
agcccttcctgattctattc

SEQ ID NO: 396201 - DNA, 20 bp, Artificial
  CRISPR gRNA sequence
cctgattctattctatcccc

SEQ ID NO: 396202 - DNA, 20 bp, Artificial
  CRISPR gRNA sequence
ctgattctattctatccccc

SEQ ID NO: 396203 - DNA, 20 bp, Artificial
  CRISPR gRNA sequence
attctattctatcccccacc

SEQ ID NO: 396204 - DNA, 20 bp, Artificial
  CRISPR gRNA sequence
tattctatcccccacctacc

SEQ ID NO: 396205 - DNA, 20 bp, Artificial
  CRISPR gRNA sequence
ttctatcccccacctaccat

SEQ ID NO: 396206 - DNA, 20 bp, Artificial
  CRISPR gRNA sequence
tatcccccacctaccatgtt

SEQ ID NO: 396207 - DNA, 20 bp, Artificial
  CRISPR gRNA sequence
tcccccacctaccatgtttc

SEQ ID NO: 396208 - DNA, 20 bp, Artificial
  CRISPR gRNA sequence
ccatgtttctgaactttgct

SEQ ID NO: 396209 - DNA, 20 bp, Artificial
  CRISPR gRNA sequence
ctgaactttgcttttcttta

SEQ ID NO: 396210 - DNA, 20 bp, Artificial
  CRISPR gRNA sequence
tgaactttgcttttctttat

SEQ ID NO: 396211 - DNA, 20 bp, Artificial
  CRISPR gRNA sequence
aactttgcttttctttatag

SEQ ID NO: 396212 - DNA, 20 bp, Artificial
  CRISPR gRNA sequence
tgcttttctttatagtttta

SEQ ID NO: 396213 - DNA, 20 bp, Artificial
  CRISPR gRNA sequence
gcttttctttatagttttac

SEQ ID NO: 396214 - DNA, 20 bp, Artificial
  CRISPR gRNA sequence
cttttctttatagttttacc

SEQ ID NO: 396215 - DNA, 20 bp, Artificial
  CRISPR gRNA sequence
ttctttatagttttaccacg

SEQ ID NO: 396216 - DNA, 20 bp, Artificial
  CRISPR gRNA sequence
tctttatagttttaccacgt

SEQ ID NO: 396217 - DNA, 20 bp, Artificial
  CRISPR gRNA sequence
ctttatagttttaccacgtt

SEQ ID NO: 396218 - DNA, 20 bp, Artificial
  CRISPR gRNA sequence
tttatagttttaccacgttt

SEQ ID NO: 396219 - DNA, 20 bp, Artificial
  CRISPR gRNA sequence
tatagttttaccacgtttgt

SEQ ID NO: 396220 - DNA, 20 bp, Artificial
  CRISPR gRNA sequence
atagttttaccacgtttgta

SEQ ID NO: 396221 - DNA, 20 bp, Artificial
  CRISPR gRNA sequence
tagttttaccacgtttgtat

SEQ ID NO: 396222 - DNA, 20 bp, Artificial
  CRISPR gRNA sequence
taccacgtttgtatctataa

SEQ ID NO: 396223 - DNA, 20 bp, Artificial
  CRISPR gRNA sequence
accacgtttgtatctataaa

SEQ ID NO: 396224 - DNA, 20 bp, Artificial
  CRISPR gRNA sequence
ccacgtttgtatctataaat

SEQ ID NO: 396225 - DNA, 20 bp, Artificial
  CRISPR gRNA sequence
gtatctataaataacgtatt

SEQ ID NO: 396226 - DNA, 20 bp, Artificial
  CRISPR gRNA sequence
tatctataaataacgtattg

SEQ ID NO: 396227 - DNA, 20 bp, Artificial
  CRISPR gRNA sequence
taaataacgtattgtttaat

SEQ ID NO: 396228 - DNA, 20 bp, Artificial
  CRISPR gRNA sequence
tttaattatgcatatttcta

SEQ ID NO: 396229 - DNA, 20 bp, Artificial
  CRISPR gRNA sequence
aattatgcatatttctaaaa

SEQ ID NO: 396230 - DNA, 20 bp, Artificial
  CRISPR gRNA sequence
attatgcatatttctaaaac

SEQ ID NO: 396231 - DNA, 20 bp, Artificial
  CRISPR gRNA sequence
tgcatatttctaaaaccttt

SEQ ID NO: 396232 - DNA, 20 bp, Artificial
  CRISPR gRNA sequence
ctaaaacctttaaagaaaag

SEQ ID NO: 396233 - DNA, 20 bp, Artificial
  CRISPR gRNA sequence
taaaacctttaaagaaaagg

SEQ ID NO: 396234 - DNA, 20 bp, Artificial
  CRISPR gRNA sequence
aaacctttaaagaaaaggaa

SEQ ID NO: 396235 - DNA, 20 bp, Artificial
  CRISPR gRNA sequence
taaagaaaaggaaccctagt

SEQ ID NO: 396236 - DNA, 20 bp, Artificial
  CRISPR gRNA sequence
aaagaaaaggaaccctagtt

SEQ ID NO: 396237 - DNA, 20 bp, Artificial
  CRISPR gRNA sequence
aagaaaaggaaccctagttt

SEQ ID NO: 396238 - DNA, 20 bp, Artificial
  CRISPR gRNA sequence
gtttacctattttttttggt

SEQ ID NO: 396239 - DNA, 20 bp, Artificial
  CRISPR gRNA sequence
acctattttttttggtaact

SEQ ID NO: 396240 - DNA, 20 bp, Artificial
  CRISPR gRNA sequence
cctattttttttggtaactt

SEQ ID NO: 396241 - DNA, 20 bp, Artificial
  CRISPR gRNA sequence
ttttttttggtaacttgctc

SEQ ID NO: 396242 - DNA, 20 bp, Artificial
  CRISPR gRNA sequence
tttttggtaacttgctcttt

SEQ ID NO: 396243 - DNA, 20 bp, Artificial
  CRISPR gRNA sequence
ttttggtaacttgctctttt

SEQ ID NO: 396244 - DNA, 20 bp, Artificial
  CRISPR gRNA sequence
tttggtaacttgctcttttc

SEQ ID NO: 396245 - DNA, 20 bp, Artificial
  CRISPR gRNA sequence
ttggtaacttgctcttttct

SEQ ID NO: 396246 - DNA, 20 bp, Artificial
  CRISPR gRNA sequence
tggtaacttgctcttttctt

SEQ ID NO: 396247 - DNA, 20 bp, Artificial
  CRISPR gRNA sequence
ggtaacttgctcttttcttt

SEQ ID NO: 396248 - DNA, 20 bp, Artificial
  CRISPR gRNA sequence
gtaacttgctcttttctttc

SEQ ID NO: 396249 - DNA, 20 bp, Artificial
  CRISPR gRNA sequence
gctcttttctttcaacacaa

SEQ ID NO: 396250 - DNA, 20 bp, Artificial
  CRISPR gRNA sequence
ctcttttctttcaacacaaa

SEQ ID NO: 396251 - DNA, 20 bp, Artificial
  CRISPR gRNA sequence
ttttctttcaacacaaagtt

SEQ ID NO: 396252 - DNA, 20 bp, Artificial
  CRISPR gRNA sequence
ttctttcaacacaaagttca

SEQ ID NO: 396253 - DNA, 20 bp, Artificial
  CRISPR gRNA sequence
tctttcaacacaaagttcat

SEQ ID NO: 396254 - DNA, 20 bp, Artificial
  CRISPR gRNA sequence
ctttcaacacaaagttcatg

SEQ ID NO: 396255 - DNA, 20 bp, Artificial
  CRISPR gRNA sequence
tttcaacacaaagttcatga

SEQ ID NO: 396256 - DNA, 20 bp, Artificial
  CRISPR gRNA sequence
tcaacacaaagttcatgagc

SEQ ID NO: 396257 - DNA, 20 bp, Artificial
  CRISPR gRNA sequence
caacacaaagttcatgagct

SEQ ID NO: 396258 - DNA, 20 bp, Artificial
  CRISPR gRNA sequence
aacacaaagttcatgagctt

SEQ ID NO: 396259 - DNA, 20 bp, Artificial
  CRISPR gRNA sequence
atgagcttcatccatgtcgg

SEQ ID NO: 396260 - DNA, 20 bp, Artificial
  CRISPR gRNA sequence
catccatgtcggtgagcaag

SEQ ID NO: 396261 - DNA, 20 bp, Artificial
  CRISPR gRNA sequence
atccatgtcggtgagcaagt

SEQ ID NO: 396262 - DNA, 20 bp, Artificial
  CRISPR gRNA sequence
actcattttagtgatgtaga

SEQ ID NO: 396263 - DNA, 20 bp, Artificial
  CRISPR gRNA sequence
attttagtgatgtagagtat

SEQ ID NO: 396264 - DNA, 20 bp, Artificial
  CRISPR gRNA sequence
tagtgatgtagagtatccta

SEQ ID NO: 396265 - DNA, 20 bp, Artificial
  CRISPR gRNA sequence
agtgatgtagagtatcctaa

SEQ ID NO: 396266 - DNA, 20 bp, Artificial
  CRISPR gRNA sequence
gtgatgtagagtatcctaat

SEQ ID NO: 396267 - DNA, 20 bp, Artificial
  CRISPR gRNA sequence
atgtgtgaatagacctcagt

SEQ ID NO: 396268 - DNA, 20 bp, Artificial
  CRISPR gRNA sequence
agtgtgcttttcggttctac

SEQ ID NO: 396269 - DNA, 20 bp, Artificial
  CRISPR gRNA sequence
ttcggttctactgttgatgg

SEQ ID NO: 396270 - DNA, 20 bp, Artificial
  CRISPR gRNA sequence
tcggttctactgttgatggg

SEQ ID NO: 396271 - DNA, 20 bp, Artificial
  CRISPR gRNA sequence
cggttctactgttgatgggt

SEQ ID NO: 396272 - DNA, 20 bp, Artificial
  CRISPR gRNA sequence
ggttctactgttgatgggta

SEQ ID NO: 396273 - DNA, 20 bp, Artificial
  CRISPR gRNA sequence
tactgttgatgggtatttgg

SEQ ID NO: 396274 - DNA, 20 bp, Artificial
  CRISPR gRNA sequence
ctgttgatgggtatttgggt

SEQ ID NO: 396275 - DNA, 20 bp, Artificial
  CRISPR gRNA sequence
ttgatgggtatttgggttgt

SEQ ID NO: 396276 - DNA, 20 bp, Artificial
  CRISPR gRNA sequence
atgggtatttgggttgttac

SEQ ID NO: 396277 - DNA, 20 bp, Artificial
  CRISPR gRNA sequence
gggttgttaccaattttttg

SEQ ID NO: 396278 - DNA, 20 bp, Artificial
  CRISPR gRNA sequence
ggttgttaccaattttttgc

SEQ ID NO: 396279 - DNA, 20 bp, Artificial
  CRISPR gRNA sequence
ttaccaattttttgctattg

SEQ ID NO: 396280 - DNA, 20 bp, Artificial
  CRISPR gRNA sequence
ccaattttttgctattgcaa

SEQ ID NO: 396281 - DNA, 20 bp, Artificial
  CRISPR gRNA sequence
tttgctattgcaatcactgt

SEQ ID NO: 396282 - DNA, 20 bp, Artificial
  CRISPR gRNA sequence
ttgctattgcaatcactgtt

SEQ ID NO: 396283 - DNA, 20 bp, Artificial
  CRISPR gRNA sequence
tgctattgcaatcactgttg

SEQ ID NO: 396284 - DNA, 20 bp, Artificial
  CRISPR gRNA sequence
gctattgcaatcactgttgc

SEQ ID NO: 396285 - DNA, 20 bp, Artificial
  CRISPR gRNA sequence
ctattgcaatcactgttgct

SEQ ID NO: 396286 - DNA, 20 bp, Artificial
  CRISPR gRNA sequence
ttgcaatcactgttgctata

SEQ ID NO: 396287 - DNA, 20 bp, Artificial
  CRISPR gRNA sequence
caatcactgttgctataaat

SEQ ID NO: 396288 - DNA, 20 bp, Artificial
  CRISPR gRNA sequence
ttgctataaatattgtcagg

SEQ ID NO: 396289 - DNA, 20 bp, Artificial
  CRISPR gRNA sequence
ctataaatattgtcaggaat

SEQ ID NO: 396290 - DNA, 20 bp, Artificial
  CRISPR gRNA sequence
taaatattgtcaggaatttt

SEQ ID NO: 396291 - DNA, 20 bp, Artificial
  CRISPR gRNA sequence
tcaggaattttccctataat

SEQ ID NO: 396292 - DNA, 20 bp, Artificial
  CRISPR gRNA sequence
tccctataatgagagaactc

SEQ ID NO: 396293 - DNA, 20 bp, Artificial
  CRISPR gRNA sequence
ccctataatgagagaactct

SEQ ID NO: 396294 - DNA, 20 bp, Artificial
  CRISPR gRNA sequence
cctataatgagagaactctt

SEQ ID NO: 396295 - DNA, 20 bp, Artificial
  CRISPR gRNA sequence
taatgagagaactcttggat

SEQ ID NO: 396296 - DNA, 20 bp, Artificial
  CRISPR gRNA sequence
ttggataccaaacagagtag

SEQ ID NO: 396297 - DNA, 20 bp, Artificial
  CRISPR gRNA sequence
ggataccaaacagagtagaa

SEQ ID NO: 396298 - DNA, 20 bp, Artificial
  CRISPR gRNA sequence
gataccaaacagagtagaat

SEQ ID NO: 396299 - DNA, 20 bp, Artificial
  CRISPR gRNA sequence
ttggatcataggatttgggg

SEQ ID NO: 396300 - DNA, 20 bp, Artificial
  CRISPR gRNA sequence
gatcataggatttggggttt

SEQ ID NO: 396301 - DNA, 20 bp, Artificial
  CRISPR gRNA sequence
ggggtttttaactagctaat

SEQ ID NO: 396302 - DNA, 20 bp, Artificial
  CRISPR gRNA sequence
gggtttttaactagctaatg

SEQ ID NO: 396303 - DNA, 20 bp, Artificial
  CRISPR gRNA sequence
ttaactagctaatgccatat

SEQ ID NO: 396304 - DNA, 20 bp, Artificial
  CRISPR gRNA sequence
taactagctaatgccatatc

SEQ ID NO: 396305 - DNA, 20 bp, Artificial
  CRISPR gRNA sequence
aactagctaatgccatatca

SEQ ID NO: 396306 - DNA, 20 bp, Artificial
  CRISPR gRNA sequence
actagctaatgccatatcat

SEQ ID NO: 396307 - DNA, 20 bp, Artificial
  CRISPR gRNA sequence
gctaatgccatatcattttc

SEQ ID NO: 396308 - DNA, 20 bp, Artificial
  CRISPR gRNA sequence
atgccatatcattttccaaa

SEQ ID NO: 396309 - DNA, 20 bp, Artificial
  CRISPR gRNA sequence
tccaaaacaggtatgatggt

SEQ ID NO: 396310 - DNA, 20 bp, Artificial
  CRISPR gRNA sequence
ccaaaacaggtatgatggtt

SEQ ID NO: 396311 - DNA, 20 bp, Artificial
  CRISPR gRNA sequence
caaaacaggtatgatggtta

SEQ ID NO: 396312 - DNA, 20 bp, Artificial
  CRISPR gRNA sequence
attttacgtgtcaatttgaa

SEQ ID NO: 396313 - DNA, 20 bp, Artificial
  CRISPR gRNA sequence
tacgtgtcaatttgaagggt

SEQ ID NO: 396314 - DNA, 20 bp, Artificial
  CRISPR gRNA sequence
acgtgtcaatttgaagggtg

SEQ ID NO: 396315 - DNA, 20 bp, Artificial
  CRISPR gRNA sequence
cgtgtcaatttgaagggtgt

SEQ ID NO: 396316 - DNA, 20 bp, Artificial
  CRISPR gRNA sequence
gaagggtgttttgggatgag

SEQ ID NO: 396317 - DNA, 20 bp, Artificial
  CRISPR gRNA sequence
aagggtgttttgggatgaga

SEQ ID NO: 396318 - DNA, 20 bp, Artificial
  CRISPR gRNA sequence
tgggatgagattaacattta

SEQ ID NO: 396319 - DNA, 20 bp, Artificial
  CRISPR gRNA sequence
gggatgagattaacatttaa

SEQ ID NO: 396320 - DNA, 20 bp, Artificial
  CRISPR gRNA sequence
ggatgagattaacatttaaa

SEQ ID NO: 396321 - DNA, 20 bp, Artificial
  CRISPR gRNA sequence
acatttaaattggtgaattt

SEQ ID NO: 396322 - DNA, 20 bp, Artificial
  CRISPR gRNA sequence
aaattggtgaattttgaata

SEQ ID NO: 396323 - DNA, 20 bp, Artificial
  CRISPR gRNA sequence
aattggtgaattttgaataa

SEQ ID NO: 396324 - DNA, 20 bp, Artificial
  CRISPR gRNA sequence
gtgaattttgaataagcagt

SEQ ID NO: 396325 - DNA, 20 bp, Artificial
  CRISPR gRNA sequence
tgaataagcagtttgcctcc

SEQ ID NO: 396326 - DNA, 20 bp, Artificial
  CRISPR gRNA sequence
gaataagcagtttgcctcca

SEQ ID NO: 396327 - DNA, 20 bp, Artificial
  CRISPR gRNA sequence
aataagcagtttgcctccat

SEQ ID NO: 396328 - DNA, 20 bp, Artificial
  CRISPR gRNA sequence
gcctccataatgtaggtgag

SEQ ID NO: 396329 - DNA, 20 bp, Artificial
  CRISPR gRNA sequence
cctccataatgtaggtgagc

SEQ ID NO: 396330 - DNA, 20 bp, Artificial
  CRISPR gRNA sequence
cataatgtaggtgagcctaa

SEQ ID NO: 396331 - DNA, 20 bp, Artificial
  CRISPR gRNA sequence
attcaacaaaaagaccagcc

SEQ ID NO: 396332 - DNA, 20 bp, Artificial
  CRISPR gRNA sequence
aacaaaaagaccagcctccc

SEQ ID NO: 396333 - DNA, 20 bp, Artificial
  CRISPR gRNA sequence
cccaagcaagagggattctg

SEQ ID NO: 396334 - DNA, 20 bp, Artificial
  CRISPR gRNA sequence
tgcagcagatgacctgggct

SEQ ID NO: 396335 - DNA, 20 bp, Artificial
  CRISPR gRNA sequence
cagcagatgacctgggcttc

SEQ ID NO: 396336 - DNA, 20 bp, Artificial
  CRISPR gRNA sequence
ggcttcacctgtaccatcgg

SEQ ID NO: 396337 - DNA, 20 bp, Artificial
  CRISPR gRNA sequence
cacctgtaccatcggctctc

SEQ ID NO: 396338 - DNA, 20 bp, Artificial
  CRISPR gRNA sequence
acctgtaccatcggctctcc

SEQ ID NO: 396339 - DNA, 20 bp, Artificial
  CRISPR gRNA sequence
taccatcggctctcctgggt

SEQ ID NO: 396340 - DNA, 20 bp, Artificial
  CRISPR gRNA sequence
tcctgggtctgcagcctgca

SEQ ID NO: 396341 - DNA, 20 bp, Artificial
  CRISPR gRNA sequence
ctgggtctgcagcctgcaag

SEQ ID NO: 396342 - DNA, 20 bp, Artificial
  CRISPR gRNA sequence
ggtctgcagcctgcaagccc

SEQ ID NO: 396343 - DNA, 20 bp, Artificial
  CRISPR gRNA sequence
cagcctgcaagcccacactg

SEQ ID NO: 396344 - DNA, 20 bp, Artificial
  CRISPR gRNA sequence
caagcccacactgcaaattt

SEQ ID NO: 396345 - DNA, 20 bp, Artificial
  CRISPR gRNA sequence
caaatttgggcttatcagtc

SEQ ID NO: 396346 - DNA, 20 bp, Artificial
  CRISPR gRNA sequence
gggcttatcagtctccatga

SEQ ID NO: 396347 - DNA, 20 bp, Artificial
  CRISPR gRNA sequence
ggcttatcagtctccatgat

SEQ ID NO: 396348 - DNA, 20 bp, Artificial
  CRISPR gRNA sequence
atcagtctccatgatcatat

SEQ ID NO: 396349 - DNA, 20 bp, Artificial
  CRISPR gRNA sequence
tcagtctccatgatcatatg

SEQ ID NO: 396350 - DNA, 20 bp, Artificial
  CRISPR gRNA sequence
catgatcatatgatataatt

SEQ ID NO: 396351 - DNA, 20 bp, Artificial
  CRISPR gRNA sequence
ggccgtgtgcccacccaaat

SEQ ID NO: 396352 - DNA, 20 bp, Artificial
  CRISPR gRNA sequence
gccgtgtgcccacccaaatc

SEQ ID NO: 396353 - DNA, 20 bp, Artificial
  CRISPR gRNA sequence
atcttgagttgtagttccca

SEQ ID NO: 396354 - DNA, 20 bp, Artificial
  CRISPR gRNA sequence
gagttgtagttcccataacc

SEQ ID NO: 396355 - DNA, 20 bp, Artificial
  CRISPR gRNA sequence
agttgtagttcccataaccc

SEQ ID NO: 396356 - DNA, 20 bp, Artificial
  CRISPR gRNA sequence
tagttcccataaccctcacg

SEQ ID NO: 396357 - DNA, 20 bp, Artificial
  CRISPR gRNA sequence
ccataaccctcacgtgtcgt

SEQ ID NO: 396358 - DNA, 20 bp, Artificial
  CRISPR gRNA sequence
acgtgtcgtgggagagacca

SEQ ID NO: 396359 - DNA, 20 bp, Artificial
  CRISPR gRNA sequence
aatcatgggggtggtttccc

SEQ ID NO: 396360 - DNA, 20 bp, Artificial
  CRISPR gRNA sequence
cccccatcctgttctcatga

SEQ ID NO: 396361 - DNA, 20 bp, Artificial
  CRISPR gRNA sequence
ccccatcctgttctcatgat

SEQ ID NO: 396362 - DNA, 20 bp, Artificial
  CRISPR gRNA sequence
ttctcatgatagtgagttag

SEQ ID NO: 396363 - DNA, 20 bp, Artificial
  CRISPR gRNA sequence
tcatgatagtgagttagttc

SEQ ID NO: 396364 - DNA, 20 bp, Artificial
  CRISPR gRNA sequence
atgatagtgagttagttctc

SEQ ID NO: 396365 - DNA, 20 bp, Artificial
  CRISPR gRNA sequence
gttctcatgagatctgatgg

SEQ ID NO: 396366 - DNA, 20 bp, Artificial
  CRISPR gRNA sequence
tcatgagatctgatggtttt

SEQ ID NO: 396367 - DNA, 20 bp, Artificial
  CRISPR gRNA sequence
atgagatctgatggttttat

SEQ ID NO: 396368 - DNA, 20 bp, Artificial
  CRISPR gRNA sequence
atggttttataaggggcttc

SEQ ID NO: 396369 - DNA, 20 bp, Artificial
  CRISPR gRNA sequence
tataaggggcttcccctgct

SEQ ID NO: 396370 - DNA, 20 bp, Artificial
  CRISPR gRNA sequence
ataaggggcttcccctgctc

SEQ ID NO: 396371 - DNA, 20 bp, Artificial
  CRISPR gRNA sequence
taaggggcttcccctgctct

SEQ ID NO: 396372 - DNA, 20 bp, Artificial
  CRISPR gRNA sequence
cccctgctctgggcactcac

SEQ ID NO: 396373 - DNA, 20 bp, Artificial
  CRISPR gRNA sequence
ccctgctctgggcactcact

SEQ ID NO: 396374 - DNA, 20 bp, Artificial
  CRISPR gRNA sequence
ctctgggcactcactcttct

SEQ ID NO: 396375 - DNA, 20 bp, Artificial
  CRISPR gRNA sequence
tgggcactcactcttcttct

SEQ ID NO: 396376 - DNA, 20 bp, Artificial
  CRISPR gRNA sequence
ggcactcactcttcttctcc

SEQ ID NO: 396377 - DNA, 20 bp, Artificial
  CRISPR gRNA sequence
actcttcttctccctgctac

SEQ ID NO: 396378 - DNA, 20 bp, Artificial
  CRISPR gRNA sequence
ttcttctccctgctaccatg

SEQ ID NO: 396379 - DNA, 20 bp, Artificial
  CRISPR gRNA sequence
cttctccctgctaccatgtg

SEQ ID NO: 396380 - DNA, 20 bp, Artificial
  CRISPR gRNA sequence
ttctccctgctaccatgtga

SEQ ID NO: 396381 - DNA, 20 bp, Artificial
  CRISPR gRNA sequence
ctccctgctaccatgtgaag

SEQ ID NO: 396382 - DNA, 20 bp, Artificial
  CRISPR gRNA sequence
tccctgctaccatgtgaagg

SEQ ID NO: 396383 - DNA, 20 bp, Artificial
  CRISPR gRNA sequence
cctgctaccatgtgaaggac

SEQ ID NO: 396384 - DNA, 20 bp, Artificial
  CRISPR gRNA sequence
ctaccatgtgaaggacatat

SEQ ID NO: 396385 - DNA, 20 bp, Artificial
  CRISPR gRNA sequence
ccatgtgaaggacatatttg

SEQ ID NO: 396386 - DNA, 20 bp, Artificial
  CRISPR gRNA sequence
gcttccccttccaccatgat

SEQ ID NO: 396387 - DNA, 20 bp, Artificial
  CRISPR gRNA sequence
cttccccttccaccatgatt

SEQ ID NO: 396388 - DNA, 20 bp, Artificial
  CRISPR gRNA sequence
ccccttccaccatgattgta

SEQ ID NO: 396389 - DNA, 20 bp, Artificial
  CRISPR gRNA sequence
cccttccaccatgattgtaa

SEQ ID NO: 396390 - DNA, 20 bp, Artificial
  CRISPR gRNA sequence
ccaccatgattgtaagtttc

SEQ ID NO: 396391 - DNA, 20 bp, Artificial
  CRISPR gRNA sequence
caccatgattgtaagtttcc

SEQ ID NO: 396392 - DNA, 20 bp, Artificial
  CRISPR gRNA sequence
taagtttcctgaggcctccc

SEQ ID NO: 396393 - DNA, 20 bp, Artificial
  CRISPR gRNA sequence
cctgaggcctccccacccat

SEQ ID NO: 396394 - DNA, 20 bp, Artificial
  CRISPR gRNA sequence
ctgaggcctccccacccata

SEQ ID NO: 396395 - DNA, 20 bp, Artificial
  CRISPR gRNA sequence
aggcctccccacccatactg

SEQ ID NO: 396396 - DNA, 20 bp, Artificial
  CRISPR gRNA sequence
cccacccatactgaactgag

SEQ ID NO: 396397 - DNA, 20 bp, Artificial
  CRISPR gRNA sequence
aactgagaatcaattaaacc

SEQ ID NO: 396398 - DNA, 20 bp, Artificial
  CRISPR gRNA sequence
agaatcaattaaacctcttt

SEQ ID NO: 396399 - DNA, 20 bp, Artificial
  CRISPR gRNA sequence
aacctctttcctttataaat

SEQ ID NO: 396400 - DNA, 20 bp, Artificial
  CRISPR gRNA sequence
tttcctttataaattaccct

SEQ ID NO: 396401 - DNA, 20 bp, Artificial
  CRISPR gRNA sequence
tcctttataaattaccctgt

SEQ ID NO: 396402 - DNA, 20 bp, Artificial
  CRISPR gRNA sequence
cctttataaattaccctgtc

SEQ ID NO: 396403 - DNA, 20 bp, Artificial
  CRISPR gRNA sequence
ctttataaattaccctgtct

SEQ ID NO: 396404 - DNA, 20 bp, Artificial
  CRISPR gRNA sequence
tataaattaccctgtctcag

SEQ ID NO: 396405 - DNA, 20 bp, Artificial
  CRISPR gRNA sequence
ataaattaccctgtctcagg

SEQ ID NO: 396406 - DNA, 20 bp, Artificial
  CRISPR gRNA sequence
taaattaccctgtctcaggt

SEQ ID NO: 396407 - DNA, 20 bp, Artificial
  CRISPR gRNA sequence
ccctgtctcaggtatgtctt

SEQ ID NO: 396408 - DNA, 20 bp, Artificial
  CRISPR gRNA sequence
tctcaggtatgtctttatta

SEQ ID NO: 396409 - DNA, 20 bp, Artificial
  CRISPR gRNA sequence
aggtatgtctttattagcag

SEQ ID NO: 396410 - DNA, 20 bp, Artificial
  CRISPR gRNA sequence
tattagcagcatgaaaactg

SEQ ID NO: 396411 - DNA, 20 bp, Artificial
  CRISPR gRNA sequence
attagcagcatgaaaactga

SEQ ID NO: 396412 - DNA, 20 bp, Artificial
  CRISPR gRNA sequence
ttagcagcatgaaaactgag

SEQ ID NO: 396413 - DNA, 20 bp, Artificial
  CRISPR gRNA sequence
gcagcatgaaaactgagtaa

SEQ ID NO: 396414 - DNA, 20 bp, Artificial
  CRISPR gRNA sequence
agtaatacagtaaatgagta

SEQ ID NO: 396415 - DNA, 20 bp, Artificial
  CRISPR gRNA sequence
ctgtaaagatatccacaagt

SEQ ID NO: 396416 - DNA, 20 bp, Artificial
  CRISPR gRNA sequence
taaagatatccacaagtgtg

SEQ ID NO: 396417 - DNA, 20 bp, Artificial
  CRISPR gRNA sequence
tggaactgggtaacaggtag

SEQ ID NO: 396418 - DNA, 20 bp, Artificial
  CRISPR gRNA sequence
ggaactgggtaacaggtaga

SEQ ID NO: 396419 - DNA, 20 bp, Artificial
  CRISPR gRNA sequence
gaactgggtaacaggtagag

SEQ ID NO: 396420 - DNA, 20 bp, Artificial
  CRISPR gRNA sequence
ggtaacaggtagaggttgga

SEQ ID NO: 396421 - DNA, 20 bp, Artificial
  CRISPR gRNA sequence
gaacagttttgagggctcag

SEQ ID NO: 396422 - DNA, 20 bp, Artificial
  CRISPR gRNA sequence
tgagggctcagaagaagaca

SEQ ID NO: 396423 - DNA, 20 bp, Artificial
  CRISPR gRNA sequence
gagggctcagaagaagacag

SEQ ID NO: 396424 - DNA, 20 bp, Artificial
  CRISPR gRNA sequence
agggctcagaagaagacagg

SEQ ID NO: 396425 - DNA, 20 bp, Artificial
  CRISPR gRNA sequence
agaagaagacaggaaaatgt

SEQ ID NO: 396426 - DNA, 20 bp, Artificial
  CRISPR gRNA sequence
gggaacttcctagaaatttg

SEQ ID NO: 396427 - DNA, 20 bp, Artificial
  CRISPR gRNA sequence
ggaacttcctagaaatttgt

SEQ ID NO: 396428 - DNA, 20 bp, Artificial
  CRISPR gRNA sequence
cctagaaatttgttgaatga

SEQ ID NO: 396429 - DNA, 20 bp, Artificial
  CRISPR gRNA sequence
ctagaaatttgttgaatgac

SEQ ID NO: 396430 - DNA, 20 bp, Artificial
  CRISPR gRNA sequence
gaaatttgttgaatgacatt

SEQ ID NO: 396431 - DNA, 20 bp, Artificial
  CRISPR gRNA sequence
gttgaatgacattgaccaaa

SEQ ID NO: 396432 - DNA, 20 bp, Artificial
  CRISPR gRNA sequence
ttgaatgacattgaccaaaa

SEQ ID NO: 396433 - DNA, 20 bp, Artificial
  CRISPR gRNA sequence
aatgacattgaccaaaatgc

SEQ ID NO: 396434 - DNA, 20 bp, Artificial
  CRISPR gRNA sequence
accaaaatgctgacagtgat

SEQ ID NO: 396435 - DNA, 20 bp, Artificial
  CRISPR gRNA sequence
acagtgatataaacaatgaa

SEQ ID NO: 396436 - DNA, 20 bp, Artificial
  CRISPR gRNA sequence
aggtggtctcagatggagat

SEQ ID NO: 396437 - DNA, 20 bp, Artificial
  CRISPR gRNA sequence
agatggagatgaggaacttt

SEQ ID NO: 396438 - DNA, 20 bp, Artificial
  CRISPR gRNA sequence
tttgggaaatggagtaaagg

SEQ ID NO: 396439 - DNA, 20 bp, Artificial
  CRISPR gRNA sequence
ttgggaaatggagtaaaggt

SEQ ID NO: 396440 - DNA, 20 bp, Artificial
  CRISPR gRNA sequence
tgggaaatggagtaaaggtc

SEQ ID NO: 396441 - DNA, 20 bp, Artificial
  CRISPR gRNA sequence
gggaaatggagtaaaggtca

SEQ ID NO: 396442 - DNA, 20 bp, Artificial
  CRISPR gRNA sequence
ggaaatggagtaaaggtcac

SEQ ID NO: 396443 - DNA, 20 bp, Artificial
  CRISPR gRNA sequence
ttgctatgcaaagagtttgg

SEQ ID NO: 396444 - DNA, 20 bp, Artificial
  CRISPR gRNA sequence
gctatgcaaagagtttggtg

SEQ ID NO: 396445 - DNA, 20 bp, Artificial
  CRISPR gRNA sequence
ctatgcaaagagtttggtgg

SEQ ID NO: 396446 - DNA, 20 bp, Artificial
  CRISPR gRNA sequence
tgcaaagagtttggtggcat

SEQ ID NO: 396447 - DNA, 20 bp, Artificial
  CRISPR gRNA sequence
ggtggcattttgcccctgcc

SEQ ID NO: 396448 - DNA, 20 bp, Artificial
  CRISPR gRNA sequence
gtggcattttgcccctgccc

SEQ ID NO: 396449 - DNA, 20 bp, Artificial
  CRISPR gRNA sequence
tgcccctgccccagagatct

SEQ ID NO: 396450 - DNA, 20 bp, Artificial
  CRISPR gRNA sequence
gcccctgccccagagatctg

SEQ ID NO: 396451 - DNA, 20 bp, Artificial
  CRISPR gRNA sequence
cccctgccccagagatctgt

SEQ ID NO: 396452 - DNA, 20 bp, Artificial
  CRISPR gRNA sequence
ccccagagatctgtggaact

SEQ ID NO: 396453 - DNA, 20 bp, Artificial
  CRISPR gRNA sequence
tggaactttgaacttgagag

SEQ ID NO: 396454 - DNA, 20 bp, Artificial
  CRISPR gRNA sequence
tgaacttgagagagataatt

SEQ ID NO: 396455 - DNA, 20 bp, Artificial
  CRISPR gRNA sequence
gaacttgagagagataattt

SEQ ID NO: 396456 - DNA, 20 bp, Artificial
  CRISPR gRNA sequence
aacttgagagagataattta

SEQ ID NO: 396457 - DNA, 20 bp, Artificial
  CRISPR gRNA sequence
gagagagataatttagggta

SEQ ID NO: 396458 - DNA, 20 bp, Artificial
  CRISPR gRNA sequence
agagagataatttagggtat

SEQ ID NO: 396459 - DNA, 20 bp, Artificial
  CRISPR gRNA sequence
agggtatctggcagaagaaa

SEQ ID NO: 396460 - DNA, 20 bp, Artificial
  CRISPR gRNA sequence
gggtatctggcagaagaaac

SEQ ID NO: 396461 - DNA, 20 bp, Artificial
  CRISPR gRNA sequence
gcagaagaaacttctaaggg

SEQ ID NO: 396462 - DNA, 20 bp, Artificial
  CRISPR gRNA sequence
ctaaggggcaaagcattcaa

SEQ ID NO: 396463 - DNA, 20 bp, Artificial
  CRISPR gRNA sequence
taaggggcaaagcattcaag

SEQ ID NO: 396464 - DNA, 20 bp, Artificial
  CRISPR gRNA sequence
aggggcaaagcattcaagag

SEQ ID NO: 396465 - DNA, 20 bp, Artificial
  CRISPR gRNA sequence
aagaggaagcagagcataaa

SEQ ID NO: 396466 - DNA, 20 bp, Artificial
  CRISPR gRNA sequence
ggaaaatttgcagcctgatg

SEQ ID NO: 396467 - DNA, 20 bp, Artificial
  CRISPR gRNA sequence
gaaaatttgcagcctgatga

SEQ ID NO: 396468 - DNA, 20 bp, Artificial
  CRISPR gRNA sequence
gcagcctgatgatgcgacag

SEQ ID NO: 396469 - DNA, 20 bp, Artificial
  CRISPR gRNA sequence
cagcctgatgatgcgacaga

SEQ ID NO: 396470 - DNA, 20 bp, Artificial
  CRISPR gRNA sequence
atgatgcgacagaaaagaaa

SEQ ID NO: 396471 - DNA, 20 bp, Artificial
  CRISPR gRNA sequence
tctgggaagaaattccagcc

SEQ ID NO: 396472 - DNA, 20 bp, Artificial
  CRISPR gRNA sequence
ctgggaagaaattccagcca

SEQ ID NO: 396473 - DNA, 20 bp, Artificial
  CRISPR gRNA sequence
tgggaagaaattccagccag

SEQ ID NO: 396474 - DNA, 20 bp, Artificial
  CRISPR gRNA sequence
ggaagaaattccagccagct

SEQ ID NO: 396475 - DNA, 20 bp, Artificial
  CRISPR gRNA sequence
cagccagctgcagaaatttg

SEQ ID NO: 396476 - DNA, 20 bp, Artificial
  CRISPR gRNA sequence
cagaaatttgcataagtaat

SEQ ID NO: 396477 - DNA, 20 bp, Artificial
  CRISPR gRNA sequence
gcataagtaatgaggagcca

SEQ ID NO: 396478 - DNA, 20 bp, Artificial
  CRISPR gRNA sequence
cataagtaatgaggagccaa

SEQ ID NO: 396479 - DNA, 20 bp, Artificial
  CRISPR gRNA sequence
caaggcatgtcagagacctt

SEQ ID NO: 396480 - DNA, 20 bp, Artificial
  CRISPR gRNA sequence
catggcagccccttccatca

SEQ ID NO: 396481 - DNA, 20 bp, Artificial
  CRISPR gRNA sequence
atggcagccccttccatcat

SEQ ID NO: 396482 - DNA, 20 bp, Artificial
  CRISPR gRNA sequence
ccatcataagcctaggaggg

SEQ ID NO: 396483 - DNA, 20 bp, Artificial
  CRISPR gRNA sequence
catcataagcctaggaggga

SEQ ID NO: 396484 - DNA, 20 bp, Artificial
  CRISPR gRNA sequence
ggagggaaaagtgatttcct

SEQ ID NO: 396485 - DNA, 20 bp, Artificial
  CRISPR gRNA sequence
cctgggccaagcctaagacc

SEQ ID NO: 396486 - DNA, 20 bp, Artificial
  CRISPR gRNA sequence
ctgggccaagcctaagaccc

SEQ ID NO: 396487 - DNA, 20 bp, Artificial
  CRISPR gRNA sequence
ggccaagcctaagaccccct

SEQ ID NO: 396488 - DNA, 20 bp, Artificial
  CRISPR gRNA sequence
agaccccctgctctatgcag

SEQ ID NO: 396489 - DNA, 20 bp, Artificial
  CRISPR gRNA sequence
ctctatgcagcctcgggact

SEQ ID NO: 396490 - DNA, 20 bp, Artificial
  CRISPR gRNA sequence
tatgcagcctcgggactgca

SEQ ID NO: 396491 - DNA, 20 bp, Artificial
  CRISPR gRNA sequence
tgcagcctcgggactgcata

SEQ ID NO: 396492 - DNA, 20 bp, Artificial
  CRISPR gRNA sequence
gggactgcatatggtgccct

SEQ ID NO: 396493 - DNA, 20 bp, Artificial
  CRISPR gRNA sequence
catatggtgccctatgtccc

SEQ ID NO: 396494 - DNA, 20 bp, Artificial
  CRISPR gRNA sequence
tgtcccagccacggctaaaa

SEQ ID NO: 396495 - DNA, 20 bp, Artificial
  CRISPR gRNA sequence
aaaggggccaacatacagct

SEQ ID NO: 396496 - DNA, 20 bp, Artificial
  CRISPR gRNA sequence
aggctgttgcttcagagggt

SEQ ID NO: 396497 - DNA, 20 bp, Artificial
  CRISPR gRNA sequence
ttgcttcagagggtgcaagc

SEQ ID NO: 396498 - DNA, 20 bp, Artificial
  CRISPR gRNA sequence
cttcagagggtgcaagcccc

SEQ ID NO: 396499 - DNA, 20 bp, Artificial
  CRISPR gRNA sequence
cagagggtgcaagccccaag

SEQ ID NO: 396500 - DNA, 20 bp, Artificial
  CRISPR gRNA sequence
agagggtgcaagccccaagc

SEQ ID NO: 396501 - DNA, 20 bp, Artificial
  CRISPR gRNA sequence
gacagcttacacgtggtgtt

SEQ ID NO: 396502 - DNA, 20 bp, Artificial
  CRISPR gRNA sequence
acagcttacacgtggtgttg

SEQ ID NO: 396503 - DNA, 20 bp, Artificial
  CRISPR gRNA sequence
acacgtggtgttgggcctgc

SEQ ID NO: 396504 - DNA, 20 bp, Artificial
  CRISPR gRNA sequence
cacgtggtgttgggcctgcg

SEQ ID NO: 396505 - DNA, 20 bp, Artificial
  CRISPR gRNA sequence
ggcctgcgggtgcacagaag

SEQ ID NO: 396506 - DNA, 20 bp, Artificial
  CRISPR gRNA sequence
cgggtgcacagaagtcaaga

SEQ ID NO: 396507 - DNA, 20 bp, Artificial
  CRISPR gRNA sequence
tggtttgagaacctctgcct

SEQ ID NO: 396508 - DNA, 20 bp, Artificial
  CRISPR gRNA sequence
gagaacctctgcctagactt

SEQ ID NO: 396509 - DNA, 20 bp, Artificial
  CRISPR gRNA sequence
agaacctctgcctagacttc

SEQ ID NO: 396510 - DNA, 20 bp, Artificial
  CRISPR gRNA sequence
tgcctagacttcagaaaatg

SEQ ID NO: 396511 - DNA, 20 bp, Artificial
  CRISPR gRNA sequence
cctagacttcagaaaatgta

SEQ ID NO: 396512 - DNA, 20 bp, Artificial
  CRISPR gRNA sequence
gacttcagaaaatgtacaga

SEQ ID NO: 396513 - DNA, 20 bp, Artificial
  CRISPR gRNA sequence
cagaaaatgtacagaaacac

SEQ ID NO: 396514 - DNA, 20 bp, Artificial
  CRISPR gRNA sequence
agaaaatgtacagaaacacc

SEQ ID NO: 396515 - DNA, 20 bp, Artificial
  CRISPR gRNA sequence
ggtgtccattcagaagttgc

SEQ ID NO: 396516 - DNA, 20 bp, Artificial
  CRISPR gRNA sequence
agaagttgctgcaagggcag

SEQ ID NO: 396517 - DNA, 20 bp, Artificial
  CRISPR gRNA sequence
ctgcaagggcagagccctca

SEQ ID NO: 396518 - DNA, 20 bp, Artificial
  CRISPR gRNA sequence
caagggcagagccctcatgg

SEQ ID NO: 396519 - DNA, 20 bp, Artificial
  CRISPR gRNA sequence
atggaagacctctgctaggg

SEQ ID NO: 396520 - DNA, 20 bp, Artificial
  CRISPR gRNA sequence
tgctagggcactgcagcagg

SEQ ID NO: 396521 - DNA, 20 bp, Artificial
  CRISPR gRNA sequence
ctagggcactgcagcaggga

SEQ ID NO: 396522 - DNA, 20 bp, Artificial
  CRISPR gRNA sequence
gggcactgcagcagggaaat

SEQ ID NO: 396523 - DNA, 20 bp, Artificial
  CRISPR gRNA sequence
cagcagggaaatgtggggtt

SEQ ID NO: 396524 - DNA, 20 bp, Artificial
  CRISPR gRNA sequence
gagcccccacacagaatccc

SEQ ID NO: 396525 - DNA, 20 bp, Artificial
  CRISPR gRNA sequence
gggcactgtctagtagagct

SEQ ID NO: 396526 - DNA, 20 bp, Artificial
  CRISPR gRNA sequence
tctagtagagctgtgagaag

SEQ ID NO: 396527 - DNA, 20 bp, Artificial
  CRISPR gRNA sequence
gtagagctgtgagaagaggg

SEQ ID NO: 396528 - DNA, 20 bp, Artificial
  CRISPR gRNA sequence
tgagaagagggccaccatcc

SEQ ID NO: 396529 - DNA, 20 bp, Artificial
  CRISPR gRNA sequence
cagaccccacaatctgaatc

SEQ ID NO: 396530 - DNA, 20 bp, Artificial
  CRISPR gRNA sequence
agaccccacaatctgaatct

SEQ ID NO: 396531 - DNA, 20 bp, Artificial
  CRISPR gRNA sequence
aatctgatccacagacggct

SEQ ID NO: 396532 - DNA, 20 bp, Artificial
  CRISPR gRNA sequence
atccacagacggcttgcacc

SEQ ID NO: 396533 - DNA, 20 bp, Artificial
  CRISPR gRNA sequence
gcaccatgcaactggagaag

SEQ ID NO: 396534 - DNA, 20 bp, Artificial
  CRISPR gRNA sequence
caccatgcaactggagaagc

SEQ ID NO: 396535 - DNA, 20 bp, Artificial
  CRISPR gRNA sequence
gagaagccacagacactcaa

SEQ ID NO: 396536 - DNA, 20 bp, Artificial
  CRISPR gRNA sequence
aacaccagcctgtgaaagca

SEQ ID NO: 396537 - DNA, 20 bp, Artificial
  CRISPR gRNA sequence
tgaaagcagccaagagggga

SEQ ID NO: 396538 - DNA, 20 bp, Artificial
  CRISPR gRNA sequence
taccctgcatagccagaggg

SEQ ID NO: 396539 - DNA, 20 bp, Artificial
  CRISPR gRNA sequence
catagccagaggggtggagc

SEQ ID NO: 396540 - DNA, 20 bp, Artificial
  CRISPR gRNA sequence
cccaagaccatgggtgccca

SEQ ID NO: 396541 - DNA, 20 bp, Artificial
  CRISPR gRNA sequence
ttgcatcagcatgcccagga

SEQ ID NO: 396542 - DNA, 20 bp, Artificial
  CRISPR gRNA sequence
gcatcagcatgcccaggatg

SEQ ID NO: 396543 - DNA, 20 bp, Artificial
  CRISPR gRNA sequence
catcagcatgcccaggatgt

SEQ ID NO: 396544 - DNA, 20 bp, Artificial
  CRISPR gRNA sequence
ttggaacttgaagttttaat

SEQ ID NO: 396545 - DNA, 20 bp, Artificial
  CRISPR gRNA sequence
tggaacttgaagttttaatg

SEQ ID NO: 396546 - DNA, 20 bp, Artificial
  CRISPR gRNA sequence
ggaacttgaagttttaatga

SEQ ID NO: 396547 - DNA, 20 bp, Artificial
  CRISPR gRNA sequence
gaacttgaagttttaatgac

SEQ ID NO: 396548 - DNA, 20 bp, Artificial
  CRISPR gRNA sequence
gaagttttaatgactgccct

SEQ ID NO: 396549 - DNA, 20 bp, Artificial
  CRISPR gRNA sequence
aagttttaatgactgcccta

SEQ ID NO: 396550 - DNA, 20 bp, Artificial
  CRISPR gRNA sequence
taatgactgccctacaggat

SEQ ID NO: 396551 - DNA, 20 bp, Artificial
  CRISPR gRNA sequence
aatgactgccctacaggatt

SEQ ID NO: 396552 - DNA, 20 bp, Artificial
  CRISPR gRNA sequence
atgactgccctacaggattt

SEQ ID NO: 396553 - DNA, 20 bp, Artificial
  CRISPR gRNA sequence
ccctacaggatttcagactt

SEQ ID NO: 396554 - DNA, 20 bp, Artificial
  CRISPR gRNA sequence
caggatttcagacttgcatg

SEQ ID NO: 396555 - DNA, 20 bp, Artificial
  CRISPR gRNA sequence
cagacttgcatggagctagt

SEQ ID NO: 396556 - DNA, 20 bp, Artificial
  CRISPR gRNA sequence
agacttgcatggagctagta

SEQ ID NO: 396557 - DNA, 20 bp, Artificial
  CRISPR gRNA sequence
gcatggagctagtagcccct

SEQ ID NO: 396558 - DNA, 20 bp, Artificial
  CRISPR gRNA sequence
catggagctagtagcccctt

SEQ ID NO: 396559 - DNA, 20 bp, Artificial
  CRISPR gRNA sequence
gtagcccctttgttttggcc

SEQ ID NO: 396560 - DNA, 20 bp, Artificial
  CRISPR gRNA sequence
tgttttggccaatttctctc

SEQ ID NO: 396561 - DNA, 20 bp, Artificial
  CRISPR gRNA sequence
gttttggccaatttctctca

SEQ ID NO: 396562 - DNA, 20 bp, Artificial
  CRISPR gRNA sequence
ttttggccaatttctctcat

SEQ ID NO: 396563 - DNA, 20 bp, Artificial
  CRISPR gRNA sequence
tggccaatttctctcattta

SEQ ID NO: 396564 - DNA, 20 bp, Artificial
  CRISPR gRNA sequence
ggccaatttctctcatttag

SEQ ID NO: 396565 - DNA, 20 bp, Artificial
  CRISPR gRNA sequence
gccaatttctctcatttaga

SEQ ID NO: 396566 - DNA, 20 bp, Artificial
  CRISPR gRNA sequence
ctctcatttagaattggtgt

SEQ ID NO: 396567 - DNA, 20 bp, Artificial
  CRISPR gRNA sequence
tctcatttagaattggtgta

SEQ ID NO: 396568 - DNA, 20 bp, Artificial
  CRISPR gRNA sequence
tcatttagaattggtgtatt

SEQ ID NO: 396569 - DNA, 20 bp, Artificial
  CRISPR gRNA sequence
atttagaattggtgtattta

SEQ ID NO: 396570 - DNA, 20 bp, Artificial
  CRISPR gRNA sequence
agaattggtgtatttatcca

SEQ ID NO: 396571 - DNA, 20 bp, Artificial
  CRISPR gRNA sequence
gaattggtgtatttatccaa

SEQ ID NO: 396572 - DNA, 20 bp, Artificial
  CRISPR gRNA sequence
gtgtatttatccaatgcctg

SEQ ID NO: 396573 - DNA, 20 bp, Artificial
  CRISPR gRNA sequence
atccaatgcctgtacccctc

SEQ ID NO: 396574 - DNA, 20 bp, Artificial
  CRISPR gRNA sequence
tccaatgcctgtacccctct

SEQ ID NO: 396575 - DNA, 20 bp, Artificial
  CRISPR gRNA sequence
tacccctcttttatctagga

SEQ ID NO: 396576 - DNA, 20 bp, Artificial
  CRISPR gRNA sequence
ttttatctaggaagtaacta

SEQ ID NO: 396577 - DNA, 20 bp, Artificial
  CRISPR gRNA sequence
ttatctaggaagtaactaac

SEQ ID NO: 396578 - DNA, 20 bp, Artificial
  CRISPR gRNA sequence
tatctaggaagtaactaact

SEQ ID NO: 396579 - DNA, 20 bp, Artificial
  CRISPR gRNA sequence
atctaggaagtaactaactt

SEQ ID NO: 396580 - DNA, 20 bp, Artificial
  CRISPR gRNA sequence
tctaggaagtaactaacttg

SEQ ID NO: 396581 - DNA, 20 bp, Artificial
  CRISPR gRNA sequence
ggaagtaactaacttgcttt

SEQ ID NO: 396582 - DNA, 20 bp, Artificial
  CRISPR gRNA sequence
acttgcttttgattttacag

SEQ ID NO: 396583 - DNA, 20 bp, Artificial
  CRISPR gRNA sequence
gcttttgattttacaggctc

SEQ ID NO: 396584 - DNA, 20 bp, Artificial
  CRISPR gRNA sequence
cttttgattttacaggctca

SEQ ID NO: 396585 - DNA, 20 bp, Artificial
  CRISPR gRNA sequence
ttgattttacaggctcatag

SEQ ID NO: 396586 - DNA, 20 bp, Artificial
  CRISPR gRNA sequence
tgattttacaggctcatagg

SEQ ID NO: 396587 - DNA, 20 bp, Artificial
  CRISPR gRNA sequence
gattttacaggctcataggc

SEQ ID NO: 396588 - DNA, 20 bp, Artificial
  CRISPR gRNA sequence
attttacaggctcataggcg

SEQ ID NO: 396589 - DNA, 20 bp, Artificial
  CRISPR gRNA sequence
tacaggctcataggcggaag

SEQ ID NO: 396590 - DNA, 20 bp, Artificial
  CRISPR gRNA sequence
acaggctcataggcggaagg

SEQ ID NO: 396591 - DNA, 20 bp, Artificial
  CRISPR gRNA sequence
caggctcataggcggaaggt

SEQ ID NO: 396592 - DNA, 20 bp, Artificial
  CRISPR gRNA sequence
ataggcggaaggtacttgcc

SEQ ID NO: 396593 - DNA, 20 bp, Artificial
  CRISPR gRNA sequence
gccttgtctcagatgagact

SEQ ID NO: 396594 - DNA, 20 bp, Artificial
  CRISPR gRNA sequence
ccttgtctcagatgagactt

SEQ ID NO: 396595 - DNA, 20 bp, Artificial
  CRISPR gRNA sequence
gtctcagatgagactttggg

SEQ ID NO: 396596 - DNA, 20 bp, Artificial
  CRISPR gRNA sequence
tctcagatgagactttgggc

SEQ ID NO: 396597 - DNA, 20 bp, Artificial
  CRISPR gRNA sequence
agatgagactttgggctgtg

SEQ ID NO: 396598 - DNA, 20 bp, Artificial
  CRISPR gRNA sequence
tgggctgtggactttcagtt

SEQ ID NO: 396599 - DNA, 20 bp, Artificial
  CRISPR gRNA sequence
gggctgtggactttcagtta

SEQ ID NO: 396600 - DNA, 20 bp, Artificial
  CRISPR gRNA sequence
ggctgtggactttcagttaa

SEQ ID NO: 396601 - DNA, 20 bp, Artificial
  CRISPR gRNA sequence
tggactttcagttaatgctg

SEQ ID NO: 396602 - DNA, 20 bp, Artificial
  CRISPR gRNA sequence
tcagttaatgctggaaagag

SEQ ID NO: 396603 - DNA, 20 bp, Artificial
  CRISPR gRNA sequence
cagttaatgctggaaagagt

SEQ ID NO: 396604 - DNA, 20 bp, Artificial
  CRISPR gRNA sequence
agttaatgctggaaagagtt

SEQ ID NO: 396605 - DNA, 20 bp, Artificial
  CRISPR gRNA sequence
atgctggaaagagttaagac

SEQ ID NO: 396606 - DNA, 20 bp, Artificial
  CRISPR gRNA sequence
gaaagagttaagactttggg

SEQ ID NO: 396607 - DNA, 20 bp, Artificial
  CRISPR gRNA sequence
agactttgggggactgttgg

SEQ ID NO: 396608 - DNA, 20 bp, Artificial
  CRISPR gRNA sequence
tgggggactgttgggagggt

SEQ ID NO: 396609 - DNA, 20 bp, Artificial
  CRISPR gRNA sequence
gggggactgttgggagggta

SEQ ID NO: 396610 - DNA, 20 bp, Artificial
  CRISPR gRNA sequence
ggggactgttgggagggtat

SEQ ID NO: 396611 - DNA, 20 bp, Artificial
  CRISPR gRNA sequence
ttgggagggtatggttgtat

SEQ ID NO: 396612 - DNA, 20 bp, Artificial
  CRISPR gRNA sequence
ggagggtatggttgtatttt

SEQ ID NO: 396613 - DNA, 20 bp, Artificial
  CRISPR gRNA sequence
tattttgaaatgtgagggca

SEQ ID NO: 396614 - DNA, 20 bp, Artificial
  CRISPR gRNA sequence
tgaaatgtgagggcatgaga

SEQ ID NO: 396615 - DNA, 20 bp, Artificial
  CRISPR gRNA sequence
gaaatgtgagggcatgagat

SEQ ID NO: 396616 - DNA, 20 bp, Artificial
  CRISPR gRNA sequence
aaatgtgagggcatgagatt

SEQ ID NO: 396617 - DNA, 20 bp, Artificial
  CRISPR gRNA sequence
cagaggggccaggggcaaaa

SEQ ID NO: 396618 - DNA, 20 bp, Artificial
  CRISPR gRNA sequence
agaggggccaggggcaaaat

SEQ ID NO: 396619 - DNA, 20 bp, Artificial
  CRISPR gRNA sequence
ggctgtttccccacccaaat

SEQ ID NO: 396620 - DNA, 20 bp, Artificial
  CRISPR gRNA sequence
gctgtttccccacccaaatc

SEQ ID NO: 396621 - DNA, 20 bp, Artificial
  CRISPR gRNA sequence
tttccccacccaaatctcat

SEQ ID NO: 396622 - DNA, 20 bp, Artificial
  CRISPR gRNA sequence
ccccacccaaatctcatctt

SEQ ID NO: 396623 - DNA, 20 bp, Artificial
  CRISPR gRNA sequence
cccacccaaatctcatcttg

SEQ ID NO: 396624 - DNA, 20 bp, Artificial
  CRISPR gRNA sequence
atcttgtagttcccataatc

SEQ ID NO: 396625 - DNA, 20 bp, Artificial
  CRISPR gRNA sequence
gtagttcccataatccccat

SEQ ID NO: 396626 - DNA, 20 bp, Artificial
  CRISPR gRNA sequence
tagttcccataatccccatg

SEQ ID NO: 396627 - DNA, 20 bp, Artificial
  CRISPR gRNA sequence
ccataatccccatgtattgt

SEQ ID NO: 396628 - DNA, 20 bp, Artificial
  CRISPR gRNA sequence
tgggaaggacccggtgggag

SEQ ID NO: 396629 - DNA, 20 bp, Artificial
  CRISPR gRNA sequence
aatcatggggccagtcacct

SEQ ID NO: 396630 - DNA, 20 bp, Artificial
  CRISPR gRNA sequence
catgctgttctggtgacagt

SEQ ID NO: 396631 - DNA, 20 bp, Artificial
  CRISPR gRNA sequence
atgctgttctggtgacagtg

SEQ ID NO: 396632 - DNA, 20 bp, Artificial
  CRISPR gRNA sequence
ttctggtgacagtgagtgaa

SEQ ID NO: 396633 - DNA, 20 bp, Artificial
  CRISPR gRNA sequence
tggtgacagtgagtgaattc

SEQ ID NO: 396634 - DNA, 20 bp, Artificial
  CRISPR gRNA sequence
gtgacagtgagtgaattctc

SEQ ID NO: 396635 - DNA, 20 bp, Artificial
  CRISPR gRNA sequence
tcacaaaatctgatggtttt

SEQ ID NO: 396636 - DNA, 20 bp, Artificial
  CRISPR gRNA sequence
acaaaatctgatggttttat

SEQ ID NO: 396637 - DNA, 20 bp, Artificial
  CRISPR gRNA sequence
atggttttataaggggcttt

SEQ ID NO: 396638 - DNA, 20 bp, Artificial
  CRISPR gRNA sequence
tataaggggcttttccccca

SEQ ID NO: 396639 - DNA, 20 bp, Artificial
  CRISPR gRNA sequence
ataaggggcttttcccccac

SEQ ID NO: 396640 - DNA, 20 bp, Artificial
  CRISPR gRNA sequence
taaggggcttttcccccacc

SEQ ID NO: 396641 - DNA, 20 bp, Artificial
  CRISPR gRNA sequence
ttcccccacctcactctgca

SEQ ID NO: 396642 - DNA, 20 bp, Artificial
  CRISPR gRNA sequence
tcccccacctcactctgcac

SEQ ID NO: 396643 - DNA, 20 bp, Artificial
  CRISPR gRNA sequence
cccccacctcactctgcact

SEQ ID NO: 396644 - DNA, 20 bp, Artificial
  CRISPR gRNA sequence
ccccacctcactctgcactt

SEQ ID NO: 396645 - DNA, 20 bp, Artificial
  CRISPR gRNA sequence
actctgcacttctccttcct

SEQ ID NO: 396646 - DNA, 20 bp, Artificial
  CRISPR gRNA sequence
tgcacttctccttcctgctg

SEQ ID NO: 396647 - DNA, 20 bp, Artificial
  CRISPR gRNA sequence
cacttctccttcctgctgcc

SEQ ID NO: 396648 - DNA, 20 bp, Artificial
  CRISPR gRNA sequence
ctccttcctgctgccatgtg

SEQ ID NO: 396649 - DNA, 20 bp, Artificial
  CRISPR gRNA sequence
tccttcctgctgccatgtga

SEQ ID NO: 396650 - DNA, 20 bp, Artificial
  CRISPR gRNA sequence
cttcctgctgccatgtgaag

SEQ ID NO: 396651 - DNA, 20 bp, Artificial
  CRISPR gRNA sequence
cctgctgccatgtgaagaag

SEQ ID NO: 396652 - DNA, 20 bp, Artificial
  CRISPR gRNA sequence
ctgctgccatgtgaagaagg

SEQ ID NO: 396653 - DNA, 20 bp, Artificial
  CRISPR gRNA sequence
ctgccatgtgaagaaggaca

SEQ ID NO: 396654 - DNA, 20 bp, Artificial
  CRISPR gRNA sequence
ccatgtgaagaaggacatgt

SEQ ID NO: 396655 - DNA, 20 bp, Artificial
  CRISPR gRNA sequence
gctccccttttcaccatgat

SEQ ID NO: 396656 - DNA, 20 bp, Artificial
  CRISPR gRNA sequence
ctccccttttcaccatgatt

SEQ ID NO: 396657 - DNA, 20 bp, Artificial
  CRISPR gRNA sequence
cccttttcaccatgattgta

SEQ ID NO: 396658 - DNA, 20 bp, Artificial
  CRISPR gRNA sequence
ttcaccatgattgtacgttt

SEQ ID NO: 396659 - DNA, 20 bp, Artificial
  CRISPR gRNA sequence
tcaccatgattgtacgtttc

SEQ ID NO: 396660 - DNA, 20 bp, Artificial
  CRISPR gRNA sequence
caccatgattgtacgtttcc

SEQ ID NO: 396661 - DNA, 20 bp, Artificial
  CRISPR gRNA sequence
accatgattgtacgtttcct

SEQ ID NO: 396662 - DNA, 20 bp, Artificial
  CRISPR gRNA sequence
tacgtttcctgaggcctccc

SEQ ID NO: 396663 - DNA, 20 bp, Artificial
  CRISPR gRNA sequence
cctgaggcctccccagccat

SEQ ID NO: 396664 - DNA, 20 bp, Artificial
  CRISPR gRNA sequence
ctgaggcctccccagccata

SEQ ID NO: 396665 - DNA, 20 bp, Artificial
  CRISPR gRNA sequence
aggcctccccagccatactg

SEQ ID NO: 396666 - DNA, 20 bp, Artificial
  CRISPR gRNA sequence
cccagccatactgaactgtg

SEQ ID NO: 396667 - DNA, 20 bp, Artificial
  CRISPR gRNA sequence
aactgtgagtcaattaaacc

SEQ ID NO: 396668 - DNA, 20 bp, Artificial
  CRISPR gRNA sequence
tgagtcaattaaacctcttt

SEQ ID NO: 396669 - DNA, 20 bp, Artificial
  CRISPR gRNA sequence
aacctctttcccttataaat

SEQ ID NO: 396670 - DNA, 20 bp, Artificial
  CRISPR gRNA sequence
tttcccttataaattaccca

SEQ ID NO: 396671 - DNA, 20 bp, Artificial
  CRISPR gRNA sequence
tcccttataaattacccagt

SEQ ID NO: 396672 - DNA, 20 bp, Artificial
  CRISPR gRNA sequence
cccttataaattacccagtc

SEQ ID NO: 396673 - DNA, 20 bp, Artificial
  CRISPR gRNA sequence
ccttataaattacccagtct

SEQ ID NO: 396674 - DNA, 20 bp, Artificial
  CRISPR gRNA sequence
ataaattacccagtcttaag

SEQ ID NO: 396675 - DNA, 20 bp, Artificial
  CRISPR gRNA sequence
taaattacccagtcttaagt

SEQ ID NO: 396676 - DNA, 20 bp, Artificial
  CRISPR gRNA sequence
cccagtcttaagtatttctt

SEQ ID NO: 396677 - DNA, 20 bp, Artificial
  CRISPR gRNA sequence
aagtatttcttcacagcagt

SEQ ID NO: 396678 - DNA, 20 bp, Artificial
  CRISPR gRNA sequence
agtatttcttcacagcagtg

SEQ ID NO: 396679 - DNA, 20 bp, Artificial
  CRISPR gRNA sequence
cttcacagcagtgtgagaat

SEQ ID NO: 396680 - DNA, 20 bp, Artificial
  CRISPR gRNA sequence
ttcacagcagtgtgagaata

SEQ ID NO: 396681 - DNA, 20 bp, Artificial
  CRISPR gRNA sequence
cacagcagtgtgagaataga

SEQ ID NO: 396682 - DNA, 20 bp, Artificial
  CRISPR gRNA sequence
acagcagtgtgagaatagac

SEQ ID NO: 396683 - DNA, 20 bp, Artificial
  CRISPR gRNA sequence
atacatcatgtgagccaatt

SEQ ID NO: 396684 - DNA, 20 bp, Artificial
  CRISPR gRNA sequence
cttataataaatctccatgt

SEQ ID NO: 396685 - DNA, 20 bp, Artificial
  CRISPR gRNA sequence
ttataataaatctccatgta

SEQ ID NO: 396686 - DNA, 20 bp, Artificial
  CRISPR gRNA sequence
ataataaatctccatgtata

SEQ ID NO: 396687 - DNA, 20 bp, Artificial
  CRISPR gRNA sequence
taataaatctccatgtatat

SEQ ID NO: 396688 - DNA, 20 bp, Artificial
  CRISPR gRNA sequence
catgtatatacacattggtt

SEQ ID NO: 396689 - DNA, 20 bp, Artificial
  CRISPR gRNA sequence
gttctctttctctggagaag

SEQ ID NO: 396690 - DNA, 20 bp, Artificial
  CRISPR gRNA sequence
tctttctctggagaagcctg

SEQ ID NO: 396691 - DNA, 20 bp, Artificial
  CRISPR gRNA sequence
tttctctggagaagcctgac

SEQ ID NO: 396692 - DNA, 20 bp, Artificial
  CRISPR gRNA sequence
tctctggagaagcctgacta

SEQ ID NO: 396693 - DNA, 20 bp, Artificial
  CRISPR gRNA sequence
ctctggagaagcctgactaa

SEQ ID NO: 396694 - DNA, 20 bp, Artificial
  CRISPR gRNA sequence
tctggagaagcctgactaaa

SEQ ID NO: 396695 - DNA, 20 bp, Artificial
  CRISPR gRNA sequence
tggagaagcctgactaaaat

SEQ ID NO: 396696 - DNA, 20 bp, Artificial
  CRISPR gRNA sequence
gagaagcctgactaaaataa

SEQ ID NO: 396697 - DNA, 20 bp, Artificial
  CRISPR gRNA sequence
actaaaataatagagatacc

SEQ ID NO: 396698 - DNA, 20 bp, Artificial
  CRISPR gRNA sequence
aaataatagagataccaatt

SEQ ID NO: 396699 - DNA, 20 bp, Artificial
  CRISPR gRNA sequence
atcctcctgctagcagtgtg

SEQ ID NO: 396700 - DNA, 20 bp, Artificial
  CRISPR gRNA sequence
ctgctagcagtgtgtaaagg

SEQ ID NO: 396701 - DNA, 20 bp, Artificial
  CRISPR gRNA sequence
ctagcagtgtgtaaaggttc

SEQ ID NO: 396702 - DNA, 20 bp, Artificial
  CRISPR gRNA sequence
gcagtgtgtaaaggttccaa

SEQ ID NO: 396703 - DNA, 20 bp, Artificial
  CRISPR gRNA sequence
caatctacagatgcctattt

SEQ ID NO: 396704 - DNA, 20 bp, Artificial
  CRISPR gRNA sequence
cagatgcctatttgcttacc

SEQ ID NO: 396705 - DNA, 20 bp, Artificial
  CRISPR gRNA sequence
tttgcttaccttgcctgcaa

SEQ ID NO: 396706 - DNA, 20 bp, Artificial
  CRISPR gRNA sequence
gcttaccttgcctgcaaact

SEQ ID NO: 396707 - DNA, 20 bp, Artificial
  CRISPR gRNA sequence
cttaccttgcctgcaaactc

SEQ ID NO: 396708 - DNA, 20 bp, Artificial
  CRISPR gRNA sequence
accttgcctgcaaactctta

SEQ ID NO: 396709 - DNA, 20 bp, Artificial
  CRISPR gRNA sequence
ccttgcctgcaaactcttac

SEQ ID NO: 396710 - DNA, 20 bp, Artificial
  CRISPR gRNA sequence
gcctgcaaactcttactctc

SEQ ID NO: 396711 - DNA, 20 bp, Artificial
  CRISPR gRNA sequence
cctgcaaactcttactctcc

SEQ ID NO: 396712 - DNA, 20 bp, Artificial
  CRISPR gRNA sequence
caaactcttactctcctaaa

SEQ ID NO: 396713 - DNA, 20 bp, Artificial
  CRISPR gRNA sequence
ttactctcctaaaagactgc

SEQ ID NO: 396714 - DNA, 20 bp, Artificial
  CRISPR gRNA sequence
actctcctaaaagactgcag

SEQ ID NO: 396715 - DNA, 20 bp, Artificial
  CRISPR gRNA sequence
ctctcctaaaagactgcagc

SEQ ID NO: 396716 - DNA, 20 bp, Artificial
  CRISPR gRNA sequence
tcctaaaagactgcagctag

SEQ ID NO: 396717 - DNA, 20 bp, Artificial
  CRISPR gRNA sequence
ctaaaagactgcagctagtg

SEQ ID NO: 396718 - DNA, 20 bp, Artificial
  CRISPR gRNA sequence
aaagactgcagctagtgtaa

SEQ ID NO: 396719 - DNA, 20 bp, Artificial
  CRISPR gRNA sequence
cagctagtgtaatcttttag

SEQ ID NO: 396720 - DNA, 20 bp, Artificial
  CRISPR gRNA sequence
gtgtaatcttttaggtggtg

SEQ ID NO: 396721 - DNA, 20 bp, Artificial
  CRISPR gRNA sequence
ttaggtggtgaaagaaaaat

SEQ ID NO: 396722 - DNA, 20 bp, Artificial
  CRISPR gRNA sequence
taggtggtgaaagaaaaatc

SEQ ID NO: 396723 - DNA, 20 bp, Artificial
  CRISPR gRNA sequence
aggtggtgaaagaaaaatct

SEQ ID NO: 396724 - DNA, 20 bp, Artificial
  CRISPR gRNA sequence
ggtggtgaaagaaaaatctg

SEQ ID NO: 396725 - DNA, 20 bp, Artificial
  CRISPR gRNA sequence
gttttattttgtgtgtctct

SEQ ID NO: 396726 - DNA, 20 bp, Artificial
  CRISPR gRNA sequence
tattttgtgtgtctctctaa

SEQ ID NO: 396727 - DNA, 20 bp, Artificial
  CRISPR gRNA sequence
attttgtgtgtctctctaaa

SEQ ID NO: 396728 - DNA, 20 bp, Artificial
  CRISPR gRNA sequence
ttttgtgtgtctctctaaaa

SEQ ID NO: 396729 - DNA, 20 bp, Artificial
  CRISPR gRNA sequence
tgtgtgtctctctaaaaact

SEQ ID NO: 396730 - DNA, 20 bp, Artificial
  CRISPR gRNA sequence
gtgtgtctctctaaaaacta

SEQ ID NO: 396731 - DNA, 20 bp, Artificial
  CRISPR gRNA sequence
tgtgtctctctaaaaactag

SEQ ID NO: 396732 - DNA, 20 bp, Artificial
  CRISPR gRNA sequence
tctaaaaactagtcagagat

SEQ ID NO: 396733 - DNA, 20 bp, Artificial
  CRISPR gRNA sequence
taaaaactagtcagagatgt

SEQ ID NO: 396734 - DNA, 20 bp, Artificial
  CRISPR gRNA sequence
aaaactagtcagagatgtcc

SEQ ID NO: 396735 - DNA, 20 bp, Artificial
  CRISPR gRNA sequence
gtcagagatgtcccctggtc

SEQ ID NO: 396736 - DNA, 20 bp, Artificial
  CRISPR gRNA sequence
gtctgcattacagacagaag

SEQ ID NO: 396737 - DNA, 20 bp, Artificial
  CRISPR gRNA sequence
cattacagacagaagtcaaa

SEQ ID NO: 396738 - DNA, 20 bp, Artificial
  CRISPR gRNA sequence
cagacagaagtcaaaattcc

SEQ ID NO: 396739 - DNA, 20 bp, Artificial
  CRISPR gRNA sequence
cattaggcacatcaataact

SEQ ID NO: 396740 - DNA, 20 bp, Artificial
  CRISPR gRNA sequence
ggcacatcaataacttttcg

SEQ ID NO: 396741 - DNA, 20 bp, Artificial
  CRISPR gRNA sequence
ttcgggtttatttctgacat

SEQ ID NO: 396742 - DNA, 20 bp, Artificial
  CRISPR gRNA sequence
tcgggtttatttctgacatt

SEQ ID NO: 396743 - DNA, 20 bp, Artificial
  CRISPR gRNA sequence
cgggtttatttctgacattc

SEQ ID NO: 396744 - DNA, 20 bp, Artificial
  CRISPR gRNA sequence
gggtttatttctgacattct

SEQ ID NO: 396745 - DNA, 20 bp, Artificial
  CRISPR gRNA sequence
atttctgacattctgctgcc

SEQ ID NO: 396746 - DNA, 20 bp, Artificial
  CRISPR gRNA sequence
tttctgacattctgctgccc

SEQ ID NO: 396747 - DNA, 20 bp, Artificial
  CRISPR gRNA sequence
ctgacattctgctgccctag

SEQ ID NO: 396748 - DNA, 20 bp, Artificial
  CRISPR gRNA sequence
tgacattctgctgccctagt

SEQ ID NO: 396749 - DNA, 20 bp, Artificial
  CRISPR gRNA sequence
acattctgctgccctagtga

SEQ ID NO: 396750 - DNA, 20 bp, Artificial
  CRISPR gRNA sequence
tgctgccctagtgagctgca

SEQ ID NO: 396751 - DNA, 20 bp, Artificial
  CRISPR gRNA sequence
ctgccctagtgagctgcaac

SEQ ID NO: 396752 - DNA, 20 bp, Artificial
  CRISPR gRNA sequence
ccctagtgagctgcaactcc

SEQ ID NO: 396753 - DNA, 20 bp, Artificial
  CRISPR gRNA sequence
gtgagctgcaactccttttt

SEQ ID NO: 396754 - DNA, 20 bp, Artificial
  CRISPR gRNA sequence
caactcctttttcaagcaca

SEQ ID NO: 396755 - DNA, 20 bp, Artificial
  CRISPR gRNA sequence
ctttttcaagcacagaatct

SEQ ID NO: 396756 - DNA, 20 bp, Artificial
  CRISPR gRNA sequence
tttcaagcacagaatctact

SEQ ID NO: 396757 - DNA, 20 bp, Artificial
  CRISPR gRNA sequence
ttcaagcacagaatctactg

SEQ ID NO: 396758 - DNA, 20 bp, Artificial
  CRISPR gRNA sequence
tcaagcacagaatctactgt

SEQ ID NO: 396759 - DNA, 20 bp, Artificial
  CRISPR gRNA sequence
caagcacagaatctactgta

SEQ ID NO: 396760 - DNA, 20 bp, Artificial
  CRISPR gRNA sequence
aagcacagaatctactgtac

SEQ ID NO: 396761 - DNA, 20 bp, Artificial
  CRISPR gRNA sequence
ctgtactaaagcttttcctg

SEQ ID NO: 396762 - DNA, 20 bp, Artificial
  CRISPR gRNA sequence
tactaaagcttttcctgaaa

SEQ ID NO: 396763 - DNA, 20 bp, Artificial
  CRISPR gRNA sequence
aagcttttcctgaaactcta

SEQ ID NO: 396764 - DNA, 20 bp, Artificial
  CRISPR gRNA sequence
ttcctgaaactctaaagtat

SEQ ID NO: 396765 - DNA, 20 bp, Artificial
  CRISPR gRNA sequence
tcctgaaactctaaagtatc

SEQ ID NO: 396766 - DNA, 20 bp, Artificial
  CRISPR gRNA sequence
cctgaaactctaaagtatca

SEQ ID NO: 396767 - DNA, 20 bp, Artificial
  CRISPR gRNA sequence
ctgaaactctaaagtatcat

SEQ ID NO: 396768 - DNA, 20 bp, Artificial
  CRISPR gRNA sequence
aaactctaaagtatcataag

SEQ ID NO: 396769 - DNA, 20 bp, Artificial
  CRISPR gRNA sequence
taaagtatcataagctgagc

SEQ ID NO: 396770 - DNA, 20 bp, Artificial
  CRISPR gRNA sequence
aagtatcataagctgagccc

SEQ ID NO: 396771 - DNA, 20 bp, Artificial
  CRISPR gRNA sequence
agcccctttgctggtgcatg

SEQ ID NO: 396772 - DNA, 20 bp, Artificial
  CRISPR gRNA sequence
tgctggtgcatgcagggaga

SEQ ID NO: 396773 - DNA, 20 bp, Artificial
  CRISPR gRNA sequence
gctggtgcatgcagggagag

SEQ ID NO: 396774 - DNA, 20 bp, Artificial
  CRISPR gRNA sequence
ctggtgcatgcagggagaga

SEQ ID NO: 396775 - DNA, 20 bp, Artificial
  CRISPR gRNA sequence
gtgcatgcagggagagagtc

SEQ ID NO: 396776 - DNA, 20 bp, Artificial
  CRISPR gRNA sequence
actctcacagtgtcttcctt

SEQ ID NO: 396777 - DNA, 20 bp, Artificial
  CRISPR gRNA sequence
tcacagtgtcttcctttcct

SEQ ID NO: 396778 - DNA, 20 bp, Artificial
  CRISPR gRNA sequence
acagtgtcttcctttcctgg

SEQ ID NO: 396779 - DNA, 20 bp, Artificial
  CRISPR gRNA sequence
cctttcctgggaggctgcct

SEQ ID NO: 396780 - DNA, 20 bp, Artificial
  CRISPR gRNA sequence
ctttcctgggaggctgcctc

SEQ ID NO: 396781 - DNA, 20 bp, Artificial
  CRISPR gRNA sequence
tcctgggaggctgcctctca

SEQ ID NO: 396782 - DNA, 20 bp, Artificial
  CRISPR gRNA sequence
cctgggaggctgcctctcag

SEQ ID NO: 396783 - DNA, 20 bp, Artificial
  CRISPR gRNA sequence
ctgggaggctgcctctcagg

SEQ ID NO: 396784 - DNA, 20 bp, Artificial
  CRISPR gRNA sequence
ggaggctgcctctcaggcca

SEQ ID NO: 396785 - DNA, 20 bp, Artificial
  CRISPR gRNA sequence
cctctcaggccacctctgtg

SEQ ID NO: 396786 - DNA, 20 bp, Artificial
  CRISPR gRNA sequence
tcaggccacctctgtgggtg

SEQ ID NO: 396787 - DNA, 20 bp, Artificial
  CRISPR gRNA sequence
aggccacctctgtgggtgta

SEQ ID NO: 396788 - DNA, 20 bp, Artificial
  CRISPR gRNA sequence
tgtgggtgtagggggcctca

SEQ ID NO: 396789 - DNA, 20 bp, Artificial
  CRISPR gRNA sequence
tgggtgtagggggcctcaga

SEQ ID NO: 396790 - DNA, 20 bp, Artificial
  CRISPR gRNA sequence
agagcccagggtgagaacca

SEQ ID NO: 396791 - DNA, 20 bp, Artificial
  CRISPR gRNA sequence
atccaaatccagtgccctag

SEQ ID NO: 396792 - DNA, 20 bp, Artificial
  CRISPR gRNA sequence
tccaaatccagtgccctagt

SEQ ID NO: 396793 - DNA, 20 bp, Artificial
  CRISPR gRNA sequence
gtcagagaaggccaggctct

SEQ ID NO: 396794 - DNA, 20 bp, Artificial
  CRISPR gRNA sequence
tgcctcttacatgaacttta

SEQ ID NO: 396795 - DNA, 20 bp, Artificial
  CRISPR gRNA sequence
cctcttacatgaactttaca

SEQ ID NO: 396796 - DNA, 20 bp, Artificial
  CRISPR gRNA sequence
ttacatgaactttacacctc

SEQ ID NO: 396797 - DNA, 20 bp, Artificial
  CRISPR gRNA sequence
acatgaactttacacctcca

SEQ ID NO: 396798 - DNA, 20 bp, Artificial
  CRISPR gRNA sequence
catgaactttacacctccac

SEQ ID NO: 396799 - DNA, 20 bp, Artificial
  CRISPR gRNA sequence
tacacctccactgtgccctt

SEQ ID NO: 396800 - DNA, 20 bp, Artificial
  CRISPR gRNA sequence
acacctccactgtgcccttc

SEQ ID NO: 396801 - DNA, 20 bp, Artificial
  CRISPR gRNA sequence
cacctccactgtgcccttct

SEQ ID NO: 396802 - DNA, 20 bp, Artificial
  CRISPR gRNA sequence
cactgtgcccttctttaagc

SEQ ID NO: 396803 - DNA, 20 bp, Artificial
  CRISPR gRNA sequence
tgcccttctttaagccatca

SEQ ID NO: 396804 - DNA, 20 bp, Artificial
  CRISPR gRNA sequence
ctttaagccatcagtacccc

SEQ ID NO: 396805 - DNA, 20 bp, Artificial
  CRISPR gRNA sequence
tttaagccatcagtaccccc

SEQ ID NO: 396806 - DNA, 20 bp, Artificial
  CRISPR gRNA sequence
taagccatcagtacccccag

SEQ ID NO: 396807 - DNA, 20 bp, Artificial
  CRISPR gRNA sequence
aagccatcagtacccccagg

SEQ ID NO: 396808 - DNA, 20 bp, Artificial
  CRISPR gRNA sequence
agccatcagtacccccagga

SEQ ID NO: 396809 - DNA, 20 bp, Artificial
  CRISPR gRNA sequence
ccctctctgtcttctctctt

SEQ ID NO: 396810 - DNA, 20 bp, Artificial
  CRISPR gRNA sequence
cctctctgtcttctctcttc

SEQ ID NO: 396811 - DNA, 20 bp, Artificial
  CRISPR gRNA sequence
tctgtcttctctcttcccca

SEQ ID NO: 396812 - DNA, 20 bp, Artificial
  CRISPR gRNA sequence
tgtcttctctcttccccaga

SEQ ID NO: 396813 - DNA, 20 bp, Artificial
  CRISPR gRNA sequence
tcttctctcttccccagacc

SEQ ID NO: 396814 - DNA, 20 bp, Artificial
  CRISPR gRNA sequence
ctctcttccccagaccccgg

SEQ ID NO: 396815 - DNA, 20 bp, Artificial
  CRISPR gRNA sequence
tctcttccccagaccccggc

SEQ ID NO: 396816 - DNA, 20 bp, Artificial
  CRISPR gRNA sequence
tcttccccagaccccggcct

SEQ ID NO: 396817 - DNA, 20 bp, Artificial
  CRISPR gRNA sequence
ttccccagaccccggcctct

SEQ ID NO: 396818 - DNA, 20 bp, Artificial
  CRISPR gRNA sequence
ccccagaccccggcctctct

SEQ ID NO: 396819 - DNA, 20 bp, Artificial
  CRISPR gRNA sequence
cccagaccccggcctctcta

SEQ ID NO: 396820 - DNA, 20 bp, Artificial
  CRISPR gRNA sequence
tctaattaaaatattccttc

SEQ ID NO: 396821 - DNA, 20 bp, Artificial
  CRISPR gRNA sequence
taattaaaatattccttcca

SEQ ID NO: 396822 - DNA, 20 bp, Artificial
  CRISPR gRNA sequence
attaaaatattccttccaat

SEQ ID NO: 396823 - DNA, 20 bp, Artificial
  CRISPR gRNA sequence
aaatattccttccaattctt

SEQ ID NO: 396824 - DNA, 20 bp, Artificial
  CRISPR gRNA sequence
cttccaattcttcaaggtcc

SEQ ID NO: 396825 - DNA, 20 bp, Artificial
  CRISPR gRNA sequence
ccaattcttcaaggtccagc

SEQ ID NO: 396826 - DNA, 20 bp, Artificial
  CRISPR gRNA sequence
caattcttcaaggtccagca

SEQ ID NO: 396827 - DNA, 20 bp, Artificial
  CRISPR gRNA sequence
ttcaaggtccagcacgactt

SEQ ID NO: 396828 - DNA, 20 bp, Artificial
  CRISPR gRNA sequence
caaggtccagcacgactttt

SEQ ID NO: 396829 - DNA, 20 bp, Artificial
  CRISPR gRNA sequence
aaggtccagcacgacttttc

SEQ ID NO: 396830 - DNA, 20 bp, Artificial
  CRISPR gRNA sequence
ttctctaccatggccctccc

SEQ ID NO: 396831 - DNA, 20 bp, Artificial
  CRISPR gRNA sequence
tctctaccatggccctccct

SEQ ID NO: 396832 - DNA, 20 bp, Artificial
  CRISPR gRNA sequence
ctctaccatggccctccctg

SEQ ID NO: 396833 - DNA, 20 bp, Artificial
  CRISPR gRNA sequence
tctaccatggccctccctgg

SEQ ID NO: 396834 - DNA, 20 bp, Artificial
  CRISPR gRNA sequence
taccatggccctccctggtt

SEQ ID NO: 396835 - DNA, 20 bp, Artificial
  CRISPR gRNA sequence
ccatggccctccctggttca

SEQ ID NO: 396836 - DNA, 20 bp, Artificial
  CRISPR gRNA sequence
cctggttcattccactggag

SEQ ID NO: 396837 - DNA, 20 bp, Artificial
  CRISPR gRNA sequence
gttcattccactggagttaa

SEQ ID NO: 396838 - DNA, 20 bp, Artificial
  CRISPR gRNA sequence
attccactggagttaagatc

SEQ ID NO: 396839 - DNA, 20 bp, Artificial
  CRISPR gRNA sequence
cactggagttaagatctctg

SEQ ID NO: 396840 - DNA, 20 bp, Artificial
  CRISPR gRNA sequence
gagttaagatctctggctct

SEQ ID NO: 396841 - DNA, 20 bp, Artificial
  CRISPR gRNA sequence
agatctctggctcttcagaa

SEQ ID NO: 396842 - DNA, 20 bp, Artificial
  CRISPR gRNA sequence
tggctcttcagaaaaatcaa

SEQ ID NO: 396843 - DNA, 20 bp, Artificial
  CRISPR gRNA sequence
gctcttcagaaaaatcaact

SEQ ID NO: 396844 - DNA, 20 bp, Artificial
  CRISPR gRNA sequence
ttcagaaaaatcaactgggg

SEQ ID NO: 396845 - DNA, 20 bp, Artificial
  CRISPR gRNA sequence
cagaaaaatcaactggggtc

SEQ ID NO: 396846 - DNA, 20 bp, Artificial
  CRISPR gRNA sequence
agaaaaatcaactggggtca

SEQ ID NO: 396847 - DNA, 20 bp, Artificial
  CRISPR gRNA sequence
gggtcattctggtgctgcca

SEQ ID NO: 396848 - DNA, 20 bp, Artificial
  CRISPR gRNA sequence
tggtgctgccacttggcagc

SEQ ID NO: 396849 - DNA, 20 bp, Artificial
  CRISPR gRNA sequence
gtgctgccacttggcagctt

SEQ ID NO: 396850 - DNA, 20 bp, Artificial
  CRISPR gRNA sequence
ccacttggcagcttgataac

SEQ ID NO: 396851 - DNA, 20 bp, Artificial
  CRISPR gRNA sequence
ggcagcttgataaccttgga

SEQ ID NO: 396852 - DNA, 20 bp, Artificial
  CRISPR gRNA sequence
gcagcttgataaccttggac

SEQ ID NO: 396853 - DNA, 20 bp, Artificial
  CRISPR gRNA sequence
gataaccttggacaagtgag

SEQ ID NO: 396854 - DNA, 20 bp, Artificial
  CRISPR gRNA sequence
ataaccttggacaagtgagt

SEQ ID NO: 396855 - DNA, 20 bp, Artificial
  CRISPR gRNA sequence
ggacaagtgagtctaccacc

SEQ ID NO: 396856 - DNA, 20 bp, Artificial
  CRISPR gRNA sequence
gacaagtgagtctaccaccc

SEQ ID NO: 396857 - DNA, 20 bp, Artificial
  CRISPR gRNA sequence
ccaccctgaacctcagtgtc

SEQ ID NO: 396858 - DNA, 20 bp, Artificial
  CRISPR gRNA sequence
aacctcagtgtcttctgttg

SEQ ID NO: 396859 - DNA, 20 bp, Artificial
  CRISPR gRNA sequence
agtgtcttctgttgtattac

SEQ ID NO: 396860 - DNA, 20 bp, Artificial
  CRISPR gRNA sequence
ctgttgtattacgggaacat

SEQ ID NO: 396861 - DNA, 20 bp, Artificial
  CRISPR gRNA sequence
tgttgtattacgggaacata

SEQ ID NO: 396862 - DNA, 20 bp, Artificial
  CRISPR gRNA sequence
ttgtattacgggaacatatt

SEQ ID NO: 396863 - DNA, 20 bp, Artificial
  CRISPR gRNA sequence
tattacgggaacatattacc

SEQ ID NO: 396864 - DNA, 20 bp, Artificial
  CRISPR gRNA sequence
cgggaacatattacctcccc

SEQ ID NO: 396865 - DNA, 20 bp, Artificial
  CRISPR gRNA sequence
cctccccatagtgcttcata

SEQ ID NO: 396866 - DNA, 20 bp, Artificial
  CRISPR gRNA sequence
cccatagtgcttcataagga

SEQ ID NO: 396867 - DNA, 20 bp, Artificial
  CRISPR gRNA sequence
cataaggattaaatgaaatg

SEQ ID NO: 396868 - DNA, 20 bp, Artificial
  CRISPR gRNA sequence
ataaggattaaatgaaatga

SEQ ID NO: 396869 - DNA, 20 bp, Artificial
  CRISPR gRNA sequence
aatgaaatgacacgcagttg

SEQ ID NO: 396870 - DNA, 20 bp, Artificial
  CRISPR gRNA sequence
catcctacagagcaggcacc

SEQ ID NO: 396871 - DNA, 20 bp, Artificial
  CRISPR gRNA sequence
cagagcaggcacccagtaaa

SEQ ID NO: 396872 - DNA, 20 bp, Artificial
  CRISPR gRNA sequence
ggtggcagagcattctgagt

SEQ ID NO: 396873 - DNA, 20 bp, Artificial
  CRISPR gRNA sequence
tgagtgggtcactcattttg

SEQ ID NO: 396874 - DNA, 20 bp, Artificial
  CRISPR gRNA sequence
agtgggtcactcattttggg

SEQ ID NO: 396875 - DNA, 20 bp, Artificial
  CRISPR gRNA sequence
attttgggggtatttctgta

SEQ ID NO: 396876 - DNA, 20 bp, Artificial
  CRISPR gRNA sequence
tgggggtatttctgtaaatg

SEQ ID NO: 396877 - DNA, 20 bp, Artificial
  CRISPR gRNA sequence
gggggtatttctgtaaatgc

SEQ ID NO: 396878 - DNA, 20 bp, Artificial
  CRISPR gRNA sequence
ggggtatttctgtaaatgca

SEQ ID NO: 396879 - DNA, 20 bp, Artificial
  CRISPR gRNA sequence
ctgtaaatgcaactatattt

SEQ ID NO: 396880 - DNA, 20 bp, Artificial
  CRISPR gRNA sequence
tgtaaatgcaactatatttg

SEQ ID NO: 396881 - DNA, 20 bp, Artificial
  CRISPR gRNA sequence
taaatgcaactatatttgct

SEQ ID NO: 396882 - DNA, 20 bp, Artificial
  CRISPR gRNA sequence
tatttgctttaactgactaa

SEQ ID NO: 396883 - DNA, 20 bp, Artificial
  CRISPR gRNA sequence
gctttaactgactaataaag

SEQ ID NO: 396884 - DNA, 20 bp, Artificial
  CRISPR gRNA sequence
ctttaactgactaataaagc

SEQ ID NO: 396885 - DNA, 20 bp, Artificial
  CRISPR gRNA sequence
taactgactaataaagccag

SEQ ID NO: 396886 - DNA, 20 bp, Artificial
  CRISPR gRNA sequence
aactgactaataaagccaga

SEQ ID NO: 396887 - DNA, 20 bp, Artificial
  CRISPR gRNA sequence
actgactaataaagccagag

SEQ ID NO: 396888 - DNA, 20 bp, Artificial
  CRISPR gRNA sequence
actaataaagccagagacac

SEQ ID NO: 396889 - DNA, 20 bp, Artificial
  CRISPR gRNA sequence
ataaagccagagacacgtag

SEQ ID NO: 396890 - DNA, 20 bp, Artificial
  CRISPR gRNA sequence
tctccatgacctcacaaact

SEQ ID NO: 396891 - DNA, 20 bp, Artificial
  CRISPR gRNA sequence
ctccatgacctcacaaactc

SEQ ID NO: 396892 - DNA, 20 bp, Artificial
  CRISPR gRNA sequence
tccatgacctcacaaactct

SEQ ID NO: 396893 - DNA, 20 bp, Artificial
  CRISPR gRNA sequence
catgacctcacaaactctgc

SEQ ID NO: 396894 - DNA, 20 bp, Artificial
  CRISPR gRNA sequence
acaaactctgctagaaaggg

SEQ ID NO: 396895 - DNA, 20 bp, Artificial
  CRISPR gRNA sequence
tgctagaaagggctatctgg

SEQ ID NO: 396896 - DNA, 20 bp, Artificial
  CRISPR gRNA sequence
ctagaaagggctatctggaa

SEQ ID NO: 396897 - DNA, 20 bp, Artificial
  CRISPR gRNA sequence
gaaagggctatctggaaaat

SEQ ID NO: 396898 - DNA, 20 bp, Artificial
  CRISPR gRNA sequence
tctggaaaatgtggtccccc

SEQ ID NO: 396899 - DNA, 20 bp, Artificial
  CRISPR gRNA sequence
gaaaatgtggtcccccaagt

SEQ ID NO: 396900 - DNA, 20 bp, Artificial
  CRISPR gRNA sequence
tgcatattttctcacaaact

SEQ ID NO: 396901 - DNA, 20 bp, Artificial
  CRISPR gRNA sequence
catattttctcacaaactag

SEQ ID NO: 396902 - DNA, 20 bp, Artificial
  CRISPR gRNA sequence
tctcacaaactaggtaaaaa

SEQ ID NO: 396903 - DNA, 20 bp, Artificial
  CRISPR gRNA sequence
ctcacaaactaggtaaaaac

SEQ ID NO: 396904 - DNA, 20 bp, Artificial
  CRISPR gRNA sequence
tcacaaactaggtaaaaaca

SEQ ID NO: 396905 - DNA, 20 bp, Artificial
  CRISPR gRNA sequence
acaaactaggtaaaaacaaa

SEQ ID NO: 396906 - DNA, 20 bp, Artificial
  CRISPR gRNA sequence
ggtaaaaacaaatgcattta

SEQ ID NO: 396907 - DNA, 20 bp, Artificial
  CRISPR gRNA sequence
attcttaccatcagagtctc

SEQ ID NO: 396908 - DNA, 20 bp, Artificial
  CRISPR gRNA sequence
ttcttaccatcagagtctct

SEQ ID NO: 396909 - DNA, 20 bp, Artificial
  CRISPR gRNA sequence
ttaccatcagagtctctaaa

SEQ ID NO: 396910 - DNA, 20 bp, Artificial
  CRISPR gRNA sequence
accatcagagtctctaaatc

SEQ ID NO: 396911 - DNA, 20 bp, Artificial
  CRISPR gRNA sequence
ccatcagagtctctaaatca

SEQ ID NO: 396912 - DNA, 20 bp, Artificial
  CRISPR gRNA sequence
taaatcaattgctaatgaag

SEQ ID NO: 396913 - DNA, 20 bp, Artificial
  CRISPR gRNA sequence
aatcaattgctaatgaagaa

SEQ ID NO: 396914 - DNA, 20 bp, Artificial
  CRISPR gRNA sequence
ctaatgaagaaatgcctgtt

SEQ ID NO: 396915 - DNA, 20 bp, Artificial
  CRISPR gRNA sequence
atgaagaaatgcctgttctg

SEQ ID NO: 396916 - DNA, 20 bp, Artificial
  CRISPR gRNA sequence
ttctggaaagaacacatatt

SEQ ID NO: 396917 - DNA, 20 bp, Artificial
  CRISPR gRNA sequence
tggaaagaacacatattttc

SEQ ID NO: 396918 - DNA, 20 bp, Artificial
  CRISPR gRNA sequence
gaaagaacacatattttcaa

SEQ ID NO: 396919 - DNA, 20 bp, Artificial
  CRISPR gRNA sequence
tcaaataactttgtattagt

SEQ ID NO: 396920 - DNA, 20 bp, Artificial
  CRISPR gRNA sequence
caaataactttgtattagta

SEQ ID NO: 396921 - DNA, 20 bp, Artificial
  CRISPR gRNA sequence
aaataactttgtattagtag

SEQ ID NO: 396922 - DNA, 20 bp, Artificial
  CRISPR gRNA sequence
tgtattagtagtaccattta

SEQ ID NO: 396923 - DNA, 20 bp, Artificial
  CRISPR gRNA sequence
gtattagtagtaccatttat

SEQ ID NO: 396924 - DNA, 20 bp, Artificial
  CRISPR gRNA sequence
tattagtagtaccatttatt

SEQ ID NO: 396925 - DNA, 20 bp, Artificial
  CRISPR gRNA sequence
gtagtaccatttattcagaa

SEQ ID NO: 396926 - DNA, 20 bp, Artificial
  CRISPR gRNA sequence
attcagaataagatgtcctg

SEQ ID NO: 396927 - DNA, 20 bp, Artificial
  CRISPR gRNA sequence
ttcagaataagatgtcctgt

SEQ ID NO: 396928 - DNA, 20 bp, Artificial
  CRISPR gRNA sequence
agaataagatgtcctgtttg

SEQ ID NO: 396929 - DNA, 20 bp, Artificial
  CRISPR gRNA sequence
tttgctcttaaactctaggc

SEQ ID NO: 396930 - DNA, 20 bp, Artificial
  CRISPR gRNA sequence
gctcttaaactctaggctga

SEQ ID NO: 396931 - DNA, 20 bp, Artificial
  CRISPR gRNA sequence
ctcttaaactctaggctgaa

SEQ ID NO: 396932 - DNA, 20 bp, Artificial
  CRISPR gRNA sequence
ttaaactctaggctgaaagc

SEQ ID NO: 396933 - DNA, 20 bp, Artificial
  CRISPR gRNA sequence
aaactctaggctgaaagctg

SEQ ID NO: 396934 - DNA, 20 bp, Artificial
  CRISPR gRNA sequence
aactctaggctgaaagctgg

SEQ ID NO: 396935 - DNA, 20 bp, Artificial
  CRISPR gRNA sequence
taggctgaaagctggagagg

SEQ ID NO: 396936 - DNA, 20 bp, Artificial
  CRISPR gRNA sequence
ggctgaaagctggagagggg

SEQ ID NO: 396937 - DNA, 20 bp, Artificial
  CRISPR gRNA sequence
aaagctggagaggggtagca

SEQ ID NO: 396938 - DNA, 20 bp, Artificial
  CRISPR gRNA sequence
gagaggggtagcattgatag

SEQ ID NO: 396939 - DNA, 20 bp, Artificial
  CRISPR gRNA sequence
ataggaggtacaaaggccaa

SEQ ID NO: 396940 - DNA, 20 bp, Artificial
  CRISPR gRNA sequence
cttcttcaagggccctggtg

SEQ ID NO: 396941 - DNA, 20 bp, Artificial
  CRISPR gRNA sequence
cttcaagggccctggtgggt

SEQ ID NO: 396942 - DNA, 20 bp, Artificial
  CRISPR gRNA sequence
ttcaagggccctggtgggtt

SEQ ID NO: 396943 - DNA, 20 bp, Artificial
  CRISPR gRNA sequence
caagggccctggtgggttcc

SEQ ID NO: 396944 - DNA, 20 bp, Artificial
  CRISPR gRNA sequence
aagggccctggtgggttccc

SEQ ID NO: 396945 - DNA, 20 bp, Artificial
  CRISPR gRNA sequence
gtgggttcccatgtccccca

SEQ ID NO: 396946 - DNA, 20 bp, Artificial
  CRISPR gRNA sequence
ccatgtcccccaggctgaca

SEQ ID NO: 396947 - DNA, 20 bp, Artificial
  CRISPR gRNA sequence
acagttacatcaatttgcaa

SEQ ID NO: 396948 - DNA, 20 bp, Artificial
  CRISPR gRNA sequence
catcaatttgcaactttatc

SEQ ID NO: 396949 - DNA, 20 bp, Artificial
  CRISPR gRNA sequence
gcaactttatctgctgggac

SEQ ID NO: 396950 - DNA, 20 bp, Artificial
  CRISPR gRNA sequence
caactttatctgctgggaca

SEQ ID NO: 396951 - DNA, 20 bp, Artificial
  CRISPR gRNA sequence
tatctgctgggacatacgtg

SEQ ID NO: 396952 - DNA, 20 bp, Artificial
  CRISPR gRNA sequence
atctgctgggacatacgtga

SEQ ID NO: 396953 - DNA, 20 bp, Artificial
  CRISPR gRNA sequence
tctgctgggacatacgtgaa

SEQ ID NO: 396954 - DNA, 20 bp, Artificial
  CRISPR gRNA sequence
ctgggacatacgtgaaactt

SEQ ID NO: 396955 - DNA, 20 bp, Artificial
  CRISPR gRNA sequence
ggacatacgtgaaacttagg

SEQ ID NO: 396956 - DNA, 20 bp, Artificial
  CRISPR gRNA sequence
agggccttggaaagactact

SEQ ID NO: 396957 - DNA, 20 bp, Artificial
  CRISPR gRNA sequence
gggccttggaaagactacta

SEQ ID NO: 396958 - DNA, 20 bp, Artificial
  CRISPR gRNA sequence
ggaaagactactagacctca

SEQ ID NO: 396959 - DNA, 20 bp, Artificial
  CRISPR gRNA sequence
gaaagactactagacctcac

SEQ ID NO: 396960 - DNA, 20 bp, Artificial
  CRISPR gRNA sequence
ctagacctcactgcacttca

SEQ ID NO: 396961 - DNA, 20 bp, Artificial
  CRISPR gRNA sequence
gacctcactgcacttcaatg

SEQ ID NO: 396962 - DNA, 20 bp, Artificial
  CRISPR gRNA sequence
actgcacttcaatgtcatca

SEQ ID NO: 396963 - DNA, 20 bp, Artificial
  CRISPR gRNA sequence
cacttcaatgtcatcatctg

SEQ ID NO: 396964 - DNA, 20 bp, Artificial
  CRISPR gRNA sequence
caatgtcatcatctgtaaaa

SEQ ID NO: 396965 - DNA, 20 bp, Artificial
  CRISPR gRNA sequence
aatgtcatcatctgtaaaat

SEQ ID NO: 396966 - DNA, 20 bp, Artificial
  CRISPR gRNA sequence
taaaatcaggcaatacaaac

SEQ ID NO: 396967 - DNA, 20 bp, Artificial
  CRISPR gRNA sequence
aagtgcacacaggagattca

SEQ ID NO: 396968 - DNA, 20 bp, Artificial
  CRISPR gRNA sequence
aaggaggaagtctatgaaga

SEQ ID NO: 396969 - DNA, 20 bp, Artificial
  CRISPR gRNA sequence
tgaagatccagactatgtaa

SEQ ID NO: 396970 - DNA, 20 bp, Artificial
  CRISPR gRNA sequence
tgtaaaattccgcacataat

SEQ ID NO: 396971 - DNA, 20 bp, Artificial
  CRISPR gRNA sequence
cgcacataataagctatcaa

SEQ ID NO: 396972 - DNA, 20 bp, Artificial
  CRISPR gRNA sequence
tcaataaatagcaaaaaatc

SEQ ID NO: 396973 - DNA, 20 bp, Artificial
  CRISPR gRNA sequence
acagagcatagggcccaact

SEQ ID NO: 396974 - DNA, 20 bp, Artificial
  CRISPR gRNA sequence
cagagcatagggcccaactc

SEQ ID NO: 396975 - DNA, 20 bp, Artificial
  CRISPR gRNA sequence
cttcatccttctgaagttct

SEQ ID NO: 396976 - DNA, 20 bp, Artificial
  CRISPR gRNA sequence
catccttctgaagttcttac

SEQ ID NO: 396977 - DNA, 20 bp, Artificial
  CRISPR gRNA sequence
atccttctgaagttcttaca

SEQ ID NO: 396978 - DNA, 20 bp, Artificial
  CRISPR gRNA sequence
ctgaagttcttacaatccat

SEQ ID NO: 396979 - DNA, 20 bp, Artificial
  CRISPR gRNA sequence
tgaagttcttacaatccatt

SEQ ID NO: 396980 - DNA, 20 bp, Artificial
  CRISPR gRNA sequence
aagttcttacaatccattat

SEQ ID NO: 396981 - DNA, 20 bp, Artificial
  CRISPR gRNA sequence
ttacaatccattatacaaac

SEQ ID NO: 396982 - DNA, 20 bp, Artificial
  CRISPR gRNA sequence
acaatccattatacaaacta

SEQ ID NO: 396983 - DNA, 20 bp, Artificial
  CRISPR gRNA sequence
caatccattatacaaactag

SEQ ID NO: 396984 - DNA, 20 bp, Artificial
  CRISPR gRNA sequence
tacaaactaggatttctaga

SEQ ID NO: 396985 - DNA, 20 bp, Artificial
  CRISPR gRNA sequence
ggatttctagattccaagtc

SEQ ID NO: 396986 - DNA, 20 bp, Artificial
  CRISPR gRNA sequence
ctagattccaagtctttttt

SEQ ID NO: 396987 - DNA, 20 bp, Artificial
  CRISPR gRNA sequence
tagattccaagtcttttttt

SEQ ID NO: 396988 - DNA, 20 bp, Artificial
  CRISPR gRNA sequence
gattccaagtcttttttttt

SEQ ID NO: 396989 - DNA, 20 bp, Artificial
  CRISPR gRNA sequence
caagtctttttttttttttt

SEQ ID NO: 396990 - DNA, 20 bp, Artificial
  CRISPR gRNA sequence
tttttttttttttttactat

SEQ ID NO: 396991 - DNA, 20 bp, Artificial
  CRISPR gRNA sequence
ttttttttttttttactatt

SEQ ID NO: 396992 - DNA, 20 bp, Artificial
  CRISPR gRNA sequence
tttttttttttttactattt

SEQ ID NO: 396993 - DNA, 20 bp, Artificial
  CRISPR gRNA sequence
ttttttttttttactattta

SEQ ID NO: 396994 - DNA, 20 bp, Artificial
  CRISPR gRNA sequence
tttttttttttactatttaa

SEQ ID NO: 396995 - DNA, 20 bp, Artificial
  CRISPR gRNA sequence
ttttttttttactatttaat

SEQ ID NO: 396996 - DNA, 20 bp, Artificial
  CRISPR gRNA sequence
tttttttttactatttaatg

SEQ ID NO: 396997 - DNA, 20 bp, Artificial
  CRISPR gRNA sequence
ttttttttactatttaatgt

SEQ ID NO: 396998 - DNA, 20 bp, Artificial
  CRISPR gRNA sequence
tttttttactatttaatgta

SEQ ID NO: 396999 - DNA, 20 bp, Artificial
  CRISPR gRNA sequence
ttttttactatttaatgtat

SEQ ID NO: 397000 - DNA, 20 bp, Artificial
  CRISPR gRNA sequence
tttttactatttaatgtatt

SEQ ID NO: 397001 - DNA, 20 bp, Artificial
  CRISPR gRNA sequence
ttttactatttaatgtattt

SEQ ID NO: 397002 - DNA, 20 bp, Artificial
  CRISPR gRNA sequence
tttactatttaatgtatttt

SEQ ID NO: 397003 - DNA, 20 bp, Artificial
  CRISPR gRNA sequence
ttactatttaatgtattttc

SEQ ID NO: 397004 - DNA, 20 bp, Artificial
  CRISPR gRNA sequence
tactatttaatgtattttca

SEQ ID NO: 397005 - DNA, 20 bp, Artificial
  CRISPR gRNA sequence
actatttaatgtattttcaa

SEQ ID NO: 397006 - DNA, 20 bp, Artificial
  CRISPR gRNA sequence
ctatttaatgtattttcaac

SEQ ID NO: 397007 - DNA, 20 bp, Artificial
  CRISPR gRNA sequence
tttaatgtattttcaactcc

SEQ ID NO: 397008 - DNA, 20 bp, Artificial
  CRISPR gRNA sequence
aatgtattttcaactccccc

SEQ ID NO: 397009 - DNA, 20 bp, Artificial
  CRISPR gRNA sequence
atgtattttcaactccccct

SEQ ID NO: 397010 - DNA, 20 bp, Artificial
  CRISPR gRNA sequence
tcaactccccctttacagta

SEQ ID NO: 397011 - DNA, 20 bp, Artificial
  CRISPR gRNA sequence
caactccccctttacagtat

SEQ ID NO: 397012 - DNA, 20 bp, Artificial
  CRISPR gRNA sequence
aactccccctttacagtata

SEQ ID NO: 397013 - DNA, 20 bp, Artificial
  CRISPR gRNA sequence
cccctttacagtatacaaaa

SEQ ID NO: 397014 - DNA, 20 bp, Artificial
  CRISPR gRNA sequence
tacagtatacaaaagtacaa

SEQ ID NO: 397015 - DNA, 20 bp, Artificial
  CRISPR gRNA sequence
acagtatacaaaagtacaat

SEQ ID NO: 397016 - DNA, 20 bp, Artificial
  CRISPR gRNA sequence
cagtatacaaaagtacaata

SEQ ID NO: 397017 - DNA, 20 bp, Artificial
  CRISPR gRNA sequence
gcaatcccagtatgttgtta

SEQ ID NO: 397018 - DNA, 20 bp, Artificial
  CRISPR gRNA sequence
caatcccagtatgttgttac

SEQ ID NO: 397019 - DNA, 20 bp, Artificial
  CRISPR gRNA sequence
ttactgaagtacataagaaa

SEQ ID NO: 397020 - DNA, 20 bp, Artificial
  CRISPR gRNA sequence
ctgaagtacataagaaaatt

SEQ ID NO: 397021 - DNA, 20 bp, Artificial
  CRISPR gRNA sequence
aagtacataagaaaatttca

SEQ ID NO: 397022 - DNA, 20 bp, Artificial
  CRISPR gRNA sequence
caagcacacctaaggttaat

SEQ ID NO: 397023 - DNA, 20 bp, Artificial
  CRISPR gRNA sequence
aagcacacctaaggttaatt

SEQ ID NO: 397024 - DNA, 20 bp, Artificial
  CRISPR gRNA sequence
aggttaattttgaaatacaa

SEQ ID NO: 397025 - DNA, 20 bp, Artificial
  CRISPR gRNA sequence
attttgaaatacaactaata

SEQ ID NO: 397026 - DNA, 20 bp, Artificial
  CRISPR gRNA sequence
tgaaatacaactaatatttt

SEQ ID NO: 397027 - DNA, 20 bp, Artificial
  CRISPR gRNA sequence
gaaatacaactaatattttt

SEQ ID NO: 397028 - DNA, 20 bp, Artificial
  CRISPR gRNA sequence
aaatacaactaatatttttt

SEQ ID NO: 397029 - DNA, 20 bp, Artificial
  CRISPR gRNA sequence
atattttttaaactcactat

SEQ ID NO: 397030 - DNA, 20 bp, Artificial
  CRISPR gRNA sequence
tttaaactcactatcattct

SEQ ID NO: 397031 - DNA, 20 bp, Artificial
  CRISPR gRNA sequence
ttaaactcactatcattctt

SEQ ID NO: 397032 - DNA, 20 bp, Artificial
  CRISPR gRNA sequence
taaactcactatcattctta

SEQ ID NO: 397033 - DNA, 20 bp, Artificial
  CRISPR gRNA sequence
aaactcactatcattcttag

SEQ ID NO: 397034 - DNA, 20 bp, Artificial
  CRISPR gRNA sequence
aactcactatcattcttagt

SEQ ID NO: 397035 - DNA, 20 bp, Artificial
  CRISPR gRNA sequence
actatcattcttagtttaaa

SEQ ID NO: 397036 - DNA, 20 bp, Artificial
  CRISPR gRNA sequence
tcattcttagtttaaaaaag

SEQ ID NO: 397037 - DNA, 20 bp, Artificial
  CRISPR gRNA sequence
ttagtttaaaaaagtgaagc

SEQ ID NO: 397038 - DNA, 20 bp, Artificial
  CRISPR gRNA sequence
agtttaaaaaagtgaagctc

SEQ ID NO: 397039 - DNA, 20 bp, Artificial
  CRISPR gRNA sequence
gtttaaaaaagtgaagctct

SEQ ID NO: 397040 - DNA, 20 bp, Artificial
  CRISPR gRNA sequence
aaaaaagtgaagctctcaaa

SEQ ID NO: 397041 - DNA, 20 bp, Artificial
  CRISPR gRNA sequence
aaaaagtgaagctctcaaac

SEQ ID NO: 397042 - DNA, 20 bp, Artificial
  CRISPR gRNA sequence
tcaaactctcaaaatagggt

SEQ ID NO: 397043 - DNA, 20 bp, Artificial
  CRISPR gRNA sequence
aaactctcaaaatagggtag

SEQ ID NO: 397044 - DNA, 20 bp, Artificial
  CRISPR gRNA sequence
tcaaaatagggtagaatgcc

SEQ ID NO: 397045 - DNA, 20 bp, Artificial
  CRISPR gRNA sequence
aaaatagggtagaatgccct

SEQ ID NO: 397046 - DNA, 20 bp, Artificial
  CRISPR gRNA sequence
actagcccattgcatcaatc

SEQ ID NO: 397047 - DNA, 20 bp, Artificial
  CRISPR gRNA sequence
gcccattgcatcaatctgct

SEQ ID NO: 397048 - DNA, 20 bp, Artificial
  CRISPR gRNA sequence
catcaatctgctctttaaaa

SEQ ID NO: 397049 - DNA, 20 bp, Artificial
  CRISPR gRNA sequence
ctctttaaaatacaaataat

SEQ ID NO: 397050 - DNA, 20 bp, Artificial
  CRISPR gRNA sequence
tttaaaatacaaataatcaa

SEQ ID NO: 397051 - DNA, 20 bp, Artificial
  CRISPR gRNA sequence
taaaatacaaataatcaaaa

SEQ ID NO: 397052 - DNA, 20 bp, Artificial
  CRISPR gRNA sequence
aaaatacaaataatcaaaac

SEQ ID NO: 397053 - DNA, 20 bp, Artificial
  CRISPR gRNA sequence
aaatacaaataatcaaaaca

SEQ ID NO: 397054 - DNA, 20 bp, Artificial
  CRISPR gRNA sequence
aggataccatcatgaagaat

SEQ ID NO: 397055 - DNA, 20 bp, Artificial
  CRISPR gRNA sequence
aaactagacggacagccggt

SEQ ID NO: 397056 - DNA, 20 bp, Artificial
  CRISPR gRNA sequence
gacggacagccggtattcct

SEQ ID NO: 397057 - DNA, 20 bp, Artificial
  CRISPR gRNA sequence
cttcctctgactgaaaactg

SEQ ID NO: 397058 - DNA, 20 bp, Artificial
  CRISPR gRNA sequence
cctctgactgaaaactgact

SEQ ID NO: 397059 - DNA, 20 bp, Artificial
  CRISPR gRNA sequence
ctctgactgaaaactgactg

SEQ ID NO: 397060 - DNA, 20 bp, Artificial
  CRISPR gRNA sequence
tgactgaaaactgactgaaa

SEQ ID NO: 397061 - DNA, 20 bp, Artificial
  CRISPR gRNA sequence
actgaaaactgactgaaaat

SEQ ID NO: 397062 - DNA, 20 bp, Artificial
  CRISPR gRNA sequence
aaaactgactgaaaatctcc

SEQ ID NO: 397063 - DNA, 20 bp, Artificial
  CRISPR gRNA sequence
actgaaaatctccacattgt

SEQ ID NO: 397064 - DNA, 20 bp, Artificial
  CRISPR gRNA sequence
aaaatctccacattgtattt

SEQ ID NO: 397065 - DNA, 20 bp, Artificial
  CRISPR gRNA sequence
cacattgtatttttttaagc

SEQ ID NO: 397066 - DNA, 20 bp, Artificial
  CRISPR gRNA sequence
tatttttttaagccccatga

SEQ ID NO: 397067 - DNA, 20 bp, Artificial
  CRISPR gRNA sequence
ttttaagccccatgaaggtg

SEQ ID NO: 397068 - DNA, 20 bp, Artificial
  CRISPR gRNA sequence
tttaagccccatgaaggtga

SEQ ID NO: 397069 - DNA, 20 bp, Artificial
  CRISPR gRNA sequence
ttaagccccatgaaggtgac

SEQ ID NO: 397070 - DNA, 20 bp, Artificial
  CRISPR gRNA sequence
taagccccatgaaggtgaca

SEQ ID NO: 397071 - DNA, 20 bp, Artificial
  CRISPR gRNA sequence
aagccccatgaaggtgacag

SEQ ID NO: 397072 - DNA, 20 bp, Artificial
  CRISPR gRNA sequence
agccccatgaaggtgacagc

SEQ ID NO: 397073 - DNA, 20 bp, Artificial
  CRISPR gRNA sequence
tcttttcctaacctcaaaaa

SEQ ID NO: 397074 - DNA, 20 bp, Artificial
  CRISPR gRNA sequence
ttttcctaacctcaaaaact

SEQ ID NO: 397075 - DNA, 20 bp, Artificial
  CRISPR gRNA sequence
ttcctaacctcaaaaactag

SEQ ID NO: 397076 - DNA, 20 bp, Artificial
  CRISPR gRNA sequence
tcctaacctcaaaaactagc

SEQ ID NO: 397077 - DNA, 20 bp, Artificial
  CRISPR gRNA sequence
cctaacctcaaaaactagca

SEQ ID NO: 397078 - DNA, 20 bp, Artificial
  CRISPR gRNA sequence
ctaacctcaaaaactagcag

SEQ ID NO: 397079 - DNA, 20 bp, Artificial
  CRISPR gRNA sequence
acctcaaaaactagcagtaa

SEQ ID NO: 397080 - DNA, 20 bp, Artificial
  CRISPR gRNA sequence
aaaaactagcagtaatgaca

SEQ ID NO: 397081 - DNA, 20 bp, Artificial
  CRISPR gRNA sequence
gcagtaatgacaaatctgga

SEQ ID NO: 397082 - DNA, 20 bp, Artificial
  CRISPR gRNA sequence
gatgaaaacaacaggaaata

SEQ ID NO: 397083 - DNA, 20 bp, Artificial
  CRISPR gRNA sequence
cgaagactattcatatgtga

SEQ ID NO: 397084 - DNA, 20 bp, Artificial
  CRISPR gRNA sequence
ttcatatgtgatgttaaaaa

SEQ ID NO: 397085 - DNA, 20 bp, Artificial
  CRISPR gRNA sequence
atatgtgatgttaaaaatcc

SEQ ID NO: 397086 - DNA, 20 bp, Artificial
  CRISPR gRNA sequence
aaaatcctacctttgcataa

SEQ ID NO: 397087 - DNA, 20 bp, Artificial
  CRISPR gRNA sequence
cctttgcataacaaccatca

SEQ ID NO: 397088 - DNA, 20 bp, Artificial
  CRISPR gRNA sequence
tgcataacaaccatcattta

SEQ ID NO: 397089 - DNA, 20 bp, Artificial
  CRISPR gRNA sequence
gcataacaaccatcatttag

SEQ ID NO: 397090 - DNA, 20 bp, Artificial
  CRISPR gRNA sequence
cataacaaccatcatttagt

SEQ ID NO: 397091 - DNA, 20 bp, Artificial
  CRISPR gRNA sequence
agttctctacaggttagctc

SEQ ID NO: 397092 - DNA, 20 bp, Artificial
  CRISPR gRNA sequence
gttctctacaggttagctcc

SEQ ID NO: 397093 - DNA, 20 bp, Artificial
  CRISPR gRNA sequence
tctacaggttagctccatcc

SEQ ID NO: 397094 - DNA, 20 bp, Artificial
  CRISPR gRNA sequence
tacaggttagctccatcctc

SEQ ID NO: 397095 - DNA, 20 bp, Artificial
  CRISPR gRNA sequence
caggttagctccatcctcta

SEQ ID NO: 397096 - DNA, 20 bp, Artificial
  CRISPR gRNA sequence
gctccatcctctatcctgaa

SEQ ID NO: 397097 - DNA, 20 bp, Artificial
  CRISPR gRNA sequence
catcctctatcctgaaaggt

SEQ ID NO: 397098 - DNA, 20 bp, Artificial
  CRISPR gRNA sequence
tatcctgaaaggttgagctg

SEQ ID NO: 397099 - DNA, 20 bp, Artificial
  CRISPR gRNA sequence
tcctgaaaggttgagctgtt

SEQ ID NO: 397100 - DNA, 20 bp, Artificial
  CRISPR gRNA sequence
aaaggttgagctgttttcaa

SEQ ID NO: 397101 - DNA, 20 bp, Artificial
  CRISPR gRNA sequence
agctgttttcaattggttgt

SEQ ID NO: 397102 - DNA, 20 bp, Artificial
  CRISPR gRNA sequence
ttttcaattggttgtcctgt

SEQ ID NO: 397103 - DNA, 20 bp, Artificial
  CRISPR gRNA sequence
tcaattggttgtcctgtgac

SEQ ID NO: 397104 - DNA, 20 bp, Artificial
  CRISPR gRNA sequence
caattggttgtcctgtgaca

SEQ ID NO: 397105 - DNA, 20 bp, Artificial
  CRISPR gRNA sequence
aattggttgtcctgtgacag

SEQ ID NO: 397106 - DNA, 20 bp, Artificial
  CRISPR gRNA sequence
gttgtcctgtgacagaaacc

SEQ ID NO: 397107 - DNA, 20 bp, Artificial
  CRISPR gRNA sequence
tcctgtgacagaaaccaaaa

SEQ ID NO: 397108 - DNA, 20 bp, Artificial
  CRISPR gRNA sequence
tgacagaaaccaaaacagct

SEQ ID NO: 397109 - DNA, 20 bp, Artificial
  CRISPR gRNA sequence
atttggaacccaaactttaa

SEQ ID NO: 397110 - DNA, 20 bp, Artificial
  CRISPR gRNA sequence
ggaacccaaactttaaaggc

SEQ ID NO: 397111 - DNA, 20 bp, Artificial
  CRISPR gRNA sequence
gaacccaaactttaaaggca

SEQ ID NO: 397112 - DNA, 20 bp, Artificial
  CRISPR gRNA sequence
taaaggcataccacacaagg

SEQ ID NO: 397113 - DNA, 20 bp, Artificial
  CRISPR gRNA sequence
aaaggcataccacacaaggc

SEQ ID NO: 397114 - DNA, 20 bp, Artificial
  CRISPR gRNA sequence
aaggcataccacacaaggca

SEQ ID NO: 397115 - DNA, 20 bp, Artificial
  CRISPR gRNA sequence
ttctagctttggtggctcag

SEQ ID NO: 397116 - DNA, 20 bp, Artificial
  CRISPR gRNA sequence
tagctttggtggctcaggcc

SEQ ID NO: 397117 - DNA, 20 bp, Artificial
  CRISPR gRNA sequence
gctttggtggctcaggcctt

SEQ ID NO: 397118 - DNA, 20 bp, Artificial
  CRISPR gRNA sequence
tggtggctcaggccttgttt

SEQ ID NO: 397119 - DNA, 20 bp, Artificial
  CRISPR gRNA sequence
ggtggctcaggccttgtttc

SEQ ID NO: 397120 - DNA, 20 bp, Artificial
  CRISPR gRNA sequence
gtggctcaggccttgtttcc

SEQ ID NO: 397121 - DNA, 20 bp, Artificial
  CRISPR gRNA sequence
aggccttgtttccaatggct

SEQ ID NO: 397122 - DNA, 20 bp, Artificial
  CRISPR gRNA sequence
gtttccaatggctcagtcta

SEQ ID NO: 397123 - DNA, 20 bp, Artificial
  CRISPR gRNA sequence
tttccaatggctcagtctat

SEQ ID NO: 397124 - DNA, 20 bp, Artificial
  CRISPR gRNA sequence
ccaatggctcagtctatgtt

SEQ ID NO: 397125 - DNA, 20 bp, Artificial
  CRISPR gRNA sequence
caatggctcagtctatgtta

SEQ ID NO: 397126 - DNA, 20 bp, Artificial
  CRISPR gRNA sequence
agtctatgttaaaagctttg

SEQ ID NO: 397127 - DNA, 20 bp, Artificial
  CRISPR gRNA sequence
tgttaaaagctttgccaatc

SEQ ID NO: 397128 - DNA, 20 bp, Artificial
  CRISPR gRNA sequence
aaagctttgccaatcttcta

SEQ ID NO: 397129 - DNA, 20 bp, Artificial
  CRISPR gRNA sequence
tgccaatcttctacttcgcc

SEQ ID NO: 397130 - DNA, 20 bp, Artificial
  CRISPR gRNA sequence
gccaatcttctacttcgcct

SEQ ID NO: 397131 - DNA, 20 bp, Artificial
  CRISPR gRNA sequence
ccaatcttctacttcgcctg

SEQ ID NO: 397132 - DNA, 20 bp, Artificial
  CRISPR gRNA sequence
ctacttcgcctgcctgactg

SEQ ID NO: 397133 - DNA, 20 bp, Artificial
  CRISPR gRNA sequence
tacttcgcctgcctgactga

SEQ ID NO: 397134 - DNA, 20 bp, Artificial
  CRISPR gRNA sequence
cttcgcctgcctgactgatt

SEQ ID NO: 397135 - DNA, 20 bp, Artificial
  CRISPR gRNA sequence
cgcctgcctgactgatttat

SEQ ID NO: 397136 - DNA, 20 bp, Artificial
  CRISPR gRNA sequence
gcctgcctgactgatttata

SEQ ID NO: 397137 - DNA, 20 bp, Artificial
  CRISPR gRNA sequence
cctgactgatttatagcaaa

SEQ ID NO: 397138 - DNA, 20 bp, Artificial
  CRISPR gRNA sequence
actgatttatagcaaactac

SEQ ID NO: 397139 - DNA, 20 bp, Artificial
  CRISPR gRNA sequence
atttatagcaaactacacag

SEQ ID NO: 397140 - DNA, 20 bp, Artificial
  CRISPR gRNA sequence
atagcaaactacacagtaaa

SEQ ID NO: 397141 - DNA, 20 bp, Artificial
  CRISPR gRNA sequence
tagcaaactacacagtaaaa

SEQ ID NO: 397142 - DNA, 20 bp, Artificial
  CRISPR gRNA sequence
cacagtaaaaacttccaagc

SEQ ID NO: 397143 - DNA, 20 bp, Artificial
  CRISPR gRNA sequence
ccaagcaggatttaacaggt

SEQ ID NO: 397144 - DNA, 20 bp, Artificial
  CRISPR gRNA sequence
caagcaggatttaacaggtg

SEQ ID NO: 397145 - DNA, 20 bp, Artificial
  CRISPR gRNA sequence
aacaggtgtctacatacaac

SEQ ID NO: 397146 - DNA, 20 bp, Artificial
  CRISPR gRNA sequence
acaggtgtctacatacaaca

SEQ ID NO: 397147 - DNA, 20 bp, Artificial
  CRISPR gRNA sequence
catacaacagcaaatgagga

SEQ ID NO: 397148 - DNA, 20 bp, Artificial
  CRISPR gRNA sequence
gtatggtgaaacagagtctt

SEQ ID NO: 397149 - DNA, 20 bp, Artificial
  CRISPR gRNA sequence
tatggtgaaacagagtcttt

SEQ ID NO: 397150 - DNA, 20 bp, Artificial
  CRISPR gRNA sequence
taataaataaacatttaact

SEQ ID NO: 397151 - DNA, 20 bp, Artificial
  CRISPR gRNA sequence
aataaataaacatttaacta

SEQ ID NO: 397152 - DNA, 20 bp, Artificial
  CRISPR gRNA sequence
ataaataaacatttaactaa

SEQ ID NO: 397153 - DNA, 20 bp, Artificial
  CRISPR gRNA sequence
aactaaagaaacattgtaaa

SEQ ID NO: 397154 - DNA, 20 bp, Artificial
  CRISPR gRNA sequence
actaaagaaacattgtaaat

SEQ ID NO: 397155 - DNA, 20 bp, Artificial
  CRISPR gRNA sequence
aagaaacattgtaaattgac

SEQ ID NO: 397156 - DNA, 20 bp, Artificial
  CRISPR gRNA sequence
taaattgacactctataagc

SEQ ID NO: 397157 - DNA, 20 bp, Artificial
  CRISPR gRNA sequence
acactctataagcctcagct

SEQ ID NO: 397158 - DNA, 20 bp, Artificial
  CRISPR gRNA sequence
tataagcctcagctatatac

SEQ ID NO: 397159 - DNA, 20 bp, Artificial
  CRISPR gRNA sequence
taagcctcagctatatacac

SEQ ID NO: 397160 - DNA, 20 bp, Artificial
  CRISPR gRNA sequence
agctatatacacaaaattag

SEQ ID NO: 397161 - DNA, 20 bp, Artificial
  CRISPR gRNA sequence
tatacacaaaattagtcttc

SEQ ID NO: 397162 - DNA, 20 bp, Artificial
  CRISPR gRNA sequence
gtcttcaccctagctacacc

SEQ ID NO: 397163 - DNA, 20 bp, Artificial
  CRISPR gRNA sequence
caccctagctacacctaaag

SEQ ID NO: 397164 - DNA, 20 bp, Artificial
  CRISPR gRNA sequence
accctagctacacctaaaga

SEQ ID NO: 397165 - DNA, 20 bp, Artificial
  CRISPR gRNA sequence
gctacacctaaagagaaagg

SEQ ID NO: 397166 - DNA, 20 bp, Artificial
  CRISPR gRNA sequence
cacctaaagagaaagggaaa

SEQ ID NO: 397167 - DNA, 20 bp, Artificial
  CRISPR gRNA sequence
aagagaaagggaaaactaaa

SEQ ID NO: 397168 - DNA, 20 bp, Artificial
  CRISPR gRNA sequence
aatatatgaagatgtttctt

SEQ ID NO: 397169 - DNA, 20 bp, Artificial
  CRISPR gRNA sequence
cttatctcctgaccatttga

SEQ ID NO: 397170 - DNA, 20 bp, Artificial
  CRISPR gRNA sequence
ttatctcctgaccatttgat

SEQ ID NO: 397171 - DNA, 20 bp, Artificial
  CRISPR gRNA sequence
atctcctgaccatttgatat

SEQ ID NO: 397172 - DNA, 20 bp, Artificial
  CRISPR gRNA sequence
tctcctgaccatttgatatt

SEQ ID NO: 397173 - DNA, 20 bp, Artificial
  CRISPR gRNA sequence
ctgaccatttgatattcctc

SEQ ID NO: 397174 - DNA, 20 bp, Artificial
  CRISPR gRNA sequence
accatttgatattcctcata

SEQ ID NO: 397175 - DNA, 20 bp, Artificial
  CRISPR gRNA sequence
gatattcctcatataattct

SEQ ID NO: 397176 - DNA, 20 bp, Artificial
  CRISPR gRNA sequence
atattcctcatataattctg

SEQ ID NO: 397177 - DNA, 20 bp, Artificial
  CRISPR gRNA sequence
ctcatataattctgtacttg

SEQ ID NO: 397178 - DNA, 20 bp, Artificial
  CRISPR gRNA sequence
atataattctgtacttgttc

SEQ ID NO: 397179 - DNA, 20 bp, Artificial
  CRISPR gRNA sequence
tgtacttgttcttttagagc

SEQ ID NO: 397180 - DNA, 20 bp, Artificial
  CRISPR gRNA sequence
tacttgttcttttagagcac

SEQ ID NO: 397181 - DNA, 20 bp, Artificial
  CRISPR gRNA sequence
gttcttttagagcacagatc

SEQ ID NO: 397182 - DNA, 20 bp, Artificial
  CRISPR gRNA sequence
ttcttttagagcacagatcc

SEQ ID NO: 397183 - DNA, 20 bp, Artificial
  CRISPR gRNA sequence
ttttagagcacagatccctt

SEQ ID NO: 397184 - DNA, 20 bp, Artificial
  CRISPR gRNA sequence
ttagagcacagatcccttaa

SEQ ID NO: 397185 - DNA, 20 bp, Artificial
  CRISPR gRNA sequence
tagagcacagatcccttaaa

SEQ ID NO: 397186 - DNA, 20 bp, Artificial
  CRISPR gRNA sequence
agagcacagatcccttaaaa

SEQ ID NO: 397187 - DNA, 20 bp, Artificial
  CRISPR gRNA sequence
gagcacagatcccttaaaaa

SEQ ID NO: 397188 - DNA, 20 bp, Artificial
  CRISPR gRNA sequence
aaaaataaagcactattatg

SEQ ID NO: 397189 - DNA, 20 bp, Artificial
  CRISPR gRNA sequence
aaaataaagcactattatgt

SEQ ID NO: 397190 - DNA, 20 bp, Artificial
  CRISPR gRNA sequence
ttatgtcagatgtcataaaa

SEQ ID NO: 397191 - DNA, 20 bp, Artificial
  CRISPR gRNA sequence
tgtcagatgtcataaaatgt

SEQ ID NO: 397192 - DNA, 20 bp, Artificial
  CRISPR gRNA sequence
ttctctgtacagccatgagt

SEQ ID NO: 397193 - DNA, 20 bp, Artificial
  CRISPR gRNA sequence
ctctgtacagccatgagtat

SEQ ID NO: 397194 - DNA, 20 bp, Artificial
  CRISPR gRNA sequence
tctgtacagccatgagtata

SEQ ID NO: 397195 - DNA, 20 bp, Artificial
  CRISPR gRNA sequence
tgtacagccatgagtataat

SEQ ID NO: 397196 - DNA, 20 bp, Artificial
  CRISPR gRNA sequence
tacagccatgagtataattt

SEQ ID NO: 397197 - DNA, 20 bp, Artificial
  CRISPR gRNA sequence
gagagacaccacacaagaaa

SEQ ID NO: 397198 - DNA, 20 bp, Artificial
  CRISPR gRNA sequence
agagacaccacacaagaaac

SEQ ID NO: 397199 - DNA, 20 bp, Artificial
  CRISPR gRNA sequence
caaaaatattccctgcttta

SEQ ID NO: 397200 - DNA, 20 bp, Artificial
  CRISPR gRNA sequence
cctgctttagattgtcacta

SEQ ID NO: 397201 - DNA, 20 bp, Artificial
  CRISPR gRNA sequence
ctttagattgtcactaatat

SEQ ID NO: 397202 - DNA, 20 bp, Artificial
  CRISPR gRNA sequence
tagattgtcactaatatctg

SEQ ID NO: 397203 - DNA, 20 bp, Artificial
  CRISPR gRNA sequence
agattgtcactaatatctga

SEQ ID NO: 397204 - DNA, 20 bp, Artificial
  CRISPR gRNA sequence
gattgtcactaatatctgaa

SEQ ID NO: 397205 - DNA, 20 bp, Artificial
  CRISPR gRNA sequence
tcactaatatctgaaaattt

SEQ ID NO: 397206 - DNA, 20 bp, Artificial
  CRISPR gRNA sequence
atatctgaaaatttcattat

SEQ ID NO: 397207 - DNA, 20 bp, Artificial
  CRISPR gRNA sequence
aaaatttcattattagtcct

SEQ ID NO: 397208 - DNA, 20 bp, Artificial
  CRISPR gRNA sequence
cattattagtccttttggat

SEQ ID NO: 397209 - DNA, 20 bp, Artificial
  CRISPR gRNA sequence
attattagtccttttggatc

SEQ ID NO: 397210 - DNA, 20 bp, Artificial
  CRISPR gRNA sequence
ttagtccttttggatcacaa

SEQ ID NO: 397211 - DNA, 20 bp, Artificial
  CRISPR gRNA sequence
gtccttttggatcacaagca

SEQ ID NO: 397212 - DNA, 20 bp, Artificial
  CRISPR gRNA sequence
ttggatcacaagcataggaa

SEQ ID NO: 397213 - DNA, 20 bp, Artificial
  CRISPR gRNA sequence
tggatcacaagcataggaaa

SEQ ID NO: 397214 - DNA, 20 bp, Artificial
  CRISPR gRNA sequence
ggatcacaagcataggaaat

SEQ ID NO: 397215 - DNA, 20 bp, Artificial
  CRISPR gRNA sequence
gatcacaagcataggaaata

SEQ ID NO: 397216 - DNA, 20 bp, Artificial
  CRISPR gRNA sequence
tctgactaccatggaccaag

SEQ ID NO: 397217 - DNA, 20 bp, Artificial
  CRISPR gRNA sequence
tgactaccatggaccaagtt

SEQ ID NO: 397218 - DNA, 20 bp, Artificial
  CRISPR gRNA sequence
actaccatggaccaagttct

SEQ ID NO: 397219 - DNA, 20 bp, Artificial
  CRISPR gRNA sequence
ccatggaccaagttctttaa

SEQ ID NO: 397220 - DNA, 20 bp, Artificial
  CRISPR gRNA sequence
tttaaatatatcgtccctca

SEQ ID NO: 397221 - DNA, 20 bp, Artificial
  CRISPR gRNA sequence
taaatatatcgtccctcagc

SEQ ID NO: 397222 - DNA, 20 bp, Artificial
  CRISPR gRNA sequence
aaatatatcgtccctcagcc

SEQ ID NO: 397223 - DNA, 20 bp, Artificial
  CRISPR gRNA sequence
aatatatcgtccctcagcca

SEQ ID NO: 397224 - DNA, 20 bp, Artificial
  CRISPR gRNA sequence
agccattcaacaagtagaat

SEQ ID NO: 397225 - DNA, 20 bp, Artificial
  CRISPR gRNA sequence
aacaagtagaatggcactac

SEQ ID NO: 397226 - DNA, 20 bp, Artificial
  CRISPR gRNA sequence
ccaaccccatttcctcttca

SEQ ID NO: 397227 - DNA, 20 bp, Artificial
  CRISPR gRNA sequence
cctcttcaggaacctgagat

SEQ ID NO: 397228 - DNA, 20 bp, Artificial
  CRISPR gRNA sequence
ctcttcaggaacctgagatt

SEQ ID NO: 397229 - DNA, 20 bp, Artificial
  CRISPR gRNA sequence
ttcaggaacctgagattcag

SEQ ID NO: 397230 - DNA, 20 bp, Artificial
  CRISPR gRNA sequence
caggaacctgagattcagag

SEQ ID NO: 397231 - DNA, 20 bp, Artificial
  CRISPR gRNA sequence
aggaacctgagattcagagg

SEQ ID NO: 397232 - DNA, 20 bp, Artificial
  CRISPR gRNA sequence
agattcagagggatcgagca

SEQ ID NO: 397233 - DNA, 20 bp, Artificial
  CRISPR gRNA sequence
agagggatcgagcaactaac

SEQ ID NO: 397234 - DNA, 20 bp, Artificial
  CRISPR gRNA sequence
acaccaggttgatggaaagt

SEQ ID NO: 397235 - DNA, 20 bp, Artificial
  CRISPR gRNA sequence
atggaaagtgatgactataa

SEQ ID NO: 397236 - DNA, 20 bp, Artificial
  CRISPR gRNA sequence
taaacccaagtgtttccaat

SEQ ID NO: 397237 - DNA, 20 bp, Artificial
  CRISPR gRNA sequence
ccaatatactacaaccagtt

SEQ ID NO: 397238 - DNA, 20 bp, Artificial
  CRISPR gRNA sequence
caatatactacaaccagttc

SEQ ID NO: 397239 - DNA, 20 bp, Artificial
  CRISPR gRNA sequence
caaccagttcatgtagtcat

SEQ ID NO: 397240 - DNA, 20 bp, Artificial
  CRISPR gRNA sequence
atgtagtcatcactagaaag

SEQ ID NO: 397241 - DNA, 20 bp, Artificial
  CRISPR gRNA sequence
gaaagacaaaaccacaatct

SEQ ID NO: 397242 - DNA, 20 bp, Artificial
  CRISPR gRNA sequence
tggtagataaagcaaaaaac

SEQ ID NO: 397243 - DNA, 20 bp, Artificial
  CRISPR gRNA sequence
gtagataaagcaaaaaacac

SEQ ID NO: 397244 - DNA, 20 bp, Artificial
  CRISPR gRNA sequence
caagggatcattgggttctt

SEQ ID NO: 397245 - DNA, 20 bp, Artificial
  CRISPR gRNA sequence
ggttctttctgacaccacag

SEQ ID NO: 397246 - DNA, 20 bp, Artificial
  CRISPR gRNA sequence
tttctgacaccacagctcac

SEQ ID NO: 397247 - DNA, 20 bp, Artificial
  CRISPR gRNA sequence
tctgacaccacagctcacaa

SEQ ID NO: 397248 - DNA, 20 bp, Artificial
  CRISPR gRNA sequence
ctgacaccacagctcacaat

SEQ ID NO: 397249 - DNA, 20 bp, Artificial
  CRISPR gRNA sequence
tgacaccacagctcacaatt

SEQ ID NO: 397250 - DNA, 20 bp, Artificial
  CRISPR gRNA sequence
acaccacagctcacaattta

SEQ ID NO: 397251 - DNA, 20 bp, Artificial
  CRISPR gRNA sequence
acaatttatgaagaaagtgt

SEQ ID NO: 397252 - DNA, 20 bp, Artificial
  CRISPR gRNA sequence
atgaagaaagtgtcctctct

SEQ ID NO: 397253 - DNA, 20 bp, Artificial
  CRISPR gRNA sequence
tgaagaaagtgtcctctcta

SEQ ID NO: 397254 - DNA, 20 bp, Artificial
  CRISPR gRNA sequence
tctagctaaacctggatgag

SEQ ID NO: 397255 - DNA, 20 bp, Artificial
  CRISPR gRNA sequence
tagctaaacctggatgaggt

SEQ ID NO: 397256 - DNA, 20 bp, Artificial
  CRISPR gRNA sequence
gctaaacctggatgaggtga

SEQ ID NO: 397257 - DNA, 20 bp, Artificial
  CRISPR gRNA sequence
aacctggatgaggtgaaaga

SEQ ID NO: 397258 - DNA, 20 bp, Artificial
  CRISPR gRNA sequence
gatgaggtgaaagatagagc

SEQ ID NO: 397259 - DNA, 20 bp, Artificial
  CRISPR gRNA sequence
ggtggttcatgccagtaatc

SEQ ID NO: 397260 - DNA, 20 bp, Artificial
  CRISPR gRNA sequence
gtggttcatgccagtaatcc

SEQ ID NO: 397261 - DNA, 20 bp, Artificial
  CRISPR gRNA sequence
atgccagtaatcctggcact

SEQ ID NO: 397262 - DNA, 20 bp, Artificial
  CRISPR gRNA sequence
gcactctgggaggccgaggc

SEQ ID NO: 397263 - DNA, 20 bp, Artificial
  CRISPR gRNA sequence
tgggaggccgaggcagttgg

SEQ ID NO: 397264 - DNA, 20 bp, Artificial
  CRISPR gRNA sequence
ggaggccgaggcagttggat

SEQ ID NO: 397265 - DNA, 20 bp, Artificial
  CRISPR gRNA sequence
gatcacttgaactcaggagt

SEQ ID NO: 397266 - DNA, 20 bp, Artificial
  CRISPR gRNA sequence
gaactcaggagtccaagacc

SEQ ID NO: 397267 - DNA, 20 bp, Artificial
  CRISPR gRNA sequence
aactcaggagtccaagacca

SEQ ID NO: 397268 - DNA, 20 bp, Artificial
  CRISPR gRNA sequence
aggagtccaagaccagcctg

SEQ ID NO: 397269 - DNA, 20 bp, Artificial
  CRISPR gRNA sequence
ggcaacatgttgaaacctca

SEQ ID NO: 397270 - DNA, 20 bp, Artificial
  CRISPR gRNA sequence
aaacctcatctctacaaaaa

SEQ ID NO: 397271 - DNA, 20 bp, Artificial
  CRISPR gRNA sequence
atctctacaaaaaatacaac

SEQ ID NO: 397272 - DNA, 20 bp, Artificial
  CRISPR gRNA sequence
tacaaaaaatacaacaatca

SEQ ID NO: 397273 - DNA, 20 bp, Artificial
  CRISPR gRNA sequence
caaaaaatacaacaatcagc

SEQ ID NO: 397274 - DNA, 20 bp, Artificial
  CRISPR gRNA sequence
gcatggtgtattagtccgtt

SEQ ID NO: 397275 - DNA, 20 bp, Artificial
  CRISPR gRNA sequence
gtccgttttcaccctgctga

SEQ ID NO: 397276 - DNA, 20 bp, Artificial
  CRISPR gRNA sequence
tcaccctgctgatgaagata

SEQ ID NO: 397277 - DNA, 20 bp, Artificial
  CRISPR gRNA sequence
caccctgctgatgaagatat

SEQ ID NO: 397278 - DNA, 20 bp, Artificial
  CRISPR gRNA sequence
accctgctgatgaagatatt

SEQ ID NO: 397279 - DNA, 20 bp, Artificial
  CRISPR gRNA sequence
ctgatgaagatattcccaag

SEQ ID NO: 397280 - DNA, 20 bp, Artificial
  CRISPR gRNA sequence
atgaagatattcccaagact

SEQ ID NO: 397281 - DNA, 20 bp, Artificial
  CRISPR gRNA sequence
ccaagactgggcaatttaca

SEQ ID NO: 397282 - DNA, 20 bp, Artificial
  CRISPR gRNA sequence
ggcaatttacaaaagaaaga

SEQ ID NO: 397283 - DNA, 20 bp, Artificial
  CRISPR gRNA sequence
acaaaagaaagaggtttaat

SEQ ID NO: 397284 - DNA, 20 bp, Artificial
  CRISPR gRNA sequence
caaaagaaagaggtttaatt

SEQ ID NO: 397285 - DNA, 20 bp, Artificial
  CRISPR gRNA sequence
aattggacttacagcaccac

SEQ ID NO: 397286 - DNA, 20 bp, Artificial
  CRISPR gRNA sequence
attggacttacagcaccaca

SEQ ID NO: 397287 - DNA, 20 bp, Artificial
  CRISPR gRNA sequence
gacttacagcaccacatgtc

SEQ ID NO: 397288 - DNA, 20 bp, Artificial
  CRISPR gRNA sequence
acagcaccacatgtctgggg

SEQ ID NO: 397289 - DNA, 20 bp, Artificial
  CRISPR gRNA sequence
cagcaccacatgtctgggga

SEQ ID NO: 397290 - DNA, 20 bp, Artificial
  CRISPR gRNA sequence
gggaagcctcacaatcaagg

SEQ ID NO: 397291 - DNA, 20 bp, Artificial
  CRISPR gRNA sequence
acaatcaaggtggaaggcaa

SEQ ID NO: 397292 - DNA, 20 bp, Artificial
  CRISPR gRNA sequence
acatggatggcagcaggcaa

SEQ ID NO: 397293 - DNA, 20 bp, Artificial
  CRISPR gRNA sequence
catggatggcagcaggcaaa

SEQ ID NO: 397294 - DNA, 20 bp, Artificial
  CRISPR gRNA sequence
gtgcaggggaactcctcttt

SEQ ID NO: 397295 - DNA, 20 bp, Artificial
  CRISPR gRNA sequence
ctcttttttaaaccatcaga

SEQ ID NO: 397296 - DNA, 20 bp, Artificial
  CRISPR gRNA sequence
ttttttaaaccatcagatct

SEQ ID NO: 397297 - DNA, 20 bp, Artificial
  CRISPR gRNA sequence
ttttaaaccatcagatctca

SEQ ID NO: 397298 - DNA, 20 bp, Artificial
  CRISPR gRNA sequence
tttaaaccatcagatctcat

SEQ ID NO: 397299 - DNA, 20 bp, Artificial
  CRISPR gRNA sequence
ttaaaccatcagatctcatg

SEQ ID NO: 397300 - DNA, 20 bp, Artificial
  CRISPR gRNA sequence
taaaccatcagatctcatga

SEQ ID NO: 397301 - DNA, 20 bp, Artificial
  CRISPR gRNA sequence
aaaccatcagatctcatgag

SEQ ID NO: 397302 - DNA, 20 bp, Artificial
  CRISPR gRNA sequence
aaccatcagatctcatgaga

SEQ ID NO: 397303 - DNA, 20 bp, Artificial
  CRISPR gRNA sequence
atgagacttatgcactatca

SEQ ID NO: 397304 - DNA, 20 bp, Artificial
  CRISPR gRNA sequence
atgcactatcatgaggacag

SEQ ID NO: 397305 - DNA, 20 bp, Artificial
  CRISPR gRNA sequence
tgcactatcatgaggacagc

SEQ ID NO: 397306 - DNA, 20 bp, Artificial
  CRISPR gRNA sequence
tcatgaggacagcatgggaa

SEQ ID NO: 397307 - DNA, 20 bp, Artificial
  CRISPR gRNA sequence
gcccgcacgattcaattacc

SEQ ID NO: 397308 - DNA, 20 bp, Artificial
  CRISPR gRNA sequence
cccgcacgattcaattacct

SEQ ID NO: 397309 - DNA, 20 bp, Artificial
  CRISPR gRNA sequence
aattacctcccaccaggtcc

SEQ ID NO: 397310 - DNA, 20 bp, Artificial
  CRISPR gRNA sequence
cctcccaccaggtccctccc

SEQ ID NO: 397311 - DNA, 20 bp, Artificial
  CRISPR gRNA sequence
ccaccaggtccctcccacaa

SEQ ID NO: 397312 - DNA, 20 bp, Artificial
  CRISPR gRNA sequence
ccacaacacatgggaattca

SEQ ID NO: 397313 - DNA, 20 bp, Artificial
  CRISPR gRNA sequence
aaaccatatcacgtggcggt

SEQ ID NO: 397314 - DNA, 20 bp, Artificial
  CRISPR gRNA sequence
tagtcccagctacttgcggg

SEQ ID NO: 397315 - DNA, 20 bp, Artificial
  CRISPR gRNA sequence
cttgcggggctgaggtagga

SEQ ID NO: 397316 - DNA, 20 bp, Artificial
  CRISPR gRNA sequence
gcggggctgaggtaggagaa

SEQ ID NO: 397317 - DNA, 20 bp, Artificial
  CRISPR gRNA sequence
cggggctgaggtaggagaat

SEQ ID NO: 397318 - DNA, 20 bp, Artificial
  CRISPR gRNA sequence
aggtaggagaatcgcttgag

SEQ ID NO: 397319 - DNA, 20 bp, Artificial
  CRISPR gRNA sequence
gagcccaggagctggaggtt

SEQ ID NO: 397320 - DNA, 20 bp, Artificial
  CRISPR gRNA sequence
agcccaggagctggaggttg

SEQ ID NO: 397321 - DNA, 20 bp, Artificial
  CRISPR gRNA sequence
gaggttgcagtgagccaaga

SEQ ID NO: 397322 - DNA, 20 bp, Artificial
  CRISPR gRNA sequence
cagtgagccaagatcatgct

SEQ ID NO: 397323 - DNA, 20 bp, Artificial
  CRISPR gRNA sequence
ctgtactccagcctggtgac

SEQ ID NO: 397324 - DNA, 20 bp, Artificial
  CRISPR gRNA sequence
tactccagcctggtgacaga

SEQ ID NO: 397325 - DNA, 20 bp, Artificial
  CRISPR gRNA sequence
cagcctggtgacagagcaag

SEQ ID NO: 397326 - DNA, 20 bp, Artificial
  CRISPR gRNA sequence
gtgacagagcaagactccat

SEQ ID NO: 397327 - DNA, 20 bp, Artificial
  CRISPR gRNA sequence
catcaaaaaaaaaaaaaaaa

SEQ ID NO: 397328 - DNA, 20 bp, Artificial
  CRISPR gRNA sequence
agatttggtactgtaggaag

SEQ ID NO: 397329 - DNA, 20 bp, Artificial
  CRISPR gRNA sequence
gatttggtactgtaggaaga

SEQ ID NO: 397330 - DNA, 20 bp, Artificial
  CRISPR gRNA sequence
ggtactgtaggaagaacctt

SEQ ID NO: 397331 - DNA, 20 bp, Artificial
  CRISPR gRNA sequence
gtactgtaggaagaaccttg

SEQ ID NO: 397332 - DNA, 20 bp, Artificial
  CRISPR gRNA sequence
taggaagaaccttgaacaca

SEQ ID NO: 397333 - DNA, 20 bp, Artificial
  CRISPR gRNA sequence
gaacacacaggggttgatgt

SEQ ID NO: 397334 - DNA, 20 bp, Artificial
  CRISPR gRNA sequence
aacacacaggggttgatgtg

SEQ ID NO: 397335 - DNA, 20 bp, Artificial
  CRISPR gRNA sequence
atgtgggtgctggagtgtcc

SEQ ID NO: 397336 - DNA, 20 bp, Artificial
  CRISPR gRNA sequence
gagtgtccagcagaagggaa

SEQ ID NO: 397337 - DNA, 20 bp, Artificial
  CRISPR gRNA sequence
tgtcactgtgataaaaccct

SEQ ID NO: 397338 - DNA, 20 bp, Artificial
  CRISPR gRNA sequence
tgataaaaccctgaaaggat

SEQ ID NO: 397339 - DNA, 20 bp, Artificial
  CRISPR gRNA sequence
aaaggatcctgaacccatgt

SEQ ID NO: 397340 - DNA, 20 bp, Artificial
  CRISPR gRNA sequence
aacccatgtgttgccaacat

SEQ ID NO: 397341 - DNA, 20 bp, Artificial
  CRISPR gRNA sequence
ccaacatcagtttaatcaag

SEQ ID NO: 397342 - DNA, 20 bp, Artificial
  CRISPR gRNA sequence
aatcaaggctcaggttatca

SEQ ID NO: 397343 - DNA, 20 bp, Artificial
  CRISPR gRNA sequence
atcaaggctcaggttatcat

SEQ ID NO: 397344 - DNA, 20 bp, Artificial
  CRISPR gRNA sequence
aggttatcattaagacaaca

SEQ ID NO: 397345 - DNA, 20 bp, Artificial
  CRISPR gRNA sequence
tcattaagacaacaaaaaac

SEQ ID NO: 397346 - DNA, 20 bp, Artificial
  CRISPR gRNA sequence
agacaacaaaaaacctgtgc

SEQ ID NO: 397347 - DNA, 20 bp, Artificial
  CRISPR gRNA sequence
tgctttcttctactacattc

SEQ ID NO: 397348 - DNA, 20 bp, Artificial
  CRISPR gRNA sequence
tcttctactacattcaaatt

SEQ ID NO: 397349 - DNA, 20 bp, Artificial
  CRISPR gRNA sequence
cttctactacattcaaattt

SEQ ID NO: 397350 - DNA, 20 bp, Artificial
  CRISPR gRNA sequence
ttctactacattcaaatttg

SEQ ID NO: 397351 - DNA, 20 bp, Artificial
  CRISPR gRNA sequence
ctactacattcaaatttgaa

SEQ ID NO: 397352 - DNA, 20 bp, Artificial
  CRISPR gRNA sequence
tactacattcaaatttgaaa

SEQ ID NO: 397353 - DNA, 20 bp, Artificial
  CRISPR gRNA sequence
ctacattcaaatttgaaagg

SEQ ID NO: 397354 - DNA, 20 bp, Artificial
  CRISPR gRNA sequence
cattcaaatttgaaaggcac

SEQ ID NO: 397355 - DNA, 20 bp, Artificial
  CRISPR gRNA sequence
aaatttgaaaggcacttcta

SEQ ID NO: 397356 - DNA, 20 bp, Artificial
  CRISPR gRNA sequence
gaaaggcacttctactcgga

SEQ ID NO: 397357 - DNA, 20 bp, Artificial
  CRISPR gRNA sequence
aaaggcacttctactcggac

SEQ ID NO: 397358 - DNA, 20 bp, Artificial
  CRISPR gRNA sequence
ctactcggacacaacagcac

SEQ ID NO: 397359 - DNA, 20 bp, Artificial
  CRISPR gRNA sequence
tactcggacacaacagcaca

SEQ ID NO: 397360 - DNA, 20 bp, Artificial
  CRISPR gRNA sequence
ctcggacacaacagcacagt

SEQ ID NO: 397361 - DNA, 20 bp, Artificial
  CRISPR gRNA sequence
ggacacaacagcacagtcag

SEQ ID NO: 397362 - DNA, 20 bp, Artificial
  CRISPR gRNA sequence
ccaagattgctccttcaaag

SEQ ID NO: 397363 - DNA, 20 bp, Artificial
  CRISPR gRNA sequence
ctccttcaaagcagtaacat

SEQ ID NO: 397364 - DNA, 20 bp, Artificial
  CRISPR gRNA sequence
cttcaaagcagtaacatcaa

SEQ ID NO: 397365 - DNA, 20 bp, Artificial
  CRISPR gRNA sequence
caaagcagtaacatcaaagc

SEQ ID NO: 397366 - DNA, 20 bp, Artificial
  CRISPR gRNA sequence
aaagcagtaacatcaaagca

SEQ ID NO: 397367 - DNA, 20 bp, Artificial
  CRISPR gRNA sequence
gaaatggaattggagaatgc

SEQ ID NO: 397368 - DNA, 20 bp, Artificial
  CRISPR gRNA sequence
gagaatgccacagaaatacg

SEQ ID NO: 397369 - DNA, 20 bp, Artificial
  CRISPR gRNA sequence
tatagcttctacttgggctt

SEQ ID NO: 397370 - DNA, 20 bp, Artificial
  CRISPR gRNA sequence
tagcttctacttgggcttta

SEQ ID NO: 397371 - DNA, 20 bp, Artificial
  CRISPR gRNA sequence
ctacttgggctttatagaaa

SEQ ID NO: 397372 - DNA, 20 bp, Artificial
  CRISPR gRNA sequence
tacttgggctttatagaaat

SEQ ID NO: 397373 - DNA, 20 bp, Artificial
  CRISPR gRNA sequence
cttgggctttatagaaataa

SEQ ID NO: 397374 - DNA, 20 bp, Artificial
  CRISPR gRNA sequence
gggctttatagaaataaatg

SEQ ID NO: 397375 - DNA, 20 bp, Artificial
  CRISPR gRNA sequence
ggctttatagaaataaatgt

SEQ ID NO: 397376 - DNA, 20 bp, Artificial
  CRISPR gRNA sequence
tatagaaataaatgttgtaa

SEQ ID NO: 397377 - DNA, 20 bp, Artificial
  CRISPR gRNA sequence
atagaaataaatgttgtaag

SEQ ID NO: 397378 - DNA, 20 bp, Artificial
  CRISPR gRNA sequence
tagaaataaatgttgtaagt

SEQ ID NO: 397379 - DNA, 20 bp, Artificial
  CRISPR gRNA sequence
taagtggataaaaagggatt

SEQ ID NO: 397380 - DNA, 20 bp, Artificial
  CRISPR gRNA sequence
aaaaaaaaaaaaaacttgcc

SEQ ID NO: 397381 - DNA, 20 bp, Artificial
  CRISPR gRNA sequence
aaaaaaaaaaaaacttgccc

SEQ ID NO: 397382 - DNA, 20 bp, Artificial
  CRISPR gRNA sequence
gcccttacctgactgaacca

SEQ ID NO: 397383 - DNA, 20 bp, Artificial
  CRISPR gRNA sequence
cccttacctgactgaaccac

SEQ ID NO: 397384 - DNA, 20 bp, Artificial
  CRISPR gRNA sequence
acctgactgaaccacctgta

SEQ ID NO: 397385 - DNA, 20 bp, Artificial
  CRISPR gRNA sequence
cctgactgaaccacctgtat

SEQ ID NO: 397386 - DNA, 20 bp, Artificial
  CRISPR gRNA sequence
actgaaccacctgtatcacc

SEQ ID NO: 397387 - DNA, 20 bp, Artificial
  CRISPR gRNA sequence
aaccacctgtatcaccttct

SEQ ID NO: 397388 - DNA, 20 bp, Artificial
  CRISPR gRNA sequence
tatcaccttctgccaagttc

SEQ ID NO: 397389 - DNA, 20 bp, Artificial
  CRISPR gRNA sequence
ctgccaagttccctgtgggt

SEQ ID NO: 397390 - DNA, 20 bp, Artificial
  CRISPR gRNA sequence
tgccaagttccctgtgggta

SEQ ID NO: 397391 - DNA, 20 bp, Artificial
  CRISPR gRNA sequence
ccaagttccctgtgggtaag

SEQ ID NO: 397392 - DNA, 20 bp, Artificial
  CRISPR gRNA sequence
cctgtgggtaagtgtaaaga

SEQ ID NO: 397393 - DNA, 20 bp, Artificial
  CRISPR gRNA sequence
tgggtaagtgtaaagagagc

SEQ ID NO: 397394 - DNA, 20 bp, Artificial
  CRISPR gRNA sequence
cagaggcattccgaaagaaa

SEQ ID NO: 397395 - DNA, 20 bp, Artificial
  CRISPR gRNA sequence
agaggcattccgaaagaaaa

SEQ ID NO: 397396 - DNA, 20 bp, Artificial
  CRISPR gRNA sequence
cgaaagaaaagagtcatgtt

SEQ ID NO: 397397 - DNA, 20 bp, Artificial
  CRISPR gRNA sequence
ttggaagccatcgttgaatt

SEQ ID NO: 397398 - DNA, 20 bp, Artificial
  CRISPR gRNA sequence
gaagccatcgttgaattcaa

SEQ ID NO: 397399 - DNA, 20 bp, Artificial
  CRISPR gRNA sequence
aattcaaaaagtaaaccctc

SEQ ID NO: 397400 - DNA, 20 bp, Artificial
  CRISPR gRNA sequence
aaaaagtaaaccctctcagc

SEQ ID NO: 397401 - DNA, 20 bp, Artificial
  CRISPR gRNA sequence
tcagcatagggcttccttat

SEQ ID NO: 397402 - DNA, 20 bp, Artificial
  CRISPR gRNA sequence
agcatagggcttccttatga

SEQ ID NO: 397403 - DNA, 20 bp, Artificial
  CRISPR gRNA sequence
ccttatgaccatgccatgag

SEQ ID NO: 397404 - DNA, 20 bp, Artificial
  CRISPR gRNA sequence
cttatgaccatgccatgagt

SEQ ID NO: 397405 - DNA, 20 bp, Artificial
  CRISPR gRNA sequence
atgaccatgccatgagtagg

SEQ ID NO: 397406 - DNA, 20 bp, Artificial
  CRISPR gRNA sequence
tgaccatgccatgagtaggg

SEQ ID NO: 397407 - DNA, 20 bp, Artificial
  CRISPR gRNA sequence
aaaatggctatggaatcctg

SEQ ID NO: 397408 - DNA, 20 bp, Artificial
  CRISPR gRNA sequence
tggaatcctgctgggtcccg

SEQ ID NO: 397409 - DNA, 20 bp, Artificial
  CRISPR gRNA sequence
ctgggtcccgatcttgaacc

SEQ ID NO: 397410 - DNA, 20 bp, Artificial
  CRISPR gRNA sequence
ggtcccgatcttgaaccact

SEQ ID NO: 397411 - DNA, 20 bp, Artificial
  CRISPR gRNA sequence
gaaccactccacctgtgtta

SEQ ID NO: 397412 - DNA, 20 bp, Artificial
  CRISPR gRNA sequence
aaccactccacctgtgttaa

SEQ ID NO: 397413 - DNA, 20 bp, Artificial
  CRISPR gRNA sequence
cacctgtgttaagatgccca

SEQ ID NO: 397414 - DNA, 20 bp, Artificial
  CRISPR gRNA sequence
tgttaagatgcccattgatg

SEQ ID NO: 397415 - DNA, 20 bp, Artificial
  CRISPR gRNA sequence
agatgcccattgatggatac

SEQ ID NO: 397416 - DNA, 20 bp, Artificial
  CRISPR gRNA sequence
atggatacacacattctaga

SEQ ID NO: 397417 - DNA, 20 bp, Artificial
  CRISPR gRNA sequence
tagagacatgttctcggcaa

SEQ ID NO: 397418 - DNA, 20 bp, Artificial
  CRISPR gRNA sequence
gagacatgttctcggcaaag

SEQ ID NO: 397419 - DNA, 20 bp, Artificial
  CRISPR gRNA sequence
tcggcaaagggaactgatgt

SEQ ID NO: 397420 - DNA, 20 bp, Artificial
  CRISPR gRNA sequence
ggcaaagggaactgatgtat

SEQ ID NO: 397421 - DNA, 20 bp, Artificial
  CRISPR gRNA sequence
atgtatgccaaagcacctct

SEQ ID NO: 397422 - DNA, 20 bp, Artificial
  CRISPR gRNA sequence
ttcacatagagctgaaatat

SEQ ID NO: 397423 - DNA, 20 bp, Artificial
  CRISPR gRNA sequence
cacatagagctgaaatatac

SEQ ID NO: 397424 - DNA, 20 bp, Artificial
  CRISPR gRNA sequence
acatagagctgaaatataca

SEQ ID NO: 397425 - DNA, 20 bp, Artificial
  CRISPR gRNA sequence
aaatatacaacatcacatta

SEQ ID NO: 397426 - DNA, 20 bp, Artificial
  CRISPR gRNA sequence
attgttagccttgatgatgg

SEQ ID NO: 397427 - DNA, 20 bp, Artificial
  CRISPR gRNA sequence
ttagccttgatgatggaaac

SEQ ID NO: 397428 - DNA, 20 bp, Artificial
  CRISPR gRNA sequence
gccttgatgatggaaacacc

SEQ ID NO: 397429 - DNA, 20 bp, Artificial
  CRISPR gRNA sequence
gatgatggaaacaccaaatc

SEQ ID NO: 397430 - DNA, 20 bp, Artificial
  CRISPR gRNA sequence
atgatggaaacaccaaatca

SEQ ID NO: 397431 - DNA, 20 bp, Artificial
  CRISPR gRNA sequence
aagcttttgaagacctagtg

SEQ ID NO: 397432 - DNA, 20 bp, Artificial
  CRISPR gRNA sequence
agcttttgaagacctagtgc

SEQ ID NO: 397433 - DNA, 20 bp, Artificial
  CRISPR gRNA sequence
ttgaagacctagtgcattga

SEQ ID NO: 397434 - DNA, 20 bp, Artificial
  CRISPR gRNA sequence
tgaagacctagtgcattgag

SEQ ID NO: 397435 - DNA, 20 bp, Artificial
  CRISPR gRNA sequence
gaagacctagtgcattgaga

SEQ ID NO: 397436 - DNA, 20 bp, Artificial
  CRISPR gRNA sequence
aagacctagtgcattgagat

SEQ ID NO: 397437 - DNA, 20 bp, Artificial
  CRISPR gRNA sequence
gtgcattgagatcacagtaa

SEQ ID NO: 397438 - DNA, 20 bp, Artificial
  CRISPR gRNA sequence
agatcacagtaaaggctgac

SEQ ID NO: 397439 - DNA, 20 bp, Artificial
  CRISPR gRNA sequence
acagtttctgcctttgtcta

SEQ ID NO: 397440 - DNA, 20 bp, Artificial
  CRISPR gRNA sequence
ctgcctttgtctaaaaaggc

SEQ ID NO: 397441 - DNA, 20 bp, Artificial
  CRISPR gRNA sequence
tgcctttgtctaaaaaggcg

SEQ ID NO: 397442 - DNA, 20 bp, Artificial
  CRISPR gRNA sequence
cctttgtctaaaaaggcgtc

SEQ ID NO: 397443 - DNA, 20 bp, Artificial
  CRISPR gRNA sequence
tgtctaaaaaggcgtcctgc

SEQ ID NO: 397444 - DNA, 20 bp, Artificial
  CRISPR gRNA sequence
gtctaaaaaggcgtcctgct

SEQ ID NO: 397445 - DNA, 20 bp, Artificial
  CRISPR gRNA sequence
tctaaaaaggcgtcctgctg

SEQ ID NO: 397446 - DNA, 20 bp, Artificial
  CRISPR gRNA sequence
aaaaggcgtcctgctgataa

SEQ ID NO: 397447 - DNA, 20 bp, Artificial
  CRISPR gRNA sequence
ctgataattggaaaatgtaa

SEQ ID NO: 397448 - DNA, 20 bp, Artificial
  CRISPR gRNA sequence
ataattggaaaatgtaactt

SEQ ID NO: 397449 - DNA, 20 bp, Artificial
  CRISPR gRNA sequence
gaaaatgtaacttttagttt

SEQ ID NO: 397450 - DNA, 20 bp, Artificial
  CRISPR gRNA sequence
ttagtttttctgaacaagtg

SEQ ID NO: 397451 - DNA, 20 bp, Artificial
  CRISPR gRNA sequence
tagtttttctgaacaagtga

SEQ ID NO: 397452 - DNA, 20 bp, Artificial
  CRISPR gRNA sequence
agtttttctgaacaagtgag

SEQ ID NO: 397453 - DNA, 20 bp, Artificial
  CRISPR gRNA sequence
gtttttctgaacaagtgaga

SEQ ID NO: 397454 - DNA, 20 bp, Artificial
  CRISPR gRNA sequence
ttctgaacaagtgagaaatt

SEQ ID NO: 397455 - DNA, 20 bp, Artificial
  CRISPR gRNA sequence
tctgaacaagtgagaaatta

SEQ ID NO: 397456 - DNA, 20 bp, Artificial
  CRISPR gRNA sequence
ctgaacaagtgagaaattat

SEQ ID NO: 397457 - DNA, 20 bp, Artificial
  CRISPR gRNA sequence
tgaacaagtgagaaattatc

SEQ ID NO: 397458 - DNA, 20 bp, Artificial
  CRISPR gRNA sequence
aacaagtgagaaattatcct

SEQ ID NO: 397459 - DNA, 20 bp, Artificial
  CRISPR gRNA sequence
tcctagccaactaaagagca

SEQ ID NO: 397460 - DNA, 20 bp, Artificial
  CRISPR gRNA sequence
gccaactaaagagcactgta

SEQ ID NO: 397461 - DNA, 20 bp, Artificial
  CRISPR gRNA sequence
aagagcactgtaaattctga

SEQ ID NO: 397462 - DNA, 20 bp, Artificial
  CRISPR gRNA sequence
taaattctgaatatgccaca

SEQ ID NO: 397463 - DNA, 20 bp, Artificial
  CRISPR gRNA sequence
tgaatatgccacactgtaca

SEQ ID NO: 397464 - DNA, 20 bp, Artificial
  CRISPR gRNA sequence
aatatgccacactgtacaaa

SEQ ID NO: 397465 - DNA, 20 bp, Artificial
  CRISPR gRNA sequence
tacaaacaaaaacaggagca

SEQ ID NO: 397466 - DNA, 20 bp, Artificial
  CRISPR gRNA sequence
ttaaatgaaaatataaagat

SEQ ID NO: 397467 - DNA, 20 bp, Artificial
  CRISPR gRNA sequence
taaatgaaaatataaagatc

SEQ ID NO: 397468 - DNA, 20 bp, Artificial
  CRISPR gRNA sequence
aaatgaaaatataaagatca

SEQ ID NO: 397469 - DNA, 20 bp, Artificial
  CRISPR gRNA sequence
aatgaaaatataaagatcat

SEQ ID NO: 397470 - DNA, 20 bp, Artificial
  CRISPR gRNA sequence
tacctctgtatacatgaaga

SEQ ID NO: 397471 - DNA, 20 bp, Artificial
  CRISPR gRNA sequence
acctctgtatacatgaagaa

SEQ ID NO: 397472 - DNA, 20 bp, Artificial
  CRISPR gRNA sequence
cctctgtatacatgaagaag

SEQ ID NO: 397473 - DNA, 20 bp, Artificial
  CRISPR gRNA sequence
tgtatacatgaagaagagcc

SEQ ID NO: 397474 - DNA, 20 bp, Artificial
  CRISPR gRNA sequence
tatacatgaagaagagccaa

SEQ ID NO: 397475 - DNA, 20 bp, Artificial
  CRISPR gRNA sequence
tggaaactgtttgaaaggct

SEQ ID NO: 397476 - DNA, 20 bp, Artificial
  CRISPR gRNA sequence
gaaactgtttgaaaggctgg

SEQ ID NO: 397477 - DNA, 20 bp, Artificial
  CRISPR gRNA sequence
tttgaaaggctggttctatt

SEQ ID NO: 397478 - DNA, 20 bp, Artificial
  CRISPR gRNA sequence
gaaaggctggttctattaaa

SEQ ID NO: 397479 - DNA, 20 bp, Artificial
  CRISPR gRNA sequence
aaaggctggttctattaaaa

SEQ ID NO: 397480 - DNA, 20 bp, Artificial
  CRISPR gRNA sequence
gttctattaaaaaaaaaaat

SEQ ID NO: 397481 - DNA, 20 bp, Artificial
  CRISPR gRNA sequence
tattaaaaaaaaaaattgct

SEQ ID NO: 397482 - DNA, 20 bp, Artificial
  CRISPR gRNA sequence
ttaaaaaaaaaaattgcttt

SEQ ID NO: 397483 - DNA, 20 bp, Artificial
  CRISPR gRNA sequence
aaaaaaaaaattgcttttta

SEQ ID NO: 397484 - DNA, 20 bp, Artificial
  CRISPR gRNA sequence
ctttttataatgtgacatgc

SEQ ID NO: 397485 - DNA, 20 bp, Artificial
  CRISPR gRNA sequence
tttataatgtgacatgcaga

SEQ ID NO: 397486 - DNA, 20 bp, Artificial
  CRISPR gRNA sequence
ttataatgtgacatgcagat

SEQ ID NO: 397487 - DNA, 20 bp, Artificial
  CRISPR gRNA sequence
tataatgtgacatgcagatc

SEQ ID NO: 397488 - DNA, 20 bp, Artificial
  CRISPR gRNA sequence
ataatgtgacatgcagatcc

SEQ ID NO: 397489 - DNA, 20 bp, Artificial
  CRISPR gRNA sequence
taatgtgacatgcagatccc

SEQ ID NO: 397490 - DNA, 20 bp, Artificial
  CRISPR gRNA sequence
ccttcctctcagatgttatc

SEQ ID NO: 397491 - DNA, 20 bp, Artificial
  CRISPR gRNA sequence
cttcctctcagatgttatca

SEQ ID NO: 397492 - DNA, 20 bp, Artificial
  CRISPR gRNA sequence
cctctcagatgttatcagtc

SEQ ID NO: 397493 - DNA, 20 bp, Artificial
  CRISPR gRNA sequence
ctctcagatgttatcagtcg

SEQ ID NO: 397494 - DNA, 20 bp, Artificial
  CRISPR gRNA sequence
tcagatgttatcagtcgtgt

SEQ ID NO: 397495 - DNA, 20 bp, Artificial
  CRISPR gRNA sequence
agatgttatcagtcgtgtct

SEQ ID NO: 397496 - DNA, 20 bp, Artificial
  CRISPR gRNA sequence
tcagtcgtgtcttctttttc

SEQ ID NO: 397497 - DNA, 20 bp, Artificial
  CRISPR gRNA sequence
ctttttctgaagtatgaaca

SEQ ID NO: 397498 - DNA, 20 bp, Artificial
  CRISPR gRNA sequence
tttttctgaagtatgaacac

SEQ ID NO: 397499 - DNA, 20 bp, Artificial
  CRISPR gRNA sequence
tttctgaagtatgaacacag

SEQ ID NO: 397500 - DNA, 20 bp, Artificial
  CRISPR gRNA sequence
ttctgaagtatgaacacagg

SEQ ID NO: 397501 - DNA, 20 bp, Artificial
  CRISPR gRNA sequence
tctgaagtatgaacacagga

SEQ ID NO: 397502 - DNA, 20 bp, Artificial
  CRISPR gRNA sequence
ctgaagtatgaacacaggaa

SEQ ID NO: 397503 - DNA, 20 bp, Artificial
  CRISPR gRNA sequence
tgaagtatgaacacaggaaa

SEQ ID NO: 397504 - DNA, 20 bp, Artificial
  CRISPR gRNA sequence
aagtatgaacacaggaaaaa

SEQ ID NO: 397505 - DNA, 20 bp, Artificial
  CRISPR gRNA sequence
agcttaaaagacaggtttgc

SEQ ID NO: 397506 - DNA, 20 bp, Artificial
  CRISPR gRNA sequence
gcttaaaagacaggtttgct

SEQ ID NO: 397507 - DNA, 20 bp, Artificial
  CRISPR gRNA sequence
aaaagacaggtttgctcctt

SEQ ID NO: 397508 - DNA, 20 bp, Artificial
  CRISPR gRNA sequence
aaagacaggtttgctccttt

SEQ ID NO: 397509 - DNA, 20 bp, Artificial
  CRISPR gRNA sequence
gctcctttatgaggatgggc

SEQ ID NO: 397510 - DNA, 20 bp, Artificial
  CRISPR gRNA sequence
ctcctttatgaggatgggca

SEQ ID NO: 397511 - DNA, 20 bp, Artificial
  CRISPR gRNA sequence
ctttatgaggatgggcagat

SEQ ID NO: 397512 - DNA, 20 bp, Artificial
  CRISPR gRNA sequence
tatgaggatgggcagatttg

SEQ ID NO: 397513 - DNA, 20 bp, Artificial
  CRISPR gRNA sequence
atgaggatgggcagatttga

SEQ ID NO: 397514 - DNA, 20 bp, Artificial
  CRISPR gRNA sequence
tgaggatgggcagatttgag

SEQ ID NO: 397515 - DNA, 20 bp, Artificial
  CRISPR gRNA sequence
gagtttcttctctctcgggg

SEQ ID NO: 397516 - DNA, 20 bp, Artificial
  CRISPR gRNA sequence
agtttcttctctctcgggga

SEQ ID NO: 397517 - DNA, 20 bp, Artificial
  CRISPR gRNA sequence
cttctctctcggggaaccag

SEQ ID NO: 397518 - DNA, 20 bp, Artificial
  CRISPR gRNA sequence
ttctctctcggggaaccagt

SEQ ID NO: 397519 - DNA, 20 bp, Artificial
  CRISPR gRNA sequence
ctctctcggggaaccagtcg

SEQ ID NO: 397520 - DNA, 20 bp, Artificial
  CRISPR gRNA sequence
tctctcggggaaccagtcgg

SEQ ID NO: 397521 - DNA, 20 bp, Artificial
  CRISPR gRNA sequence
tctcggggaaccagtcggct

SEQ ID NO: 397522 - DNA, 20 bp, Artificial
  CRISPR gRNA sequence
tcggggaaccagtcggctta

SEQ ID NO: 397523 - DNA, 20 bp, Artificial
  CRISPR gRNA sequence
ggggaaccagtcggcttatt

SEQ ID NO: 397524 - DNA, 20 bp, Artificial
  CRISPR gRNA sequence
attttcgggctttcattttc

SEQ ID NO: 397525 - DNA, 20 bp, Artificial
  CRISPR gRNA sequence
ttttcgggctttcattttct

SEQ ID NO: 397526 - DNA, 20 bp, Artificial
  CRISPR gRNA sequence
tcgggctttcattttctaca

SEQ ID NO: 397527 - DNA, 20 bp, Artificial
  CRISPR gRNA sequence
cgggctttcattttctacaa

SEQ ID NO: 397528 - DNA, 20 bp, Artificial
  CRISPR gRNA sequence
gggctttcattttctacaag

SEQ ID NO: 397529 - DNA, 20 bp, Artificial
  CRISPR gRNA sequence
tcattttctacaaggagtca

SEQ ID NO: 397530 - DNA, 20 bp, Artificial
  CRISPR gRNA sequence
cattttctacaaggagtcat

SEQ ID NO: 397531 - DNA, 20 bp, Artificial
  CRISPR gRNA sequence
attttctacaaggagtcatt

SEQ ID NO: 397532 - DNA, 20 bp, Artificial
  CRISPR gRNA sequence
tctacaaggagtcattcatt

SEQ ID NO: 397533 - DNA, 20 bp, Artificial
  CRISPR gRNA sequence
ctacaaggagtcattcattc

SEQ ID NO: 397534 - DNA, 20 bp, Artificial
  CRISPR gRNA sequence
tacaaggagtcattcattca

SEQ ID NO: 397535 - DNA, 20 bp, Artificial
  CRISPR gRNA sequence
caaggagtcattcattcaac

SEQ ID NO: 397536 - DNA, 20 bp, Artificial
  CRISPR gRNA sequence
attcaacaaacatgtgctgc

SEQ ID NO: 397537 - DNA, 20 bp, Artificial
  CRISPR gRNA sequence
aacaaacatgtgctgcatgc

SEQ ID NO: 397538 - DNA, 20 bp, Artificial
  CRISPR gRNA sequence
catgcattctctgtgcctaa

SEQ ID NO: 397539 - DNA, 20 bp, Artificial
  CRISPR gRNA sequence
tctgtgcctaactcagctgt

SEQ ID NO: 397540 - DNA, 20 bp, Artificial
  CRISPR gRNA sequence
tgtgcctaactcagctgtag

SEQ ID NO: 397541 - DNA, 20 bp, Artificial
  CRISPR gRNA sequence
tgcctaactcagctgtaggc

SEQ ID NO: 397542 - DNA, 20 bp, Artificial
  CRISPR gRNA sequence
actcagctgtaggcaatgag

SEQ ID NO: 397543 - DNA, 20 bp, Artificial
  CRISPR gRNA sequence
agctgtaggcaatgaggata

SEQ ID NO: 397544 - DNA, 20 bp, Artificial
  CRISPR gRNA sequence
taggcaatgaggatacaata

SEQ ID NO: 397545 - DNA, 20 bp, Artificial
  CRISPR gRNA sequence
ccatgatagaacttacattc

SEQ ID NO: 397546 - DNA, 20 bp, Artificial
  CRISPR gRNA sequence
acattctatgtggaggaggc

SEQ ID NO: 397547 - DNA, 20 bp, Artificial
  CRISPR gRNA sequence
cattctatgtggaggaggca

SEQ ID NO: 397548 - DNA, 20 bp, Artificial
  CRISPR gRNA sequence
tatgtggaggaggcagaaac

SEQ ID NO: 397549 - DNA, 20 bp, Artificial
  CRISPR gRNA sequence
tgtggaggaggcagaaacta

SEQ ID NO: 397550 - DNA, 20 bp, Artificial
  CRISPR gRNA sequence
aaataaagatgtaaaaatat

SEQ ID NO: 397551 - DNA, 20 bp, Artificial
  CRISPR gRNA sequence
actgagagcataagatgagg

SEQ ID NO: 397552 - DNA, 20 bp, Artificial
  CRISPR gRNA sequence
agagcataagatgaggcaga

SEQ ID NO: 397553 - DNA, 20 bp, Artificial
  CRISPR gRNA sequence
aagtgggcggagggagccta

SEQ ID NO: 397554 - DNA, 20 bp, Artificial
  CRISPR gRNA sequence
cgcccagcgctgacagccca

SEQ ID NO: 397555 - DNA, 20 bp, Artificial
  CRISPR gRNA sequence
acagcccatcctgtggcctt

SEQ ID NO: 397556 - DNA, 20 bp, Artificial
  CRISPR gRNA sequence
tggccttcctttcacctctt

SEQ ID NO: 397557 - DNA, 20 bp, Artificial
  CRISPR gRNA sequence
cctttcacctcttcctcctt

SEQ ID NO: 397558 - DNA, 20 bp, Artificial
  CRISPR gRNA sequence
ctttcacctcttcctccttg

SEQ ID NO: 397559 - DNA, 20 bp, Artificial
  CRISPR gRNA sequence
tcacctcttcctccttgctg

SEQ ID NO: 397560 - DNA, 20 bp, Artificial
  CRISPR gRNA sequence
cacctcttcctccttgctga

SEQ ID NO: 397561 - DNA, 20 bp, Artificial
  CRISPR gRNA sequence
acctcttcctccttgctgat

SEQ ID NO: 397562 - DNA, 20 bp, Artificial
  CRISPR gRNA sequence
ttcctccttgctgatctcag

SEQ ID NO: 397563 - DNA, 20 bp, Artificial
  CRISPR gRNA sequence
cctccttgctgatctcagac

SEQ ID NO: 397564 - DNA, 20 bp, Artificial
  CRISPR gRNA sequence
ctccttgctgatctcagaca

SEQ ID NO: 397565 - DNA, 20 bp, Artificial
  CRISPR gRNA sequence
cttgctgatctcagacattt

SEQ ID NO: 397566 - DNA, 20 bp, Artificial
  CRISPR gRNA sequence
gctgatctcagacatttgct

SEQ ID NO: 397567 - DNA, 20 bp, Artificial
  CRISPR gRNA sequence
ctgatctcagacatttgctt

SEQ ID NO: 397568 - DNA, 20 bp, Artificial
  CRISPR gRNA sequence
atctcagacatttgctttga

SEQ ID NO: 397569 - DNA, 20 bp, Artificial
  CRISPR gRNA sequence
agacatttgctttgatgagg

SEQ ID NO: 397570 - DNA, 20 bp, Artificial
  CRISPR gRNA sequence
gctttgatgaggaccaaaaa

SEQ ID NO: 397571 - DNA, 20 bp, Artificial
  CRISPR gRNA sequence
ctttgatgaggaccaaaaaa

SEQ ID NO: 397572 - DNA, 20 bp, Artificial
  CRISPR gRNA sequence
tgatgaggaccaaaaaacag

SEQ ID NO: 397573 - DNA, 20 bp, Artificial
  CRISPR gRNA sequence
gatgaggaccaaaaaacaga

SEQ ID NO: 397574 - DNA, 20 bp, Artificial
  CRISPR gRNA sequence
atgaggaccaaaaaacagat

SEQ ID NO: 397575 - DNA, 20 bp, Artificial
  CRISPR gRNA sequence
gcccagggcatatgcagatc

SEQ ID NO: 397576 - DNA, 20 bp, Artificial
  CRISPR gRNA sequence
ccattatgagagatttaact

SEQ ID NO: 397577 - DNA, 20 bp, Artificial
  CRISPR gRNA sequence
tgagagatttaacttctgat

SEQ ID NO: 397578 - DNA, 20 bp, Artificial
  CRISPR gRNA sequence
aacttctgattttgaaataa

SEQ ID NO: 397579 - DNA, 20 bp, Artificial
  CRISPR gRNA sequence
acttctgattttgaaataat

SEQ ID NO: 397580 - DNA, 20 bp, Artificial
  CRISPR gRNA sequence
ctgattttgaaataattata

SEQ ID NO: 397581 - DNA, 20 bp, Artificial
  CRISPR gRNA sequence
tgattttgaaataattatag

SEQ ID NO: 397582 - DNA, 20 bp, Artificial
  CRISPR gRNA sequence
attttgaaataattatagag

SEQ ID NO: 397583 - DNA, 20 bp, Artificial
  CRISPR gRNA sequence
tgaaataattatagagtcac

SEQ ID NO: 397584 - DNA, 20 bp, Artificial
  CRISPR gRNA sequence
gaaataattatagagtcaca

SEQ ID NO: 397585 - DNA, 20 bp, Artificial
  CRISPR gRNA sequence
aaataattatagagtcacag

SEQ ID NO: 397586 - DNA, 20 bp, Artificial
  CRISPR gRNA sequence
tagagtcacagtaagtcaca

SEQ ID NO: 397587 - DNA, 20 bp, Artificial
  CRISPR gRNA sequence
tccccaggttctgtcagggg

SEQ ID NO: 397588 - DNA, 20 bp, Artificial
  CRISPR gRNA sequence
tgtcaggggtcatatcttac

SEQ ID NO: 397589 - DNA, 20 bp, Artificial
  CRISPR gRNA sequence
tcaggggtcatatcttacat

SEQ ID NO: 397590 - DNA, 20 bp, Artificial
  CRISPR gRNA sequence
acataattatagtacaatat

SEQ ID NO: 397591 - DNA, 20 bp, Artificial
  CRISPR gRNA sequence
cataattatagtacaatatc

SEQ ID NO: 397592 - DNA, 20 bp, Artificial
  CRISPR gRNA sequence
tagtacaatatcaaaacagg

SEQ ID NO: 397593 - DNA, 20 bp, Artificial
  CRISPR gRNA sequence
atttttcaggttcatcattg

SEQ ID NO: 397594 - DNA, 20 bp, Artificial
  CRISPR gRNA sequence
ttcaggttcatcattgctct

SEQ ID NO: 397595 - DNA, 20 bp, Artificial
  CRISPR gRNA sequence
tcaggttcatcattgctctc

SEQ ID NO: 397596 - DNA, 20 bp, Artificial
  CRISPR gRNA sequence
caggttcatcattgctctct

SEQ ID NO: 397597 - DNA, 20 bp, Artificial
  CRISPR gRNA sequence
aggttcatcattgctctctt

SEQ ID NO: 397598 - DNA, 20 bp, Artificial
  CRISPR gRNA sequence
atcattgctctcttctttct

SEQ ID NO: 397599 - DNA, 20 bp, Artificial
  CRISPR gRNA sequence
ctctcttctttctcttataa

SEQ ID NO: 397600 - DNA, 20 bp, Artificial
  CRISPR gRNA sequence
tcttctttctcttataaaat

SEQ ID NO: 397601 - DNA, 20 bp, Artificial
  CRISPR gRNA sequence
ttctttctcttataaaatac

SEQ ID NO: 397602 - DNA, 20 bp, Artificial
  CRISPR gRNA sequence
ctttctcttataaaatacaa

SEQ ID NO: 397603 - DNA, 20 bp, Artificial
  CRISPR gRNA sequence
tttctcttataaaatacaag

SEQ ID NO: 397604 - DNA, 20 bp, Artificial
  CRISPR gRNA sequence
tctcttataaaatacaagtt

SEQ ID NO: 397605 - DNA, 20 bp, Artificial
  CRISPR gRNA sequence
ctcttataaaatacaagttc

SEQ ID NO: 397606 - DNA, 20 bp, Artificial
  CRISPR gRNA sequence
tcttataaaatacaagttcc

SEQ ID NO: 397607 - DNA, 20 bp, Artificial
  CRISPR gRNA sequence
ttataaaatacaagttccaa

SEQ ID NO: 397608 - DNA, 20 bp, Artificial
  CRISPR gRNA sequence
ataaaatacaagttccaatt

SEQ ID NO: 397609 - DNA, 20 bp, Artificial
  CRISPR gRNA sequence
taaaatacaagttccaattc

SEQ ID NO: 397610 - DNA, 20 bp, Artificial
  CRISPR gRNA sequence
caattcttaagaacttgtta

SEQ ID NO: 397611 - DNA, 20 bp, Artificial
  CRISPR gRNA sequence
ttaagaacttgttaggtaca

SEQ ID NO: 397612 - DNA, 20 bp, Artificial
  CRISPR gRNA sequence
aagaacttgttaggtacaag

SEQ ID NO: 397613 - DNA, 20 bp, Artificial
  CRISPR gRNA sequence
agaacttgttaggtacaagt

SEQ ID NO: 397614 - DNA, 20 bp, Artificial
  CRISPR gRNA sequence
gttaggtacaagttccaatt

SEQ ID NO: 397615 - DNA, 20 bp, Artificial
  CRISPR gRNA sequence
ttaggtacaagttccaattc

SEQ ID NO: 397616 - DNA, 20 bp, Artificial
  CRISPR gRNA sequence
ggtacaagttccaattctta

SEQ ID NO: 397617 - DNA, 20 bp, Artificial
  CRISPR gRNA sequence
caattcttaagaacttgtta

SEQ ID NO: 397618 - DNA, 20 bp, Artificial
  CRISPR gRNA sequence
ttaagaacttgttaggaaca

SEQ ID NO: 397619 - DNA, 20 bp, Artificial
  CRISPR gRNA sequence
aagaacttgttaggaacata

SEQ ID NO: 397620 - DNA, 20 bp, Artificial
  CRISPR gRNA sequence
agaacttgttaggaacatat

SEQ ID NO: 397621 - DNA, 20 bp, Artificial
  CRISPR gRNA sequence
gttaggaacatatcagcatg

SEQ ID NO: 397622 - DNA, 20 bp, Artificial
  CRISPR gRNA sequence
ttaggaacatatcagcatgt

SEQ ID NO: 397623 - DNA, 20 bp, Artificial
  CRISPR gRNA sequence
ggaacatatcagcatgttag

SEQ ID NO: 397624 - DNA, 20 bp, Artificial
  CRISPR gRNA sequence
gtataaaaagtataccccta

SEQ ID NO: 397625 - DNA, 20 bp, Artificial
  CRISPR gRNA sequence
caaaaagaggaattgtataa

SEQ ID NO: 397626 - DNA, 20 bp, Artificial
  CRISPR gRNA sequence
tataaatgcatttgaccctg

SEQ ID NO: 397627 - DNA, 20 bp, Artificial
  CRISPR gRNA sequence
gaccctggtaagactgtcaa

SEQ ID NO: 397628 - DNA, 20 bp, Artificial
  CRISPR gRNA sequence
accctggtaagactgtcaaa

SEQ ID NO: 397629 - DNA, 20 bp, Artificial
  CRISPR gRNA sequence
gtaagactgtcaaaatagaa

SEQ ID NO: 397630 - DNA, 20 bp, Artificial
  CRISPR gRNA sequence
tcaaaatagaagatgagtaa

SEQ ID NO: 397631 - DNA, 20 bp, Artificial
  CRISPR gRNA sequence
ggaaaagtaggagcagaaac

SEQ ID NO: 397632 - DNA, 20 bp, Artificial
  CRISPR gRNA sequence
aagacaattttatctaatgc

SEQ ID NO: 397633 - DNA, 20 bp, Artificial
  CRISPR gRNA sequence
tatctaatgccgaccctgaa

SEQ ID NO: 397634 - DNA, 20 bp, Artificial
  CRISPR gRNA sequence
atctaatgccgaccctgaac

SEQ ID NO: 397635 - DNA, 20 bp, Artificial
  CRISPR gRNA sequence
tctaatgccgaccctgaact

SEQ ID NO: 397636 - DNA, 20 bp, Artificial
  CRISPR gRNA sequence
atgccgaccctgaactttgt

SEQ ID NO: 397637 - DNA, 20 bp, Artificial
  CRISPR gRNA sequence
aactttgtttgtgactcagt

SEQ ID NO: 397638 - DNA, 20 bp, Artificial
  CRISPR gRNA sequence
tgtttgtgactcagtctcaa

SEQ ID NO: 397639 - DNA, 20 bp, Artificial
  CRISPR gRNA sequence
gtttgtgactcagtctcaaa

SEQ ID NO: 397640 - DNA, 20 bp, Artificial
  CRISPR gRNA sequence
tttgtgactcagtctcaaag

SEQ ID NO: 397641 - DNA, 20 bp, Artificial
  CRISPR gRNA sequence
gtgactcagtctcaaagtgt

SEQ ID NO: 397642 - DNA, 20 bp, Artificial
  CRISPR gRNA sequence
tgactcagtctcaaagtgta

SEQ ID NO: 397643 - DNA, 20 bp, Artificial
  CRISPR gRNA sequence
agtctcaaagtgtatcagca

SEQ ID NO: 397644 - DNA, 20 bp, Artificial
  CRISPR gRNA sequence
aaagtgtatcagcaagtgtc

SEQ ID NO: 397645 - DNA, 20 bp, Artificial
  CRISPR gRNA sequence
ctcagcatgaatatctaatg

SEQ ID NO: 397646 - DNA, 20 bp, Artificial
  CRISPR gRNA sequence
agcatgaatatctaatgtgg

SEQ ID NO: 397647 - DNA, 20 bp, Artificial
  CRISPR gRNA sequence
atgtgggaactttctcaggg

SEQ ID NO: 397648 - DNA, 20 bp, Artificial
  CRISPR gRNA sequence
tctcagggaacataaaatca

SEQ ID NO: 397649 - DNA, 20 bp, Artificial
  CRISPR gRNA sequence
ctcagggaacataaaatcaa

SEQ ID NO: 397650 - DNA, 20 bp, Artificial
  CRISPR gRNA sequence
tcagggaacataaaatcaac

SEQ ID NO: 397651 - DNA, 20 bp, Artificial
  CRISPR gRNA sequence
agggaacataaaatcaacaa

SEQ ID NO: 397652 - DNA, 20 bp, Artificial
  CRISPR gRNA sequence
taatgtgtacatataatcaa

SEQ ID NO: 397653 - DNA, 20 bp, Artificial
  CRISPR gRNA sequence
gtgtttatatggcattatat

SEQ ID NO: 397654 - DNA, 20 bp, Artificial
  CRISPR gRNA sequence
tgtttatatggcattatatt

SEQ ID NO: 397655 - DNA, 20 bp, Artificial
  CRISPR gRNA sequence
atatggcattatattttcta

SEQ ID NO: 397656 - DNA, 20 bp, Artificial
  CRISPR gRNA sequence
tatggcattatattttctaa

SEQ ID NO: 397657 - DNA, 20 bp, Artificial
  CRISPR gRNA sequence
tattttctaaaagttttcac

SEQ ID NO: 397658 - DNA, 20 bp, Artificial
  CRISPR gRNA sequence
tctaaaagttttcacatcta

SEQ ID NO: 397659 - DNA, 20 bp, Artificial
  CRISPR gRNA sequence
ctaaaagttttcacatctat

SEQ ID NO: 397660 - DNA, 20 bp, Artificial
  CRISPR gRNA sequence
taaaagttttcacatctatg

SEQ ID NO: 397661 - DNA, 20 bp, Artificial
  CRISPR gRNA sequence
aaagttttcacatctatgat

SEQ ID NO: 397662 - DNA, 20 bp, Artificial
  CRISPR gRNA sequence
tcacatctatgatattattt

SEQ ID NO: 397663 - DNA, 20 bp, Artificial
  CRISPR gRNA sequence
cacatctatgatattatttg

SEQ ID NO: 397664 - DNA, 20 bp, Artificial
  CRISPR gRNA sequence
acatctatgatattatttgt

SEQ ID NO: 397665 - DNA, 20 bp, Artificial
  CRISPR gRNA sequence
tgatattatttgtgcctcta

SEQ ID NO: 397666 - DNA, 20 bp, Artificial
  CRISPR gRNA sequence
tttgtgcctctagttgtttt

SEQ ID NO: 397667 - DNA, 20 bp, Artificial
  CRISPR gRNA sequence
gtgcctctagttgttttgtg

SEQ ID NO: 397668 - DNA, 20 bp, Artificial
  CRISPR gRNA sequence
tgcctctagttgttttgtga

SEQ ID NO: 397669 - DNA, 20 bp, Artificial
  CRISPR gRNA sequence
tagttgttttgtgatgtagt

SEQ ID NO: 397670 - DNA, 20 bp, Artificial
  CRISPR gRNA sequence
gttgttttgtgatgtagtca

SEQ ID NO: 397671 - DNA, 20 bp, Artificial
  CRISPR gRNA sequence
ttttgtgatgtagtcaaaag

SEQ ID NO: 397672 - DNA, 20 bp, Artificial
  CRISPR gRNA sequence
tgtgatgtagtcaaaagagg

SEQ ID NO: 397673 - DNA, 20 bp, Artificial
  CRISPR gRNA sequence
gtgatgtagtcaaaagaggc

SEQ ID NO: 397674 - DNA, 20 bp, Artificial
  CRISPR gRNA sequence
tgatgtagtcaaaagaggca

SEQ ID NO: 397675 - DNA, 20 bp, Artificial
  CRISPR gRNA sequence
ttatctctgttttgtaaata

SEQ ID NO: 397676 - DNA, 20 bp, Artificial
  CRISPR gRNA sequence
tctctgttttgtaaataagt

SEQ ID NO: 397677 - DNA, 20 bp, Artificial
  CRISPR gRNA sequence
tgttttgtaaataagtcaac

SEQ ID NO: 397678 - DNA, 20 bp, Artificial
  CRISPR gRNA sequence
ttttgtaaataagtcaaccc

SEQ ID NO: 397679 - DNA, 20 bp, Artificial
  CRISPR gRNA sequence
tgtaaataagtcaacccaac

SEQ ID NO: 397680 - DNA, 20 bp, Artificial
  CRISPR gRNA sequence
gtaaataagtcaacccaaca

SEQ ID NO: 397681 - DNA, 20 bp, Artificial
  CRISPR gRNA sequence
taaataagtcaacccaacaa

SEQ ID NO: 397682 - DNA, 20 bp, Artificial
  CRISPR gRNA sequence
ctccaaattgtactgagtta

SEQ ID NO: 397683 - DNA, 20 bp, Artificial
  CRISPR gRNA sequence
caaattgtactgagttatgc

SEQ ID NO: 397684 - DNA, 20 bp, Artificial
  CRISPR gRNA sequence
tactgagttatgctgggtcc

SEQ ID NO: 397685 - DNA, 20 bp, Artificial
  CRISPR gRNA sequence
agttatgctgggtcctctgc

SEQ ID NO: 397686 - DNA, 20 bp, Artificial
  CRISPR gRNA sequence
tgctgggtcctctgcttagt

SEQ ID NO: 397687 - DNA, 20 bp, Artificial
  CRISPR gRNA sequence
ggtcctctgcttagtccctt

SEQ ID NO: 397688 - DNA, 20 bp, Artificial
  CRISPR gRNA sequence
tgcttagtcccttggaaata

SEQ ID NO: 397689 - DNA, 20 bp, Artificial
  CRISPR gRNA sequence
cttagtcccttggaaataca

SEQ ID NO: 397690 - DNA, 20 bp, Artificial
  CRISPR gRNA sequence
agtcccttggaaatacaatc

SEQ ID NO: 397691 - DNA, 20 bp, Artificial
  CRISPR gRNA sequence
gtcccttggaaatacaatca

SEQ ID NO: 397692 - DNA, 20 bp, Artificial
  CRISPR gRNA sequence
ggaaatacaatcataaagag

SEQ ID NO: 397693 - DNA, 20 bp, Artificial
  CRISPR gRNA sequence
gaaatacaatcataaagagg

SEQ ID NO: 397694 - DNA, 20 bp, Artificial
  CRISPR gRNA sequence
tgctctcaggttatgcataa

SEQ ID NO: 397695 - DNA, 20 bp, Artificial
  CRISPR gRNA sequence
ctctcaggttatgcataata

SEQ ID NO: 397696 - DNA, 20 bp, Artificial
  CRISPR gRNA sequence
tcaggttatgcataatatag

SEQ ID NO: 397697 - DNA, 20 bp, Artificial
  CRISPR gRNA sequence
aggttatgcataatatagtg

SEQ ID NO: 397698 - DNA, 20 bp, Artificial
  CRISPR gRNA sequence
tgcataatatagtgggtcat

SEQ ID NO: 397699 - DNA, 20 bp, Artificial
  CRISPR gRNA sequence
attttaaaagcaatttattg

SEQ ID NO: 397700 - DNA, 20 bp, Artificial
  CRISPR gRNA sequence
taaaagcaatttattgtagc

SEQ ID NO: 397701 - DNA, 20 bp, Artificial
  CRISPR gRNA sequence
aaaagcaatttattgtagca

SEQ ID NO: 397702 - DNA, 20 bp, Artificial
  CRISPR gRNA sequence
aaagcaatttattgtagcaa

SEQ ID NO: 397703 - DNA, 20 bp, Artificial
  CRISPR gRNA sequence
attgtagcaaaacatgatca

SEQ ID NO: 397704 - DNA, 20 bp, Artificial
  CRISPR gRNA sequence
ttgtagcaaaacatgatcat

SEQ ID NO: 397705 - DNA, 20 bp, Artificial
  CRISPR gRNA sequence
tagcaaaacatgatcatctc

SEQ ID NO: 397706 - DNA, 20 bp, Artificial
  CRISPR gRNA sequence
tatacaagtcatttgctaag

SEQ ID NO: 397707 - DNA, 20 bp, Artificial
  CRISPR gRNA sequence
tacaagtcatttgctaagtt

SEQ ID NO: 397708 - DNA, 20 bp, Artificial
  CRISPR gRNA sequence
gctaagttttatgaaagcca

SEQ ID NO: 397709 - DNA, 20 bp, Artificial
  CRISPR gRNA sequence
ctaagttttatgaaagccag

SEQ ID NO: 397710 - DNA, 20 bp, Artificial
  CRISPR gRNA sequence
agttttatgaaagccagaga

SEQ ID NO: 397711 - DNA, 20 bp, Artificial
  CRISPR gRNA sequence
tatgaaagccagagagaaca

SEQ ID NO: 397712 - DNA, 20 bp, Artificial
  CRISPR gRNA sequence
atgaaagccagagagaacaa

SEQ ID NO: 397713 - DNA, 20 bp, Artificial
  CRISPR gRNA sequence
tgaaagccagagagaacaaa

SEQ ID NO: 397714 - DNA, 20 bp, Artificial
  CRISPR gRNA sequence
taatagattgtggaaaaggt

SEQ ID NO: 397715 - DNA, 20 bp, Artificial
  CRISPR gRNA sequence
atagattgtggaaaaggttt

SEQ ID NO: 397716 - DNA, 20 bp, Artificial
  CRISPR gRNA sequence
tggaaaaggttttatagaaa

SEQ ID NO: 397717 - DNA, 20 bp, Artificial
  CRISPR gRNA sequence
tatagaaaaagtggggggaa

SEQ ID NO: 397718 - DNA, 20 bp, Artificial
  CRISPR gRNA sequence
atagaaaaagtggggggaaa

SEQ ID NO: 397719 - DNA, 20 bp, Artificial
  CRISPR gRNA sequence
tagaaaaagtggggggaaaa

SEQ ID NO: 397720 - DNA, 20 bp, Artificial
  CRISPR gRNA sequence
caggaaatggtgtgactaca

SEQ ID NO: 397721 - DNA, 20 bp, Artificial
  CRISPR gRNA sequence
aggaaatggtgtgactacag

SEQ ID NO: 397722 - DNA, 20 bp, Artificial
  CRISPR gRNA sequence
cagtctagtgggtggggaag

SEQ ID NO: 397723 - DNA, 20 bp, Artificial
  CRISPR gRNA sequence
gtgggtggggaagtgaccga

SEQ ID NO: 397724 - DNA, 20 bp, Artificial
  CRISPR gRNA sequence
agtctggactgaaaagtgac

SEQ ID NO: 397725 - DNA, 20 bp, Artificial
  CRISPR gRNA sequence
gactgaaaagtgacctgagt

SEQ ID NO: 397726 - DNA, 20 bp, Artificial
  CRISPR gRNA sequence
aaaagtgacctgagtgacac

SEQ ID NO: 397727 - DNA, 20 bp, Artificial
  CRISPR gRNA sequence
agtgacacacataaaggaac

SEQ ID NO: 397728 - DNA, 20 bp, Artificial
  CRISPR gRNA sequence
aaacgtagcaatcagaaacc

SEQ ID NO: 397729 - DNA, 20 bp, Artificial
  CRISPR gRNA sequence
acttctgtaactccagcacc

SEQ ID NO: 397730 - DNA, 20 bp, Artificial
  CRISPR gRNA sequence
ctgtaactccagcacccagc

SEQ ID NO: 397731 - DNA, 20 bp, Artificial
  CRISPR gRNA sequence
tgtaactccagcacccagca

SEQ ID NO: 397732 - DNA, 20 bp, Artificial
  CRISPR gRNA sequence
taactccagcacccagcaca

SEQ ID NO: 397733 - DNA, 20 bp, Artificial
  CRISPR gRNA sequence
cagcacccagcacaattcct

SEQ ID NO: 397734 - DNA, 20 bp, Artificial
  CRISPR gRNA sequence
ctcaggcaaagcaggctctc

SEQ ID NO: 397735 - DNA, 20 bp, Artificial
  CRISPR gRNA sequence
aggcaaagcaggctctcagt

SEQ ID NO: 397736 - DNA, 20 bp, Artificial
  CRISPR gRNA sequence
tcagtaacgcctgtgacgtt

SEQ ID NO: 397737 - DNA, 20 bp, Artificial
  CRISPR gRNA sequence
agtaacgcctgtgacgttaa

SEQ ID NO: 397738 - DNA, 20 bp, Artificial
  CRISPR gRNA sequence
tgacgttaacacattcctga

SEQ ID NO: 397739 - DNA, 20 bp, Artificial
  CRISPR gRNA sequence
acacattcctgagaggaaca

SEQ ID NO: 397740 - DNA, 20 bp, Artificial
  CRISPR gRNA sequence
ctgagaggaacatggagccg

SEQ ID NO: 397741 - DNA, 20 bp, Artificial
  CRISPR gRNA sequence
agaggaacatggagccgccg

SEQ ID NO: 397742 - DNA, 20 bp, Artificial
  CRISPR gRNA sequence
atggagaaagcggtgcacac

SEQ ID NO: 397743 - DNA, 20 bp, Artificial
  CRISPR gRNA sequence
cgcgttttggaaagataatc

SEQ ID NO: 397744 - DNA, 20 bp, Artificial
  CRISPR gRNA sequence
gcgttttggaaagataatct

SEQ ID NO: 397745 - DNA, 20 bp, Artificial
  CRISPR gRNA sequence
tggaaagataatcttggtca

SEQ ID NO: 397746 - DNA, 20 bp, Artificial
  CRISPR gRNA sequence
ggaaagataatcttggtcac

SEQ ID NO: 397747 - DNA, 20 bp, Artificial
  CRISPR gRNA sequence
gaaagataatcttggtcact

SEQ ID NO: 397748 - DNA, 20 bp, Artificial
  CRISPR gRNA sequence
ggtcactgtacagaacaaac

SEQ ID NO: 397749 - DNA, 20 bp, Artificial
  CRISPR gRNA sequence
gtcactgtacagaacaaact

SEQ ID NO: 397750 - DNA, 20 bp, Artificial
  CRISPR gRNA sequence
tacagaacaaactggagtgg

SEQ ID NO: 397751 - DNA, 20 bp, Artificial
  CRISPR gRNA sequence
gagtggcaaggacatggaag

SEQ ID NO: 397752 - DNA, 20 bp, Artificial
  CRISPR gRNA sequence
catcagaattggaaaaatta

SEQ ID NO: 397753 - DNA, 20 bp, Artificial
  CRISPR gRNA sequence
gaaaaattaatttcatctat

SEQ ID NO: 397754 - DNA, 20 bp, Artificial
  CRISPR gRNA sequence
atttcatctattatgtccta

SEQ ID NO: 397755 - DNA, 20 bp, Artificial
  CRISPR gRNA sequence
catctattatgtcctattat

SEQ ID NO: 397756 - DNA, 20 bp, Artificial
  CRISPR gRNA sequence
atctattatgtcctattatg

SEQ ID NO: 397757 - DNA, 20 bp, Artificial
  CRISPR gRNA sequence
ttatgtcctattatgtccta

SEQ ID NO: 397758 - DNA, 20 bp, Artificial
  CRISPR gRNA sequence
tgtcctattatgtcctaatg

SEQ ID NO: 397759 - DNA, 20 bp, Artificial
  CRISPR gRNA sequence
ttatgtcctaatgacaagat

SEQ ID NO: 397760 - DNA, 20 bp, Artificial
  CRISPR gRNA sequence
tgtcctaatgacaagatttt

SEQ ID NO: 397761 - DNA, 20 bp, Artificial
  CRISPR gRNA sequence
atgacaagattttcccctga

SEQ ID NO: 397762 - DNA, 20 bp, Artificial
  CRISPR gRNA sequence
tcccctgacaggcaccagca

SEQ ID NO: 397763 - DNA, 20 bp, Artificial
  CRISPR gRNA sequence
cccctgacaggcaccagcaa

SEQ ID NO: 397764 - DNA, 20 bp, Artificial
  CRISPR gRNA sequence
ccctgacaggcaccagcaaa

SEQ ID NO: 397765 - DNA, 20 bp, Artificial
  CRISPR gRNA sequence
acaggcaccagcaaaaatca

SEQ ID NO: 397766 - DNA, 20 bp, Artificial
  CRISPR gRNA sequence
caaatgccgggctaaaccaa

SEQ ID NO: 397767 - DNA, 20 bp, Artificial
  CRISPR gRNA sequence
aaccaagtccagagaattcc

SEQ ID NO: 397768 - DNA, 20 bp, Artificial
  CRISPR gRNA sequence
ctgaggtcctgaggacaggg

SEQ ID NO: 397769 - DNA, 20 bp, Artificial
  CRISPR gRNA sequence
aggtcctgaggacagggtcc

SEQ ID NO: 397770 - DNA, 20 bp, Artificial
  CRISPR gRNA sequence
aggacagggtccccctaagt

SEQ ID NO: 397771 - DNA, 20 bp, Artificial
  CRISPR gRNA sequence
agtactcctcctgcattcat

SEQ ID NO: 397772 - DNA, 20 bp, Artificial
  CRISPR gRNA sequence
ctcctgcattcatatcttct

SEQ ID NO: 397773 - DNA, 20 bp, Artificial
  CRISPR gRNA sequence
ctgcattcatatcttctgtc

SEQ ID NO: 397774 - DNA, 20 bp, Artificial
  CRISPR gRNA sequence
cattcatatcttctgtctca

SEQ ID NO: 397775 - DNA, 20 bp, Artificial
  CRISPR gRNA sequence
atatcttctgtctcaggcct

SEQ ID NO: 397776 - DNA, 20 bp, Artificial
  CRISPR gRNA sequence
ctgtctcaggcctgtgtccc

SEQ ID NO: 397777 - DNA, 20 bp, Artificial
  CRISPR gRNA sequence
tgtctcaggcctgtgtccct

SEQ ID NO: 397778 - DNA, 20 bp, Artificial
  CRISPR gRNA sequence
tctcaggcctgtgtcccttc

SEQ ID NO: 397779 - DNA, 20 bp, Artificial
  CRISPR gRNA sequence
aggcctgtgtcccttcacac

SEQ ID NO: 397780 - DNA, 20 bp, Artificial
  CRISPR gRNA sequence
tgtcccttcacacacacaca

SEQ ID NO: 397781 - DNA, 20 bp, Artificial
  CRISPR gRNA sequence
cacacacacacacacacacg

SEQ ID NO: 397782 - DNA, 20 bp, Artificial
  CRISPR gRNA sequence
acacacacacacacacacgg

SEQ ID NO: 397783 - DNA, 20 bp, Artificial
  CRISPR gRNA sequence
acacactcacgtgctcaaat

SEQ ID NO: 397784 - DNA, 20 bp, Artificial
  CRISPR gRNA sequence
acgtgctcaaatgcatgaac

SEQ ID NO: 397785 - DNA, 20 bp, Artificial
  CRISPR gRNA sequence
aaatgcatgaacccacacat

SEQ ID NO: 397786 - DNA, 20 bp, Artificial
  CRISPR gRNA sequence
tctcccaaacatgcatgcac

SEQ ID NO: 397787 - DNA, 20 bp, Artificial
  CRISPR gRNA sequence
ccaaacatgcatgcactcac

SEQ ID NO: 397788 - DNA, 20 bp, Artificial
  CRISPR gRNA sequence
acacacacatgcagtctcac

SEQ ID NO: 397789 - DNA, 20 bp, Artificial
  CRISPR gRNA sequence
acatatgcacccacacatgc

SEQ ID NO: 397790 - DNA, 20 bp, Artificial
  CRISPR gRNA sequence
taacacacattcacacacac

SEQ ID NO: 397791 - DNA, 20 bp, Artificial
  CRISPR gRNA sequence
acacacattcacacacacaa

SEQ ID NO: 397792 - DNA, 20 bp, Artificial
  CRISPR gRNA sequence
acacacacaacatgcaccca

SEQ ID NO: 397793 - DNA, 20 bp, Artificial
  CRISPR gRNA sequence
acagtctcagacacacaatc

SEQ ID NO: 397794 - DNA, 20 bp, Artificial
  CRISPR gRNA sequence
agacacacaatcacatgcat

SEQ ID NO: 397795 - DNA, 20 bp, Artificial
  CRISPR gRNA sequence
tcacatccacgcacactcac

SEQ ID NO: 397796 - DNA, 20 bp, Artificial
  CRISPR gRNA sequence
acatccacgcacactcacac

SEQ ID NO: 397797 - DNA, 20 bp, Artificial
  CRISPR gRNA sequence
acactcatgcacttacacgt

SEQ ID NO: 397798 - DNA, 20 bp, Artificial
  CRISPR gRNA sequence
atgcacttacacgttatcac

SEQ ID NO: 397799 - DNA, 20 bp, Artificial
  CRISPR gRNA sequence
acacgttatcactcacatat

SEQ ID NO: 397800 - DNA, 20 bp, Artificial
  CRISPR gRNA sequence
cacgttatcactcacatatg

SEQ ID NO: 397801 - DNA, 20 bp, Artificial
  CRISPR gRNA sequence
tcactcacatatgcacactg

SEQ ID NO: 397802 - DNA, 20 bp, Artificial
  CRISPR gRNA sequence
acatatgcacactgtctcac

SEQ ID NO: 397803 - DNA, 20 bp, Artificial
  CRISPR gRNA sequence
tctcactctatctcaatcac

SEQ ID NO: 397804 - DNA, 20 bp, Artificial
  CRISPR gRNA sequence
actctatctcaatcacatgc

SEQ ID NO: 397805 - DNA, 20 bp, Artificial
  CRISPR gRNA sequence
tatctcaatcacatgcatgt

SEQ ID NO: 397806 - DNA, 20 bp, Artificial
  CRISPR gRNA sequence
tctcaatcacatgcatgtgc

SEQ ID NO: 397807 - DNA, 20 bp, Artificial
  CRISPR gRNA sequence
aatcacatgcatgtgcacat

SEQ ID NO: 397808 - DNA, 20 bp, Artificial
  CRISPR gRNA sequence
tcaaacacacatccacacac

SEQ ID NO: 397809 - DNA, 20 bp, Artificial
  CRISPR gRNA sequence
aaacacacatccacacacac

SEQ ID NO: 397810 - DNA, 20 bp, Artificial
  CRISPR gRNA sequence
acacatgctctcacactcac

SEQ ID NO: 397811 - DNA, 20 bp, Artificial
  CRISPR gRNA sequence
cacatgctctcacactcaca

SEQ ID NO: 397812 - DNA, 20 bp, Artificial
  CRISPR gRNA sequence
tcacactcacatatgcacac

SEQ ID NO: 397813 - DNA, 20 bp, Artificial
  CRISPR gRNA sequence
acactcacatatgcacacat

SEQ ID NO: 397814 - DNA, 20 bp, Artificial
  CRISPR gRNA sequence
acatatgcacacattcacac

SEQ ID NO: 397815 - DNA, 20 bp, Artificial
  CRISPR gRNA sequence
acactttgtttctcacactc

SEQ ID NO: 397816 - DNA, 20 bp, Artificial
  CRISPR gRNA sequence
tgtttctcacactctctcac

SEQ ID NO: 397817 - DNA, 20 bp, Artificial
  CRISPR gRNA sequence
gtttctcacactctctcaca

SEQ ID NO: 397818 - DNA, 20 bp, Artificial
  CRISPR gRNA sequence
tttctcacactctctcacac

SEQ ID NO: 397819 - DNA, 20 bp, Artificial
  CRISPR gRNA sequence
ctcacactctctcacacaca

SEQ ID NO: 397820 - DNA, 20 bp, Artificial
  CRISPR gRNA sequence
tcacactctctcacacacac

SEQ ID NO: 397821 - DNA, 20 bp, Artificial
  CRISPR gRNA sequence
acactctctcacacacacaa

SEQ ID NO: 397822 - DNA, 20 bp, Artificial
  CRISPR gRNA sequence
tctcacacacacaatcacat

SEQ ID NO: 397823 - DNA, 20 bp, Artificial
  CRISPR gRNA sequence
tcacacacacaatcacatgc

SEQ ID NO: 397824 - DNA, 20 bp, Artificial
  CRISPR gRNA sequence
acacacacaatcacatgcag

SEQ ID NO: 397825 - DNA, 20 bp, Artificial
  CRISPR gRNA sequence
tcaaacacgtatacatgcac

SEQ ID NO: 397826 - DNA, 20 bp, Artificial
  CRISPR gRNA sequence
aaacacgtatacatgcactc

SEQ ID NO: 397827 - DNA, 20 bp, Artificial
  CRISPR gRNA sequence
acacacatgcacacacgcat

SEQ ID NO: 397828 - DNA, 20 bp, Artificial
  CRISPR gRNA sequence
atacatgttctcacacatgc

SEQ ID NO: 397829 - DNA, 20 bp, Artificial
  CRISPR gRNA sequence
tacatgttctcacacatgct

SEQ ID NO: 397830 - DNA, 20 bp, Artificial
  CRISPR gRNA sequence
tcacacatgctcacatatgc

SEQ ID NO: 397831 - DNA, 20 bp, Artificial
  CRISPR gRNA sequence
acacatgctcacatatgcac

SEQ ID NO: 397832 - DNA, 20 bp, Artificial
  CRISPR gRNA sequence
acatatgcacacacaatctc

SEQ ID NO: 397833 - DNA, 20 bp, Artificial
  CRISPR gRNA sequence
acacaatcacatgcatctgc

SEQ ID NO: 397834 - DNA, 20 bp, Artificial
  CRISPR gRNA sequence
cacgtactctcaaacacact

SEQ ID NO: 397835 - DNA, 20 bp, Artificial
  CRISPR gRNA sequence
tcaaacacactcgtacatgc

SEQ ID NO: 397836 - DNA, 20 bp, Artificial
  CRISPR gRNA sequence
aaacacactcgtacatgcat

SEQ ID NO: 397837 - DNA, 20 bp, Artificial
  CRISPR gRNA sequence
gtacatgcatacactcacat

SEQ ID NO: 397838 - DNA, 20 bp, Artificial
  CRISPR gRNA sequence
acatgcacgcacacatgcat

SEQ ID NO: 397839 - DNA, 20 bp, Artificial
  CRISPR gRNA sequence
acacatgctcacacacattt

SEQ ID NO: 397840 - DNA, 20 bp, Artificial
  CRISPR gRNA sequence
cacatgctcacacacatttg

SEQ ID NO: 397841 - DNA, 20 bp, Artificial
  CRISPR gRNA sequence
acacacatttgcacacactc

SEQ ID NO: 397842 - DNA, 20 bp, Artificial
  CRISPR gRNA sequence
gcacacactctcacacactc

SEQ ID NO: 397843 - DNA, 20 bp, Artificial
  CRISPR gRNA sequence
cacacactctcacacactct

SEQ ID NO: 397844 - DNA, 20 bp, Artificial
  CRISPR gRNA sequence
tcacacactctgtctctctc

SEQ ID NO: 397845 - DNA, 20 bp, Artificial
  CRISPR gRNA sequence
acacactctgtctctctctc

SEQ ID NO: 397846 - DNA, 20 bp, Artificial
  CRISPR gRNA sequence
tgtctctctctctctctcac

SEQ ID NO: 397847 - DNA, 20 bp, Artificial
  CRISPR gRNA sequence
tctctctctctctctcacac

SEQ ID NO: 397848 - DNA, 20 bp, Artificial
  CRISPR gRNA sequence
tctctctctctcacacacat

SEQ ID NO: 397849 - DNA, 20 bp, Artificial
  CRISPR gRNA sequence
tctctctctcacacacatac

SEQ ID NO: 397850 - DNA, 20 bp, Artificial
  CRISPR gRNA sequence
tctctctcacacacatactg

SEQ ID NO: 397851 - DNA, 20 bp, Artificial
  CRISPR gRNA sequence
tctctcacacacatactgca

SEQ ID NO: 397852 - DNA, 20 bp, Artificial
  CRISPR gRNA sequence
tctcacacacatactgcatc

SEQ ID NO: 397853 - DNA, 20 bp, Artificial
  CRISPR gRNA sequence
tcacacacatactgcatctg

SEQ ID NO: 397854 - DNA, 20 bp, Artificial
  CRISPR gRNA sequence
acacacatactgcatctggc

SEQ ID NO: 397855 - DNA, 20 bp, Artificial
  CRISPR gRNA sequence
catctggcgtgatctcaaaa

SEQ ID NO: 397856 - DNA, 20 bp, Artificial
  CRISPR gRNA sequence
gcgtgatctcaaaacagagt

SEQ ID NO: 397857 - DNA, 20 bp, Artificial
  CRISPR gRNA sequence
aaaacagagtgtacggccaa

SEQ ID NO: 397858 - DNA, 20 bp, Artificial
  CRISPR gRNA sequence
acataccacctgctctttta

SEQ ID NO: 397859 - DNA, 20 bp, Artificial
  CRISPR gRNA sequence
ctcttttacagaaaaacttt

SEQ ID NO: 397860 - DNA, 20 bp, Artificial
  CRISPR gRNA sequence
ttttacagaaaaactttttc

SEQ ID NO: 397861 - DNA, 20 bp, Artificial
  CRISPR gRNA sequence
ttacagaaaaactttttcat

SEQ ID NO: 397862 - DNA, 20 bp, Artificial
  CRISPR gRNA sequence
tacagaaaaactttttcatg

SEQ ID NO: 397863 - DNA, 20 bp, Artificial
  CRISPR gRNA sequence
acagaaaaactttttcatgc

SEQ ID NO: 397864 - DNA, 20 bp, Artificial
  CRISPR gRNA sequence
cagaaaaactttttcatgcc

SEQ ID NO: 397865 - DNA, 20 bp, Artificial
  CRISPR gRNA sequence
tttcatgcccccagtctagt

SEQ ID NO: 397866 - DNA, 20 bp, Artificial
  CRISPR gRNA sequence
ttcatgcccccagtctagtt

SEQ ID NO: 397867 - DNA, 20 bp, Artificial
  CRISPR gRNA sequence
tcatgcccccagtctagttg

SEQ ID NO: 397868 - DNA, 20 bp, Artificial
  CRISPR gRNA sequence
catgcccccagtctagttgg

SEQ ID NO: 397869 - DNA, 20 bp, Artificial
  CRISPR gRNA sequence
atgcccccagtctagttgga

SEQ ID NO: 397870 - DNA, 20 bp, Artificial
  CRISPR gRNA sequence
gttggaaagacagacatcag

SEQ ID NO: 397871 - DNA, 20 bp, Artificial
  CRISPR gRNA sequence
gaaagacagacatcagacga

SEQ ID NO: 397872 - DNA, 20 bp, Artificial
  CRISPR gRNA sequence
tgaagtgcatgtcacgttat

SEQ ID NO: 397873 - DNA, 20 bp, Artificial
  CRISPR gRNA sequence
tgaaaaggaagcaacacaca

SEQ ID NO: 397874 - DNA, 20 bp, Artificial
  CRISPR gRNA sequence
gggctgcagccaagcagagg

SEQ ID NO: 397875 - DNA, 20 bp, Artificial
  CRISPR gRNA sequence
cagccaagcagaggctgtgt

SEQ ID NO: 397876 - DNA, 20 bp, Artificial
  CRISPR gRNA sequence
tgtcaggttggtggtcggga

SEQ ID NO: 397877 - DNA, 20 bp, Artificial
  CRISPR gRNA sequence
gtggtcgggaaaggctctcg

SEQ ID NO: 397878 - DNA, 20 bp, Artificial
  CRISPR gRNA sequence
tcgggcagtgaagtgtgttc

SEQ ID NO: 397879 - DNA, 20 bp, Artificial
  CRISPR gRNA sequence
gggcagtgaagtgtgttctg

SEQ ID NO: 397880 - DNA, 20 bp, Artificial
  CRISPR gRNA sequence
tggaatctgcagaagcagga

SEQ ID NO: 397881 - DNA, 20 bp, Artificial
  CRISPR gRNA sequence
gaatctgcagaagcaggagg

SEQ ID NO: 397882 - DNA, 20 bp, Artificial
  CRISPR gRNA sequence
cagaagcaggaggctgtggc

SEQ ID NO: 397883 - DNA, 20 bp, Artificial
  CRISPR gRNA sequence
tggccacatgcagggtgtgg

SEQ ID NO: 397884 - DNA, 20 bp, Artificial
  CRISPR gRNA sequence
tgtggaagtttttcaatcat

SEQ ID NO: 397885 - DNA, 20 bp, Artificial
  CRISPR gRNA sequence
gtggaagtttttcaatcatt

SEQ ID NO: 397886 - DNA, 20 bp, Artificial
  CRISPR gRNA sequence
tggaagtttttcaatcattg

SEQ ID NO: 397887 - DNA, 20 bp, Artificial
  CRISPR gRNA sequence
ttcaatcattgtagctggat

SEQ ID NO: 397888 - DNA, 20 bp, Artificial
  CRISPR gRNA sequence
tcaatcattgtagctggata

SEQ ID NO: 397889 - DNA, 20 bp, Artificial
  CRISPR gRNA sequence
caatcattgtagctggatac

SEQ ID NO: 397890 - DNA, 20 bp, Artificial
  CRISPR gRNA sequence
aatcattgtagctggataca

SEQ ID NO: 397891 - DNA, 20 bp, Artificial
  CRISPR gRNA sequence
tagctggatacattgagggg

SEQ ID NO: 397892 - DNA, 20 bp, Artificial
  CRISPR gRNA sequence
gatacattgaggggagatgg

SEQ ID NO: 397893 - DNA, 20 bp, Artificial
  CRISPR gRNA sequence
aggggagatggaaacagaaa

SEQ ID NO: 397894 - DNA, 20 bp, Artificial
  CRISPR gRNA sequence
gccttatatacttcctggta

SEQ ID NO: 397895 - DNA, 20 bp, Artificial
  CRISPR gRNA sequence
ccttatatacttcctggtac

SEQ ID NO: 397896 - DNA, 20 bp, Artificial
  CRISPR gRNA sequence
atatacttcctggtacaatt

SEQ ID NO: 397897 - DNA, 20 bp, Artificial
  CRISPR gRNA sequence
tatacttcctggtacaattc

SEQ ID NO: 397898 - DNA, 20 bp, Artificial
  CRISPR gRNA sequence
cctggtacaattctaagagc

SEQ ID NO: 397899 - DNA, 20 bp, Artificial
  CRISPR gRNA sequence
ctggtacaattctaagagcg

SEQ ID NO: 397900 - DNA, 20 bp, Artificial
  CRISPR gRNA sequence
gtacaattctaagagcgatt

SEQ ID NO: 397901 - DNA, 20 bp, Artificial
  CRISPR gRNA sequence
taagagcgattggagattgt

SEQ ID NO: 397902 - DNA, 20 bp, Artificial
  CRISPR gRNA sequence
agagcgattggagattgtta

SEQ ID NO: 397903 - DNA, 20 bp, Artificial
  CRISPR gRNA sequence
gagattgttaagcaccagaa

SEQ ID NO: 397904 - DNA, 20 bp, Artificial
  CRISPR gRNA sequence
ttaagcaccagaatgatata

SEQ ID NO: 397905 - DNA, 20 bp, Artificial
  CRISPR gRNA sequence
agcaccagaatgatataatc

SEQ ID NO: 397906 - DNA, 20 bp, Artificial
  CRISPR gRNA sequence
caattattagaaagataact

SEQ ID NO: 397907 - DNA, 20 bp, Artificial
  CRISPR gRNA sequence
aattattagaaagataactg

SEQ ID NO: 397908 - DNA, 20 bp, Artificial
  CRISPR gRNA sequence
ttagaaagataactgaccat

SEQ ID NO: 397909 - DNA, 20 bp, Artificial
  CRISPR gRNA sequence
gaaagataactgaccatcac

SEQ ID NO: 397910 - DNA, 20 bp, Artificial
  CRISPR gRNA sequence
accatcacccatttcacttt

SEQ ID NO: 397911 - DNA, 20 bp, Artificial
  CRISPR gRNA sequence
cactttcctcactcctagca

SEQ ID NO: 397912 - DNA, 20 bp, Artificial
  CRISPR gRNA sequence
actttcctcactcctagcag

SEQ ID NO: 397913 - DNA, 20 bp, Artificial
  CRISPR gRNA sequence
tcctcactcctagcagtact

SEQ ID NO: 397914 - DNA, 20 bp, Artificial
  CRISPR gRNA sequence
cctcactcctagcagtactg

SEQ ID NO: 397915 - DNA, 20 bp, Artificial
  CRISPR gRNA sequence
ctcactcctagcagtactgt

SEQ ID NO: 397916 - DNA, 20 bp, Artificial
  CRISPR gRNA sequence
actcctagcagtactgtacc

SEQ ID NO: 397917 - DNA, 20 bp, Artificial
  CRISPR gRNA sequence
ctagcagtactgtacctgag

SEQ ID NO: 397918 - DNA, 20 bp, Artificial
  CRISPR gRNA sequence
gcagtactgtacctgagttt

SEQ ID NO: 397919 - DNA, 20 bp, Artificial
  CRISPR gRNA sequence
tacctgagtttgagtatcca

SEQ ID NO: 397920 - DNA, 20 bp, Artificial
  CRISPR gRNA sequence
agtttgagtatccacccctt

SEQ ID NO: 397921 - DNA, 20 bp, Artificial
  CRISPR gRNA sequence
gagtatccacccctttccac

SEQ ID NO: 397922 - DNA, 20 bp, Artificial
  CRISPR gRNA sequence
agtatccacccctttccaca

SEQ ID NO: 397923 - DNA, 20 bp, Artificial
  CRISPR gRNA sequence
tccacacgccacagagatat

SEQ ID NO: 397924 - DNA, 20 bp, Artificial
  CRISPR gRNA sequence
ccacacgccacagagatatt

SEQ ID NO: 397925 - DNA, 20 bp, Artificial
  CRISPR gRNA sequence
cacacgccacagagatatta

SEQ ID NO: 397926 - DNA, 20 bp, Artificial
  CRISPR gRNA sequence
tgacaaatagaagctattgt

SEQ ID NO: 397927 - DNA, 20 bp, Artificial
  CRISPR gRNA sequence
ttgtactgaaaactatgatt

SEQ ID NO: 397928 - DNA, 20 bp, Artificial
  CRISPR gRNA sequence
tactgaaaactatgattttg

SEQ ID NO: 397929 - DNA, 20 bp, Artificial
  CRISPR gRNA sequence
aaaactatgattttgtgtgt

SEQ ID NO: 397930 - DNA, 20 bp, Artificial
  CRISPR gRNA sequence
tgattttgtgtgtgtgtgtg

SEQ ID NO: 397931 - DNA, 20 bp, Artificial
  CRISPR gRNA sequence
tgtgtgtgtgtgtgtgtgtg

SEQ ID NO: 397932 - DNA, 20 bp, Artificial
  CRISPR gRNA sequence
gtgtgtgtgtgtgtgtgtgt

SEQ ID NO: 397933 - DNA, 20 bp, Artificial
  CRISPR gRNA sequence
tgtgtgtgtgtgtgtgtgtg

SEQ ID NO: 397934 - DNA, 20 bp, Artificial
  CRISPR gRNA sequence
tgttgtccaggctgatctca

SEQ ID NO: 397935 - DNA, 20 bp, Artificial
  CRISPR gRNA sequence
tccaggctgatctcaaactc

SEQ ID NO: 397936 - DNA, 20 bp, Artificial
  CRISPR gRNA sequence
atctcaaactcctggtctca

SEQ ID NO: 397937 - DNA, 20 bp, Artificial
  CRISPR gRNA sequence
aaactcctggtctcaagtga

SEQ ID NO: 397938 - DNA, 20 bp, Artificial
  CRISPR gRNA sequence
ctggtctcaagtgaccctcc

SEQ ID NO: 397939 - DNA, 20 bp, Artificial
  CRISPR gRNA sequence
gtctcaagtgaccctcccac

SEQ ID NO: 397940 - DNA, 20 bp, Artificial
  CRISPR gRNA sequence
aagtgaccctcccacttcag

SEQ ID NO: 397941 - DNA, 20 bp, Artificial
  CRISPR gRNA sequence
ccacttcagcctcctgggta

SEQ ID NO: 397942 - DNA, 20 bp, Artificial
  CRISPR gRNA sequence
cagcctcctgggtagctggg

SEQ ID NO: 397943 - DNA, 20 bp, Artificial
  CRISPR gRNA sequence
agcctcctgggtagctggga

SEQ ID NO: 397944 - DNA, 20 bp, Artificial
  CRISPR gRNA sequence
ctgggtagctgggacccagc

SEQ ID NO: 397945 - DNA, 20 bp, Artificial
  CRISPR gRNA sequence
ggtagctgggacccagctga

SEQ ID NO: 397946 - DNA, 20 bp, Artificial
  CRISPR gRNA sequence
ggacccagctgagccaccac

SEQ ID NO: 397947 - DNA, 20 bp, Artificial
  CRISPR gRNA sequence
agccaccacactcagctaat

SEQ ID NO: 397948 - DNA, 20 bp, Artificial
  CRISPR gRNA sequence
agctaattttttaaaattat

SEQ ID NO: 397949 - DNA, 20 bp, Artificial
  CRISPR gRNA sequence
attttttaaaattatttttt

SEQ ID NO: 397950 - DNA, 20 bp, Artificial
  CRISPR gRNA sequence
tttaaaattatttttttttt

SEQ ID NO: 397951 - DNA, 20 bp, Artificial
  CRISPR gRNA sequence
ttaaaattattttttttttg

SEQ ID NO: 397952 - DNA, 20 bp, Artificial
  CRISPR gRNA sequence
taaaattattttttttttgg

SEQ ID NO: 397953 - DNA, 20 bp, Artificial
  CRISPR gRNA sequence
aaaattattttttttttgga

SEQ ID NO: 397954 - DNA, 20 bp, Artificial
  CRISPR gRNA sequence
aaattattttttttttggag

SEQ ID NO: 397955 - DNA, 20 bp, Artificial
  CRISPR gRNA sequence
ttttttttttggagacaggg

SEQ ID NO: 397956 - DNA, 20 bp, Artificial
  CRISPR gRNA sequence
tttttttggagacagggtct

SEQ ID NO: 397957 - DNA, 20 bp, Artificial
  CRISPR gRNA sequence
ttttttggagacagggtctt

SEQ ID NO: 397958 - DNA, 20 bp, Artificial
  CRISPR gRNA sequence
tttttggagacagggtcttg

SEQ ID NO: 397959 - DNA, 20 bp, Artificial
  CRISPR gRNA sequence
ttttggagacagggtcttgc

SEQ ID NO: 397960 - DNA, 20 bp, Artificial
  CRISPR gRNA sequence
tttggagacagggtcttgct

SEQ ID NO: 397961 - DNA, 20 bp, Artificial
  CRISPR gRNA sequence
ttggagacagggtcttgcta

SEQ ID NO: 397962 - DNA, 20 bp, Artificial
  CRISPR gRNA sequence
tggagacagggtcttgctac

SEQ ID NO: 397963 - DNA, 20 bp, Artificial
  CRISPR gRNA sequence
ggagacagggtcttgctaca

SEQ ID NO: 397964 - DNA, 20 bp, Artificial
  CRISPR gRNA sequence
gagacagggtcttgctacat

SEQ ID NO: 397965 - DNA, 20 bp, Artificial
  CRISPR gRNA sequence
gctacattgccaaggcttgc

SEQ ID NO: 397966 - DNA, 20 bp, Artificial
  CRISPR gRNA sequence
ctacattgccaaggcttgct

SEQ ID NO: 397967 - DNA, 20 bp, Artificial
  CRISPR gRNA sequence
cattgccaaggcttgcttgg

SEQ ID NO: 397968 - DNA, 20 bp, Artificial
  CRISPR gRNA sequence
ccaaggcttgcttggagctt

SEQ ID NO: 397969 - DNA, 20 bp, Artificial
  CRISPR gRNA sequence
gcttggagcttctggactca

SEQ ID NO: 397970 - DNA, 20 bp, Artificial
  CRISPR gRNA sequence
cttggagcttctggactcat

SEQ ID NO: 397971 - DNA, 20 bp, Artificial
  CRISPR gRNA sequence
ggagcttctggactcatgta

SEQ ID NO: 397972 - DNA, 20 bp, Artificial
  CRISPR gRNA sequence
gagcttctggactcatgtaa

SEQ ID NO: 397973 - DNA, 20 bp, Artificial
  CRISPR gRNA sequence
ctggactcatgtaattttgc

SEQ ID NO: 397974 - DNA, 20 bp, Artificial
  CRISPR gRNA sequence
tggactcatgtaattttgca

SEQ ID NO: 397975 - DNA, 20 bp, Artificial
  CRISPR gRNA sequence
gactcatgtaattttgcact

SEQ ID NO: 397976 - DNA, 20 bp, Artificial
  CRISPR gRNA sequence
atgtaattttgcacttgtac

SEQ ID NO: 397977 - DNA, 20 bp, Artificial
  CRISPR gRNA sequence
tgcacttgtacatgttggcc

SEQ ID NO: 397978 - DNA, 20 bp, Artificial
  CRISPR gRNA sequence
gcacttgtacatgttggcct

SEQ ID NO: 397979 - DNA, 20 bp, Artificial
  CRISPR gRNA sequence
cacttgtacatgttggcctc

SEQ ID NO: 397980 - DNA, 20 bp, Artificial
  CRISPR gRNA sequence
gtacatgttggcctcctaaa

SEQ ID NO: 397981 - DNA, 20 bp, Artificial
  CRISPR gRNA sequence
tacatgttggcctcctaaag

SEQ ID NO: 397982 - DNA, 20 bp, Artificial
  CRISPR gRNA sequence
gcctcctaaagtgttgggag

SEQ ID NO: 397983 - DNA, 20 bp, Artificial
  CRISPR gRNA sequence
ctaaagtgttgggagtacgg

SEQ ID NO: 397984 - DNA, 20 bp, Artificial
  CRISPR gRNA sequence
aagtgttgggagtacgggca

SEQ ID NO: 397985 - DNA, 20 bp, Artificial
  CRISPR gRNA sequence
ggagtacgggcatgatccac

SEQ ID NO: 397986 - DNA, 20 bp, Artificial
  CRISPR gRNA sequence
aaaactatgattgatttgag

SEQ ID NO: 397987 - DNA, 20 bp, Artificial
  CRISPR gRNA sequence
tgattgatttgaggggtcag

SEQ ID NO: 397988 - DNA, 20 bp, Artificial
  CRISPR gRNA sequence
atttgaggggtcagagaagc

SEQ ID NO: 397989 - DNA, 20 bp, Artificial
  CRISPR gRNA sequence
gaggggtcagagaagccaac

SEQ ID NO: 397990 - DNA, 20 bp, Artificial
  CRISPR gRNA sequence
aggggtcagagaagccaact

SEQ ID NO: 397991 - DNA, 20 bp, Artificial
  CRISPR gRNA sequence
tggcctgagttggcccatca

SEQ ID NO: 397992 - DNA, 20 bp, Artificial
  CRISPR gRNA sequence
agttggcccatcagagtgaa

SEQ ID NO: 397993 - DNA, 20 bp, Artificial
  CRISPR gRNA sequence
gcccatcagagtgaaggaag

SEQ ID NO: 397994 - DNA, 20 bp, Artificial
  CRISPR gRNA sequence
ttcacattccatgccagaaa

SEQ ID NO: 397995 - DNA, 20 bp, Artificial
  CRISPR gRNA sequence
acattccatgccagaaaaac

SEQ ID NO: 397996 - DNA, 20 bp, Artificial
  CRISPR gRNA sequence
catgccagaaaaacagcatg

SEQ ID NO: 397997 - DNA, 20 bp, Artificial
  CRISPR gRNA sequence
ctcttctctccatccttgtt

SEQ ID NO: 397998 - DNA, 20 bp, Artificial
  CRISPR gRNA sequence
tcttctctccatccttgttt

SEQ ID NO: 397999 - DNA, 20 bp, Artificial
  CRISPR gRNA sequence
ttctctccatccttgtttct

SEQ ID NO: 398000 - DNA, 20 bp, Artificial
  CRISPR gRNA sequence
ctctccatccttgtttctat

SEQ ID NO: 398001 - DNA, 20 bp, Artificial
  CRISPR gRNA sequence
tctccatccttgtttctatc

SEQ ID NO: 398002 - DNA, 20 bp, Artificial
  CRISPR gRNA sequence
tccatccttgtttctatctt

SEQ ID NO: 398003 - DNA, 20 bp, Artificial
  CRISPR gRNA sequence
catccttgtttctatcttta

SEQ ID NO: 398004 - DNA, 20 bp, Artificial
  CRISPR gRNA sequence
gtttctatctttatctcctc

SEQ ID NO: 398005 - DNA, 20 bp, Artificial
  CRISPR gRNA sequence
tttctatctttatctcctct

SEQ ID NO: 398006 - DNA, 20 bp, Artificial
  CRISPR gRNA sequence
ctatctttatctcctctcat

SEQ ID NO: 398007 - DNA, 20 bp, Artificial
  CRISPR gRNA sequence
tatctttatctcctctcatt

SEQ ID NO: 398008 - DNA, 20 bp, Artificial
  CRISPR gRNA sequence
tctttatctcctctcattat

SEQ ID NO: 398009 - DNA, 20 bp, Artificial
  CRISPR gRNA sequence
tatctcctctcattatgcat

SEQ ID NO: 398010 - DNA, 20 bp, Artificial
  CRISPR gRNA sequence
atctcctctcattatgcatg

SEQ ID NO: 398011 - DNA, 20 bp, Artificial
  CRISPR gRNA sequence
tctcctctcattatgcatga

SEQ ID NO: 398012 - DNA, 20 bp, Artificial
  CRISPR gRNA sequence
ctctcattatgcatgaacaa

SEQ ID NO: 398013 - DNA, 20 bp, Artificial
  CRISPR gRNA sequence
tcattatgcatgaacaagaa

SEQ ID NO: 398014 - DNA, 20 bp, Artificial
  CRISPR gRNA sequence
attatgcatgaacaagaatg

SEQ ID NO: 398015 - DNA, 20 bp, Artificial
  CRISPR gRNA sequence
tgcatgaacaagaatgctgt

SEQ ID NO: 398016 - DNA, 20 bp, Artificial
  CRISPR gRNA sequence
tcctggttaccacaggcagc

SEQ ID NO: 398017 - DNA, 20 bp, Artificial
  CRISPR gRNA sequence
gttaccacaggcagccatat

SEQ ID NO: 398018 - DNA, 20 bp, Artificial
  CRISPR gRNA sequence
ccacaggcagccatattgaa

SEQ ID NO: 398019 - DNA, 20 bp, Artificial
  CRISPR gRNA sequence
aaggaaatcagcctgaggac

SEQ ID NO: 398020 - DNA, 20 bp, Artificial
  CRISPR gRNA sequence
aggacaaacagggtggtaga

SEQ ID NO: 398021 - DNA, 20 bp, Artificial
  CRISPR gRNA sequence
agatggcattactgagctac

SEQ ID NO: 398022 - DNA, 20 bp, Artificial
  CRISPR gRNA sequence
ctgagctactgaatccacca

SEQ ID NO: 398023 - DNA, 20 bp, Artificial
  CRISPR gRNA sequence
agctactgaatccaccaact

SEQ ID NO: 398024 - DNA, 20 bp, Artificial
  CRISPR gRNA sequence
ctgaatccaccaactctgaa

SEQ ID NO: 398025 - DNA, 20 bp, Artificial
  CRISPR gRNA sequence
aatccaccaactctgaagtc

SEQ ID NO: 398026 - DNA, 20 bp, Artificial
  CRISPR gRNA sequence
tgaagtctgaacatattaca

SEQ ID NO: 398027 - DNA, 20 bp, Artificial
  CRISPR gRNA sequence
aagtctgaacatattacata

SEQ ID NO: 398028 - DNA, 20 bp, Artificial
  CRISPR gRNA sequence
aacatattacatagaattgc

SEQ ID NO: 398029 - DNA, 20 bp, Artificial
  CRISPR gRNA sequence
catagaattgcaaggggtcc

SEQ ID NO: 398030 - DNA, 20 bp, Artificial
  CRISPR gRNA sequence
caaggggtcctgaatagcca

SEQ ID NO: 398031 - DNA, 20 bp, Artificial
  CRISPR gRNA sequence
aatagccaaaatggtattaa

SEQ ID NO: 398032 - DNA, 20 bp, Artificial
  CRISPR gRNA sequence
aaaaagaagaaaaagctgaa

SEQ ID NO: 398033 - DNA, 20 bp, Artificial
  CRISPR gRNA sequence
aaagactaacatttcccatt

SEQ ID NO: 398034 - DNA, 20 bp, Artificial
  CRISPR gRNA sequence
acatttcccatttcaaaact

SEQ ID NO: 398035 - DNA, 20 bp, Artificial
  CRISPR gRNA sequence
cccatttcaaaactgtagta

SEQ ID NO: 398036 - DNA, 20 bp, Artificial
  CRISPR gRNA sequence
ccatttcaaaactgtagtac

SEQ ID NO: 398037 - DNA, 20 bp, Artificial
  CRISPR gRNA sequence
caaaactgtagtacacagct

SEQ ID NO: 398038 - DNA, 20 bp, Artificial
  CRISPR gRNA sequence
aaaactgtagtacacagcta

SEQ ID NO: 398039 - DNA, 20 bp, Artificial
  CRISPR gRNA sequence
tagtacacagctacagtaat

SEQ ID NO: 398040 - DNA, 20 bp, Artificial
  CRISPR gRNA sequence
cagtaatcaaaacagtgtgg

SEQ ID NO: 398041 - DNA, 20 bp, Artificial
  CRISPR gRNA sequence
gcatatacatagacaaatag

SEQ ID NO: 398042 - DNA, 20 bp, Artificial
  CRISPR gRNA sequence
aaatgatgatcaaaacagat

SEQ ID NO: 398043 - DNA, 20 bp, Artificial
  CRISPR gRNA sequence
ggtaggatgtggaggaaaga

SEQ ID NO: 398044 - DNA, 20 bp, Artificial
  CRISPR gRNA sequence
atacactgttcatgggaatg

SEQ ID NO: 398045 - DNA, 20 bp, Artificial
  CRISPR gRNA sequence
tacactgttcatgggaatgt

SEQ ID NO: 398046 - DNA, 20 bp, Artificial
  CRISPR gRNA sequence
ttcatgggaatgtaaattag

SEQ ID NO: 398047 - DNA, 20 bp, Artificial
  CRISPR gRNA sequence
atgggaatgtaaattagtac

SEQ ID NO: 398048 - DNA, 20 bp, Artificial
  CRISPR gRNA sequence
gtacaacgtctatggaaaat

SEQ ID NO: 398049 - DNA, 20 bp, Artificial
  CRISPR gRNA sequence
tggaaaatagtatggcagtt

SEQ ID NO: 398050 - DNA, 20 bp, Artificial
  CRISPR gRNA sequence
ctcaaagaactaaaaataga

SEQ ID NO: 398051 - DNA, 20 bp, Artificial
  CRISPR gRNA sequence
aaagaactaaaaatagaatt

SEQ ID NO: 398052 - DNA, 20 bp, Artificial
  CRISPR gRNA sequence
aaaatagaattaccattaga

SEQ ID NO: 398053 - DNA, 20 bp, Artificial
  CRISPR gRNA sequence
ccattagatccggcagtctc

SEQ ID NO: 398054 - DNA, 20 bp, Artificial
  CRISPR gRNA sequence
gatccggcagtctcactaca

SEQ ID NO: 398055 - DNA, 20 bp, Artificial
  CRISPR gRNA sequence
actacagggtatctacccaa

SEQ ID NO: 398056 - DNA, 20 bp, Artificial
  CRISPR gRNA sequence
cagggtatctacccaaagga

SEQ ID NO: 398057 - DNA, 20 bp, Artificial
  CRISPR gRNA sequence
cccaaaggaaaagaaatcat

SEQ ID NO: 398058 - DNA, 20 bp, Artificial
  CRISPR gRNA sequence
tattaaaaatatacctgccc

SEQ ID NO: 398059 - DNA, 20 bp, Artificial
  CRISPR gRNA sequence
aaaatatacctgcccttata

SEQ ID NO: 398060 - DNA, 20 bp, Artificial
  CRISPR gRNA sequence
cccttatatgtttattgcag

SEQ ID NO: 398061 - DNA, 20 bp, Artificial
  CRISPR gRNA sequence
atatgtttattgcagcacta

SEQ ID NO: 398062 - DNA, 20 bp, Artificial
  CRISPR gRNA sequence
tatgtttattgcagcactat

SEQ ID NO: 398063 - DNA, 20 bp, Artificial
  CRISPR gRNA sequence
attgcagcactattcacaat

SEQ ID NO: 398064 - DNA, 20 bp, Artificial
  CRISPR gRNA sequence
ttgcagcactattcacaata

SEQ ID NO: 398065 - DNA, 20 bp, Artificial
  CRISPR gRNA sequence
cagcactattcacaataacc

SEQ ID NO: 398066 - DNA, 20 bp, Artificial
  CRISPR gRNA sequence
ttcacaataaccaagatatg

SEQ ID NO: 398067 - DNA, 20 bp, Artificial
  CRISPR gRNA sequence
acaataaccaagatatggaa

SEQ ID NO: 398068 - DNA, 20 bp, Artificial
  CRISPR gRNA sequence
agtgcccatcaatgaagggt

SEQ ID NO: 398069 - DNA, 20 bp, Artificial
  CRISPR gRNA sequence
gataaagaaactgtggtata

SEQ ID NO: 398070 - DNA, 20 bp, Artificial
  CRISPR gRNA sequence
tggtatatatccacaatgga

SEQ ID NO: 398071 - DNA, 20 bp, Artificial
  CRISPR gRNA sequence
cacagccctaaaaagaatga

SEQ ID NO: 398072 - DNA, 20 bp, Artificial
  CRISPR gRNA sequence
aaaagaatgaaatcatgtct

SEQ ID NO: 398073 - DNA, 20 bp, Artificial
  CRISPR gRNA sequence
ttgcagcaacatagatagac

SEQ ID NO: 398074 - DNA, 20 bp, Artificial
  CRISPR gRNA sequence
tgcagcaacatagatagacc

SEQ ID NO: 398075 - DNA, 20 bp, Artificial
  CRISPR gRNA sequence
gcagcaacatagatagaccg

SEQ ID NO: 398076 - DNA, 20 bp, Artificial
  CRISPR gRNA sequence
cagcaacatagatagaccgg

SEQ ID NO: 398077 - DNA, 20 bp, Artificial
  CRISPR gRNA sequence
tattaaatgaaacaactcag

SEQ ID NO: 398078 - DNA, 20 bp, Artificial
  CRISPR gRNA sequence
aatgaaacaactcagacaca

SEQ ID NO: 398079 - DNA, 20 bp, Artificial
  CRISPR gRNA sequence
agacacagaaactcaaaaac

SEQ ID NO: 398080 - DNA, 20 bp, Artificial
  CRISPR gRNA sequence
aaaaaccacatgttctcact

SEQ ID NO: 398081 - DNA, 20 bp, Artificial
  CRISPR gRNA sequence
tcacttataaatgggagcaa

SEQ ID NO: 398082 - DNA, 20 bp, Artificial
  CRISPR gRNA sequence
acttataaatgggagcaaaa

SEQ ID NO: 398083 - DNA, 20 bp, Artificial
  CRISPR gRNA sequence
ataaatgggagcaaaataat

SEQ ID NO: 398084 - DNA, 20 bp, Artificial
  CRISPR gRNA sequence
taaatgggagcaaaataatg

SEQ ID NO: 398085 - DNA, 20 bp, Artificial
  CRISPR gRNA sequence
gagacttggaagaatgggag

SEQ ID NO: 398086 - DNA, 20 bp, Artificial
  CRISPR gRNA sequence
ggaagaatgggagagtagaa

SEQ ID NO: 398087 - DNA, 20 bp, Artificial
  CRISPR gRNA sequence
gaagaatgggagagtagaaa

SEQ ID NO: 398088 - DNA, 20 bp, Artificial
  CRISPR gRNA sequence
cttaatgtgtacaacatata

SEQ ID NO: 398089 - DNA, 20 bp, Artificial
  CRISPR gRNA sequence
aatgtgtacaacatatatta

SEQ ID NO: 398090 - DNA, 20 bp, Artificial
  CRISPR gRNA sequence
atgtgtacaacatatattat

SEQ ID NO: 398091 - DNA, 20 bp, Artificial
  CRISPR gRNA sequence
ttcaggtgatggttatatta

SEQ ID NO: 398092 - DNA, 20 bp, Artificial
  CRISPR gRNA sequence
aggtgatggttatattaaaa

SEQ ID NO: 398093 - DNA, 20 bp, Artificial
  CRISPR gRNA sequence
tattaaaagtccagacttca

SEQ ID NO: 398094 - DNA, 20 bp, Artificial
  CRISPR gRNA sequence
aaagtccagacttcaccact

SEQ ID NO: 398095 - DNA, 20 bp, Artificial
  CRISPR gRNA sequence
caccactacataataaaact

SEQ ID NO: 398096 - DNA, 20 bp, Artificial
  CRISPR gRNA sequence
accactacataataaaactg

SEQ ID NO: 398097 - DNA, 20 bp, Artificial
  CRISPR gRNA sequence
cataataaaactgcccttgt

SEQ ID NO: 398098 - DNA, 20 bp, Artificial
  CRISPR gRNA sequence
cccttgtacaaaactgccct

SEQ ID NO: 398099 - DNA, 20 bp, Artificial
  CRISPR gRNA sequence
gtacaaaactgcccttgtac

SEQ ID NO: 398100 - DNA, 20 bp, Artificial
  CRISPR gRNA sequence
tacaaaactgcccttgtacc

SEQ ID NO: 398101 - DNA, 20 bp, Artificial
  CRISPR gRNA sequence
cccttgtaccccttgaattt

SEQ ID NO: 398102 - DNA, 20 bp, Artificial
  CRISPR gRNA sequence
gtaccccttgaatttataca

SEQ ID NO: 398103 - DNA, 20 bp, Artificial
  CRISPR gRNA sequence
taccccttgaatttatacaa

SEQ ID NO: 398104 - DNA, 20 bp, Artificial
  CRISPR gRNA sequence
gaatttatacaaataaaaat

SEQ ID NO: 398105 - DNA, 20 bp, Artificial
  CRISPR gRNA sequence
aatttatacaaataaaaata

SEQ ID NO: 398106 - DNA, 20 bp, Artificial
  CRISPR gRNA sequence
atacaaataaaaataataat

SEQ ID NO: 398107 - DNA, 20 bp, Artificial
  CRISPR gRNA sequence
tacaaataaaaataataata

SEQ ID NO: 398108 - DNA, 20 bp, Artificial
  CRISPR gRNA sequence
tgaacaattgatattcaaca

SEQ ID NO: 398109 - DNA, 20 bp, Artificial
  CRISPR gRNA sequence
atattcaacaaggtgccaac

SEQ ID NO: 398110 - DNA, 20 bp, Artificial
  CRISPR gRNA sequence
aacaaggtgccaaccccact

SEQ ID NO: 398111 - DNA, 20 bp, Artificial
  CRISPR gRNA sequence
agtggggaaagaatagcttc

SEQ ID NO: 398112 - DNA, 20 bp, Artificial
  CRISPR gRNA sequence
cttcaataaatggtcctggg

SEQ ID NO: 398113 - DNA, 20 bp, Artificial
  CRISPR gRNA sequence
ttcaataaatggtcctggga

SEQ ID NO: 398114 - DNA, 20 bp, Artificial
  CRISPR gRNA sequence
caataaatggtcctgggaca

SEQ ID NO: 398115 - DNA, 20 bp, Artificial
  CRISPR gRNA sequence
aataaatggtcctgggacaa

SEQ ID NO: 398116 - DNA, 20 bp, Artificial
  CRISPR gRNA sequence
ggacaactggatagccacat

SEQ ID NO: 398117 - DNA, 20 bp, Artificial
  CRISPR gRNA sequence
gatagccacatgcaaaagca

SEQ ID NO: 398118 - DNA, 20 bp, Artificial
  CRISPR gRNA sequence
gatccctacctccgtgaaac

SEQ ID NO: 398119 - DNA, 20 bp, Artificial
  CRISPR gRNA sequence
cctccgtgaaacacaaaaat

SEQ ID NO: 398120 - DNA, 20 bp, Artificial
  CRISPR gRNA sequence
cgtgaaacacaaaaattaac

SEQ ID NO: 398121 - DNA, 20 bp, Artificial
  CRISPR gRNA sequence
actcaaaatgggttgaccta

SEQ ID NO: 398122 - DNA, 20 bp, Artificial
  CRISPR gRNA sequence
aaaatgggttgacctaaata

SEQ ID NO: 398123 - DNA, 20 bp, Artificial
  CRISPR gRNA sequence
acctaaatataagacctcag

SEQ ID NO: 398124 - DNA, 20 bp, Artificial
  CRISPR gRNA sequence
aatataagacctcagactgt

SEQ ID NO: 398125 - DNA, 20 bp, Artificial
  CRISPR gRNA sequence
agactgtagaaatcttagaa

SEQ ID NO: 398126 - DNA, 20 bp, Artificial
  CRISPR gRNA sequence
tagaaatcttagaataagca

SEQ ID NO: 398127 - DNA, 20 bp, Artificial
  CRISPR gRNA sequence
agaataagcacaggggtaaa

SEQ ID NO: 398128 - DNA, 20 bp, Artificial
  CRISPR gRNA sequence
gaataagcacaggggtaaat

SEQ ID NO: 398129 - DNA, 20 bp, Artificial
  CRISPR gRNA sequence
ttaagacctggaagttgtca

SEQ ID NO: 398130 - DNA, 20 bp, Artificial
  CRISPR gRNA sequence
taagacctggaagttgtcaa

SEQ ID NO: 398131 - DNA, 20 bp, Artificial
  CRISPR gRNA sequence
aagacctggaagttgtcaac

SEQ ID NO: 398132 - DNA, 20 bp, Artificial
  CRISPR gRNA sequence
agacctggaagttgtcaacg

SEQ ID NO: 398133 - DNA, 20 bp, Artificial
  CRISPR gRNA sequence
gaagttgtcaacggattctt

SEQ ID NO: 398134 - DNA, 20 bp, Artificial
  CRISPR gRNA sequence
tcaacggattcttagacatg

SEQ ID NO: 398135 - DNA, 20 bp, Artificial
  CRISPR gRNA sequence
ttagacatgacagcaaacct

SEQ ID NO: 398136 - DNA, 20 bp, Artificial
  CRISPR gRNA sequence
agacatgacagcaaacctat

SEQ ID NO: 398137 - DNA, 20 bp, Artificial
  CRISPR gRNA sequence
gacatgacagcaaacctatg

SEQ ID NO: 398138 - DNA, 20 bp, Artificial
  CRISPR gRNA sequence
tgggcaacaaaagaaaaaaa

SEQ ID NO: 398139 - DNA, 20 bp, Artificial
  CRISPR gRNA sequence
gacttactaaaattaaaaac

SEQ ID NO: 398140 - DNA, 20 bp, Artificial
  CRISPR gRNA sequence
actaaaattaaaaacttttg

SEQ ID NO: 398141 - DNA, 20 bp, Artificial
  CRISPR gRNA sequence
ctaaaattaaaaacttttgt

SEQ ID NO: 398142 - DNA, 20 bp, Artificial
  CRISPR gRNA sequence
aaattaaaaacttttgtgca

SEQ ID NO: 398143 - DNA, 20 bp, Artificial
  CRISPR gRNA sequence
aaaacttttgtgcatcaaag

SEQ ID NO: 398144 - DNA, 20 bp, Artificial
  CRISPR gRNA sequence
ttgtgcatcaaaggacattt

SEQ ID NO: 398145 - DNA, 20 bp, Artificial
  CRISPR gRNA sequence
tgtgcatcaaaggacatttt

SEQ ID NO: 398146 - DNA, 20 bp, Artificial
  CRISPR gRNA sequence
gtgcatcaaaggacattttc

SEQ ID NO: 398147 - DNA, 20 bp, Artificial
  CRISPR gRNA sequence
tgcatcaaaggacattttca

SEQ ID NO: 398148 - DNA, 20 bp, Artificial
  CRISPR gRNA sequence
tcaagaaagtgaaaagtcac

SEQ ID NO: 398149 - DNA, 20 bp, Artificial
  CRISPR gRNA sequence
caagaaagtgaaaagtcacc

SEQ ID NO: 398150 - DNA, 20 bp, Artificial
  CRISPR gRNA sequence
aagaaagtgaaaagtcaccc

SEQ ID NO: 398151 - DNA, 20 bp, Artificial
  CRISPR gRNA sequence
cagaatgcaagcaaatattt

SEQ ID NO: 398152 - DNA, 20 bp, Artificial
  CRISPR gRNA sequence
gcaaataatctatctgatta

SEQ ID NO: 398153 - DNA, 20 bp, Artificial
  CRISPR gRNA sequence
caaataatctatctgattat

SEQ ID NO: 398154 - DNA, 20 bp, Artificial
  CRISPR gRNA sequence
tctgattatggtctaatatc

SEQ ID NO: 398155 - DNA, 20 bp, Artificial
  CRISPR gRNA sequence
attatggtctaatatccata

SEQ ID NO: 398156 - DNA, 20 bp, Artificial
  CRISPR gRNA sequence
tggtctaatatccataatat

SEQ ID NO: 398157 - DNA, 20 bp, Artificial
  CRISPR gRNA sequence
atatccataatatataagga

SEQ ID NO: 398158 - DNA, 20 bp, Artificial
  CRISPR gRNA sequence
tcacactttaacataaaaga

SEQ ID NO: 398159 - DNA, 20 bp, Artificial
  CRISPR gRNA sequence
acactttaacataaaagaaa

SEQ ID NO: 398160 - DNA, 20 bp, Artificial
  CRISPR gRNA sequence
taacataaaagaaacaaccc

SEQ ID NO: 398161 - DNA, 20 bp, Artificial
  CRISPR gRNA sequence
aacataaaagaaacaaccca

SEQ ID NO: 398162 - DNA, 20 bp, Artificial
  CRISPR gRNA sequence
acataaaagaaacaacccaa

SEQ ID NO: 398163 - DNA, 20 bp, Artificial
  CRISPR gRNA sequence
tcaaatgggcaaagtacttg

SEQ ID NO: 398164 - DNA, 20 bp, Artificial
  CRISPR gRNA sequence
caaatgggcaaagtacttga

SEQ ID NO: 398165 - DNA, 20 bp, Artificial
  CRISPR gRNA sequence
aaatgggcaaagtacttgaa

SEQ ID NO: 398166 - DNA, 20 bp, Artificial
  CRISPR gRNA sequence
gaatagacatttttctccaa

SEQ ID NO: 398167 - DNA, 20 bp, Artificial
  CRISPR gRNA sequence
aatagacatttttctccaaa

SEQ ID NO: 398168 - DNA, 20 bp, Artificial
  CRISPR gRNA sequence
ttctccaaaagatgctcaac

SEQ ID NO: 398169 - DNA, 20 bp, Artificial
  CRISPR gRNA sequence
tctccaaaagatgctcaaca

SEQ ID NO: 398170 - DNA, 20 bp, Artificial
  CRISPR gRNA sequence
ctccaaaagatgctcaacat

SEQ ID NO: 398171 - DNA, 20 bp, Artificial
  CRISPR gRNA sequence
tccaaaagatgctcaacatt

SEQ ID NO: 398172 - DNA, 20 bp, Artificial
  CRISPR gRNA sequence
caaaagatgctcaacattat

SEQ ID NO: 398173 - DNA, 20 bp, Artificial
  CRISPR gRNA sequence
aacattatcagtcaataagg

SEQ ID NO: 398174 - DNA, 20 bp, Artificial
  CRISPR gRNA sequence
tcagtcaataaggaaacaca

SEQ ID NO: 398175 - DNA, 20 bp, Artificial
  CRISPR gRNA sequence
actttatatctactaggatg

SEQ ID NO: 398176 - DNA, 20 bp, Artificial
  CRISPR gRNA sequence
tatatctactaggatggaca

SEQ ID NO: 398177 - DNA, 20 bp, Artificial
  CRISPR gRNA sequence
atatctactaggatggacat

SEQ ID NO: 398178 - DNA, 20 bp, Artificial
  CRISPR gRNA sequence
tatctactaggatggacata

SEQ ID NO: 398179 - DNA, 20 bp, Artificial
  CRISPR gRNA sequence
ctaggatggacataatcaaa

SEQ ID NO: 398180 - DNA, 20 bp, Artificial
  CRISPR gRNA sequence
ggatggacataatcaaaaag

SEQ ID NO: 398181 - DNA, 20 bp, Artificial
  CRISPR gRNA sequence
atatgttagggaaaatgtgg

SEQ ID NO: 398182 - DNA, 20 bp, Artificial
  CRISPR gRNA sequence
gggaaaatgtggagaaattc

SEQ ID NO: 398183 - DNA, 20 bp, Artificial
  CRISPR gRNA sequence
gaacccttgtgtactgttgc

SEQ ID NO: 398184 - DNA, 20 bp, Artificial
  CRISPR gRNA sequence
gtgtactgttgcacaagcgt

SEQ ID NO: 398185 - DNA, 20 bp, Artificial
  CRISPR gRNA sequence
tgtactgttgcacaagcgtt

SEQ ID NO: 398186 - DNA, 20 bp, Artificial
  CRISPR gRNA sequence
ttgcacaagcgttgtaaaga

SEQ ID NO: 398187 - DNA, 20 bp, Artificial
  CRISPR gRNA sequence
cacaagcgttgtaaagaaat

SEQ ID NO: 398188 - DNA, 20 bp, Artificial
  CRISPR gRNA sequence
taaagaaatgtaaaatgatg

SEQ ID NO: 398189 - DNA, 20 bp, Artificial
  CRISPR gRNA sequence
ctgtgaagaacagtttagag

SEQ ID NO: 398190 - DNA, 20 bp, Artificial
  CRISPR gRNA sequence
tgaagaacagtttagagatt

SEQ ID NO: 398191 - DNA, 20 bp, Artificial
  CRISPR gRNA sequence
agagattcttcaaaacgttc

SEQ ID NO: 398192 - DNA, 20 bp, Artificial
  CRISPR gRNA sequence
gagattcttcaaaacgttca

SEQ ID NO: 398193 - DNA, 20 bp, Artificial
  CRISPR gRNA sequence
ttcaaaacgttcaacaggat

SEQ ID NO: 398194 - DNA, 20 bp, Artificial
  CRISPR gRNA sequence
caaaacgttcaacaggatta

SEQ ID NO: 398195 - DNA, 20 bp, Artificial
  CRISPR gRNA sequence
aaaacgttcaacaggattac

SEQ ID NO: 398196 - DNA, 20 bp, Artificial
  CRISPR gRNA sequence
aacaggattactgtatgacc

SEQ ID NO: 398197 - DNA, 20 bp, Artificial
  CRISPR gRNA sequence
ctgtatgacccagaagtttt

SEQ ID NO: 398198 - DNA, 20 bp, Artificial
  CRISPR gRNA sequence
tatgacccagaagttttatt

SEQ ID NO: 398199 - DNA, 20 bp, Artificial
  CRISPR gRNA sequence
tattcctaggtatatactca

SEQ ID NO: 398200 - DNA, 20 bp, Artificial
  CRISPR gRNA sequence
attcctaggtatatactcaa

SEQ ID NO: 398201 - DNA, 20 bp, Artificial
  CRISPR gRNA sequence
ttcctaggtatatactcaaa

SEQ ID NO: 398202 - DNA, 20 bp, Artificial
  CRISPR gRNA sequence
ctaggtatatactcaaaaga

SEQ ID NO: 398203 - DNA, 20 bp, Artificial
  CRISPR gRNA sequence
ggtatatactcaaaagaata

SEQ ID NO: 398204 - DNA, 20 bp, Artificial
  CRISPR gRNA sequence
aaaagaatatactcaaacca

SEQ ID NO: 398205 - DNA, 20 bp, Artificial
  CRISPR gRNA sequence
aaaccaatatttgtagacca

SEQ ID NO: 398206 - DNA, 20 bp, Artificial
  CRISPR gRNA sequence
gtagaccaatgtttacagca

SEQ ID NO: 398207 - DNA, 20 bp, Artificial
  CRISPR gRNA sequence
tagaccaatgtttacagcag

SEQ ID NO: 398208 - DNA, 20 bp, Artificial
  CRISPR gRNA sequence
acagcagcattattcacaaa

SEQ ID NO: 398209 - DNA, 20 bp, Artificial
  CRISPR gRNA sequence
cagcagcattattcacaaaa

SEQ ID NO: 398210 - DNA, 20 bp, Artificial
  CRISPR gRNA sequence
ttcacaaaagccagaaggtg

SEQ ID NO: 398211 - DNA, 20 bp, Artificial
  CRISPR gRNA sequence
acaaaagccagaaggtggta

SEQ ID NO: 398212 - DNA, 20 bp, Artificial
  CRISPR gRNA sequence
ccaacaggtgaatgaatgaa

SEQ ID NO: 398213 - DNA, 20 bp, Artificial
  CRISPR gRNA sequence
tgatcaaatccatacaatgg

SEQ ID NO: 398214 - DNA, 20 bp, Artificial
  CRISPR gRNA sequence
ctcagccataaaaaggaatg

SEQ ID NO: 398215 - DNA, 20 bp, Artificial
  CRISPR gRNA sequence
agccataaaaaggaatgaag

SEQ ID NO: 398216 - DNA, 20 bp, Artificial
  CRISPR gRNA sequence
atgcatgctacaacatgaat

SEQ ID NO: 398217 - DNA, 20 bp, Artificial
  CRISPR gRNA sequence
caacatgaataagccttgat

SEQ ID NO: 398218 - DNA, 20 bp, Artificial
  CRISPR gRNA sequence
gataacattatgctaagtca

SEQ ID NO: 398219 - DNA, 20 bp, Artificial
  CRISPR gRNA sequence
ataacattatgctaagtcaa

SEQ ID NO: 398220 - DNA, 20 bp, Artificial
  CRISPR gRNA sequence
tgctaagtcaaagaatgcag

SEQ ID NO: 398221 - DNA, 20 bp, Artificial
  CRISPR gRNA sequence
agtcaaagaatgcagaaaca

SEQ ID NO: 398222 - DNA, 20 bp, Artificial
  CRISPR gRNA sequence
tgtaagaatccatttatatg

SEQ ID NO: 398223 - DNA, 20 bp, Artificial
  CRISPR gRNA sequence
gtaagaatccatttatatga

SEQ ID NO: 398224 - DNA, 20 bp, Artificial
  CRISPR gRNA sequence
taagaatccatttatatgaa

SEQ ID NO: 398225 - DNA, 20 bp, Artificial
  CRISPR gRNA sequence
atatgaaatatccagatagt

SEQ ID NO: 398226 - DNA, 20 bp, Artificial
  CRISPR gRNA sequence
tatgaaatatccagatagtt

SEQ ID NO: 398227 - DNA, 20 bp, Artificial
  CRISPR gRNA sequence
aatccatggagatggaaagc

SEQ ID NO: 398228 - DNA, 20 bp, Artificial
  CRISPR gRNA sequence
gtgatttgccaattgattga

SEQ ID NO: 398229 - DNA, 20 bp, Artificial
  CRISPR gRNA sequence
gccaattgattgactgttgg

SEQ ID NO: 398230 - DNA, 20 bp, Artificial
  CRISPR gRNA sequence
ccaattgattgactgttgga

SEQ ID NO: 398231 - DNA, 20 bp, Artificial
  CRISPR gRNA sequence
attgactgttggaaggaggg

SEQ ID NO: 398232 - DNA, 20 bp, Artificial
  CRISPR gRNA sequence
actgttggaaggagggaata

SEQ ID NO: 398233 - DNA, 20 bp, Artificial
  CRISPR gRNA sequence
ttggaaggagggaataggga

SEQ ID NO: 398234 - DNA, 20 bp, Artificial
  CRISPR gRNA sequence
gaaggagggaatagggagtg

SEQ ID NO: 398235 - DNA, 20 bp, Artificial
  CRISPR gRNA sequence
tttaaggtatggggttttct

SEQ ID NO: 398236 - DNA, 20 bp, Artificial
  CRISPR gRNA sequence
aaggtatggggttttcttta

SEQ ID NO: 398237 - DNA, 20 bp, Artificial
  CRISPR gRNA sequence
aggtatggggttttctttaa

SEQ ID NO: 398238 - DNA, 20 bp, Artificial
  CRISPR gRNA sequence
tctttaaaatgatgaaaatg

SEQ ID NO: 398239 - DNA, 20 bp, Artificial
  CRISPR gRNA sequence
ctttaaaatgatgaaaatgt

SEQ ID NO: 398240 - DNA, 20 bp, Artificial
  CRISPR gRNA sequence
tttaaaatgatgaaaatgtt

SEQ ID NO: 398241 - DNA, 20 bp, Artificial
  CRISPR gRNA sequence
taaaatgatgaaaatgtttt

SEQ ID NO: 398242 - DNA, 20 bp, Artificial
  CRISPR gRNA sequence
aaaatgatgaaaatgttttg

SEQ ID NO: 398243 - DNA, 20 bp, Artificial
  CRISPR gRNA sequence
aaatgatgaaaatgttttgg

SEQ ID NO: 398244 - DNA, 20 bp, Artificial
  CRISPR gRNA sequence
tggaatctgataaaagcggt

SEQ ID NO: 398245 - DNA, 20 bp, Artificial
  CRISPR gRNA sequence
ggaatctgataaaagcggtc

SEQ ID NO: 398246 - DNA, 20 bp, Artificial
  CRISPR gRNA sequence
gaatctgataaaagcggtca

SEQ ID NO: 398247 - DNA, 20 bp, Artificial
  CRISPR gRNA sequence
ataaaagcggtcatcacaga

SEQ ID NO: 398248 - DNA, 20 bp, Artificial
  CRISPR gRNA sequence
tggatgtactaaataccact

SEQ ID NO: 398249 - DNA, 20 bp, Artificial
  CRISPR gRNA sequence
aataccactgaactgtatat

SEQ ID NO: 398250 - DNA, 20 bp, Artificial
  CRISPR gRNA sequence
aactgtatattttaaaatat

SEQ ID NO: 398251 - DNA, 20 bp, Artificial
  CRISPR gRNA sequence
tatattttaaaatatttaat

SEQ ID NO: 398252 - DNA, 20 bp, Artificial
  CRISPR gRNA sequence
taaaatatttaatcttgacc

SEQ ID NO: 398253 - DNA, 20 bp, Artificial
  CRISPR gRNA sequence
aaaatatttaatcttgacct

SEQ ID NO: 398254 - DNA, 20 bp, Artificial
  CRISPR gRNA sequence
aaatatttaatcttgacctg

SEQ ID NO: 398255 - DNA, 20 bp, Artificial
  CRISPR gRNA sequence
aatcttgacctggtgtggtg

SEQ ID NO: 398256 - DNA, 20 bp, Artificial
  CRISPR gRNA sequence
atcttgacctggtgtggtgg

SEQ ID NO: 398257 - DNA, 20 bp, Artificial
  CRISPR gRNA sequence
gacctggtgtggtggctcac

SEQ ID NO: 398258 - DNA, 20 bp, Artificial
  CRISPR gRNA sequence
acctggtgtggtggctcaca

SEQ ID NO: 398259 - DNA, 20 bp, Artificial
  CRISPR gRNA sequence
gtgtggtggctcacacctgt

SEQ ID NO: 398260 - DNA, 20 bp, Artificial
  CRISPR gRNA sequence
acacctgtaatcccagtact

SEQ ID NO: 398261 - DNA, 20 bp, Artificial
  CRISPR gRNA sequence
taatcccagtactttgggag

SEQ ID NO: 398262 - DNA, 20 bp, Artificial
  CRISPR gRNA sequence
tgggaggccaaggcaggtgg

SEQ ID NO: 398263 - DNA, 20 bp, Artificial
  CRISPR gRNA sequence
gggaggccaaggcaggtgga

SEQ ID NO: 398264 - DNA, 20 bp, Artificial
  CRISPR gRNA sequence
ggaggccaaggcaggtggat

SEQ ID NO: 398265 - DNA, 20 bp, Artificial
  CRISPR gRNA sequence
cttgaggtcaggaattcaaa

SEQ ID NO: 398266 - DNA, 20 bp, Artificial
  CRISPR gRNA sequence
gaggtcaggaattcaaaacc

SEQ ID NO: 398267 - DNA, 20 bp, Artificial
  CRISPR gRNA sequence
aggtcaggaattcaaaacca

SEQ ID NO: 398268 - DNA, 20 bp, Artificial
  CRISPR gRNA sequence
aaaaccagcctggccaacat

SEQ ID NO: 398269 - DNA, 20 bp, Artificial
  CRISPR gRNA sequence
gccaacatggtgaaaccccg

SEQ ID NO: 398270 - DNA, 20 bp, Artificial
  CRISPR gRNA sequence
tactaaaaatacaaaaatta

SEQ ID NO: 398271 - DNA, 20 bp, Artificial
  CRISPR gRNA sequence
ctaaaaatacaaaaattagc

SEQ ID NO: 398272 - DNA, 20 bp, Artificial
  CRISPR gRNA sequence
aaaatacaaaaattagctgt

SEQ ID NO: 398273 - DNA, 20 bp, Artificial
  CRISPR gRNA sequence
gctgtgcgtggtggtgcgca

SEQ ID NO: 398274 - DNA, 20 bp, Artificial
  CRISPR gRNA sequence
tgcgtggtggtgcgcaactg

SEQ ID NO: 398275 - DNA, 20 bp, Artificial
  CRISPR gRNA sequence
taatcccagctacttgggag

SEQ ID NO: 398276 - DNA, 20 bp, Artificial
  CRISPR gRNA sequence
cttgggaggctgagacagga

SEQ ID NO: 398277 - DNA, 20 bp, Artificial
  CRISPR gRNA sequence
gggaggctgagacaggagaa

SEQ ID NO: 398278 - DNA, 20 bp, Artificial
  CRISPR gRNA sequence
ggaggctgagacaggagaat

SEQ ID NO: 398279 - DNA, 20 bp, Artificial
  CRISPR gRNA sequence
agacaggagaatcgcttgaa

SEQ ID NO: 398280 - DNA, 20 bp, Artificial
  CRISPR gRNA sequence
gaacccaggaggtggaggtt

SEQ ID NO: 398281 - DNA, 20 bp, Artificial
  CRISPR gRNA sequence
aacccaggaggtggaggttg

SEQ ID NO: 398282 - DNA, 20 bp, Artificial
  CRISPR gRNA sequence
cagtgagctgagattgtgcc

SEQ ID NO: 398283 - DNA, 20 bp, Artificial
  CRISPR gRNA sequence
agattgtgccactgcactcc

SEQ ID NO: 398284 - DNA, 20 bp, Artificial
  CRISPR gRNA sequence
tgccactgcactccagccag

SEQ ID NO: 398285 - DNA, 20 bp, Artificial
  CRISPR gRNA sequence
cactccagccaggtcaacag

SEQ ID NO: 398286 - DNA, 20 bp, Artificial
  CRISPR gRNA sequence
cagccaggtcaacagagcaa

SEQ ID NO: 398287 - DNA, 20 bp, Artificial
  CRISPR gRNA sequence
cgtttcaaaaaaaaaaaaaa

SEQ ID NO: 398288 - DNA, 20 bp, Artificial
  CRISPR gRNA sequence
caaaaaaaaaaaaaaaaagt

SEQ ID NO: 398289 - DNA, 20 bp, Artificial
  CRISPR gRNA sequence
aaaaaaaaaaaaaaaaagtt

SEQ ID NO: 398290 - DNA, 20 bp, Artificial
  CRISPR gRNA sequence
aatcttatgttgactaaatc

SEQ ID NO: 398291 - DNA, 20 bp, Artificial
  CRISPR gRNA sequence
atcttatgttgactaaatct

SEQ ID NO: 398292 - DNA, 20 bp, Artificial
  CRISPR gRNA sequence
atgttgactaaatcttaggt

SEQ ID NO: 398293 - DNA, 20 bp, Artificial
  CRISPR gRNA sequence
tgttgactaaatcttaggtg

SEQ ID NO: 398294 - DNA, 20 bp, Artificial
  CRISPR gRNA sequence
actaaatcttaggtgaacaa

SEQ ID NO: 398295 - DNA, 20 bp, Artificial
  CRISPR gRNA sequence
aatcttaggtgaacaatgtt

SEQ ID NO: 398296 - DNA, 20 bp, Artificial
  CRISPR gRNA sequence
aggtgaacaatgttatgtga

SEQ ID NO: 398297 - DNA, 20 bp, Artificial
  CRISPR gRNA sequence
ggtgaacaatgttatgtgaa

SEQ ID NO: 398298 - DNA, 20 bp, Artificial
  CRISPR gRNA sequence
tgtgaatttcacctcaattt

SEQ ID NO: 398299 - DNA, 20 bp, Artificial
  CRISPR gRNA sequence
cacctcaatttttaaaaatt

SEQ ID NO: 398300 - DNA, 20 bp, Artificial
  CRISPR gRNA sequence
acctcaatttttaaaaattg

SEQ ID NO: 398301 - DNA, 20 bp, Artificial
  CRISPR gRNA sequence
aatttttaaaaattgttact

SEQ ID NO: 398302 - DNA, 20 bp, Artificial
  CRISPR gRNA sequence
ttaaaaattgttactagtga

SEQ ID NO: 398303 - DNA, 20 bp, Artificial
  CRISPR gRNA sequence
taaaaattgttactagtgaa

SEQ ID NO: 398304 - DNA, 20 bp, Artificial
  CRISPR gRNA sequence
aaaaattgttactagtgaat

SEQ ID NO: 398305 - DNA, 20 bp, Artificial
  CRISPR gRNA sequence
aaaattgttactagtgaata

SEQ ID NO: 398306 - DNA, 20 bp, Artificial
  CRISPR gRNA sequence
ttactagtgaatagtatgag

SEQ ID NO: 398307 - DNA, 20 bp, Artificial
  CRISPR gRNA sequence
ctagtgaatagtatgagtcc

SEQ ID NO: 398308 - DNA, 20 bp, Artificial
  CRISPR gRNA sequence
gtgaatagtatgagtccaca

SEQ ID NO: 398309 - DNA, 20 bp, Artificial
  CRISPR gRNA sequence
accccaggtcttaccaatga

SEQ ID NO: 398310 - DNA, 20 bp, Artificial
  CRISPR gRNA sequence
accaatgaatgaggccaccc

SEQ ID NO: 398311 - DNA, 20 bp, Artificial
  CRISPR gRNA sequence
ccaatgaatgaggccacccc

SEQ ID NO: 398312 - DNA, 20 bp, Artificial
  CRISPR gRNA sequence
gctgttggccacgtattaat

SEQ ID NO: 398313 - DNA, 20 bp, Artificial
  CRISPR gRNA sequence
ctgttggccacgtattaatt

SEQ ID NO: 398314 - DNA, 20 bp, Artificial
  CRISPR gRNA sequence
ttggccacgtattaattgat

SEQ ID NO: 398315 - DNA, 20 bp, Artificial
  CRISPR gRNA sequence
gccacgtattaattgatttc

SEQ ID NO: 398316 - DNA, 20 bp, Artificial
  CRISPR gRNA sequence
attgatttcatttgatcccc

SEQ ID NO: 398317 - DNA, 20 bp, Artificial
  CRISPR gRNA sequence
atttcatttgatcccccaac

SEQ ID NO: 398318 - DNA, 20 bp, Artificial
  CRISPR gRNA sequence
catttgatcccccaaccacc

SEQ ID NO: 398319 - DNA, 20 bp, Artificial
  CRISPR gRNA sequence
atttgatcccccaaccaccc

SEQ ID NO: 398320 - DNA, 20 bp, Artificial
  CRISPR gRNA sequence
gatcccccaaccaccccggt

SEQ ID NO: 398321 - DNA, 20 bp, Artificial
  CRISPR gRNA sequence
atcccccaaccaccccggtc

SEQ ID NO: 398322 - DNA, 20 bp, Artificial
  CRISPR gRNA sequence
taagaatacagtacattagc

SEQ ID NO: 398323 - DNA, 20 bp, Artificial
  CRISPR gRNA sequence
agaatacagtacattagcat

SEQ ID NO: 398324 - DNA, 20 bp, Artificial
  CRISPR gRNA sequence
gcatagtacagtctaagcat

SEQ ID NO: 398325 - DNA, 20 bp, Artificial
  CRISPR gRNA sequence
agcatagagtccacagacac

SEQ ID NO: 398326 - DNA, 20 bp, Artificial
  CRISPR gRNA sequence
tgtcacaactttgtgataac

SEQ ID NO: 398327 - DNA, 20 bp, Artificial
  CRISPR gRNA sequence
tcacaactttgtgataacag

SEQ ID NO: 398328 - DNA, 20 bp, Artificial
  CRISPR gRNA sequence
tgtgataacagctggaaatc

SEQ ID NO: 398329 - DNA, 20 bp, Artificial
  CRISPR gRNA sequence
gtgataacagctggaaatca

SEQ ID NO: 398330 - DNA, 20 bp, Artificial
  CRISPR gRNA sequence
tgataacagctggaaatcaa

SEQ ID NO: 398331 - DNA, 20 bp, Artificial
  CRISPR gRNA sequence
gaaatcaataatgcaaaaga

SEQ ID NO: 398332 - DNA, 20 bp, Artificial
  CRISPR gRNA sequence
tcagataaatgatttaagat

SEQ ID NO: 398333 - DNA, 20 bp, Artificial
  CRISPR gRNA sequence
aagatatttttaaaaatcat

SEQ ID NO: 398334 - DNA, 20 bp, Artificial
  CRISPR gRNA sequence
agatatttttaaaaatcatt

SEQ ID NO: 398335 - DNA, 20 bp, Artificial
  CRISPR gRNA sequence
ttaaaaatcattatgtgctt

SEQ ID NO: 398336 - DNA, 20 bp, Artificial
  CRISPR gRNA sequence
taaaaatcattatgtgctta

SEQ ID NO: 398337 - DNA, 20 bp, Artificial
  CRISPR gRNA sequence
aaaaatcattatgtgcttat

SEQ ID NO: 398338 - DNA, 20 bp, Artificial
  CRISPR gRNA sequence
aaaatcattatgtgcttatt

SEQ ID NO: 398339 - DNA, 20 bp, Artificial
  CRISPR gRNA sequence
tgtgcttattaaacaaatgc

SEQ ID NO: 398340 - DNA, 20 bp, Artificial
  CRISPR gRNA sequence
attaaacaaatgccaaaaca

SEQ ID NO: 398341 - DNA, 20 bp, Artificial
  CRISPR gRNA sequence
ttaaacaaatgccaaaacat

SEQ ID NO: 398342 - DNA, 20 bp, Artificial
  CRISPR gRNA sequence
aacaaatgccaaaacatatc

SEQ ID NO: 398343 - DNA, 20 bp, Artificial
  CRISPR gRNA sequence
ttttctgagggaggggtcag

SEQ ID NO: 398344 - DNA, 20 bp, Artificial
  CRISPR gRNA sequence
tctgagggaggggtcagggt

SEQ ID NO: 398345 - DNA, 20 bp, Artificial
  CRISPR gRNA sequence
ctgagggaggggtcagggtt

SEQ ID NO: 398346 - DNA, 20 bp, Artificial
  CRISPR gRNA sequence
tgagggaggggtcagggttg

SEQ ID NO: 398347 - DNA, 20 bp, Artificial
  CRISPR gRNA sequence
agggaggggtcagggttggg

SEQ ID NO: 398348 - DNA, 20 bp, Artificial
  CRISPR gRNA sequence
ggtaaagtggggtagaggtg

SEQ ID NO: 398349 - DNA, 20 bp, Artificial
  CRISPR gRNA sequence
agggccaagcaggcatctgc

SEQ ID NO: 398350 - DNA, 20 bp, Artificial
  CRISPR gRNA sequence
caacaccgtgctgcctcaaa

SEQ ID NO: 398351 - DNA, 20 bp, Artificial
  CRISPR gRNA sequence
cctcaaatcctaaaggaaat

SEQ ID NO: 398352 - DNA, 20 bp, Artificial
  CRISPR gRNA sequence
aaatcctaaaggaaatgaga

SEQ ID NO: 398353 - DNA, 20 bp, Artificial
  CRISPR gRNA sequence
aaggaaatgagatgaaacct

SEQ ID NO: 398354 - DNA, 20 bp, Artificial
  CRISPR gRNA sequence
gcatcatccactctcggtgg

SEQ ID NO: 398355 - DNA, 20 bp, Artificial
  CRISPR gRNA sequence
tcggtggtttctatgatcag

SEQ ID NO: 398356 - DNA, 20 bp, Artificial
  CRISPR gRNA sequence
ggtggtttctatgatcaggc

SEQ ID NO: 398357 - DNA, 20 bp, Artificial
  CRISPR gRNA sequence
ctatgatcaggcccaaagtg

SEQ ID NO: 398358 - DNA, 20 bp, Artificial
  CRISPR gRNA sequence
tatgatcaggcccaaagtga

SEQ ID NO: 398359 - DNA, 20 bp, Artificial
  CRISPR gRNA sequence
tgatcaggcccaaagtgaac

SEQ ID NO: 398360 - DNA, 20 bp, Artificial
  CRISPR gRNA sequence
cctcacccaggataaagaaa

SEQ ID NO: 398361 - DNA, 20 bp, Artificial
  CRISPR gRNA sequence
ctcacccaggataaagaaat

SEQ ID NO: 398362 - DNA, 20 bp, Artificial
  CRISPR gRNA sequence
acccaggataaagaaatgag

SEQ ID NO: 398363 - DNA, 20 bp, Artificial
  CRISPR gRNA sequence
atgggaggaggactggaaaa

SEQ ID NO: 398364 - DNA, 20 bp, Artificial
  CRISPR gRNA sequence
gaaaaggggtactaactggt

SEQ ID NO: 398365 - DNA, 20 bp, Artificial
  CRISPR gRNA sequence
actggtaataacttgtagga

SEQ ID NO: 398366 - DNA, 20 bp, Artificial
  CRISPR gRNA sequence
gtaataacttgtaggaactc

SEQ ID NO: 398367 - DNA, 20 bp, Artificial
  CRISPR gRNA sequence
gtaggaactccttattccca

SEQ ID NO: 398368 - DNA, 20 bp, Artificial
  CRISPR gRNA sequence
taggaactccttattcccaa

SEQ ID NO: 398369 - DNA, 20 bp, Artificial
  CRISPR gRNA sequence
cttattcccaaggcatccag

SEQ ID NO: 398370 - DNA, 20 bp, Artificial
  CRISPR gRNA sequence
attcccaaggcatccagagc

SEQ ID NO: 398371 - DNA, 20 bp, Artificial
  CRISPR gRNA sequence
ttcccaaggcatccagagcc

SEQ ID NO: 398372 - DNA, 20 bp, Artificial
  CRISPR gRNA sequence
ccaaggcatccagagccaac

SEQ ID NO: 398373 - DNA, 20 bp, Artificial
  CRISPR gRNA sequence
gtcaagagatgaagagaact

SEQ ID NO: 398374 - DNA, 20 bp, Artificial
  CRISPR gRNA sequence
gtgtatttgcaccctggaat

SEQ ID NO: 398375 - DNA, 20 bp, Artificial
  CRISPR gRNA sequence
tgtatttgcaccctggaatt

SEQ ID NO: 398376 - DNA, 20 bp, Artificial
  CRISPR gRNA sequence
gcaccctggaattgagggtc

SEQ ID NO: 398377 - DNA, 20 bp, Artificial
  CRISPR gRNA sequence
caccctggaattgagggtcc

SEQ ID NO: 398378 - DNA, 20 bp, Artificial
  CRISPR gRNA sequence
gaattgagggtcctagaggt

SEQ ID NO: 398379 - DNA, 20 bp, Artificial
  CRISPR gRNA sequence
agggtcctagaggtcacaga

SEQ ID NO: 398380 - DNA, 20 bp, Artificial
  CRISPR gRNA sequence
gaggtcacagattcgaatga

SEQ ID NO: 398381 - DNA, 20 bp, Artificial
  CRISPR gRNA sequence
gaatgaaaggggcagaaaga

SEQ ID NO: 398382 - DNA, 20 bp, Artificial
  CRISPR gRNA sequence
gcagctgaagacaaagtcca

SEQ ID NO: 398383 - DNA, 20 bp, Artificial
  CRISPR gRNA sequence
cagctgaagacaaagtccag

SEQ ID NO: 398384 - DNA, 20 bp, Artificial
  CRISPR gRNA sequence
aagacaaagtccagctgtta

SEQ ID NO: 398385 - DNA, 20 bp, Artificial
  CRISPR gRNA sequence
ttacgactttgctagagatg

SEQ ID NO: 398386 - DNA, 20 bp, Artificial
  CRISPR gRNA sequence
cgactttgctagagatgagc

SEQ ID NO: 398387 - DNA, 20 bp, Artificial
  CRISPR gRNA sequence
tgctagagatgagccctatt

SEQ ID NO: 398388 - DNA, 20 bp, Artificial
  CRISPR gRNA sequence
gctagagatgagccctattt

SEQ ID NO: 398389 - DNA, 20 bp, Artificial
  CRISPR gRNA sequence
ctagagatgagccctattta

SEQ ID NO: 398390 - DNA, 20 bp, Artificial
  CRISPR gRNA sequence
gagatgagccctatttatca

SEQ ID NO: 398391 - DNA, 20 bp, Artificial
  CRISPR gRNA sequence
tttatcaacatctaaccaaa

SEQ ID NO: 398392 - DNA, 20 bp, Artificial
  CRISPR gRNA sequence
atcaacatctaaccaaagac

SEQ ID NO: 398393 - DNA, 20 bp, Artificial
  CRISPR gRNA sequence
tcaacatctaaccaaagaca

SEQ ID NO: 398394 - DNA, 20 bp, Artificial
  CRISPR gRNA sequence
accaaagacaaatagagaca

SEQ ID NO: 398395 - DNA, 20 bp, Artificial
  CRISPR gRNA sequence
gagctatttttgttgtgtca

SEQ ID NO: 398396 - DNA, 20 bp, Artificial
  CRISPR gRNA sequence
agctatttttgttgtgtcag

SEQ ID NO: 398397 - DNA, 20 bp, Artificial
  CRISPR gRNA sequence
tttttgttgtgtcagcagcc

SEQ ID NO: 398398 - DNA, 20 bp, Artificial
  CRISPR gRNA sequence
ttgttgtgtcagcagccatt

SEQ ID NO: 398399 - DNA, 20 bp, Artificial
  CRISPR gRNA sequence
tgttgtgtcagcagccattt

SEQ ID NO: 398400 - DNA, 20 bp, Artificial
  CRISPR gRNA sequence
gttgtgtcagcagccatttt

SEQ ID NO: 398401 - DNA, 20 bp, Artificial
  CRISPR gRNA sequence
ttgtgtcagcagccattttt

SEQ ID NO: 398402 - DNA, 20 bp, Artificial
  CRISPR gRNA sequence
tgtcagcagccattttttgc

SEQ ID NO: 398403 - DNA, 20 bp, Artificial
  CRISPR gRNA sequence
tttgcatgatttatgaaggg

SEQ ID NO: 398404 - DNA, 20 bp, Artificial
  CRISPR gRNA sequence
ttgcatgatttatgaaggga

SEQ ID NO: 398405 - DNA, 20 bp, Artificial
  CRISPR gRNA sequence
tgcatgatttatgaagggat

SEQ ID NO: 398406 - DNA, 20 bp, Artificial
  CRISPR gRNA sequence
gcatgatttatgaagggatt

SEQ ID NO: 398407 - DNA, 20 bp, Artificial
  CRISPR gRNA sequence
catgatttatgaagggattt

SEQ ID NO: 398408 - DNA, 20 bp, Artificial
  CRISPR gRNA sequence
atgaagggattttggcttga

SEQ ID NO: 398409 - DNA, 20 bp, Artificial
  CRISPR gRNA sequence
tgaagggattttggcttgag

SEQ ID NO: 398410 - DNA, 20 bp, Artificial
  CRISPR gRNA sequence
tggcttgaggttttttttct

SEQ ID NO: 398411 - DNA, 20 bp, Artificial
  CRISPR gRNA sequence
ggcttgaggttttttttcta

SEQ ID NO: 398412 - DNA, 20 bp, Artificial
  CRISPR gRNA sequence
gcttgaggttttttttctaa

SEQ ID NO: 398413 - DNA, 20 bp, Artificial
  CRISPR gRNA sequence
gaggttttttttctaataga

SEQ ID NO: 398414 - DNA, 20 bp, Artificial
  CRISPR gRNA sequence
aggttttttttctaatagag

SEQ ID NO: 398415 - DNA, 20 bp, Artificial
  CRISPR gRNA sequence
tttttctaatagagctgtct

SEQ ID NO: 398416 - DNA, 20 bp, Artificial
  CRISPR gRNA sequence
ttttctaatagagctgtctg

SEQ ID NO: 398417 - DNA, 20 bp, Artificial
  CRISPR gRNA sequence
tttctaatagagctgtctgt

SEQ ID NO: 398418 - DNA, 20 bp, Artificial
  CRISPR gRNA sequence
ttctaatagagctgtctgta

SEQ ID NO: 398419 - DNA, 20 bp, Artificial
  CRISPR gRNA sequence
tctaatagagctgtctgtat

SEQ ID NO: 398420 - DNA, 20 bp, Artificial
  CRISPR gRNA sequence
ctaatagagctgtctgtata

SEQ ID NO: 398421 - DNA, 20 bp, Artificial
  CRISPR gRNA sequence
taatagagctgtctgtataa

SEQ ID NO: 398422 - DNA, 20 bp, Artificial
  CRISPR gRNA sequence
atagagctgtctgtataaaa

SEQ ID NO: 398423 - DNA, 20 bp, Artificial
  CRISPR gRNA sequence
tctgtataaaagagctttgt

SEQ ID NO: 398424 - DNA, 20 bp, Artificial
  CRISPR gRNA sequence
tataaaagagctttgtcctc

SEQ ID NO: 398425 - DNA, 20 bp, Artificial
  CRISPR gRNA sequence
tgtcctcaaggaagtcatta

SEQ ID NO: 398426 - DNA, 20 bp, Artificial
  CRISPR gRNA sequence
gtcctcaaggaagtcattaa

SEQ ID NO: 398427 - DNA, 20 bp, Artificial
  CRISPR gRNA sequence
tcctcaaggaagtcattaat

SEQ ID NO: 398428 - DNA, 20 bp, Artificial
  CRISPR gRNA sequence
aaggaagtcattaatcaaaa

SEQ ID NO: 398429 - DNA, 20 bp, Artificial
  CRISPR gRNA sequence
atcaaaatattactggattt

SEQ ID NO: 398430 - DNA, 20 bp, Artificial
  CRISPR gRNA sequence
ctggatttctctactattaa

SEQ ID NO: 398431 - DNA, 20 bp, Artificial
  CRISPR gRNA sequence
gatttctctactattaaaaa

SEQ ID NO: 398432 - DNA, 20 bp, Artificial
  CRISPR gRNA sequence
ctctactattaaaaatgtct

SEQ ID NO: 398433 - DNA, 20 bp, Artificial
  CRISPR gRNA sequence
tctactattaaaaatgtctc

SEQ ID NO: 398434 - DNA, 20 bp, Artificial
  CRISPR gRNA sequence
tactattaaaaatgtctcag

SEQ ID NO: 398435 - DNA, 20 bp, Artificial
  CRISPR gRNA sequence
ctattaaaaatgtctcagct

SEQ ID NO: 398436 - DNA, 20 bp, Artificial
  CRISPR gRNA sequence
ttaaaaatgtctcagctaac

SEQ ID NO: 398437 - DNA, 20 bp, Artificial
  CRISPR gRNA sequence
aaaatgtctcagctaaccac

SEQ ID NO: 398438 - DNA, 20 bp, Artificial
  CRISPR gRNA sequence
agctaaccacatgagcatga

SEQ ID NO: 398439 - DNA, 20 bp, Artificial
  CRISPR gRNA sequence
accacatgagcatgaattca

SEQ ID NO: 398440 - DNA, 20 bp, Artificial
  CRISPR gRNA sequence
atctcacaagcttgcctctg

SEQ ID NO: 398441 - DNA, 20 bp, Artificial
  CRISPR gRNA sequence
acaagcttgcctctgaatgc

SEQ ID NO: 398442 - DNA, 20 bp, Artificial
  CRISPR gRNA sequence
gcctctgaatgcagactcct

SEQ ID NO: 398443 - DNA, 20 bp, Artificial
  CRISPR gRNA sequence
cctctgaatgcagactccta

SEQ ID NO: 398444 - DNA, 20 bp, Artificial
  CRISPR gRNA sequence
tgaatgcagactcctaggtg

SEQ ID NO: 398445 - DNA, 20 bp, Artificial
  CRISPR gRNA sequence
aatgcagactcctaggtggc

SEQ ID NO: 398446 - DNA, 20 bp, Artificial
  CRISPR gRNA sequence
ctaggtggcctgggtgggtg

SEQ ID NO: 398447 - DNA, 20 bp, Artificial
  CRISPR gRNA sequence
ggtggcctgggtgggtgggg

SEQ ID NO: 398448 - DNA, 20 bp, Artificial
  CRISPR gRNA sequence
ggtgggtggggacggggaac

SEQ ID NO: 398449 - DNA, 20 bp, Artificial
  CRISPR gRNA sequence
ttcagccacactgttcttct

SEQ ID NO: 398450 - DNA, 20 bp, Artificial
  CRISPR gRNA sequence
cagccacactgttcttcttc

SEQ ID NO: 398451 - DNA, 20 bp, Artificial
  CRISPR gRNA sequence
agccacactgttcttcttcc

SEQ ID NO: 398452 - DNA, 20 bp, Artificial
  CRISPR gRNA sequence
ttcttcttcctgtaggctgt

SEQ ID NO: 398453 - DNA, 20 bp, Artificial
  CRISPR gRNA sequence
ttcttcctgtaggctgtcca

SEQ ID NO: 398454 - DNA, 20 bp, Artificial
  CRISPR gRNA sequence
cttcctgtaggctgtccacc

SEQ ID NO: 398455 - DNA, 20 bp, Artificial
  CRISPR gRNA sequence
ttcctgtaggctgtccaccc

SEQ ID NO: 398456 - DNA, 20 bp, Artificial
  CRISPR gRNA sequence
cctgtaggctgtccacccag

SEQ ID NO: 398457 - DNA, 20 bp, Artificial
  CRISPR gRNA sequence
ctgtaggctgtccacccagg

SEQ ID NO: 398458 - DNA, 20 bp, Artificial
  CRISPR gRNA sequence
taggctgtccacccaggtag

SEQ ID NO: 398459 - DNA, 20 bp, Artificial
  CRISPR gRNA sequence
tccacccaggtagaaccttc

SEQ ID NO: 398460 - DNA, 20 bp, Artificial
  CRISPR gRNA sequence
ccctgtcacctcagtttcat

SEQ ID NO: 398461 - DNA, 20 bp, Artificial
  CRISPR gRNA sequence
cctgtcacctcagtttcatt

SEQ ID NO: 398462 - DNA, 20 bp, Artificial
  CRISPR gRNA sequence
tcacctcagtttcattgttt

SEQ ID NO: 398463 - DNA, 20 bp, Artificial
  CRISPR gRNA sequence
agtttcattgtttctgctac

SEQ ID NO: 398464 - DNA, 20 bp, Artificial
  CRISPR gRNA sequence
cattgtttctgctacctaca

SEQ ID NO: 398465 - DNA, 20 bp, Artificial
  CRISPR gRNA sequence
attgtttctgctacctacaa

SEQ ID NO: 398466 - DNA, 20 bp, Artificial
  CRISPR gRNA sequence
tttctgctacctacaatatg

SEQ ID NO: 398467 - DNA, 20 bp, Artificial
  CRISPR gRNA sequence
ctgctacctacaatatgtcc

SEQ ID NO: 398468 - DNA, 20 bp, Artificial
  CRISPR gRNA sequence
tgctacctacaatatgtcct

SEQ ID NO: 398469 - DNA, 20 bp, Artificial
  CRISPR gRNA sequence
ctacctacaatatgtcctgc

SEQ ID NO: 398470 - DNA, 20 bp, Artificial
  CRISPR gRNA sequence
cctacaatatgtcctgcttc

SEQ ID NO: 398471 - DNA, 20 bp, Artificial
  CRISPR gRNA sequence
caatatgtcctgcttcccca

SEQ ID NO: 398472 - DNA, 20 bp, Artificial
  CRISPR gRNA sequence
cttccccagatgtctctatg

SEQ ID NO: 398473 - DNA, 20 bp, Artificial
  CRISPR gRNA sequence
ccccagatgtctctatggtt

SEQ ID NO: 398474 - DNA, 20 bp, Artificial
  CRISPR gRNA sequence
cccagatgtctctatggttt

SEQ ID NO: 398475 - DNA, 20 bp, Artificial
  CRISPR gRNA sequence
tatggtttctgagcattggg

SEQ ID NO: 398476 - DNA, 20 bp, Artificial
  CRISPR gRNA sequence
tggtttctgagcattgggag

SEQ ID NO: 398477 - DNA, 20 bp, Artificial
  CRISPR gRNA sequence
ctgagcattgggaggagtct

SEQ ID NO: 398478 - DNA, 20 bp, Artificial
  CRISPR gRNA sequence
tgagcattgggaggagtctc

SEQ ID NO: 398479 - DNA, 20 bp, Artificial
  CRISPR gRNA sequence
agcattgggaggagtctcct

SEQ ID NO: 398480 - DNA, 20 bp, Artificial
  CRISPR gRNA sequence
ggaggagtctcctagtgtct

SEQ ID NO: 398481 - DNA, 20 bp, Artificial
  CRISPR gRNA sequence
ctagtgtctactcaatgacc

SEQ ID NO: 398482 - DNA, 20 bp, Artificial
  CRISPR gRNA sequence
gtgtctactcaatgacccca

SEQ ID NO: 398483 - DNA, 20 bp, Artificial
  CRISPR gRNA sequence
ctcaatgaccccaccttccc

SEQ ID NO: 398484 - DNA, 20 bp, Artificial
  CRISPR gRNA sequence
aatgaccccaccttccccag

SEQ ID NO: 398485 - DNA, 20 bp, Artificial
  CRISPR gRNA sequence
ccccagtttatgcaaaaaca

SEQ ID NO: 398486 - DNA, 20 bp, Artificial
  CRISPR gRNA sequence
cccagtttatgcaaaaacac

SEQ ID NO: 398487 - DNA, 20 bp, Artificial
  CRISPR gRNA sequence
atgcaaaaacacctgatgtg

SEQ ID NO: 398488 - DNA, 20 bp, Artificial
  CRISPR gRNA sequence
tgcaaaaacacctgatgtgt

SEQ ID NO: 398489 - DNA, 20 bp, Artificial
  CRISPR gRNA sequence
atgtgtgtgatggagaatct

SEQ ID NO: 398490 - DNA, 20 bp, Artificial
  CRISPR gRNA sequence
ctctgatacctttcgacact

SEQ ID NO: 398491 - DNA, 20 bp, Artificial
  CRISPR gRNA sequence
tgatacctttcgacacttgc

SEQ ID NO: 398492 - DNA, 20 bp, Artificial
  CRISPR gRNA sequence
atacctttcgacacttgctt

SEQ ID NO: 398493 - DNA, 20 bp, Artificial
  CRISPR gRNA sequence
tcgacacttgcttggaaaac

SEQ ID NO: 398494 - DNA, 20 bp, Artificial
  CRISPR gRNA sequence
cgacacttgcttggaaaact

SEQ ID NO: 398495 - DNA, 20 bp, Artificial
  CRISPR gRNA sequence
gacacttgcttggaaaacta

SEQ ID NO: 398496 - DNA, 20 bp, Artificial
  CRISPR gRNA sequence
gcttggaaaactattcacat

SEQ ID NO: 398497 - DNA, 20 bp, Artificial
  CRISPR gRNA sequence
cttggaaaactattcacatg

SEQ ID NO: 398498 - DNA, 20 bp, Artificial
  CRISPR gRNA sequence
ggaaaactattcacatgctg

SEQ ID NO: 398499 - DNA, 20 bp, Artificial
  CRISPR gRNA sequence
gaaaactattcacatgctgg

SEQ ID NO: 398500 - DNA, 20 bp, Artificial
  CRISPR gRNA sequence
ttcacatgctggaaagcaga

SEQ ID NO: 398501 - DNA, 20 bp, Artificial
  CRISPR gRNA sequence
acatgctggaaagcagagga

SEQ ID NO: 398502 - DNA, 20 bp, Artificial
  CRISPR gRNA sequence
gaaagcagaggactgtgaac

SEQ ID NO: 398503 - DNA, 20 bp, Artificial
  CRISPR gRNA sequence
tgaacagaaaatctagctaa

SEQ ID NO: 398504 - DNA, 20 bp, Artificial
  CRISPR gRNA sequence
gctaaactcagaacaagtga

SEQ ID NO: 398505 - DNA, 20 bp, Artificial
  CRISPR gRNA sequence
aactcagaacaagtgactgg

SEQ ID NO: 398506 - DNA, 20 bp, Artificial
  CRISPR gRNA sequence
agaacaagtgactggggctg

SEQ ID NO: 398507 - DNA, 20 bp, Artificial
  CRISPR gRNA sequence
gggctgggaagattatagtg

SEQ ID NO: 398508 - DNA, 20 bp, Artificial
  CRISPR gRNA sequence
ggaagattatagtgtgagag

SEQ ID NO: 398509 - DNA, 20 bp, Artificial
  CRISPR gRNA sequence
tagtgtgagaggtcgtttgc

SEQ ID NO: 398510 - DNA, 20 bp, Artificial
  CRISPR gRNA sequence
gctccctccactccttctca

SEQ ID NO: 398511 - DNA, 20 bp, Artificial
  CRISPR gRNA sequence
ctccctccactccttctcag

SEQ ID NO: 398512 - DNA, 20 bp, Artificial
  CRISPR gRNA sequence
cctccactccttctcagatg

SEQ ID NO: 398513 - DNA, 20 bp, Artificial
  CRISPR gRNA sequence
cactccttctcagatgcgag

SEQ ID NO: 398514 - DNA, 20 bp, Artificial
  CRISPR gRNA sequence
cttctcagatgcgagggttt

SEQ ID NO: 398515 - DNA, 20 bp, Artificial
  CRISPR gRNA sequence
ctcagatgcgagggtttgcc

SEQ ID NO: 398516 - DNA, 20 bp, Artificial
  CRISPR gRNA sequence
tcagatgcgagggtttgcct

SEQ ID NO: 398517 - DNA, 20 bp, Artificial
  CRISPR gRNA sequence
agatgcgagggtttgcctgc

SEQ ID NO: 398518 - DNA, 20 bp, Artificial
  CRISPR gRNA sequence
gcctgccttctgctgggatg

SEQ ID NO: 398519 - DNA, 20 bp, Artificial
  CRISPR gRNA sequence
cctgccttctgctgggatgc

SEQ ID NO: 398520 - DNA, 20 bp, Artificial
  CRISPR gRNA sequence
ccttctgctgggatgcccca

SEQ ID NO: 398521 - DNA, 20 bp, Artificial
  CRISPR gRNA sequence
ctgctgggatgccccagctg

SEQ ID NO: 398522 - DNA, 20 bp, Artificial
  CRISPR gRNA sequence
tgctgggatgccccagctgt

SEQ ID NO: 398523 - DNA, 20 bp, Artificial
  CRISPR gRNA sequence
ctgggatgccccagctgtta

SEQ ID NO: 398524 - DNA, 20 bp, Artificial
  CRISPR gRNA sequence
ggatgccccagctgttaaga

SEQ ID NO: 398525 - DNA, 20 bp, Artificial
  CRISPR gRNA sequence
ttaagaggctcatacttcca

SEQ ID NO: 398526 - DNA, 20 bp, Artificial
  CRISPR gRNA sequence
agaggctcatacttccagta

SEQ ID NO: 398527 - DNA, 20 bp, Artificial
  CRISPR gRNA sequence
atacttccagtaagatttcc

SEQ ID NO: 398528 - DNA, 20 bp, Artificial
  CRISPR gRNA sequence
ccagtaagatttccacagga

SEQ ID NO: 398529 - DNA, 20 bp, Artificial
  CRISPR gRNA sequence
cagtaagatttccacaggag

SEQ ID NO: 398530 - DNA, 20 bp, Artificial
  CRISPR gRNA sequence
ccacaggaggccgggtgcgg

SEQ ID NO: 398531 - DNA, 20 bp, Artificial
  CRISPR gRNA sequence
cacaggaggccgggtgcggt

SEQ ID NO: 398532 - DNA, 20 bp, Artificial
  CRISPR gRNA sequence
acgcctgtaatcccaaagtg

SEQ ID NO: 398533 - DNA, 20 bp, Artificial
  CRISPR gRNA sequence
taatcccaaagtgaaggccg

SEQ ID NO: 398534 - DNA, 20 bp, Artificial
  CRISPR gRNA sequence
acacggtgaaaccacgtctc

SEQ ID NO: 398535 - DNA, 20 bp, Artificial
  CRISPR gRNA sequence
tgctaaaaatacaaaaaatt

SEQ ID NO: 398536 - DNA, 20 bp, Artificial
  CRISPR gRNA sequence
ctaaaaatacaaaaaattag

SEQ ID NO: 398537 - DNA, 20 bp, Artificial
  CRISPR gRNA sequence
aaaatacaaaaaattagccg

SEQ ID NO: 398538 - DNA, 20 bp, Artificial
  CRISPR gRNA sequence
gccgggtgtggtagcgggca

SEQ ID NO: 398539 - DNA, 20 bp, Artificial
  CRISPR gRNA sequence
tagtcccagctactcaggag

SEQ ID NO: 398540 - DNA, 20 bp, Artificial
  CRISPR gRNA sequence
ctcaggaggctgaggcagga

SEQ ID NO: 398541 - DNA, 20 bp, Artificial
  CRISPR gRNA sequence
aggaggctgaggcaggagaa

SEQ ID NO: 398542 - DNA, 20 bp, Artificial
  CRISPR gRNA sequence
aggcaggagaatggcgtgaa

SEQ ID NO: 398543 - DNA, 20 bp, Artificial
  CRISPR gRNA sequence
gcagtgagccgacatcgcac

SEQ ID NO: 398544 - DNA, 20 bp, Artificial
  CRISPR gRNA sequence
cagtgagccgacatcgcacc

SEQ ID NO: 398545 - DNA, 20 bp, Artificial
  CRISPR gRNA sequence
cactccagcctgggcaaagg

SEQ ID NO: 398546 - DNA, 20 bp, Artificial
  CRISPR gRNA sequence
cagcctgggcaaaggagcga

SEQ ID NO: 398547 - DNA, 20 bp, Artificial
  CRISPR gRNA sequence
ggcaaaggagcgagactcca

SEQ ID NO: 398548 - DNA, 20 bp, Artificial
  CRISPR gRNA sequence
catctcaaaaaaaaaaaaaa

SEQ ID NO: 398549 - DNA, 20 bp, Artificial
  CRISPR gRNA sequence
aaaaaaaaaaaaaaaaaaaa

SEQ ID NO: 398550 - DNA, 20 bp, Artificial
  CRISPR gRNA sequence
cctcaggaacacaatagtct

SEQ ID NO: 398551 - DNA, 20 bp, Artificial
  CRISPR gRNA sequence
ctcaggaacacaatagtctg

SEQ ID NO: 398552 - DNA, 20 bp, Artificial
  CRISPR gRNA sequence
aggaacacaatagtctgggt

SEQ ID NO: 398553 - DNA, 20 bp, Artificial
  CRISPR gRNA sequence
ggtttctgctcccttcctca

SEQ ID NO: 398554 - DNA, 20 bp, Artificial
  CRISPR gRNA sequence
ctgctcccttcctcaaataa

SEQ ID NO: 398555 - DNA, 20 bp, Artificial
  CRISPR gRNA sequence
tgctcccttcctcaaataat

SEQ ID NO: 398556 - DNA, 20 bp, Artificial
  CRISPR gRNA sequence
ctcccttcctcaaataatct

SEQ ID NO: 398557 - DNA, 20 bp, Artificial
  CRISPR gRNA sequence
ccttcctcaaataatctcat

SEQ ID NO: 398558 - DNA, 20 bp, Artificial
  CRISPR gRNA sequence
cctcaaataatctcattaag

SEQ ID NO: 398559 - DNA, 20 bp, Artificial
  CRISPR gRNA sequence
ctcaaataatctcattaaga

SEQ ID NO: 398560 - DNA, 20 bp, Artificial
  CRISPR gRNA sequence
aaataatctcattaagagaa

SEQ ID NO: 398561 - DNA, 20 bp, Artificial
  CRISPR gRNA sequence
attaagagaacctttccaat

SEQ ID NO: 398562 - DNA, 20 bp, Artificial
  CRISPR gRNA sequence
agagaacctttccaatgtgg

SEQ ID NO: 398563 - DNA, 20 bp, Artificial
  CRISPR gRNA sequence
tccaatgtgggccacatggt

SEQ ID NO: 398564 - DNA, 20 bp, Artificial
  CRISPR gRNA sequence
ccaatgtgggccacatggtc

SEQ ID NO: 398565 - DNA, 20 bp, Artificial
  CRISPR gRNA sequence
caatgtgggccacatggtct

SEQ ID NO: 398566 - DNA, 20 bp, Artificial
  CRISPR gRNA sequence
ctctagaccacgataccctt

SEQ ID NO: 398567 - DNA, 20 bp, Artificial
  CRISPR gRNA sequence
tagaccacgatacccttaga

SEQ ID NO: 398568 - DNA, 20 bp, Artificial
  CRISPR gRNA sequence
gaccacgatacccttagaac

SEQ ID NO: 398569 - DNA, 20 bp, Artificial
  CRISPR gRNA sequence
agaaccttggcaagtcatac

SEQ ID NO: 398570 - DNA, 20 bp, Artificial
  CRISPR gRNA sequence
gaaccttggcaagtcataca

SEQ ID NO: 398571 - DNA, 20 bp, Artificial
  CRISPR gRNA sequence
ggcaagtcatacacatgtcc

SEQ ID NO: 398572 - DNA, 20 bp, Artificial
  CRISPR gRNA sequence
gcaagtcatacacatgtccc

SEQ ID NO: 398573 - DNA, 20 bp, Artificial
  CRISPR gRNA sequence
ctgctgagtgaccagtagaa

SEQ ID NO: 398574 - DNA, 20 bp, Artificial
  CRISPR gRNA sequence
ctgagtgaccagtagaaccc

SEQ ID NO: 398575 - DNA, 20 bp, Artificial
  CRISPR gRNA sequence
agtgaccagtagaaccccac

SEQ ID NO: 398576 - DNA, 20 bp, Artificial
  CRISPR gRNA sequence
ccagtcaacgcaaagactcc

SEQ ID NO: 398577 - DNA, 20 bp, Artificial
  CRISPR gRNA sequence
cagtcaacgcaaagactcca

SEQ ID NO: 398578 - DNA, 20 bp, Artificial
  CRISPR gRNA sequence
cagttggggttcagcaggga

SEQ ID NO: 398579 - DNA, 20 bp, Artificial
  CRISPR gRNA sequence
gggttcagcagggatcctct

SEQ ID NO: 398580 - DNA, 20 bp, Artificial
  CRISPR gRNA sequence
agcagggatcctctaagaca

SEQ ID NO: 398581 - DNA, 20 bp, Artificial
  CRISPR gRNA sequence
taagacagggttctgaaact

SEQ ID NO: 398582 - DNA, 20 bp, Artificial
  CRISPR gRNA sequence
agacagggttctgaaactat

SEQ ID NO: 398583 - DNA, 20 bp, Artificial
  CRISPR gRNA sequence
tgaaactatggcctgagggc

SEQ ID NO: 398584 - DNA, 20 bp, Artificial
  CRISPR gRNA sequence
aaactatggcctgagggctg

SEQ ID NO: 398585 - DNA, 20 bp, Artificial
  CRISPR gRNA sequence
tggcctgagggctgggcgca

SEQ ID NO: 398586 - DNA, 20 bp, Artificial
  CRISPR gRNA sequence
agggctgggcgcagcccact

SEQ ID NO: 398587 - DNA, 20 bp, Artificial
  CRISPR gRNA sequence
ggcgcagcccactgatttcc

SEQ ID NO: 398588 - DNA, 20 bp, Artificial
  CRISPR gRNA sequence
atttccataaacagtttggt

SEQ ID NO: 398589 - DNA, 20 bp, Artificial
  CRISPR gRNA sequence
ccataaacagtttggttgga

SEQ ID NO: 398590 - DNA, 20 bp, Artificial
  CRISPR gRNA sequence
cataaacagtttggttggag

SEQ ID NO: 398591 - DNA, 20 bp, Artificial
  CRISPR gRNA sequence
ggttggagacagccatgctc

SEQ ID NO: 398592 - DNA, 20 bp, Artificial
  CRISPR gRNA sequence
gttggagacagccatgctca

SEQ ID NO: 398593 - DNA, 20 bp, Artificial
  CRISPR gRNA sequence
gagacagccatgctcacttg

SEQ ID NO: 398594 - DNA, 20 bp, Artificial
  CRISPR gRNA sequence
acttggttacataccatcca

SEQ ID NO: 398595 - DNA, 20 bp, Artificial
  CRISPR gRNA sequence
ggttacataccatccaccgc

SEQ ID NO: 398596 - DNA, 20 bp, Artificial
  CRISPR gRNA sequence
gttacataccatccaccgct

SEQ ID NO: 398597 - DNA, 20 bp, Artificial
  CRISPR gRNA sequence
cataccatccaccgctgttt

SEQ ID NO: 398598 - DNA, 20 bp, Artificial
  CRISPR gRNA sequence
tttttgtgctgcaatgctgg

SEQ ID NO: 398599 - DNA, 20 bp, Artificial
  CRISPR gRNA sequence
ttgtgctgcaatgctggaac

SEQ ID NO: 398600 - DNA, 20 bp, Artificial
  CRISPR gRNA sequence
tgtgctgcaatgctggaacc

SEQ ID NO: 398601 - DNA, 20 bp, Artificial
  CRISPR gRNA sequence
gtgctgcaatgctggaacca

SEQ ID NO: 398602 - DNA, 20 bp, Artificial
  CRISPR gRNA sequence
tgctgcaatgctggaaccaa

SEQ ID NO: 398603 - DNA, 20 bp, Artificial
  CRISPR gRNA sequence
caatgctggaaccaagaggt

SEQ ID NO: 398604 - DNA, 20 bp, Artificial
  CRISPR gRNA sequence
gaaccaagaggtgttaggtc

SEQ ID NO: 398605 - DNA, 20 bp, Artificial
  CRISPR gRNA sequence
ggtcacaactgacagacacc

SEQ ID NO: 398606 - DNA, 20 bp, Artificial
  CRISPR gRNA sequence
acagacaccacacggcccac

SEQ ID NO: 398607 - DNA, 20 bp, Artificial
  CRISPR gRNA sequence
taaatattaactatctggcc

SEQ ID NO: 398608 - DNA, 20 bp, Artificial
  CRISPR gRNA sequence
actatctggccctttacaga

SEQ ID NO: 398609 - DNA, 20 bp, Artificial
  CRISPR gRNA sequence
tctggccctttacagaaaaa

SEQ ID NO: 398610 - DNA, 20 bp, Artificial
  CRISPR gRNA sequence
gccctttacagaaaaagttt

SEQ ID NO: 398611 - DNA, 20 bp, Artificial
  CRISPR gRNA sequence
tacagaaaaagtttcccaac

SEQ ID NO: 398612 - DNA, 20 bp, Artificial
  CRISPR gRNA sequence
acagaaaaagtttcccaacc

SEQ ID NO: 398613 - DNA, 20 bp, Artificial
  CRISPR gRNA sequence
cagaaaaagtttcccaaccc

SEQ ID NO: 398614 - DNA, 20 bp, Artificial
  CRISPR gRNA sequence
cccaacccttgagtaggata

SEQ ID NO: 398615 - DNA, 20 bp, Artificial
  CRISPR gRNA sequence
ccaacccttgagtaggataa

SEQ ID NO: 398616 - DNA, 20 bp, Artificial
  CRISPR gRNA sequence
gagtaggataataaatcttt

SEQ ID NO: 398617 - DNA, 20 bp, Artificial
  CRISPR gRNA sequence
agtaggataataaatctttg

SEQ ID NO: 398618 - DNA, 20 bp, Artificial
  CRISPR gRNA sequence
tggatcatggacatttatta

SEQ ID NO: 398619 - DNA, 20 bp, Artificial
  CRISPR gRNA sequence
ggatcatggacatttattat

SEQ ID NO: 398620 - DNA, 20 bp, Artificial
  CRISPR gRNA sequence
gatcatggacatttattatt

SEQ ID NO: 398621 - DNA, 20 bp, Artificial
  CRISPR gRNA sequence
attatttaagttcatccttg

SEQ ID NO: 398622 - DNA, 20 bp, Artificial
  CRISPR gRNA sequence
ttatttaagttcatccttgt

SEQ ID NO: 398623 - DNA, 20 bp, Artificial
  CRISPR gRNA sequence
tttaagttcatccttgttca

SEQ ID NO: 398624 - DNA, 20 bp, Artificial
  CRISPR gRNA sequence
aagttcatccttgttcagtc

SEQ ID NO: 398625 - DNA, 20 bp, Artificial
  CRISPR gRNA sequence
agttcatccttgttcagtct

SEQ ID NO: 398626 - DNA, 20 bp, Artificial
  CRISPR gRNA sequence
atccttgttcagtcttgctg

SEQ ID NO: 398627 - DNA, 20 bp, Artificial
  CRISPR gRNA sequence
gttcagtcttgctggagaga

SEQ ID NO: 398628 - DNA, 20 bp, Artificial
  CRISPR gRNA sequence
ttcagtcttgctggagagaa

SEQ ID NO: 398629 - DNA, 20 bp, Artificial
  CRISPR gRNA sequence
agtcttgctggagagaagga

SEQ ID NO: 398630 - DNA, 20 bp, Artificial
  CRISPR gRNA sequence
gctggagagaaggaagattt

SEQ ID NO: 398631 - DNA, 20 bp, Artificial
  CRISPR gRNA sequence
ctggagagaaggaagattta

SEQ ID NO: 398632 - DNA, 20 bp, Artificial
  CRISPR gRNA sequence
gagagaaggaagatttaagc

SEQ ID NO: 398633 - DNA, 20 bp, Artificial
  CRISPR gRNA sequence
aagcttgacagaccagatgc

SEQ ID NO: 398634 - DNA, 20 bp, Artificial
  CRISPR gRNA sequence
agcttgacagaccagatgcc

SEQ ID NO: 398635 - DNA, 20 bp, Artificial
  CRISPR gRNA sequence
gacagaccagatgccggtaa

SEQ ID NO: 398636 - DNA, 20 bp, Artificial
  CRISPR gRNA sequence
acagaccagatgccggtaaa

SEQ ID NO: 398637 - DNA, 20 bp, Artificial
  CRISPR gRNA sequence
gctcagttttcttattctca

SEQ ID NO: 398638 - DNA, 20 bp, Artificial
  CRISPR gRNA sequence
agttttcttattctcaagaa

SEQ ID NO: 398639 - DNA, 20 bp, Artificial
  CRISPR gRNA sequence
tcttattctcaagaacttta

SEQ ID NO: 398640 - DNA, 20 bp, Artificial
  CRISPR gRNA sequence
cttattctcaagaactttac

SEQ ID NO: 398641 - DNA, 20 bp, Artificial
  CRISPR gRNA sequence
ttattctcaagaactttacg

SEQ ID NO: 398642 - DNA, 20 bp, Artificial
  CRISPR gRNA sequence
attctcaagaactttacgat

SEQ ID NO: 398643 - DNA, 20 bp, Artificial
  CRISPR gRNA sequence
ttctcaagaactttacgatc

SEQ ID NO: 398644 - DNA, 20 bp, Artificial
  CRISPR gRNA sequence
tcaagaactttacgatcaga

SEQ ID NO: 398645 - DNA, 20 bp, Artificial
  CRISPR gRNA sequence
aagaactttacgatcagatc

SEQ ID NO: 398646 - DNA, 20 bp, Artificial
  CRISPR gRNA sequence
tacgatcagatctattataa

SEQ ID NO: 398647 - DNA, 20 bp, Artificial
  CRISPR gRNA sequence
acgatcagatctattataaa

SEQ ID NO: 398648 - DNA, 20 bp, Artificial
  CRISPR gRNA sequence
cgatcagatctattataaat

SEQ ID NO: 398649 - DNA, 20 bp, Artificial
  CRISPR gRNA sequence
ttataaatacaattctagag

SEQ ID NO: 398650 - DNA, 20 bp, Artificial
  CRISPR gRNA sequence
taaatacaattctagagaca

SEQ ID NO: 398651 - DNA, 20 bp, Artificial
  CRISPR gRNA sequence
tagagacagactgagaaaaa

SEQ ID NO: 398652 - DNA, 20 bp, Artificial
  CRISPR gRNA sequence
gagacagactgagaaaaagt

SEQ ID NO: 398653 - DNA, 20 bp, Artificial
  CRISPR gRNA sequence
agaaaaagtacttaactggc

SEQ ID NO: 398654 - DNA, 20 bp, Artificial
  CRISPR gRNA sequence
aactggcacccttttactac

SEQ ID NO: 398655 - DNA, 20 bp, Artificial
  CRISPR gRNA sequence
actggcacccttttactaca

SEQ ID NO: 398656 - DNA, 20 bp, Artificial
  CRISPR gRNA sequence
gcacccttttactacaaact

SEQ ID NO: 398657 - DNA, 20 bp, Artificial
  CRISPR gRNA sequence
ttactacaaactgcacccct

SEQ ID NO: 398658 - DNA, 20 bp, Artificial
  CRISPR gRNA sequence
tactacaaactgcacccctc

SEQ ID NO: 398659 - DNA, 20 bp, Artificial
  CRISPR gRNA sequence
actacaaactgcacccctca

SEQ ID NO: 398660 - DNA, 20 bp, Artificial
  CRISPR gRNA sequence
ctacaaactgcacccctcat

SEQ ID NO: 398661 - DNA, 20 bp, Artificial
  CRISPR gRNA sequence
caaactgcacccctcattaa

SEQ ID NO: 398662 - DNA, 20 bp, Artificial
  CRISPR gRNA sequence
cacccctcattaaactaaca

SEQ ID NO: 398663 - DNA, 20 bp, Artificial
  CRISPR gRNA sequence
attaaactaacagttcacag

SEQ ID NO: 398664 - DNA, 20 bp, Artificial
  CRISPR gRNA sequence
aactaacagttcacagaaca

SEQ ID NO: 398665 - DNA, 20 bp, Artificial
  CRISPR gRNA sequence
acagttcacagaacaccgag

SEQ ID NO: 398666 - DNA, 20 bp, Artificial
  CRISPR gRNA sequence
acagaacaccgagcacttaa

SEQ ID NO: 398667 - DNA, 20 bp, Artificial
  CRISPR gRNA sequence
aacttactccagctttttcc

SEQ ID NO: 398668 - DNA, 20 bp, Artificial
  CRISPR gRNA sequence
acttactccagctttttccg

SEQ ID NO: 398669 - DNA, 20 bp, Artificial
  CRISPR gRNA sequence
actccagctttttccggcaa

SEQ ID NO: 398670 - DNA, 20 bp, Artificial
  CRISPR gRNA sequence
ctccagctttttccggcaac

SEQ ID NO: 398671 - DNA, 20 bp, Artificial
  CRISPR gRNA sequence
cagctttttccggcaactct

SEQ ID NO: 398672 - DNA, 20 bp, Artificial
  CRISPR gRNA sequence
tttccggcaactctcttgtc

SEQ ID NO: 398673 - DNA, 20 bp, Artificial
  CRISPR gRNA sequence
ttccggcaactctcttgtcc

SEQ ID NO: 398674 - DNA, 20 bp, Artificial
  CRISPR gRNA sequence
tccggcaactctcttgtcct

SEQ ID NO: 398675 - DNA, 20 bp, Artificial
  CRISPR gRNA sequence
ccggcaactctcttgtcctg

SEQ ID NO: 398676 - DNA, 20 bp, Artificial
  CRISPR gRNA sequence
cggcaactctcttgtcctgc

SEQ ID NO: 398677 - DNA, 20 bp, Artificial
  CRISPR gRNA sequence
tcttgtcctgctgcatcaac

SEQ ID NO: 398678 - DNA, 20 bp, Artificial
  CRISPR gRNA sequence
ttgtcctgctgcatcaactt

SEQ ID NO: 398679 - DNA, 20 bp, Artificial
  CRISPR gRNA sequence
gtcctgctgcatcaacttgc

SEQ ID NO: 398680 - DNA, 20 bp, Artificial
  CRISPR gRNA sequence
tcctgctgcatcaacttgcc

SEQ ID NO: 398681 - DNA, 20 bp, Artificial
  CRISPR gRNA sequence
ctgcatcaacttgccatggt

SEQ ID NO: 398682 - DNA, 20 bp, Artificial
  CRISPR gRNA sequence
catcaacttgccatggtttc

SEQ ID NO: 398683 - DNA, 20 bp, Artificial
  CRISPR gRNA sequence
gccatggtttcactggcagc

SEQ ID NO: 398684 - DNA, 20 bp, Artificial
  CRISPR gRNA sequence
ccatggtttcactggcagcc

SEQ ID NO: 398685 - DNA, 20 bp, Artificial
  CRISPR gRNA sequence
cactggcagcccccaccctt

SEQ ID NO: 398686 - DNA, 20 bp, Artificial
  CRISPR gRNA sequence
actggcagcccccacccttt

SEQ ID NO: 398687 - DNA, 20 bp, Artificial
  CRISPR gRNA sequence
gcagcccccaccctttcgca

SEQ ID NO: 398688 - DNA, 20 bp, Artificial
  CRISPR gRNA sequence
tcgcacacgattcatttaaa

SEQ ID NO: 398689 - DNA, 20 bp, Artificial
  CRISPR gRNA sequence
cgcacacgattcatttaaaa

SEQ ID NO: 398690 - DNA, 20 bp, Artificial
  CRISPR gRNA sequence
gcacacgattcatttaaaaa

SEQ ID NO: 398691 - DNA, 20 bp, Artificial
  CRISPR gRNA sequence
atttaaaaagttgagctcag

SEQ ID NO: 398692 - DNA, 20 bp, Artificial
  CRISPR gRNA sequence
aaaaagttgagctcagacac

SEQ ID NO: 398693 - DNA, 20 bp, Artificial
  CRISPR gRNA sequence
aaaagttgagctcagacaca

SEQ ID NO: 398694 - DNA, 20 bp, Artificial
  CRISPR gRNA sequence
agctcagacacatccagtct

SEQ ID NO: 398695 - DNA, 20 bp, Artificial
  CRISPR gRNA sequence
agacacatccagtctttttt

SEQ ID NO: 398696 - DNA, 20 bp, Artificial
  CRISPR gRNA sequence
ttttctgagaaggttactaa

SEQ ID NO: 398697 - DNA, 20 bp, Artificial
  CRISPR gRNA sequence
tttctgagaaggttactaac

SEQ ID NO: 398698 - DNA, 20 bp, Artificial
  CRISPR gRNA sequence
ttctgagaaggttactaacc

SEQ ID NO: 398699 - DNA, 20 bp, Artificial
  CRISPR gRNA sequence
tctgagaaggttactaacct

SEQ ID NO: 398700 - DNA, 20 bp, Artificial
  CRISPR gRNA sequence
ctgagaaggttactaacctt

SEQ ID NO: 398701 - DNA, 20 bp, Artificial
  CRISPR gRNA sequence
tgagaaggttactaaccttg

SEQ ID NO: 398702 - DNA, 20 bp, Artificial
  CRISPR gRNA sequence
agaaggttactaaccttgag

SEQ ID NO: 398703 - DNA, 20 bp, Artificial
  CRISPR gRNA sequence
ctaaccttgagatgtgagtg

SEQ ID NO: 398704 - DNA, 20 bp, Artificial
  CRISPR gRNA sequence
accttgagatgtgagtgctg

SEQ ID NO: 398705 - DNA, 20 bp, Artificial
  CRISPR gRNA sequence
gagatgtgagtgctgctcgc

SEQ ID NO: 398706 - DNA, 20 bp, Artificial
  CRISPR gRNA sequence
agatgtgagtgctgctcgct

SEQ ID NO: 398707 - DNA, 20 bp, Artificial
  CRISPR gRNA sequence
ctcgctctaacgcttcttcc

SEQ ID NO: 398708 - DNA, 20 bp, Artificial
  CRISPR gRNA sequence
gctctaacgcttcttcccat

SEQ ID NO: 398709 - DNA, 20 bp, Artificial
  CRISPR gRNA sequence
taacgcttcttcccatctgc

SEQ ID NO: 398710 - DNA, 20 bp, Artificial
  CRISPR gRNA sequence
acgcttcttcccatctgcgt

SEQ ID NO: 398711 - DNA, 20 bp, Artificial
  CRISPR gRNA sequence
cttcccatctgcgtcttggt

SEQ ID NO: 398712 - DNA, 20 bp, Artificial
  CRISPR gRNA sequence
ttcccatctgcgtcttggtt

SEQ ID NO: 398713 - DNA, 20 bp, Artificial
  CRISPR gRNA sequence
cccatctgcgtcttggttaa

SEQ ID NO: 398714 - DNA, 20 bp, Artificial
  CRISPR gRNA sequence
ccatctgcgtcttggttaag

SEQ ID NO: 398715 - DNA, 20 bp, Artificial
  CRISPR gRNA sequence
cgtcttggttaaggactttt

SEQ ID NO: 398716 - DNA, 20 bp, Artificial
  CRISPR gRNA sequence
ggttaaggacttttatcgta

SEQ ID NO: 398717 - DNA, 20 bp, Artificial
  CRISPR gRNA sequence
gttaaggacttttatcgtat

SEQ ID NO: 398718 - DNA, 20 bp, Artificial
  CRISPR gRNA sequence
aggacttttatcgtatcctg

SEQ ID NO: 398719 - DNA, 20 bp, Artificial
  CRISPR gRNA sequence
ttatcgtatcctgtttatcg

SEQ ID NO: 398720 - DNA, 20 bp, Artificial
  CRISPR gRNA sequence
tatcgtatcctgtttatcgt

SEQ ID NO: 398721 - DNA, 20 bp, Artificial
  CRISPR gRNA sequence
atcgtatcctgtttatcgtg

SEQ ID NO: 398722 - DNA, 20 bp, Artificial
  CRISPR gRNA sequence
tcgtatcctgtttatcgtgg

SEQ ID NO: 398723 - DNA, 20 bp, Artificial
  CRISPR gRNA sequence
tttatcgtggcctcctagcc

SEQ ID NO: 398724 - DNA, 20 bp, Artificial
  CRISPR gRNA sequence
atcgtggcctcctagcctca

SEQ ID NO: 398725 - DNA, 20 bp, Artificial
  CRISPR gRNA sequence
tcgtggcctcctagcctcaa

SEQ ID NO: 398726 - DNA, 20 bp, Artificial
  CRISPR gRNA sequence
ctagcctcaacaccctcttg

SEQ ID NO: 398727 - DNA, 20 bp, Artificial
  CRISPR gRNA sequence
gcctcaacaccctcttggtc

SEQ ID NO: 398728 - DNA, 20 bp, Artificial
  CRISPR gRNA sequence
aacaccctcttggtcactgc

SEQ ID NO: 398729 - DNA, 20 bp, Artificial
  CRISPR gRNA sequence
ttggtcactgcaagctcccc

SEQ ID NO: 398730 - DNA, 20 bp, Artificial
  CRISPR gRNA sequence
ggtcactgcaagctccccgc

SEQ ID NO: 398731 - DNA, 20 bp, Artificial
  CRISPR gRNA sequence
gtcactgcaagctccccgct

SEQ ID NO: 398732 - DNA, 20 bp, Artificial
  CRISPR gRNA sequence
caagctccccgctgctccct

SEQ ID NO: 398733 - DNA, 20 bp, Artificial
  CRISPR gRNA sequence
cccgctgctccctcccttaa

SEQ ID NO: 398734 - DNA, 20 bp, Artificial
  CRISPR gRNA sequence
ctccctcccttaattagcac

SEQ ID NO: 398735 - DNA, 20 bp, Artificial
  CRISPR gRNA sequence
cctcccttaattagcactgc

SEQ ID NO: 398736 - DNA, 20 bp, Artificial
  CRISPR gRNA sequence
ccttaattagcactgcagga

SEQ ID NO: 398737 - DNA, 20 bp, Artificial
  CRISPR gRNA sequence
aattagcactgcaggagctg

SEQ ID NO: 398738 - DNA, 20 bp, Artificial
  CRISPR gRNA sequence
attagcactgcaggagctga

SEQ ID NO: 398739 - DNA, 20 bp, Artificial
  CRISPR gRNA sequence
gcactgcaggagctgagggg

SEQ ID NO: 398740 - DNA, 20 bp, Artificial
  CRISPR gRNA sequence
caggagctgaggggagcgtt

SEQ ID NO: 398741 - DNA, 20 bp, Artificial
  CRISPR gRNA sequence
aggggagcgttcagcccact

SEQ ID NO: 398742 - DNA, 20 bp, Artificial
  CRISPR gRNA sequence
agcccactcaggagctgact

SEQ ID NO: 398743 - DNA, 20 bp, Artificial
  CRISPR gRNA sequence
aggagctgactctgcccatg

SEQ ID NO: 398744 - DNA, 20 bp, Artificial
  CRISPR gRNA sequence
actctgcccatgctcttgag

SEQ ID NO: 398745 - DNA, 20 bp, Artificial
  CRISPR gRNA sequence
tgcccatgctcttgagctct

SEQ ID NO: 398746 - DNA, 20 bp, Artificial
  CRISPR gRNA sequence
cccatgctcttgagctcttc

SEQ ID NO: 398747 - DNA, 20 bp, Artificial
  CRISPR gRNA sequence
ttgagctcttctctctacca

SEQ ID NO: 398748 - DNA, 20 bp, Artificial
  CRISPR gRNA sequence
gagctcttctctctaccaga

SEQ ID NO: 398749 - DNA, 20 bp, Artificial
  CRISPR gRNA sequence
agctcttctctctaccagaa

SEQ ID NO: 398750 - DNA, 20 bp, Artificial
  CRISPR gRNA sequence
ttctctctaccagaacttcc

SEQ ID NO: 398751 - DNA, 20 bp, Artificial
  CRISPR gRNA sequence
ctctctaccagaacttcctc

SEQ ID NO: 398752 - DNA, 20 bp, Artificial
  CRISPR gRNA sequence
tctctaccagaacttcctca

SEQ ID NO: 398753 - DNA, 20 bp, Artificial
  CRISPR gRNA sequence
tctaccagaacttcctcaga

SEQ ID NO: 398754 - DNA, 20 bp, Artificial
  CRISPR gRNA sequence
taccagaacttcctcagata

SEQ ID NO: 398755 - DNA, 20 bp, Artificial
  CRISPR gRNA sequence
ccagaacttcctcagatagc

SEQ ID NO: 398756 - DNA, 20 bp, Artificial
  CRISPR gRNA sequence
cctcagatagcaactgaagt

SEQ ID NO: 398757 - DNA, 20 bp, Artificial
  CRISPR gRNA sequence
ctcagatagcaactgaagtg

SEQ ID NO: 398758 - DNA, 20 bp, Artificial
  CRISPR gRNA sequence
agatagcaactgaagtgaat

SEQ ID NO: 398759 - DNA, 20 bp, Artificial
  CRISPR gRNA sequence
aagtgaatcactaatatttc

SEQ ID NO: 398760 - DNA, 20 bp, Artificial
  CRISPR gRNA sequence
atatttcatgaagcggggtt

SEQ ID NO: 398761 - DNA, 20 bp, Artificial
  CRISPR gRNA sequence
catgaagcggggttttttga

SEQ ID NO: 398762 - DNA, 20 bp, Artificial
  CRISPR gRNA sequence
atgaagcggggttttttgaa

SEQ ID NO: 398763 - DNA, 20 bp, Artificial
  CRISPR gRNA sequence
tttgaagtcaagtttacctg

SEQ ID NO: 398764 - DNA, 20 bp, Artificial
  CRISPR gRNA sequence
ttgaagtcaagtttacctgc

SEQ ID NO: 398765 - DNA, 20 bp, Artificial
  CRISPR gRNA sequence
tgaagtcaagtttacctgct

SEQ ID NO: 398766 - DNA, 20 bp, Artificial
  CRISPR gRNA sequence
gaagtcaagtttacctgctt

SEQ ID NO: 398767 - DNA, 20 bp, Artificial
  CRISPR gRNA sequence
aagtcaagtttacctgcttc

SEQ ID NO: 398768 - DNA, 20 bp, Artificial
  CRISPR gRNA sequence
acctgcttctggaagcaact

SEQ ID NO: 398769 - DNA, 20 bp, Artificial
  CRISPR gRNA sequence
cctgcttctggaagcaactt

SEQ ID NO: 398770 - DNA, 20 bp, Artificial
  CRISPR gRNA sequence
cttctggaagcaactttact

SEQ ID NO: 398771 - DNA, 20 bp, Artificial
  CRISPR gRNA sequence
ctggaagcaactttactatt

SEQ ID NO: 398772 - DNA, 20 bp, Artificial
  CRISPR gRNA sequence
tggaagcaactttactattg

SEQ ID NO: 398773 - DNA, 20 bp, Artificial
  CRISPR gRNA sequence
gaagcaactttactattgca

SEQ ID NO: 398774 - DNA, 20 bp, Artificial
  CRISPR gRNA sequence
tactattgcagctactcaga

SEQ ID NO: 398775 - DNA, 20 bp, Artificial
  CRISPR gRNA sequence
actattgcagctactcagac

SEQ ID NO: 398776 - DNA, 20 bp, Artificial
  CRISPR gRNA sequence
ctattgcagctactcagact

SEQ ID NO: 398777 - DNA, 20 bp, Artificial
  CRISPR gRNA sequence
ttgcagctactcagactcat

SEQ ID NO: 398778 - DNA, 20 bp, Artificial
  CRISPR gRNA sequence
cagctactcagactcattcc

SEQ ID NO: 398779 - DNA, 20 bp, Artificial
  CRISPR gRNA sequence
ctcagactcattccaaactc

SEQ ID NO: 398780 - DNA, 20 bp, Artificial
  CRISPR gRNA sequence
agactcattccaaactcaga

SEQ ID NO: 398781 - DNA, 20 bp, Artificial
  CRISPR gRNA sequence
attccaaactcagataaagt

SEQ ID NO: 398782 - DNA, 20 bp, Artificial
  CRISPR gRNA sequence
caaactcagataaagttctg

SEQ ID NO: 398783 - DNA, 20 bp, Artificial
  CRISPR gRNA sequence
agataaagttctgtccctct

SEQ ID NO: 398784 - DNA, 20 bp, Artificial
  CRISPR gRNA sequence
tgtccctcttttcccccaaa

SEQ ID NO: 398785 - DNA, 20 bp, Artificial
  CRISPR gRNA sequence
tccctcttttcccccaaaga

SEQ ID NO: 398786 - DNA, 20 bp, Artificial
  CRISPR gRNA sequence
ttttcccccaaagaatctat

SEQ ID NO: 398787 - DNA, 20 bp, Artificial
  CRISPR gRNA sequence
ttcccccaaagaatctataa

SEQ ID NO: 398788 - DNA, 20 bp, Artificial
  CRISPR gRNA sequence
tcccccaaagaatctataat

SEQ ID NO: 398789 - DNA, 20 bp, Artificial
  CRISPR gRNA sequence
cccccaaagaatctataatt

SEQ ID NO: 398790 - DNA, 20 bp, Artificial
  CRISPR gRNA sequence
ccccaaagaatctataattt

SEQ ID NO: 398791 - DNA, 20 bp, Artificial
  CRISPR gRNA sequence
taatttgaaaggacgcactt

SEQ ID NO: 398792 - DNA, 20 bp, Artificial
  CRISPR gRNA sequence
gaaaggacgcacttctcctt

SEQ ID NO: 398793 - DNA, 20 bp, Artificial
  CRISPR gRNA sequence
aaaggacgcacttctccttt

SEQ ID NO: 398794 - DNA, 20 bp, Artificial
  CRISPR gRNA sequence
ctcctttgttctagctctaa

SEQ ID NO: 398795 - DNA, 20 bp, Artificial
  CRISPR gRNA sequence
tcctttgttctagctctaaa

SEQ ID NO: 398796 - DNA, 20 bp, Artificial
  CRISPR gRNA sequence
ctttgttctagctctaaata

SEQ ID NO: 398797 - DNA, 20 bp, Artificial
  CRISPR gRNA sequence
tgttctagctctaaatagaa

SEQ ID NO: 398798 - DNA, 20 bp, Artificial
  CRISPR gRNA sequence
gttctagctctaaatagaaa

SEQ ID NO: 398799 - DNA, 20 bp, Artificial
  CRISPR gRNA sequence
ttctagctctaaatagaaac

SEQ ID NO: 398800 - DNA, 20 bp, Artificial
  CRISPR gRNA sequence
tagctctaaatagaaactac

SEQ ID NO: 398801 - DNA, 20 bp, Artificial
  CRISPR gRNA sequence
gctctaaatagaaactacac

SEQ ID NO: 398802 - DNA, 20 bp, Artificial
  CRISPR gRNA sequence
taaatagaaactacactccc

SEQ ID NO: 398803 - DNA, 20 bp, Artificial
  CRISPR gRNA sequence
aatagaaactacactccccg

SEQ ID NO: 398804 - DNA, 20 bp, Artificial
  CRISPR gRNA sequence
cactccccgccgaaatcagt

SEQ ID NO: 398805 - DNA, 20 bp, Artificial
  CRISPR gRNA sequence
cccgccgaaatcagtttgtt

SEQ ID NO: 398806 - DNA, 20 bp, Artificial
  CRISPR gRNA sequence
gtttctttgccttttcttcc

SEQ ID NO: 398807 - DNA, 20 bp, Artificial
  CRISPR gRNA sequence
tttctttgccttttcttcct

SEQ ID NO: 398808 - DNA, 20 bp, Artificial
  CRISPR gRNA sequence
ctttgccttttcttcctcgt

SEQ ID NO: 398809 - DNA, 20 bp, Artificial
  CRISPR gRNA sequence
tttgccttttcttcctcgtg

SEQ ID NO: 398810 - DNA, 20 bp, Artificial
  CRISPR gRNA sequence
tgccttttcttcctcgtgtt

SEQ ID NO: 398811 - DNA, 20 bp, Artificial
  CRISPR gRNA sequence
gccttttcttcctcgtgttt

SEQ ID NO: 398812 - DNA, 20 bp, Artificial
  CRISPR gRNA sequence
ccttttcttcctcgtgtttt

SEQ ID NO: 398813 - DNA, 20 bp, Artificial
  CRISPR gRNA sequence
ttcttcctcgtgttttttcc

SEQ ID NO: 398814 - DNA, 20 bp, Artificial
  CRISPR gRNA sequence
tcttcctcgtgttttttcct

SEQ ID NO: 398815 - DNA, 20 bp, Artificial
  CRISPR gRNA sequence
cttcctcgtgttttttcctg

SEQ ID NO: 398816 - DNA, 20 bp, Artificial
  CRISPR gRNA sequence
ttcctcgtgttttttcctgc

SEQ ID NO: 398817 - DNA, 20 bp, Artificial
  CRISPR gRNA sequence
cctcgtgttttttcctgcca

SEQ ID NO: 398818 - DNA, 20 bp, Artificial
  CRISPR gRNA sequence
ctcgtgttttttcctgccaa

SEQ ID NO: 398819 - DNA, 20 bp, Artificial
  CRISPR gRNA sequence
gtgttttttcctgccaatca

SEQ ID NO: 398820 - DNA, 20 bp, Artificial
  CRISPR gRNA sequence
tttcctgccaatcaaagcac

SEQ ID NO: 398821 - DNA, 20 bp, Artificial
  CRISPR gRNA sequence
ttcctgccaatcaaagcaca

SEQ ID NO: 398822 - DNA, 20 bp, Artificial
  CRISPR gRNA sequence
tcctgccaatcaaagcacat

SEQ ID NO: 398823 - DNA, 20 bp, Artificial
  CRISPR gRNA sequence
cctgccaatcaaagcacatt

SEQ ID NO: 398824 - DNA, 20 bp, Artificial
  CRISPR gRNA sequence
ctgccaatcaaagcacatta

SEQ ID NO: 398825 - DNA, 20 bp, Artificial
  CRISPR gRNA sequence
ccaatcaaagcacattagat

SEQ ID NO: 398826 - DNA, 20 bp, Artificial
  CRISPR gRNA sequence
aatctaatgtgctttgattg

SEQ ID NO: 398827 - DNA, 20 bp, Artificial
  CRISPR gRNA sequence
atgtgctttgattggcagga

SEQ ID NO: 398828 - DNA, 20 bp, Artificial
  CRISPR gRNA sequence
tgattggcaggaaaaaacac

SEQ ID NO: 398829 - DNA, 20 bp, Artificial
  CRISPR gRNA sequence
gattggcaggaaaaaacacg

SEQ ID NO: 398830 - DNA, 20 bp, Artificial
  CRISPR gRNA sequence
attggcaggaaaaaacacga

SEQ ID NO: 398831 - DNA, 20 bp, Artificial
  CRISPR gRNA sequence
gcaggaaaaaacacgaggaa

SEQ ID NO: 398832 - DNA, 20 bp, Artificial
  CRISPR gRNA sequence
atttcggcggggagtgtagt

SEQ ID NO: 398833 - DNA, 20 bp, Artificial
  CRISPR gRNA sequence
cggcggggagtgtagtttct

SEQ ID NO: 398834 - DNA, 20 bp, Artificial
  CRISPR gRNA sequence
ggcggggagtgtagtttcta

SEQ ID NO: 398835 - DNA, 20 bp, Artificial
  CRISPR gRNA sequence
ctatttagagctagaacaaa

SEQ ID NO: 398836 - DNA, 20 bp, Artificial
  CRISPR gRNA sequence
tatttagagctagaacaaag

SEQ ID NO: 398837 - DNA, 20 bp, Artificial
  CRISPR gRNA sequence
tttagagctagaacaaagga

SEQ ID NO: 398838 - DNA, 20 bp, Artificial
  CRISPR gRNA sequence
agagctagaacaaaggagaa

SEQ ID NO: 398839 - DNA, 20 bp, Artificial
  CRISPR gRNA sequence
gagctagaacaaaggagaag

SEQ ID NO: 398840 - DNA, 20 bp, Artificial
  CRISPR gRNA sequence
gaacaaaggagaagtgcgtc

SEQ ID NO: 398841 - DNA, 20 bp, Artificial
  CRISPR gRNA sequence
tcaaattatagattctttgg

SEQ ID NO: 398842 - DNA, 20 bp, Artificial
  CRISPR gRNA sequence
caaattatagattctttggg

SEQ ID NO: 398843 - DNA, 20 bp, Artificial
  CRISPR gRNA sequence
aaattatagattctttgggg

SEQ ID NO: 398844 - DNA, 20 bp, Artificial
  CRISPR gRNA sequence
tagattctttgggggaaaag

SEQ ID NO: 398845 - DNA, 20 bp, Artificial
  CRISPR gRNA sequence
tttgggggaaaagagggaca

SEQ ID NO: 398846 - DNA, 20 bp, Artificial
  CRISPR gRNA sequence
tgggggaaaagagggacaga

SEQ ID NO: 398847 - DNA, 20 bp, Artificial
  CRISPR gRNA sequence
gggggaaaagagggacagaa

SEQ ID NO: 398848 - DNA, 20 bp, Artificial
  CRISPR gRNA sequence
ggggaaaagagggacagaac

SEQ ID NO: 398849 - DNA, 20 bp, Artificial
  CRISPR gRNA sequence
tatctgagtttggaatgagt

SEQ ID NO: 398850 - DNA, 20 bp, Artificial
  CRISPR gRNA sequence
atctgagtttggaatgagtc

SEQ ID NO: 398851 - DNA, 20 bp, Artificial
  CRISPR gRNA sequence
tctgagtttggaatgagtct

SEQ ID NO: 398852 - DNA, 20 bp, Artificial
  CRISPR gRNA sequence
agtttggaatgagtctgagt

SEQ ID NO: 398853 - DNA, 20 bp, Artificial
  CRISPR gRNA sequence
ggaatgagtctgagtagctg

SEQ ID NO: 398854 - DNA, 20 bp, Artificial
  CRISPR gRNA sequence
gaatgagtctgagtagctgc

SEQ ID NO: 398855 - DNA, 20 bp, Artificial
  CRISPR gRNA sequence
agtagctgcaatagtaaagt

SEQ ID NO: 398856 - DNA, 20 bp, Artificial
  CRISPR gRNA sequence
caatagtaaagttgcttcca

SEQ ID NO: 398857 - DNA, 20 bp, Artificial
  CRISPR gRNA sequence
cttccagaagcaggtaaact

SEQ ID NO: 398858 - DNA, 20 bp, Artificial
  CRISPR gRNA sequence
ccagaagcaggtaaacttga

SEQ ID NO: 398859 - DNA, 20 bp, Artificial
  CRISPR gRNA sequence
cagaagcaggtaaacttgac

SEQ ID NO: 398860 - DNA, 20 bp, Artificial
  CRISPR gRNA sequence
gacttcaaaaaaccccgctt

SEQ ID NO: 398861 - DNA, 20 bp, Artificial
  CRISPR gRNA sequence
acttcaaaaaaccccgcttc

SEQ ID NO: 398862 - DNA, 20 bp, Artificial
  CRISPR gRNA sequence
caaaaaaccccgcttcatga

SEQ ID NO: 398863 - DNA, 20 bp, Artificial
  CRISPR gRNA sequence
aaaaaaccccgcttcatgaa

SEQ ID NO: 398864 - DNA, 20 bp, Artificial
  CRISPR gRNA sequence
catgaaatattagtgattca

SEQ ID NO: 398865 - DNA, 20 bp, Artificial
  CRISPR gRNA sequence
atgaaatattagtgattcac

SEQ ID NO: 398866 - DNA, 20 bp, Artificial
  CRISPR gRNA sequence
gtgattcacttcagttgcta

SEQ ID NO: 398867 - DNA, 20 bp, Artificial
  CRISPR gRNA sequence
acttcagttgctatctgagg

SEQ ID NO: 398868 - DNA, 20 bp, Artificial
  CRISPR gRNA sequence
cagttgctatctgaggaagt

SEQ ID NO: 398869 - DNA, 20 bp, Artificial
  CRISPR gRNA sequence
agttgctatctgaggaagtt

SEQ ID NO: 398870 - DNA, 20 bp, Artificial
  CRISPR gRNA sequence
ctatctgaggaagttctggt

SEQ ID NO: 398871 - DNA, 20 bp, Artificial
  CRISPR gRNA sequence
tctgaggaagttctggtaga

SEQ ID NO: 398872 - DNA, 20 bp, Artificial
  CRISPR gRNA sequence
aggaagttctggtagagaga

SEQ ID NO: 398873 - DNA, 20 bp, Artificial
  CRISPR gRNA sequence
tggtagagagaagagctcaa

SEQ ID NO: 398874 - DNA, 20 bp, Artificial
  CRISPR gRNA sequence
gtagagagaagagctcaaga

SEQ ID NO: 398875 - DNA, 20 bp, Artificial
  CRISPR gRNA sequence
aagagcatgggcagagtcag

SEQ ID NO: 398876 - DNA, 20 bp, Artificial
  CRISPR gRNA sequence
ctgagtgggctgaacgctcc

SEQ ID NO: 398877 - DNA, 20 bp, Artificial
  CRISPR gRNA sequence
agtgggctgaacgctcccct

SEQ ID NO: 398878 - DNA, 20 bp, Artificial
  CRISPR gRNA sequence
aacgctcccctcagctcctg

SEQ ID NO: 398879 - DNA, 20 bp, Artificial
  CRISPR gRNA sequence
ccctcagctcctgcagtgct

SEQ ID NO: 398880 - DNA, 20 bp, Artificial
  CRISPR gRNA sequence
agctcctgcagtgctaatta

SEQ ID NO: 398881 - DNA, 20 bp, Artificial
  CRISPR gRNA sequence
ctgcagtgctaattaaggga

SEQ ID NO: 398882 - DNA, 20 bp, Artificial
  CRISPR gRNA sequence
cagtgctaattaagggaggg

SEQ ID NO: 398883 - DNA, 20 bp, Artificial
  CRISPR gRNA sequence
attaagggagggagcagcgg

SEQ ID NO: 398884 - DNA, 20 bp, Artificial
  CRISPR gRNA sequence
agggagggagcagcggggag

SEQ ID NO: 398885 - DNA, 20 bp, Artificial
  CRISPR gRNA sequence
gcagtgaccaagagggtgtt

SEQ ID NO: 398886 - DNA, 20 bp, Artificial
  CRISPR gRNA sequence
cagtgaccaagagggtgttg

SEQ ID NO: 398887 - DNA, 20 bp, Artificial
  CRISPR gRNA sequence
aggctaggaggccacgataa

SEQ ID NO: 398888 - DNA, 20 bp, Artificial
  CRISPR gRNA sequence
ggaggccacgataaacagga

SEQ ID NO: 398889 - DNA, 20 bp, Artificial
  CRISPR gRNA sequence
aaccaagacgcagatgggaa

SEQ ID NO: 398890 - DNA, 20 bp, Artificial
  CRISPR gRNA sequence
accaagacgcagatgggaag

SEQ ID NO: 398891 - DNA, 20 bp, Artificial
  CRISPR gRNA sequence
gagcgagcagcactcacatc

SEQ ID NO: 398892 - DNA, 20 bp, Artificial
  CRISPR gRNA sequence
acatctcaaggttagtaacc

SEQ ID NO: 398893 - DNA, 20 bp, Artificial
  CRISPR gRNA sequence
aaggttagtaaccttctcag

SEQ ID NO: 398894 - DNA, 20 bp, Artificial
  CRISPR gRNA sequence
gtaaccttctcagaaaaaag

SEQ ID NO: 398895 - DNA, 20 bp, Artificial
  CRISPR gRNA sequence
ctcagaaaaaagactggatg

SEQ ID NO: 398896 - DNA, 20 bp, Artificial
  CRISPR gRNA sequence
tcagaaaaaagactggatgt

SEQ ID NO: 398897 - DNA, 20 bp, Artificial
  CRISPR gRNA sequence
agaaaaaagactggatgtgt

SEQ ID NO: 398898 - DNA, 20 bp, Artificial
  CRISPR gRNA sequence
gatgtgtctgagctcaactt

SEQ ID NO: 398899 - DNA, 20 bp, Artificial
  CRISPR gRNA sequence
agctcaactttttaaatgaa

SEQ ID NO: 398900 - DNA, 20 bp, Artificial
  CRISPR gRNA sequence
aactttttaaatgaatcgtg

SEQ ID NO: 398901 - DNA, 20 bp, Artificial
  CRISPR gRNA sequence
tttaaatgaatcgtgtgcga

SEQ ID NO: 398902 - DNA, 20 bp, Artificial
  CRISPR gRNA sequence
ttaaatgaatcgtgtgcgaa

SEQ ID NO: 398903 - DNA, 20 bp, Artificial
  CRISPR gRNA sequence
taaatgaatcgtgtgcgaaa

SEQ ID NO: 398904 - DNA, 20 bp, Artificial
  CRISPR gRNA sequence
aaatgaatcgtgtgcgaaag

SEQ ID NO: 398905 - DNA, 20 bp, Artificial
  CRISPR gRNA sequence
aatgaatcgtgtgcgaaagg

SEQ ID NO: 398906 - DNA, 20 bp, Artificial
  CRISPR gRNA sequence
ccagtgaaaccatggcaagt

SEQ ID NO: 398907 - DNA, 20 bp, Artificial
  CRISPR gRNA sequence
atgcagcaggacaagagagt

SEQ ID NO: 398908 - DNA, 20 bp, Artificial
  CRISPR gRNA sequence
ccggaaaaagctggagtaag

SEQ ID NO: 398909 - DNA, 20 bp, Artificial
  CRISPR gRNA sequence
gagtaagttaagtgctcggt

SEQ ID NO: 398910 - DNA, 20 bp, Artificial
  CRISPR gRNA sequence
agtgctcggtgttctgtgaa

SEQ ID NO: 398911 - DNA, 20 bp, Artificial
  CRISPR gRNA sequence
ggtgttctgtgaactgttag

SEQ ID NO: 398912 - DNA, 20 bp, Artificial
  CRISPR gRNA sequence
tgtgaactgttagtttaatg

SEQ ID NO: 398913 - DNA, 20 bp, Artificial
  CRISPR gRNA sequence
tgaactgttagtttaatgag

SEQ ID NO: 398914 - DNA, 20 bp, Artificial
  CRISPR gRNA sequence
ttagtttaatgaggggtgca

SEQ ID NO: 398915 - DNA, 20 bp, Artificial
  CRISPR gRNA sequence
gtttaatgaggggtgcagtt

SEQ ID NO: 398916 - DNA, 20 bp, Artificial
  CRISPR gRNA sequence
aatgaggggtgcagtttgta

SEQ ID NO: 398917 - DNA, 20 bp, Artificial
  CRISPR gRNA sequence
atgaggggtgcagtttgtag

SEQ ID NO: 398918 - DNA, 20 bp, Artificial
  CRISPR gRNA sequence
gtagtaaaagggtgccagtt

SEQ ID NO: 398919 - DNA, 20 bp, Artificial
  CRISPR gRNA sequence
tagtaaaagggtgccagtta

SEQ ID NO: 398920 - DNA, 20 bp, Artificial
  CRISPR gRNA sequence
agtactttttctcagtctgt

SEQ ID NO: 398921 - DNA, 20 bp, Artificial
  CRISPR gRNA sequence
tttctcagtctgtctctaga

SEQ ID NO: 398922 - DNA, 20 bp, Artificial
  CRISPR gRNA sequence
ttctcagtctgtctctagaa

SEQ ID NO: 398923 - DNA, 20 bp, Artificial
  CRISPR gRNA sequence
tctcagtctgtctctagaat

SEQ ID NO: 398924 - DNA, 20 bp, Artificial
  CRISPR gRNA sequence
ctcagtctgtctctagaatt

SEQ ID NO: 398925 - DNA, 20 bp, Artificial
  CRISPR gRNA sequence
tcagtctgtctctagaattg

SEQ ID NO: 398926 - DNA, 20 bp, Artificial
  CRISPR gRNA sequence
agtctgtctctagaattgta

SEQ ID NO: 398927 - DNA, 20 bp, Artificial
  CRISPR gRNA sequence
tctctagaattgtatttata

SEQ ID NO: 398928 - DNA, 20 bp, Artificial
  CRISPR gRNA sequence
tagaattgtatttataatag

SEQ ID NO: 398929 - DNA, 20 bp, Artificial
  CRISPR gRNA sequence
gaattgtatttataatagat

SEQ ID NO: 398930 - DNA, 20 bp, Artificial
  CRISPR gRNA sequence
tatttataatagatctgatc

SEQ ID NO: 398931 - DNA, 20 bp, Artificial
  CRISPR gRNA sequence
ataatagatctgatcgtaaa

SEQ ID NO: 398932 - DNA, 20 bp, Artificial
  CRISPR gRNA sequence
taatagatctgatcgtaaag

SEQ ID NO: 398933 - DNA, 20 bp, Artificial
  CRISPR gRNA sequence
atcgtaaagttcttgagaat

SEQ ID NO: 398934 - DNA, 20 bp, Artificial
  CRISPR gRNA sequence
ttgagaataagaaaactgag

SEQ ID NO: 398935 - DNA, 20 bp, Artificial
  CRISPR gRNA sequence
gagaataagaaaactgagct

SEQ ID NO: 398936 - DNA, 20 bp, Artificial
  CRISPR gRNA sequence
agaataagaaaactgagcta

SEQ ID NO: 398937 - DNA, 20 bp, Artificial
  CRISPR gRNA sequence
agctaattttaccggcatct

SEQ ID NO: 398938 - DNA, 20 bp, Artificial
  CRISPR gRNA sequence
attttaccggcatctggtct

SEQ ID NO: 398939 - DNA, 20 bp, Artificial
  CRISPR gRNA sequence
taccggcatctggtctgtca

SEQ ID NO: 398940 - DNA, 20 bp, Artificial
  CRISPR gRNA sequence
accggcatctggtctgtcaa

SEQ ID NO: 398941 - DNA, 20 bp, Artificial
  CRISPR gRNA sequence
ccggcatctggtctgtcaag

SEQ ID NO: 398942 - DNA, 20 bp, Artificial
  CRISPR gRNA sequence
gtctgtcaagcttaaatctt

SEQ ID NO: 398943 - DNA, 20 bp, Artificial
  CRISPR gRNA sequence
tcaagcttaaatcttccttc

SEQ ID NO: 398944 - DNA, 20 bp, Artificial
  CRISPR gRNA sequence
aaatcttccttctctccagc

SEQ ID NO: 398945 - DNA, 20 bp, Artificial
  CRISPR gRNA sequence
aatcttccttctctccagca

SEQ ID NO: 398946 - DNA, 20 bp, Artificial
  CRISPR gRNA sequence
ccttctctccagcaagactg

SEQ ID NO: 398947 - DNA, 20 bp, Artificial
  CRISPR gRNA sequence
cttctctccagcaagactga

SEQ ID NO: 398948 - DNA, 20 bp, Artificial
  CRISPR gRNA sequence
ctctccagcaagactgaaca

SEQ ID NO: 398949 - DNA, 20 bp, Artificial
  CRISPR gRNA sequence
tctccagcaagactgaacaa

SEQ ID NO: 398950 - DNA, 20 bp, Artificial
  CRISPR gRNA sequence
tccagcaagactgaacaagg

SEQ ID NO: 398951 - DNA, 20 bp, Artificial
  CRISPR gRNA sequence
cagcaagactgaacaaggat

SEQ ID NO: 398952 - DNA, 20 bp, Artificial
  CRISPR gRNA sequence
aacaaggatgaacttaaata

SEQ ID NO: 398953 - DNA, 20 bp, Artificial
  CRISPR gRNA sequence
aaataataaatgtccatgat

SEQ ID NO: 398954 - DNA, 20 bp, Artificial
  CRISPR gRNA sequence
aataataaatgtccatgatc

SEQ ID NO: 398955 - DNA, 20 bp, Artificial
  CRISPR gRNA sequence
attatcctactcaagggttg

SEQ ID NO: 398956 - DNA, 20 bp, Artificial
  CRISPR gRNA sequence
ttatcctactcaagggttgg

SEQ ID NO: 398957 - DNA, 20 bp, Artificial
  CRISPR gRNA sequence
tcctactcaagggttgggaa

SEQ ID NO: 398958 - DNA, 20 bp, Artificial
  CRISPR gRNA sequence
ctcaagggttgggaaacttt

SEQ ID NO: 398959 - DNA, 20 bp, Artificial
  CRISPR gRNA sequence
aagggttgggaaactttttc

SEQ ID NO: 398960 - DNA, 20 bp, Artificial
  CRISPR gRNA sequence
ggaaactttttctgtaaagg

SEQ ID NO: 398961 - DNA, 20 bp, Artificial
  CRISPR gRNA sequence
tttctgtaaagggccagata

SEQ ID NO: 398962 - DNA, 20 bp, Artificial
  CRISPR gRNA sequence
ttctgtaaagggccagatag

SEQ ID NO: 398963 - DNA, 20 bp, Artificial
  CRISPR gRNA sequence
tctgtaaagggccagatagt

SEQ ID NO: 398964 - DNA, 20 bp, Artificial
  CRISPR gRNA sequence
ctgtaaagggccagatagtt

SEQ ID NO: 398965 - DNA, 20 bp, Artificial
  CRISPR gRNA sequence
tgtaaagggccagatagtta

SEQ ID NO: 398966 - DNA, 20 bp, Artificial
  CRISPR gRNA sequence
taaagggccagatagttaat

SEQ ID NO: 398967 - DNA, 20 bp, Artificial
  CRISPR gRNA sequence
atatttacagctttgtgggc

SEQ ID NO: 398968 - DNA, 20 bp, Artificial
  CRISPR gRNA sequence
acagctttgtgggccgtgtg

SEQ ID NO: 398969 - DNA, 20 bp, Artificial
  CRISPR gRNA sequence
cagctttgtgggccgtgtgg

SEQ ID NO: 398970 - DNA, 20 bp, Artificial
  CRISPR gRNA sequence
tgtgggccgtgtggtgtctg

SEQ ID NO: 398971 - DNA, 20 bp, Artificial
  CRISPR gRNA sequence
gtgggccgtgtggtgtctgt

SEQ ID NO: 398972 - DNA, 20 bp, Artificial
  CRISPR gRNA sequence
tgggccgtgtggtgtctgtc

SEQ ID NO: 398973 - DNA, 20 bp, Artificial
  CRISPR gRNA sequence
tcagttgtgacctaacacct

SEQ ID NO: 398974 - DNA, 20 bp, Artificial
  CRISPR gRNA sequence
tgacctaacacctcttggtt

SEQ ID NO: 398975 - DNA, 20 bp, Artificial
  CRISPR gRNA sequence
acacctcttggttccagcat

SEQ ID NO: 398976 - DNA, 20 bp, Artificial
  CRISPR gRNA sequence
ttggttccagcattgcagca

SEQ ID NO: 398977 - DNA, 20 bp, Artificial
  CRISPR gRNA sequence
ggttccagcattgcagcaca

SEQ ID NO: 398978 - DNA, 20 bp, Artificial
  CRISPR gRNA sequence
gttccagcattgcagcacaa

SEQ ID NO: 398979 - DNA, 20 bp, Artificial
  CRISPR gRNA sequence
cagcattgcagcacaaaaac

SEQ ID NO: 398980 - DNA, 20 bp, Artificial
  CRISPR gRNA sequence
cagcacaaaaacagcggtgg

SEQ ID NO: 398981 - DNA, 20 bp, Artificial
  CRISPR gRNA sequence
tctccaaccaaactgtttat

SEQ ID NO: 398982 - DNA, 20 bp, Artificial
  CRISPR gRNA sequence
caaccaaactgtttatggaa

SEQ ID NO: 398983 - DNA, 20 bp, Artificial
  CRISPR gRNA sequence
tttatggaaatcagtgggct

SEQ ID NO: 398984 - DNA, 20 bp, Artificial
  CRISPR gRNA sequence
atggaaatcagtgggctgcg

SEQ ID NO: 398985 - DNA, 20 bp, Artificial
  CRISPR gRNA sequence
tggaaatcagtgggctgcgc

SEQ ID NO: 398986 - DNA, 20 bp, Artificial
  CRISPR gRNA sequence
cgcccagccctcaggccata

SEQ ID NO: 398987 - DNA, 20 bp, Artificial
  CRISPR gRNA sequence
aggccatagtttcagaaccc

SEQ ID NO: 398988 - DNA, 20 bp, Artificial
  CRISPR gRNA sequence
cagaaccctgtcttagagga

SEQ ID NO: 398989 - DNA, 20 bp, Artificial
  CRISPR gRNA sequence
agaaccctgtcttagaggat

SEQ ID NO: 398990 - DNA, 20 bp, Artificial
  CRISPR gRNA sequence
tcttagaggatccctgctga

SEQ ID NO: 398991 - DNA, 20 bp, Artificial
  CRISPR gRNA sequence
agaggatccctgctgaaccc

SEQ ID NO: 398992 - DNA, 20 bp, Artificial
  CRISPR gRNA sequence
gaggatccctgctgaacccc

SEQ ID NO: 398993 - DNA, 20 bp, Artificial
  CRISPR gRNA sequence
ctgaaccccaactggagtct

SEQ ID NO: 398994 - DNA, 20 bp, Artificial
  CRISPR gRNA sequence
aaccccaactggagtctttg

SEQ ID NO: 398995 - DNA, 20 bp, Artificial
  CRISPR gRNA sequence
gagtctttgcgttgactgga

SEQ ID NO: 398996 - DNA, 20 bp, Artificial
  CRISPR gRNA sequence
tgcgttgactggaagtgggg

SEQ ID NO: 398997 - DNA, 20 bp, Artificial
  CRISPR gRNA sequence
gcgttgactggaagtggggt

SEQ ID NO: 398998 - DNA, 20 bp, Artificial
  CRISPR gRNA sequence
cgttgactggaagtggggtt

SEQ ID NO: 398999 - DNA, 20 bp, Artificial
  CRISPR gRNA sequence
actggaagtggggttctact

SEQ ID NO: 399000 - DNA, 20 bp, Artificial
  CRISPR gRNA sequence
gaagtggggttctactggtc

SEQ ID NO: 399001 - DNA, 20 bp, Artificial
  CRISPR gRNA sequence
tactggtcactcagcagtag

SEQ ID NO: 399002 - DNA, 20 bp, Artificial
  CRISPR gRNA sequence
ctggtcactcagcagtagcc

SEQ ID NO: 399003 - DNA, 20 bp, Artificial
  CRISPR gRNA sequence
gtcactcagcagtagcctca

SEQ ID NO: 399004 - DNA, 20 bp, Artificial
  CRISPR gRNA sequence
agcagtagcctcactcctgg

SEQ ID NO: 399005 - DNA, 20 bp, Artificial
  CRISPR gRNA sequence
actcctggggacatgtgtat

SEQ ID NO: 399006 - DNA, 20 bp, Artificial
  CRISPR gRNA sequence
ctggggacatgtgtatgact

SEQ ID NO: 399007 - DNA, 20 bp, Artificial
  CRISPR gRNA sequence
gggacatgtgtatgacttgc

SEQ ID NO: 399008 - DNA, 20 bp, Artificial
  CRISPR gRNA sequence
gccaaggttctaagggtatc

SEQ ID NO: 399009 - DNA, 20 bp, Artificial
  CRISPR gRNA sequence
ccaaggttctaagggtatcg

SEQ ID NO: 399010 - DNA, 20 bp, Artificial
  CRISPR gRNA sequence
taagggtatcgtggtctaga

SEQ ID NO: 399011 - DNA, 20 bp, Artificial
  CRISPR gRNA sequence
agggtatcgtggtctagagg

SEQ ID NO: 399012 - DNA, 20 bp, Artificial
  CRISPR gRNA sequence
gaggagaccatgtggcccac

SEQ ID NO: 399013 - DNA, 20 bp, Artificial
  CRISPR gRNA sequence
gaaaggttctcttaatgaga

SEQ ID NO: 399014 - DNA, 20 bp, Artificial
  CRISPR gRNA sequence
tcttaatgagattatttgag

SEQ ID NO: 399015 - DNA, 20 bp, Artificial
  CRISPR gRNA sequence
ttaatgagattatttgagga

SEQ ID NO: 399016 - DNA, 20 bp, Artificial
  CRISPR gRNA sequence
aatgagattatttgaggaag

SEQ ID NO: 399017 - DNA, 20 bp, Artificial
  CRISPR gRNA sequence
atgagattatttgaggaagg

SEQ ID NO: 399018 - DNA, 20 bp, Artificial
  CRISPR gRNA sequence
tttgaggaagggagcagaaa

SEQ ID NO: 399019 - DNA, 20 bp, Artificial
  CRISPR gRNA sequence
gaggaagggagcagaaaccc

SEQ ID NO: 399020 - DNA, 20 bp, Artificial
  CRISPR gRNA sequence
aggaagggagcagaaaccca

SEQ ID NO: 399021 - DNA, 20 bp, Artificial
  CRISPR gRNA sequence
ttgtgttcctgaggaaattt

SEQ ID NO: 399022 - DNA, 20 bp, Artificial
  CRISPR gRNA sequence
tgttcctgaggaaatttttt

SEQ ID NO: 399023 - DNA, 20 bp, Artificial
  CRISPR gRNA sequence
ctgaggaaattttttttttt

SEQ ID NO: 399024 - DNA, 20 bp, Artificial
  CRISPR gRNA sequence
aggaaatttttttttttttt

SEQ ID NO: 399025 - DNA, 20 bp, Artificial
  CRISPR gRNA sequence
tttttttttttttttttttg

SEQ ID NO: 399026 - DNA, 20 bp, Artificial
  CRISPR gRNA sequence
ttttttttttttttttttga

SEQ ID NO: 399027 - DNA, 20 bp, Artificial
  CRISPR gRNA sequence
tttttttttttttttttgag

SEQ ID NO: 399028 - DNA, 20 bp, Artificial
  CRISPR gRNA sequence
ttttttttttttttttgaga

SEQ ID NO: 399029 - DNA, 20 bp, Artificial
  CRISPR gRNA sequence
tttttttttttttttgagat

SEQ ID NO: 399030 - DNA, 20 bp, Artificial
  CRISPR gRNA sequence
ttttttttttttttgagatg

SEQ ID NO: 399031 - DNA, 20 bp, Artificial
  CRISPR gRNA sequence
tttttttttttttgagatgg

SEQ ID NO: 399032 - DNA, 20 bp, Artificial
  CRISPR gRNA sequence
ttttttttttttgagatgga

SEQ ID NO: 399033 - DNA, 20 bp, Artificial
  CRISPR gRNA sequence
tttttttttttgagatggag

SEQ ID NO: 399034 - DNA, 20 bp, Artificial
  CRISPR gRNA sequence
ttttttttttgagatggagt

SEQ ID NO: 399035 - DNA, 20 bp, Artificial
  CRISPR gRNA sequence
tttttttttgagatggagtc

SEQ ID NO: 399036 - DNA, 20 bp, Artificial
  CRISPR gRNA sequence
ttttttttgagatggagtct

SEQ ID NO: 399037 - DNA, 20 bp, Artificial
  CRISPR gRNA sequence
tttttttgagatggagtctc

SEQ ID NO: 399038 - DNA, 20 bp, Artificial
  CRISPR gRNA sequence
ttttttgagatggagtctcg

SEQ ID NO: 399039 - DNA, 20 bp, Artificial
  CRISPR gRNA sequence
tttttgagatggagtctcgc

SEQ ID NO: 399040 - DNA, 20 bp, Artificial
  CRISPR gRNA sequence
ttttgagatggagtctcgct

SEQ ID NO: 399041 - DNA, 20 bp, Artificial
  CRISPR gRNA sequence
tttgagatggagtctcgctc

SEQ ID NO: 399042 - DNA, 20 bp, Artificial
  CRISPR gRNA sequence
ttgagatggagtctcgctcc

SEQ ID NO: 399043 - DNA, 20 bp, Artificial
  CRISPR gRNA sequence
tgagatggagtctcgctcct

SEQ ID NO: 399044 - DNA, 20 bp, Artificial
  CRISPR gRNA sequence
gagatggagtctcgctcctt

SEQ ID NO: 399045 - DNA, 20 bp, Artificial
  CRISPR gRNA sequence
agatggagtctcgctccttt

SEQ ID NO: 399046 - DNA, 20 bp, Artificial
  CRISPR gRNA sequence
gctcctttgcccaggctgga

SEQ ID NO: 399047 - DNA, 20 bp, Artificial
  CRISPR gRNA sequence
ctttgcccaggctggagtgc

SEQ ID NO: 399048 - DNA, 20 bp, Artificial
  CRISPR gRNA sequence
tgcccaggctggagtgcagt

SEQ ID NO: 399049 - DNA, 20 bp, Artificial
  CRISPR gRNA sequence
gcccaggctggagtgcagtg

SEQ ID NO: 399050 - DNA, 20 bp, Artificial
  CRISPR gRNA sequence
cccaggctggagtgcagtgg

SEQ ID NO: 399051 - DNA, 20 bp, Artificial
  CRISPR gRNA sequence
gagtgcagtggtgcgatgtc

SEQ ID NO: 399052 - DNA, 20 bp, Artificial
  CRISPR gRNA sequence
actgcaagctctgcctcctg

SEQ ID NO: 399053 - DNA, 20 bp, Artificial
  CRISPR gRNA sequence
caagctctgcctcctgggtt

SEQ ID NO: 399054 - DNA, 20 bp, Artificial
  CRISPR gRNA sequence
tgcctcctgggttcacgcca

SEQ ID NO: 399055 - DNA, 20 bp, Artificial
  CRISPR gRNA sequence
cctcctgggttcacgccatt

SEQ ID NO: 399056 - DNA, 20 bp, Artificial
  CRISPR gRNA sequence
ctgggttcacgccattctcc

SEQ ID NO: 399057 - DNA, 20 bp, Artificial
  CRISPR gRNA sequence
ggttcacgccattctcctgc

SEQ ID NO: 399058 - DNA, 20 bp, Artificial
  CRISPR gRNA sequence
acgccattctcctgcctcag

SEQ ID NO: 399059 - DNA, 20 bp, Artificial
  CRISPR gRNA sequence
tcctgcctcagcctcctgag

SEQ ID NO: 399060 - DNA, 20 bp, Artificial
  CRISPR gRNA sequence
ctgcctcagcctcctgagta

SEQ ID NO: 399061 - DNA, 20 bp, Artificial
  CRISPR gRNA sequence
cctcagcctcctgagtagct

SEQ ID NO: 399062 - DNA, 20 bp, Artificial
  CRISPR gRNA sequence
agcctcctgagtagctggga

SEQ ID NO: 399063 - DNA, 20 bp, Artificial
  CRISPR gRNA sequence
ctgagtagctgggactacag

SEQ ID NO: 399064 - DNA, 20 bp, Artificial
  CRISPR gRNA sequence
agtagctgggactacaggtg

SEQ ID NO: 399065 - DNA, 20 bp, Artificial
  CRISPR gRNA sequence
ggactacaggtgcccgctac

SEQ ID NO: 399066 - DNA, 20 bp, Artificial
  CRISPR gRNA sequence
caggtgcccgctaccacacc

SEQ ID NO: 399067 - DNA, 20 bp, Artificial
  CRISPR gRNA sequence
ccacacccggctaatttttt

SEQ ID NO: 399068 - DNA, 20 bp, Artificial
  CRISPR gRNA sequence
attttttgtatttttagcag

SEQ ID NO: 399069 - DNA, 20 bp, Artificial
  CRISPR gRNA sequence
tttgtatttttagcagagac

SEQ ID NO: 399070 - DNA, 20 bp, Artificial
  CRISPR gRNA sequence
ttgtatttttagcagagacg

SEQ ID NO: 399071 - DNA, 20 bp, Artificial
  CRISPR gRNA sequence
tgtatttttagcagagacgt

SEQ ID NO: 399072 - DNA, 20 bp, Artificial
  CRISPR gRNA sequence
gtatttttagcagagacgtg

SEQ ID NO: 399073 - DNA, 20 bp, Artificial
  CRISPR gRNA sequence
tatttttagcagagacgtgg

SEQ ID NO: 399074 - DNA, 20 bp, Artificial
  CRISPR gRNA sequence
ttagcagagacgtggtttca

SEQ ID NO: 399075 - DNA, 20 bp, Artificial
  CRISPR gRNA sequence
tagcagagacgtggtttcac

SEQ ID NO: 399076 - DNA, 20 bp, Artificial
  CRISPR gRNA sequence
agcagagacgtggtttcacc

SEQ ID NO: 399077 - DNA, 20 bp, Artificial
  CRISPR gRNA sequence
gcagagacgtggtttcaccg

SEQ ID NO: 399078 - DNA, 20 bp, Artificial
  CRISPR gRNA sequence
caccgtgttagccacgatgg

SEQ ID NO: 399079 - DNA, 20 bp, Artificial
  CRISPR gRNA sequence
accgtgttagccacgatggt

SEQ ID NO: 399080 - DNA, 20 bp, Artificial
  CRISPR gRNA sequence
gccacgatggtctcgatctc

SEQ ID NO: 399081 - DNA, 20 bp, Artificial
  CRISPR gRNA sequence
gatctcctgacctcatgatc

SEQ ID NO: 399082 - DNA, 20 bp, Artificial
  CRISPR gRNA sequence
ctgacctcatgatccgcccg

SEQ ID NO: 399083 - DNA, 20 bp, Artificial
  CRISPR gRNA sequence
acctcatgatccgcccgcct

SEQ ID NO: 399084 - DNA, 20 bp, Artificial
  CRISPR gRNA sequence
atgatccgcccgcctcggcc

SEQ ID NO: 399085 - DNA, 20 bp, Artificial
  CRISPR gRNA sequence
ggccttcactttgggattac

SEQ ID NO: 399086 - DNA, 20 bp, Artificial
  CRISPR gRNA sequence
cactttgggattacaggcgt

SEQ ID NO: 399087 - DNA, 20 bp, Artificial
  CRISPR gRNA sequence
actttgggattacaggcgtg

SEQ ID NO: 399088 - DNA, 20 bp, Artificial
  CRISPR gRNA sequence
tgggattacaggcgtgagcc

SEQ ID NO: 399089 - DNA, 20 bp, Artificial
  CRISPR gRNA sequence
gggattacaggcgtgagcca

SEQ ID NO: 399090 - DNA, 20 bp, Artificial
  CRISPR gRNA sequence
ggattacaggcgtgagccac

SEQ ID NO: 399091 - DNA, 20 bp, Artificial
  CRISPR gRNA sequence
caggcgtgagccaccgcacc

SEQ ID NO: 399092 - DNA, 20 bp, Artificial
  CRISPR gRNA sequence
ctgtggaaatcttactggaa

SEQ ID NO: 399093 - DNA, 20 bp, Artificial
  CRISPR gRNA sequence
tggaaatcttactggaagta

SEQ ID NO: 399094 - DNA, 20 bp, Artificial
  CRISPR gRNA sequence
actggaagtatgagcctctt

SEQ ID NO: 399095 - DNA, 20 bp, Artificial
  CRISPR gRNA sequence
ctggaagtatgagcctctta

SEQ ID NO: 399096 - DNA, 20 bp, Artificial
  CRISPR gRNA sequence
gaagtatgagcctcttaaca

SEQ ID NO: 399097 - DNA, 20 bp, Artificial
  CRISPR gRNA sequence
ttaacagctggggcatccca

SEQ ID NO: 399098 - DNA, 20 bp, Artificial
  CRISPR gRNA sequence
aacagctggggcatcccagc

SEQ ID NO: 399099 - DNA, 20 bp, Artificial
  CRISPR gRNA sequence
acagctggggcatcccagca

SEQ ID NO: 399100 - DNA, 20 bp, Artificial
  CRISPR gRNA sequence
gggcatcccagcagaaggca

SEQ ID NO: 399101 - DNA, 20 bp, Artificial
  CRISPR gRNA sequence
gcatctgagaaggagtggag

SEQ ID NO: 399102 - DNA, 20 bp, Artificial
  CRISPR gRNA sequence
agaaggagtggagggagcaa

SEQ ID NO: 399103 - DNA, 20 bp, Artificial
  CRISPR gRNA sequence
tcacactataatcttcccag

SEQ ID NO: 399104 - DNA, 20 bp, Artificial
  CRISPR gRNA sequence
acactataatcttcccagcc

SEQ ID NO: 399105 - DNA, 20 bp, Artificial
  CRISPR gRNA sequence
taatcttcccagccccagtc

SEQ ID NO: 399106 - DNA, 20 bp, Artificial
  CRISPR gRNA sequence
cccagccccagtcacttgtt

SEQ ID NO: 399107 - DNA, 20 bp, Artificial
  CRISPR gRNA sequence
ccagccccagtcacttgttc

SEQ ID NO: 399108 - DNA, 20 bp, Artificial
  CRISPR gRNA sequence
gttctgagtttagctagatt

SEQ ID NO: 399109 - DNA, 20 bp, Artificial
  CRISPR gRNA sequence
ttctgagtttagctagattt

SEQ ID NO: 399110 - DNA, 20 bp, Artificial
  CRISPR gRNA sequence
tgagtttagctagattttct

SEQ ID NO: 399111 - DNA, 20 bp, Artificial
  CRISPR gRNA sequence
agtttagctagattttctgt

SEQ ID NO: 399112 - DNA, 20 bp, Artificial
  CRISPR gRNA sequence
agctagattttctgttcaca

SEQ ID NO: 399113 - DNA, 20 bp, Artificial
  CRISPR gRNA sequence
gctagattttctgttcacag

SEQ ID NO: 399114 - DNA, 20 bp, Artificial
  CRISPR gRNA sequence
gattttctgttcacagtcct

SEQ ID NO: 399115 - DNA, 20 bp, Artificial
  CRISPR gRNA sequence
tctgttcacagtcctctgct

SEQ ID NO: 399116 - DNA, 20 bp, Artificial
  CRISPR gRNA sequence
ctgttcacagtcctctgctt

SEQ ID NO: 399117 - DNA, 20 bp, Artificial
  CRISPR gRNA sequence
tgttcacagtcctctgcttt

SEQ ID NO: 399118 - DNA, 20 bp, Artificial
  CRISPR gRNA sequence
ttcacagtcctctgctttcc

SEQ ID NO: 399119 - DNA, 20 bp, Artificial
  CRISPR gRNA sequence
acagtcctctgctttccagc

SEQ ID NO: 399120 - DNA, 20 bp, Artificial
  CRISPR gRNA sequence
tgctttccagcatgtgaata

SEQ ID NO: 399121 - DNA, 20 bp, Artificial
  CRISPR gRNA sequence
ctttccagcatgtgaatagt

SEQ ID NO: 399122 - DNA, 20 bp, Artificial
  CRISPR gRNA sequence
tccagcatgtgaatagtttt

SEQ ID NO: 399123 - DNA, 20 bp, Artificial
  CRISPR gRNA sequence
ccagcatgtgaatagttttc

SEQ ID NO: 399124 - DNA, 20 bp, Artificial
  CRISPR gRNA sequence
cagcatgtgaatagttttcc

SEQ ID NO: 399125 - DNA, 20 bp, Artificial
  CRISPR gRNA sequence
tccaagcaagtgtcgaaagg

SEQ ID NO: 399126 - DNA, 20 bp, Artificial
  CRISPR gRNA sequence
ccaagcaagtgtcgaaaggt

SEQ ID NO: 399127 - DNA, 20 bp, Artificial
  CRISPR gRNA sequence
caagcaagtgtcgaaaggta

SEQ ID NO: 399128 - DNA, 20 bp, Artificial
  CRISPR gRNA sequence
tccatcacacacatcaggtg

SEQ ID NO: 399129 - DNA, 20 bp, Artificial
  CRISPR gRNA sequence
catcacacacatcaggtgtt

SEQ ID NO: 399130 - DNA, 20 bp, Artificial
  CRISPR gRNA sequence
ttgcataaactggggaaggt

SEQ ID NO: 399131 - DNA, 20 bp, Artificial
  CRISPR gRNA sequence
tgcataaactggggaaggtg

SEQ ID NO: 399132 - DNA, 20 bp, Artificial
  CRISPR gRNA sequence
gcataaactggggaaggtgg

SEQ ID NO: 399133 - DNA, 20 bp, Artificial
  CRISPR gRNA sequence
cataaactggggaaggtggg

SEQ ID NO: 399134 - DNA, 20 bp, Artificial
  CRISPR gRNA sequence
gggaaggtggggtcattgag

SEQ ID NO: 399135 - DNA, 20 bp, Artificial
  CRISPR gRNA sequence
agtagacactaggagactcc

SEQ ID NO: 399136 - DNA, 20 bp, Artificial
  CRISPR gRNA sequence
ggagactcctcccaatgctc

SEQ ID NO: 399137 - DNA, 20 bp, Artificial
  CRISPR gRNA sequence
ctcccaatgctcagaaacca

SEQ ID NO: 399138 - DNA, 20 bp, Artificial
  CRISPR gRNA sequence
ccaatgctcagaaaccatag

SEQ ID NO: 399139 - DNA, 20 bp, Artificial
  CRISPR gRNA sequence
agaaaccatagagacatctg

SEQ ID NO: 399140 - DNA, 20 bp, Artificial
  CRISPR gRNA sequence
gggaagcaggacatattgta

SEQ ID NO: 399141 - DNA, 20 bp, Artificial
  CRISPR gRNA sequence
taggtagcagaaacaatgaa

SEQ ID NO: 399142 - DNA, 20 bp, Artificial
  CRISPR gRNA sequence
aggtgacagggaaggttcta

SEQ ID NO: 399143 - DNA, 20 bp, Artificial
  CRISPR gRNA sequence
tacctgggtggacagcctac

SEQ ID NO: 399144 - DNA, 20 bp, Artificial
  CRISPR gRNA sequence
cctgggtggacagcctacag

SEQ ID NO: 399145 - DNA, 20 bp, Artificial
  CRISPR gRNA sequence
ggtggacagcctacaggaag

SEQ ID NO: 399146 - DNA, 20 bp, Artificial
  CRISPR gRNA sequence
caggaagaagaacagtgtgg

SEQ ID NO: 399147 - DNA, 20 bp, Artificial
  CRISPR gRNA sequence
aagagtgttccccgtcccca

SEQ ID NO: 399148 - DNA, 20 bp, Artificial
  CRISPR gRNA sequence
cccgtccccacccacccagg

SEQ ID NO: 399149 - DNA, 20 bp, Artificial
  CRISPR gRNA sequence
ggagtctgcattcagaggca

SEQ ID NO: 399150 - DNA, 20 bp, Artificial
  CRISPR gRNA sequence
cattcagaggcaagcttgtg

SEQ ID NO: 399151 - DNA, 20 bp, Artificial
  CRISPR gRNA sequence
agaggcaagcttgtgagatg

SEQ ID NO: 399152 - DNA, 20 bp, Artificial
  CRISPR gRNA sequence
gtgagatgaattcatgctca

SEQ ID NO: 399153 - DNA, 20 bp, Artificial
  CRISPR gRNA sequence
tgagatgaattcatgctcat

SEQ ID NO: 399154 - DNA, 20 bp, Artificial
  CRISPR gRNA sequence
atgctcatgtggttagctga

SEQ ID NO: 399155 - DNA, 20 bp, Artificial
  CRISPR gRNA sequence
atgtggttagctgagacatt

SEQ ID NO: 399156 - DNA, 20 bp, Artificial
  CRISPR gRNA sequence
gctgagacatttttaatagt

SEQ ID NO: 399157 - DNA, 20 bp, Artificial
  CRISPR gRNA sequence
agacatttttaatagtagag

SEQ ID NO: 399158 - DNA, 20 bp, Artificial
  CRISPR gRNA sequence
ttaatagtagagaaatccag

SEQ ID NO: 399159 - DNA, 20 bp, Artificial
  CRISPR gRNA sequence
taatagtagagaaatccagt

SEQ ID NO: 399160 - DNA, 20 bp, Artificial
  CRISPR gRNA sequence
aatagtagagaaatccagta

SEQ ID NO: 399161 - DNA, 20 bp, Artificial
  CRISPR gRNA sequence
atagtagagaaatccagtaa

SEQ ID NO: 399162 - DNA, 20 bp, Artificial
  CRISPR gRNA sequence
tgattaatgacttccttgag

SEQ ID NO: 399163 - DNA, 20 bp, Artificial
  CRISPR gRNA sequence
gattaatgacttccttgagg

SEQ ID NO: 399164 - DNA, 20 bp, Artificial
  CRISPR gRNA sequence
attaatgacttccttgagga

SEQ ID NO: 399165 - DNA, 20 bp, Artificial
  CRISPR gRNA sequence
atgacttccttgaggacaaa

SEQ ID NO: 399166 - DNA, 20 bp, Artificial
  CRISPR gRNA sequence
ccttgaggacaaagctcttt

SEQ ID NO: 399167 - DNA, 20 bp, Artificial
  CRISPR gRNA sequence
cttgaggacaaagctctttt

SEQ ID NO: 399168 - DNA, 20 bp, Artificial
  CRISPR gRNA sequence
gaggacaaagctcttttata

SEQ ID NO: 399169 - DNA, 20 bp, Artificial
  CRISPR gRNA sequence
aggacaaagctcttttatac

SEQ ID NO: 399170 - DNA, 20 bp, Artificial
  CRISPR gRNA sequence
ttttatacagacagctctat

SEQ ID NO: 399171 - DNA, 20 bp, Artificial
  CRISPR gRNA sequence
ttatacagacagctctatta

SEQ ID NO: 399172 - DNA, 20 bp, Artificial
  CRISPR gRNA sequence
tatacagacagctctattag

SEQ ID NO: 399173 - DNA, 20 bp, Artificial
  CRISPR gRNA sequence
atacagacagctctattaga

SEQ ID NO: 399174 - DNA, 20 bp, Artificial
  CRISPR gRNA sequence
tacagacagctctattagaa

SEQ ID NO: 399175 - DNA, 20 bp, Artificial
  CRISPR gRNA sequence
tattagaaaaaaaacctcaa

SEQ ID NO: 399176 - DNA, 20 bp, Artificial
  CRISPR gRNA sequence
ttagaaaaaaaacctcaagc

SEQ ID NO: 399177 - DNA, 20 bp, Artificial
  CRISPR gRNA sequence
gaaaaaaaacctcaagccaa

SEQ ID NO: 399178 - DNA, 20 bp, Artificial
  CRISPR gRNA sequence
aagccaaaatcccttcataa

SEQ ID NO: 399179 - DNA, 20 bp, Artificial
  CRISPR gRNA sequence
cataaatcatgcaaaaaatg

SEQ ID NO: 399180 - DNA, 20 bp, Artificial
  CRISPR gRNA sequence
ataaatcatgcaaaaaatgg

SEQ ID NO: 399181 - DNA, 20 bp, Artificial
  CRISPR gRNA sequence
ctgacacaacaaaaatagct

SEQ ID NO: 399182 - DNA, 20 bp, Artificial
  CRISPR gRNA sequence
acacaacaaaaatagctcaa

SEQ ID NO: 399183 - DNA, 20 bp, Artificial
  CRISPR gRNA sequence
aagcgctgtctctatttgtc

SEQ ID NO: 399184 - DNA, 20 bp, Artificial
  CRISPR gRNA sequence
tctctatttgtctttggtta

SEQ ID NO: 399185 - DNA, 20 bp, Artificial
  CRISPR gRNA sequence
tatttgtctttggttagatg

SEQ ID NO: 399186 - DNA, 20 bp, Artificial
  CRISPR gRNA sequence
tttgtctttggttagatgtt

SEQ ID NO: 399187 - DNA, 20 bp, Artificial
  CRISPR gRNA sequence
gtctttggttagatgttgat

SEQ ID NO: 399188 - DNA, 20 bp, Artificial
  CRISPR gRNA sequence
tctttggttagatgttgata

SEQ ID NO: 399189 - DNA, 20 bp, Artificial
  CRISPR gRNA sequence
tggttagatgttgataaata

SEQ ID NO: 399190 - DNA, 20 bp, Artificial
  CRISPR gRNA sequence
ggttagatgttgataaatag

SEQ ID NO: 399191 - DNA, 20 bp, Artificial
  CRISPR gRNA sequence
gttagatgttgataaatagg

SEQ ID NO: 399192 - DNA, 20 bp, Artificial
  CRISPR gRNA sequence
gatgttgataaatagggctc

SEQ ID NO: 399193 - DNA, 20 bp, Artificial
  CRISPR gRNA sequence
ataaatagggctcatctcta

SEQ ID NO: 399194 - DNA, 20 bp, Artificial
  CRISPR gRNA sequence
atctctagcaaagtcgtaac

SEQ ID NO: 399195 - DNA, 20 bp, Artificial
  CRISPR gRNA sequence
tagcaaagtcgtaacagctg

SEQ ID NO: 399196 - DNA, 20 bp, Artificial
  CRISPR gRNA sequence
gcaaagtcgtaacagctgga

SEQ ID NO: 399197 - DNA, 20 bp, Artificial
  CRISPR gRNA sequence
gactttgtcttcagctgcaa

SEQ ID NO: 399198 - DNA, 20 bp, Artificial
  CRISPR gRNA sequence
tgtcttcagctgcaagtctt

SEQ ID NO: 399199 - DNA, 20 bp, Artificial
  CRISPR gRNA sequence
gtcttcagctgcaagtcttt

SEQ ID NO: 399200 - DNA, 20 bp, Artificial
  CRISPR gRNA sequence
tcttcagctgcaagtctttc

SEQ ID NO: 399201 - DNA, 20 bp, Artificial
  CRISPR gRNA sequence
cagctgcaagtctttctgcc

SEQ ID NO: 399202 - DNA, 20 bp, Artificial
  CRISPR gRNA sequence
agctgcaagtctttctgccc

SEQ ID NO: 399203 - DNA, 20 bp, Artificial
  CRISPR gRNA sequence
caagtctttctgcccctttc

SEQ ID NO: 399204 - DNA, 20 bp, Artificial
  CRISPR gRNA sequence
tctgcccctttcattcgaat

SEQ ID NO: 399205 - DNA, 20 bp, Artificial
  CRISPR gRNA sequence
ctgcccctttcattcgaatc

SEQ ID NO: 399206 - DNA, 20 bp, Artificial
  CRISPR gRNA sequence
tgcccctttcattcgaatct

SEQ ID NO: 399207 - DNA, 20 bp, Artificial
  CRISPR gRNA sequence
cccctttcattcgaatctgt

SEQ ID NO: 399208 - DNA, 20 bp, Artificial
  CRISPR gRNA sequence
tcattcgaatctgtgacctc

SEQ ID NO: 399209 - DNA, 20 bp, Artificial
  CRISPR gRNA sequence
cattcgaatctgtgacctct

SEQ ID NO: 399210 - DNA, 20 bp, Artificial
  CRISPR gRNA sequence
attcgaatctgtgacctcta

SEQ ID NO: 399211 - DNA, 20 bp, Artificial
  CRISPR gRNA sequence
gaatctgtgacctctaggac

SEQ ID NO: 399212 - DNA, 20 bp, Artificial
  CRISPR gRNA sequence
tgacctctaggaccctcaat

SEQ ID NO: 399213 - DNA, 20 bp, Artificial
  CRISPR gRNA sequence
taggaccctcaattccaggg

SEQ ID NO: 399214 - DNA, 20 bp, Artificial
  CRISPR gRNA sequence
ggaccctcaattccagggtg

SEQ ID NO: 399215 - DNA, 20 bp, Artificial
  CRISPR gRNA sequence
aattccagggtgcaaataca

SEQ ID NO: 399216 - DNA, 20 bp, Artificial
  CRISPR gRNA sequence
cagggtgcaaatacacaagt

SEQ ID NO: 399217 - DNA, 20 bp, Artificial
  CRISPR gRNA sequence
tcttcatctcttgactagtt

SEQ ID NO: 399218 - DNA, 20 bp, Artificial
  CRISPR gRNA sequence
ttcatctcttgactagttgg

SEQ ID NO: 399219 - DNA, 20 bp, Artificial
  CRISPR gRNA sequence
catctcttgactagttggct

SEQ ID NO: 399220 - DNA, 20 bp, Artificial
  CRISPR gRNA sequence
atctcttgactagttggctc

SEQ ID NO: 399221 - DNA, 20 bp, Artificial
  CRISPR gRNA sequence
ttgactagttggctctggat

SEQ ID NO: 399222 - DNA, 20 bp, Artificial
  CRISPR gRNA sequence
gactagttggctctggatgc

SEQ ID NO: 399223 - DNA, 20 bp, Artificial
  CRISPR gRNA sequence
actagttggctctggatgcc

SEQ ID NO: 399224 - DNA, 20 bp, Artificial
  CRISPR gRNA sequence
gttggctctggatgccttgg

SEQ ID NO: 399225 - DNA, 20 bp, Artificial
  CRISPR gRNA sequence
gctctggatgccttgggaat

SEQ ID NO: 399226 - DNA, 20 bp, Artificial
  CRISPR gRNA sequence
tggatgccttgggaataagg

SEQ ID NO: 399227 - DNA, 20 bp, Artificial
  CRISPR gRNA sequence
gatgccttgggaataaggag

SEQ ID NO: 399228 - DNA, 20 bp, Artificial
  CRISPR gRNA sequence
gggaataaggagttcctaca

SEQ ID NO: 399229 - DNA, 20 bp, Artificial
  CRISPR gRNA sequence
ggaataaggagttcctacaa

SEQ ID NO: 399230 - DNA, 20 bp, Artificial
  CRISPR gRNA sequence
ctacaagttattaccagtta

SEQ ID NO: 399231 - DNA, 20 bp, Artificial
  CRISPR gRNA sequence
caagttattaccagttagta

SEQ ID NO: 399232 - DNA, 20 bp, Artificial
  CRISPR gRNA sequence
ttaccagttagtaccccttt

SEQ ID NO: 399233 - DNA, 20 bp, Artificial
  CRISPR gRNA sequence
ccagttagtaccccttttcc

SEQ ID NO: 399234 - DNA, 20 bp, Artificial
  CRISPR gRNA sequence
gtaccccttttccagtcctc

SEQ ID NO: 399235 - DNA, 20 bp, Artificial
  CRISPR gRNA sequence
ttccagtcctcctcccatga

SEQ ID NO: 399236 - DNA, 20 bp, Artificial
  CRISPR gRNA sequence
tccagtcctcctcccatgaa

SEQ ID NO: 399237 - DNA, 20 bp, Artificial
  CRISPR gRNA sequence
ccagtcctcctcccatgaac

SEQ ID NO: 399238 - DNA, 20 bp, Artificial
  CRISPR gRNA sequence
cagtcctcctcccatgaacc

SEQ ID NO: 399239 - DNA, 20 bp, Artificial
  CRISPR gRNA sequence
ctcccatgaacctcatttct

SEQ ID NO: 399240 - DNA, 20 bp, Artificial
  CRISPR gRNA sequence
ccatgaacctcatttcttta

SEQ ID NO: 399241 - DNA, 20 bp, Artificial
  CRISPR gRNA sequence
atttctttatcctgggtgag

SEQ ID NO: 399242 - DNA, 20 bp, Artificial
  CRISPR gRNA sequence
ctttatcctgggtgaggaag

SEQ ID NO: 399243 - DNA, 20 bp, Artificial
  CRISPR gRNA sequence
tttatcctgggtgaggaagt

SEQ ID NO: 399244 - DNA, 20 bp, Artificial
  CRISPR gRNA sequence
tatcctgggtgaggaagttc

SEQ ID NO: 399245 - DNA, 20 bp, Artificial
  CRISPR gRNA sequence
atcctgggtgaggaagttca

SEQ ID NO: 399246 - DNA, 20 bp, Artificial
  CRISPR gRNA sequence
tcctgggtgaggaagttcac

SEQ ID NO: 399247 - DNA, 20 bp, Artificial
  CRISPR gRNA sequence
ggtgaggaagttcactttgg

SEQ ID NO: 399248 - DNA, 20 bp, Artificial
  CRISPR gRNA sequence
actttgggcctgatcataga

SEQ ID NO: 399249 - DNA, 20 bp, Artificial
  CRISPR gRNA sequence
tgggcctgatcatagaaacc

SEQ ID NO: 399250 - DNA, 20 bp, Artificial
  CRISPR gRNA sequence
gggcctgatcatagaaacca

SEQ ID NO: 399251 - DNA, 20 bp, Artificial
  CRISPR gRNA sequence
ggcctgatcatagaaaccac

SEQ ID NO: 399252 - DNA, 20 bp, Artificial
  CRISPR gRNA sequence
atcatagaaaccaccgagag

SEQ ID NO: 399253 - DNA, 20 bp, Artificial
  CRISPR gRNA sequence
ggtttcatctcatttccttt

SEQ ID NO: 399254 - DNA, 20 bp, Artificial
  CRISPR gRNA sequence
catctcatttcctttaggat

SEQ ID NO: 399255 - DNA, 20 bp, Artificial
  CRISPR gRNA sequence
atctcatttcctttaggatt

SEQ ID NO: 399256 - DNA, 20 bp, Artificial
  CRISPR gRNA sequence
atttcctttaggatttgagg

SEQ ID NO: 399257 - DNA, 20 bp, Artificial
  CRISPR gRNA sequence
cctttaggatttgaggcagc

SEQ ID NO: 399258 - DNA, 20 bp, Artificial
  CRISPR gRNA sequence
ctttaggatttgaggcagca

SEQ ID NO: 399259 - DNA, 20 bp, Artificial
  CRISPR gRNA sequence
taggatttgaggcagcacgg

SEQ ID NO: 399260 - DNA, 20 bp, Artificial
  CRISPR gRNA sequence
aggatttgaggcagcacggt

SEQ ID NO: 399261 - DNA, 20 bp, Artificial
  CRISPR gRNA sequence
ggatttgaggcagcacggtg

SEQ ID NO: 399262 - DNA, 20 bp, Artificial
  CRISPR gRNA sequence
gaggcagcacggtgttgcag

SEQ ID NO: 399263 - DNA, 20 bp, Artificial
  CRISPR gRNA sequence
aggcagcacggtgttgcaga

SEQ ID NO: 399264 - DNA, 20 bp, Artificial
  CRISPR gRNA sequence
cagatgcctgcttggccctc

SEQ ID NO: 399265 - DNA, 20 bp, Artificial
  CRISPR gRNA sequence
cttggccctcagcccttcta

SEQ ID NO: 399266 - DNA, 20 bp, Artificial
  CRISPR gRNA sequence
ggccctcagcccttctacct

SEQ ID NO: 399267 - DNA, 20 bp, Artificial
  CRISPR gRNA sequence
gccctcagcccttctacctc

SEQ ID NO: 399268 - DNA, 20 bp, Artificial
  CRISPR gRNA sequence
agcccttctacctctctacc

SEQ ID NO: 399269 - DNA, 20 bp, Artificial
  CRISPR gRNA sequence
ctacctctctacctgcacct

SEQ ID NO: 399270 - DNA, 20 bp, Artificial
  CRISPR gRNA sequence
tacctctctacctgcacctc

SEQ ID NO: 399271 - DNA, 20 bp, Artificial
  CRISPR gRNA sequence
cctctctacctgcacctcta

SEQ ID NO: 399272 - DNA, 20 bp, Artificial
  CRISPR gRNA sequence
tctacctgcacctctacccc

SEQ ID NO: 399273 - DNA, 20 bp, Artificial
  CRISPR gRNA sequence
tacctgcacctctaccccac

SEQ ID NO: 399274 - DNA, 20 bp, Artificial
  CRISPR gRNA sequence
cctgcacctctaccccactt

SEQ ID NO: 399275 - DNA, 20 bp, Artificial
  CRISPR gRNA sequence
cacctctaccccactttacc

SEQ ID NO: 399276 - DNA, 20 bp, Artificial
  CRISPR gRNA sequence
taccccactttacccaaccc

SEQ ID NO: 399277 - DNA, 20 bp, Artificial
  CRISPR gRNA sequence
ccccactttacccaaccctg

SEQ ID NO: 399278 - DNA, 20 bp, Artificial
  CRISPR gRNA sequence
tacccaaccctgacccctcc

SEQ ID NO: 399279 - DNA, 20 bp, Artificial
  CRISPR gRNA sequence
acccaaccctgacccctccc

SEQ ID NO: 399280 - DNA, 20 bp, Artificial
  CRISPR gRNA sequence
cccaaccctgacccctccct

SEQ ID NO: 399281 - DNA, 20 bp, Artificial
  CRISPR gRNA sequence
acccctccctcagaaaatag

SEQ ID NO: 399282 - DNA, 20 bp, Artificial
  CRISPR gRNA sequence
cctcagaaaatagatatgtt

SEQ ID NO: 399283 - DNA, 20 bp, Artificial
  CRISPR gRNA sequence
agaaaatagatatgttttgg

SEQ ID NO: 399284 - DNA, 20 bp, Artificial
  CRISPR gRNA sequence
tggcatttgtttaataagca

SEQ ID NO: 399285 - DNA, 20 bp, Artificial
  CRISPR gRNA sequence
ggcatttgtttaataagcac

SEQ ID NO: 399286 - DNA, 20 bp, Artificial
  CRISPR gRNA sequence
gcatttgtttaataagcaca

SEQ ID NO: 399287 - DNA, 20 bp, Artificial
  CRISPR gRNA sequence
gtttaataagcacataatga

SEQ ID NO: 399288 - DNA, 20 bp, Artificial
  CRISPR gRNA sequence
tttaataagcacataatgat

SEQ ID NO: 399289 - DNA, 20 bp, Artificial
  CRISPR gRNA sequence
aataagcacataatgatttt

SEQ ID NO: 399290 - DNA, 20 bp, Artificial
  CRISPR gRNA sequence
ataagcacataatgattttt

SEQ ID NO: 399291 - DNA, 20 bp, Artificial
  CRISPR gRNA sequence
ttaaaaatatcttaaatcat

SEQ ID NO: 399292 - DNA, 20 bp, Artificial
  CRISPR gRNA sequence
taaaaatatcttaaatcatt

SEQ ID NO: 399293 - DNA, 20 bp, Artificial
  CRISPR gRNA sequence
aaaaatatcttaaatcattt

SEQ ID NO: 399294 - DNA, 20 bp, Artificial
  CRISPR gRNA sequence
aaaatatcttaaatcattta

SEQ ID NO: 399295 - DNA, 20 bp, Artificial
  CRISPR gRNA sequence
aaatcatttatctgacaacc

SEQ ID NO: 399296 - DNA, 20 bp, Artificial
  CRISPR gRNA sequence
aatcatttatctgacaacct

SEQ ID NO: 399297 - DNA, 20 bp, Artificial
  CRISPR gRNA sequence
atctgacaacctcgactatc

SEQ ID NO: 399298 - DNA, 20 bp, Artificial
  CRISPR gRNA sequence
tctgacaacctcgactatca

SEQ ID NO: 399299 - DNA, 20 bp, Artificial
  CRISPR gRNA sequence
acaacctcgactatcatgat

SEQ ID NO: 399300 - DNA, 20 bp, Artificial
  CRISPR gRNA sequence
gactatcatgatcttttgca

SEQ ID NO: 399301 - DNA, 20 bp, Artificial
  CRISPR gRNA sequence
tcatgatcttttgcattatt

SEQ ID NO: 399302 - DNA, 20 bp, Artificial
  CRISPR gRNA sequence
ttgcattattgatttccagc

SEQ ID NO: 399303 - DNA, 20 bp, Artificial
  CRISPR gRNA sequence
tgcattattgatttccagct

SEQ ID NO: 399304 - DNA, 20 bp, Artificial
  CRISPR gRNA sequence
gcattattgatttccagctg

SEQ ID NO: 399305 - DNA, 20 bp, Artificial
  CRISPR gRNA sequence
cattattgatttccagctgt

SEQ ID NO: 399306 - DNA, 20 bp, Artificial
  CRISPR gRNA sequence
ttgatttccagctgttatca

SEQ ID NO: 399307 - DNA, 20 bp, Artificial
  CRISPR gRNA sequence
atttccagctgttatcacaa

SEQ ID NO: 399308 - DNA, 20 bp, Artificial
  CRISPR gRNA sequence
ccagctgttatcacaaagtt

SEQ ID NO: 399309 - DNA, 20 bp, Artificial
  CRISPR gRNA sequence
cagctgttatcacaaagttg

SEQ ID NO: 399310 - DNA, 20 bp, Artificial
  CRISPR gRNA sequence
ttatcacaaagttgtgacag

SEQ ID NO: 399311 - DNA, 20 bp, Artificial
  CRISPR gRNA sequence
tcacaaagttgtgacagagt

SEQ ID NO: 399312 - DNA, 20 bp, Artificial
  CRISPR gRNA sequence
tgacagagtgtgtctgtgga

SEQ ID NO: 399313 - DNA, 20 bp, Artificial
  CRISPR gRNA sequence
tggactctatgcttagactg

SEQ ID NO: 399314 - DNA, 20 bp, Artificial
  CRISPR gRNA sequence
tatgcttagactgtactatg

SEQ ID NO: 399315 - DNA, 20 bp, Artificial
  CRISPR gRNA sequence
tgcttagactgtactatgct

SEQ ID NO: 399316 - DNA, 20 bp, Artificial
  CRISPR gRNA sequence
agactgtactatgctaatgt

SEQ ID NO: 399317 - DNA, 20 bp, Artificial
  CRISPR gRNA sequence
gactgtactatgctaatgta

SEQ ID NO: 399318 - DNA, 20 bp, Artificial
  CRISPR gRNA sequence
tactatgctaatgtactgta

SEQ ID NO: 399319 - DNA, 20 bp, Artificial
  CRISPR gRNA sequence
tgctaatgtactgtattctt

SEQ ID NO: 399320 - DNA, 20 bp, Artificial
  CRISPR gRNA sequence
atgtactgtattcttagaat

SEQ ID NO: 399321 - DNA, 20 bp, Artificial
  CRISPR gRNA sequence
tattcttagaatgtacttgg

SEQ ID NO: 399322 - DNA, 20 bp, Artificial
  CRISPR gRNA sequence
ttagaatgtacttggcatct

SEQ ID NO: 399323 - DNA, 20 bp, Artificial
  CRISPR gRNA sequence
agaatgtacttggcatcttt

SEQ ID NO: 399324 - DNA, 20 bp, Artificial
  CRISPR gRNA sequence
gaatgtacttggcatctttg

SEQ ID NO: 399325 - DNA, 20 bp, Artificial
  CRISPR gRNA sequence
ggcatctttggaccggggtg

SEQ ID NO: 399326 - DNA, 20 bp, Artificial
  CRISPR gRNA sequence
gcatctttggaccggggtgg

SEQ ID NO: 399327 - DNA, 20 bp, Artificial
  CRISPR gRNA sequence
tggaccggggtggttggggg

SEQ ID NO: 399328 - DNA, 20 bp, Artificial
  CRISPR gRNA sequence
ggaccggggtggttggggga

SEQ ID NO: 399329 - DNA, 20 bp, Artificial
  CRISPR gRNA sequence
gaccggggtggttgggggat

SEQ ID NO: 399330 - DNA, 20 bp, Artificial
  CRISPR gRNA sequence
ggggatcaaatgaaatcaat

SEQ ID NO: 399331 - DNA, 20 bp, Artificial
  CRISPR gRNA sequence
atacgtggccaacagcaaga

SEQ ID NO: 399332 - DNA, 20 bp, Artificial
  CRISPR gRNA sequence
attcattggtaagacctggg

SEQ ID NO: 399333 - DNA, 20 bp, Artificial
  CRISPR gRNA sequence
attggtaagacctggggtga

SEQ ID NO: 399334 - DNA, 20 bp, Artificial
  CRISPR gRNA sequence
gtaagacctggggtgaatgt

SEQ ID NO: 399335 - DNA, 20 bp, Artificial
  CRISPR gRNA sequence
gggtgaatgtggactcatac

SEQ ID NO: 399336 - DNA, 20 bp, Artificial
  CRISPR gRNA sequence
atactattcactagtaacaa

SEQ ID NO: 399337 - DNA, 20 bp, Artificial
  CRISPR gRNA sequence
ttcactagtaacaattttta

SEQ ID NO: 399338 - DNA, 20 bp, Artificial
  CRISPR gRNA sequence
actagtaacaatttttaaaa

SEQ ID NO: 399339 - DNA, 20 bp, Artificial
  CRISPR gRNA sequence
gtaacaatttttaaaaattg

SEQ ID NO: 399340 - DNA, 20 bp, Artificial
  CRISPR gRNA sequence
ttaaaaattgaggtgaaatt

SEQ ID NO: 399341 - DNA, 20 bp, Artificial
  CRISPR gRNA sequence
taaaaattgaggtgaaattc

SEQ ID NO: 399342 - DNA, 20 bp, Artificial
  CRISPR gRNA sequence
aaaaattgaggtgaaattca

SEQ ID NO: 399343 - DNA, 20 bp, Artificial
  CRISPR gRNA sequence
aaaattgaggtgaaattcac

SEQ ID NO: 399344 - DNA, 20 bp, Artificial
  CRISPR gRNA sequence
aggtgaaattcacataacat

SEQ ID NO: 399345 - DNA, 20 bp, Artificial
  CRISPR gRNA sequence
acataacattgttcacctaa

SEQ ID NO: 399346 - DNA, 20 bp, Artificial
  CRISPR gRNA sequence
ttcacctaagatttagtcaa

SEQ ID NO: 399347 - DNA, 20 bp, Artificial
  CRISPR gRNA sequence
acctaagatttagtcaacat

SEQ ID NO: 399348 - DNA, 20 bp, Artificial
  CRISPR gRNA sequence
agatttagtcaacataagat

SEQ ID NO: 399349 - DNA, 20 bp, Artificial
  CRISPR gRNA sequence
agtcaacataagattaaact

SEQ ID NO: 399350 - DNA, 20 bp, Artificial
  CRISPR gRNA sequence
gtcaacataagattaaactt

SEQ ID NO: 399351 - DNA, 20 bp, Artificial
  CRISPR gRNA sequence
aacttttttttttttttttt

SEQ ID NO: 399352 - DNA, 20 bp, Artificial
  CRISPR gRNA sequence
tttttttttttttttgaaac

SEQ ID NO: 399353 - DNA, 20 bp, Artificial
  CRISPR gRNA sequence
ttttttttttttttgaaacg

SEQ ID NO: 399354 - DNA, 20 bp, Artificial
  CRISPR gRNA sequence
tttttttttttttgaaacgg

SEQ ID NO: 399355 - DNA, 20 bp, Artificial
  CRISPR gRNA sequence
ttttttttttttgaaacgga

SEQ ID NO: 399356 - DNA, 20 bp, Artificial
  CRISPR gRNA sequence
tttttttttttgaaacggag

SEQ ID NO: 399357 - DNA, 20 bp, Artificial
  CRISPR gRNA sequence
ttttttttttgaaacggagt

SEQ ID NO: 399358 - DNA, 20 bp, Artificial
  CRISPR gRNA sequence
tttttttttgaaacggagtc

SEQ ID NO: 399359 - DNA, 20 bp, Artificial
  CRISPR gRNA sequence
ttttttttgaaacggagtct

SEQ ID NO: 399360 - DNA, 20 bp, Artificial
  CRISPR gRNA sequence
tttttttgaaacggagtctt

SEQ ID NO: 399361 - DNA, 20 bp, Artificial
  CRISPR gRNA sequence
ttttttgaaacggagtcttg

SEQ ID NO: 399362 - DNA, 20 bp, Artificial
  CRISPR gRNA sequence
tttttgaaacggagtcttgc

SEQ ID NO: 399363 - DNA, 20 bp, Artificial
  CRISPR gRNA sequence
ttttgaaacggagtcttgct

SEQ ID NO: 399364 - DNA, 20 bp, Artificial
  CRISPR gRNA sequence
tttgaaacggagtcttgctc

SEQ ID NO: 399365 - DNA, 20 bp, Artificial
  CRISPR gRNA sequence
ttgaaacggagtcttgctct

SEQ ID NO: 399366 - DNA, 20 bp, Artificial
  CRISPR gRNA sequence
tgaaacggagtcttgctctg

SEQ ID NO: 399367 - DNA, 20 bp, Artificial
  CRISPR gRNA sequence
gaaacggagtcttgctctgt

SEQ ID NO: 399368 - DNA, 20 bp, Artificial
  CRISPR gRNA sequence
aaacggagtcttgctctgtt

SEQ ID NO: 399369 - DNA, 20 bp, Artificial
  CRISPR gRNA sequence
gctctgttgacctggctgga

SEQ ID NO: 399370 - DNA, 20 bp, Artificial
  CRISPR gRNA sequence
ctctgttgacctggctggag

SEQ ID NO: 399371 - DNA, 20 bp, Artificial
  CRISPR gRNA sequence
tgttgacctggctggagtgc

SEQ ID NO: 399372 - DNA, 20 bp, Artificial
  CRISPR gRNA sequence
ttgacctggctggagtgcag

SEQ ID NO: 399373 - DNA, 20 bp, Artificial
  CRISPR gRNA sequence
acctggctggagtgcagtgg

SEQ ID NO: 399374 - DNA, 20 bp, Artificial
  CRISPR gRNA sequence
gctggagtgcagtggcacaa

SEQ ID NO: 399375 - DNA, 20 bp, Artificial
  CRISPR gRNA sequence
gagtgcagtggcacaatctc

SEQ ID NO: 399376 - DNA, 20 bp, Artificial
  CRISPR gRNA sequence
agctcactgcaacctccacc

SEQ ID NO: 399377 - DNA, 20 bp, Artificial
  CRISPR gRNA sequence
actgcaacctccacctcctg

SEQ ID NO: 399378 - DNA, 20 bp, Artificial
  CRISPR gRNA sequence
caacctccacctcctgggtt

SEQ ID NO: 399379 - DNA, 20 bp, Artificial
  CRISPR gRNA sequence
cacctcctgggttcaagcga

SEQ ID NO: 399380 - DNA, 20 bp, Artificial
  CRISPR gRNA sequence
ctgggttcaagcgattctcc

SEQ ID NO: 399381 - DNA, 20 bp, Artificial
  CRISPR gRNA sequence
ggttcaagcgattctcctgt

SEQ ID NO: 399382 - DNA, 20 bp, Artificial
  CRISPR gRNA sequence
aagcgattctcctgtctcag

SEQ ID NO: 399383 - DNA, 20 bp, Artificial
  CRISPR gRNA sequence
tcctgtctcagcctcccaag

SEQ ID NO: 399384 - DNA, 20 bp, Artificial
  CRISPR gRNA sequence
ctgtctcagcctcccaagta

SEQ ID NO: 399385 - DNA, 20 bp, Artificial
  CRISPR gRNA sequence
tctcagcctcccaagtagct

SEQ ID NO: 399386 - DNA, 20 bp, Artificial
  CRISPR gRNA sequence
agcctcccaagtagctggga

SEQ ID NO: 399387 - DNA, 20 bp, Artificial
  CRISPR gRNA sequence
ccaagtagctgggattacag

SEQ ID NO: 399388 - DNA, 20 bp, Artificial
  CRISPR gRNA sequence
ggattacagttgcgcaccac

SEQ ID NO: 399389 - DNA, 20 bp, Artificial
  CRISPR gRNA sequence
cagttgcgcaccaccacgca

SEQ ID NO: 399390 - DNA, 20 bp, Artificial
  CRISPR gRNA sequence
cgcaccaccacgcacagcta

SEQ ID NO: 399391 - DNA, 20 bp, Artificial
  CRISPR gRNA sequence
atttttgtatttttagtaga

SEQ ID NO: 399392 - DNA, 20 bp, Artificial
  CRISPR gRNA sequence
ttgtatttttagtagagtcg

SEQ ID NO: 399393 - DNA, 20 bp, Artificial
  CRISPR gRNA sequence
tgtatttttagtagagtcgg

SEQ ID NO: 399394 - DNA, 20 bp, Artificial
  CRISPR gRNA sequence
gtatttttagtagagtcggg

SEQ ID NO: 399395 - DNA, 20 bp, Artificial
  CRISPR gRNA sequence
tatttttagtagagtcgggg

SEQ ID NO: 399396 - DNA, 20 bp, Artificial
  CRISPR gRNA sequence
ttagtagagtcggggtttca

SEQ ID NO: 399397 - DNA, 20 bp, Artificial
  CRISPR gRNA sequence
tagtagagtcggggtttcac

SEQ ID NO: 399398 - DNA, 20 bp, Artificial
  CRISPR gRNA sequence
agtagagtcggggtttcacc

SEQ ID NO: 399399 - DNA, 20 bp, Artificial
  CRISPR gRNA sequence
gtagagtcggggtttcacca

SEQ ID NO: 399400 - DNA, 20 bp, Artificial
  CRISPR gRNA sequence
caccatgttggccaggctgg

SEQ ID NO: 399401 - DNA, 20 bp, Artificial
  CRISPR gRNA sequence
accatgttggccaggctggt

SEQ ID NO: 399402 - DNA, 20 bp, Artificial
  CRISPR gRNA sequence
gccaggctggttttgaattc

SEQ ID NO: 399403 - DNA, 20 bp, Artificial
  CRISPR gRNA sequence
gttttgaattcctgacctca

SEQ ID NO: 399404 - DNA, 20 bp, Artificial
  CRISPR gRNA sequence
tgaattcctgacctcaagca

SEQ ID NO: 399405 - DNA, 20 bp, Artificial
  CRISPR gRNA sequence
gaattcctgacctcaagcaa

SEQ ID NO: 399406 - DNA, 20 bp, Artificial
  CRISPR gRNA sequence
aattcctgacctcaagcaat

SEQ ID NO: 399407 - DNA, 20 bp, Artificial
  CRISPR gRNA sequence
ctgacctcaagcaatccacc

SEQ ID NO: 399408 - DNA, 20 bp, Artificial
  CRISPR gRNA sequence
acctcaagcaatccacctgc

SEQ ID NO: 399409 - DNA, 20 bp, Artificial
  CRISPR gRNA sequence
aagcaatccacctgccttgg

SEQ ID NO: 399410 - DNA, 20 bp, Artificial
  CRISPR gRNA sequence
ccttggcctcccaaagtact

SEQ ID NO: 399411 - DNA, 20 bp, Artificial
  CRISPR gRNA sequence
ggcctcccaaagtactggga

SEQ ID NO: 399412 - DNA, 20 bp, Artificial
  CRISPR gRNA sequence
gcctcccaaagtactgggat

SEQ ID NO: 399413 - DNA, 20 bp, Artificial
  CRISPR gRNA sequence
ccaaagtactgggattacag

SEQ ID NO: 399414 - DNA, 20 bp, Artificial
  CRISPR gRNA sequence
ggattacaggtgtgagccac

SEQ ID NO: 399415 - DNA, 20 bp, Artificial
  CRISPR gRNA sequence
caggtgtgagccaccacacc

SEQ ID NO: 399416 - DNA, 20 bp, Artificial
  CRISPR gRNA sequence
aatattttaaaatatacagt

SEQ ID NO: 399417 - DNA, 20 bp, Artificial
  CRISPR gRNA sequence
taaaatatacagttcagtgg

SEQ ID NO: 399418 - DNA, 20 bp, Artificial
  CRISPR gRNA sequence
aaaatatacagttcagtggt

SEQ ID NO: 399419 - DNA, 20 bp, Artificial
  CRISPR gRNA sequence
aaatatacagttcagtggta

SEQ ID NO: 399420 - DNA, 20 bp, Artificial
  CRISPR gRNA sequence
agtggtatttagtacatcca

SEQ ID NO: 399421 - DNA, 20 bp, Artificial
  CRISPR gRNA sequence
agtacatccacagtgttctg

SEQ ID NO: 399422 - DNA, 20 bp, Artificial
  CRISPR gRNA sequence
gtacatccacagtgttctgt

SEQ ID NO: 399423 - DNA, 20 bp, Artificial
  CRISPR gRNA sequence
tgtgatgaccgcttttatca

SEQ ID NO: 399424 - DNA, 20 bp, Artificial
  CRISPR gRNA sequence
tgatgaccgcttttatcaga

SEQ ID NO: 399425 - DNA, 20 bp, Artificial
  CRISPR gRNA sequence
ttatcagattccaaaacatt

SEQ ID NO: 399426 - DNA, 20 bp, Artificial
  CRISPR gRNA sequence
tatcagattccaaaacattt

SEQ ID NO: 399427 - DNA, 20 bp, Artificial
  CRISPR gRNA sequence
atcagattccaaaacatttt

SEQ ID NO: 399428 - DNA, 20 bp, Artificial
  CRISPR gRNA sequence
tcagattccaaaacattttc

SEQ ID NO: 399429 - DNA, 20 bp, Artificial
  CRISPR gRNA sequence
caaaacattttcatcatttt

SEQ ID NO: 399430 - DNA, 20 bp, Artificial
  CRISPR gRNA sequence
tcatcattttaaagaaaacc

SEQ ID NO: 399431 - DNA, 20 bp, Artificial
  CRISPR gRNA sequence
catcattttaaagaaaaccc

SEQ ID NO: 399432 - DNA, 20 bp, Artificial
  CRISPR gRNA sequence
atcattttaaagaaaacccc

SEQ ID NO: 399433 - DNA, 20 bp, Artificial
  CRISPR gRNA sequence
taaagaaaaccccatacctt

SEQ ID NO: 399434 - DNA, 20 bp, Artificial
  CRISPR gRNA sequence
aaagaaaaccccatacctta

SEQ ID NO: 399435 - DNA, 20 bp, Artificial
  CRISPR gRNA sequence
aagaaaaccccataccttaa

SEQ ID NO: 399436 - DNA, 20 bp, Artificial
  CRISPR gRNA sequence
aaacagtcactccctattcc

SEQ ID NO: 399437 - DNA, 20 bp, Artificial
  CRISPR gRNA sequence
aacagtcactccctattccc

SEQ ID NO: 399438 - DNA, 20 bp, Artificial
  CRISPR gRNA sequence
cctattccctccttccaaca

SEQ ID NO: 399439 - DNA, 20 bp, Artificial
  CRISPR gRNA sequence
ttccctccttccaacagtca

SEQ ID NO: 399440 - DNA, 20 bp, Artificial
  CRISPR gRNA sequence
cctccttccaacagtcaatc

SEQ ID NO: 399441 - DNA, 20 bp, Artificial
  CRISPR gRNA sequence
cttccaacagtcaatcaatt

SEQ ID NO: 399442 - DNA, 20 bp, Artificial
  CRISPR gRNA sequence
ccaacagtcaatcaattggc

SEQ ID NO: 399443 - DNA, 20 bp, Artificial
  CRISPR gRNA sequence
caacagtcaatcaattggca

SEQ ID NO: 399444 - DNA, 20 bp, Artificial
  CRISPR gRNA sequence
gcaaatcaccaatctgcttt

SEQ ID NO: 399445 - DNA, 20 bp, Artificial
  CRISPR gRNA sequence
ctttccatctccatggattt

SEQ ID NO: 399446 - DNA, 20 bp, Artificial
  CRISPR gRNA sequence
tccatctccatggatttaac

SEQ ID NO: 399447 - DNA, 20 bp, Artificial
  CRISPR gRNA sequence
ccatctccatggatttaact

SEQ ID NO: 399448 - DNA, 20 bp, Artificial
  CRISPR gRNA sequence
catctccatggatttaacta

SEQ ID NO: 399449 - DNA, 20 bp, Artificial
  CRISPR gRNA sequence
catggatttaactatctgga

SEQ ID NO: 399450 - DNA, 20 bp, Artificial
  CRISPR gRNA sequence
aactatctggatatttcata

SEQ ID NO: 399451 - DNA, 20 bp, Artificial
  CRISPR gRNA sequence
actatctggatatttcatat

SEQ ID NO: 399452 - DNA, 20 bp, Artificial
  CRISPR gRNA sequence
tctggatatttcatataaat

SEQ ID NO: 399453 - DNA, 20 bp, Artificial
  CRISPR gRNA sequence
gatatttcatataaatggat

SEQ ID NO: 399454 - DNA, 20 bp, Artificial
  CRISPR gRNA sequence
catataaatggattcttaca

SEQ ID NO: 399455 - DNA, 20 bp, Artificial
  CRISPR gRNA sequence
atataaatggattcttacaa

SEQ ID NO: 399456 - DNA, 20 bp, Artificial
  CRISPR gRNA sequence
ttacaaaatgtggccttttg

SEQ ID NO: 399457 - DNA, 20 bp, Artificial
  CRISPR gRNA sequence
acaaaatgtggccttttgtt

SEQ ID NO: 399458 - DNA, 20 bp, Artificial
  CRISPR gRNA sequence
caaaatgtggccttttgttt

SEQ ID NO: 399459 - DNA, 20 bp, Artificial
  CRISPR gRNA sequence
ttgtttctgcattctttgac

SEQ ID NO: 399460 - DNA, 20 bp, Artificial
  CRISPR gRNA sequence
tgtttctgcattctttgact

SEQ ID NO: 399461 - DNA, 20 bp, Artificial
  CRISPR gRNA sequence
gtttctgcattctttgactt

SEQ ID NO: 399462 - DNA, 20 bp, Artificial
  CRISPR gRNA sequence
tttctgcattctttgactta

SEQ ID NO: 399463 - DNA, 20 bp, Artificial
  CRISPR gRNA sequence
ctgcattctttgacttagca

SEQ ID NO: 399464 - DNA, 20 bp, Artificial
  CRISPR gRNA sequence
tgcattctttgacttagcat

SEQ ID NO: 399465 - DNA, 20 bp, Artificial
  CRISPR gRNA sequence
cattctttgacttagcataa

SEQ ID NO: 399466 - DNA, 20 bp, Artificial
  CRISPR gRNA sequence
tttgacttagcataatgtta

SEQ ID NO: 399467 - DNA, 20 bp, Artificial
  CRISPR gRNA sequence
tgacttagcataatgttatc

SEQ ID NO: 399468 - DNA, 20 bp, Artificial
  CRISPR gRNA sequence
gacttagcataatgttatca

SEQ ID NO: 399469 - DNA, 20 bp, Artificial
  CRISPR gRNA sequence
acttagcataatgttatcaa

SEQ ID NO: 399470 - DNA, 20 bp, Artificial
  CRISPR gRNA sequence
agcataatgttatcaaggct

SEQ ID NO: 399471 - DNA, 20 bp, Artificial
  CRISPR gRNA sequence
gcataatgttatcaaggctt

SEQ ID NO: 399472 - DNA, 20 bp, Artificial
  CRISPR gRNA sequence
tcaaggcttattcatgttgt

SEQ ID NO: 399473 - DNA, 20 bp, Artificial
  CRISPR gRNA sequence
attcatgttgtagcatgcat

SEQ ID NO: 399474 - DNA, 20 bp, Artificial
  CRISPR gRNA sequence
ttcatgttgtagcatgcatt

SEQ ID NO: 399475 - DNA, 20 bp, Artificial
  CRISPR gRNA sequence
atgttgtagcatgcattagc

SEQ ID NO: 399476 - DNA, 20 bp, Artificial
  CRISPR gRNA sequence
tagcatgcattagcccttca

SEQ ID NO: 399477 - DNA, 20 bp, Artificial
  CRISPR gRNA sequence
gcccttcattcctttttatg

SEQ ID NO: 399478 - DNA, 20 bp, Artificial
  CRISPR gRNA sequence
cattcctttttatggctgag

SEQ ID NO: 399479 - DNA, 20 bp, Artificial
  CRISPR gRNA sequence
attcctttttatggctgagt

SEQ ID NO: 399480 - DNA, 20 bp, Artificial
  CRISPR gRNA sequence
ctttttatggctgagtaata

SEQ ID NO: 399481 - DNA, 20 bp, Artificial
  CRISPR gRNA sequence
tttatggctgagtaatattc

SEQ ID NO: 399482 - DNA, 20 bp, Artificial
  CRISPR gRNA sequence
ttatggctgagtaatattcc

SEQ ID NO: 399483 - DNA, 20 bp, Artificial
  CRISPR gRNA sequence
tatggctgagtaatattcca

SEQ ID NO: 399484 - DNA, 20 bp, Artificial
  CRISPR gRNA sequence
atggctgagtaatattccat

SEQ ID NO: 399485 - DNA, 20 bp, Artificial
  CRISPR gRNA sequence
tggctgagtaatattccatt

SEQ ID NO: 399486 - DNA, 20 bp, Artificial
  CRISPR gRNA sequence
agtaatattccattgtatgg

SEQ ID NO: 399487 - DNA, 20 bp, Artificial
  CRISPR gRNA sequence
cattgtatggatttgatcac

SEQ ID NO: 399488 - DNA, 20 bp, Artificial
  CRISPR gRNA sequence
tatggatttgatcacaattt

SEQ ID NO: 399489 - DNA, 20 bp, Artificial
  CRISPR gRNA sequence
gatcacaatttgttcattca

SEQ ID NO: 399490 - DNA, 20 bp, Artificial
  CRISPR gRNA sequence
atcacaatttgttcattcat

SEQ ID NO: 399491 - DNA, 20 bp, Artificial
  CRISPR gRNA sequence
gttcattcattcattcacct

SEQ ID NO: 399492 - DNA, 20 bp, Artificial
  CRISPR gRNA sequence
ttcattcattcattcacctg

SEQ ID NO: 399493 - DNA, 20 bp, Artificial
  CRISPR gRNA sequence
attcattcattcacctgttg

SEQ ID NO: 399494 - DNA, 20 bp, Artificial
  CRISPR gRNA sequence
attcattcacctgttggcag

SEQ ID NO: 399495 - DNA, 20 bp, Artificial
  CRISPR gRNA sequence
attcacctgttggcagacgc

SEQ ID NO: 399496 - DNA, 20 bp, Artificial
  CRISPR gRNA sequence
acctgttggcagacgcttgg

SEQ ID NO: 399497 - DNA, 20 bp, Artificial
  CRISPR gRNA sequence
ttggcagacgcttggatcgt

SEQ ID NO: 399498 - DNA, 20 bp, Artificial
  CRISPR gRNA sequence
gcagacgcttggatcgttac

SEQ ID NO: 399499 - DNA, 20 bp, Artificial
  CRISPR gRNA sequence
ggatcgttaccaccttctgg

SEQ ID NO: 399500 - DNA, 20 bp, Artificial
  CRISPR gRNA sequence
gatcgttaccaccttctggc

SEQ ID NO: 399501 - DNA, 20 bp, Artificial
  CRISPR gRNA sequence
ccaccttctggcttttgtga

SEQ ID NO: 399502 - DNA, 20 bp, Artificial
  CRISPR gRNA sequence
ctggcttttgtgaataatgc

SEQ ID NO: 399503 - DNA, 20 bp, Artificial
  CRISPR gRNA sequence
tggcttttgtgaataatgct

SEQ ID NO: 399504 - DNA, 20 bp, Artificial
  CRISPR gRNA sequence
gcttttgtgaataatgctgc

SEQ ID NO: 399505 - DNA, 20 bp, Artificial
  CRISPR gRNA sequence
ttgtgaataatgctgctgta

SEQ ID NO: 399506 - DNA, 20 bp, Artificial
  CRISPR gRNA sequence
tgtgaataatgctgctgtaa

SEQ ID NO: 399507 - DNA, 20 bp, Artificial
  CRISPR gRNA sequence
gtgaataatgctgctgtaaa

SEQ ID NO: 399508 - DNA, 20 bp, Artificial
  CRISPR gRNA sequence
tgaataatgctgctgtaaac

SEQ ID NO: 399509 - DNA, 20 bp, Artificial
  CRISPR gRNA sequence
ctgtaaacattggtctacaa

SEQ ID NO: 399510 - DNA, 20 bp, Artificial
  CRISPR gRNA sequence
taaacattggtctacaaata

SEQ ID NO: 399511 - DNA, 20 bp, Artificial
  CRISPR gRNA sequence
gtctacaaatattggtttga

SEQ ID NO: 399512 - DNA, 20 bp, Artificial
  CRISPR gRNA sequence
caaatattggtttgagtata

SEQ ID NO: 399513 - DNA, 20 bp, Artificial
  CRISPR gRNA sequence
gtttgagtatattcttttga

SEQ ID NO: 399514 - DNA, 20 bp, Artificial
  CRISPR gRNA sequence
gagtatattcttttgagtat

SEQ ID NO: 399515 - DNA, 20 bp, Artificial
  CRISPR gRNA sequence
agtatattcttttgagtata

SEQ ID NO: 399516 - DNA, 20 bp, Artificial
  CRISPR gRNA sequence
ttttgagtatatacctagga

SEQ ID NO: 399517 - DNA, 20 bp, Artificial
  CRISPR gRNA sequence
ttgagtatatacctaggaat

SEQ ID NO: 399518 - DNA, 20 bp, Artificial
  CRISPR gRNA sequence
tgagtatatacctaggaata

SEQ ID NO: 399519 - DNA, 20 bp, Artificial
  CRISPR gRNA sequence
gagtatatacctaggaataa

SEQ ID NO: 399520 - DNA, 20 bp, Artificial
  CRISPR gRNA sequence
agtatatacctaggaataaa

SEQ ID NO: 399521 - DNA, 20 bp, Artificial
  CRISPR gRNA sequence
ggaataaaacttctgggtca

SEQ ID NO: 399522 - DNA, 20 bp, Artificial
  CRISPR gRNA sequence
ctgggtcatacagtaatcct

SEQ ID NO: 399523 - DNA, 20 bp, Artificial
  CRISPR gRNA sequence
tgggtcatacagtaatcctg

SEQ ID NO: 399524 - DNA, 20 bp, Artificial
  CRISPR gRNA sequence
ggtcatacagtaatcctgtt

SEQ ID NO: 399525 - DNA, 20 bp, Artificial
  CRISPR gRNA sequence
ttgaacgttttgaagaatct

SEQ ID NO: 399526 - DNA, 20 bp, Artificial
  CRISPR gRNA sequence
aacgttttgaagaatctcta

SEQ ID NO: 399527 - DNA, 20 bp, Artificial
  CRISPR gRNA sequence
tgaagaatctctaaactgtt

SEQ ID NO: 399528 - DNA, 20 bp, Artificial
  CRISPR gRNA sequence
gaagaatctctaaactgttc

SEQ ID NO: 399529 - DNA, 20 bp, Artificial
  CRISPR gRNA sequence
aagaatctctaaactgttct

SEQ ID NO: 399530 - DNA, 20 bp, Artificial
  CRISPR gRNA sequence
taaactgttcttcacagcag

SEQ ID NO: 399531 - DNA, 20 bp, Artificial
  CRISPR gRNA sequence
aactgttcttcacagcagct

SEQ ID NO: 399532 - DNA, 20 bp, Artificial
  CRISPR gRNA sequence
ttcttcacagcagctgcatc

SEQ ID NO: 399533 - DNA, 20 bp, Artificial
  CRISPR gRNA sequence
ttcacagcagctgcatcatt

SEQ ID NO: 399534 - DNA, 20 bp, Artificial
  CRISPR gRNA sequence
cacagcagctgcatcatttt

SEQ ID NO: 399535 - DNA, 20 bp, Artificial
  CRISPR gRNA sequence
acagcagctgcatcatttta

SEQ ID NO: 399536 - DNA, 20 bp, Artificial
  CRISPR gRNA sequence
catcattttacatttcttta

SEQ ID NO: 399537 - DNA, 20 bp, Artificial
  CRISPR gRNA sequence
tacatttctttacaacgctt

SEQ ID NO: 399538 - DNA, 20 bp, Artificial
  CRISPR gRNA sequence
acatttctttacaacgcttg

SEQ ID NO: 399539 - DNA, 20 bp, Artificial
  CRISPR gRNA sequence
catttctttacaacgcttgt

SEQ ID NO: 399540 - DNA, 20 bp, Artificial
  CRISPR gRNA sequence
ctttacaacgcttgtgcaac

SEQ ID NO: 399541 - DNA, 20 bp, Artificial
  CRISPR gRNA sequence
tttacaacgcttgtgcaaca

SEQ ID NO: 399542 - DNA, 20 bp, Artificial
  CRISPR gRNA sequence
tacaacgcttgtgcaacagt

SEQ ID NO: 399543 - DNA, 20 bp, Artificial
  CRISPR gRNA sequence
acaacgcttgtgcaacagta

SEQ ID NO: 399544 - DNA, 20 bp, Artificial
  CRISPR gRNA sequence
caacgcttgtgcaacagtac

SEQ ID NO: 399545 - DNA, 20 bp, Artificial
  CRISPR gRNA sequence
gtgcaacagtacacaagggt

SEQ ID NO: 399546 - DNA, 20 bp, Artificial
  CRISPR gRNA sequence
tgcaacagtacacaagggtt

SEQ ID NO: 399547 - DNA, 20 bp, Artificial
  CRISPR gRNA sequence
gaatttctccacattttccc

SEQ ID NO: 399548 - DNA, 20 bp, Artificial
  CRISPR gRNA sequence
ctccacattttccctaacat

SEQ ID NO: 399549 - DNA, 20 bp, Artificial
  CRISPR gRNA sequence
tccacattttccctaacata

SEQ ID NO: 399550 - DNA, 20 bp, Artificial
  CRISPR gRNA sequence
cacattttccctaacatatt

SEQ ID NO: 399551 - DNA, 20 bp, Artificial
  CRISPR gRNA sequence
tccctaacatattaattttt

SEQ ID NO: 399552 - DNA, 20 bp, Artificial
  CRISPR gRNA sequence
ccctaacatattaatttttc

SEQ ID NO: 399553 - DNA, 20 bp, Artificial
  CRISPR gRNA sequence
cctaacatattaatttttct

SEQ ID NO: 399554 - DNA, 20 bp, Artificial
  CRISPR gRNA sequence
acatattaatttttctcttt

SEQ ID NO: 399555 - DNA, 20 bp, Artificial
  CRISPR gRNA sequence
atttttctctttttgattat

SEQ ID NO: 399556 - DNA, 20 bp, Artificial
  CRISPR gRNA sequence
ttctctttttgattatgtcc

SEQ ID NO: 399557 - DNA, 20 bp, Artificial
  CRISPR gRNA sequence
tctctttttgattatgtcca

SEQ ID NO: 399558 - DNA, 20 bp, Artificial
  CRISPR gRNA sequence
ctctttttgattatgtccat

SEQ ID NO: 399559 - DNA, 20 bp, Artificial
  CRISPR gRNA sequence
tctttttgattatgtccatc

SEQ ID NO: 399560 - DNA, 20 bp, Artificial
  CRISPR gRNA sequence
tttttgattatgtccatcct

SEQ ID NO: 399561 - DNA, 20 bp, Artificial
  CRISPR gRNA sequence
tttgattatgtccatcctag

SEQ ID NO: 399562 - DNA, 20 bp, Artificial
  CRISPR gRNA sequence
ttgattatgtccatcctagt

SEQ ID NO: 399563 - DNA, 20 bp, Artificial
  CRISPR gRNA sequence
tgattatgtccatcctagta

SEQ ID NO: 399564 - DNA, 20 bp, Artificial
  CRISPR gRNA sequence
gattatgtccatcctagtag

SEQ ID NO: 399565 - DNA, 20 bp, Artificial
  CRISPR gRNA sequence
attatgtccatcctagtaga

SEQ ID NO: 399566 - DNA, 20 bp, Artificial
  CRISPR gRNA sequence
tgtccatcctagtagatata

SEQ ID NO: 399567 - DNA, 20 bp, Artificial
  CRISPR gRNA sequence
gtagatataaagtgagttct

SEQ ID NO: 399568 - DNA, 20 bp, Artificial
  CRISPR gRNA sequence
tcattgtggttcttatttgt

SEQ ID NO: 399569 - DNA, 20 bp, Artificial
  CRISPR gRNA sequence
attgtggttcttatttgtgt

SEQ ID NO: 399570 - DNA, 20 bp, Artificial
  CRISPR gRNA sequence
tggttcttatttgtgtttcc

SEQ ID NO: 399571 - DNA, 20 bp, Artificial
  CRISPR gRNA sequence
ttatttgtgtttccttattg

SEQ ID NO: 399572 - DNA, 20 bp, Artificial
  CRISPR gRNA sequence
atttgtgtttccttattgac

SEQ ID NO: 399573 - DNA, 20 bp, Artificial
  CRISPR gRNA sequence
tttgtgtttccttattgact

SEQ ID NO: 399574 - DNA, 20 bp, Artificial
  CRISPR gRNA sequence
gtgtttccttattgactgat

SEQ ID NO: 399575 - DNA, 20 bp, Artificial
  CRISPR gRNA sequence
tgtttccttattgactgata

SEQ ID NO: 399576 - DNA, 20 bp, Artificial
  CRISPR gRNA sequence
ccttattgactgataatgtt

SEQ ID NO: 399577 - DNA, 20 bp, Artificial
  CRISPR gRNA sequence
cttattgactgataatgttg

SEQ ID NO: 399578 - DNA, 20 bp, Artificial
  CRISPR gRNA sequence
attgactgataatgttgagc

SEQ ID NO: 399579 - DNA, 20 bp, Artificial
  CRISPR gRNA sequence
ttgactgataatgttgagca

SEQ ID NO: 399580 - DNA, 20 bp, Artificial
  CRISPR gRNA sequence
actgataatgttgagcatct

SEQ ID NO: 399581 - DNA, 20 bp, Artificial
  CRISPR gRNA sequence
ataatgttgagcatcttttg

SEQ ID NO: 399582 - DNA, 20 bp, Artificial
  CRISPR gRNA sequence
agcatcttttggagaaaaat

SEQ ID NO: 399583 - DNA, 20 bp, Artificial
  CRISPR gRNA sequence
ttggagaaaaatgtctattc

SEQ ID NO: 399584 - DNA, 20 bp, Artificial
  CRISPR gRNA sequence
tggagaaaaatgtctattca

SEQ ID NO: 399585 - DNA, 20 bp, Artificial
  CRISPR gRNA sequence
ggagaaaaatgtctattcaa

SEQ ID NO: 399586 - DNA, 20 bp, Artificial
  CRISPR gRNA sequence
gagaaaaatgtctattcaag

SEQ ID NO: 399587 - DNA, 20 bp, Artificial
  CRISPR gRNA sequence
ttcaagtactttgcccattt

SEQ ID NO: 399588 - DNA, 20 bp, Artificial
  CRISPR gRNA sequence
aagtactttgcccatttgaa

SEQ ID NO: 399589 - DNA, 20 bp, Artificial
  CRISPR gRNA sequence
tgcccatttgaaaattgggt

SEQ ID NO: 399590 - DNA, 20 bp, Artificial
  CRISPR gRNA sequence
gcccatttgaaaattgggtt

SEQ ID NO: 399591 - DNA, 20 bp, Artificial
  CRISPR gRNA sequence
cccatttgaaaattgggttg

SEQ ID NO: 399592 - DNA, 20 bp, Artificial
  CRISPR gRNA sequence
gaaaattgggttgtttcttt

SEQ ID NO: 399593 - DNA, 20 bp, Artificial
  CRISPR gRNA sequence
aaaattgggttgtttctttt

SEQ ID NO: 399594 - DNA, 20 bp, Artificial
  CRISPR gRNA sequence
ggttgtttcttttatgttaa

SEQ ID NO: 399595 - DNA, 20 bp, Artificial
  CRISPR gRNA sequence
tttcttttatgttaaagtgt

SEQ ID NO: 399596 - DNA, 20 bp, Artificial
  CRISPR gRNA sequence
cttttatgttaaagtgtgag

SEQ ID NO: 399597 - DNA, 20 bp, Artificial
  CRISPR gRNA sequence
ttttatgttaaagtgtgaga

SEQ ID NO: 399598 - DNA, 20 bp, Artificial
  CRISPR gRNA sequence
ttatgttaaagtgtgagagt

SEQ ID NO: 399599 - DNA, 20 bp, Artificial
  CRISPR gRNA sequence
tatgttaaagtgtgagagtt

SEQ ID NO: 399600 - DNA, 20 bp, Artificial
  CRISPR gRNA sequence
atgttaaagtgtgagagttc

SEQ ID NO: 399601 - DNA, 20 bp, Artificial
  CRISPR gRNA sequence
tgttaaagtgtgagagttcc

SEQ ID NO: 399602 - DNA, 20 bp, Artificial
  CRISPR gRNA sequence
aagtgtgagagttccttata

SEQ ID NO: 399603 - DNA, 20 bp, Artificial
  CRISPR gRNA sequence
cttatatattatggatatta

SEQ ID NO: 399604 - DNA, 20 bp, Artificial
  CRISPR gRNA sequence
atatattatggatattagac

SEQ ID NO: 399605 - DNA, 20 bp, Artificial
  CRISPR gRNA sequence
tatattatggatattagacc

SEQ ID NO: 399606 - DNA, 20 bp, Artificial
  CRISPR gRNA sequence
tggatattagaccataatca

SEQ ID NO: 399607 - DNA, 20 bp, Artificial
  CRISPR gRNA sequence
gaccataatcagatagatta

SEQ ID NO: 399608 - DNA, 20 bp, Artificial
  CRISPR gRNA sequence
tttgcaaatatttgcttgca

SEQ ID NO: 399609 - DNA, 20 bp, Artificial
  CRISPR gRNA sequence
gcaaatatttgcttgcattc

SEQ ID NO: 399610 - DNA, 20 bp, Artificial
  CRISPR gRNA sequence
caaatatttgcttgcattct

SEQ ID NO: 399611 - DNA, 20 bp, Artificial
  CRISPR gRNA sequence
gcttgcattctgtagggtga

SEQ ID NO: 399612 - DNA, 20 bp, Artificial
  CRISPR gRNA sequence
cttgcattctgtagggtgac

SEQ ID NO: 399613 - DNA, 20 bp, Artificial
  CRISPR gRNA sequence
gcattctgtagggtgacttt

SEQ ID NO: 399614 - DNA, 20 bp, Artificial
  CRISPR gRNA sequence
cattctgtagggtgactttt

SEQ ID NO: 399615 - DNA, 20 bp, Artificial
  CRISPR gRNA sequence
tgtagggtgacttttcactt

SEQ ID NO: 399616 - DNA, 20 bp, Artificial
  CRISPR gRNA sequence
tagggtgacttttcactttc

SEQ ID NO: 399617 - DNA, 20 bp, Artificial
  CRISPR gRNA sequence
ttcactttcttgaaaatgtc

SEQ ID NO: 399618 - DNA, 20 bp, Artificial
  CRISPR gRNA sequence
tcactttcttgaaaatgtcc

SEQ ID NO: 399619 - DNA, 20 bp, Artificial
  CRISPR gRNA sequence
cactttcttgaaaatgtcct

SEQ ID NO: 399620 - DNA, 20 bp, Artificial
  CRISPR gRNA sequence
actttcttgaaaatgtcctt

SEQ ID NO: 399621 - DNA, 20 bp, Artificial
  CRISPR gRNA sequence
tcttgaaaatgtcctttgat

SEQ ID NO: 399622 - DNA, 20 bp, Artificial
  CRISPR gRNA sequence
cttgaaaatgtcctttgatg

SEQ ID NO: 399623 - DNA, 20 bp, Artificial
  CRISPR gRNA sequence
ttgaaaatgtcctttgatgc

SEQ ID NO: 399624 - DNA, 20 bp, Artificial
  CRISPR gRNA sequence
gaaaatgtcctttgatgcac

SEQ ID NO: 399625 - DNA, 20 bp, Artificial
  CRISPR gRNA sequence
aaaatgtcctttgatgcaca

SEQ ID NO: 399626 - DNA, 20 bp, Artificial
  CRISPR gRNA sequence
tgatgcacaaaagtttttaa

SEQ ID NO: 399627 - DNA, 20 bp, Artificial
  CRISPR gRNA sequence
gatgcacaaaagtttttaat

SEQ ID NO: 399628 - DNA, 20 bp, Artificial
  CRISPR gRNA sequence
atgcacaaaagtttttaatt

SEQ ID NO: 399629 - DNA, 20 bp, Artificial
  CRISPR gRNA sequence
ttaattttagtaagtccaat

SEQ ID NO: 399630 - DNA, 20 bp, Artificial
  CRISPR gRNA sequence
taattttagtaagtccaatt

SEQ ID NO: 399631 - DNA, 20 bp, Artificial
  CRISPR gRNA sequence
aattttagtaagtccaattt

SEQ ID NO: 399632 - DNA, 20 bp, Artificial
  CRISPR gRNA sequence
attttagtaagtccaattta

SEQ ID NO: 399633 - DNA, 20 bp, Artificial
  CRISPR gRNA sequence
tagtaagtccaatttatttt

SEQ ID NO: 399634 - DNA, 20 bp, Artificial
  CRISPR gRNA sequence
agtaagtccaatttattttt

SEQ ID NO: 399635 - DNA, 20 bp, Artificial
  CRISPR gRNA sequence
gtaagtccaatttatttttt

SEQ ID NO: 399636 - DNA, 20 bp, Artificial
  CRISPR gRNA sequence
atttttttcttttgttgccc

SEQ ID NO: 399637 - DNA, 20 bp, Artificial
  CRISPR gRNA sequence
tttttttcttttgttgccca

SEQ ID NO: 399638 - DNA, 20 bp, Artificial
  CRISPR gRNA sequence
ttttcttttgttgcccatag

SEQ ID NO: 399639 - DNA, 20 bp, Artificial
  CRISPR gRNA sequence
tttcttttgttgcccatagg

SEQ ID NO: 399640 - DNA, 20 bp, Artificial
  CRISPR gRNA sequence
ttcttttgttgcccataggt

SEQ ID NO: 399641 - DNA, 20 bp, Artificial
  CRISPR gRNA sequence
tcttttgttgcccataggtt

SEQ ID NO: 399642 - DNA, 20 bp, Artificial
  CRISPR gRNA sequence
cttttgttgcccataggttt

SEQ ID NO: 399643 - DNA, 20 bp, Artificial
  CRISPR gRNA sequence
ttttgttgcccataggtttg

SEQ ID NO: 399644 - DNA, 20 bp, Artificial
  CRISPR gRNA sequence
ttgttgcccataggtttgct

SEQ ID NO: 399645 - DNA, 20 bp, Artificial
  CRISPR gRNA sequence
tgttgcccataggtttgctg

SEQ ID NO: 399646 - DNA, 20 bp, Artificial
  CRISPR gRNA sequence
gttgcccataggtttgctgt

SEQ ID NO: 399647 - DNA, 20 bp, Artificial
  CRISPR gRNA sequence
ttgcccataggtttgctgtc

SEQ ID NO: 399648 - DNA, 20 bp, Artificial
  CRISPR gRNA sequence
cccataggtttgctgtcatg

SEQ ID NO: 399649 - DNA, 20 bp, Artificial
  CRISPR gRNA sequence
gctgtcatgtctaagaatcc

SEQ ID NO: 399650 - DNA, 20 bp, Artificial
  CRISPR gRNA sequence
ctgtcatgtctaagaatccg

SEQ ID NO: 399651 - DNA, 20 bp, Artificial
  CRISPR gRNA sequence
tcatgtctaagaatccgttg

SEQ ID NO: 399652 - DNA, 20 bp, Artificial
  CRISPR gRNA sequence
agaatccgttgacaacttcc

SEQ ID NO: 399653 - DNA, 20 bp, Artificial
  CRISPR gRNA sequence
acaacttccaggtcttaaaa

SEQ ID NO: 399654 - DNA, 20 bp, Artificial
  CRISPR gRNA sequence
ccaggtcttaaaaatttacc

SEQ ID NO: 399655 - DNA, 20 bp, Artificial
  CRISPR gRNA sequence
caggtcttaaaaatttaccc

SEQ ID NO: 399656 - DNA, 20 bp, Artificial
  CRISPR gRNA sequence
aaaaatttacccctgtgctt

SEQ ID NO: 399657 - DNA, 20 bp, Artificial
  CRISPR gRNA sequence
aaaatttacccctgtgctta

SEQ ID NO: 399658 - DNA, 20 bp, Artificial
  CRISPR gRNA sequence
acccctgtgcttattctaag

SEQ ID NO: 399659 - DNA, 20 bp, Artificial
  CRISPR gRNA sequence
cccctgtgcttattctaaga

SEQ ID NO: 399660 - DNA, 20 bp, Artificial
  CRISPR gRNA sequence
tgcttattctaagatttcta

SEQ ID NO: 399661 - DNA, 20 bp, Artificial
  CRISPR gRNA sequence
attctaagatttctacagtc

SEQ ID NO: 399662 - DNA, 20 bp, Artificial
  CRISPR gRNA sequence
ttctaagatttctacagtct

SEQ ID NO: 399663 - DNA, 20 bp, Artificial
  CRISPR gRNA sequence
taagatttctacagtctgag

SEQ ID NO: 399664 - DNA, 20 bp, Artificial
  CRISPR gRNA sequence
agatttctacagtctgaggt

SEQ ID NO: 399665 - DNA, 20 bp, Artificial
  CRISPR gRNA sequence
ctacagtctgaggtcttata

SEQ ID NO: 399666 - DNA, 20 bp, Artificial
  CRISPR gRNA sequence
tacagtctgaggtcttatat

SEQ ID NO: 399667 - DNA, 20 bp, Artificial
  CRISPR gRNA sequence
cagtctgaggtcttatattt

SEQ ID NO: 399668 - DNA, 20 bp, Artificial
  CRISPR gRNA sequence
aggtcttatatttaggtcaa

SEQ ID NO: 399669 - DNA, 20 bp, Artificial
  CRISPR gRNA sequence
atatttaggtcaacccattt

SEQ ID NO: 399670 - DNA, 20 bp, Artificial
  CRISPR gRNA sequence
tatttaggtcaacccatttt

SEQ ID NO: 399671 - DNA, 20 bp, Artificial
  CRISPR gRNA sequence
aggtcaacccattttgagtt

SEQ ID NO: 399672 - DNA, 20 bp, Artificial
  CRISPR gRNA sequence
ggtcaacccattttgagtta

SEQ ID NO: 399673 - DNA, 20 bp, Artificial
  CRISPR gRNA sequence
tgagttaatttttgtgtttc

SEQ ID NO: 399674 - DNA, 20 bp, Artificial
  CRISPR gRNA sequence
gagttaatttttgtgtttca

SEQ ID NO: 399675 - DNA, 20 bp, Artificial
  CRISPR gRNA sequence
agttaatttttgtgtttcac

SEQ ID NO: 399676 - DNA, 20 bp, Artificial
  CRISPR gRNA sequence
atttttgtgtttcacggagg

SEQ ID NO: 399677 - DNA, 20 bp, Artificial
  CRISPR gRNA sequence
ttgtgtttcacggaggtagg

SEQ ID NO: 399678 - DNA, 20 bp, Artificial
  CRISPR gRNA sequence
tgtgtttcacggaggtaggg

SEQ ID NO: 399679 - DNA, 20 bp, Artificial
  CRISPR gRNA sequence
gtgtttcacggaggtaggga

SEQ ID NO: 399680 - DNA, 20 bp, Artificial
  CRISPR gRNA sequence
tgtttcacggaggtagggat

SEQ ID NO: 399681 - DNA, 20 bp, Artificial
  CRISPR gRNA sequence
cacggaggtagggatccaat

SEQ ID NO: 399682 - DNA, 20 bp, Artificial
  CRISPR gRNA sequence
acggaggtagggatccaatt

SEQ ID NO: 399683 - DNA, 20 bp, Artificial
  CRISPR gRNA sequence
catgcttttgcatgtggcta

SEQ ID NO: 399684 - DNA, 20 bp, Artificial
  CRISPR gRNA sequence
atgcttttgcatgtggctat

SEQ ID NO: 399685 - DNA, 20 bp, Artificial
  CRISPR gRNA sequence
ttgcatgtggctatccagtt

SEQ ID NO: 399686 - DNA, 20 bp, Artificial
  CRISPR gRNA sequence
tgcatgtggctatccagttg

SEQ ID NO: 399687 - DNA, 20 bp, Artificial
  CRISPR gRNA sequence
gcatgtggctatccagttgt

SEQ ID NO: 399688 - DNA, 20 bp, Artificial
  CRISPR gRNA sequence
catgtggctatccagttgtc

SEQ ID NO: 399689 - DNA, 20 bp, Artificial
  CRISPR gRNA sequence
tccagttgtcccaggaccat

SEQ ID NO: 399690 - DNA, 20 bp, Artificial
  CRISPR gRNA sequence
tcccaggaccatttattgaa

SEQ ID NO: 399691 - DNA, 20 bp, Artificial
  CRISPR gRNA sequence
attgaagaagctattctttc

SEQ ID NO: 399692 - DNA, 20 bp, Artificial
  CRISPR gRNA sequence
ttgaagaagctattctttcc

SEQ ID NO: 399693 - DNA, 20 bp, Artificial
  CRISPR gRNA sequence
aagaagctattctttcccca

SEQ ID NO: 399694 - DNA, 20 bp, Artificial
  CRISPR gRNA sequence
ttctttccccactcagtggg

SEQ ID NO: 399695 - DNA, 20 bp, Artificial
  CRISPR gRNA sequence
tttccccactcagtggggtt

SEQ ID NO: 399696 - DNA, 20 bp, Artificial
  CRISPR gRNA sequence
tccccactcagtggggttgg

SEQ ID NO: 399697 - DNA, 20 bp, Artificial
  CRISPR gRNA sequence
ccccactcagtggggttggc

SEQ ID NO: 399698 - DNA, 20 bp, Artificial
  CRISPR gRNA sequence
cccactcagtggggttggca

SEQ ID NO: 399699 - DNA, 20 bp, Artificial
  CRISPR gRNA sequence
agtggggttggcaccttgtt

SEQ ID NO: 399700 - DNA, 20 bp, Artificial
  CRISPR gRNA sequence
gcaccttgttgaatatcaat

SEQ ID NO: 399701 - DNA, 20 bp, Artificial
  CRISPR gRNA sequence
gttgaatatcaattgttcat

SEQ ID NO: 399702 - DNA, 20 bp, Artificial
  CRISPR gRNA sequence
ttgaatatcaattgttcata

SEQ ID NO: 399703 - DNA, 20 bp, Artificial
  CRISPR gRNA sequence
aatatcaattgttcatagat

SEQ ID NO: 399704 - DNA, 20 bp, Artificial
  CRISPR gRNA sequence
ttcatagatgtatgggctta

SEQ ID NO: 399705 - DNA, 20 bp, Artificial
  CRISPR gRNA sequence
atagatgtatgggcttatta

SEQ ID NO: 399706 - DNA, 20 bp, Artificial
  CRISPR gRNA sequence
attattatttttatttgtat

SEQ ID NO: 399707 - DNA, 20 bp, Artificial
  CRISPR gRNA sequence
ttattatttttatttgtata

SEQ ID NO: 399708 - DNA, 20 bp, Artificial
  CRISPR gRNA sequence
ttatttttatttgtataaat

SEQ ID NO: 399709 - DNA, 20 bp, Artificial
  CRISPR gRNA sequence
tttttatttgtataaattca

SEQ ID NO: 399710 - DNA, 20 bp, Artificial
  CRISPR gRNA sequence
ttatttgtataaattcaagg

SEQ ID NO: 399711 - DNA, 20 bp, Artificial
  CRISPR gRNA sequence
tatttgtataaattcaaggg

SEQ ID NO: 399712 - DNA, 20 bp, Artificial
  CRISPR gRNA sequence
atttgtataaattcaagggg

SEQ ID NO: 399713 - DNA, 20 bp, Artificial
  CRISPR gRNA sequence
tttgtataaattcaaggggt

SEQ ID NO: 399714 - DNA, 20 bp, Artificial
  CRISPR gRNA sequence
gtataaattcaaggggtaca

SEQ ID NO: 399715 - DNA, 20 bp, Artificial
  CRISPR gRNA sequence
tataaattcaaggggtacaa

SEQ ID NO: 399716 - DNA, 20 bp, Artificial
  CRISPR gRNA sequence
aaggggtacaagggcagttt

SEQ ID NO: 399717 - DNA, 20 bp, Artificial
  CRISPR gRNA sequence
tgtacaagggcagttttatt

SEQ ID NO: 399718 - DNA, 20 bp, Artificial
  CRISPR gRNA sequence
gtacaagggcagttttatta

SEQ ID NO: 399719 - DNA, 20 bp, Artificial
  CRISPR gRNA sequence
tacaagggcagttttattat

SEQ ID NO: 399720 - DNA, 20 bp, Artificial
  CRISPR gRNA sequence
tattatgtagtggtgaagtc

SEQ ID NO: 399721 - DNA, 20 bp, Artificial
  CRISPR gRNA sequence
attatgtagtggtgaagtct

SEQ ID NO: 399722 - DNA, 20 bp, Artificial
  CRISPR gRNA sequence
ttatgtagtggtgaagtctg

SEQ ID NO: 399723 - DNA, 20 bp, Artificial
  CRISPR gRNA sequence
tgtagtggtgaagtctggac

SEQ ID NO: 399724 - DNA, 20 bp, Artificial
  CRISPR gRNA sequence
gacttttaatataaccatca

SEQ ID NO: 399725 - DNA, 20 bp, Artificial
  CRISPR gRNA sequence
ttaatataaccatcacctga

SEQ ID NO: 399726 - DNA, 20 bp, Artificial
  CRISPR gRNA sequence
taatataaccatcacctgaa

SEQ ID NO: 399727 - DNA, 20 bp, Artificial
  CRISPR gRNA sequence
aatataaccatcacctgaat

SEQ ID NO: 399728 - DNA, 20 bp, Artificial
  CRISPR gRNA sequence
atataaccatcacctgaata

SEQ ID NO: 399729 - DNA, 20 bp, Artificial
  CRISPR gRNA sequence
aataatatatgttgtacaca

SEQ ID NO: 399730 - DNA, 20 bp, Artificial
  CRISPR gRNA sequence
tacacattaagtaatttcta

SEQ ID NO: 399731 - DNA, 20 bp, Artificial
  CRISPR gRNA sequence
agtaatttctatccctcacc

SEQ ID NO: 399732 - DNA, 20 bp, Artificial
  CRISPR gRNA sequence
ctatccctcacccctttcta

SEQ ID NO: 399733 - DNA, 20 bp, Artificial
  CRISPR gRNA sequence
tatccctcacccctttctac

SEQ ID NO: 399734 - DNA, 20 bp, Artificial
  CRISPR gRNA sequence
tccctcacccctttctactc

SEQ ID NO: 399735 - DNA, 20 bp, Artificial
  CRISPR gRNA sequence
acccctttctactctcccat

SEQ ID NO: 399736 - DNA, 20 bp, Artificial
  CRISPR gRNA sequence
tctactctcccattcttcca

SEQ ID NO: 399737 - DNA, 20 bp, Artificial
  CRISPR gRNA sequence
ctactctcccattcttccaa

SEQ ID NO: 399738 - DNA, 20 bp, Artificial
  CRISPR gRNA sequence
tactctcccattcttccaag

SEQ ID NO: 399739 - DNA, 20 bp, Artificial
  CRISPR gRNA sequence
ctctcccattcttccaagtc

SEQ ID NO: 399740 - DNA, 20 bp, Artificial
  CRISPR gRNA sequence
tcccattcttccaagtctcc

SEQ ID NO: 399741 - DNA, 20 bp, Artificial
  CRISPR gRNA sequence
ccattcttccaagtctccag

SEQ ID NO: 399742 - DNA, 20 bp, Artificial
  CRISPR gRNA sequence
ttccaagtctccagtgtcca

SEQ ID NO: 399743 - DNA, 20 bp, Artificial
  CRISPR gRNA sequence
ccaagtctccagtgtccatt

SEQ ID NO: 399744 - DNA, 20 bp, Artificial
  CRISPR gRNA sequence
caagtctccagtgtccatta

SEQ ID NO: 399745 - DNA, 20 bp, Artificial
  CRISPR gRNA sequence
cagtgtccattattgcatac

SEQ ID NO: 399746 - DNA, 20 bp, Artificial
  CRISPR gRNA sequence
ttgcatactgtatgtccatg

SEQ ID NO: 399747 - DNA, 20 bp, Artificial
  CRISPR gRNA sequence
catactgtatgtccatgggt

SEQ ID NO: 399748 - DNA, 20 bp, Artificial
  CRISPR gRNA sequence
tatgtccatgggtacacatt

SEQ ID NO: 399749 - DNA, 20 bp, Artificial
  CRISPR gRNA sequence
ttttgctcccatttataagt

SEQ ID NO: 399750 - DNA, 20 bp, Artificial
  CRISPR gRNA sequence
tgctcccatttataagtgag

SEQ ID NO: 399751 - DNA, 20 bp, Artificial
  CRISPR gRNA sequence
gctcccatttataagtgaga

SEQ ID NO: 399752 - DNA, 20 bp, Artificial
  CRISPR gRNA sequence
ctcccatttataagtgagaa

SEQ ID NO: 399753 - DNA, 20 bp, Artificial
  CRISPR gRNA sequence
ccatttataagtgagaacat

SEQ ID NO: 399754 - DNA, 20 bp, Artificial
  CRISPR gRNA sequence
ataagtgagaacatgtggtt

SEQ ID NO: 399755 - DNA, 20 bp, Artificial
  CRISPR gRNA sequence
taagtgagaacatgtggttt

SEQ ID NO: 399756 - DNA, 20 bp, Artificial
  CRISPR gRNA sequence
ttgagtttctgtgtctgagt

SEQ ID NO: 399757 - DNA, 20 bp, Artificial
  CRISPR gRNA sequence
tgagtttctgtgtctgagtt

SEQ ID NO: 399758 - DNA, 20 bp, Artificial
  CRISPR gRNA sequence
gagtttctgtgtctgagttg

SEQ ID NO: 399759 - DNA, 20 bp, Artificial
  CRISPR gRNA sequence
agtttctgtgtctgagttgt

SEQ ID NO: 399760 - DNA, 20 bp, Artificial
  CRISPR gRNA sequence
ctgtgtctgagttgtttcat

SEQ ID NO: 399761 - DNA, 20 bp, Artificial
  CRISPR gRNA sequence
tgtgtctgagttgtttcatt

SEQ ID NO: 399762 - DNA, 20 bp, Artificial
  CRISPR gRNA sequence
tgtctgagttgtttcattta

SEQ ID NO: 399763 - DNA, 20 bp, Artificial
  CRISPR gRNA sequence
agttgtttcatttaatataa

SEQ ID NO: 399764 - DNA, 20 bp, Artificial
  CRISPR gRNA sequence
tttcatttaatataatggct

SEQ ID NO: 399765 - DNA, 20 bp, Artificial
  CRISPR gRNA sequence
catttaatataatggcttcc

SEQ ID NO: 399766 - DNA, 20 bp, Artificial
  CRISPR gRNA sequence
atttaatataatggcttccc

SEQ ID NO: 399767 - DNA, 20 bp, Artificial
  CRISPR gRNA sequence
aatataatggcttcccggtc

SEQ ID NO: 399768 - DNA, 20 bp, Artificial
  CRISPR gRNA sequence
atataatggcttcccggtct

SEQ ID NO: 399769 - DNA, 20 bp, Artificial
  CRISPR gRNA sequence
cccggtctatctatgttgct

SEQ ID NO: 399770 - DNA, 20 bp, Artificial
  CRISPR gRNA sequence
ccggtctatctatgttgctg

SEQ ID NO: 399771 - DNA, 20 bp, Artificial
  CRISPR gRNA sequence
tctatgttgctgcaaaagac

SEQ ID NO: 399772 - DNA, 20 bp, Artificial
  CRISPR gRNA sequence
tgttgctgcaaaagacatga

SEQ ID NO: 399773 - DNA, 20 bp, Artificial
  CRISPR gRNA sequence
ctgcaaaagacatgatttca

SEQ ID NO: 399774 - DNA, 20 bp, Artificial
  CRISPR gRNA sequence
caaaagacatgatttcattc

SEQ ID NO: 399775 - DNA, 20 bp, Artificial
  CRISPR gRNA sequence
cattctttttagggctgtgt

SEQ ID NO: 399776 - DNA, 20 bp, Artificial
  CRISPR gRNA sequence
attctttttagggctgtgta

SEQ ID NO: 399777 - DNA, 20 bp, Artificial
  CRISPR gRNA sequence
tttttagggctgtgtagtat

SEQ ID NO: 399778 - DNA, 20 bp, Artificial
  CRISPR gRNA sequence
tttagggctgtgtagtattc

SEQ ID NO: 399779 - DNA, 20 bp, Artificial
  CRISPR gRNA sequence
ttagggctgtgtagtattcc

SEQ ID NO: 399780 - DNA, 20 bp, Artificial
  CRISPR gRNA sequence
tagggctgtgtagtattcca

SEQ ID NO: 399781 - DNA, 20 bp, Artificial
  CRISPR gRNA sequence
agggctgtgtagtattccat

SEQ ID NO: 399782 - DNA, 20 bp, Artificial
  CRISPR gRNA sequence
gggctgtgtagtattccatt

SEQ ID NO: 399783 - DNA, 20 bp, Artificial
  CRISPR gRNA sequence
tgtagtattccattgtggat

SEQ ID NO: 399784 - DNA, 20 bp, Artificial
  CRISPR gRNA sequence
cattgtggatatataccaca

SEQ ID NO: 399785 - DNA, 20 bp, Artificial
  CRISPR gRNA sequence
tggatatataccacagtttc

SEQ ID NO: 399786 - DNA, 20 bp, Artificial
  CRISPR gRNA sequence
ctttatctaacccttcattg

SEQ ID NO: 399787 - DNA, 20 bp, Artificial
  CRISPR gRNA sequence
tttatctaacccttcattga

SEQ ID NO: 399788 - DNA, 20 bp, Artificial
  CRISPR gRNA sequence
tatctaacccttcattgatg

SEQ ID NO: 399789 - DNA, 20 bp, Artificial
  CRISPR gRNA sequence
atctaacccttcattgatgg

SEQ ID NO: 399790 - DNA, 20 bp, Artificial
  CRISPR gRNA sequence
tctaacccttcattgatggg

SEQ ID NO: 399791 - DNA, 20 bp, Artificial
  CRISPR gRNA sequence
acccttcattgatgggcact

SEQ ID NO: 399792 - DNA, 20 bp, Artificial
  CRISPR gRNA sequence
cattgatgggcacttaggtt

SEQ ID NO: 399793 - DNA, 20 bp, Artificial
  CRISPR gRNA sequence
attgatgggcacttaggttg

SEQ ID NO: 399794 - DNA, 20 bp, Artificial
  CRISPR gRNA sequence
atgggcacttaggttgattc

SEQ ID NO: 399795 - DNA, 20 bp, Artificial
  CRISPR gRNA sequence
aggttgattccatatcttgg

SEQ ID NO: 399796 - DNA, 20 bp, Artificial
  CRISPR gRNA sequence
ggttgattccatatcttggt

SEQ ID NO: 399797 - DNA, 20 bp, Artificial
  CRISPR gRNA sequence
attccatatcttggttattg

SEQ ID NO: 399798 - DNA, 20 bp, Artificial
  CRISPR gRNA sequence
catatcttggttattgtgaa

SEQ ID NO: 399799 - DNA, 20 bp, Artificial
  CRISPR gRNA sequence
ggttattgtgaatagtgctg

SEQ ID NO: 399800 - DNA, 20 bp, Artificial
  CRISPR gRNA sequence
gttattgtgaatagtgctgc

SEQ ID NO: 399801 - DNA, 20 bp, Artificial
  CRISPR gRNA sequence
ttgtgaatagtgctgcaata

SEQ ID NO: 399802 - DNA, 20 bp, Artificial
  CRISPR gRNA sequence
tgaatagtgctgcaataaac

SEQ ID NO: 399803 - DNA, 20 bp, Artificial
  CRISPR gRNA sequence
caataaacatataagggcag

SEQ ID NO: 399804 - DNA, 20 bp, Artificial
  CRISPR gRNA sequence
ttaatataatgatttctttt

SEQ ID NO: 399805 - DNA, 20 bp, Artificial
  CRISPR gRNA sequence
taatataatgatttcttttc

SEQ ID NO: 399806 - DNA, 20 bp, Artificial
  CRISPR gRNA sequence
aatataatgatttcttttcc

SEQ ID NO: 399807 - DNA, 20 bp, Artificial
  CRISPR gRNA sequence
atataatgatttcttttcct

SEQ ID NO: 399808 - DNA, 20 bp, Artificial
  CRISPR gRNA sequence
cttttcctttgggtagatac

SEQ ID NO: 399809 - DNA, 20 bp, Artificial
  CRISPR gRNA sequence
ttttcctttgggtagatacc

SEQ ID NO: 399810 - DNA, 20 bp, Artificial
  CRISPR gRNA sequence
ttcctttgggtagataccct

SEQ ID NO: 399811 - DNA, 20 bp, Artificial
  CRISPR gRNA sequence
tcctttgggtagataccctg

SEQ ID NO: 399812 - DNA, 20 bp, Artificial
  CRISPR gRNA sequence
cctttgggtagataccctgt

SEQ ID NO: 399813 - DNA, 20 bp, Artificial
  CRISPR gRNA sequence
ctttgggtagataccctgta

SEQ ID NO: 399814 - DNA, 20 bp, Artificial
  CRISPR gRNA sequence
tgggtagataccctgtagtg

SEQ ID NO: 399815 - DNA, 20 bp, Artificial
  CRISPR gRNA sequence
gggtagataccctgtagtga

SEQ ID NO: 399816 - DNA, 20 bp, Artificial
  CRISPR gRNA sequence
ggtagataccctgtagtgag

SEQ ID NO: 399817 - DNA, 20 bp, Artificial
  CRISPR gRNA sequence
tagtgagactgccggatcta

SEQ ID NO: 399818 - DNA, 20 bp, Artificial
  CRISPR gRNA sequence
ccggatctaatggtaattct

SEQ ID NO: 399819 - DNA, 20 bp, Artificial
  CRISPR gRNA sequence
atggtaattctatttttagt

SEQ ID NO: 399820 - DNA, 20 bp, Artificial
  CRISPR gRNA sequence
tatttttagttctttgagga

SEQ ID NO: 399821 - DNA, 20 bp, Artificial
  CRISPR gRNA sequence
tttttagttctttgaggaac

SEQ ID NO: 399822 - DNA, 20 bp, Artificial
  CRISPR gRNA sequence
ttagttctttgaggaactgc

SEQ ID NO: 399823 - DNA, 20 bp, Artificial
  CRISPR gRNA sequence
tagttctttgaggaactgcc

SEQ ID NO: 399824 - DNA, 20 bp, Artificial
  CRISPR gRNA sequence
agttctttgaggaactgcca

SEQ ID NO: 399825 - DNA, 20 bp, Artificial
  CRISPR gRNA sequence
gttctttgaggaactgccat

SEQ ID NO: 399826 - DNA, 20 bp, Artificial
  CRISPR gRNA sequence
tttgaggaactgccatacta

SEQ ID NO: 399827 - DNA, 20 bp, Artificial
  CRISPR gRNA sequence
tgaggaactgccatactatt

SEQ ID NO: 399828 - DNA, 20 bp, Artificial
  CRISPR gRNA sequence
gaggaactgccatactattt

SEQ ID NO: 399829 - DNA, 20 bp, Artificial
  CRISPR gRNA sequence
aggaactgccatactatttt

SEQ ID NO: 399830 - DNA, 20 bp, Artificial
  CRISPR gRNA sequence
ccatactattttccatagac

SEQ ID NO: 399831 - DNA, 20 bp, Artificial
  CRISPR gRNA sequence
ttttccatagacgttgtact

SEQ ID NO: 399832 - DNA, 20 bp, Artificial
  CRISPR gRNA sequence
tccatagacgttgtactaat

SEQ ID NO: 399833 - DNA, 20 bp, Artificial
  CRISPR gRNA sequence
ccatagacgttgtactaatt

SEQ ID NO: 399834 - DNA, 20 bp, Artificial
  CRISPR gRNA sequence
catagacgttgtactaattt

SEQ ID NO: 399835 - DNA, 20 bp, Artificial
  CRISPR gRNA sequence
tactaatttacattcccatg

SEQ ID NO: 399836 - DNA, 20 bp, Artificial
  CRISPR gRNA sequence
atttacattcccatgaacag

SEQ ID NO: 399837 - DNA, 20 bp, Artificial
  CRISPR gRNA sequence
acattcccatgaacagtgta

SEQ ID NO: 399838 - DNA, 20 bp, Artificial
  CRISPR gRNA sequence
cattcccatgaacagtgtat

SEQ ID NO: 399839 - DNA, 20 bp, Artificial
  CRISPR gRNA sequence
ccatgaacagtgtataaatg

SEQ ID NO: 399840 - DNA, 20 bp, Artificial
  CRISPR gRNA sequence
tctttcctccacatcctacc

SEQ ID NO: 399841 - DNA, 20 bp, Artificial
  CRISPR gRNA sequence
tttcctccacatcctaccta

SEQ ID NO: 399842 - DNA, 20 bp, Artificial
  CRISPR gRNA sequence
tcctccacatcctacctaac

SEQ ID NO: 399843 - DNA, 20 bp, Artificial
  CRISPR gRNA sequence
cctccacatcctacctaaca

SEQ ID NO: 399844 - DNA, 20 bp, Artificial
  CRISPR gRNA sequence
ctccacatcctacctaacat

SEQ ID NO: 399845 - DNA, 20 bp, Artificial
  CRISPR gRNA sequence
cacatcctacctaacatctg

SEQ ID NO: 399846 - DNA, 20 bp, Artificial
  CRISPR gRNA sequence
cctaacatctgttttgatca

SEQ ID NO: 399847 - DNA, 20 bp, Artificial
  CRISPR gRNA sequence
acatctgttttgatcatcat

SEQ ID NO: 399848 - DNA, 20 bp, Artificial
  CRISPR gRNA sequence
ttttgatcatcatttcaatt

SEQ ID NO: 399849 - DNA, 20 bp, Artificial
  CRISPR gRNA sequence
tgatcatcatttcaatttcc

SEQ ID NO: 399850 - DNA, 20 bp, Artificial
  CRISPR gRNA sequence
gatcatcatttcaatttcct

SEQ ID NO: 399851 - DNA, 20 bp, Artificial
  CRISPR gRNA sequence
atcatcatttcaatttcctt

SEQ ID NO: 399852 - DNA, 20 bp, Artificial
  CRISPR gRNA sequence
caatttccttggtctatttg

SEQ ID NO: 399853 - DNA, 20 bp, Artificial
  CRISPR gRNA sequence
aatttccttggtctatttgt

SEQ ID NO: 399854 - DNA, 20 bp, Artificial
  CRISPR gRNA sequence
ccttggtctatttgtctatg

SEQ ID NO: 399855 - DNA, 20 bp, Artificial
  CRISPR gRNA sequence
cttggtctatttgtctatgt

SEQ ID NO: 399856 - DNA, 20 bp, Artificial
  CRISPR gRNA sequence
ggtctatttgtctatgtata

SEQ ID NO: 399857 - DNA, 20 bp, Artificial
  CRISPR gRNA sequence
gtctatttgtctatgtatat

SEQ ID NO: 399858 - DNA, 20 bp, Artificial
  CRISPR gRNA sequence
tttgtctatgtatatgccaa

SEQ ID NO: 399859 - DNA, 20 bp, Artificial
  CRISPR gRNA sequence
gtctatgtatatgccaatac

SEQ ID NO: 399860 - DNA, 20 bp, Artificial
  CRISPR gRNA sequence
tctatgtatatgccaatacc

SEQ ID NO: 399861 - DNA, 20 bp, Artificial
  CRISPR gRNA sequence
tgtatatgccaatacccaca

SEQ ID NO: 399862 - DNA, 20 bp, Artificial
  CRISPR gRNA sequence
ttttgattactgtagctgtg

SEQ ID NO: 399863 - DNA, 20 bp, Artificial
  CRISPR gRNA sequence
tgattactgtagctgtgtac

SEQ ID NO: 399864 - DNA, 20 bp, Artificial
  CRISPR gRNA sequence
gattactgtagctgtgtact

SEQ ID NO: 399865 - DNA, 20 bp, Artificial
  CRISPR gRNA sequence
attactgtagctgtgtacta

SEQ ID NO: 399866 - DNA, 20 bp, Artificial
  CRISPR gRNA sequence
ctgtagctgtgtactacagt

SEQ ID NO: 399867 - DNA, 20 bp, Artificial
  CRISPR gRNA sequence
tagctgtgtactacagtttt

SEQ ID NO: 399868 - DNA, 20 bp, Artificial
  CRISPR gRNA sequence
tgtactacagttttgaaatg

SEQ ID NO: 399869 - DNA, 20 bp, Artificial
  CRISPR gRNA sequence
cagttttgaaatgggaaatg

SEQ ID NO: 399870 - DNA, 20 bp, Artificial
  CRISPR gRNA sequence
tgaaatgggaaatgttagtc

SEQ ID NO: 399871 - DNA, 20 bp, Artificial
  CRISPR gRNA sequence
gaaatgggaaatgttagtct

SEQ ID NO: 399872 - DNA, 20 bp, Artificial
  CRISPR gRNA sequence
aaatgggaaatgttagtctt

SEQ ID NO: 399873 - DNA, 20 bp, Artificial
  CRISPR gRNA sequence
gtctttcagctttttcttct

SEQ ID NO: 399874 - DNA, 20 bp, Artificial
  CRISPR gRNA sequence
tcagctttttcttctttttt

SEQ ID NO: 399875 - DNA, 20 bp, Artificial
  CRISPR gRNA sequence
cagctttttcttctttttta

SEQ ID NO: 399876 - DNA, 20 bp, Artificial
  CRISPR gRNA sequence
agctttttcttcttttttaa

SEQ ID NO: 399877 - DNA, 20 bp, Artificial
  CRISPR gRNA sequence
tttcttcttttttaatacca

SEQ ID NO: 399878 - DNA, 20 bp, Artificial
  CRISPR gRNA sequence
ttcttcttttttaataccat

SEQ ID NO: 399879 - DNA, 20 bp, Artificial
  CRISPR gRNA sequence
tcttcttttttaataccatt

SEQ ID NO: 399880 - DNA, 20 bp, Artificial
  CRISPR gRNA sequence
cttcttttttaataccattt

SEQ ID NO: 399881 - DNA, 20 bp, Artificial
  CRISPR gRNA sequence
ttcttttttaataccatttt

SEQ ID NO: 399882 - DNA, 20 bp, Artificial
  CRISPR gRNA sequence
cttttttaataccattttgg

SEQ ID NO: 399883 - DNA, 20 bp, Artificial
  CRISPR gRNA sequence
ttttttaataccattttggc

SEQ ID NO: 399884 - DNA, 20 bp, Artificial
  CRISPR gRNA sequence
ttttaataccattttggcta

SEQ ID NO: 399885 - DNA, 20 bp, Artificial
  CRISPR gRNA sequence
tttaataccattttggctat

SEQ ID NO: 399886 - DNA, 20 bp, Artificial
  CRISPR gRNA sequence
ttaataccattttggctatt

SEQ ID NO: 399887 - DNA, 20 bp, Artificial
  CRISPR gRNA sequence
taataccattttggctattc

SEQ ID NO: 399888 - DNA, 20 bp, Artificial
  CRISPR gRNA sequence
aataccattttggctattca

SEQ ID NO: 399889 - DNA, 20 bp, Artificial
  CRISPR gRNA sequence
ataccattttggctattcag

SEQ ID NO: 399890 - DNA, 20 bp, Artificial
  CRISPR gRNA sequence
tggctattcaggaccccttg

SEQ ID NO: 399891 - DNA, 20 bp, Artificial
  CRISPR gRNA sequence
ggctattcaggaccccttgc

SEQ ID NO: 399892 - DNA, 20 bp, Artificial
  CRISPR gRNA sequence
gctattcaggaccccttgca

SEQ ID NO: 399893 - DNA, 20 bp, Artificial
  CRISPR gRNA sequence
ttcaggaccccttgcaattc

SEQ ID NO: 399894 - DNA, 20 bp, Artificial
  CRISPR gRNA sequence
aggaccccttgcaattctat

SEQ ID NO: 399895 - DNA, 20 bp, Artificial
  CRISPR gRNA sequence
gcaattctatgtaatatgtt

SEQ ID NO: 399896 - DNA, 20 bp, Artificial
  CRISPR gRNA sequence
caattctatgtaatatgttc

SEQ ID NO: 399897 - DNA, 20 bp, Artificial
  CRISPR gRNA sequence
tatgtaatatgttcagactt

SEQ ID NO: 399898 - DNA, 20 bp, Artificial
  CRISPR gRNA sequence
tgtaatatgttcagacttca

SEQ ID NO: 399899 - DNA, 20 bp, Artificial
  CRISPR gRNA sequence
agacttcagagttggtggat

SEQ ID NO: 399900 - DNA, 20 bp, Artificial
  CRISPR gRNA sequence
cagagttggtggattcagta

SEQ ID NO: 399901 - DNA, 20 bp, Artificial
  CRISPR gRNA sequence
agagttggtggattcagtag

SEQ ID NO: 399902 - DNA, 20 bp, Artificial
  CRISPR gRNA sequence
gtggattcagtagctcagta

SEQ ID NO: 399903 - DNA, 20 bp, Artificial
  CRISPR gRNA sequence
agtagctcagtaatgccatc

SEQ ID NO: 399904 - DNA, 20 bp, Artificial
  CRISPR gRNA sequence
agtaatgccatctgagcccc

SEQ ID NO: 399905 - DNA, 20 bp, Artificial
  CRISPR gRNA sequence
agccccacattcattctgtc

SEQ ID NO: 399906 - DNA, 20 bp, Artificial
  CRISPR gRNA sequence
attctgtctctctctaccac

SEQ ID NO: 399907 - DNA, 20 bp, Artificial
  CRISPR gRNA sequence
tgtctctctctaccaccctg

SEQ ID NO: 399908 - DNA, 20 bp, Artificial
  CRISPR gRNA sequence
tctctctctaccaccctgtt

SEQ ID NO: 399909 - DNA, 20 bp, Artificial
  CRISPR gRNA sequence
tctctaccaccctgtttgtc

SEQ ID NO: 399910 - DNA, 20 bp, Artificial
  CRISPR gRNA sequence
tctaccaccctgtttgtcct

SEQ ID NO: 399911 - DNA, 20 bp, Artificial
  CRISPR gRNA sequence
taccaccctgtttgtcctca

SEQ ID NO: 399912 - DNA, 20 bp, Artificial
  CRISPR gRNA sequence
ccaccctgtttgtcctcagg

SEQ ID NO: 399913 - DNA, 20 bp, Artificial
  CRISPR gRNA sequence
tttgtcctcaggctgatttc

SEQ ID NO: 399914 - DNA, 20 bp, Artificial
  CRISPR gRNA sequence
gtcctcaggctgatttcctt

SEQ ID NO: 399915 - DNA, 20 bp, Artificial
  CRISPR gRNA sequence
tcctcaggctgatttccttc

SEQ ID NO: 399916 - DNA, 20 bp, Artificial
  CRISPR gRNA sequence
aggctgatttccttcaatat

SEQ ID NO: 399917 - DNA, 20 bp, Artificial
  CRISPR gRNA sequence
atttccttcaatatggctgc

SEQ ID NO: 399918 - DNA, 20 bp, Artificial
  CRISPR gRNA sequence
ccttcaatatggctgcctgt

SEQ ID NO: 399919 - DNA, 20 bp, Artificial
  CRISPR gRNA sequence
cttcaatatggctgcctgtg

SEQ ID NO: 399920 - DNA, 20 bp, Artificial
  CRISPR gRNA sequence
caatatggctgcctgtggta

SEQ ID NO: 399921 - DNA, 20 bp, Artificial
  CRISPR gRNA sequence
aatatggctgcctgtggtaa

SEQ ID NO: 399922 - DNA, 20 bp, Artificial
  CRISPR gRNA sequence
cctgtggtaaccaggacagc

SEQ ID NO: 399923 - DNA, 20 bp, Artificial
  CRISPR gRNA sequence
tggtaaccaggacagcattc

SEQ ID NO: 399924 - DNA, 20 bp, Artificial
  CRISPR gRNA sequence
ttgttcatgcataatgagag

SEQ ID NO: 399925 - DNA, 20 bp, Artificial
  CRISPR gRNA sequence
gttcatgcataatgagagga

SEQ ID NO: 399926 - DNA, 20 bp, Artificial
  CRISPR gRNA sequence
ttcatgcataatgagaggag

SEQ ID NO: 399927 - DNA, 20 bp, Artificial
  CRISPR gRNA sequence
atgcataatgagaggagata

SEQ ID NO: 399928 - DNA, 20 bp, Artificial
  CRISPR gRNA sequence
ttcacattccatgctgtttt

SEQ ID NO: 399929 - DNA, 20 bp, Artificial
  CRISPR gRNA sequence
acattccatgctgtttttct

SEQ ID NO: 399930 - DNA, 20 bp, Artificial
  CRISPR gRNA sequence
catgctgtttttctggcatg

SEQ ID NO: 399931 - DNA, 20 bp, Artificial
  CRISPR gRNA sequence
tttttctggcatggaatgtg

SEQ ID NO: 399932 - DNA, 20 bp, Artificial
  CRISPR gRNA sequence
ttctggcatggaatgtgaat

SEQ ID NO: 399933 - DNA, 20 bp, Artificial
  CRISPR gRNA sequence
tctggcatggaatgtgaata

SEQ ID NO: 399934 - DNA, 20 bp, Artificial
  CRISPR gRNA sequence
ctggcatggaatgtgaataa

SEQ ID NO: 399935 - DNA, 20 bp, Artificial
  CRISPR gRNA sequence
tggcatggaatgtgaataac

SEQ ID NO: 399936 - DNA, 20 bp, Artificial
  CRISPR gRNA sequence
gcatggaatgtgaataactt

SEQ ID NO: 399937 - DNA, 20 bp, Artificial
  CRISPR gRNA sequence
ccttcactctgatgggccaa

SEQ ID NO: 399938 - DNA, 20 bp, Artificial
  CRISPR gRNA sequence
cttcactctgatgggccaac

SEQ ID NO: 399939 - DNA, 20 bp, Artificial
  CRISPR gRNA sequence
cactctgatgggccaactca

SEQ ID NO: 399940 - DNA, 20 bp, Artificial
  CRISPR gRNA sequence
actctgatgggccaactcag

SEQ ID NO: 399941 - DNA, 20 bp, Artificial
  CRISPR gRNA sequence
tgatgggccaactcaggcca

SEQ ID NO: 399942 - DNA, 20 bp, Artificial
  CRISPR gRNA sequence
atgggccaactcaggccata

SEQ ID NO: 399943 - DNA, 20 bp, Artificial
  CRISPR gRNA sequence
aggccatagttggcttctct

SEQ ID NO: 399944 - DNA, 20 bp, Artificial
  CRISPR gRNA sequence
gcttctctgacccctcaaat

SEQ ID NO: 399945 - DNA, 20 bp, Artificial
  CRISPR gRNA sequence
ctctgacccctcaaatcaat

SEQ ID NO: 399946 - DNA, 20 bp, Artificial
  CRISPR gRNA sequence
tctgacccctcaaatcaatc

SEQ ID NO: 399947 - DNA, 20 bp, Artificial
  CRISPR gRNA sequence
tgacccctcaaatcaatcat

SEQ ID NO: 399948 - DNA, 20 bp, Artificial
  CRISPR gRNA sequence
acccctcaaatcaatcatag

SEQ ID NO: 399949 - DNA, 20 bp, Artificial
  CRISPR gRNA sequence
aaatcaatcatagttttcag

SEQ ID NO: 399950 - DNA, 20 bp, Artificial
  CRISPR gRNA sequence
tcaggctgggcatggtggat

SEQ ID NO: 399951 - DNA, 20 bp, Artificial
  CRISPR gRNA sequence
caggctgggcatggtggatc

SEQ ID NO: 399952 - DNA, 20 bp, Artificial
  CRISPR gRNA sequence
aggctgggcatggtggatca

SEQ ID NO: 399953 - DNA, 20 bp, Artificial
  CRISPR gRNA sequence
ggcatggtggatcatgcccg

SEQ ID NO: 399954 - DNA, 20 bp, Artificial
  CRISPR gRNA sequence
ccaacactttaggaggccaa

SEQ ID NO: 399955 - DNA, 20 bp, Artificial
  CRISPR gRNA sequence
taggaggccaacatgtacaa

SEQ ID NO: 399956 - DNA, 20 bp, Artificial
  CRISPR gRNA sequence
aggaggccaacatgtacaag

SEQ ID NO: 399957 - DNA, 20 bp, Artificial
  CRISPR gRNA sequence
ggaggccaacatgtacaagt

SEQ ID NO: 399958 - DNA, 20 bp, Artificial
  CRISPR gRNA sequence
catgagtccagaagctccaa

SEQ ID NO: 399959 - DNA, 20 bp, Artificial
  CRISPR gRNA sequence
caagcaagccttggcaatgt

SEQ ID NO: 399960 - DNA, 20 bp, Artificial
  CRISPR gRNA sequence
ggcaatgtagcaagaccctg

SEQ ID NO: 399961 - DNA, 20 bp, Artificial
  CRISPR gRNA sequence
gcaatgtagcaagaccctgt

SEQ ID NO: 399962 - DNA, 20 bp, Artificial
  CRISPR gRNA sequence
tctccaaaaaaaaaataatt

SEQ ID NO: 399963 - DNA, 20 bp, Artificial
  CRISPR gRNA sequence
caaaaaaaaaataattttaa

SEQ ID NO: 399964 - DNA, 20 bp, Artificial
  CRISPR gRNA sequence
taaaaaattagctgagtgtg

SEQ ID NO: 399965 - DNA, 20 bp, Artificial
  CRISPR gRNA sequence
aaaaaattagctgagtgtgg

SEQ ID NO: 399966 - DNA, 20 bp, Artificial
  CRISPR gRNA sequence
aaaaattagctgagtgtggt

SEQ ID NO: 399967 - DNA, 20 bp, Artificial
  CRISPR gRNA sequence
gctgagtgtggtggctcagc

SEQ ID NO: 399968 - DNA, 20 bp, Artificial
  CRISPR gRNA sequence
agtgtggtggctcagctggg

SEQ ID NO: 399969 - DNA, 20 bp, Artificial
  CRISPR gRNA sequence
agctgggtcccagctaccca

SEQ ID NO: 399970 - DNA, 20 bp, Artificial
  CRISPR gRNA sequence
ggtcccagctacccaggagg

SEQ ID NO: 399971 - DNA, 20 bp, Artificial
  CRISPR gRNA sequence
cccaggaggctgaagtggga

SEQ ID NO: 399972 - DNA, 20 bp, Artificial
  CRISPR gRNA sequence
aagtgggagggtcacttgag

SEQ ID NO: 399973 - DNA, 20 bp, Artificial
  CRISPR gRNA sequence
gagaccaggagtttgagatc

SEQ ID NO: 399974 - DNA, 20 bp, Artificial
  CRISPR gRNA sequence
agaccaggagtttgagatca

SEQ ID NO: 399975 - DNA, 20 bp, Artificial
  CRISPR gRNA sequence
gagatcagcctggacaacat

SEQ ID NO: 399976 - DNA, 20 bp, Artificial
  CRISPR gRNA sequence
agatcagcctggacaacata

SEQ ID NO: 399977 - DNA, 20 bp, Artificial
  CRISPR gRNA sequence
gacaacatagcacgtcccca

SEQ ID NO: 399978 - DNA, 20 bp, Artificial
  CRISPR gRNA sequence
tacacacacacacacacaca

SEQ ID NO: 399979 - DNA, 20 bp, Artificial
  CRISPR gRNA sequence
cacacacacacacacacaca

SEQ ID NO: 399980 - DNA, 20 bp, Artificial
  CRISPR gRNA sequence
tcagtacaatagcttctatt

SEQ ID NO: 399981 - DNA, 20 bp, Artificial
  CRISPR gRNA sequence
cagtacaatagcttctattt

SEQ ID NO: 399982 - DNA, 20 bp, Artificial
  CRISPR gRNA sequence
agtacaatagcttctatttg

SEQ ID NO: 399983 - DNA, 20 bp, Artificial
  CRISPR gRNA sequence
ctatttgtcataatatctct

SEQ ID NO: 399984 - DNA, 20 bp, Artificial
  CRISPR gRNA sequence
tatttgtcataatatctctg

SEQ ID NO: 399985 - DNA, 20 bp, Artificial
  CRISPR gRNA sequence
tttgtcataatatctctgtg

SEQ ID NO: 399986 - DNA, 20 bp, Artificial
  CRISPR gRNA sequence
gtcataatatctctgtggcg

SEQ ID NO: 399987 - DNA, 20 bp, Artificial
  CRISPR gRNA sequence
tcataatatctctgtggcgt

SEQ ID NO: 399988 - DNA, 20 bp, Artificial
  CRISPR gRNA sequence
tgtggcgtgtggaaaggggt

SEQ ID NO: 399989 - DNA, 20 bp, Artificial
  CRISPR gRNA sequence
tggcgtgtggaaaggggtgg

SEQ ID NO: 399990 - DNA, 20 bp, Artificial
  CRISPR gRNA sequence
aaactcaggtacagtactgc

SEQ ID NO: 399991 - DNA, 20 bp, Artificial
  CRISPR gRNA sequence
aggtacagtactgctaggag

SEQ ID NO: 399992 - DNA, 20 bp, Artificial
  CRISPR gRNA sequence
ctaggagtgaggaaagtgaa

SEQ ID NO: 399993 - DNA, 20 bp, Artificial
  CRISPR gRNA sequence
ggagtgaggaaagtgaaatg

SEQ ID NO: 399994 - DNA, 20 bp, Artificial
  CRISPR gRNA sequence
tctttctaataattgaaatc

SEQ ID NO: 399995 - DNA, 20 bp, Artificial
  CRISPR gRNA sequence
tctaataattgaaatctgat

SEQ ID NO: 399996 - DNA, 20 bp, Artificial
  CRISPR gRNA sequence
ctaataattgaaatctgatt

SEQ ID NO: 399997 - DNA, 20 bp, Artificial
  CRISPR gRNA sequence
taataattgaaatctgatta

SEQ ID NO: 399998 - DNA, 20 bp, Artificial
  CRISPR gRNA sequence
ataattgaaatctgattata

SEQ ID NO: 399999 - DNA, 20 bp, Artificial
  CRISPR gRNA sequence
aaatctgattatatcattct

SEQ ID NO: 400000 - DNA, 20 bp, Artificial
  CRISPR gRNA sequence
attatatcattctggtgctt

SEQ ID NO: 400001 - DNA, 20 bp, Artificial
  CRISPR gRNA sequence
tatcattctggtgcttaaca

SEQ ID NO: 400002 - DNA, 20 bp, Artificial
  CRISPR gRNA sequence
tggtgcttaacaatctccaa

SEQ ID NO: 400003 - DNA, 20 bp, Artificial
  CRISPR gRNA sequence
gtgcttaacaatctccaatc

SEQ ID NO: 400004 - DNA, 20 bp, Artificial
  CRISPR gRNA sequence
aacaatctccaatcgctctt

SEQ ID NO: 400005 - DNA, 20 bp, Artificial
  CRISPR gRNA sequence
acaatctccaatcgctctta

SEQ ID NO: 400006 - DNA, 20 bp, Artificial
  CRISPR gRNA sequence
caatcgctcttagaattgta

SEQ ID NO: 400007 - DNA, 20 bp, Artificial
  CRISPR gRNA sequence
ttagaattgtaccaggaagt

SEQ ID NO: 400008 - DNA, 20 bp, Artificial
  CRISPR gRNA sequence
agaattgtaccaggaagtat

SEQ ID NO: 400009 - DNA, 20 bp, Artificial
  CRISPR gRNA sequence
gaattgtaccaggaagtata

SEQ ID NO: 400010 - DNA, 20 bp, Artificial
  CRISPR gRNA sequence
taccaggaagtatataaggc

SEQ ID NO: 400011 - DNA, 20 bp, Artificial
  CRISPR gRNA sequence
ccaccccactcatctctaca

SEQ ID NO: 400012 - DNA, 20 bp, Artificial
  CRISPR gRNA sequence
atctctacatctttctgttt

SEQ ID NO: 400013 - DNA, 20 bp, Artificial
  CRISPR gRNA sequence
tacatctttctgtttccatc

SEQ ID NO: 400014 - DNA, 20 bp, Artificial
  CRISPR gRNA sequence
catctttctgtttccatctc

SEQ ID NO: 400015 - DNA, 20 bp, Artificial
  CRISPR gRNA sequence
tctgtttccatctcccctca

SEQ ID NO: 400016 - DNA, 20 bp, Artificial
  CRISPR gRNA sequence
ctgtttccatctcccctcaa

SEQ ID NO: 400017 - DNA, 20 bp, Artificial
  CRISPR gRNA sequence
tgtttccatctcccctcaat

SEQ ID NO: 400018 - DNA, 20 bp, Artificial
  CRISPR gRNA sequence
tttccatctcccctcaatgt

SEQ ID NO: 400019 - DNA, 20 bp, Artificial
  CRISPR gRNA sequence
ccatctcccctcaatgtatc

SEQ ID NO: 400020 - DNA, 20 bp, Artificial
  CRISPR gRNA sequence
catctcccctcaatgtatcc

SEQ ID NO: 400021 - DNA, 20 bp, Artificial
  CRISPR gRNA sequence
ccctcaatgtatccagctac

SEQ ID NO: 400022 - DNA, 20 bp, Artificial
  CRISPR gRNA sequence
aatgtatccagctacaatga

SEQ ID NO: 400023 - DNA, 20 bp, Artificial
  CRISPR gRNA sequence
caatgattgaaaaacttcca

SEQ ID NO: 400024 - DNA, 20 bp, Artificial
  CRISPR gRNA sequence
aaaaacttccacaaagtctc

SEQ ID NO: 400025 - DNA, 20 bp, Artificial
  CRISPR gRNA sequence
ccacaaagtctctgactttg

SEQ ID NO: 400026 - DNA, 20 bp, Artificial
  CRISPR gRNA sequence
cacaaagtctctgactttgt

SEQ ID NO: 400027 - DNA, 20 bp, Artificial
  CRISPR gRNA sequence
tgactttgtgcacctgctct

SEQ ID NO: 400028 - DNA, 20 bp, Artificial
  CRISPR gRNA sequence
actttgtgcacctgctctcc

SEQ ID NO: 400029 - DNA, 20 bp, Artificial
  CRISPR gRNA sequence
tgtgcacctgctctcctatc

SEQ ID NO: 400030 - DNA, 20 bp, Artificial
  CRISPR gRNA sequence
gtgcacctgctctcctatcc

SEQ ID NO: 400031 - DNA, 20 bp, Artificial
  CRISPR gRNA sequence
tgcacctgctctcctatcca

SEQ ID NO: 400032 - DNA, 20 bp, Artificial
  CRISPR gRNA sequence
ctctcctatccacctggact

SEQ ID NO: 400033 - DNA, 20 bp, Artificial
  CRISPR gRNA sequence
tcctatccacctggactgct

SEQ ID NO: 400034 - DNA, 20 bp, Artificial
  CRISPR gRNA sequence
ctatccacctggactgctcg

SEQ ID NO: 400035 - DNA, 20 bp, Artificial
  CRISPR gRNA sequence
tccacctggactgctcgttc

SEQ ID NO: 400036 - DNA, 20 bp, Artificial
  CRISPR gRNA sequence
gactgctcgttcacacacct

SEQ ID NO: 400037 - DNA, 20 bp, Artificial
  CRISPR gRNA sequence
ctcgttcacacacctggcca

SEQ ID NO: 400038 - DNA, 20 bp, Artificial
  CRISPR gRNA sequence
gttcacacacctggccacac

SEQ ID NO: 400039 - DNA, 20 bp, Artificial
  CRISPR gRNA sequence
acacacctggccacaccctg

SEQ ID NO: 400040 - DNA, 20 bp, Artificial
  CRISPR gRNA sequence
gccacaccctgcatgtggcc

SEQ ID NO: 400041 - DNA, 20 bp, Artificial
  CRISPR gRNA sequence
catgtggccacagcctcctg

SEQ ID NO: 400042 - DNA, 20 bp, Artificial
  CRISPR gRNA sequence
ctgcttctgcagattccaga

SEQ ID NO: 400043 - DNA, 20 bp, Artificial
  CRISPR gRNA sequence
cttctgcagattccagaaca

SEQ ID NO: 400044 - DNA, 20 bp, Artificial
  CRISPR gRNA sequence
ctgcagattccagaacacac

SEQ ID NO: 400045 - DNA, 20 bp, Artificial
  CRISPR gRNA sequence
tgcagattccagaacacact

SEQ ID NO: 400046 - DNA, 20 bp, Artificial
  CRISPR gRNA sequence
cagattccagaacacacttc

SEQ ID NO: 400047 - DNA, 20 bp, Artificial
  CRISPR gRNA sequence
cagaacacacttcactgccc

SEQ ID NO: 400048 - DNA, 20 bp, Artificial
  CRISPR gRNA sequence
cactgcccgagagcctttcc

SEQ ID NO: 400049 - DNA, 20 bp, Artificial
  CRISPR gRNA sequence
actgcccgagagcctttccc

SEQ ID NO: 400050 - DNA, 20 bp, Artificial
  CRISPR gRNA sequence
cccgagagcctttcccgacc

SEQ ID NO: 400051 - DNA, 20 bp, Artificial
  CRISPR gRNA sequence
tcccgaccaccaacctgaca

SEQ ID NO: 400052 - DNA, 20 bp, Artificial
  CRISPR gRNA sequence
cccgaccaccaacctgacac

SEQ ID NO: 400053 - DNA, 20 bp, Artificial
  CRISPR gRNA sequence
ccgaccaccaacctgacaca

SEQ ID NO: 400054 - DNA, 20 bp, Artificial
  CRISPR gRNA sequence
acacagcctctgcttggctg

SEQ ID NO: 400055 - DNA, 20 bp, Artificial
  CRISPR gRNA sequence
tgcttggctgcagccccagc

SEQ ID NO: 400056 - DNA, 20 bp, Artificial
  CRISPR gRNA sequence
cttggctgcagccccagcca

SEQ ID NO: 400057 - DNA, 20 bp, Artificial
  CRISPR gRNA sequence
ggctgcagccccagccattc

SEQ ID NO: 400058 - DNA, 20 bp, Artificial
  CRISPR gRNA sequence
gctgcagccccagccattct

SEQ ID NO: 400059 - DNA, 20 bp, Artificial
  CRISPR gRNA sequence
cagccccagccattctctcc

SEQ ID NO: 400060 - DNA, 20 bp, Artificial
  CRISPR gRNA sequence
tctcccatgcctgtgtgtgt

SEQ ID NO: 400061 - DNA, 20 bp, Artificial
  CRISPR gRNA sequence
tcccatgcctgtgtgtgttg

SEQ ID NO: 400062 - DNA, 20 bp, Artificial
  CRISPR gRNA sequence
ccatgcctgtgtgtgttgct

SEQ ID NO: 400063 - DNA, 20 bp, Artificial
  CRISPR gRNA sequence
tgtgtgttgcttccttttca

SEQ ID NO: 400064 - DNA, 20 bp, Artificial
  CRISPR gRNA sequence
cttccttttcataacgtgac

SEQ ID NO: 400065 - DNA, 20 bp, Artificial
  CRISPR gRNA sequence
ccttttcataacgtgacatg

SEQ ID NO: 400066 - DNA, 20 bp, Artificial
  CRISPR gRNA sequence
cttttcataacgtgacatgc

SEQ ID NO: 400067 - DNA, 20 bp, Artificial
  CRISPR gRNA sequence
ttcataacgtgacatgcact

SEQ ID NO: 400068 - DNA, 20 bp, Artificial
  CRISPR gRNA sequence
tcataacgtgacatgcactt

SEQ ID NO: 400069 - DNA, 20 bp, Artificial
  CRISPR gRNA sequence
cataacgtgacatgcacttc

SEQ ID NO: 400070 - DNA, 20 bp, Artificial
  CRISPR gRNA sequence
ataacgtgacatgcacttca

SEQ ID NO: 400071 - DNA, 20 bp, Artificial
  CRISPR gRNA sequence
cataactgtgcatttatttg

SEQ ID NO: 400072 - DNA, 20 bp, Artificial
  CRISPR gRNA sequence
ataactgtgcatttatttgt

SEQ ID NO: 400073 - DNA, 20 bp, Artificial
  CRISPR gRNA sequence
tgcatttatttgtatgttcg

SEQ ID NO: 400074 - DNA, 20 bp, Artificial
  CRISPR gRNA sequence
atttgtatgttcgtctgatg

SEQ ID NO: 400075 - DNA, 20 bp, Artificial
  CRISPR gRNA sequence
tttgtatgttcgtctgatgt

SEQ ID NO: 400076 - DNA, 20 bp, Artificial
  CRISPR gRNA sequence
gtatgttcgtctgatgtctg

SEQ ID NO: 400077 - DNA, 20 bp, Artificial
  CRISPR gRNA sequence
tatgttcgtctgatgtctgt

SEQ ID NO: 400078 - DNA, 20 bp, Artificial
  CRISPR gRNA sequence
gtctgatgtctgtctttcca

SEQ ID NO: 400079 - DNA, 20 bp, Artificial
  CRISPR gRNA sequence
atgtctgtctttccaactag

SEQ ID NO: 400080 - DNA, 20 bp, Artificial
  CRISPR gRNA sequence
tctttccaactagactgggg

SEQ ID NO: 400081 - DNA, 20 bp, Artificial
  CRISPR gRNA sequence
tccaactagactgggggcat

SEQ ID NO: 400082 - DNA, 20 bp, Artificial
  CRISPR gRNA sequence
ccaactagactgggggcatg

SEQ ID NO: 400083 - DNA, 20 bp, Artificial
  CRISPR gRNA sequence
caactagactgggggcatga

SEQ ID NO: 400084 - DNA, 20 bp, Artificial
  CRISPR gRNA sequence
gactgggggcatgaaaaagt

SEQ ID NO: 400085 - DNA, 20 bp, Artificial
  CRISPR gRNA sequence
ggggcatgaaaaagtttttc

SEQ ID NO: 400086 - DNA, 20 bp, Artificial
  CRISPR gRNA sequence
ttctgtaaaagagcaggtgg

SEQ ID NO: 400087 - DNA, 20 bp, Artificial
  CRISPR gRNA sequence
tctgtaaaagagcaggtggt

SEQ ID NO: 400088 - DNA, 20 bp, Artificial
  CRISPR gRNA sequence
ctgtaaaagagcaggtggta

SEQ ID NO: 400089 - DNA, 20 bp, Artificial
  CRISPR gRNA sequence
tgtaaaagagcaggtggtat

SEQ ID NO: 400090 - DNA, 20 bp, Artificial
  CRISPR gRNA sequence
taaaagagcaggtggtatgt

SEQ ID NO: 400091 - DNA, 20 bp, Artificial
  CRISPR gRNA sequence
gactttggccgtacactctg

SEQ ID NO: 400092 - DNA, 20 bp, Artificial
  CRISPR gRNA sequence
tggccgtacactctgttttg

SEQ ID NO: 400093 - DNA, 20 bp, Artificial
  CRISPR gRNA sequence
ggccgtacactctgttttga

SEQ ID NO: 400094 - DNA, 20 bp, Artificial
  CRISPR gRNA sequence
gccgtacactctgttttgag

SEQ ID NO: 400095 - DNA, 20 bp, Artificial
  CRISPR gRNA sequence
tgttttgagatcacgccaga

SEQ ID NO: 400096 - DNA, 20 bp, Artificial
  CRISPR gRNA sequence
ttttgagatcacgccagatg

SEQ ID NO: 400097 - DNA, 20 bp, Artificial
  CRISPR gRNA sequence
tgagatcacgccagatgcag

SEQ ID NO: 400098 - DNA, 20 bp, Artificial
  CRISPR gRNA sequence
gagatcacgccagatgcagt

SEQ ID NO: 400099 - DNA, 20 bp, Artificial
  CRISPR gRNA sequence
agatcacgccagatgcagta

SEQ ID NO: 400100 - DNA, 20 bp, Artificial
  CRISPR gRNA sequence
gagagtacgtgcagatgcat

SEQ ID NO: 400101 - DNA, 20 bp, Artificial
  CRISPR gRNA sequence
agagtacgtgcagatgcatg

SEQ ID NO: 400102 - DNA, 20 bp, Artificial
  CRISPR gRNA sequence
tgtgagattgtgtgtgcata

SEQ ID NO: 400103 - DNA, 20 bp, Artificial
  CRISPR gRNA sequence
tgtgtgcatatgtgagcatg

SEQ ID NO: 400104 - DNA, 20 bp, Artificial
  CRISPR gRNA sequence
gagagtatgtgtgcacctgc

SEQ ID NO: 400105 - DNA, 20 bp, Artificial
  CRISPR gRNA sequence
agagtatgtgtgcacctgca

SEQ ID NO: 400106 - DNA, 20 bp, Artificial
  CRISPR gRNA sequence
catgtgattgtgtgtgtgag

SEQ ID NO: 400107 - DNA, 20 bp, Artificial
  CRISPR gRNA sequence
tgtgtgtgagagagtgtgag

SEQ ID NO: 400108 - DNA, 20 bp, Artificial
  CRISPR gRNA sequence
gagagtatatgtgcacatgc

SEQ ID NO: 400109 - DNA, 20 bp, Artificial
  CRISPR gRNA sequence
agagtatatgtgcacatgca

SEQ ID NO: 400110 - DNA, 20 bp, Artificial
  CRISPR gRNA sequence
agatagagtgagacagtgtg

SEQ ID NO: 400111 - DNA, 20 bp, Artificial
  CRISPR gRNA sequence
tgtgtctgagactgtgagca

SEQ ID NO: 400112 - DNA, 20 bp, Artificial
  CRISPR gRNA sequence
agactgtgagcatgtgtgtg

SEQ ID NO: 400113 - DNA, 20 bp, Artificial
  CRISPR gRNA sequence
tgagcatgtgtgtgtgggtg

SEQ ID NO: 400114 - DNA, 20 bp, Artificial
  CRISPR gRNA sequence
tgtgtgtgaatgtgtgttag

SEQ ID NO: 400115 - DNA, 20 bp, Artificial
  CRISPR gRNA sequence
gagcatgtgtgggtgcatat

SEQ ID NO: 400116 - DNA, 20 bp, Artificial
  CRISPR gRNA sequence
catgtgtgtgtgagtgcatg

SEQ ID NO: 400117 - DNA, 20 bp, Artificial
  CRISPR gRNA sequence
gggagacagcatgtgtgggt

SEQ ID NO: 400118 - DNA, 20 bp, Artificial
  CRISPR gRNA sequence
ggagacagcatgtgtgggtt

SEQ ID NO: 400119 - DNA, 20 bp, Artificial
  CRISPR gRNA sequence
atgcatttgagcacgtgagt

SEQ ID NO: 400120 - DNA, 20 bp, Artificial
  CRISPR gRNA sequence
gagcacgtgagtgtgtcagt

SEQ ID NO: 400121 - DNA, 20 bp, Artificial
  CRISPR gRNA sequence
agcacgtgagtgtgtcagtg

SEQ ID NO: 400122 - DNA, 20 bp, Artificial
  CRISPR gRNA sequence
agacagaagatatgaatgca

SEQ ID NO: 400123 - DNA, 20 bp, Artificial
  CRISPR gRNA sequence
agggggaccctgtcctcagg

SEQ ID NO: 400124 - DNA, 20 bp, Artificial
  CRISPR gRNA sequence
gggggaccctgtcctcagga

SEQ ID NO: 400125 - DNA, 20 bp, Artificial
  CRISPR gRNA sequence
tcctcaggacctcaggaatt

SEQ ID NO: 400126 - DNA, 20 bp, Artificial
  CRISPR gRNA sequence
aggacctcaggaattctctg

SEQ ID NO: 400127 - DNA, 20 bp, Artificial
  CRISPR gRNA sequence
aggaattctctggacttggt

SEQ ID NO: 400128 - DNA, 20 bp, Artificial
  CRISPR gRNA sequence
tctggacttggtttagcccg

SEQ ID NO: 400129 - DNA, 20 bp, Artificial
  CRISPR gRNA sequence
tggacttggtttagcccggc

SEQ ID NO: 400130 - DNA, 20 bp, Artificial
  CRISPR gRNA sequence
gacttggtttagcccggcat

SEQ ID NO: 400131 - DNA, 20 bp, Artificial
  CRISPR gRNA sequence
ggtttagcccggcatttgta

SEQ ID NO: 400132 - DNA, 20 bp, Artificial
  CRISPR gRNA sequence
gtttagcccggcatttgtag

SEQ ID NO: 400133 - DNA, 20 bp, Artificial
  CRISPR gRNA sequence
agcccggcatttgtagtttg

SEQ ID NO: 400134 - DNA, 20 bp, Artificial
  CRISPR gRNA sequence
gcccggcatttgtagtttga

SEQ ID NO: 400135 - DNA, 20 bp, Artificial
  CRISPR gRNA sequence
gtagtttgatttttgctggt

SEQ ID NO: 400136 - DNA, 20 bp, Artificial
  CRISPR gRNA sequence
tagtttgatttttgctggtg

SEQ ID NO: 400137 - DNA, 20 bp, Artificial
  CRISPR gRNA sequence
gatttttgctggtgcctgtc

SEQ ID NO: 400138 - DNA, 20 bp, Artificial
  CRISPR gRNA sequence
atttttgctggtgcctgtca

SEQ ID NO: 400139 - DNA, 20 bp, Artificial
  CRISPR gRNA sequence
ttgctggtgcctgtcagggg

SEQ ID NO: 400140 - DNA, 20 bp, Artificial
  CRISPR gRNA sequence
tgctggtgcctgtcagggga

SEQ ID NO: 400141 - DNA, 20 bp, Artificial
  CRISPR gRNA sequence
gctggtgcctgtcaggggaa

SEQ ID NO: 400142 - DNA, 20 bp, Artificial
  CRISPR gRNA sequence
ctggtgcctgtcaggggaaa

SEQ ID NO: 400143 - DNA, 20 bp, Artificial
  CRISPR gRNA sequence
gtgcctgtcaggggaaaatc

SEQ ID NO: 400144 - DNA, 20 bp, Artificial
  CRISPR gRNA sequence
tcaggggaaaatcttgtcat

SEQ ID NO: 400145 - DNA, 20 bp, Artificial
  CRISPR gRNA sequence
gtcattaggacataatagga

SEQ ID NO: 400146 - DNA, 20 bp, Artificial
  CRISPR gRNA sequence
tcattaggacataataggac

SEQ ID NO: 400147 - DNA, 20 bp, Artificial
  CRISPR gRNA sequence
ggacataataggacataata

SEQ ID NO: 400148 - DNA, 20 bp, Artificial
  CRISPR gRNA sequence
atttttccaattctgatgga

SEQ ID NO: 400149 - DNA, 20 bp, Artificial
  CRISPR gRNA sequence
ttccaattctgatggaggtc

SEQ ID NO: 400150 - DNA, 20 bp, Artificial
  CRISPR gRNA sequence
tccaattctgatggaggtct

SEQ ID NO: 400151 - DNA, 20 bp, Artificial
  CRISPR gRNA sequence
ccaattctgatggaggtctt

SEQ ID NO: 400152 - DNA, 20 bp, Artificial
  CRISPR gRNA sequence
caattctgatggaggtcttc

SEQ ID NO: 400153 - DNA, 20 bp, Artificial
  CRISPR gRNA sequence
tgatggaggtcttccatgtc

SEQ ID NO: 400154 - DNA, 20 bp, Artificial
  CRISPR gRNA sequence
atggaggtcttccatgtcct

SEQ ID NO: 400155 - DNA, 20 bp, Artificial
  CRISPR gRNA sequence
ccatgtccttgccactccag

SEQ ID NO: 400156 - DNA, 20 bp, Artificial
  CRISPR gRNA sequence
catgtccttgccactccagt

SEQ ID NO: 400157 - DNA, 20 bp, Artificial
  CRISPR gRNA sequence
gccactccagtttgttctgt

SEQ ID NO: 400158 - DNA, 20 bp, Artificial
  CRISPR gRNA sequence
ccactccagtttgttctgta

SEQ ID NO: 400159 - DNA, 20 bp, Artificial
  CRISPR gRNA sequence
cagtttgttctgtacagtga

SEQ ID NO: 400160 - DNA, 20 bp, Artificial
  CRISPR gRNA sequence
gttctgtacagtgaccaaga

SEQ ID NO: 400161 - DNA, 20 bp, Artificial
  CRISPR gRNA sequence
ttctgtacagtgaccaagat

SEQ ID NO: 400162 - DNA, 20 bp, Artificial
  CRISPR gRNA sequence
tgtacagtgaccaagattat

SEQ ID NO: 400163 - DNA, 20 bp, Artificial
  CRISPR gRNA sequence
tacagtgaccaagattatct

SEQ ID NO: 400164 - DNA, 20 bp, Artificial
  CRISPR gRNA sequence
tctttccaaaacgcgaagtt

SEQ ID NO: 400165 - DNA, 20 bp, Artificial
  CRISPR gRNA sequence
tccaaaacgcgaagttgtgt

SEQ ID NO: 400166 - DNA, 20 bp, Artificial
  CRISPR gRNA sequence
ccaaaacgcgaagttgtgtg

SEQ ID NO: 400167 - DNA, 20 bp, Artificial
  CRISPR gRNA sequence
caaaacgcgaagttgtgtgc

SEQ ID NO: 400168 - DNA, 20 bp, Artificial
  CRISPR gRNA sequence
tgtgcaccgctttctccatc

SEQ ID NO: 400169 - DNA, 20 bp, Artificial
  CRISPR gRNA sequence
tctccatcagctcctcggcg

SEQ ID NO: 400170 - DNA, 20 bp, Artificial
  CRISPR gRNA sequence
ctccatcagctcctcggcgg

SEQ ID NO: 400171 - DNA, 20 bp, Artificial
  CRISPR gRNA sequence
tccatcagctcctcggcggc

SEQ ID NO: 400172 - DNA, 20 bp, Artificial
  CRISPR gRNA sequence
catcagctcctcggcggctc

SEQ ID NO: 400173 - DNA, 20 bp, Artificial
  CRISPR gRNA sequence
ctcggcggctccatgttcct

SEQ ID NO: 400174 - DNA, 20 bp, Artificial
  CRISPR gRNA sequence
ggcggctccatgttcctctc

SEQ ID NO: 400175 - DNA, 20 bp, Artificial
  CRISPR gRNA sequence
catgttcctctcaggaatgt

SEQ ID NO: 400176 - DNA, 20 bp, Artificial
  CRISPR gRNA sequence
ctctcaggaatgtgttaacg

SEQ ID NO: 400177 - DNA, 20 bp, Artificial
  CRISPR gRNA sequence
tcaggaatgtgttaacgtca

SEQ ID NO: 400178 - DNA, 20 bp, Artificial
  CRISPR gRNA sequence
aggaatgtgttaacgtcaca

SEQ ID NO: 400179 - DNA, 20 bp, Artificial
  CRISPR gRNA sequence
acgtcacaggcgttactgag

SEQ ID NO: 400180 - DNA, 20 bp, Artificial
  CRISPR gRNA sequence
ctgagagcctgctttgcctg

SEQ ID NO: 400181 - DNA, 20 bp, Artificial
  CRISPR gRNA sequence
agagcctgctttgcctgagg

SEQ ID NO: 400182 - DNA, 20 bp, Artificial
  CRISPR gRNA sequence
ctttgcctgaggaattgtgc

SEQ ID NO: 400183 - DNA, 20 bp, Artificial
  CRISPR gRNA sequence
tgcctgaggaattgtgctgg

SEQ ID NO: 400184 - DNA, 20 bp, Artificial
  CRISPR gRNA sequence
gcctgaggaattgtgctggg

SEQ ID NO: 400185 - DNA, 20 bp, Artificial
  CRISPR gRNA sequence
cctgaggaattgtgctgggt

SEQ ID NO: 400186 - DNA, 20 bp, Artificial
  CRISPR gRNA sequence
aggaattgtgctgggtgctg

SEQ ID NO: 400187 - DNA, 20 bp, Artificial
  CRISPR gRNA sequence
tgctgggtgctggagttaca

SEQ ID NO: 400188 - DNA, 20 bp, Artificial
  CRISPR gRNA sequence
ggtgctggagttacagaagt

SEQ ID NO: 400189 - DNA, 20 bp, Artificial
  CRISPR gRNA sequence
gagttacagaagttagcatg

SEQ ID NO: 400190 - DNA, 20 bp, Artificial
  CRISPR gRNA sequence
cagaagttagcatgacgccg

SEQ ID NO: 400191 - DNA, 20 bp, Artificial
  CRISPR gRNA sequence
gcatgacgccgcggtttctg

SEQ ID NO: 400192 - DNA, 20 bp, Artificial
  CRISPR gRNA sequence
ctgattgctacgtttcagtt

SEQ ID NO: 400193 - DNA, 20 bp, Artificial
  CRISPR gRNA sequence
tgattgctacgtttcagttc

SEQ ID NO: 400194 - DNA, 20 bp, Artificial
  CRISPR gRNA sequence
attgctacgtttcagttcct

SEQ ID NO: 400195 - DNA, 20 bp, Artificial
  CRISPR gRNA sequence
ctacgtttcagttcctttat

SEQ ID NO: 400196 - DNA, 20 bp, Artificial
  CRISPR gRNA sequence
cgtttcagttcctttatgtg

SEQ ID NO: 400197 - DNA, 20 bp, Artificial
  CRISPR gRNA sequence
cagttcctttatgtgtgtca

SEQ ID NO: 400198 - DNA, 20 bp, Artificial
  CRISPR gRNA sequence
agttcctttatgtgtgtcac

SEQ ID NO: 400199 - DNA, 20 bp, Artificial
  CRISPR gRNA sequence
ctttatgtgtgtcactcagg

SEQ ID NO: 400200 - DNA, 20 bp, Artificial
  CRISPR gRNA sequence
tatgtgtgtcactcaggtca

SEQ ID NO: 400201 - DNA, 20 bp, Artificial
  CRISPR gRNA sequence
atgtgtgtcactcaggtcac

SEQ ID NO: 400202 - DNA, 20 bp, Artificial
  CRISPR gRNA sequence
tgtgtgtcactcaggtcact

SEQ ID NO: 400203 - DNA, 20 bp, Artificial
  CRISPR gRNA sequence
aggtcacttttcagtccaga

SEQ ID NO: 400204 - DNA, 20 bp, Artificial
  CRISPR gRNA sequence
ttcagtccagactcagtctc

SEQ ID NO: 400205 - DNA, 20 bp, Artificial
  CRISPR gRNA sequence
tcagtccagactcagtctca

SEQ ID NO: 400206 - DNA, 20 bp, Artificial
  CRISPR gRNA sequence
cagtccagactcagtctcat

SEQ ID NO: 400207 - DNA, 20 bp, Artificial
  CRISPR gRNA sequence
agtccagactcagtctcatt

SEQ ID NO: 400208 - DNA, 20 bp, Artificial
  CRISPR gRNA sequence
agtctcattttcggtcactt

SEQ ID NO: 400209 - DNA, 20 bp, Artificial
  CRISPR gRNA sequence
attttcggtcacttccccac

SEQ ID NO: 400210 - DNA, 20 bp, Artificial
  CRISPR gRNA sequence
tcggtcacttccccacccac

SEQ ID NO: 400211 - DNA, 20 bp, Artificial
  CRISPR gRNA sequence
cggtcacttccccacccact

SEQ ID NO: 400212 - DNA, 20 bp, Artificial
  CRISPR gRNA sequence
ggtcacttccccacccacta

SEQ ID NO: 400213 - DNA, 20 bp, Artificial
  CRISPR gRNA sequence
ccccacccactagactgtag

SEQ ID NO: 400214 - DNA, 20 bp, Artificial
  CRISPR gRNA sequence
cccacccactagactgtagt

SEQ ID NO: 400215 - DNA, 20 bp, Artificial
  CRISPR gRNA sequence
gactgtagtcacaccatttc

SEQ ID NO: 400216 - DNA, 20 bp, Artificial
  CRISPR gRNA sequence
tagtcacaccatttcctgaa

SEQ ID NO: 400217 - DNA, 20 bp, Artificial
  CRISPR gRNA sequence
cctgaaacacccgcattgtc

SEQ ID NO: 400218 - DNA, 20 bp, Artificial
  CRISPR gRNA sequence
ctgaaacacccgcattgtca

SEQ ID NO: 400219 - DNA, 20 bp, Artificial
  CRISPR gRNA sequence
aaacacccgcattgtcacgc

SEQ ID NO: 400220 - DNA, 20 bp, Artificial
  CRISPR gRNA sequence
tcacgcctctgttttccccc

SEQ ID NO: 400221 - DNA, 20 bp, Artificial
  CRISPR gRNA sequence
tgttttccccccactttttc

SEQ ID NO: 400222 - DNA, 20 bp, Artificial
  CRISPR gRNA sequence
ttttccccccactttttcta

SEQ ID NO: 400223 - DNA, 20 bp, Artificial
  CRISPR gRNA sequence
tccccccactttttctataa

SEQ ID NO: 400224 - DNA, 20 bp, Artificial
  CRISPR gRNA sequence
ccccccactttttctataaa

SEQ ID NO: 400225 - DNA, 20 bp, Artificial
  CRISPR gRNA sequence
cccccactttttctataaaa

SEQ ID NO: 400226 - DNA, 20 bp, Artificial
  CRISPR gRNA sequence
tttctataaaaccttttcca

SEQ ID NO: 400227 - DNA, 20 bp, Artificial
  CRISPR gRNA sequence
ttctataaaaccttttccac

SEQ ID NO: 400228 - DNA, 20 bp, Artificial
  CRISPR gRNA sequence
tctataaaaccttttccaca

SEQ ID NO: 400229 - DNA, 20 bp, Artificial
  CRISPR gRNA sequence
ctataaaaccttttccacaa

SEQ ID NO: 400230 - DNA, 20 bp, Artificial
  CRISPR gRNA sequence
tataaaaccttttccacaat

SEQ ID NO: 400231 - DNA, 20 bp, Artificial
  CRISPR gRNA sequence
taaaaccttttccacaatct

SEQ ID NO: 400232 - DNA, 20 bp, Artificial
  CRISPR gRNA sequence
ttccacaatctattagaatg

SEQ ID NO: 400233 - DNA, 20 bp, Artificial
  CRISPR gRNA sequence
tccacaatctattagaatga

SEQ ID NO: 400234 - DNA, 20 bp, Artificial
  CRISPR gRNA sequence
ccacaatctattagaatgat

SEQ ID NO: 400235 - DNA, 20 bp, Artificial
  CRISPR gRNA sequence
cacaatctattagaatgatt

SEQ ID NO: 400236 - DNA, 20 bp, Artificial
  CRISPR gRNA sequence
ttagaatgatttgttctctc

SEQ ID NO: 400237 - DNA, 20 bp, Artificial
  CRISPR gRNA sequence
gaatgatttgttctctctgg

SEQ ID NO: 400238 - DNA, 20 bp, Artificial
  CRISPR gRNA sequence
gttctctctggctttcataa

SEQ ID NO: 400239 - DNA, 20 bp, Artificial
  CRISPR gRNA sequence
ttctctctggctttcataaa

SEQ ID NO: 400240 - DNA, 20 bp, Artificial
  CRISPR gRNA sequence
tctctggctttcataaaact

SEQ ID NO: 400241 - DNA, 20 bp, Artificial
  CRISPR gRNA sequence
tctggctttcataaaactta

SEQ ID NO: 400242 - DNA, 20 bp, Artificial
  CRISPR gRNA sequence
tggctttcataaaacttagc

SEQ ID NO: 400243 - DNA, 20 bp, Artificial
  CRISPR gRNA sequence
gctttcataaaacttagcaa

SEQ ID NO: 400244 - DNA, 20 bp, Artificial
  CRISPR gRNA sequence
tcataaaacttagcaaatga

SEQ ID NO: 400245 - DNA, 20 bp, Artificial
  CRISPR gRNA sequence
cataaaacttagcaaatgac

SEQ ID NO: 400246 - DNA, 20 bp, Artificial
  CRISPR gRNA sequence
ataaaacttagcaaatgact

SEQ ID NO: 400247 - DNA, 20 bp, Artificial
  CRISPR gRNA sequence
agcaaatgacttgtatagag

SEQ ID NO: 400248 - DNA, 20 bp, Artificial
  CRISPR gRNA sequence
gcaaatgacttgtatagaga

SEQ ID NO: 400249 - DNA, 20 bp, Artificial
  CRISPR gRNA sequence
gtatagagatgatcatgttt

SEQ ID NO: 400250 - DNA, 20 bp, Artificial
  CRISPR gRNA sequence
tatagagatgatcatgtttt

SEQ ID NO: 400251 - DNA, 20 bp, Artificial
  CRISPR gRNA sequence
tgctacaataaattgctttt

SEQ ID NO: 400252 - DNA, 20 bp, Artificial
  CRISPR gRNA sequence
gctacaataaattgctttta

SEQ ID NO: 400253 - DNA, 20 bp, Artificial
  CRISPR gRNA sequence
ctacaataaattgcttttaa

SEQ ID NO: 400254 - DNA, 20 bp, Artificial
  CRISPR gRNA sequence
caataaattgcttttaaaat

SEQ ID NO: 400255 - DNA, 20 bp, Artificial
  CRISPR gRNA sequence
cttttaaaattaatatgacc

SEQ ID NO: 400256 - DNA, 20 bp, Artificial
  CRISPR gRNA sequence
ttaaaattaatatgacccac

SEQ ID NO: 400257 - DNA, 20 bp, Artificial
  CRISPR gRNA sequence
taaaattaatatgacccact

SEQ ID NO: 400258 - DNA, 20 bp, Artificial
  CRISPR gRNA sequence
aaaattaatatgacccacta

SEQ ID NO: 400259 - DNA, 20 bp, Artificial
  CRISPR gRNA sequence
aaattaatatgacccactat

SEQ ID NO: 400260 - DNA, 20 bp, Artificial
  CRISPR gRNA sequence
atatgacccactatattatg

SEQ ID NO: 400261 - DNA, 20 bp, Artificial
  CRISPR gRNA sequence
tattatgcataacctgagag

SEQ ID NO: 400262 - DNA, 20 bp, Artificial
  CRISPR gRNA sequence
tgcataacctgagagcagag

SEQ ID NO: 400263 - DNA, 20 bp, Artificial
  CRISPR gRNA sequence
agagcagagatgtgtcctct

SEQ ID NO: 400264 - DNA, 20 bp, Artificial
  CRISPR gRNA sequence
tttatgattgtatttccaag

SEQ ID NO: 400265 - DNA, 20 bp, Artificial
  CRISPR gRNA sequence
tatgattgtatttccaaggg

SEQ ID NO: 400266 - DNA, 20 bp, Artificial
  CRISPR gRNA sequence
atgattgtatttccaaggga

SEQ ID NO: 400267 - DNA, 20 bp, Artificial
  CRISPR gRNA sequence
tgattgtatttccaagggac

SEQ ID NO: 400268 - DNA, 20 bp, Artificial
  CRISPR gRNA sequence
tatttccaagggactaagca

SEQ ID NO: 400269 - DNA, 20 bp, Artificial
  CRISPR gRNA sequence
ccaagggactaagcagagga

SEQ ID NO: 400270 - DNA, 20 bp, Artificial
  CRISPR gRNA sequence
caagggactaagcagaggac

SEQ ID NO: 400271 - DNA, 20 bp, Artificial
  CRISPR gRNA sequence
agcagaggacccagcataac

SEQ ID NO: 400272 - DNA, 20 bp, Artificial
  CRISPR gRNA sequence
agtacaatttggaggaattg

SEQ ID NO: 400273 - DNA, 20 bp, Artificial
  CRISPR gRNA sequence
ggaggaattgttgggttgac

SEQ ID NO: 400274 - DNA, 20 bp, Artificial
  CRISPR gRNA sequence
gaggaattgttgggttgact

SEQ ID NO: 400275 - DNA, 20 bp, Artificial
  CRISPR gRNA sequence
ttgggttgacttatttacaa

SEQ ID NO: 400276 - DNA, 20 bp, Artificial
  CRISPR gRNA sequence
ggttgacttatttacaaaac

SEQ ID NO: 400277 - DNA, 20 bp, Artificial
  CRISPR gRNA sequence
acttatttacaaaacagaga

SEQ ID NO: 400278 - DNA, 20 bp, Artificial
  CRISPR gRNA sequence
atttacaaaacagagataac

SEQ ID NO: 400279 - DNA, 20 bp, Artificial
  CRISPR gRNA sequence
tttacaaaacagagataaca

SEQ ID NO: 400280 - DNA, 20 bp, Artificial
  CRISPR gRNA sequence
acaaaacagagataacagat

SEQ ID NO: 400281 - DNA, 20 bp, Artificial
  CRISPR gRNA sequence
caaaacagagataacagatg

SEQ ID NO: 400282 - DNA, 20 bp, Artificial
  CRISPR gRNA sequence
ttttgactacatcacaaaac

SEQ ID NO: 400283 - DNA, 20 bp, Artificial
  CRISPR gRNA sequence
ttgactacatcacaaaacaa

SEQ ID NO: 400284 - DNA, 20 bp, Artificial
  CRISPR gRNA sequence
tgactacatcacaaaacaac

SEQ ID NO: 400285 - DNA, 20 bp, Artificial
  CRISPR gRNA sequence
gactacatcacaaaacaact

SEQ ID NO: 400286 - DNA, 20 bp, Artificial
  CRISPR gRNA sequence
actacatcacaaaacaacta

SEQ ID NO: 400287 - DNA, 20 bp, Artificial
  CRISPR gRNA sequence
catcacaaaacaactagagg

SEQ ID NO: 400288 - DNA, 20 bp, Artificial
  CRISPR gRNA sequence
gaggcacaaataatatcata

SEQ ID NO: 400289 - DNA, 20 bp, Artificial
  CRISPR gRNA sequence
ttagaaaatataatgccata

SEQ ID NO: 400290 - DNA, 20 bp, Artificial
  CRISPR gRNA sequence
tagaaaatataatgccatat

SEQ ID NO: 400291 - DNA, 20 bp, Artificial
  CRISPR gRNA sequence
agaaaatataatgccatata

SEQ ID NO: 400292 - DNA, 20 bp, Artificial
  CRISPR gRNA sequence
gaaaatataatgccatataa

SEQ ID NO: 400293 - DNA, 20 bp, Artificial
  CRISPR gRNA sequence
gattatatgtacacattaca

SEQ ID NO: 400294 - DNA, 20 bp, Artificial
  CRISPR gRNA sequence
attatatgtacacattacaa

SEQ ID NO: 400295 - DNA, 20 bp, Artificial
  CRISPR gRNA sequence
tatgtacacattacaatttt

SEQ ID NO: 400296 - DNA, 20 bp, Artificial
  CRISPR gRNA sequence
caattttgttctgattatca

SEQ ID NO: 400297 - DNA, 20 bp, Artificial
  CRISPR gRNA sequence
tgttctgattatcattgcat

SEQ ID NO: 400298 - DNA, 20 bp, Artificial
  CRISPR gRNA sequence
gttctgattatcattgcatt

SEQ ID NO: 400299 - DNA, 20 bp, Artificial
  CRISPR gRNA sequence
ttctgattatcattgcattg

SEQ ID NO: 400300 - DNA, 20 bp, Artificial
  CRISPR gRNA sequence
tgattatcattgcattgttg

SEQ ID NO: 400301 - DNA, 20 bp, Artificial
  CRISPR gRNA sequence
attatcattgcattgttgat

SEQ ID NO: 400302 - DNA, 20 bp, Artificial
  CRISPR gRNA sequence
tcattgcattgttgatttta

SEQ ID NO: 400303 - DNA, 20 bp, Artificial
  CRISPR gRNA sequence
cattgttgattttatgttcc

SEQ ID NO: 400304 - DNA, 20 bp, Artificial
  CRISPR gRNA sequence
ttgattttatgttccctgag

SEQ ID NO: 400305 - DNA, 20 bp, Artificial
  CRISPR gRNA sequence
attttatgttccctgagaaa

SEQ ID NO: 400306 - DNA, 20 bp, Artificial
  CRISPR gRNA sequence
tatgttccctgagaaagttc

SEQ ID NO: 400307 - DNA, 20 bp, Artificial
  CRISPR gRNA sequence
atgttccctgagaaagttcc

SEQ ID NO: 400308 - DNA, 20 bp, Artificial
  CRISPR gRNA sequence
tgttccctgagaaagttccc

SEQ ID NO: 400309 - DNA, 20 bp, Artificial
  CRISPR gRNA sequence
cctgagaaagttcccacatt

SEQ ID NO: 400310 - DNA, 20 bp, Artificial
  CRISPR gRNA sequence
agaaagttcccacattagat

SEQ ID NO: 400311 - DNA, 20 bp, Artificial
  CRISPR gRNA sequence
ccacattagatattcatgct

SEQ ID NO: 400312 - DNA, 20 bp, Artificial
  CRISPR gRNA sequence
gatattcatgctgagtagtc

SEQ ID NO: 400313 - DNA, 20 bp, Artificial
  CRISPR gRNA sequence
atgctgagtagtcgacactt

SEQ ID NO: 400314 - DNA, 20 bp, Artificial
  CRISPR gRNA sequence
agtagtcgacacttgctgat

SEQ ID NO: 400315 - DNA, 20 bp, Artificial
  CRISPR gRNA sequence
gctgatacactttgagactg

SEQ ID NO: 400316 - DNA, 20 bp, Artificial
  CRISPR gRNA sequence
ctgatacactttgagactga

SEQ ID NO: 400317 - DNA, 20 bp, Artificial
  CRISPR gRNA sequence
atacactttgagactgagtc

SEQ ID NO: 400318 - DNA, 20 bp, Artificial
  CRISPR gRNA sequence
tgagactgagtcacaaacaa

SEQ ID NO: 400319 - DNA, 20 bp, Artificial
  CRISPR gRNA sequence
gagactgagtcacaaacaaa

SEQ ID NO: 400320 - DNA, 20 bp, Artificial
  CRISPR gRNA sequence
agactgagtcacaaacaaag

SEQ ID NO: 400321 - DNA, 20 bp, Artificial
  CRISPR gRNA sequence
agtcacaaacaaagttcagg

SEQ ID NO: 400322 - DNA, 20 bp, Artificial
  CRISPR gRNA sequence
agggtcggcattagataaaa

SEQ ID NO: 400323 - DNA, 20 bp, Artificial
  CRISPR gRNA sequence
gataaaattgtcttcagtgg

SEQ ID NO: 400324 - DNA, 20 bp, Artificial
  CRISPR gRNA sequence
tcttcagtggtttctgctcc

SEQ ID NO: 400325 - DNA, 20 bp, Artificial
  CRISPR gRNA sequence
cagtggtttctgctcctact

SEQ ID NO: 400326 - DNA, 20 bp, Artificial
  CRISPR gRNA sequence
agtggtttctgctcctactt

SEQ ID NO: 400327 - DNA, 20 bp, Artificial
  CRISPR gRNA sequence
ctgctcctacttttcccaat

SEQ ID NO: 400328 - DNA, 20 bp, Artificial
  CRISPR gRNA sequence
tgctcctacttttcccaatt

SEQ ID NO: 400329 - DNA, 20 bp, Artificial
  CRISPR gRNA sequence
ctcctacttttcccaatttt

SEQ ID NO: 400330 - DNA, 20 bp, Artificial
  CRISPR gRNA sequence
ctacttttcccaatttttac

SEQ ID NO: 400331 - DNA, 20 bp, Artificial
  CRISPR gRNA sequence
cttttcccaatttttactca

SEQ ID NO: 400332 - DNA, 20 bp, Artificial
  CRISPR gRNA sequence
ttcccaatttttactcatct

SEQ ID NO: 400333 - DNA, 20 bp, Artificial
  CRISPR gRNA sequence
tcccaatttttactcatctt

SEQ ID NO: 400334 - DNA, 20 bp, Artificial
  CRISPR gRNA sequence
cccaatttttactcatcttc

SEQ ID NO: 400335 - DNA, 20 bp, Artificial
  CRISPR gRNA sequence
ccaatttttactcatcttct

SEQ ID NO: 400336 - DNA, 20 bp, Artificial
  CRISPR gRNA sequence
ttactcatcttctattttga

SEQ ID NO: 400337 - DNA, 20 bp, Artificial
  CRISPR gRNA sequence
tactcatcttctattttgac

SEQ ID NO: 400338 - DNA, 20 bp, Artificial
  CRISPR gRNA sequence
actcatcttctattttgaca

SEQ ID NO: 400339 - DNA, 20 bp, Artificial
  CRISPR gRNA sequence
ctcatcttctattttgacag

SEQ ID NO: 400340 - DNA, 20 bp, Artificial
  CRISPR gRNA sequence
atcttctattttgacagtct

SEQ ID NO: 400341 - DNA, 20 bp, Artificial
  CRISPR gRNA sequence
ctattttgacagtcttacca

SEQ ID NO: 400342 - DNA, 20 bp, Artificial
  CRISPR gRNA sequence
tattttgacagtcttaccag

SEQ ID NO: 400343 - DNA, 20 bp, Artificial
  CRISPR gRNA sequence
ttttgacagtcttaccaggg

SEQ ID NO: 400344 - DNA, 20 bp, Artificial
  CRISPR gRNA sequence
tgacagtcttaccagggtca

SEQ ID NO: 400345 - DNA, 20 bp, Artificial
  CRISPR gRNA sequence
gacagtcttaccagggtcaa

SEQ ID NO: 400346 - DNA, 20 bp, Artificial
  CRISPR gRNA sequence
acagtcttaccagggtcaaa

SEQ ID NO: 400347 - DNA, 20 bp, Artificial
  CRISPR gRNA sequence
accagggtcaaatgcattta

SEQ ID NO: 400348 - DNA, 20 bp, Artificial
  CRISPR gRNA sequence
ccagggtcaaatgcatttat

SEQ ID NO: 400349 - DNA, 20 bp, Artificial
  CRISPR gRNA sequence
atacaattcctctttttgta

SEQ ID NO: 400350 - DNA, 20 bp, Artificial
  CRISPR gRNA sequence
tacaattcctctttttgtag

SEQ ID NO: 400351 - DNA, 20 bp, Artificial
  CRISPR gRNA sequence
ctctttttgtaggggtatac

SEQ ID NO: 400352 - DNA, 20 bp, Artificial
  CRISPR gRNA sequence
tttttgtaggggtatacttt

SEQ ID NO: 400353 - DNA, 20 bp, Artificial
  CRISPR gRNA sequence
tttgtaggggtatacttttt

SEQ ID NO: 400354 - DNA, 20 bp, Artificial
  CRISPR gRNA sequence
ttgtaggggtatacttttta

SEQ ID NO: 400355 - DNA, 20 bp, Artificial
  CRISPR gRNA sequence
tgtaggggtatactttttat

SEQ ID NO: 400356 - DNA, 20 bp, Artificial
  CRISPR gRNA sequence
gtaggggtatactttttata

SEQ ID NO: 400357 - DNA, 20 bp, Artificial
  CRISPR gRNA sequence
taggggtatactttttatac

SEQ ID NO: 400358 - DNA, 20 bp, Artificial
  CRISPR gRNA sequence
tttatactaacatgctgata

SEQ ID NO: 400359 - DNA, 20 bp, Artificial
  CRISPR gRNA sequence
ttatactaacatgctgatat

SEQ ID NO: 400360 - DNA, 20 bp, Artificial
  CRISPR gRNA sequence
tatactaacatgctgatatg

SEQ ID NO: 400361 - DNA, 20 bp, Artificial
  CRISPR gRNA sequence
atactaacatgctgatatgt

SEQ ID NO: 400362 - DNA, 20 bp, Artificial
  CRISPR gRNA sequence
tactaacatgctgatatgtt

SEQ ID NO: 400363 - DNA, 20 bp, Artificial
  CRISPR gRNA sequence
acatgctgatatgttcctaa

SEQ ID NO: 400364 - DNA, 20 bp, Artificial
  CRISPR gRNA sequence
atatgttcctaacaagttct

SEQ ID NO: 400365 - DNA, 20 bp, Artificial
  CRISPR gRNA sequence
ctaacaagttcttaagaatt

SEQ ID NO: 400366 - DNA, 20 bp, Artificial
  CRISPR gRNA sequence
acaagttcttaagaattgga

SEQ ID NO: 400367 - DNA, 20 bp, Artificial
  CRISPR gRNA sequence
ttaagaattggaacttgtac

SEQ ID NO: 400368 - DNA, 20 bp, Artificial
  CRISPR gRNA sequence
aagaattggaacttgtacct

SEQ ID NO: 400369 - DNA, 20 bp, Artificial
  CRISPR gRNA sequence
agaattggaacttgtaccta

SEQ ID NO: 400370 - DNA, 20 bp, Artificial
  CRISPR gRNA sequence
gaacttgtacctaacaagtt

SEQ ID NO: 400371 - DNA, 20 bp, Artificial
  CRISPR gRNA sequence
gtacctaacaagttcttaag

SEQ ID NO: 400372 - DNA, 20 bp, Artificial
  CRISPR gRNA sequence
tacctaacaagttcttaaga

SEQ ID NO: 400373 - DNA, 20 bp, Artificial
  CRISPR gRNA sequence
acaagttcttaagaattgga

SEQ ID NO: 400374 - DNA, 20 bp, Artificial
  CRISPR gRNA sequence
ttaagaattggaacttgtat

SEQ ID NO: 400375 - DNA, 20 bp, Artificial
  CRISPR gRNA sequence
aagaattggaacttgtattt

SEQ ID NO: 400376 - DNA, 20 bp, Artificial
  CRISPR gRNA sequence
agaattggaacttgtatttt

SEQ ID NO: 400377 - DNA, 20 bp, Artificial
  CRISPR gRNA sequence
gaacttgtattttataagag

SEQ ID NO: 400378 - DNA, 20 bp, Artificial
  CRISPR gRNA sequence
gtattttataagagaaagaa

SEQ ID NO: 400379 - DNA, 20 bp, Artificial
  CRISPR gRNA sequence
tattttataagagaaagaag

SEQ ID NO: 400380 - DNA, 20 bp, Artificial
  CRISPR gRNA sequence
tataagagaaagaagagagc

SEQ ID NO: 400381 - DNA, 20 bp, Artificial
  CRISPR gRNA sequence
ataagagaaagaagagagca

SEQ ID NO: 400382 - DNA, 20 bp, Artificial
  CRISPR gRNA sequence
taagagaaagaagagagcaa

SEQ ID NO: 400383 - DNA, 20 bp, Artificial
  CRISPR gRNA sequence
aaaaatgaatcctgttttga

SEQ ID NO: 400384 - DNA, 20 bp, Artificial
  CRISPR gRNA sequence
ttttgatattgtactataat

SEQ ID NO: 400385 - DNA, 20 bp, Artificial
  CRISPR gRNA sequence
tgatattgtactataattat

SEQ ID NO: 400386 - DNA, 20 bp, Artificial
  CRISPR gRNA sequence
gatattgtactataattatg

SEQ ID NO: 400387 - DNA, 20 bp, Artificial
  CRISPR gRNA sequence
atattgtactataattatgt

SEQ ID NO: 400388 - DNA, 20 bp, Artificial
  CRISPR gRNA sequence
tactataattatgtaagata

SEQ ID NO: 400389 - DNA, 20 bp, Artificial
  CRISPR gRNA sequence
taattatgtaagatatgacc

SEQ ID NO: 400390 - DNA, 20 bp, Artificial
  CRISPR gRNA sequence
tgtaagatatgacccctgac

SEQ ID NO: 400391 - DNA, 20 bp, Artificial
  CRISPR gRNA sequence
acagaacctggggacaggga

SEQ ID NO: 400392 - DNA, 20 bp, Artificial
  CRISPR gRNA sequence
gggacagggacctgtctgta

SEQ ID NO: 400393 - DNA, 20 bp, Artificial
  CRISPR gRNA sequence
tctgtactctctttgtgact

SEQ ID NO: 400394 - DNA, 20 bp, Artificial
  CRISPR gRNA sequence
tactctctttgtgacttact

SEQ ID NO: 400395 - DNA, 20 bp, Artificial
  CRISPR gRNA sequence
tctttgtgacttactgtgac

SEQ ID NO: 400396 - DNA, 20 bp, Artificial
  CRISPR gRNA sequence
tttgtgacttactgtgactc

SEQ ID NO: 400397 - DNA, 20 bp, Artificial
  CRISPR gRNA sequence
tgtgacttactgtgactcta

SEQ ID NO: 400398 - DNA, 20 bp, Artificial
  CRISPR gRNA sequence
gtgacttactgtgactctat

SEQ ID NO: 400399 - DNA, 20 bp, Artificial
  CRISPR gRNA sequence
tgacttactgtgactctata

SEQ ID NO: 400400 - DNA, 20 bp, Artificial
  CRISPR gRNA sequence
actgtgactctataattatt

SEQ ID NO: 400401 - DNA, 20 bp, Artificial
  CRISPR gRNA sequence
ctgtgactctataattattt

SEQ ID NO: 400402 - DNA, 20 bp, Artificial
  CRISPR gRNA sequence
tgactctataattatttcaa

SEQ ID NO: 400403 - DNA, 20 bp, Artificial
  CRISPR gRNA sequence
tataattatttcaaaatcag

SEQ ID NO: 400404 - DNA, 20 bp, Artificial
  CRISPR gRNA sequence
taattatttcaaaatcagaa

SEQ ID NO: 400405 - DNA, 20 bp, Artificial
  CRISPR gRNA sequence
tttcaaaatcagaagttaaa

SEQ ID NO: 400406 - DNA, 20 bp, Artificial
  CRISPR gRNA sequence
caaaatcagaagttaaatct

SEQ ID NO: 400407 - DNA, 20 bp, Artificial
  CRISPR gRNA sequence
aaaatcagaagttaaatctc

SEQ ID NO: 400408 - DNA, 20 bp, Artificial
  CRISPR gRNA sequence
aatctctcataatggtagat

SEQ ID NO: 400409 - DNA, 20 bp, Artificial
  CRISPR gRNA sequence
tcataatggtagatctgcat

SEQ ID NO: 400410 - DNA, 20 bp, Artificial
  CRISPR gRNA sequence
ataatggtagatctgcatat

SEQ ID NO: 400411 - DNA, 20 bp, Artificial
  CRISPR gRNA sequence
catatgccctgggccagcat

SEQ ID NO: 400412 - DNA, 20 bp, Artificial
  CRISPR gRNA sequence
ggccagcatacttttgtatc

SEQ ID NO: 400413 - DNA, 20 bp, Artificial
  CRISPR gRNA sequence
ttgtatctgatgggcttttg

SEQ ID NO: 400414 - DNA, 20 bp, Artificial
  CRISPR gRNA sequence
tgtatctgatgggcttttga

SEQ ID NO: 400415 - DNA, 20 bp, Artificial
  CRISPR gRNA sequence
gtatctgatgggcttttgat

SEQ ID NO: 400416 - DNA, 20 bp, Artificial
  CRISPR gRNA sequence
tatctgatgggcttttgatc

SEQ ID NO: 400417 - DNA, 20 bp, Artificial
  CRISPR gRNA sequence
atgggcttttgatctgtttt

SEQ ID NO: 400418 - DNA, 20 bp, Artificial
  CRISPR gRNA sequence
ttgatctgttttttggtcct

SEQ ID NO: 400419 - DNA, 20 bp, Artificial
  CRISPR gRNA sequence
tgatctgttttttggtcctc

SEQ ID NO: 400420 - DNA, 20 bp, Artificial
  CRISPR gRNA sequence
gatctgttttttggtcctca

SEQ ID NO: 400421 - DNA, 20 bp, Artificial
  CRISPR gRNA sequence
atctgttttttggtcctcat

SEQ ID NO: 400422 - DNA, 20 bp, Artificial
  CRISPR gRNA sequence
ttttttggtcctcatcaaag

SEQ ID NO: 400423 - DNA, 20 bp, Artificial
  CRISPR gRNA sequence
tttggtcctcatcaaagcaa

SEQ ID NO: 400424 - DNA, 20 bp, Artificial
  CRISPR gRNA sequence
ttggtcctcatcaaagcaaa

SEQ ID NO: 400425 - DNA, 20 bp, Artificial
  CRISPR gRNA sequence
tggtcctcatcaaagcaaat

SEQ ID NO: 400426 - DNA, 20 bp, Artificial
  CRISPR gRNA sequence
ggtcctcatcaaagcaaatg

SEQ ID NO: 400427 - DNA, 20 bp, Artificial
  CRISPR gRNA sequence
gtcctcatcaaagcaaatgt

SEQ ID NO: 400428 - DNA, 20 bp, Artificial
  CRISPR gRNA sequence
atcaaagcaaatgtctgaga

SEQ ID NO: 400429 - DNA, 20 bp, Artificial
  CRISPR gRNA sequence
agatcagcaaggaggaagag

SEQ ID NO: 400430 - DNA, 20 bp, Artificial
  CRISPR gRNA sequence
tcagcgctgggcgtaggctc

SEQ ID NO: 400431 - DNA, 20 bp, Artificial
  CRISPR gRNA sequence
ggcgtaggctccctccgccc

SEQ ID NO: 400432 - DNA, 20 bp, Artificial
  CRISPR gRNA sequence
cctccgcccacttcagcctc

SEQ ID NO: 400433 - DNA, 20 bp, Artificial
  CRISPR gRNA sequence
cgcccacttcagcctctgcc

SEQ ID NO: 400434 - DNA, 20 bp, Artificial
  CRISPR gRNA sequence
cagcctctgcctcatcttat

SEQ ID NO: 400435 - DNA, 20 bp, Artificial
  CRISPR gRNA sequence
agcctctgcctcatcttatg

SEQ ID NO: 400436 - DNA, 20 bp, Artificial
  CRISPR gRNA sequence
tgcctcatcttatgctctca

SEQ ID NO: 400437 - DNA, 20 bp, Artificial
  CRISPR gRNA sequence
cctcatcttatgctctcagt

SEQ ID NO: 400438 - DNA, 20 bp, Artificial
  CRISPR gRNA sequence
atcttatgctctcagtgagg

SEQ ID NO: 400439 - DNA, 20 bp, Artificial
  CRISPR gRNA sequence
atgctctcagtgaggacttc

SEQ ID NO: 400440 - DNA, 20 bp, Artificial
  CRISPR gRNA sequence
tgctctcagtgaggacttct

SEQ ID NO: 400441 - DNA, 20 bp, Artificial
  CRISPR gRNA sequence
tcagtgaggacttctctgct

SEQ ID NO: 400442 - DNA, 20 bp, Artificial
  CRISPR gRNA sequence
agtgaggacttctctgctcc

SEQ ID NO: 400443 - DNA, 20 bp, Artificial
  CRISPR gRNA sequence
ctctgctccatgcatgcacc

SEQ ID NO: 400444 - DNA, 20 bp, Artificial
  CRISPR gRNA sequence
tctgctccatgcatgcacca

SEQ ID NO: 400445 - DNA, 20 bp, Artificial
  CRISPR gRNA sequence
tgctccatgcatgcaccacc

SEQ ID NO: 400446 - DNA, 20 bp, Artificial
  CRISPR gRNA sequence
ctccatgcatgcaccacctt

SEQ ID NO: 400447 - DNA, 20 bp, Artificial
  CRISPR gRNA sequence
catgcatgcaccacctttca

SEQ ID NO: 400448 - DNA, 20 bp, Artificial
  CRISPR gRNA sequence
tcacttattatttatatttt

SEQ ID NO: 400449 - DNA, 20 bp, Artificial
  CRISPR gRNA sequence
cacttattatttatattttt

SEQ ID NO: 400450 - DNA, 20 bp, Artificial
  CRISPR gRNA sequence
acttattatttatattttta

SEQ ID NO: 400451 - DNA, 20 bp, Artificial
  CRISPR gRNA sequence
attatttatatttttacatc

SEQ ID NO: 400452 - DNA, 20 bp, Artificial
  CRISPR gRNA sequence
ttatttatatttttacatct

SEQ ID NO: 400453 - DNA, 20 bp, Artificial
  CRISPR gRNA sequence
tttatatttttacatcttta

SEQ ID NO: 400454 - DNA, 20 bp, Artificial
  CRISPR gRNA sequence
atatttttacatctttattt

SEQ ID NO: 400455 - DNA, 20 bp, Artificial
  CRISPR gRNA sequence
tatttttacatctttatttt

SEQ ID NO: 400456 - DNA, 20 bp, Artificial
  CRISPR gRNA sequence
ttacatctttattttagttt

SEQ ID NO: 400457 - DNA, 20 bp, Artificial
  CRISPR gRNA sequence
tacatctttattttagtttc

SEQ ID NO: 400458 - DNA, 20 bp, Artificial
  CRISPR gRNA sequence
acatctttattttagtttct

SEQ ID NO: 400459 - DNA, 20 bp, Artificial
  CRISPR gRNA sequence
catctttattttagtttctg

SEQ ID NO: 400460 - DNA, 20 bp, Artificial
  CRISPR gRNA sequence
tattttagtttctgcctcct

SEQ ID NO: 400461 - DNA, 20 bp, Artificial
  CRISPR gRNA sequence
attttagtttctgcctcctc

SEQ ID NO: 400462 - DNA, 20 bp, Artificial
  CRISPR gRNA sequence
ttttagtttctgcctcctcc

SEQ ID NO: 400463 - DNA, 20 bp, Artificial
  CRISPR gRNA sequence
tagtttctgcctcctccaca

SEQ ID NO: 400464 - DNA, 20 bp, Artificial
  CRISPR gRNA sequence
agtttctgcctcctccacat

SEQ ID NO: 400465 - DNA, 20 bp, Artificial
  CRISPR gRNA sequence
gtttctgcctcctccacata

SEQ ID NO: 400466 - DNA, 20 bp, Artificial
  CRISPR gRNA sequence
ctgcctcctccacatagaat

SEQ ID NO: 400467 - DNA, 20 bp, Artificial
  CRISPR gRNA sequence
tgcctcctccacatagaatg

SEQ ID NO: 400468 - DNA, 20 bp, Artificial
  CRISPR gRNA sequence
cctcctccacatagaatgta

SEQ ID NO: 400469 - DNA, 20 bp, Artificial
  CRISPR gRNA sequence
ctccacatagaatgtaagtt

SEQ ID NO: 400470 - DNA, 20 bp, Artificial
  CRISPR gRNA sequence
cacatagaatgtaagttcta

SEQ ID NO: 400471 - DNA, 20 bp, Artificial
  CRISPR gRNA sequence
tatcatggcaatattttttt

SEQ ID NO: 400472 - DNA, 20 bp, Artificial
  CRISPR gRNA sequence
tcatggcaatattttttttt

SEQ ID NO: 400473 - DNA, 20 bp, Artificial
  CRISPR gRNA sequence
ttttttttttgtattattgt

SEQ ID NO: 400474 - DNA, 20 bp, Artificial
  CRISPR gRNA sequence
tttttttttgtattattgta

SEQ ID NO: 400475 - DNA, 20 bp, Artificial
  CRISPR gRNA sequence
ttttttttgtattattgtat

SEQ ID NO: 400476 - DNA, 20 bp, Artificial
  CRISPR gRNA sequence
tttttttgtattattgtatc

SEQ ID NO: 400477 - DNA, 20 bp, Artificial
  CRISPR gRNA sequence
ttttttgtattattgtatcc

SEQ ID NO: 400478 - DNA, 20 bp, Artificial
  CRISPR gRNA sequence
tttttgtattattgtatcct

SEQ ID NO: 400479 - DNA, 20 bp, Artificial
  CRISPR gRNA sequence
ttttgtattattgtatcctc

SEQ ID NO: 400480 - DNA, 20 bp, Artificial
  CRISPR gRNA sequence
tttgtattattgtatcctca

SEQ ID NO: 400481 - DNA, 20 bp, Artificial
  CRISPR gRNA sequence
ttgtattattgtatcctcat

SEQ ID NO: 400482 - DNA, 20 bp, Artificial
  CRISPR gRNA sequence
tgtattattgtatcctcatt

SEQ ID NO: 400483 - DNA, 20 bp, Artificial
  CRISPR gRNA sequence
gtattattgtatcctcattg

SEQ ID NO: 400484 - DNA, 20 bp, Artificial
  CRISPR gRNA sequence
tattattgtatcctcattgc

SEQ ID NO: 400485 - DNA, 20 bp, Artificial
  CRISPR gRNA sequence
ttgtatcctcattgcctaca

SEQ ID NO: 400486 - DNA, 20 bp, Artificial
  CRISPR gRNA sequence
tatcctcattgcctacagct

SEQ ID NO: 400487 - DNA, 20 bp, Artificial
  CRISPR gRNA sequence
attgcctacagctgagttag

SEQ ID NO: 400488 - DNA, 20 bp, Artificial
  CRISPR gRNA sequence
cctacagctgagttaggcac

SEQ ID NO: 400489 - DNA, 20 bp, Artificial
  CRISPR gRNA sequence
cagctgagttaggcacagag

SEQ ID NO: 400490 - DNA, 20 bp, Artificial
  CRISPR gRNA sequence
agttaggcacagagaatgca

SEQ ID NO: 400491 - DNA, 20 bp, Artificial
  CRISPR gRNA sequence
ggcacagagaatgcatgcag

SEQ ID NO: 400492 - DNA, 20 bp, Artificial
  CRISPR gRNA sequence
gttgaatgaatgactccttg

SEQ ID NO: 400493 - DNA, 20 bp, Artificial
  CRISPR gRNA sequence
ttgaatgaatgactccttgt

SEQ ID NO: 400494 - DNA, 20 bp, Artificial
  CRISPR gRNA sequence
aatgaatgactccttgtaga

SEQ ID NO: 400495 - DNA, 20 bp, Artificial
  CRISPR gRNA sequence
cttgtagaaaatgaaagccc

SEQ ID NO: 400496 - DNA, 20 bp, Artificial
  CRISPR gRNA sequence
gtagaaaatgaaagcccgaa

SEQ ID NO: 400497 - DNA, 20 bp, Artificial
  CRISPR gRNA sequence
tagaaaatgaaagcccgaaa

SEQ ID NO: 400498 - DNA, 20 bp, Artificial
  CRISPR gRNA sequence
gttccccgagagagaagaaa

SEQ ID NO: 400499 - DNA, 20 bp, Artificial
  CRISPR gRNA sequence
cccgagagagaagaaactca

SEQ ID NO: 400500 - DNA, 20 bp, Artificial
  CRISPR gRNA sequence
aaatctgcccatcctcataa

SEQ ID NO: 400501 - DNA, 20 bp, Artificial
  CRISPR gRNA sequence
cccatcctcataaaggagca

SEQ ID NO: 400502 - DNA, 20 bp, Artificial
  CRISPR gRNA sequence
ataaaggagcaaacctgtct

SEQ ID NO: 400503 - DNA, 20 bp, Artificial
  CRISPR gRNA sequence
tcttttaagctaaggccttt

SEQ ID NO: 400504 - DNA, 20 bp, Artificial
  CRISPR gRNA sequence
ttaagctaaggcctttttcc

SEQ ID NO: 400505 - DNA, 20 bp, Artificial
  CRISPR gRNA sequence
taagctaaggcctttttcct

SEQ ID NO: 400506 - DNA, 20 bp, Artificial
  CRISPR gRNA sequence
aagctaaggcctttttcctg

SEQ ID NO: 400507 - DNA, 20 bp, Artificial
  CRISPR gRNA sequence
agctaaggcctttttcctgt

SEQ ID NO: 400508 - DNA, 20 bp, Artificial
  CRISPR gRNA sequence
aggcctttttcctgtgttca

SEQ ID NO: 400509 - DNA, 20 bp, Artificial
  CRISPR gRNA sequence
tttcctgtgttcatacttca

SEQ ID NO: 400510 - DNA, 20 bp, Artificial
  CRISPR gRNA sequence
ttcctgtgttcatacttcag

SEQ ID NO: 400511 - DNA, 20 bp, Artificial
  CRISPR gRNA sequence
tcctgtgttcatacttcaga

SEQ ID NO: 400512 - DNA, 20 bp, Artificial
  CRISPR gRNA sequence
cctgtgttcatacttcagaa

SEQ ID NO: 400513 - DNA, 20 bp, Artificial
  CRISPR gRNA sequence
ctgtgttcatacttcagaaa

SEQ ID NO: 400514 - DNA, 20 bp, Artificial
  CRISPR gRNA sequence
tgttcatacttcagaaaaag

SEQ ID NO: 400515 - DNA, 20 bp, Artificial
  CRISPR gRNA sequence
atacttcagaaaaagaagac

SEQ ID NO: 400516 - DNA, 20 bp, Artificial
  CRISPR gRNA sequence
cagaaaaagaagacacgact

SEQ ID NO: 400517 - DNA, 20 bp, Artificial
  CRISPR gRNA sequence
agaaaaagaagacacgactg

SEQ ID NO: 400518 - DNA, 20 bp, Artificial
  CRISPR gRNA sequence
ataacatctgagaggaagga

SEQ ID NO: 400519 - DNA, 20 bp, Artificial
  CRISPR gRNA sequence
agaggaaggaaactgcattg

SEQ ID NO: 400520 - DNA, 20 bp, Artificial
  CRISPR gRNA sequence
cattgtgctggggatctgca

SEQ ID NO: 400521 - DNA, 20 bp, Artificial
  CRISPR gRNA sequence
tgctggggatctgcatgtca

SEQ ID NO: 400522 - DNA, 20 bp, Artificial
  CRISPR gRNA sequence
gggatctgcatgtcacatta

SEQ ID NO: 400523 - DNA, 20 bp, Artificial
  CRISPR gRNA sequence
catgtcacattataaaaagc

SEQ ID NO: 400524 - DNA, 20 bp, Artificial
  CRISPR gRNA sequence
taaaaagcaatttttttttt

SEQ ID NO: 400525 - DNA, 20 bp, Artificial
  CRISPR gRNA sequence
ttttttttaatagaaccagc

SEQ ID NO: 400526 - DNA, 20 bp, Artificial
  CRISPR gRNA sequence
tttttttaatagaaccagcc

SEQ ID NO: 400527 - DNA, 20 bp, Artificial
  CRISPR gRNA sequence
ttttttaatagaaccagcct

SEQ ID NO: 400528 - DNA, 20 bp, Artificial
  CRISPR gRNA sequence
tttttaatagaaccagcctt

SEQ ID NO: 400529 - DNA, 20 bp, Artificial
  CRISPR gRNA sequence
ttttaatagaaccagccttt

SEQ ID NO: 400530 - DNA, 20 bp, Artificial
  CRISPR gRNA sequence
tttaatagaaccagcctttc

SEQ ID NO: 400531 - DNA, 20 bp, Artificial
  CRISPR gRNA sequence
ttaatagaaccagcctttca

SEQ ID NO: 400532 - DNA, 20 bp, Artificial
  CRISPR gRNA sequence
taatagaaccagcctttcaa

SEQ ID NO: 400533 - DNA, 20 bp, Artificial
  CRISPR gRNA sequence
aatagaaccagcctttcaaa

SEQ ID NO: 400534 - DNA, 20 bp, Artificial
  CRISPR gRNA sequence
atagaaccagcctttcaaac

SEQ ID NO: 400535 - DNA, 20 bp, Artificial
  CRISPR gRNA sequence
tcaaacagtttccagagatg

SEQ ID NO: 400536 - DNA, 20 bp, Artificial
  CRISPR gRNA sequence
caaacagtttccagagatgg

SEQ ID NO: 400537 - DNA, 20 bp, Artificial
  CRISPR gRNA sequence
aaacagtttccagagatgga

SEQ ID NO: 400538 - DNA, 20 bp, Artificial
  CRISPR gRNA sequence
ccagagatggattatcctac

SEQ ID NO: 400539 - DNA, 20 bp, Artificial
  CRISPR gRNA sequence
cagagatggattatcctact

SEQ ID NO: 400540 - DNA, 20 bp, Artificial
  CRISPR gRNA sequence
tcctactttacttttggctc

SEQ ID NO: 400541 - DNA, 20 bp, Artificial
  CRISPR gRNA sequence
ctttacttttggctcttctt

SEQ ID NO: 400542 - DNA, 20 bp, Artificial
  CRISPR gRNA sequence
tacttttggctcttcttcat

SEQ ID NO: 400543 - DNA, 20 bp, Artificial
  CRISPR gRNA sequence
acttttggctcttcttcatg

SEQ ID NO: 400544 - DNA, 20 bp, Artificial
  CRISPR gRNA sequence
cttttggctcttcttcatgt

SEQ ID NO: 400545 - DNA, 20 bp, Artificial
  CRISPR gRNA sequence
ttggctcttcttcatgtata

SEQ ID NO: 400546 - DNA, 20 bp, Artificial
  CRISPR gRNA sequence
tggctcttcttcatgtatac

SEQ ID NO: 400547 - DNA, 20 bp, Artificial
  CRISPR gRNA sequence
ggctcttcttcatgtataca

SEQ ID NO: 400548 - DNA, 20 bp, Artificial
  CRISPR gRNA sequence
gctcttcttcatgtatacag

SEQ ID NO: 400549 - DNA, 20 bp, Artificial
  CRISPR gRNA sequence
ttcttcatgtatacagaggt

SEQ ID NO: 400550 - DNA, 20 bp, Artificial
  CRISPR gRNA sequence
cttcatgtatacagaggtaa

SEQ ID NO: 400551 - DNA, 20 bp, Artificial
  CRISPR gRNA sequence
ttcatgtatacagaggtaaa

SEQ ID NO: 400552 - DNA, 20 bp, Artificial
  CRISPR gRNA sequence
catgtatacagaggtaaaga

SEQ ID NO: 400553 - DNA, 20 bp, Artificial
  CRISPR gRNA sequence
atgtatacagaggtaaagat

SEQ ID NO: 400554 - DNA, 20 bp, Artificial
  CRISPR gRNA sequence
tatattttcatttaaaagtt

SEQ ID NO: 400555 - DNA, 20 bp, Artificial
  CRISPR gRNA sequence
atattttcatttaaaagttt

SEQ ID NO: 400556 - DNA, 20 bp, Artificial
  CRISPR gRNA sequence
tattttcatttaaaagtttt

SEQ ID NO: 400557 - DNA, 20 bp, Artificial
  CRISPR gRNA sequence
tcatttaaaagttttgctcc

SEQ ID NO: 400558 - DNA, 20 bp, Artificial
  CRISPR gRNA sequence
catttaaaagttttgctcct

SEQ ID NO: 400559 - DNA, 20 bp, Artificial
  CRISPR gRNA sequence
atttaaaagttttgctcctg

SEQ ID NO: 400560 - DNA, 20 bp, Artificial
  CRISPR gRNA sequence
aaaagttttgctcctgtttt

SEQ ID NO: 400561 - DNA, 20 bp, Artificial
  CRISPR gRNA sequence
aaagttttgctcctgttttt

SEQ ID NO: 400562 - DNA, 20 bp, Artificial
  CRISPR gRNA sequence
tgctcctgtttttgtttgta

SEQ ID NO: 400563 - DNA, 20 bp, Artificial
  CRISPR gRNA sequence
gctcctgtttttgtttgtac

SEQ ID NO: 400564 - DNA, 20 bp, Artificial
  CRISPR gRNA sequence
ctcctgtttttgtttgtaca

SEQ ID NO: 400565 - DNA, 20 bp, Artificial
  CRISPR gRNA sequence
ctgtttttgtttgtacagtg

SEQ ID NO: 400566 - DNA, 20 bp, Artificial
  CRISPR gRNA sequence
tttttgtttgtacagtgtgg

SEQ ID NO: 400567 - DNA, 20 bp, Artificial
  CRISPR gRNA sequence
ttgtttgtacagtgtggcat

SEQ ID NO: 400568 - DNA, 20 bp, Artificial
  CRISPR gRNA sequence
tgtttgtacagtgtggcata

SEQ ID NO: 400569 - DNA, 20 bp, Artificial
  CRISPR gRNA sequence
gtttgtacagtgtggcatat

SEQ ID NO: 400570 - DNA, 20 bp, Artificial
  CRISPR gRNA sequence
tttgtacagtgtggcatatt

SEQ ID NO: 400571 - DNA, 20 bp, Artificial
  CRISPR gRNA sequence
gtacagtgtggcatattcag

SEQ ID NO: 400572 - DNA, 20 bp, Artificial
  CRISPR gRNA sequence
tacagtgtggcatattcaga

SEQ ID NO: 400573 - DNA, 20 bp, Artificial
  CRISPR gRNA sequence
agaatttacagtgctcttta

SEQ ID NO: 400574 - DNA, 20 bp, Artificial
  CRISPR gRNA sequence
acagtgctctttagttggct

SEQ ID NO: 400575 - DNA, 20 bp, Artificial
  CRISPR gRNA sequence
cagtgctctttagttggcta

SEQ ID NO: 400576 - DNA, 20 bp, Artificial
  CRISPR gRNA sequence
tttagttggctaggataatt

SEQ ID NO: 400577 - DNA, 20 bp, Artificial
  CRISPR gRNA sequence
tagttggctaggataatttc

SEQ ID NO: 400578 - DNA, 20 bp, Artificial
  CRISPR gRNA sequence
agttggctaggataatttct

SEQ ID NO: 400579 - DNA, 20 bp, Artificial
  CRISPR gRNA sequence
gttggctaggataatttctc

SEQ ID NO: 400580 - DNA, 20 bp, Artificial
  CRISPR gRNA sequence
gctaggataatttctcactt

SEQ ID NO: 400581 - DNA, 20 bp, Artificial
  CRISPR gRNA sequence
ggataatttctcacttgttc

SEQ ID NO: 400582 - DNA, 20 bp, Artificial
  CRISPR gRNA sequence
ctcacttgttcagaaaaact

SEQ ID NO: 400583 - DNA, 20 bp, Artificial
  CRISPR gRNA sequence
tcacttgttcagaaaaacta

SEQ ID NO: 400584 - DNA, 20 bp, Artificial
  CRISPR gRNA sequence
acttgttcagaaaaactaaa

SEQ ID NO: 400585 - DNA, 20 bp, Artificial
  CRISPR gRNA sequence
gttcagaaaaactaaaagtt

SEQ ID NO: 400586 - DNA, 20 bp, Artificial
  CRISPR gRNA sequence
ttcagaaaaactaaaagtta

SEQ ID NO: 400587 - DNA, 20 bp, Artificial
  CRISPR gRNA sequence
agaaaaactaaaagttacat

SEQ ID NO: 400588 - DNA, 20 bp, Artificial
  CRISPR gRNA sequence
aaagttacattttccaatta

SEQ ID NO: 400589 - DNA, 20 bp, Artificial
  CRISPR gRNA sequence
cattttccaattatcagcag

SEQ ID NO: 400590 - DNA, 20 bp, Artificial
  CRISPR gRNA sequence
tccaattatcagcaggacgc

SEQ ID NO: 400591 - DNA, 20 bp, Artificial
  CRISPR gRNA sequence
ccaattatcagcaggacgcc

SEQ ID NO: 400592 - DNA, 20 bp, Artificial
  CRISPR gRNA sequence
caattatcagcaggacgcct

SEQ ID NO: 400593 - DNA, 20 bp, Artificial
  CRISPR gRNA sequence
tcagcaggacgcctttttag

SEQ ID NO: 400594 - DNA, 20 bp, Artificial
  CRISPR gRNA sequence
tttagacaaaggcagaaact

SEQ ID NO: 400595 - DNA, 20 bp, Artificial
  CRISPR gRNA sequence
ttagacaaaggcagaaactg

SEQ ID NO: 400596 - DNA, 20 bp, Artificial
  CRISPR gRNA sequence
tagacaaaggcagaaactgt

SEQ ID NO: 400597 - DNA, 20 bp, Artificial
  CRISPR gRNA sequence
agacaaaggcagaaactgtc

SEQ ID NO: 400598 - DNA, 20 bp, Artificial
  CRISPR gRNA sequence
gacaaaggcagaaactgtca

SEQ ID NO: 400599 - DNA, 20 bp, Artificial
  CRISPR gRNA sequence
tcagcctttactgtgatctc

SEQ ID NO: 400600 - DNA, 20 bp, Artificial
  CRISPR gRNA sequence
tactgtgatctcaatgcact

SEQ ID NO: 400601 - DNA, 20 bp, Artificial
  CRISPR gRNA sequence
actgtgatctcaatgcacta

SEQ ID NO: 400602 - DNA, 20 bp, Artificial
  CRISPR gRNA sequence
ctgtgatctcaatgcactag

SEQ ID NO: 400603 - DNA, 20 bp, Artificial
  CRISPR gRNA sequence
tgatctcaatgcactaggtc

SEQ ID NO: 400604 - DNA, 20 bp, Artificial
  CRISPR gRNA sequence
aatgcactaggtcttcaaaa

SEQ ID NO: 400605 - DNA, 20 bp, Artificial
  CRISPR gRNA sequence
ggtcttcaaaagcttaagat

SEQ ID NO: 400606 - DNA, 20 bp, Artificial
  CRISPR gRNA sequence
caaaagcttaagatattgat

SEQ ID NO: 400607 - DNA, 20 bp, Artificial
  CRISPR gRNA sequence
aaaagcttaagatattgatt

SEQ ID NO: 400608 - DNA, 20 bp, Artificial
  CRISPR gRNA sequence
aagatattgatttggtgttt

SEQ ID NO: 400609 - DNA, 20 bp, Artificial
  CRISPR gRNA sequence
agatattgatttggtgtttc

SEQ ID NO: 400610 - DNA, 20 bp, Artificial
  CRISPR gRNA sequence
atttggtgtttccatcatca

SEQ ID NO: 400611 - DNA, 20 bp, Artificial
  CRISPR gRNA sequence
ggtgtttccatcatcaaggc

SEQ ID NO: 400612 - DNA, 20 bp, Artificial
  CRISPR gRNA sequence
gtgtttccatcatcaaggct

SEQ ID NO: 400613 - DNA, 20 bp, Artificial
  CRISPR gRNA sequence
ccatcatcaaggctaacaat

SEQ ID NO: 400614 - DNA, 20 bp, Artificial
  CRISPR gRNA sequence
catcatcaaggctaacaatt

SEQ ID NO: 400615 - DNA, 20 bp, Artificial
  CRISPR gRNA sequence
acaattaatgtgatgttgta

SEQ ID NO: 400616 - DNA, 20 bp, Artificial
  CRISPR gRNA sequence
atgtgatgttgtatatttca

SEQ ID NO: 400617 - DNA, 20 bp, Artificial
  CRISPR gRNA sequence
tatatttcagctctatgtga

SEQ ID NO: 400618 - DNA, 20 bp, Artificial
  CRISPR gRNA sequence
cagctctatgtgaagaggtg

SEQ ID NO: 400619 - DNA, 20 bp, Artificial
  CRISPR gRNA sequence
agctctatgtgaagaggtgc

SEQ ID NO: 400620 - DNA, 20 bp, Artificial
  CRISPR gRNA sequence
tatgtgaagaggtgctttgg

SEQ ID NO: 400621 - DNA, 20 bp, Artificial
  CRISPR gRNA sequence
tgtgaagaggtgctttggca

SEQ ID NO: 400622 - DNA, 20 bp, Artificial
  CRISPR gRNA sequence
tggcatacatcagttccctt

SEQ ID NO: 400623 - DNA, 20 bp, Artificial
  CRISPR gRNA sequence
ggcatacatcagttcccttt

SEQ ID NO: 400624 - DNA, 20 bp, Artificial
  CRISPR gRNA sequence
gcatacatcagttccctttg

SEQ ID NO: 400625 - DNA, 20 bp, Artificial
  CRISPR gRNA sequence
cctttgccgagaacatgtct

SEQ ID NO: 400626 - DNA, 20 bp, Artificial
  CRISPR gRNA sequence
tgccgagaacatgtctctag

SEQ ID NO: 400627 - DNA, 20 bp, Artificial
  CRISPR gRNA sequence
gccgagaacatgtctctaga

SEQ ID NO: 400628 - DNA, 20 bp, Artificial
  CRISPR gRNA sequence
ccgagaacatgtctctagaa

SEQ ID NO: 400629 - DNA, 20 bp, Artificial
  CRISPR gRNA sequence
tagaatgtgtgtatccatca

SEQ ID NO: 400630 - DNA, 20 bp, Artificial
  CRISPR gRNA sequence
gaatgtgtgtatccatcaat

SEQ ID NO: 400631 - DNA, 20 bp, Artificial
  CRISPR gRNA sequence
aacacaggtggagtggttca

SEQ ID NO: 400632 - DNA, 20 bp, Artificial
  CRISPR gRNA sequence
acacaggtggagtggttcaa

SEQ ID NO: 400633 - DNA, 20 bp, Artificial
  CRISPR gRNA sequence
aagatcgggacccagcagga

SEQ ID NO: 400634 - DNA, 20 bp, Artificial
  CRISPR gRNA sequence
catagccattttcagcccta

SEQ ID NO: 400635 - DNA, 20 bp, Artificial
  CRISPR gRNA sequence
tcagccctactcatggcatg

SEQ ID NO: 400636 - DNA, 20 bp, Artificial
  CRISPR gRNA sequence
cagccctactcatggcatgg

SEQ ID NO: 400637 - DNA, 20 bp, Artificial
  CRISPR gRNA sequence
agccctactcatggcatggt

SEQ ID NO: 400638 - DNA, 20 bp, Artificial
  CRISPR gRNA sequence
ctcatggcatggtcataagg

SEQ ID NO: 400639 - DNA, 20 bp, Artificial
  CRISPR gRNA sequence
atggcatggtcataaggaag

SEQ ID NO: 400640 - DNA, 20 bp, Artificial
  CRISPR gRNA sequence
tgctgagagggtttactttt

SEQ ID NO: 400641 - DNA, 20 bp, Artificial
  CRISPR gRNA sequence
agagggtttactttttgaat

SEQ ID NO: 400642 - DNA, 20 bp, Artificial
  CRISPR gRNA sequence
actttttgaattcaacgatg

SEQ ID NO: 400643 - DNA, 20 bp, Artificial
  CRISPR gRNA sequence
ctttttgaattcaacgatgg

SEQ ID NO: 400644 - DNA, 20 bp, Artificial
  CRISPR gRNA sequence
tttgaattcaacgatggctt

SEQ ID NO: 400645 - DNA, 20 bp, Artificial
  CRISPR gRNA sequence
ttgaattcaacgatggcttc

SEQ ID NO: 400646 - DNA, 20 bp, Artificial
  CRISPR gRNA sequence
tgaattcaacgatggcttcc

SEQ ID NO: 400647 - DNA, 20 bp, Artificial
  CRISPR gRNA sequence
gaattcaacgatggcttcca

SEQ ID NO: 400648 - DNA, 20 bp, Artificial
  CRISPR gRNA sequence
aattcaacgatggcttccaa

SEQ ID NO: 400649 - DNA, 20 bp, Artificial
  CRISPR gRNA sequence
aacgatggcttccaataaca

SEQ ID NO: 400650 - DNA, 20 bp, Artificial
  CRISPR gRNA sequence
ccaataacatgactcttttc

SEQ ID NO: 400651 - DNA, 20 bp, Artificial
  CRISPR gRNA sequence
caataacatgactcttttct

SEQ ID NO: 400652 - DNA, 20 bp, Artificial
  CRISPR gRNA sequence
ttttctttcggaatgcctct

SEQ ID NO: 400653 - DNA, 20 bp, Artificial
  CRISPR gRNA sequence
ttctttcggaatgcctctga

SEQ ID NO: 400654 - DNA, 20 bp, Artificial
  CRISPR gRNA sequence
tctttcggaatgcctctgaa

SEQ ID NO: 400655 - DNA, 20 bp, Artificial
  CRISPR gRNA sequence
ctttcggaatgcctctgaag

SEQ ID NO: 400656 - DNA, 20 bp, Artificial
  CRISPR gRNA sequence
tttcggaatgcctctgaaga

SEQ ID NO: 400657 - DNA, 20 bp, Artificial
  CRISPR gRNA sequence
tcggaatgcctctgaagatg

SEQ ID NO: 400658 - DNA, 20 bp, Artificial
  CRISPR gRNA sequence
cggaatgcctctgaagatga

SEQ ID NO: 400659 - DNA, 20 bp, Artificial
  CRISPR gRNA sequence
ggaatgcctctgaagatgat

SEQ ID NO: 400660 - DNA, 20 bp, Artificial
  CRISPR gRNA sequence
tgaagatgatgttggctact

SEQ ID NO: 400661 - DNA, 20 bp, Artificial
  CRISPR gRNA sequence
aagatgatgttggctactat

SEQ ID NO: 400662 - DNA, 20 bp, Artificial
  CRISPR gRNA sequence
gctactattcctgctctctt

SEQ ID NO: 400663 - DNA, 20 bp, Artificial
  CRISPR gRNA sequence
ctattcctgctctctttaca

SEQ ID NO: 400664 - DNA, 20 bp, Artificial
  CRISPR gRNA sequence
ttcctgctctctttacactt

SEQ ID NO: 400665 - DNA, 20 bp, Artificial
  CRISPR gRNA sequence
ctgctctctttacacttacc

SEQ ID NO: 400666 - DNA, 20 bp, Artificial
  CRISPR gRNA sequence
ctctctttacacttacccac

SEQ ID NO: 400667 - DNA, 20 bp, Artificial
  CRISPR gRNA sequence
tctttacacttacccacagg

SEQ ID NO: 400668 - DNA, 20 bp, Artificial
  CRISPR gRNA sequence
tttacacttacccacaggga

SEQ ID NO: 400669 - DNA, 20 bp, Artificial
  CRISPR gRNA sequence
tacacttacccacagggaac

SEQ ID NO: 400670 - DNA, 20 bp, Artificial
  CRISPR gRNA sequence
acacttacccacagggaact

SEQ ID NO: 400671 - DNA, 20 bp, Artificial
  CRISPR gRNA sequence
cacttacccacagggaactt

SEQ ID NO: 400672 - DNA, 20 bp, Artificial
  CRISPR gRNA sequence
acccacagggaacttggcag

SEQ ID NO: 400673 - DNA, 20 bp, Artificial
  CRISPR gRNA sequence
cccacagggaacttggcaga

SEQ ID NO: 400674 - DNA, 20 bp, Artificial
  CRISPR gRNA sequence
ggcagaaggtgatacaggtg

SEQ ID NO: 400675 - DNA, 20 bp, Artificial
  CRISPR gRNA sequence
gcagaaggtgatacaggtgg

SEQ ID NO: 400676 - DNA, 20 bp, Artificial
  CRISPR gRNA sequence
agtcaggtaagggcaagttt

SEQ ID NO: 400677 - DNA, 20 bp, Artificial
  CRISPR gRNA sequence
tttttttttttaaatccctt

SEQ ID NO: 400678 - DNA, 20 bp, Artificial
  CRISPR gRNA sequence
ttttttttttaaatcccttt

SEQ ID NO: 400679 - DNA, 20 bp, Artificial
  CRISPR gRNA sequence
tttttttttaaatccctttt

SEQ ID NO: 400680 - DNA, 20 bp, Artificial
  CRISPR gRNA sequence
ttttttttaaatcccttttt

SEQ ID NO: 400681 - DNA, 20 bp, Artificial
  CRISPR gRNA sequence
tttttttaaatcccttttta

SEQ ID NO: 400682 - DNA, 20 bp, Artificial
  CRISPR gRNA sequence
ttttttaaatccctttttat

SEQ ID NO: 400683 - DNA, 20 bp, Artificial
  CRISPR gRNA sequence
tttttaaatccctttttatc

SEQ ID NO: 400684 - DNA, 20 bp, Artificial
  CRISPR gRNA sequence
ttttaaatccctttttatcc

SEQ ID NO: 400685 - DNA, 20 bp, Artificial
  CRISPR gRNA sequence
tttaaatccctttttatcca

SEQ ID NO: 400686 - DNA, 20 bp, Artificial
  CRISPR gRNA sequence
ttaaatccctttttatccac

SEQ ID NO: 400687 - DNA, 20 bp, Artificial
  CRISPR gRNA sequence
taaatccctttttatccact

SEQ ID NO: 400688 - DNA, 20 bp, Artificial
  CRISPR gRNA sequence
aaatccctttttatccactt

SEQ ID NO: 400689 - DNA, 20 bp, Artificial
  CRISPR gRNA sequence
aatccctttttatccactta

SEQ ID NO: 400690 - DNA, 20 bp, Artificial
  CRISPR gRNA sequence
tttatccacttacaacattt

SEQ ID NO: 400691 - DNA, 20 bp, Artificial
  CRISPR gRNA sequence
ttatccacttacaacattta

SEQ ID NO: 400692 - DNA, 20 bp, Artificial
  CRISPR gRNA sequence
tatccacttacaacatttat

SEQ ID NO: 400693 - DNA, 20 bp, Artificial
  CRISPR gRNA sequence
atccacttacaacatttatt

SEQ ID NO: 400694 - DNA, 20 bp, Artificial
  CRISPR gRNA sequence
tccacttacaacatttattt

SEQ ID NO: 400695 - DNA, 20 bp, Artificial
  CRISPR gRNA sequence
acaacatttatttctataaa

SEQ ID NO: 400696 - DNA, 20 bp, Artificial
  CRISPR gRNA sequence
caacatttatttctataaag

SEQ ID NO: 400697 - DNA, 20 bp, Artificial
  CRISPR gRNA sequence
atttctataaagcccaagta

SEQ ID NO: 400698 - DNA, 20 bp, Artificial
  CRISPR gRNA sequence
tttctataaagcccaagtag

SEQ ID NO: 400699 - DNA, 20 bp, Artificial
  CRISPR gRNA sequence
ctataaagcccaagtagaag

SEQ ID NO: 400700 - DNA, 20 bp, Artificial
  CRISPR gRNA sequence
tataaagcccaagtagaagc

SEQ ID NO: 400701 - DNA, 20 bp, Artificial
  CRISPR gRNA sequence
taaagcccaagtagaagcta

SEQ ID NO: 400702 - DNA, 20 bp, Artificial
  CRISPR gRNA sequence
tagaatgtcttctcgtattt

SEQ ID NO: 400703 - DNA, 20 bp, Artificial
  CRISPR gRNA sequence
ctcgtatttctgtggcattc

SEQ ID NO: 400704 - DNA, 20 bp, Artificial
  CRISPR gRNA sequence
tcgtatttctgtggcattct

SEQ ID NO: 400705 - DNA, 20 bp, Artificial
  CRISPR gRNA sequence
gtatttctgtggcattctcc

SEQ ID NO: 400706 - DNA, 20 bp, Artificial
  CRISPR gRNA sequence
ctgtggcattctccaattcc

SEQ ID NO: 400707 - DNA, 20 bp, Artificial
  CRISPR gRNA sequence
tgtggcattctccaattcca

SEQ ID NO: 400708 - DNA, 20 bp, Artificial
  CRISPR gRNA sequence
tggcattctccaattccatt

SEQ ID NO: 400709 - DNA, 20 bp, Artificial
  CRISPR gRNA sequence
tccaattccatttctagatg

SEQ ID NO: 400710 - DNA, 20 bp, Artificial
  CRISPR gRNA sequence
caattccatttctagatgct

SEQ ID NO: 400711 - DNA, 20 bp, Artificial
  CRISPR gRNA sequence
catttctagatgctttgatg

SEQ ID NO: 400712 - DNA, 20 bp, Artificial
  CRISPR gRNA sequence
ctagatgctttgatgttact

SEQ ID NO: 400713 - DNA, 20 bp, Artificial
  CRISPR gRNA sequence
tagatgctttgatgttactg

SEQ ID NO: 400714 - DNA, 20 bp, Artificial
  CRISPR gRNA sequence
gatgctttgatgttactgct

SEQ ID NO: 400715 - DNA, 20 bp, Artificial
  CRISPR gRNA sequence
tgatgttactgctttgaagg

SEQ ID NO: 400716 - DNA, 20 bp, Artificial
  CRISPR gRNA sequence
gatgttactgctttgaagga

SEQ ID NO: 400717 - DNA, 20 bp, Artificial
  CRISPR gRNA sequence
atgttactgctttgaaggag

SEQ ID NO: 400718 - DNA, 20 bp, Artificial
  CRISPR gRNA sequence
ctgctttgaaggagcaatct

SEQ ID NO: 400719 - DNA, 20 bp, Artificial
  CRISPR gRNA sequence
ctttgaaggagcaatcttgg

SEQ ID NO: 400720 - DNA, 20 bp, Artificial
  CRISPR gRNA sequence
tgaaggagcaatcttgggag

SEQ ID NO: 400721 - DNA, 20 bp, Artificial
  CRISPR gRNA sequence
gaaggagcaatcttgggagt

SEQ ID NO: 400722 - DNA, 20 bp, Artificial
  CRISPR gRNA sequence
aaggagcaatcttgggagtc

SEQ ID NO: 400723 - DNA, 20 bp, Artificial
  CRISPR gRNA sequence
gggagtctgtttcatttttc

SEQ ID NO: 400724 - DNA, 20 bp, Artificial
  CRISPR gRNA sequence
ggagtctgtttcatttttct

SEQ ID NO: 400725 - DNA, 20 bp, Artificial
  CRISPR gRNA sequence
tttcatttttctgactgtgc

SEQ ID NO: 400726 - DNA, 20 bp, Artificial
  CRISPR gRNA sequence
catttttctgactgtgctgt

SEQ ID NO: 400727 - DNA, 20 bp, Artificial
  CRISPR gRNA sequence
atttttctgactgtgctgtt

SEQ ID NO: 400728 - DNA, 20 bp, Artificial
  CRISPR gRNA sequence
ttctgactgtgctgttgtgt

SEQ ID NO: 400729 - DNA, 20 bp, Artificial
  CRISPR gRNA sequence
tctgactgtgctgttgtgtc

SEQ ID NO: 400730 - DNA, 20 bp, Artificial
  CRISPR gRNA sequence
ctgactgtgctgttgtgtcc

SEQ ID NO: 400731 - DNA, 20 bp, Artificial
  CRISPR gRNA sequence
tgactgtgctgttgtgtccg

SEQ ID NO: 400732 - DNA, 20 bp, Artificial
  CRISPR gRNA sequence
actgtgctgttgtgtccgag

SEQ ID NO: 400733 - DNA, 20 bp, Artificial
  CRISPR gRNA sequence
tgctgttgtgtccgagtaga

SEQ ID NO: 400734 - DNA, 20 bp, Artificial
  CRISPR gRNA sequence
ttgtgtccgagtagaagtgc

SEQ ID NO: 400735 - DNA, 20 bp, Artificial
  CRISPR gRNA sequence
tgtccgagtagaagtgcctt

SEQ ID NO: 400736 - DNA, 20 bp, Artificial
  CRISPR gRNA sequence
tcaaatttgaatgtagtaga

SEQ ID NO: 400737 - DNA, 20 bp, Artificial
  CRISPR gRNA sequence
caaatttgaatgtagtagaa

SEQ ID NO: 400738 - DNA, 20 bp, Artificial
  CRISPR gRNA sequence
aaatttgaatgtagtagaag

SEQ ID NO: 400739 - DNA, 20 bp, Artificial
  CRISPR gRNA sequence
gaatgtagtagaagaaagca

SEQ ID NO: 400740 - DNA, 20 bp, Artificial
  CRISPR gRNA sequence
aatgtagtagaagaaagcac

SEQ ID NO: 400741 - DNA, 20 bp, Artificial
  CRISPR gRNA sequence
tttgttgtcttaatgataac

SEQ ID NO: 400742 - DNA, 20 bp, Artificial
  CRISPR gRNA sequence
ttgttgtcttaatgataacc

SEQ ID NO: 400743 - DNA, 20 bp, Artificial
  CRISPR gRNA sequence
tgttgtcttaatgataacct

SEQ ID NO: 400744 - DNA, 20 bp, Artificial
  CRISPR gRNA sequence
gttgtcttaatgataacctg

SEQ ID NO: 400745 - DNA, 20 bp, Artificial
  CRISPR gRNA sequence
ttgtcttaatgataacctga

SEQ ID NO: 400746 - DNA, 20 bp, Artificial
  CRISPR gRNA sequence
tcttaatgataacctgagcc

SEQ ID NO: 400747 - DNA, 20 bp, Artificial
  CRISPR gRNA sequence
aatgataacctgagccttga

SEQ ID NO: 400748 - DNA, 20 bp, Artificial
  CRISPR gRNA sequence
atgataacctgagccttgat

SEQ ID NO: 400749 - DNA, 20 bp, Artificial
  CRISPR gRNA sequence
agccttgattaaactgatgt

SEQ ID NO: 400750 - DNA, 20 bp, Artificial
  CRISPR gRNA sequence
gattaaactgatgttggcaa

SEQ ID NO: 400751 - DNA, 20 bp, Artificial
  CRISPR gRNA sequence
attaaactgatgttggcaac

SEQ ID NO: 400752 - DNA, 20 bp, Artificial
  CRISPR gRNA sequence
aactgatgttggcaacacat

SEQ ID NO: 400753 - DNA, 20 bp, Artificial
  CRISPR gRNA sequence
atgttggcaacacatgggtt

SEQ ID NO: 400754 - DNA, 20 bp, Artificial
  CRISPR gRNA sequence
gcaacacatgggttcaggat

SEQ ID NO: 400755 - DNA, 20 bp, Artificial
  CRISPR gRNA sequence
aggatcctttcagggtttta

SEQ ID NO: 400756 - DNA, 20 bp, Artificial
  CRISPR gRNA sequence
tcagggttttatcacagtga

SEQ ID NO: 400757 - DNA, 20 bp, Artificial
  CRISPR gRNA sequence
cagggttttatcacagtgac

SEQ ID NO: 400758 - DNA, 20 bp, Artificial
  CRISPR gRNA sequence
agggttttatcacagtgaca

SEQ ID NO: 400759 - DNA, 20 bp, Artificial
  CRISPR gRNA sequence
tatcacagtgacatagcacc

SEQ ID NO: 400760 - DNA, 20 bp, Artificial
  CRISPR gRNA sequence
atcacagtgacatagcacca

SEQ ID NO: 400761 - DNA, 20 bp, Artificial
  CRISPR gRNA sequence
tcacagtgacatagcaccat

SEQ ID NO: 400762 - DNA, 20 bp, Artificial
  CRISPR gRNA sequence
ccttctgctggacactccag

SEQ ID NO: 400763 - DNA, 20 bp, Artificial
  CRISPR gRNA sequence
ctgctggacactccagcacc

SEQ ID NO: 400764 - DNA, 20 bp, Artificial
  CRISPR gRNA sequence
tgctggacactccagcaccc

SEQ ID NO: 400765 - DNA, 20 bp, Artificial
  CRISPR gRNA sequence
ctggacactccagcacccac

SEQ ID NO: 400766 - DNA, 20 bp, Artificial
  CRISPR gRNA sequence
gacactccagcacccacatc

SEQ ID NO: 400767 - DNA, 20 bp, Artificial
  CRISPR gRNA sequence
cagcacccacatcaacccct

SEQ ID NO: 400768 - DNA, 20 bp, Artificial
  CRISPR gRNA sequence
tgtgttcaaggttcttccta

SEQ ID NO: 400769 - DNA, 20 bp, Artificial
  CRISPR gRNA sequence
aaggttcttcctacagtacc

SEQ ID NO: 400770 - DNA, 20 bp, Artificial
  CRISPR gRNA sequence
ttcctacagtaccaaatcta

SEQ ID NO: 400771 - DNA, 20 bp, Artificial
  CRISPR gRNA sequence
cctacagtaccaaatctaag

SEQ ID NO: 400772 - DNA, 20 bp, Artificial
  CRISPR gRNA sequence
ctacagtaccaaatctaagt

SEQ ID NO: 400773 - DNA, 20 bp, Artificial
  CRISPR gRNA sequence
cagtaccaaatctaagtttg

SEQ ID NO: 400774 - DNA, 20 bp, Artificial
  CRISPR gRNA sequence
agtttgttttctttctttct

SEQ ID NO: 400775 - DNA, 20 bp, Artificial
  CRISPR gRNA sequence
gttttctttctttctttttc

SEQ ID NO: 400776 - DNA, 20 bp, Artificial
  CRISPR gRNA sequence
ttttctttctttctttttct

SEQ ID NO: 400777 - DNA, 20 bp, Artificial
  CRISPR gRNA sequence
tctttctttctttttctctt

SEQ ID NO: 400778 - DNA, 20 bp, Artificial
  CRISPR gRNA sequence
ctttctttctttttctcttt

SEQ ID NO: 400779 - DNA, 20 bp, Artificial
  CRISPR gRNA sequence
tttctttctttttctctttc

SEQ ID NO: 400780 - DNA, 20 bp, Artificial
  CRISPR gRNA sequence
tctttctttttctctttctt

SEQ ID NO: 400781 - DNA, 20 bp, Artificial
  CRISPR gRNA sequence
ctttctttttctctttcttt

SEQ ID NO: 400782 - DNA, 20 bp, Artificial
  CRISPR gRNA sequence
tttctttttctctttctttc

SEQ ID NO: 400783 - DNA, 20 bp, Artificial
  CRISPR gRNA sequence
tctttttctctttctttctt

SEQ ID NO: 400784 - DNA, 20 bp, Artificial
  CRISPR gRNA sequence
ctttttctctttctttcttt

SEQ ID NO: 400785 - DNA, 20 bp, Artificial
  CRISPR gRNA sequence
tttttctctttctttctttc

SEQ ID NO: 400786 - DNA, 20 bp, Artificial
  CRISPR gRNA sequence
tttctctttctttctttctc

SEQ ID NO: 400787 - DNA, 20 bp, Artificial
  CRISPR gRNA sequence
ttctctttctttctttctct

SEQ ID NO: 400788 - DNA, 20 bp, Artificial
  CRISPR gRNA sequence
tctctttctttctttctctc

SEQ ID NO: 400789 - DNA, 20 bp, Artificial
  CRISPR gRNA sequence
ctctttctttctttctctct

SEQ ID NO: 400790 - DNA, 20 bp, Artificial
  CRISPR gRNA sequence
tctttctttctttctctctc

SEQ ID NO: 400791 - DNA, 20 bp, Artificial
  CRISPR gRNA sequence
tttctttctttctctctctc

SEQ ID NO: 400792 - DNA, 20 bp, Artificial
  CRISPR gRNA sequence
tctttctttctctctctctc

SEQ ID NO: 400793 - DNA, 20 bp, Artificial
  CRISPR gRNA sequence
ctttctttctctctctctct

SEQ ID NO: 400794 - DNA, 20 bp, Artificial
  CRISPR gRNA sequence
tttctttctctctctctctt

SEQ ID NO: 400795 - DNA, 20 bp, Artificial
  CRISPR gRNA sequence
tctttctctctctctctttc

SEQ ID NO: 400796 - DNA, 20 bp, Artificial
  CRISPR gRNA sequence
ctttctctctctctctttct

SEQ ID NO: 400797 - DNA, 20 bp, Artificial
  CRISPR gRNA sequence
tttctctctctctctttctt

SEQ ID NO: 400798 - DNA, 20 bp, Artificial
  CRISPR gRNA sequence
tctctctctctctttctttc

SEQ ID NO: 400799 - DNA, 20 bp, Artificial
  CRISPR gRNA sequence
ctctctctctctttctttct

SEQ ID NO: 400800 - DNA, 20 bp, Artificial
  CRISPR gRNA sequence
tctctctctctttctttctt

SEQ ID NO: 400801 - DNA, 20 bp, Artificial
  CRISPR gRNA sequence
tctctctctttctttctttt

SEQ ID NO: 400802 - DNA, 20 bp, Artificial
  CRISPR gRNA sequence
tctctctttctttcttttct

SEQ ID NO: 400803 - DNA, 20 bp, Artificial
  CRISPR gRNA sequence
tctctttctttcttttcttt

SEQ ID NO: 400804 - DNA, 20 bp, Artificial
  CRISPR gRNA sequence
tctttctttcttttctttcc

SEQ ID NO: 400805 - DNA, 20 bp, Artificial
  CRISPR gRNA sequence
tttctttcttttctttcctt

SEQ ID NO: 400806 - DNA, 20 bp, Artificial
  CRISPR gRNA sequence
tctttcttttctttcctttc

SEQ ID NO: 400807 - DNA, 20 bp, Artificial
  CRISPR gRNA sequence
ctttcttttctttcctttct

SEQ ID NO: 400808 - DNA, 20 bp, Artificial
  CRISPR gRNA sequence
tttcttttctttcctttctt

SEQ ID NO: 400809 - DNA, 20 bp, Artificial
  CRISPR gRNA sequence
tcttttctttcctttctttc

SEQ ID NO: 400810 - DNA, 20 bp, Artificial
  CRISPR gRNA sequence
cttttctttcctttctttcc

SEQ ID NO: 400811 - DNA, 20 bp, Artificial
  CRISPR gRNA sequence
ttttctttcctttctttcct

SEQ ID NO: 400812 - DNA, 20 bp, Artificial
  CRISPR gRNA sequence
ttctttcctttctttcctgt

SEQ ID NO: 400813 - DNA, 20 bp, Artificial
  CRISPR gRNA sequence
tctttcctttctttcctgtc

SEQ ID NO: 400814 - DNA, 20 bp, Artificial
  CRISPR gRNA sequence
ctttcctttctttcctgtct

SEQ ID NO: 400815 - DNA, 20 bp, Artificial
  CRISPR gRNA sequence
tttcctttctttcctgtctt

SEQ ID NO: 400816 - DNA, 20 bp, Artificial
  CRISPR gRNA sequence
tcctttctttcctgtctttc

SEQ ID NO: 400817 - DNA, 20 bp, Artificial
  CRISPR gRNA sequence
cctttctttcctgtctttct

SEQ ID NO: 400818 - DNA, 20 bp, Artificial
  CRISPR gRNA sequence
ctttctttcctgtctttctt

SEQ ID NO: 400819 - DNA, 20 bp, Artificial
  CRISPR gRNA sequence
tctttcctgtctttctttct

SEQ ID NO: 400820 - DNA, 20 bp, Artificial
  CRISPR gRNA sequence
ctttcctgtctttctttctt

SEQ ID NO: 400821 - DNA, 20 bp, Artificial
  CRISPR gRNA sequence
tttcctgtctttctttcttc

SEQ ID NO: 400822 - DNA, 20 bp, Artificial
  CRISPR gRNA sequence
tcctgtctttctttcttctt

SEQ ID NO: 400823 - DNA, 20 bp, Artificial
  CRISPR gRNA sequence
cctgtctttctttcttcttc

SEQ ID NO: 400824 - DNA, 20 bp, Artificial
  CRISPR gRNA sequence
ctgtctttctttcttcttcc

SEQ ID NO: 400825 - DNA, 20 bp, Artificial
  CRISPR gRNA sequence
tctttctttcttcttccttc

SEQ ID NO: 400826 - DNA, 20 bp, Artificial
  CRISPR gRNA sequence
tctttcttcttccttctttt

SEQ ID NO: 400827 - DNA, 20 bp, Artificial
  CRISPR gRNA sequence
ctttcttcttccttcttttt

SEQ ID NO: 400828 - DNA, 20 bp, Artificial
  CRISPR gRNA sequence
tttcttcttccttctttttt

SEQ ID NO: 400829 - DNA, 20 bp, Artificial
  CRISPR gRNA sequence
tcttcttccttctttttttt

SEQ ID NO: 400830 - DNA, 20 bp, Artificial
  CRISPR gRNA sequence
cttcttccttcttttttttt

SEQ ID NO: 400831 - DNA, 20 bp, Artificial
  CRISPR gRNA sequence
ttcttccttctttttttttt

SEQ ID NO: 400832 - DNA, 20 bp, Artificial
  CRISPR gRNA sequence
cttccttctttttttttttt

SEQ ID NO: 400833 - DNA, 20 bp, Artificial
  CRISPR gRNA sequence
ttccttcttttttttttttt

SEQ ID NO: 400834 - DNA, 20 bp, Artificial
  CRISPR gRNA sequence
ccttcttttttttttttttt

SEQ ID NO: 400835 - DNA, 20 bp, Artificial
  CRISPR gRNA sequence
cttctttttttttttttttt

SEQ ID NO: 400836 - DNA, 20 bp, Artificial
  CRISPR gRNA sequence
cttttttttttttttttttt

SEQ ID NO: 400837 - DNA, 20 bp, Artificial
  CRISPR gRNA sequence
tttttttttttttttttttt

SEQ ID NO: 400838 - DNA, 20 bp, Artificial
  CRISPR gRNA sequence
tttttttttttttttttttt

SEQ ID NO: 400839 - DNA, 20 bp, Artificial
  CRISPR gRNA sequence
tttttttttttttttttttt

SEQ ID NO: 400840 - DNA, 20 bp, Artificial
  CRISPR gRNA sequence
tttttttttttttttttttt

SEQ ID NO: 400841 - DNA, 20 bp, Artificial
  CRISPR gRNA sequence
tttttttttttttttttttt

SEQ ID NO: 400842 - DNA, 20 bp, Artificial
  CRISPR gRNA sequence
tttttttttttttttttttt

SEQ ID NO: 400843 - DNA, 20 bp, Artificial
  CRISPR gRNA sequence
tttttttttttttttttttt

SEQ ID NO: 400844 - DNA, 20 bp, Artificial
  CRISPR gRNA sequence
tttttttttttttttttttt

SEQ ID NO: 400845 - DNA, 20 bp, Artificial
  CRISPR gRNA sequence
tttttttttttttttttttg

SEQ ID NO: 400846 - DNA, 20 bp, Artificial
  CRISPR gRNA sequence
ttttttttttttttttttga

SEQ ID NO: 400847 - DNA, 20 bp, Artificial
  CRISPR gRNA sequence
tttttttttttttttttgat

SEQ ID NO: 400848 - DNA, 20 bp, Artificial
  CRISPR gRNA sequence
ttttttttttttttttgatg

SEQ ID NO: 400849 - DNA, 20 bp, Artificial
  CRISPR gRNA sequence
tttttttttttttttgatgg

SEQ ID NO: 400850 - DNA, 20 bp, Artificial
  CRISPR gRNA sequence
ttttttttttttttgatgga

SEQ ID NO: 400851 - DNA, 20 bp, Artificial
  CRISPR gRNA sequence
tttttttttttttgatggag

SEQ ID NO: 400852 - DNA, 20 bp, Artificial
  CRISPR gRNA sequence
ttttttttttttgatggagt

SEQ ID NO: 400853 - DNA, 20 bp, Artificial
  CRISPR gRNA sequence
tttttttttttgatggagtc

SEQ ID NO: 400854 - DNA, 20 bp, Artificial
  CRISPR gRNA sequence
ttttttttttgatggagtct

SEQ ID NO: 400855 - DNA, 20 bp, Artificial
  CRISPR gRNA sequence
tttttttttgatggagtctt

SEQ ID NO: 400856 - DNA, 20 bp, Artificial
  CRISPR gRNA sequence
ttttttttgatggagtcttg

SEQ ID NO: 400857 - DNA, 20 bp, Artificial
  CRISPR gRNA sequence
tttttttgatggagtcttgc

SEQ ID NO: 400858 - DNA, 20 bp, Artificial
  CRISPR gRNA sequence
ttttttgatggagtcttgct

SEQ ID NO: 400859 - DNA, 20 bp, Artificial
  CRISPR gRNA sequence
tttttgatggagtcttgctc

SEQ ID NO: 400860 - DNA, 20 bp, Artificial
  CRISPR gRNA sequence
ttttgatggagtcttgctct

SEQ ID NO: 400861 - DNA, 20 bp, Artificial
  CRISPR gRNA sequence
tttgatggagtcttgctctg

SEQ ID NO: 400862 - DNA, 20 bp, Artificial
  CRISPR gRNA sequence
ttgatggagtcttgctctgt

SEQ ID NO: 400863 - DNA, 20 bp, Artificial
  CRISPR gRNA sequence
tgatggagtcttgctctgtc

SEQ ID NO: 400864 - DNA, 20 bp, Artificial
  CRISPR gRNA sequence
gatggagtcttgctctgtca

SEQ ID NO: 400865 - DNA, 20 bp, Artificial
  CRISPR gRNA sequence
atggagtcttgctctgtcac

SEQ ID NO: 400866 - DNA, 20 bp, Artificial
  CRISPR gRNA sequence
gctctgtcaccaggctggag

SEQ ID NO: 400867 - DNA, 20 bp, Artificial
  CRISPR gRNA sequence
ctctgtcaccaggctggagt

SEQ ID NO: 400868 - DNA, 20 bp, Artificial
  CRISPR gRNA sequence
tgtcaccaggctggagtaca

SEQ ID NO: 400869 - DNA, 20 bp, Artificial
  CRISPR gRNA sequence
tcaccaggctggagtacagt

SEQ ID NO: 400870 - DNA, 20 bp, Artificial
  CRISPR gRNA sequence
gagtacagtagcatgatctt

SEQ ID NO: 400871 - DNA, 20 bp, Artificial
  CRISPR gRNA sequence
ggctcactgcaacctccagc

SEQ ID NO: 400872 - DNA, 20 bp, Artificial
  CRISPR gRNA sequence
gctcactgcaacctccagct

SEQ ID NO: 400873 - DNA, 20 bp, Artificial
  CRISPR gRNA sequence
actgcaacctccagctcctg

SEQ ID NO: 400874 - DNA, 20 bp, Artificial
  CRISPR gRNA sequence
caacctccagctcctgggct

SEQ ID NO: 400875 - DNA, 20 bp, Artificial
  CRISPR gRNA sequence
cagctcctgggctcaagcga

SEQ ID NO: 400876 - DNA, 20 bp, Artificial
  CRISPR gRNA sequence
ctgggctcaagcgattctcc

SEQ ID NO: 400877 - DNA, 20 bp, Artificial
  CRISPR gRNA sequence
ggctcaagcgattctcctac

SEQ ID NO: 400878 - DNA, 20 bp, Artificial
  CRISPR gRNA sequence
aagcgattctcctacctcag

SEQ ID NO: 400879 - DNA, 20 bp, Artificial
  CRISPR gRNA sequence
tcctacctcagccccgcaag

SEQ ID NO: 400880 - DNA, 20 bp, Artificial
  CRISPR gRNA sequence
ctacctcagccccgcaagta

SEQ ID NO: 400881 - DNA, 20 bp, Artificial
  CRISPR gRNA sequence
cctcagccccgcaagtagct

SEQ ID NO: 400882 - DNA, 20 bp, Artificial
  CRISPR gRNA sequence
agccccgcaagtagctggga

SEQ ID NO: 400883 - DNA, 20 bp, Artificial
  CRISPR gRNA sequence
ggactacaggtgtgcaccgc

SEQ ID NO: 400884 - DNA, 20 bp, Artificial
  CRISPR gRNA sequence
caggtgtgcaccgccacgtg

SEQ ID NO: 400885 - DNA, 20 bp, Artificial
  CRISPR gRNA sequence
gaattcccatgtgttgtggg

SEQ ID NO: 400886 - DNA, 20 bp, Artificial
  CRISPR gRNA sequence
aattcccatgtgttgtggga

SEQ ID NO: 400887 - DNA, 20 bp, Artificial
  CRISPR gRNA sequence
ccatgtgttgtgggagggac

SEQ ID NO: 400888 - DNA, 20 bp, Artificial
  CRISPR gRNA sequence
tgggagggacctggtgggag

SEQ ID NO: 400889 - DNA, 20 bp, Artificial
  CRISPR gRNA sequence
gtgggaggtaattgaatcgt

SEQ ID NO: 400890 - DNA, 20 bp, Artificial
  CRISPR gRNA sequence
aatcgtgcgggcaagtcttt

SEQ ID NO: 400891 - DNA, 20 bp, Artificial
  CRISPR gRNA sequence
tcccatgctgtcctcatgat

SEQ ID NO: 400892 - DNA, 20 bp, Artificial
  CRISPR gRNA sequence
cccatgctgtcctcatgata

SEQ ID NO: 400893 - DNA, 20 bp, Artificial
  CRISPR gRNA sequence
ccatgctgtcctcatgatag

SEQ ID NO: 400894 - DNA, 20 bp, Artificial
  CRISPR gRNA sequence
tcctcatgatagtgcataag

SEQ ID NO: 400895 - DNA, 20 bp, Artificial
  CRISPR gRNA sequence
atgatagtgcataagtctca

SEQ ID NO: 400896 - DNA, 20 bp, Artificial
  CRISPR gRNA sequence
atgagatctgatggtttaaa

SEQ ID NO: 400897 - DNA, 20 bp, Artificial
  CRISPR gRNA sequence
atggtttaaaaaagaggagt

SEQ ID NO: 400898 - DNA, 20 bp, Artificial
  CRISPR gRNA sequence
aaaaaagaggagttcccctg

SEQ ID NO: 400899 - DNA, 20 bp, Artificial
  CRISPR gRNA sequence
aaaaagaggagttcccctgc

SEQ ID NO: 400900 - DNA, 20 bp, Artificial
  CRISPR gRNA sequence
ccctgcactagctctctctg

SEQ ID NO: 400901 - DNA, 20 bp, Artificial
  CRISPR gRNA sequence
cactagctctctctgtttgc

SEQ ID NO: 400902 - DNA, 20 bp, Artificial
  CRISPR gRNA sequence
gctctctctgtttgcctgct

SEQ ID NO: 400903 - DNA, 20 bp, Artificial
  CRISPR gRNA sequence
tctctgtttgcctgctgcca

SEQ ID NO: 400904 - DNA, 20 bp, Artificial
  CRISPR gRNA sequence
tctgtttgcctgctgccatc

SEQ ID NO: 400905 - DNA, 20 bp, Artificial
  CRISPR gRNA sequence
tgtttgcctgctgccatcca

SEQ ID NO: 400906 - DNA, 20 bp, Artificial
  CRISPR gRNA sequence
tttgcctgctgccatccatg

SEQ ID NO: 400907 - DNA, 20 bp, Artificial
  CRISPR gRNA sequence
gcctgctgccatccatgtaa

SEQ ID NO: 400908 - DNA, 20 bp, Artificial
  CRISPR gRNA sequence
cctgctgccatccatgtaag

SEQ ID NO: 400909 - DNA, 20 bp, Artificial
  CRISPR gRNA sequence
ctgccatccatgtaagacgt

SEQ ID NO: 400910 - DNA, 20 bp, Artificial
  CRISPR gRNA sequence
ccatccatgtaagacgtgac

SEQ ID NO: 400911 - DNA, 20 bp, Artificial
  CRISPR gRNA sequence
ctccttgccttccaccttga

SEQ ID NO: 400912 - DNA, 20 bp, Artificial
  CRISPR gRNA sequence
tccttgccttccaccttgat

SEQ ID NO: 400913 - DNA, 20 bp, Artificial
  CRISPR gRNA sequence
cttgccttccaccttgattg

SEQ ID NO: 400914 - DNA, 20 bp, Artificial
  CRISPR gRNA sequence
gccttccaccttgattgtga

SEQ ID NO: 400915 - DNA, 20 bp, Artificial
  CRISPR gRNA sequence
ccttccaccttgattgtgag

SEQ ID NO: 400916 - DNA, 20 bp, Artificial
  CRISPR gRNA sequence
ccaccttgattgtgaggctt

SEQ ID NO: 400917 - DNA, 20 bp, Artificial
  CRISPR gRNA sequence
caccttgattgtgaggcttc

SEQ ID NO: 400918 - DNA, 20 bp, Artificial
  CRISPR gRNA sequence
gattgtgaggcttccccaga

SEQ ID NO: 400919 - DNA, 20 bp, Artificial
  CRISPR gRNA sequence
attgtgaggcttccccagac

SEQ ID NO: 400920 - DNA, 20 bp, Artificial
  CRISPR gRNA sequence
tgaggcttccccagacatgt

SEQ ID NO: 400921 - DNA, 20 bp, Artificial
  CRISPR gRNA sequence
ccccagacatgtggtgctgt

SEQ ID NO: 400922 - DNA, 20 bp, Artificial
  CRISPR gRNA sequence
cccagacatgtggtgctgta

SEQ ID NO: 400923 - DNA, 20 bp, Artificial
  CRISPR gRNA sequence
taagtccaattaaacctctt

SEQ ID NO: 400924 - DNA, 20 bp, Artificial
  CRISPR gRNA sequence
aacctctttcttttgtaaat

SEQ ID NO: 400925 - DNA, 20 bp, Artificial
  CRISPR gRNA sequence
tttcttttgtaaattgccca

SEQ ID NO: 400926 - DNA, 20 bp, Artificial
  CRISPR gRNA sequence
tcttttgtaaattgcccagt

SEQ ID NO: 400927 - DNA, 20 bp, Artificial
  CRISPR gRNA sequence
cttttgtaaattgcccagtc

SEQ ID NO: 400928 - DNA, 20 bp, Artificial
  CRISPR gRNA sequence
ttttgtaaattgcccagtct

SEQ ID NO: 400929 - DNA, 20 bp, Artificial
  CRISPR gRNA sequence
ttgtaaattgcccagtcttg

SEQ ID NO: 400930 - DNA, 20 bp, Artificial
  CRISPR gRNA sequence
tgtaaattgcccagtcttgg

SEQ ID NO: 400931 - DNA, 20 bp, Artificial
  CRISPR gRNA sequence
gtaaattgcccagtcttggg

SEQ ID NO: 400932 - DNA, 20 bp, Artificial
  CRISPR gRNA sequence
taaattgcccagtcttggga

SEQ ID NO: 400933 - DNA, 20 bp, Artificial
  CRISPR gRNA sequence
cccagtcttgggaatatctt

SEQ ID NO: 400934 - DNA, 20 bp, Artificial
  CRISPR gRNA sequence
gggaatatcttcatcagcag

SEQ ID NO: 400935 - DNA, 20 bp, Artificial
  CRISPR gRNA sequence
ggaatatcttcatcagcagg

SEQ ID NO: 400936 - DNA, 20 bp, Artificial
  CRISPR gRNA sequence
catcagcagggtgaaaacgg

SEQ ID NO: 400937 - DNA, 20 bp, Artificial
  CRISPR gRNA sequence
atcagcagggtgaaaacgga

SEQ ID NO: 400938 - DNA, 20 bp, Artificial
  CRISPR gRNA sequence
atacaccatgccaggctgat

SEQ ID NO: 400939 - DNA, 20 bp, Artificial
  CRISPR gRNA sequence
attgttgtattttttgtaga

SEQ ID NO: 400940 - DNA, 20 bp, Artificial
  CRISPR gRNA sequence
ttgtattttttgtagagatg

SEQ ID NO: 400941 - DNA, 20 bp, Artificial
  CRISPR gRNA sequence
tattttttgtagagatgagg

SEQ ID NO: 400942 - DNA, 20 bp, Artificial
  CRISPR gRNA sequence
tttgtagagatgaggtttca

SEQ ID NO: 400943 - DNA, 20 bp, Artificial
  CRISPR gRNA sequence
ttgtagagatgaggtttcaa

SEQ ID NO: 400944 - DNA, 20 bp, Artificial
  CRISPR gRNA sequence
tgtagagatgaggtttcaac

SEQ ID NO: 400945 - DNA, 20 bp, Artificial
  CRISPR gRNA sequence
gtagagatgaggtttcaaca

SEQ ID NO: 400946 - DNA, 20 bp, Artificial
  CRISPR gRNA sequence
tagagatgaggtttcaacat

SEQ ID NO: 400947 - DNA, 20 bp, Artificial
  CRISPR gRNA sequence
caacatgttgcccaggctgg

SEQ ID NO: 400948 - DNA, 20 bp, Artificial
  CRISPR gRNA sequence
aacatgttgcccaggctggt

SEQ ID NO: 400949 - DNA, 20 bp, Artificial
  CRISPR gRNA sequence
cccaggctggtcttggactc

SEQ ID NO: 400950 - DNA, 20 bp, Artificial
  CRISPR gRNA sequence
gtcttggactcctgagttca

SEQ ID NO: 400951 - DNA, 20 bp, Artificial
  CRISPR gRNA sequence
ggactcctgagttcaagtga

SEQ ID NO: 400952 - DNA, 20 bp, Artificial
  CRISPR gRNA sequence
gactcctgagttcaagtgat

SEQ ID NO: 400953 - DNA, 20 bp, Artificial
  CRISPR gRNA sequence
ctgagttcaagtgatccaac

SEQ ID NO: 400954 - DNA, 20 bp, Artificial
  CRISPR gRNA sequence
agttcaagtgatccaactgc

SEQ ID NO: 400955 - DNA, 20 bp, Artificial
  CRISPR gRNA sequence
aagtgatccaactgcctcgg

SEQ ID NO: 400956 - DNA, 20 bp, Artificial
  CRISPR gRNA sequence
cctcggcctcccagagtgcc

SEQ ID NO: 400957 - DNA, 20 bp, Artificial
  CRISPR gRNA sequence
ggcctcccagagtgccagga

SEQ ID NO: 400958 - DNA, 20 bp, Artificial
  CRISPR gRNA sequence
ccagagtgccaggattactg

SEQ ID NO: 400959 - DNA, 20 bp, Artificial
  CRISPR gRNA sequence
ctggcatgaaccaccaagct

SEQ ID NO: 400960 - DNA, 20 bp, Artificial
  CRISPR gRNA sequence
gcatgaaccaccaagcttgg

SEQ ID NO: 400961 - DNA, 20 bp, Artificial
  CRISPR gRNA sequence
ggccctggctctatctttca

SEQ ID NO: 400962 - DNA, 20 bp, Artificial
  CRISPR gRNA sequence
gccctggctctatctttcac

SEQ ID NO: 400963 - DNA, 20 bp, Artificial
  CRISPR gRNA sequence
gctctatctttcacctcatc

SEQ ID NO: 400964 - DNA, 20 bp, Artificial
  CRISPR gRNA sequence
tatctttcacctcatccagg

SEQ ID NO: 400965 - DNA, 20 bp, Artificial
  CRISPR gRNA sequence
tctttcacctcatccaggtt

SEQ ID NO: 400966 - DNA, 20 bp, Artificial
  CRISPR gRNA sequence
tcacctcatccaggtttagc

SEQ ID NO: 400967 - DNA, 20 bp, Artificial
  CRISPR gRNA sequence
cacctcatccaggtttagct

SEQ ID NO: 400968 - DNA, 20 bp, Artificial
  CRISPR gRNA sequence
acctcatccaggtttagcta

SEQ ID NO: 400969 - DNA, 20 bp, Artificial
  CRISPR gRNA sequence
atccaggtttagctagagag

SEQ ID NO: 400970 - DNA, 20 bp, Artificial
  CRISPR gRNA sequence
agctagagaggacactttct

SEQ ID NO: 400971 - DNA, 20 bp, Artificial
  CRISPR gRNA sequence
gctagagaggacactttctt

SEQ ID NO: 400972 - DNA, 20 bp, Artificial
  CRISPR gRNA sequence
gagaggacactttcttcata

SEQ ID NO: 400973 - DNA, 20 bp, Artificial
  CRISPR gRNA sequence
tcttcataaattgtgagctg

SEQ ID NO: 400974 - DNA, 20 bp, Artificial
  CRISPR gRNA sequence
cttcataaattgtgagctgt

SEQ ID NO: 400975 - DNA, 20 bp, Artificial
  CRISPR gRNA sequence
ttcataaattgtgagctgtg

SEQ ID NO: 400976 - DNA, 20 bp, Artificial
  CRISPR gRNA sequence
cataaattgtgagctgtggt

SEQ ID NO: 400977 - DNA, 20 bp, Artificial
  CRISPR gRNA sequence
ataaattgtgagctgtggtg

SEQ ID NO: 400978 - DNA, 20 bp, Artificial
  CRISPR gRNA sequence
tgagctgtggtgtcagaaag

SEQ ID NO: 400979 - DNA, 20 bp, Artificial
  CRISPR gRNA sequence
tggtgtcagaaagaacccaa

SEQ ID NO: 400980 - DNA, 20 bp, Artificial
  CRISPR gRNA sequence
ggagtgttttttgctttatc

SEQ ID NO: 400981 - DNA, 20 bp, Artificial
  CRISPR gRNA sequence
gagtgttttttgctttatct

SEQ ID NO: 400982 - DNA, 20 bp, Artificial
  CRISPR gRNA sequence
tttgctttatctaccagaga

SEQ ID NO: 400983 - DNA, 20 bp, Artificial
  CRISPR gRNA sequence
ttgctttatctaccagagat

SEQ ID NO: 400984 - DNA, 20 bp, Artificial
  CRISPR gRNA sequence
tgctttatctaccagagatt

SEQ ID NO: 400985 - DNA, 20 bp, Artificial
  CRISPR gRNA sequence
gctttatctaccagagattg

SEQ ID NO: 400986 - DNA, 20 bp, Artificial
  CRISPR gRNA sequence
ctttatctaccagagattgt

SEQ ID NO: 400987 - DNA, 20 bp, Artificial
  CRISPR gRNA sequence
tatctaccagagattgtggt

SEQ ID NO: 400988 - DNA, 20 bp, Artificial
  CRISPR gRNA sequence
atctaccagagattgtggtt

SEQ ID NO: 400989 - DNA, 20 bp, Artificial
  CRISPR gRNA sequence
tctaccagagattgtggttt

SEQ ID NO: 400990 - DNA, 20 bp, Artificial
  CRISPR gRNA sequence
ccagagattgtggttttgtc

SEQ ID NO: 400991 - DNA, 20 bp, Artificial
  CRISPR gRNA sequence
tggttttgtctttctagtga

SEQ ID NO: 400992 - DNA, 20 bp, Artificial
  CRISPR gRNA sequence
tgtctttctagtgatgacta

SEQ ID NO: 400993 - DNA, 20 bp, Artificial
  CRISPR gRNA sequence
gtctttctagtgatgactac

SEQ ID NO: 400994 - DNA, 20 bp, Artificial
  CRISPR gRNA sequence
tctttctagtgatgactaca

SEQ ID NO: 400995 - DNA, 20 bp, Artificial
  CRISPR gRNA sequence
tctagtgatgactacatgaa

SEQ ID NO: 400996 - DNA, 20 bp, Artificial
  CRISPR gRNA sequence
ctagtgatgactacatgaac

SEQ ID NO: 400997 - DNA, 20 bp, Artificial
  CRISPR gRNA sequence
tagtgatgactacatgaact

SEQ ID NO: 400998 - DNA, 20 bp, Artificial
  CRISPR gRNA sequence
gtgatgactacatgaactgg

SEQ ID NO: 400999 - DNA, 20 bp, Artificial
  CRISPR gRNA sequence
catgaactggttgtagtata

SEQ ID NO: 401000 - DNA, 20 bp, Artificial
  CRISPR gRNA sequence
gttgtagtatattggaaaca

SEQ ID NO: 401001 - DNA, 20 bp, Artificial
  CRISPR gRNA sequence
tagtatattggaaacacttg

SEQ ID NO: 401002 - DNA, 20 bp, Artificial
  CRISPR gRNA sequence
gaaacacttgggtttatagt

SEQ ID NO: 401003 - DNA, 20 bp, Artificial
  CRISPR gRNA sequence
gggtttatagtcatcacttt

SEQ ID NO: 401004 - DNA, 20 bp, Artificial
  CRISPR gRNA sequence
ggtttatagtcatcactttc

SEQ ID NO: 401005 - DNA, 20 bp, Artificial
  CRISPR gRNA sequence
atagtcatcactttccatca

SEQ ID NO: 401006 - DNA, 20 bp, Artificial
  CRISPR gRNA sequence
tagtcatcactttccatcaa

SEQ ID NO: 401007 - DNA, 20 bp, Artificial
  CRISPR gRNA sequence
tccatcaacctggtgttagt

SEQ ID NO: 401008 - DNA, 20 bp, Artificial
  CRISPR gRNA sequence
ccatcaacctggtgttagtt

SEQ ID NO: 401009 - DNA, 20 bp, Artificial
  CRISPR gRNA sequence
catcaacctggtgttagttg

SEQ ID NO: 401010 - DNA, 20 bp, Artificial
  CRISPR gRNA sequence
gtgttagttgctcgatccct

SEQ ID NO: 401011 - DNA, 20 bp, Artificial
  CRISPR gRNA sequence
gttgctcgatccctctgaat

SEQ ID NO: 401012 - DNA, 20 bp, Artificial
  CRISPR gRNA sequence
ctcgatccctctgaatctca

SEQ ID NO: 401013 - DNA, 20 bp, Artificial
  CRISPR gRNA sequence
gatccctctgaatctcaggt

SEQ ID NO: 401014 - DNA, 20 bp, Artificial
  CRISPR gRNA sequence
tgaatctcaggttcctgaag

SEQ ID NO: 401015 - DNA, 20 bp, Artificial
  CRISPR gRNA sequence
aatctcaggttcctgaagag

SEQ ID NO: 401016 - DNA, 20 bp, Artificial
  CRISPR gRNA sequence
aggttcctgaagaggaaatg

SEQ ID NO: 401017 - DNA, 20 bp, Artificial
  CRISPR gRNA sequence
ctgaagaggaaatggggttg

SEQ ID NO: 401018 - DNA, 20 bp, Artificial
  CRISPR gRNA sequence
aagaggaaatggggttggta

SEQ ID NO: 401019 - DNA, 20 bp, Artificial
  CRISPR gRNA sequence
gtagtgccattctacttgtt

SEQ ID NO: 401020 - DNA, 20 bp, Artificial
  CRISPR gRNA sequence
tacttgttgaatggctgagg

SEQ ID NO: 401021 - DNA, 20 bp, Artificial
  CRISPR gRNA sequence
cttgttgaatggctgaggga

SEQ ID NO: 401022 - DNA, 20 bp, Artificial
  CRISPR gRNA sequence
gttgaatggctgagggacga

SEQ ID NO: 401023 - DNA, 20 bp, Artificial
  CRISPR gRNA sequence
ttgaatggctgagggacgat

SEQ ID NO: 401024 - DNA, 20 bp, Artificial
  CRISPR gRNA sequence
aatggctgagggacgatata

SEQ ID NO: 401025 - DNA, 20 bp, Artificial
  CRISPR gRNA sequence
agggacgatatatttaaaga

SEQ ID NO: 401026 - DNA, 20 bp, Artificial
  CRISPR gRNA sequence
aaagaacttggtccatggta

SEQ ID NO: 401027 - DNA, 20 bp, Artificial
  CRISPR gRNA sequence
aagaacttggtccatggtag

SEQ ID NO: 401028 - DNA, 20 bp, Artificial
  CRISPR gRNA sequence
ggtccatggtagtcagagaa

SEQ ID NO: 401029 - DNA, 20 bp, Artificial
  CRISPR gRNA sequence
gtccatggtagtcagagaat

SEQ ID NO: 401030 - DNA, 20 bp, Artificial
  CRISPR gRNA sequence
attatttcctatgcttgtga

SEQ ID NO: 401031 - DNA, 20 bp, Artificial
  CRISPR gRNA sequence
ttatttcctatgcttgtgat

SEQ ID NO: 401032 - DNA, 20 bp, Artificial
  CRISPR gRNA sequence
tttcctatgcttgtgatcca

SEQ ID NO: 401033 - DNA, 20 bp, Artificial
  CRISPR gRNA sequence
cctatgcttgtgatccaaaa

SEQ ID NO: 401034 - DNA, 20 bp, Artificial
  CRISPR gRNA sequence
ctatgcttgtgatccaaaag

SEQ ID NO: 401035 - DNA, 20 bp, Artificial
  CRISPR gRNA sequence
tgcttgtgatccaaaaggac

SEQ ID NO: 401036 - DNA, 20 bp, Artificial
  CRISPR gRNA sequence
gtgatccaaaaggactaata

SEQ ID NO: 401037 - DNA, 20 bp, Artificial
  CRISPR gRNA sequence
tgatccaaaaggactaataa

SEQ ID NO: 401038 - DNA, 20 bp, Artificial
  CRISPR gRNA sequence
ataatgaaattttcagatat

SEQ ID NO: 401039 - DNA, 20 bp, Artificial
  CRISPR gRNA sequence
tcagatattagtgacaatct

SEQ ID NO: 401040 - DNA, 20 bp, Artificial
  CRISPR gRNA sequence
cagatattagtgacaatcta

SEQ ID NO: 401041 - DNA, 20 bp, Artificial
  CRISPR gRNA sequence
agatattagtgacaatctaa

SEQ ID NO: 401042 - DNA, 20 bp, Artificial
  CRISPR gRNA sequence
gtgacaatctaaagcaggga

SEQ ID NO: 401043 - DNA, 20 bp, Artificial
  CRISPR gRNA sequence
aagcagggaatatttttgga

SEQ ID NO: 401044 - DNA, 20 bp, Artificial
  CRISPR gRNA sequence
ttggaactgtgtgtttcttg

SEQ ID NO: 401045 - DNA, 20 bp, Artificial
  CRISPR gRNA sequence
tggaactgtgtgtttcttgt

SEQ ID NO: 401046 - DNA, 20 bp, Artificial
  CRISPR gRNA sequence
ggaactgtgtgtttcttgtg

SEQ ID NO: 401047 - DNA, 20 bp, Artificial
  CRISPR gRNA sequence
gaactgtgtgtttcttgtgt

SEQ ID NO: 401048 - DNA, 20 bp, Artificial
  CRISPR gRNA sequence
tgtgtttcttgtgtggtgtc

SEQ ID NO: 401049 - DNA, 20 bp, Artificial
  CRISPR gRNA sequence
cttgtgtggtgtctctcaaa

SEQ ID NO: 401050 - DNA, 20 bp, Artificial
  CRISPR gRNA sequence
ttgtgtggtgtctctcaaat

SEQ ID NO: 401051 - DNA, 20 bp, Artificial
  CRISPR gRNA sequence
gtgtggtgtctctcaaatta

SEQ ID NO: 401052 - DNA, 20 bp, Artificial
  CRISPR gRNA sequence
tgtggtgtctctcaaattat

SEQ ID NO: 401053 - DNA, 20 bp, Artificial
  CRISPR gRNA sequence
tcaaattatactcatggctg

SEQ ID NO: 401054 - DNA, 20 bp, Artificial
  CRISPR gRNA sequence
aaattatactcatggctgta

SEQ ID NO: 401055 - DNA, 20 bp, Artificial
  CRISPR gRNA sequence
tactcatggctgtacagaga

SEQ ID NO: 401056 - DNA, 20 bp, Artificial
  CRISPR gRNA sequence
atggctgtacagagaagaac

SEQ ID NO: 401057 - DNA, 20 bp, Artificial
  CRISPR gRNA sequence
tacagagaagaacattttat

SEQ ID NO: 401058 - DNA, 20 bp, Artificial
  CRISPR gRNA sequence
tatgacatctgacataatag

SEQ ID NO: 401059 - DNA, 20 bp, Artificial
  CRISPR gRNA sequence
atgacatctgacataatagt

SEQ ID NO: 401060 - DNA, 20 bp, Artificial
  CRISPR gRNA sequence
tgacatctgacataatagtg

SEQ ID NO: 401061 - DNA, 20 bp, Artificial
  CRISPR gRNA sequence
acataatagtgctttatttt

SEQ ID NO: 401062 - DNA, 20 bp, Artificial
  CRISPR gRNA sequence
tatttttaagggatctgtgc

SEQ ID NO: 401063 - DNA, 20 bp, Artificial
  CRISPR gRNA sequence
atttttaagggatctgtgct

SEQ ID NO: 401064 - DNA, 20 bp, Artificial
  CRISPR gRNA sequence
tttttaagggatctgtgctc

SEQ ID NO: 401065 - DNA, 20 bp, Artificial
  CRISPR gRNA sequence
ttaagggatctgtgctctaa

SEQ ID NO: 401066 - DNA, 20 bp, Artificial
  CRISPR gRNA sequence
taagggatctgtgctctaaa

SEQ ID NO: 401067 - DNA, 20 bp, Artificial
  CRISPR gRNA sequence
aagggatctgtgctctaaaa

SEQ ID NO: 401068 - DNA, 20 bp, Artificial
  CRISPR gRNA sequence
agggatctgtgctctaaaag

SEQ ID NO: 401069 - DNA, 20 bp, Artificial
  CRISPR gRNA sequence
tgctctaaaagaacaagtac

SEQ ID NO: 401070 - DNA, 20 bp, Artificial
  CRISPR gRNA sequence
taaaagaacaagtacagaat

SEQ ID NO: 401071 - DNA, 20 bp, Artificial
  CRISPR gRNA sequence
aaagaacaagtacagaatta

SEQ ID NO: 401072 - DNA, 20 bp, Artificial
  CRISPR gRNA sequence
tatgaggaatatcaaatggt

SEQ ID NO: 401073 - DNA, 20 bp, Artificial
  CRISPR gRNA sequence
catatatttagttttccctt

SEQ ID NO: 401074 - DNA, 20 bp, Artificial
  CRISPR gRNA sequence
atatatttagttttcccttt

SEQ ID NO: 401075 - DNA, 20 bp, Artificial
  CRISPR gRNA sequence
agttttccctttctctttag

SEQ ID NO: 401076 - DNA, 20 bp, Artificial
  CRISPR gRNA sequence
gttttccctttctctttagg

SEQ ID NO: 401077 - DNA, 20 bp, Artificial
  CRISPR gRNA sequence
tccctttctctttaggtgta

SEQ ID NO: 401078 - DNA, 20 bp, Artificial
  CRISPR gRNA sequence
ccctttctctttaggtgtag

SEQ ID NO: 401079 - DNA, 20 bp, Artificial
  CRISPR gRNA sequence
cctttctctttaggtgtagc

SEQ ID NO: 401080 - DNA, 20 bp, Artificial
  CRISPR gRNA sequence
tctctttaggtgtagctagg

SEQ ID NO: 401081 - DNA, 20 bp, Artificial
  CRISPR gRNA sequence
ctctttaggtgtagctaggg

SEQ ID NO: 401082 - DNA, 20 bp, Artificial
  CRISPR gRNA sequence
tctttaggtgtagctagggt

SEQ ID NO: 401083 - DNA, 20 bp, Artificial
  CRISPR gRNA sequence
tttaggtgtagctagggtga

SEQ ID NO: 401084 - DNA, 20 bp, Artificial
  CRISPR gRNA sequence
taggtgtagctagggtgaag

SEQ ID NO: 401085 - DNA, 20 bp, Artificial
  CRISPR gRNA sequence
aggtgtagctagggtgaaga

SEQ ID NO: 401086 - DNA, 20 bp, Artificial
  CRISPR gRNA sequence
ggtgtagctagggtgaagac

SEQ ID NO: 401087 - DNA, 20 bp, Artificial
  CRISPR gRNA sequence
gggtgaagactaattttgtg

SEQ ID NO: 401088 - DNA, 20 bp, Artificial
  CRISPR gRNA sequence
attttgtgtatatagctgag

SEQ ID NO: 401089 - DNA, 20 bp, Artificial
  CRISPR gRNA sequence
tgtgtatatagctgaggctt

SEQ ID NO: 401090 - DNA, 20 bp, Artificial
  CRISPR gRNA sequence
gtgtatatagctgaggctta

SEQ ID NO: 401091 - DNA, 20 bp, Artificial
  CRISPR gRNA sequence
tgtatatagctgaggcttat

SEQ ID NO: 401092 - DNA, 20 bp, Artificial
  CRISPR gRNA sequence
aggcttatagagtgtcaatt

SEQ ID NO: 401093 - DNA, 20 bp, Artificial
  CRISPR gRNA sequence
atagagtgtcaatttacaat

SEQ ID NO: 401094 - DNA, 20 bp, Artificial
  CRISPR gRNA sequence
tagagtgtcaatttacaatg

SEQ ID NO: 401095 - DNA, 20 bp, Artificial
  CRISPR gRNA sequence
acaatgtttctttagttaaa

SEQ ID NO: 401096 - DNA, 20 bp, Artificial
  CRISPR gRNA sequence
caatgtttctttagttaaat

SEQ ID NO: 401097 - DNA, 20 bp, Artificial
  CRISPR gRNA sequence
ctttagttaaatgtttattt

SEQ ID NO: 401098 - DNA, 20 bp, Artificial
  CRISPR gRNA sequence
tttagttaaatgtttattta

SEQ ID NO: 401099 - DNA, 20 bp, Artificial
  CRISPR gRNA sequence
tagttaaatgtttatttatt

SEQ ID NO: 401100 - DNA, 20 bp, Artificial
  CRISPR gRNA sequence
agttaaatgtttatttatta

SEQ ID NO: 401101 - DNA, 20 bp, Artificial
  CRISPR gRNA sequence
gttaaatgtttatttattaa

SEQ ID NO: 401102 - DNA, 20 bp, Artificial
  CRISPR gRNA sequence
aatgtttatttattaaagac

SEQ ID NO: 401103 - DNA, 20 bp, Artificial
  CRISPR gRNA sequence
atttattaaagactctgttt

SEQ ID NO: 401104 - DNA, 20 bp, Artificial
  CRISPR gRNA sequence
tttattaaagactctgtttc

SEQ ID NO: 401105 - DNA, 20 bp, Artificial
  CRISPR gRNA sequence
attaaagactctgtttcacc

SEQ ID NO: 401106 - DNA, 20 bp, Artificial
  CRISPR gRNA sequence
ttaaagactctgtttcacca

SEQ ID NO: 401107 - DNA, 20 bp, Artificial
  CRISPR gRNA sequence
aagactctgtttcaccatac

SEQ ID NO: 401108 - DNA, 20 bp, Artificial
  CRISPR gRNA sequence
tgtttcaccatacaagtcct

SEQ ID NO: 401109 - DNA, 20 bp, Artificial
  CRISPR gRNA sequence
tttcaccatacaagtcctca

SEQ ID NO: 401110 - DNA, 20 bp, Artificial
  CRISPR gRNA sequence
caccatacaagtcctcattt

SEQ ID NO: 401111 - DNA, 20 bp, Artificial
  CRISPR gRNA sequence
accatacaagtcctcatttg

SEQ ID NO: 401112 - DNA, 20 bp, Artificial
  CRISPR gRNA sequence
atttgctgttgtatgtagac

SEQ ID NO: 401113 - DNA, 20 bp, Artificial
  CRISPR gRNA sequence
gctgttgtatgtagacacct

SEQ ID NO: 401114 - DNA, 20 bp, Artificial
  CRISPR gRNA sequence
ctgttgtatgtagacacctg

SEQ ID NO: 401115 - DNA, 20 bp, Artificial
  CRISPR gRNA sequence
ttgtatgtagacacctgtta

SEQ ID NO: 401116 - DNA, 20 bp, Artificial
  CRISPR gRNA sequence
tatgtagacacctgttaaat

SEQ ID NO: 401117 - DNA, 20 bp, Artificial
  CRISPR gRNA sequence
ttaaatcctgcttggaagtt

SEQ ID NO: 401118 - DNA, 20 bp, Artificial
  CRISPR gRNA sequence
aatcctgcttggaagttttt

SEQ ID NO: 401119 - DNA, 20 bp, Artificial
  CRISPR gRNA sequence
cttggaagtttttactgtgt

SEQ ID NO: 401120 - DNA, 20 bp, Artificial
  CRISPR gRNA sequence
ggaagtttttactgtgtagt

SEQ ID NO: 401121 - DNA, 20 bp, Artificial
  CRISPR gRNA sequence
gaagtttttactgtgtagtt

SEQ ID NO: 401122 - DNA, 20 bp, Artificial
  CRISPR gRNA sequence
ttactgtgtagtttgctata

SEQ ID NO: 401123 - DNA, 20 bp, Artificial
  CRISPR gRNA sequence
tactgtgtagtttgctataa

SEQ ID NO: 401124 - DNA, 20 bp, Artificial
  CRISPR gRNA sequence
actgtgtagtttgctataaa

SEQ ID NO: 401125 - DNA, 20 bp, Artificial
  CRISPR gRNA sequence
ctgtgtagtttgctataaat

SEQ ID NO: 401126 - DNA, 20 bp, Artificial
  CRISPR gRNA sequence
tgtagtttgctataaatcag

SEQ ID NO: 401127 - DNA, 20 bp, Artificial
  CRISPR gRNA sequence
gctataaatcagtcaggcag

SEQ ID NO: 401128 - DNA, 20 bp, Artificial
  CRISPR gRNA sequence
ctataaatcagtcaggcagg

SEQ ID NO: 401129 - DNA, 20 bp, Artificial
  CRISPR gRNA sequence
taaatcagtcaggcaggcga

SEQ ID NO: 401130 - DNA, 20 bp, Artificial
  CRISPR gRNA sequence
gcaaagcttttaacatagac

SEQ ID NO: 401131 - DNA, 20 bp, Artificial
  CRISPR gRNA sequence
ttaacatagactgagccatt

SEQ ID NO: 401132 - DNA, 20 bp, Artificial
  CRISPR gRNA sequence
taacatagactgagccattg

SEQ ID NO: 401133 - DNA, 20 bp, Artificial
  CRISPR gRNA sequence
aacatagactgagccattgg

SEQ ID NO: 401134 - DNA, 20 bp, Artificial
  CRISPR gRNA sequence
acatagactgagccattgga

SEQ ID NO: 401135 - DNA, 20 bp, Artificial
  CRISPR gRNA sequence
agccattggaaacaaggcct

SEQ ID NO: 401136 - DNA, 20 bp, Artificial
  CRISPR gRNA sequence
gaaacaaggcctgagccacc

SEQ ID NO: 401137 - DNA, 20 bp, Artificial
  CRISPR gRNA sequence
agccaccaaagctagaacag

SEQ ID NO: 401138 - DNA, 20 bp, Artificial
  CRISPR gRNA sequence
gaacaggatgcactccccac

SEQ ID NO: 401139 - DNA, 20 bp, Artificial
  CRISPR gRNA sequence
cccactgctgccttgtgtgg

SEQ ID NO: 401140 - DNA, 20 bp, Artificial
  CRISPR gRNA sequence
ctgccttgtgtggtatgcct

SEQ ID NO: 401141 - DNA, 20 bp, Artificial
  CRISPR gRNA sequence
ccttgtgtggtatgccttta

SEQ ID NO: 401142 - DNA, 20 bp, Artificial
  CRISPR gRNA sequence
gtgtggtatgcctttaaagt

SEQ ID NO: 401143 - DNA, 20 bp, Artificial
  CRISPR gRNA sequence
tgtggtatgcctttaaagtt

SEQ ID NO: 401144 - DNA, 20 bp, Artificial
  CRISPR gRNA sequence
taaagtttgggttccaaatt

SEQ ID NO: 401145 - DNA, 20 bp, Artificial
  CRISPR gRNA sequence
aaagtttgggttccaaatta

SEQ ID NO: 401146 - DNA, 20 bp, Artificial
  CRISPR gRNA sequence
aagtttgggttccaaattag

SEQ ID NO: 401147 - DNA, 20 bp, Artificial
  CRISPR gRNA sequence
gggttccaaattagctgttt

SEQ ID NO: 401148 - DNA, 20 bp, Artificial
  CRISPR gRNA sequence
ggttccaaattagctgtttt

SEQ ID NO: 401149 - DNA, 20 bp, Artificial
  CRISPR gRNA sequence
caaattagctgttttggttt

SEQ ID NO: 401150 - DNA, 20 bp, Artificial
  CRISPR gRNA sequence
gctgttttggtttctgtcac

SEQ ID NO: 401151 - DNA, 20 bp, Artificial
  CRISPR gRNA sequence
ttttggtttctgtcacagga

SEQ ID NO: 401152 - DNA, 20 bp, Artificial
  CRISPR gRNA sequence
tggtttctgtcacaggacaa

SEQ ID NO: 401153 - DNA, 20 bp, Artificial
  CRISPR gRNA sequence
ggtttctgtcacaggacaac

SEQ ID NO: 401154 - DNA, 20 bp, Artificial
  CRISPR gRNA sequence
gtttctgtcacaggacaacc

SEQ ID NO: 401155 - DNA, 20 bp, Artificial
  CRISPR gRNA sequence
ctgtcacaggacaaccaatt

SEQ ID NO: 401156 - DNA, 20 bp, Artificial
  CRISPR gRNA sequence
tgtcacaggacaaccaattg

SEQ ID NO: 401157 - DNA, 20 bp, Artificial
  CRISPR gRNA sequence
tcacaggacaaccaattgaa

SEQ ID NO: 401158 - DNA, 20 bp, Artificial
  CRISPR gRNA sequence
aaaacagctcaacctttcag

SEQ ID NO: 401159 - DNA, 20 bp, Artificial
  CRISPR gRNA sequence
aacctttcaggatagaggat

SEQ ID NO: 401160 - DNA, 20 bp, Artificial
  CRISPR gRNA sequence
tcaggatagaggatggagct

SEQ ID NO: 401161 - DNA, 20 bp, Artificial
  CRISPR gRNA sequence
caggatagaggatggagcta

SEQ ID NO: 401162 - DNA, 20 bp, Artificial
  CRISPR gRNA sequence
aggatagaggatggagctaa

SEQ ID NO: 401163 - DNA, 20 bp, Artificial
  CRISPR gRNA sequence
acctgtagagaactaaatga

SEQ ID NO: 401164 - DNA, 20 bp, Artificial
  CRISPR gRNA sequence
tagagaactaaatgatggtt

SEQ ID NO: 401165 - DNA, 20 bp, Artificial
  CRISPR gRNA sequence
aatgatggttgttatgcaaa

SEQ ID NO: 401166 - DNA, 20 bp, Artificial
  CRISPR gRNA sequence
ttatgcaaaggtaggatttt

SEQ ID NO: 401167 - DNA, 20 bp, Artificial
  CRISPR gRNA sequence
tgcaaaggtaggatttttaa

SEQ ID NO: 401168 - DNA, 20 bp, Artificial
  CRISPR gRNA sequence
ttaacatcacatatgaatag

SEQ ID NO: 401169 - DNA, 20 bp, Artificial
  CRISPR gRNA sequence
taacatcacatatgaatagt

SEQ ID NO: 401170 - DNA, 20 bp, Artificial
  CRISPR gRNA sequence
aacatcacatatgaatagtc

SEQ ID NO: 401171 - DNA, 20 bp, Artificial
  CRISPR gRNA sequence
acatcacatatgaatagtct

SEQ ID NO: 401172 - DNA, 20 bp, Artificial
  CRISPR gRNA sequence
cggaatatttcctgttgttt

SEQ ID NO: 401173 - DNA, 20 bp, Artificial
  CRISPR gRNA sequence
ggaatatttcctgttgtttt

SEQ ID NO: 401174 - DNA, 20 bp, Artificial
  CRISPR gRNA sequence
cctgttgttttcatccagat

SEQ ID NO: 401175 - DNA, 20 bp, Artificial
  CRISPR gRNA sequence
ctgttgttttcatccagatt

SEQ ID NO: 401176 - DNA, 20 bp, Artificial
  CRISPR gRNA sequence
ttgttttcatccagatttgt

SEQ ID NO: 401177 - DNA, 20 bp, Artificial
  CRISPR gRNA sequence
ttttcatccagatttgtcat

SEQ ID NO: 401178 - DNA, 20 bp, Artificial
  CRISPR gRNA sequence
tcatccagatttgtcattac

SEQ ID NO: 401179 - DNA, 20 bp, Artificial
  CRISPR gRNA sequence
catccagatttgtcattact

SEQ ID NO: 401180 - DNA, 20 bp, Artificial
  CRISPR gRNA sequence
atccagatttgtcattactg

SEQ ID NO: 401181 - DNA, 20 bp, Artificial
  CRISPR gRNA sequence
gtcattactgctagtttttg

SEQ ID NO: 401182 - DNA, 20 bp, Artificial
  CRISPR gRNA sequence
tcattactgctagtttttga

SEQ ID NO: 401183 - DNA, 20 bp, Artificial
  CRISPR gRNA sequence
ctgctagtttttgaggttag

SEQ ID NO: 401184 - DNA, 20 bp, Artificial
  CRISPR gRNA sequence
ctagtttttgaggttaggaa

SEQ ID NO: 401185 - DNA, 20 bp, Artificial
  CRISPR gRNA sequence
gtttttgaggttaggaaaag

SEQ ID NO: 401186 - DNA, 20 bp, Artificial
  CRISPR gRNA sequence
ttgaggttaggaaaagagag

SEQ ID NO: 401187 - DNA, 20 bp, Artificial
  CRISPR gRNA sequence
tgaggttaggaaaagagagc

SEQ ID NO: 401188 - DNA, 20 bp, Artificial
  CRISPR gRNA sequence
gaggttaggaaaagagagct

SEQ ID NO: 401189 - DNA, 20 bp, Artificial
  CRISPR gRNA sequence
aggttaggaaaagagagctg

SEQ ID NO: 401190 - DNA, 20 bp, Artificial
  CRISPR gRNA sequence
ggaaaagagagctgtcacct

SEQ ID NO: 401191 - DNA, 20 bp, Artificial
  CRISPR gRNA sequence
tcaccttcatggggcttaaa

SEQ ID NO: 401192 - DNA, 20 bp, Artificial
  CRISPR gRNA sequence
catggggcttaaaaaaatac

SEQ ID NO: 401193 - DNA, 20 bp, Artificial
  CRISPR gRNA sequence
atggggcttaaaaaaataca

SEQ ID NO: 401194 - DNA, 20 bp, Artificial
  CRISPR gRNA sequence
aaaaaaatacaatgtggaga

SEQ ID NO: 401195 - DNA, 20 bp, Artificial
  CRISPR gRNA sequence
aaaaaatacaatgtggagat

SEQ ID NO: 401196 - DNA, 20 bp, Artificial
  CRISPR gRNA sequence
tcagtcagttttcagtcaga

SEQ ID NO: 401197 - DNA, 20 bp, Artificial
  CRISPR gRNA sequence
cagtcagttttcagtcagag

SEQ ID NO: 401198 - DNA, 20 bp, Artificial
  CRISPR gRNA sequence
agtcagttttcagtcagagg

SEQ ID NO: 401199 - DNA, 20 bp, Artificial
  CRISPR gRNA sequence
tcagtcagaggaaggaatac

SEQ ID NO: 401200 - DNA, 20 bp, Artificial
  CRISPR gRNA sequence
cagtcagaggaaggaatacc

SEQ ID NO: 401201 - DNA, 20 bp, Artificial
  CRISPR gRNA sequence
agtcagaggaaggaataccg

SEQ ID NO: 401202 - DNA, 20 bp, Artificial
  CRISPR gRNA sequence
tccgtctagtttgaattctt

SEQ ID NO: 401203 - DNA, 20 bp, Artificial
  CRISPR gRNA sequence
gtttgaattcttcatgatgg

SEQ ID NO: 401204 - DNA, 20 bp, Artificial
  CRISPR gRNA sequence
gaattcttcatgatggtatc

SEQ ID NO: 401205 - DNA, 20 bp, Artificial
  CRISPR gRNA sequence
aattcttcatgatggtatcc

SEQ ID NO: 401206 - DNA, 20 bp, Artificial
  CRISPR gRNA sequence
ttcatgatggtatccttagc

SEQ ID NO: 401207 - DNA, 20 bp, Artificial
  CRISPR gRNA sequence
catgatggtatccttagcca

SEQ ID NO: 401208 - DNA, 20 bp, Artificial
  CRISPR gRNA sequence
atgatggtatccttagccat

SEQ ID NO: 401209 - DNA, 20 bp, Artificial
  CRISPR gRNA sequence
agccatgatccattgctctt

SEQ ID NO: 401210 - DNA, 20 bp, Artificial
  CRISPR gRNA sequence
gccatgatccattgctcttg

SEQ ID NO: 401211 - DNA, 20 bp, Artificial
  CRISPR gRNA sequence
ctcttgttttgattatttgt

SEQ ID NO: 401212 - DNA, 20 bp, Artificial
  CRISPR gRNA sequence
ttgttttgattatttgtatt

SEQ ID NO: 401213 - DNA, 20 bp, Artificial
  CRISPR gRNA sequence
gttttgattatttgtatttt

SEQ ID NO: 401214 - DNA, 20 bp, Artificial
  CRISPR gRNA sequence
ttttgattatttgtatttta

SEQ ID NO: 401215 - DNA, 20 bp, Artificial
  CRISPR gRNA sequence
tgattatttgtattttaaag

SEQ ID NO: 401216 - DNA, 20 bp, Artificial
  CRISPR gRNA sequence
gattatttgtattttaaaga

SEQ ID NO: 401217 - DNA, 20 bp, Artificial
  CRISPR gRNA sequence
attatttgtattttaaagag

SEQ ID NO: 401218 - DNA, 20 bp, Artificial
  CRISPR gRNA sequence
tttgtattttaaagagcaga

SEQ ID NO: 401219 - DNA, 20 bp, Artificial
  CRISPR gRNA sequence
gtattttaaagagcagattg

SEQ ID NO: 401220 - DNA, 20 bp, Artificial
  CRISPR gRNA sequence
tattttaaagagcagattga

SEQ ID NO: 401221 - DNA, 20 bp, Artificial
  CRISPR gRNA sequence
taaagagcagattgatgcaa

SEQ ID NO: 401222 - DNA, 20 bp, Artificial
  CRISPR gRNA sequence
aaagagcagattgatgcaat

SEQ ID NO: 401223 - DNA, 20 bp, Artificial
  CRISPR gRNA sequence
aagagcagattgatgcaatg

SEQ ID NO: 401224 - DNA, 20 bp, Artificial
  CRISPR gRNA sequence
atgcaatgggctagtgaggg

SEQ ID NO: 401225 - DNA, 20 bp, Artificial
  CRISPR gRNA sequence
gtgagggcattctaccctat

SEQ ID NO: 401226 - DNA, 20 bp, Artificial
  CRISPR gRNA sequence
taccctattttgagagtttg

SEQ ID NO: 401227 - DNA, 20 bp, Artificial
  CRISPR gRNA sequence
ccctattttgagagtttgag

SEQ ID NO: 401228 - DNA, 20 bp, Artificial
  CRISPR gRNA sequence
ttttgagagtttgagagctt

SEQ ID NO: 401229 - DNA, 20 bp, Artificial
  CRISPR gRNA sequence
tgagagtttgagagcttcac

SEQ ID NO: 401230 - DNA, 20 bp, Artificial
  CRISPR gRNA sequence
gagagtttgagagcttcact

SEQ ID NO: 401231 - DNA, 20 bp, Artificial
  CRISPR gRNA sequence
agagtttgagagcttcactt

SEQ ID NO: 401232 - DNA, 20 bp, Artificial
  CRISPR gRNA sequence
gagagcttcacttttttaaa

SEQ ID NO: 401233 - DNA, 20 bp, Artificial
  CRISPR gRNA sequence
agagcttcacttttttaaac

SEQ ID NO: 401234 - DNA, 20 bp, Artificial
  CRISPR gRNA sequence
cacttttttaaactaagaat

SEQ ID NO: 401235 - DNA, 20 bp, Artificial
  CRISPR gRNA sequence
acttttttaaactaagaatg

SEQ ID NO: 401236 - DNA, 20 bp, Artificial
  CRISPR gRNA sequence
ttttaaactaagaatgatag

SEQ ID NO: 401237 - DNA, 20 bp, Artificial
  CRISPR gRNA sequence
tttaaactaagaatgatagt

SEQ ID NO: 401238 - DNA, 20 bp, Artificial
  CRISPR gRNA sequence
ttaaactaagaatgatagtg

SEQ ID NO: 401239 - DNA, 20 bp, Artificial
  CRISPR gRNA sequence
taaactaagaatgatagtga

SEQ ID NO: 401240 - DNA, 20 bp, Artificial
  CRISPR gRNA sequence
aaactaagaatgatagtgag

SEQ ID NO: 401241 - DNA, 20 bp, Artificial
  CRISPR gRNA sequence
aactaagaatgatagtgagt

SEQ ID NO: 401242 - DNA, 20 bp, Artificial
  CRISPR gRNA sequence
agaatgatagtgagtttaaa

SEQ ID NO: 401243 - DNA, 20 bp, Artificial
  CRISPR gRNA sequence
aaaaaatattagttgtattt

SEQ ID NO: 401244 - DNA, 20 bp, Artificial
  CRISPR gRNA sequence
aaaaatattagttgtatttc

SEQ ID NO: 401245 - DNA, 20 bp, Artificial
  CRISPR gRNA sequence
gttgtatttcaaaattaacc

SEQ ID NO: 401246 - DNA, 20 bp, Artificial
  CRISPR gRNA sequence
tatttcaaaattaaccttag

SEQ ID NO: 401247 - DNA, 20 bp, Artificial
  CRISPR gRNA sequence
caaaattaaccttaggtgtg

SEQ ID NO: 401248 - DNA, 20 bp, Artificial
  CRISPR gRNA sequence
aaaattaaccttaggtgtgc

SEQ ID NO: 401249 - DNA, 20 bp, Artificial
  CRISPR gRNA sequence
accttaggtgtgcttgaaat

SEQ ID NO: 401250 - DNA, 20 bp, Artificial
  CRISPR gRNA sequence
aggtgtgcttgaaattttct

SEQ ID NO: 401251 - DNA, 20 bp, Artificial
  CRISPR gRNA sequence
ggtgtgcttgaaattttctt

SEQ ID NO: 401252 - DNA, 20 bp, Artificial
  CRISPR gRNA sequence
gaaattttcttatgtacttc

SEQ ID NO: 401253 - DNA, 20 bp, Artificial
  CRISPR gRNA sequence
aaattttcttatgtacttca

SEQ ID NO: 401254 - DNA, 20 bp, Artificial
  CRISPR gRNA sequence
tcttatgtacttcagtaaca

SEQ ID NO: 401255 - DNA, 20 bp, Artificial
  CRISPR gRNA sequence
cttatgtacttcagtaacaa

SEQ ID NO: 401256 - DNA, 20 bp, Artificial
  CRISPR gRNA sequence
ttatgtacttcagtaacaac

SEQ ID NO: 401257 - DNA, 20 bp, Artificial
  CRISPR gRNA sequence
atgtacttcagtaacaacat

SEQ ID NO: 401258 - DNA, 20 bp, Artificial
  CRISPR gRNA sequence
tgtacttcagtaacaacata

SEQ ID NO: 401259 - DNA, 20 bp, Artificial
  CRISPR gRNA sequence
cagtaacaacatactgggat

SEQ ID NO: 401260 - DNA, 20 bp, Artificial
  CRISPR gRNA sequence
agtaacaacatactgggatt

SEQ ID NO: 401261 - DNA, 20 bp, Artificial
  CRISPR gRNA sequence
ggattgcaaatattgtactt

SEQ ID NO: 401262 - DNA, 20 bp, Artificial
  CRISPR gRNA sequence
caaatattgtacttttgtat

SEQ ID NO: 401263 - DNA, 20 bp, Artificial
  CRISPR gRNA sequence
tacttttgtatactgtaaag

SEQ ID NO: 401264 - DNA, 20 bp, Artificial
  CRISPR gRNA sequence
ttgtatactgtaaaggggga

SEQ ID NO: 401265 - DNA, 20 bp, Artificial
  CRISPR gRNA sequence
tgtatactgtaaagggggag

SEQ ID NO: 401266 - DNA, 20 bp, Artificial
  CRISPR gRNA sequence
gtatactgtaaagggggagt

SEQ ID NO: 401267 - DNA, 20 bp, Artificial
  CRISPR gRNA sequence
tatactgtaaagggggagtt

SEQ ID NO: 401268 - DNA, 20 bp, Artificial
  CRISPR gRNA sequence
taaagggggagttgaaaata

SEQ ID NO: 401269 - DNA, 20 bp, Artificial
  CRISPR gRNA sequence
aaaatacattaaatagtaaa

SEQ ID NO: 401270 - DNA, 20 bp, Artificial
  CRISPR gRNA sequence
aatagtaaaaaaaaaaaaaa

SEQ ID NO: 401271 - DNA, 20 bp, Artificial
  CRISPR gRNA sequence
ggaatctagaaatcctagtt

SEQ ID NO: 401272 - DNA, 20 bp, Artificial
  CRISPR gRNA sequence
gaatctagaaatcctagttt

SEQ ID NO: 401273 - DNA, 20 bp, Artificial
  CRISPR gRNA sequence
gaaatcctagtttgtataat

SEQ ID NO: 401274 - DNA, 20 bp, Artificial
  CRISPR gRNA sequence
gtttgtataatggattgtaa

SEQ ID NO: 401275 - DNA, 20 bp, Artificial
  CRISPR gRNA sequence
gtataatggattgtaagaac

SEQ ID NO: 401276 - DNA, 20 bp, Artificial
  CRISPR gRNA sequence
tataatggattgtaagaact

SEQ ID NO: 401277 - DNA, 20 bp, Artificial
  CRISPR gRNA sequence
taagaacttcagaaggatga

SEQ ID NO: 401278 - DNA, 20 bp, Artificial
  CRISPR gRNA sequence
cagaaggatgaaggagttgg

SEQ ID NO: 401279 - DNA, 20 bp, Artificial
  CRISPR gRNA sequence
agaaggatgaaggagttggg

SEQ ID NO: 401280 - DNA, 20 bp, Artificial
  CRISPR gRNA sequence
ggccctatgctctgtaaata

SEQ ID NO: 401281 - DNA, 20 bp, Artificial
  CRISPR gRNA sequence
tgctctgtaaatatgttgat

SEQ ID NO: 401282 - DNA, 20 bp, Artificial
  CRISPR gRNA sequence
tgtaaatatgttgatttttt

SEQ ID NO: 401283 - DNA, 20 bp, Artificial
  CRISPR gRNA sequence
taaatatgttgattttttgc

SEQ ID NO: 401284 - DNA, 20 bp, Artificial
  CRISPR gRNA sequence
attttttgctatttattgat

SEQ ID NO: 401285 - DNA, 20 bp, Artificial
  CRISPR gRNA sequence
tttgctatttattgatagct

SEQ ID NO: 401286 - DNA, 20 bp, Artificial
  CRISPR gRNA sequence
ttgctatttattgatagctt

SEQ ID NO: 401287 - DNA, 20 bp, Artificial
  CRISPR gRNA sequence
tgctatttattgatagctta

SEQ ID NO: 401288 - DNA, 20 bp, Artificial
  CRISPR gRNA sequence
gctatttattgatagcttat

SEQ ID NO: 401289 - DNA, 20 bp, Artificial
  CRISPR gRNA sequence
ctatttattgatagcttatt

SEQ ID NO: 401290 - DNA, 20 bp, Artificial
  CRISPR gRNA sequence
tttattgatagcttattatg

SEQ ID NO: 401291 - DNA, 20 bp, Artificial
  CRISPR gRNA sequence
attgatagcttattatgtgc

SEQ ID NO: 401292 - DNA, 20 bp, Artificial
  CRISPR gRNA sequence
ttgatagcttattatgtgcg

SEQ ID NO: 401293 - DNA, 20 bp, Artificial
  CRISPR gRNA sequence
atagcttattatgtgcggaa

SEQ ID NO: 401294 - DNA, 20 bp, Artificial
  CRISPR gRNA sequence
attatgtgcggaattttaca

SEQ ID NO: 401295 - DNA, 20 bp, Artificial
  CRISPR gRNA sequence
ttatgtgcggaattttacat

SEQ ID NO: 401296 - DNA, 20 bp, Artificial
  CRISPR gRNA sequence
tgtgcggaattttacatagt

SEQ ID NO: 401297 - DNA, 20 bp, Artificial
  CRISPR gRNA sequence
tacatagtctggatcttcat

SEQ ID NO: 401298 - DNA, 20 bp, Artificial
  CRISPR gRNA sequence
acatagtctggatcttcata

SEQ ID NO: 401299 - DNA, 20 bp, Artificial
  CRISPR gRNA sequence
catagtctggatcttcatag

SEQ ID NO: 401300 - DNA, 20 bp, Artificial
  CRISPR gRNA sequence
gatcttcatagacttcctcc

SEQ ID NO: 401301 - DNA, 20 bp, Artificial
  CRISPR gRNA sequence
catagacttcctccttgaat

SEQ ID NO: 401302 - DNA, 20 bp, Artificial
  CRISPR gRNA sequence
atagacttcctccttgaatc

SEQ ID NO: 401303 - DNA, 20 bp, Artificial
  CRISPR gRNA sequence
cctccttgaatctcctgtgt

SEQ ID NO: 401304 - DNA, 20 bp, Artificial
  CRISPR gRNA sequence
ctccttgaatctcctgtgtg

SEQ ID NO: 401305 - DNA, 20 bp, Artificial
  CRISPR gRNA sequence
cttgaatctcctgtgtgcac

SEQ ID NO: 401306 - DNA, 20 bp, Artificial
  CRISPR gRNA sequence
gaatctcctgtgtgcacttg

SEQ ID NO: 401307 - DNA, 20 bp, Artificial
  CRISPR gRNA sequence
aatctcctgtgtgcacttga

SEQ ID NO: 401308 - DNA, 20 bp, Artificial
  CRISPR gRNA sequence
ctgtgtgcacttgaacgttt

SEQ ID NO: 401309 - DNA, 20 bp, Artificial
  CRISPR gRNA sequence
tgtgcacttgaacgtttgta

SEQ ID NO: 401310 - DNA, 20 bp, Artificial
  CRISPR gRNA sequence
gaacgtttgtattgcctgat

SEQ ID NO: 401311 - DNA, 20 bp, Artificial
  CRISPR gRNA sequence
aacgtttgtattgcctgatt

SEQ ID NO: 401312 - DNA, 20 bp, Artificial
  CRISPR gRNA sequence
gtattgcctgattttacaga

SEQ ID NO: 401313 - DNA, 20 bp, Artificial
  CRISPR gRNA sequence
tattgcctgattttacagat

SEQ ID NO: 401314 - DNA, 20 bp, Artificial
  CRISPR gRNA sequence
cctgattttacagatgatga

SEQ ID NO: 401315 - DNA, 20 bp, Artificial
  CRISPR gRNA sequence
attttacagatgatgacatt

SEQ ID NO: 401316 - DNA, 20 bp, Artificial
  CRISPR gRNA sequence
tacagatgatgacattgaag

SEQ ID NO: 401317 - DNA, 20 bp, Artificial
  CRISPR gRNA sequence
acagatgatgacattgaagt

SEQ ID NO: 401318 - DNA, 20 bp, Artificial
  CRISPR gRNA sequence
cagatgatgacattgaagtg

SEQ ID NO: 401319 - DNA, 20 bp, Artificial
  CRISPR gRNA sequence
aagtgcagtgaggtctagta

SEQ ID NO: 401320 - DNA, 20 bp, Artificial
  CRISPR gRNA sequence
gtagtctttccaaggcccta

SEQ ID NO: 401321 - DNA, 20 bp, Artificial
  CRISPR gRNA sequence
tccaaggccctaagtttcac

SEQ ID NO: 401322 - DNA, 20 bp, Artificial
  CRISPR gRNA sequence
ccaaggccctaagtttcacg

SEQ ID NO: 401323 - DNA, 20 bp, Artificial
  CRISPR gRNA sequence
caaggccctaagtttcacgt

SEQ ID NO: 401324 - DNA, 20 bp, Artificial
  CRISPR gRNA sequence
agtttcacgtatgtcccagc

SEQ ID NO: 401325 - DNA, 20 bp, Artificial
  CRISPR gRNA sequence
cacgtatgtcccagcagata

SEQ ID NO: 401326 - DNA, 20 bp, Artificial
  CRISPR gRNA sequence
acgtatgtcccagcagataa

SEQ ID NO: 401327 - DNA, 20 bp, Artificial
  CRISPR gRNA sequence
caaattgatgtaactgtcag

SEQ ID NO: 401328 - DNA, 20 bp, Artificial
  CRISPR gRNA sequence
atgtaactgtcagcctgggg

SEQ ID NO: 401329 - DNA, 20 bp, Artificial
  CRISPR gRNA sequence
tcagcctgggggacatggga

SEQ ID NO: 401330 - DNA, 20 bp, Artificial
  CRISPR gRNA sequence
ggggacatgggaacccacca

SEQ ID NO: 401331 - DNA, 20 bp, Artificial
  CRISPR gRNA sequence
gaagaaggagaccttggcct

SEQ ID NO: 401332 - DNA, 20 bp, Artificial
  CRISPR gRNA sequence
aagaaggagaccttggcctt

SEQ ID NO: 401333 - DNA, 20 bp, Artificial
  CRISPR gRNA sequence
ggcctttgtacctcctatca

SEQ ID NO: 401334 - DNA, 20 bp, Artificial
  CRISPR gRNA sequence
gcctttgtacctcctatcaa

SEQ ID NO: 401335 - DNA, 20 bp, Artificial
  CRISPR gRNA sequence
tgtacctcctatcaatgcta

SEQ ID NO: 401336 - DNA, 20 bp, Artificial
  CRISPR gRNA sequence
gtacctcctatcaatgctac

SEQ ID NO: 401337 - DNA, 20 bp, Artificial
  CRISPR gRNA sequence
tacctcctatcaatgctacc

SEQ ID NO: 401338 - DNA, 20 bp, Artificial
  CRISPR gRNA sequence
ctatcaatgctacccctctc

SEQ ID NO: 401339 - DNA, 20 bp, Artificial
  CRISPR gRNA sequence
tcaatgctacccctctccag

SEQ ID NO: 401340 - DNA, 20 bp, Artificial
  CRISPR gRNA sequence
cccctctccagctttcagcc

SEQ ID NO: 401341 - DNA, 20 bp, Artificial
  CRISPR gRNA sequence
tccagctttcagcctagagt

SEQ ID NO: 401342 - DNA, 20 bp, Artificial
  CRISPR gRNA sequence
cagctttcagcctagagttt

SEQ ID NO: 401343 - DNA, 20 bp, Artificial
  CRISPR gRNA sequence
tcagcctagagtttaagagc

SEQ ID NO: 401344 - DNA, 20 bp, Artificial
  CRISPR gRNA sequence
cagcctagagtttaagagca

SEQ ID NO: 401345 - DNA, 20 bp, Artificial
  CRISPR gRNA sequence
agcctagagtttaagagcaa

SEQ ID NO: 401346 - DNA, 20 bp, Artificial
  CRISPR gRNA sequence
gagtttaagagcaaacagga

SEQ ID NO: 401347 - DNA, 20 bp, Artificial
  CRISPR gRNA sequence
aagagcaaacaggacatctt

SEQ ID NO: 401348 - DNA, 20 bp, Artificial
  CRISPR gRNA sequence
agagcaaacaggacatctta

SEQ ID NO: 401349 - DNA, 20 bp, Artificial
  CRISPR gRNA sequence
attctgaataaatggtacta

SEQ ID NO: 401350 - DNA, 20 bp, Artificial
  CRISPR gRNA sequence
ttctgaataaatggtactac

SEQ ID NO: 401351 - DNA, 20 bp, Artificial
  CRISPR gRNA sequence
tgaataaatggtactactaa

SEQ ID NO: 401352 - DNA, 20 bp, Artificial
  CRISPR gRNA sequence
aataaatggtactactaata

SEQ ID NO: 401353 - DNA, 20 bp, Artificial
  CRISPR gRNA sequence
ctaatacaaagttatttgaa

SEQ ID NO: 401354 - DNA, 20 bp, Artificial
  CRISPR gRNA sequence
atacaaagttatttgaaaat

SEQ ID NO: 401355 - DNA, 20 bp, Artificial
  CRISPR gRNA sequence
tttgaaaatatgtgttcttt

SEQ ID NO: 401356 - DNA, 20 bp, Artificial
  CRISPR gRNA sequence
gaaaatatgtgttctttcca

SEQ ID NO: 401357 - DNA, 20 bp, Artificial
  CRISPR gRNA sequence
aaaatatgtgttctttccag

SEQ ID NO: 401358 - DNA, 20 bp, Artificial
  CRISPR gRNA sequence
tttccagaacaggcatttct

SEQ ID NO: 401359 - DNA, 20 bp, Artificial
  CRISPR gRNA sequence
tccagaacaggcatttcttc

SEQ ID NO: 401360 - DNA, 20 bp, Artificial
  CRISPR gRNA sequence
ccagaacaggcatttcttca

SEQ ID NO: 401361 - DNA, 20 bp, Artificial
  CRISPR gRNA sequence
cagaacaggcatttcttcat

SEQ ID NO: 401362 - DNA, 20 bp, Artificial
  CRISPR gRNA sequence
cttcattagcaattgattta

SEQ ID NO: 401363 - DNA, 20 bp, Artificial
  CRISPR gRNA sequence
ttcattagcaattgatttag

SEQ ID NO: 401364 - DNA, 20 bp, Artificial
  CRISPR gRNA sequence
cattagcaattgatttagag

SEQ ID NO: 401365 - DNA, 20 bp, Artificial
  CRISPR gRNA sequence
attagcaattgatttagaga

SEQ ID NO: 401366 - DNA, 20 bp, Artificial
  CRISPR gRNA sequence
gcaattgatttagagactct

SEQ ID NO: 401367 - DNA, 20 bp, Artificial
  CRISPR gRNA sequence
atttagagactctgatggta

SEQ ID NO: 401368 - DNA, 20 bp, Artificial
  CRISPR gRNA sequence
agagactctgatggtaagaa

SEQ ID NO: 401369 - DNA, 20 bp, Artificial
  CRISPR gRNA sequence
gagactctgatggtaagaat

SEQ ID NO: 401370 - DNA, 20 bp, Artificial
  CRISPR gRNA sequence
tgatggtaagaataaatgca

SEQ ID NO: 401371 - DNA, 20 bp, Artificial
  CRISPR gRNA sequence
atggtaagaataaatgcatt

SEQ ID NO: 401372 - DNA, 20 bp, Artificial
  CRISPR gRNA sequence
gtttttacctagtttgtgag

SEQ ID NO: 401373 - DNA, 20 bp, Artificial
  CRISPR gRNA sequence
tttttacctagtttgtgaga

SEQ ID NO: 401374 - DNA, 20 bp, Artificial
  CRISPR gRNA sequence
ttacctagtttgtgagaaaa

SEQ ID NO: 401375 - DNA, 20 bp, Artificial
  CRISPR gRNA sequence
tacctagtttgtgagaaaat

SEQ ID NO: 401376 - DNA, 20 bp, Artificial
  CRISPR gRNA sequence
acctagtttgtgagaaaata

SEQ ID NO: 401377 - DNA, 20 bp, Artificial
  CRISPR gRNA sequence
cctagtttgtgagaaaatat

SEQ ID NO: 401378 - DNA, 20 bp, Artificial
  CRISPR gRNA sequence
gtttgtgagaaaatatgcag

SEQ ID NO: 401379 - DNA, 20 bp, Artificial
  CRISPR gRNA sequence
gtgagaaaatatgcagagat

SEQ ID NO: 401380 - DNA, 20 bp, Artificial
  CRISPR gRNA sequence
tgagaaaatatgcagagatg

SEQ ID NO: 401381 - DNA, 20 bp, Artificial
  CRISPR gRNA sequence
gggggaccacattttccaga

SEQ ID NO: 401382 - DNA, 20 bp, Artificial
  CRISPR gRNA sequence
ggggaccacattttccagat

SEQ ID NO: 401383 - DNA, 20 bp, Artificial
  CRISPR gRNA sequence
tccagatagccctttctagc

SEQ ID NO: 401384 - DNA, 20 bp, Artificial
  CRISPR gRNA sequence
ccagatagccctttctagca

SEQ ID NO: 401385 - DNA, 20 bp, Artificial
  CRISPR gRNA sequence
cagatagccctttctagcag

SEQ ID NO: 401386 - DNA, 20 bp, Artificial
  CRISPR gRNA sequence
tctagcagagtttgtgaggt

SEQ ID NO: 401387 - DNA, 20 bp, Artificial
  CRISPR gRNA sequence
ctagcagagtttgtgaggtc

SEQ ID NO: 401388 - DNA, 20 bp, Artificial
  CRISPR gRNA sequence
tagcagagtttgtgaggtca

SEQ ID NO: 401389 - DNA, 20 bp, Artificial
  CRISPR gRNA sequence
gcagagtttgtgaggtcatg

SEQ ID NO: 401390 - DNA, 20 bp, Artificial
  CRISPR gRNA sequence
gtgaggtcatggagaaaact

SEQ ID NO: 401391 - DNA, 20 bp, Artificial
  CRISPR gRNA sequence
tgaggtcatggagaaaacta

SEQ ID NO: 401392 - DNA, 20 bp, Artificial
  CRISPR gRNA sequence
ctgtcacctacgtgtctctg

SEQ ID NO: 401393 - DNA, 20 bp, Artificial
  CRISPR gRNA sequence
tcacctacgtgtctctggct

SEQ ID NO: 401394 - DNA, 20 bp, Artificial
  CRISPR gRNA sequence
cgtgtctctggctttattag

SEQ ID NO: 401395 - DNA, 20 bp, Artificial
  CRISPR gRNA sequence
tggctttattagtcagttaa

SEQ ID NO: 401396 - DNA, 20 bp, Artificial
  CRISPR gRNA sequence
gctttattagtcagttaaag

SEQ ID NO: 401397 - DNA, 20 bp, Artificial
  CRISPR gRNA sequence
tattagtcagttaaagcaaa

SEQ ID NO: 401398 - DNA, 20 bp, Artificial
  CRISPR gRNA sequence
attagtcagttaaagcaaat

SEQ ID NO: 401399 - DNA, 20 bp, Artificial
  CRISPR gRNA sequence
ttagtcagttaaagcaaata

SEQ ID NO: 401400 - DNA, 20 bp, Artificial
  CRISPR gRNA sequence
gtcagttaaagcaaatatag

SEQ ID NO: 401401 - DNA, 20 bp, Artificial
  CRISPR gRNA sequence
aagcaaatatagttgcattt

SEQ ID NO: 401402 - DNA, 20 bp, Artificial
  CRISPR gRNA sequence
catttacagaaataccccca

SEQ ID NO: 401403 - DNA, 20 bp, Artificial
  CRISPR gRNA sequence
acagaaatacccccaaaatg

SEQ ID NO: 401404 - DNA, 20 bp, Artificial
  CRISPR gRNA sequence
cagaaatacccccaaaatga

SEQ ID NO: 401405 - DNA, 20 bp, Artificial
  CRISPR gRNA sequence
agaatgctctgccacctagt

SEQ ID NO: 401406 - DNA, 20 bp, Artificial
  CRISPR gRNA sequence
tgccacctagtgtttactgg

SEQ ID NO: 401407 - DNA, 20 bp, Artificial
  CRISPR gRNA sequence
ccacctagtgtttactgggt

SEQ ID NO: 401408 - DNA, 20 bp, Artificial
  CRISPR gRNA sequence
gtgtttactgggtgcctgct

SEQ ID NO: 401409 - DNA, 20 bp, Artificial
  CRISPR gRNA sequence
actgggtgcctgctctgtag

SEQ ID NO: 401410 - DNA, 20 bp, Artificial
  CRISPR gRNA sequence
ctgggtgcctgctctgtagg

SEQ ID NO: 401411 - DNA, 20 bp, Artificial
  CRISPR gRNA sequence
ggtgcctgctctgtaggatg

SEQ ID NO: 401412 - DNA, 20 bp, Artificial
  CRISPR gRNA sequence
ctctgtaggatgcaactgcg

SEQ ID NO: 401413 - DNA, 20 bp, Artificial
  CRISPR gRNA sequence
tgtaggatgcaactgcgtgt

SEQ ID NO: 401414 - DNA, 20 bp, Artificial
  CRISPR gRNA sequence
taggatgcaactgcgtgtca

SEQ ID NO: 401415 - DNA, 20 bp, Artificial
  CRISPR gRNA sequence
cgtgtcatttcatttaatcc

SEQ ID NO: 401416 - DNA, 20 bp, Artificial
  CRISPR gRNA sequence
catttaatccttatgaagca

SEQ ID NO: 401417 - DNA, 20 bp, Artificial
  CRISPR gRNA sequence
atttaatccttatgaagcac

SEQ ID NO: 401418 - DNA, 20 bp, Artificial
  CRISPR gRNA sequence
aatccttatgaagcactatg

SEQ ID NO: 401419 - DNA, 20 bp, Artificial
  CRISPR gRNA sequence
atccttatgaagcactatgg

SEQ ID NO: 401420 - DNA, 20 bp, Artificial
  CRISPR gRNA sequence
atgaagcactatggggaggt

SEQ ID NO: 401421 - DNA, 20 bp, Artificial
  CRISPR gRNA sequence
tgaagcactatggggaggta

SEQ ID NO: 401422 - DNA, 20 bp, Artificial
  CRISPR gRNA sequence
tggggaggtaatatgttccc

SEQ ID NO: 401423 - DNA, 20 bp, Artificial
  CRISPR gRNA sequence
ccgtaatacaacagaagaca

SEQ ID NO: 401424 - DNA, 20 bp, Artificial
  CRISPR gRNA sequence
aggttcagggtggtagactc

SEQ ID NO: 401425 - DNA, 20 bp, Artificial
  CRISPR gRNA sequence
agggtggtagactcacttgt

SEQ ID NO: 401426 - DNA, 20 bp, Artificial
  CRISPR gRNA sequence
acttgtccaaggttatcaag

SEQ ID NO: 401427 - DNA, 20 bp, Artificial
  CRISPR gRNA sequence
gtccaaggttatcaagctgc

SEQ ID NO: 401428 - DNA, 20 bp, Artificial
  CRISPR gRNA sequence
tccaaggttatcaagctgcc

SEQ ID NO: 401429 - DNA, 20 bp, Artificial
  CRISPR gRNA sequence
tcaagctgccaagtggcagc

SEQ ID NO: 401430 - DNA, 20 bp, Artificial
  CRISPR gRNA sequence
ccaagtggcagcaccagaat

SEQ ID NO: 401431 - DNA, 20 bp, Artificial
  CRISPR gRNA sequence
atttttctgaagagccagag

SEQ ID NO: 401432 - DNA, 20 bp, Artificial
  CRISPR gRNA sequence
ttctgaagagccagagatct

SEQ ID NO: 401433 - DNA, 20 bp, Artificial
  CRISPR gRNA sequence
tctgaagagccagagatctt

SEQ ID NO: 401434 - DNA, 20 bp, Artificial
  CRISPR gRNA sequence
ctgaagagccagagatctta

SEQ ID NO: 401435 - DNA, 20 bp, Artificial
  CRISPR gRNA sequence
tgaagagccagagatcttaa

SEQ ID NO: 401436 - DNA, 20 bp, Artificial
  CRISPR gRNA sequence
aagagccagagatcttaact

SEQ ID NO: 401437 - DNA, 20 bp, Artificial
  CRISPR gRNA sequence
aactccagtggaatgaacca

SEQ ID NO: 401438 - DNA, 20 bp, Artificial
  CRISPR gRNA sequence
actccagtggaatgaaccag

SEQ ID NO: 401439 - DNA, 20 bp, Artificial
  CRISPR gRNA sequence
cagtggaatgaaccagggag

SEQ ID NO: 401440 - DNA, 20 bp, Artificial
  CRISPR gRNA sequence
gaccttgaagaattggaagg

SEQ ID NO: 401441 - DNA, 20 bp, Artificial
  CRISPR gRNA sequence
gaagaattggaaggaatatt

SEQ ID NO: 401442 - DNA, 20 bp, Artificial
  CRISPR gRNA sequence
aagaattggaaggaatattt

SEQ ID NO: 401443 - DNA, 20 bp, Artificial
  CRISPR gRNA sequence
gaaggaatattttaattaga

SEQ ID NO: 401444 - DNA, 20 bp, Artificial
  CRISPR gRNA sequence
taattagagaggccggggtc

SEQ ID NO: 401445 - DNA, 20 bp, Artificial
  CRISPR gRNA sequence
aattagagaggccggggtct

SEQ ID NO: 401446 - DNA, 20 bp, Artificial
  CRISPR gRNA sequence
attagagaggccggggtctg

SEQ ID NO: 401447 - DNA, 20 bp, Artificial
  CRISPR gRNA sequence
gagaggccggggtctgggga

SEQ ID NO: 401448 - DNA, 20 bp, Artificial
  CRISPR gRNA sequence
gggaagagagaagacagaga

SEQ ID NO: 401449 - DNA, 20 bp, Artificial
  CRISPR gRNA sequence
ggggtactgatggcttaaag

SEQ ID NO: 401450 - DNA, 20 bp, Artificial
  CRISPR gRNA sequence
atggcttaaagaagggcaca

SEQ ID NO: 401451 - DNA, 20 bp, Artificial
  CRISPR gRNA sequence
aaagaagggcacagtggagg

SEQ ID NO: 401452 - DNA, 20 bp, Artificial
  CRISPR gRNA sequence
aagaagggcacagtggaggt

SEQ ID NO: 401453 - DNA, 20 bp, Artificial
  CRISPR gRNA sequence
atgtaagaggcagagcctgg

SEQ ID NO: 401454 - DNA, 20 bp, Artificial
  CRISPR gRNA sequence
gccttctctgactagggcac

SEQ ID NO: 401455 - DNA, 20 bp, Artificial
  CRISPR gRNA sequence
ctctgactagggcactggat

SEQ ID NO: 401456 - DNA, 20 bp, Artificial
  CRISPR gRNA sequence
tctgactagggcactggatt

SEQ ID NO: 401457 - DNA, 20 bp, Artificial
  CRISPR gRNA sequence
tgactagggcactggatttg

SEQ ID NO: 401458 - DNA, 20 bp, Artificial
  CRISPR gRNA sequence
actagggcactggatttgga

SEQ ID NO: 401459 - DNA, 20 bp, Artificial
  CRISPR gRNA sequence
gggcactggatttggataag

SEQ ID NO: 401460 - DNA, 20 bp, Artificial
  CRISPR gRNA sequence
gatttggataagatgtggtt

SEQ ID NO: 401461 - DNA, 20 bp, Artificial
  CRISPR gRNA sequence
ggataagatgtggttctcac

SEQ ID NO: 401462 - DNA, 20 bp, Artificial
  CRISPR gRNA sequence
gataagatgtggttctcacc

SEQ ID NO: 401463 - DNA, 20 bp, Artificial
  CRISPR gRNA sequence
tcaccctgggctctgaggcc

SEQ ID NO: 401464 - DNA, 20 bp, Artificial
  CRISPR gRNA sequence
accctgggctctgaggcccc

SEQ ID NO: 401465 - DNA, 20 bp, Artificial
  CRISPR gRNA sequence
ggctctgaggccccctacac

SEQ ID NO: 401466 - DNA, 20 bp, Artificial
  CRISPR gRNA sequence
tgaggccccctacacccaca

SEQ ID NO: 401467 - DNA, 20 bp, Artificial
  CRISPR gRNA sequence
aggccccctacacccacaga

SEQ ID NO: 401468 - DNA, 20 bp, Artificial
  CRISPR gRNA sequence
cacccacagaggtggcctga

SEQ ID NO: 401469 - DNA, 20 bp, Artificial
  CRISPR gRNA sequence
agaggcagcctcccaggaaa

SEQ ID NO: 401470 - DNA, 20 bp, Artificial
  CRISPR gRNA sequence
ccaggaaaggaagacactgt

SEQ ID NO: 401471 - DNA, 20 bp, Artificial
  CRISPR gRNA sequence
tgagagtgagactctctccc

SEQ ID NO: 401472 - DNA, 20 bp, Artificial
  CRISPR gRNA sequence
tctccctgcatgcaccagca

SEQ ID NO: 401473 - DNA, 20 bp, Artificial
  CRISPR gRNA sequence
tccctgcatgcaccagcaaa

SEQ ID NO: 401474 - DNA, 20 bp, Artificial
  CRISPR gRNA sequence
cctgcatgcaccagcaaagg

SEQ ID NO: 401475 - DNA, 20 bp, Artificial
  CRISPR gRNA sequence
catgcaccagcaaaggggct

SEQ ID NO: 401476 - DNA, 20 bp, Artificial
  CRISPR gRNA sequence
agcttatgatactttagagt

SEQ ID NO: 401477 - DNA, 20 bp, Artificial
  CRISPR gRNA sequence
atgatactttagagtttcag

SEQ ID NO: 401478 - DNA, 20 bp, Artificial
  CRISPR gRNA sequence
tgatactttagagtttcagg

SEQ ID NO: 401479 - DNA, 20 bp, Artificial
  CRISPR gRNA sequence
tagagtttcaggaaaagctt

SEQ ID NO: 401480 - DNA, 20 bp, Artificial
  CRISPR gRNA sequence
agagtttcaggaaaagcttt

SEQ ID NO: 401481 - DNA, 20 bp, Artificial
  CRISPR gRNA sequence
gagtttcaggaaaagcttta

SEQ ID NO: 401482 - DNA, 20 bp, Artificial
  CRISPR gRNA sequence
caggaaaagctttagtacag

SEQ ID NO: 401483 - DNA, 20 bp, Artificial
  CRISPR gRNA sequence
aggaaaagctttagtacagt

SEQ ID NO: 401484 - DNA, 20 bp, Artificial
  CRISPR gRNA sequence
tagtacagtagattctgtgc

SEQ ID NO: 401485 - DNA, 20 bp, Artificial
  CRISPR gRNA sequence
agtacagtagattctgtgct

SEQ ID NO: 401486 - DNA, 20 bp, Artificial
  CRISPR gRNA sequence
gtacagtagattctgtgctt

SEQ ID NO: 401487 - DNA, 20 bp, Artificial
  CRISPR gRNA sequence
tgtgcttgaaaaaggagttg

SEQ ID NO: 401488 - DNA, 20 bp, Artificial
  CRISPR gRNA sequence
tgcttgaaaaaggagttgca

SEQ ID NO: 401489 - DNA, 20 bp, Artificial
  CRISPR gRNA sequence
gaaaaaggagttgcagctca

SEQ ID NO: 401490 - DNA, 20 bp, Artificial
  CRISPR gRNA sequence
aaaaaggagttgcagctcac

SEQ ID NO: 401491 - DNA, 20 bp, Artificial
  CRISPR gRNA sequence
cagctcactagggcagcaga

SEQ ID NO: 401492 - DNA, 20 bp, Artificial
  CRISPR gRNA sequence
actagggcagcagaatgtca

SEQ ID NO: 401493 - DNA, 20 bp, Artificial
  CRISPR gRNA sequence
gggcagcagaatgtcagaaa

SEQ ID NO: 401494 - DNA, 20 bp, Artificial
  CRISPR gRNA sequence
ttgatgtgcctaatggaatt

SEQ ID NO: 401495 - DNA, 20 bp, Artificial
  CRISPR gRNA sequence
atgtgcctaatggaattttg

SEQ ID NO: 401496 - DNA, 20 bp, Artificial
  CRISPR gRNA sequence
atggaattttgacttctgtc

SEQ ID NO: 401497 - DNA, 20 bp, Artificial
  CRISPR gRNA sequence
tgacttctgtctgtaatgca

SEQ ID NO: 401498 - DNA, 20 bp, Artificial
  CRISPR gRNA sequence
gacttctgtctgtaatgcag

SEQ ID NO: 401499 - DNA, 20 bp, Artificial
  CRISPR gRNA sequence
acttctgtctgtaatgcaga

SEQ ID NO: 401500 - DNA, 20 bp, Artificial
  CRISPR gRNA sequence
ctgtctgtaatgcagaccag

SEQ ID NO: 401501 - DNA, 20 bp, Artificial
  CRISPR gRNA sequence
tgtctgtaatgcagaccagg

SEQ ID NO: 401502 - DNA, 20 bp, Artificial
  CRISPR gRNA sequence
tctgtaatgcagaccagggg

SEQ ID NO: 401503 - DNA, 20 bp, Artificial
  CRISPR gRNA sequence
taatgcagaccaggggacat
